United States Patent 7,888,497 (BIOINFORMATICALLY DETECTABLE GROUP OF NOVEL REGULATORY OLIGONUCLEOTIDES AND USES THEREOF) - sequence listing, part 142

SEQ ID NO: 6021656 - DNA, 15 bp, Homo sapiens
catctttgccttggg

SEQ ID NO: 6021657 - DNA, 17 bp, Homo sapiens
catctttgccttgggct

SEQ ID NO: 6021658 - DNA, 23 bp, Homo sapiens
catctttgccttgggctgctcct

SEQ ID NO: 6021659 - DNA, 11 bp, Homo sapiens
catctttgggg

SEQ ID NO: 6021660 - DNA, 12 bp, Homo sapiens
catctttgggga

SEQ ID NO: 6021661 - DNA, 17 bp, Homo sapiens
catctttgtatatttac

SEQ ID NO: 6021662 - DNA, 19 bp, Homo sapiens
catctttgtatatttacat

SEQ ID NO: 6021663 - DNA, 13 bp, Homo sapiens
catctttgtgaag

SEQ ID NO: 6021664 - DNA, 14 bp, Homo sapiens
catctttgtgaagg

SEQ ID NO: 6021665 - DNA, 22 bp, Homo sapiens
catctttgtgaaggcctcgcag

SEQ ID NO: 6021666 - DNA, 20 bp, Homo sapiens
catctttgttacttccttat

SEQ ID NO: 6021667 - DNA, 18 bp, Homo sapiens
catctttgtttttaaaat

SEQ ID NO: 6021668 - DNA, 15 bp, Homo sapiens
catcttttaaagaaa

SEQ ID NO: 6021669 - DNA, 14 bp, Homo sapiens
catcttttaagaca

SEQ ID NO: 6021670 - DNA, 20 bp, Homo sapiens
catcttttaatatgctgtgg

SEQ ID NO: 6021671 - DNA, 13 bp, Homo sapiens
catcttttaatca

SEQ ID NO: 6021672 - DNA, 20 bp, Homo sapiens
catcttttaattcacctctt

SEQ ID NO: 6021673 - DNA, 13 bp, Homo sapiens
catcttttacatt

SEQ ID NO: 6021674 - DNA, 13 bp, Homo sapiens
catcttttatcta

SEQ ID NO: 6021675 - DNA, 12 bp, Homo sapiens
catcttttattc

SEQ ID NO: 6021676 - DNA, 15 bp, Homo sapiens
catcttttattttgg

SEQ ID NO: 6021677 - DNA, 19 bp, Homo sapiens
catcttttattttggaact

SEQ ID NO: 6021678 - DNA, 17 bp, Homo sapiens
catcttttccatcctga

SEQ ID NO: 6021679 - DNA, 22 bp, Homo sapiens
catcttttcctcccattttaga

SEQ ID NO: 6021680 - DNA, 16 bp, Homo sapiens
catcttttcctgctta

SEQ ID NO: 6021681 - DNA, 20 bp, Homo sapiens
catcttttcctgcttagaat

SEQ ID NO: 6021682 - DNA, 15 bp, Homo sapiens
catcttttctacttc

SEQ ID NO: 6021683 - DNA, 13 bp, Homo sapiens
catcttttgtatt

SEQ ID NO: 6021684 - DNA, 15 bp, Homo sapiens
catcttttgtattaa

SEQ ID NO: 6021685 - DNA, 21 bp, Homo sapiens
catctttttaacctgcaaaat

SEQ ID NO: 6021686 - DNA, 22 bp, Homo sapiens
catctttttgaccctcattctt

SEQ ID NO: 6021687 - DNA, 19 bp, Homo sapiens
catgaaaaacacggcagct

SEQ ID NO: 6021688 - DNA, 18 bp, Homo sapiens
catgaaaaagcagctacc

SEQ ID NO: 6021689 - DNA, 23 bp, Homo sapiens
catgaaaaagcagctaccaggtg

SEQ ID NO: 6021690 - DNA, 14 bp, Homo sapiens
catgaaaaagctgc

SEQ ID NO: 6021691 - DNA, 13 bp, Homo sapiens
catgaaaaatttt

SEQ ID NO: 6021692 - DNA, 18 bp, Homo sapiens
catgaaaacacacataca

SEQ ID NO: 6021693 - DNA, 14 bp, Homo sapiens
catgaaaacacatt

SEQ ID NO: 6021694 - DNA, 16 bp, Homo sapiens
catgaaaacacatttt

SEQ ID NO: 6021695 - DNA, 17 bp, Homo sapiens
catgaaaacacattttt

SEQ ID NO: 6021696 - DNA, 18 bp, Homo sapiens
catgaaaacattgatgaa

SEQ ID NO: 6021697 - DNA, 21 bp, Homo sapiens
catgaaaaccattacctgact

SEQ ID NO: 6021698 - DNA, 16 bp, Homo sapiens
catgaaaacgttttat

SEQ ID NO: 6021699 - DNA, 22 bp, Homo sapiens
catgaaaaggattccttggtta

SEQ ID NO: 6021700 - DNA, 13 bp, Homo sapiens
catgaaaagtgct

SEQ ID NO: 6021701 - DNA, 15 bp, Homo sapiens
catgaaaagttttca

SEQ ID NO: 6021702 - DNA, 16 bp, Homo sapiens
catgaaaagttttcaa

SEQ ID NO: 6021703 - DNA, 17 bp, Homo sapiens
catgaaaagttttcaag

SEQ ID NO: 6021704 - DNA, 23 bp, Homo sapiens
catgaaaataaacgccacctgca

SEQ ID NO: 6021705 - DNA, 14 bp, Homo sapiens
catgaaaataccat

SEQ ID NO: 6021706 - DNA, 15 bp, Homo sapiens
catgaaaatagcaat

SEQ ID NO: 6021707 - DNA, 19 bp, Homo sapiens
catgaaaatagctattttt

SEQ ID NO: 6021708 - DNA, 16 bp, Homo sapiens
catgaaaatcctacca

SEQ ID NO: 6021709 - DNA, 22 bp, Homo sapiens
catgaaaatcctaccaacctct

SEQ ID NO: 6021710 - DNA, 14 bp, Homo sapiens
catgaaaatgacat

SEQ ID NO: 6021711 - DNA, 13 bp, Homo sapiens
catgaaaatgtat

SEQ ID NO: 6021712 - DNA, 23 bp, Homo sapiens
catgaaaatgtattcctttaaaa

SEQ ID NO: 6021713 - DNA, 11 bp, Homo sapiens
catgaaaattt

SEQ ID NO: 6021714 - DNA, 17 bp, Homo sapiens
catgaaaatttgtttga

SEQ ID NO: 6021715 - DNA, 13 bp, Homo sapiens
catgaaaatttta

SEQ ID NO: 6021716 - DNA, 14 bp, Homo sapiens
catgaaaattttaa

SEQ ID NO: 6021717 - DNA, 19 bp, Homo sapiens
catgaaaattttaaaaata

SEQ ID NO: 6021718 - DNA, 13 bp, Homo sapiens
catgaaacagcag

SEQ ID NO: 6021719 - DNA, 20 bp, Homo sapiens
catgaaacattattttaatt

SEQ ID NO: 6021720 - DNA, 23 bp, Homo sapiens
catgaaacatttcagaaggtatc

SEQ ID NO: 6021721 - DNA, 21 bp, Homo sapiens
catgaaacggaggcagatgga

SEQ ID NO: 6021722 - DNA, 19 bp, Homo sapiens
catgaaagagaaagactga

SEQ ID NO: 6021723 - DNA, 14 bp, Homo sapiens
catgaaagctgatg

SEQ ID NO: 6021724 - DNA, 24 bp, Homo sapiens
catgaaagtagacagttttgagaa

SEQ ID NO: 6021725 - DNA, 21 bp, Homo sapiens
catgaaataaaatatatctta

SEQ ID NO: 6021726 - DNA, 12 bp, Homo sapiens
catgaaatatat

SEQ ID NO: 6021727 - DNA, 13 bp, Homo sapiens
catgaaatatatt

SEQ ID NO: 6021728 - DNA, 14 bp, Homo sapiens
catgaaatatgcat

SEQ ID NO: 6021729 - DNA, 20 bp, Homo sapiens
catgaaatgaacacaaatta

SEQ ID NO: 6021730 - DNA, 22 bp, Homo sapiens
catgaaatgatagatttgacct

SEQ ID NO: 6021731 - DNA, 13 bp, Homo sapiens
catgaaatgccct

SEQ ID NO: 6021732 - DNA, 19 bp, Homo sapiens
catgaaatgctatgtcatt

SEQ ID NO: 6021733 - DNA, 21 bp, Homo sapiens
catgaaatgctatgtcatttc

SEQ ID NO: 6021734 - DNA, 14 bp, Homo sapiens
catgaaatgtgttt

SEQ ID NO: 6021735 - DNA, 17 bp, Homo sapiens
catgaaattgtatctca

SEQ ID NO: 6021736 - DNA, 21 bp, Homo sapiens
catgaacacaaatgtgtattt

SEQ ID NO: 6021737 - DNA, 18 bp, Homo sapiens
catgaacacagcctggga

SEQ ID NO: 6021738 - DNA, 18 bp, Homo sapiens
catgaacacccttagaaa

SEQ ID NO: 6021739 - DNA, 14 bp, Homo sapiens
catgaacactggct

SEQ ID NO: 6021740 - DNA, 12 bp, Homo sapiens
catgaacagctc

SEQ ID NO: 6021741 - DNA, 17 bp, Homo sapiens
catgaacagctctgaga

SEQ ID NO: 6021742 - DNA, 13 bp, Homo sapiens
catgaacagcttg

SEQ ID NO: 6021743 - DNA, 15 bp, Homo sapiens
catgaacatgtactg

SEQ ID NO: 6021744 - DNA, 12 bp, Homo sapiens
catgaaccaaat

SEQ ID NO: 6021745 - DNA, 20 bp, Homo sapiens
catgaaccatgcttacaaag

SEQ ID NO: 6021746 - DNA, 16 bp, Homo sapiens
catgaaccccaggctg

SEQ ID NO: 6021747 - DNA, 17 bp, Homo sapiens
catgaaccccaggctgg

SEQ ID NO: 6021748 - DNA, 21 bp, Homo sapiens
catgaaccctcttgccatcct

SEQ ID NO: 6021749 - DNA, 19 bp, Homo sapiens
catgaacctcaagctgcat

SEQ ID NO: 6021750 - DNA, 17 bp, Homo sapiens
catgaacttagatttta

SEQ ID NO: 6021751 - DNA, 18 bp, Homo sapiens
catgaacttcatatacta

SEQ ID NO: 6021752 - DNA, 23 bp, Homo sapiens
catgaacttcgcatcaaaagaca

SEQ ID NO: 6021753 - DNA, 14 bp, Homo sapiens
catgaacttgatac

SEQ ID NO: 6021754 - DNA, 12 bp, Homo sapiens
catgaagaatgt

SEQ ID NO: 6021755 - DNA, 13 bp, Homo sapiens
catgaagaatgta

SEQ ID NO: 6021756 - DNA, 14 bp, Homo sapiens
catgaagacaggac

SEQ ID NO: 6021757 - DNA, 15 bp, Homo sapiens
catgaagaccttttt

SEQ ID NO: 6021758 - DNA, 17 bp, Homo sapiens
catgaagacctttttct

SEQ ID NO: 6021759 - DNA, 15 bp, Homo sapiens
catgaagagaagcaa

SEQ ID NO: 6021760 - DNA, 13 bp, Homo sapiens
catgaagagcttg

SEQ ID NO: 6021761 - DNA, 13 bp, Homo sapiens
catgaagatattt

SEQ ID NO: 6021762 - DNA, 18 bp, Homo sapiens
catgaagatttggttttt

SEQ ID NO: 6021763 - DNA, 14 bp, Homo sapiens
catgaagattttct

SEQ ID NO: 6021764 - DNA, 14 bp, Homo sapiens
catgaagcaacgat

SEQ ID NO: 6021765 - DNA, 19 bp, Homo sapiens
catgaagcaggaggccctt

SEQ ID NO: 6021766 - DNA, 23 bp, Homo sapiens
catgaagcaggaggcccttgtcg

SEQ ID NO: 6021767 - DNA, 20 bp, Homo sapiens
catgaagcataatttgttta

SEQ ID NO: 6021768 - DNA, 12 bp, Homo sapiens
catgaagcatta

SEQ ID NO: 6021769 - DNA, 17 bp, Homo sapiens
catgaagccacagccca

SEQ ID NO: 6021770 - DNA, 22 bp, Homo sapiens
catgaagccacagcccaggcct

SEQ ID NO: 6021771 - DNA, 21 bp, Homo sapiens
catgaagccacgggtgccaga

SEQ ID NO: 6021772 - DNA, 22 bp, Homo sapiens
catgaagcccaagtgaaatcaa

SEQ ID NO: 6021773 - DNA, 11 bp, Homo sapiens
catgaagcctg

SEQ ID NO: 6021774 - DNA, 13 bp, Homo sapiens
catgaagcctgtg

SEQ ID NO: 6021775 - DNA, 16 bp, Homo sapiens
catgaagcctgtggat

SEQ ID NO: 6021776 - DNA, 13 bp, Homo sapiens
catgaagcctttt

SEQ ID NO: 6021777 - DNA, 15 bp, Homo sapiens
catgaagccttttga

SEQ ID NO: 6021778 - DNA, 22 bp, Homo sapiens
catgaagcgagtcgggtcccca

SEQ ID NO: 6021779 - DNA, 16 bp, Homo sapiens
catgaagctaataaaa

SEQ ID NO: 6021780 - DNA, 21 bp, Homo sapiens
catgaagctcagtttggctgt

SEQ ID NO: 6021781 - DNA, 16 bp, Homo sapiens
catgaagctggccctc

SEQ ID NO: 6021782 - DNA, 21 bp, Homo sapiens
catgaagctggccctcagctc

SEQ ID NO: 6021783 - DNA, 13 bp, Homo sapiens
catgaaggaaact

SEQ ID NO: 6021784 - DNA, 17 bp, Homo sapiens
catgaaggacactctgc

SEQ ID NO: 6021785 - DNA, 19 bp, Homo sapiens
catgaaggagacagcagca

SEQ ID NO: 6021786 - DNA, 23 bp, Homo sapiens
catgaaggagacagcagcaccca

SEQ ID NO: 6021787 - DNA, 15 bp, Homo sapiens
catgaaggagaggat

SEQ ID NO: 6021788 - DNA, 18 bp, Homo sapiens
catgaaggatcaaaaaat

SEQ ID NO: 6021789 - DNA, 21 bp, Homo sapiens
catgaagtaaattatgtaact

SEQ ID NO: 6021790 - DNA, 15 bp, Homo sapiens
catgaagtaatatgc

SEQ ID NO: 6021791 - DNA, 19 bp, Homo sapiens
catgaagtaatatgcacac

SEQ ID NO: 6021792 - DNA, 18 bp, Homo sapiens
catgaagtttccttggct

SEQ ID NO: 6021793 - DNA, 22 bp, Homo sapiens
catgaagtttccttggctggtg

SEQ ID NO: 6021794 - DNA, 14 bp, Homo sapiens
catgaataaaaata

SEQ ID NO: 6021795 - DNA, 15 bp, Homo sapiens
catgaataaaaataa

SEQ ID NO: 6021796 - DNA, 14 bp, Homo sapiens
catgaataaaacac

SEQ ID NO: 6021797 - DNA, 13 bp, Homo sapiens
catgaataaaatt

SEQ ID NO: 6021798 - DNA, 17 bp, Homo sapiens
catgaataacatttaaa

SEQ ID NO: 6021799 - DNA, 22 bp, Homo sapiens
catgaataacatttaaattcca

SEQ ID NO: 6021800 - DNA, 13 bp, Homo sapiens
catgaatacacaa

SEQ ID NO: 6021801 - DNA, 22 bp, Homo sapiens
catgaatactatccatgtaata

SEQ ID NO: 6021802 - DNA, 22 bp, Homo sapiens
catgaatatcaagaatagttgt

SEQ ID NO: 6021803 - DNA, 22 bp, Homo sapiens
catgaatatggttggagagccc

SEQ ID NO: 6021804 - DNA, 21 bp, Homo sapiens
catgaatatttagtgttcata

SEQ ID NO: 6021805 - DNA, 14 bp, Homo sapiens
catgaatatttatt

SEQ ID NO: 6021806 - DNA, 22 bp, Homo sapiens
catgaatattttcaagtttttc

SEQ ID NO: 6021807 - DNA, 14 bp, Homo sapiens
catgaatcactgtg

SEQ ID NO: 6021808 - DNA, 15 bp, Homo sapiens
catgaatcactgtgc

SEQ ID NO: 6021809 - DNA, 21 bp, Homo sapiens
catgaatcactgtgctcagcc

SEQ ID NO: 6021810 - DNA, 22 bp, Homo sapiens
caggaacacccgactcctcaaa

SEQ ID NO: 6021811 - DNA, 15 bp, Homo sapiens
caggaacagaacact

SEQ ID NO: 6021812 - DNA, 18 bp, Homo sapiens
caggaacagaacacttct

SEQ ID NO: 6021813 - DNA, 13 bp, Homo sapiens
caggaacagaagg

SEQ ID NO: 6021814 - DNA, 14 bp, Homo sapiens
caggaacagaagga

SEQ ID NO: 6021815 - DNA, 14 bp, Homo sapiens
caggaacagctatg

SEQ ID NO: 6021816 - DNA, 13 bp, Homo sapiens
caggaacagggac

SEQ ID NO: 6021817 - DNA, 15 bp, Homo sapiens
caggaacagggacca

SEQ ID NO: 6021818 - DNA, 17 bp, Homo sapiens
caggaacagggaccagc

SEQ ID NO: 6021819 - DNA, 16 bp, Homo sapiens
caggaacagtggctgg

SEQ ID NO: 6021820 - DNA, 20 bp, Homo sapiens
caggaacatacagacacatt

SEQ ID NO: 6021821 - DNA, 18 bp, Homo sapiens
caggaaccaaaaagagca

SEQ ID NO: 6021822 - DNA, 23 bp, Homo sapiens
caggaaccaaaaagagcatccct

SEQ ID NO: 6021823 - DNA, 16 bp, Homo sapiens
caggaaccacaccaca

SEQ ID NO: 6021824 - DNA, 16 bp, Homo sapiens
caggaaccagggcctc

SEQ ID NO: 6021825 - DNA, 17 bp, Homo sapiens
caggaaccagggcctcc

SEQ ID NO: 6021826 - DNA, 12 bp, Homo sapiens
caggaacccagc

SEQ ID NO: 6021827 - DNA, 15 bp, Homo sapiens
caggaacccatcact

SEQ ID NO: 6021828 - DNA, 18 bp, Homo sapiens
caggaacccatcactgtg

SEQ ID NO: 6021829 - DNA, 18 bp, Homo sapiens
caggaacctcgagtactg

SEQ ID NO: 6021830 - DNA, 19 bp, Homo sapiens
caggaacctcgagtactgt

SEQ ID NO: 6021831 - DNA, 23 bp, Homo sapiens
caggaacctcgagtactgtgggc

SEQ ID NO: 6021832 - DNA, 13 bp, Homo sapiens
caggaacctggac

SEQ ID NO: 6021833 - DNA, 17 bp, Homo sapiens
caggaacgagcactggc

SEQ ID NO: 6021834 - DNA, 18 bp, Homo sapiens
caggaacgagcactggcc

SEQ ID NO: 6021835 - DNA, 22 bp, Homo sapiens
caggaacgagcactggccagag

SEQ ID NO: 6021836 - DNA, 23 bp, Homo sapiens
caggaacggccctgcaggagcag

SEQ ID NO: 6021837 - DNA, 20 bp, Homo sapiens
caggaacggtggaggcagag

SEQ ID NO: 6021838 - DNA, 22 bp, Homo sapiens
caggaacggtggaggcagaggt

SEQ ID NO: 6021839 - DNA, 20 bp, Homo sapiens
caggaacgttgccacaccaa

SEQ ID NO: 6021840 - DNA, 15 bp, Homo sapiens
caggaactataaaaa

SEQ ID NO: 6021841 - DNA, 17 bp, Homo sapiens
caggaactataaaaaca

SEQ ID NO: 6021842 - DNA, 21 bp, Homo sapiens
caggaactatggcaaggaact

SEQ ID NO: 6021843 - DNA, 23 bp, Homo sapiens
caggaactccccttcttcctgga

SEQ ID NO: 6021844 - DNA, 22 bp, Homo sapiens
caggaactcgcacctgtgctgg

SEQ ID NO: 6021845 - DNA, 23 bp, Homo sapiens
caggaactcgcacctgtgctgga

SEQ ID NO: 6021846 - DNA, 15 bp, Homo sapiens
caggaactctggacc

SEQ ID NO: 6021847 - DNA, 14 bp, Homo sapiens
caggaactctgtgt

SEQ ID NO: 6021848 - DNA, 20 bp, Homo sapiens
caggaactctgtgtgagaga

SEQ ID NO: 6021849 - DNA, 22 bp, Homo sapiens
caggaactctgtgtgagagaga

SEQ ID NO: 6021850 - DNA, 16 bp, Homo sapiens
caggaactgagccaga

SEQ ID NO: 6021851 - DNA, 18 bp, Homo sapiens
caggaactgcctgggcca

SEQ ID NO: 6021852 - DNA, 13 bp, Homo sapiens
caggaactggctc

SEQ ID NO: 6021853 - DNA, 23 bp, Homo sapiens
caggaactggggctttgccttgc

SEQ ID NO: 6021854 - DNA, 18 bp, Homo sapiens
caggaacttctagctcat

SEQ ID NO: 6021855 - DNA, 19 bp, Homo sapiens
caggaacttctagctcatt

SEQ ID NO: 6021856 - DNA, 18 bp, Homo sapiens
caggaagaaaccccaagc

SEQ ID NO: 6021857 - DNA, 16 bp, Homo sapiens
caggaagaaagcagaa

SEQ ID NO: 6021858 - DNA, 21 bp, Homo sapiens
caggaagaaatcacagaatca

SEQ ID NO: 6021859 - DNA, 18 bp, Homo sapiens
caggaagaaggcccggga

SEQ ID NO: 6021860 - DNA, 20 bp, Homo sapiens
caggaagaaggcccgggagg

SEQ ID NO: 6021861 - DNA, 13 bp, Homo sapiens
caggaagaaggtg

SEQ ID NO: 6021862 - DNA, 21 bp, Homo sapiens
caggaagaatgggctgcagaa

SEQ ID NO: 6021863 - DNA, 23 bp, Homo sapiens
caggaagaatggtgtgtttccct

SEQ ID NO: 6021864 - DNA, 15 bp, Homo sapiens
caggaagactggaga

SEQ ID NO: 6021865 - DNA, 17 bp, Homo sapiens
caggaagactggagact

SEQ ID NO: 6021866 - DNA, 16 bp, Homo sapiens
caggaagacttccagc

SEQ ID NO: 6021867 - DNA, 14 bp, Homo sapiens
caggaagagagcat

SEQ ID NO: 6021868 - DNA, 17 bp, Homo sapiens
caggaagagatttaaca

SEQ ID NO: 6021869 - DNA, 14 bp, Homo sapiens
caggaagagctatg

SEQ ID NO: 6021870 - DNA, 19 bp, Homo sapiens
caggaagaggggcgctgcc

SEQ ID NO: 6021871 - DNA, 17 bp, Homo sapiens
caggaagatgggaggtg

SEQ ID NO: 6021872 - DNA, 14 bp, Homo sapiens
caggaagcaaggcc

SEQ ID NO: 6021873 - DNA, 13 bp, Homo sapiens
caggaagcacagg

SEQ ID NO: 6021874 - DNA, 16 bp, Homo sapiens
caggaagcaccccatg

SEQ ID NO: 6021875 - DNA, 14 bp, Homo sapiens
caggaagcagggag

SEQ ID NO: 6021876 - DNA, 15 bp, Homo sapiens
caggaagcagggaga

SEQ ID NO: 6021877 - DNA, 20 bp, Homo sapiens
caggaagcagggagagttgg

SEQ ID NO: 6021878 - DNA, 19 bp, Homo sapiens
caggaagcattcagagagc

SEQ ID NO: 6021879 - DNA, 20 bp, Homo sapiens
caggaagcattcagagagca

SEQ ID NO: 6021880 - DNA, 12 bp, Homo sapiens
caggaagccaga

SEQ ID NO: 6021881 - DNA, 14 bp, Homo sapiens
caggaagccagagc

SEQ ID NO: 6021882 - DNA, 14 bp, Homo sapiens
caggaagccagcag

SEQ ID NO: 6021883 - DNA, 16 bp, Homo sapiens
caggaagccagcaggc

SEQ ID NO: 6021884 - DNA, 19 bp, Homo sapiens
caggaagccagcaggctct

SEQ ID NO: 6021885 - DNA, 15 bp, Homo sapiens
caggaagccaggctg

SEQ ID NO: 6021886 - DNA, 19 bp, Homo sapiens
caggaagccaggctgagtg

SEQ ID NO: 6021887 - DNA, 16 bp, Homo sapiens
caggaagcccaaggca

SEQ ID NO: 6021888 - DNA, 16 bp, Homo sapiens
caggaagcccaattgc

SEQ ID NO: 6021889 - DNA, 12 bp, Homo sapiens
caggaagcccac

SEQ ID NO: 6021890 - DNA, 14 bp, Homo sapiens
caggaagcccacac

SEQ ID NO: 6021891 - DNA, 17 bp, Homo sapiens
caggaagcccactgcct

SEQ ID NO: 6021892 - DNA, 21 bp, Homo sapiens
caggaagcccactgcctcctc

SEQ ID NO: 6021893 - DNA, 16 bp, Homo sapiens
caggaagcccaggagc

SEQ ID NO: 6021894 - DNA, 18 bp, Homo sapiens
caggaagcccaggagcct

SEQ ID NO: 6021895 - DNA, 23 bp, Homo sapiens
caggaagccgccagtacttgtca

SEQ ID NO: 6021896 - DNA, 14 bp, Homo sapiens
caggaagccggtgc

SEQ ID NO: 6021897 - DNA, 19 bp, Homo sapiens
caggaagcctcctgctgag

SEQ ID NO: 6021898 - DNA, 13 bp, Homo sapiens
caggaagcctctc

SEQ ID NO: 6021899 - DNA, 13 bp, Homo sapiens
caggaagcctgca

SEQ ID NO: 6021900 - DNA, 19 bp, Homo sapiens
caggaagcctgcagtcctg

SEQ ID NO: 6021901 - DNA, 14 bp, Homo sapiens
caggaagctcagcc

SEQ ID NO: 6021902 - DNA, 14 bp, Homo sapiens
caggaagctcaggg

SEQ ID NO: 6021903 - DNA, 20 bp, Homo sapiens
caggaagctcagggcctggc

SEQ ID NO: 6021904 - DNA, 23 bp, Homo sapiens
caggaagctcagggcctggctca

SEQ ID NO: 6021905 - DNA, 22 bp, Homo sapiens
caggaagctccctccctcactg

SEQ ID NO: 6021906 - DNA, 13 bp, Homo sapiens
caggaagctctct

SEQ ID NO: 6021907 - DNA, 16 bp, Homo sapiens
caggaagctctcttaa

SEQ ID NO: 6021908 - DNA, 13 bp, Homo sapiens
caggaagctgtga

SEQ ID NO: 6021909 - DNA, 15 bp, Homo sapiens
caggaaggaaaacta

SEQ ID NO: 6021910 - DNA, 19 bp, Homo sapiens
caggaaggaaaactatgta

SEQ ID NO: 6021911 - DNA, 16 bp, Homo sapiens
caggaaggaaacagat

SEQ ID NO: 6021912 - DNA, 12 bp, Homo sapiens
caggaaggaaca

SEQ ID NO: 6021913 - DNA, 22 bp, Homo sapiens
caggaaggaactcaaggtggct

SEQ ID NO: 6021914 - DNA, 23 bp, Homo sapiens
caggaaggaactcaaggtggctg

SEQ ID NO: 6021915 - DNA, 13 bp, Homo sapiens
caggaaggaagca

SEQ ID NO: 6021916 - DNA, 15 bp, Homo sapiens
caggaaggacagact

SEQ ID NO: 6021917 - DNA, 21 bp, Homo sapiens
caggaaggacagactggccgg

SEQ ID NO: 6021918 - DNA, 15 bp, Homo sapiens
caggaaggagagcct

SEQ ID NO: 6021919 - DNA, 17 bp, Homo sapiens
caggaaggagagcctgc

SEQ ID NO: 6021920 - DNA, 18 bp, Homo sapiens
caggaaggagagcctgct

SEQ ID NO: 6021921 - DNA, 18 bp, Homo sapiens
caggaaggagccagactt

SEQ ID NO: 6021922 - DNA, 15 bp, Homo sapiens
caggaaggagcggcg

SEQ ID NO: 6021923 - DNA, 23 bp, Homo sapiens
caggaaggagcggcgccctggac

SEQ ID NO: 6021924 - DNA, 13 bp, Homo sapiens
caggaaggagctg

SEQ ID NO: 6021925 - DNA, 16 bp, Homo sapiens
caggaaggagctgcct

SEQ ID NO: 6021926 - DNA, 22 bp, Homo sapiens
caggaaggagctgcctggaccc

SEQ ID NO: 6021927 - DNA, 16 bp, Homo sapiens
caggaaggaggggaga

SEQ ID NO: 6021928 - DNA, 17 bp, Homo sapiens
caggaaggaggggagag

SEQ ID NO: 6021929 - DNA, 19 bp, Homo sapiens
caggaaggcagctgctctt

SEQ ID NO: 6021930 - DNA, 22 bp, Homo sapiens
caggaaggccaaaatcaagagt

SEQ ID NO: 6021931 - DNA, 21 bp, Homo sapiens
caggaaggcctaggctaggac

SEQ ID NO: 6021932 - DNA, 12 bp, Homo sapiens
caggaaggcctg

SEQ ID NO: 6021933 - DNA, 14 bp, Homo sapiens
caggaaggcggcag

SEQ ID NO: 6021934 - DNA, 19 bp, Homo sapiens
caggaaggctgagaggaga

SEQ ID NO: 6021935 - DNA, 13 bp, Homo sapiens
caggaaggcttgt

SEQ ID NO: 6021936 - DNA, 15 bp, Homo sapiens
caggaagggagagga

SEQ ID NO: 6021937 - DNA, 17 bp, Homo sapiens
caggaagggagaggagg

SEQ ID NO: 6021938 - DNA, 18 bp, Homo sapiens
caggaagggagggagctg

SEQ ID NO: 6021939 - DNA, 20 bp, Homo sapiens
caggaagggatgcaggctcc

SEQ ID NO: 6021940 - DNA, 15 bp, Homo sapiens
caggaaggggacagg

SEQ ID NO: 6021941 - DNA, 23 bp, Homo sapiens
caggaaggggacaggattgtctg

SEQ ID NO: 6021942 - DNA, 22 bp, Homo sapiens
caggaaggtctgatttgcagga

SEQ ID NO: 6021943 - DNA, 20 bp, Homo sapiens
caggaagtactggagaaaat

SEQ ID NO: 6021944 - DNA, 19 bp, Homo sapiens
caggaagtacttccacctc

SEQ ID NO: 6021945 - DNA, 15 bp, Homo sapiens
caggaagtagaggag

SEQ ID NO: 6021946 - DNA, 15 bp, Homo sapiens
caggaagtagcacag

SEQ ID NO: 6021947 - DNA, 21 bp, Homo sapiens
caggaagtagcacaggctgag

SEQ ID NO: 6021948 - DNA, 17 bp, Homo sapiens
caggaagtcaggagcca

SEQ ID NO: 6021949 - DNA, 19 bp, Homo sapiens
caggaagtcaggagccagc

SEQ ID NO: 6021950 - DNA, 16 bp, Homo sapiens
caggaagtccagccac

SEQ ID NO: 6021951 - DNA, 14 bp, Homo sapiens
caggaagtccctga

SEQ ID NO: 6021952 - DNA, 16 bp, Homo sapiens
caggaagtcttcaggg

SEQ ID NO: 6021953 - DNA, 15 bp, Homo sapiens
caggaagtggctcag

SEQ ID NO: 6021954 - DNA, 19 bp, Homo sapiens
caggaagtgggagaagtgg

SEQ ID NO: 6021955 - DNA, 20 bp, Homo sapiens
caggaagtgggagaagtggc

SEQ ID NO: 6021956 - DNA, 22 bp, Homo sapiens
caggaagtgggagaagtggccc

SEQ ID NO: 6021957 - DNA, 23 bp, Homo sapiens
caggaagtgggagaagtggcccc

SEQ ID NO: 6021958 - DNA, 23 bp, Homo sapiens
caggaagttgccatgggaaacaa

SEQ ID NO: 6021959 - DNA, 15 bp, Homo sapiens
caggaatataaatat

SEQ ID NO: 6021960 - DNA, 17 bp, Homo sapiens
caggaatatatgtgtgc

SEQ ID NO: 6021961 - DNA, 21 bp, Homo sapiens
caggaatatctgttcccagcc

SEQ ID NO: 6021962 - DNA, 19 bp, Homo sapiens
caggaatattgtcatcctt

SEQ ID NO: 6021963 - DNA, 17 bp, Homo sapiens
caggaatatttcctcca

SEQ ID NO: 6021964 - DNA, 17 bp, Homo sapiens
caggaatattttccaaa

SEQ ID NO: 6021965 - DNA, 23 bp, Homo sapiens
caggaatcaagagctgccctcct

SEQ ID NO: 6021966 - DNA, 17 bp, Homo sapiens
caggaatcaaggagcct

SEQ ID NO: 6021967 - DNA, 18 bp, Homo sapiens
caggaatcaaggagcctc

SEQ ID NO: 6021968 - DNA, 23 bp, Homo sapiens
caggaatcacccctctgcccctg

SEQ ID NO: 6021969 - DNA, 24 bp, Homo sapiens
caggaatcacccctctgcccctgc

SEQ ID NO: 6021970 - DNA, 21 bp, Homo sapiens
caggaatcccggctccagagc

SEQ ID NO: 6021971 - DNA, 15 bp, Homo sapiens
caggaatccttactg

SEQ ID NO: 6021972 - DNA, 13 bp, Homo sapiens
caggaatctcaga

SEQ ID NO: 6021973 - DNA, 14 bp, Homo sapiens
caggaatctcagag

SEQ ID NO: 6021974 - DNA, 24 bp, Homo sapiens
caggaatctcagagacaggtggcc

SEQ ID NO: 6021975 - DNA, 13 bp, Homo sapiens
caggaatgaaata

SEQ ID NO: 6021976 - DNA, 21 bp, Homo sapiens
caggaatgacccttttgtgtc

SEQ ID NO: 6021977 - DNA, 16 bp, Homo sapiens
caggaatgctgggccc

SEQ ID NO: 6021978 - DNA, 17 bp, Homo sapiens
caggaatggaaagcgga

SEQ ID NO: 6021979 - DNA, 12 bp, Homo sapiens
caggaatggggg

SEQ ID NO: 6021980 - DNA, 22 bp, Homo sapiens
caggaatggggggcgggccagg

SEQ ID NO: 6021981 - DNA, 17 bp, Homo sapiens
caggaatgggggtcaga

SEQ ID NO: 6021982 - DNA, 14 bp, Homo sapiens
caggaatggtgctt

SEQ ID NO: 6021983 - DNA, 16 bp, Homo sapiens
caggaatgtctggagt

SEQ ID NO: 6021984 - DNA, 19 bp, Homo sapiens
caggaatgtgtggcctgca

SEQ ID NO: 6021985 - DNA, 18 bp, Homo sapiens
caggaatgttaaagtcag

SEQ ID NO: 6021986 - DNA, 19 bp, Homo sapiens
caggaatgttaaagtcagt

SEQ ID NO: 6021987 - DNA, 13 bp, Homo sapiens
caggaattagaga

SEQ ID NO: 6021988 - DNA, 22 bp, Homo sapiens
catgaatcactgtgctcagcca

SEQ ID NO: 6021989 - DNA, 16 bp, Homo sapiens
catgaatccagtccag

SEQ ID NO: 6021990 - DNA, 20 bp, Homo sapiens
catgaatcgcttctcttttg

SEQ ID NO: 6021991 - DNA, 22 bp, Homo sapiens
catgaatcgggctaaggtccct

SEQ ID NO: 6021992 - DNA, 23 bp, Homo sapiens
catgaatcgggctaaggtccctg

SEQ ID NO: 6021993 - DNA, 18 bp, Homo sapiens
catgaatctctgcctctc

SEQ ID NO: 6021994 - DNA, 20 bp, Homo sapiens
catgaatctttcatacatat

SEQ ID NO: 6021995 - DNA, 22 bp, Homo sapiens
catgaatggtatggaactctct

SEQ ID NO: 6021996 - DNA, 13 bp, Homo sapiens
catgaatgtaaat

SEQ ID NO: 6021997 - DNA, 16 bp, Homo sapiens
catgaatgtaaatttg

SEQ ID NO: 6021998 - DNA, 18 bp, Homo sapiens
catgaatgtatcaggaaa

SEQ ID NO: 6021999 - DNA, 15 bp, Homo sapiens
catgaatgtgctggt

SEQ ID NO: 6022000 - DNA, 23 bp, Homo sapiens
catgaatgttcatatagccaggg

SEQ ID NO: 6022001 - DNA, 21 bp, Homo sapiens
catgaattacctggatgttct

SEQ ID NO: 6022002 - DNA, 22 bp, Homo sapiens
catgaattacctggatgttctt

SEQ ID NO: 6022003 - DNA, 16 bp, Homo sapiens
catgaattagttttat

SEQ ID NO: 6022004 - DNA, 15 bp, Homo sapiens
catgaattatataat

SEQ ID NO: 6022005 - DNA, 17 bp, Homo sapiens
catgaattattacagtg

SEQ ID NO: 6022006 - DNA, 16 bp, Homo sapiens
catgaattcatactct

SEQ ID NO: 6022007 - DNA, 19 bp, Homo sapiens
catgaattcatactctgtt

SEQ ID NO: 6022008 - DNA, 18 bp, Homo sapiens
catgaattcccttttaat

SEQ ID NO: 6022009 - DNA, 18 bp, Homo sapiens
catgaattcttatgctta

SEQ ID NO: 6022010 - DNA, 13 bp, Homo sapiens
catgaattcttga

SEQ ID NO: 6022011 - DNA, 13 bp, Homo sapiens
catgaatttaatg

SEQ ID NO: 6022012 - DNA, 14 bp, Homo sapiens
catgaatttaatgt

SEQ ID NO: 6022013 - DNA, 17 bp, Homo sapiens
catgaatttctgccata

SEQ ID NO: 6022014 - DNA, 18 bp, Homo sapiens
catgaatttgtaatgtct

SEQ ID NO: 6022015 - DNA, 19 bp, Homo sapiens
catgaatttgtaatgtctt

SEQ ID NO: 6022016 - DNA, 16 bp, Homo sapiens
catgaatttgtgaagg

SEQ ID NO: 6022017 - DNA, 15 bp, Homo sapiens
catgaattttaaaat

SEQ ID NO: 6022018 - DNA, 14 bp, Homo sapiens
catgaattttaaag

SEQ ID NO: 6022019 - DNA, 15 bp, Homo sapiens
catgaattttaaagt

SEQ ID NO: 6022020 - DNA, 16 bp, Homo sapiens
catgaattttaaagta

SEQ ID NO: 6022021 - DNA, 18 bp, Homo sapiens
catgaattttaaataatg

SEQ ID NO: 6022022 - DNA, 13 bp, Homo sapiens
catgaattttaca

SEQ ID NO: 6022023 - DNA, 18 bp, Homo sapiens
catgaattttagcttttg

SEQ ID NO: 6022024 - DNA, 14 bp, Homo sapiens
catgacaaaaataa

SEQ ID NO: 6022025 - DNA, 20 bp, Homo sapiens
catgacaaaaataacactgt

SEQ ID NO: 6022026 - DNA, 14 bp, Homo sapiens
catgacaaaaatta

SEQ ID NO: 6022027 - DNA, 19 bp, Homo sapiens
catgacaaaatagcccagc

SEQ ID NO: 6022028 - DNA, 12 bp, Homo sapiens
catgacaaagtt

SEQ ID NO: 6022029 - DNA, 19 bp, Homo sapiens
catgacaactttgccagct

SEQ ID NO: 6022030 - DNA, 23 bp, Homo sapiens
catgacaagatgggacagcaaca

SEQ ID NO: 6022031 - DNA, 14 bp, Homo sapiens
catgacaagcccca

SEQ ID NO: 6022032 - DNA, 16 bp, Homo sapiens
catgacaagccccagg

SEQ ID NO: 6022033 - DNA, 18 bp, Homo sapiens
catgacaagccccaggca

SEQ ID NO: 6022034 - DNA, 16 bp, Homo sapiens
catgacaatgttgtag

SEQ ID NO: 6022035 - DNA, 23 bp, Homo sapiens
catgacacagctttatcaccaga

SEQ ID NO: 6022036 - DNA, 23 bp, Homo sapiens
catgacacccgtgagcgcctgtg

SEQ ID NO: 6022037 - DNA, 18 bp, Homo sapiens
catgacacgaatattgct

SEQ ID NO: 6022038 - DNA, 21 bp, Homo sapiens
catgacacgaatattgctgat

SEQ ID NO: 6022039 - DNA, 23 bp, Homo sapiens
catgacacgaatattgctgatgg

SEQ ID NO: 6022040 - DNA, 13 bp, Homo sapiens
catgacactgacc

SEQ ID NO: 6022041 - DNA, 15 bp, Homo sapiens
catgacactgacctt

SEQ ID NO: 6022042 - DNA, 16 bp, Homo sapiens
catgacacttccaaag

SEQ ID NO: 6022043 - DNA, 14 bp, Homo sapiens
catgacagaggctg

SEQ ID NO: 6022044 - DNA, 18 bp, Homo sapiens
catgacagcctgcagcag

SEQ ID NO: 6022045 - DNA, 20 bp, Homo sapiens
catgacagcgctaaacgttg

SEQ ID NO: 6022046 - DNA, 14 bp, Homo sapiens
catgacaggctgtt

SEQ ID NO: 6022047 - DNA, 13 bp, Homo sapiens
catgacagtggtt

SEQ ID NO: 6022048 - DNA, 22 bp, Homo sapiens
catgacagtggttatatttcaa

SEQ ID NO: 6022049 - DNA, 23 bp, Homo sapiens
catgacagttcattcagggccga

SEQ ID NO: 6022050 - DNA, 15 bp, Homo sapiens
catgacataataaag

SEQ ID NO: 6022051 - DNA, 17 bp, Homo sapiens
catgacataataaagta

SEQ ID NO: 6022052 - DNA, 20 bp, Homo sapiens
catgacatttaccagcaact

SEQ ID NO: 6022053 - DNA, 18 bp, Homo sapiens
catgacatttcatctggg

SEQ ID NO: 6022054 - DNA, 17 bp, Homo sapiens
catgacatttctaagtg

SEQ ID NO: 6022055 - DNA, 15 bp, Homo sapiens
catgacatttctcaa

SEQ ID NO: 6022056 - DNA, 16 bp, Homo sapiens
catgacatttctcaaa

SEQ ID NO: 6022057 - DNA, 17 bp, Homo sapiens
catgacatttctcaaag

SEQ ID NO: 6022058 - DNA, 11 bp, Homo sapiens
catgaccaaaa

SEQ ID NO: 6022059 - DNA, 13 bp, Homo sapiens
catgaccaaaaac

SEQ ID NO: 6022060 - DNA, 19 bp, Homo sapiens
catgaccaaaaaccaaaag

SEQ ID NO: 6022061 - DNA, 12 bp, Homo sapiens
catgaccactgg

SEQ ID NO: 6022062 - DNA, 15 bp, Homo sapiens
catgaccactgggcc

SEQ ID NO: 6022063 - DNA, 21 bp, Homo sapiens
catgaccactgggcctgctag

SEQ ID NO: 6022064 - DNA, 22 bp, Homo sapiens
catgaccactgggcctgctagt

SEQ ID NO: 6022065 - DNA, 14 bp, Homo sapiens
catgaccaggccac

SEQ ID NO: 6022066 - DNA, 14 bp, Homo sapiens
catgaccagtaaag

SEQ ID NO: 6022067 - DNA, 16 bp, Homo sapiens
catgaccatcctgtcc

SEQ ID NO: 6022068 - DNA, 12 bp, Homo sapiens
catgacccaccc

SEQ ID NO: 6022069 - DNA, 14 bp, Homo sapiens
catgacccacccct

SEQ ID NO: 6022070 - DNA, 16 bp, Homo sapiens
catgacccacccctgt

SEQ ID NO: 6022071 - DNA, 18 bp, Homo sapiens
catgacccacccctgtgc

SEQ ID NO: 6022072 - DNA, 13 bp, Homo sapiens
catgacccaggct

SEQ ID NO: 6022073 - DNA, 19 bp, Homo sapiens
catgacccaggctgggcaa

SEQ ID NO: 6022074 - DNA, 20 bp, Homo sapiens
catgacccctcgtccacccc

SEQ ID NO: 6022075 - DNA, 21 bp, Homo sapiens
catgaccccttctctctccag

SEQ ID NO: 6022076 - DNA, 16 bp, Homo sapiens
catgacccgtacacac

SEQ ID NO: 6022077 - DNA, 15 bp, Homo sapiens
catgaccctcctgtc

SEQ ID NO: 6022078 - DNA, 23 bp, Homo sapiens
catgaccctcctgtccagcaggt

SEQ ID NO: 6022079 - DNA, 20 bp, Homo sapiens
catgaccctctgtccccagg

SEQ ID NO: 6022080 - DNA, 21 bp, Homo sapiens
catgaccctctgtccccaggc

SEQ ID NO: 6022081 - DNA, 22 bp, Homo sapiens
catgaccctctgtccccaggcc

SEQ ID NO: 6022082 - DNA, 16 bp, Homo sapiens
catgaccctggagccc

SEQ ID NO: 6022083 - DNA, 14 bp, Homo sapiens
catgaccctgggct

SEQ ID NO: 6022084 - DNA, 21 bp, Homo sapiens
catgacctaccaggacagaac

SEQ ID NO: 6022085 - DNA, 18 bp, Homo sapiens
catgacctagttttccat

SEQ ID NO: 6022086 - DNA, 19 bp, Homo sapiens
catgacctcagtcaggcac

SEQ ID NO: 6022087 - DNA, 21 bp, Homo sapiens
catgacctccagctttcctgt

SEQ ID NO: 6022088 - DNA, 22 bp, Homo sapiens
catgacctgatcactagcctgt

SEQ ID NO: 6022089 - DNA, 14 bp, Homo sapiens
catgacctgtgacc

SEQ ID NO: 6022090 - DNA, 13 bp, Homo sapiens
catgaccttacat

SEQ ID NO: 6022091 - DNA, 23 bp, Homo sapiens
catgaccttgacgtgtgtggtcc

SEQ ID NO: 6022092 - DNA, 19 bp, Homo sapiens
catgaccttttggcctttg

SEQ ID NO: 6022093 - DNA, 20 bp, Homo sapiens
catgacgcaaagagagattt

SEQ ID NO: 6022094 - DNA, 13 bp, Homo sapiens
catgacggcctgc

SEQ ID NO: 6022095 - DNA, 16 bp, Homo sapiens
catgacgtgaatgtgt

SEQ ID NO: 6022096 - DNA, 18 bp, Homo sapiens
catgacgtggtaaaatgt

SEQ ID NO: 6022097 - DNA, 21 bp, Homo sapiens
catgactagagacgcaccttg

SEQ ID NO: 6022098 - DNA, 22 bp, Homo sapiens
catgactagggtcctcaggcag

SEQ ID NO: 6022099 - DNA, 14 bp, Homo sapiens
catgactatggata

SEQ ID NO: 6022100 - DNA, 17 bp, Homo sapiens
catgactatgtattttt

SEQ ID NO: 6022101 - DNA, 17 bp, Homo sapiens
catgactcgggggtggg

SEQ ID NO: 6022102 - DNA, 15 bp, Homo sapiens
catgactctcatttt

SEQ ID NO: 6022103 - DNA, 18 bp, Homo sapiens
catgactctttattgtct

SEQ ID NO: 6022104 - DNA, 23 bp, Homo sapiens
catgactgagtctggcaaacatg

SEQ ID NO: 6022105 - DNA, 19 bp, Homo sapiens
catgactgcacccagctcc

SEQ ID NO: 6022106 - DNA, 14 bp, Homo sapiens
catgactgcatgac

SEQ ID NO: 6022107 - DNA, 20 bp, Homo sapiens
catgactgccccttgcttct

SEQ ID NO: 6022108 - DNA, 19 bp, Homo sapiens
catgactgctcaggcctca

SEQ ID NO: 6022109 - DNA, 18 bp, Homo sapiens
catgactgcttgccctaa

SEQ ID NO: 6022110 - DNA, 16 bp, Homo sapiens
catgactggctgtctg

SEQ ID NO: 6022111 - DNA, 21 bp, Homo sapiens
catgactggctgtctgcctgt

SEQ ID NO: 6022112 - DNA, 22 bp, Homo sapiens
catgactggctgtctgcctgta

SEQ ID NO: 6022113 - DNA, 13 bp, Homo sapiens
catgactgggcct

SEQ ID NO: 6022114 - DNA, 15 bp, Homo sapiens
catgactgggcctcc

SEQ ID NO: 6022115 - DNA, 16 bp, Homo sapiens
catgactgtcgccaca

SEQ ID NO: 6022116 - DNA, 19 bp, Homo sapiens
catgactgtcgccacacgc

SEQ ID NO: 6022117 - DNA, 14 bp, Homo sapiens
catgactgtttctt

SEQ ID NO: 6022118 - DNA, 23 bp, Homo sapiens
catgactgtttcttttgtaaaga

SEQ ID NO: 6022119 - DNA, 14 bp, Homo sapiens
catgacttattatg

SEQ ID NO: 6022120 - DNA, 15 bp, Homo sapiens
catgacttccttatt

SEQ ID NO: 6022121 - DNA, 22 bp, Homo sapiens
catgacttccttatttctgaac

SEQ ID NO: 6022122 - DNA, 22 bp, Homo sapiens
catgacttctttactaacactg

SEQ ID NO: 6022123 - DNA, 14 bp, Homo sapiens
catgacttgtgtgt

SEQ ID NO: 6022124 - DNA, 15 bp, Homo sapiens
catgacttttccatg

SEQ ID NO: 6022125 - DNA, 17 bp, Homo sapiens
catgagaaaatcagtaa

SEQ ID NO: 6022126 - DNA, 10 bp, Homo sapiens
catgagaaat

SEQ ID NO: 6022127 - DNA, 14 bp, Homo sapiens
catgagaaatgtga

SEQ ID NO: 6022128 - DNA, 16 bp, Homo sapiens
catgagaacaaacaga

SEQ ID NO: 6022129 - DNA, 15 bp, Homo sapiens
catgagaacagactg

SEQ ID NO: 6022130 - DNA, 15 bp, Homo sapiens
catgagaactaaata

SEQ ID NO: 6022131 - DNA, 15 bp, Homo sapiens
catgagaagagggcc

SEQ ID NO: 6022132 - DNA, 16 bp, Homo sapiens
catgagaagccataca

SEQ ID NO: 6022133 - DNA, 19 bp, Homo sapiens
catgagaatctatatttaa

SEQ ID NO: 6022134 - DNA, 21 bp, Homo sapiens
catgagaatgtcatttgctaa

SEQ ID NO: 6022135 - DNA, 22 bp, Homo sapiens
catgagaatgtcatttgctaat

SEQ ID NO: 6022136 - DNA, 23 bp, Homo sapiens
catgagaatgtcatttgctaatg

SEQ ID NO: 6022137 - DNA, 19 bp, Homo sapiens
catgagaattacagaaaat

SEQ ID NO: 6022138 - DNA, 17 bp, Homo sapiens
catgagaatttgcaaca

SEQ ID NO: 6022139 - DNA, 20 bp, Homo sapiens
catgagaatttgcaacaggg

SEQ ID NO: 6022140 - DNA, 22 bp, Homo sapiens
catgagaccctggtgcctggct

SEQ ID NO: 6022141 - DNA, 14 bp, Homo sapiens
catgagactaagag

SEQ ID NO: 6022142 - DNA, 17 bp, Homo sapiens
catgagactcagtgcag

SEQ ID NO: 6022143 - DNA, 15 bp, Homo sapiens
catgagactgccctg

SEQ ID NO: 6022144 - DNA, 20 bp, Homo sapiens
catgagaggaggcagcagga

SEQ ID NO: 6022145 - DNA, 17 bp, Homo sapiens
catgagaggctctgtgc

SEQ ID NO: 6022146 - DNA, 17 bp, Homo sapiens
catgagagtagggccct

SEQ ID NO: 6022147 - DNA, 22 bp, Homo sapiens
catgagagtagggccctgacag

SEQ ID NO: 6022148 - DNA, 23 bp, Homo sapiens
catgagagtagggccctgacagg

SEQ ID NO: 6022149 - DNA, 19 bp, Homo sapiens
catgagatcagggcctgcc

SEQ ID NO: 6022150 - DNA, 17 bp, Homo sapiens
catgagatgtgtggact

SEQ ID NO: 6022151 - DNA, 16 bp, Homo sapiens
catgagattgtacatt

SEQ ID NO: 6022152 - DNA, 17 bp, Homo sapiens
catgagattgtacattt

SEQ ID NO: 6022153 - DNA, 18 bp, Homo sapiens
catgagattgtacatttt

SEQ ID NO: 6022154 - DNA, 16 bp, Homo sapiens
catgagcaccccaagg

SEQ ID NO: 6022155 - DNA, 19 bp, Homo sapiens
catgagcacctttctggct

SEQ ID NO: 6022156 - DNA, 13 bp, Homo sapiens
catgagcatcagg

SEQ ID NO: 6022157 - DNA, 17 bp, Homo sapiens
catgagcatcaggccag

SEQ ID NO: 6022158 - DNA, 22 bp, Homo sapiens
catgagcatcaggccaggccct

SEQ ID NO: 6022159 - DNA, 22 bp, Homo sapiens
catgagcattggatacagcagt

SEQ ID NO: 6022160 - DNA, 23 bp, Homo sapiens
catgagcattggatacagcagta

SEQ ID NO: 6022161 - DNA, 12 bp, Homo sapiens
catgagccaccg

SEQ ID NO: 6022162 - DNA, 20 bp, Homo sapiens
catgagccactgagcctggc

SEQ ID NO: 6022163 - DNA, 14 bp, Homo sapiens
catgagccactgtg

SEQ ID NO: 6022164 - DNA, 19 bp, Homo sapiens
catgagccgcccaaggcct

SEQ ID NO: 6022165 - DNA, 19 bp, Homo sapiens
catgagcctcagcatcctg

SEQ ID NO: 6022166 - DNA, 15 bp, Homo sapiens
caggaattcagtgcc

SEQ ID NO: 6022167 - DNA, 17 bp, Homo sapiens
caggaattcagtgcctt

SEQ ID NO: 6022168 - DNA, 19 bp, Homo sapiens
caggaattccaattaaatt

SEQ ID NO: 6022169 - DNA, 16 bp, Homo sapiens
caggaattctcaagac

SEQ ID NO: 6022170 - DNA, 21 bp, Homo sapiens
caggaatttaagaatttgttt

SEQ ID NO: 6022171 - DNA, 17 bp, Homo sapiens
caggaatttaatttata

SEQ ID NO: 6022172 - DNA, 19 bp, Homo sapiens
caggaatttgggaccctgc

SEQ ID NO: 6022173 - DNA, 14 bp, Homo sapiens
caggaattttattt

SEQ ID NO: 6022174 - DNA, 17 bp, Homo sapiens
caggacaaagggaggga

SEQ ID NO: 6022175 - DNA, 22 bp, Homo sapiens
caggacaaagggagggagcaag

SEQ ID NO: 6022176 - DNA, 16 bp, Homo sapiens
caggacaacgaggaag

SEQ ID NO: 6022177 - DNA, 19 bp, Homo sapiens
caggacaacgaggaagccc

SEQ ID NO: 6022178 - DNA, 14 bp, Homo sapiens
caggacaagcatgg

SEQ ID NO: 6022179 - DNA, 23 bp, Homo sapiens
caggacaaggccttgctcactca

SEQ ID NO: 6022180 - DNA, 17 bp, Homo sapiens
caggacacaggcctgtg

SEQ ID NO: 6022181 - DNA, 20 bp, Homo sapiens
caggacacaggcctgtgtag

SEQ ID NO: 6022182 - DNA, 21 bp, Homo sapiens
caggacacatcccggcctctt

SEQ ID NO: 6022183 - DNA, 17 bp, Homo sapiens
caggacacctgccccag

SEQ ID NO: 6022184 - DNA, 18 bp, Homo sapiens
caggacacctggccgcct

SEQ ID NO: 6022185 - DNA, 21 bp, Homo sapiens
caggacacgaaggctgcccct

SEQ ID NO: 6022186 - DNA, 12 bp, Homo sapiens
caggacactgcc

SEQ ID NO: 6022187 - DNA, 15 bp, Homo sapiens
caggacactgccttt

SEQ ID NO: 6022188 - DNA, 21 bp, Homo sapiens
caggacactgcctttgctgcc

SEQ ID NO: 6022189 - DNA, 22 bp, Homo sapiens
caggacactgcctttgctgcct

SEQ ID NO: 6022190 - DNA, 23 bp, Homo sapiens
caggacagagggaagccagtcag

SEQ ID NO: 6022191 - DNA, 13 bp, Homo sapiens
caggacagagttc

SEQ ID NO: 6022192 - DNA, 15 bp, Homo sapiens
caggacagagttcac

SEQ ID NO: 6022193 - DNA, 17 bp, Homo sapiens
caggacagagttcacag

SEQ ID NO: 6022194 - DNA, 14 bp, Homo sapiens
caggacagatgcca

SEQ ID NO: 6022195 - DNA, 15 bp, Homo sapiens
caggacagcagcact

SEQ ID NO: 6022196 - DNA, 16 bp, Homo sapiens
caggacagcagcactc

SEQ ID NO: 6022197 - DNA, 19 bp, Homo sapiens
caggacagcatcccttccc

SEQ ID NO: 6022198 - DNA, 16 bp, Homo sapiens
caggacagccagcagc

SEQ ID NO: 6022199 - DNA, 23 bp, Homo sapiens
caggacagcccttctttccacag

SEQ ID NO: 6022200 - DNA, 12 bp, Homo sapiens
caggacagctct

SEQ ID NO: 6022201 - DNA, 14 bp, Homo sapiens
caggacagctgcag

SEQ ID NO: 6022202 - DNA, 19 bp, Homo sapiens
caggacagctgcaggtgcc

SEQ ID NO: 6022203 - DNA, 12 bp, Homo sapiens
caggacagctgg

SEQ ID NO: 6022204 - DNA, 17 bp, Homo sapiens
caggacagctggctgct

SEQ ID NO: 6022205 - DNA, 20 bp, Homo sapiens
caggacagctggctgctgac

SEQ ID NO: 6022206 - DNA, 12 bp, Homo sapiens
caggacaggaaa

SEQ ID NO: 6022207 - DNA, 14 bp, Homo sapiens
caggacaggaaata

SEQ ID NO: 6022208 - DNA, 13 bp, Homo sapiens
caggacaggagac

SEQ ID NO: 6022209 - DNA, 21 bp, Homo sapiens
caggacaggagatgctgtgcc

SEQ ID NO: 6022210 - DNA, 13 bp, Homo sapiens
caggacaggaggc

SEQ ID NO: 6022211 - DNA, 17 bp, Homo sapiens
caggacaggaggcggcc

SEQ ID NO: 6022212 - DNA, 12 bp, Homo sapiens
caggacaggccc

SEQ ID NO: 6022213 - DNA, 22 bp, Homo sapiens
caggacagtgcttcagcctgag

SEQ ID NO: 6022214 - DNA, 13 bp, Homo sapiens
caggacagtttat

SEQ ID NO: 6022215 - DNA, 18 bp, Homo sapiens
caggacatctcctggcta

SEQ ID NO: 6022216 - DNA, 15 bp, Homo sapiens
caggacatgcaataa

SEQ ID NO: 6022217 - DNA, 13 bp, Homo sapiens
caggacatgctga

SEQ ID NO: 6022218 - DNA, 13 bp, Homo sapiens
caggacatggggc

SEQ ID NO: 6022219 - DNA, 17 bp, Homo sapiens
caggacatggggcatag

SEQ ID NO: 6022220 - DNA, 18 bp, Homo sapiens
caggacatggggcataga

SEQ ID NO: 6022221 - DNA, 23 bp, Homo sapiens
caggacatggggcatagaaactg

SEQ ID NO: 6022222 - DNA, 23 bp, Homo sapiens
caggacattaataaagttgcttt

SEQ ID NO: 6022223 - DNA, 12 bp, Homo sapiens
caggacatttct

SEQ ID NO: 6022224 - DNA, 14 bp, Homo sapiens
caggacatttctct

SEQ ID NO: 6022225 - DNA, 21 bp, Homo sapiens
caggaccaaaaaacctcactg

SEQ ID NO: 6022226 - DNA, 13 bp, Homo sapiens
caggaccaagcca

SEQ ID NO: 6022227 - DNA, 16 bp, Homo sapiens
caggaccaagggcaga

SEQ ID NO: 6022228 - DNA, 20 bp, Homo sapiens
caggaccaatggctgagcct

SEQ ID NO: 6022229 - DNA, 12 bp, Homo sapiens
caggaccacaaa

SEQ ID NO: 6022230 - DNA, 13 bp, Homo sapiens
caggaccacacag

SEQ ID NO: 6022231 - DNA, 16 bp, Homo sapiens
caggaccacacagtcc

SEQ ID NO: 6022232 - DNA, 18 bp, Homo sapiens
caggaccacacagtcccc

SEQ ID NO: 6022233 - DNA, 19 bp, Homo sapiens
caggaccacacagtcccca

SEQ ID NO: 6022234 - DNA, 14 bp, Homo sapiens
caggaccacaggct

SEQ ID NO: 6022235 - DNA, 15 bp, Homo sapiens
caggaccacaggctc

SEQ ID NO: 6022236 - DNA, 16 bp, Homo sapiens
caggaccacaggctca

SEQ ID NO: 6022237 - DNA, 19 bp, Homo sapiens
caggaccaccctgccaagg

SEQ ID NO: 6022238 - DNA, 13 bp, Homo sapiens
caggaccacctcc

SEQ ID NO: 6022239 - DNA, 21 bp, Homo sapiens
caggaccacctcctctgccag

SEQ ID NO: 6022240 - DNA, 13 bp, Homo sapiens
caggaccagaagc

SEQ ID NO: 6022241 - DNA, 15 bp, Homo sapiens
caggaccagaagctc

SEQ ID NO: 6022242 - DNA, 14 bp, Homo sapiens
caggaccagaaggc

SEQ ID NO: 6022243 - DNA, 15 bp, Homo sapiens
caggaccagaaggca

SEQ ID NO: 6022244 - DNA, 16 bp, Homo sapiens
caggaccagaaggcaa

SEQ ID NO: 6022245 - DNA, 19 bp, Homo sapiens
caggaccagaaggcaatca

SEQ ID NO: 6022246 - DNA, 10 bp, Homo sapiens
caggaccagc

SEQ ID NO: 6022247 - DNA, 20 bp, Homo sapiens
caggaccagccagcagcagc

SEQ ID NO: 6022248 - DNA, 14 bp, Homo sapiens
caggaccagcccac

SEQ ID NO: 6022249 - DNA, 16 bp, Homo sapiens
caggaccagcccacgc

SEQ ID NO: 6022250 - DNA, 13 bp, Homo sapiens
caggaccagcctg

SEQ ID NO: 6022251 - DNA, 15 bp, Homo sapiens
caggaccagcctgta

SEQ ID NO: 6022252 - DNA, 12 bp, Homo sapiens
caggaccagctc

SEQ ID NO: 6022253 - DNA, 14 bp, Homo sapiens
caggaccagctcag

SEQ ID NO: 6022254 - DNA, 17 bp, Homo sapiens
caggaccagctcaggac

SEQ ID NO: 6022255 - DNA, 19 bp, Homo sapiens
caggaccagctcaggacag

SEQ ID NO: 6022256 - DNA, 19 bp, Homo sapiens
caggaccaggacccaggga

SEQ ID NO: 6022257 - DNA, 12 bp, Homo sapiens
caggaccaggag

SEQ ID NO: 6022258 - DNA, 15 bp, Homo sapiens
caggaccaggagcca

SEQ ID NO: 6022259 - DNA, 19 bp, Homo sapiens
caggaccagggttggcacc

SEQ ID NO: 6022260 - DNA, 22 bp, Homo sapiens
caggaccagggttggcaccttc

SEQ ID NO: 6022261 - DNA, 18 bp, Homo sapiens
caggaccagtcccagagc

SEQ ID NO: 6022262 - DNA, 20 bp, Homo sapiens
caggaccagtttatgtttgt

SEQ ID NO: 6022263 - DNA, 22 bp, Homo sapiens
caggaccatgggaccaggtctt

SEQ ID NO: 6022264 - DNA, 15 bp, Homo sapiens
caggaccattttaga

SEQ ID NO: 6022265 - DNA, 16 bp, Homo sapiens
caggaccattttagaa

SEQ ID NO: 6022266 - DNA, 20 bp, Homo sapiens
caggacccaccatgtctgcc

SEQ ID NO: 6022267 - DNA, 14 bp, Homo sapiens
caggacccagagga

SEQ ID NO: 6022268 - DNA, 13 bp, Homo sapiens
caggacccaggcc

SEQ ID NO: 6022269 - DNA, 14 bp, Homo sapiens
caggacccaggccc

SEQ ID NO: 6022270 - DNA, 15 bp, Homo sapiens
caggacccaggccct

SEQ ID NO: 6022271 - DNA, 24 bp, Homo sapiens
caggacccaggccctccatgggct

SEQ ID NO: 6022272 - DNA, 17 bp, Homo sapiens
caggacccaggccgcct

SEQ ID NO: 6022273 - DNA, 12 bp, Homo sapiens
caggacccaggg

SEQ ID NO: 6022274 - DNA, 15 bp, Homo sapiens
caggacccagggaga

SEQ ID NO: 6022275 - DNA, 22 bp, Homo sapiens
caggacccagggagaggctgtg

SEQ ID NO: 6022276 - DNA, 13 bp, Homo sapiens
caggacccagggt

SEQ ID NO: 6022277 - DNA, 23 bp, Homo sapiens
caggacccagggtcccctcccca

SEQ ID NO: 6022278 - DNA, 14 bp, Homo sapiens
caggacccagtggt

SEQ ID NO: 6022279 - DNA, 19 bp, Homo sapiens
caggacccagtggtcagca

SEQ ID NO: 6022280 - DNA, 16 bp, Homo sapiens
caggacccatccctgc

SEQ ID NO: 6022281 - DNA, 19 bp, Homo sapiens
caggacccatccctgcctg

SEQ ID NO: 6022282 - DNA, 16 bp, Homo sapiens
caggaccccaacccct

SEQ ID NO: 6022283 - DNA, 23 bp, Homo sapiens
caggaccccaaggacctgcctcc

SEQ ID NO: 6022284 - DNA, 13 bp, Homo sapiens
caggaccccagag

SEQ ID NO: 6022285 - DNA, 13 bp, Homo sapiens
caggaccccagct

SEQ ID NO: 6022286 - DNA, 14 bp, Homo sapiens
caggaccccagctc

SEQ ID NO: 6022287 - DNA, 16 bp, Homo sapiens
caggaccccagctctg

SEQ ID NO: 6022288 - DNA, 13 bp, Homo sapiens
caggaccccatct

SEQ ID NO: 6022289 - DNA, 20 bp, Homo sapiens
caggaccccatctgctgagc

SEQ ID NO: 6022290 - DNA, 11 bp, Homo sapiens
caggacccccc

SEQ ID NO: 6022291 - DNA, 15 bp, Homo sapiens
caggacccccttccc

SEQ ID NO: 6022292 - DNA, 19 bp, Homo sapiens
caggacccctcagctcccc

SEQ ID NO: 6022293 - DNA, 14 bp, Homo sapiens
caggacccctgagt

SEQ ID NO: 6022294 - DNA, 18 bp, Homo sapiens
caggacccctgtccagga

SEQ ID NO: 6022295 - DNA, 16 bp, Homo sapiens
caggacccgccagccc

SEQ ID NO: 6022296 - DNA, 22 bp, Homo sapiens
caggaccctcagccctggcctt

SEQ ID NO: 6022297 - DNA, 13 bp, Homo sapiens
caggaccctcagg

SEQ ID NO: 6022298 - DNA, 14 bp, Homo sapiens
caggaccctcagga

SEQ ID NO: 6022299 - DNA, 12 bp, Homo sapiens
caggaccctcgc

SEQ ID NO: 6022300 - DNA, 17 bp, Homo sapiens
caggaccctcgctggcc

SEQ ID NO: 6022301 - DNA, 19 bp, Homo sapiens
caggaccctcgctggcccc

SEQ ID NO: 6022302 - DNA, 15 bp, Homo sapiens
caggaccctgaaggg

SEQ ID NO: 6022303 - DNA, 13 bp, Homo sapiens
caggaccctgcca

SEQ ID NO: 6022304 - DNA, 19 bp, Homo sapiens
caggaccctgccaggcaca

SEQ ID NO: 6022305 - DNA, 15 bp, Homo sapiens
caggaccctggacct

SEQ ID NO: 6022306 - DNA, 18 bp, Homo sapiens
caggaccctgggtcacct

SEQ ID NO: 6022307 - DNA, 24 bp, Homo sapiens
caggaccctgtcctgcagtcccac

SEQ ID NO: 6022308 - DNA, 14 bp, Homo sapiens
caggacccttctac

SEQ ID NO: 6022309 - DNA, 15 bp, Homo sapiens
caggacccttctact

SEQ ID NO: 6022310 - DNA, 15 bp, Homo sapiens
caggaccgccaaaga

SEQ ID NO: 6022311 - DNA, 22 bp, Homo sapiens
caggacctcagagtccaggccc

SEQ ID NO: 6022312 - DNA, 20 bp, Homo sapiens
caggacctcccttccgaccc

SEQ ID NO: 6022313 - DNA, 22 bp, Homo sapiens
caggacctcccttccgaccctc

SEQ ID NO: 6022314 - DNA, 20 bp, Homo sapiens
caggacctccggagcgccct

SEQ ID NO: 6022315 - DNA, 22 bp, Homo sapiens
caggacctccggagcgccctgc

SEQ ID NO: 6022316 - DNA, 20 bp, Homo sapiens
caggacctctgtaggcagca

SEQ ID NO: 6022317 - DNA, 17 bp, Homo sapiens
caggacctgagcctggc

SEQ ID NO: 6022318 - DNA, 14 bp, Homo sapiens
caggacctgccaag

SEQ ID NO: 6022319 - DNA, 13 bp, Homo sapiens
caggacctgccta

SEQ ID NO: 6022320 - DNA, 15 bp, Homo sapiens
caggacctgcctagc

SEQ ID NO: 6022321 - DNA, 21 bp, Homo sapiens
caggacctgcctagcatgggg

SEQ ID NO: 6022322 - DNA, 19 bp, Homo sapiens
caggacctgcctgtagccc

SEQ ID NO: 6022323 - DNA, 14 bp, Homo sapiens
caggacctggctgc

SEQ ID NO: 6022324 - DNA, 14 bp, Homo sapiens
caggacctggcttg

SEQ ID NO: 6022325 - DNA, 20 bp, Homo sapiens
caggacctggcttggcttta

SEQ ID NO: 6022326 - DNA, 14 bp, Homo sapiens
caggacctgtgctt

SEQ ID NO: 6022327 - DNA, 13 bp, Homo sapiens
caggaccttttga

SEQ ID NO: 6022328 - DNA, 19 bp, Homo sapiens
caggacgaaaaagaggcat

SEQ ID NO: 6022329 - DNA, 14 bp, Homo sapiens
caggacgaggagga

SEQ ID NO: 6022330 - DNA, 16 bp, Homo sapiens
caggacgccactcatt

SEQ ID NO: 6022331 - DNA, 21 bp, Homo sapiens
caggacgccactcatttcatc

SEQ ID NO: 6022332 - DNA, 16 bp, Homo sapiens
caggacgcttctgaat

SEQ ID NO: 6022333 - DNA, 15 bp, Homo sapiens
caggacggctcctca

SEQ ID NO: 6022334 - DNA, 23 bp, Homo sapiens
caggacggctcctcagagcgcca

SEQ ID NO: 6022335 - DNA, 23 bp, Homo sapiens
caggacggggccggccaggtggg

SEQ ID NO: 6022336 - DNA, 24 bp, Homo sapiens
caggacggggccggccaggtgggc

SEQ ID NO: 6022337 - DNA, 17 bp, Homo sapiens
caggacggtctgtgccc

SEQ ID NO: 6022338 - DNA, 21 bp, Homo sapiens
caggacgtcctatctccccca

SEQ ID NO: 6022339 - DNA, 17 bp, Homo sapiens
caggacgtctggggtgt

SEQ ID NO: 6022340 - DNA, 16 bp, Homo sapiens
caggacgttagactgt

SEQ ID NO: 6022341 - DNA, 21 bp, Homo sapiens
caggactaacactcagaagcc

SEQ ID NO: 6022342 - DNA, 22 bp, Homo sapiens
caggactaacactcagaagcct

SEQ ID NO: 6022343 - DNA, 23 bp, Homo sapiens
caggactaacactcagaagcctg

SEQ ID NO: 6022344 - DNA, 18 bp, Homo sapiens
caggactaggcatgtcag

SEQ ID NO: 6022345 - DNA, 18 bp, Homo sapiens
caggactatagcccaggt

SEQ ID NO: 6022346 - DNA, 20 bp, Homo sapiens
caggactatatttgggcctg

SEQ ID NO: 6022347 - DNA, 22 bp, Homo sapiens
catgagcctgctggaagcccag

SEQ ID NO: 6022348 - DNA, 15 bp, Homo sapiens
catgagcctgtttat

SEQ ID NO: 6022349 - DNA, 16 bp, Homo sapiens
catgagcctgtttatt

SEQ ID NO: 6022350 - DNA, 21 bp, Homo sapiens
catgagcgtcaaagaaaatgc

SEQ ID NO: 6022351 - DNA, 18 bp, Homo sapiens
catgagcgtccaggtgat

SEQ ID NO: 6022352 - DNA, 19 bp, Homo sapiens
catgagctacgcctgcctc

SEQ ID NO: 6022353 - DNA, 15 bp, Homo sapiens
catgagctccagacc

SEQ ID NO: 6022354 - DNA, 13 bp, Homo sapiens
catgagctcctga

SEQ ID NO: 6022355 - DNA, 16 bp, Homo sapiens
catgagctcctgatca

SEQ ID NO: 6022356 - DNA, 20 bp, Homo sapiens
catgagctcctgatcagagg

SEQ ID NO: 6022357 - DNA, 14 bp, Homo sapiens
catgagctgctcat

SEQ ID NO: 6022358 - DNA, 20 bp, Homo sapiens
catgagctgctgtgcccagc

SEQ ID NO: 6022359 - DNA, 22 bp, Homo sapiens
catgagctggcaaccagccagc

SEQ ID NO: 6022360 - DNA, 15 bp, Homo sapiens
catgagctgggtact

SEQ ID NO: 6022361 - DNA, 23 bp, Homo sapiens
catgagctgggtactgactgaga

SEQ ID NO: 6022362 - DNA, 14 bp, Homo sapiens
catgaggaaaataa

SEQ ID NO: 6022363 - DNA, 12 bp, Homo sapiens
catgaggaaaga

SEQ ID NO: 6022364 - DNA, 14 bp, Homo sapiens
catgaggaaagaca

SEQ ID NO: 6022365 - DNA, 19 bp, Homo sapiens
catgaggaaagacacagat

SEQ ID NO: 6022366 - DNA, 21 bp, Homo sapiens
catgaggaaagcagttgaaat

SEQ ID NO: 6022367 - DNA, 16 bp, Homo sapiens
catgaggaacaaggca

SEQ ID NO: 6022368 - DNA, 20 bp, Homo sapiens
catgaggaacaaggcaaggc

SEQ ID NO: 6022369 - DNA, 18 bp, Homo sapiens
catgaggaactgtagatg

SEQ ID NO: 6022370 - DNA, 15 bp, Homo sapiens
catgaggaaggaaca

SEQ ID NO: 6022371 - DNA, 13 bp, Homo sapiens
catgaggacagaa

SEQ ID NO: 6022372 - DNA, 17 bp, Homo sapiens
catgaggagcgtggact

SEQ ID NO: 6022373 - DNA, 16 bp, Homo sapiens
catgaggaggcagaga

SEQ ID NO: 6022374 - DNA, 13 bp, Homo sapiens
catgaggaggggc

SEQ ID NO: 6022375 - DNA, 21 bp, Homo sapiens
catgaggaggggcccccctgc

SEQ ID NO: 6022376 - DNA, 23 bp, Homo sapiens
catgaggaggggcccccctgccc

SEQ ID NO: 6022377 - DNA, 13 bp, Homo sapiens
catgaggagggtg

SEQ ID NO: 6022378 - DNA, 20 bp, Homo sapiens
catgaggagggtgggggagg

SEQ ID NO: 6022379 - DNA, 22 bp, Homo sapiens
catgaggcaatgtcaggaacag

SEQ ID NO: 6022380 - DNA, 16 bp, Homo sapiens
catgaggccatctcag

SEQ ID NO: 6022381 - DNA, 18 bp, Homo sapiens
catgaggccatctcagga

SEQ ID NO: 6022382 - DNA, 20 bp, Homo sapiens
catgaggccatctcaggaga

SEQ ID NO: 6022383 - DNA, 13 bp, Homo sapiens
catgaggccccga

SEQ ID NO: 6022384 - DNA, 21 bp, Homo sapiens
catgaggcctcagtggacttt

SEQ ID NO: 6022385 - DNA, 17 bp, Homo sapiens
catgaggcctcctgcca

SEQ ID NO: 6022386 - DNA, 19 bp, Homo sapiens
catgaggcctcctgccatg

SEQ ID NO: 6022387 - DNA, 17 bp, Homo sapiens
catgaggctcactcatt

SEQ ID NO: 6022388 - DNA, 17 bp, Homo sapiens
catgagggacagggtct

SEQ ID NO: 6022389 - DNA, 12 bp, Homo sapiens
catgagggctgg

SEQ ID NO: 6022390 - DNA, 13 bp, Homo sapiens
catgaggggagag

SEQ ID NO: 6022391 - DNA, 15 bp, Homo sapiens
catgaggggagagga

SEQ ID NO: 6022392 - DNA, 16 bp, Homo sapiens
catgaggggattccct

SEQ ID NO: 6022393 - DNA, 15 bp, Homo sapiens
catgagggtgttttt

SEQ ID NO: 6022394 - DNA, 14 bp, Homo sapiens
catgaggtcaggag

SEQ ID NO: 6022395 - DNA, 21 bp, Homo sapiens
catgagtagataatttcaggg

SEQ ID NO: 6022396 - DNA, 16 bp, Homo sapiens
catgagtatctgtggg

SEQ ID NO: 6022397 - DNA, 18 bp, Homo sapiens
catgagtcactacgcctg

SEQ ID NO: 6022398 - DNA, 14 bp, Homo sapiens
catgagtcccagtg

SEQ ID NO: 6022399 - DNA, 13 bp, Homo sapiens
catgagtcccctg

SEQ ID NO: 6022400 - DNA, 18 bp, Homo sapiens
catgagtctccagataga

SEQ ID NO: 6022401 - DNA, 16 bp, Homo sapiens
catgagtctgtaggag

SEQ ID NO: 6022402 - DNA, 17 bp, Homo sapiens
catgagtctgtaggagc

SEQ ID NO: 6022403 - DNA, 22 bp, Homo sapiens
catgagtctgtttcccaagcta

SEQ ID NO: 6022404 - DNA, 14 bp, Homo sapiens
catgagtgaataaa

SEQ ID NO: 6022405 - DNA, 23 bp, Homo sapiens
catgagtgctaagagcctctgga

SEQ ID NO: 6022406 - DNA, 13 bp, Homo sapiens
catgagtgctgat

SEQ ID NO: 6022407 - DNA, 14 bp, Homo sapiens
catgagtggaaata

SEQ ID NO: 6022408 - DNA, 17 bp, Homo sapiens
catgagtggaaatacac

SEQ ID NO: 6022409 - DNA, 18 bp, Homo sapiens
catgagtggaaatacact

SEQ ID NO: 6022410 - DNA, 21 bp, Homo sapiens
catgagtggacgtcagaagaa

SEQ ID NO: 6022411 - DNA, 22 bp, Homo sapiens
catgagtggatggatggacaga

SEQ ID NO: 6022412 - DNA, 20 bp, Homo sapiens
catgagtggccttaataaat

SEQ ID NO: 6022413 - DNA, 18 bp, Homo sapiens
catgagttattcataaag

SEQ ID NO: 6022414 - DNA, 23 bp, Homo sapiens
catgagttattcataaagagaaa

SEQ ID NO: 6022415 - DNA, 19 bp, Homo sapiens
catgagttccagaaagtaa

SEQ ID NO: 6022416 - DNA, 20 bp, Homo sapiens
catgagttccagaaagtaaa

SEQ ID NO: 6022417 - DNA, 12 bp, Homo sapiens
catgagttctgc

SEQ ID NO: 6022418 - DNA, 19 bp, Homo sapiens
catgagttctgcacataca

SEQ ID NO: 6022419 - DNA, 22 bp, Homo sapiens
catgagttctgcacatacagat

SEQ ID NO: 6022420 - DNA, 15 bp, Homo sapiens
catgagttctgctga

SEQ ID NO: 6022421 - DNA, 16 bp, Homo sapiens
catgataaacattcat

SEQ ID NO: 6022422 - DNA, 14 bp, Homo sapiens
catgataagaacag

SEQ ID NO: 6022423 - DNA, 13 bp, Homo sapiens
catgataagacat

SEQ ID NO: 6022424 - DNA, 15 bp, Homo sapiens
catgataagacattt

SEQ ID NO: 6022425 - DNA, 18 bp, Homo sapiens
catgataagacattttgt

SEQ ID NO: 6022426 - DNA, 16 bp, Homo sapiens
catgataataggtcat

SEQ ID NO: 6022427 - DNA, 21 bp, Homo sapiens
catgataataggtcatatgtt

SEQ ID NO: 6022428 - DNA, 18 bp, Homo sapiens
catgataatgaacagaac

SEQ ID NO: 6022429 - DNA, 19 bp, Homo sapiens
catgataccacctttactg

SEQ ID NO: 6022430 - DNA, 13 bp, Homo sapiens
catgatactattc

SEQ ID NO: 6022431 - DNA, 14 bp, Homo sapiens
catgatactgctgc

SEQ ID NO: 6022432 - DNA, 21 bp, Homo sapiens
catgatactgctgcttgtcaa

SEQ ID NO: 6022433 - DNA, 16 bp, Homo sapiens
catgatactttaattt

SEQ ID NO: 6022434 - DNA, 23 bp, Homo sapiens
catgatagaaagaataaaatgtt

SEQ ID NO: 6022435 - DNA, 17 bp, Homo sapiens
catgatagtgtgatttt

SEQ ID NO: 6022436 - DNA, 14 bp, Homo sapiens
catgatattgtatg

SEQ ID NO: 6022437 - DNA, 16 bp, Homo sapiens
catgatcaaaatgcat

SEQ ID NO: 6022438 - DNA, 19 bp, Homo sapiens
catgatcaagatatatgtg

SEQ ID NO: 6022439 - DNA, 12 bp, Homo sapiens
catgatcacaca

SEQ ID NO: 6022440 - DNA, 21 bp, Homo sapiens
catgatcagacatacagctgc

SEQ ID NO: 6022441 - DNA, 20 bp, Homo sapiens
catgatccaagcaagactga

SEQ ID NO: 6022442 - DNA, 21 bp, Homo sapiens
catgatccacactttgggctt

SEQ ID NO: 6022443 - DNA, 21 bp, Homo sapiens
catgatccctgtgttgtctct

SEQ ID NO: 6022444 - DNA, 17 bp, Homo sapiens
catgatctccctgccgc

SEQ ID NO: 6022445 - DNA, 19 bp, Homo sapiens
catgatctccctgccgcct

SEQ ID NO: 6022446 - DNA, 20 bp, Homo sapiens
catgatctccctgccgcctc

SEQ ID NO: 6022447 - DNA, 21 bp, Homo sapiens
catgatctgactttaattgtg

SEQ ID NO: 6022448 - DNA, 23 bp, Homo sapiens
catgatctgtatttaatggtttt

SEQ ID NO: 6022449 - DNA, 13 bp, Homo sapiens
catgatctgtcaa

SEQ ID NO: 6022450 - DNA, 14 bp, Homo sapiens
catgatctgtcaaa

SEQ ID NO: 6022451 - DNA, 18 bp, Homo sapiens
catgatcttacacgaaga

SEQ ID NO: 6022452 - DNA, 22 bp, Homo sapiens
catgatcttgagatttctttta

SEQ ID NO: 6022453 - DNA, 15 bp, Homo sapiens
catgatcttgagcaa

SEQ ID NO: 6022454 - DNA, 14 bp, Homo sapiens
catgatcttggttt

SEQ ID NO: 6022455 - DNA, 21 bp, Homo sapiens
catgatcttgtgacatattat

SEQ ID NO: 6022456 - DNA, 16 bp, Homo sapiens
catgatgaaactgtca

SEQ ID NO: 6022457 - DNA, 21 bp, Homo sapiens
catgatgaaactgtcataatg

SEQ ID NO: 6022458 - DNA, 16 bp, Homo sapiens
catgatgatttcagaa

SEQ ID NO: 6022459 - DNA, 18 bp, Homo sapiens
catgatgcacagtatctg

SEQ ID NO: 6022460 - DNA, 12 bp, Homo sapiens
catgatgcagtc

SEQ ID NO: 6022461 - DNA, 19 bp, Homo sapiens
catgatgccctcccctcag

SEQ ID NO: 6022462 - DNA, 23 bp, Homo sapiens
catgatgccgctcttctgtcatc

SEQ ID NO: 6022463 - DNA, 16 bp, Homo sapiens
catgatgcctctgtct

SEQ ID NO: 6022464 - DNA, 17 bp, Homo sapiens
catgatgcctctgtctt

SEQ ID NO: 6022465 - DNA, 16 bp, Homo sapiens
catgatgcgcttcaaa

SEQ ID NO: 6022466 - DNA, 19 bp, Homo sapiens
catgatgctagttcttacg

SEQ ID NO: 6022467 - DNA, 16 bp, Homo sapiens
catgatgctctttccc

SEQ ID NO: 6022468 - DNA, 18 bp, Homo sapiens
catgatgctgagcccgga

SEQ ID NO: 6022469 - DNA, 20 bp, Homo sapiens
catgatgctgagcccggaaa

SEQ ID NO: 6022470 - DNA, 15 bp, Homo sapiens
catgatgctgggatt

SEQ ID NO: 6022471 - DNA, 16 bp, Homo sapiens
catgatgctgggattt

SEQ ID NO: 6022472 - DNA, 17 bp, Homo sapiens
catgatgcttttactga

SEQ ID NO: 6022473 - DNA, 23 bp, Homo sapiens
catgatggatggaaatatgttct

SEQ ID NO: 6022474 - DNA, 15 bp, Homo sapiens
catgatggcaacaga

SEQ ID NO: 6022475 - DNA, 19 bp, Homo sapiens
catgatggcaacagatctg

SEQ ID NO: 6022476 - DNA, 18 bp, Homo sapiens
catgatgggaaaatattt

SEQ ID NO: 6022477 - DNA, 19 bp, Homo sapiens
catgatgggaaaatatttc

SEQ ID NO: 6022478 - DNA, 20 bp, Homo sapiens
catgatgggaaaatatttcc

SEQ ID NO: 6022479 - DNA, 20 bp, Homo sapiens
catgatgggaatagggagac

SEQ ID NO: 6022480 - DNA, 17 bp, Homo sapiens
catgatgggccgagcca

SEQ ID NO: 6022481 - DNA, 18 bp, Homo sapiens
catgatggtgagagccca

SEQ ID NO: 6022482 - DNA, 16 bp, Homo sapiens
catgatggtgcatgcc

SEQ ID NO: 6022483 - DNA, 23 bp, Homo sapiens
catgatggttattttcttttctt

SEQ ID NO: 6022484 - DNA, 15 bp, Homo sapiens
catgatgtaaaaaat

SEQ ID NO: 6022485 - DNA, 23 bp, Homo sapiens
catgatgtaaaaaatattaaaga

SEQ ID NO: 6022486 - DNA, 13 bp, Homo sapiens
catgatgtactaa

SEQ ID NO: 6022487 - DNA, 13 bp, Homo sapiens
catgatgtatatc

SEQ ID NO: 6022488 - DNA, 13 bp, Homo sapiens
catgatgtccttg

SEQ ID NO: 6022489 - DNA, 20 bp, Homo sapiens
catgatgtccttggactcca

SEQ ID NO: 6022490 - DNA, 15 bp, Homo sapiens
catgatgtgaagagt

SEQ ID NO: 6022491 - DNA, 22 bp, Homo sapiens
catgatgtgaagagtttcacaa

SEQ ID NO: 6022492 - DNA, 22 bp, Homo sapiens
catgatgttaaccagaataaag

SEQ ID NO: 6022493 - DNA, 17 bp, Homo sapiens
catgatgtttcttccac

SEQ ID NO: 6022494 - DNA, 21 bp, Homo sapiens
catgatgtttgcccaaaattt

SEQ ID NO: 6022495 - DNA, 18 bp, Homo sapiens
catgatgtttttaaaatc

SEQ ID NO: 6022496 - DNA, 18 bp, Homo sapiens
catgattagacaatgtgg

SEQ ID NO: 6022497 - DNA, 21 bp, Homo sapiens
catgattagcagaagaaagga

SEQ ID NO: 6022498 - DNA, 14 bp, Homo sapiens
catgattagcataa

SEQ ID NO: 6022499 - DNA, 15 bp, Homo sapiens
catgattcaacctga

SEQ ID NO: 6022500 - DNA, 18 bp, Homo sapiens
catgattcattttaacat

SEQ ID NO: 6022501 - DNA, 15 bp, Homo sapiens
catgattccaagggc

SEQ ID NO: 6022502 - DNA, 19 bp, Homo sapiens
catgattccaagggcccag

SEQ ID NO: 6022503 - DNA, 20 bp, Homo sapiens
catgattccaagggcccaga

SEQ ID NO: 6022504 - DNA, 17 bp, Homo sapiens
catgattccagccatca

SEQ ID NO: 6022505 - DNA, 14 bp, Homo sapiens
catgattccttcct

SEQ ID NO: 6022506 - DNA, 21 bp, Homo sapiens
catgattcgcccaaagccaga

SEQ ID NO: 6022507 - DNA, 14 bp, Homo sapiens
catgattctattta

SEQ ID NO: 6022508 - DNA, 15 bp, Homo sapiens
catgattctctgagt

SEQ ID NO: 6022509 - DNA, 21 bp, Homo sapiens
catgattctttaatagaagtt

SEQ ID NO: 6022510 - DNA, 21 bp, Homo sapiens
catgattgaaaccaagttgaa

SEQ ID NO: 6022511 - DNA, 20 bp, Homo sapiens
catgattgcagaattgttta

SEQ ID NO: 6022512 - DNA, 22 bp, Homo sapiens
catgattgcagaattgtttaga

SEQ ID NO: 6022513 - DNA, 16 bp, Homo sapiens
catgattggcttaaag

SEQ ID NO: 6022514 - DNA, 17 bp, Homo sapiens
catgattggcttaaagt

SEQ ID NO: 6022515 - DNA, 20 bp, Homo sapiens
catgattggcttaaagtgaa

SEQ ID NO: 6022516 - DNA, 22 bp, Homo sapiens
catgattggcttaaagtgaagg

SEQ ID NO: 6022517 - DNA, 22 bp, Homo sapiens
catgattgtataagcatgcttt

SEQ ID NO: 6022518 - DNA, 20 bp, Homo sapiens
catgatttacagagaagtga

SEQ ID NO: 6022519 - DNA, 12 bp, Homo sapiens
catgatttatat

SEQ ID NO: 6022520 - DNA, 16 bp, Homo sapiens
catgatttatatatgg

SEQ ID NO: 6022521 - DNA, 17 bp, Homo sapiens
catgatttatatatggc

SEQ ID NO: 6022522 - DNA, 18 bp, Homo sapiens
catgatttatttgtcctt

SEQ ID NO: 6022523 - DNA, 14 bp, Homo sapiens
catgatttcacaaa

SEQ ID NO: 6022524 - DNA, 22 bp, Homo sapiens
catgatttcacaaatattaaaa

SEQ ID NO: 6022525 - DNA, 13 bp, Homo sapiens
caggactcacagg

SEQ ID NO: 6022526 - DNA, 16 bp, Homo sapiens
caggactcagaagcct

SEQ ID NO: 6022527 - DNA, 21 bp, Homo sapiens
caggactcagaagcctctggg

SEQ ID NO: 6022528 - DNA, 19 bp, Homo sapiens
caggactcagctccccaga

SEQ ID NO: 6022529 - DNA, 23 bp, Homo sapiens
caggactcagggactcaggccag

SEQ ID NO: 6022530 - DNA, 19 bp, Homo sapiens
caggactccactggacaga

SEQ ID NO: 6022531 - DNA, 19 bp, Homo sapiens
caggactccaggcccaagg

SEQ ID NO: 6022532 - DNA, 14 bp, Homo sapiens
caggactcccacct

SEQ ID NO: 6022533 - DNA, 13 bp, Homo sapiens
caggactcccaga

SEQ ID NO: 6022534 - DNA, 16 bp, Homo sapiens
caggactcccagaacc

SEQ ID NO: 6022535 - DNA, 18 bp, Homo sapiens
caggactcccagaacctc

SEQ ID NO: 6022536 - DNA, 20 bp, Homo sapiens
caggactcccagaacctcta

SEQ ID NO: 6022537 - DNA, 16 bp, Homo sapiens
caggactccccaggcc

SEQ ID NO: 6022538 - DNA, 16 bp, Homo sapiens
caggactccctcctca

SEQ ID NO: 6022539 - DNA, 22 bp, Homo sapiens
caggactccctcctcacctctg

SEQ ID NO: 6022540 - DNA, 16 bp, Homo sapiens
caggactcctccccac

SEQ ID NO: 6022541 - DNA, 13 bp, Homo sapiens
caggactcctggc

SEQ ID NO: 6022542 - DNA, 15 bp, Homo sapiens
caggactcctggcag

SEQ ID NO: 6022543 - DNA, 16 bp, Homo sapiens
caggactcctggcagg

SEQ ID NO: 6022544 - DNA, 19 bp, Homo sapiens
caggactccttagactgat

SEQ ID NO: 6022545 - DNA, 14 bp, Homo sapiens
caggactctctcca

SEQ ID NO: 6022546 - DNA, 19 bp, Homo sapiens
caggactctctccaggagg

SEQ ID NO: 6022547 - DNA, 15 bp, Homo sapiens
caggactctctgctt

SEQ ID NO: 6022548 - DNA, 13 bp, Homo sapiens
caggactctcttt

SEQ ID NO: 6022549 - DNA, 14 bp, Homo sapiens
caggactctctttc

SEQ ID NO: 6022550 - DNA, 14 bp, Homo sapiens
caggactctgaccc

SEQ ID NO: 6022551 - DNA, 11 bp, Homo sapiens
caggactctgc

SEQ ID NO: 6022552 - DNA, 13 bp, Homo sapiens
caggactctgcag

SEQ ID NO: 6022553 - DNA, 14 bp, Homo sapiens
caggactctgcaga

SEQ ID NO: 6022554 - DNA, 16 bp, Homo sapiens
caggactctgcagcct

SEQ ID NO: 6022555 - DNA, 19 bp, Homo sapiens
caggactctgcagcctcag

SEQ ID NO: 6022556 - DNA, 21 bp, Homo sapiens
caggactctgcagcctcagag

SEQ ID NO: 6022557 - DNA, 21 bp, Homo sapiens
caggactctgccccttctgtt

SEQ ID NO: 6022558 - DNA, 19 bp, Homo sapiens
caggactctgccttccagg

SEQ ID NO: 6022559 - DNA, 12 bp, Homo sapiens
caggactctggc

SEQ ID NO: 6022560 - DNA, 14 bp, Homo sapiens
caggactctggcac

SEQ ID NO: 6022561 - DNA, 18 bp, Homo sapiens
caggactctttgaagaaa

SEQ ID NO: 6022562 - DNA, 18 bp, Homo sapiens
caggactgaattgtcccc

SEQ ID NO: 6022563 - DNA, 19 bp, Homo sapiens
caggactgaattgtcccca

SEQ ID NO: 6022564 - DNA, 14 bp, Homo sapiens
caggactgagcccc

SEQ ID NO: 6022565 - DNA, 18 bp, Homo sapiens
caggactgagccccgcag

SEQ ID NO: 6022566 - DNA, 19 bp, Homo sapiens
caggactgagccctctcac

SEQ ID NO: 6022567 - DNA, 22 bp, Homo sapiens
caggactgagccctctcactcc

SEQ ID NO: 6022568 - DNA, 18 bp, Homo sapiens
caggactgatgtctccta

SEQ ID NO: 6022569 - DNA, 13 bp, Homo sapiens
caggactgcagag

SEQ ID NO: 6022570 - DNA, 15 bp, Homo sapiens
caggactgcagagca

SEQ ID NO: 6022571 - DNA, 18 bp, Homo sapiens
caggactgcagagggctc

SEQ ID NO: 6022572 - DNA, 13 bp, Homo sapiens
caggactggctca

SEQ ID NO: 6022573 - DNA, 13 bp, Homo sapiens
caggactggctgt

SEQ ID NO: 6022574 - DNA, 13 bp, Homo sapiens
caggactgggccg

SEQ ID NO: 6022575 - DNA, 22 bp, Homo sapiens
caggactggtactcaagccagc

SEQ ID NO: 6022576 - DNA, 23 bp, Homo sapiens
caggactggtgaatataaatgat

SEQ ID NO: 6022577 - DNA, 14 bp, Homo sapiens
caggactgtcccct

SEQ ID NO: 6022578 - DNA, 17 bp, Homo sapiens
caggactgtgaccaaag

SEQ ID NO: 6022579 - DNA, 19 bp, Homo sapiens
caggactgtgaccaaagca

SEQ ID NO: 6022580 - DNA, 13 bp, Homo sapiens
caggactgttgtg

SEQ ID NO: 6022581 - DNA, 17 bp, Homo sapiens
caggactgtttcaaaca

SEQ ID NO: 6022582 - DNA, 19 bp, Homo sapiens
caggacttaagacaaatgg

SEQ ID NO: 6022583 - DNA, 15 bp, Homo sapiens
caggacttccatctg

SEQ ID NO: 6022584 - DNA, 19 bp, Homo sapiens
caggacttctgcctgaacc

SEQ ID NO: 6022585 - DNA, 13 bp, Homo sapiens
caggacttgaatt

SEQ ID NO: 6022586 - DNA, 15 bp, Homo sapiens
caggacttgtgcgcc

SEQ ID NO: 6022587 - DNA, 19 bp, Homo sapiens
caggagaaagccgggggag

SEQ ID NO: 6022588 - DNA, 23 bp, Homo sapiens
caggagaaatgcatccattcctc

SEQ ID NO: 6022589 - DNA, 11 bp, Homo sapiens
caggagaacca

SEQ ID NO: 6022590 - DNA, 20 bp, Homo sapiens
caggagaactcatgttattt

SEQ ID NO: 6022591 - DNA, 20 bp, Homo sapiens
caggagaagaaagaggtgac

SEQ ID NO: 6022592 - DNA, 16 bp, Homo sapiens
caggagaagacccctg

SEQ ID NO: 6022593 - DNA, 21 bp, Homo sapiens
caggagaagacccctgcccaa

SEQ ID NO: 6022594 - DNA, 14 bp, Homo sapiens
caggagaagctcag

SEQ ID NO: 6022595 - DNA, 16 bp, Homo sapiens
caggagaagctcagct

SEQ ID NO: 6022596 - DNA, 20 bp, Homo sapiens
caggagaagctcagctgcat

SEQ ID NO: 6022597 - DNA, 21 bp, Homo sapiens
caggagaaggccaattcctat

SEQ ID NO: 6022598 - DNA, 15 bp, Homo sapiens
caggagaaggggccc

SEQ ID NO: 6022599 - DNA, 23 bp, Homo sapiens
caggagaaggtcagcgagaagga

SEQ ID NO: 6022600 - DNA, 20 bp, Homo sapiens
caggagaagtgctccctgga

SEQ ID NO: 6022601 - DNA, 22 bp, Homo sapiens
caggagaatcactgcagcccag

SEQ ID NO: 6022602 - DNA, 20 bp, Homo sapiens
caggagaatggggttcctgc

SEQ ID NO: 6022603 - DNA, 22 bp, Homo sapiens
caggagaattaggaaggccatg

SEQ ID NO: 6022604 - DNA, 19 bp, Homo sapiens
caggagaatttctactgag

SEQ ID NO: 6022605 - DNA, 22 bp, Homo sapiens
caggagacaaacagcccttcct

SEQ ID NO: 6022606 - DNA, 12 bp, Homo sapiens
caggagacaaga

SEQ ID NO: 6022607 - DNA, 20 bp, Homo sapiens
caggagacactggtctcaga

SEQ ID NO: 6022608 - DNA, 23 bp, Homo sapiens
caggagacactggtctcagagga

SEQ ID NO: 6022609 - DNA, 12 bp, Homo sapiens
caggagacatcc

SEQ ID NO: 6022610 - DNA, 18 bp, Homo sapiens
caggagacattttcatat

SEQ ID NO: 6022611 - DNA, 16 bp, Homo sapiens
caggagaccacccccg

SEQ ID NO: 6022612 - DNA, 15 bp, Homo sapiens
caggagacccacctg

SEQ ID NO: 6022613 - DNA, 23 bp, Homo sapiens
caggagacccctttgcaggactt

SEQ ID NO: 6022614 - DNA, 12 bp, Homo sapiens
caggagacctgc

SEQ ID NO: 6022615 - DNA, 18 bp, Homo sapiens
caggagactccaaggagc

SEQ ID NO: 6022616 - DNA, 18 bp, Homo sapiens
caggagactggcaagagc

SEQ ID NO: 6022617 - DNA, 22 bp, Homo sapiens
caggagactgggctctggctct

SEQ ID NO: 6022618 - DNA, 21 bp, Homo sapiens
caggagactttacaaaccttt

SEQ ID NO: 6022619 - DNA, 20 bp, Homo sapiens
caggagagaaaactgcctga

SEQ ID NO: 6022620 - DNA, 13 bp, Homo sapiens
caggagagaagct

SEQ ID NO: 6022621 - DNA, 14 bp, Homo sapiens
caggagagacccct

SEQ ID NO: 6022622 - DNA, 20 bp, Homo sapiens
caggagagacccctcccctc

SEQ ID NO: 6022623 - DNA, 23 bp, Homo sapiens
caggagagacgcagccctggggg

SEQ ID NO: 6022624 - DNA, 18 bp, Homo sapiens
caggagagactgagcagc

SEQ ID NO: 6022625 - DNA, 19 bp, Homo sapiens
caggagagactgagcagcc

SEQ ID NO: 6022626 - DNA, 21 bp, Homo sapiens
caggagagactgagcagccgc

SEQ ID NO: 6022627 - DNA, 11 bp, Homo sapiens
caggagagaga

SEQ ID NO: 6022628 - DNA, 19 bp, Homo sapiens
caggagagagaaagccagg

SEQ ID NO: 6022629 - DNA, 12 bp, Homo sapiens
caggagagagag

SEQ ID NO: 6022630 - DNA, 13 bp, Homo sapiens
caggagagagaga

SEQ ID NO: 6022631 - DNA, 14 bp, Homo sapiens
caggagagagagag

SEQ ID NO: 6022632 - DNA, 15 bp, Homo sapiens
caggagagagccagg

SEQ ID NO: 6022633 - DNA, 16 bp, Homo sapiens
caggagagagccttgg

SEQ ID NO: 6022634 - DNA, 18 bp, Homo sapiens
caggagagagccttggcc

SEQ ID NO: 6022635 - DNA, 23 bp, Homo sapiens
caggagagagcttcctgtttcta

SEQ ID NO: 6022636 - DNA, 15 bp, Homo sapiens
caggagagcacccac

SEQ ID NO: 6022637 - DNA, 18 bp, Homo sapiens
caggagagcacccacagc

SEQ ID NO: 6022638 - DNA, 22 bp, Homo sapiens
caggagagcacccacagccgca

SEQ ID NO: 6022639 - DNA, 19 bp, Homo sapiens
caggagagcatcaccacca

SEQ ID NO: 6022640 - DNA, 23 bp, Homo sapiens
caggagagccagccctccctgtc

SEQ ID NO: 6022641 - DNA, 19 bp, Homo sapiens
caggagagccctctgctgc

SEQ ID NO: 6022642 - DNA, 14 bp, Homo sapiens
caggagagcttccc

SEQ ID NO: 6022643 - DNA, 17 bp, Homo sapiens
caggagaggaagatttg

SEQ ID NO: 6022644 - DNA, 16 bp, Homo sapiens
caggagaggagagcca

SEQ ID NO: 6022645 - DNA, 17 bp, Homo sapiens
caggagaggagagccag

SEQ ID NO: 6022646 - DNA, 12 bp, Homo sapiens
caggagaggagc

SEQ ID NO: 6022647 - DNA, 18 bp, Homo sapiens
caggagaggatggcccag

SEQ ID NO: 6022648 - DNA, 14 bp, Homo sapiens
caggagaggcagca

SEQ ID NO: 6022649 - DNA, 16 bp, Homo sapiens
caggagaggctgggct

SEQ ID NO: 6022650 - DNA, 12 bp, Homo sapiens
caggagagggcc

SEQ ID NO: 6022651 - DNA, 15 bp, Homo sapiens
caggagagtgtgcaa

SEQ ID NO: 6022652 - DNA, 24 bp, Homo sapiens
caggagagtgtgcaactggccagc

SEQ ID NO: 6022653 - DNA, 19 bp, Homo sapiens
caggagagtgtgtgggcag

SEQ ID NO: 6022654 - DNA, 22 bp, Homo sapiens
caggagagtgtgtgggcagggt

SEQ ID NO: 6022655 - DNA, 17 bp, Homo sapiens
caggagatcgagaccat

SEQ ID NO: 6022656 - DNA, 16 bp, Homo sapiens
caggagatgaggctgg

SEQ ID NO: 6022657 - DNA, 20 bp, Homo sapiens
caggagatggaagttgcagt

SEQ ID NO: 6022658 - DNA, 18 bp, Homo sapiens
caggagatggagggcttg

SEQ ID NO: 6022659 - DNA, 20 bp, Homo sapiens
caggagatggagggcttggc

SEQ ID NO: 6022660 - DNA, 15 bp, Homo sapiens
caggagattggattt

SEQ ID NO: 6022661 - DNA, 14 bp, Homo sapiens
caggagcaaatgct

SEQ ID NO: 6022662 - DNA, 17 bp, Homo sapiens
caggagcaaatggcgtt

SEQ ID NO: 6022663 - DNA, 22 bp, Homo sapiens
caggagcaaatgtttctgcagt

SEQ ID NO: 6022664 - DNA, 15 bp, Homo sapiens
caggagcaacgccag

SEQ ID NO: 6022665 - DNA, 19 bp, Homo sapiens
caggagcaaggctgccctg

SEQ ID NO: 6022666 - DNA, 17 bp, Homo sapiens
caggagcaagtgaggcc

SEQ ID NO: 6022667 - DNA, 16 bp, Homo sapiens
caggagcaatcacagg

SEQ ID NO: 6022668 - DNA, 19 bp, Homo sapiens
caggagcaatgggactgga

SEQ ID NO: 6022669 - DNA, 20 bp, Homo sapiens
caggagcaatgggactggag

SEQ ID NO: 6022670 - DNA, 22 bp, Homo sapiens
caggagcaatgggactggagtc

SEQ ID NO: 6022671 - DNA, 13 bp, Homo sapiens
caggagcacagcc

SEQ ID NO: 6022672 - DNA, 18 bp, Homo sapiens
caggagcacaggcagctg

SEQ ID NO: 6022673 - DNA, 21 bp, Homo sapiens
caggagcaccctgtcttctta

SEQ ID NO: 6022674 - DNA, 14 bp, Homo sapiens
caggagcagaagag

SEQ ID NO: 6022675 - DNA, 14 bp, Homo sapiens
caggagcagacaga

SEQ ID NO: 6022676 - DNA, 21 bp, Homo sapiens
caggagcagacagagaaatgt

SEQ ID NO: 6022677 - DNA, 17 bp, Homo sapiens
caggagcagcagccagc

SEQ ID NO: 6022678 - DNA, 18 bp, Homo sapiens
caggagcagcagccagca

SEQ ID NO: 6022679 - DNA, 12 bp, Homo sapiens
caggagcagcca

SEQ ID NO: 6022680 - DNA, 17 bp, Homo sapiens
caggagcagcccaccca

SEQ ID NO: 6022681 - DNA, 14 bp, Homo sapiens
caggagcagccctg

SEQ ID NO: 6022682 - DNA, 15 bp, Homo sapiens
caggagcagcctcag

SEQ ID NO: 6022683 - DNA, 12 bp, Homo sapiens
caggagcagctg

SEQ ID NO: 6022684 - DNA, 15 bp, Homo sapiens
caggagcagctggca

SEQ ID NO: 6022685 - DNA, 15 bp, Homo sapiens
caggagcagctgtgc

SEQ ID NO: 6022686 - DNA, 15 bp, Homo sapiens
caggagcaggaccta

SEQ ID NO: 6022687 - DNA, 14 bp, Homo sapiens
caggagcagggcgg

SEQ ID NO: 6022688 - DNA, 22 bp, Homo sapiens
caggagcagggcggctgccgac

SEQ ID NO: 6022689 - DNA, 15 bp, Homo sapiens
caggagcagtttgcc

SEQ ID NO: 6022690 - DNA, 18 bp, Homo sapiens
caggagcagtttgccacc

SEQ ID NO: 6022691 - DNA, 19 bp, Homo sapiens
caggagcatcctctgctgg

SEQ ID NO: 6022692 - DNA, 22 bp, Homo sapiens
caggagcatgtatgtctgcagg

SEQ ID NO: 6022693 - DNA, 16 bp, Homo sapiens
caggagcatgtcctat

SEQ ID NO: 6022694 - DNA, 22 bp, Homo sapiens
caggagccaaatgaccgagccc

SEQ ID NO: 6022695 - DNA, 16 bp, Homo sapiens
caggagccagcctgct

SEQ ID NO: 6022696 - DNA, 18 bp, Homo sapiens
caggagccagcctgcttc

SEQ ID NO: 6022697 - DNA, 21 bp, Homo sapiens
caggagccagcctgcttccca

SEQ ID NO: 6022698 - DNA, 22 bp, Homo sapiens
caggagccagcctgcttcccac

SEQ ID NO: 6022699 - DNA, 18 bp, Homo sapiens
caggagccaggtgtcctg

SEQ ID NO: 6022700 - DNA, 12 bp, Homo sapiens
caggagcccaga

SEQ ID NO: 6022701 - DNA, 14 bp, Homo sapiens
caggagcccagagg

SEQ ID NO: 6022702 - DNA, 17 bp, Homo sapiens
caggagccccagccagc

SEQ ID NO: 6022703 - DNA, 18 bp, Homo sapiens
caggagcccccaacacag

SEQ ID NO: 6022704 - DNA, 19 bp, Homo sapiens
catgatttcatgtactgca

SEQ ID NO: 6022705 - DNA, 23 bp, Homo sapiens
catgatttcccactgcactccag

SEQ ID NO: 6022706 - DNA, 21 bp, Homo sapiens
catgatttccctccagagaaa

SEQ ID NO: 6022707 - DNA, 22 bp, Homo sapiens
catgatttccctccagagaaag

SEQ ID NO: 6022708 - DNA, 12 bp, Homo sapiens
catgatttcctt

SEQ ID NO: 6022709 - DNA, 16 bp, Homo sapiens
catgatttccttgaat

SEQ ID NO: 6022710 - DNA, 17 bp, Homo sapiens
catgatttccttgaatg

SEQ ID NO: 6022711 - DNA, 14 bp, Homo sapiens
catgatttctgtga

SEQ ID NO: 6022712 - DNA, 17 bp, Homo sapiens
catgatttgtcccagcc

SEQ ID NO: 6022713 - DNA, 18 bp, Homo sapiens
catgattttaagaggctt

SEQ ID NO: 6022714 - DNA, 21 bp, Homo sapiens
catgattttaagtttctctgc

SEQ ID NO: 6022715 - DNA, 22 bp, Homo sapiens
catgattttaagtttctctgca

SEQ ID NO: 6022716 - DNA, 16 bp, Homo sapiens
catgattttacaagta

SEQ ID NO: 6022717 - DNA, 20 bp, Homo sapiens
catgattttacaagtataac

SEQ ID NO: 6022718 - DNA, 11 bp, Homo sapiens
catgattttat

SEQ ID NO: 6022719 - DNA, 15 bp, Homo sapiens
catgattttatacat

SEQ ID NO: 6022720 - DNA, 17 bp, Homo sapiens
catgattttatacatag

SEQ ID NO: 6022721 - DNA, 13 bp, Homo sapiens
catgattttctaa

SEQ ID NO: 6022722 - DNA, 24 bp, Homo sapiens
catgattttgaaatcatgaagata

SEQ ID NO: 6022723 - DNA, 18 bp, Homo sapiens
catgattttggctcactg

SEQ ID NO: 6022724 - DNA, 21 bp, Homo sapiens
catgatttttggtatttatgt

SEQ ID NO: 6022725 - DNA, 23 bp, Homo sapiens
catgatttttggtatttatgtaa

SEQ ID NO: 6022726 - DNA, 17 bp, Homo sapiens
catgcaaaaagaaatga

SEQ ID NO: 6022727 - DNA, 23 bp, Homo sapiens
catgcaaaaatgaattcacccct

SEQ ID NO: 6022728 - DNA, 15 bp, Homo sapiens
catgcaaaagtgggg

SEQ ID NO: 6022729 - DNA, 16 bp, Homo sapiens
catgcaaaatatgttt

SEQ ID NO: 6022730 - DNA, 17 bp, Homo sapiens
catgcaaaatatgttta

SEQ ID NO: 6022731 - DNA, 22 bp, Homo sapiens
catgcaaaatcaggaaaggctg

SEQ ID NO: 6022732 - DNA, 23 bp, Homo sapiens
catgcaaaatcaggaaaggctgt

SEQ ID NO: 6022733 - DNA, 15 bp, Homo sapiens
catgcaaacaagaaa

SEQ ID NO: 6022734 - DNA, 16 bp, Homo sapiens
catgcaaacaagaaac

SEQ ID NO: 6022735 - DNA, 22 bp, Homo sapiens
catgcaaaccaggagcattttg

SEQ ID NO: 6022736 - DNA, 12 bp, Homo sapiens
catgcaaactct

SEQ ID NO: 6022737 - DNA, 21 bp, Homo sapiens
catgcaaatgtcttccaggtc

SEQ ID NO: 6022738 - DNA, 13 bp, Homo sapiens
catgcaaattgtg

SEQ ID NO: 6022739 - DNA, 14 bp, Homo sapiens
catgcaaattgtga

SEQ ID NO: 6022740 - DNA, 16 bp, Homo sapiens
catgcaacaaaaatgt

SEQ ID NO: 6022741 - DNA, 16 bp, Homo sapiens
catgcaacagaagtga

SEQ ID NO: 6022742 - DNA, 17 bp, Homo sapiens
catgcaactccatgcct

SEQ ID NO: 6022743 - DNA, 15 bp, Homo sapiens
catgcaagcagagga

SEQ ID NO: 6022744 - DNA, 19 bp, Homo sapiens
catgcaaggggaaaatctc

SEQ ID NO: 6022745 - DNA, 20 bp, Homo sapiens
catgcaaggggaaaatctca

SEQ ID NO: 6022746 - DNA, 15 bp, Homo sapiens
catgcaaggtcattt

SEQ ID NO: 6022747 - DNA, 17 bp, Homo sapiens
catgcaaggtcattttt

SEQ ID NO: 6022748 - DNA, 22 bp, Homo sapiens
catgcaaggtcattttttttaa

SEQ ID NO: 6022749 - DNA, 15 bp, Homo sapiens
catgcaagtagctgg

SEQ ID NO: 6022750 - DNA, 16 bp, Homo sapiens
catgcaagtagctggc

SEQ ID NO: 6022751 - DNA, 16 bp, Homo sapiens
catgcaagtattctca

SEQ ID NO: 6022752 - DNA, 14 bp, Homo sapiens
catgcaagtgagaa

SEQ ID NO: 6022753 - DNA, 11 bp, Homo sapiens
catgcaagtgg

SEQ ID NO: 6022754 - DNA, 12 bp, Homo sapiens
catgcaagtgga

SEQ ID NO: 6022755 - DNA, 10 bp, Homo sapiens
catgcaataa

SEQ ID NO: 6022756 - DNA, 19 bp, Homo sapiens
catgcaataatgtgcaaat

SEQ ID NO: 6022757 - DNA, 16 bp, Homo sapiens
catgcaatacatacca

SEQ ID NO: 6022758 - DNA, 21 bp, Homo sapiens
catgcaatgaaaaatacttta

SEQ ID NO: 6022759 - DNA, 22 bp, Homo sapiens
catgcaattggggaagaaaaaa

SEQ ID NO: 6022760 - DNA, 14 bp, Homo sapiens
catgcaatttgaag

SEQ ID NO: 6022761 - DNA, 12 bp, Homo sapiens
catgcacaaatt

SEQ ID NO: 6022762 - DNA, 13 bp, Homo sapiens
catgcacacagat

SEQ ID NO: 6022763 - DNA, 14 bp, Homo sapiens
catgcacacctccc

SEQ ID NO: 6022764 - DNA, 12 bp, Homo sapiens
catgcacacggc

SEQ ID NO: 6022765 - DNA, 20 bp, Homo sapiens
catgcacacggctggtcact

SEQ ID NO: 6022766 - DNA, 14 bp, Homo sapiens
catgcacactcatg

SEQ ID NO: 6022767 - DNA, 16 bp, Homo sapiens
catgcacactgagaat

SEQ ID NO: 6022768 - DNA, 14 bp, Homo sapiens
catgcacagaacaa

SEQ ID NO: 6022769 - DNA, 19 bp, Homo sapiens
catgcacagctgcttgtcc

SEQ ID NO: 6022770 - DNA, 22 bp, Homo sapiens
catgcacagtatttgtaattaa

SEQ ID NO: 6022771 - DNA, 24 bp, Homo sapiens
catgcacattcatcctcacatgtg

SEQ ID NO: 6022772 - DNA, 17 bp, Homo sapiens
catgcacatttatatat

SEQ ID NO: 6022773 - DNA, 20 bp, Homo sapiens
catgcaccaacccactgccc

SEQ ID NO: 6022774 - DNA, 18 bp, Homo sapiens
catgcacccctgagccag

SEQ ID NO: 6022775 - DNA, 19 bp, Homo sapiens
catgcacccgcatgtacaa

SEQ ID NO: 6022776 - DNA, 17 bp, Homo sapiens
catgcacctcagggcca

SEQ ID NO: 6022777 - DNA, 23 bp, Homo sapiens
catgcaccttatatttctgtgta

SEQ ID NO: 6022778 - DNA, 13 bp, Homo sapiens
catgcaccttgct

SEQ ID NO: 6022779 - DNA, 17 bp, Homo sapiens
catgcaccttgctccca

SEQ ID NO: 6022780 - DNA, 22 bp, Homo sapiens
catgcacgggcatgcacacggc

SEQ ID NO: 6022781 - DNA, 18 bp, Homo sapiens
catgcactatatttgtat

SEQ ID NO: 6022782 - DNA, 16 bp, Homo sapiens
catgcactcaccccta

SEQ ID NO: 6022783 - DNA, 23 bp, Homo sapiens
catgcactcacccctagccctgg

SEQ ID NO: 6022784 - DNA, 22 bp, Homo sapiens
catgcactgacccttccagaca

SEQ ID NO: 6022785 - DNA, 18 bp, Homo sapiens
catgcactgaggtccaca

SEQ ID NO: 6022786 - DNA, 14 bp, Homo sapiens
catgcactgatgtt

SEQ ID NO: 6022787 - DNA, 15 bp, Homo sapiens
catgcactgtaaata

SEQ ID NO: 6022788 - DNA, 20 bp, Homo sapiens
catgcactgtaaatatccct

SEQ ID NO: 6022789 - DNA, 23 bp, Homo sapiens
catgcactgtaaatatccctccc

SEQ ID NO: 6022790 - DNA, 13 bp, Homo sapiens
catgcactgtgaa

SEQ ID NO: 6022791 - DNA, 20 bp, Homo sapiens
catgcactgtgaaggaccct

SEQ ID NO: 6022792 - DNA, 13 bp, Homo sapiens
catgcactttaat

SEQ ID NO: 6022793 - DNA, 14 bp, Homo sapiens
catgcagaaagcat

SEQ ID NO: 6022794 - DNA, 15 bp, Homo sapiens
catgcagaagtgcat

SEQ ID NO: 6022795 - DNA, 19 bp, Homo sapiens
catgcagacaaagccctgt

SEQ ID NO: 6022796 - DNA, 22 bp, Homo sapiens
catgcagacaaagccctgtcct

SEQ ID NO: 6022797 - DNA, 19 bp, Homo sapiens
catgcagacatgagtgcgt

SEQ ID NO: 6022798 - DNA, 22 bp, Homo sapiens
catgcagacctcatgcccagct

SEQ ID NO: 6022799 - DNA, 13 bp, Homo sapiens
catgcagagcgcc

SEQ ID NO: 6022800 - DNA, 17 bp, Homo sapiens
catgcagatctagccag

SEQ ID NO: 6022801 - DNA, 22 bp, Homo sapiens
catgcagatctagccaggcctc

SEQ ID NO: 6022802 - DNA, 14 bp, Homo sapiens
catgcagcagcttg

SEQ ID NO: 6022803 - DNA, 16 bp, Homo sapiens
catgcagcagcttgct

SEQ ID NO: 6022804 - DNA, 19 bp, Homo sapiens
catgcagcccatgcccacc

SEQ ID NO: 6022805 - DNA, 22 bp, Homo sapiens
catgcagcccctgggcccttgt

SEQ ID NO: 6022806 - DNA, 12 bp, Homo sapiens
catgcagcttgt

SEQ ID NO: 6022807 - DNA, 20 bp, Homo sapiens
catgcagcttgtccttgctc

SEQ ID NO: 6022808 - DNA, 24 bp, Homo sapiens
catgcagcttgtccttgctcctgg

SEQ ID NO: 6022809 - DNA, 22 bp, Homo sapiens
catgcaggaagaggcccactag

SEQ ID NO: 6022810 - DNA, 18 bp, Homo sapiens
catgcaggaaggaaaact

SEQ ID NO: 6022811 - DNA, 14 bp, Homo sapiens
catgcaggaggtgg

SEQ ID NO: 6022812 - DNA, 21 bp, Homo sapiens
catgcagggcccccacaggag

SEQ ID NO: 6022813 - DNA, 19 bp, Homo sapiens
catgcagggggctcctggg

SEQ ID NO: 6022814 - DNA, 13 bp, Homo sapiens
catgcaggtctcc

SEQ ID NO: 6022815 - DNA, 18 bp, Homo sapiens
catgcaggtctccatgaa

SEQ ID NO: 6022816 - DNA, 21 bp, Homo sapiens
catgcaggtctccatgaagaa

SEQ ID NO: 6022817 - DNA, 22 bp, Homo sapiens
catgcaggtggtgtcgggccct

SEQ ID NO: 6022818 - DNA, 15 bp, Homo sapiens
catgcagtacttttg

SEQ ID NO: 6022819 - DNA, 14 bp, Homo sapiens
catgcagtgctctt

SEQ ID NO: 6022820 - DNA, 19 bp, Homo sapiens
catgcagttatatattttg

SEQ ID NO: 6022821 - DNA, 17 bp, Homo sapiens
catgcagttcctggccc

SEQ ID NO: 6022822 - DNA, 14 bp, Homo sapiens
catgcagtttgaaa

SEQ ID NO: 6022823 - DNA, 20 bp, Homo sapiens
catgcagtttgaaattctga

SEQ ID NO: 6022824 - DNA, 21 bp, Homo sapiens
catgcagtttgaaattctgaa

SEQ ID NO: 6022825 - DNA, 13 bp, Homo sapiens
catgcataaaagg

SEQ ID NO: 6022826 - DNA, 18 bp, Homo sapiens
catgcataaactaaaaac

SEQ ID NO: 6022827 - DNA, 16 bp, Homo sapiens
catgcataaatatgca

SEQ ID NO: 6022828 - DNA, 18 bp, Homo sapiens
catgcataaatatgcagt

SEQ ID NO: 6022829 - DNA, 22 bp, Homo sapiens
catgcataaatatgcagtgata

SEQ ID NO: 6022830 - DNA, 15 bp, Homo sapiens
catgcataacacact

SEQ ID NO: 6022831 - DNA, 20 bp, Homo sapiens
catgcataagaaatgtagct

SEQ ID NO: 6022832 - DNA, 13 bp, Homo sapiens
catgcatacacac

SEQ ID NO: 6022833 - DNA, 16 bp, Homo sapiens
catgcatacttcaaaa

SEQ ID NO: 6022834 - DNA, 15 bp, Homo sapiens
catgcatactttatt

SEQ ID NO: 6022835 - DNA, 18 bp, Homo sapiens
catgcatagtcccagcta

SEQ ID NO: 6022836 - DNA, 14 bp, Homo sapiens
catgcatataatga

SEQ ID NO: 6022837 - DNA, 18 bp, Homo sapiens
catgcatataatgaataa

SEQ ID NO: 6022838 - DNA, 22 bp, Homo sapiens
catgcatataatgaataaatca

SEQ ID NO: 6022839 - DNA, 16 bp, Homo sapiens
catgcatctccacctg

SEQ ID NO: 6022840 - DNA, 14 bp, Homo sapiens
catgcatcttactg

SEQ ID NO: 6022841 - DNA, 15 bp, Homo sapiens
catgcatcttccact

SEQ ID NO: 6022842 - DNA, 19 bp, Homo sapiens
catgcatgacagcctctat

SEQ ID NO: 6022843 - DNA, 14 bp, Homo sapiens
catgcatgatgggt

SEQ ID NO: 6022844 - DNA, 15 bp, Homo sapiens
catgcatgccctctc

SEQ ID NO: 6022845 - DNA, 19 bp, Homo sapiens
catgcatgccctctctgag

SEQ ID NO: 6022846 - DNA, 16 bp, Homo sapiens
catgcatggaggactc

SEQ ID NO: 6022847 - DNA, 20 bp, Homo sapiens
catgcatggaggactctcct

SEQ ID NO: 6022848 - DNA, 13 bp, Homo sapiens
catgcatggcctc

SEQ ID NO: 6022849 - DNA, 14 bp, Homo sapiens
catgcatggcctcc

SEQ ID NO: 6022850 - DNA, 18 bp, Homo sapiens
catgcatggcctcccagc

SEQ ID NO: 6022851 - DNA, 22 bp, Homo sapiens
catgcatggcctcccagccacc

SEQ ID NO: 6022852 - DNA, 16 bp, Homo sapiens
catgcatgtcctgtaa

SEQ ID NO: 6022853 - DNA, 18 bp, Homo sapiens
catgcatgtcctgtaaag

SEQ ID NO: 6022854 - DNA, 14 bp, Homo sapiens
catgcatgtctgcc

SEQ ID NO: 6022855 - DNA, 14 bp, Homo sapiens
catgcatgtgcttg

SEQ ID NO: 6022856 - DNA, 15 bp, Homo sapiens
catgcattactgcat

SEQ ID NO: 6022857 - DNA, 20 bp, Homo sapiens
catgcattactgcatgcact

SEQ ID NO: 6022858 - DNA, 16 bp, Homo sapiens
catgcattcctaagaa

SEQ ID NO: 6022859 - DNA, 22 bp, Homo sapiens
catgcattgagctgcctccagc

SEQ ID NO: 6022860 - DNA, 23 bp, Homo sapiens
catgcattgagctgcctccagcc

SEQ ID NO: 6022861 - DNA, 18 bp, Homo sapiens
catgcattgttggctatt

SEQ ID NO: 6022862 - DNA, 19 bp, Homo sapiens
catgcattgttggctattt

SEQ ID NO: 6022863 - DNA, 21 bp, Homo sapiens
catgcattgttggctatttga

SEQ ID NO: 6022864 - DNA, 23 bp, Homo sapiens
catgcatttagcatgagttctgc

SEQ ID NO: 6022865 - DNA, 20 bp, Homo sapiens
catgcattttgcagcagtga

SEQ ID NO: 6022866 - DNA, 15 bp, Homo sapiens
catgcatttttaaaa

SEQ ID NO: 6022867 - DNA, 20 bp, Homo sapiens
catgccaacaagaatgcatt

SEQ ID NO: 6022868 - DNA, 22 bp, Homo sapiens
catgccaaccccgccctaggcc

SEQ ID NO: 6022869 - DNA, 16 bp, Homo sapiens
catgccaaccctgggc

SEQ ID NO: 6022870 - DNA, 20 bp, Homo sapiens
catgccaaccctgggctatt

SEQ ID NO: 6022871 - DNA, 17 bp, Homo sapiens
catgccaactcgggagc

SEQ ID NO: 6022872 - DNA, 22 bp, Homo sapiens
catgccaaggcctccctcaggc

SEQ ID NO: 6022873 - DNA, 12 bp, Homo sapiens
catgccaataaa

SEQ ID NO: 6022874 - DNA, 22 bp, Homo sapiens
catgccacaccggtaccctcct

SEQ ID NO: 6022875 - DNA, 23 bp, Homo sapiens
catgccacaccggtaccctcctc

SEQ ID NO: 6022876 - DNA, 17 bp, Homo sapiens
catgccaccacccaccc

SEQ ID NO: 6022877 - DNA, 15 bp, Homo sapiens
catgccaccctcaca

SEQ ID NO: 6022878 - DNA, 13 bp, Homo sapiens
catgccaccctct

SEQ ID NO: 6022879 - DNA, 14 bp, Homo sapiens
catgccacctggca

SEQ ID NO: 6022880 - DNA, 15 bp, Homo sapiens
catgccacctggcaa

SEQ ID NO: 6022881 - DNA, 16 bp, Homo sapiens
catgccacctggcaaa

SEQ ID NO: 6022882 - DNA, 14 bp, Homo sapiens
caggagccccgcca

SEQ ID NO: 6022883 - DNA, 18 bp, Homo sapiens
caggagccctactgaagg

SEQ ID NO: 6022884 - DNA, 15 bp, Homo sapiens
caggagccctgctat

SEQ ID NO: 6022885 - DNA, 18 bp, Homo sapiens
caggagccgggcctccca

SEQ ID NO: 6022886 - DNA, 19 bp, Homo sapiens
caggagccgggcctcccac

SEQ ID NO: 6022887 - DNA, 16 bp, Homo sapiens
caggagcctaccccct

SEQ ID NO: 6022888 - DNA, 14 bp, Homo sapiens
caggagcctagagg

SEQ ID NO: 6022889 - DNA, 17 bp, Homo sapiens
caggagcctagaggagg

SEQ ID NO: 6022890 - DNA, 13 bp, Homo sapiens
caggagcctagcg

SEQ ID NO: 6022891 - DNA, 19 bp, Homo sapiens
caggagcctagcggagccc

SEQ ID NO: 6022892 - DNA, 23 bp, Homo sapiens
caggagcctagcggagcccagcc

SEQ ID NO: 6022893 - DNA, 16 bp, Homo sapiens
caggagcctcactggg

SEQ ID NO: 6022894 - DNA, 17 bp, Homo sapiens
caggagcctcatccagc

SEQ ID NO: 6022895 - DNA, 12 bp, Homo sapiens
caggagcctccc

SEQ ID NO: 6022896 - DNA, 15 bp, Homo sapiens
caggagcctccctgc

SEQ ID NO: 6022897 - DNA, 19 bp, Homo sapiens
caggagcctcgtgtcctgc

SEQ ID NO: 6022898 - DNA, 16 bp, Homo sapiens
caggagcctgcccagc

SEQ ID NO: 6022899 - DNA, 12 bp, Homo sapiens
caggagcctggc

SEQ ID NO: 6022900 - DNA, 17 bp, Homo sapiens
caggagcctggccaggc

SEQ ID NO: 6022901 - DNA, 19 bp, Homo sapiens
caggagcctggccaggcag

SEQ ID NO: 6022902 - DNA, 21 bp, Homo sapiens
caggagcctggccaggcaggg

SEQ ID NO: 6022903 - DNA, 15 bp, Homo sapiens
caggagcctggtcct

SEQ ID NO: 6022904 - DNA, 19 bp, Homo sapiens
caggagccttcctttctcc

SEQ ID NO: 6022905 - DNA, 21 bp, Homo sapiens
caggagcgatcgctcccctgg

SEQ ID NO: 6022906 - DNA, 22 bp, Homo sapiens
caggagcgctcccttgacctgc

SEQ ID NO: 6022907 - DNA, 14 bp, Homo sapiens
caggagcgtgtcct

SEQ ID NO: 6022908 - DNA, 22 bp, Homo sapiens
caggagctacctgtgtggacag

SEQ ID NO: 6022909 - DNA, 21 bp, Homo sapiens
caggagctagttctcagcttg

SEQ ID NO: 6022910 - DNA, 23 bp, Homo sapiens
caggagctagttctcagcttgca

SEQ ID NO: 6022911 - DNA, 13 bp, Homo sapiens
caggagctcaggt

SEQ ID NO: 6022912 - DNA, 23 bp, Homo sapiens
caggagctccagtgtcctgagct

SEQ ID NO: 6022913 - DNA, 19 bp, Homo sapiens
caggagctccatacacacg

SEQ ID NO: 6022914 - DNA, 22 bp, Homo sapiens
caggagctcccctccccaactg

SEQ ID NO: 6022915 - DNA, 12 bp, Homo sapiens
caggagctcctg

SEQ ID NO: 6022916 - DNA, 14 bp, Homo sapiens
caggagctcctgga

SEQ ID NO: 6022917 - DNA, 17 bp, Homo sapiens
caggagctcctggaagc

SEQ ID NO: 6022918 - DNA, 16 bp, Homo sapiens
caggagctctctgctg

SEQ ID NO: 6022919 - DNA, 17 bp, Homo sapiens
caggagctctctgctga

SEQ ID NO: 6022920 - DNA, 12 bp, Homo sapiens
caggagctctgc

SEQ ID NO: 6022921 - DNA, 16 bp, Homo sapiens
caggagctctgcgcca

SEQ ID NO: 6022922 - DNA, 21 bp, Homo sapiens
caggagctctgcgccaggcag

SEQ ID NO: 6022923 - DNA, 22 bp, Homo sapiens
caggagctctgcgccaggcaga

SEQ ID NO: 6022924 - DNA, 12 bp, Homo sapiens
caggagctcttc

SEQ ID NO: 6022925 - DNA, 18 bp, Homo sapiens
caggagctcttcaggcct

SEQ ID NO: 6022926 - DNA, 20 bp, Homo sapiens
caggagctcttcaggcctcc

SEQ ID NO: 6022927 - DNA, 15 bp, Homo sapiens
caggagctgacagag

SEQ ID NO: 6022928 - DNA, 14 bp, Homo sapiens
caggagctgagtca

SEQ ID NO: 6022929 - DNA, 18 bp, Homo sapiens
caggagctgagtcacctc

SEQ ID NO: 6022930 - DNA, 19 bp, Homo sapiens
caggagctgagtcacctcc

SEQ ID NO: 6022931 - DNA, 23 bp, Homo sapiens
caggagctgggcagaaggccaag

SEQ ID NO: 6022932 - DNA, 19 bp, Homo sapiens
caggagctgtcaccaagga

SEQ ID NO: 6022933 - DNA, 17 bp, Homo sapiens
caggagcttgcaagaag

SEQ ID NO: 6022934 - DNA, 19 bp, Homo sapiens
caggagcttgcaagaagca

SEQ ID NO: 6022935 - DNA, 17 bp, Homo sapiens
caggagcttgggcagtg

SEQ ID NO: 6022936 - DNA, 13 bp, Homo sapiens
caggagcttgggt

SEQ ID NO: 6022937 - DNA, 17 bp, Homo sapiens
caggagcttgggtctct

SEQ ID NO: 6022938 - DNA, 20 bp, Homo sapiens
caggagcttgggtctctctc

SEQ ID NO: 6022939 - DNA, 17 bp, Homo sapiens
caggaggaaaaggcttg

SEQ ID NO: 6022940 - DNA, 13 bp, Homo sapiens
caggaggaagggg

SEQ ID NO: 6022941 - DNA, 15 bp, Homo sapiens
caggaggaatactga

SEQ ID NO: 6022942 - DNA, 13 bp, Homo sapiens
caggaggacaatt

SEQ ID NO: 6022943 - DNA, 22 bp, Homo sapiens
caggaggacaattcatgaactt

SEQ ID NO: 6022944 - DNA, 20 bp, Homo sapiens
caggaggacagagtgccctg

SEQ ID NO: 6022945 - DNA, 21 bp, Homo sapiens
caggaggacagagtgccctgg

SEQ ID NO: 6022946 - DNA, 15 bp, Homo sapiens
caggaggacccaggg

SEQ ID NO: 6022947 - DNA, 19 bp, Homo sapiens
caggaggactgccccgtgc

SEQ ID NO: 6022948 - DNA, 21 bp, Homo sapiens
caggaggactgccccgtgcag

SEQ ID NO: 6022949 - DNA, 16 bp, Homo sapiens
caggaggagaaaagaa

SEQ ID NO: 6022950 - DNA, 13 bp, Homo sapiens
caggaggagacag

SEQ ID NO: 6022951 - DNA, 17 bp, Homo sapiens
caggaggagacagtcag

SEQ ID NO: 6022952 - DNA, 22 bp, Homo sapiens
caggaggagacagtcaggaagc

SEQ ID NO: 6022953 - DNA, 23 bp, Homo sapiens
caggaggagactagatttatgaa

SEQ ID NO: 6022954 - DNA, 20 bp, Homo sapiens
caggaggagattaacacact

SEQ ID NO: 6022955 - DNA, 22 bp, Homo sapiens
caggaggagggcgcatgtgtgt

SEQ ID NO: 6022956 - DNA, 23 bp, Homo sapiens
caggaggagggcgcatgtgtgta

SEQ ID NO: 6022957 - DNA, 19 bp, Homo sapiens
caggaggaggtgccaacag

SEQ ID NO: 6022958 - DNA, 20 bp, Homo sapiens
caggaggagtgggacagaca

SEQ ID NO: 6022959 - DNA, 17 bp, Homo sapiens
caggaggagttagccaa

SEQ ID NO: 6022960 - DNA, 21 bp, Homo sapiens
caggaggagttagccaaacaa

SEQ ID NO: 6022961 - DNA, 19 bp, Homo sapiens
caggaggatcccctgaggt

SEQ ID NO: 6022962 - DNA, 17 bp, Homo sapiens
caggaggattccttgtg

SEQ ID NO: 6022963 - DNA, 21 bp, Homo sapiens
caggaggcaagcgtgttctca

SEQ ID NO: 6022964 - DNA, 12 bp, Homo sapiens
caggaggcacag

SEQ ID NO: 6022965 - DNA, 15 bp, Homo sapiens
caggaggcaggacct

SEQ ID NO: 6022966 - DNA, 18 bp, Homo sapiens
caggaggcaggaccttcg

SEQ ID NO: 6022967 - DNA, 12 bp, Homo sapiens
caggaggcaggc

SEQ ID NO: 6022968 - DNA, 20 bp, Homo sapiens
caggaggcagggaggcagcc

SEQ ID NO: 6022969 - DNA, 16 bp, Homo sapiens
caggaggcagggctct

SEQ ID NO: 6022970 - DNA, 19 bp, Homo sapiens
caggaggcagtggcttgga

SEQ ID NO: 6022971 - DNA, 15 bp, Homo sapiens
caggaggccaaactg

SEQ ID NO: 6022972 - DNA, 16 bp, Homo sapiens
caggaggccagccttg

SEQ ID NO: 6022973 - DNA, 18 bp, Homo sapiens
caggaggccaggccggcg

SEQ ID NO: 6022974 - DNA, 16 bp, Homo sapiens
caggaggccagtgggc

SEQ ID NO: 6022975 - DNA, 16 bp, Homo sapiens
caggaggccattccag

SEQ ID NO: 6022976 - DNA, 19 bp, Homo sapiens
caggaggccccaggctgag

SEQ ID NO: 6022977 - DNA, 14 bp, Homo sapiens
caggaggcccctgg

SEQ ID NO: 6022978 - DNA, 21 bp, Homo sapiens
caggaggccctggtcctggcc

SEQ ID NO: 6022979 - DNA, 22 bp, Homo sapiens
caggaggccctggtcctggcct

SEQ ID NO: 6022980 - DNA, 14 bp, Homo sapiens
caggaggcctagga

SEQ ID NO: 6022981 - DNA, 14 bp, Homo sapiens
caggaggcctggcc

SEQ ID NO: 6022982 - DNA, 23 bp, Homo sapiens
caggaggcctgggagatgcagct

SEQ ID NO: 6022983 - DNA, 16 bp, Homo sapiens
caggaggcctgggagg

SEQ ID NO: 6022984 - DNA, 19 bp, Homo sapiens
caggaggcctgggagggca

SEQ ID NO: 6022985 - DNA, 16 bp, Homo sapiens
caggaggcgaataaat

SEQ ID NO: 6022986 - DNA, 18 bp, Homo sapiens
caggaggcgaataaatgt

SEQ ID NO: 6022987 - DNA, 20 bp, Homo sapiens
caggaggcgaataaatgttc

SEQ ID NO: 6022988 - DNA, 16 bp, Homo sapiens
caggaggcgcagcccg

SEQ ID NO: 6022989 - DNA, 18 bp, Homo sapiens
caggaggcgcagcccgaa

SEQ ID NO: 6022990 - DNA, 13 bp, Homo sapiens
caggaggcgccct

SEQ ID NO: 6022991 - DNA, 22 bp, Homo sapiens
caggaggcggcagctcttctgg

SEQ ID NO: 6022992 - DNA, 15 bp, Homo sapiens
caggaggcggcccgg

SEQ ID NO: 6022993 - DNA, 20 bp, Homo sapiens
caggaggcggcccggccagc

SEQ ID NO: 6022994 - DNA, 17 bp, Homo sapiens
caggaggctccatcctt

SEQ ID NO: 6022995 - DNA, 21 bp, Homo sapiens
caggaggctccatccttctcc

SEQ ID NO: 6022996 - DNA, 21 bp, Homo sapiens
caggaggctccgtgagccctt

SEQ ID NO: 6022997 - DNA, 18 bp, Homo sapiens
caggaggctgagacagga

SEQ ID NO: 6022998 - DNA, 19 bp, Homo sapiens
caggaggctgagacaggag

SEQ ID NO: 6022999 - DNA, 13 bp, Homo sapiens
caggaggctgagg

SEQ ID NO: 6023000 - DNA, 20 bp, Homo sapiens
caggaggctgaggcaggaga

SEQ ID NO: 6023001 - DNA, 22 bp, Homo sapiens
caggaggctgaggcaggagaat

SEQ ID NO: 6023002 - DNA, 14 bp, Homo sapiens
caggaggctgaggt

SEQ ID NO: 6023003 - DNA, 12 bp, Homo sapiens
caggaggctgcg

SEQ ID NO: 6023004 - DNA, 15 bp, Homo sapiens
caggaggctggcagt

SEQ ID NO: 6023005 - DNA, 20 bp, Homo sapiens
caggaggctggcagtacaga

SEQ ID NO: 6023006 - DNA, 22 bp, Homo sapiens
caggaggctttaagctccagct

SEQ ID NO: 6023007 - DNA, 18 bp, Homo sapiens
caggaggctttctgggct

SEQ ID NO: 6023008 - DNA, 22 bp, Homo sapiens
caggaggctttctgggctctgg

SEQ ID NO: 6023009 - DNA, 18 bp, Homo sapiens
caggaggctttttcagtg

SEQ ID NO: 6023010 - DNA, 13 bp, Homo sapiens
caggagggaagga

SEQ ID NO: 6023011 - DNA, 20 bp, Homo sapiens
caggagggacagtctcacca

SEQ ID NO: 6023012 - DNA, 20 bp, Homo sapiens
caggagggactctgtctggc

SEQ ID NO: 6023013 - DNA, 18 bp, Homo sapiens
caggagggagagcctctg

SEQ ID NO: 6023014 - DNA, 19 bp, Homo sapiens
caggagggagagcctctgt

SEQ ID NO: 6023015 - DNA, 11 bp, Homo sapiens
caggagggagg

SEQ ID NO: 6023016 - DNA, 15 bp, Homo sapiens
caggagggaggcagg

SEQ ID NO: 6023017 - DNA, 13 bp, Homo sapiens
caggagggagggt

SEQ ID NO: 6023018 - DNA, 21 bp, Homo sapiens
caggagggagggtttctctcc

SEQ ID NO: 6023019 - DNA, 22 bp, Homo sapiens
caggagggagggtttctctccc

SEQ ID NO: 6023020 - DNA, 19 bp, Homo sapiens
caggagggaggtttgtgag

SEQ ID NO: 6023021 - DNA, 14 bp, Homo sapiens
caggagggcacagc

SEQ ID NO: 6023022 - DNA, 18 bp, Homo sapiens
caggagggcactggagct

SEQ ID NO: 6023023 - DNA, 17 bp, Homo sapiens
caggagggcaggctgag

SEQ ID NO: 6023024 - DNA, 13 bp, Homo sapiens
caggagggcagtg

SEQ ID NO: 6023025 - DNA, 21 bp, Homo sapiens
caggagggcagtggtggagct

SEQ ID NO: 6023026 - DNA, 16 bp, Homo sapiens
caggagggcatccctg

SEQ ID NO: 6023027 - DNA, 18 bp, Homo sapiens
caggagggccagcgctgt

SEQ ID NO: 6023028 - DNA, 12 bp, Homo sapiens
caggagggccct

SEQ ID NO: 6023029 - DNA, 23 bp, Homo sapiens
caggagggctaattagaaatcaa

SEQ ID NO: 6023030 - DNA, 22 bp, Homo sapiens
caggagggctcggggtgtgtca

SEQ ID NO: 6023031 - DNA, 13 bp, Homo sapiens
caggagggcttga

SEQ ID NO: 6023032 - DNA, 19 bp, Homo sapiens
caggaggggaactgagtca

SEQ ID NO: 6023033 - DNA, 21 bp, Homo sapiens
caggaggggaactgagtcacg

SEQ ID NO: 6023034 - DNA, 15 bp, Homo sapiens
caggaggggaagagg

SEQ ID NO: 6023035 - DNA, 15 bp, Homo sapiens
caggaggggcagcgc

SEQ ID NO: 6023036 - DNA, 16 bp, Homo sapiens
caggaggggcctctga

SEQ ID NO: 6023037 - DNA, 17 bp, Homo sapiens
caggaggggcctgggca

SEQ ID NO: 6023038 - DNA, 18 bp, Homo sapiens
caggagggggtcgtggag

SEQ ID NO: 6023039 - DNA, 16 bp, Homo sapiens
caggaggggtctcatg

SEQ ID NO: 6023040 - DNA, 17 bp, Homo sapiens
caggaggggtctgcctc

SEQ ID NO: 6023041 - DNA, 20 bp, Homo sapiens
caggaggggtctgcctccca

SEQ ID NO: 6023042 - DNA, 24 bp, Homo sapiens
caggaggggtgagtcccctactcc

SEQ ID NO: 6023043 - DNA, 18 bp, Homo sapiens
caggagggtaacagaaga

SEQ ID NO: 6023044 - DNA, 22 bp, Homo sapiens
caggagggtatggtgctgctct

SEQ ID NO: 6023045 - DNA, 23 bp, Homo sapiens
caggagggtccccagctggtcca

SEQ ID NO: 6023046 - DNA, 15 bp, Homo sapiens
caggagggtctatgg

SEQ ID NO: 6023047 - DNA, 19 bp, Homo sapiens
caggagggtgacgcccagc

SEQ ID NO: 6023048 - DNA, 21 bp, Homo sapiens
caggagggtgacgcccagctc

SEQ ID NO: 6023049 - DNA, 15 bp, Homo sapiens
caggagggtgcagta

SEQ ID NO: 6023050 - DNA, 16 bp, Homo sapiens
caggagggtggcactt

SEQ ID NO: 6023051 - DNA, 15 bp, Homo sapiens
caggaggtcaagcct

SEQ ID NO: 6023052 - DNA, 16 bp, Homo sapiens
caggaggtcacctgcc

SEQ ID NO: 6023053 - DNA, 16 bp, Homo sapiens
caggaggtcctcctct

SEQ ID NO: 6023054 - DNA, 16 bp, Homo sapiens
caggaggtgcagtgga

SEQ ID NO: 6023055 - DNA, 20 bp, Homo sapiens
caggaggtgcagtggagggg

SEQ ID NO: 6023056 - DNA, 20 bp, Homo sapiens
caggaggtgccactggagtg

SEQ ID NO: 6023057 - DNA, 21 bp, Homo sapiens
caggaggtgccggtaccagcc

SEQ ID NO: 6023058 - DNA, 20 bp, Homo sapiens
caggaggtgcctgagagcag

SEQ ID NO: 6023059 - DNA, 13 bp, Homo sapiens
catgccactgcct

SEQ ID NO: 6023060 - DNA, 18 bp, Homo sapiens
catgccactgcctgcacc

SEQ ID NO: 6023061 - DNA, 19 bp, Homo sapiens
catgccagagcctggggca

SEQ ID NO: 6023062 - DNA, 22 bp, Homo sapiens
catgccagattctgcctctctg

SEQ ID NO: 6023063 - DNA, 23 bp, Homo sapiens
catgccagattctgcctctctgg

SEQ ID NO: 6023064 - DNA, 21 bp, Homo sapiens
catgccagcgcagcgccaggg

SEQ ID NO: 6023065 - DNA, 19 bp, Homo sapiens
catgccaggaacctgtcct

SEQ ID NO: 6023066 - DNA, 13 bp, Homo sapiens
catgccaggaccc

SEQ ID NO: 6023067 - DNA, 18 bp, Homo sapiens
catgccaggctgcgtccc

SEQ ID NO: 6023068 - DNA, 22 bp, Homo sapiens
catgccagggattgaggaggac

SEQ ID NO: 6023069 - DNA, 13 bp, Homo sapiens
catgccaggggcc

SEQ ID NO: 6023070 - DNA, 17 bp, Homo sapiens
catgccagtaacaggct

SEQ ID NO: 6023071 - DNA, 19 bp, Homo sapiens
catgccagtatttttaaag

SEQ ID NO: 6023072 - DNA, 16 bp, Homo sapiens
catgccagtgcatgcc

SEQ ID NO: 6023073 - DNA, 10 bp, Homo sapiens
catgccatct

SEQ ID NO: 6023074 - DNA, 23 bp, Homo sapiens
catgccatctccaccctgagcct

SEQ ID NO: 6023075 - DNA, 15 bp, Homo sapiens
catgccattttattt

SEQ ID NO: 6023076 - DNA, 15 bp, Homo sapiens
catgcccaaatataa

SEQ ID NO: 6023077 - DNA, 19 bp, Homo sapiens
catgcccaccccctgccct

SEQ ID NO: 6023078 - DNA, 21 bp, Homo sapiens
catgcccaccccctgccctgc

SEQ ID NO: 6023079 - DNA, 13 bp, Homo sapiens
catgcccacctgc

SEQ ID NO: 6023080 - DNA, 14 bp, Homo sapiens
catgcccacctgcc

SEQ ID NO: 6023081 - DNA, 21 bp, Homo sapiens
catgcccacctgcccatcaca

SEQ ID NO: 6023082 - DNA, 19 bp, Homo sapiens
catgcccactcccccagga

SEQ ID NO: 6023083 - DNA, 23 bp, Homo sapiens
catgcccactcccccaggagcag

SEQ ID NO: 6023084 - DNA, 13 bp, Homo sapiens
catgcccactgct

SEQ ID NO: 6023085 - DNA, 12 bp, Homo sapiens
catgcccagaga

SEQ ID NO: 6023086 - DNA, 19 bp, Homo sapiens
catgcccagagacccagcg

SEQ ID NO: 6023087 - DNA, 18 bp, Homo sapiens
catgcccagattcccaga

SEQ ID NO: 6023088 - DNA, 19 bp, Homo sapiens
catgcccagctctctgacg

SEQ ID NO: 6023089 - DNA, 12 bp, Homo sapiens
catgcccaggac

SEQ ID NO: 6023090 - DNA, 15 bp, Homo sapiens
catgcccatcccagt

SEQ ID NO: 6023091 - DNA, 12 bp, Homo sapiens
catgccccaccc

SEQ ID NO: 6023092 - DNA, 14 bp, Homo sapiens
catgccccaccccc

SEQ ID NO: 6023093 - DNA, 18 bp, Homo sapiens
catgccccacccccctcc

SEQ ID NO: 6023094 - DNA, 22 bp, Homo sapiens
catgccccacccccctcctccc

SEQ ID NO: 6023095 - DNA, 15 bp, Homo sapiens
catgccccactctgc

SEQ ID NO: 6023096 - DNA, 16 bp, Homo sapiens
catgccccactctgct

SEQ ID NO: 6023097 - DNA, 19 bp, Homo sapiens
catgccccactctgctgag

SEQ ID NO: 6023098 - DNA, 20 bp, Homo sapiens
catgccccactctgctgagg

SEQ ID NO: 6023099 - DNA, 22 bp, Homo sapiens
catgccccactctgctgaggcc

SEQ ID NO: 6023100 - DNA, 16 bp, Homo sapiens
catgccccagctctgg

SEQ ID NO: 6023101 - DNA, 17 bp, Homo sapiens
catgccccagctctgga

SEQ ID NO: 6023102 - DNA, 20 bp, Homo sapiens
catgccccagctctggatga

SEQ ID NO: 6023103 - DNA, 18 bp, Homo sapiens
catgccccatcccatgct

SEQ ID NO: 6023104 - DNA, 13 bp, Homo sapiens
catgcccccctca

SEQ ID NO: 6023105 - DNA, 19 bp, Homo sapiens
catgcccccctcaaacctc

SEQ ID NO: 6023106 - DNA, 21 bp, Homo sapiens
catgcccccctcaaacctcct

SEQ ID NO: 6023107 - DNA, 16 bp, Homo sapiens
catgcccccgccacct

SEQ ID NO: 6023108 - DNA, 19 bp, Homo sapiens
catgcccccgccacctccc

SEQ ID NO: 6023109 - DNA, 21 bp, Homo sapiens
catgcccccgccacctcccca

SEQ ID NO: 6023110 - DNA, 15 bp, Homo sapiens
catgccccctcgtgc

SEQ ID NO: 6023111 - DNA, 16 bp, Homo sapiens
catgccccctgcagac

SEQ ID NO: 6023112 - DNA, 13 bp, Homo sapiens
catgcccccttcg

SEQ ID NO: 6023113 - DNA, 19 bp, Homo sapiens
catgcccccttcgctcctc

SEQ ID NO: 6023114 - DNA, 15 bp, Homo sapiens
catgccccggctgca

SEQ ID NO: 6023115 - DNA, 16 bp, Homo sapiens
catgccccgtttttga

SEQ ID NO: 6023116 - DNA, 17 bp, Homo sapiens
catgcccctcccccagc

SEQ ID NO: 6023117 - DNA, 17 bp, Homo sapiens
catgcccctcccctccc

SEQ ID NO: 6023118 - DNA, 13 bp, Homo sapiens
catgcccctgaac

SEQ ID NO: 6023119 - DNA, 13 bp, Homo sapiens
catgcccctgagt

SEQ ID NO: 6023120 - DNA, 15 bp, Homo sapiens
catgcccctgagtgt

SEQ ID NO: 6023121 - DNA, 16 bp, Homo sapiens
catgcccctggctggg

SEQ ID NO: 6023122 - DNA, 13 bp, Homo sapiens
catgccccttggc

SEQ ID NO: 6023123 - DNA, 15 bp, Homo sapiens
catgccccttggctg

SEQ ID NO: 6023124 - DNA, 16 bp, Homo sapiens
catgccccttggctgg

SEQ ID NO: 6023125 - DNA, 20 bp, Homo sapiens
catgcccggtcccacccctc

SEQ ID NO: 6023126 - DNA, 13 bp, Homo sapiens
catgccctcaggc

SEQ ID NO: 6023127 - DNA, 14 bp, Homo sapiens
catgccctcaggct

SEQ ID NO: 6023128 - DNA, 22 bp, Homo sapiens
catgccctccactccactgcct

SEQ ID NO: 6023129 - DNA, 15 bp, Homo sapiens
catgccctcccagga

SEQ ID NO: 6023130 - DNA, 23 bp, Homo sapiens
catgccctcccttctccctggat

SEQ ID NO: 6023131 - DNA, 11 bp, Homo sapiens
catgccctcct

SEQ ID NO: 6023132 - DNA, 13 bp, Homo sapiens
catgccctcctct

SEQ ID NO: 6023133 - DNA, 14 bp, Homo sapiens
catgccctcctctc

SEQ ID NO: 6023134 - DNA, 20 bp, Homo sapiens
catgccctcctctcccattg

SEQ ID NO: 6023135 - DNA, 13 bp, Homo sapiens
catgccctcctgg

SEQ ID NO: 6023136 - DNA, 16 bp, Homo sapiens
catgccctctcaggcc

SEQ ID NO: 6023137 - DNA, 21 bp, Homo sapiens
catgccctctcaggccggcag

SEQ ID NO: 6023138 - DNA, 16 bp, Homo sapiens
catgccctctctgagt

SEQ ID NO: 6023139 - DNA, 10 bp, Homo sapiens
catgccctgc

SEQ ID NO: 6023140 - DNA, 14 bp, Homo sapiens
catgccctgtgcaa

SEQ ID NO: 6023141 - DNA, 19 bp, Homo sapiens
catgccctgtgcaacctct

SEQ ID NO: 6023142 - DNA, 14 bp, Homo sapiens
catgcccttctgat

SEQ ID NO: 6023143 - DNA, 18 bp, Homo sapiens
catgccgagtgccccaga

SEQ ID NO: 6023144 - DNA, 18 bp, Homo sapiens
catgccgatttcatacct

SEQ ID NO: 6023145 - DNA, 17 bp, Homo sapiens
catgccgccgcagctgg

SEQ ID NO: 6023146 - DNA, 19 bp, Homo sapiens
catgccgcgggcggccagg

SEQ ID NO: 6023147 - DNA, 21 bp, Homo sapiens
catgccgctgcatccgtgagc

SEQ ID NO: 6023148 - DNA, 14 bp, Homo sapiens
catgccgctgtgtc

SEQ ID NO: 6023149 - DNA, 16 bp, Homo sapiens
catgccgtctgccgga

SEQ ID NO: 6023150 - DNA, 20 bp, Homo sapiens
catgcctaaagcccattgct

SEQ ID NO: 6023151 - DNA, 20 bp, Homo sapiens
catgcctacattagtgagat

SEQ ID NO: 6023152 - DNA, 21 bp, Homo sapiens
catgcctatatgagaagaata

SEQ ID NO: 6023153 - DNA, 17 bp, Homo sapiens
catgcctatgggccaga

SEQ ID NO: 6023154 - DNA, 21 bp, Homo sapiens
catgcctatttactggaaacc

SEQ ID NO: 6023155 - DNA, 18 bp, Homo sapiens
catgcctcactaattttt

SEQ ID NO: 6023156 - DNA, 12 bp, Homo sapiens
catgcctcagcc

SEQ ID NO: 6023157 - DNA, 11 bp, Homo sapiens
catgcctcagt

SEQ ID NO: 6023158 - DNA, 16 bp, Homo sapiens
catgcctcagtttccc

SEQ ID NO: 6023159 - DNA, 16 bp, Homo sapiens
catgcctcatgccaca

SEQ ID NO: 6023160 - DNA, 20 bp, Homo sapiens
catgcctcctcctgccctcc

SEQ ID NO: 6023161 - DNA, 21 bp, Homo sapiens
catgcctcgctcagtcagtgc

SEQ ID NO: 6023162 - DNA, 16 bp, Homo sapiens
catgcctctctcaggc

SEQ ID NO: 6023163 - DNA, 17 bp, Homo sapiens
catgcctctctcaggcc

SEQ ID NO: 6023164 - DNA, 19 bp, Homo sapiens
catgcctctctcaggccaa

SEQ ID NO: 6023165 - DNA, 15 bp, Homo sapiens
catgcctctgagctt

SEQ ID NO: 6023166 - DNA, 14 bp, Homo sapiens
catgcctctgaggc

SEQ ID NO: 6023167 - DNA, 16 bp, Homo sapiens
catgcctctgaggcca

SEQ ID NO: 6023168 - DNA, 23 bp, Homo sapiens
catgcctctgaggccagcctggc

SEQ ID NO: 6023169 - DNA, 12 bp, Homo sapiens
catgcctctgat

SEQ ID NO: 6023170 - DNA, 21 bp, Homo sapiens
catgcctctggaggcctctgg

SEQ ID NO: 6023171 - DNA, 20 bp, Homo sapiens
catgcctgagaatgcctagg

SEQ ID NO: 6023172 - DNA, 11 bp, Homo sapiens
catgcctgagg

SEQ ID NO: 6023173 - DNA, 11 bp, Homo sapiens
catgcctgcca

SEQ ID NO: 6023174 - DNA, 12 bp, Homo sapiens
catgcctgcgcc

SEQ ID NO: 6023175 - DNA, 19 bp, Homo sapiens
catgcctgcgcctgctgcc

SEQ ID NO: 6023176 - DNA, 21 bp, Homo sapiens
catgcctgcgcctgctgcctg

SEQ ID NO: 6023177 - DNA, 24 bp, Homo sapiens
catgcctgcgcctgctgcctgctg

SEQ ID NO: 6023178 - DNA, 12 bp, Homo sapiens
catgcctgctcc

SEQ ID NO: 6023179 - DNA, 13 bp, Homo sapiens
catgcctgctctc

SEQ ID NO: 6023180 - DNA, 14 bp, Homo sapiens
catgcctgctgaga

SEQ ID NO: 6023181 - DNA, 16 bp, Homo sapiens
catgcctgctttagaa

SEQ ID NO: 6023182 - DNA, 13 bp, Homo sapiens
catgcctggcccc

SEQ ID NO: 6023183 - DNA, 12 bp, Homo sapiens
catgcctggcct

SEQ ID NO: 6023184 - DNA, 14 bp, Homo sapiens
catgcctggcctga

SEQ ID NO: 6023185 - DNA, 10 bp, Homo sapiens
catgcctggg

SEQ ID NO: 6023186 - DNA, 22 bp, Homo sapiens
catgcctgggaatcctgctgcc

SEQ ID NO: 6023187 - DNA, 15 bp, Homo sapiens
catgcctgggcccag

SEQ ID NO: 6023188 - DNA, 18 bp, Homo sapiens
catgcctggggtggaggc

SEQ ID NO: 6023189 - DNA, 21 bp, Homo sapiens
catgcctgtaatcccagaact

SEQ ID NO: 6023190 - DNA, 19 bp, Homo sapiens
catgcctgtaatcccagct

SEQ ID NO: 6023191 - DNA, 20 bp, Homo sapiens
catgcctgtagctttcctgg

SEQ ID NO: 6023192 - DNA, 22 bp, Homo sapiens
catgcctgtagtctcagctagt

SEQ ID NO: 6023193 - DNA, 18 bp, Homo sapiens
catgcctgtccagcctgg

SEQ ID NO: 6023194 - DNA, 13 bp, Homo sapiens
catgcctgtcctg

SEQ ID NO: 6023195 - DNA, 22 bp, Homo sapiens
catgcctgtcctgaaagcggct

SEQ ID NO: 6023196 - DNA, 23 bp, Homo sapiens
catgcctgtcctgaaagcggctg

SEQ ID NO: 6023197 - DNA, 18 bp, Homo sapiens
catgcctgtgatcctagc

SEQ ID NO: 6023198 - DNA, 16 bp, Homo sapiens
catgcctgtggctgcg

SEQ ID NO: 6023199 - DNA, 19 bp, Homo sapiens
catgccttccagcaccctg

SEQ ID NO: 6023200 - DNA, 20 bp, Homo sapiens
catgccttccagcaccctgc

SEQ ID NO: 6023201 - DNA, 15 bp, Homo sapiens
catgccttgataaat

SEQ ID NO: 6023202 - DNA, 17 bp, Homo sapiens
catgccttgataaatat

SEQ ID NO: 6023203 - DNA, 14 bp, Homo sapiens
catgccttggtgcc

SEQ ID NO: 6023204 - DNA, 15 bp, Homo sapiens
catgccttggtgccg

SEQ ID NO: 6023205 - DNA, 16 bp, Homo sapiens
catgcctttatacttt

SEQ ID NO: 6023206 - DNA, 15 bp, Homo sapiens
catgcctttcatagt

SEQ ID NO: 6023207 - DNA, 13 bp, Homo sapiens
catgcctttgtaa

SEQ ID NO: 6023208 - DNA, 15 bp, Homo sapiens
catgcctttgtaagt

SEQ ID NO: 6023209 - DNA, 16 bp, Homo sapiens
catgcgaaatgttctc

SEQ ID NO: 6023210 - DNA, 17 bp, Homo sapiens
catgcgaatgagctggg

SEQ ID NO: 6023211 - DNA, 19 bp, Homo sapiens
catgcgaatgagctgggcc

SEQ ID NO: 6023212 - DNA, 17 bp, Homo sapiens
catgcgaattcttgctt

SEQ ID NO: 6023213 - DNA, 22 bp, Homo sapiens
catgcgatgacacttgtacaat

SEQ ID NO: 6023214 - DNA, 12 bp, Homo sapiens
catgcgcacaga

SEQ ID NO: 6023215 - DNA, 14 bp, Homo sapiens
catgcgcagaggcc

SEQ ID NO: 6023216 - DNA, 16 bp, Homo sapiens
catgcgcagatgaggg

SEQ ID NO: 6023217 - DNA, 14 bp, Homo sapiens
catgcgcaggctca

SEQ ID NO: 6023218 - DNA, 17 bp, Homo sapiens
catgcgccaccatgccc

SEQ ID NO: 6023219 - DNA, 21 bp, Homo sapiens
catgcgccccctccgccctgc

SEQ ID NO: 6023220 - DNA, 23 bp, Homo sapiens
catgcgccccctccgccctgcca

SEQ ID NO: 6023221 - DNA, 17 bp, Homo sapiens
catgcgcgctgtgggca

SEQ ID NO: 6023222 - DNA, 15 bp, Homo sapiens
catgcgctcctggct

SEQ ID NO: 6023223 - DNA, 17 bp, Homo sapiens
catgcgctcctggcttt

SEQ ID NO: 6023224 - DNA, 14 bp, Homo sapiens
catgcggagaacaa

SEQ ID NO: 6023225 - DNA, 18 bp, Homo sapiens
catgcggcccagcccggc

SEQ ID NO: 6023226 - DNA, 21 bp, Homo sapiens
catgcggcccagcccggctcc

SEQ ID NO: 6023227 - DNA, 17 bp, Homo sapiens
catgcggccggcctggg

SEQ ID NO: 6023228 - DNA, 15 bp, Homo sapiens
catgcgggctcgccc

SEQ ID NO: 6023229 - DNA, 19 bp, Homo sapiens
catgcgggctcgcccatac

SEQ ID NO: 6023230 - DNA, 15 bp, Homo sapiens
catgcgggctgggca

SEQ ID NO: 6023231 - DNA, 18 bp, Homo sapiens
catgcgggctgggcagct

SEQ ID NO: 6023232 - DNA, 13 bp, Homo sapiens
catgcggtagcca

SEQ ID NO: 6023233 - DNA, 21 bp, Homo sapiens
catgcggtagccagcacacag

SEQ ID NO: 6023234 - DNA, 15 bp, Homo sapiens
catgcgtatatgtgc

SEQ ID NO: 6023235 - DNA, 22 bp, Homo sapiens
catgcgtgccgcctgctcctca

SEQ ID NO: 6023236 - DNA, 23 bp, Homo sapiens
catgcgtgggtggggagggaggt

SEQ ID NO: 6023237 - DNA, 15 bp, Homo sapiens
catgctaaataacta

SEQ ID NO: 6023238 - DNA, 16 bp, Homo sapiens
catgctaaataactat

SEQ ID NO: 6023239 - DNA, 17 bp, Homo sapiens
catgctaagagaagtag

SEQ ID NO: 6023240 - DNA, 14 bp, Homo sapiens
caggaggtggaggc

SEQ ID NO: 6023241 - DNA, 15 bp, Homo sapiens
caggaggtgggtgag

SEQ ID NO: 6023242 - DNA, 14 bp, Homo sapiens
caggaggtgtgaat

SEQ ID NO: 6023243 - DNA, 17 bp, Homo sapiens
caggaggttctgggcct

SEQ ID NO: 6023244 - DNA, 23 bp, Homo sapiens
caggaggttctgggcctctgaac

SEQ ID NO: 6023245 - DNA, 17 bp, Homo sapiens
caggaggttggagggaa

SEQ ID NO: 6023246 - DNA, 21 bp, Homo sapiens
caggaggttgtggatgctcca

SEQ ID NO: 6023247 - DNA, 22 bp, Homo sapiens
caggagtaagacaagtgggatt

SEQ ID NO: 6023248 - DNA, 23 bp, Homo sapiens
caggagtaagcccaagctaagct

SEQ ID NO: 6023249 - DNA, 15 bp, Homo sapiens
caggagtagctgagc

SEQ ID NO: 6023250 - DNA, 18 bp, Homo sapiens
caggagtagctgagctca

SEQ ID NO: 6023251 - DNA, 22 bp, Homo sapiens
caggagtagtgaagactccaga

SEQ ID NO: 6023252 - DNA, 23 bp, Homo sapiens
caggagtatcttacctgtaaagt

SEQ ID NO: 6023253 - DNA, 21 bp, Homo sapiens
caggagtcaccatgcaagggt

SEQ ID NO: 6023254 - DNA, 21 bp, Homo sapiens
caggagtcagtgtctggcttt

SEQ ID NO: 6023255 - DNA, 19 bp, Homo sapiens
caggagtccaagaccagac

SEQ ID NO: 6023256 - DNA, 20 bp, Homo sapiens
caggagtccaagaccagact

SEQ ID NO: 6023257 - DNA, 13 bp, Homo sapiens
caggagtccagac

SEQ ID NO: 6023258 - DNA, 15 bp, Homo sapiens
caggagtccagaccc

SEQ ID NO: 6023259 - DNA, 16 bp, Homo sapiens
caggagtccagacccc

SEQ ID NO: 6023260 - DNA, 17 bp, Homo sapiens
caggagtccagaccccc

SEQ ID NO: 6023261 - DNA, 20 bp, Homo sapiens
caggagtccagaccccccag

SEQ ID NO: 6023262 - DNA, 21 bp, Homo sapiens
caggagtccagaccccccagc

SEQ ID NO: 6023263 - DNA, 13 bp, Homo sapiens
caggagtccagcc

SEQ ID NO: 6023264 - DNA, 17 bp, Homo sapiens
caggagtccagcccctc

SEQ ID NO: 6023265 - DNA, 22 bp, Homo sapiens
caggagtccagcccctcctccc

SEQ ID NO: 6023266 - DNA, 14 bp, Homo sapiens
caggagtccaggcc

SEQ ID NO: 6023267 - DNA, 23 bp, Homo sapiens
caggagtccaggcccccagcccc

SEQ ID NO: 6023268 - DNA, 16 bp, Homo sapiens
caggagtcccaaggaa

SEQ ID NO: 6023269 - DNA, 17 bp, Homo sapiens
caggagtcccaaggaaa

SEQ ID NO: 6023270 - DNA, 18 bp, Homo sapiens
caggagtcccaaggaaag

SEQ ID NO: 6023271 - DNA, 13 bp, Homo sapiens
caggagtccctgg

SEQ ID NO: 6023272 - DNA, 14 bp, Homo sapiens
caggagtccctggt

SEQ ID NO: 6023273 - DNA, 15 bp, Homo sapiens
caggagtctctgcca

SEQ ID NO: 6023274 - DNA, 19 bp, Homo sapiens
caggagtctctgccaccca

SEQ ID NO: 6023275 - DNA, 22 bp, Homo sapiens
caggagtctctgccacccactc

SEQ ID NO: 6023276 - DNA, 20 bp, Homo sapiens
caggagtctgccacttgtca

SEQ ID NO: 6023277 - DNA, 14 bp, Homo sapiens
caggagtctgtgct

SEQ ID NO: 6023278 - DNA, 16 bp, Homo sapiens
caggagtctgtgctct

SEQ ID NO: 6023279 - DNA, 16 bp, Homo sapiens
caggagtcttcagacc

SEQ ID NO: 6023280 - DNA, 19 bp, Homo sapiens
caggagtcttcagacccag

SEQ ID NO: 6023281 - DNA, 20 bp, Homo sapiens
caggagtcttcagacccaga

SEQ ID NO: 6023282 - DNA, 17 bp, Homo sapiens
caggagtgccaggacca

SEQ ID NO: 6023283 - DNA, 21 bp, Homo sapiens
caggagtgccaggaccagcct

SEQ ID NO: 6023284 - DNA, 17 bp, Homo sapiens
caggagtgcccccggga

SEQ ID NO: 6023285 - DNA, 21 bp, Homo sapiens
caggagtgctgccctctccca

SEQ ID NO: 6023286 - DNA, 13 bp, Homo sapiens
caggagtggggag

SEQ ID NO: 6023287 - DNA, 18 bp, Homo sapiens
caggagtgggtcgcccac

SEQ ID NO: 6023288 - DNA, 21 bp, Homo sapiens
caggagtgggtgggacacaga

SEQ ID NO: 6023289 - DNA, 23 bp, Homo sapiens
caggagtgggtgggacacagaga

SEQ ID NO: 6023290 - DNA, 17 bp, Homo sapiens
caggagtgtcctgccca

SEQ ID NO: 6023291 - DNA, 16 bp, Homo sapiens
caggagtgtcctggct

SEQ ID NO: 6023292 - DNA, 13 bp, Homo sapiens
caggagtgtgcgg

SEQ ID NO: 6023293 - DNA, 16 bp, Homo sapiens
caggagttagaggcca

SEQ ID NO: 6023294 - DNA, 20 bp, Homo sapiens
caggagttagaggccagcct

SEQ ID NO: 6023295 - DNA, 21 bp, Homo sapiens
caggagttagaggccagcctg

SEQ ID NO: 6023296 - DNA, 21 bp, Homo sapiens
caggagttcaagaccagcctg

SEQ ID NO: 6023297 - DNA, 23 bp, Homo sapiens
caggagttcaagaccagcctgga

SEQ ID NO: 6023298 - DNA, 17 bp, Homo sapiens
caggagttcaagactag

SEQ ID NO: 6023299 - DNA, 21 bp, Homo sapiens
caggagttccagtgctgcatg

SEQ ID NO: 6023300 - DNA, 18 bp, Homo sapiens
caggagttcctttccctc

SEQ ID NO: 6023301 - DNA, 18 bp, Homo sapiens
caggagttcgagaccagc

SEQ ID NO: 6023302 - DNA, 21 bp, Homo sapiens
caggagttcgagaccagcctc

SEQ ID NO: 6023303 - DNA, 23 bp, Homo sapiens
caggagttcgagaccagcctcgc

SEQ ID NO: 6023304 - DNA, 21 bp, Homo sapiens
caggagttcgagagcagcctg

SEQ ID NO: 6023305 - DNA, 21 bp, Homo sapiens
caggagttcgaggcgagcctg

SEQ ID NO: 6023306 - DNA, 12 bp, Homo sapiens
caggagttctga

SEQ ID NO: 6023307 - DNA, 15 bp, Homo sapiens
caggagttctgctca

SEQ ID NO: 6023308 - DNA, 16 bp, Homo sapiens
caggagttctgctcat

SEQ ID NO: 6023309 - DNA, 20 bp, Homo sapiens
caggagttgatacaccacct

SEQ ID NO: 6023310 - DNA, 22 bp, Homo sapiens
caggagttggaatgttgtagtt

SEQ ID NO: 6023311 - DNA, 17 bp, Homo sapiens
caggagttgggggcagg

SEQ ID NO: 6023312 - DNA, 22 bp, Homo sapiens
caggagttgggggcaggtcagg

SEQ ID NO: 6023313 - DNA, 17 bp, Homo sapiens
caggagttgtgagccct

SEQ ID NO: 6023314 - DNA, 22 bp, Homo sapiens
caggagttgtgtctaggctgga

SEQ ID NO: 6023315 - DNA, 22 bp, Homo sapiens
caggagtttaagaccagcctgg

SEQ ID NO: 6023316 - DNA, 23 bp, Homo sapiens
caggagtttgagacaagccctgg

SEQ ID NO: 6023317 - DNA, 21 bp, Homo sapiens
caggagtttgagaccaacctg

SEQ ID NO: 6023318 - DNA, 18 bp, Homo sapiens
caggagtttgagaccagg

SEQ ID NO: 6023319 - DNA, 13 bp, Homo sapiens
caggagtttggcc

SEQ ID NO: 6023320 - DNA, 15 bp, Homo sapiens
caggagtttgtggta

SEQ ID NO: 6023321 - DNA, 16 bp, Homo sapiens
caggagtttgtggtaa

SEQ ID NO: 6023322 - DNA, 22 bp, Homo sapiens
caggagtttgtggtaacttgag

SEQ ID NO: 6023323 - DNA, 17 bp, Homo sapiens
caggagttttaagtcca

SEQ ID NO: 6023324 - DNA, 18 bp, Homo sapiens
caggagttttactgcctg

SEQ ID NO: 6023325 - DNA, 21 bp, Homo sapiens
caggataaacattccagagaa

SEQ ID NO: 6023326 - DNA, 17 bp, Homo sapiens
caggataaagttattct

SEQ ID NO: 6023327 - DNA, 15 bp, Homo sapiens
caggataacagagaa

SEQ ID NO: 6023328 - DNA, 16 bp, Homo sapiens
caggataaggagactg

SEQ ID NO: 6023329 - DNA, 22 bp, Homo sapiens
caggataaggagactgaggctt

SEQ ID NO: 6023330 - DNA, 15 bp, Homo sapiens
caggataataatttt

SEQ ID NO: 6023331 - DNA, 18 bp, Homo sapiens
caggatacaggtgacagt

SEQ ID NO: 6023332 - DNA, 23 bp, Homo sapiens
caggatacgatgactgacactca

SEQ ID NO: 6023333 - DNA, 23 bp, Homo sapiens
caggatactctgtcagatgggaa

SEQ ID NO: 6023334 - DNA, 17 bp, Homo sapiens
caggatactggcacaga

SEQ ID NO: 6023335 - DNA, 20 bp, Homo sapiens
caggatactggcacagaggt

SEQ ID NO: 6023336 - DNA, 21 bp, Homo sapiens
caggatactgtagtttcctct

SEQ ID NO: 6023337 - DNA, 13 bp, Homo sapiens
caggatagacttt

SEQ ID NO: 6023338 - DNA, 17 bp, Homo sapiens
caggatagataactctt

SEQ ID NO: 6023339 - DNA, 23 bp, Homo sapiens
caggatagctttataaagcagtt

SEQ ID NO: 6023340 - DNA, 18 bp, Homo sapiens
caggatatccccagggaa

SEQ ID NO: 6023341 - DNA, 14 bp, Homo sapiens
caggatatgcttta

SEQ ID NO: 6023342 - DNA, 21 bp, Homo sapiens
caggatattaaacgtgtaaat

SEQ ID NO: 6023343 - DNA, 22 bp, Homo sapiens
caggatattaaacgtgtaaatt

SEQ ID NO: 6023344 - DNA, 13 bp, Homo sapiens
caggatattagtt

SEQ ID NO: 6023345 - DNA, 16 bp, Homo sapiens
caggatattagttaat

SEQ ID NO: 6023346 - DNA, 20 bp, Homo sapiens
caggatattagttaatgagc

SEQ ID NO: 6023347 - DNA, 13 bp, Homo sapiens
caggatcacagct

SEQ ID NO: 6023348 - DNA, 19 bp, Homo sapiens
caggatcactctctgctgg

SEQ ID NO: 6023349 - DNA, 22 bp, Homo sapiens
caggatcactctctgctggcag

SEQ ID NO: 6023350 - DNA, 13 bp, Homo sapiens
caggatcagatga

SEQ ID NO: 6023351 - DNA, 23 bp, Homo sapiens
caggatcagattgcatgtgactc

SEQ ID NO: 6023352 - DNA, 24 bp, Homo sapiens
caggatcagattgcatgtgactct

SEQ ID NO: 6023353 - DNA, 12 bp, Homo sapiens
caggatcagcca

SEQ ID NO: 6023354 - DNA, 17 bp, Homo sapiens
caggatcagttaactat

SEQ ID NO: 6023355 - DNA, 20 bp, Homo sapiens
caggatcatcatttaaaaaa

SEQ ID NO: 6023356 - DNA, 15 bp, Homo sapiens
caggatcatggtgta

SEQ ID NO: 6023357 - DNA, 21 bp, Homo sapiens
caggatcatggtgtaataaga

SEQ ID NO: 6023358 - DNA, 17 bp, Homo sapiens
caggatccaagctaagc

SEQ ID NO: 6023359 - DNA, 13 bp, Homo sapiens
caggatccaggcc

SEQ ID NO: 6023360 - DNA, 14 bp, Homo sapiens
caggatccagtgac

SEQ ID NO: 6023361 - DNA, 15 bp, Homo sapiens
caggatccagtgaca

SEQ ID NO: 6023362 - DNA, 14 bp, Homo sapiens
caggatcccagagc

SEQ ID NO: 6023363 - DNA, 16 bp, Homo sapiens
caggatcccaggggcc

SEQ ID NO: 6023364 - DNA, 22 bp, Homo sapiens
caggatccccaaggcacttgag

SEQ ID NO: 6023365 - DNA, 15 bp, Homo sapiens
caggatccctcctga

SEQ ID NO: 6023366 - DNA, 16 bp, Homo sapiens
caggatccctcctgag

SEQ ID NO: 6023367 - DNA, 17 bp, Homo sapiens
caggatccctcctgagc

SEQ ID NO: 6023368 - DNA, 19 bp, Homo sapiens
caggatccctcctgagctc

SEQ ID NO: 6023369 - DNA, 15 bp, Homo sapiens
caggatccgctgcca

SEQ ID NO: 6023370 - DNA, 18 bp, Homo sapiens
caggatccgctgccacca

SEQ ID NO: 6023371 - DNA, 19 bp, Homo sapiens
caggatccgctgccaccac

SEQ ID NO: 6023372 - DNA, 20 bp, Homo sapiens
caggatcctattctcaccag

SEQ ID NO: 6023373 - DNA, 13 bp, Homo sapiens
caggatcctcctg

SEQ ID NO: 6023374 - DNA, 18 bp, Homo sapiens
caggatcctcctggagca

SEQ ID NO: 6023375 - DNA, 15 bp, Homo sapiens
caggatcctgcagga

SEQ ID NO: 6023376 - DNA, 15 bp, Homo sapiens
caggatcgaagggtt

SEQ ID NO: 6023377 - DNA, 20 bp, Homo sapiens
caggatctatttttggaggt

SEQ ID NO: 6023378 - DNA, 16 bp, Homo sapiens
caggatctcaagccag

SEQ ID NO: 6023379 - DNA, 18 bp, Homo sapiens
caggatctcaagccagcc

SEQ ID NO: 6023380 - DNA, 19 bp, Homo sapiens
caggatctcaagccagccc

SEQ ID NO: 6023381 - DNA, 19 bp, Homo sapiens
caggatctcagatcactgc

SEQ ID NO: 6023382 - DNA, 12 bp, Homo sapiens
caggatctcttt

SEQ ID NO: 6023383 - DNA, 21 bp, Homo sapiens
caggatctctttccccaagga

SEQ ID NO: 6023384 - DNA, 14 bp, Homo sapiens
caggatctgaactt

SEQ ID NO: 6023385 - DNA, 15 bp, Homo sapiens
caggatctgaacttt

SEQ ID NO: 6023386 - DNA, 14 bp, Homo sapiens
caggatctgctcca

SEQ ID NO: 6023387 - DNA, 17 bp, Homo sapiens
caggatctgctccaaca

SEQ ID NO: 6023388 - DNA, 15 bp, Homo sapiens
caggatctgtctgtg

SEQ ID NO: 6023389 - DNA, 17 bp, Homo sapiens
caggatctgtctgtgca

SEQ ID NO: 6023390 - DNA, 20 bp, Homo sapiens
caggatctgtctgtgcacat

SEQ ID NO: 6023391 - DNA, 22 bp, Homo sapiens
caggatctgtctgtgcacatgc

SEQ ID NO: 6023392 - DNA, 16 bp, Homo sapiens
caggatctttgactga

SEQ ID NO: 6023393 - DNA, 13 bp, Homo sapiens
caggatgaactag

SEQ ID NO: 6023394 - DNA, 19 bp, Homo sapiens
caggatgaactagccatga

SEQ ID NO: 6023395 - DNA, 14 bp, Homo sapiens
caggatgaagcatt

SEQ ID NO: 6023396 - DNA, 15 bp, Homo sapiens
caggatgaagcattt

SEQ ID NO: 6023397 - DNA, 23 bp, Homo sapiens
caggatgaattttctgcagctgt

SEQ ID NO: 6023398 - DNA, 16 bp, Homo sapiens
caggatgaccacgcac

SEQ ID NO: 6023399 - DNA, 21 bp, Homo sapiens
caggatgaccacgcacctcca

SEQ ID NO: 6023400 - DNA, 15 bp, Homo sapiens
caggatgaccctgcg

SEQ ID NO: 6023401 - DNA, 15 bp, Homo sapiens
caggatgagaacaca

SEQ ID NO: 6023402 - DNA, 16 bp, Homo sapiens
caggatgaggacagag

SEQ ID NO: 6023403 - DNA, 12 bp, Homo sapiens
caggatgaggcc

SEQ ID NO: 6023404 - DNA, 23 bp, Homo sapiens
caggatgaggtctcgaccctgtc

SEQ ID NO: 6023405 - DNA, 17 bp, Homo sapiens
caggatgattgtacaga

SEQ ID NO: 6023406 - DNA, 17 bp, Homo sapiens
caggatgcacatttctg

SEQ ID NO: 6023407 - DNA, 17 bp, Homo sapiens
caggatgcatattaaag

SEQ ID NO: 6023408 - DNA, 20 bp, Homo sapiens
caggatgccacgcctggaag

SEQ ID NO: 6023409 - DNA, 14 bp, Homo sapiens
caggatgccagccc

SEQ ID NO: 6023410 - DNA, 17 bp, Homo sapiens
caggatgccagcccctg

SEQ ID NO: 6023411 - DNA, 21 bp, Homo sapiens
caggatgccagcccctgcctg

SEQ ID NO: 6023412 - DNA, 17 bp, Homo sapiens
caggatgcccagatgaa

SEQ ID NO: 6023413 - DNA, 21 bp, Homo sapiens
caggatgcccagatgaactga

SEQ ID NO: 6023414 - DNA, 14 bp, Homo sapiens
caggatgcccaggg

SEQ ID NO: 6023415 - DNA, 17 bp, Homo sapiens
caggatgcccagggcca

SEQ ID NO: 6023416 - DNA, 19 bp, Homo sapiens
caggatgcccagggccact

SEQ ID NO: 6023417 - DNA, 19 bp, Homo sapiens
catgctaagagaagtagaa

SEQ ID NO: 6023418 - DNA, 13 bp, Homo sapiens
catgctacagtta

SEQ ID NO: 6023419 - DNA, 22 bp, Homo sapiens
catgctagcctcacgaaactgg

SEQ ID NO: 6023420 - DNA, 18 bp, Homo sapiens
catgctagtgttgtattt

SEQ ID NO: 6023421 - DNA, 19 bp, Homo sapiens
catgctatcagaaacagta

SEQ ID NO: 6023422 - DNA, 16 bp, Homo sapiens
catgctatccaatctc

SEQ ID NO: 6023423 - DNA, 21 bp, Homo sapiens
catgctatgctgaagacattc

SEQ ID NO: 6023424 - DNA, 12 bp, Homo sapiens
catgctatgttc

SEQ ID NO: 6023425 - DNA, 18 bp, Homo sapiens
catgctattcacaattat

SEQ ID NO: 6023426 - DNA, 17 bp, Homo sapiens
catgctcaacccccctc

SEQ ID NO: 6023427 - DNA, 18 bp, Homo sapiens
catgctcaacccccctcc

SEQ ID NO: 6023428 - DNA, 13 bp, Homo sapiens
catgctcacctct

SEQ ID NO: 6023429 - DNA, 15 bp, Homo sapiens
catgctcacctctag

SEQ ID NO: 6023430 - DNA, 13 bp, Homo sapiens
catgctcagccct

SEQ ID NO: 6023431 - DNA, 23 bp, Homo sapiens
catgctcagccctgactggtgct

SEQ ID NO: 6023432 - DNA, 12 bp, Homo sapiens
catgctcagcct

SEQ ID NO: 6023433 - DNA, 22 bp, Homo sapiens
catgctcagccttgctgctctg

SEQ ID NO: 6023434 - DNA, 23 bp, Homo sapiens
catgctcagccttgctgctctgc

SEQ ID NO: 6023435 - DNA, 12 bp, Homo sapiens
catgctcagtac

SEQ ID NO: 6023436 - DNA, 14 bp, Homo sapiens
catgctcagtattg

SEQ ID NO: 6023437 - DNA, 16 bp, Homo sapiens
catgctcatctgctgg

SEQ ID NO: 6023438 - DNA, 17 bp, Homo sapiens
catgctcatctgctggt

SEQ ID NO: 6023439 - DNA, 17 bp, Homo sapiens
catgctcatgtatattt

SEQ ID NO: 6023440 - DNA, 12 bp, Homo sapiens
catgctccaaat

SEQ ID NO: 6023441 - DNA, 14 bp, Homo sapiens
catgctccaaatat

SEQ ID NO: 6023442 - DNA, 14 bp, Homo sapiens
catgctccaagact

SEQ ID NO: 6023443 - DNA, 12 bp, Homo sapiens
catgctccaggg

SEQ ID NO: 6023444 - DNA, 18 bp, Homo sapiens
catgctccagggtcaggc

SEQ ID NO: 6023445 - DNA, 11 bp, Homo sapiens
catgctcccaa

SEQ ID NO: 6023446 - DNA, 17 bp, Homo sapiens
catgctcccaactccct

SEQ ID NO: 6023447 - DNA, 20 bp, Homo sapiens
catgctcccaactcccttct

SEQ ID NO: 6023448 - DNA, 16 bp, Homo sapiens
catgctcccagcattt

SEQ ID NO: 6023449 - DNA, 15 bp, Homo sapiens
catgctcccctgtgc

SEQ ID NO: 6023450 - DNA, 19 bp, Homo sapiens
catgctcccctgtgccagc

SEQ ID NO: 6023451 - DNA, 19 bp, Homo sapiens
catgctccctcatgcagat

SEQ ID NO: 6023452 - DNA, 18 bp, Homo sapiens
catgctcctcacctgtct

SEQ ID NO: 6023453 - DNA, 19 bp, Homo sapiens
catgctcctctgcctgtgc

SEQ ID NO: 6023454 - DNA, 17 bp, Homo sapiens
catgctcctggcccact

SEQ ID NO: 6023455 - DNA, 13 bp, Homo sapiens
catgctccttaat

SEQ ID NO: 6023456 - DNA, 16 bp, Homo sapiens
catgctctccccacag

SEQ ID NO: 6023457 - DNA, 20 bp, Homo sapiens
catgctctctcacctgctcc

SEQ ID NO: 6023458 - DNA, 19 bp, Homo sapiens
catgctctctgtggcctcc

SEQ ID NO: 6023459 - DNA, 23 bp, Homo sapiens
catgctctctttcttttctctgt

SEQ ID NO: 6023460 - DNA, 22 bp, Homo sapiens
catgctctgagaagaggagccc

SEQ ID NO: 6023461 - DNA, 24 bp, Homo sapiens
catgctctgatgcagtgccctaga

SEQ ID NO: 6023462 - DNA, 16 bp, Homo sapiens
catgctctgcaaaagg

SEQ ID NO: 6023463 - DNA, 19 bp, Homo sapiens
catgctctgccccaagccc

SEQ ID NO: 6023464 - DNA, 11 bp, Homo sapiens
catgctctgga

SEQ ID NO: 6023465 - DNA, 12 bp, Homo sapiens
catgctctggaa

SEQ ID NO: 6023466 - DNA, 16 bp, Homo sapiens
catgctctggaagcct

SEQ ID NO: 6023467 - DNA, 22 bp, Homo sapiens
catgctctgtaagttgcttcct

SEQ ID NO: 6023468 - DNA, 16 bp, Homo sapiens
catgctctgtccagct

SEQ ID NO: 6023469 - DNA, 16 bp, Homo sapiens
catgctcttagaaaat

SEQ ID NO: 6023470 - DNA, 17 bp, Homo sapiens
catgctcttagaaaatt

SEQ ID NO: 6023471 - DNA, 18 bp, Homo sapiens
catgctctttcaccctgc

SEQ ID NO: 6023472 - DNA, 19 bp, Homo sapiens
catgctctttcaccctgcc

SEQ ID NO: 6023473 - DNA, 16 bp, Homo sapiens
catgctctttttttaa

SEQ ID NO: 6023474 - DNA, 17 bp, Homo sapiens
catgctgaaaaatatag

SEQ ID NO: 6023475 - DNA, 16 bp, Homo sapiens
catgctgacttgcaga

SEQ ID NO: 6023476 - DNA, 21 bp, Homo sapiens
catgctgactttcatttcttg

SEQ ID NO: 6023477 - DNA, 18 bp, Homo sapiens
catgctgagacatccctc

SEQ ID NO: 6023478 - DNA, 19 bp, Homo sapiens
catgctgaggcctgggccg

SEQ ID NO: 6023479 - DNA, 19 bp, Homo sapiens
catgctgaggttttgaata

SEQ ID NO: 6023480 - DNA, 20 bp, Homo sapiens
catgctgaggttttgaataa

SEQ ID NO: 6023481 - DNA, 20 bp, Homo sapiens
catgctgatttaccacttat

SEQ ID NO: 6023482 - DNA, 10 bp, Homo sapiens
catgctgccc

SEQ ID NO: 6023483 - DNA, 13 bp, Homo sapiens
catgctgcccagc

SEQ ID NO: 6023484 - DNA, 16 bp, Homo sapiens
catgctgcccctgcct

SEQ ID NO: 6023485 - DNA, 14 bp, Homo sapiens
catgctgcctccag

SEQ ID NO: 6023486 - DNA, 22 bp, Homo sapiens
catgctgcctgagtattactag

SEQ ID NO: 6023487 - DNA, 13 bp, Homo sapiens
catgctgcctgcc

SEQ ID NO: 6023488 - DNA, 17 bp, Homo sapiens
catgctgcctgccatgt

SEQ ID NO: 6023489 - DNA, 19 bp, Homo sapiens
catgctgcctgcctccggc

SEQ ID NO: 6023490 - DNA, 14 bp, Homo sapiens
catgctgccttcag

SEQ ID NO: 6023491 - DNA, 15 bp, Homo sapiens
catgctgccttcagg

SEQ ID NO: 6023492 - DNA, 16 bp, Homo sapiens
catgctgctatgaaga

SEQ ID NO: 6023493 - DNA, 19 bp, Homo sapiens
catgctgctatgaagacta

SEQ ID NO: 6023494 - DNA, 19 bp, Homo sapiens
catgctgctggacagtatc

SEQ ID NO: 6023495 - DNA, 21 bp, Homo sapiens
catgctgctggggaagacagt

SEQ ID NO: 6023496 - DNA, 12 bp, Homo sapiens
catgctgcttta

SEQ ID NO: 6023497 - DNA, 13 bp, Homo sapiens
catgctgctttaa

SEQ ID NO: 6023498 - DNA, 20 bp, Homo sapiens
catgctgctttaattgtgaa

SEQ ID NO: 6023499 - DNA, 21 bp, Homo sapiens
catgctgctttaattgtgaat

SEQ ID NO: 6023500 - DNA, 15 bp, Homo sapiens
catgctgctttgcca

SEQ ID NO: 6023501 - DNA, 22 bp, Homo sapiens
catgctggacaggtctgggaga

SEQ ID NO: 6023502 - DNA, 22 bp, Homo sapiens
catgctggagcctgtgtaacag

SEQ ID NO: 6023503 - DNA, 18 bp, Homo sapiens
catgctggagtacccagc

SEQ ID NO: 6023504 - DNA, 19 bp, Homo sapiens
catgctggagtacccagcc

SEQ ID NO: 6023505 - DNA, 23 bp, Homo sapiens
catgctggatgaccccatgctcc

SEQ ID NO: 6023506 - DNA, 16 bp, Homo sapiens
catgctggccagcctg

SEQ ID NO: 6023507 - DNA, 16 bp, Homo sapiens
catgctggcctgtggc

SEQ ID NO: 6023508 - DNA, 21 bp, Homo sapiens
catgctggctcagtctgagct

SEQ ID NO: 6023509 - DNA, 13 bp, Homo sapiens
catgctggctggg

SEQ ID NO: 6023510 - DNA, 13 bp, Homo sapiens
catgctgggattt

SEQ ID NO: 6023511 - DNA, 19 bp, Homo sapiens
catgctgggccactgggga

SEQ ID NO: 6023512 - DNA, 21 bp, Homo sapiens
catgctgggccactggggact

SEQ ID NO: 6023513 - DNA, 15 bp, Homo sapiens
catgctgggtctgag

SEQ ID NO: 6023514 - DNA, 21 bp, Homo sapiens
catgctgggtctgaggcccct

SEQ ID NO: 6023515 - DNA, 22 bp, Homo sapiens
catgctgggtctgaggcccctg

SEQ ID NO: 6023516 - DNA, 16 bp, Homo sapiens
catgctgggttctgca

SEQ ID NO: 6023517 - DNA, 16 bp, Homo sapiens
catgctggtcagagac

SEQ ID NO: 6023518 - DNA, 16 bp, Homo sapiens
catgctggtgagtgcc

SEQ ID NO: 6023519 - DNA, 23 bp, Homo sapiens
catgctggtgtggccaaggctga

SEQ ID NO: 6023520 - DNA, 23 bp, Homo sapiens
catgctggttacctgttccattg

SEQ ID NO: 6023521 - DNA, 18 bp, Homo sapiens
catgctgtccctgcactg

SEQ ID NO: 6023522 - DNA, 15 bp, Homo sapiens
catgctgtccctgtg

SEQ ID NO: 6023523 - DNA, 23 bp, Homo sapiens
catgctgtccctgtgggctcaca

SEQ ID NO: 6023524 - DNA, 15 bp, Homo sapiens
catgctgtccggcct

SEQ ID NO: 6023525 - DNA, 17 bp, Homo sapiens
catgctgtctggcacag

SEQ ID NO: 6023526 - DNA, 20 bp, Homo sapiens
catgctgtctggcacagcct

SEQ ID NO: 6023527 - DNA, 23 bp, Homo sapiens
catgctgtctgtgtgaggctccc

SEQ ID NO: 6023528 - DNA, 20 bp, Homo sapiens
catgctgtgcgcccagggct

SEQ ID NO: 6023529 - DNA, 13 bp, Homo sapiens
catgctgtgtaag

SEQ ID NO: 6023530 - DNA, 18 bp, Homo sapiens
catgctgttcatgaaaga

SEQ ID NO: 6023531 - DNA, 16 bp, Homo sapiens
catgctgttctctttg

SEQ ID NO: 6023532 - DNA, 17 bp, Homo sapiens
catgctgttctctttgc

SEQ ID NO: 6023533 - DNA, 19 bp, Homo sapiens
catgctgttctctttgctg

SEQ ID NO: 6023534 - DNA, 21 bp, Homo sapiens
catgctgttctctttgctgac

SEQ ID NO: 6023535 - DNA, 16 bp, Homo sapiens
catgctgttctgaaag

SEQ ID NO: 6023536 - DNA, 22 bp, Homo sapiens
catgctgttctgaaagggatgg

SEQ ID NO: 6023537 - DNA, 19 bp, Homo sapiens
catgctgttgattgctaaa

SEQ ID NO: 6023538 - DNA, 21 bp, Homo sapiens
catgctgttgcatttagaact

SEQ ID NO: 6023539 - DNA, 22 bp, Homo sapiens
catgctgttggcctcaagcaag

SEQ ID NO: 6023540 - DNA, 22 bp, Homo sapiens
catgctgtttatgacacaatga

SEQ ID NO: 6023541 - DNA, 12 bp, Homo sapiens
catgcttaaata

SEQ ID NO: 6023542 - DNA, 21 bp, Homo sapiens
catgcttaaataaaaattatg

SEQ ID NO: 6023543 - DNA, 12 bp, Homo sapiens
catgcttacctt

SEQ ID NO: 6023544 - DNA, 18 bp, Homo sapiens
catgcttactttttaatt

SEQ ID NO: 6023545 - DNA, 13 bp, Homo sapiens
catgcttagaaag

SEQ ID NO: 6023546 - DNA, 14 bp, Homo sapiens
catgcttagagcat

SEQ ID NO: 6023547 - DNA, 17 bp, Homo sapiens
catgcttagagcatgtt

SEQ ID NO: 6023548 - DNA, 17 bp, Homo sapiens
catgcttagcttatctt

SEQ ID NO: 6023549 - DNA, 19 bp, Homo sapiens
catgcttattagcagctgg

SEQ ID NO: 6023550 - DNA, 17 bp, Homo sapiens
catgcttattccatgac

SEQ ID NO: 6023551 - DNA, 22 bp, Homo sapiens
catgcttcaatagttcaaggaa

SEQ ID NO: 6023552 - DNA, 18 bp, Homo sapiens
catgcttcagtgaacata

SEQ ID NO: 6023553 - DNA, 23 bp, Homo sapiens
catgcttcatcattccctctcat

SEQ ID NO: 6023554 - DNA, 23 bp, Homo sapiens
catgcttcatgaaaatcctacca

SEQ ID NO: 6023555 - DNA, 20 bp, Homo sapiens
catgcttccaggtaaaaaca

SEQ ID NO: 6023556 - DNA, 17 bp, Homo sapiens
catgcttcccagaggga

SEQ ID NO: 6023557 - DNA, 15 bp, Homo sapiens
catgcttccctgcag

SEQ ID NO: 6023558 - DNA, 17 bp, Homo sapiens
catgcttccctgcagct

SEQ ID NO: 6023559 - DNA, 15 bp, Homo sapiens
catgcttccctttcc

SEQ ID NO: 6023560 - DNA, 17 bp, Homo sapiens
catgcttcctttctctc

SEQ ID NO: 6023561 - DNA, 21 bp, Homo sapiens
catgcttcctttctctcctgg

SEQ ID NO: 6023562 - DNA, 22 bp, Homo sapiens
catgcttcctttctctcctggc

SEQ ID NO: 6023563 - DNA, 23 bp, Homo sapiens
catgcttctcatcttgtgaaatg

SEQ ID NO: 6023564 - DNA, 14 bp, Homo sapiens
catgcttcttcctt

SEQ ID NO: 6023565 - DNA, 14 bp, Homo sapiens
catgcttcttgccc

SEQ ID NO: 6023566 - DNA, 14 bp, Homo sapiens
catgcttgatggtt

SEQ ID NO: 6023567 - DNA, 14 bp, Homo sapiens
catgcttgggctga

SEQ ID NO: 6023568 - DNA, 15 bp, Homo sapiens
catgcttgggctgac

SEQ ID NO: 6023569 - DNA, 18 bp, Homo sapiens
catgcttgggctgaccca

SEQ ID NO: 6023570 - DNA, 23 bp, Homo sapiens
catgcttgggctgacccagcatc

SEQ ID NO: 6023571 - DNA, 22 bp, Homo sapiens
catgcttggttttcttttttct

SEQ ID NO: 6023572 - DNA, 13 bp, Homo sapiens
catgcttgtgtta

SEQ ID NO: 6023573 - DNA, 18 bp, Homo sapiens
catgcttgtgtttcttag

SEQ ID NO: 6023574 - DNA, 19 bp, Homo sapiens
catgcttgtgtttcttagt

SEQ ID NO: 6023575 - DNA, 14 bp, Homo sapiens
catgctttaaagtg

SEQ ID NO: 6023576 - DNA, 13 bp, Homo sapiens
catgctttatgtg

SEQ ID NO: 6023577 - DNA, 12 bp, Homo sapiens
catgctttccca

SEQ ID NO: 6023578 - DNA, 23 bp, Homo sapiens
catgctttcctaaagtctctgct

SEQ ID NO: 6023579 - DNA, 13 bp, Homo sapiens
catgctttctcct

SEQ ID NO: 6023580 - DNA, 15 bp, Homo sapiens
catgctttctccttt

SEQ ID NO: 6023581 - DNA, 16 bp, Homo sapiens
catgctttctcctttt

SEQ ID NO: 6023582 - DNA, 23 bp, Homo sapiens
catgctttgagaccagaagaaaa

SEQ ID NO: 6023583 - DNA, 20 bp, Homo sapiens
catgctttgagtccacgccc

SEQ ID NO: 6023584 - DNA, 12 bp, Homo sapiens
catgctttgatt

SEQ ID NO: 6023585 - DNA, 20 bp, Homo sapiens
catgctttgctctcaaggct

SEQ ID NO: 6023586 - DNA, 15 bp, Homo sapiens
catgctttgctgcta

SEQ ID NO: 6023587 - DNA, 19 bp, Homo sapiens
catgctttgctgctatgaa

SEQ ID NO: 6023588 - DNA, 12 bp, Homo sapiens
catgctttggca

SEQ ID NO: 6023589 - DNA, 12 bp, Homo sapiens
catgctttgttt

SEQ ID NO: 6023590 - DNA, 20 bp, Homo sapiens
catgctttgtttacgtgtaa

SEQ ID NO: 6023591 - DNA, 14 bp, Homo sapiens
catgcttttccaaa

SEQ ID NO: 6023592 - DNA, 15 bp, Homo sapiens
catgcttttctgcca

SEQ ID NO: 6023593 - DNA, 11 bp, Homo sapiens
catggaaaaaa

SEQ ID NO: 6023594 - DNA, 16 bp, Homo sapiens
catggaaaaacttcct

SEQ ID NO: 6023595 - DNA, 14 bp, Homo sapiens
catggaaaaatact

SEQ ID NO: 6023596 - DNA, 18 bp, Homo sapiens
caggatgccctgttgggg

SEQ ID NO: 6023597 - DNA, 15 bp, Homo sapiens
caggatgctgagctt

SEQ ID NO: 6023598 - DNA, 13 bp, Homo sapiens
caggatgctgggt

SEQ ID NO: 6023599 - DNA, 15 bp, Homo sapiens
caggatgctttggtt

SEQ ID NO: 6023600 - DNA, 20 bp, Homo sapiens
caggatggaacatcagtgga

SEQ ID NO: 6023601 - DNA, 22 bp, Homo sapiens
caggatggaggggtggtcctga

SEQ ID NO: 6023602 - DNA, 13 bp, Homo sapiens
caggatggagggt

SEQ ID NO: 6023603 - DNA, 17 bp, Homo sapiens
caggatggcagcaatgg

SEQ ID NO: 6023604 - DNA, 23 bp, Homo sapiens
caggatggccgggcgcggtggct

SEQ ID NO: 6023605 - DNA, 15 bp, Homo sapiens
caggatggcctggcc

SEQ ID NO: 6023606 - DNA, 24 bp, Homo sapiens
caggatggcctggccagggcctgg

SEQ ID NO: 6023607 - DNA, 15 bp, Homo sapiens
caggatggcctttcc

SEQ ID NO: 6023608 - DNA, 18 bp, Homo sapiens
caggatggcctttccttc

SEQ ID NO: 6023609 - DNA, 21 bp, Homo sapiens
caggatggcctttccttccct

SEQ ID NO: 6023610 - DNA, 14 bp, Homo sapiens
caggatggcgcagg

SEQ ID NO: 6023611 - DNA, 23 bp, Homo sapiens
caggatggcgcaggaactcaata

SEQ ID NO: 6023612 - DNA, 21 bp, Homo sapiens
caggatggcgtgtcccctgcc

SEQ ID NO: 6023613 - DNA, 20 bp, Homo sapiens
caggatgggaagaaaaagga

SEQ ID NO: 6023614 - DNA, 15 bp, Homo sapiens
caggatgggctgagc

SEQ ID NO: 6023615 - DNA, 17 bp, Homo sapiens
caggatgggctgagcta

SEQ ID NO: 6023616 - DNA, 22 bp, Homo sapiens
caggatgggctgagctagcctc

SEQ ID NO: 6023617 - DNA, 23 bp, Homo sapiens
caggatgggctgagctagcctcc

SEQ ID NO: 6023618 - DNA, 14 bp, Homo sapiens
caggatggggacac

SEQ ID NO: 6023619 - DNA, 13 bp, Homo sapiens
caggatggggagg

SEQ ID NO: 6023620 - DNA, 19 bp, Homo sapiens
caggatgggggctggcctc

SEQ ID NO: 6023621 - DNA, 21 bp, Homo sapiens
caggatgggggctggcctctg

SEQ ID NO: 6023622 - DNA, 23 bp, Homo sapiens
caggatggggtatggattctaaa

SEQ ID NO: 6023623 - DNA, 18 bp, Homo sapiens
caggatggggttctggaa

SEQ ID NO: 6023624 - DNA, 19 bp, Homo sapiens
caggatggggttctggaaa

SEQ ID NO: 6023625 - DNA, 17 bp, Homo sapiens
caggatgggtgaaacca

SEQ ID NO: 6023626 - DNA, 14 bp, Homo sapiens
caggatggtaattc

SEQ ID NO: 6023627 - DNA, 18 bp, Homo sapiens
caggatggtctccatctc

SEQ ID NO: 6023628 - DNA, 19 bp, Homo sapiens
caggatggtctcgatctcc

SEQ ID NO: 6023629 - DNA, 22 bp, Homo sapiens
caggatggtctcgatctcctga

SEQ ID NO: 6023630 - DNA, 13 bp, Homo sapiens
caggatggtctgg

SEQ ID NO: 6023631 - DNA, 15 bp, Homo sapiens
caggatggtgcagga

SEQ ID NO: 6023632 - DNA, 21 bp, Homo sapiens
caggatggtggcaggaaaatg

SEQ ID NO: 6023633 - DNA, 20 bp, Homo sapiens
caggatggtgggcaggatct

SEQ ID NO: 6023634 - DNA, 21 bp, Homo sapiens
caggatggtgttactgcagtt

SEQ ID NO: 6023635 - DNA, 22 bp, Homo sapiens
caggatgtagttctgccaggca

SEQ ID NO: 6023636 - DNA, 20 bp, Homo sapiens
caggatgtcctttgtgtcca

SEQ ID NO: 6023637 - DNA, 14 bp, Homo sapiens
caggatgtggcact

SEQ ID NO: 6023638 - DNA, 23 bp, Homo sapiens
caggatgtggcactgcttgagga

SEQ ID NO: 6023639 - DNA, 18 bp, Homo sapiens
caggatgtgtttgctttc

SEQ ID NO: 6023640 - DNA, 20 bp, Homo sapiens
caggatgtgtttgctttctg

SEQ ID NO: 6023641 - DNA, 21 bp, Homo sapiens
caggatgttcaacttaatgaa

SEQ ID NO: 6023642 - DNA, 22 bp, Homo sapiens
caggatgttcaacttaatgaag

SEQ ID NO: 6023643 - DNA, 23 bp, Homo sapiens
caggatgttcaacttaatgaaga

SEQ ID NO: 6023644 - DNA, 17 bp, Homo sapiens
caggattcagccggagg

SEQ ID NO: 6023645 - DNA, 13 bp, Homo sapiens
caggattcaggcc

SEQ ID NO: 6023646 - DNA, 15 bp, Homo sapiens
caggattcaggcctc

SEQ ID NO: 6023647 - DNA, 16 bp, Homo sapiens
caggattcaggcctct

SEQ ID NO: 6023648 - DNA, 19 bp, Homo sapiens
caggattcaggcctctgag

SEQ ID NO: 6023649 - DNA, 23 bp, Homo sapiens
caggattccagttgcgtgtctgt

SEQ ID NO: 6023650 - DNA, 14 bp, Homo sapiens
caggattcccagag

SEQ ID NO: 6023651 - DNA, 16 bp, Homo sapiens
caggattcccagagag

SEQ ID NO: 6023652 - DNA, 17 bp, Homo sapiens
caggattcccagagaga

SEQ ID NO: 6023653 - DNA, 20 bp, Homo sapiens
caggattcccttctgggctt

SEQ ID NO: 6023654 - DNA, 20 bp, Homo sapiens
caggattcctcttttctctg

SEQ ID NO: 6023655 - DNA, 14 bp, Homo sapiens
caggattctctgca

SEQ ID NO: 6023656 - DNA, 16 bp, Homo sapiens
caggattctctgcagc

SEQ ID NO: 6023657 - DNA, 17 bp, Homo sapiens
caggattctctgcagcc

SEQ ID NO: 6023658 - DNA, 18 bp, Homo sapiens
caggattctgacagagca

SEQ ID NO: 6023659 - DNA, 12 bp, Homo sapiens
caggattctgca

SEQ ID NO: 6023660 - DNA, 17 bp, Homo sapiens
caggattcttcctccct

SEQ ID NO: 6023661 - DNA, 18 bp, Homo sapiens
caggattcttcctccctc

SEQ ID NO: 6023662 - DNA, 12 bp, Homo sapiens
caggattgagca

SEQ ID NO: 6023663 - DNA, 16 bp, Homo sapiens
caggattgcaggtgcc

SEQ ID NO: 6023664 - DNA, 21 bp, Homo sapiens
caggattgcaggtgcctggct

SEQ ID NO: 6023665 - DNA, 13 bp, Homo sapiens
caggattgcgaga

SEQ ID NO: 6023666 - DNA, 16 bp, Homo sapiens
caggattgcgagagat

SEQ ID NO: 6023667 - DNA, 18 bp, Homo sapiens
caggattgcgagagatgt

SEQ ID NO: 6023668 - DNA, 20 bp, Homo sapiens
caggattgcgagagatgtgt

SEQ ID NO: 6023669 - DNA, 13 bp, Homo sapiens
caggattggcctg

SEQ ID NO: 6023670 - DNA, 18 bp, Homo sapiens
caggattggcctgtgtct

SEQ ID NO: 6023671 - DNA, 19 bp, Homo sapiens
caggattgtacgtgggaga

SEQ ID NO: 6023672 - DNA, 20 bp, Homo sapiens
caggattgtacgtgggagag

SEQ ID NO: 6023673 - DNA, 21 bp, Homo sapiens
caggattgtacgtgggagagg

SEQ ID NO: 6023674 - DNA, 21 bp, Homo sapiens
caggattgtccacaaatgtcc

SEQ ID NO: 6023675 - DNA, 19 bp, Homo sapiens
caggattgtctgctgcctc

SEQ ID NO: 6023676 - DNA, 22 bp, Homo sapiens
caggattgtctgctgcctccaa

SEQ ID NO: 6023677 - DNA, 15 bp, Homo sapiens
caggatttaaaaact

SEQ ID NO: 6023678 - DNA, 18 bp, Homo sapiens
caggatttaaaaactgga

SEQ ID NO: 6023679 - DNA, 19 bp, Homo sapiens
caggatttaaaaactggaa

SEQ ID NO: 6023680 - DNA, 16 bp, Homo sapiens
caggatttaggcctta

SEQ ID NO: 6023681 - DNA, 19 bp, Homo sapiens
caggatttaggccttaaca

SEQ ID NO: 6023682 - DNA, 22 bp, Homo sapiens
caggatttatacatacagagat

SEQ ID NO: 6023683 - DNA, 14 bp, Homo sapiens
caggatttcattga

SEQ ID NO: 6023684 - DNA, 18 bp, Homo sapiens
caggatttcattgactga

SEQ ID NO: 6023685 - DNA, 22 bp, Homo sapiens
caggatttgcacagaagcacat

SEQ ID NO: 6023686 - DNA, 17 bp, Homo sapiens
caggatttgctgggaga

SEQ ID NO: 6023687 - DNA, 14 bp, Homo sapiens
caggatttggccac

SEQ ID NO: 6023688 - DNA, 14 bp, Homo sapiens
caggatttggtttt

SEQ ID NO: 6023689 - DNA, 20 bp, Homo sapiens
caggatttgttctctgtcca

SEQ ID NO: 6023690 - DNA, 19 bp, Homo sapiens
caggatttttagagcatta

SEQ ID NO: 6023691 - DNA, 23 bp, Homo sapiens
caggatttttagagcattaaaat

SEQ ID NO: 6023692 - DNA, 18 bp, Homo sapiens
caggcaaaaaagggacag

SEQ ID NO: 6023693 - DNA, 19 bp, Homo sapiens
caggcaaaaaagggacagc

SEQ ID NO: 6023694 - DNA, 17 bp, Homo sapiens
caggcaaaacacgcaag

SEQ ID NO: 6023695 - DNA, 17 bp, Homo sapiens
caggcaaagaaaatgaa

SEQ ID NO: 6023696 - DNA, 17 bp, Homo sapiens
caggcaaagaggtgctg

SEQ ID NO: 6023697 - DNA, 23 bp, Homo sapiens
caggcaaagaggtgctgctttgc

SEQ ID NO: 6023698 - DNA, 15 bp, Homo sapiens
caggcaaagctggag

SEQ ID NO: 6023699 - DNA, 23 bp, Homo sapiens
caggcaacattacaaacaaagga

SEQ ID NO: 6023700 - DNA, 15 bp, Homo sapiens
caggcaacctcccat

SEQ ID NO: 6023701 - DNA, 22 bp, Homo sapiens
caggcaacgcacaaaacagaaa

SEQ ID NO: 6023702 - DNA, 21 bp, Homo sapiens
caggcaacttcagtcctggga

SEQ ID NO: 6023703 - DNA, 13 bp, Homo sapiens
caggcaagaaaag

SEQ ID NO: 6023704 - DNA, 21 bp, Homo sapiens
caggcaagaaagcttccttca

SEQ ID NO: 6023705 - DNA, 16 bp, Homo sapiens
caggcaagcacctcct

SEQ ID NO: 6023706 - DNA, 19 bp, Homo sapiens
caggcaagcccctcagccc

SEQ ID NO: 6023707 - DNA, 22 bp, Homo sapiens
caggcaagcccctcagcccttg

SEQ ID NO: 6023708 - DNA, 24 bp, Homo sapiens
caggcaagcccctcagcccttgcc

SEQ ID NO: 6023709 - DNA, 10 bp, Homo sapiens
caggcaagga

SEQ ID NO: 6023710 - DNA, 15 bp, Homo sapiens
caggcaaggaggagg

SEQ ID NO: 6023711 - DNA, 23 bp, Homo sapiens
caggcaaggctgacttctctgaa

SEQ ID NO: 6023712 - DNA, 14 bp, Homo sapiens
caggcaaggctgtg

SEQ ID NO: 6023713 - DNA, 17 bp, Homo sapiens
caggcaaggctgtggac

SEQ ID NO: 6023714 - DNA, 17 bp, Homo sapiens
caggcaaggtctggcct

SEQ ID NO: 6023715 - DNA, 23 bp, Homo sapiens
caggcaatagtgttgaggagggg

SEQ ID NO: 6023716 - DNA, 21 bp, Homo sapiens
caggcaatgactgcgcagagt

SEQ ID NO: 6023717 - DNA, 17 bp, Homo sapiens
caggcaatgccctgcgg

SEQ ID NO: 6023718 - DNA, 24 bp, Homo sapiens
caggcaatgccctgcggctctgga

SEQ ID NO: 6023719 - DNA, 14 bp, Homo sapiens
caggcaatgctggc

SEQ ID NO: 6023720 - DNA, 20 bp, Homo sapiens
caggcaatgctggctgttgg

SEQ ID NO: 6023721 - DNA, 15 bp, Homo sapiens
caggcaatggcctaa

SEQ ID NO: 6023722 - DNA, 16 bp, Homo sapiens
caggcacaaaatgtga

SEQ ID NO: 6023723 - DNA, 23 bp, Homo sapiens
caggcacaaaatgtgacatcttt

SEQ ID NO: 6023724 - DNA, 21 bp, Homo sapiens
caggcacaacttcagcagggg

SEQ ID NO: 6023725 - DNA, 23 bp, Homo sapiens
caggcacacaaggggcccttgga

SEQ ID NO: 6023726 - DNA, 13 bp, Homo sapiens
caggcacacacag

SEQ ID NO: 6023727 - DNA, 14 bp, Homo sapiens
caggcacacactgt

SEQ ID NO: 6023728 - DNA, 12 bp, Homo sapiens
caggcacacagc

SEQ ID NO: 6023729 - DNA, 21 bp, Homo sapiens
caggcacacagcagcccccca

SEQ ID NO: 6023730 - DNA, 20 bp, Homo sapiens
caggcacacagctactctcc

SEQ ID NO: 6023731 - DNA, 15 bp, Homo sapiens
caggcacacttcttc

SEQ ID NO: 6023732 - DNA, 20 bp, Homo sapiens
caggcacagaggaggtcagc

SEQ ID NO: 6023733 - DNA, 18 bp, Homo sapiens
caggcacagcagctgcag

SEQ ID NO: 6023734 - DNA, 13 bp, Homo sapiens
caggcacagctga

SEQ ID NO: 6023735 - DNA, 16 bp, Homo sapiens
caggcacagctgagtt

SEQ ID NO: 6023736 - DNA, 15 bp, Homo sapiens
caggcacaggcaggg

SEQ ID NO: 6023737 - DNA, 16 bp, Homo sapiens
caggcacaggcagggc

SEQ ID NO: 6023738 - DNA, 14 bp, Homo sapiens
caggcacagggccc

SEQ ID NO: 6023739 - DNA, 15 bp, Homo sapiens
caggcacagggcccg

SEQ ID NO: 6023740 - DNA, 18 bp, Homo sapiens
caggcacagggcccgcag

SEQ ID NO: 6023741 - DNA, 12 bp, Homo sapiens
caggcacaggtc

SEQ ID NO: 6023742 - DNA, 20 bp, Homo sapiens
caggcacatacacctcgtca

SEQ ID NO: 6023743 - DNA, 13 bp, Homo sapiens
caggcacatggct

SEQ ID NO: 6023744 - DNA, 23 bp, Homo sapiens
caggcacatggctgggggaggga

SEQ ID NO: 6023745 - DNA, 15 bp, Homo sapiens
caggcaccaaaagaa

SEQ ID NO: 6023746 - DNA, 17 bp, Homo sapiens
caggcaccaccaggagc

SEQ ID NO: 6023747 - DNA, 13 bp, Homo sapiens
caggcaccagcat

SEQ ID NO: 6023748 - DNA, 17 bp, Homo sapiens
caggcaccagcatccac

SEQ ID NO: 6023749 - DNA, 20 bp, Homo sapiens
caggcaccaggactagggct

SEQ ID NO: 6023750 - DNA, 22 bp, Homo sapiens
caggcaccatctgccaatgcca

SEQ ID NO: 6023751 - DNA, 18 bp, Homo sapiens
caggcaccatgctgggcc

SEQ ID NO: 6023752 - DNA, 22 bp, Homo sapiens
caggcacccaccatcatgtctg

SEQ ID NO: 6023753 - DNA, 23 bp, Homo sapiens
caggcacccaccatcatgtctgg

SEQ ID NO: 6023754 - DNA, 15 bp, Homo sapiens
caggcacccatgtgg

SEQ ID NO: 6023755 - DNA, 23 bp, Homo sapiens
caggcacccatgtgggcgcccac

SEQ ID NO: 6023756 - DNA, 15 bp, Homo sapiens
caggcaccccctgga

SEQ ID NO: 6023757 - DNA, 17 bp, Homo sapiens
caggcacccgtccccac

SEQ ID NO: 6023758 - DNA, 14 bp, Homo sapiens
caggcaccctcagg

SEQ ID NO: 6023759 - DNA, 16 bp, Homo sapiens
caggcaccctcaggga

SEQ ID NO: 6023760 - DNA, 13 bp, Homo sapiens
caggcacccttct

SEQ ID NO: 6023761 - DNA, 21 bp, Homo sapiens
caggcacccttctttcctctt

SEQ ID NO: 6023762 - DNA, 17 bp, Homo sapiens
caggcaccgagaatgtt

SEQ ID NO: 6023763 - DNA, 20 bp, Homo sapiens
caggcaccgccacgtcccag

SEQ ID NO: 6023764 - DNA, 22 bp, Homo sapiens
caggcaccgccacgtcccagca

SEQ ID NO: 6023765 - DNA, 23 bp, Homo sapiens
caggcaccgccagagtgtcctgc

SEQ ID NO: 6023766 - DNA, 16 bp, Homo sapiens
caggcaccgcctgccc

SEQ ID NO: 6023767 - DNA, 15 bp, Homo sapiens
caggcaccgggctgg

SEQ ID NO: 6023768 - DNA, 22 bp, Homo sapiens
caggcaccgggctggctgcttg

SEQ ID NO: 6023769 - DNA, 14 bp, Homo sapiens
caggcacctaccac

SEQ ID NO: 6023770 - DNA, 16 bp, Homo sapiens
caggcacctcacagaa

SEQ ID NO: 6023771 - DNA, 12 bp, Homo sapiens
caggcacctggc

SEQ ID NO: 6023772 - DNA, 16 bp, Homo sapiens
catggaaaaatcctgt

SEQ ID NO: 6023773 - DNA, 14 bp, Homo sapiens
catggaaaaatggt

SEQ ID NO: 6023774 - DNA, 15 bp, Homo sapiens
catggaaaaatggtt

SEQ ID NO: 6023775 - DNA, 16 bp, Homo sapiens
catggaaaaatggttg

SEQ ID NO: 6023776 - DNA, 17 bp, Homo sapiens
catggaaaagcccagtg

SEQ ID NO: 6023777 - DNA, 21 bp, Homo sapiens
catggaaaatgtcctgtggtg

SEQ ID NO: 6023778 - DNA, 17 bp, Homo sapiens
catggaaacctgaaaaa

SEQ ID NO: 6023779 - DNA, 20 bp, Homo sapiens
catggaaatagaatgaatag

SEQ ID NO: 6023780 - DNA, 15 bp, Homo sapiens
catggaaatttaaag

SEQ ID NO: 6023781 - DNA, 16 bp, Homo sapiens
catggaaatttaaagc

SEQ ID NO: 6023782 - DNA, 16 bp, Homo sapiens
catggaacaaagcatg

SEQ ID NO: 6023783 - DNA, 15 bp, Homo sapiens
catggaacacttcga

SEQ ID NO: 6023784 - DNA, 23 bp, Homo sapiens
catggaacagccctgcacgccca

SEQ ID NO: 6023785 - DNA, 14 bp, Homo sapiens
catggaacagtgta

SEQ ID NO: 6023786 - DNA, 20 bp, Homo sapiens
catggaacgcgttgaaattg

SEQ ID NO: 6023787 - DNA, 23 bp, Homo sapiens
catggaacgcgttgaaattgtaa

SEQ ID NO: 6023788 - DNA, 21 bp, Homo sapiens
catggaactcattcctgcctg

SEQ ID NO: 6023789 - DNA, 18 bp, Homo sapiens
catggaacttaaaacata

SEQ ID NO: 6023790 - DNA, 20 bp, Homo sapiens
catggaagaggctacagggc

SEQ ID NO: 6023791 - DNA, 18 bp, Homo sapiens
catggaagagggagggtc

SEQ ID NO: 6023792 - DNA, 16 bp, Homo sapiens
catggaagctggcagg

SEQ ID NO: 6023793 - DNA, 21 bp, Homo sapiens
catggaaggggcttctggacc

SEQ ID NO: 6023794 - DNA, 21 bp, Homo sapiens
catggaaggtgccagaaggaa

SEQ ID NO: 6023795 - DNA, 14 bp, Homo sapiens
catggaaggttaga

SEQ ID NO: 6023796 - DNA, 16 bp, Homo sapiens
catggaatcttgctgc

SEQ ID NO: 6023797 - DNA, 20 bp, Homo sapiens
catggaatcttgctgcaggc

SEQ ID NO: 6023798 - DNA, 18 bp, Homo sapiens
catggaatgactgaagac

SEQ ID NO: 6023799 - DNA, 15 bp, Homo sapiens
catggaatgagggtt

SEQ ID NO: 6023800 - DNA, 18 bp, Homo sapiens
catggaatgcttgaaaaa

SEQ ID NO: 6023801 - DNA, 21 bp, Homo sapiens
catggaatgcttgaaaaatgt

SEQ ID NO: 6023802 - DNA, 19 bp, Homo sapiens
catggaatggacatcctgt

SEQ ID NO: 6023803 - DNA, 14 bp, Homo sapiens
catggaatggttat

SEQ ID NO: 6023804 - DNA, 21 bp, Homo sapiens
catggaatggttataaaagtg

SEQ ID NO: 6023805 - DNA, 19 bp, Homo sapiens
catggaattcacaaagtaa

SEQ ID NO: 6023806 - DNA, 17 bp, Homo sapiens
catggaattggtttaaa

SEQ ID NO: 6023807 - DNA, 21 bp, Homo sapiens
catggaattggtttaaacttt

SEQ ID NO: 6023808 - DNA, 18 bp, Homo sapiens
catggaatttaatgctga

SEQ ID NO: 6023809 - DNA, 20 bp, Homo sapiens
catggaatttaatgctgaat

SEQ ID NO: 6023810 - DNA, 17 bp, Homo sapiens
catggacaaggagctgt

SEQ ID NO: 6023811 - DNA, 20 bp, Homo sapiens
catggacaatataaactgaa

SEQ ID NO: 6023812 - DNA, 18 bp, Homo sapiens
catggacaatggaccgga

SEQ ID NO: 6023813 - DNA, 14 bp, Homo sapiens
catggacacccctt

SEQ ID NO: 6023814 - DNA, 14 bp, Homo sapiens
catggacaccttgt

SEQ ID NO: 6023815 - DNA, 18 bp, Homo sapiens
catggacactacacccag

SEQ ID NO: 6023816 - DNA, 19 bp, Homo sapiens
catggacactacacccagc

SEQ ID NO: 6023817 - DNA, 21 bp, Homo sapiens
catggacactacacccagcaa

SEQ ID NO: 6023818 - DNA, 23 bp, Homo sapiens
catggacactacacccagcaata

SEQ ID NO: 6023819 - DNA, 13 bp, Homo sapiens
catggacagctga

SEQ ID NO: 6023820 - DNA, 14 bp, Homo sapiens
catggacagctgag

SEQ ID NO: 6023821 - DNA, 14 bp, Homo sapiens
catggacaggctgg

SEQ ID NO: 6023822 - DNA, 15 bp, Homo sapiens
catggacagggccag

SEQ ID NO: 6023823 - DNA, 18 bp, Homo sapiens
catggacagggccagggt

SEQ ID NO: 6023824 - DNA, 19 bp, Homo sapiens
catggacagggccagggtt

SEQ ID NO: 6023825 - DNA, 18 bp, Homo sapiens
catggacatgagtttaaa

SEQ ID NO: 6023826 - DNA, 18 bp, Homo sapiens
catggacatgggcagcaa

SEQ ID NO: 6023827 - DNA, 24 bp, Homo sapiens
catggacatgggcagcaattcacg

SEQ ID NO: 6023828 - DNA, 18 bp, Homo sapiens
catggacatttagaagaa

SEQ ID NO: 6023829 - DNA, 14 bp, Homo sapiens
catggaccactgtt

SEQ ID NO: 6023830 - DNA, 16 bp, Homo sapiens
catggaccactgtttc

SEQ ID NO: 6023831 - DNA, 23 bp, Homo sapiens
catggaccactgtttcttgcttg

SEQ ID NO: 6023832 - DNA, 12 bp, Homo sapiens
catggaccagca

SEQ ID NO: 6023833 - DNA, 17 bp, Homo sapiens
catggaccagcatctgg

SEQ ID NO: 6023834 - DNA, 22 bp, Homo sapiens
catggacccactacccttctcc

SEQ ID NO: 6023835 - DNA, 15 bp, Homo sapiens
catggacccggagct

SEQ ID NO: 6023836 - DNA, 22 bp, Homo sapiens
catggaccgaggttcccactct

SEQ ID NO: 6023837 - DNA, 16 bp, Homo sapiens
catggacgaatatgaa

SEQ ID NO: 6023838 - DNA, 19 bp, Homo sapiens
catggacgaatatgaatgt

SEQ ID NO: 6023839 - DNA, 20 bp, Homo sapiens
catggactccaggatcctcc

SEQ ID NO: 6023840 - DNA, 22 bp, Homo sapiens
catggactcgtaaagctgctag

SEQ ID NO: 6023841 - DNA, 19 bp, Homo sapiens
catggactctgtcctgaag

SEQ ID NO: 6023842 - DNA, 20 bp, Homo sapiens
catggactgttcatttgaaa

SEQ ID NO: 6023843 - DNA, 21 bp, Homo sapiens
catggactgttcatttgaaac

SEQ ID NO: 6023844 - DNA, 18 bp, Homo sapiens
catggactgttgccacca

SEQ ID NO: 6023845 - DNA, 14 bp, Homo sapiens
catggacttcacat

SEQ ID NO: 6023846 - DNA, 17 bp, Homo sapiens
catggacttgtatattt

SEQ ID NO: 6023847 - DNA, 22 bp, Homo sapiens
catggacttgtatatttgtaca

SEQ ID NO: 6023848 - DNA, 11 bp, Homo sapiens
catggactttg

SEQ ID NO: 6023849 - DNA, 19 bp, Homo sapiens
catggactttggaaaatat

SEQ ID NO: 6023850 - DNA, 15 bp, Homo sapiens
catggagaaaccctg

SEQ ID NO: 6023851 - DNA, 17 bp, Homo sapiens
catggagaaaccctgtc

SEQ ID NO: 6023852 - DNA, 15 bp, Homo sapiens
catggagaaagctga

SEQ ID NO: 6023853 - DNA, 17 bp, Homo sapiens
catggagaaagctgact

SEQ ID NO: 6023854 - DNA, 21 bp, Homo sapiens
catggagaaagctgacttggc

SEQ ID NO: 6023855 - DNA, 22 bp, Homo sapiens
catggagaaagctgacttggct

SEQ ID NO: 6023856 - DNA, 12 bp, Homo sapiens
catggagaagtt

SEQ ID NO: 6023857 - DNA, 21 bp, Homo sapiens
catggagaagttgccaagagt

SEQ ID NO: 6023858 - DNA, 22 bp, Homo sapiens
catggagaagttgccaagagtt

SEQ ID NO: 6023859 - DNA, 20 bp, Homo sapiens
catggagacaataaacagct

SEQ ID NO: 6023860 - DNA, 21 bp, Homo sapiens
catggagacaataaacagctg

SEQ ID NO: 6023861 - DNA, 14 bp, Homo sapiens
catggagacagcag

SEQ ID NO: 6023862 - DNA, 16 bp, Homo sapiens
catggagacgcatttc

SEQ ID NO: 6023863 - DNA, 15 bp, Homo sapiens
catggagactcctgc

SEQ ID NO: 6023864 - DNA, 16 bp, Homo sapiens
catggagactcctgcc

SEQ ID NO: 6023865 - DNA, 18 bp, Homo sapiens
catggagactctgagagc

SEQ ID NO: 6023866 - DNA, 15 bp, Homo sapiens
catggagagagactc

SEQ ID NO: 6023867 - DNA, 16 bp, Homo sapiens
catggagagcctctta

SEQ ID NO: 6023868 - DNA, 14 bp, Homo sapiens
catggagagctaga

SEQ ID NO: 6023869 - DNA, 15 bp, Homo sapiens
catggagagctgttc

SEQ ID NO: 6023870 - DNA, 20 bp, Homo sapiens
catggagaggtttgtcaaca

SEQ ID NO: 6023871 - DNA, 22 bp, Homo sapiens
catggagaggtttgtcaacaca

SEQ ID NO: 6023872 - DNA, 15 bp, Homo sapiens
catggagatctgaag

SEQ ID NO: 6023873 - DNA, 17 bp, Homo sapiens
catggagattctcataa

SEQ ID NO: 6023874 - DNA, 13 bp, Homo sapiens
catggagcagccc

SEQ ID NO: 6023875 - DNA, 17 bp, Homo sapiens
catggagcagcccccaa

SEQ ID NO: 6023876 - DNA, 17 bp, Homo sapiens
catggagccagctccct

SEQ ID NO: 6023877 - DNA, 15 bp, Homo sapiens
catggagccccagcc

SEQ ID NO: 6023878 - DNA, 22 bp, Homo sapiens
catggagcctacctctgtctga

SEQ ID NO: 6023879 - DNA, 22 bp, Homo sapiens
catggagctataactaagcatc

SEQ ID NO: 6023880 - DNA, 13 bp, Homo sapiens
catggagctcagg

SEQ ID NO: 6023881 - DNA, 12 bp, Homo sapiens
catggagctgtc

SEQ ID NO: 6023882 - DNA, 14 bp, Homo sapiens
catggagctgtcac

SEQ ID NO: 6023883 - DNA, 16 bp, Homo sapiens
catggagctgtcacct

SEQ ID NO: 6023884 - DNA, 14 bp, Homo sapiens
catggaggagacag

SEQ ID NO: 6023885 - DNA, 14 bp, Homo sapiens
catggaggagcttg

SEQ ID NO: 6023886 - DNA, 17 bp, Homo sapiens
catggaggaggaagacc

SEQ ID NO: 6023887 - DNA, 19 bp, Homo sapiens
catggaggatggtgtcctg

SEQ ID NO: 6023888 - DNA, 15 bp, Homo sapiens
catggaggcagatgc

SEQ ID NO: 6023889 - DNA, 17 bp, Homo sapiens
catggaggcagatgccc

SEQ ID NO: 6023890 - DNA, 19 bp, Homo sapiens
catggaggcagatgccctt

SEQ ID NO: 6023891 - DNA, 18 bp, Homo sapiens
catggaggccctcctgtg

SEQ ID NO: 6023892 - DNA, 20 bp, Homo sapiens
catggaggccctcctgtgct

SEQ ID NO: 6023893 - DNA, 17 bp, Homo sapiens
catggaggcgccttcct

SEQ ID NO: 6023894 - DNA, 19 bp, Homo sapiens
catggaggcgccttcctgg

SEQ ID NO: 6023895 - DNA, 20 bp, Homo sapiens
catggaggcgccttcctggg

SEQ ID NO: 6023896 - DNA, 23 bp, Homo sapiens
catggagggtatactgaggggtc

SEQ ID NO: 6023897 - DNA, 17 bp, Homo sapiens
catggaggtttgaagat

SEQ ID NO: 6023898 - DNA, 22 bp, Homo sapiens
catggagtagaggtactagaat

SEQ ID NO: 6023899 - DNA, 20 bp, Homo sapiens
catggagtagagtcaggaga

SEQ ID NO: 6023900 - DNA, 15 bp, Homo sapiens
catggagtagcctgg

SEQ ID NO: 6023901 - DNA, 23 bp, Homo sapiens
catggagtgagcagtagaagcct

SEQ ID NO: 6023902 - DNA, 15 bp, Homo sapiens
catggagtggcagcc

SEQ ID NO: 6023903 - DNA, 17 bp, Homo sapiens
catggagtggcagccca

SEQ ID NO: 6023904 - DNA, 19 bp, Homo sapiens
catggagtggcagcccagc

SEQ ID NO: 6023905 - DNA, 20 bp, Homo sapiens
catggagtggcagcccagcc

SEQ ID NO: 6023906 - DNA, 17 bp, Homo sapiens
catggagtgtgtattgt

SEQ ID NO: 6023907 - DNA, 22 bp, Homo sapiens
catggagtgtgtattgttccca

SEQ ID NO: 6023908 - DNA, 15 bp, Homo sapiens
catggagtgtttgac

SEQ ID NO: 6023909 - DNA, 21 bp, Homo sapiens
catggagtgtttgacgaagaa

SEQ ID NO: 6023910 - DNA, 19 bp, Homo sapiens
catggatacttcctgggtc

SEQ ID NO: 6023911 - DNA, 19 bp, Homo sapiens
catggatagctcagaggta

SEQ ID NO: 6023912 - DNA, 18 bp, Homo sapiens
catggatatagttttact

SEQ ID NO: 6023913 - DNA, 23 bp, Homo sapiens
catggatatgttatactgaacca

SEQ ID NO: 6023914 - DNA, 21 bp, Homo sapiens
catggatcaaccaagttacac

SEQ ID NO: 6023915 - DNA, 13 bp, Homo sapiens
catggatgagcac

SEQ ID NO: 6023916 - DNA, 13 bp, Homo sapiens
catggatgattct

SEQ ID NO: 6023917 - DNA, 14 bp, Homo sapiens
catggatgattctt

SEQ ID NO: 6023918 - DNA, 16 bp, Homo sapiens
catggatgattctttt

SEQ ID NO: 6023919 - DNA, 17 bp, Homo sapiens
catggatgattcttttc

SEQ ID NO: 6023920 - DNA, 13 bp, Homo sapiens
catggatgcattt

SEQ ID NO: 6023921 - DNA, 19 bp, Homo sapiens
catggatgcatttcaaatg

SEQ ID NO: 6023922 - DNA, 22 bp, Homo sapiens
catggatgcatttcaaatgtta

SEQ ID NO: 6023923 - DNA, 18 bp, Homo sapiens
catggatgcgaggaccac

SEQ ID NO: 6023924 - DNA, 20 bp, Homo sapiens
catggatgcgaggaccactt

SEQ ID NO: 6023925 - DNA, 13 bp, Homo sapiens
catggatggctca

SEQ ID NO: 6023926 - DNA, 19 bp, Homo sapiens
catggatgggggaactcag

SEQ ID NO: 6023927 - DNA, 12 bp, Homo sapiens
catggatgtttt

SEQ ID NO: 6023928 - DNA, 19 bp, Homo sapiens
catggattacttctctata

SEQ ID NO: 6023929 - DNA, 22 bp, Homo sapiens
catggattcacccccctctgct

SEQ ID NO: 6023930 - DNA, 17 bp, Homo sapiens
catggattccaaagcat

SEQ ID NO: 6023931 - DNA, 18 bp, Homo sapiens
catggattccaaagcatt

SEQ ID NO: 6023932 - DNA, 19 bp, Homo sapiens
catggattccaaagcattt

SEQ ID NO: 6023933 - DNA, 22 bp, Homo sapiens
catggattccaaagcattttca

SEQ ID NO: 6023934 - DNA, 22 bp, Homo sapiens
catggattgattcagtcttctg

SEQ ID NO: 6023935 - DNA, 23 bp, Homo sapiens
catggattgattcagtcttctgg

SEQ ID NO: 6023936 - DNA, 17 bp, Homo sapiens
catggattgtacatatt

SEQ ID NO: 6023937 - DNA, 23 bp, Homo sapiens
catggatttcctttgacctctca

SEQ ID NO: 6023938 - DNA, 12 bp, Homo sapiens
catggatttctt

SEQ ID NO: 6023939 - DNA, 18 bp, Homo sapiens
catggattttggcagggc

SEQ ID NO: 6023940 - DNA, 19 bp, Homo sapiens
catggattttggcagggcg

SEQ ID NO: 6023941 - DNA, 14 bp, Homo sapiens
catggatttttaca

SEQ ID NO: 6023942 - DNA, 20 bp, Homo sapiens
catggcaaatcaggggccag

SEQ ID NO: 6023943 - DNA, 16 bp, Homo sapiens
catggcaaatcctgtc

SEQ ID NO: 6023944 - DNA, 19 bp, Homo sapiens
catggcaaatgggcagctc

SEQ ID NO: 6023945 - DNA, 22 bp, Homo sapiens
catggcaaggggtctccttgga

SEQ ID NO: 6023946 - DNA, 13 bp, Homo sapiens
catggcaagtggg

SEQ ID NO: 6023947 - DNA, 17 bp, Homo sapiens
catggcaagtggggctg

SEQ ID NO: 6023948 - DNA, 14 bp, Homo sapiens
catggcaattctgg

SEQ ID NO: 6023949 - DNA, 18 bp, Homo sapiens
catggcacactgccctct

SEQ ID NO: 6023950 - DNA, 22 bp, Homo sapiens
catggcacaggcccgccctctg

SEQ ID NO: 6023951 - DNA, 18 bp, Homo sapiens
catggcaccagccccctg

SEQ ID NO: 6023952 - DNA, 23 bp, Homo sapiens
catggcacctgtcgcccagtgcc

SEQ ID NO: 6023953 - DNA, 21 bp, Homo sapiens
catggcacctttgagagaggg

SEQ ID NO: 6023954 - DNA, 16 bp, Homo sapiens
catggcactccctcca

SEQ ID NO: 6023955 - DNA, 18 bp, Homo sapiens
catggcacttgcatctgt

SEQ ID NO: 6023956 - DNA, 19 bp, Homo sapiens
catggcacttgcatctgtg

SEQ ID NO: 6023957 - DNA, 17 bp, Homo sapiens
catggcagaagcgtctc

SEQ ID NO: 6023958 - DNA, 20 bp, Homo sapiens
catggcagaagcgtctccct

SEQ ID NO: 6023959 - DNA, 22 bp, Homo sapiens
catggcagatgatttgggcaga

SEQ ID NO: 6023960 - DNA, 13 bp, Homo sapiens
catggcagcagcc

SEQ ID NO: 6023961 - DNA, 18 bp, Homo sapiens
catggcagcagccaggga

SEQ ID NO: 6023962 - DNA, 18 bp, Homo sapiens
catggcagcatgcgatgt

SEQ ID NO: 6023963 - DNA, 20 bp, Homo sapiens
catggcagcatggagagcct

SEQ ID NO: 6023964 - DNA, 18 bp, Homo sapiens
catggcagctcctgacct

SEQ ID NO: 6023965 - DNA, 19 bp, Homo sapiens
catggcagctcctgacctt

SEQ ID NO: 6023966 - DNA, 12 bp, Homo sapiens
catggcagctgg

SEQ ID NO: 6023967 - DNA, 19 bp, Homo sapiens
catggcagctgggcccaca

SEQ ID NO: 6023968 - DNA, 21 bp, Homo sapiens
catggcagctgggcccacagc

SEQ ID NO: 6023969 - DNA, 13 bp, Homo sapiens
catggcagctggt

SEQ ID NO: 6023970 - DNA, 20 bp, Homo sapiens
catggcagctgtttctcatg

SEQ ID NO: 6023971 - DNA, 12 bp, Homo sapiens
catggcaggagt

SEQ ID NO: 6023972 - DNA, 17 bp, Homo sapiens
catggcaggagtctctg

SEQ ID NO: 6023973 - DNA, 22 bp, Homo sapiens
catggcaggagtctctgccagt

SEQ ID NO: 6023974 - DNA, 16 bp, Homo sapiens
catggcagggccaggc

SEQ ID NO: 6023975 - DNA, 14 bp, Homo sapiens
catggcagggggct

SEQ ID NO: 6023976 - DNA, 17 bp, Homo sapiens
catggcagggggctgct

SEQ ID NO: 6023977 - DNA, 18 bp, Homo sapiens
catggcagggggctgctg

SEQ ID NO: 6023978 - DNA, 12 bp, Homo sapiens
catggcagtggg

SEQ ID NO: 6023979 - DNA, 18 bp, Homo sapiens
catggcatcacctccacc

SEQ ID NO: 6023980 - DNA, 19 bp, Homo sapiens
catggcatcacctccacca

SEQ ID NO: 6023981 - DNA, 19 bp, Homo sapiens
catggcatcctccagcccc

SEQ ID NO: 6023982 - DNA, 17 bp, Homo sapiens
catggcatgttttgtca

SEQ ID NO: 6023983 - DNA, 15 bp, Homo sapiens
catggccaaggggcc

SEQ ID NO: 6023984 - DNA, 22 bp, Homo sapiens
catggccaatagtcatatgtga

SEQ ID NO: 6023985 - DNA, 19 bp, Homo sapiens
catggccacaaagggacac

SEQ ID NO: 6023986 - DNA, 18 bp, Homo sapiens
catggccacactgtgaca

SEQ ID NO: 6023987 - DNA, 14 bp, Homo sapiens
catggccacagcca

SEQ ID NO: 6023988 - DNA, 12 bp, Homo sapiens
catggccacccc

SEQ ID NO: 6023989 - DNA, 20 bp, Homo sapiens
catggccagcagcacctgcc

SEQ ID NO: 6023990 - DNA, 23 bp, Homo sapiens
catggccagcagcacctgcccta

SEQ ID NO: 6023991 - DNA, 16 bp, Homo sapiens
catggccagctaattt

SEQ ID NO: 6023992 - DNA, 21 bp, Homo sapiens
catggccagctggaggcaggg

SEQ ID NO: 6023993 - DNA, 14 bp, Homo sapiens
catggccaggtggc

SEQ ID NO: 6023994 - DNA, 17 bp, Homo sapiens
catggccatagaggccc

SEQ ID NO: 6023995 - DNA, 22 bp, Homo sapiens
catggccatagaggcccaggca

SEQ ID NO: 6023996 - DNA, 15 bp, Homo sapiens
catggccatcttctt

SEQ ID NO: 6023997 - DNA, 19 bp, Homo sapiens
catggccatcttctttctt

SEQ ID NO: 6023998 - DNA, 18 bp, Homo sapiens
catggcccaaatccagtg

SEQ ID NO: 6023999 - DNA, 13 bp, Homo sapiens
catggcccagcag

SEQ ID NO: 6024000 - DNA, 17 bp, Homo sapiens
catggcccagcctggag

SEQ ID NO: 6024001 - DNA, 21 bp, Homo sapiens
catggcccattggagcacctg

SEQ ID NO: 6024002 - DNA, 13 bp, Homo sapiens
catggccccagct

SEQ ID NO: 6024003 - DNA, 14 bp, Homo sapiens
catggccccagctg

SEQ ID NO: 6024004 - DNA, 20 bp, Homo sapiens
catggccccagctggctggg

SEQ ID NO: 6024005 - DNA, 13 bp, Homo sapiens
catggcccccaat

SEQ ID NO: 6024006 - DNA, 16 bp, Homo sapiens
catggcccccaataaa

SEQ ID NO: 6024007 - DNA, 17 bp, Homo sapiens
catggcccccaataaag

SEQ ID NO: 6024008 - DNA, 22 bp, Homo sapiens
catggcccccaataaaggcagc

SEQ ID NO: 6024009 - DNA, 16 bp, Homo sapiens
catggcccctccagga

SEQ ID NO: 6024010 - DNA, 18 bp, Homo sapiens
catggcccctccaggaac

SEQ ID NO: 6024011 - DNA, 13 bp, Homo sapiens
catggcccctctg

SEQ ID NO: 6024012 - DNA, 15 bp, Homo sapiens
catggcccctgtgag

SEQ ID NO: 6024013 - DNA, 22 bp, Homo sapiens
catggccctcccagtacctcct

SEQ ID NO: 6024014 - DNA, 17 bp, Homo sapiens
catggccctgctgcccc

SEQ ID NO: 6024015 - DNA, 19 bp, Homo sapiens
catggccctgctgcccctc

SEQ ID NO: 6024016 - DNA, 12 bp, Homo sapiens
catggccctggg

SEQ ID NO: 6024017 - DNA, 14 bp, Homo sapiens
catggccctgggcg

SEQ ID NO: 6024018 - DNA, 19 bp, Homo sapiens
catggccctgtcccaggcc

SEQ ID NO: 6024019 - DNA, 14 bp, Homo sapiens
catggccctgtgct

SEQ ID NO: 6024020 - DNA, 20 bp, Homo sapiens
catggccgaagccccttgga

SEQ ID NO: 6024021 - DNA, 21 bp, Homo sapiens
catggccgaagccccttggag

SEQ ID NO: 6024022 - DNA, 16 bp, Homo sapiens
catggccggctttcag

SEQ ID NO: 6024023 - DNA, 20 bp, Homo sapiens
catggccggctttcaggagc

SEQ ID NO: 6024024 - DNA, 14 bp, Homo sapiens
catggccgggccct

SEQ ID NO: 6024025 - DNA, 21 bp, Homo sapiens
catggccgggccctctgtagc

SEQ ID NO: 6024026 - DNA, 19 bp, Homo sapiens
catggcctaatcacctttc

SEQ ID NO: 6024027 - DNA, 19 bp, Homo sapiens
catggcctatgcacatatg

SEQ ID NO: 6024028 - DNA, 20 bp, Homo sapiens
catggcctattatattaaaa

SEQ ID NO: 6024029 - DNA, 21 bp, Homo sapiens
catggcctattatattaaaat

SEQ ID NO: 6024030 - DNA, 13 bp, Homo sapiens
catggcctcagat

SEQ ID NO: 6024031 - DNA, 16 bp, Homo sapiens
catggcctcagccctg

SEQ ID NO: 6024032 - DNA, 19 bp, Homo sapiens
catggcctcagccctgctc

SEQ ID NO: 6024033 - DNA, 20 bp, Homo sapiens
catggcctcagccctgctcc

SEQ ID NO: 6024034 - DNA, 23 bp, Homo sapiens
catggcctcagccctgctccctg

SEQ ID NO: 6024035 - DNA, 18 bp, Homo sapiens
catggcctcccagccacc

SEQ ID NO: 6024036 - DNA, 20 bp, Homo sapiens
catggcctcccagccacccg

SEQ ID NO: 6024037 - DNA, 16 bp, Homo sapiens
catggcctctgcaact

SEQ ID NO: 6024038 - DNA, 15 bp, Homo sapiens
catggcctctggaaa

SEQ ID NO: 6024039 - DNA, 21 bp, Homo sapiens
catggcctcttcagatctcta

SEQ ID NO: 6024040 - DNA, 22 bp, Homo sapiens
catggcctcttcagatctctaa

SEQ ID NO: 6024041 - DNA, 16 bp, Homo sapiens
catggcctcttgaaga

SEQ ID NO: 6024042 - DNA, 14 bp, Homo sapiens
catggcctgagcat

SEQ ID NO: 6024043 - DNA, 18 bp, Homo sapiens
catggcctgagcatccag

SEQ ID NO: 6024044 - DNA, 19 bp, Homo sapiens
catggcctggactgactgc

SEQ ID NO: 6024045 - DNA, 15 bp, Homo sapiens
catggcctgtgctgg

SEQ ID NO: 6024046 - DNA, 21 bp, Homo sapiens
catggcctttctaataaactg

SEQ ID NO: 6024047 - DNA, 15 bp, Homo sapiens
catggcgccctgcct

SEQ ID NO: 6024048 - DNA, 15 bp, Homo sapiens
catggcggcacacat

SEQ ID NO: 6024049 - DNA, 18 bp, Homo sapiens
catggcggcacacatctg

SEQ ID NO: 6024050 - DNA, 19 bp, Homo sapiens
catggcggcccctcagcct

SEQ ID NO: 6024051 - DNA, 22 bp, Homo sapiens
catggcgtattttgtatttaaa

SEQ ID NO: 6024052 - DNA, 17 bp, Homo sapiens
catggctaagcttaaaa

SEQ ID NO: 6024053 - DNA, 22 bp, Homo sapiens
catggctataaacaattacatg

SEQ ID NO: 6024054 - DNA, 21 bp, Homo sapiens
catggctatcctagagaggct

SEQ ID NO: 6024055 - DNA, 12 bp, Homo sapiens
catggctatctg

SEQ ID NO: 6024056 - DNA, 17 bp, Homo sapiens
catggctattttatatt

SEQ ID NO: 6024057 - DNA, 17 bp, Homo sapiens
catggctcaaggattca

SEQ ID NO: 6024058 - DNA, 14 bp, Homo sapiens
catggctcactgca

SEQ ID NO: 6024059 - DNA, 15 bp, Homo sapiens
catggctcactgcag

SEQ ID NO: 6024060 - DNA, 16 bp, Homo sapiens
catggctcactgcagc

SEQ ID NO: 6024061 - DNA, 14 bp, Homo sapiens
catggctcagagct

SEQ ID NO: 6024062 - DNA, 20 bp, Homo sapiens
catggctcagagcttgaaga

SEQ ID NO: 6024063 - DNA, 12 bp, Homo sapiens
catggctcaggc

SEQ ID NO: 6024064 - DNA, 13 bp, Homo sapiens
catggctcaggca

SEQ ID NO: 6024065 - DNA, 15 bp, Homo sapiens
catggctccagtctg

SEQ ID NO: 6024066 - DNA, 20 bp, Homo sapiens
catggctccagtctgctgcc

SEQ ID NO: 6024067 - DNA, 17 bp, Homo sapiens
catggctccccctccac

SEQ ID NO: 6024068 - DNA, 17 bp, Homo sapiens
catggctccggcctctg

SEQ ID NO: 6024069 - DNA, 13 bp, Homo sapiens
catggctcctgtc

SEQ ID NO: 6024070 - DNA, 16 bp, Homo sapiens
catggctcctgtctgg

SEQ ID NO: 6024071 - DNA, 17 bp, Homo sapiens
catggctcctgtctggc

SEQ ID NO: 6024072 - DNA, 23 bp, Homo sapiens
catggctctgaactgcacaatgc

SEQ ID NO: 6024073 - DNA, 13 bp, Homo sapiens
catggctctgtta

SEQ ID NO: 6024074 - DNA, 14 bp, Homo sapiens
catggctcttagaa

SEQ ID NO: 6024075 - DNA, 19 bp, Homo sapiens
catggctcttagaaactca

SEQ ID NO: 6024076 - DNA, 15 bp, Homo sapiens
catggctgaagctgg

SEQ ID NO: 6024077 - DNA, 18 bp, Homo sapiens
catggctgaagctggagc

SEQ ID NO: 6024078 - DNA, 13 bp, Homo sapiens
catggctgagctg

SEQ ID NO: 6024079 - DNA, 17 bp, Homo sapiens
catggctgagctgccca

SEQ ID NO: 6024080 - DNA, 17 bp, Homo sapiens
catggctgccaatggga

SEQ ID NO: 6024081 - DNA, 15 bp, Homo sapiens
catggctgctgttgc

SEQ ID NO: 6024082 - DNA, 22 bp, Homo sapiens
catggctggagctagaatttga

SEQ ID NO: 6024083 - DNA, 12 bp, Homo sapiens
catggctggcct

SEQ ID NO: 6024084 - DNA, 19 bp, Homo sapiens
catggctggcctggtaagg

SEQ ID NO: 6024085 - DNA, 12 bp, Homo sapiens
catggctgggaa

SEQ ID NO: 6024086 - DNA, 12 bp, Homo sapiens
catggctggggg

SEQ ID NO: 6024087 - DNA, 20 bp, Homo sapiens
catggctggggggtctcagc

SEQ ID NO: 6024088 - DNA, 22 bp, Homo sapiens
catggctggggggtctcagcat

SEQ ID NO: 6024089 - DNA, 15 bp, Homo sapiens
catggctgtcccctg

SEQ ID NO: 6024090 - DNA, 15 bp, Homo sapiens
catggctgtctgcac

SEQ ID NO: 6024091 - DNA, 14 bp, Homo sapiens
catggctgtgagga

SEQ ID NO: 6024092 - DNA, 23 bp, Homo sapiens
catggctgtggttcctaagcctg

SEQ ID NO: 6024093 - DNA, 20 bp, Homo sapiens
catggcttaatgtttattcc

SEQ ID NO: 6024094 - DNA, 13 bp, Homo sapiens
catggcttcctcc

SEQ ID NO: 6024095 - DNA, 16 bp, Homo sapiens
catggcttcctcctcc

SEQ ID NO: 6024096 - DNA, 14 bp, Homo sapiens
catggcttctcctt

SEQ ID NO: 6024097 - DNA, 19 bp, Homo sapiens
catggcttctgaacctgtc

SEQ ID NO: 6024098 - DNA, 22 bp, Homo sapiens
catggcttctgaacctgtcttt

SEQ ID NO: 6024099 - DNA, 12 bp, Homo sapiens
catggcttgccc

SEQ ID NO: 6024100 - DNA, 18 bp, Homo sapiens
catggcttggggagcaga

SEQ ID NO: 6024101 - DNA, 23 bp, Homo sapiens
catggcttgttctctggaacctg

SEQ ID NO: 6024102 - DNA, 20 bp, Homo sapiens
catggctttcatcctgtgtc

SEQ ID NO: 6024103 - DNA, 21 bp, Homo sapiens
catggctttgtgctgctgagt

SEQ ID NO: 6024104 - DNA, 17 bp, Homo sapiens
catggcttttctctttg

SEQ ID NO: 6024105 - DNA, 18 bp, Homo sapiens
catgggaaaaagagactc

SEQ ID NO: 6024106 - DNA, 19 bp, Homo sapiens
catgggaaaaagagactct

SEQ ID NO: 6024107 - DNA, 18 bp, Homo sapiens
catgggaaagccacctct

SEQ ID NO: 6024108 - DNA, 18 bp, Homo sapiens
catgggaaagtattctct

SEQ ID NO: 6024109 - DNA, 20 bp, Homo sapiens
catgggaaagtattctcttt

SEQ ID NO: 6024110 - DNA, 14 bp, Homo sapiens
catgggaaagtgca

SEQ ID NO: 6024111 - DNA, 19 bp, Homo sapiens
catgggaaatagcggccct

SEQ ID NO: 6024112 - DNA, 21 bp, Homo sapiens
catgggaaatagcggccctgg

SEQ ID NO: 6024113 - DNA, 16 bp, Homo sapiens
catgggaaatgagcca

SEQ ID NO: 6024114 - DNA, 20 bp, Homo sapiens
catgggaaatgtcaacaagt

SEQ ID NO: 6024115 - DNA, 15 bp, Homo sapiens
catgggaacctcata

SEQ ID NO: 6024116 - DNA, 17 bp, Homo sapiens
catgggaacgcagcctc

SEQ ID NO: 6024117 - DNA, 20 bp, Homo sapiens
catgggaacgcagcctccag

SEQ ID NO: 6024118 - DNA, 21 bp, Homo sapiens
catgggaacgcagcctccagt

SEQ ID NO: 6024119 - DNA, 18 bp, Homo sapiens
catgggaagatgtctcag

SEQ ID NO: 6024120 - DNA, 23 bp, Homo sapiens
catgggaagatgtctcagagcct

SEQ ID NO: 6024121 - DNA, 16 bp, Homo sapiens
catgggaatacaaaag

SEQ ID NO: 6024122 - DNA, 14 bp, Homo sapiens
catgggaatgaatg

SEQ ID NO: 6024123 - DNA, 15 bp, Homo sapiens
catgggaatgaatgt

SEQ ID NO: 6024124 - DNA, 17 bp, Homo sapiens
catgggaatgaatgtca

SEQ ID NO: 6024125 - DNA, 17 bp, Homo sapiens
catgggaccacaactat

SEQ ID NO: 6024126 - DNA, 18 bp, Homo sapiens
catgggacctcctccctc

SEQ ID NO: 6024127 - DNA, 13 bp, Homo sapiens
caggcacctggcc

SEQ ID NO: 6024128 - DNA, 15 bp, Homo sapiens
caggcacctggcctg

SEQ ID NO: 6024129 - DNA, 18 bp, Homo sapiens
caggcacctggcctgctg

SEQ ID NO: 6024130 - DNA, 21 bp, Homo sapiens
caggcacgaacccacctgctg

SEQ ID NO: 6024131 - DNA, 15 bp, Homo sapiens
caggcacggaggctc

SEQ ID NO: 6024132 - DNA, 16 bp, Homo sapiens
caggcacgggtggtcc

SEQ ID NO: 6024133 - DNA, 18 bp, Homo sapiens
caggcacgggtggtcccc

SEQ ID NO: 6024134 - DNA, 19 bp, Homo sapiens
caggcacgggtggtccccg

SEQ ID NO: 6024135 - DNA, 20 bp, Homo sapiens
caggcacgggtggtccccgt

SEQ ID NO: 6024136 - DNA, 14 bp, Homo sapiens
caggcacggtttgg

SEQ ID NO: 6024137 - DNA, 18 bp, Homo sapiens
caggcacgtctcctgctg

SEQ ID NO: 6024138 - DNA, 20 bp, Homo sapiens
caggcacgtctcctgctgcg

SEQ ID NO: 6024139 - DNA, 22 bp, Homo sapiens
caggcactagcctttggctctg

SEQ ID NO: 6024140 - DNA, 12 bp, Homo sapiens
caggcactccaa

SEQ ID NO: 6024141 - DNA, 20 bp, Homo sapiens
caggcactgaacaggctggg

SEQ ID NO: 6024142 - DNA, 22 bp, Homo sapiens
caggcactgaacaggctggggc

SEQ ID NO: 6024143 - DNA, 22 bp, Homo sapiens
caggcactgagataccagcgag

SEQ ID NO: 6024144 - DNA, 14 bp, Homo sapiens
caggcactgcaaac

SEQ ID NO: 6024145 - DNA, 15 bp, Homo sapiens
caggcactgccctgg

SEQ ID NO: 6024146 - DNA, 22 bp, Homo sapiens
caggcactgccctggtggccct

SEQ ID NO: 6024147 - DNA, 17 bp, Homo sapiens
caggcactgccttctcc

SEQ ID NO: 6024148 - DNA, 21 bp, Homo sapiens
caggcactgccttctcctctc

SEQ ID NO: 6024149 - DNA, 16 bp, Homo sapiens
caggcactgctgccca

SEQ ID NO: 6024150 - DNA, 17 bp, Homo sapiens
caggcactgctgcccag

SEQ ID NO: 6024151 - DNA, 18 bp, Homo sapiens
caggcactgggcatgagg

SEQ ID NO: 6024152 - DNA, 13 bp, Homo sapiens
caggcactgtggc

SEQ ID NO: 6024153 - DNA, 16 bp, Homo sapiens
caggcactgtggccct

SEQ ID NO: 6024154 - DNA, 11 bp, Homo sapiens
caggcactgtt

SEQ ID NO: 6024155 - DNA, 21 bp, Homo sapiens
caggcacttggcagccttgtg

SEQ ID NO: 6024156 - DNA, 23 bp, Homo sapiens
caggcactttgagatgtgttcct

SEQ ID NO: 6024157 - DNA, 22 bp, Homo sapiens
caggcagaaatagttgtctgtg

SEQ ID NO: 6024158 - DNA, 20 bp, Homo sapiens
caggcagaagaatctttctt

SEQ ID NO: 6024159 - DNA, 16 bp, Homo sapiens
caggcagaatggctgc

SEQ ID NO: 6024160 - DNA, 18 bp, Homo sapiens
caggcagaatggctgcac

SEQ ID NO: 6024161 - DNA, 19 bp, Homo sapiens
caggcagacaaccttgtcc

SEQ ID NO: 6024162 - DNA, 14 bp, Homo sapiens
caggcagacaagag

SEQ ID NO: 6024163 - DNA, 19 bp, Homo sapiens
caggcagacaagagctgct

SEQ ID NO: 6024164 - DNA, 20 bp, Homo sapiens
caggcagacaagagctgctg

SEQ ID NO: 6024165 - DNA, 22 bp, Homo sapiens
caggcagacaagagctgctgtc

SEQ ID NO: 6024166 - DNA, 23 bp, Homo sapiens
caggcagacaagagctgctgtcc

SEQ ID NO: 6024167 - DNA, 16 bp, Homo sapiens
caggcagacacatgct

SEQ ID NO: 6024168 - DNA, 12 bp, Homo sapiens
caggcagacacg

SEQ ID NO: 6024169 - DNA, 22 bp, Homo sapiens
caggcagacacggatctgagaa

SEQ ID NO: 6024170 - DNA, 21 bp, Homo sapiens
caggcagagacaataaaacat

SEQ ID NO: 6024171 - DNA, 23 bp, Homo sapiens
caggcagagacaataaaacattc

SEQ ID NO: 6024172 - DNA, 20 bp, Homo sapiens
caggcagagagtacagactg

SEQ ID NO: 6024173 - DNA, 15 bp, Homo sapiens
caggcagagcgggga

SEQ ID NO: 6024174 - DNA, 19 bp, Homo sapiens
caggcagagctcagcacag

SEQ ID NO: 6024175 - DNA, 20 bp, Homo sapiens
caggcagagctggagccccc

SEQ ID NO: 6024176 - DNA, 22 bp, Homo sapiens
caggcagagctggagcccccag

SEQ ID NO: 6024177 - DNA, 15 bp, Homo sapiens
caggcagaggcaact

SEQ ID NO: 6024178 - DNA, 21 bp, Homo sapiens
caggcagaggcccaggctgcc

SEQ ID NO: 6024179 - DNA, 21 bp, Homo sapiens
caggcagagggcatcggggcc

SEQ ID NO: 6024180 - DNA, 23 bp, Homo sapiens
caggcagagtggcgtggcctccc

SEQ ID NO: 6024181 - DNA, 17 bp, Homo sapiens
caggcagataagttgga

SEQ ID NO: 6024182 - DNA, 18 bp, Homo sapiens
caggcagatacaggaaaa

SEQ ID NO: 6024183 - DNA, 18 bp, Homo sapiens
caggcagatctgtgcccc

SEQ ID NO: 6024184 - DNA, 15 bp, Homo sapiens
caggcagatgacctc

SEQ ID NO: 6024185 - DNA, 19 bp, Homo sapiens
caggcagattaataacaga

SEQ ID NO: 6024186 - DNA, 15 bp, Homo sapiens
caggcagcacagaga

SEQ ID NO: 6024187 - DNA, 16 bp, Homo sapiens
caggcagcacagtgtg

SEQ ID NO: 6024188 - DNA, 15 bp, Homo sapiens
caggcagcaccacac

SEQ ID NO: 6024189 - DNA, 18 bp, Homo sapiens
caggcagcaccacactgg

SEQ ID NO: 6024190 - DNA, 20 bp, Homo sapiens
caggcagcaccacactgggt

SEQ ID NO: 6024191 - DNA, 16 bp, Homo sapiens
caggcagcacctggag

SEQ ID NO: 6024192 - DNA, 19 bp, Homo sapiens
caggcagcacctggagccc

SEQ ID NO: 6024193 - DNA, 22 bp, Homo sapiens
caggcagcacctggagcccaca

SEQ ID NO: 6024194 - DNA, 17 bp, Homo sapiens
caggcagccacgtctca

SEQ ID NO: 6024195 - DNA, 14 bp, Homo sapiens
caggcagccagcat

SEQ ID NO: 6024196 - DNA, 18 bp, Homo sapiens
caggcagccagcatctgg

SEQ ID NO: 6024197 - DNA, 13 bp, Homo sapiens
caggcagccagcc

SEQ ID NO: 6024198 - DNA, 15 bp, Homo sapiens
caggcagccaggcca

SEQ ID NO: 6024199 - DNA, 12 bp, Homo sapiens
caggcagccagt

SEQ ID NO: 6024200 - DNA, 20 bp, Homo sapiens
caggcagccagtgccctgag

SEQ ID NO: 6024201 - DNA, 13 bp, Homo sapiens
caggcagcccagc

SEQ ID NO: 6024202 - DNA, 15 bp, Homo sapiens
caggcagcccagcag

SEQ ID NO: 6024203 - DNA, 20 bp, Homo sapiens
caggcagcccagcagtgtgg

SEQ ID NO: 6024204 - DNA, 12 bp, Homo sapiens
caggcagcccca

SEQ ID NO: 6024205 - DNA, 15 bp, Homo sapiens
caggcagcctatgaa

SEQ ID NO: 6024206 - DNA, 19 bp, Homo sapiens
caggcagcctcctttgtgt

SEQ ID NO: 6024207 - DNA, 16 bp, Homo sapiens
caggcagcctctgggg

SEQ ID NO: 6024208 - DNA, 16 bp, Homo sapiens
caggcagcctctgtca

SEQ ID NO: 6024209 - DNA, 13 bp, Homo sapiens
caggcagcctgga

SEQ ID NO: 6024210 - DNA, 13 bp, Homo sapiens
caggcagcctgtg

SEQ ID NO: 6024211 - DNA, 20 bp, Homo sapiens
caggcagcctgtgggtcctt

SEQ ID NO: 6024212 - DNA, 12 bp, Homo sapiens
caggcagcgatg

SEQ ID NO: 6024213 - DNA, 18 bp, Homo sapiens
caggcagcgcagggctgg

SEQ ID NO: 6024214 - DNA, 14 bp, Homo sapiens
caggcagcgccaag

SEQ ID NO: 6024215 - DNA, 17 bp, Homo sapiens
caggcagcgcctgtccc

SEQ ID NO: 6024216 - DNA, 22 bp, Homo sapiens
caggcagctcataagagccaca

SEQ ID NO: 6024217 - DNA, 15 bp, Homo sapiens
caggcagctcgagca

SEQ ID NO: 6024218 - DNA, 14 bp, Homo sapiens
caggcagctcgagg

SEQ ID NO: 6024219 - DNA, 14 bp, Homo sapiens
caggcagctgaaat

SEQ ID NO: 6024220 - DNA, 15 bp, Homo sapiens
caggcagctgagacc

SEQ ID NO: 6024221 - DNA, 13 bp, Homo sapiens
caggcagctggca

SEQ ID NO: 6024222 - DNA, 18 bp, Homo sapiens
caggcagctggcaggagt

SEQ ID NO: 6024223 - DNA, 13 bp, Homo sapiens
caggcagcttcca

SEQ ID NO: 6024224 - DNA, 21 bp, Homo sapiens
caggcagcttctactcctgcc

SEQ ID NO: 6024225 - DNA, 19 bp, Homo sapiens
caggcagctttttctctcc

SEQ ID NO: 6024226 - DNA, 18 bp, Homo sapiens
caggcaggaagagagaga

SEQ ID NO: 6024227 - DNA, 12 bp, Homo sapiens
caggcaggagga

SEQ ID NO: 6024228 - DNA, 14 bp, Homo sapiens
caggcaggcactgt

SEQ ID NO: 6024229 - DNA, 16 bp, Homo sapiens
caggcaggccagatgg

SEQ ID NO: 6024230 - DNA, 17 bp, Homo sapiens
caggcaggcccagcctc

SEQ ID NO: 6024231 - DNA, 18 bp, Homo sapiens
caggcaggcccagcctct

SEQ ID NO: 6024232 - DNA, 20 bp, Homo sapiens
caggcaggcccagcctctgc

SEQ ID NO: 6024233 - DNA, 16 bp, Homo sapiens
caggcaggcggctcct

SEQ ID NO: 6024234 - DNA, 17 bp, Homo sapiens
caggcaggcggctcctc

SEQ ID NO: 6024235 - DNA, 19 bp, Homo sapiens
caggcaggcggctcctcct

SEQ ID NO: 6024236 - DNA, 21 bp, Homo sapiens
caggcaggcggctcctcctca

SEQ ID NO: 6024237 - DNA, 13 bp, Homo sapiens
caggcagggagaa

SEQ ID NO: 6024238 - DNA, 14 bp, Homo sapiens
caggcagggagaga

SEQ ID NO: 6024239 - DNA, 23 bp, Homo sapiens
caggcagggagagagtagctgca

SEQ ID NO: 6024240 - DNA, 22 bp, Homo sapiens
caggcagggagggaaacccggg

SEQ ID NO: 6024241 - DNA, 17 bp, Homo sapiens
caggcagggagtgtctg

SEQ ID NO: 6024242 - DNA, 19 bp, Homo sapiens
caggcagggagtgtctgca

SEQ ID NO: 6024243 - DNA, 17 bp, Homo sapiens
caggcagggcaggacca

SEQ ID NO: 6024244 - DNA, 13 bp, Homo sapiens
caggcagggcctg

SEQ ID NO: 6024245 - DNA, 14 bp, Homo sapiens
caggcagggcctgg

SEQ ID NO: 6024246 - DNA, 15 bp, Homo sapiens
caggcagggcctggc

SEQ ID NO: 6024247 - DNA, 17 bp, Homo sapiens
caggcagggcctggctc

SEQ ID NO: 6024248 - DNA, 11 bp, Homo sapiens
caggcagggct

SEQ ID NO: 6024249 - DNA, 13 bp, Homo sapiens
caggcagggctct

SEQ ID NO: 6024250 - DNA, 17 bp, Homo sapiens
caggcagggctctcctg

SEQ ID NO: 6024251 - DNA, 20 bp, Homo sapiens
caggcaggggcatctgtctg

SEQ ID NO: 6024252 - DNA, 15 bp, Homo sapiens
caggcaggggcccac

SEQ ID NO: 6024253 - DNA, 17 bp, Homo sapiens
caggcaggggccctgca

SEQ ID NO: 6024254 - DNA, 20 bp, Homo sapiens
caggcaggggccctgcagct

SEQ ID NO: 6024255 - DNA, 23 bp, Homo sapiens
caggcaggggccctgcagctctc

SEQ ID NO: 6024256 - DNA, 16 bp, Homo sapiens
caggcaggggcttccc

SEQ ID NO: 6024257 - DNA, 14 bp, Homo sapiens
caggcaggggcttg

SEQ ID NO: 6024258 - DNA, 18 bp, Homo sapiens
caggcaggggcttggctg

SEQ ID NO: 6024259 - DNA, 22 bp, Homo sapiens
caggcaggggcttggctgcccc

SEQ ID NO: 6024260 - DNA, 22 bp, Homo sapiens
caggcaggggtgggggtggagg

SEQ ID NO: 6024261 - DNA, 17 bp, Homo sapiens
caggcaggtctgcaagg

SEQ ID NO: 6024262 - DNA, 19 bp, Homo sapiens
caggcaggtgccaggaact

SEQ ID NO: 6024263 - DNA, 20 bp, Homo sapiens
caggcaggtgccaggaactc

SEQ ID NO: 6024264 - DNA, 16 bp, Homo sapiens
caggcaggtgcctgga

SEQ ID NO: 6024265 - DNA, 20 bp, Homo sapiens
caggcaggtggactgactgt

SEQ ID NO: 6024266 - DNA, 15 bp, Homo sapiens
caggcaggtgggatg

SEQ ID NO: 6024267 - DNA, 15 bp, Homo sapiens
caggcagtccaggcc

SEQ ID NO: 6024268 - DNA, 19 bp, Homo sapiens
caggcagtcgggggctggc

SEQ ID NO: 6024269 - DNA, 20 bp, Homo sapiens
caggcagtcgggggctggcc

SEQ ID NO: 6024270 - DNA, 22 bp, Homo sapiens
caggcagtcgggggctggccta

SEQ ID NO: 6024271 - DNA, 22 bp, Homo sapiens
caggcagtgatgctggatgctc

SEQ ID NO: 6024272 - DNA, 22 bp, Homo sapiens
caggcagtggggctggaagcag

SEQ ID NO: 6024273 - DNA, 17 bp, Homo sapiens
caggcagtgtcttaagg

SEQ ID NO: 6024274 - DNA, 20 bp, Homo sapiens
caggcagtgtttaaaatgat

SEQ ID NO: 6024275 - DNA, 16 bp, Homo sapiens
caggcagttctagaag

SEQ ID NO: 6024276 - DNA, 15 bp, Homo sapiens
caggcagttctctcg

SEQ ID NO: 6024277 - DNA, 18 bp, Homo sapiens
caggcagtttcagagatg

SEQ ID NO: 6024278 - DNA, 19 bp, Homo sapiens
caggcagtttcagagatgg

SEQ ID NO: 6024279 - DNA, 22 bp, Homo sapiens
caggcagtttcagagatggaca

SEQ ID NO: 6024280 - DNA, 23 bp, Homo sapiens
caggcataagctatcacctagca

SEQ ID NO: 6024281 - DNA, 18 bp, Homo sapiens
caggcatagaggcttctc

SEQ ID NO: 6024282 - DNA, 19 bp, Homo sapiens
caggcatagaggcttctcc

SEQ ID NO: 6024283 - DNA, 23 bp, Homo sapiens
caggcatagaggcttctccgcca

SEQ ID NO: 6024284 - DNA, 16 bp, Homo sapiens
caggcatatgtttccc

SEQ ID NO: 6024285 - DNA, 21 bp, Homo sapiens
caggcatattccctgcacaca

SEQ ID NO: 6024286 - DNA, 18 bp, Homo sapiens
caggcatcactgattccc

SEQ ID NO: 6024287 - DNA, 14 bp, Homo sapiens
caggcatcccatcc

SEQ ID NO: 6024288 - DNA, 20 bp, Homo sapiens
caggcatccgctgcgctccc

SEQ ID NO: 6024289 - DNA, 14 bp, Homo sapiens
caggcatccggccc

SEQ ID NO: 6024290 - DNA, 15 bp, Homo sapiens
caggcatctccttgg

SEQ ID NO: 6024291 - DNA, 15 bp, Homo sapiens
caggcatctgcctct

SEQ ID NO: 6024292 - DNA, 18 bp, Homo sapiens
caggcatctgcctctgga

SEQ ID NO: 6024293 - DNA, 24 bp, Homo sapiens
caggcatctgttagcagagtctgt

SEQ ID NO: 6024294 - DNA, 20 bp, Homo sapiens
caggcatgaacatgtactgt

SEQ ID NO: 6024295 - DNA, 14 bp, Homo sapiens
caggcatgaccctg

SEQ ID NO: 6024296 - DNA, 15 bp, Homo sapiens
caggcatgaccctgg

SEQ ID NO: 6024297 - DNA, 16 bp, Homo sapiens
caggcatgaccctgga

SEQ ID NO: 6024298 - DNA, 23 bp, Homo sapiens
caggcatgagccaccgcgcctgg

SEQ ID NO: 6024299 - DNA, 22 bp, Homo sapiens
caggcatgaggaatctgggagg

SEQ ID NO: 6024300 - DNA, 14 bp, Homo sapiens
caggcatgcagctg

SEQ ID NO: 6024301 - DNA, 15 bp, Homo sapiens
caggcatgcagctgc

SEQ ID NO: 6024302 - DNA, 18 bp, Homo sapiens
caggcatgcagctgcctg

SEQ ID NO: 6024303 - DNA, 23 bp, Homo sapiens
caggcatgctgaacaaggggcct

SEQ ID NO: 6024304 - DNA, 14 bp, Homo sapiens
caggcatgctggcc

SEQ ID NO: 6024305 - DNA, 19 bp, Homo sapiens
catgggactgattctgttg

SEQ ID NO: 6024306 - DNA, 15 bp, Homo sapiens
catgggactgtgcct

SEQ ID NO: 6024307 - DNA, 17 bp, Homo sapiens
catgggactgtgccttt

SEQ ID NO: 6024308 - DNA, 17 bp, Homo sapiens
catgggagaagaggggt

SEQ ID NO: 6024309 - DNA, 15 bp, Homo sapiens
catgggagagtccag

SEQ ID NO: 6024310 - DNA, 20 bp, Homo sapiens
catgggagcagtccatgcat

SEQ ID NO: 6024311 - DNA, 20 bp, Homo sapiens
catgggagccagctgctttt

SEQ ID NO: 6024312 - DNA, 14 bp, Homo sapiens
catgggagggatca

SEQ ID NO: 6024313 - DNA, 13 bp, Homo sapiens
catgggaggggga

SEQ ID NO: 6024314 - DNA, 22 bp, Homo sapiens
catgggagggggcttgaagcca

SEQ ID NO: 6024315 - DNA, 20 bp, Homo sapiens
catgggaggggtctagctgg

SEQ ID NO: 6024316 - DNA, 19 bp, Homo sapiens
catgggaggtggggcctca

SEQ ID NO: 6024317 - DNA, 18 bp, Homo sapiens
catgggataaatgccatc

SEQ ID NO: 6024318 - DNA, 23 bp, Homo sapiens
catgggataaatgccatcaataa

SEQ ID NO: 6024319 - DNA, 16 bp, Homo sapiens
catgggatacaacctc

SEQ ID NO: 6024320 - DNA, 21 bp, Homo sapiens
catgggatacaacctccctct

SEQ ID NO: 6024321 - DNA, 22 bp, Homo sapiens
catgggatacaacctccctctt

SEQ ID NO: 6024322 - DNA, 21 bp, Homo sapiens
catgggcaactcgtgacagcc

SEQ ID NO: 6024323 - DNA, 15 bp, Homo sapiens
catgggcacagtggt

SEQ ID NO: 6024324 - DNA, 23 bp, Homo sapiens
catgggcactgctgggtggccca

SEQ ID NO: 6024325 - DNA, 12 bp, Homo sapiens
catgggcagcaa

SEQ ID NO: 6024326 - DNA, 14 bp, Homo sapiens
catgggcagcccaa

SEQ ID NO: 6024327 - DNA, 23 bp, Homo sapiens
catgggcataggtaagctgtgcc

SEQ ID NO: 6024328 - DNA, 18 bp, Homo sapiens
catgggcattgcagcctt

SEQ ID NO: 6024329 - DNA, 13 bp, Homo sapiens
catgggccagccc

SEQ ID NO: 6024330 - DNA, 17 bp, Homo sapiens
catgggccagcctagcc

SEQ ID NO: 6024331 - DNA, 19 bp, Homo sapiens
catgggcccctctgactcc

SEQ ID NO: 6024332 - DNA, 17 bp, Homo sapiens
catgggcccgctgcctc

SEQ ID NO: 6024333 - DNA, 23 bp, Homo sapiens
catgggcccgctgcctcttggct

SEQ ID NO: 6024334 - DNA, 12 bp, Homo sapiens
catgggccctca

SEQ ID NO: 6024335 - DNA, 21 bp, Homo sapiens
catgggcctcatgaataaatg

SEQ ID NO: 6024336 - DNA, 12 bp, Homo sapiens
catgggcctccc

SEQ ID NO: 6024337 - DNA, 19 bp, Homo sapiens
catgggcctcccactcctg

SEQ ID NO: 6024338 - DNA, 13 bp, Homo sapiens
catgggcctctct

SEQ ID NO: 6024339 - DNA, 16 bp, Homo sapiens
catgggcctctctggg

SEQ ID NO: 6024340 - DNA, 20 bp, Homo sapiens
catgggcctctctgggggag

SEQ ID NO: 6024341 - DNA, 22 bp, Homo sapiens
catgggcctgctgcgtcagacc

SEQ ID NO: 6024342 - DNA, 11 bp, Homo sapiens
catgggcctgg

SEQ ID NO: 6024343 - DNA, 23 bp, Homo sapiens
catgggcctggccacctctctcc

SEQ ID NO: 6024344 - DNA, 13 bp, Homo sapiens
catgggcctgggc

SEQ ID NO: 6024345 - DNA, 14 bp, Homo sapiens
catgggcctgggcc

SEQ ID NO: 6024346 - DNA, 15 bp, Homo sapiens
catgggcctgggcct

SEQ ID NO: 6024347 - DNA, 19 bp, Homo sapiens
catgggcctgggcctgctt

SEQ ID NO: 6024348 - DNA, 17 bp, Homo sapiens
catgggcgcaggcccag

SEQ ID NO: 6024349 - DNA, 24 bp, Homo sapiens
catgggctatcagggaggaagatg

SEQ ID NO: 6024350 - DNA, 14 bp, Homo sapiens
catgggctcagggc

SEQ ID NO: 6024351 - DNA, 16 bp, Homo sapiens
catgggctcagggcca

SEQ ID NO: 6024352 - DNA, 16 bp, Homo sapiens
catgggctcctgcccc

SEQ ID NO: 6024353 - DNA, 13 bp, Homo sapiens
catgggctctggc

SEQ ID NO: 6024354 - DNA, 13 bp, Homo sapiens
catgggctcttca

SEQ ID NO: 6024355 - DNA, 14 bp, Homo sapiens
catgggctgagtgg

SEQ ID NO: 6024356 - DNA, 22 bp, Homo sapiens
catgggctgagtggggagcagt

SEQ ID NO: 6024357 - DNA, 20 bp, Homo sapiens
catgggcttcactgtataaa

SEQ ID NO: 6024358 - DNA, 23 bp, Homo sapiens
catgggcttcactgtataaatag

SEQ ID NO: 6024359 - DNA, 15 bp, Homo sapiens
catggggaaaaaaat

SEQ ID NO: 6024360 - DNA, 20 bp, Homo sapiens
catggggaaaaaaatcatct

SEQ ID NO: 6024361 - DNA, 21 bp, Homo sapiens
catggggaaaaaaatcatcta

SEQ ID NO: 6024362 - DNA, 16 bp, Homo sapiens
catggggaaggcagag

SEQ ID NO: 6024363 - DNA, 14 bp, Homo sapiens
catggggaggagac

SEQ ID NO: 6024364 - DNA, 16 bp, Homo sapiens
catggggaggcagcag

SEQ ID NO: 6024365 - DNA, 20 bp, Homo sapiens
catggggagggattctggtt

SEQ ID NO: 6024366 - DNA, 15 bp, Homo sapiens
catggggaggggaga

SEQ ID NO: 6024367 - DNA, 16 bp, Homo sapiens
catggggaggggagag

SEQ ID NO: 6024368 - DNA, 16 bp, Homo sapiens
catggggatctggggg

SEQ ID NO: 6024369 - DNA, 17 bp, Homo sapiens
catggggattgcagagt

SEQ ID NO: 6024370 - DNA, 18 bp, Homo sapiens
catggggcaagccagggc

SEQ ID NO: 6024371 - DNA, 21 bp, Homo sapiens
catggggcaagccagggccca

SEQ ID NO: 6024372 - DNA, 18 bp, Homo sapiens
catggggcagaggcttcc

SEQ ID NO: 6024373 - DNA, 17 bp, Homo sapiens
catggggcagcctccag

SEQ ID NO: 6024374 - DNA, 22 bp, Homo sapiens
catggggcatagaaactgagga

SEQ ID NO: 6024375 - DNA, 15 bp, Homo sapiens
catggggccaggaaa

SEQ ID NO: 6024376 - DNA, 17 bp, Homo sapiens
catggggcccctctcat

SEQ ID NO: 6024377 - DNA, 19 bp, Homo sapiens
catggggcccctggcccag

SEQ ID NO: 6024378 - DNA, 20 bp, Homo sapiens
catggggccctcccagaacc

SEQ ID NO: 6024379 - DNA, 18 bp, Homo sapiens
catggggcgctcccactc

SEQ ID NO: 6024380 - DNA, 20 bp, Homo sapiens
catggggcgggtcctagctg

SEQ ID NO: 6024381 - DNA, 15 bp, Homo sapiens
catggggctcctgga

SEQ ID NO: 6024382 - DNA, 19 bp, Homo sapiens
catgggggaacaatgagca

SEQ ID NO: 6024383 - DNA, 19 bp, Homo sapiens
catgggggaccccttccca

SEQ ID NO: 6024384 - DNA, 16 bp, Homo sapiens
catgggggaggctctg

SEQ ID NO: 6024385 - DNA, 20 bp, Homo sapiens
catgggggaggctctgaaga

SEQ ID NO: 6024386 - DNA, 13 bp, Homo sapiens
catgggggagggg

SEQ ID NO: 6024387 - DNA, 14 bp, Homo sapiens
catgggggcaccgg

SEQ ID NO: 6024388 - DNA, 17 bp, Homo sapiens
catgggggcacttgagt

SEQ ID NO: 6024389 - DNA, 16 bp, Homo sapiens
catgggggcccaaagg

SEQ ID NO: 6024390 - DNA, 17 bp, Homo sapiens
catgggggcccctcggc

SEQ ID NO: 6024391 - DNA, 15 bp, Homo sapiens
catgggggctccaga

SEQ ID NO: 6024392 - DNA, 18 bp, Homo sapiens
catgggggctgtctttgc

SEQ ID NO: 6024393 - DNA, 18 bp, Homo sapiens
catgggggtgaccccacg

SEQ ID NO: 6024394 - DNA, 15 bp, Homo sapiens
catggggtaggagga

SEQ ID NO: 6024395 - DNA, 22 bp, Homo sapiens
catggggtcagccccaagggct

SEQ ID NO: 6024396 - DNA, 13 bp, Homo sapiens
catggggtccttg

SEQ ID NO: 6024397 - DNA, 17 bp, Homo sapiens
catggggtccttggagt

SEQ ID NO: 6024398 - DNA, 16 bp, Homo sapiens
catggggtctctcaca

SEQ ID NO: 6024399 - DNA, 19 bp, Homo sapiens
catggggtgatgctgggct

SEQ ID NO: 6024400 - DNA, 13 bp, Homo sapiens
catggggtgggcc

SEQ ID NO: 6024401 - DNA, 21 bp, Homo sapiens
catggggtggggtagggctga

SEQ ID NO: 6024402 - DNA, 16 bp, Homo sapiens
catggggttcgagact

SEQ ID NO: 6024403 - DNA, 17 bp, Homo sapiens
catggggttcgagactc

SEQ ID NO: 6024404 - DNA, 19 bp, Homo sapiens
catggggttggctgggccc

SEQ ID NO: 6024405 - DNA, 21 bp, Homo sapiens
catggggtttcagttgcgaaa

SEQ ID NO: 6024406 - DNA, 15 bp, Homo sapiens
catggggtttttatt

SEQ ID NO: 6024407 - DNA, 22 bp, Homo sapiens
catggggtttttattattttta

SEQ ID NO: 6024408 - DNA, 23 bp, Homo sapiens
catggggtttttattatttttac

SEQ ID NO: 6024409 - DNA, 16 bp, Homo sapiens
catgggtactgtctcg

SEQ ID NO: 6024410 - DNA, 16 bp, Homo sapiens
catgggtagcctgggt

SEQ ID NO: 6024411 - DNA, 22 bp, Homo sapiens
catgggtagcttctgacctcag

SEQ ID NO: 6024412 - DNA, 23 bp, Homo sapiens
catgggtagcttctgacctcagc

SEQ ID NO: 6024413 - DNA, 14 bp, Homo sapiens
catgggtcagggtg

SEQ ID NO: 6024414 - DNA, 21 bp, Homo sapiens
catgggtccagggcctgacac

SEQ ID NO: 6024415 - DNA, 21 bp, Homo sapiens
catgggtccatgggaataaag

SEQ ID NO: 6024416 - DNA, 23 bp, Homo sapiens
catgggtcccgggttagcctggt

SEQ ID NO: 6024417 - DNA, 21 bp, Homo sapiens
catgggtcctagcccttccct

SEQ ID NO: 6024418 - DNA, 18 bp, Homo sapiens
catgggtcctcggcccat

SEQ ID NO: 6024419 - DNA, 20 bp, Homo sapiens
catgggtcctcggcccatct

SEQ ID NO: 6024420 - DNA, 23 bp, Homo sapiens
catgggtcctcggcccatctgtc

SEQ ID NO: 6024421 - DNA, 19 bp, Homo sapiens
catgggtccttgatgccag

SEQ ID NO: 6024422 - DNA, 22 bp, Homo sapiens
catgggtccttgatgccagagg

SEQ ID NO: 6024423 - DNA, 13 bp, Homo sapiens
catgggtcgggag

SEQ ID NO: 6024424 - DNA, 14 bp, Homo sapiens
catgggtcgggaga

SEQ ID NO: 6024425 - DNA, 16 bp, Homo sapiens
catgggtcgggagagg

SEQ ID NO: 6024426 - DNA, 14 bp, Homo sapiens
catgggtctggcta

SEQ ID NO: 6024427 - DNA, 23 bp, Homo sapiens
catgggtgaagggagagccagct

SEQ ID NO: 6024428 - DNA, 17 bp, Homo sapiens
catgggtgaattatgtt

SEQ ID NO: 6024429 - DNA, 12 bp, Homo sapiens
catgggtgacta

SEQ ID NO: 6024430 - DNA, 18 bp, Homo sapiens
catgggtgactatctccc

SEQ ID NO: 6024431 - DNA, 21 bp, Homo sapiens
catgggtgcagaccctgaacc

SEQ ID NO: 6024432 - DNA, 13 bp, Homo sapiens
catgggtgcatgg

SEQ ID NO: 6024433 - DNA, 14 bp, Homo sapiens
catgggtggagggt

SEQ ID NO: 6024434 - DNA, 22 bp, Homo sapiens
catgggtgggctctgatgcaga

SEQ ID NO: 6024435 - DNA, 18 bp, Homo sapiens
catgggtgtcagctttgc

SEQ ID NO: 6024436 - DNA, 19 bp, Homo sapiens
catgggtgtggatggcagt

SEQ ID NO: 6024437 - DNA, 15 bp, Homo sapiens
catgggtgttttgat

SEQ ID NO: 6024438 - DNA, 23 bp, Homo sapiens
catgggttatgtgtatgtgccat

SEQ ID NO: 6024439 - DNA, 14 bp, Homo sapiens
catgggttggcagg

SEQ ID NO: 6024440 - DNA, 21 bp, Homo sapiens
catgggttttgtaggtacttt

SEQ ID NO: 6024441 - DNA, 16 bp, Homo sapiens
catggtaaaaactagt

SEQ ID NO: 6024442 - DNA, 22 bp, Homo sapiens
catggtaattatgtgatataaa

SEQ ID NO: 6024443 - DNA, 23 bp, Homo sapiens
catggtaatttatagtttataca

SEQ ID NO: 6024444 - DNA, 14 bp, Homo sapiens
catggtaccagccc

SEQ ID NO: 6024445 - DNA, 15 bp, Homo sapiens
catggtaccagccct

SEQ ID NO: 6024446 - DNA, 23 bp, Homo sapiens
catggtaccaggcccgcactggg

SEQ ID NO: 6024447 - DNA, 18 bp, Homo sapiens
catggtacccccttctgg

SEQ ID NO: 6024448 - DNA, 15 bp, Homo sapiens
catggtactacccca

SEQ ID NO: 6024449 - DNA, 16 bp, Homo sapiens
catggtactaccccag

SEQ ID NO: 6024450 - DNA, 17 bp, Homo sapiens
catggtactaccccagc

SEQ ID NO: 6024451 - DNA, 18 bp, Homo sapiens
catggtactaccccagcc

SEQ ID NO: 6024452 - DNA, 15 bp, Homo sapiens
catggtactgtagca

SEQ ID NO: 6024453 - DNA, 15 bp, Homo sapiens
catggtacttcctct

SEQ ID NO: 6024454 - DNA, 23 bp, Homo sapiens
catggtagaaaatgcaccaaata

SEQ ID NO: 6024455 - DNA, 21 bp, Homo sapiens
catggtagatttttttcatag

SEQ ID NO: 6024456 - DNA, 14 bp, Homo sapiens
catggtagtttaaa

SEQ ID NO: 6024457 - DNA, 14 bp, Homo sapiens
catggtatcatata

SEQ ID NO: 6024458 - DNA, 17 bp, Homo sapiens
catggtatcttgagtct

SEQ ID NO: 6024459 - DNA, 15 bp, Homo sapiens
catggtatgtaactc

SEQ ID NO: 6024460 - DNA, 20 bp, Homo sapiens
catggtattgactcaacagt

SEQ ID NO: 6024461 - DNA, 16 bp, Homo sapiens
catggtatttgaccat

SEQ ID NO: 6024462 - DNA, 14 bp, Homo sapiens
catggtatttgaga

SEQ ID NO: 6024463 - DNA, 16 bp, Homo sapiens
catggtatttgagaca

SEQ ID NO: 6024464 - DNA, 16 bp, Homo sapiens
catggtcacagacccc

SEQ ID NO: 6024465 - DNA, 21 bp, Homo sapiens
catggtcacagacccctgggg

SEQ ID NO: 6024466 - DNA, 19 bp, Homo sapiens
catggtcagccctagggtg

SEQ ID NO: 6024467 - DNA, 22 bp, Homo sapiens
catggtcagctcacaccctaat

SEQ ID NO: 6024468 - DNA, 19 bp, Homo sapiens
catggtcaggggtgagacc

SEQ ID NO: 6024469 - DNA, 15 bp, Homo sapiens
catggtcatggacag

SEQ ID NO: 6024470 - DNA, 17 bp, Homo sapiens
catggtccatcccctga

SEQ ID NO: 6024471 - DNA, 15 bp, Homo sapiens
catggtcccacatcc

SEQ ID NO: 6024472 - DNA, 16 bp, Homo sapiens
catggtcccacatccc

SEQ ID NO: 6024473 - DNA, 17 bp, Homo sapiens
catggtcccacatccct

SEQ ID NO: 6024474 - DNA, 19 bp, Homo sapiens
catggtcccacatccctgg

SEQ ID NO: 6024475 - DNA, 16 bp, Homo sapiens
catggtccccaagacc

SEQ ID NO: 6024476 - DNA, 22 bp, Homo sapiens
catggtcccgaagtgtagggca

SEQ ID NO: 6024477 - DNA, 13 bp, Homo sapiens
catggtccctgcc

SEQ ID NO: 6024478 - DNA, 15 bp, Homo sapiens
catggtccctgcctt

SEQ ID NO: 6024479 - DNA, 20 bp, Homo sapiens
catggtcccttaaggcacag

SEQ ID NO: 6024480 - DNA, 15 bp, Homo sapiens
catggtcctggctgg

SEQ ID NO: 6024481 - DNA, 19 bp, Homo sapiens
catggtcctgtctgtcctt

SEQ ID NO: 6024482 - DNA, 12 bp, Homo sapiens
catggtcctgtg

SEQ ID NO: 6024483 - DNA, 13 bp, Homo sapiens
catggtcctgtgc

SEQ ID NO: 6024484 - DNA, 14 bp, Homo sapiens
catggtcctgtgcc

SEQ ID NO: 6024485 - DNA, 15 bp, Homo sapiens
catggtcctgtgccc

SEQ ID NO: 6024486 - DNA, 19 bp, Homo sapiens
catggtcctttctggaagt

SEQ ID NO: 6024487 - DNA, 15 bp, Homo sapiens
catggtcgctcaggc

SEQ ID NO: 6024488 - DNA, 16 bp, Homo sapiens
catggtcggaaaacat

SEQ ID NO: 6024489 - DNA, 16 bp, Homo sapiens
catggtctagaaatgc

SEQ ID NO: 6024490 - DNA, 21 bp, Homo sapiens
catggtctctcgggcccccca

SEQ ID NO: 6024491 - DNA, 22 bp, Homo sapiens
catggtctctcgggccccccac

SEQ ID NO: 6024492 - DNA, 15 bp, Homo sapiens
catggtctgccctct

SEQ ID NO: 6024493 - DNA, 15 bp, Homo sapiens
catggtgaaaagctc

SEQ ID NO: 6024494 - DNA, 18 bp, Homo sapiens
catggtgaaaatgtactg

SEQ ID NO: 6024495 - DNA, 19 bp, Homo sapiens
catggtgaaaatgtactga

SEQ ID NO: 6024496 - DNA, 19 bp, Homo sapiens
catggtgaaaccccgtctc

SEQ ID NO: 6024497 - DNA, 19 bp, Homo sapiens
catggtgaaaccctgtctc

SEQ ID NO: 6024498 - DNA, 13 bp, Homo sapiens
catggtgaaactc

SEQ ID NO: 6024499 - DNA, 17 bp, Homo sapiens
catggtgaaatctgctc

SEQ ID NO: 6024500 - DNA, 18 bp, Homo sapiens
catggtgaaatctgctct

SEQ ID NO: 6024501 - DNA, 17 bp, Homo sapiens
catggtgaactgaagca

SEQ ID NO: 6024502 - DNA, 23 bp, Homo sapiens
catggtgaaggtttttgtttctt

SEQ ID NO: 6024503 - DNA, 14 bp, Homo sapiens
catggtgacacaca

SEQ ID NO: 6024504 - DNA, 15 bp, Homo sapiens
catggtgacacacag

SEQ ID NO: 6024505 - DNA, 20 bp, Homo sapiens
catggtgacatttgagatga

SEQ ID NO: 6024506 - DNA, 20 bp, Homo sapiens
catggtgacttttgaaaaga

SEQ ID NO: 6024507 - DNA, 15 bp, Homo sapiens
catggtgagcctagc

SEQ ID NO: 6024508 - DNA, 19 bp, Homo sapiens
catggtgagcctagccctg

SEQ ID NO: 6024509 - DNA, 22 bp, Homo sapiens
catggtgagtctatttttaatg

SEQ ID NO: 6024510 - DNA, 23 bp, Homo sapiens
catggtgagtctatttttaatgc

SEQ ID NO: 6024511 - DNA, 13 bp, Homo sapiens
catggtgatgcaa

SEQ ID NO: 6024512 - DNA, 17 bp, Homo sapiens
catggtgcaatttgtct

SEQ ID NO: 6024513 - DNA, 20 bp, Homo sapiens
catggtgcaatttgtctttg

SEQ ID NO: 6024514 - DNA, 19 bp, Homo sapiens
catggtgcagttgacagca

SEQ ID NO: 6024515 - DNA, 16 bp, Homo sapiens
catggtgccctggctt

SEQ ID NO: 6024516 - DNA, 21 bp, Homo sapiens
catggtgcctatatctgagag

SEQ ID NO: 6024517 - DNA, 14 bp, Homo sapiens
catggtgcctgaga

SEQ ID NO: 6024518 - DNA, 18 bp, Homo sapiens
catggtgcctgagaggca

SEQ ID NO: 6024519 - DNA, 21 bp, Homo sapiens
catggtgctaagcgggcccgg

SEQ ID NO: 6024520 - DNA, 13 bp, Homo sapiens
catggtgctactt

SEQ ID NO: 6024521 - DNA, 21 bp, Homo sapiens
catggtgctagtgggccctct

SEQ ID NO: 6024522 - DNA, 12 bp, Homo sapiens
catggtgctgca

SEQ ID NO: 6024523 - DNA, 15 bp, Homo sapiens
catggtgctgggaga

SEQ ID NO: 6024524 - DNA, 14 bp, Homo sapiens
catggtggagggca

SEQ ID NO: 6024525 - DNA, 15 bp, Homo sapiens
catggtggagggcac

SEQ ID NO: 6024526 - DNA, 19 bp, Homo sapiens
catggtggagggcacttca

SEQ ID NO: 6024527 - DNA, 21 bp, Homo sapiens
catggtggagggcacttcagg

SEQ ID NO: 6024528 - DNA, 18 bp, Homo sapiens
catggtggcgcaagcctg

SEQ ID NO: 6024529 - DNA, 20 bp, Homo sapiens
catggtggcgcaagcctgta

SEQ ID NO: 6024530 - DNA, 19 bp, Homo sapiens
catggtggctcatgcctgt

SEQ ID NO: 6024531 - DNA, 16 bp, Homo sapiens
catggtggctcccgcc

SEQ ID NO: 6024532 - DNA, 20 bp, Homo sapiens
catggtggggtctcctcagg

SEQ ID NO: 6024533 - DNA, 23 bp, Homo sapiens
catggtggggtctcctcaggacc

SEQ ID NO: 6024534 - DNA, 12 bp, Homo sapiens
catggtgggtag

SEQ ID NO: 6024535 - DNA, 19 bp, Homo sapiens
catggtgggttcaggggac

SEQ ID NO: 6024536 - DNA, 19 bp, Homo sapiens
catggtggtgatgtccaaa

SEQ ID NO: 6024537 - DNA, 19 bp, Homo sapiens
catggtggttgggacccag

SEQ ID NO: 6024538 - DNA, 22 bp, Homo sapiens
catggtggttgggacccagtgg

SEQ ID NO: 6024539 - DNA, 14 bp, Homo sapiens
catggtgtaataag

SEQ ID NO: 6024540 - DNA, 15 bp, Homo sapiens
catggtgtaataaga

SEQ ID NO: 6024541 - DNA, 16 bp, Homo sapiens
catggtgtaataagac

SEQ ID NO: 6024542 - DNA, 17 bp, Homo sapiens
catggtgtatgtggttt

SEQ ID NO: 6024543 - DNA, 16 bp, Homo sapiens
catggtgtccagacag

SEQ ID NO: 6024544 - DNA, 15 bp, Homo sapiens
catggtgtctcccaa

SEQ ID NO: 6024545 - DNA, 16 bp, Homo sapiens
catggtgtctcccaac

SEQ ID NO: 6024546 - DNA, 17 bp, Homo sapiens
catggtgtctcccaaca

SEQ ID NO: 6024547 - DNA, 20 bp, Homo sapiens
catggtgtctcccaacatgg

SEQ ID NO: 6024548 - DNA, 22 bp, Homo sapiens
catggtgtggccatcactcagc

SEQ ID NO: 6024549 - DNA, 15 bp, Homo sapiens
catggtgtggggggc

SEQ ID NO: 6024550 - DNA, 16 bp, Homo sapiens
catggtgtggggggct

SEQ ID NO: 6024551 - DNA, 23 bp, Homo sapiens
catggtgtggggggctgggggag

SEQ ID NO: 6024552 - DNA, 13 bp, Homo sapiens
catggtgtgtcat

SEQ ID NO: 6024553 - DNA, 15 bp, Homo sapiens
catggtgtgtgtctc

SEQ ID NO: 6024554 - DNA, 15 bp, Homo sapiens
catggtgtgttacac

SEQ ID NO: 6024555 - DNA, 16 bp, Homo sapiens
catggtgtgtttgtaa

SEQ ID NO: 6024556 - DNA, 16 bp, Homo sapiens
catggtgttctcctgc

SEQ ID NO: 6024557 - DNA, 13 bp, Homo sapiens
catggtgttgcgt

SEQ ID NO: 6024558 - DNA, 18 bp, Homo sapiens
catggtgttggaggggca

SEQ ID NO: 6024559 - DNA, 23 bp, Homo sapiens
catggtgtttttataaagaattc

SEQ ID NO: 6024560 - DNA, 13 bp, Homo sapiens
catggttaagagt

SEQ ID NO: 6024561 - DNA, 19 bp, Homo sapiens
catggttaccatgggtgtg

SEQ ID NO: 6024562 - DNA, 20 bp, Homo sapiens
catggttcaagtattaagca

SEQ ID NO: 6024563 - DNA, 21 bp, Homo sapiens
catggttccaattttttttaa

SEQ ID NO: 6024564 - DNA, 21 bp, Homo sapiens
catggttgttgcatatagtta

SEQ ID NO: 6024565 - DNA, 14 bp, Homo sapiens
catggttgtttttt

SEQ ID NO: 6024566 - DNA, 15 bp, Homo sapiens
catggtttaaagtca

SEQ ID NO: 6024567 - DNA, 21 bp, Homo sapiens
catggtttaaatatgaatgaa

SEQ ID NO: 6024568 - DNA, 14 bp, Homo sapiens
catggtttgactca

SEQ ID NO: 6024569 - DNA, 16 bp, Homo sapiens
catggtttgactctgg

SEQ ID NO: 6024570 - DNA, 13 bp, Homo sapiens
catggtttgatat

SEQ ID NO: 6024571 - DNA, 16 bp, Homo sapiens
catggtttgatatgta

SEQ ID NO: 6024572 - DNA, 16 bp, Homo sapiens
catggtttgcatgact

SEQ ID NO: 6024573 - DNA, 17 bp, Homo sapiens
catggtttgcatttaaa

SEQ ID NO: 6024574 - DNA, 14 bp, Homo sapiens
catgtaaaaagaca

SEQ ID NO: 6024575 - DNA, 12 bp, Homo sapiens
catgtaaaacaa

SEQ ID NO: 6024576 - DNA, 18 bp, Homo sapiens
catgtaaaacaaaaaaca

SEQ ID NO: 6024577 - DNA, 14 bp, Homo sapiens
catgtaaaagagtc

SEQ ID NO: 6024578 - DNA, 16 bp, Homo sapiens
catgtaaaatcttcag

SEQ ID NO: 6024579 - DNA, 23 bp, Homo sapiens
catgtaaaatcttcagctggtgg

SEQ ID NO: 6024580 - DNA, 22 bp, Homo sapiens
catgtaaaatgcagtccagaat

SEQ ID NO: 6024581 - DNA, 21 bp, Homo sapiens
catgtaaacaaaatttagttt

SEQ ID NO: 6024582 - DNA, 22 bp, Homo sapiens
catgtaaacacgcctgcaaacg

SEQ ID NO: 6024583 - DNA, 21 bp, Homo sapiens
catgtaaactatttgtggcaa

SEQ ID NO: 6024584 - DNA, 20 bp, Homo sapiens
catgtaaagcagtattaaaa

SEQ ID NO: 6024585 - DNA, 17 bp, Homo sapiens
catgtaaagctgttaaa

SEQ ID NO: 6024586 - DNA, 20 bp, Homo sapiens
catgtaaagctgttaaaata

SEQ ID NO: 6024587 - DNA, 17 bp, Homo sapiens
catgtaaagtgtcagaa

SEQ ID NO: 6024588 - DNA, 18 bp, Homo sapiens
catgtaaatacaaatttt

SEQ ID NO: 6024589 - DNA, 21 bp, Homo sapiens
catgtaaatacaaattttgta

SEQ ID NO: 6024590 - DNA, 16 bp, Homo sapiens
catgtaaatgtaaact

SEQ ID NO: 6024591 - DNA, 15 bp, Homo sapiens
catgtaaattaagtg

SEQ ID NO: 6024592 - DNA, 17 bp, Homo sapiens
catgtaaattgactgta

SEQ ID NO: 6024593 - DNA, 9 bp, Homo sapiens
catgtaaca

SEQ ID NO: 6024594 - DNA, 17 bp, Homo sapiens
catgtaacacataaaca

SEQ ID NO: 6024595 - DNA, 15 bp, Homo sapiens
catgtaacactgttg

SEQ ID NO: 6024596 - DNA, 15 bp, Homo sapiens
catgtaacagaaagg

SEQ ID NO: 6024597 - DNA, 17 bp, Homo sapiens
catgtaacagaaagggc

SEQ ID NO: 6024598 - DNA, 21 bp, Homo sapiens
catgtaacaggtaaccacaat

SEQ ID NO: 6024599 - DNA, 16 bp, Homo sapiens
catgtaacatagattt

SEQ ID NO: 6024600 - DNA, 13 bp, Homo sapiens
catgtaacattgg

SEQ ID NO: 6024601 - DNA, 16 bp, Homo sapiens
catgtaacattggtga

SEQ ID NO: 6024602 - DNA, 18 bp, Homo sapiens
catgtaaccactgcactt

SEQ ID NO: 6024603 - DNA, 17 bp, Homo sapiens
catgtaaccggcatgtt

SEQ ID NO: 6024604 - DNA, 19 bp, Homo sapiens
catgtaactatttcttcag

SEQ ID NO: 6024605 - DNA, 15 bp, Homo sapiens
catgtaactgcctag

SEQ ID NO: 6024606 - DNA, 19 bp, Homo sapiens
catgtaacttttttatttt

SEQ ID NO: 6024607 - DNA, 21 bp, Homo sapiens
catgtaacttttttattttaa

SEQ ID NO: 6024608 - DNA, 15 bp, Homo sapiens
catgtaagaaaatgt

SEQ ID NO: 6024609 - DNA, 15 bp, Homo sapiens
catgtaagaaataag

SEQ ID NO: 6024610 - DNA, 19 bp, Homo sapiens
catgtaagaatgactgatg

SEQ ID NO: 6024611 - DNA, 18 bp, Homo sapiens
catgtaagctgaaaatat

SEQ ID NO: 6024612 - DNA, 17 bp, Homo sapiens
catgtaaggaagggact

SEQ ID NO: 6024613 - DNA, 19 bp, Homo sapiens
catgtaaggaagggactga

SEQ ID NO: 6024614 - DNA, 21 bp, Homo sapiens
catgtaataaaaagtatatgt

SEQ ID NO: 6024615 - DNA, 22 bp, Homo sapiens
catgtaataaaaagtatatgtt

SEQ ID NO: 6024616 - DNA, 13 bp, Homo sapiens
catgtaataaatc

SEQ ID NO: 6024617 - DNA, 23 bp, Homo sapiens
catgtaataagcacttgcctgga

SEQ ID NO: 6024618 - DNA, 17 bp, Homo sapiens
catgtaatagtggcttt

SEQ ID NO: 6024619 - DNA, 18 bp, Homo sapiens
catgtaatagtggctttc

SEQ ID NO: 6024620 - DNA, 21 bp, Homo sapiens
catgtaatagtggctttcatt

SEQ ID NO: 6024621 - DNA, 22 bp, Homo sapiens
catgtaatatatttcagacatt

SEQ ID NO: 6024622 - DNA, 14 bp, Homo sapiens
catgtaatattaaa

SEQ ID NO: 6024623 - DNA, 16 bp, Homo sapiens
catgtaatattaaatt

SEQ ID NO: 6024624 - DNA, 18 bp, Homo sapiens
catgtaatcccagctact

SEQ ID NO: 6024625 - DNA, 18 bp, Homo sapiens
catgtaatgaatggtcag

SEQ ID NO: 6024626 - DNA, 21 bp, Homo sapiens
catgtaatggtatcttaaagt

SEQ ID NO: 6024627 - DNA, 21 bp, Homo sapiens
catgtaattaagtactatgta

SEQ ID NO: 6024628 - DNA, 12 bp, Homo sapiens
catgtaattatc

SEQ ID NO: 6024629 - DNA, 23 bp, Homo sapiens
catgtaattatctagtagttgta

SEQ ID NO: 6024630 - DNA, 18 bp, Homo sapiens
catgtacaaaaacacaaa

SEQ ID NO: 6024631 - DNA, 15 bp, Homo sapiens
catgtacaaaaccat

SEQ ID NO: 6024632 - DNA, 22 bp, Homo sapiens
catgtacagagaactaacacta

SEQ ID NO: 6024633 - DNA, 10 bp, Homo sapiens
catgtacagt

SEQ ID NO: 6024634 - DNA, 15 bp, Homo sapiens
catgtacagtgttct

SEQ ID NO: 6024635 - DNA, 20 bp, Homo sapiens
catgtacatgaagaagctaa

SEQ ID NO: 6024636 - DNA, 14 bp, Homo sapiens
catgtacatttgga

SEQ ID NO: 6024637 - DNA, 20 bp, Homo sapiens
catgtaccagtgtactgctt

SEQ ID NO: 6024638 - DNA, 13 bp, Homo sapiens
catgtaccccaat

SEQ ID NO: 6024639 - DNA, 21 bp, Homo sapiens
catgtaccccctttcccttct

SEQ ID NO: 6024640 - DNA, 21 bp, Homo sapiens
catgtacctcccctgccttgc

SEQ ID NO: 6024641 - DNA, 13 bp, Homo sapiens
catgtactacagc

SEQ ID NO: 6024642 - DNA, 14 bp, Homo sapiens
catgtactacagct

SEQ ID NO: 6024643 - DNA, 21 bp, Homo sapiens
catgtactacagctatatttg

SEQ ID NO: 6024644 - DNA, 16 bp, Homo sapiens
catgtactagtcctct

SEQ ID NO: 6024645 - DNA, 14 bp, Homo sapiens
catgtactatctta

SEQ ID NO: 6024646 - DNA, 12 bp, Homo sapiens
catgtactgaga

SEQ ID NO: 6024647 - DNA, 22 bp, Homo sapiens
catgtactgagccttgtaattc

SEQ ID NO: 6024648 - DNA, 15 bp, Homo sapiens
catgtactgcattat

SEQ ID NO: 6024649 - DNA, 16 bp, Homo sapiens
catgtactgcattatt

SEQ ID NO: 6024650 - DNA, 22 bp, Homo sapiens
catgtactgtagtttttcttca

SEQ ID NO: 6024651 - DNA, 15 bp, Homo sapiens
catgtacttcctgtg

SEQ ID NO: 6024652 - DNA, 21 bp, Homo sapiens
catgtacttcctgtgtactct

SEQ ID NO: 6024653 - DNA, 14 bp, Homo sapiens
catgtacttgaagg

SEQ ID NO: 6024654 - DNA, 18 bp, Homo sapiens
catgtacttgaaggatgg

SEQ ID NO: 6024655 - DNA, 19 bp, Homo sapiens
catgtacttgaaggatgga

SEQ ID NO: 6024656 - DNA, 19 bp, Homo sapiens
catgtactttggcatcttt

SEQ ID NO: 6024657 - DNA, 23 bp, Homo sapiens
catgtactttggcatcttttgga

SEQ ID NO: 6024658 - DNA, 16 bp, Homo sapiens
catgtagaactcagca

SEQ ID NO: 6024659 - DNA, 17 bp, Homo sapiens
catgtagaacttgaact

SEQ ID NO: 6024660 - DNA, 19 bp, Homo sapiens
catgtagaagagggagaag

SEQ ID NO: 6024661 - DNA, 17 bp, Homo sapiens
catgtagactgtgccag

SEQ ID NO: 6024662 - DNA, 24 bp, Homo sapiens
caggcatgctggctcccagggcca

SEQ ID NO: 6024663 - DNA, 13 bp, Homo sapiens
caggcatgcttct

SEQ ID NO: 6024664 - DNA, 22 bp, Homo sapiens
caggcatggaaagatggggagc

SEQ ID NO: 6024665 - DNA, 18 bp, Homo sapiens
caggcatggcccagcctg

SEQ ID NO: 6024666 - DNA, 21 bp, Homo sapiens
caggcatggcccagcctggag

SEQ ID NO: 6024667 - DNA, 22 bp, Homo sapiens
caggcatggcccagcctggagc

SEQ ID NO: 6024668 - DNA, 15 bp, Homo sapiens
caggcatgggccacc

SEQ ID NO: 6024669 - DNA, 13 bp, Homo sapiens
caggcatgtgcca

SEQ ID NO: 6024670 - DNA, 14 bp, Homo sapiens
caggcatgtgccac

SEQ ID NO: 6024671 - DNA, 12 bp, Homo sapiens
caggcatgtgtc

SEQ ID NO: 6024672 - DNA, 18 bp, Homo sapiens
caggcatgtgtcccttcc

SEQ ID NO: 6024673 - DNA, 19 bp, Homo sapiens
caggcatgtgtctggccct

SEQ ID NO: 6024674 - DNA, 17 bp, Homo sapiens
caggcattccccaggag

SEQ ID NO: 6024675 - DNA, 18 bp, Homo sapiens
caggcattccccaggagg

SEQ ID NO: 6024676 - DNA, 19 bp, Homo sapiens
caggcattccccaggaggc

SEQ ID NO: 6024677 - DNA, 22 bp, Homo sapiens
caggcattccccaggaggccag

SEQ ID NO: 6024678 - DNA, 21 bp, Homo sapiens
caggcattcctgaagggaact

SEQ ID NO: 6024679 - DNA, 14 bp, Homo sapiens
caggcattgaggaa

SEQ ID NO: 6024680 - DNA, 18 bp, Homo sapiens
caggcattgcactaaaag

SEQ ID NO: 6024681 - DNA, 22 bp, Homo sapiens
caggcattgcctcggctggctc

SEQ ID NO: 6024682 - DNA, 16 bp, Homo sapiens
caggcattgctttgcc

SEQ ID NO: 6024683 - DNA, 23 bp, Homo sapiens
caggcattgctttgccctggagc

SEQ ID NO: 6024684 - DNA, 21 bp, Homo sapiens
caggcattggctcagcccgct

SEQ ID NO: 6024685 - DNA, 16 bp, Homo sapiens
caggcatttagccctc

SEQ ID NO: 6024686 - DNA, 17 bp, Homo sapiens
caggcatttagctagtt

SEQ ID NO: 6024687 - DNA, 15 bp, Homo sapiens
caggcatttcctggg

SEQ ID NO: 6024688 - DNA, 18 bp, Homo sapiens
caggcatttcctgggtgg

SEQ ID NO: 6024689 - DNA, 19 bp, Homo sapiens
caggcatttcctgggtggc

SEQ ID NO: 6024690 - DNA, 23 bp, Homo sapiens
caggcatttgactgaagatgcag

SEQ ID NO: 6024691 - DNA, 22 bp, Homo sapiens
caggcatttgctaaggcagctg

SEQ ID NO: 6024692 - DNA, 16 bp, Homo sapiens
caggccaaacatggcc

SEQ ID NO: 6024693 - DNA, 18 bp, Homo sapiens
caggccaaactcacctgc

SEQ ID NO: 6024694 - DNA, 18 bp, Homo sapiens
caggccaaagacctccca

SEQ ID NO: 6024695 - DNA, 16 bp, Homo sapiens
caggccaaagccccat

SEQ ID NO: 6024696 - DNA, 16 bp, Homo sapiens
caggccaacagcacct

SEQ ID NO: 6024697 - DNA, 16 bp, Homo sapiens
caggccaacagtagcc

SEQ ID NO: 6024698 - DNA, 15 bp, Homo sapiens
caggccaaccctcct

SEQ ID NO: 6024699 - DNA, 14 bp, Homo sapiens
caggccaactgccc

SEQ ID NO: 6024700 - DNA, 19 bp, Homo sapiens
caggccaagagcagaggca

SEQ ID NO: 6024701 - DNA, 21 bp, Homo sapiens
caggccaagagcagaggcagc

SEQ ID NO: 6024702 - DNA, 12 bp, Homo sapiens
caggccaaggct

SEQ ID NO: 6024703 - DNA, 20 bp, Homo sapiens
caggccaaggtctgagccac

SEQ ID NO: 6024704 - DNA, 16 bp, Homo sapiens
caggccaatcccttct

SEQ ID NO: 6024705 - DNA, 16 bp, Homo sapiens
caggccacaaatgtgt

SEQ ID NO: 6024706 - DNA, 17 bp, Homo sapiens
caggccacacgctgccc

SEQ ID NO: 6024707 - DNA, 12 bp, Homo sapiens
caggccacagag

SEQ ID NO: 6024708 - DNA, 17 bp, Homo sapiens
caggccacagagaacct

SEQ ID NO: 6024709 - DNA, 17 bp, Homo sapiens
caggccacagcccctgg

SEQ ID NO: 6024710 - DNA, 22 bp, Homo sapiens
caggccacagccgcctttgggt

SEQ ID NO: 6024711 - DNA, 22 bp, Homo sapiens
caggccacagtggggctgcagg

SEQ ID NO: 6024712 - DNA, 24 bp, Homo sapiens
caggccacagtggggctgcaggca

SEQ ID NO: 6024713 - DNA, 23 bp, Homo sapiens
caggccacatggggctgggcagc

SEQ ID NO: 6024714 - DNA, 16 bp, Homo sapiens
caggccaccagctgct

SEQ ID NO: 6024715 - DNA, 17 bp, Homo sapiens
caggccaccagctgctg

SEQ ID NO: 6024716 - DNA, 13 bp, Homo sapiens
caggccaccagga

SEQ ID NO: 6024717 - DNA, 15 bp, Homo sapiens
caggccacccgggct

SEQ ID NO: 6024718 - DNA, 15 bp, Homo sapiens
caggccaccctgtgc

SEQ ID NO: 6024719 - DNA, 17 bp, Homo sapiens
caggccaccctgtgcag

SEQ ID NO: 6024720 - DNA, 16 bp, Homo sapiens
caggccacctcagtct

SEQ ID NO: 6024721 - DNA, 16 bp, Homo sapiens
caggccacctccagaa

SEQ ID NO: 6024722 - DNA, 18 bp, Homo sapiens
caggccacctccagaaac

SEQ ID NO: 6024723 - DNA, 13 bp, Homo sapiens
caggccacctgcc

SEQ ID NO: 6024724 - DNA, 17 bp, Homo sapiens
caggccacctgccccct

SEQ ID NO: 6024725 - DNA, 23 bp, Homo sapiens
caggccacctgcccccttctccc

SEQ ID NO: 6024726 - DNA, 22 bp, Homo sapiens
caggccacctggctctcacctc

SEQ ID NO: 6024727 - DNA, 16 bp, Homo sapiens
caggccacgctcaggc

SEQ ID NO: 6024728 - DNA, 17 bp, Homo sapiens
caggccacggcagccta

SEQ ID NO: 6024729 - DNA, 20 bp, Homo sapiens
caggccactagtgacagttt

SEQ ID NO: 6024730 - DNA, 14 bp, Homo sapiens
caggccactgcaaa

SEQ ID NO: 6024731 - DNA, 23 bp, Homo sapiens
caggccactgggccctgagccag

SEQ ID NO: 6024732 - DNA, 12 bp, Homo sapiens
caggccactgtg

SEQ ID NO: 6024733 - DNA, 22 bp, Homo sapiens
caggccactgtggccagagctg

SEQ ID NO: 6024734 - DNA, 15 bp, Homo sapiens
caggccacttgctca

SEQ ID NO: 6024735 - DNA, 16 bp, Homo sapiens
caggccagagaaagca

SEQ ID NO: 6024736 - DNA, 16 bp, Homo sapiens
caggccagagggagtg

SEQ ID NO: 6024737 - DNA, 20 bp, Homo sapiens
caggccagatgttgttcctg

SEQ ID NO: 6024738 - DNA, 15 bp, Homo sapiens
caggccagcccagcc

SEQ ID NO: 6024739 - DNA, 20 bp, Homo sapiens
caggccagcccagccaggcc

SEQ ID NO: 6024740 - DNA, 15 bp, Homo sapiens
caggccagccccccc

SEQ ID NO: 6024741 - DNA, 19 bp, Homo sapiens
caggccagcccccccaccc

SEQ ID NO: 6024742 - DNA, 12 bp, Homo sapiens
caggccagcctc

SEQ ID NO: 6024743 - DNA, 15 bp, Homo sapiens
caggccagcctccga

SEQ ID NO: 6024744 - DNA, 22 bp, Homo sapiens
caggccagcgaggcgaggctgc

SEQ ID NO: 6024745 - DNA, 14 bp, Homo sapiens
caggccagcgtgga

SEQ ID NO: 6024746 - DNA, 14 bp, Homo sapiens
caggccagctcagg

SEQ ID NO: 6024747 - DNA, 16 bp, Homo sapiens
caggccagctcaggaa

SEQ ID NO: 6024748 - DNA, 12 bp, Homo sapiens
caggccagctgc

SEQ ID NO: 6024749 - DNA, 17 bp, Homo sapiens
caggccagctgcttggg

SEQ ID NO: 6024750 - DNA, 20 bp, Homo sapiens
caggccagcttcgtgctgga

SEQ ID NO: 6024751 - DNA, 21 bp, Homo sapiens
caggccagcttcgtgctggag

SEQ ID NO: 6024752 - DNA, 23 bp, Homo sapiens
caggccagcttcgtgctggagga

SEQ ID NO: 6024753 - DNA, 23 bp, Homo sapiens
caggccaggaccacacagtcccc

SEQ ID NO: 6024754 - DNA, 14 bp, Homo sapiens
caggccaggactct

SEQ ID NO: 6024755 - DNA, 21 bp, Homo sapiens
caggccaggactctgcagcct

SEQ ID NO: 6024756 - DNA, 12 bp, Homo sapiens
caggccaggcca

SEQ ID NO: 6024757 - DNA, 14 bp, Homo sapiens
caggccaggccacc

SEQ ID NO: 6024758 - DNA, 14 bp, Homo sapiens
caggccaggccagc

SEQ ID NO: 6024759 - DNA, 19 bp, Homo sapiens
caggccaggccagcttccc

SEQ ID NO: 6024760 - DNA, 14 bp, Homo sapiens
caggccaggccctc

SEQ ID NO: 6024761 - DNA, 22 bp, Homo sapiens
caggccaggccctctgcccact

SEQ ID NO: 6024762 - DNA, 16 bp, Homo sapiens
caggccaggctgcctc

SEQ ID NO: 6024763 - DNA, 16 bp, Homo sapiens
caggccagggctcctg

SEQ ID NO: 6024764 - DNA, 16 bp, Homo sapiens
caggccagggctgggt

SEQ ID NO: 6024765 - DNA, 18 bp, Homo sapiens
caggccagggctgggtca

SEQ ID NO: 6024766 - DNA, 21 bp, Homo sapiens
caggccaggggacccctgcca

SEQ ID NO: 6024767 - DNA, 16 bp, Homo sapiens
caggccaggtgcccag

SEQ ID NO: 6024768 - DNA, 12 bp, Homo sapiens
caggccaggtgg

SEQ ID NO: 6024769 - DNA, 17 bp, Homo sapiens
caggccaggtgggcgga

SEQ ID NO: 6024770 - DNA, 20 bp, Homo sapiens
caggccaggtgggcggacaa

SEQ ID NO: 6024771 - DNA, 23 bp, Homo sapiens
caggccagtaagggaaatagaaa

SEQ ID NO: 6024772 - DNA, 24 bp, Homo sapiens
caggccagtcccacggctctgtgc

SEQ ID NO: 6024773 - DNA, 13 bp, Homo sapiens
caggccagtgcca

SEQ ID NO: 6024774 - DNA, 20 bp, Homo sapiens
caggccagtgccaggacagc

SEQ ID NO: 6024775 - DNA, 19 bp, Homo sapiens
caggccagtgctgtgagca

SEQ ID NO: 6024776 - DNA, 16 bp, Homo sapiens
caggccagtggacaga

SEQ ID NO: 6024777 - DNA, 18 bp, Homo sapiens
caggccagtggacagagg

SEQ ID NO: 6024778 - DNA, 19 bp, Homo sapiens
caggccagtgtctgggttt

SEQ ID NO: 6024779 - DNA, 16 bp, Homo sapiens
caggccatcaccacag

SEQ ID NO: 6024780 - DNA, 21 bp, Homo sapiens
caggccatcatcagtggagcc

SEQ ID NO: 6024781 - DNA, 11 bp, Homo sapiens
caggccatggc

SEQ ID NO: 6024782 - DNA, 17 bp, Homo sapiens
caggccatgtggcctgc

SEQ ID NO: 6024783 - DNA, 18 bp, Homo sapiens
caggccatgtggcctgcc

SEQ ID NO: 6024784 - DNA, 23 bp, Homo sapiens
caggccatgtggcctgcccagcc

SEQ ID NO: 6024785 - DNA, 14 bp, Homo sapiens
caggccattcagtc

SEQ ID NO: 6024786 - DNA, 18 bp, Homo sapiens
caggccattccccgtctc

SEQ ID NO: 6024787 - DNA, 23 bp, Homo sapiens
caggcccaaattatcaagctaat

SEQ ID NO: 6024788 - DNA, 15 bp, Homo sapiens
caggcccaactgtga

SEQ ID NO: 6024789 - DNA, 15 bp, Homo sapiens
caggcccaaggaggg

SEQ ID NO: 6024790 - DNA, 16 bp, Homo sapiens
caggcccaatgctgct

SEQ ID NO: 6024791 - DNA, 17 bp, Homo sapiens
caggcccaatgctgctt

SEQ ID NO: 6024792 - DNA, 18 bp, Homo sapiens
caggcccaatgctgcttt

SEQ ID NO: 6024793 - DNA, 21 bp, Homo sapiens
caggcccacagcgtgggaact

SEQ ID NO: 6024794 - DNA, 16 bp, Homo sapiens
caggcccacaggttta

SEQ ID NO: 6024795 - DNA, 13 bp, Homo sapiens
caggcccacagta

SEQ ID NO: 6024796 - DNA, 12 bp, Homo sapiens
caggcccacatt

SEQ ID NO: 6024797 - DNA, 13 bp, Homo sapiens
caggcccaccctg

SEQ ID NO: 6024798 - DNA, 24 bp, Homo sapiens
caggcccaccctgcttggcccagg

SEQ ID NO: 6024799 - DNA, 11 bp, Homo sapiens
caggcccaccg

SEQ ID NO: 6024800 - DNA, 22 bp, Homo sapiens
caggcccaccggatgctgtgcc

SEQ ID NO: 6024801 - DNA, 23 bp, Homo sapiens
caggcccacctaccttcaaagct

SEQ ID NO: 6024802 - DNA, 22 bp, Homo sapiens
caggcccacgaggagcagcagc

SEQ ID NO: 6024803 - DNA, 14 bp, Homo sapiens
caggcccactcagg

SEQ ID NO: 6024804 - DNA, 12 bp, Homo sapiens
caggcccactcc

SEQ ID NO: 6024805 - DNA, 14 bp, Homo sapiens
caggcccactcccc

SEQ ID NO: 6024806 - DNA, 19 bp, Homo sapiens
caggcccactccccagccc

SEQ ID NO: 6024807 - DNA, 17 bp, Homo sapiens
caggcccactgcagaga

SEQ ID NO: 6024808 - DNA, 12 bp, Homo sapiens
caggcccagaga

SEQ ID NO: 6024809 - DNA, 11 bp, Homo sapiens
caggcccagca

SEQ ID NO: 6024810 - DNA, 12 bp, Homo sapiens
caggcccagcat

SEQ ID NO: 6024811 - DNA, 19 bp, Homo sapiens
caggcccagcattgctggt

SEQ ID NO: 6024812 - DNA, 20 bp, Homo sapiens
caggcccagcattgctggtt

SEQ ID NO: 6024813 - DNA, 21 bp, Homo sapiens
caggcccagcattgctggttc

SEQ ID NO: 6024814 - DNA, 19 bp, Homo sapiens
caggcccagccgaccccct

SEQ ID NO: 6024815 - DNA, 20 bp, Homo sapiens
caggcccagccgaccccctc

SEQ ID NO: 6024816 - DNA, 17 bp, Homo sapiens
caggcccagcctctgcc

SEQ ID NO: 6024817 - DNA, 19 bp, Homo sapiens
caggcccagcctggcccca

SEQ ID NO: 6024818 - DNA, 18 bp, Homo sapiens
caggcccagcgcggccag

SEQ ID NO: 6024819 - DNA, 15 bp, Homo sapiens
caggcccagctgctc

SEQ ID NO: 6024820 - DNA, 16 bp, Homo sapiens
caggcccagctgctcc

SEQ ID NO: 6024821 - DNA, 22 bp, Homo sapiens
caggcccagctgctcccctgga

SEQ ID NO: 6024822 - DNA, 16 bp, Homo sapiens
caggcccagctggggc

SEQ ID NO: 6024823 - DNA, 21 bp, Homo sapiens
caggcccagctttccctgcca

SEQ ID NO: 6024824 - DNA, 15 bp, Homo sapiens
caggcccaggaaggc

SEQ ID NO: 6024825 - DNA, 16 bp, Homo sapiens
caggcccaggagtcca

SEQ ID NO: 6024826 - DNA, 20 bp, Homo sapiens
caggcccaggagtccaggcc

SEQ ID NO: 6024827 - DNA, 12 bp, Homo sapiens
caggcccaggca

SEQ ID NO: 6024828 - DNA, 14 bp, Homo sapiens
caggcccaggcaga

SEQ ID NO: 6024829 - DNA, 16 bp, Homo sapiens
caggcccaggcaggcc

SEQ ID NO: 6024830 - DNA, 13 bp, Homo sapiens
caggcccaggcca

SEQ ID NO: 6024831 - DNA, 15 bp, Homo sapiens
caggcccaggccagc

SEQ ID NO: 6024832 - DNA, 16 bp, Homo sapiens
caggcccaggccagcc

SEQ ID NO: 6024833 - DNA, 17 bp, Homo sapiens
caggcccaggccagccc

SEQ ID NO: 6024834 - DNA, 16 bp, Homo sapiens
caggcccaggcctcac

SEQ ID NO: 6024835 - DNA, 14 bp, Homo sapiens
caggcccagtgaca

SEQ ID NO: 6024836 - DNA, 19 bp, Homo sapiens
caggcccatctcaggtgcc

SEQ ID NO: 6024837 - DNA, 21 bp, Homo sapiens
caggcccatctcaggtgccac

SEQ ID NO: 6024838 - DNA, 18 bp, Homo sapiens
caggcccatgccaaggcc

SEQ ID NO: 6024839 - DNA, 10 bp, Homo sapiens
caggccccac

SEQ ID NO: 6024840 - DNA, 12 bp, Homo sapiens
caggccccaccc

SEQ ID NO: 6024841 - DNA, 16 bp, Homo sapiens
catgtagagaaaagca

SEQ ID NO: 6024842 - DNA, 21 bp, Homo sapiens
catgtagcagacaacacacaa

SEQ ID NO: 6024843 - DNA, 20 bp, Homo sapiens
catgtagcaggactgaattg

SEQ ID NO: 6024844 - DNA, 16 bp, Homo sapiens
catgtagcatataaat

SEQ ID NO: 6024845 - DNA, 19 bp, Homo sapiens
catgtagcatataaatgtt

SEQ ID NO: 6024846 - DNA, 20 bp, Homo sapiens
catgtagcatataaatgttt

SEQ ID NO: 6024847 - DNA, 20 bp, Homo sapiens
catgtagccagcagaactga

SEQ ID NO: 6024848 - DNA, 18 bp, Homo sapiens
catgtagccccctggcct

SEQ ID NO: 6024849 - DNA, 20 bp, Homo sapiens
catgtagccccctggcctct

SEQ ID NO: 6024850 - DNA, 18 bp, Homo sapiens
catgtagcctcaacctcc

SEQ ID NO: 6024851 - DNA, 15 bp, Homo sapiens
catgtagctgagttt

SEQ ID NO: 6024852 - DNA, 23 bp, Homo sapiens
catgtagctgttttaagaaatct

SEQ ID NO: 6024853 - DNA, 16 bp, Homo sapiens
catgtagcttcttctg

SEQ ID NO: 6024854 - DNA, 15 bp, Homo sapiens
catgtaggctaagaa

SEQ ID NO: 6024855 - DNA, 20 bp, Homo sapiens
catgtagggcaagaggatga

SEQ ID NO: 6024856 - DNA, 21 bp, Homo sapiens
catgtagggcaagaggatgaa

SEQ ID NO: 6024857 - DNA, 20 bp, Homo sapiens
catgtaggtgagcctgggca

SEQ ID NO: 6024858 - DNA, 21 bp, Homo sapiens
catgtaggtgagcctgggcag

SEQ ID NO: 6024859 - DNA, 22 bp, Homo sapiens
catgtagtaacactaatatatt

SEQ ID NO: 6024860 - DNA, 23 bp, Homo sapiens
catgtagtaacactaatatattt

SEQ ID NO: 6024861 - DNA, 16 bp, Homo sapiens
catgtagtatcaaata

SEQ ID NO: 6024862 - DNA, 17 bp, Homo sapiens
catgtagtatcaaatat

SEQ ID NO: 6024863 - DNA, 19 bp, Homo sapiens
catgtagtatcaaatatta

SEQ ID NO: 6024864 - DNA, 20 bp, Homo sapiens
catgtagtatcaaatattag

SEQ ID NO: 6024865 - DNA, 22 bp, Homo sapiens
catgtagtatcaaatattagat

SEQ ID NO: 6024866 - DNA, 18 bp, Homo sapiens
catgtataaatgaagttt

SEQ ID NO: 6024867 - DNA, 21 bp, Homo sapiens
catgtataaatgaagtttata

SEQ ID NO: 6024868 - DNA, 15 bp, Homo sapiens
catgtataaatgtga

SEQ ID NO: 6024869 - DNA, 16 bp, Homo sapiens
catgtataaatgtgat

SEQ ID NO: 6024870 - DNA, 13 bp, Homo sapiens
catgtataatttt

SEQ ID NO: 6024871 - DNA, 15 bp, Homo sapiens
catgtatagttgctt

SEQ ID NO: 6024872 - DNA, 17 bp, Homo sapiens
catgtatagttgctttt

SEQ ID NO: 6024873 - DNA, 14 bp, Homo sapiens
catgtatctacctc

SEQ ID NO: 6024874 - DNA, 13 bp, Homo sapiens
catgtatctgtct

SEQ ID NO: 6024875 - DNA, 18 bp, Homo sapiens
catgtatgagtgtatgtg

SEQ ID NO: 6024876 - DNA, 13 bp, Homo sapiens
catgtatgatgag

SEQ ID NO: 6024877 - DNA, 14 bp, Homo sapiens
catgtatgatttct

SEQ ID NO: 6024878 - DNA, 18 bp, Homo sapiens
catgtatgatttctgttg

SEQ ID NO: 6024879 - DNA, 22 bp, Homo sapiens
catgtatggaatcccactgtat

SEQ ID NO: 6024880 - DNA, 22 bp, Homo sapiens
catgtatgtaaatagctaagat

SEQ ID NO: 6024881 - DNA, 14 bp, Homo sapiens
catgtatgtataca

SEQ ID NO: 6024882 - DNA, 19 bp, Homo sapiens
catgtatgtatgagacaga

SEQ ID NO: 6024883 - DNA, 17 bp, Homo sapiens
catgtatgtcttggaca

SEQ ID NO: 6024884 - DNA, 21 bp, Homo sapiens
catgtatgtcttggacactgt

SEQ ID NO: 6024885 - DNA, 15 bp, Homo sapiens
catgtatgtgcacat

SEQ ID NO: 6024886 - DNA, 17 bp, Homo sapiens
catgtatgtgcacatgt

SEQ ID NO: 6024887 - DNA, 19 bp, Homo sapiens
catgtatgtgcacatgtgt

SEQ ID NO: 6024888 - DNA, 13 bp, Homo sapiens
catgtatgtggaa

SEQ ID NO: 6024889 - DNA, 16 bp, Homo sapiens
catgtatgtggataca

SEQ ID NO: 6024890 - DNA, 14 bp, Homo sapiens
catgtatgttatga

SEQ ID NO: 6024891 - DNA, 17 bp, Homo sapiens
catgtatgttatgatat

SEQ ID NO: 6024892 - DNA, 22 bp, Homo sapiens
catgtatgttatgatattgttt

SEQ ID NO: 6024893 - DNA, 13 bp, Homo sapiens
catgtatgttgca

SEQ ID NO: 6024894 - DNA, 12 bp, Homo sapiens
catgtatgtttc

SEQ ID NO: 6024895 - DNA, 22 bp, Homo sapiens
catgtatgttttggtatctgtt

SEQ ID NO: 6024896 - DNA, 15 bp, Homo sapiens
catgtattatcacat

SEQ ID NO: 6024897 - DNA, 15 bp, Homo sapiens
catgtattatgaaaa

SEQ ID NO: 6024898 - DNA, 16 bp, Homo sapiens
catgtattatgaaaaa

SEQ ID NO: 6024899 - DNA, 17 bp, Homo sapiens
catgtattatgaaaaag

SEQ ID NO: 6024900 - DNA, 19 bp, Homo sapiens
catgtattatgaaaaagat

SEQ ID NO: 6024901 - DNA, 19 bp, Homo sapiens
catgtattcactaaaataa

SEQ ID NO: 6024902 - DNA, 14 bp, Homo sapiens
catgtattctgttg

SEQ ID NO: 6024903 - DNA, 22 bp, Homo sapiens
catgtattgaagaggatattct

SEQ ID NO: 6024904 - DNA, 18 bp, Homo sapiens
catgtattgcacattgta

SEQ ID NO: 6024905 - DNA, 21 bp, Homo sapiens
catgtattgcacattgtaaaa

SEQ ID NO: 6024906 - DNA, 18 bp, Homo sapiens
catgtattggcctggagg

SEQ ID NO: 6024907 - DNA, 19 bp, Homo sapiens
catgtattggcctggaggt

SEQ ID NO: 6024908 - DNA, 13 bp, Homo sapiens
catgtattgtaaa

SEQ ID NO: 6024909 - DNA, 15 bp, Homo sapiens
catgtattgtgtctt

SEQ ID NO: 6024910 - DNA, 20 bp, Homo sapiens
catgtattgtgtcttttgca

SEQ ID NO: 6024911 - DNA, 23 bp, Homo sapiens
catgtattgtgtcttttgcatga

SEQ ID NO: 6024912 - DNA, 20 bp, Homo sapiens
catgtatttatctctattta

SEQ ID NO: 6024913 - DNA, 18 bp, Homo sapiens
catgtatttattcctctg

SEQ ID NO: 6024914 - DNA, 15 bp, Homo sapiens
catgtatttcaggga

SEQ ID NO: 6024915 - DNA, 17 bp, Homo sapiens
catgtatttcagggacc

SEQ ID NO: 6024916 - DNA, 22 bp, Homo sapiens
catgtatttcagggacctcagg

SEQ ID NO: 6024917 - DNA, 13 bp, Homo sapiens
catgtatttcttt

SEQ ID NO: 6024918 - DNA, 14 bp, Homo sapiens
catgtatttgagca

SEQ ID NO: 6024919 - DNA, 15 bp, Homo sapiens
catgtatttgttata

SEQ ID NO: 6024920 - DNA, 17 bp, Homo sapiens
catgtatttgttatata

SEQ ID NO: 6024921 - DNA, 14 bp, Homo sapiens
catgtattttatga

SEQ ID NO: 6024922 - DNA, 13 bp, Homo sapiens
catgtattttgtt

SEQ ID NO: 6024923 - DNA, 21 bp, Homo sapiens
catgtcaaacatgagatgtgt

SEQ ID NO: 6024924 - DNA, 14 bp, Homo sapiens
catgtcaaacgtga

SEQ ID NO: 6024925 - DNA, 19 bp, Homo sapiens
catgtcaaacgtgaaaatg

SEQ ID NO: 6024926 - DNA, 22 bp, Homo sapiens
catgtcaaagctgcatgtgtag

SEQ ID NO: 6024927 - DNA, 13 bp, Homo sapiens
catgtcaaagtga

SEQ ID NO: 6024928 - DNA, 22 bp, Homo sapiens
catgtcaacagcgttcctagag

SEQ ID NO: 6024929 - DNA, 22 bp, Homo sapiens
catgtcaacttctggctcctca

SEQ ID NO: 6024930 - DNA, 14 bp, Homo sapiens
catgtcaagattca

SEQ ID NO: 6024931 - DNA, 17 bp, Homo sapiens
catgtcaagattcagct

SEQ ID NO: 6024932 - DNA, 20 bp, Homo sapiens
catgtcaagggttcaagatt

SEQ ID NO: 6024933 - DNA, 21 bp, Homo sapiens
catgtcaattcataaaaacaa

SEQ ID NO: 6024934 - DNA, 16 bp, Homo sapiens
catgtcacaatacagt

SEQ ID NO: 6024935 - DNA, 20 bp, Homo sapiens
catgtcacacaaactgatga

SEQ ID NO: 6024936 - DNA, 14 bp, Homo sapiens
catgtcacatgcca

SEQ ID NO: 6024937 - DNA, 16 bp, Homo sapiens
catgtcacatgccaca

SEQ ID NO: 6024938 - DNA, 21 bp, Homo sapiens
catgtcacatgccacaaccac

SEQ ID NO: 6024939 - DNA, 21 bp, Homo sapiens
catgtcaccggtcagtgcctt

SEQ ID NO: 6024940 - DNA, 23 bp, Homo sapiens
catgtcaccgtggaccttcctgc

SEQ ID NO: 6024941 - DNA, 13 bp, Homo sapiens
catgtcacctggc

SEQ ID NO: 6024942 - DNA, 13 bp, Homo sapiens
catgtcactgcag

SEQ ID NO: 6024943 - DNA, 14 bp, Homo sapiens
catgtcactgtggt

SEQ ID NO: 6024944 - DNA, 14 bp, Homo sapiens
catgtcagacacag

SEQ ID NO: 6024945 - DNA, 13 bp, Homo sapiens
catgtcagagcca

SEQ ID NO: 6024946 - DNA, 18 bp, Homo sapiens
catgtcagagccaggctc

SEQ ID NO: 6024947 - DNA, 19 bp, Homo sapiens
catgtcagagcttggccct

SEQ ID NO: 6024948 - DNA, 22 bp, Homo sapiens
catgtcagaggaccccagggtg

SEQ ID NO: 6024949 - DNA, 20 bp, Homo sapiens
catgtcagataagtgtaaat

SEQ ID NO: 6024950 - DNA, 14 bp, Homo sapiens
catgtcagcaaaaa

SEQ ID NO: 6024951 - DNA, 17 bp, Homo sapiens
catgtcagcaaaaagca

SEQ ID NO: 6024952 - DNA, 19 bp, Homo sapiens
catgtcaggccagcctgtc

SEQ ID NO: 6024953 - DNA, 21 bp, Homo sapiens
catgtcaggcctgtgtgtgaa

SEQ ID NO: 6024954 - DNA, 19 bp, Homo sapiens
catgtcagtctgcttagaa

SEQ ID NO: 6024955 - DNA, 10 bp, Homo sapiens
catgtcatgt

SEQ ID NO: 6024956 - DNA, 22 bp, Homo sapiens
catgtcatgtaggttgtctaaa

SEQ ID NO: 6024957 - DNA, 19 bp, Homo sapiens
catgtcattaatcaatttc

SEQ ID NO: 6024958 - DNA, 14 bp, Homo sapiens
catgtcatttgcac

SEQ ID NO: 6024959 - DNA, 15 bp, Homo sapiens
catgtcatttgcaca

SEQ ID NO: 6024960 - DNA, 17 bp, Homo sapiens
catgtccaaagaggctg

SEQ ID NO: 6024961 - DNA, 18 bp, Homo sapiens
catgtccaaagaggctgc

SEQ ID NO: 6024962 - DNA, 20 bp, Homo sapiens
catgtccaaagaggctgccc

SEQ ID NO: 6024963 - DNA, 22 bp, Homo sapiens
catgtccaagtccaacctgcct

SEQ ID NO: 6024964 - DNA, 15 bp, Homo sapiens
catgtccaagttctt

SEQ ID NO: 6024965 - DNA, 20 bp, Homo sapiens
catgtccaagttcttcacct

SEQ ID NO: 6024966 - DNA, 21 bp, Homo sapiens
catgtccagagggactggaca

SEQ ID NO: 6024967 - DNA, 23 bp, Homo sapiens
catgtccagcaccttgtgcctgg

SEQ ID NO: 6024968 - DNA, 20 bp, Homo sapiens
catgtccagtgagcagtgtt

SEQ ID NO: 6024969 - DNA, 21 bp, Homo sapiens
catgtccagtgagcagtgttg

SEQ ID NO: 6024970 - DNA, 14 bp, Homo sapiens
catgtcccacccac

SEQ ID NO: 6024971 - DNA, 17 bp, Homo sapiens
catgtcccacccacccg

SEQ ID NO: 6024972 - DNA, 17 bp, Homo sapiens
catgtccccagtgtgga

SEQ ID NO: 6024973 - DNA, 19 bp, Homo sapiens
catgtccccagtgtggact

SEQ ID NO: 6024974 - DNA, 10 bp, Homo sapiens
catgtccccc

SEQ ID NO: 6024975 - DNA, 16 bp, Homo sapiens
catgtcccctcccaga

SEQ ID NO: 6024976 - DNA, 18 bp, Homo sapiens
catgtcccctcccagagc

SEQ ID NO: 6024977 - DNA, 12 bp, Homo sapiens
catgtccccttc

SEQ ID NO: 6024978 - DNA, 13 bp, Homo sapiens
catgtccccttcc

SEQ ID NO: 6024979 - DNA, 15 bp, Homo sapiens
catgtccccttcctg

SEQ ID NO: 6024980 - DNA, 16 bp, Homo sapiens
catgtcccgtgtctcc

SEQ ID NO: 6024981 - DNA, 18 bp, Homo sapiens
catgtccctacaaagaac

SEQ ID NO: 6024982 - DNA, 16 bp, Homo sapiens
catgtccctaccgagt

SEQ ID NO: 6024983 - DNA, 14 bp, Homo sapiens
catgtccctccaag

SEQ ID NO: 6024984 - DNA, 17 bp, Homo sapiens
catgtccctccaaggct

SEQ ID NO: 6024985 - DNA, 16 bp, Homo sapiens
catgtccctccaggga

SEQ ID NO: 6024986 - DNA, 21 bp, Homo sapiens
catgtcctaaagaagacattt

SEQ ID NO: 6024987 - DNA, 23 bp, Homo sapiens
catgtcctaaagaagacattttc

SEQ ID NO: 6024988 - DNA, 15 bp, Homo sapiens
catgtcctaggctct

SEQ ID NO: 6024989 - DNA, 18 bp, Homo sapiens
catgtcctatgcctcaca

SEQ ID NO: 6024990 - DNA, 13 bp, Homo sapiens
catgtcctgccta

SEQ ID NO: 6024991 - DNA, 22 bp, Homo sapiens
catgtcctgcctattatctgtc

SEQ ID NO: 6024992 - DNA, 14 bp, Homo sapiens
catgtcctgctggc

SEQ ID NO: 6024993 - DNA, 18 bp, Homo sapiens
catgtcctgctggcttcc

SEQ ID NO: 6024994 - DNA, 20 bp, Homo sapiens
catgtcctgctggcttccag

SEQ ID NO: 6024995 - DNA, 22 bp, Homo sapiens
catgtcctgctggcttccagct

SEQ ID NO: 6024996 - DNA, 16 bp, Homo sapiens
catgtcctgtcctggt

SEQ ID NO: 6024997 - DNA, 17 bp, Homo sapiens
catgtcctgtcctggtc

SEQ ID NO: 6024998 - DNA, 14 bp, Homo sapiens
catgtcctgtgtca

SEQ ID NO: 6024999 - DNA, 18 bp, Homo sapiens
catgtcctgtgtcagttt

SEQ ID NO: 6025000 - DNA, 20 bp, Homo sapiens
catgtcctgtgtcagtttat

SEQ ID NO: 6025001 - DNA, 17 bp, Homo sapiens
catgtccttctgagccc

SEQ ID NO: 6025002 - DNA, 20 bp, Homo sapiens
catgtcctttccatctgtcc

SEQ ID NO: 6025003 - DNA, 14 bp, Homo sapiens
catgtcgcacaatg

SEQ ID NO: 6025004 - DNA, 14 bp, Homo sapiens
catgtcgcctctgc

SEQ ID NO: 6025005 - DNA, 18 bp, Homo sapiens
catgtcgcctctgcattc

SEQ ID NO: 6025006 - DNA, 19 bp, Homo sapiens
catgtcgcgctcagcatgc

SEQ ID NO: 6025007 - DNA, 22 bp, Homo sapiens
catgtcgctagccagtgctcca

SEQ ID NO: 6025008 - DNA, 15 bp, Homo sapiens
catgtcgctccggtc

SEQ ID NO: 6025009 - DNA, 16 bp, Homo sapiens
catgtcgctccggtca

SEQ ID NO: 6025010 - DNA, 13 bp, Homo sapiens
catgtcggcctct

SEQ ID NO: 6025011 - DNA, 14 bp, Homo sapiens
catgtcggcctcta

SEQ ID NO: 6025012 - DNA, 17 bp, Homo sapiens
catgtcggggcccctgc

SEQ ID NO: 6025013 - DNA, 21 bp, Homo sapiens
catgtcgtggacacacacaga

SEQ ID NO: 6025014 - DNA, 14 bp, Homo sapiens
catgtctaaagtta

SEQ ID NO: 6025015 - DNA, 23 bp, Homo sapiens
catgtctaacctgatttacctct

SEQ ID NO: 6025016 - DNA, 22 bp, Homo sapiens
catgtctaattcatttactcac

SEQ ID NO: 6025017 - DNA, 14 bp, Homo sapiens
catgtctacaaaag

SEQ ID NO: 6025018 - DNA, 17 bp, Homo sapiens
catgtctacaaaagcaa

SEQ ID NO: 6025019 - DNA, 14 bp, Homo sapiens
caggccccacccct

SEQ ID NO: 6025020 - DNA, 15 bp, Homo sapiens
caggccccacccctg

SEQ ID NO: 6025021 - DNA, 18 bp, Homo sapiens
caggccccaccccttccc

SEQ ID NO: 6025022 - DNA, 19 bp, Homo sapiens
caggccccaccggccaggc

SEQ ID NO: 6025023 - DNA, 21 bp, Homo sapiens
caggccccaccggccaggccg

SEQ ID NO: 6025024 - DNA, 22 bp, Homo sapiens
caggccccagccaagtgccttc

SEQ ID NO: 6025025 - DNA, 13 bp, Homo sapiens
caggccccaggaa

SEQ ID NO: 6025026 - DNA, 15 bp, Homo sapiens
caggccccaggaagc

SEQ ID NO: 6025027 - DNA, 16 bp, Homo sapiens
caggccccaggaagcc

SEQ ID NO: 6025028 - DNA, 17 bp, Homo sapiens
caggccccaggaagccg

SEQ ID NO: 6025029 - DNA, 12 bp, Homo sapiens
caggccccaggc

SEQ ID NO: 6025030 - DNA, 13 bp, Homo sapiens
caggccccaggct

SEQ ID NO: 6025031 - DNA, 17 bp, Homo sapiens
caggccccaggctggat

SEQ ID NO: 6025032 - DNA, 13 bp, Homo sapiens
caggccccaggtc

SEQ ID NO: 6025033 - DNA, 14 bp, Homo sapiens
caggccccatgacc

SEQ ID NO: 6025034 - DNA, 18 bp, Homo sapiens
caggccccatggagggta

SEQ ID NO: 6025035 - DNA, 17 bp, Homo sapiens
caggcccccaacccctc

SEQ ID NO: 6025036 - DNA, 22 bp, Homo sapiens
caggcccccaacccctccttcc

SEQ ID NO: 6025037 - DNA, 17 bp, Homo sapiens
caggcccccaagcctgc

SEQ ID NO: 6025038 - DNA, 18 bp, Homo sapiens
caggcccccaagcctgca

SEQ ID NO: 6025039 - DNA, 21 bp, Homo sapiens
caggcccccaccacacatccc

SEQ ID NO: 6025040 - DNA, 22 bp, Homo sapiens
caggcccccaccacacatccca

SEQ ID NO: 6025041 - DNA, 15 bp, Homo sapiens
caggcccccaccact

SEQ ID NO: 6025042 - DNA, 17 bp, Homo sapiens
caggcccccacctggct

SEQ ID NO: 6025043 - DNA, 14 bp, Homo sapiens
caggcccccaggtg

SEQ ID NO: 6025044 - DNA, 20 bp, Homo sapiens
caggcccccaggtgccagtt

SEQ ID NO: 6025045 - DNA, 19 bp, Homo sapiens
caggccccccgcagcaccc

SEQ ID NO: 6025046 - DNA, 22 bp, Homo sapiens
caggccccccgcagcaccctgc

SEQ ID NO: 6025047 - DNA, 17 bp, Homo sapiens
caggcccccgccttggc

SEQ ID NO: 6025048 - DNA, 20 bp, Homo sapiens
caggcccccgccttggcctg

SEQ ID NO: 6025049 - DNA, 22 bp, Homo sapiens
caggcccccggctttcctccgg

SEQ ID NO: 6025050 - DNA, 17 bp, Homo sapiens
caggcccccgttgaagc

SEQ ID NO: 6025051 - DNA, 19 bp, Homo sapiens
caggcccccgttgaagccg

SEQ ID NO: 6025052 - DNA, 23 bp, Homo sapiens
caggcccccgttgaagccgctcc

SEQ ID NO: 6025053 - DNA, 13 bp, Homo sapiens
caggccccctagg

SEQ ID NO: 6025054 - DNA, 14 bp, Homo sapiens
caggccccctagga

SEQ ID NO: 6025055 - DNA, 15 bp, Homo sapiens
caggccccctgcatc

SEQ ID NO: 6025056 - DNA, 17 bp, Homo sapiens
caggccccgaggaccca

SEQ ID NO: 6025057 - DNA, 18 bp, Homo sapiens
caggccccgaggacccag

SEQ ID NO: 6025058 - DNA, 20 bp, Homo sapiens
caggccccgccccctcggcc

SEQ ID NO: 6025059 - DNA, 17 bp, Homo sapiens
caggccccgcttgtcca

SEQ ID NO: 6025060 - DNA, 19 bp, Homo sapiens
caggccccgcttgtccagc

SEQ ID NO: 6025061 - DNA, 22 bp, Homo sapiens
caggccccgcttgtccagcgcc

SEQ ID NO: 6025062 - DNA, 19 bp, Homo sapiens
caggccccgggcttccctt

SEQ ID NO: 6025063 - DNA, 17 bp, Homo sapiens
caggcccctccctctcc

SEQ ID NO: 6025064 - DNA, 15 bp, Homo sapiens
caggcccctctcctc

SEQ ID NO: 6025065 - DNA, 16 bp, Homo sapiens
caggcccctctcctcc

SEQ ID NO: 6025066 - DNA, 20 bp, Homo sapiens
caggcccctgaggactggag

SEQ ID NO: 6025067 - DNA, 15 bp, Homo sapiens
caggcccctgccacc

SEQ ID NO: 6025068 - DNA, 17 bp, Homo sapiens
caggcccctgccaccct

SEQ ID NO: 6025069 - DNA, 13 bp, Homo sapiens
caggcccctggag

SEQ ID NO: 6025070 - DNA, 14 bp, Homo sapiens
caggcccctggagg

SEQ ID NO: 6025071 - DNA, 19 bp, Homo sapiens
caggcccctggaggctgcc

SEQ ID NO: 6025072 - DNA, 22 bp, Homo sapiens
caggcccctggaggctgcctcc

SEQ ID NO: 6025073 - DNA, 21 bp, Homo sapiens
caggcccctgttatgcttagg

SEQ ID NO: 6025074 - DNA, 18 bp, Homo sapiens
caggcccgaaagaggcac

SEQ ID NO: 6025075 - DNA, 22 bp, Homo sapiens
caggcccgaaggtctctctggc

SEQ ID NO: 6025076 - DNA, 20 bp, Homo sapiens
caggcccgacagagagatga

SEQ ID NO: 6025077 - DNA, 23 bp, Homo sapiens
caggcccgagatgtgacccacca

SEQ ID NO: 6025078 - DNA, 15 bp, Homo sapiens
caggcccgagcgcct

SEQ ID NO: 6025079 - DNA, 21 bp, Homo sapiens
caggcccgcaccccggcctca

SEQ ID NO: 6025080 - DNA, 22 bp, Homo sapiens
caggcccgcaccccggcctcag

SEQ ID NO: 6025081 - DNA, 17 bp, Homo sapiens
caggcccgcactggggg

SEQ ID NO: 6025082 - DNA, 23 bp, Homo sapiens
caggcccgccctctgcctcctca

SEQ ID NO: 6025083 - DNA, 21 bp, Homo sapiens
caggcccgccctgcccgcgcc

SEQ ID NO: 6025084 - DNA, 22 bp, Homo sapiens
caggcccgcgggcacagccagc

SEQ ID NO: 6025085 - DNA, 14 bp, Homo sapiens
caggcccggatgca

SEQ ID NO: 6025086 - DNA, 18 bp, Homo sapiens
caggcccggatgcagagg

SEQ ID NO: 6025087 - DNA, 22 bp, Homo sapiens
caggcccggatgcagaggcctg

SEQ ID NO: 6025088 - DNA, 19 bp, Homo sapiens
caggcccggcatgaggccc

SEQ ID NO: 6025089 - DNA, 21 bp, Homo sapiens
caggcccggcccagcctaggc

SEQ ID NO: 6025090 - DNA, 18 bp, Homo sapiens
caggcccggcgcggtggc

SEQ ID NO: 6025091 - DNA, 19 bp, Homo sapiens
caggcccggcgcggtggct

SEQ ID NO: 6025092 - DNA, 18 bp, Homo sapiens
caggcccggctccaggct

SEQ ID NO: 6025093 - DNA, 22 bp, Homo sapiens
caggcccggctccaggctcctt

SEQ ID NO: 6025094 - DNA, 14 bp, Homo sapiens
caggcccggggctg

SEQ ID NO: 6025095 - DNA, 18 bp, Homo sapiens
caggcccggtgaggccaa

SEQ ID NO: 6025096 - DNA, 17 bp, Homo sapiens
caggcccgtcagcatca

SEQ ID NO: 6025097 - DNA, 20 bp, Homo sapiens
caggcccgtcagcatcactg

SEQ ID NO: 6025098 - DNA, 19 bp, Homo sapiens
caggcccgtcggagctgcc

SEQ ID NO: 6025099 - DNA, 24 bp, Homo sapiens
caggcccgtcggagctgcctgcag

SEQ ID NO: 6025100 - DNA, 17 bp, Homo sapiens
caggcccgtctgtccat

SEQ ID NO: 6025101 - DNA, 19 bp, Homo sapiens
caggcccgtctgtccatct

SEQ ID NO: 6025102 - DNA, 20 bp, Homo sapiens
caggcccgtctgtccatctg

SEQ ID NO: 6025103 - DNA, 22 bp, Homo sapiens
caggcccgtctgtccatctgcc

SEQ ID NO: 6025104 - DNA, 16 bp, Homo sapiens
caggcccgtgggcgca

SEQ ID NO: 6025105 - DNA, 17 bp, Homo sapiens
caggccctacaatgctc

SEQ ID NO: 6025106 - DNA, 15 bp, Homo sapiens
caggccctcagatgg

SEQ ID NO: 6025107 - DNA, 16 bp, Homo sapiens
caggccctccatgggc

SEQ ID NO: 6025108 - DNA, 20 bp, Homo sapiens
caggccctccatgggctagt

SEQ ID NO: 6025109 - DNA, 20 bp, Homo sapiens
caggccctcccaccacccca

SEQ ID NO: 6025110 - DNA, 16 bp, Homo sapiens
caggccctccctgact

SEQ ID NO: 6025111 - DNA, 19 bp, Homo sapiens
caggccctccctgactccc

SEQ ID NO: 6025112 - DNA, 16 bp, Homo sapiens
caggccctccctgtct

SEQ ID NO: 6025113 - DNA, 23 bp, Homo sapiens
caggccctccctgtctccagggc

SEQ ID NO: 6025114 - DNA, 11 bp, Homo sapiens
caggccctcct

SEQ ID NO: 6025115 - DNA, 23 bp, Homo sapiens
caggccctcctccctcccagctc

SEQ ID NO: 6025116 - DNA, 13 bp, Homo sapiens
caggccctcctgc

SEQ ID NO: 6025117 - DNA, 16 bp, Homo sapiens
caggccctcctgctgg

SEQ ID NO: 6025118 - DNA, 17 bp, Homo sapiens
caggccctcctgctggc

SEQ ID NO: 6025119 - DNA, 21 bp, Homo sapiens
caggccctctgcccactccct

SEQ ID NO: 6025120 - DNA, 14 bp, Homo sapiens
caggccctctgcct

SEQ ID NO: 6025121 - DNA, 16 bp, Homo sapiens
caggccctctgcctgc

SEQ ID NO: 6025122 - DNA, 13 bp, Homo sapiens
caggccctctgtg

SEQ ID NO: 6025123 - DNA, 14 bp, Homo sapiens
caggccctctgtgg

SEQ ID NO: 6025124 - DNA, 15 bp, Homo sapiens
caggccctctgtggc

SEQ ID NO: 6025125 - DNA, 16 bp, Homo sapiens
caggccctctgtggcc

SEQ ID NO: 6025126 - DNA, 18 bp, Homo sapiens
caggccctctgtggcctg

SEQ ID NO: 6025127 - DNA, 21 bp, Homo sapiens
caggccctgactcctctggct

SEQ ID NO: 6025128 - DNA, 22 bp, Homo sapiens
caggccctgactcctctggctt

SEQ ID NO: 6025129 - DNA, 18 bp, Homo sapiens
caggccctgagagtctgg

SEQ ID NO: 6025130 - DNA, 13 bp, Homo sapiens
caggccctgcact

SEQ ID NO: 6025131 - DNA, 16 bp, Homo sapiens
caggccctgcactgtc

SEQ ID NO: 6025132 - DNA, 18 bp, Homo sapiens
caggccctgcactgtcct

SEQ ID NO: 6025133 - DNA, 20 bp, Homo sapiens
caggccctgcactgtcctgc

SEQ ID NO: 6025134 - DNA, 18 bp, Homo sapiens
caggccctgcccagccag

SEQ ID NO: 6025135 - DNA, 21 bp, Homo sapiens
caggccctgcccagccagcca

SEQ ID NO: 6025136 - DNA, 14 bp, Homo sapiens
caggccctgctcat

SEQ ID NO: 6025137 - DNA, 21 bp, Homo sapiens
caggccctggagggcagagac

SEQ ID NO: 6025138 - DNA, 14 bp, Homo sapiens
caggccctggcctc

SEQ ID NO: 6025139 - DNA, 15 bp, Homo sapiens
caggccctggcctcc

SEQ ID NO: 6025140 - DNA, 22 bp, Homo sapiens
caggccctggctgagggcagct

SEQ ID NO: 6025141 - DNA, 22 bp, Homo sapiens
caggccctgggcctccacctct

SEQ ID NO: 6025142 - DNA, 23 bp, Homo sapiens
caggccctgggcctccacctctg

SEQ ID NO: 6025143 - DNA, 12 bp, Homo sapiens
caggccctgggt

SEQ ID NO: 6025144 - DNA, 21 bp, Homo sapiens
caggccctgggtcttgccatg

SEQ ID NO: 6025145 - DNA, 17 bp, Homo sapiens
caggcccttagggaagt

SEQ ID NO: 6025146 - DNA, 19 bp, Homo sapiens
caggcccttagggaagttg

SEQ ID NO: 6025147 - DNA, 21 bp, Homo sapiens
caggcccttcctctccactgc

SEQ ID NO: 6025148 - DNA, 23 bp, Homo sapiens
caggcccttcctctccactgcct

SEQ ID NO: 6025149 - DNA, 18 bp, Homo sapiens
caggcccttggctgcagg

SEQ ID NO: 6025150 - DNA, 20 bp, Homo sapiens
caggcccttggctgcaggca

SEQ ID NO: 6025151 - DNA, 12 bp, Homo sapiens
caggcccttggg

SEQ ID NO: 6025152 - DNA, 15 bp, Homo sapiens
caggcccttggggtt

SEQ ID NO: 6025153 - DNA, 19 bp, Homo sapiens
caggcccttggtagagctg

SEQ ID NO: 6025154 - DNA, 21 bp, Homo sapiens
caggcccttggtagagctggt

SEQ ID NO: 6025155 - DNA, 16 bp, Homo sapiens
caggccctttggcttc

SEQ ID NO: 6025156 - DNA, 19 bp, Homo sapiens
caggccctttggcttctga

SEQ ID NO: 6025157 - DNA, 17 bp, Homo sapiens
caggccgacaggaggcc

SEQ ID NO: 6025158 - DNA, 19 bp, Homo sapiens
caggccgacaggaggccat

SEQ ID NO: 6025159 - DNA, 18 bp, Homo sapiens
caggccgacagtcggtga

SEQ ID NO: 6025160 - DNA, 14 bp, Homo sapiens
caggccgagagcct

SEQ ID NO: 6025161 - DNA, 18 bp, Homo sapiens
caggccgcagctcttgcc

SEQ ID NO: 6025162 - DNA, 22 bp, Homo sapiens
caggccgcagctcttgcccttc

SEQ ID NO: 6025163 - DNA, 22 bp, Homo sapiens
caggccgcatggcccctccagg

SEQ ID NO: 6025164 - DNA, 14 bp, Homo sapiens
caggccgccccagc

SEQ ID NO: 6025165 - DNA, 20 bp, Homo sapiens
caggccgccccagcctctga

SEQ ID NO: 6025166 - DNA, 16 bp, Homo sapiens
caggccgcgcccagca

SEQ ID NO: 6025167 - DNA, 19 bp, Homo sapiens
caggccgcgcccagcagag

SEQ ID NO: 6025168 - DNA, 18 bp, Homo sapiens
caggccgcgccctttccc

SEQ ID NO: 6025169 - DNA, 16 bp, Homo sapiens
caggccggaaccacag

SEQ ID NO: 6025170 - DNA, 17 bp, Homo sapiens
caggccggaaccacagg

SEQ ID NO: 6025171 - DNA, 21 bp, Homo sapiens
caggccggaaccacagggcca

SEQ ID NO: 6025172 - DNA, 22 bp, Homo sapiens
caggccggaaccacagggccag

SEQ ID NO: 6025173 - DNA, 14 bp, Homo sapiens
caggccggagccca

SEQ ID NO: 6025174 - DNA, 14 bp, Homo sapiens
caggccggccagcc

SEQ ID NO: 6025175 - DNA, 16 bp, Homo sapiens
caggccggcccagatg

SEQ ID NO: 6025176 - DNA, 20 bp, Homo sapiens
caggccggcgagccctgtgg

SEQ ID NO: 6025177 - DNA, 20 bp, Homo sapiens
caggccggcttgccacaccc

SEQ ID NO: 6025178 - DNA, 19 bp, Homo sapiens
caggccgggcacagtggct

SEQ ID NO: 6025179 - DNA, 17 bp, Homo sapiens
caggccgggcctgtaca

SEQ ID NO: 6025180 - DNA, 19 bp, Homo sapiens
caggccgggcctgtacagt

SEQ ID NO: 6025181 - DNA, 21 bp, Homo sapiens
caggccgggcctgtacagtct

SEQ ID NO: 6025182 - DNA, 18 bp, Homo sapiens
caggccgggcttgggccc

SEQ ID NO: 6025183 - DNA, 19 bp, Homo sapiens
caggccgggcttgggccct

SEQ ID NO: 6025184 - DNA, 24 bp, Homo sapiens
caggccgggctttccagaaggcca

SEQ ID NO: 6025185 - DNA, 19 bp, Homo sapiens
caggccggggtggagcatg

SEQ ID NO: 6025186 - DNA, 16 bp, Homo sapiens
caggccgtcaccctgg

SEQ ID NO: 6025187 - DNA, 19 bp, Homo sapiens
caggccgtcaccctgggag

SEQ ID NO: 6025188 - DNA, 14 bp, Homo sapiens
caggccgtgccttg

SEQ ID NO: 6025189 - DNA, 15 bp, Homo sapiens
caggccgtggctgcc

SEQ ID NO: 6025190 - DNA, 17 bp, Homo sapiens
caggccgtggctgccca

SEQ ID NO: 6025191 - DNA, 21 bp, Homo sapiens
caggccgtgggacccaggctc

SEQ ID NO: 6025192 - DNA, 13 bp, Homo sapiens
caggcctacagaa

SEQ ID NO: 6025193 - DNA, 19 bp, Homo sapiens
caggcctacagccacatcc

SEQ ID NO: 6025194 - DNA, 18 bp, Homo sapiens
caggcctactcctgtctt

SEQ ID NO: 6025195 - DNA, 15 bp, Homo sapiens
catgtctacttttta

SEQ ID NO: 6025196 - DNA, 16 bp, Homo sapiens
catgtctactttttaa

SEQ ID NO: 6025197 - DNA, 17 bp, Homo sapiens
catgtctactttttaat

SEQ ID NO: 6025198 - DNA, 20 bp, Homo sapiens
catgtctactttttaatttt

SEQ ID NO: 6025199 - DNA, 17 bp, Homo sapiens
catgtctattccattcc

SEQ ID NO: 6025200 - DNA, 19 bp, Homo sapiens
catgtctattccattccct

SEQ ID NO: 6025201 - DNA, 14 bp, Homo sapiens
catgtctattgtcc

SEQ ID NO: 6025202 - DNA, 14 bp, Homo sapiens
catgtctcatattt

SEQ ID NO: 6025203 - DNA, 22 bp, Homo sapiens
catgtctccccagttccacagc

SEQ ID NO: 6025204 - DNA, 17 bp, Homo sapiens
catgtctcctatcctgg

SEQ ID NO: 6025205 - DNA, 22 bp, Homo sapiens
catgtctcctttaagagctctg

SEQ ID NO: 6025206 - DNA, 14 bp, Homo sapiens
catgtctctctgcc

SEQ ID NO: 6025207 - DNA, 12 bp, Homo sapiens
catgtctctgat

SEQ ID NO: 6025208 - DNA, 13 bp, Homo sapiens
catgtctctgctt

SEQ ID NO: 6025209 - DNA, 14 bp, Homo sapiens
catgtctctgcttc

SEQ ID NO: 6025210 - DNA, 16 bp, Homo sapiens
catgtctctgcttcca

SEQ ID NO: 6025211 - DNA, 17 bp, Homo sapiens
catgtctctgcttccat

SEQ ID NO: 6025212 - DNA, 20 bp, Homo sapiens
catgtctctttggggagagc

SEQ ID NO: 6025213 - DNA, 13 bp, Homo sapiens
catgtctgaaaaa

SEQ ID NO: 6025214 - DNA, 24 bp, Homo sapiens
catgtctgaaaaatgcctgctgct

SEQ ID NO: 6025215 - DNA, 22 bp, Homo sapiens
catgtctgagcggcgcagagcc

SEQ ID NO: 6025216 - DNA, 14 bp, Homo sapiens
catgtctgcatttc

SEQ ID NO: 6025217 - DNA, 23 bp, Homo sapiens
catgtctgcatttcggtggctag

SEQ ID NO: 6025218 - DNA, 21 bp, Homo sapiens
catgtctgcctatgcactgaa

SEQ ID NO: 6025219 - DNA, 12 bp, Homo sapiens
catgtctgcctg

SEQ ID NO: 6025220 - DNA, 14 bp, Homo sapiens
catgtctgcctgga

SEQ ID NO: 6025221 - DNA, 15 bp, Homo sapiens
catgtctgcctggag

SEQ ID NO: 6025222 - DNA, 16 bp, Homo sapiens
catgtctgcctggagt

SEQ ID NO: 6025223 - DNA, 23 bp, Homo sapiens
catgtctgcctggagtgctgtgc

SEQ ID NO: 6025224 - DNA, 13 bp, Homo sapiens
catgtctgcttgt

SEQ ID NO: 6025225 - DNA, 13 bp, Homo sapiens
catgtctgtatac

SEQ ID NO: 6025226 - DNA, 22 bp, Homo sapiens
catgtctgtatccccagtgccc

SEQ ID NO: 6025227 - DNA, 23 bp, Homo sapiens
catgtctgtatccccagtgcccg

SEQ ID NO: 6025228 - DNA, 20 bp, Homo sapiens
catgtctgtcctcagagcag

SEQ ID NO: 6025229 - DNA, 18 bp, Homo sapiens
catgtcttaaatgctcat

SEQ ID NO: 6025230 - DNA, 21 bp, Homo sapiens
catgtcttaaatgctcataaa

SEQ ID NO: 6025231 - DNA, 14 bp, Homo sapiens
catgtcttaatgaa

SEQ ID NO: 6025232 - DNA, 20 bp, Homo sapiens
catgtcttaatgaagtttga

SEQ ID NO: 6025233 - DNA, 15 bp, Homo sapiens
catgtcttatttaaa

SEQ ID NO: 6025234 - DNA, 23 bp, Homo sapiens
catgtcttccattaagaacacta

SEQ ID NO: 6025235 - DNA, 15 bp, Homo sapiens
catgtcttctccctg

SEQ ID NO: 6025236 - DNA, 11 bp, Homo sapiens
catgtcttctg

SEQ ID NO: 6025237 - DNA, 19 bp, Homo sapiens
catgtcttctgctgttctt

SEQ ID NO: 6025238 - DNA, 15 bp, Homo sapiens
catgtcttgtgcata

SEQ ID NO: 6025239 - DNA, 16 bp, Homo sapiens
catgtcttgtgcataa

SEQ ID NO: 6025240 - DNA, 23 bp, Homo sapiens
catgtctttattagtaacatcat

SEQ ID NO: 6025241 - DNA, 15 bp, Homo sapiens
catgtctttcctatt

SEQ ID NO: 6025242 - DNA, 22 bp, Homo sapiens
catgtctttggcttcagaattg

SEQ ID NO: 6025243 - DNA, 14 bp, Homo sapiens
catgtcttttcttg

SEQ ID NO: 6025244 - DNA, 21 bp, Homo sapiens
catgtcttttcttgcatgagg

SEQ ID NO: 6025245 - DNA, 19 bp, Homo sapiens
catgtgaaaatcaaataca

SEQ ID NO: 6025246 - DNA, 18 bp, Homo sapiens
catgtgaaacctttttta

SEQ ID NO: 6025247 - DNA, 24 bp, Homo sapiens
catgtgaaaccttttttaagattt

SEQ ID NO: 6025248 - DNA, 12 bp, Homo sapiens
catgtgaaactc

SEQ ID NO: 6025249 - DNA, 18 bp, Homo sapiens
catgtgaaactcatctca

SEQ ID NO: 6025250 - DNA, 15 bp, Homo sapiens
catgtgaacccggga

SEQ ID NO: 6025251 - DNA, 22 bp, Homo sapiens
catgtgaattctgtgaagaatg

SEQ ID NO: 6025252 - DNA, 14 bp, Homo sapiens
catgtgacacccac

SEQ ID NO: 6025253 - DNA, 16 bp, Homo sapiens
catgtgaccactctgt

SEQ ID NO: 6025254 - DNA, 18 bp, Homo sapiens
catgtgaccactctgtct

SEQ ID NO: 6025255 - DNA, 23 bp, Homo sapiens
catgtgaccattctgcctctcct

SEQ ID NO: 6025256 - DNA, 23 bp, Homo sapiens
catgtgactaaaaatgcatctgg

SEQ ID NO: 6025257 - DNA, 12 bp, Homo sapiens
catgtgactctg

SEQ ID NO: 6025258 - DNA, 17 bp, Homo sapiens
catgtgactctgaagct

SEQ ID NO: 6025259 - DNA, 20 bp, Homo sapiens
catgtgactctggcttggcc

SEQ ID NO: 6025260 - DNA, 23 bp, Homo sapiens
catgtgactgtattacctattca

SEQ ID NO: 6025261 - DNA, 15 bp, Homo sapiens
catgtgagatagttt

SEQ ID NO: 6025262 - DNA, 18 bp, Homo sapiens
catgtgagcatggtcaca

SEQ ID NO: 6025263 - DNA, 14 bp, Homo sapiens
catgtgagctcttc

SEQ ID NO: 6025264 - DNA, 19 bp, Homo sapiens
catgtgaggactgggggca

SEQ ID NO: 6025265 - DNA, 14 bp, Homo sapiens
catgtgaggaggaa

SEQ ID NO: 6025266 - DNA, 18 bp, Homo sapiens
catgtgaggaggaaaagg

SEQ ID NO: 6025267 - DNA, 23 bp, Homo sapiens
catgtgaggaggaaaaggaaaaa

SEQ ID NO: 6025268 - DNA, 17 bp, Homo sapiens
catgtgaggttaaacca

SEQ ID NO: 6025269 - DNA, 16 bp, Homo sapiens
catgtgagtctgggat

SEQ ID NO: 6025270 - DNA, 12 bp, Homo sapiens
catgtgataatt

SEQ ID NO: 6025271 - DNA, 20 bp, Homo sapiens
catgtgataattgtaaaggt

SEQ ID NO: 6025272 - DNA, 16 bp, Homo sapiens
catgtgatccttttat

SEQ ID NO: 6025273 - DNA, 19 bp, Homo sapiens
catgtgatccttttatgtt

SEQ ID NO: 6025274 - DNA, 20 bp, Homo sapiens
catgtgatctattactctga

SEQ ID NO: 6025275 - DNA, 23 bp, Homo sapiens
catgtgatctattactctgacat

SEQ ID NO: 6025276 - DNA, 18 bp, Homo sapiens
catgtgatgagaggaaat

SEQ ID NO: 6025277 - DNA, 19 bp, Homo sapiens
catgtgatggacactccag

SEQ ID NO: 6025278 - DNA, 21 bp, Homo sapiens
catgtgatggacactccaggg

SEQ ID NO: 6025279 - DNA, 16 bp, Homo sapiens
catgtgattaatgttt

SEQ ID NO: 6025280 - DNA, 20 bp, Homo sapiens
catgtgattaatgttttcat

SEQ ID NO: 6025281 - DNA, 22 bp, Homo sapiens
catgtgattaatgttttcatta

SEQ ID NO: 6025282 - DNA, 22 bp, Homo sapiens
catgtgattcactgccttcctc

SEQ ID NO: 6025283 - DNA, 20 bp, Homo sapiens
catgtgattggcagcttcaa

SEQ ID NO: 6025284 - DNA, 16 bp, Homo sapiens
catgtgcaactcttgt

SEQ ID NO: 6025285 - DNA, 14 bp, Homo sapiens
catgtgcacatgca

SEQ ID NO: 6025286 - DNA, 20 bp, Homo sapiens
catgtgcacccggcctggat

SEQ ID NO: 6025287 - DNA, 21 bp, Homo sapiens
catgtgcacccggcctggatg

SEQ ID NO: 6025288 - DNA, 19 bp, Homo sapiens
catgtgcacctatggccca

SEQ ID NO: 6025289 - DNA, 12 bp, Homo sapiens
catgtgcagaca

SEQ ID NO: 6025290 - DNA, 20 bp, Homo sapiens
catgtgcagacactcaagag

SEQ ID NO: 6025291 - DNA, 15 bp, Homo sapiens
catgtgcatagtttc

SEQ ID NO: 6025292 - DNA, 14 bp, Homo sapiens
catgtgcatataaa

SEQ ID NO: 6025293 - DNA, 11 bp, Homo sapiens
catgtgccaag

SEQ ID NO: 6025294 - DNA, 13 bp, Homo sapiens
catgtgccaccac

SEQ ID NO: 6025295 - DNA, 14 bp, Homo sapiens
catgtgcccagtta

SEQ ID NO: 6025296 - DNA, 13 bp, Homo sapiens
catgtgcccctgc

SEQ ID NO: 6025297 - DNA, 13 bp, Homo sapiens
catgtgccctcag

SEQ ID NO: 6025298 - DNA, 12 bp, Homo sapiens
catgtgccctgc

SEQ ID NO: 6025299 - DNA, 16 bp, Homo sapiens
catgtgcctctttgtc

SEQ ID NO: 6025300 - DNA, 16 bp, Homo sapiens
catgtgcctgcaccag

SEQ ID NO: 6025301 - DNA, 19 bp, Homo sapiens
catgtgcctgtattcccag

SEQ ID NO: 6025302 - DNA, 19 bp, Homo sapiens
catgtgccttgtccaggaa

SEQ ID NO: 6025303 - DNA, 14 bp, Homo sapiens
catgtgcctttctt

SEQ ID NO: 6025304 - DNA, 19 bp, Homo sapiens
catgtgcctttctttgcct

SEQ ID NO: 6025305 - DNA, 22 bp, Homo sapiens
catgtgcctttctttgcctctg

SEQ ID NO: 6025306 - DNA, 19 bp, Homo sapiens
catgtgcggagcagccttt

SEQ ID NO: 6025307 - DNA, 16 bp, Homo sapiens
catgtgcggctgaact

SEQ ID NO: 6025308 - DNA, 18 bp, Homo sapiens
catgtgcggctgaactga

SEQ ID NO: 6025309 - DNA, 20 bp, Homo sapiens
catgtgcggctgaactgaga

SEQ ID NO: 6025310 - DNA, 14 bp, Homo sapiens
catgtgcgtggaag

SEQ ID NO: 6025311 - DNA, 15 bp, Homo sapiens
catgtgcgtggaagt

SEQ ID NO: 6025312 - DNA, 16 bp, Homo sapiens
catgtgcgtggaagtg

SEQ ID NO: 6025313 - DNA, 19 bp, Homo sapiens
catgtgcgtggaagtgttc

SEQ ID NO: 6025314 - DNA, 21 bp, Homo sapiens
catgtgcgtggaagtgttcct

SEQ ID NO: 6025315 - DNA, 18 bp, Homo sapiens
catgtgctaataagtttg

SEQ ID NO: 6025316 - DNA, 21 bp, Homo sapiens
catgtgctagtcactggcagc

SEQ ID NO: 6025317 - DNA, 22 bp, Homo sapiens
catgtgctattgaactgagcca

SEQ ID NO: 6025318 - DNA, 18 bp, Homo sapiens
catgtgctgatgtttaca

SEQ ID NO: 6025319 - DNA, 24 bp, Homo sapiens
catgtgctgccctacagcaccctg

SEQ ID NO: 6025320 - DNA, 15 bp, Homo sapiens
catgtgctgctgtgg

SEQ ID NO: 6025321 - DNA, 17 bp, Homo sapiens
catgtgctgctgtggca

SEQ ID NO: 6025322 - DNA, 19 bp, Homo sapiens
catgtgctgggaaatgcag

SEQ ID NO: 6025323 - DNA, 22 bp, Homo sapiens
catgtgctgggaaatgcagaaa

SEQ ID NO: 6025324 - DNA, 17 bp, Homo sapiens
catgtgctgtctccatg

SEQ ID NO: 6025325 - DNA, 23 bp, Homo sapiens
catgtgctgtgaccatttataat

SEQ ID NO: 6025326 - DNA, 15 bp, Homo sapiens
catgtgcttctgcca

SEQ ID NO: 6025327 - DNA, 16 bp, Homo sapiens
catgtgcttgtgccta

SEQ ID NO: 6025328 - DNA, 18 bp, Homo sapiens
catgtggaaaactcacag

SEQ ID NO: 6025329 - DNA, 18 bp, Homo sapiens
catgtggaaagtgaattt

SEQ ID NO: 6025330 - DNA, 20 bp, Homo sapiens
catgtggaaagtgaatttga

SEQ ID NO: 6025331 - DNA, 22 bp, Homo sapiens
catgtggaagaaaacaagacat

SEQ ID NO: 6025332 - DNA, 22 bp, Homo sapiens
catgtggaaggcaagccaggct

SEQ ID NO: 6025333 - DNA, 19 bp, Homo sapiens
catgtggaggggcagcctg

SEQ ID NO: 6025334 - DNA, 18 bp, Homo sapiens
catgtggagtcagcctcg

SEQ ID NO: 6025335 - DNA, 12 bp, Homo sapiens
catgtggagtgg

SEQ ID NO: 6025336 - DNA, 13 bp, Homo sapiens
catgtggagtgga

SEQ ID NO: 6025337 - DNA, 17 bp, Homo sapiens
catgtggcaaaatatgg

SEQ ID NO: 6025338 - DNA, 15 bp, Homo sapiens
catgtggcagcaggc

SEQ ID NO: 6025339 - DNA, 23 bp, Homo sapiens
catgtggcagggagcagtacaca

SEQ ID NO: 6025340 - DNA, 21 bp, Homo sapiens
catgtggcattctctctgctc

SEQ ID NO: 6025341 - DNA, 22 bp, Homo sapiens
catgtggcattctctctgctca

SEQ ID NO: 6025342 - DNA, 23 bp, Homo sapiens
catgtggcattctctctgctcag

SEQ ID NO: 6025343 - DNA, 18 bp, Homo sapiens
catgtggccccaggtgcc

SEQ ID NO: 6025344 - DNA, 17 bp, Homo sapiens
catgtggcctaatattg

SEQ ID NO: 6025345 - DNA, 20 bp, Homo sapiens
catgtggcctaatattgaaa

SEQ ID NO: 6025346 - DNA, 14 bp, Homo sapiens
catgtggcctgccc

SEQ ID NO: 6025347 - DNA, 16 bp, Homo sapiens
catgtggcctgcccag

SEQ ID NO: 6025348 - DNA, 19 bp, Homo sapiens
catgtggcctgcccagcct

SEQ ID NO: 6025349 - DNA, 18 bp, Homo sapiens
catgtggccttgagcaag

SEQ ID NO: 6025350 - DNA, 19 bp, Homo sapiens
catgtggctcctcccagcc

SEQ ID NO: 6025351 - DNA, 21 bp, Homo sapiens
catgtgggatgagtttttaaa

SEQ ID NO: 6025352 - DNA, 15 bp, Homo sapiens
catgtgggcacggag

SEQ ID NO: 6025353 - DNA, 23 bp, Homo sapiens
catgtgggccacacaagtgcagt

SEQ ID NO: 6025354 - DNA, 18 bp, Homo sapiens
catgtgggcgcccaccct

SEQ ID NO: 6025355 - DNA, 20 bp, Homo sapiens
catgtgggcgcccaccctgg

SEQ ID NO: 6025356 - DNA, 23 bp, Homo sapiens
catgtgggcgcccaccctgggct

SEQ ID NO: 6025357 - DNA, 13 bp, Homo sapiens
catgtgggcttca

SEQ ID NO: 6025358 - DNA, 20 bp, Homo sapiens
catgtggggatgtttgtgct

SEQ ID NO: 6025359 - DNA, 21 bp, Homo sapiens
catgtggggatgtttgtgctg

SEQ ID NO: 6025360 - DNA, 17 bp, Homo sapiens
catgtggggccaggtca

SEQ ID NO: 6025361 - DNA, 18 bp, Homo sapiens
catgtggggccaggtcac

SEQ ID NO: 6025362 - DNA, 14 bp, Homo sapiens
catgtgggggaagg

SEQ ID NO: 6025363 - DNA, 23 bp, Homo sapiens
catgtgggggaaggccttgctgt

SEQ ID NO: 6025364 - DNA, 18 bp, Homo sapiens
catgtgggggaggaggga

SEQ ID NO: 6025365 - DNA, 15 bp, Homo sapiens
catgtgggtcttcca

SEQ ID NO: 6025366 - DNA, 18 bp, Homo sapiens
catgtgggtgagccagtg

SEQ ID NO: 6025367 - DNA, 15 bp, Homo sapiens
catgtgggtgctagg

SEQ ID NO: 6025368 - DNA, 17 bp, Homo sapiens
catgtgggtggagaagg

SEQ ID NO: 6025369 - DNA, 14 bp, Homo sapiens
catgtggtatgagt

SEQ ID NO: 6025370 - DNA, 22 bp, Homo sapiens
catgtggtggcacaggccccct

SEQ ID NO: 6025371 - DNA, 16 bp, Homo sapiens
catgtggttacacagt

SEQ ID NO: 6025372 - DNA, 19 bp, Homo sapiens
caggcctactcctgtcttc

SEQ ID NO: 6025373 - DNA, 18 bp, Homo sapiens
caggcctaggacctcagg

SEQ ID NO: 6025374 - DNA, 15 bp, Homo sapiens
caggcctaggaggcc

SEQ ID NO: 6025375 - DNA, 22 bp, Homo sapiens
caggcctaggtgcagctcctca

SEQ ID NO: 6025376 - DNA, 23 bp, Homo sapiens
caggcctaggtgcagctcctcag

SEQ ID NO: 6025377 - DNA, 19 bp, Homo sapiens
caggcctagtaaccaaggc

SEQ ID NO: 6025378 - DNA, 23 bp, Homo sapiens
caggcctcacccctcccctggga

SEQ ID NO: 6025379 - DNA, 12 bp, Homo sapiens
caggcctcacct

SEQ ID NO: 6025380 - DNA, 15 bp, Homo sapiens
caggcctcacctccc

SEQ ID NO: 6025381 - DNA, 21 bp, Homo sapiens
caggcctcacctcccagggct

SEQ ID NO: 6025382 - DNA, 19 bp, Homo sapiens
caggcctcacctctaccca

SEQ ID NO: 6025383 - DNA, 21 bp, Homo sapiens
caggcctcacctctacccaaa

SEQ ID NO: 6025384 - DNA, 15 bp, Homo sapiens
caggcctcacctggc

SEQ ID NO: 6025385 - DNA, 15 bp, Homo sapiens
caggcctcactggct

SEQ ID NO: 6025386 - DNA, 16 bp, Homo sapiens
caggcctcactggctc

SEQ ID NO: 6025387 - DNA, 20 bp, Homo sapiens
caggcctcactggctcatgc

SEQ ID NO: 6025388 - DNA, 23 bp, Homo sapiens
caggcctcactggctcatgcccc

SEQ ID NO: 6025389 - DNA, 12 bp, Homo sapiens
caggcctcagcc

SEQ ID NO: 6025390 - DNA, 14 bp, Homo sapiens
caggcctcagggac

SEQ ID NO: 6025391 - DNA, 16 bp, Homo sapiens
caggcctcagggctcc

SEQ ID NO: 6025392 - DNA, 17 bp, Homo sapiens
caggcctcagggctcct

SEQ ID NO: 6025393 - DNA, 15 bp, Homo sapiens
caggcctccagcggc

SEQ ID NO: 6025394 - DNA, 17 bp, Homo sapiens
caggcctccagctcagc

SEQ ID NO: 6025395 - DNA, 14 bp, Homo sapiens
caggcctcccaagc

SEQ ID NO: 6025396 - DNA, 12 bp, Homo sapiens
caggcctcccca

SEQ ID NO: 6025397 - DNA, 13 bp, Homo sapiens
caggcctccccag

SEQ ID NO: 6025398 - DNA, 14 bp, Homo sapiens
caggcctccccagc

SEQ ID NO: 6025399 - DNA, 18 bp, Homo sapiens
caggcctccccagcacct

SEQ ID NO: 6025400 - DNA, 18 bp, Homo sapiens
caggcctcccgcatgctg

SEQ ID NO: 6025401 - DNA, 21 bp, Homo sapiens
caggcctccctcccccggggt

SEQ ID NO: 6025402 - DNA, 17 bp, Homo sapiens
caggcctccctctctct

SEQ ID NO: 6025403 - DNA, 22 bp, Homo sapiens
caggcctccctctctcttctgc

SEQ ID NO: 6025404 - DNA, 13 bp, Homo sapiens
caggcctccctga

SEQ ID NO: 6025405 - DNA, 15 bp, Homo sapiens
caggcctccctgaaa

SEQ ID NO: 6025406 - DNA, 19 bp, Homo sapiens
caggcctccctgcagactc

SEQ ID NO: 6025407 - DNA, 20 bp, Homo sapiens
caggcctccctgcagactcc

SEQ ID NO: 6025408 - DNA, 18 bp, Homo sapiens
caggcctccctgcctcag

SEQ ID NO: 6025409 - DNA, 13 bp, Homo sapiens
caggcctccctgt

SEQ ID NO: 6025410 - DNA, 20 bp, Homo sapiens
caggcctccctttggggaga

SEQ ID NO: 6025411 - DNA, 11 bp, Homo sapiens
caggcctccta

SEQ ID NO: 6025412 - DNA, 18 bp, Homo sapiens
caggcctcctaggggaag

SEQ ID NO: 6025413 - DNA, 17 bp, Homo sapiens
caggcctcgcctgccct

SEQ ID NO: 6025414 - DNA, 19 bp, Homo sapiens
caggcctctactaggtctg

SEQ ID NO: 6025415 - DNA, 12 bp, Homo sapiens
caggcctctcca

SEQ ID NO: 6025416 - DNA, 19 bp, Homo sapiens
caggcctctcggtgctcca

SEQ ID NO: 6025417 - DNA, 23 bp, Homo sapiens
caggcctctcggtgctccatctc

SEQ ID NO: 6025418 - DNA, 18 bp, Homo sapiens
caggcctctctctgctcc

SEQ ID NO: 6025419 - DNA, 19 bp, Homo sapiens
caggcctctctctgctcca

SEQ ID NO: 6025420 - DNA, 21 bp, Homo sapiens
caggcctctgaggagcccacg

SEQ ID NO: 6025421 - DNA, 14 bp, Homo sapiens
caggcctctgcaga

SEQ ID NO: 6025422 - DNA, 16 bp, Homo sapiens
caggcctctgccccaa

SEQ ID NO: 6025423 - DNA, 22 bp, Homo sapiens
caggcctctgcctgctggggat

SEQ ID NO: 6025424 - DNA, 23 bp, Homo sapiens
caggcctctgctgccgcccttcc

SEQ ID NO: 6025425 - DNA, 22 bp, Homo sapiens
caggcctctgctggctcaggag

SEQ ID NO: 6025426 - DNA, 21 bp, Homo sapiens
caggcctctgggacccacaga

SEQ ID NO: 6025427 - DNA, 19 bp, Homo sapiens
caggcctctggttgcctcc

SEQ ID NO: 6025428 - DNA, 15 bp, Homo sapiens
caggcctcttggcag

SEQ ID NO: 6025429 - DNA, 21 bp, Homo sapiens
caggcctgaacccgtccattc

SEQ ID NO: 6025430 - DNA, 18 bp, Homo sapiens
caggcctgaccagggggc

SEQ ID NO: 6025431 - DNA, 22 bp, Homo sapiens
caggcctgagaatgagtgggaa

SEQ ID NO: 6025432 - DNA, 15 bp, Homo sapiens
caggcctgagctgct

SEQ ID NO: 6025433 - DNA, 18 bp, Homo sapiens
caggcctgagctgcttca

SEQ ID NO: 6025434 - DNA, 14 bp, Homo sapiens
caggcctgaggctg

SEQ ID NO: 6025435 - DNA, 21 bp, Homo sapiens
caggcctgattcactggcctg

SEQ ID NO: 6025436 - DNA, 15 bp, Homo sapiens
caggcctgcagcccc

SEQ ID NO: 6025437 - DNA, 17 bp, Homo sapiens
caggcctgcagccccta

SEQ ID NO: 6025438 - DNA, 18 bp, Homo sapiens
caggcctgcaggggcaag

SEQ ID NO: 6025439 - DNA, 11 bp, Homo sapiens
caggcctgcca

SEQ ID NO: 6025440 - DNA, 16 bp, Homo sapiens
caggcctgccaatgcc

SEQ ID NO: 6025441 - DNA, 19 bp, Homo sapiens
caggcctgccaatgccaca

SEQ ID NO: 6025442 - DNA, 12 bp, Homo sapiens
caggcctgccag

SEQ ID NO: 6025443 - DNA, 16 bp, Homo sapiens
caggcctgccagcccc

SEQ ID NO: 6025444 - DNA, 17 bp, Homo sapiens
caggcctgccagcccct

SEQ ID NO: 6025445 - DNA, 12 bp, Homo sapiens
caggcctgccct

SEQ ID NO: 6025446 - DNA, 16 bp, Homo sapiens
caggcctgccctgcta

SEQ ID NO: 6025447 - DNA, 15 bp, Homo sapiens
caggcctgcctccca

SEQ ID NO: 6025448 - DNA, 17 bp, Homo sapiens
caggcctgcctcccact

SEQ ID NO: 6025449 - DNA, 21 bp, Homo sapiens
caggcctgccttctcagggac

SEQ ID NO: 6025450 - DNA, 19 bp, Homo sapiens
caggcctgcgggcccctgg

SEQ ID NO: 6025451 - DNA, 22 bp, Homo sapiens
caggcctgcgggcccctggtga

SEQ ID NO: 6025452 - DNA, 16 bp, Homo sapiens
caggcctgcgtgccgg

SEQ ID NO: 6025453 - DNA, 18 bp, Homo sapiens
caggcctgcgtgcgctgg

SEQ ID NO: 6025454 - DNA, 14 bp, Homo sapiens
caggcctgctggca

SEQ ID NO: 6025455 - DNA, 16 bp, Homo sapiens
caggcctgctggcatc

SEQ ID NO: 6025456 - DNA, 17 bp, Homo sapiens
caggcctgctggcatca

SEQ ID NO: 6025457 - DNA, 18 bp, Homo sapiens
caggcctgctggcatcag

SEQ ID NO: 6025458 - DNA, 23 bp, Homo sapiens
caggcctgctggcatcaggtctg

SEQ ID NO: 6025459 - DNA, 21 bp, Homo sapiens
caggcctggacgggccctcct

SEQ ID NO: 6025460 - DNA, 12 bp, Homo sapiens
caggcctggagc

SEQ ID NO: 6025461 - DNA, 15 bp, Homo sapiens
caggcctggagggca

SEQ ID NO: 6025462 - DNA, 17 bp, Homo sapiens
caggcctggcaagtggg

SEQ ID NO: 6025463 - DNA, 14 bp, Homo sapiens
caggcctggcccag

SEQ ID NO: 6025464 - DNA, 18 bp, Homo sapiens
caggcctggcccagccag

SEQ ID NO: 6025465 - DNA, 21 bp, Homo sapiens
caggcctggcccagccagcag

SEQ ID NO: 6025466 - DNA, 23 bp, Homo sapiens
caggcctggcccagccagcaggt

SEQ ID NO: 6025467 - DNA, 14 bp, Homo sapiens
caggcctggccctt

SEQ ID NO: 6025468 - DNA, 19 bp, Homo sapiens
caggcctggccctttcacc

SEQ ID NO: 6025469 - DNA, 22 bp, Homo sapiens
caggcctggccctttcacccct

SEQ ID NO: 6025470 - DNA, 15 bp, Homo sapiens
caggcctggcctcaa

SEQ ID NO: 6025471 - DNA, 16 bp, Homo sapiens
caggcctggcctcatc

SEQ ID NO: 6025472 - DNA, 19 bp, Homo sapiens
caggcctggcctcatctca

SEQ ID NO: 6025473 - DNA, 16 bp, Homo sapiens
caggcctggcctctgg

SEQ ID NO: 6025474 - DNA, 21 bp, Homo sapiens
caggcctgggacccagctact

SEQ ID NO: 6025475 - DNA, 16 bp, Homo sapiens
caggcctgggatgcag

SEQ ID NO: 6025476 - DNA, 19 bp, Homo sapiens
caggcctgggcaggaccct

SEQ ID NO: 6025477 - DNA, 18 bp, Homo sapiens
caggcctgggtctgtgtc

SEQ ID NO: 6025478 - DNA, 20 bp, Homo sapiens
caggcctgggtctgtgtctc

SEQ ID NO: 6025479 - DNA, 13 bp, Homo sapiens
caggcctgggttt

SEQ ID NO: 6025480 - DNA, 16 bp, Homo sapiens
caggcctggtggaggg

SEQ ID NO: 6025481 - DNA, 14 bp, Homo sapiens
caggcctgtatgag

SEQ ID NO: 6025482 - DNA, 16 bp, Homo sapiens
caggcctgtccaccct

SEQ ID NO: 6025483 - DNA, 21 bp, Homo sapiens
caggcctgtccctgggagtgt

SEQ ID NO: 6025484 - DNA, 12 bp, Homo sapiens
caggcctgtgcc

SEQ ID NO: 6025485 - DNA, 13 bp, Homo sapiens
caggcctgtgccc

SEQ ID NO: 6025486 - DNA, 12 bp, Homo sapiens
caggcctgtggc

SEQ ID NO: 6025487 - DNA, 18 bp, Homo sapiens
caggcctgtggctccctt

SEQ ID NO: 6025488 - DNA, 19 bp, Homo sapiens
caggcctgtgtagctgtga

SEQ ID NO: 6025489 - DNA, 21 bp, Homo sapiens
caggcctgtgtagctgtgacc

SEQ ID NO: 6025490 - DNA, 20 bp, Homo sapiens
caggcctgtgtgactccatt

SEQ ID NO: 6025491 - DNA, 23 bp, Homo sapiens
caggcctgttcccttgtggcttg

SEQ ID NO: 6025492 - DNA, 16 bp, Homo sapiens
caggccttatctccaa

SEQ ID NO: 6025493 - DNA, 22 bp, Homo sapiens
caggccttatctccaagaccag

SEQ ID NO: 6025494 - DNA, 18 bp, Homo sapiens
caggccttcatcctcctc

SEQ ID NO: 6025495 - DNA, 10 bp, Homo sapiens
caggccttct

SEQ ID NO: 6025496 - DNA, 13 bp, Homo sapiens
caggccttctgtg

SEQ ID NO: 6025497 - DNA, 21 bp, Homo sapiens
caggccttctgtggggctggg

SEQ ID NO: 6025498 - DNA, 20 bp, Homo sapiens
caggccttgctgactctctg

SEQ ID NO: 6025499 - DNA, 15 bp, Homo sapiens
caggccttgctgggg

SEQ ID NO: 6025500 - DNA, 16 bp, Homo sapiens
caggccttgctggggt

SEQ ID NO: 6025501 - DNA, 18 bp, Homo sapiens
caggccttgctggggtcc

SEQ ID NO: 6025502 - DNA, 11 bp, Homo sapiens
caggccttgtc

SEQ ID NO: 6025503 - DNA, 21 bp, Homo sapiens
caggcctttcaggaagggaga

SEQ ID NO: 6025504 - DNA, 17 bp, Homo sapiens
caggcctttccctgccg

SEQ ID NO: 6025505 - DNA, 17 bp, Homo sapiens
caggcctttggagggga

SEQ ID NO: 6025506 - DNA, 15 bp, Homo sapiens
caggcgaccgggcct

SEQ ID NO: 6025507 - DNA, 14 bp, Homo sapiens
caggcgagcctgac

SEQ ID NO: 6025508 - DNA, 12 bp, Homo sapiens
caggcgaggccc

SEQ ID NO: 6025509 - DNA, 22 bp, Homo sapiens
caggcgcaagggaggcccagcg

SEQ ID NO: 6025510 - DNA, 14 bp, Homo sapiens
caggcgcagaggtc

SEQ ID NO: 6025511 - DNA, 17 bp, Homo sapiens
caggcgcagaggtccca

SEQ ID NO: 6025512 - DNA, 22 bp, Homo sapiens
caggcgcagaggtcccagcccc

SEQ ID NO: 6025513 - DNA, 21 bp, Homo sapiens
caggcgcatgagtatctgtgg

SEQ ID NO: 6025514 - DNA, 15 bp, Homo sapiens
caggcgcatgtctgc

SEQ ID NO: 6025515 - DNA, 22 bp, Homo sapiens
caggcgcatgtctgcacctccg

SEQ ID NO: 6025516 - DNA, 17 bp, Homo sapiens
caggcgccccttccccc

SEQ ID NO: 6025517 - DNA, 17 bp, Homo sapiens
caggcgccgcctcgccc

SEQ ID NO: 6025518 - DNA, 19 bp, Homo sapiens
caggcgcctataatcccag

SEQ ID NO: 6025519 - DNA, 21 bp, Homo sapiens
caggcgcctataatcccagct

SEQ ID NO: 6025520 - DNA, 13 bp, Homo sapiens
caggcgcctgcca

SEQ ID NO: 6025521 - DNA, 16 bp, Homo sapiens
caggcgcgcaccgccc

SEQ ID NO: 6025522 - DNA, 17 bp, Homo sapiens
caggcgcgcaccgccca

SEQ ID NO: 6025523 - DNA, 19 bp, Homo sapiens
caggcgcgcaccgcccaac

SEQ ID NO: 6025524 - DNA, 24 bp, Homo sapiens
caggcgctccaggccactctcaga

SEQ ID NO: 6025525 - DNA, 14 bp, Homo sapiens
caggcgctgcaggg

SEQ ID NO: 6025526 - DNA, 16 bp, Homo sapiens
caggcgctgcatacag

SEQ ID NO: 6025527 - DNA, 16 bp, Homo sapiens
caggcgctggacagag

SEQ ID NO: 6025528 - DNA, 20 bp, Homo sapiens
caggcgctgtgctatcatga

SEQ ID NO: 6025529 - DNA, 22 bp, Homo sapiens
caggcgcttctccaatgctctg

SEQ ID NO: 6025530 - DNA, 23 bp, Homo sapiens
caggcggagctgctgagtgacag

SEQ ID NO: 6025531 - DNA, 17 bp, Homo sapiens
caggcggaggggcttgg

SEQ ID NO: 6025532 - DNA, 22 bp, Homo sapiens
caggcggaggggcttggagcag

SEQ ID NO: 6025533 - DNA, 16 bp, Homo sapiens
caggcggccagggcgg

SEQ ID NO: 6025534 - DNA, 15 bp, Homo sapiens
caggcggccctgggg

SEQ ID NO: 6025535 - DNA, 12 bp, Homo sapiens
caggcggctcct

SEQ ID NO: 6025536 - DNA, 21 bp, Homo sapiens
caggcgggagcggtggccctg

SEQ ID NO: 6025537 - DNA, 23 bp, Homo sapiens
caggcgggagcggtggccctgtc

SEQ ID NO: 6025538 - DNA, 20 bp, Homo sapiens
caggcgggaggggcagaaca

SEQ ID NO: 6025539 - DNA, 15 bp, Homo sapiens
caggcgggctcaagg

SEQ ID NO: 6025540 - DNA, 16 bp, Homo sapiens
caggcgggctcaagga

SEQ ID NO: 6025541 - DNA, 12 bp, Homo sapiens
caggcggggcag

SEQ ID NO: 6025542 - DNA, 20 bp, Homo sapiens
caggcggggcagtatgtgat

SEQ ID NO: 6025543 - DNA, 24 bp, Homo sapiens
caggcggggcccagcgctctcctg

SEQ ID NO: 6025544 - DNA, 22 bp, Homo sapiens
caggcggggcgccccaagagcc

SEQ ID NO: 6025545 - DNA, 13 bp, Homo sapiens
caggcggggctcc

SEQ ID NO: 6025546 - DNA, 17 bp, Homo sapiens
caggcggggctcctcct

SEQ ID NO: 6025547 - DNA, 15 bp, Homo sapiens
caggcggggggggcg

SEQ ID NO: 6025548 - DNA, 19 bp, Homo sapiens
caggcggggggggcgcctg

SEQ ID NO: 6025549 - DNA, 16 bp, Homo sapiens
caggcggggtgctgtg

SEQ ID NO: 6025550 - DNA, 20 bp, Homo sapiens
catgtggtttatagagggcc

SEQ ID NO: 6025551 - DNA, 23 bp, Homo sapiens
catgtggtttggttcctctctgg

SEQ ID NO: 6025552 - DNA, 17 bp, Homo sapiens
catgtgtaacttctaga

SEQ ID NO: 6025553 - DNA, 18 bp, Homo sapiens
catgtgtaatcaataaac

SEQ ID NO: 6025554 - DNA, 22 bp, Homo sapiens
catgtgtaatcaataaacgatt

SEQ ID NO: 6025555 - DNA, 12 bp, Homo sapiens
catgtgtacata

SEQ ID NO: 6025556 - DNA, 20 bp, Homo sapiens
catgtgtacttaatttcttt

SEQ ID NO: 6025557 - DNA, 17 bp, Homo sapiens
catgtgtagagccccta

SEQ ID NO: 6025558 - DNA, 19 bp, Homo sapiens
catgtgtagattgcgtgga

SEQ ID NO: 6025559 - DNA, 15 bp, Homo sapiens
catgtgtaggaagag

SEQ ID NO: 6025560 - DNA, 14 bp, Homo sapiens
catgtgtataaaaa

SEQ ID NO: 6025561 - DNA, 17 bp, Homo sapiens
catgtgtataaaaataa

SEQ ID NO: 6025562 - DNA, 13 bp, Homo sapiens
catgtgtatatat

SEQ ID NO: 6025563 - DNA, 18 bp, Homo sapiens
catgtgtatattcctttt

SEQ ID NO: 6025564 - DNA, 19 bp, Homo sapiens
catgtgtatattcctttta

SEQ ID NO: 6025565 - DNA, 23 bp, Homo sapiens
catgtgtatccatgcattatata

SEQ ID NO: 6025566 - DNA, 23 bp, Homo sapiens
catgtgtatgcgtgtccgtctgt

SEQ ID NO: 6025567 - DNA, 23 bp, Homo sapiens
catgtgtatggaagacaaataca

SEQ ID NO: 6025568 - DNA, 15 bp, Homo sapiens
catgtgtatgtgtct

SEQ ID NO: 6025569 - DNA, 14 bp, Homo sapiens
catgtgtcatgtaa

SEQ ID NO: 6025570 - DNA, 17 bp, Homo sapiens
catgtgtccatcccagc

SEQ ID NO: 6025571 - DNA, 13 bp, Homo sapiens
catgtgtcccaga

SEQ ID NO: 6025572 - DNA, 21 bp, Homo sapiens
catgtgtcccagaagatgact

SEQ ID NO: 6025573 - DNA, 14 bp, Homo sapiens
catgtgtcccagga

SEQ ID NO: 6025574 - DNA, 18 bp, Homo sapiens
catgtgtcccaggagcag

SEQ ID NO: 6025575 - DNA, 18 bp, Homo sapiens
catgtgtcccccctgtgg

SEQ ID NO: 6025576 - DNA, 20 bp, Homo sapiens
catgtgtcccctcactctgt

SEQ ID NO: 6025577 - DNA, 14 bp, Homo sapiens
catgtgtctcagca

SEQ ID NO: 6025578 - DNA, 14 bp, Homo sapiens
catgtgtctggccc

SEQ ID NO: 6025579 - DNA, 12 bp, Homo sapiens
catgtgtctgta

SEQ ID NO: 6025580 - DNA, 15 bp, Homo sapiens
catgtgtgagtcact

SEQ ID NO: 6025581 - DNA, 20 bp, Homo sapiens
catgtgtgagtcacttctac

SEQ ID NO: 6025582 - DNA, 17 bp, Homo sapiens
catgtgtgagtgtgtgc

SEQ ID NO: 6025583 - DNA, 21 bp, Homo sapiens
catgtgtgagtgtgtgcaagt

SEQ ID NO: 6025584 - DNA, 16 bp, Homo sapiens
catgtgtgatgctgac

SEQ ID NO: 6025585 - DNA, 17 bp, Homo sapiens
catgtgtgatgctgaca

SEQ ID NO: 6025586 - DNA, 18 bp, Homo sapiens
catgtgtgcaacagggta

SEQ ID NO: 6025587 - DNA, 12 bp, Homo sapiens
catgtgtgcaga

SEQ ID NO: 6025588 - DNA, 13 bp, Homo sapiens
catgtgtgcatgt

SEQ ID NO: 6025589 - DNA, 14 bp, Homo sapiens
catgtgtgcatgtg

SEQ ID NO: 6025590 - DNA, 18 bp, Homo sapiens
catgtgtgcatgtgctgt

SEQ ID NO: 6025591 - DNA, 19 bp, Homo sapiens
catgtgtgcctgtggcaga

SEQ ID NO: 6025592 - DNA, 20 bp, Homo sapiens
catgtgtgctcttcttcttt

SEQ ID NO: 6025593 - DNA, 16 bp, Homo sapiens
catgtgtgctgtgctg

SEQ ID NO: 6025594 - DNA, 12 bp, Homo sapiens
catgtgtggaag

SEQ ID NO: 6025595 - DNA, 14 bp, Homo sapiens
catgtgtggtggtg

SEQ ID NO: 6025596 - DNA, 14 bp, Homo sapiens
catgtgtgtataag

SEQ ID NO: 6025597 - DNA, 15 bp, Homo sapiens
catgtgtgtatatat

SEQ ID NO: 6025598 - DNA, 21 bp, Homo sapiens
catgtgtgtatcaccctcagc

SEQ ID NO: 6025599 - DNA, 15 bp, Homo sapiens
catgtgtgtattttt

SEQ ID NO: 6025600 - DNA, 19 bp, Homo sapiens
catgtgtgtgccaagccct

SEQ ID NO: 6025601 - DNA, 18 bp, Homo sapiens
catgtgtgtgtctgtctt

SEQ ID NO: 6025602 - DNA, 21 bp, Homo sapiens
catgtgtgtgtgtgtgtgtgt

SEQ ID NO: 6025603 - DNA, 23 bp, Homo sapiens
catgtgtgtgtgtgtgtgtgtct

SEQ ID NO: 6025604 - DNA, 13 bp, Homo sapiens
catgtgttaaaat

SEQ ID NO: 6025605 - DNA, 17 bp, Homo sapiens
catgtgttaaaatactc

SEQ ID NO: 6025606 - DNA, 16 bp, Homo sapiens
catgtgttatctacct

SEQ ID NO: 6025607 - DNA, 11 bp, Homo sapiens
catgtgttcca

SEQ ID NO: 6025608 - DNA, 21 bp, Homo sapiens
catgtgttccaaatttgcttt

SEQ ID NO: 6025609 - DNA, 22 bp, Homo sapiens
catgtgttccaaatttgcttta

SEQ ID NO: 6025610 - DNA, 14 bp, Homo sapiens
catgtgttcccttt

SEQ ID NO: 6025611 - DNA, 23 bp, Homo sapiens
catgtgttgcaaattattctagt

SEQ ID NO: 6025612 - DNA, 24 bp, Homo sapiens
catgtgttgcaaattattctagtc

SEQ ID NO: 6025613 - DNA, 18 bp, Homo sapiens
catgtgtttactttatgt

SEQ ID NO: 6025614 - DNA, 14 bp, Homo sapiens
catgtgtttatcct

SEQ ID NO: 6025615 - DNA, 18 bp, Homo sapiens
catgtgtttattcatcca

SEQ ID NO: 6025616 - DNA, 21 bp, Homo sapiens
catgtgtttattcatccagca

SEQ ID NO: 6025617 - DNA, 13 bp, Homo sapiens
catgtgtttctga

SEQ ID NO: 6025618 - DNA, 15 bp, Homo sapiens
catgtgtttctgtgt

SEQ ID NO: 6025619 - DNA, 19 bp, Homo sapiens
catgtgtttggttctgggg

SEQ ID NO: 6025620 - DNA, 15 bp, Homo sapiens
catgtgttttataag

SEQ ID NO: 6025621 - DNA, 21 bp, Homo sapiens
catgtgttttcatcatttcag

SEQ ID NO: 6025622 - DNA, 23 bp, Homo sapiens
catgtgttttcatcatttcagcc

SEQ ID NO: 6025623 - DNA, 21 bp, Homo sapiens
catgtgttttgcttttatcca

SEQ ID NO: 6025624 - DNA, 16 bp, Homo sapiens
catgttaaaataatta

SEQ ID NO: 6025625 - DNA, 13 bp, Homo sapiens
catgttaaaccat

SEQ ID NO: 6025626 - DNA, 13 bp, Homo sapiens
catgttaaatatt

SEQ ID NO: 6025627 - DNA, 19 bp, Homo sapiens
catgttaagtcctccctga

SEQ ID NO: 6025628 - DNA, 14 bp, Homo sapiens
catgttaatacatc

SEQ ID NO: 6025629 - DNA, 19 bp, Homo sapiens
catgttaatatttgaattg

SEQ ID NO: 6025630 - DNA, 18 bp, Homo sapiens
catgttaattgatagaat

SEQ ID NO: 6025631 - DNA, 21 bp, Homo sapiens
catgttacataagataaatgt

SEQ ID NO: 6025632 - DNA, 17 bp, Homo sapiens
catgttacctcctataa

SEQ ID NO: 6025633 - DNA, 15 bp, Homo sapiens
catgttacgtgtgca

SEQ ID NO: 6025634 - DNA, 20 bp, Homo sapiens
catgttactacagaggaaag

SEQ ID NO: 6025635 - DNA, 15 bp, Homo sapiens
catgttactgccaaa

SEQ ID NO: 6025636 - DNA, 14 bp, Homo sapiens
catgttacttctct

SEQ ID NO: 6025637 - DNA, 19 bp, Homo sapiens
catgttaggaaaatttcac

SEQ ID NO: 6025638 - DNA, 24 bp, Homo sapiens
catgttagtaatacctctaatagt

SEQ ID NO: 6025639 - DNA, 20 bp, Homo sapiens
catgttagtaatggcagagc

SEQ ID NO: 6025640 - DNA, 16 bp, Homo sapiens
catgttagtcaaggac

SEQ ID NO: 6025641 - DNA, 14 bp, Homo sapiens
catgttagttacct

SEQ ID NO: 6025642 - DNA, 14 bp, Homo sapiens
catgttatatattt

SEQ ID NO: 6025643 - DNA, 20 bp, Homo sapiens
catgttatatattttttgta

SEQ ID NO: 6025644 - DNA, 15 bp, Homo sapiens
catgttatattgctt

SEQ ID NO: 6025645 - DNA, 19 bp, Homo sapiens
catgttatattgcttcctg

SEQ ID NO: 6025646 - DNA, 14 bp, Homo sapiens
catgttatgataaa

SEQ ID NO: 6025647 - DNA, 15 bp, Homo sapiens
catgttatgcagtga

SEQ ID NO: 6025648 - DNA, 23 bp, Homo sapiens
catgttatttgtaatagatgttt

SEQ ID NO: 6025649 - DNA, 16 bp, Homo sapiens
catgttcaaaagaagt

SEQ ID NO: 6025650 - DNA, 23 bp, Homo sapiens
catgttcacgttgttcacatccc

SEQ ID NO: 6025651 - DNA, 19 bp, Homo sapiens
catgttcagaaaagaagtg

SEQ ID NO: 6025652 - DNA, 18 bp, Homo sapiens
catgttcattataatctc

SEQ ID NO: 6025653 - DNA, 21 bp, Homo sapiens
catgttcattataatctcaaa

SEQ ID NO: 6025654 - DNA, 19 bp, Homo sapiens
catgttccaataaacagga

SEQ ID NO: 6025655 - DNA, 15 bp, Homo sapiens
catgttccactaacc

SEQ ID NO: 6025656 - DNA, 12 bp, Homo sapiens
catgttcccaga

SEQ ID NO: 6025657 - DNA, 13 bp, Homo sapiens
catgttcccagaa

SEQ ID NO: 6025658 - DNA, 14 bp, Homo sapiens
catgttcccagaac

SEQ ID NO: 6025659 - DNA, 16 bp, Homo sapiens
catgttcccagctcag

SEQ ID NO: 6025660 - DNA, 21 bp, Homo sapiens
catgttcccagctcagtgcca

SEQ ID NO: 6025661 - DNA, 20 bp, Homo sapiens
catgttcctggacaccaccc

SEQ ID NO: 6025662 - DNA, 13 bp, Homo sapiens
catgttccttcaa

SEQ ID NO: 6025663 - DNA, 16 bp, Homo sapiens
catgttctcttcccag

SEQ ID NO: 6025664 - DNA, 18 bp, Homo sapiens
catgttctcttcccaggc

SEQ ID NO: 6025665 - DNA, 20 bp, Homo sapiens
catgttctcttcccaggcct

SEQ ID NO: 6025666 - DNA, 21 bp, Homo sapiens
catgttctcttcccaggcctt

SEQ ID NO: 6025667 - DNA, 15 bp, Homo sapiens
catgttctgccccca

SEQ ID NO: 6025668 - DNA, 16 bp, Homo sapiens
catgttctgcccccag

SEQ ID NO: 6025669 - DNA, 20 bp, Homo sapiens
catgttctgcccccagccca

SEQ ID NO: 6025670 - DNA, 21 bp, Homo sapiens
catgttctgcccccagcccaa

SEQ ID NO: 6025671 - DNA, 19 bp, Homo sapiens
catgttctgggtgatggaa

SEQ ID NO: 6025672 - DNA, 23 bp, Homo sapiens
catgttctggtggtttgattgtt

SEQ ID NO: 6025673 - DNA, 14 bp, Homo sapiens
catgttctgtccct

SEQ ID NO: 6025674 - DNA, 21 bp, Homo sapiens
catgttctgtgacatcctgct

SEQ ID NO: 6025675 - DNA, 22 bp, Homo sapiens
catgttctgtgtgccctgaaaa

SEQ ID NO: 6025676 - DNA, 16 bp, Homo sapiens
catgttcttgcagtca

SEQ ID NO: 6025677 - DNA, 19 bp, Homo sapiens
catgttgaagccactgcct

SEQ ID NO: 6025678 - DNA, 23 bp, Homo sapiens
catgttgaagtaattcttctgcc

SEQ ID NO: 6025679 - DNA, 17 bp, Homo sapiens
catgttgatttagtctt

SEQ ID NO: 6025680 - DNA, 18 bp, Homo sapiens
catgttgcacacccactc

SEQ ID NO: 6025681 - DNA, 23 bp, Homo sapiens
catgttgcacacccactcagctc

SEQ ID NO: 6025682 - DNA, 18 bp, Homo sapiens
catgttgcactgtttgca

SEQ ID NO: 6025683 - DNA, 18 bp, Homo sapiens
catgttgccatgaggcct

SEQ ID NO: 6025684 - DNA, 22 bp, Homo sapiens
catgttgccatgaggcctttcc

SEQ ID NO: 6025685 - DNA, 13 bp, Homo sapiens
catgttgcccaga

SEQ ID NO: 6025686 - DNA, 17 bp, Homo sapiens
catgttgcccctttctc

SEQ ID NO: 6025687 - DNA, 13 bp, Homo sapiens
catgttgctgaat

SEQ ID NO: 6025688 - DNA, 15 bp, Homo sapiens
catgttgctgacttt

SEQ ID NO: 6025689 - DNA, 15 bp, Homo sapiens
catgttgctgaggag

SEQ ID NO: 6025690 - DNA, 16 bp, Homo sapiens
catgttgctgaggagt

SEQ ID NO: 6025691 - DNA, 19 bp, Homo sapiens
catgttgcttgtcgctttc

SEQ ID NO: 6025692 - DNA, 20 bp, Homo sapiens
catgttggaggagagagcct

SEQ ID NO: 6025693 - DNA, 21 bp, Homo sapiens
catgttggaggagagagcctt

SEQ ID NO: 6025694 - DNA, 22 bp, Homo sapiens
catgttggaggagagagccttg

SEQ ID NO: 6025695 - DNA, 21 bp, Homo sapiens
catgttggatagtcagctgta

SEQ ID NO: 6025696 - DNA, 19 bp, Homo sapiens
catgttggccaggctggtc

SEQ ID NO: 6025697 - DNA, 20 bp, Homo sapiens
catgttggccaggctggtct

SEQ ID NO: 6025698 - DNA, 21 bp, Homo sapiens
catgttggccaggctggtcta

SEQ ID NO: 6025699 - DNA, 19 bp, Homo sapiens
catgttggcctcttcaggc

SEQ ID NO: 6025700 - DNA, 13 bp, Homo sapiens
catgttggcctgt

SEQ ID NO: 6025701 - DNA, 21 bp, Homo sapiens
catgttgggaaacttggctcg

SEQ ID NO: 6025702 - DNA, 19 bp, Homo sapiens
catgttgggttgttacaga

SEQ ID NO: 6025703 - DNA, 17 bp, Homo sapiens
catgttggtaccctgga

SEQ ID NO: 6025704 - DNA, 22 bp, Homo sapiens
catgttggtcaaaagctggatt

SEQ ID NO: 6025705 - DNA, 20 bp, Homo sapiens
catgttggttgcactttgta

SEQ ID NO: 6025706 - DNA, 19 bp, Homo sapiens
catgttgtctaagaaattg

SEQ ID NO: 6025707 - DNA, 18 bp, Homo sapiens
catgttgtcttataaaca

SEQ ID NO: 6025708 - DNA, 21 bp, Homo sapiens
catgttgtgcctccctggtga

SEQ ID NO: 6025709 - DNA, 23 bp, Homo sapiens
catgttgttgtgtgtatatgtat

SEQ ID NO: 6025710 - DNA, 15 bp, Homo sapiens
catgttgttttttca

SEQ ID NO: 6025711 - DNA, 21 bp, Homo sapiens
catgttgttttttcatagtgc

SEQ ID NO: 6025712 - DNA, 23 bp, Homo sapiens
catgtttaaatagcctaaatgat

SEQ ID NO: 6025713 - DNA, 14 bp, Homo sapiens
catgtttaaattgt

SEQ ID NO: 6025714 - DNA, 16 bp, Homo sapiens
catgtttaagaaatga

SEQ ID NO: 6025715 - DNA, 17 bp, Homo sapiens
catgtttaagaaatgag

SEQ ID NO: 6025716 - DNA, 18 bp, Homo sapiens
catgtttaagaaatgaga

SEQ ID NO: 6025717 - DNA, 14 bp, Homo sapiens
catgtttaagattt

SEQ ID NO: 6025718 - DNA, 15 bp, Homo sapiens
catgtttaataatat

SEQ ID NO: 6025719 - DNA, 22 bp, Homo sapiens
catgtttaatgtgaactctccc

SEQ ID NO: 6025720 - DNA, 16 bp, Homo sapiens
catgtttaatgttatc

SEQ ID NO: 6025721 - DNA, 15 bp, Homo sapiens
catgtttacagaact

SEQ ID NO: 6025722 - DNA, 19 bp, Homo sapiens
catgtttagactttaacat

SEQ ID NO: 6025723 - DNA, 13 bp, Homo sapiens
catgtttatattt

SEQ ID NO: 6025724 - DNA, 14 bp, Homo sapiens
catgtttatgaaaa

SEQ ID NO: 6025725 - DNA, 16 bp, Homo sapiens
catgtttatgaaaata

SEQ ID NO: 6025726 - DNA, 19 bp, Homo sapiens
catgtttatgaaaataaat

SEQ ID NO: 6025727 - DNA, 17 bp, Homo sapiens
caggcggggtgctgtgg

SEQ ID NO: 6025728 - DNA, 16 bp, Homo sapiens
caggcggtatccagag

SEQ ID NO: 6025729 - DNA, 22 bp, Homo sapiens
caggcggtccccatccccacca

SEQ ID NO: 6025730 - DNA, 17 bp, Homo sapiens
caggcggtgggcaccca

SEQ ID NO: 6025731 - DNA, 23 bp, Homo sapiens
caggcggtttcacgccccacact

SEQ ID NO: 6025732 - DNA, 16 bp, Homo sapiens
caggcgtagggccagg

SEQ ID NO: 6025733 - DNA, 17 bp, Homo sapiens
caggcgtagggccaggg

SEQ ID NO: 6025734 - DNA, 20 bp, Homo sapiens
caggcgtagggccagggctc

SEQ ID NO: 6025735 - DNA, 21 bp, Homo sapiens
caggcgtagggccagggctct

SEQ ID NO: 6025736 - DNA, 22 bp, Homo sapiens
caggcgtagggccagggctctg

SEQ ID NO: 6025737 - DNA, 18 bp, Homo sapiens
caggcgtgactcagcagc

SEQ ID NO: 6025738 - DNA, 20 bp, Homo sapiens
caggcgtgactcagcagcct

SEQ ID NO: 6025739 - DNA, 16 bp, Homo sapiens
caggcgtgagccactg

SEQ ID NO: 6025740 - DNA, 21 bp, Homo sapiens
caggcgtgagccactgttccc

SEQ ID NO: 6025741 - DNA, 21 bp, Homo sapiens
caggcgtgggacgtggtcagg

SEQ ID NO: 6025742 - DNA, 14 bp, Homo sapiens
caggcgtgtggcag

SEQ ID NO: 6025743 - DNA, 17 bp, Homo sapiens
caggcgtgtggcagcca

SEQ ID NO: 6025744 - DNA, 18 bp, Homo sapiens
caggcgtgtggcagccac

SEQ ID NO: 6025745 - DNA, 13 bp, Homo sapiens
caggcgttcagct

SEQ ID NO: 6025746 - DNA, 16 bp, Homo sapiens
caggcgttggtgccac

SEQ ID NO: 6025747 - DNA, 17 bp, Homo sapiens
caggcgttggtgccact

SEQ ID NO: 6025748 - DNA, 15 bp, Homo sapiens
caggcgtttctgaag

SEQ ID NO: 6025749 - DNA, 21 bp, Homo sapiens
caggctaaatgcaccaagaaa

SEQ ID NO: 6025750 - DNA, 22 bp, Homo sapiens
caggctaaatgcaccaagaaag

SEQ ID NO: 6025751 - DNA, 19 bp, Homo sapiens
caggctaagaccctgtgtc

SEQ ID NO: 6025752 - DNA, 15 bp, Homo sapiens
caggctacaggtgcc

SEQ ID NO: 6025753 - DNA, 14 bp, Homo sapiens
caggctacagttga

SEQ ID NO: 6025754 - DNA, 17 bp, Homo sapiens
caggctacagttgggaa

SEQ ID NO: 6025755 - DNA, 20 bp, Homo sapiens
caggctaccccttcatggtg

SEQ ID NO: 6025756 - DNA, 15 bp, Homo sapiens
caggctacctttttc

SEQ ID NO: 6025757 - DNA, 15 bp, Homo sapiens
caggctactctcctc

SEQ ID NO: 6025758 - DNA, 19 bp, Homo sapiens
caggctactctgcccaccc

SEQ ID NO: 6025759 - DNA, 11 bp, Homo sapiens
caggctactgt

SEQ ID NO: 6025760 - DNA, 17 bp, Homo sapiens
caggctactgttcttga

SEQ ID NO: 6025761 - DNA, 15 bp, Homo sapiens
caggctagaacctgg

SEQ ID NO: 6025762 - DNA, 20 bp, Homo sapiens
caggctagaatggaaaactg

SEQ ID NO: 6025763 - DNA, 23 bp, Homo sapiens
caggctagacagaaacatgtctt

SEQ ID NO: 6025764 - DNA, 16 bp, Homo sapiens
caggctagagtgcagt

SEQ ID NO: 6025765 - DNA, 13 bp, Homo sapiens
caggctagatgta

SEQ ID NO: 6025766 - DNA, 14 bp, Homo sapiens
caggctagctgtgc

SEQ ID NO: 6025767 - DNA, 15 bp, Homo sapiens
caggctagctgtgct

SEQ ID NO: 6025768 - DNA, 23 bp, Homo sapiens
caggctagtccggacccacctca

SEQ ID NO: 6025769 - DNA, 21 bp, Homo sapiens
caggctatggttgccacccca

SEQ ID NO: 6025770 - DNA, 21 bp, Homo sapiens
caggctatgtataaaatacat

SEQ ID NO: 6025771 - DNA, 19 bp, Homo sapiens
caggctatttgttcagaga

SEQ ID NO: 6025772 - DNA, 20 bp, Homo sapiens
caggctatttgttcagagag

SEQ ID NO: 6025773 - DNA, 18 bp, Homo sapiens
caggctcaaacaatgaca

SEQ ID NO: 6025774 - DNA, 18 bp, Homo sapiens
caggctcaagctatcctt

SEQ ID NO: 6025775 - DNA, 12 bp, Homo sapiens
caggctcaagtt

SEQ ID NO: 6025776 - DNA, 16 bp, Homo sapiens
caggctcaagttttta

SEQ ID NO: 6025777 - DNA, 15 bp, Homo sapiens
caggctcactgccag

SEQ ID NO: 6025778 - DNA, 16 bp, Homo sapiens
caggctcactgccagg

SEQ ID NO: 6025779 - DNA, 20 bp, Homo sapiens
caggctcactgccaggccag

SEQ ID NO: 6025780 - DNA, 14 bp, Homo sapiens
caggctcagactct

SEQ ID NO: 6025781 - DNA, 11 bp, Homo sapiens
caggctcagca

SEQ ID NO: 6025782 - DNA, 12 bp, Homo sapiens
caggctcaggag

SEQ ID NO: 6025783 - DNA, 21 bp, Homo sapiens
caggctcaggcaggggcctcc

SEQ ID NO: 6025784 - DNA, 15 bp, Homo sapiens
caggctcaggctgcc

SEQ ID NO: 6025785 - DNA, 19 bp, Homo sapiens
caggctcaggctgcccagc

SEQ ID NO: 6025786 - DNA, 15 bp, Homo sapiens
caggctccaaactgg

SEQ ID NO: 6025787 - DNA, 22 bp, Homo sapiens
caggctccaggctgactggggg

SEQ ID NO: 6025788 - DNA, 19 bp, Homo sapiens
caggctccagttgaacact

SEQ ID NO: 6025789 - DNA, 13 bp, Homo sapiens
caggctccatggg

SEQ ID NO: 6025790 - DNA, 17 bp, Homo sapiens
caggctccatggggaag

SEQ ID NO: 6025791 - DNA, 17 bp, Homo sapiens
caggctcccaaactcag

SEQ ID NO: 6025792 - DNA, 18 bp, Homo sapiens
caggctcccaaactcagg

SEQ ID NO: 6025793 - DNA, 15 bp, Homo sapiens
caggctcccactgcc

SEQ ID NO: 6025794 - DNA, 18 bp, Homo sapiens
caggctcccactgcccct

SEQ ID NO: 6025795 - DNA, 21 bp, Homo sapiens
caggctcccactgcccctgca

SEQ ID NO: 6025796 - DNA, 14 bp, Homo sapiens
caggctcccagcct

SEQ ID NO: 6025797 - DNA, 22 bp, Homo sapiens
caggctcccaggagcctgccca

SEQ ID NO: 6025798 - DNA, 24 bp, Homo sapiens
caggctcccaggagcctgcccagc

SEQ ID NO: 6025799 - DNA, 17 bp, Homo sapiens
caggctccccagaactg

SEQ ID NO: 6025800 - DNA, 15 bp, Homo sapiens
caggctcccctgagg

SEQ ID NO: 6025801 - DNA, 15 bp, Homo sapiens
caggctcccctggtc

SEQ ID NO: 6025802 - DNA, 22 bp, Homo sapiens
caggctcccgaccccatccacc

SEQ ID NO: 6025803 - DNA, 13 bp, Homo sapiens
caggctccctccc

SEQ ID NO: 6025804 - DNA, 19 bp, Homo sapiens
caggctccctccctcccag

SEQ ID NO: 6025805 - DNA, 14 bp, Homo sapiens
caggctccctgacc

SEQ ID NO: 6025806 - DNA, 20 bp, Homo sapiens
caggctccctgaccaccctg

SEQ ID NO: 6025807 - DNA, 21 bp, Homo sapiens
caggctccctgaccaccctgc

SEQ ID NO: 6025808 - DNA, 22 bp, Homo sapiens
caggctccctgaccaccctgcc

SEQ ID NO: 6025809 - DNA, 23 bp, Homo sapiens
caggctccctgaccaccctgcct

SEQ ID NO: 6025810 - DNA, 16 bp, Homo sapiens
caggctccctttctct

SEQ ID NO: 6025811 - DNA, 17 bp, Homo sapiens
caggctccgcccttagt

SEQ ID NO: 6025812 - DNA, 18 bp, Homo sapiens
caggctccgcccttagtc

SEQ ID NO: 6025813 - DNA, 23 bp, Homo sapiens
caggctcctcatgaggccatgca

SEQ ID NO: 6025814 - DNA, 14 bp, Homo sapiens
caggctcctgccac

SEQ ID NO: 6025815 - DNA, 18 bp, Homo sapiens
caggctcctgccaccacg

SEQ ID NO: 6025816 - DNA, 17 bp, Homo sapiens
caggctcctggctgtgc

SEQ ID NO: 6025817 - DNA, 20 bp, Homo sapiens
caggctcctggctgtgccca

SEQ ID NO: 6025818 - DNA, 22 bp, Homo sapiens
caggctcctggctgtgcccagc

SEQ ID NO: 6025819 - DNA, 20 bp, Homo sapiens
caggctccttcctgtcttcc

SEQ ID NO: 6025820 - DNA, 21 bp, Homo sapiens
caggctccttcctgtcttcct

SEQ ID NO: 6025821 - DNA, 14 bp, Homo sapiens
caggctcctttagc

SEQ ID NO: 6025822 - DNA, 21 bp, Homo sapiens
caggctcctttagcgcccagt

SEQ ID NO: 6025823 - DNA, 14 bp, Homo sapiens
caggctcgccaagg

SEQ ID NO: 6025824 - DNA, 18 bp, Homo sapiens
caggctcgccaaggccta

SEQ ID NO: 6025825 - DNA, 21 bp, Homo sapiens
caggctcgccaaggcctagga

SEQ ID NO: 6025826 - DNA, 14 bp, Homo sapiens
caggctcggcctgc

SEQ ID NO: 6025827 - DNA, 23 bp, Homo sapiens
caggctcggcctgcccccacccc

SEQ ID NO: 6025828 - DNA, 17 bp, Homo sapiens
caggctcgtcagccacc

SEQ ID NO: 6025829 - DNA, 20 bp, Homo sapiens
caggctcgtcagccacctgg

SEQ ID NO: 6025830 - DNA, 21 bp, Homo sapiens
caggctcgtggactgagtggg

SEQ ID NO: 6025831 - DNA, 13 bp, Homo sapiens
caggctctcaaca

SEQ ID NO: 6025832 - DNA, 15 bp, Homo sapiens
caggctctcaggcca

SEQ ID NO: 6025833 - DNA, 17 bp, Homo sapiens
caggctctcaggccagc

SEQ ID NO: 6025834 - DNA, 21 bp, Homo sapiens
caggctctcaggccagctgct

SEQ ID NO: 6025835 - DNA, 14 bp, Homo sapiens
caggctctccgggc

SEQ ID NO: 6025836 - DNA, 16 bp, Homo sapiens
caggctctgagacaca

SEQ ID NO: 6025837 - DNA, 20 bp, Homo sapiens
caggctctgagatttcacag

SEQ ID NO: 6025838 - DNA, 22 bp, Homo sapiens
caggctctgccctgccctagct

SEQ ID NO: 6025839 - DNA, 17 bp, Homo sapiens
caggctctgcctcacct

SEQ ID NO: 6025840 - DNA, 14 bp, Homo sapiens
caggctctgcctgg

SEQ ID NO: 6025841 - DNA, 21 bp, Homo sapiens
caggctctgcctggaggatcc

SEQ ID NO: 6025842 - DNA, 18 bp, Homo sapiens
caggctctgctgacttct

SEQ ID NO: 6025843 - DNA, 13 bp, Homo sapiens
caggctctgctgg

SEQ ID NO: 6025844 - DNA, 14 bp, Homo sapiens
caggctctgctggt

SEQ ID NO: 6025845 - DNA, 23 bp, Homo sapiens
caggctctgctggtggaaagcga

SEQ ID NO: 6025846 - DNA, 14 bp, Homo sapiens
caggctctggccct

SEQ ID NO: 6025847 - DNA, 12 bp, Homo sapiens
caggctctggga

SEQ ID NO: 6025848 - DNA, 15 bp, Homo sapiens
caggctctgggaagg

SEQ ID NO: 6025849 - DNA, 23 bp, Homo sapiens
caggctctgggaaggggtgccct

SEQ ID NO: 6025850 - DNA, 16 bp, Homo sapiens
caggctctgggcacag

SEQ ID NO: 6025851 - DNA, 21 bp, Homo sapiens
caggctctgggcacagtgctg

SEQ ID NO: 6025852 - DNA, 18 bp, Homo sapiens
caggctctgggctcaggg

SEQ ID NO: 6025853 - DNA, 20 bp, Homo sapiens
caggctctgggctcagggct

SEQ ID NO: 6025854 - DNA, 18 bp, Homo sapiens
caggctctgtgctgaccc

SEQ ID NO: 6025855 - DNA, 22 bp, Homo sapiens
caggctctgtgctgaccctcct

SEQ ID NO: 6025856 - DNA, 24 bp, Homo sapiens
caggctctgtgctgaccctcctgt

SEQ ID NO: 6025857 - DNA, 14 bp, Homo sapiens
caggctctgttcct

SEQ ID NO: 6025858 - DNA, 21 bp, Homo sapiens
caggctctgttcctcaatggc

SEQ ID NO: 6025859 - DNA, 15 bp, Homo sapiens
caggctcttagcagc

SEQ ID NO: 6025860 - DNA, 18 bp, Homo sapiens
caggctcttagcagcttc

SEQ ID NO: 6025861 - DNA, 20 bp, Homo sapiens
caggctcttcctggacctga

SEQ ID NO: 6025862 - DNA, 22 bp, Homo sapiens
caggctcttcctggacctgagt

SEQ ID NO: 6025863 - DNA, 14 bp, Homo sapiens
caggctcttctcct

SEQ ID NO: 6025864 - DNA, 14 bp, Homo sapiens
caggctgaaaacaa

SEQ ID NO: 6025865 - DNA, 12 bp, Homo sapiens
caggctgaagag

SEQ ID NO: 6025866 - DNA, 16 bp, Homo sapiens
caggctgacatctgtg

SEQ ID NO: 6025867 - DNA, 19 bp, Homo sapiens
caggctgacgttccgggca

SEQ ID NO: 6025868 - DNA, 13 bp, Homo sapiens
caggctgactggg

SEQ ID NO: 6025869 - DNA, 21 bp, Homo sapiens
caggctgactgggggcctctg

SEQ ID NO: 6025870 - DNA, 14 bp, Homo sapiens
caggctgagagcca

SEQ ID NO: 6025871 - DNA, 23 bp, Homo sapiens
caggctgagagccggccgtggaa

SEQ ID NO: 6025872 - DNA, 13 bp, Homo sapiens
caggctgagccat

SEQ ID NO: 6025873 - DNA, 14 bp, Homo sapiens
caggctgagccatg

SEQ ID NO: 6025874 - DNA, 15 bp, Homo sapiens
caggctgagccatga

SEQ ID NO: 6025875 - DNA, 16 bp, Homo sapiens
caggctgagccatgag

SEQ ID NO: 6025876 - DNA, 12 bp, Homo sapiens
caggctgagccc

SEQ ID NO: 6025877 - DNA, 14 bp, Homo sapiens
caggctgagcccag

SEQ ID NO: 6025878 - DNA, 20 bp, Homo sapiens
caggctgagcccagccacct

SEQ ID NO: 6025879 - DNA, 21 bp, Homo sapiens
caggctgagccgatctggtct

SEQ ID NO: 6025880 - DNA, 12 bp, Homo sapiens
caggctgagcct

SEQ ID NO: 6025881 - DNA, 16 bp, Homo sapiens
caggctgagcctcagt

SEQ ID NO: 6025882 - DNA, 21 bp, Homo sapiens
caggctgagcctcagtctccc

SEQ ID NO: 6025883 - DNA, 13 bp, Homo sapiens
caggctgagctga

SEQ ID NO: 6025884 - DNA, 18 bp, Homo sapiens
caggctgagggaggcaga

SEQ ID NO: 6025885 - DNA, 22 bp, Homo sapiens
caggctgagggtcgtgggaaag

SEQ ID NO: 6025886 - DNA, 22 bp, Homo sapiens
caggctgaggtcctgatcagct

SEQ ID NO: 6025887 - DNA, 16 bp, Homo sapiens
caggctgaggtgagaa

SEQ ID NO: 6025888 - DNA, 14 bp, Homo sapiens
caggctgaggtggg

SEQ ID NO: 6025889 - DNA, 21 bp, Homo sapiens
caggctgaggtggggaaggag

SEQ ID NO: 6025890 - DNA, 21 bp, Homo sapiens
caggctgagtccctccatgca

SEQ ID NO: 6025891 - DNA, 19 bp, Homo sapiens
caggctgagtgagccacag

SEQ ID NO: 6025892 - DNA, 18 bp, Homo sapiens
caggctgagtgcactggc

SEQ ID NO: 6025893 - DNA, 15 bp, Homo sapiens
caggctgagtgcagg

SEQ ID NO: 6025894 - DNA, 18 bp, Homo sapiens
caggctgagtgcaggccc

SEQ ID NO: 6025895 - DNA, 19 bp, Homo sapiens
caggctgagtgcaggccca

SEQ ID NO: 6025896 - DNA, 23 bp, Homo sapiens
caggctgatgcttgaagtaactg

SEQ ID NO: 6025897 - DNA, 16 bp, Homo sapiens
caggctgatttctagg

SEQ ID NO: 6025898 - DNA, 17 bp, Homo sapiens
caggctgatttctaggt

SEQ ID NO: 6025899 - DNA, 19 bp, Homo sapiens
caggctgcaagctgcaggg

SEQ ID NO: 6025900 - DNA, 13 bp, Homo sapiens
caggctgcacctc

SEQ ID NO: 6025901 - DNA, 20 bp, Homo sapiens
caggctgcactgcagtgatg

SEQ ID NO: 6025902 - DNA, 13 bp, Homo sapiens
caggctgcagagc

SEQ ID NO: 6025903 - DNA, 19 bp, Homo sapiens
caggctgcagagcccggcc

SEQ ID NO: 6025904 - DNA, 23 bp, Homo sapiens
caggctgcagagcccggccccac

SEQ ID NO: 6025905 - DNA, 19 bp, Homo sapiens
catgtttattacagtataa

SEQ ID NO: 6025906 - DNA, 23 bp, Homo sapiens
catgtttatttatttccagtggt

SEQ ID NO: 6025907 - DNA, 20 bp, Homo sapiens
catgtttatttttcttgtct

SEQ ID NO: 6025908 - DNA, 14 bp, Homo sapiens
catgtttcacaaca

SEQ ID NO: 6025909 - DNA, 19 bp, Homo sapiens
catgtttcacaacaggcat

SEQ ID NO: 6025910 - DNA, 14 bp, Homo sapiens
catgtttcacagtg

SEQ ID NO: 6025911 - DNA, 13 bp, Homo sapiens
catgtttcatgtt

SEQ ID NO: 6025912 - DNA, 16 bp, Homo sapiens
catgtttccagcattc

SEQ ID NO: 6025913 - DNA, 17 bp, Homo sapiens
catgtttccagcattcc

SEQ ID NO: 6025914 - DNA, 19 bp, Homo sapiens
catgtttccatcatttctg

SEQ ID NO: 6025915 - DNA, 20 bp, Homo sapiens
catgtttccatcatttctgt

SEQ ID NO: 6025916 - DNA, 13 bp, Homo sapiens
catgtttcctcta

SEQ ID NO: 6025917 - DNA, 17 bp, Homo sapiens
catgtttctcacattgc

SEQ ID NO: 6025918 - DNA, 22 bp, Homo sapiens
catgtttctcacattgctgtat

SEQ ID NO: 6025919 - DNA, 22 bp, Homo sapiens
catgtttctcccataggctgtg

SEQ ID NO: 6025920 - DNA, 12 bp, Homo sapiens
catgtttctgcc

SEQ ID NO: 6025921 - DNA, 18 bp, Homo sapiens
catgtttctgggtgggtg

SEQ ID NO: 6025922 - DNA, 20 bp, Homo sapiens
catgtttctttgtaatgaaa

SEQ ID NO: 6025923 - DNA, 18 bp, Homo sapiens
catgtttgagctcagacc

SEQ ID NO: 6025924 - DNA, 19 bp, Homo sapiens
catgtttgagctcagaccc

SEQ ID NO: 6025925 - DNA, 23 bp, Homo sapiens
catgtttgagctcagacccccac

SEQ ID NO: 6025926 - DNA, 12 bp, Homo sapiens
catgtttggaaa

SEQ ID NO: 6025927 - DNA, 16 bp, Homo sapiens
catgtttggaaagctg

SEQ ID NO: 6025928 - DNA, 21 bp, Homo sapiens
catgtttgtctgtgtgctgta

SEQ ID NO: 6025929 - DNA, 13 bp, Homo sapiens
catgttttaacaa

SEQ ID NO: 6025930 - DNA, 20 bp, Homo sapiens
catgttttaacaaaaaccaa

SEQ ID NO: 6025931 - DNA, 14 bp, Homo sapiens
catgttttacaaag

SEQ ID NO: 6025932 - DNA, 19 bp, Homo sapiens
catgttttactacataggt

SEQ ID NO: 6025933 - DNA, 16 bp, Homo sapiens
catgttttacttttat

SEQ ID NO: 6025934 - DNA, 22 bp, Homo sapiens
catgttttacttttatctaaag

SEQ ID NO: 6025935 - DNA, 14 bp, Homo sapiens
catgttttagcatt

SEQ ID NO: 6025936 - DNA, 19 bp, Homo sapiens
catgttttagcatttgtat

SEQ ID NO: 6025937 - DNA, 13 bp, Homo sapiens
catgttttcaaat

SEQ ID NO: 6025938 - DNA, 20 bp, Homo sapiens
catgttttcaaatggagttg

SEQ ID NO: 6025939 - DNA, 15 bp, Homo sapiens
catgttttcaactgc

SEQ ID NO: 6025940 - DNA, 18 bp, Homo sapiens
catgttttccagctcctc

SEQ ID NO: 6025941 - DNA, 15 bp, Homo sapiens
catgttttccattgt

SEQ ID NO: 6025942 - DNA, 17 bp, Homo sapiens
catgttttccattgttt

SEQ ID NO: 6025943 - DNA, 21 bp, Homo sapiens
catgttttccattgtttgaaa

SEQ ID NO: 6025944 - DNA, 14 bp, Homo sapiens
catgttttccgtga

SEQ ID NO: 6025945 - DNA, 21 bp, Homo sapiens
catgttttctgaaaatataac

SEQ ID NO: 6025946 - DNA, 13 bp, Homo sapiens
catgttttctgct

SEQ ID NO: 6025947 - DNA, 20 bp, Homo sapiens
catgttttctgctttaaatt

SEQ ID NO: 6025948 - DNA, 22 bp, Homo sapiens
catgttttgaatgattgaagat

SEQ ID NO: 6025949 - DNA, 20 bp, Homo sapiens
catgttttgagacataaatg

SEQ ID NO: 6025950 - DNA, 13 bp, Homo sapiens
catgttttgctaa

SEQ ID NO: 6025951 - DNA, 15 bp, Homo sapiens
catgttttgtataca

SEQ ID NO: 6025952 - DNA, 17 bp, Homo sapiens
catgttttgtatacaaa

SEQ ID NO: 6025953 - DNA, 22 bp, Homo sapiens
catgttttgtatacaaatatat

SEQ ID NO: 6025954 - DNA, 23 bp, Homo sapiens
catgttttgtgactatatagaga

SEQ ID NO: 6025955 - DNA, 18 bp, Homo sapiens
catgtttttaacttttaa

SEQ ID NO: 6025956 - DNA, 14 bp, Homo sapiens
catgtttttcccct

SEQ ID NO: 6025957 - DNA, 20 bp, Homo sapiens
catgtttttctattaaaaat

SEQ ID NO: 6025958 - DNA, 18 bp, Homo sapiens
catgtttttcttctccct

SEQ ID NO: 6025959 - DNA, 15 bp, Homo sapiens
catgtttttgaaaaa

SEQ ID NO: 6025960 - DNA, 15 bp, Homo sapiens
catgtttttgccaaa

SEQ ID NO: 6025961 - DNA, 16 bp, Homo sapiens
catgtttttgttttaa

SEQ ID NO: 6025962 - DNA, 19 bp, Homo sapiens
catgttttttaggaatcag

SEQ ID NO: 6025963 - DNA, 14 bp, Homo sapiens
catgttttttcatt

SEQ ID NO: 6025964 - DNA, 16 bp, Homo sapiens
catgttttttcatttg

SEQ ID NO: 6025965 - DNA, 18 bp, Homo sapiens
catgttttttcttcaaat

SEQ ID NO: 6025966 - DNA, 21 bp, Homo sapiens
cattaaaaaacagcttgttct

SEQ ID NO: 6025967 - DNA, 18 bp, Homo sapiens
cattaaaaagttgttctt

SEQ ID NO: 6025968 - DNA, 17 bp, Homo sapiens
cattaaaaataaaagtt

SEQ ID NO: 6025969 - DNA, 19 bp, Homo sapiens
cattaaaaatgagatttct

SEQ ID NO: 6025970 - DNA, 14 bp, Homo sapiens
cattaaaaatggaa

SEQ ID NO: 6025971 - DNA, 13 bp, Homo sapiens
cattaaaaattac

SEQ ID NO: 6025972 - DNA, 21 bp, Homo sapiens
cattaaaacaatattgtttct

SEQ ID NO: 6025973 - DNA, 22 bp, Homo sapiens
cattaaaacaatattgtttcta

SEQ ID NO: 6025974 - DNA, 20 bp, Homo sapiens
cattaaaactaggtaatgtt

SEQ ID NO: 6025975 - DNA, 13 bp, Homo sapiens
cattaaaactgct

SEQ ID NO: 6025976 - DNA, 12 bp, Homo sapiens
cattaaaagaaa

SEQ ID NO: 6025977 - DNA, 14 bp, Homo sapiens
cattaaaagaaaat

SEQ ID NO: 6025978 - DNA, 19 bp, Homo sapiens
cattaaaagacaaatatgt

SEQ ID NO: 6025979 - DNA, 14 bp, Homo sapiens
cattaaaaggaaaa

SEQ ID NO: 6025980 - DNA, 19 bp, Homo sapiens
cattaaaagttttatgtac

SEQ ID NO: 6025981 - DNA, 16 bp, Homo sapiens
cattaaaataaaacaa

SEQ ID NO: 6025982 - DNA, 18 bp, Homo sapiens
cattaaaataaaacaagc

SEQ ID NO: 6025983 - DNA, 21 bp, Homo sapiens
cattaaaataaaacaagcctt

SEQ ID NO: 6025984 - DNA, 18 bp, Homo sapiens
cattaaaataaaccaaat

SEQ ID NO: 6025985 - DNA, 23 bp, Homo sapiens
cattaaaataactatcaggcaga

SEQ ID NO: 6025986 - DNA, 11 bp, Homo sapiens
cattaaaatat

SEQ ID NO: 6025987 - DNA, 16 bp, Homo sapiens
cattaaaatcttgaaa

SEQ ID NO: 6025988 - DNA, 15 bp, Homo sapiens
cattaaaatgaattt

SEQ ID NO: 6025989 - DNA, 12 bp, Homo sapiens
cattaaaattaa

SEQ ID NO: 6025990 - DNA, 11 bp, Homo sapiens
cattaaaattg

SEQ ID NO: 6025991 - DNA, 15 bp, Homo sapiens
cattaaaattgttac

SEQ ID NO: 6025992 - DNA, 21 bp, Homo sapiens
cattaaaatttcttatttacc

SEQ ID NO: 6025993 - DNA, 20 bp, Homo sapiens
cattaaaattttacctctct

SEQ ID NO: 6025994 - DNA, 15 bp, Homo sapiens
cattaaacaaataaa

SEQ ID NO: 6025995 - DNA, 21 bp, Homo sapiens
cattaaacactgtaatcttaa

SEQ ID NO: 6025996 - DNA, 12 bp, Homo sapiens
cattaaacagaa

SEQ ID NO: 6025997 - DNA, 15 bp, Homo sapiens
cattaaacatgactc

SEQ ID NO: 6025998 - DNA, 23 bp, Homo sapiens
cattaaacctgtctccactgtgc

SEQ ID NO: 6025999 - DNA, 17 bp, Homo sapiens
cattaaacgtcattcag

SEQ ID NO: 6026000 - DNA, 19 bp, Homo sapiens
cattaaactagtgttatac

SEQ ID NO: 6026001 - DNA, 10 bp, Homo sapiens
cattaaactg

SEQ ID NO: 6026002 - DNA, 19 bp, Homo sapiens
cattaaacttttttaacca

SEQ ID NO: 6026003 - DNA, 13 bp, Homo sapiens
cattaaagaaaaa

SEQ ID NO: 6026004 - DNA, 14 bp, Homo sapiens
cattaaagaaaaac

SEQ ID NO: 6026005 - DNA, 22 bp, Homo sapiens
cattaaagaaaaaccacagata

SEQ ID NO: 6026006 - DNA, 23 bp, Homo sapiens
cattaaagaaaaaccacagatac

SEQ ID NO: 6026007 - DNA, 14 bp, Homo sapiens
cattaaagaagacc

SEQ ID NO: 6026008 - DNA, 15 bp, Homo sapiens
cattaaagaagacct

SEQ ID NO: 6026009 - DNA, 14 bp, Homo sapiens
cattaaagagccat

SEQ ID NO: 6026010 - DNA, 22 bp, Homo sapiens
cattaaagcagtcacttttcct

SEQ ID NO: 6026011 - DNA, 18 bp, Homo sapiens
cattaaagcatttacttt

SEQ ID NO: 6026012 - DNA, 21 bp, Homo sapiens
cattaaagcctgagtttgctt

SEQ ID NO: 6026013 - DNA, 18 bp, Homo sapiens
cattaaaggcttctctct

SEQ ID NO: 6026014 - DNA, 21 bp, Homo sapiens
cattaaaggcttctctctcac

SEQ ID NO: 6026015 - DNA, 13 bp, Homo sapiens
cattaaagtcaga

SEQ ID NO: 6026016 - DNA, 21 bp, Homo sapiens
cattaaagtcgagcttttcta

SEQ ID NO: 6026017 - DNA, 22 bp, Homo sapiens
cattaaagttaaactgtatttt

SEQ ID NO: 6026018 - DNA, 19 bp, Homo sapiens
cattaaagttaatagaact

SEQ ID NO: 6026019 - DNA, 13 bp, Homo sapiens
cattaaataaatt

SEQ ID NO: 6026020 - DNA, 16 bp, Homo sapiens
cattaaatataaaata

SEQ ID NO: 6026021 - DNA, 15 bp, Homo sapiens
cattaaatattctgt

SEQ ID NO: 6026022 - DNA, 18 bp, Homo sapiens
cattaaatcaatcaggaa

SEQ ID NO: 6026023 - DNA, 17 bp, Homo sapiens
cattaaatcacttgaat

SEQ ID NO: 6026024 - DNA, 23 bp, Homo sapiens
cattaaatctgacagtctcaaat

SEQ ID NO: 6026025 - DNA, 14 bp, Homo sapiens
cattaaatgactct

SEQ ID NO: 6026026 - DNA, 13 bp, Homo sapiens
cattaaatgcaaa

SEQ ID NO: 6026027 - DNA, 14 bp, Homo sapiens
cattaaatgcaaaa

SEQ ID NO: 6026028 - DNA, 15 bp, Homo sapiens
cattaaatgctttga

SEQ ID NO: 6026029 - DNA, 13 bp, Homo sapiens
cattaaatggaat

SEQ ID NO: 6026030 - DNA, 11 bp, Homo sapiens
cattaaatggt

SEQ ID NO: 6026031 - DNA, 22 bp, Homo sapiens
cattaaatggtgatttcttgct

SEQ ID NO: 6026032 - DNA, 14 bp, Homo sapiens
cattaaattcacaa

SEQ ID NO: 6026033 - DNA, 13 bp, Homo sapiens
cattaaattgata

SEQ ID NO: 6026034 - DNA, 20 bp, Homo sapiens
cattaaattggaattttctt

SEQ ID NO: 6026035 - DNA, 14 bp, Homo sapiens
cattaaattttcta

SEQ ID NO: 6026036 - DNA, 13 bp, Homo sapiens
cattaacacattg

SEQ ID NO: 6026037 - DNA, 15 bp, Homo sapiens
cattaacaggtcttt

SEQ ID NO: 6026038 - DNA, 16 bp, Homo sapiens
cattaacattttgagc

SEQ ID NO: 6026039 - DNA, 13 bp, Homo sapiens
cattaacattttt

SEQ ID NO: 6026040 - DNA, 15 bp, Homo sapiens
cattaaccaaagaaa

SEQ ID NO: 6026041 - DNA, 16 bp, Homo sapiens
cattaaccagtggccg

SEQ ID NO: 6026042 - DNA, 17 bp, Homo sapiens
cattaaccatctttaat

SEQ ID NO: 6026043 - DNA, 19 bp, Homo sapiens
cattaacccatctctgaac

SEQ ID NO: 6026044 - DNA, 20 bp, Homo sapiens
cattaaccgatgctttacca

SEQ ID NO: 6026045 - DNA, 19 bp, Homo sapiens
cattaactatttttttcaa

SEQ ID NO: 6026046 - DNA, 21 bp, Homo sapiens
cattaactatttttttcaaag

SEQ ID NO: 6026047 - DNA, 13 bp, Homo sapiens
cattaactcaggc

SEQ ID NO: 6026048 - DNA, 14 bp, Homo sapiens
cattaactccctcc

SEQ ID NO: 6026049 - DNA, 17 bp, Homo sapiens
cattaactccctccacc

SEQ ID NO: 6026050 - DNA, 21 bp, Homo sapiens
cattaactccctccaccagcc

SEQ ID NO: 6026051 - DNA, 22 bp, Homo sapiens
cattaactccctccaccagcct

SEQ ID NO: 6026052 - DNA, 13 bp, Homo sapiens
cattaactgcttc

SEQ ID NO: 6026053 - DNA, 17 bp, Homo sapiens
cattaacttagcatgtg

SEQ ID NO: 6026054 - DNA, 11 bp, Homo sapiens
cattaagaaaa

SEQ ID NO: 6026055 - DNA, 19 bp, Homo sapiens
cattaagaaaaacaataaa

SEQ ID NO: 6026056 - DNA, 12 bp, Homo sapiens
cattaagaaaat

SEQ ID NO: 6026057 - DNA, 17 bp, Homo sapiens
cattaagaacaaggaat

SEQ ID NO: 6026058 - DNA, 19 bp, Homo sapiens
cattaagagaacaaagagt

SEQ ID NO: 6026059 - DNA, 10 bp, Homo sapiens
cattaagagt

SEQ ID NO: 6026060 - DNA, 15 bp, Homo sapiens
cattaagagtgaatg

SEQ ID NO: 6026061 - DNA, 16 bp, Homo sapiens
cattaagcacacacat

SEQ ID NO: 6026062 - DNA, 17 bp, Homo sapiens
cattaagccctcttcca

SEQ ID NO: 6026063 - DNA, 22 bp, Homo sapiens
cattaagcgggatcccagcatc

SEQ ID NO: 6026064 - DNA, 13 bp, Homo sapiens
cattaagcttttt

SEQ ID NO: 6026065 - DNA, 16 bp, Homo sapiens
cattaaggcagtatga

SEQ ID NO: 6026066 - DNA, 14 bp, Homo sapiens
cattaagggcctgc

SEQ ID NO: 6026067 - DNA, 19 bp, Homo sapiens
cattaaggttatgcactgc

SEQ ID NO: 6026068 - DNA, 21 bp, Homo sapiens
cattaaggttatgcactgcct

SEQ ID NO: 6026069 - DNA, 13 bp, Homo sapiens
cattaagtaaatg

SEQ ID NO: 6026070 - DNA, 16 bp, Homo sapiens
cattaagtaatctttt

SEQ ID NO: 6026071 - DNA, 15 bp, Homo sapiens
cattaagtcatgtgt

SEQ ID NO: 6026072 - DNA, 20 bp, Homo sapiens
cattaagtcatgtgtgaaca

SEQ ID NO: 6026073 - DNA, 15 bp, Homo sapiens
cattaagtggctttt

SEQ ID NO: 6026074 - DNA, 23 bp, Homo sapiens
cattaagtggtagtaatttcctt

SEQ ID NO: 6026075 - DNA, 13 bp, Homo sapiens
cattaataaaaat

SEQ ID NO: 6026076 - DNA, 13 bp, Homo sapiens
cattaataaaact

SEQ ID NO: 6026077 - DNA, 16 bp, Homo sapiens
cattaataaaactgtg

SEQ ID NO: 6026078 - DNA, 14 bp, Homo sapiens
cattaataagtgaa

SEQ ID NO: 6026079 - DNA, 21 bp, Homo sapiens
cattaataagtgaagaataca

SEQ ID NO: 6026080 - DNA, 17 bp, Homo sapiens
cattaatacttccttat

SEQ ID NO: 6026081 - DNA, 18 bp, Homo sapiens
cattaatagcagcctttc

SEQ ID NO: 6026082 - DNA, 22 bp, Homo sapiens
cattaataggaaagatttaatg

SEQ ID NO: 6026083 - DNA, 14 bp, Homo sapiens
cattaatattcttt

SEQ ID NO: 6026084 - DNA, 12 bp, Homo sapiens
cattaatattta

SEQ ID NO: 6026085 - DNA, 16 bp, Homo sapiens
cattaatatttgctga

SEQ ID NO: 6026086 - DNA, 20 bp, Homo sapiens
caggctgcagcaggcagagg

SEQ ID NO: 6026087 - DNA, 22 bp, Homo sapiens
caggctgcagcaggcagaggag

SEQ ID NO: 6026088 - DNA, 18 bp, Homo sapiens
caggctgcagctggacag

SEQ ID NO: 6026089 - DNA, 18 bp, Homo sapiens
caggctgcaggagggcac

SEQ ID NO: 6026090 - DNA, 17 bp, Homo sapiens
caggctgcatagaagga

SEQ ID NO: 6026091 - DNA, 22 bp, Homo sapiens
caggctgccaaggccagagtgg

SEQ ID NO: 6026092 - DNA, 12 bp, Homo sapiens
caggctgccagt

SEQ ID NO: 6026093 - DNA, 20 bp, Homo sapiens
caggctgccagtgcctgggt

SEQ ID NO: 6026094 - DNA, 21 bp, Homo sapiens
caggctgccagtgcctgggtg

SEQ ID NO: 6026095 - DNA, 18 bp, Homo sapiens
caggctgcccactctggg

SEQ ID NO: 6026096 - DNA, 20 bp, Homo sapiens
caggctgcccactctgggga

SEQ ID NO: 6026097 - DNA, 19 bp, Homo sapiens
caggctgcccagcggctct

SEQ ID NO: 6026098 - DNA, 11 bp, Homo sapiens
caggctgcccc

SEQ ID NO: 6026099 - DNA, 15 bp, Homo sapiens
caggctgccccaccc

SEQ ID NO: 6026100 - DNA, 18 bp, Homo sapiens
caggctgccccacccctc

SEQ ID NO: 6026101 - DNA, 21 bp, Homo sapiens
caggctgcccccaacactcca

SEQ ID NO: 6026102 - DNA, 14 bp, Homo sapiens
caggctgccggctc

SEQ ID NO: 6026103 - DNA, 16 bp, Homo sapiens
caggctgccggctccc

SEQ ID NO: 6026104 - DNA, 17 bp, Homo sapiens
caggctgccggctcccc

SEQ ID NO: 6026105 - DNA, 19 bp, Homo sapiens
caggctgcctcctgccctt

SEQ ID NO: 6026106 - DNA, 21 bp, Homo sapiens
caggctgcctcggactccatg

SEQ ID NO: 6026107 - DNA, 22 bp, Homo sapiens
caggctgcctcggactccatgg

SEQ ID NO: 6026108 - DNA, 21 bp, Homo sapiens
caggctgcctgagcacctccc

SEQ ID NO: 6026109 - DNA, 14 bp, Homo sapiens
caggctgcgcctgc

SEQ ID NO: 6026110 - DNA, 16 bp, Homo sapiens
caggctgcgcctgccc

SEQ ID NO: 6026111 - DNA, 16 bp, Homo sapiens
caggctgcggcccctc

SEQ ID NO: 6026112 - DNA, 18 bp, Homo sapiens
caggctgcggcccctccc

SEQ ID NO: 6026113 - DNA, 19 bp, Homo sapiens
caggctgcggcccctcccc

SEQ ID NO: 6026114 - DNA, 20 bp, Homo sapiens
caggctgcggcccctccccc

SEQ ID NO: 6026115 - DNA, 18 bp, Homo sapiens
caggctgcggtgggcagc

SEQ ID NO: 6026116 - DNA, 21 bp, Homo sapiens
caggctgcggtgggcagccat

SEQ ID NO: 6026117 - DNA, 12 bp, Homo sapiens
caggctgctctt

SEQ ID NO: 6026118 - DNA, 11 bp, Homo sapiens
caggctgctgg

SEQ ID NO: 6026119 - DNA, 18 bp, Homo sapiens
caggctgctggaaggcag

SEQ ID NO: 6026120 - DNA, 14 bp, Homo sapiens
caggctgctggagg

SEQ ID NO: 6026121 - DNA, 18 bp, Homo sapiens
caggctgctggcgcctct

SEQ ID NO: 6026122 - DNA, 22 bp, Homo sapiens
caggctgctggcgcctctgcaa

SEQ ID NO: 6026123 - DNA, 12 bp, Homo sapiens
caggctgcttgg

SEQ ID NO: 6026124 - DNA, 19 bp, Homo sapiens
caggctggaagatagctgt

SEQ ID NO: 6026125 - DNA, 18 bp, Homo sapiens
caggctggaagtacttgg

SEQ ID NO: 6026126 - DNA, 16 bp, Homo sapiens
caggctggaatgaggg

SEQ ID NO: 6026127 - DNA, 18 bp, Homo sapiens
caggctggaatgagggag

SEQ ID NO: 6026128 - DNA, 20 bp, Homo sapiens
caggctggacaccctctgcc

SEQ ID NO: 6026129 - DNA, 21 bp, Homo sapiens
caggctggacaccctctgccg

SEQ ID NO: 6026130 - DNA, 22 bp, Homo sapiens
caggctggacatgctgactgtc

SEQ ID NO: 6026131 - DNA, 15 bp, Homo sapiens
caggctggactgcag

SEQ ID NO: 6026132 - DNA, 19 bp, Homo sapiens
caggctggactgcagtggc

SEQ ID NO: 6026133 - DNA, 15 bp, Homo sapiens
caggctggagacccc

SEQ ID NO: 6026134 - DNA, 16 bp, Homo sapiens
caggctggagaccccc

SEQ ID NO: 6026135 - DNA, 21 bp, Homo sapiens
caggctggagataacagcctc

SEQ ID NO: 6026136 - DNA, 20 bp, Homo sapiens
caggctggagtgatctcagc

SEQ ID NO: 6026137 - DNA, 16 bp, Homo sapiens
caggctggagtgcaat

SEQ ID NO: 6026138 - DNA, 17 bp, Homo sapiens
caggctggagtgcagtg

SEQ ID NO: 6026139 - DNA, 19 bp, Homo sapiens
caggctggagtgcagtggc

SEQ ID NO: 6026140 - DNA, 17 bp, Homo sapiens
caggctggcagctctcc

SEQ ID NO: 6026141 - DNA, 19 bp, Homo sapiens
caggctggcagctctccag

SEQ ID NO: 6026142 - DNA, 15 bp, Homo sapiens
caggctggcagttgg

SEQ ID NO: 6026143 - DNA, 16 bp, Homo sapiens
caggctggcatctccc

SEQ ID NO: 6026144 - DNA, 23 bp, Homo sapiens
caggctggcatctcccccaccct

SEQ ID NO: 6026145 - DNA, 17 bp, Homo sapiens
caggctggccagcccca

SEQ ID NO: 6026146 - DNA, 15 bp, Homo sapiens
caggctggccagccg

SEQ ID NO: 6026147 - DNA, 16 bp, Homo sapiens
caggctggccagtcca

SEQ ID NO: 6026148 - DNA, 14 bp, Homo sapiens
caggctggccagtg

SEQ ID NO: 6026149 - DNA, 17 bp, Homo sapiens
caggctggcccccaccc

SEQ ID NO: 6026150 - DNA, 20 bp, Homo sapiens
caggctggcccccacccacc

SEQ ID NO: 6026151 - DNA, 21 bp, Homo sapiens
caggctggcccccacccacct

SEQ ID NO: 6026152 - DNA, 16 bp, Homo sapiens
caggctggccctgccc

SEQ ID NO: 6026153 - DNA, 19 bp, Homo sapiens
caggctggccctgccctgg

SEQ ID NO: 6026154 - DNA, 16 bp, Homo sapiens
caggctggctccagat

SEQ ID NO: 6026155 - DNA, 17 bp, Homo sapiens
caggctggctccagatg

SEQ ID NO: 6026156 - DNA, 18 bp, Homo sapiens
caggctggctccagatgc

SEQ ID NO: 6026157 - DNA, 20 bp, Homo sapiens
caggctggctccagatgcag

SEQ ID NO: 6026158 - DNA, 20 bp, Homo sapiens
caggctggctcgtaggcctg

SEQ ID NO: 6026159 - DNA, 16 bp, Homo sapiens
caggctggctgttggc

SEQ ID NO: 6026160 - DNA, 12 bp, Homo sapiens
caggctgggaac

SEQ ID NO: 6026161 - DNA, 23 bp, Homo sapiens
caggctgggacggaccagcatct

SEQ ID NO: 6026162 - DNA, 21 bp, Homo sapiens
caggctgggagagccttccag

SEQ ID NO: 6026163 - DNA, 13 bp, Homo sapiens
caggctgggaggc

SEQ ID NO: 6026164 - DNA, 17 bp, Homo sapiens
caggctgggaggctcgg

SEQ ID NO: 6026165 - DNA, 13 bp, Homo sapiens
caggctgggcagc

SEQ ID NO: 6026166 - DNA, 13 bp, Homo sapiens
caggctgggccat

SEQ ID NO: 6026167 - DNA, 13 bp, Homo sapiens
caggctgggccgc

SEQ ID NO: 6026168 - DNA, 19 bp, Homo sapiens
caggctgggccgcaagggc

SEQ ID NO: 6026169 - DNA, 16 bp, Homo sapiens
caggctgggctgagcc

SEQ ID NO: 6026170 - DNA, 17 bp, Homo sapiens
caggctgggctgagcca

SEQ ID NO: 6026171 - DNA, 21 bp, Homo sapiens
caggctgggctgagccaaagc

SEQ ID NO: 6026172 - DNA, 15 bp, Homo sapiens
caggctgggcttcag

SEQ ID NO: 6026173 - DNA, 16 bp, Homo sapiens
caggctgggcttcagt

SEQ ID NO: 6026174 - DNA, 19 bp, Homo sapiens
caggctgggcttcagtggc

SEQ ID NO: 6026175 - DNA, 20 bp, Homo sapiens
caggctgggcttcagtggca

SEQ ID NO: 6026176 - DNA, 17 bp, Homo sapiens
caggctggggaggtgct

SEQ ID NO: 6026177 - DNA, 11 bp, Homo sapiens
caggctggggc

SEQ ID NO: 6026178 - DNA, 12 bp, Homo sapiens
caggctggggcc

SEQ ID NO: 6026179 - DNA, 19 bp, Homo sapiens
caggctggggccaggggac

SEQ ID NO: 6026180 - DNA, 19 bp, Homo sapiens
caggctgggtcctgccagc

SEQ ID NO: 6026181 - DNA, 20 bp, Homo sapiens
caggctgggtcctgccagct

SEQ ID NO: 6026182 - DNA, 23 bp, Homo sapiens
caggctgggtcctgccagctgga

SEQ ID NO: 6026183 - DNA, 21 bp, Homo sapiens
caggctgggtcgccctggact

SEQ ID NO: 6026184 - DNA, 16 bp, Homo sapiens
caggctgggtgacaga

SEQ ID NO: 6026185 - DNA, 23 bp, Homo sapiens
caggctgggtgacagagcgagac

SEQ ID NO: 6026186 - DNA, 20 bp, Homo sapiens
caggctgggttgtcactgag

SEQ ID NO: 6026187 - DNA, 22 bp, Homo sapiens
caggctgggttgtcactgagac

SEQ ID NO: 6026188 - DNA, 20 bp, Homo sapiens
caggctggtctcaaactcct

SEQ ID NO: 6026189 - DNA, 22 bp, Homo sapiens
caggctggtctcaaactcctga

SEQ ID NO: 6026190 - DNA, 24 bp, Homo sapiens
caggctggtctcgaactgctggat

SEQ ID NO: 6026191 - DNA, 21 bp, Homo sapiens
caggctggtcttgaactcctg

SEQ ID NO: 6026192 - DNA, 22 bp, Homo sapiens
caggctggtcttgaactcctgg

SEQ ID NO: 6026193 - DNA, 22 bp, Homo sapiens
caggctggtttcaaactcctga

SEQ ID NO: 6026194 - DNA, 19 bp, Homo sapiens
caggctgtaaattgaactt

SEQ ID NO: 6026195 - DNA, 15 bp, Homo sapiens
caggctgtaagcatt

SEQ ID NO: 6026196 - DNA, 23 bp, Homo sapiens
caggctgtaagcattctgagctg

SEQ ID NO: 6026197 - DNA, 21 bp, Homo sapiens
caggctgtaggaaatctagtt

SEQ ID NO: 6026198 - DNA, 20 bp, Homo sapiens
caggctgtatcccatgagcc

SEQ ID NO: 6026199 - DNA, 23 bp, Homo sapiens
caggctgtatcccatgagcctca

SEQ ID NO: 6026200 - DNA, 21 bp, Homo sapiens
caggctgtcagcgcctcaagg

SEQ ID NO: 6026201 - DNA, 21 bp, Homo sapiens
caggctgtcccaagctcccaa

SEQ ID NO: 6026202 - DNA, 17 bp, Homo sapiens
caggctgtctggccagg

SEQ ID NO: 6026203 - DNA, 14 bp, Homo sapiens
caggctgtgactct

SEQ ID NO: 6026204 - DNA, 17 bp, Homo sapiens
caggctgtgactcttct

SEQ ID NO: 6026205 - DNA, 20 bp, Homo sapiens
caggctgtgactcttctctc

SEQ ID NO: 6026206 - DNA, 14 bp, Homo sapiens
caggctgtgctagc

SEQ ID NO: 6026207 - DNA, 12 bp, Homo sapiens
caggctgtgctt

SEQ ID NO: 6026208 - DNA, 19 bp, Homo sapiens
caggctgtgcttacctgtg

SEQ ID NO: 6026209 - DNA, 17 bp, Homo sapiens
caggctgtgggcctcaa

SEQ ID NO: 6026210 - DNA, 21 bp, Homo sapiens
caggctgtgtgtggggcccaa

SEQ ID NO: 6026211 - DNA, 16 bp, Homo sapiens
caggctgttattatga

SEQ ID NO: 6026212 - DNA, 23 bp, Homo sapiens
caggctgttattatgaaggaatt

SEQ ID NO: 6026213 - DNA, 12 bp, Homo sapiens
caggctgttctc

SEQ ID NO: 6026214 - DNA, 14 bp, Homo sapiens
caggctgttctcag

SEQ ID NO: 6026215 - DNA, 17 bp, Homo sapiens
caggctgttctccaggc

SEQ ID NO: 6026216 - DNA, 20 bp, Homo sapiens
caggctgttctcgaactcct

SEQ ID NO: 6026217 - DNA, 22 bp, Homo sapiens
caggctgttctcgaactcctga

SEQ ID NO: 6026218 - DNA, 20 bp, Homo sapiens
caggctgttctgcactgaaa

SEQ ID NO: 6026219 - DNA, 19 bp, Homo sapiens
caggctgttggcgtgtccc

SEQ ID NO: 6026220 - DNA, 15 bp, Homo sapiens
caggctgtttctttt

SEQ ID NO: 6026221 - DNA, 21 bp, Homo sapiens
caggcttaataaaaatgacag

SEQ ID NO: 6026222 - DNA, 17 bp, Homo sapiens
caggcttactgagctgt

SEQ ID NO: 6026223 - DNA, 21 bp, Homo sapiens
caggcttactgagctgtccag

SEQ ID NO: 6026224 - DNA, 19 bp, Homo sapiens
caggcttatttttaaaata

SEQ ID NO: 6026225 - DNA, 16 bp, Homo sapiens
caggcttcacagtctg

SEQ ID NO: 6026226 - DNA, 19 bp, Homo sapiens
caggcttccacacttctgg

SEQ ID NO: 6026227 - DNA, 21 bp, Homo sapiens
caggcttccacacttctgggc

SEQ ID NO: 6026228 - DNA, 20 bp, Homo sapiens
caggcttcccaaaccaagtg

SEQ ID NO: 6026229 - DNA, 15 bp, Homo sapiens
caggcttcccctccc

SEQ ID NO: 6026230 - DNA, 20 bp, Homo sapiens
caggcttccctgacttgctt

SEQ ID NO: 6026231 - DNA, 22 bp, Homo sapiens
caggcttcctgcaattttctaa

SEQ ID NO: 6026232 - DNA, 16 bp, Homo sapiens
caggcttcctgcccta

SEQ ID NO: 6026233 - DNA, 12 bp, Homo sapiens
caggcttcctgg

SEQ ID NO: 6026234 - DNA, 21 bp, Homo sapiens
caggcttcctgggtcctgcct

SEQ ID NO: 6026235 - DNA, 22 bp, Homo sapiens
caggcttcctgggtcctgcctg

SEQ ID NO: 6026236 - DNA, 13 bp, Homo sapiens
caggcttcctggt

SEQ ID NO: 6026237 - DNA, 21 bp, Homo sapiens
caggcttcggacagtgcccat

SEQ ID NO: 6026238 - DNA, 16 bp, Homo sapiens
caggcttcgtctcaga

SEQ ID NO: 6026239 - DNA, 21 bp, Homo sapiens
caggcttcgtctcagaaggct

SEQ ID NO: 6026240 - DNA, 21 bp, Homo sapiens
caggcttcgtttgcctccaga

SEQ ID NO: 6026241 - DNA, 14 bp, Homo sapiens
caggcttctcccgg

SEQ ID NO: 6026242 - DNA, 14 bp, Homo sapiens
caggcttctgctgg

SEQ ID NO: 6026243 - DNA, 17 bp, Homo sapiens
caggcttctgctggggc

SEQ ID NO: 6026244 - DNA, 17 bp, Homo sapiens
caggcttgagggagggc

SEQ ID NO: 6026245 - DNA, 20 bp, Homo sapiens
caggcttgagttttcatttc

SEQ ID NO: 6026246 - DNA, 15 bp, Homo sapiens
caggcttgcattaaa

SEQ ID NO: 6026247 - DNA, 22 bp, Homo sapiens
caggcttgcattaaaagactgt

SEQ ID NO: 6026248 - DNA, 13 bp, Homo sapiens
caggcttgcctca

SEQ ID NO: 6026249 - DNA, 17 bp, Homo sapiens
caggcttgcctgcaggc

SEQ ID NO: 6026250 - DNA, 18 bp, Homo sapiens
caggcttgcctgcaggca

SEQ ID NO: 6026251 - DNA, 23 bp, Homo sapiens
caggcttgctgtatgacccctgg

SEQ ID NO: 6026252 - DNA, 18 bp, Homo sapiens
caggcttggaatgaattc

SEQ ID NO: 6026253 - DNA, 21 bp, Homo sapiens
caggcttggaatgaattctct

SEQ ID NO: 6026254 - DNA, 12 bp, Homo sapiens
caggcttggagg

SEQ ID NO: 6026255 - DNA, 17 bp, Homo sapiens
caggcttggagggaagg

SEQ ID NO: 6026256 - DNA, 17 bp, Homo sapiens
caggcttggcaaagaag

SEQ ID NO: 6026257 - DNA, 22 bp, Homo sapiens
caggcttggcggagggagcggc

SEQ ID NO: 6026258 - DNA, 21 bp, Homo sapiens
caggcttgtcactagcagctg

SEQ ID NO: 6026259 - DNA, 21 bp, Homo sapiens
caggcttgtggcagcctgatt

SEQ ID NO: 6026260 - DNA, 14 bp, Homo sapiens
caggctttatgtac

SEQ ID NO: 6026261 - DNA, 22 bp, Homo sapiens
caggctttatgtacaaacatgt

SEQ ID NO: 6026262 - DNA, 18 bp, Homo sapiens
cattaatcaatcatctgt

SEQ ID NO: 6026263 - DNA, 16 bp, Homo sapiens
cattaatcaatttctc

SEQ ID NO: 6026264 - DNA, 17 bp, Homo sapiens
cattaatcatttcccca

SEQ ID NO: 6026265 - DNA, 22 bp, Homo sapiens
cattaatccacatgtttcagag

SEQ ID NO: 6026266 - DNA, 13 bp, Homo sapiens
cattaatctcaaa

SEQ ID NO: 6026267 - DNA, 16 bp, Homo sapiens
cattaatctcaaagag

SEQ ID NO: 6026268 - DNA, 12 bp, Homo sapiens
cattaatctgcc

SEQ ID NO: 6026269 - DNA, 18 bp, Homo sapiens
cattaatctgcctccctc

SEQ ID NO: 6026270 - DNA, 15 bp, Homo sapiens
cattaatctgtttgt

SEQ ID NO: 6026271 - DNA, 14 bp, Homo sapiens
cattaatgaaatac

SEQ ID NO: 6026272 - DNA, 13 bp, Homo sapiens
cattaatgacttt

SEQ ID NO: 6026273 - DNA, 23 bp, Homo sapiens
cattaatgagatgttattactgt

SEQ ID NO: 6026274 - DNA, 13 bp, Homo sapiens
cattaatgcccag

SEQ ID NO: 6026275 - DNA, 14 bp, Homo sapiens
cattaatgcccagc

SEQ ID NO: 6026276 - DNA, 15 bp, Homo sapiens
cattaatgcccagcc

SEQ ID NO: 6026277 - DNA, 16 bp, Homo sapiens
cattaatgcccagcca

SEQ ID NO: 6026278 - DNA, 22 bp, Homo sapiens
cattaatgcccagccagccacc

SEQ ID NO: 6026279 - DNA, 19 bp, Homo sapiens
cattaatgcctgctttttg

SEQ ID NO: 6026280 - DNA, 14 bp, Homo sapiens
cattaatgtgttgg

SEQ ID NO: 6026281 - DNA, 21 bp, Homo sapiens
cattaatgttgaaaaagaaaa

SEQ ID NO: 6026282 - DNA, 16 bp, Homo sapiens
cattaattaatggctt

SEQ ID NO: 6026283 - DNA, 12 bp, Homo sapiens
cattaattatta

SEQ ID NO: 6026284 - DNA, 19 bp, Homo sapiens
cattaattattattgctgt

SEQ ID NO: 6026285 - DNA, 21 bp, Homo sapiens
cattaattattattgctgttg

SEQ ID NO: 6026286 - DNA, 13 bp, Homo sapiens
cattaattctact

SEQ ID NO: 6026287 - DNA, 12 bp, Homo sapiens
cattaattctat

SEQ ID NO: 6026288 - DNA, 22 bp, Homo sapiens
cattaatttcaatcaaccaaag

SEQ ID NO: 6026289 - DNA, 15 bp, Homo sapiens
cattaattttgtgca

SEQ ID NO: 6026290 - DNA, 20 bp, Homo sapiens
cattaattttgtgcattctt

SEQ ID NO: 6026291 - DNA, 16 bp, Homo sapiens
cattaattttttttca

SEQ ID NO: 6026292 - DNA, 23 bp, Homo sapiens
cattacaaacaaaggatttgaaa

SEQ ID NO: 6026293 - DNA, 16 bp, Homo sapiens
cattacaaattgctta

SEQ ID NO: 6026294 - DNA, 20 bp, Homo sapiens
cattacaagcctggaaaaaa

SEQ ID NO: 6026295 - DNA, 16 bp, Homo sapiens
cattacaatacagtat

SEQ ID NO: 6026296 - DNA, 18 bp, Homo sapiens
cattacaatacagtattt

SEQ ID NO: 6026297 - DNA, 23 bp, Homo sapiens
cattacaatcgagactgcaatgt

SEQ ID NO: 6026298 - DNA, 22 bp, Homo sapiens
cattacaattttctgtaagaga

SEQ ID NO: 6026299 - DNA, 15 bp, Homo sapiens
cattacaccacagca

SEQ ID NO: 6026300 - DNA, 14 bp, Homo sapiens
cattacactaaatt

SEQ ID NO: 6026301 - DNA, 14 bp, Homo sapiens
cattacactccagc

SEQ ID NO: 6026302 - DNA, 15 bp, Homo sapiens
cattacagagaggag

SEQ ID NO: 6026303 - DNA, 21 bp, Homo sapiens
cattacagaggtattaaaact

SEQ ID NO: 6026304 - DNA, 21 bp, Homo sapiens
cattacagggcacaggccatg

SEQ ID NO: 6026305 - DNA, 12 bp, Homo sapiens
cattacagttct

SEQ ID NO: 6026306 - DNA, 15 bp, Homo sapiens
cattacatagaacac

SEQ ID NO: 6026307 - DNA, 23 bp, Homo sapiens
cattacatcctctgcttgtcatt

SEQ ID NO: 6026308 - DNA, 23 bp, Homo sapiens
cattacatgtgtttattcatcca

SEQ ID NO: 6026309 - DNA, 15 bp, Homo sapiens
cattacatgtttaaa

SEQ ID NO: 6026310 - DNA, 19 bp, Homo sapiens
cattacatgtttaaattgt

SEQ ID NO: 6026311 - DNA, 21 bp, Homo sapiens
cattacatgtttaaattgtaa

SEQ ID NO: 6026312 - DNA, 15 bp, Homo sapiens
cattacattattaaa

SEQ ID NO: 6026313 - DNA, 21 bp, Homo sapiens
cattacattccttgataatgt

SEQ ID NO: 6026314 - DNA, 19 bp, Homo sapiens
cattacattgtttaaagaa

SEQ ID NO: 6026315 - DNA, 14 bp, Homo sapiens
cattacatttctga

SEQ ID NO: 6026316 - DNA, 15 bp, Homo sapiens
cattacatttctgaa

SEQ ID NO: 6026317 - DNA, 17 bp, Homo sapiens
cattacatttctgaatt

SEQ ID NO: 6026318 - DNA, 11 bp, Homo sapiens
cattaccaaaa

SEQ ID NO: 6026319 - DNA, 14 bp, Homo sapiens
cattaccactcagg

SEQ ID NO: 6026320 - DNA, 16 bp, Homo sapiens
cattaccactcaggca

SEQ ID NO: 6026321 - DNA, 23 bp, Homo sapiens
cattaccagacggttcaccagcc

SEQ ID NO: 6026322 - DNA, 20 bp, Homo sapiens
cattacccacccgacctggc

SEQ ID NO: 6026323 - DNA, 14 bp, Homo sapiens
cattaccccatacc

SEQ ID NO: 6026324 - DNA, 16 bp, Homo sapiens
cattaccctacagaca

SEQ ID NO: 6026325 - DNA, 13 bp, Homo sapiens
cattacccttccc

SEQ ID NO: 6026326 - DNA, 15 bp, Homo sapiens
cattacccttccctg

SEQ ID NO: 6026327 - DNA, 16 bp, Homo sapiens
cattacccttccctgc

SEQ ID NO: 6026328 - DNA, 19 bp, Homo sapiens
cattacccttccctgcact

SEQ ID NO: 6026329 - DNA, 22 bp, Homo sapiens
cattaccgcgttgtaaaatata

SEQ ID NO: 6026330 - DNA, 21 bp, Homo sapiens
cattacctcagtgagaagcca

SEQ ID NO: 6026331 - DNA, 22 bp, Homo sapiens
cattacctcagtgagaagccag

SEQ ID NO: 6026332 - DNA, 24 bp, Homo sapiens
cattacctccatccatccttccaa

SEQ ID NO: 6026333 - DNA, 14 bp, Homo sapiens
cattacctgtttat

SEQ ID NO: 6026334 - DNA, 13 bp, Homo sapiens
cattaccttactg

SEQ ID NO: 6026335 - DNA, 18 bp, Homo sapiens
cattaccttgtctttcaa

SEQ ID NO: 6026336 - DNA, 19 bp, Homo sapiens
cattaccttttaccagctt

SEQ ID NO: 6026337 - DNA, 22 bp, Homo sapiens
cattaccttttaccagctttta

SEQ ID NO: 6026338 - DNA, 13 bp, Homo sapiens
cattacgtgagcc

SEQ ID NO: 6026339 - DNA, 18 bp, Homo sapiens
cattactaacttcttcca

SEQ ID NO: 6026340 - DNA, 13 bp, Homo sapiens
cattactactgta

SEQ ID NO: 6026341 - DNA, 18 bp, Homo sapiens
cattactagataaaatgt

SEQ ID NO: 6026342 - DNA, 17 bp, Homo sapiens
cattactataagaactt

SEQ ID NO: 6026343 - DNA, 23 bp, Homo sapiens
cattactataagaactttgagct

SEQ ID NO: 6026344 - DNA, 20 bp, Homo sapiens
cattactattaactctgcat

SEQ ID NO: 6026345 - DNA, 14 bp, Homo sapiens
cattactctgcact

SEQ ID NO: 6026346 - DNA, 16 bp, Homo sapiens
cattactcttgtaaga

SEQ ID NO: 6026347 - DNA, 22 bp, Homo sapiens
cattactcttgtaagattttga

SEQ ID NO: 6026348 - DNA, 17 bp, Homo sapiens
cattactgaaaacttca

SEQ ID NO: 6026349 - DNA, 14 bp, Homo sapiens
cattactgagggga

SEQ ID NO: 6026350 - DNA, 16 bp, Homo sapiens
cattactgcatgcact

SEQ ID NO: 6026351 - DNA, 23 bp, Homo sapiens
cattactgcatgcacttcttaca

SEQ ID NO: 6026352 - DNA, 20 bp, Homo sapiens
cattactgccttcagtatca

SEQ ID NO: 6026353 - DNA, 15 bp, Homo sapiens
cattactgcttcatt

SEQ ID NO: 6026354 - DNA, 17 bp, Homo sapiens
cattactgcttcatttt

SEQ ID NO: 6026355 - DNA, 23 bp, Homo sapiens
cattactgtacagggttatctgc

SEQ ID NO: 6026356 - DNA, 19 bp, Homo sapiens
cattactgtatttaagaaa

SEQ ID NO: 6026357 - DNA, 13 bp, Homo sapiens
cattactgtcccc

SEQ ID NO: 6026358 - DNA, 17 bp, Homo sapiens
cattactgtgatttctg

SEQ ID NO: 6026359 - DNA, 18 bp, Homo sapiens
cattactgtgatttctgg

SEQ ID NO: 6026360 - DNA, 15 bp, Homo sapiens
cattactgttccaga

SEQ ID NO: 6026361 - DNA, 20 bp, Homo sapiens
cattactgtttaagacactt

SEQ ID NO: 6026362 - DNA, 11 bp, Homo sapiens
cattacttgaa

SEQ ID NO: 6026363 - DNA, 20 bp, Homo sapiens
cattacttgcacaagcttgt

SEQ ID NO: 6026364 - DNA, 18 bp, Homo sapiens
cattacttgctttcaatt

SEQ ID NO: 6026365 - DNA, 17 bp, Homo sapiens
cattacttgttgcctat

SEQ ID NO: 6026366 - DNA, 19 bp, Homo sapiens
cattacttttaaaaatgta

SEQ ID NO: 6026367 - DNA, 12 bp, Homo sapiens
cattagaaaaaa

SEQ ID NO: 6026368 - DNA, 14 bp, Homo sapiens
cattagaaaaagag

SEQ ID NO: 6026369 - DNA, 22 bp, Homo sapiens
cattagaaaattttgtaaaaca

SEQ ID NO: 6026370 - DNA, 13 bp, Homo sapiens
cattagaaaggct

SEQ ID NO: 6026371 - DNA, 14 bp, Homo sapiens
cattagaaatattc

SEQ ID NO: 6026372 - DNA, 18 bp, Homo sapiens
cattagaaattagctgtg

SEQ ID NO: 6026373 - DNA, 15 bp, Homo sapiens
cattagaagaaaaca

SEQ ID NO: 6026374 - DNA, 19 bp, Homo sapiens
cattagaagaaaacatata

SEQ ID NO: 6026375 - DNA, 19 bp, Homo sapiens
cattagaagacaattgaca

SEQ ID NO: 6026376 - DNA, 22 bp, Homo sapiens
cattagaagatattagtcttgg

SEQ ID NO: 6026377 - DNA, 17 bp, Homo sapiens
cattagacaaatgtctt

SEQ ID NO: 6026378 - DNA, 14 bp, Homo sapiens
cattagacacacat

SEQ ID NO: 6026379 - DNA, 20 bp, Homo sapiens
cattagacacacatatacat

SEQ ID NO: 6026380 - DNA, 17 bp, Homo sapiens
cattagactcctcctcc

SEQ ID NO: 6026381 - DNA, 16 bp, Homo sapiens
cattagactgaattta

SEQ ID NO: 6026382 - DNA, 22 bp, Homo sapiens
cattagactgaatttaactact

SEQ ID NO: 6026383 - DNA, 18 bp, Homo sapiens
cattagagaaaaccttaa

SEQ ID NO: 6026384 - DNA, 21 bp, Homo sapiens
cattagagcacagcttcttct

SEQ ID NO: 6026385 - DNA, 13 bp, Homo sapiens
cattagagcaggc

SEQ ID NO: 6026386 - DNA, 17 bp, Homo sapiens
cattagagtcaactaca

SEQ ID NO: 6026387 - DNA, 21 bp, Homo sapiens
cattagataaacacaggcagg

SEQ ID NO: 6026388 - DNA, 20 bp, Homo sapiens
cattagatagtcatgctgct

SEQ ID NO: 6026389 - DNA, 14 bp, Homo sapiens
cattagatgtcatg

SEQ ID NO: 6026390 - DNA, 17 bp, Homo sapiens
cattagattatcaaaaa

SEQ ID NO: 6026391 - DNA, 21 bp, Homo sapiens
cattagattcctttcctgtgt

SEQ ID NO: 6026392 - DNA, 21 bp, Homo sapiens
cattagattttattttactat

SEQ ID NO: 6026393 - DNA, 16 bp, Homo sapiens
cattagcaaaaaaagt

SEQ ID NO: 6026394 - DNA, 17 bp, Homo sapiens
cattagcaaaaaaagtt

SEQ ID NO: 6026395 - DNA, 20 bp, Homo sapiens
cattagcaaggcagagcctt

SEQ ID NO: 6026396 - DNA, 16 bp, Homo sapiens
cattagcacagatttt

SEQ ID NO: 6026397 - DNA, 23 bp, Homo sapiens
cattagcacagattttaattgtc

SEQ ID NO: 6026398 - DNA, 17 bp, Homo sapiens
cattagcagtttgcttt

SEQ ID NO: 6026399 - DNA, 17 bp, Homo sapiens
cattaggaaaacatctt

SEQ ID NO: 6026400 - DNA, 13 bp, Homo sapiens
cattaggaattgt

SEQ ID NO: 6026401 - DNA, 23 bp, Homo sapiens
cattaggaattgtttatacacaa

SEQ ID NO: 6026402 - DNA, 22 bp, Homo sapiens
cattaggacaatcagtcccctc

SEQ ID NO: 6026403 - DNA, 20 bp, Homo sapiens
cattaggaccttagaatttt

SEQ ID NO: 6026404 - DNA, 14 bp, Homo sapiens
cattaggccccagc

SEQ ID NO: 6026405 - DNA, 15 bp, Homo sapiens
cattaggccccagca

SEQ ID NO: 6026406 - DNA, 22 bp, Homo sapiens
cattaggctgtgtcaccattgt

SEQ ID NO: 6026407 - DNA, 16 bp, Homo sapiens
cattaggcttctaaag

SEQ ID NO: 6026408 - DNA, 23 bp, Homo sapiens
cattagggcaaagatctcagcag

SEQ ID NO: 6026409 - DNA, 18 bp, Homo sapiens
cattaggttgtcctagaa

SEQ ID NO: 6026410 - DNA, 14 bp, Homo sapiens
cattaggttgtgaa

SEQ ID NO: 6026411 - DNA, 19 bp, Homo sapiens
cattagtaaatgtctttgt

SEQ ID NO: 6026412 - DNA, 21 bp, Homo sapiens
cattagtacacagcaccagaa

SEQ ID NO: 6026413 - DNA, 17 bp, Homo sapiens
cattagtcatatttttg

SEQ ID NO: 6026414 - DNA, 21 bp, Homo sapiens
cattagtcatatttttgtaaa

SEQ ID NO: 6026415 - DNA, 19 bp, Homo sapiens
cattagtcctttgtctaag

SEQ ID NO: 6026416 - DNA, 23 bp, Homo sapiens
cattagtgaattacactcaagga

SEQ ID NO: 6026417 - DNA, 21 bp, Homo sapiens
cattagtgagacatatttaca

SEQ ID NO: 6026418 - DNA, 19 bp, Homo sapiens
cattagtgtccccccttga

SEQ ID NO: 6026419 - DNA, 22 bp, Homo sapiens
cattagtgtccccccttgaagc

SEQ ID NO: 6026420 - DNA, 19 bp, Homo sapiens
cattagttaagatgtctga

SEQ ID NO: 6026421 - DNA, 13 bp, Homo sapiens
cattataaaaaca

SEQ ID NO: 6026422 - DNA, 14 bp, Homo sapiens
cattataaatgaca

SEQ ID NO: 6026423 - DNA, 16 bp, Homo sapiens
cattataaccttaatt

SEQ ID NO: 6026424 - DNA, 20 bp, Homo sapiens
cattataactgaaggagaag

SEQ ID NO: 6026425 - DNA, 15 bp, Homo sapiens
cattataataaaatt

SEQ ID NO: 6026426 - DNA, 15 bp, Homo sapiens
cattataatctcaaa

SEQ ID NO: 6026427 - DNA, 15 bp, Homo sapiens
cattataatgaattt

SEQ ID NO: 6026428 - DNA, 21 bp, Homo sapiens
cattataatttgggtgactag

SEQ ID NO: 6026429 - DNA, 13 bp, Homo sapiens
cattataattttg

SEQ ID NO: 6026430 - DNA, 13 bp, Homo sapiens
cattatactttat

SEQ ID NO: 6026431 - DNA, 18 bp, Homo sapiens
cattatactttatatctg

SEQ ID NO: 6026432 - DNA, 21 bp, Homo sapiens
cattatactttatatctgtaa

SEQ ID NO: 6026433 - DNA, 13 bp, Homo sapiens
cattatagaaatt

SEQ ID NO: 6026434 - DNA, 21 bp, Homo sapiens
cattatagcatgtaatattaa

SEQ ID NO: 6026435 - DNA, 16 bp, Homo sapiens
cattatagcgcctgta

SEQ ID NO: 6026436 - DNA, 20 bp, Homo sapiens
cattatattcctctaaaact

SEQ ID NO: 6026437 - DNA, 15 bp, Homo sapiens
cattatatttgagtt

SEQ ID NO: 6026438 - DNA, 14 bp, Homo sapiens
cattatatttgcat

SEQ ID NO: 6026439 - DNA, 16 bp, Homo sapiens
cattatatttgcatta

SEQ ID NO: 6026440 - DNA, 18 bp, Homo sapiens
caggctttctagaaagaa

SEQ ID NO: 6026441 - DNA, 14 bp, Homo sapiens
caggctttctggag

SEQ ID NO: 6026442 - DNA, 14 bp, Homo sapiens
caggctttgtgaga

SEQ ID NO: 6026443 - DNA, 18 bp, Homo sapiens
caggctttgtgagagagg

SEQ ID NO: 6026444 - DNA, 19 bp, Homo sapiens
caggctttgtgagagagga

SEQ ID NO: 6026445 - DNA, 20 bp, Homo sapiens
caggctttgtgagagaggac

SEQ ID NO: 6026446 - DNA, 22 bp, Homo sapiens
caggctttgtgagagaggacct

SEQ ID NO: 6026447 - DNA, 14 bp, Homo sapiens
caggcttttatgag

SEQ ID NO: 6026448 - DNA, 19 bp, Homo sapiens
caggcttttctcaggagct

SEQ ID NO: 6026449 - DNA, 14 bp, Homo sapiens
caggcttttgtttc

SEQ ID NO: 6026450 - DNA, 19 bp, Homo sapiens
cagggaaaaagaccaaatt

SEQ ID NO: 6026451 - DNA, 15 bp, Homo sapiens
cagggaaaagcagct

SEQ ID NO: 6026452 - DNA, 20 bp, Homo sapiens
cagggaaaagcagctctccc

SEQ ID NO: 6026453 - DNA, 17 bp, Homo sapiens
cagggaaaattgcccca

SEQ ID NO: 6026454 - DNA, 16 bp, Homo sapiens
cagggaaacagcctct

SEQ ID NO: 6026455 - DNA, 16 bp, Homo sapiens
cagggaaacagctaat

SEQ ID NO: 6026456 - DNA, 21 bp, Homo sapiens
cagggaaagcatttaggagaa

SEQ ID NO: 6026457 - DNA, 16 bp, Homo sapiens
cagggaaagctccacg

SEQ ID NO: 6026458 - DNA, 17 bp, Homo sapiens
cagggaaagctccacgg

SEQ ID NO: 6026459 - DNA, 14 bp, Homo sapiens
cagggaaaggctct

SEQ ID NO: 6026460 - DNA, 23 bp, Homo sapiens
cagggaaaggctctgaaagccag

SEQ ID NO: 6026461 - DNA, 16 bp, Homo sapiens
cagggaaatggagggt

SEQ ID NO: 6026462 - DNA, 15 bp, Homo sapiens
cagggaaatggcctt

SEQ ID NO: 6026463 - DNA, 18 bp, Homo sapiens
cagggaaatggccttccc

SEQ ID NO: 6026464 - DNA, 14 bp, Homo sapiens
cagggaaatgtgta

SEQ ID NO: 6026465 - DNA, 15 bp, Homo sapiens
cagggaaatgtgtat

SEQ ID NO: 6026466 - DNA, 16 bp, Homo sapiens
cagggaaatgtgtatc

SEQ ID NO: 6026467 - DNA, 12 bp, Homo sapiens
cagggaacaaaa

SEQ ID NO: 6026468 - DNA, 17 bp, Homo sapiens
cagggaacacattcctt

SEQ ID NO: 6026469 - DNA, 18 bp, Homo sapiens
cagggaacatggggagga

SEQ ID NO: 6026470 - DNA, 19 bp, Homo sapiens
cagggaacattggagctga

SEQ ID NO: 6026471 - DNA, 16 bp, Homo sapiens
cagggaaccccagggg

SEQ ID NO: 6026472 - DNA, 22 bp, Homo sapiens
cagggaaccctgcttgcacttt

SEQ ID NO: 6026473 - DNA, 18 bp, Homo sapiens
cagggaacgtgattagtg

SEQ ID NO: 6026474 - DNA, 19 bp, Homo sapiens
cagggaacgtgattagtga

SEQ ID NO: 6026475 - DNA, 14 bp, Homo sapiens
cagggaactgaccc

SEQ ID NO: 6026476 - DNA, 19 bp, Homo sapiens
cagggaactgaccctcagg

SEQ ID NO: 6026477 - DNA, 14 bp, Homo sapiens
cagggaactgcttg

SEQ ID NO: 6026478 - DNA, 20 bp, Homo sapiens
cagggaactgcttgcccagg

SEQ ID NO: 6026479 - DNA, 18 bp, Homo sapiens
cagggaactgggaagatg

SEQ ID NO: 6026480 - DNA, 13 bp, Homo sapiens
cagggaagacaga

SEQ ID NO: 6026481 - DNA, 14 bp, Homo sapiens
cagggaagacagag

SEQ ID NO: 6026482 - DNA, 19 bp, Homo sapiens
cagggaagacagagcaggc

SEQ ID NO: 6026483 - DNA, 20 bp, Homo sapiens
cagggaagacagagcaggct

SEQ ID NO: 6026484 - DNA, 23 bp, Homo sapiens
cagggaagacagagcaggctttg

SEQ ID NO: 6026485 - DNA, 16 bp, Homo sapiens
cagggaagagaaagtg

SEQ ID NO: 6026486 - DNA, 19 bp, Homo sapiens
cagggaagataagttggaa

SEQ ID NO: 6026487 - DNA, 17 bp, Homo sapiens
cagggaagcagcagcct

SEQ ID NO: 6026488 - DNA, 16 bp, Homo sapiens
cagggaagcaggcaga

SEQ ID NO: 6026489 - DNA, 18 bp, Homo sapiens
cagggaagcccagctcca

SEQ ID NO: 6026490 - DNA, 15 bp, Homo sapiens
cagggaagccccaca

SEQ ID NO: 6026491 - DNA, 22 bp, Homo sapiens
cagggaagccccacatgtccag

SEQ ID NO: 6026492 - DNA, 23 bp, Homo sapiens
cagggaagccccacatgtccagc

SEQ ID NO: 6026493 - DNA, 21 bp, Homo sapiens
cagggaagccctcggcctcca

SEQ ID NO: 6026494 - DNA, 21 bp, Homo sapiens
cagggaagcgtcgccccagtg

SEQ ID NO: 6026495 - DNA, 22 bp, Homo sapiens
cagggaagctacaggttacaac

SEQ ID NO: 6026496 - DNA, 24 bp, Homo sapiens
cagggaagctacaggttacaacag

SEQ ID NO: 6026497 - DNA, 14 bp, Homo sapiens
cagggaagctggcc

SEQ ID NO: 6026498 - DNA, 17 bp, Homo sapiens
cagggaagctggccgag

SEQ ID NO: 6026499 - DNA, 18 bp, Homo sapiens
cagggaagctgtcctgga

SEQ ID NO: 6026500 - DNA, 20 bp, Homo sapiens
cagggaaggaatcctggtgg

SEQ ID NO: 6026501 - DNA, 17 bp, Homo sapiens
cagggaaggacaggacc

SEQ ID NO: 6026502 - DNA, 19 bp, Homo sapiens
cagggaaggaccccctccc

SEQ ID NO: 6026503 - DNA, 14 bp, Homo sapiens
cagggaaggagaca

SEQ ID NO: 6026504 - DNA, 12 bp, Homo sapiens
cagggaaggagg

SEQ ID NO: 6026505 - DNA, 15 bp, Homo sapiens
cagggaaggaggagc

SEQ ID NO: 6026506 - DNA, 18 bp, Homo sapiens
cagggaaggatcccatga

SEQ ID NO: 6026507 - DNA, 15 bp, Homo sapiens
cagggaaggcaggca

SEQ ID NO: 6026508 - DNA, 20 bp, Homo sapiens
cagggaaggcaggcagggct

SEQ ID NO: 6026509 - DNA, 23 bp, Homo sapiens
cagggaaggcaggcagggctctc

SEQ ID NO: 6026510 - DNA, 21 bp, Homo sapiens
cagggaagggactgggagggg

SEQ ID NO: 6026511 - DNA, 16 bp, Homo sapiens
cagggaagggcttggc

SEQ ID NO: 6026512 - DNA, 17 bp, Homo sapiens
cagggaaggggacaagg

SEQ ID NO: 6026513 - DNA, 16 bp, Homo sapiens
cagggaaggtgaaaca

SEQ ID NO: 6026514 - DNA, 19 bp, Homo sapiens
cagggaaggtggccacagc

SEQ ID NO: 6026515 - DNA, 20 bp, Homo sapiens
cagggaaggtggggccctgc

SEQ ID NO: 6026516 - DNA, 21 bp, Homo sapiens
cagggaaggtggggccctgcc

SEQ ID NO: 6026517 - DNA, 22 bp, Homo sapiens
cagggaaggtggggccctgccc

SEQ ID NO: 6026518 - DNA, 14 bp, Homo sapiens
cagggaagtcccca

SEQ ID NO: 6026519 - DNA, 18 bp, Homo sapiens
cagggaagtccccaggcc

SEQ ID NO: 6026520 - DNA, 23 bp, Homo sapiens
cagggaagtccccaggccccagg

SEQ ID NO: 6026521 - DNA, 18 bp, Homo sapiens
cagggaatatatattttt

SEQ ID NO: 6026522 - DNA, 16 bp, Homo sapiens
cagggaatcagggacc

SEQ ID NO: 6026523 - DNA, 20 bp, Homo sapiens
cagggaatcagggaccagct

SEQ ID NO: 6026524 - DNA, 15 bp, Homo sapiens
cagggaatcagggag

SEQ ID NO: 6026525 - DNA, 16 bp, Homo sapiens
cagggaatcagggagc

SEQ ID NO: 6026526 - DNA, 14 bp, Homo sapiens
cagggaatccaagc

SEQ ID NO: 6026527 - DNA, 18 bp, Homo sapiens
cagggaatgcagcaggaa

SEQ ID NO: 6026528 - DNA, 23 bp, Homo sapiens
cagggaatgcctgagtgcctggc

SEQ ID NO: 6026529 - DNA, 15 bp, Homo sapiens
cagggaatgcctgga

SEQ ID NO: 6026530 - DNA, 23 bp, Homo sapiens
cagggaatggccacaaacctgcc

SEQ ID NO: 6026531 - DNA, 14 bp, Homo sapiens
cagggaatttctat

SEQ ID NO: 6026532 - DNA, 21 bp, Homo sapiens
cagggaattttcattggatgc

SEQ ID NO: 6026533 - DNA, 21 bp, Homo sapiens
cagggacaaaacactgtgtcc

SEQ ID NO: 6026534 - DNA, 13 bp, Homo sapiens
cagggacaaagag

SEQ ID NO: 6026535 - DNA, 17 bp, Homo sapiens
cagggacaaagaggcct

SEQ ID NO: 6026536 - DNA, 15 bp, Homo sapiens
cagggacaccagcca

SEQ ID NO: 6026537 - DNA, 16 bp, Homo sapiens
cagggacaccagccag

SEQ ID NO: 6026538 - DNA, 19 bp, Homo sapiens
cagggacaccagccaggct

SEQ ID NO: 6026539 - DNA, 22 bp, Homo sapiens
cagggacaccagccaggctctg

SEQ ID NO: 6026540 - DNA, 20 bp, Homo sapiens
cagggacacccacacaggtg

SEQ ID NO: 6026541 - DNA, 17 bp, Homo sapiens
cagggacacctgggaga

SEQ ID NO: 6026542 - DNA, 15 bp, Homo sapiens
cagggacacgggcag

SEQ ID NO: 6026543 - DNA, 16 bp, Homo sapiens
cagggacacgggcagc

SEQ ID NO: 6026544 - DNA, 17 bp, Homo sapiens
cagggacacgggcagcc

SEQ ID NO: 6026545 - DNA, 20 bp, Homo sapiens
cagggacactacaaacatgg

SEQ ID NO: 6026546 - DNA, 14 bp, Homo sapiens
cagggacagaagca

SEQ ID NO: 6026547 - DNA, 18 bp, Homo sapiens
cagggacagaagcaggag

SEQ ID NO: 6026548 - DNA, 14 bp, Homo sapiens
cagggacagagaca

SEQ ID NO: 6026549 - DNA, 20 bp, Homo sapiens
cagggacagagacacctgca

SEQ ID NO: 6026550 - DNA, 23 bp, Homo sapiens
cagggacagagacacctgcacct

SEQ ID NO: 6026551 - DNA, 14 bp, Homo sapiens
cagggacagagcca

SEQ ID NO: 6026552 - DNA, 16 bp, Homo sapiens
cagggacagaggccaa

SEQ ID NO: 6026553 - DNA, 16 bp, Homo sapiens
cagggacagaggcccc

SEQ ID NO: 6026554 - DNA, 19 bp, Homo sapiens
cagggacagaggccccagc

SEQ ID NO: 6026555 - DNA, 23 bp, Homo sapiens
cagggacagaggccccagcctcc

SEQ ID NO: 6026556 - DNA, 23 bp, Homo sapiens
cagggacagagggggtggcctcc

SEQ ID NO: 6026557 - DNA, 17 bp, Homo sapiens
cagggacagcctgcaca

SEQ ID NO: 6026558 - DNA, 17 bp, Homo sapiens
cagggacatggggcaag

SEQ ID NO: 6026559 - DNA, 14 bp, Homo sapiens
cagggaccaaggac

SEQ ID NO: 6026560 - DNA, 15 bp, Homo sapiens
cagggaccacagcaa

SEQ ID NO: 6026561 - DNA, 20 bp, Homo sapiens
cagggaccacagcaaggcac

SEQ ID NO: 6026562 - DNA, 14 bp, Homo sapiens
cagggaccacatcc

SEQ ID NO: 6026563 - DNA, 19 bp, Homo sapiens
cagggaccacatccacccc

SEQ ID NO: 6026564 - DNA, 20 bp, Homo sapiens
cagggaccactgggtgagag

SEQ ID NO: 6026565 - DNA, 24 bp, Homo sapiens
cagggaccactgggtgagagagga

SEQ ID NO: 6026566 - DNA, 20 bp, Homo sapiens
cagggaccagcccagcctgc

SEQ ID NO: 6026567 - DNA, 13 bp, Homo sapiens
cagggaccagctc

SEQ ID NO: 6026568 - DNA, 14 bp, Homo sapiens
cagggaccagctcc

SEQ ID NO: 6026569 - DNA, 16 bp, Homo sapiens
cagggaccagctcccc

SEQ ID NO: 6026570 - DNA, 13 bp, Homo sapiens
cagggaccagctt

SEQ ID NO: 6026571 - DNA, 16 bp, Homo sapiens
cagggaccagctttac

SEQ ID NO: 6026572 - DNA, 18 bp, Homo sapiens
cagggaccatcaagaacc

SEQ ID NO: 6026573 - DNA, 18 bp, Homo sapiens
cagggacccaggtgtgcc

SEQ ID NO: 6026574 - DNA, 21 bp, Homo sapiens
cagggacccaggtgtgcctgt

SEQ ID NO: 6026575 - DNA, 22 bp, Homo sapiens
cagggacccaggtgtgcctgtg

SEQ ID NO: 6026576 - DNA, 15 bp, Homo sapiens
cagggaccccagaat

SEQ ID NO: 6026577 - DNA, 14 bp, Homo sapiens
cagggacccccaga

SEQ ID NO: 6026578 - DNA, 12 bp, Homo sapiens
cagggacccccg

SEQ ID NO: 6026579 - DNA, 15 bp, Homo sapiens
cagggacccccgagg

SEQ ID NO: 6026580 - DNA, 16 bp, Homo sapiens
cagggacccccgaggc

SEQ ID NO: 6026581 - DNA, 14 bp, Homo sapiens
cagggacccctgcc

SEQ ID NO: 6026582 - DNA, 23 bp, Homo sapiens
cagggaccctggagtatttggaa

SEQ ID NO: 6026583 - DNA, 23 bp, Homo sapiens
cagggacccttgcctgcctccta

SEQ ID NO: 6026584 - DNA, 17 bp, Homo sapiens
cagggaccggcagagct

SEQ ID NO: 6026585 - DNA, 21 bp, Homo sapiens
cagggaccggcagagctctac

SEQ ID NO: 6026586 - DNA, 15 bp, Homo sapiens
cagggaccggtgctg

SEQ ID NO: 6026587 - DNA, 20 bp, Homo sapiens
cagggaccggtgctgcagga

SEQ ID NO: 6026588 - DNA, 22 bp, Homo sapiens
cagggaccggtgctgcaggagt

SEQ ID NO: 6026589 - DNA, 15 bp, Homo sapiens
cagggaccgtccagg

SEQ ID NO: 6026590 - DNA, 17 bp, Homo sapiens
cagggaccgtccagggg

SEQ ID NO: 6026591 - DNA, 18 bp, Homo sapiens
cagggacctaaagggact

SEQ ID NO: 6026592 - DNA, 12 bp, Homo sapiens
cagggacctcag

SEQ ID NO: 6026593 - DNA, 14 bp, Homo sapiens
cagggacctcaggg

SEQ ID NO: 6026594 - DNA, 17 bp, Homo sapiens
cagggacctcaggggca

SEQ ID NO: 6026595 - DNA, 19 bp, Homo sapiens
cagggacctcaggggcacc

SEQ ID NO: 6026596 - DNA, 23 bp, Homo sapiens
cagggacctcaggggcacctccg

SEQ ID NO: 6026597 - DNA, 13 bp, Homo sapiens
cagggacctgaga

SEQ ID NO: 6026598 - DNA, 16 bp, Homo sapiens
cagggacctgagagca

SEQ ID NO: 6026599 - DNA, 19 bp, Homo sapiens
cagggacctgctgctcagt

SEQ ID NO: 6026600 - DNA, 14 bp, Homo sapiens
cagggacgacccgg

SEQ ID NO: 6026601 - DNA, 19 bp, Homo sapiens
cagggacgtctcatctccc

SEQ ID NO: 6026602 - DNA, 21 bp, Homo sapiens
cagggactatgaatgggcaaa

SEQ ID NO: 6026603 - DNA, 19 bp, Homo sapiens
cagggactcaggccagtca

SEQ ID NO: 6026604 - DNA, 13 bp, Homo sapiens
cagggactctcca

SEQ ID NO: 6026605 - DNA, 21 bp, Homo sapiens
cagggactgaaaacctctcct

SEQ ID NO: 6026606 - DNA, 15 bp, Homo sapiens
cagggactgtacctg

SEQ ID NO: 6026607 - DNA, 17 bp, Homo sapiens
cagggacttcgcagagg

SEQ ID NO: 6026608 - DNA, 19 bp, Homo sapiens
cagggacttcgcagaggca

SEQ ID NO: 6026609 - DNA, 19 bp, Homo sapiens
cagggacttgaagttgtta

SEQ ID NO: 6026610 - DNA, 16 bp, Homo sapiens
cagggacttgtttaga

SEQ ID NO: 6026611 - DNA, 12 bp, Homo sapiens
cagggagaagtt

SEQ ID NO: 6026612 - DNA, 11 bp, Homo sapiens
cagggagacaa

SEQ ID NO: 6026613 - DNA, 12 bp, Homo sapiens
cagggagacaga

SEQ ID NO: 6026614 - DNA, 22 bp, Homo sapiens
cagggagaccaggcttcccaaa

SEQ ID NO: 6026615 - DNA, 19 bp, Homo sapiens
cagggagaccgagcgcttt

SEQ ID NO: 6026616 - DNA, 20 bp, Homo sapiens
cagggagacctggacacagg

SEQ ID NO: 6026617 - DNA, 21 bp, Homo sapiens
cagggagacctggacacaggc

SEQ ID NO: 6026618 - DNA, 20 bp, Homo sapiens
cattatattttgaaagaagc

SEQ ID NO: 6026619 - DNA, 13 bp, Homo sapiens
cattatcacatga

SEQ ID NO: 6026620 - DNA, 20 bp, Homo sapiens
cattatcactgaaaaaatgt

SEQ ID NO: 6026621 - DNA, 12 bp, Homo sapiens
cattatcatgtg

SEQ ID NO: 6026622 - DNA, 13 bp, Homo sapiens
cattatccctgaa

SEQ ID NO: 6026623 - DNA, 15 bp, Homo sapiens
cattatcctgtgtga

SEQ ID NO: 6026624 - DNA, 22 bp, Homo sapiens
cattatcctgtgtgattacagc

SEQ ID NO: 6026625 - DNA, 20 bp, Homo sapiens
cattatcgccttttgacagc

SEQ ID NO: 6026626 - DNA, 22 bp, Homo sapiens
cattatcgccttttgacagctg

SEQ ID NO: 6026627 - DNA, 18 bp, Homo sapiens
cattatcgggagcagtgt

SEQ ID NO: 6026628 - DNA, 20 bp, Homo sapiens
cattatcgggagcagtgtct

SEQ ID NO: 6026629 - DNA, 19 bp, Homo sapiens
cattatctaactgtgctca

SEQ ID NO: 6026630 - DNA, 17 bp, Homo sapiens
cattatctagatactgt

SEQ ID NO: 6026631 - DNA, 23 bp, Homo sapiens
cattatctagatactgtatcatg

SEQ ID NO: 6026632 - DNA, 16 bp, Homo sapiens
cattatctatgcagca

SEQ ID NO: 6026633 - DNA, 17 bp, Homo sapiens
cattatctctttctctc

SEQ ID NO: 6026634 - DNA, 13 bp, Homo sapiens
cattatctgctgt

SEQ ID NO: 6026635 - DNA, 14 bp, Homo sapiens
cattatctgctgtt

SEQ ID NO: 6026636 - DNA, 15 bp, Homo sapiens
cattatctgtactga

SEQ ID NO: 6026637 - DNA, 15 bp, Homo sapiens
cattatcttatcatt

SEQ ID NO: 6026638 - DNA, 12 bp, Homo sapiens
cattatcttatg

SEQ ID NO: 6026639 - DNA, 17 bp, Homo sapiens
cattatctttgctgtta

SEQ ID NO: 6026640 - DNA, 15 bp, Homo sapiens
cattatcttttggct

SEQ ID NO: 6026641 - DNA, 15 bp, Homo sapiens
cattatgaaaaacat

SEQ ID NO: 6026642 - DNA, 16 bp, Homo sapiens
cattatgaaaaacatc

SEQ ID NO: 6026643 - DNA, 16 bp, Homo sapiens
cattatgaagatgttt

SEQ ID NO: 6026644 - DNA, 17 bp, Homo sapiens
cattatgaagatgtttt

SEQ ID NO: 6026645 - DNA, 16 bp, Homo sapiens
cattatgagaggcaat

SEQ ID NO: 6026646 - DNA, 15 bp, Homo sapiens
cattatgaggaaact

SEQ ID NO: 6026647 - DNA, 12 bp, Homo sapiens
cattatgaggtc

SEQ ID NO: 6026648 - DNA, 15 bp, Homo sapiens
cattatgaggtcaga

SEQ ID NO: 6026649 - DNA, 17 bp, Homo sapiens
cattatgagtaaaagca

SEQ ID NO: 6026650 - DNA, 18 bp, Homo sapiens
cattatgatcccttcccc

SEQ ID NO: 6026651 - DNA, 21 bp, Homo sapiens
cattatgatcccttccccctg

SEQ ID NO: 6026652 - DNA, 23 bp, Homo sapiens
cattatgatctaataaactttat

SEQ ID NO: 6026653 - DNA, 21 bp, Homo sapiens
cattatgatgtgggtcaagga

SEQ ID NO: 6026654 - DNA, 22 bp, Homo sapiens
cattatgatgtgggtcaaggaa

SEQ ID NO: 6026655 - DNA, 23 bp, Homo sapiens
cattatgatgtgggtcaaggaat

SEQ ID NO: 6026656 - DNA, 13 bp, Homo sapiens
cattatgatgtgt

SEQ ID NO: 6026657 - DNA, 13 bp, Homo sapiens
cattatgattctt

SEQ ID NO: 6026658 - DNA, 16 bp, Homo sapiens
cattatgatttcatta

SEQ ID NO: 6026659 - DNA, 23 bp, Homo sapiens
cattatgatttcattatcacatg

SEQ ID NO: 6026660 - DNA, 14 bp, Homo sapiens
cattatgcaaataa

SEQ ID NO: 6026661 - DNA, 19 bp, Homo sapiens
cattatgcaatttttatat

SEQ ID NO: 6026662 - DNA, 22 bp, Homo sapiens
cattatgcacttttagaaatgc

SEQ ID NO: 6026663 - DNA, 23 bp, Homo sapiens
cattatgccacttccttttaact

SEQ ID NO: 6026664 - DNA, 16 bp, Homo sapiens
cattatgctttgaact

SEQ ID NO: 6026665 - DNA, 17 bp, Homo sapiens
cattatggctttgtgct

SEQ ID NO: 6026666 - DNA, 22 bp, Homo sapiens
cattatggtagaatcattttta

SEQ ID NO: 6026667 - DNA, 17 bp, Homo sapiens
cattatgtaaaatgttt

SEQ ID NO: 6026668 - DNA, 13 bp, Homo sapiens
cattatgtagaaa

SEQ ID NO: 6026669 - DNA, 17 bp, Homo sapiens
cattatgtagaaatatt

SEQ ID NO: 6026670 - DNA, 14 bp, Homo sapiens
cattatgtatctta

SEQ ID NO: 6026671 - DNA, 12 bp, Homo sapiens
cattatgtgtgc

SEQ ID NO: 6026672 - DNA, 17 bp, Homo sapiens
cattatgtgtgcatgtg

SEQ ID NO: 6026673 - DNA, 19 bp, Homo sapiens
cattatgtgtgcatgtgtg

SEQ ID NO: 6026674 - DNA, 20 bp, Homo sapiens
cattatgtgtgcatgtgtgt

SEQ ID NO: 6026675 - DNA, 22 bp, Homo sapiens
cattatgtgtgcatgtgtgtat

SEQ ID NO: 6026676 - DNA, 14 bp, Homo sapiens
cattatgttaatat

SEQ ID NO: 6026677 - DNA, 15 bp, Homo sapiens
cattatgttaatatt

SEQ ID NO: 6026678 - DNA, 17 bp, Homo sapiens
cattatgttaatatttc

SEQ ID NO: 6026679 - DNA, 20 bp, Homo sapiens
cattatgtttcctaactgtg

SEQ ID NO: 6026680 - DNA, 13 bp, Homo sapiens
cattatgttttat

SEQ ID NO: 6026681 - DNA, 19 bp, Homo sapiens
cattattaaatcagaatct

SEQ ID NO: 6026682 - DNA, 16 bp, Homo sapiens
cattattaataattaa

SEQ ID NO: 6026683 - DNA, 12 bp, Homo sapiens
cattattaatca

SEQ ID NO: 6026684 - DNA, 15 bp, Homo sapiens
cattattaatcattc

SEQ ID NO: 6026685 - DNA, 16 bp, Homo sapiens
cattattaatcattcc

SEQ ID NO: 6026686 - DNA, 16 bp, Homo sapiens
cattattacttttgct

SEQ ID NO: 6026687 - DNA, 18 bp, Homo sapiens
cattattacttttgctgt

SEQ ID NO: 6026688 - DNA, 23 bp, Homo sapiens
cattattacttttgctgtaatgt

SEQ ID NO: 6026689 - DNA, 15 bp, Homo sapiens
cattattagaatata

SEQ ID NO: 6026690 - DNA, 20 bp, Homo sapiens
cattattaggtcttaaagta

SEQ ID NO: 6026691 - DNA, 13 bp, Homo sapiens
cattattatcaac

SEQ ID NO: 6026692 - DNA, 19 bp, Homo sapiens
cattattatctagctaagc

SEQ ID NO: 6026693 - DNA, 15 bp, Homo sapiens
cattattatgatgtt

SEQ ID NO: 6026694 - DNA, 21 bp, Homo sapiens
cattattatgcaaaatttaga

SEQ ID NO: 6026695 - DNA, 21 bp, Homo sapiens
cattattcaaagttgcctaaa

SEQ ID NO: 6026696 - DNA, 22 bp, Homo sapiens
cattattcaaagttgcctaaat

SEQ ID NO: 6026697 - DNA, 23 bp, Homo sapiens
cattattcaagaaagatatctat

SEQ ID NO: 6026698 - DNA, 16 bp, Homo sapiens
cattattcataaaaaa

SEQ ID NO: 6026699 - DNA, 18 bp, Homo sapiens
cattattcatatgcttcc

SEQ ID NO: 6026700 - DNA, 20 bp, Homo sapiens
cattattcatttagtgagtt

SEQ ID NO: 6026701 - DNA, 21 bp, Homo sapiens
cattattcctcagattgctga

SEQ ID NO: 6026702 - DNA, 14 bp, Homo sapiens
cattattcctccag

SEQ ID NO: 6026703 - DNA, 12 bp, Homo sapiens
cattattctatg

SEQ ID NO: 6026704 - DNA, 14 bp, Homo sapiens
cattattctatgta

SEQ ID NO: 6026705 - DNA, 17 bp, Homo sapiens
cattattctatgtagtg

SEQ ID NO: 6026706 - DNA, 24 bp, Homo sapiens
cattattctctgctatatataaaa

SEQ ID NO: 6026707 - DNA, 18 bp, Homo sapiens
cattattctcttttatct

SEQ ID NO: 6026708 - DNA, 20 bp, Homo sapiens
cattattgacgaactggcta

SEQ ID NO: 6026709 - DNA, 22 bp, Homo sapiens
cattattgaggaaaattaatat

SEQ ID NO: 6026710 - DNA, 23 bp, Homo sapiens
cattattgaggaaaattaatatc

SEQ ID NO: 6026711 - DNA, 14 bp, Homo sapiens
cattattggaatta

SEQ ID NO: 6026712 - DNA, 20 bp, Homo sapiens
cattattggaattaacctgg

SEQ ID NO: 6026713 - DNA, 16 bp, Homo sapiens
cattattgtcccacaa

SEQ ID NO: 6026714 - DNA, 12 bp, Homo sapiens
cattatttaata

SEQ ID NO: 6026715 - DNA, 14 bp, Homo sapiens
cattatttaatgtt

SEQ ID NO: 6026716 - DNA, 17 bp, Homo sapiens
cattatttaatgtttga

SEQ ID NO: 6026717 - DNA, 19 bp, Homo sapiens
cattatttaatgtttgatt

SEQ ID NO: 6026718 - DNA, 20 bp, Homo sapiens
cattatttagtcaattgttt

SEQ ID NO: 6026719 - DNA, 14 bp, Homo sapiens
cattatttatatgg

SEQ ID NO: 6026720 - DNA, 20 bp, Homo sapiens
cattatttattaaaaatgtt

SEQ ID NO: 6026721 - DNA, 21 bp, Homo sapiens
cattatttattaaaaatgttc

SEQ ID NO: 6026722 - DNA, 23 bp, Homo sapiens
cattatttattaaaaatgttctc

SEQ ID NO: 6026723 - DNA, 18 bp, Homo sapiens
cattatttattaaatttt

SEQ ID NO: 6026724 - DNA, 19 bp, Homo sapiens
cattatttcaaaatgatag

SEQ ID NO: 6026725 - DNA, 14 bp, Homo sapiens
cattatttcagtgt

SEQ ID NO: 6026726 - DNA, 20 bp, Homo sapiens
cattatttctagtccaaaat

SEQ ID NO: 6026727 - DNA, 13 bp, Homo sapiens
cattatttctgta

SEQ ID NO: 6026728 - DNA, 20 bp, Homo sapiens
cattatttgagaagctgctc

SEQ ID NO: 6026729 - DNA, 22 bp, Homo sapiens
cattatttgagaagctgctcaa

SEQ ID NO: 6026730 - DNA, 21 bp, Homo sapiens
cattatttgagactgtcctgt

SEQ ID NO: 6026731 - DNA, 14 bp, Homo sapiens
cattatttgcatgt

SEQ ID NO: 6026732 - DNA, 13 bp, Homo sapiens
cattatttgtgct

SEQ ID NO: 6026733 - DNA, 18 bp, Homo sapiens
cattattttatatatttt

SEQ ID NO: 6026734 - DNA, 14 bp, Homo sapiens
cattattttattat

SEQ ID NO: 6026735 - DNA, 16 bp, Homo sapiens
cattattttattatga

SEQ ID NO: 6026736 - DNA, 16 bp, Homo sapiens
cattattttctgtcag

SEQ ID NO: 6026737 - DNA, 18 bp, Homo sapiens
cattattttctgtcagat

SEQ ID NO: 6026738 - DNA, 19 bp, Homo sapiens
cattattttgggaagaaaa

SEQ ID NO: 6026739 - DNA, 15 bp, Homo sapiens
cattatttttagatt

SEQ ID NO: 6026740 - DNA, 14 bp, Homo sapiens
cattatttttcaat

SEQ ID NO: 6026741 - DNA, 19 bp, Homo sapiens
cattattttttaatgttta

SEQ ID NO: 6026742 - DNA, 17 bp, Homo sapiens
cattattttttgttgaa

SEQ ID NO: 6026743 - DNA, 17 bp, Homo sapiens
cattcaaaaaactctct

SEQ ID NO: 6026744 - DNA, 14 bp, Homo sapiens
cattcaaaaacccc

SEQ ID NO: 6026745 - DNA, 13 bp, Homo sapiens
cattcaaaaattt

SEQ ID NO: 6026746 - DNA, 23 bp, Homo sapiens
cattcaaaacagttacttaagat

SEQ ID NO: 6026747 - DNA, 14 bp, Homo sapiens
cattcaaaacgtga

SEQ ID NO: 6026748 - DNA, 21 bp, Homo sapiens
cattcaaaacgtgatgttttg

SEQ ID NO: 6026749 - DNA, 18 bp, Homo sapiens
cattcaaaagcacaaacc

SEQ ID NO: 6026750 - DNA, 23 bp, Homo sapiens
cattcaaaagcacaaaccctggg

SEQ ID NO: 6026751 - DNA, 18 bp, Homo sapiens
cattcaaaagttgaaatt

SEQ ID NO: 6026752 - DNA, 13 bp, Homo sapiens
cattcaaaatagt

SEQ ID NO: 6026753 - DNA, 14 bp, Homo sapiens
cattcaaactgcac

SEQ ID NO: 6026754 - DNA, 22 bp, Homo sapiens
cattcaaatcagtgatctatgt

SEQ ID NO: 6026755 - DNA, 16 bp, Homo sapiens
cattcaaatgaagatt

SEQ ID NO: 6026756 - DNA, 12 bp, Homo sapiens
cattcaaattaa

SEQ ID NO: 6026757 - DNA, 23 bp, Homo sapiens
cattcaaattaagggttaagaaa

SEQ ID NO: 6026758 - DNA, 17 bp, Homo sapiens
cattcaaccttaccaaa

SEQ ID NO: 6026759 - DNA, 20 bp, Homo sapiens
cattcaaccttaccaaaaaa

SEQ ID NO: 6026760 - DNA, 17 bp, Homo sapiens
cattcaagcatgtttaa

SEQ ID NO: 6026761 - DNA, 17 bp, Homo sapiens
cattcaagcctgtgaat

SEQ ID NO: 6026762 - DNA, 14 bp, Homo sapiens
cattcaagctattt

SEQ ID NO: 6026763 - DNA, 15 bp, Homo sapiens
cattcaagctattta

SEQ ID NO: 6026764 - DNA, 18 bp, Homo sapiens
cattcaaggcttatctct

SEQ ID NO: 6026765 - DNA, 16 bp, Homo sapiens
cattcaaggcttattt

SEQ ID NO: 6026766 - DNA, 17 bp, Homo sapiens
cattcaagtcagctctt

SEQ ID NO: 6026767 - DNA, 17 bp, Homo sapiens
cattcaagtgtaaaata

SEQ ID NO: 6026768 - DNA, 23 bp, Homo sapiens
cattcaagtgtaaaatattttga

SEQ ID NO: 6026769 - DNA, 21 bp, Homo sapiens
cattcaataagcatcaaactc

SEQ ID NO: 6026770 - DNA, 18 bp, Homo sapiens
cattcaatatctgacagt

SEQ ID NO: 6026771 - DNA, 21 bp, Homo sapiens
cattcaatattgacatttgta

SEQ ID NO: 6026772 - DNA, 13 bp, Homo sapiens
cattcaatgttta

SEQ ID NO: 6026773 - DNA, 21 bp, Homo sapiens
cattcaattagtggtcataaa

SEQ ID NO: 6026774 - DNA, 20 bp, Homo sapiens
cattcaatttattcaagaaa

SEQ ID NO: 6026775 - DNA, 17 bp, Homo sapiens
cattcacaacacaatca

SEQ ID NO: 6026776 - DNA, 20 bp, Homo sapiens
cattcacaacacaatcaaaa

SEQ ID NO: 6026777 - DNA, 20 bp, Homo sapiens
cattcacaagcctcctgtac

SEQ ID NO: 6026778 - DNA, 12 bp, Homo sapiens
cattcacacaca

SEQ ID NO: 6026779 - DNA, 17 bp, Homo sapiens
cattcacacacagcctg

SEQ ID NO: 6026780 - DNA, 21 bp, Homo sapiens
cattcacacacagcctggcct

SEQ ID NO: 6026781 - DNA, 13 bp, Homo sapiens
cattcacagagcc

SEQ ID NO: 6026782 - DNA, 10 bp, Homo sapiens
cattcacagc

SEQ ID NO: 6026783 - DNA, 13 bp, Homo sapiens
cattcacagccca

SEQ ID NO: 6026784 - DNA, 15 bp, Homo sapiens
cattcacatttagaa

SEQ ID NO: 6026785 - DNA, 19 bp, Homo sapiens
cattcaccaacaacagtca

SEQ ID NO: 6026786 - DNA, 20 bp, Homo sapiens
cattcacccagacagctccc

SEQ ID NO: 6026787 - DNA, 15 bp, Homo sapiens
cattcacctgcccca

SEQ ID NO: 6026788 - DNA, 15 bp, Homo sapiens
cattcacggcctggc

SEQ ID NO: 6026789 - DNA, 16 bp, Homo sapiens
cattcacggcctggca

SEQ ID NO: 6026790 - DNA, 15 bp, Homo sapiens
cattcactaagccat

SEQ ID NO: 6026791 - DNA, 13 bp, Homo sapiens
cattcactcttcc

SEQ ID NO: 6026792 - DNA, 16 bp, Homo sapiens
cattcactcttccaga

SEQ ID NO: 6026793 - DNA, 16 bp, Homo sapiens
cattcactgattggaa

SEQ ID NO: 6026794 - DNA, 11 bp, Homo sapiens
cattcacttca

SEQ ID NO: 6026795 - DNA, 17 bp, Homo sapiens
cattcacttcactgtgc

SEQ ID NO: 6026796 - DNA, 14 bp, Homo sapiens
cattcacttcataa

SEQ ID NO: 6026797 - DNA, 21 bp, Homo sapiens
cagggagacggtttccaggga

SEQ ID NO: 6026798 - DNA, 23 bp, Homo sapiens
cagggagacggtttccagggagg

SEQ ID NO: 6026799 - DNA, 23 bp, Homo sapiens
cagggagagagtagctgcagcct

SEQ ID NO: 6026800 - DNA, 16 bp, Homo sapiens
cagggagagcccagga

SEQ ID NO: 6026801 - DNA, 20 bp, Homo sapiens
cagggagagcccaggagctc

SEQ ID NO: 6026802 - DNA, 22 bp, Homo sapiens
cagggagagcgcctcttcctct

SEQ ID NO: 6026803 - DNA, 16 bp, Homo sapiens
cagggagagctcacca

SEQ ID NO: 6026804 - DNA, 18 bp, Homo sapiens
cagggagagctcaccatg

SEQ ID NO: 6026805 - DNA, 21 bp, Homo sapiens
cagggagagctgggcagacag

SEQ ID NO: 6026806 - DNA, 23 bp, Homo sapiens
cagggagagctgggcagacaggt

SEQ ID NO: 6026807 - DNA, 16 bp, Homo sapiens
cagggagaggccatga

SEQ ID NO: 6026808 - DNA, 14 bp, Homo sapiens
cagggagaggctgt

SEQ ID NO: 6026809 - DNA, 22 bp, Homo sapiens
cagggagaggctgtgtccctgc

SEQ ID NO: 6026810 - DNA, 18 bp, Homo sapiens
cagggagagttggggaag

SEQ ID NO: 6026811 - DNA, 20 bp, Homo sapiens
cagggagagttggggaaggc

SEQ ID NO: 6026812 - DNA, 22 bp, Homo sapiens
cagggagatttgctcaatacct

SEQ ID NO: 6026813 - DNA, 20 bp, Homo sapiens
cagggagcaactctccactc

SEQ ID NO: 6026814 - DNA, 17 bp, Homo sapiens
cagggagcaagacagag

SEQ ID NO: 6026815 - DNA, 18 bp, Homo sapiens
cagggagcaccacggcca

SEQ ID NO: 6026816 - DNA, 14 bp, Homo sapiens
cagggagcactgga

SEQ ID NO: 6026817 - DNA, 16 bp, Homo sapiens
cagggagcactggagg

SEQ ID NO: 6026818 - DNA, 19 bp, Homo sapiens
cagggagcactggaggcct

SEQ ID NO: 6026819 - DNA, 20 bp, Homo sapiens
cagggagcactggaggcctc

SEQ ID NO: 6026820 - DNA, 16 bp, Homo sapiens
cagggagcactgttca

SEQ ID NO: 6026821 - DNA, 18 bp, Homo sapiens
cagggagcagggaaggcc

SEQ ID NO: 6026822 - DNA, 21 bp, Homo sapiens
cagggagcatgagaggaggca

SEQ ID NO: 6026823 - DNA, 22 bp, Homo sapiens
cagggagcatgagaggaggcag

SEQ ID NO: 6026824 - DNA, 19 bp, Homo sapiens
cagggagcatggctgtgag

SEQ ID NO: 6026825 - DNA, 23 bp, Homo sapiens
cagggagcatttaatggcagcta

SEQ ID NO: 6026826 - DNA, 20 bp, Homo sapiens
cagggagcattttcctccat

SEQ ID NO: 6026827 - DNA, 19 bp, Homo sapiens
cagggagcccctaggaaag

SEQ ID NO: 6026828 - DNA, 15 bp, Homo sapiens
cagggagcccggggc

SEQ ID NO: 6026829 - DNA, 21 bp, Homo sapiens
cagggagcccggggcagagct

SEQ ID NO: 6026830 - DNA, 22 bp, Homo sapiens
cagggagccctggggtttccac

SEQ ID NO: 6026831 - DNA, 18 bp, Homo sapiens
cagggagccggcggcctc

SEQ ID NO: 6026832 - DNA, 20 bp, Homo sapiens
cagggagccggcggcctctc

SEQ ID NO: 6026833 - DNA, 22 bp, Homo sapiens
cagggagccggcggcctctcga

SEQ ID NO: 6026834 - DNA, 15 bp, Homo sapiens
cagggagcctcccca

SEQ ID NO: 6026835 - DNA, 14 bp, Homo sapiens
cagggagcctcctg

SEQ ID NO: 6026836 - DNA, 18 bp, Homo sapiens
cagggagccttctgccac

SEQ ID NO: 6026837 - DNA, 22 bp, Homo sapiens
cagggagcgatccaggggaagc

SEQ ID NO: 6026838 - DNA, 16 bp, Homo sapiens
cagggagcggaaagca

SEQ ID NO: 6026839 - DNA, 23 bp, Homo sapiens
cagggagcggccggccagcccct

SEQ ID NO: 6026840 - DNA, 22 bp, Homo sapiens
cagggagctgatgccccttctc

SEQ ID NO: 6026841 - DNA, 14 bp, Homo sapiens
cagggagctgcagg

SEQ ID NO: 6026842 - DNA, 15 bp, Homo sapiens
cagggagctgggaca

SEQ ID NO: 6026843 - DNA, 15 bp, Homo sapiens
cagggagcttcctgg

SEQ ID NO: 6026844 - DNA, 16 bp, Homo sapiens
cagggagcttcctggc

SEQ ID NO: 6026845 - DNA, 18 bp, Homo sapiens
cagggagcttcctggctc

SEQ ID NO: 6026846 - DNA, 20 bp, Homo sapiens
cagggagcttcctggctctg

SEQ ID NO: 6026847 - DNA, 22 bp, Homo sapiens
cagggagcttcctggctctggg

SEQ ID NO: 6026848 - DNA, 18 bp, Homo sapiens
cagggagcttgccacact

SEQ ID NO: 6026849 - DNA, 12 bp, Homo sapiens
cagggaggaaga

SEQ ID NO: 6026850 - DNA, 18 bp, Homo sapiens
cagggaggaagatgttca

SEQ ID NO: 6026851 - DNA, 15 bp, Homo sapiens
cagggaggaaggagg

SEQ ID NO: 6026852 - DNA, 16 bp, Homo sapiens
cagggaggaaggaggc

SEQ ID NO: 6026853 - DNA, 23 bp, Homo sapiens
cagggaggaattggggtttctgg

SEQ ID NO: 6026854 - DNA, 23 bp, Homo sapiens
cagggaggagaggggaagggcca

SEQ ID NO: 6026855 - DNA, 16 bp, Homo sapiens
cagggaggagccccag

SEQ ID NO: 6026856 - DNA, 12 bp, Homo sapiens
cagggaggagtg

SEQ ID NO: 6026857 - DNA, 14 bp, Homo sapiens
cagggaggatgcca

SEQ ID NO: 6026858 - DNA, 9 bp, Homo sapiens
cagggaggc

SEQ ID NO: 6026859 - DNA, 24 bp, Homo sapiens
cagggaggcaccattcaggaacct

SEQ ID NO: 6026860 - DNA, 14 bp, Homo sapiens
cagggaggcagccg

SEQ ID NO: 6026861 - DNA, 22 bp, Homo sapiens
cagggaggcagcgtgggctctg

SEQ ID NO: 6026862 - DNA, 13 bp, Homo sapiens
cagggaggccaca

SEQ ID NO: 6026863 - DNA, 13 bp, Homo sapiens
cagggaggcgcag

SEQ ID NO: 6026864 - DNA, 18 bp, Homo sapiens
cagggaggcgcagggaca

SEQ ID NO: 6026865 - DNA, 19 bp, Homo sapiens
cagggaggcgcagggacat

SEQ ID NO: 6026866 - DNA, 14 bp, Homo sapiens
cagggaggctgcag

SEQ ID NO: 6026867 - DNA, 13 bp, Homo sapiens
cagggaggctggt

SEQ ID NO: 6026868 - DNA, 22 bp, Homo sapiens
cagggaggctggtcctatggcc

SEQ ID NO: 6026869 - DNA, 18 bp, Homo sapiens
cagggagggaaacccggg

SEQ ID NO: 6026870 - DNA, 12 bp, Homo sapiens
cagggagggaag

SEQ ID NO: 6026871 - DNA, 21 bp, Homo sapiens
cagggagggaaggggatggag

SEQ ID NO: 6026872 - DNA, 21 bp, Homo sapiens
cagggagggagggcggtggac

SEQ ID NO: 6026873 - DNA, 13 bp, Homo sapiens
cagggagggccag

SEQ ID NO: 6026874 - DNA, 15 bp, Homo sapiens
cagggagggccaggg

SEQ ID NO: 6026875 - DNA, 24 bp, Homo sapiens
cagggagggccggcggctctgagc

SEQ ID NO: 6026876 - DNA, 14 bp, Homo sapiens
cagggagggcctgg

SEQ ID NO: 6026877 - DNA, 17 bp, Homo sapiens
cagggagggcctgggcc

SEQ ID NO: 6026878 - DNA, 20 bp, Homo sapiens
cagggagggcttggggctgc

SEQ ID NO: 6026879 - DNA, 19 bp, Homo sapiens
cagggaggggactatttat

SEQ ID NO: 6026880 - DNA, 17 bp, Homo sapiens
cagggaggggaggcaga

SEQ ID NO: 6026881 - DNA, 18 bp, Homo sapiens
cagggaggggaggcagat

SEQ ID NO: 6026882 - DNA, 14 bp, Homo sapiens
cagggaggggccgg

SEQ ID NO: 6026883 - DNA, 21 bp, Homo sapiens
cagggaggggccggccctgtg

SEQ ID NO: 6026884 - DNA, 15 bp, Homo sapiens
cagggaggggctgag

SEQ ID NO: 6026885 - DNA, 22 bp, Homo sapiens
cagggaggggctgagtctggct

SEQ ID NO: 6026886 - DNA, 17 bp, Homo sapiens
cagggaggggctggggc

SEQ ID NO: 6026887 - DNA, 23 bp, Homo sapiens
cagggaggggctggggcaggctc

SEQ ID NO: 6026888 - DNA, 20 bp, Homo sapiens
cagggagggggacctgtccc

SEQ ID NO: 6026889 - DNA, 22 bp, Homo sapiens
cagggagggggacctgtccccc

SEQ ID NO: 6026890 - DNA, 23 bp, Homo sapiens
cagggagggggacctgtccccca

SEQ ID NO: 6026891 - DNA, 14 bp, Homo sapiens
cagggagggtgagc

SEQ ID NO: 6026892 - DNA, 23 bp, Homo sapiens
cagggagggtgagctggtgcctg

SEQ ID NO: 6026893 - DNA, 19 bp, Homo sapiens
cagggagggttagcctgca

SEQ ID NO: 6026894 - DNA, 22 bp, Homo sapiens
cagggagggttagcctgcaccg

SEQ ID NO: 6026895 - DNA, 23 bp, Homo sapiens
cagggaggtcaggccctggaact

SEQ ID NO: 6026896 - DNA, 20 bp, Homo sapiens
cagggaggtgtgaggcagga

SEQ ID NO: 6026897 - DNA, 15 bp, Homo sapiens
cagggagtccagggt

SEQ ID NO: 6026898 - DNA, 22 bp, Homo sapiens
cagggagtccagggtttctctg

SEQ ID NO: 6026899 - DNA, 22 bp, Homo sapiens
cagggagtcccctccccggccc

SEQ ID NO: 6026900 - DNA, 14 bp, Homo sapiens
cagggagtgctggc

SEQ ID NO: 6026901 - DNA, 18 bp, Homo sapiens
cagggagtgtctgcagtc

SEQ ID NO: 6026902 - DNA, 23 bp, Homo sapiens
cagggagtgtgatgcaggaagac

SEQ ID NO: 6026903 - DNA, 12 bp, Homo sapiens
cagggagtgttc

SEQ ID NO: 6026904 - DNA, 16 bp, Homo sapiens
cagggatattgcctta

SEQ ID NO: 6026905 - DNA, 16 bp, Homo sapiens
cagggatcacactgcc

SEQ ID NO: 6026906 - DNA, 23 bp, Homo sapiens
cagggatcacagaccacaggaag

SEQ ID NO: 6026907 - DNA, 16 bp, Homo sapiens
cagggatccagggaca

SEQ ID NO: 6026908 - DNA, 21 bp, Homo sapiens
cagggatccccaggaggcctg

SEQ ID NO: 6026909 - DNA, 22 bp, Homo sapiens
cagggatctgtttgaacactta

SEQ ID NO: 6026910 - DNA, 17 bp, Homo sapiens
cagggatcttgcattcc

SEQ ID NO: 6026911 - DNA, 16 bp, Homo sapiens
cagggatgagcatgga

SEQ ID NO: 6026912 - DNA, 17 bp, Homo sapiens
cagggatgagttgaggt

SEQ ID NO: 6026913 - DNA, 20 bp, Homo sapiens
cagggatgatggcagagcca

SEQ ID NO: 6026914 - DNA, 23 bp, Homo sapiens
cagggatgatggcagagccaggc

SEQ ID NO: 6026915 - DNA, 16 bp, Homo sapiens
cagggatgccctggag

SEQ ID NO: 6026916 - DNA, 12 bp, Homo sapiens
cagggatgctgg

SEQ ID NO: 6026917 - DNA, 14 bp, Homo sapiens
cagggatgctgggc

SEQ ID NO: 6026918 - DNA, 19 bp, Homo sapiens
cagggatgctgggctgggc

SEQ ID NO: 6026919 - DNA, 20 bp, Homo sapiens
cagggatgctgggctgggcc

SEQ ID NO: 6026920 - DNA, 21 bp, Homo sapiens
cagggatgctgggctgggccc

SEQ ID NO: 6026921 - DNA, 14 bp, Homo sapiens
cagggatggagatg

SEQ ID NO: 6026922 - DNA, 19 bp, Homo sapiens
cagggatggagatgggaag

SEQ ID NO: 6026923 - DNA, 17 bp, Homo sapiens
cagggatggcagtggct

SEQ ID NO: 6026924 - DNA, 18 bp, Homo sapiens
cagggatggcagtggctg

SEQ ID NO: 6026925 - DNA, 14 bp, Homo sapiens
cagggatgggcagc

SEQ ID NO: 6026926 - DNA, 17 bp, Homo sapiens
cagggatgggcagccca

SEQ ID NO: 6026927 - DNA, 22 bp, Homo sapiens
cagggatgggggatgggccagg

SEQ ID NO: 6026928 - DNA, 14 bp, Homo sapiens
cagggatgggggtg

SEQ ID NO: 6026929 - DNA, 17 bp, Homo sapiens
cagggatgggggtggct

SEQ ID NO: 6026930 - DNA, 14 bp, Homo sapiens
cagggatgtctgtt

SEQ ID NO: 6026931 - DNA, 21 bp, Homo sapiens
cagggatgtgggaatctccca

SEQ ID NO: 6026932 - DNA, 15 bp, Homo sapiens
cagggatgttcctta

SEQ ID NO: 6026933 - DNA, 19 bp, Homo sapiens
cagggattaacctctgcac

SEQ ID NO: 6026934 - DNA, 21 bp, Homo sapiens
cagggattacaggcgtgagcc

SEQ ID NO: 6026935 - DNA, 20 bp, Homo sapiens
cagggattgattttaaaatg

SEQ ID NO: 6026936 - DNA, 22 bp, Homo sapiens
cagggattgattttaaaatgta

SEQ ID NO: 6026937 - DNA, 21 bp, Homo sapiens
cagggatttccaactggcact

SEQ ID NO: 6026938 - DNA, 23 bp, Homo sapiens
cagggcaaaatattcactgggcc

SEQ ID NO: 6026939 - DNA, 21 bp, Homo sapiens
cagggcaaaatcgccataggc

SEQ ID NO: 6026940 - DNA, 16 bp, Homo sapiens
cagggcaaaggtcaag

SEQ ID NO: 6026941 - DNA, 18 bp, Homo sapiens
cagggcaactcggagagg

SEQ ID NO: 6026942 - DNA, 18 bp, Homo sapiens
cagggcaagctccgcagg

SEQ ID NO: 6026943 - DNA, 21 bp, Homo sapiens
cagggcaagctccgcaggact

SEQ ID NO: 6026944 - DNA, 17 bp, Homo sapiens
cagggcaaggacacagc

SEQ ID NO: 6026945 - DNA, 18 bp, Homo sapiens
cagggcaaggccccttcc

SEQ ID NO: 6026946 - DNA, 22 bp, Homo sapiens
cagggcaagggttaaggcctga

SEQ ID NO: 6026947 - DNA, 23 bp, Homo sapiens
cagggcaagggttaaggcctgaa

SEQ ID NO: 6026948 - DNA, 22 bp, Homo sapiens
cagggcaataaaatgaccatgg

SEQ ID NO: 6026949 - DNA, 17 bp, Homo sapiens
cagggcaatcaatgttc

SEQ ID NO: 6026950 - DNA, 20 bp, Homo sapiens
cagggcaatgccatcagccc

SEQ ID NO: 6026951 - DNA, 14 bp, Homo sapiens
cagggcacagatga

SEQ ID NO: 6026952 - DNA, 16 bp, Homo sapiens
cagggcacagatgacc

SEQ ID NO: 6026953 - DNA, 13 bp, Homo sapiens
cagggcacagctg

SEQ ID NO: 6026954 - DNA, 19 bp, Homo sapiens
cagggcacagctgccctgc

SEQ ID NO: 6026955 - DNA, 14 bp, Homo sapiens
cagggcacagctgg

SEQ ID NO: 6026956 - DNA, 12 bp, Homo sapiens
cagggcacagga

SEQ ID NO: 6026957 - DNA, 16 bp, Homo sapiens
cagggcacaggagcta

SEQ ID NO: 6026958 - DNA, 20 bp, Homo sapiens
cagggcacaggagctacctg

SEQ ID NO: 6026959 - DNA, 22 bp, Homo sapiens
cagggcacaggagctacctgtg

SEQ ID NO: 6026960 - DNA, 18 bp, Homo sapiens
cagggcacagggcctggc

SEQ ID NO: 6026961 - DNA, 19 bp, Homo sapiens
cagggcacagggcctggcc

SEQ ID NO: 6026962 - DNA, 21 bp, Homo sapiens
cagggcacagggcctggccca

SEQ ID NO: 6026963 - DNA, 20 bp, Homo sapiens
cagggcacagtctccatgtg

SEQ ID NO: 6026964 - DNA, 19 bp, Homo sapiens
cagggcaccaagcccacag

SEQ ID NO: 6026965 - DNA, 21 bp, Homo sapiens
cagggcaccaagcccacaggt

SEQ ID NO: 6026966 - DNA, 13 bp, Homo sapiens
cagggcaccagag

SEQ ID NO: 6026967 - DNA, 16 bp, Homo sapiens
cagggcaccagaggcc

SEQ ID NO: 6026968 - DNA, 15 bp, Homo sapiens
cagggcaccatccag

SEQ ID NO: 6026969 - DNA, 19 bp, Homo sapiens
cagggcaccatccagctcc

SEQ ID NO: 6026970 - DNA, 13 bp, Homo sapiens
cagggcacccagg

SEQ ID NO: 6026971 - DNA, 14 bp, Homo sapiens
cagggcacccaggc

SEQ ID NO: 6026972 - DNA, 20 bp, Homo sapiens
cattcacttctgcattcctg

SEQ ID NO: 6026973 - DNA, 14 bp, Homo sapiens
cattcacttttgtt

SEQ ID NO: 6026974 - DNA, 20 bp, Homo sapiens
cattcagaaatgttgagtct

SEQ ID NO: 6026975 - DNA, 21 bp, Homo sapiens
cattcagaacaccaagacttg

SEQ ID NO: 6026976 - DNA, 18 bp, Homo sapiens
cattcagaactctcagac

SEQ ID NO: 6026977 - DNA, 19 bp, Homo sapiens
cattcagaatatcatcttt

SEQ ID NO: 6026978 - DNA, 14 bp, Homo sapiens
cattcagactaaaa

SEQ ID NO: 6026979 - DNA, 19 bp, Homo sapiens
cattcagactaaaaataca

SEQ ID NO: 6026980 - DNA, 19 bp, Homo sapiens
cattcagactttcagccga

SEQ ID NO: 6026981 - DNA, 17 bp, Homo sapiens
cattcagagactgccct

SEQ ID NO: 6026982 - DNA, 12 bp, Homo sapiens
cattcagagagc

SEQ ID NO: 6026983 - DNA, 15 bp, Homo sapiens
cattcagagagcagc

SEQ ID NO: 6026984 - DNA, 19 bp, Homo sapiens
cattcagaggttttgttag

SEQ ID NO: 6026985 - DNA, 22 bp, Homo sapiens
cattcagagtcagccaggacca

SEQ ID NO: 6026986 - DNA, 15 bp, Homo sapiens
cattcagatataaga

SEQ ID NO: 6026987 - DNA, 16 bp, Homo sapiens
cattcagatctgaagt

SEQ ID NO: 6026988 - DNA, 16 bp, Homo sapiens
cattcagatttaccat

SEQ ID NO: 6026989 - DNA, 19 bp, Homo sapiens
cattcagcaaatgcctttt

SEQ ID NO: 6026990 - DNA, 15 bp, Homo sapiens
cattcagcaagacaa

SEQ ID NO: 6026991 - DNA, 18 bp, Homo sapiens
cattcagcacaccccaag

SEQ ID NO: 6026992 - DNA, 20 bp, Homo sapiens
cattcagcacaccccaaggg

SEQ ID NO: 6026993 - DNA, 16 bp, Homo sapiens
cattcagccttgctga

SEQ ID NO: 6026994 - DNA, 18 bp, Homo sapiens
cattcagccttgctgacc

SEQ ID NO: 6026995 - DNA, 16 bp, Homo sapiens
cattcagctctggaga

SEQ ID NO: 6026996 - DNA, 20 bp, Homo sapiens
cattcagctctggagaacag

SEQ ID NO: 6026997 - DNA, 23 bp, Homo sapiens
cattcaggaaaactgacagagga

SEQ ID NO: 6026998 - DNA, 15 bp, Homo sapiens
cattcaggaacctgg

SEQ ID NO: 6026999 - DNA, 19 bp, Homo sapiens
cattcaggaacctggacca

SEQ ID NO: 6027000 - DNA, 13 bp, Homo sapiens
cattcaggaattc

SEQ ID NO: 6027001 - DNA, 23 bp, Homo sapiens
cattcaggaccccaacccctctc

SEQ ID NO: 6027002 - DNA, 17 bp, Homo sapiens
cattcaggactgctggt

SEQ ID NO: 6027003 - DNA, 17 bp, Homo sapiens
cattcaggcagcactga

SEQ ID NO: 6027004 - DNA, 23 bp, Homo sapiens
cattcagggttatacacagaaaa

SEQ ID NO: 6027005 - DNA, 17 bp, Homo sapiens
cattcagtaagttctgt

SEQ ID NO: 6027006 - DNA, 13 bp, Homo sapiens
cattcagtactta

SEQ ID NO: 6027007 - DNA, 18 bp, Homo sapiens
cattcagtactttatgaa

SEQ ID NO: 6027008 - DNA, 18 bp, Homo sapiens
cattcagtatataaaata

SEQ ID NO: 6027009 - DNA, 21 bp, Homo sapiens
cattcagtatttattgagcat

SEQ ID NO: 6027010 - DNA, 19 bp, Homo sapiens
cattcagtgattactgtca

SEQ ID NO: 6027011 - DNA, 20 bp, Homo sapiens
cattcagtgattactgtcaa

SEQ ID NO: 6027012 - DNA, 23 bp, Homo sapiens
cattcagtgcacctgcctcagct

SEQ ID NO: 6027013 - DNA, 17 bp, Homo sapiens
cattcagttctaggcct

SEQ ID NO: 6027014 - DNA, 19 bp, Homo sapiens
cattcagttctaggccttt

SEQ ID NO: 6027015 - DNA, 19 bp, Homo sapiens
cattcataaaccttgtcta

SEQ ID NO: 6027016 - DNA, 15 bp, Homo sapiens
cattcataactttca

SEQ ID NO: 6027017 - DNA, 15 bp, Homo sapiens
cattcatactaaata

SEQ ID NO: 6027018 - DNA, 22 bp, Homo sapiens
cattcatactaaataaaacaat

SEQ ID NO: 6027019 - DNA, 15 bp, Homo sapiens
cattcatacttaaaa

SEQ ID NO: 6027020 - DNA, 18 bp, Homo sapiens
cattcatagggaaaggtt

SEQ ID NO: 6027021 - DNA, 17 bp, Homo sapiens
cattcatattacaatat

SEQ ID NO: 6027022 - DNA, 20 bp, Homo sapiens
cattcatatttgcaataaaa

SEQ ID NO: 6027023 - DNA, 21 bp, Homo sapiens
cattcatatttgcaataaaaa

SEQ ID NO: 6027024 - DNA, 21 bp, Homo sapiens
cattcatatttgtctttgaat

SEQ ID NO: 6027025 - DNA, 21 bp, Homo sapiens
cattcatccaggactgagatg

SEQ ID NO: 6027026 - DNA, 22 bp, Homo sapiens
cattcatccaggactgagatgc

SEQ ID NO: 6027027 - DNA, 19 bp, Homo sapiens
cattcatccagttgcaata

SEQ ID NO: 6027028 - DNA, 21 bp, Homo sapiens
cattcatccatccgttcattc

SEQ ID NO: 6027029 - DNA, 13 bp, Homo sapiens
cattcatcctcac

SEQ ID NO: 6027030 - DNA, 16 bp, Homo sapiens
cattcatcctgaccaa

SEQ ID NO: 6027031 - DNA, 16 bp, Homo sapiens
cattcatctgggctgg

SEQ ID NO: 6027032 - DNA, 20 bp, Homo sapiens
cattcatctgggctggcaga

SEQ ID NO: 6027033 - DNA, 18 bp, Homo sapiens
cattcatcttgtgtttta

SEQ ID NO: 6027034 - DNA, 12 bp, Homo sapiens
cattcatgaata

SEQ ID NO: 6027035 - DNA, 16 bp, Homo sapiens
cattcatgcaagagtt

SEQ ID NO: 6027036 - DNA, 16 bp, Homo sapiens
cattcatggatatttg

SEQ ID NO: 6027037 - DNA, 21 bp, Homo sapiens
cattcatgtactaccctcagt

SEQ ID NO: 6027038 - DNA, 22 bp, Homo sapiens
cattcatgttttaaaagtttgt

SEQ ID NO: 6027039 - DNA, 21 bp, Homo sapiens
cattcattagtcatgtttatc

SEQ ID NO: 6027040 - DNA, 16 bp, Homo sapiens
cattcattcactgtat

SEQ ID NO: 6027041 - DNA, 15 bp, Homo sapiens
cattcattcttagct

SEQ ID NO: 6027042 - DNA, 23 bp, Homo sapiens
cattcatttgttttttcaatgtt

SEQ ID NO: 6027043 - DNA, 16 bp, Homo sapiens
cattcattttctgaca

SEQ ID NO: 6027044 - DNA, 15 bp, Homo sapiens
cattcattttgaaat

SEQ ID NO: 6027045 - DNA, 17 bp, Homo sapiens
cattcatttttgttgtt

SEQ ID NO: 6027046 - DNA, 23 bp, Homo sapiens
cattccaaaattcatttcataag

SEQ ID NO: 6027047 - DNA, 16 bp, Homo sapiens
cattccaaagctttat

SEQ ID NO: 6027048 - DNA, 17 bp, Homo sapiens
cattccaaagctttatt

SEQ ID NO: 6027049 - DNA, 16 bp, Homo sapiens
cattccaaagttctta

SEQ ID NO: 6027050 - DNA, 15 bp, Homo sapiens
cattccaaatcatac

SEQ ID NO: 6027051 - DNA, 12 bp, Homo sapiens
cattccaacaaa

SEQ ID NO: 6027052 - DNA, 14 bp, Homo sapiens
cattccaacaaagg

SEQ ID NO: 6027053 - DNA, 15 bp, Homo sapiens
cattccaactcctac

SEQ ID NO: 6027054 - DNA, 21 bp, Homo sapiens
cattccaactcgtatagcatg

SEQ ID NO: 6027055 - DNA, 23 bp, Homo sapiens
cattccaagacagtatacagtcc

SEQ ID NO: 6027056 - DNA, 18 bp, Homo sapiens
cattccaagactctagag

SEQ ID NO: 6027057 - DNA, 18 bp, Homo sapiens
cattccaagtcaacactc

SEQ ID NO: 6027058 - DNA, 20 bp, Homo sapiens
cattccaagtcaacactctt

SEQ ID NO: 6027059 - DNA, 17 bp, Homo sapiens
cattccaattctaaatc

SEQ ID NO: 6027060 - DNA, 13 bp, Homo sapiens
cattccacagagt

SEQ ID NO: 6027061 - DNA, 20 bp, Homo sapiens
cattccacagctgccctggc

SEQ ID NO: 6027062 - DNA, 20 bp, Homo sapiens
cattccacaggatcatcatt

SEQ ID NO: 6027063 - DNA, 12 bp, Homo sapiens
cattccactcca

SEQ ID NO: 6027064 - DNA, 18 bp, Homo sapiens
cattccactgttggtatt

SEQ ID NO: 6027065 - DNA, 21 bp, Homo sapiens
cattccactttttgttacata

SEQ ID NO: 6027066 - DNA, 17 bp, Homo sapiens
cattccagagctgcaga

SEQ ID NO: 6027067 - DNA, 12 bp, Homo sapiens
cattccagagtt

SEQ ID NO: 6027068 - DNA, 15 bp, Homo sapiens
cattccagcagctgc

SEQ ID NO: 6027069 - DNA, 16 bp, Homo sapiens
cattccagcagctgca

SEQ ID NO: 6027070 - DNA, 12 bp, Homo sapiens
cattccagccag

SEQ ID NO: 6027071 - DNA, 19 bp, Homo sapiens
cattccagccaggcccagg

SEQ ID NO: 6027072 - DNA, 12 bp, Homo sapiens
cattccagctct

SEQ ID NO: 6027073 - DNA, 14 bp, Homo sapiens
cattccagctctgc

SEQ ID NO: 6027074 - DNA, 15 bp, Homo sapiens
cattccagctctgcc

SEQ ID NO: 6027075 - DNA, 22 bp, Homo sapiens
cattccagctgtcactctgtgc

SEQ ID NO: 6027076 - DNA, 12 bp, Homo sapiens
cattccaggccc

SEQ ID NO: 6027077 - DNA, 13 bp, Homo sapiens
cattccaggctcc

SEQ ID NO: 6027078 - DNA, 17 bp, Homo sapiens
cattccaggctcctccc

SEQ ID NO: 6027079 - DNA, 15 bp, Homo sapiens
cattccagggctggg

SEQ ID NO: 6027080 - DNA, 23 bp, Homo sapiens
cattccaggggctgcagccccct

SEQ ID NO: 6027081 - DNA, 23 bp, Homo sapiens
cattccagtaacttttttgtgta

SEQ ID NO: 6027082 - DNA, 22 bp, Homo sapiens
cattccagtacagtattctttt

SEQ ID NO: 6027083 - DNA, 24 bp, Homo sapiens
cattccagtaggaaatcaggcagt

SEQ ID NO: 6027084 - DNA, 15 bp, Homo sapiens
cattccagtccaatt

SEQ ID NO: 6027085 - DNA, 19 bp, Homo sapiens
cattccagtccaattttcc

SEQ ID NO: 6027086 - DNA, 20 bp, Homo sapiens
cattccagtgctagaaaatt

SEQ ID NO: 6027087 - DNA, 21 bp, Homo sapiens
cattccagtgctagaaaattt

SEQ ID NO: 6027088 - DNA, 20 bp, Homo sapiens
cattccagtggaccctggac

SEQ ID NO: 6027089 - DNA, 17 bp, Homo sapiens
cattccatattgggaat

SEQ ID NO: 6027090 - DNA, 15 bp, Homo sapiens
cattccatcacagcc

SEQ ID NO: 6027091 - DNA, 12 bp, Homo sapiens
cattccatcctt

SEQ ID NO: 6027092 - DNA, 14 bp, Homo sapiens
cattccatccttga

SEQ ID NO: 6027093 - DNA, 14 bp, Homo sapiens
cattccatgactct

SEQ ID NO: 6027094 - DNA, 18 bp, Homo sapiens
cattccatgactctgcct

SEQ ID NO: 6027095 - DNA, 19 bp, Homo sapiens
cattccatgagtcttcaga

SEQ ID NO: 6027096 - DNA, 20 bp, Homo sapiens
cattccattaataactgaat

SEQ ID NO: 6027097 - DNA, 14 bp, Homo sapiens
cattccattctgga

SEQ ID NO: 6027098 - DNA, 21 bp, Homo sapiens
cattccattgcctagctcttt

SEQ ID NO: 6027099 - DNA, 12 bp, Homo sapiens
cattccattgtt

SEQ ID NO: 6027100 - DNA, 23 bp, Homo sapiens
cattccatttatggaacttccct

SEQ ID NO: 6027101 - DNA, 12 bp, Homo sapiens
cattccatttgc

SEQ ID NO: 6027102 - DNA, 13 bp, Homo sapiens
cattcccaagatg

SEQ ID NO: 6027103 - DNA, 18 bp, Homo sapiens
cattcccaagatgcctga

SEQ ID NO: 6027104 - DNA, 15 bp, Homo sapiens
cattcccaattatca

SEQ ID NO: 6027105 - DNA, 20 bp, Homo sapiens
cattcccaattatcaaaaaa

SEQ ID NO: 6027106 - DNA, 23 bp, Homo sapiens
cattcccaattatcaaaaaacag

SEQ ID NO: 6027107 - DNA, 21 bp, Homo sapiens
cattcccacataatacattcc

SEQ ID NO: 6027108 - DNA, 14 bp, Homo sapiens
cattcccaccaaca

SEQ ID NO: 6027109 - DNA, 12 bp, Homo sapiens
cattcccacccc

SEQ ID NO: 6027110 - DNA, 13 bp, Homo sapiens
cattcccactgca

SEQ ID NO: 6027111 - DNA, 15 bp, Homo sapiens
cattcccactgcact

SEQ ID NO: 6027112 - DNA, 14 bp, Homo sapiens
cattcccactgcca

SEQ ID NO: 6027113 - DNA, 14 bp, Homo sapiens
cattcccagacagc

SEQ ID NO: 6027114 - DNA, 11 bp, Homo sapiens
cattcccagag

SEQ ID NO: 6027115 - DNA, 14 bp, Homo sapiens
cattcccagcccag

SEQ ID NO: 6027116 - DNA, 13 bp, Homo sapiens
cattcccagcctg

SEQ ID NO: 6027117 - DNA, 14 bp, Homo sapiens
cattcccagcctga

SEQ ID NO: 6027118 - DNA, 16 bp, Homo sapiens
cattcccagcctgact

SEQ ID NO: 6027119 - DNA, 23 bp, Homo sapiens
cattcccagcctgactagaactc

SEQ ID NO: 6027120 - DNA, 14 bp, Homo sapiens
cattcccaggaaaa

SEQ ID NO: 6027121 - DNA, 15 bp, Homo sapiens
cattcccatggtggc

SEQ ID NO: 6027122 - DNA, 11 bp, Homo sapiens
cattcccattc

SEQ ID NO: 6027123 - DNA, 15 bp, Homo sapiens
cattccccagcctct

SEQ ID NO: 6027124 - DNA, 23 bp, Homo sapiens
cattccccaggtggctgacccag

SEQ ID NO: 6027125 - DNA, 14 bp, Homo sapiens
cattcccccaccag

SEQ ID NO: 6027126 - DNA, 18 bp, Homo sapiens
cattcccccaccagctgc

SEQ ID NO: 6027127 - DNA, 20 bp, Homo sapiens
cattcccccatgtggctgaa

SEQ ID NO: 6027128 - DNA, 15 bp, Homo sapiens
cattccctatcaaaa

SEQ ID NO: 6027129 - DNA, 23 bp, Homo sapiens
cattccctatcaaaacatatcaa

SEQ ID NO: 6027130 - DNA, 17 bp, Homo sapiens
cattccctccacccact

SEQ ID NO: 6027131 - DNA, 14 bp, Homo sapiens
cattccctcgggac

SEQ ID NO: 6027132 - DNA, 21 bp, Homo sapiens
cattccctcgggaccctccca

SEQ ID NO: 6027133 - DNA, 18 bp, Homo sapiens
cattccctcgtctttccc

SEQ ID NO: 6027134 - DNA, 15 bp, Homo sapiens
cattccctctcatcc

SEQ ID NO: 6027135 - DNA, 14 bp, Homo sapiens
cattccctctcctg

SEQ ID NO: 6027136 - DNA, 19 bp, Homo sapiens
cattccctgaatctgtgcc

SEQ ID NO: 6027137 - DNA, 20 bp, Homo sapiens
cattccctgagtcaccagga

SEQ ID NO: 6027138 - DNA, 13 bp, Homo sapiens
cattccctggcct

SEQ ID NO: 6027139 - DNA, 12 bp, Homo sapiens
cattccctggga

SEQ ID NO: 6027140 - DNA, 21 bp, Homo sapiens
cattcccttctctcagcctcc

SEQ ID NO: 6027141 - DNA, 20 bp, Homo sapiens
cattccggactggcagaagc

SEQ ID NO: 6027142 - DNA, 15 bp, Homo sapiens
cattccggccacatc

SEQ ID NO: 6027143 - DNA, 21 bp, Homo sapiens
cattccggccacatcattctg

SEQ ID NO: 6027144 - DNA, 22 bp, Homo sapiens
cattccgtcctgatgattttta

SEQ ID NO: 6027145 - DNA, 17 bp, Homo sapiens
cattcctaaaacaccct

SEQ ID NO: 6027146 - DNA, 22 bp, Homo sapiens
cattcctaaaacacccttcagc

SEQ ID NO: 6027147 - DNA, 14 bp, Homo sapiens
cattcctaaaatgc

SEQ ID NO: 6027148 - DNA, 16 bp, Homo sapiens
cattcctaaaatgctt

SEQ ID NO: 6027149 - DNA, 18 bp, Homo sapiens
cattcctaaactatcttt

SEQ ID NO: 6027150 - DNA, 14 bp, Homo sapiens
cattcctaactaga

SEQ ID NO: 6027151 - DNA, 16 bp, Homo sapiens
cagggcacccaggcag

SEQ ID NO: 6027152 - DNA, 19 bp, Homo sapiens
cagggcacgcaggaccagt

SEQ ID NO: 6027153 - DNA, 17 bp, Homo sapiens
cagggcacggggacctg

SEQ ID NO: 6027154 - DNA, 22 bp, Homo sapiens
cagggcacggggacctggatag

SEQ ID NO: 6027155 - DNA, 21 bp, Homo sapiens
cagggcactctgttcccctcc

SEQ ID NO: 6027156 - DNA, 22 bp, Homo sapiens
cagggcactctgttcccctccc

SEQ ID NO: 6027157 - DNA, 17 bp, Homo sapiens
cagggcacttcacagag

SEQ ID NO: 6027158 - DNA, 18 bp, Homo sapiens
cagggcacttcacagagt

SEQ ID NO: 6027159 - DNA, 18 bp, Homo sapiens
cagggcagagcaggaagg

SEQ ID NO: 6027160 - DNA, 12 bp, Homo sapiens
cagggcagagcc

SEQ ID NO: 6027161 - DNA, 15 bp, Homo sapiens
cagggcagagccggg

SEQ ID NO: 6027162 - DNA, 16 bp, Homo sapiens
cagggcagagccggga

SEQ ID NO: 6027163 - DNA, 13 bp, Homo sapiens
cagggcagaggaa

SEQ ID NO: 6027164 - DNA, 16 bp, Homo sapiens
cagggcagaggaatgt

SEQ ID NO: 6027165 - DNA, 13 bp, Homo sapiens
cagggcagaggga

SEQ ID NO: 6027166 - DNA, 19 bp, Homo sapiens
cagggcagagtgagaccca

SEQ ID NO: 6027167 - DNA, 13 bp, Homo sapiens
cagggcagcaggc

SEQ ID NO: 6027168 - DNA, 15 bp, Homo sapiens
cagggcagcaggcca

SEQ ID NO: 6027169 - DNA, 19 bp, Homo sapiens
cagggcagcagggaacaaa

SEQ ID NO: 6027170 - DNA, 22 bp, Homo sapiens
cagggcagcagggaacaaaact

SEQ ID NO: 6027171 - DNA, 18 bp, Homo sapiens
cagggcagcagtggggtg

SEQ ID NO: 6027172 - DNA, 15 bp, Homo sapiens
cagggcagccaggga

SEQ ID NO: 6027173 - DNA, 17 bp, Homo sapiens
cagggcagccagggaga

SEQ ID NO: 6027174 - DNA, 11 bp, Homo sapiens
cagggcagcct

SEQ ID NO: 6027175 - DNA, 21 bp, Homo sapiens
cagggcagcctcccccggctc

SEQ ID NO: 6027176 - DNA, 15 bp, Homo sapiens
cagggcagcctcgtt

SEQ ID NO: 6027177 - DNA, 19 bp, Homo sapiens
cagggcagcctgcctggag

SEQ ID NO: 6027178 - DNA, 22 bp, Homo sapiens
cagggcagcctgtgggagaagg

SEQ ID NO: 6027179 - DNA, 23 bp, Homo sapiens
cagggcagcctgtgggagaaggg

SEQ ID NO: 6027180 - DNA, 14 bp, Homo sapiens
cagggcagcgccag

SEQ ID NO: 6027181 - DNA, 18 bp, Homo sapiens
cagggcagcgccaggctg

SEQ ID NO: 6027182 - DNA, 19 bp, Homo sapiens
cagggcagcgccaggctga

SEQ ID NO: 6027183 - DNA, 16 bp, Homo sapiens
cagggcagctgcctgg

SEQ ID NO: 6027184 - DNA, 19 bp, Homo sapiens
cagggcagctgcctggcca

SEQ ID NO: 6027185 - DNA, 20 bp, Homo sapiens
cagggcagctgcctggccat

SEQ ID NO: 6027186 - DNA, 13 bp, Homo sapiens
cagggcaggacca

SEQ ID NO: 6027187 - DNA, 16 bp, Homo sapiens
cagggcaggaccagcc

SEQ ID NO: 6027188 - DNA, 19 bp, Homo sapiens
cagggcaggaccagcccac

SEQ ID NO: 6027189 - DNA, 15 bp, Homo sapiens
cagggcaggagctgc

SEQ ID NO: 6027190 - DNA, 17 bp, Homo sapiens
cagggcaggagctgctg

SEQ ID NO: 6027191 - DNA, 20 bp, Homo sapiens
cagggcaggagcttggcaga

SEQ ID NO: 6027192 - DNA, 14 bp, Homo sapiens
cagggcaggccttg

SEQ ID NO: 6027193 - DNA, 18 bp, Homo sapiens
cagggcaggctacccctt

SEQ ID NO: 6027194 - DNA, 19 bp, Homo sapiens
cagggcagggctctgatat

SEQ ID NO: 6027195 - DNA, 22 bp, Homo sapiens
cagggcaggggatgcccagaag

SEQ ID NO: 6027196 - DNA, 15 bp, Homo sapiens
cagggcaggggtggt

SEQ ID NO: 6027197 - DNA, 13 bp, Homo sapiens
cagggcagggtct

SEQ ID NO: 6027198 - DNA, 20 bp, Homo sapiens
cagggcagggtctgggctgg

SEQ ID NO: 6027199 - DNA, 17 bp, Homo sapiens
cagggcagggtgggcag

SEQ ID NO: 6027200 - DNA, 14 bp, Homo sapiens
cagggcagtacctg

SEQ ID NO: 6027201 - DNA, 15 bp, Homo sapiens
cagggcagtacctga

SEQ ID NO: 6027202 - DNA, 13 bp, Homo sapiens
cagggcagtggcc

SEQ ID NO: 6027203 - DNA, 14 bp, Homo sapiens
cagggcagtggcca

SEQ ID NO: 6027204 - DNA, 15 bp, Homo sapiens
cagggcagtggccaa

SEQ ID NO: 6027205 - DNA, 19 bp, Homo sapiens
cagggcagtgtggtgggag

SEQ ID NO: 6027206 - DNA, 17 bp, Homo sapiens
cagggcatcccatgggg

SEQ ID NO: 6027207 - DNA, 17 bp, Homo sapiens
cagggcatctctgggct

SEQ ID NO: 6027208 - DNA, 14 bp, Homo sapiens
cagggcatctggga

SEQ ID NO: 6027209 - DNA, 14 bp, Homo sapiens
cagggcatgaaatg

SEQ ID NO: 6027210 - DNA, 23 bp, Homo sapiens
cagggcatgaaatgaacacaaat

SEQ ID NO: 6027211 - DNA, 24 bp, Homo sapiens
cagggcatgaaatgaacacaaatt

SEQ ID NO: 6027212 - DNA, 22 bp, Homo sapiens
cagggcatgcctggcctgagga

SEQ ID NO: 6027213 - DNA, 22 bp, Homo sapiens
cagggcatgtgtatgtgtctgc

SEQ ID NO: 6027214 - DNA, 21 bp, Homo sapiens
cagggcattcgggccacaggg

SEQ ID NO: 6027215 - DNA, 14 bp, Homo sapiens
cagggcattgctca

SEQ ID NO: 6027216 - DNA, 16 bp, Homo sapiens
cagggcattgctcagc

SEQ ID NO: 6027217 - DNA, 19 bp, Homo sapiens
cagggcattgctcagcccg

SEQ ID NO: 6027218 - DNA, 22 bp, Homo sapiens
cagggcattgctcagcccgctt

SEQ ID NO: 6027219 - DNA, 20 bp, Homo sapiens
cagggccaaacgctgagcca

SEQ ID NO: 6027220 - DNA, 22 bp, Homo sapiens
cagggccaagcgggggcgtggc

SEQ ID NO: 6027221 - DNA, 16 bp, Homo sapiens
cagggccaatccccag

SEQ ID NO: 6027222 - DNA, 22 bp, Homo sapiens
cagggccaccccactctacctc

SEQ ID NO: 6027223 - DNA, 17 bp, Homo sapiens
cagggccaccgcagggg

SEQ ID NO: 6027224 - DNA, 20 bp, Homo sapiens
cagggccacctgcaggaccc

SEQ ID NO: 6027225 - DNA, 16 bp, Homo sapiens
cagggccacgtgccag

SEQ ID NO: 6027226 - DNA, 21 bp, Homo sapiens
cagggccacgtgccaggcccg

SEQ ID NO: 6027227 - DNA, 12 bp, Homo sapiens
cagggccactct

SEQ ID NO: 6027228 - DNA, 16 bp, Homo sapiens
cagggccactctgcct

SEQ ID NO: 6027229 - DNA, 17 bp, Homo sapiens
cagggccactggaagga

SEQ ID NO: 6027230 - DNA, 14 bp, Homo sapiens
cagggccagaagga

SEQ ID NO: 6027231 - DNA, 16 bp, Homo sapiens
cagggccagaaggagg

SEQ ID NO: 6027232 - DNA, 21 bp, Homo sapiens
cagggccagaaggagggcaga

SEQ ID NO: 6027233 - DNA, 22 bp, Homo sapiens
cagggccagaaggagggcagag

SEQ ID NO: 6027234 - DNA, 19 bp, Homo sapiens
cagggccagaagtagcttt

SEQ ID NO: 6027235 - DNA, 23 bp, Homo sapiens
cagggccagactggaagacactt

SEQ ID NO: 6027236 - DNA, 15 bp, Homo sapiens
cagggccagagggag

SEQ ID NO: 6027237 - DNA, 18 bp, Homo sapiens
cagggccagcaggcagcg

SEQ ID NO: 6027238 - DNA, 19 bp, Homo sapiens
cagggccagcctctagagc

SEQ ID NO: 6027239 - DNA, 24 bp, Homo sapiens
cagggccaggaaggacagactggc

SEQ ID NO: 6027240 - DNA, 12 bp, Homo sapiens
cagggccaggac

SEQ ID NO: 6027241 - DNA, 20 bp, Homo sapiens
cagggccaggactgagcccc

SEQ ID NO: 6027242 - DNA, 22 bp, Homo sapiens
cagggccaggattcaggcctct

SEQ ID NO: 6027243 - DNA, 11 bp, Homo sapiens
cagggccaggc

SEQ ID NO: 6027244 - DNA, 12 bp, Homo sapiens
cagggccaggcc

SEQ ID NO: 6027245 - DNA, 16 bp, Homo sapiens
cagggccaggctggtc

SEQ ID NO: 6027246 - DNA, 12 bp, Homo sapiens
cagggccagggc

SEQ ID NO: 6027247 - DNA, 19 bp, Homo sapiens
cagggccagggcaatgcca

SEQ ID NO: 6027248 - DNA, 13 bp, Homo sapiens
cagggccagggcc

SEQ ID NO: 6027249 - DNA, 19 bp, Homo sapiens
cagggccagggccctgcag

SEQ ID NO: 6027250 - DNA, 12 bp, Homo sapiens
cagggccagggt

SEQ ID NO: 6027251 - DNA, 13 bp, Homo sapiens
cagggccagggtt

SEQ ID NO: 6027252 - DNA, 14 bp, Homo sapiens
cagggccagggttg

SEQ ID NO: 6027253 - DNA, 15 bp, Homo sapiens
cagggccaggtcctc

SEQ ID NO: 6027254 - DNA, 16 bp, Homo sapiens
cagggccaggtcctca

SEQ ID NO: 6027255 - DNA, 19 bp, Homo sapiens
cagggccaggtcctcacag

SEQ ID NO: 6027256 - DNA, 20 bp, Homo sapiens
cagggccaggtcctcacagc

SEQ ID NO: 6027257 - DNA, 21 bp, Homo sapiens
cagggccaggtcctcacagca

SEQ ID NO: 6027258 - DNA, 19 bp, Homo sapiens
cagggccaggtgcagacct

SEQ ID NO: 6027259 - DNA, 16 bp, Homo sapiens
cagggccagtcatggc

SEQ ID NO: 6027260 - DNA, 17 bp, Homo sapiens
cagggccagtggggcct

SEQ ID NO: 6027261 - DNA, 18 bp, Homo sapiens
cagggccagtggggcctg

SEQ ID NO: 6027262 - DNA, 19 bp, Homo sapiens
cagggccagtggggcctgt

SEQ ID NO: 6027263 - DNA, 21 bp, Homo sapiens
cagggccagtggggcctgtgg

SEQ ID NO: 6027264 - DNA, 17 bp, Homo sapiens
cagggccatccactgtg

SEQ ID NO: 6027265 - DNA, 18 bp, Homo sapiens
cagggccatccactgtga

SEQ ID NO: 6027266 - DNA, 20 bp, Homo sapiens
cagggccatccactgtgacg

SEQ ID NO: 6027267 - DNA, 18 bp, Homo sapiens
cagggccatctcctccca

SEQ ID NO: 6027268 - DNA, 21 bp, Homo sapiens
cagggccatctgactgccaag

SEQ ID NO: 6027269 - DNA, 23 bp, Homo sapiens
cagggccatctgactgccaagcc

SEQ ID NO: 6027270 - DNA, 15 bp, Homo sapiens
cagggccatgcagac

SEQ ID NO: 6027271 - DNA, 22 bp, Homo sapiens
cagggccatgcagacctcatgc

SEQ ID NO: 6027272 - DNA, 16 bp, Homo sapiens
cagggccatgctgagg

SEQ ID NO: 6027273 - DNA, 17 bp, Homo sapiens
cagggccatgctgaggc

SEQ ID NO: 6027274 - DNA, 21 bp, Homo sapiens
cagggccatgctgaggcctgg

SEQ ID NO: 6027275 - DNA, 17 bp, Homo sapiens
cagggccatggctcagg

SEQ ID NO: 6027276 - DNA, 18 bp, Homo sapiens
cagggccatggctcaggg

SEQ ID NO: 6027277 - DNA, 22 bp, Homo sapiens
cagggccatggctcagggtggt

SEQ ID NO: 6027278 - DNA, 17 bp, Homo sapiens
cagggccatgtgctgcc

SEQ ID NO: 6027279 - DNA, 21 bp, Homo sapiens
cagggcccaaagcccagctct

SEQ ID NO: 6027280 - DNA, 19 bp, Homo sapiens
cagggcccaagtccctgtt

SEQ ID NO: 6027281 - DNA, 14 bp, Homo sapiens
cagggcccacaccc

SEQ ID NO: 6027282 - DNA, 13 bp, Homo sapiens
cagggcccacccc

SEQ ID NO: 6027283 - DNA, 14 bp, Homo sapiens
cagggcccacccca

SEQ ID NO: 6027284 - DNA, 15 bp, Homo sapiens
cagggcccaccccag

SEQ ID NO: 6027285 - DNA, 21 bp, Homo sapiens
cagggcccaccccagcctcgc

SEQ ID NO: 6027286 - DNA, 12 bp, Homo sapiens
cagggcccacct

SEQ ID NO: 6027287 - DNA, 16 bp, Homo sapiens
cagggcccagagccca

SEQ ID NO: 6027288 - DNA, 16 bp, Homo sapiens
cagggcccagagccct

SEQ ID NO: 6027289 - DNA, 16 bp, Homo sapiens
cagggcccagaggctg

SEQ ID NO: 6027290 - DNA, 17 bp, Homo sapiens
cagggcccagaggctga

SEQ ID NO: 6027291 - DNA, 14 bp, Homo sapiens
cagggcccagcagg

SEQ ID NO: 6027292 - DNA, 11 bp, Homo sapiens
cagggcccagg

SEQ ID NO: 6027293 - DNA, 14 bp, Homo sapiens
cagggcccaggcca

SEQ ID NO: 6027294 - DNA, 14 bp, Homo sapiens
cagggcccaggcct

SEQ ID NO: 6027295 - DNA, 14 bp, Homo sapiens
cagggcccaggttc

SEQ ID NO: 6027296 - DNA, 17 bp, Homo sapiens
cagggcccagttaaata

SEQ ID NO: 6027297 - DNA, 20 bp, Homo sapiens
cagggcccatgtagctggca

SEQ ID NO: 6027298 - DNA, 13 bp, Homo sapiens
cagggccccagaa

SEQ ID NO: 6027299 - DNA, 17 bp, Homo sapiens
cagggccccagaaggca

SEQ ID NO: 6027300 - DNA, 14 bp, Homo sapiens
cagggccccagcac

SEQ ID NO: 6027301 - DNA, 15 bp, Homo sapiens
cagggccccagcact

SEQ ID NO: 6027302 - DNA, 17 bp, Homo sapiens
cagggcccccaataaac

SEQ ID NO: 6027303 - DNA, 18 bp, Homo sapiens
cagggcccccaataaacc

SEQ ID NO: 6027304 - DNA, 21 bp, Homo sapiens
cagggcccccaataaaccagt

SEQ ID NO: 6027305 - DNA, 14 bp, Homo sapiens
cagggcccccacag

SEQ ID NO: 6027306 - DNA, 17 bp, Homo sapiens
cagggcccccacaggcc

SEQ ID NO: 6027307 - DNA, 16 bp, Homo sapiens
cagggcccccacaggg

SEQ ID NO: 6027308 - DNA, 21 bp, Homo sapiens
cagggcccccagcgagagtcc

SEQ ID NO: 6027309 - DNA, 18 bp, Homo sapiens
cagggcccccatgcaggc

SEQ ID NO: 6027310 - DNA, 21 bp, Homo sapiens
cagggccccccaaatcccagg

SEQ ID NO: 6027311 - DNA, 11 bp, Homo sapiens
cagggcccctc

SEQ ID NO: 6027312 - DNA, 22 bp, Homo sapiens
cagggcccctccctctgcccca

SEQ ID NO: 6027313 - DNA, 20 bp, Homo sapiens
cagggcccgggaagcaaatg

SEQ ID NO: 6027314 - DNA, 17 bp, Homo sapiens
cagggcccgggcaccca

SEQ ID NO: 6027315 - DNA, 18 bp, Homo sapiens
cagggcccgggcacccac

SEQ ID NO: 6027316 - DNA, 18 bp, Homo sapiens
cagggcccgggcccaggc

SEQ ID NO: 6027317 - DNA, 23 bp, Homo sapiens
cagggcccgggcccaggcagaga

SEQ ID NO: 6027318 - DNA, 21 bp, Homo sapiens
cagggccctaacgggggtgcg

SEQ ID NO: 6027319 - DNA, 20 bp, Homo sapiens
cagggccctaggcccctcct

SEQ ID NO: 6027320 - DNA, 15 bp, Homo sapiens
cagggccctcccagc

SEQ ID NO: 6027321 - DNA, 17 bp, Homo sapiens
cagggccctcccagccc

SEQ ID NO: 6027322 - DNA, 18 bp, Homo sapiens
cagggccctctgaggctc

SEQ ID NO: 6027323 - DNA, 11 bp, Homo sapiens
cagggccctga

SEQ ID NO: 6027324 - DNA, 21 bp, Homo sapiens
cagggccctgaaatggcctgt

SEQ ID NO: 6027325 - DNA, 13 bp, Homo sapiens
cagggccctgcag

SEQ ID NO: 6027326 - DNA, 14 bp, Homo sapiens
cagggccctgcaga

SEQ ID NO: 6027327 - DNA, 13 bp, Homo sapiens
cagggccctgctc

SEQ ID NO: 6027328 - DNA, 15 bp, Homo sapiens
cagggccctggccag

SEQ ID NO: 6027329 - DNA, 13 bp, Homo sapiens
cagggccctgggc

SEQ ID NO: 6027330 - DNA, 22 bp, Homo sapiens
cattcctaactagaattagtat

SEQ ID NO: 6027331 - DNA, 22 bp, Homo sapiens
cattcctaagagtggaggagga

SEQ ID NO: 6027332 - DNA, 23 bp, Homo sapiens
cattcctaatcaaattctgtctg

SEQ ID NO: 6027333 - DNA, 20 bp, Homo sapiens
cattcctagagagcagaaat

SEQ ID NO: 6027334 - DNA, 23 bp, Homo sapiens
cattcctagagagcagaaataaa

SEQ ID NO: 6027335 - DNA, 19 bp, Homo sapiens
cattcctaggtcacttgaa

SEQ ID NO: 6027336 - DNA, 13 bp, Homo sapiens
cattcctcacctt

SEQ ID NO: 6027337 - DNA, 23 bp, Homo sapiens
cattcctcaggaaggacatgggt

SEQ ID NO: 6027338 - DNA, 16 bp, Homo sapiens
cattcctcagggacag

SEQ ID NO: 6027339 - DNA, 18 bp, Homo sapiens
cattcctcatgaatgtaa

SEQ ID NO: 6027340 - DNA, 19 bp, Homo sapiens
cattcctcatgaatgtaaa

SEQ ID NO: 6027341 - DNA, 16 bp, Homo sapiens
cattcctccactctgt

SEQ ID NO: 6027342 - DNA, 21 bp, Homo sapiens
cattcctccagcctcccctcc

SEQ ID NO: 6027343 - DNA, 20 bp, Homo sapiens
cattcctccagtgcatactg

SEQ ID NO: 6027344 - DNA, 12 bp, Homo sapiens
cattcctccctc

SEQ ID NO: 6027345 - DNA, 13 bp, Homo sapiens
cattcctctccta

SEQ ID NO: 6027346 - DNA, 13 bp, Homo sapiens
cattcctgaaaga

SEQ ID NO: 6027347 - DNA, 18 bp, Homo sapiens
cattcctgaagtctctaa

SEQ ID NO: 6027348 - DNA, 15 bp, Homo sapiens
cattcctgagattct

SEQ ID NO: 6027349 - DNA, 18 bp, Homo sapiens
cattcctgagattctggg

SEQ ID NO: 6027350 - DNA, 20 bp, Homo sapiens
cattcctgagattctgggaa

SEQ ID NO: 6027351 - DNA, 19 bp, Homo sapiens
cattcctgatgcttcttca

SEQ ID NO: 6027352 - DNA, 23 bp, Homo sapiens
cattcctgatgcttcttcagaga

SEQ ID NO: 6027353 - DNA, 16 bp, Homo sapiens
cattcctgcctgtctc

SEQ ID NO: 6027354 - DNA, 19 bp, Homo sapiens
cattcctggaaaccacagt

SEQ ID NO: 6027355 - DNA, 18 bp, Homo sapiens
cattcctggagcccgagg

SEQ ID NO: 6027356 - DNA, 21 bp, Homo sapiens
cattcctgggaaatattccct

SEQ ID NO: 6027357 - DNA, 17 bp, Homo sapiens
cattcctggtacccagc

SEQ ID NO: 6027358 - DNA, 23 bp, Homo sapiens
cattcctggtacccagccatctg

SEQ ID NO: 6027359 - DNA, 24 bp, Homo sapiens
cattcctggtacccagccatctgc

SEQ ID NO: 6027360 - DNA, 20 bp, Homo sapiens
cattcctgtaacttttaatc

SEQ ID NO: 6027361 - DNA, 14 bp, Homo sapiens
cattcctgtcaaca

SEQ ID NO: 6027362 - DNA, 15 bp, Homo sapiens
cattcctgtcccttt

SEQ ID NO: 6027363 - DNA, 16 bp, Homo sapiens
cattcctgtccctttg

SEQ ID NO: 6027364 - DNA, 13 bp, Homo sapiens
cattcctgttctt

SEQ ID NO: 6027365 - DNA, 21 bp, Homo sapiens
cattcctgttgatgggaaaag

SEQ ID NO: 6027366 - DNA, 15 bp, Homo sapiens
cattccttaattgta

SEQ ID NO: 6027367 - DNA, 17 bp, Homo sapiens
cattccttacttgcact

SEQ ID NO: 6027368 - DNA, 18 bp, Homo sapiens
cattccttagcagctcag

SEQ ID NO: 6027369 - DNA, 14 bp, Homo sapiens
cattccttcaaata

SEQ ID NO: 6027370 - DNA, 19 bp, Homo sapiens
cattccttcaaataaagaa

SEQ ID NO: 6027371 - DNA, 22 bp, Homo sapiens
cattccttcccagaggggcctg

SEQ ID NO: 6027372 - DNA, 11 bp, Homo sapiens
cattccttctc

SEQ ID NO: 6027373 - DNA, 17 bp, Homo sapiens
cattccttctggcctct

SEQ ID NO: 6027374 - DNA, 14 bp, Homo sapiens
cattccttctttga

SEQ ID NO: 6027375 - DNA, 15 bp, Homo sapiens
cattccttctttgat

SEQ ID NO: 6027376 - DNA, 18 bp, Homo sapiens
cattccttctttgataat

SEQ ID NO: 6027377 - DNA, 17 bp, Homo sapiens
cattccttgaggacaga

SEQ ID NO: 6027378 - DNA, 20 bp, Homo sapiens
cattccttgataatgttgtg

SEQ ID NO: 6027379 - DNA, 13 bp, Homo sapiens
cattccttgcctg

SEQ ID NO: 6027380 - DNA, 18 bp, Homo sapiens
cattccttgtcaccagca

SEQ ID NO: 6027381 - DNA, 23 bp, Homo sapiens
cattcctttcttgtgccctgggc

SEQ ID NO: 6027382 - DNA, 18 bp, Homo sapiens
cattcctttttatttata

SEQ ID NO: 6027383 - DNA, 22 bp, Homo sapiens
cattcgaagatccccagacttc

SEQ ID NO: 6027384 - DNA, 16 bp, Homo sapiens
cattcgacctataaga

SEQ ID NO: 6027385 - DNA, 21 bp, Homo sapiens
cattcgacctataagaagcct

SEQ ID NO: 6027386 - DNA, 20 bp, Homo sapiens
cattcgaggtgtcaccctgc

SEQ ID NO: 6027387 - DNA, 14 bp, Homo sapiens
cattcgcagcagct

SEQ ID NO: 6027388 - DNA, 22 bp, Homo sapiens
cattcgcctttgtcttgtactt

SEQ ID NO: 6027389 - DNA, 24 bp, Homo sapiens
cattcgcctttgtcttgtacttct

SEQ ID NO: 6027390 - DNA, 16 bp, Homo sapiens
cattcgcgctctgctc

SEQ ID NO: 6027391 - DNA, 18 bp, Homo sapiens
cattcgcgctctgctcag

SEQ ID NO: 6027392 - DNA, 22 bp, Homo sapiens
cattcgctactatgatttaatt

SEQ ID NO: 6027393 - DNA, 14 bp, Homo sapiens
cattcggaccctgc

SEQ ID NO: 6027394 - DNA, 16 bp, Homo sapiens
cattcggaccctgccc

SEQ ID NO: 6027395 - DNA, 19 bp, Homo sapiens
cattcggaccctgcccata

SEQ ID NO: 6027396 - DNA, 22 bp, Homo sapiens
cattcgggccccacctgcagct

SEQ ID NO: 6027397 - DNA, 16 bp, Homo sapiens
cattcggggctgacga

SEQ ID NO: 6027398 - DNA, 20 bp, Homo sapiens
cattcggtgtgaacttttct

SEQ ID NO: 6027399 - DNA, 17 bp, Homo sapiens
cattcgtacataatact

SEQ ID NO: 6027400 - DNA, 19 bp, Homo sapiens
cattcgtatccagctcttt

SEQ ID NO: 6027401 - DNA, 15 bp, Homo sapiens
cattcgtctgtccca

SEQ ID NO: 6027402 - DNA, 16 bp, Homo sapiens
cattcgtctgtcccag

SEQ ID NO: 6027403 - DNA, 20 bp, Homo sapiens
cattcgtctgtcccagagct

SEQ ID NO: 6027404 - DNA, 21 bp, Homo sapiens
cattcgtgaaaaccaaccctg

SEQ ID NO: 6027405 - DNA, 23 bp, Homo sapiens
cattcgtgaaaaccaaccctgtg

SEQ ID NO: 6027406 - DNA, 15 bp, Homo sapiens
cattcgtgagctggg

SEQ ID NO: 6027407 - DNA, 17 bp, Homo sapiens
cattcgtgagctgggga

SEQ ID NO: 6027408 - DNA, 23 bp, Homo sapiens
cattcgtgagctggggactcagg

SEQ ID NO: 6027409 - DNA, 19 bp, Homo sapiens
cattcgtgggcctgctgct

SEQ ID NO: 6027410 - DNA, 24 bp, Homo sapiens
cattcgttgctccagtataaatta

SEQ ID NO: 6027411 - DNA, 18 bp, Homo sapiens
cattctaaaccaaaacag

SEQ ID NO: 6027412 - DNA, 17 bp, Homo sapiens
cattctaaatgaactca

SEQ ID NO: 6027413 - DNA, 13 bp, Homo sapiens
cattctaatgatg

SEQ ID NO: 6027414 - DNA, 22 bp, Homo sapiens
cattctaatgatggcccattct

SEQ ID NO: 6027415 - DNA, 13 bp, Homo sapiens
cattctaatgcat

SEQ ID NO: 6027416 - DNA, 15 bp, Homo sapiens
cattctaatgcatat

SEQ ID NO: 6027417 - DNA, 20 bp, Homo sapiens
cattctacaagtaattttgc

SEQ ID NO: 6027418 - DNA, 22 bp, Homo sapiens
cattctacacagagcaggactg

SEQ ID NO: 6027419 - DNA, 14 bp, Homo sapiens
cattctacacctgg

SEQ ID NO: 6027420 - DNA, 19 bp, Homo sapiens
cattctacagttgtgataa

SEQ ID NO: 6027421 - DNA, 17 bp, Homo sapiens
cattctacttcagcttt

SEQ ID NO: 6027422 - DNA, 12 bp, Homo sapiens
cattctacttgc

SEQ ID NO: 6027423 - DNA, 16 bp, Homo sapiens
cattctacttgctctg

SEQ ID NO: 6027424 - DNA, 18 bp, Homo sapiens
cattctacttgctctgga

SEQ ID NO: 6027425 - DNA, 21 bp, Homo sapiens
cattctacttgcttattacat

SEQ ID NO: 6027426 - DNA, 11 bp, Homo sapiens
cattctagatc

SEQ ID NO: 6027427 - DNA, 16 bp, Homo sapiens
cattctagatcctgca

SEQ ID NO: 6027428 - DNA, 23 bp, Homo sapiens
cattctagattacttttcttact

SEQ ID NO: 6027429 - DNA, 15 bp, Homo sapiens
cattctaggatgtgg

SEQ ID NO: 6027430 - DNA, 18 bp, Homo sapiens
cattctatcaagcccagg

SEQ ID NO: 6027431 - DNA, 22 bp, Homo sapiens
cattctatcggccaggctggag

SEQ ID NO: 6027432 - DNA, 15 bp, Homo sapiens
cattctatctactga

SEQ ID NO: 6027433 - DNA, 16 bp, Homo sapiens
cattctattctccaga

SEQ ID NO: 6027434 - DNA, 20 bp, Homo sapiens
cattctattctccagacatg

SEQ ID NO: 6027435 - DNA, 21 bp, Homo sapiens
cattctattgactttcttaaa

SEQ ID NO: 6027436 - DNA, 13 bp, Homo sapiens
cattctattgcct

SEQ ID NO: 6027437 - DNA, 16 bp, Homo sapiens
cattctattgccttct

SEQ ID NO: 6027438 - DNA, 19 bp, Homo sapiens
cattctattgccttctttg

SEQ ID NO: 6027439 - DNA, 17 bp, Homo sapiens
cattctattttagaata

SEQ ID NO: 6027440 - DNA, 14 bp, Homo sapiens
cattctcaagccct

SEQ ID NO: 6027441 - DNA, 14 bp, Homo sapiens
cattctcaagggac

SEQ ID NO: 6027442 - DNA, 16 bp, Homo sapiens
cattctcaagggacgt

SEQ ID NO: 6027443 - DNA, 16 bp, Homo sapiens
cattctcaccctgtga

SEQ ID NO: 6027444 - DNA, 22 bp, Homo sapiens
cattctcacctaaaccctctgt

SEQ ID NO: 6027445 - DNA, 16 bp, Homo sapiens
cattctcactcctacc

SEQ ID NO: 6027446 - DNA, 14 bp, Homo sapiens
cattctcaggcacc

SEQ ID NO: 6027447 - DNA, 16 bp, Homo sapiens
cattctcaggcaccag

SEQ ID NO: 6027448 - DNA, 15 bp, Homo sapiens
cattctcagtttttc

SEQ ID NO: 6027449 - DNA, 19 bp, Homo sapiens
cattctcagtttttcttaa

SEQ ID NO: 6027450 - DNA, 20 bp, Homo sapiens
cattctcagtttttcttaat

SEQ ID NO: 6027451 - DNA, 17 bp, Homo sapiens
cattctcataattccta

SEQ ID NO: 6027452 - DNA, 21 bp, Homo sapiens
cattctcataattcctacagc

SEQ ID NO: 6027453 - DNA, 21 bp, Homo sapiens
cattctcatatgtagccctca

SEQ ID NO: 6027454 - DNA, 22 bp, Homo sapiens
cattctcatatgtagccctcat

SEQ ID NO: 6027455 - DNA, 23 bp, Homo sapiens
cattctcatccaaaagtgaccag

SEQ ID NO: 6027456 - DNA, 13 bp, Homo sapiens
cattctcatctgc

SEQ ID NO: 6027457 - DNA, 23 bp, Homo sapiens
cattctcatctgcacccttcttt

SEQ ID NO: 6027458 - DNA, 15 bp, Homo sapiens
cattctcattggaaa

SEQ ID NO: 6027459 - DNA, 22 bp, Homo sapiens
cattctcattggaaatttagca

SEQ ID NO: 6027460 - DNA, 14 bp, Homo sapiens
cattctccacagca

SEQ ID NO: 6027461 - DNA, 15 bp, Homo sapiens
cattctccacagcaa

SEQ ID NO: 6027462 - DNA, 18 bp, Homo sapiens
cattctccacctgccagg

SEQ ID NO: 6027463 - DNA, 16 bp, Homo sapiens
cattctccactcactg

SEQ ID NO: 6027464 - DNA, 20 bp, Homo sapiens
cattctccagttgattattt

SEQ ID NO: 6027465 - DNA, 21 bp, Homo sapiens
cattctccagttgattatttc

SEQ ID NO: 6027466 - DNA, 21 bp, Homo sapiens
cattctccagtttcagaagca

SEQ ID NO: 6027467 - DNA, 11 bp, Homo sapiens
cattctcccag

SEQ ID NO: 6027468 - DNA, 12 bp, Homo sapiens
cattctcccagg

SEQ ID NO: 6027469 - DNA, 21 bp, Homo sapiens
cattctcccaggtaccagctg

SEQ ID NO: 6027470 - DNA, 15 bp, Homo sapiens
cattctccccagtgt

SEQ ID NO: 6027471 - DNA, 19 bp, Homo sapiens
cattctcccgcttcctggc

SEQ ID NO: 6027472 - DNA, 20 bp, Homo sapiens
cattctcctcagtggcttct

SEQ ID NO: 6027473 - DNA, 16 bp, Homo sapiens
cattctcctcatgctt

SEQ ID NO: 6027474 - DNA, 11 bp, Homo sapiens
cattctcctgc

SEQ ID NO: 6027475 - DNA, 12 bp, Homo sapiens
cattctcctgcc

SEQ ID NO: 6027476 - DNA, 15 bp, Homo sapiens
cattctcctgcctca

SEQ ID NO: 6027477 - DNA, 16 bp, Homo sapiens
cattctcctgcctcac

SEQ ID NO: 6027478 - DNA, 16 bp, Homo sapiens
cattctcctgcctcag

SEQ ID NO: 6027479 - DNA, 19 bp, Homo sapiens
cattctcctgcctcagcct

SEQ ID NO: 6027480 - DNA, 20 bp, Homo sapiens
cattctcctgcctcagcctt

SEQ ID NO: 6027481 - DNA, 20 bp, Homo sapiens
cattctccttagcttctggc

SEQ ID NO: 6027482 - DNA, 15 bp, Homo sapiens
cattctccttgttgt

SEQ ID NO: 6027483 - DNA, 17 bp, Homo sapiens
cattctcgcttccctga

SEQ ID NO: 6027484 - DNA, 16 bp, Homo sapiens
cattctctaagcctgg

SEQ ID NO: 6027485 - DNA, 15 bp, Homo sapiens
cattctctacccatc

SEQ ID NO: 6027486 - DNA, 21 bp, Homo sapiens
cattctctagacaaaatcaaa

SEQ ID NO: 6027487 - DNA, 18 bp, Homo sapiens
cattctctattgtaattt

SEQ ID NO: 6027488 - DNA, 21 bp, Homo sapiens
cattctctattgtaattttgt

SEQ ID NO: 6027489 - DNA, 16 bp, Homo sapiens
cattctctcatagaac

SEQ ID NO: 6027490 - DNA, 22 bp, Homo sapiens
cattctctccatttcactggct

SEQ ID NO: 6027491 - DNA, 16 bp, Homo sapiens
cattctctcccatcct

SEQ ID NO: 6027492 - DNA, 18 bp, Homo sapiens
cattctctcccatcctgg

SEQ ID NO: 6027493 - DNA, 21 bp, Homo sapiens
cattctctcccatcctggggc

SEQ ID NO: 6027494 - DNA, 18 bp, Homo sapiens
cattctctctcctgtcca

SEQ ID NO: 6027495 - DNA, 16 bp, Homo sapiens
cattctctctgctcag

SEQ ID NO: 6027496 - DNA, 19 bp, Homo sapiens
cattctctctgctcagtga

SEQ ID NO: 6027497 - DNA, 13 bp, Homo sapiens
cattctctgaaga

SEQ ID NO: 6027498 - DNA, 12 bp, Homo sapiens
cattctctgccc

SEQ ID NO: 6027499 - DNA, 14 bp, Homo sapiens
cattctctgtctca

SEQ ID NO: 6027500 - DNA, 20 bp, Homo sapiens
cattctcttactttttgtaa

SEQ ID NO: 6027501 - DNA, 21 bp, Homo sapiens
cattctcttactttttgtaaa

SEQ ID NO: 6027502 - DNA, 16 bp, Homo sapiens
cattctcttatatagt

SEQ ID NO: 6027503 - DNA, 16 bp, Homo sapiens
cattctcttcttgcta

SEQ ID NO: 6027504 - DNA, 19 bp, Homo sapiens
cattctcttgaaggtgctg

SEQ ID NO: 6027505 - DNA, 21 bp, Homo sapiens
cattctcttgaaggtgctgcc

SEQ ID NO: 6027506 - DNA, 18 bp, Homo sapiens
cattctctttctttttct

SEQ ID NO: 6027507 - DNA, 24 bp, Homo sapiens
cagggccctggggtctctgagcag

SEQ ID NO: 6027508 - DNA, 17 bp, Homo sapiens
cagggccctgtggctcc

SEQ ID NO: 6027509 - DNA, 22 bp, Homo sapiens
cagggccctgtggctccaggag

SEQ ID NO: 6027510 - DNA, 23 bp, Homo sapiens
cagggccgaccagaggagccttt

SEQ ID NO: 6027511 - DNA, 14 bp, Homo sapiens
cagggccgcagggc

SEQ ID NO: 6027512 - DNA, 15 bp, Homo sapiens
cagggccgcagggcg

SEQ ID NO: 6027513 - DNA, 19 bp, Homo sapiens
cagggccgcagggcgctcc

SEQ ID NO: 6027514 - DNA, 14 bp, Homo sapiens
cagggccgccaggg

SEQ ID NO: 6027515 - DNA, 22 bp, Homo sapiens
cagggccgccagggagacctgg

SEQ ID NO: 6027516 - DNA, 21 bp, Homo sapiens
cagggccgcccgggcccagag

SEQ ID NO: 6027517 - DNA, 20 bp, Homo sapiens
cagggccgccgaagggcagc

SEQ ID NO: 6027518 - DNA, 17 bp, Homo sapiens
cagggccgcgagaggcc

SEQ ID NO: 6027519 - DNA, 12 bp, Homo sapiens
cagggccgcggc

SEQ ID NO: 6027520 - DNA, 18 bp, Homo sapiens
cagggccgcggccgcccg

SEQ ID NO: 6027521 - DNA, 22 bp, Homo sapiens
cagggccgctcgatgcctttgc

SEQ ID NO: 6027522 - DNA, 17 bp, Homo sapiens
cagggccgcttctcctg

SEQ ID NO: 6027523 - DNA, 20 bp, Homo sapiens
cagggccgtagactcacggc

SEQ ID NO: 6027524 - DNA, 20 bp, Homo sapiens
cagggccgtcaaggaaaggg

SEQ ID NO: 6027525 - DNA, 14 bp, Homo sapiens
cagggcctccaggg

SEQ ID NO: 6027526 - DNA, 19 bp, Homo sapiens
cagggcctccagggcccag

SEQ ID NO: 6027527 - DNA, 23 bp, Homo sapiens
cagggcctcccgcatcaaggtca

SEQ ID NO: 6027528 - DNA, 12 bp, Homo sapiens
cagggcctccct

SEQ ID NO: 6027529 - DNA, 16 bp, Homo sapiens
cagggcctccctgttc

SEQ ID NO: 6027530 - DNA, 18 bp, Homo sapiens
cagggcctccctgttcac

SEQ ID NO: 6027531 - DNA, 21 bp, Homo sapiens
cagggcctctccttggaaggt

SEQ ID NO: 6027532 - DNA, 15 bp, Homo sapiens
cagggcctctgcgga

SEQ ID NO: 6027533 - DNA, 20 bp, Homo sapiens
cagggcctctggcttccctg

SEQ ID NO: 6027534 - DNA, 22 bp, Homo sapiens
cagggcctctggcttccctgcc

SEQ ID NO: 6027535 - DNA, 18 bp, Homo sapiens
cagggcctgaaacccgcc

SEQ ID NO: 6027536 - DNA, 14 bp, Homo sapiens
cagggcctgacacc

SEQ ID NO: 6027537 - DNA, 20 bp, Homo sapiens
cagggcctgacttgagccac

SEQ ID NO: 6027538 - DNA, 19 bp, Homo sapiens
cagggcctgagcctggcca

SEQ ID NO: 6027539 - DNA, 20 bp, Homo sapiens
cagggcctgagcctggccag

SEQ ID NO: 6027540 - DNA, 12 bp, Homo sapiens
cagggcctgagt

SEQ ID NO: 6027541 - DNA, 15 bp, Homo sapiens
cagggcctgagtgac

SEQ ID NO: 6027542 - DNA, 22 bp, Homo sapiens
cagggcctgcaggacctgcctg

SEQ ID NO: 6027543 - DNA, 15 bp, Homo sapiens
cagggcctgccccct

SEQ ID NO: 6027544 - DNA, 16 bp, Homo sapiens
cagggcctgccccctg

SEQ ID NO: 6027545 - DNA, 17 bp, Homo sapiens
cagggcctgccccctgg

SEQ ID NO: 6027546 - DNA, 20 bp, Homo sapiens
cagggcctgccccctgggga

SEQ ID NO: 6027547 - DNA, 21 bp, Homo sapiens
cagggcctgccccctggggat

SEQ ID NO: 6027548 - DNA, 13 bp, Homo sapiens
cagggcctgcgag

SEQ ID NO: 6027549 - DNA, 13 bp, Homo sapiens
cagggcctgctat

SEQ ID NO: 6027550 - DNA, 19 bp, Homo sapiens
cagggcctggaagacagag

SEQ ID NO: 6027551 - DNA, 16 bp, Homo sapiens
cagggcctggagcccc

SEQ ID NO: 6027552 - DNA, 15 bp, Homo sapiens
cagggcctggcaggc

SEQ ID NO: 6027553 - DNA, 20 bp, Homo sapiens
cagggcctggcaggccagtg

SEQ ID NO: 6027554 - DNA, 15 bp, Homo sapiens
cagggcctggcatag

SEQ ID NO: 6027555 - DNA, 13 bp, Homo sapiens
cagggcctggccc

SEQ ID NO: 6027556 - DNA, 16 bp, Homo sapiens
cagggcctggcccatg

SEQ ID NO: 6027557 - DNA, 18 bp, Homo sapiens
cagggcctggcccatgta

SEQ ID NO: 6027558 - DNA, 13 bp, Homo sapiens
cagggcctggcct

SEQ ID NO: 6027559 - DNA, 14 bp, Homo sapiens
cagggcctggcctg

SEQ ID NO: 6027560 - DNA, 13 bp, Homo sapiens
cagggcctggctc

SEQ ID NO: 6027561 - DNA, 16 bp, Homo sapiens
cagggcctggctcagg

SEQ ID NO: 6027562 - DNA, 18 bp, Homo sapiens
cagggcctggctccagtc

SEQ ID NO: 6027563 - DNA, 15 bp, Homo sapiens
cagggcctgggcctc

SEQ ID NO: 6027564 - DNA, 17 bp, Homo sapiens
cagggcctgggcctcat

SEQ ID NO: 6027565 - DNA, 13 bp, Homo sapiens
cagggcctggggc

SEQ ID NO: 6027566 - DNA, 18 bp, Homo sapiens
cagggcctggggcctgag

SEQ ID NO: 6027567 - DNA, 22 bp, Homo sapiens
cagggcctgggggcagtgactg

SEQ ID NO: 6027568 - DNA, 23 bp, Homo sapiens
cagggcctgggggcagtgactgg

SEQ ID NO: 6027569 - DNA, 17 bp, Homo sapiens
cagggccttgcccagag

SEQ ID NO: 6027570 - DNA, 19 bp, Homo sapiens
cagggccttgcccagagat

SEQ ID NO: 6027571 - DNA, 20 bp, Homo sapiens
cagggccttgcccagagatg

SEQ ID NO: 6027572 - DNA, 24 bp, Homo sapiens
cagggccttgcccagagatgcctc

SEQ ID NO: 6027573 - DNA, 19 bp, Homo sapiens
cagggccttggcccagggg

SEQ ID NO: 6027574 - DNA, 17 bp, Homo sapiens
cagggcctttctcctcc

SEQ ID NO: 6027575 - DNA, 18 bp, Homo sapiens
cagggcctttctcctccc

SEQ ID NO: 6027576 - DNA, 21 bp, Homo sapiens
cagggcctttctcctccccac

SEQ ID NO: 6027577 - DNA, 15 bp, Homo sapiens
cagggcgagctgcag

SEQ ID NO: 6027578 - DNA, 17 bp, Homo sapiens
cagggcgagctgcagga

SEQ ID NO: 6027579 - DNA, 20 bp, Homo sapiens
cagggcgcccagcgccgtcc

SEQ ID NO: 6027580 - DNA, 16 bp, Homo sapiens
cagggcgcccctggga

SEQ ID NO: 6027581 - DNA, 17 bp, Homo sapiens
cagggcgctccggcaga

SEQ ID NO: 6027582 - DNA, 22 bp, Homo sapiens
cagggcgctccggcagaggcag

SEQ ID NO: 6027583 - DNA, 18 bp, Homo sapiens
cagggcgctgggaagggg

SEQ ID NO: 6027584 - DNA, 18 bp, Homo sapiens
cagggcggcctcccaggt

SEQ ID NO: 6027585 - DNA, 20 bp, Homo sapiens
cagggcggcctcccaggtcc

SEQ ID NO: 6027586 - DNA, 21 bp, Homo sapiens
cagggcggcctcccaggtccc

SEQ ID NO: 6027587 - DNA, 21 bp, Homo sapiens
cagggcggctgccgactcccc

SEQ ID NO: 6027588 - DNA, 21 bp, Homo sapiens
cagggcgggcagagggctgga

SEQ ID NO: 6027589 - DNA, 16 bp, Homo sapiens
cagggcgggccaggag

SEQ ID NO: 6027590 - DNA, 15 bp, Homo sapiens
cagggcggggctggc

SEQ ID NO: 6027591 - DNA, 19 bp, Homo sapiens
cagggcggggctggccagc

SEQ ID NO: 6027592 - DNA, 24 bp, Homo sapiens
cagggcggggctggccagctgtgc

SEQ ID NO: 6027593 - DNA, 20 bp, Homo sapiens
cagggcgggggggggggcgg

SEQ ID NO: 6027594 - DNA, 16 bp, Homo sapiens
cagggctaaataaaga

SEQ ID NO: 6027595 - DNA, 17 bp, Homo sapiens
cagggctaagagctagc

SEQ ID NO: 6027596 - DNA, 18 bp, Homo sapiens
cagggctacacagaccct

SEQ ID NO: 6027597 - DNA, 16 bp, Homo sapiens
cagggctaccctgagc

SEQ ID NO: 6027598 - DNA, 22 bp, Homo sapiens
cagggctagtgaagtggcctct

SEQ ID NO: 6027599 - DNA, 15 bp, Homo sapiens
cagggctcacactcc

SEQ ID NO: 6027600 - DNA, 16 bp, Homo sapiens
cagggctcacactcct

SEQ ID NO: 6027601 - DNA, 17 bp, Homo sapiens
cagggctcacagggcag

SEQ ID NO: 6027602 - DNA, 21 bp, Homo sapiens
cagggctcacagggcaggcct

SEQ ID NO: 6027603 - DNA, 23 bp, Homo sapiens
cagggctcacagggcaggccttg

SEQ ID NO: 6027604 - DNA, 13 bp, Homo sapiens
cagggctcagagt

SEQ ID NO: 6027605 - DNA, 12 bp, Homo sapiens
cagggctcagcc

SEQ ID NO: 6027606 - DNA, 13 bp, Homo sapiens
cagggctcagcct

SEQ ID NO: 6027607 - DNA, 14 bp, Homo sapiens
cagggctcagcctg

SEQ ID NO: 6027608 - DNA, 15 bp, Homo sapiens
cagggctcagcctgg

SEQ ID NO: 6027609 - DNA, 21 bp, Homo sapiens
cagggctcagcggggacagct

SEQ ID NO: 6027610 - DNA, 12 bp, Homo sapiens
cagggctcagct

SEQ ID NO: 6027611 - DNA, 13 bp, Homo sapiens
cagggctcaggat

SEQ ID NO: 6027612 - DNA, 23 bp, Homo sapiens
cagggctccacgggggcctagtg

SEQ ID NO: 6027613 - DNA, 13 bp, Homo sapiens
cagggctccagcc

SEQ ID NO: 6027614 - DNA, 16 bp, Homo sapiens
cagggctccagcccct

SEQ ID NO: 6027615 - DNA, 22 bp, Homo sapiens
cagggctccagcctgtcggcca

SEQ ID NO: 6027616 - DNA, 18 bp, Homo sapiens
cagggctcccacagagac

SEQ ID NO: 6027617 - DNA, 14 bp, Homo sapiens
cagggctcccaggg

SEQ ID NO: 6027618 - DNA, 21 bp, Homo sapiens
cagggctcccaggggtctccc

SEQ ID NO: 6027619 - DNA, 23 bp, Homo sapiens
cagggctccctcctggagcatcc

SEQ ID NO: 6027620 - DNA, 19 bp, Homo sapiens
cagggctcctcccagcttg

SEQ ID NO: 6027621 - DNA, 18 bp, Homo sapiens
cagggctcctccctggag

SEQ ID NO: 6027622 - DNA, 22 bp, Homo sapiens
cagggctcctccctggagctag

SEQ ID NO: 6027623 - DNA, 20 bp, Homo sapiens
cagggctcctgccttctgtc

SEQ ID NO: 6027624 - DNA, 12 bp, Homo sapiens
cagggctcctgg

SEQ ID NO: 6027625 - DNA, 13 bp, Homo sapiens
cagggctcctggg

SEQ ID NO: 6027626 - DNA, 23 bp, Homo sapiens
cagggctcctgtggcagctgccc

SEQ ID NO: 6027627 - DNA, 15 bp, Homo sapiens
cagggctcgggcgct

SEQ ID NO: 6027628 - DNA, 16 bp, Homo sapiens
cagggctcgggcgctg

SEQ ID NO: 6027629 - DNA, 18 bp, Homo sapiens
cagggctcgggcgctgtg

SEQ ID NO: 6027630 - DNA, 22 bp, Homo sapiens
cagggctcgggcgctgtggctc

SEQ ID NO: 6027631 - DNA, 17 bp, Homo sapiens
cagggctctcctggctt

SEQ ID NO: 6027632 - DNA, 18 bp, Homo sapiens
cagggctctcctggcttc

SEQ ID NO: 6027633 - DNA, 16 bp, Homo sapiens
cagggctctctggacc

SEQ ID NO: 6027634 - DNA, 24 bp, Homo sapiens
cagggctctctttccttcttgcct

SEQ ID NO: 6027635 - DNA, 15 bp, Homo sapiens
cagggctctgaccag

SEQ ID NO: 6027636 - DNA, 22 bp, Homo sapiens
cagggctctgactctgccaggg

SEQ ID NO: 6027637 - DNA, 15 bp, Homo sapiens
cagggctctgcagca

SEQ ID NO: 6027638 - DNA, 15 bp, Homo sapiens
cagggctctgcaggc

SEQ ID NO: 6027639 - DNA, 16 bp, Homo sapiens
cagggctctgcaggcc

SEQ ID NO: 6027640 - DNA, 16 bp, Homo sapiens
cagggctctgccccag

SEQ ID NO: 6027641 - DNA, 19 bp, Homo sapiens
cagggctctgccccagtcg

SEQ ID NO: 6027642 - DNA, 15 bp, Homo sapiens
cagggctctggcagg

SEQ ID NO: 6027643 - DNA, 16 bp, Homo sapiens
cagggctctggcaggt

SEQ ID NO: 6027644 - DNA, 18 bp, Homo sapiens
cagggctctggcaggtgg

SEQ ID NO: 6027645 - DNA, 14 bp, Homo sapiens
cagggctctggggg

SEQ ID NO: 6027646 - DNA, 21 bp, Homo sapiens
cagggctgacacgtccacccc

SEQ ID NO: 6027647 - DNA, 16 bp, Homo sapiens
cagggctgagcgtgga

SEQ ID NO: 6027648 - DNA, 16 bp, Homo sapiens
cagggctgaggcctct

SEQ ID NO: 6027649 - DNA, 23 bp, Homo sapiens
cagggctgcccctgtaggttgct

SEQ ID NO: 6027650 - DNA, 23 bp, Homo sapiens
cagggctgccctgagaagctgct

SEQ ID NO: 6027651 - DNA, 13 bp, Homo sapiens
cagggctgctccc

SEQ ID NO: 6027652 - DNA, 23 bp, Homo sapiens
cagggctgctccccaacacctgc

SEQ ID NO: 6027653 - DNA, 16 bp, Homo sapiens
cagggctgctctttcc

SEQ ID NO: 6027654 - DNA, 17 bp, Homo sapiens
cagggctgctctttcca

SEQ ID NO: 6027655 - DNA, 16 bp, Homo sapiens
cagggctgctgtggcc

SEQ ID NO: 6027656 - DNA, 19 bp, Homo sapiens
cagggctgctgtggcccag

SEQ ID NO: 6027657 - DNA, 22 bp, Homo sapiens
cagggctggaaaagtcacacag

SEQ ID NO: 6027658 - DNA, 15 bp, Homo sapiens
cagggctggactgag

SEQ ID NO: 6027659 - DNA, 17 bp, Homo sapiens
cagggctggactgaggc

SEQ ID NO: 6027660 - DNA, 18 bp, Homo sapiens
cagggctggactgaggcc

SEQ ID NO: 6027661 - DNA, 19 bp, Homo sapiens
cagggctggactgaggcct

SEQ ID NO: 6027662 - DNA, 22 bp, Homo sapiens
cagggctggactgaggcctgag

SEQ ID NO: 6027663 - DNA, 14 bp, Homo sapiens
cagggctggagcct

SEQ ID NO: 6027664 - DNA, 16 bp, Homo sapiens
cagggctggagcctgg

SEQ ID NO: 6027665 - DNA, 17 bp, Homo sapiens
cagggctggagggaagg

SEQ ID NO: 6027666 - DNA, 13 bp, Homo sapiens
cagggctggatgg

SEQ ID NO: 6027667 - DNA, 14 bp, Homo sapiens
cagggctggatgga

SEQ ID NO: 6027668 - DNA, 15 bp, Homo sapiens
cagggctggatggac

SEQ ID NO: 6027669 - DNA, 12 bp, Homo sapiens
cagggctggatt

SEQ ID NO: 6027670 - DNA, 18 bp, Homo sapiens
cagggctggattggcagg

SEQ ID NO: 6027671 - DNA, 21 bp, Homo sapiens
cagggctggcacgtgacaggc

SEQ ID NO: 6027672 - DNA, 16 bp, Homo sapiens
cagggctggcccagcc

SEQ ID NO: 6027673 - DNA, 21 bp, Homo sapiens
cagggctggcccagccctgct

SEQ ID NO: 6027674 - DNA, 22 bp, Homo sapiens
cagggctggcccagccctgctg

SEQ ID NO: 6027675 - DNA, 23 bp, Homo sapiens
cagggctggcccagccctgctgg

SEQ ID NO: 6027676 - DNA, 20 bp, Homo sapiens
cagggctggccccagggcac

SEQ ID NO: 6027677 - DNA, 13 bp, Homo sapiens
cagggctggccct

SEQ ID NO: 6027678 - DNA, 11 bp, Homo sapiens
cagggctggct

SEQ ID NO: 6027679 - DNA, 20 bp, Homo sapiens
cagggctggctcctctgccc

SEQ ID NO: 6027680 - DNA, 13 bp, Homo sapiens
cagggctggctct

SEQ ID NO: 6027681 - DNA, 15 bp, Homo sapiens
cagggctggctctgc

SEQ ID NO: 6027682 - DNA, 10 bp, Homo sapiens
cagggctggg

SEQ ID NO: 6027683 - DNA, 16 bp, Homo sapiens
cagggctgggaggaag

SEQ ID NO: 6027684 - DNA, 13 bp, Homo sapiens
cagggctgggcca

SEQ ID NO: 6027685 - DNA, 18 bp, Homo sapiens
cattctctttgataacaa

SEQ ID NO: 6027686 - DNA, 22 bp, Homo sapiens
cattctgaatcaagcacactgt

SEQ ID NO: 6027687 - DNA, 23 bp, Homo sapiens
cattctgaatcaagcacactgta

SEQ ID NO: 6027688 - DNA, 11 bp, Homo sapiens
cattctgaatg

SEQ ID NO: 6027689 - DNA, 16 bp, Homo sapiens
cattctgaatgaataa

SEQ ID NO: 6027690 - DNA, 20 bp, Homo sapiens
cattctgaattaattaattt

SEQ ID NO: 6027691 - DNA, 15 bp, Homo sapiens
cattctgacatccac

SEQ ID NO: 6027692 - DNA, 12 bp, Homo sapiens
cattctgactcg

SEQ ID NO: 6027693 - DNA, 23 bp, Homo sapiens
cattctgatgtccatttgtccca

SEQ ID NO: 6027694 - DNA, 20 bp, Homo sapiens
cattctgatttggaaaaaga

SEQ ID NO: 6027695 - DNA, 22 bp, Homo sapiens
cattctgcacgctgcccagggg

SEQ ID NO: 6027696 - DNA, 14 bp, Homo sapiens
cattctgcattaat

SEQ ID NO: 6027697 - DNA, 23 bp, Homo sapiens
cattctgcatttagctgtattca

SEQ ID NO: 6027698 - DNA, 11 bp, Homo sapiens
cattctgccaa

SEQ ID NO: 6027699 - DNA, 18 bp, Homo sapiens
cattctgccaaagtaaaa

SEQ ID NO: 6027700 - DNA, 17 bp, Homo sapiens
cattctgccctgtggga

SEQ ID NO: 6027701 - DNA, 14 bp, Homo sapiens
cattctgcctagag

SEQ ID NO: 6027702 - DNA, 23 bp, Homo sapiens
cattctgcctcagcctcccaagt

SEQ ID NO: 6027703 - DNA, 21 bp, Homo sapiens
cattctgcctcagcctcctga

SEQ ID NO: 6027704 - DNA, 11 bp, Homo sapiens
cattctgcctt

SEQ ID NO: 6027705 - DNA, 16 bp, Homo sapiens
cattctgctccttccc

SEQ ID NO: 6027706 - DNA, 15 bp, Homo sapiens
cattctgctctgccc

SEQ ID NO: 6027707 - DNA, 16 bp, Homo sapiens
cattctgctctgccca

SEQ ID NO: 6027708 - DNA, 12 bp, Homo sapiens
cattctggaagt

SEQ ID NO: 6027709 - DNA, 16 bp, Homo sapiens
cattctggaagtgact

SEQ ID NO: 6027710 - DNA, 16 bp, Homo sapiens
cattctggagacagaa

SEQ ID NO: 6027711 - DNA, 20 bp, Homo sapiens
cattctggaggggagagctt

SEQ ID NO: 6027712 - DNA, 16 bp, Homo sapiens
cattctggaggggcag

SEQ ID NO: 6027713 - DNA, 12 bp, Homo sapiens
cattctggatct

SEQ ID NO: 6027714 - DNA, 21 bp, Homo sapiens
cattctggatctgaccctccc

SEQ ID NO: 6027715 - DNA, 20 bp, Homo sapiens
cattctggcactttaatgat

SEQ ID NO: 6027716 - DNA, 17 bp, Homo sapiens
cattctggcagttttga

SEQ ID NO: 6027717 - DNA, 12 bp, Homo sapiens
cattctggctcc

SEQ ID NO: 6027718 - DNA, 22 bp, Homo sapiens
cattctggcttaaacaacacct

SEQ ID NO: 6027719 - DNA, 15 bp, Homo sapiens
cattctgggctggga

SEQ ID NO: 6027720 - DNA, 20 bp, Homo sapiens
cattctggggaaacaacatt

SEQ ID NO: 6027721 - DNA, 17 bp, Homo sapiens
cattctggtctcgtctt

SEQ ID NO: 6027722 - DNA, 18 bp, Homo sapiens
cattctggtctcgtcttc

SEQ ID NO: 6027723 - DNA, 22 bp, Homo sapiens
cattctggtctcgtcttccgtc

SEQ ID NO: 6027724 - DNA, 16 bp, Homo sapiens
cattctggtctctcta

SEQ ID NO: 6027725 - DNA, 21 bp, Homo sapiens
cattctggttccctgctgcgc

SEQ ID NO: 6027726 - DNA, 15 bp, Homo sapiens
cattctgtctctgct

SEQ ID NO: 6027727 - DNA, 23 bp, Homo sapiens
cattctgtgaccaaaataccttg

SEQ ID NO: 6027728 - DNA, 12 bp, Homo sapiens
cattctgtgcag

SEQ ID NO: 6027729 - DNA, 14 bp, Homo sapiens
cattctgtgccatt

SEQ ID NO: 6027730 - DNA, 14 bp, Homo sapiens
cattctgttccacc

SEQ ID NO: 6027731 - DNA, 15 bp, Homo sapiens
cattctgtttcctct

SEQ ID NO: 6027732 - DNA, 16 bp, Homo sapiens
cattctgttttccccc

SEQ ID NO: 6027733 - DNA, 20 bp, Homo sapiens
cattcttaacaaactcttca

SEQ ID NO: 6027734 - DNA, 18 bp, Homo sapiens
cattcttaatttatgtaa

SEQ ID NO: 6027735 - DNA, 21 bp, Homo sapiens
cattcttacaattgcactgct

SEQ ID NO: 6027736 - DNA, 24 bp, Homo sapiens
cattcttacaattgcactgctgtt

SEQ ID NO: 6027737 - DNA, 12 bp, Homo sapiens
cattcttactaa

SEQ ID NO: 6027738 - DNA, 12 bp, Homo sapiens
cattcttactta

SEQ ID NO: 6027739 - DNA, 21 bp, Homo sapiens
cattcttagactagttgaaca

SEQ ID NO: 6027740 - DNA, 22 bp, Homo sapiens
cattcttagcctgtggcagtaa

SEQ ID NO: 6027741 - DNA, 17 bp, Homo sapiens
cattcttaggctttcag

SEQ ID NO: 6027742 - DNA, 14 bp, Homo sapiens
cattcttataacat

SEQ ID NO: 6027743 - DNA, 18 bp, Homo sapiens
cattcttatgttccagat

SEQ ID NO: 6027744 - DNA, 12 bp, Homo sapiens
cattcttcaaga

SEQ ID NO: 6027745 - DNA, 17 bp, Homo sapiens
cattcttcaagatccca

SEQ ID NO: 6027746 - DNA, 13 bp, Homo sapiens
cattcttcactgt

SEQ ID NO: 6027747 - DNA, 17 bp, Homo sapiens
cattcttcagtgcctag

SEQ ID NO: 6027748 - DNA, 18 bp, Homo sapiens
cattcttcagtgcctagc

SEQ ID NO: 6027749 - DNA, 21 bp, Homo sapiens
cattcttcagtgtctctgttt

SEQ ID NO: 6027750 - DNA, 15 bp, Homo sapiens
cattcttcagttctc

SEQ ID NO: 6027751 - DNA, 20 bp, Homo sapiens
cattcttccatcatcactgt

SEQ ID NO: 6027752 - DNA, 11 bp, Homo sapiens
cattcttcccg

SEQ ID NO: 6027753 - DNA, 14 bp, Homo sapiens
cattcttcccttat

SEQ ID NO: 6027754 - DNA, 20 bp, Homo sapiens
cattcttcggtctgaatttt

SEQ ID NO: 6027755 - DNA, 19 bp, Homo sapiens
cattcttctaaaactactg

SEQ ID NO: 6027756 - DNA, 18 bp, Homo sapiens
cattcttctgagcactgt

SEQ ID NO: 6027757 - DNA, 13 bp, Homo sapiens
cattcttctgggt

SEQ ID NO: 6027758 - DNA, 23 bp, Homo sapiens
cattcttctgtacgtctgacagg

SEQ ID NO: 6027759 - DNA, 14 bp, Homo sapiens
cattcttcttgcta

SEQ ID NO: 6027760 - DNA, 18 bp, Homo sapiens
cattcttcttttttgtaa

SEQ ID NO: 6027761 - DNA, 17 bp, Homo sapiens
cattcttgaaagctgtg

SEQ ID NO: 6027762 - DNA, 17 bp, Homo sapiens
cattcttgagttttgat

SEQ ID NO: 6027763 - DNA, 20 bp, Homo sapiens
cattcttgagttttgataaa

SEQ ID NO: 6027764 - DNA, 14 bp, Homo sapiens
cattcttgcttgtg

SEQ ID NO: 6027765 - DNA, 20 bp, Homo sapiens
cattcttggcatctactctg

SEQ ID NO: 6027766 - DNA, 17 bp, Homo sapiens
cattcttggttggctgg

SEQ ID NO: 6027767 - DNA, 19 bp, Homo sapiens
cattcttgtcacaataaat

SEQ ID NO: 6027768 - DNA, 17 bp, Homo sapiens
cattcttgtgggagaca

SEQ ID NO: 6027769 - DNA, 23 bp, Homo sapiens
cattcttgtgggagacagcagcc

SEQ ID NO: 6027770 - DNA, 22 bp, Homo sapiens
cattcttgttggtagcatgtac

SEQ ID NO: 6027771 - DNA, 23 bp, Homo sapiens
cattcttgttttctttctttaaa

SEQ ID NO: 6027772 - DNA, 20 bp, Homo sapiens
cattctttaacatacatcta

SEQ ID NO: 6027773 - DNA, 16 bp, Homo sapiens
cattctttactgcact

SEQ ID NO: 6027774 - DNA, 18 bp, Homo sapiens
cattctttactgcactca

SEQ ID NO: 6027775 - DNA, 19 bp, Homo sapiens
cattctttactgcactcag

SEQ ID NO: 6027776 - DNA, 18 bp, Homo sapiens
cattctttataaaatgta

SEQ ID NO: 6027777 - DNA, 19 bp, Homo sapiens
cattctttataaaatgtat

SEQ ID NO: 6027778 - DNA, 21 bp, Homo sapiens
cattctttataatcctctgta

SEQ ID NO: 6027779 - DNA, 16 bp, Homo sapiens
cattctttatagtgaa

SEQ ID NO: 6027780 - DNA, 18 bp, Homo sapiens
cattctttatcttgacat

SEQ ID NO: 6027781 - DNA, 15 bp, Homo sapiens
cattctttcccctca

SEQ ID NO: 6027782 - DNA, 20 bp, Homo sapiens
cattctttcccctcagagct

SEQ ID NO: 6027783 - DNA, 13 bp, Homo sapiens
cattctttcctaa

SEQ ID NO: 6027784 - DNA, 19 bp, Homo sapiens
cattctttcctaaatataa

SEQ ID NO: 6027785 - DNA, 14 bp, Homo sapiens
cattctttccttct

SEQ ID NO: 6027786 - DNA, 16 bp, Homo sapiens
cattctttgctagttg

SEQ ID NO: 6027787 - DNA, 12 bp, Homo sapiens
cattctttgctt

SEQ ID NO: 6027788 - DNA, 13 bp, Homo sapiens
cattctttgcttg

SEQ ID NO: 6027789 - DNA, 21 bp, Homo sapiens
cattctttgcttgaacacagt

SEQ ID NO: 6027790 - DNA, 12 bp, Homo sapiens
cattctttggta

SEQ ID NO: 6027791 - DNA, 14 bp, Homo sapiens
cattctttggtaat

SEQ ID NO: 6027792 - DNA, 16 bp, Homo sapiens
cattctttgtatctta

SEQ ID NO: 6027793 - DNA, 17 bp, Homo sapiens
cattcttttaacttctt

SEQ ID NO: 6027794 - DNA, 22 bp, Homo sapiens
cattcttttcacttcctctcca

SEQ ID NO: 6027795 - DNA, 12 bp, Homo sapiens
cattcttttgta

SEQ ID NO: 6027796 - DNA, 15 bp, Homo sapiens
cattcttttgtaatt

SEQ ID NO: 6027797 - DNA, 19 bp, Homo sapiens
cattctttttctgttgaaa

SEQ ID NO: 6027798 - DNA, 17 bp, Homo sapiens
cattctttttgctctaa

SEQ ID NO: 6027799 - DNA, 19 bp, Homo sapiens
cattctttttgctctaaaa

SEQ ID NO: 6027800 - DNA, 23 bp, Homo sapiens
cattctttttgctctaaaatatt

SEQ ID NO: 6027801 - DNA, 16 bp, Homo sapiens
cattctttttttcttg

SEQ ID NO: 6027802 - DNA, 17 bp, Homo sapiens
cattctttttttcttgg

SEQ ID NO: 6027803 - DNA, 19 bp, Homo sapiens
cattcttttttttatatat

SEQ ID NO: 6027804 - DNA, 17 bp, Homo sapiens
cattgaaaaaaatatat

SEQ ID NO: 6027805 - DNA, 19 bp, Homo sapiens
cattgaaaaaaatatatga

SEQ ID NO: 6027806 - DNA, 17 bp, Homo sapiens
cattgaaaacaaagaca

SEQ ID NO: 6027807 - DNA, 18 bp, Homo sapiens
cattgaaaacaaagacat

SEQ ID NO: 6027808 - DNA, 16 bp, Homo sapiens
cattgaaaacagatat

SEQ ID NO: 6027809 - DNA, 20 bp, Homo sapiens
cattgaaaacagatattaca

SEQ ID NO: 6027810 - DNA, 19 bp, Homo sapiens
cattgaaaagaagctctcc

SEQ ID NO: 6027811 - DNA, 15 bp, Homo sapiens
cattgaaaagagctg

SEQ ID NO: 6027812 - DNA, 16 bp, Homo sapiens
cattgaaaagagctga

SEQ ID NO: 6027813 - DNA, 17 bp, Homo sapiens
cattgaaaataggagag

SEQ ID NO: 6027814 - DNA, 22 bp, Homo sapiens
cattgaaaatgtaagtaaatgt

SEQ ID NO: 6027815 - DNA, 19 bp, Homo sapiens
cattgaaacatttataaac

SEQ ID NO: 6027816 - DNA, 20 bp, Homo sapiens
cattgaaacatttataaact

SEQ ID NO: 6027817 - DNA, 21 bp, Homo sapiens
cattgaaacatttataaacta

SEQ ID NO: 6027818 - DNA, 14 bp, Homo sapiens
cattgaaactgtat

SEQ ID NO: 6027819 - DNA, 17 bp, Homo sapiens
cattgaaagaagagatg

SEQ ID NO: 6027820 - DNA, 20 bp, Homo sapiens
cattgaaagtaaaaaataac

SEQ ID NO: 6027821 - DNA, 14 bp, Homo sapiens
cattgaaagtgctt

SEQ ID NO: 6027822 - DNA, 14 bp, Homo sapiens
cattgaaatcagca

SEQ ID NO: 6027823 - DNA, 19 bp, Homo sapiens
cattgaaatcagcatgaca

SEQ ID NO: 6027824 - DNA, 19 bp, Homo sapiens
cattgaaatgtaatttcag

SEQ ID NO: 6027825 - DNA, 14 bp, Homo sapiens
cattgaacacaaac

SEQ ID NO: 6027826 - DNA, 17 bp, Homo sapiens
cattgaacacatttcct

SEQ ID NO: 6027827 - DNA, 20 bp, Homo sapiens
cattgaacattttatcatta

SEQ ID NO: 6027828 - DNA, 15 bp, Homo sapiens
cattgaactctgaga

SEQ ID NO: 6027829 - DNA, 14 bp, Homo sapiens
cattgaacttcttt

SEQ ID NO: 6027830 - DNA, 21 bp, Homo sapiens
cattgaagaatgttagagtaa

SEQ ID NO: 6027831 - DNA, 11 bp, Homo sapiens
cattgaagaga

SEQ ID NO: 6027832 - DNA, 21 bp, Homo sapiens
cattgaagcttgcaccttttc

SEQ ID NO: 6027833 - DNA, 17 bp, Homo sapiens
cattgaaggcgaggctg

SEQ ID NO: 6027834 - DNA, 14 bp, Homo sapiens
cattgaaggcttaa

SEQ ID NO: 6027835 - DNA, 22 bp, Homo sapiens
cattgaaggcttaattgactga

SEQ ID NO: 6027836 - DNA, 20 bp, Homo sapiens
cattgaagtatattcttatt

SEQ ID NO: 6027837 - DNA, 19 bp, Homo sapiens
cattgaagtgtttaaaaga

SEQ ID NO: 6027838 - DNA, 21 bp, Homo sapiens
cattgaagtgtttgctgcaga

SEQ ID NO: 6027839 - DNA, 13 bp, Homo sapiens
cattgaatacttt

SEQ ID NO: 6027840 - DNA, 15 bp, Homo sapiens
cattgaatactttat

SEQ ID NO: 6027841 - DNA, 22 bp, Homo sapiens
cattgaatatcagttgacagaa

SEQ ID NO: 6027842 - DNA, 19 bp, Homo sapiens
cattgaatctgtatggcta

SEQ ID NO: 6027843 - DNA, 19 bp, Homo sapiens
cattgaatggatcaataca

SEQ ID NO: 6027844 - DNA, 14 bp, Homo sapiens
cattgaattagaaa

SEQ ID NO: 6027845 - DNA, 16 bp, Homo sapiens
cattgaattcattata

SEQ ID NO: 6027846 - DNA, 22 bp, Homo sapiens
cattgaattcttggttgaggaa

SEQ ID NO: 6027847 - DNA, 23 bp, Homo sapiens
cattgaattcttggttgaggaaa

SEQ ID NO: 6027848 - DNA, 20 bp, Homo sapiens
cattgaatttagtcattatt

SEQ ID NO: 6027849 - DNA, 21 bp, Homo sapiens
cattgacaaatctgtgtatat

SEQ ID NO: 6027850 - DNA, 14 bp, Homo sapiens
cattgacaccagaa

SEQ ID NO: 6027851 - DNA, 14 bp, Homo sapiens
cattgacagattga

SEQ ID NO: 6027852 - DNA, 12 bp, Homo sapiens
cattgacagcaa

SEQ ID NO: 6027853 - DNA, 15 bp, Homo sapiens
cattgacatttgaat

SEQ ID NO: 6027854 - DNA, 20 bp, Homo sapiens
cattgaccaagaactgcatg

SEQ ID NO: 6027855 - DNA, 20 bp, Homo sapiens
cattgaccagctctcttcct

SEQ ID NO: 6027856 - DNA, 21 bp, Homo sapiens
cattgaccgcgactaatttca

SEQ ID NO: 6027857 - DNA, 13 bp, Homo sapiens
cattgacctcagc

SEQ ID NO: 6027858 - DNA, 17 bp, Homo sapiens
cattgacctcagctgca

SEQ ID NO: 6027859 - DNA, 23 bp, Homo sapiens
cattgacctcagctgcacattcc

SEQ ID NO: 6027860 - DNA, 16 bp, Homo sapiens
cattgacctcatcatt

SEQ ID NO: 6027861 - DNA, 18 bp, Homo sapiens
cattgacctctcagggcc

SEQ ID NO: 6027862 - DNA, 18 bp, Homo sapiens
cattgacctgaggccctt

SEQ ID NO: 6027863 - DNA, 17 bp, Homo sapiens
cattgacctggagggga

SEQ ID NO: 6027864 - DNA, 16 bp, Homo sapiens
cagggctgggcctgcg

SEQ ID NO: 6027865 - DNA, 14 bp, Homo sapiens
cagggctgggcgcc

SEQ ID NO: 6027866 - DNA, 19 bp, Homo sapiens
cagggctgggctctgtctt

SEQ ID NO: 6027867 - DNA, 20 bp, Homo sapiens
cagggctgggctctgtcttc

SEQ ID NO: 6027868 - DNA, 23 bp, Homo sapiens
cagggctgggctctgtcttcctg

SEQ ID NO: 6027869 - DNA, 11 bp, Homo sapiens
cagggctgggg

SEQ ID NO: 6027870 - DNA, 12 bp, Homo sapiens
cagggctgggga

SEQ ID NO: 6027871 - DNA, 17 bp, Homo sapiens
cagggctggggacagag

SEQ ID NO: 6027872 - DNA, 15 bp, Homo sapiens
cagggctggggcagc

SEQ ID NO: 6027873 - DNA, 19 bp, Homo sapiens
cagggctggggcagcctct

SEQ ID NO: 6027874 - DNA, 21 bp, Homo sapiens
cagggctggggccaagaggaa

SEQ ID NO: 6027875 - DNA, 22 bp, Homo sapiens
cagggctggggccaagaggaaa

SEQ ID NO: 6027876 - DNA, 22 bp, Homo sapiens
cagggctggggtgagcctgact

SEQ ID NO: 6027877 - DNA, 19 bp, Homo sapiens
cagggctggggttgccaga

SEQ ID NO: 6027878 - DNA, 20 bp, Homo sapiens
cagggctggggttgccagag

SEQ ID NO: 6027879 - DNA, 21 bp, Homo sapiens
cagggctggggttgccagagg

SEQ ID NO: 6027880 - DNA, 22 bp, Homo sapiens
cagggctggggttgccagaggc

SEQ ID NO: 6027881 - DNA, 12 bp, Homo sapiens
cagggctgggtc

SEQ ID NO: 6027882 - DNA, 17 bp, Homo sapiens
cagggctgggtcacagg

SEQ ID NO: 6027883 - DNA, 22 bp, Homo sapiens
cagggctgggtcacaggaagga

SEQ ID NO: 6027884 - DNA, 15 bp, Homo sapiens
cagggctgggtcagg

SEQ ID NO: 6027885 - DNA, 18 bp, Homo sapiens
cagggctggtcacctccc

SEQ ID NO: 6027886 - DNA, 12 bp, Homo sapiens
cagggctggtct

SEQ ID NO: 6027887 - DNA, 12 bp, Homo sapiens
cagggctggttt

SEQ ID NO: 6027888 - DNA, 19 bp, Homo sapiens
cagggctgtaactgccagg

SEQ ID NO: 6027889 - DNA, 15 bp, Homo sapiens
cagggctgtcccagc

SEQ ID NO: 6027890 - DNA, 13 bp, Homo sapiens
cagggctgtgctt

SEQ ID NO: 6027891 - DNA, 19 bp, Homo sapiens
cagggctgtgcttgaaggc

SEQ ID NO: 6027892 - DNA, 12 bp, Homo sapiens
cagggctgtggg

SEQ ID NO: 6027893 - DNA, 19 bp, Homo sapiens
cagggctgtgggtggggaa

SEQ ID NO: 6027894 - DNA, 18 bp, Homo sapiens
cagggcttacggccctgg

SEQ ID NO: 6027895 - DNA, 23 bp, Homo sapiens
cagggcttccccatcagctccca

SEQ ID NO: 6027896 - DNA, 15 bp, Homo sapiens
cagggcttctagttt

SEQ ID NO: 6027897 - DNA, 16 bp, Homo sapiens
cagggcttctcctctg

SEQ ID NO: 6027898 - DNA, 23 bp, Homo sapiens
cagggcttggggagcaggtctct

SEQ ID NO: 6027899 - DNA, 18 bp, Homo sapiens
cagggcttgtggactctc

SEQ ID NO: 6027900 - DNA, 21 bp, Homo sapiens
cagggcttgtggactctctgc

SEQ ID NO: 6027901 - DNA, 22 bp, Homo sapiens
cagggcttgtggactctctgcc

SEQ ID NO: 6027902 - DNA, 20 bp, Homo sapiens
cagggctttggggggcacta

SEQ ID NO: 6027903 - DNA, 17 bp, Homo sapiens
cagggcttttcccagga

SEQ ID NO: 6027904 - DNA, 18 bp, Homo sapiens
cagggcttttcccaggaa

SEQ ID NO: 6027905 - DNA, 16 bp, Homo sapiens
caggggaaaagaggag

SEQ ID NO: 6027906 - DNA, 17 bp, Homo sapiens
caggggaaaatcagcct

SEQ ID NO: 6027907 - DNA, 19 bp, Homo sapiens
caggggaaaatcagcctgc

SEQ ID NO: 6027908 - DNA, 20 bp, Homo sapiens
caggggaaaatcagcctgct

SEQ ID NO: 6027909 - DNA, 14 bp, Homo sapiens
caggggaaaatgaa

SEQ ID NO: 6027910 - DNA, 16 bp, Homo sapiens
caggggaaaatgaagg

SEQ ID NO: 6027911 - DNA, 17 bp, Homo sapiens
caggggaaactctggtg

SEQ ID NO: 6027912 - DNA, 18 bp, Homo sapiens
caggggaaactctggtgc

SEQ ID NO: 6027913 - DNA, 23 bp, Homo sapiens
caggggaaagatgagcttttcta

SEQ ID NO: 6027914 - DNA, 15 bp, Homo sapiens
caggggaacctgcca

SEQ ID NO: 6027915 - DNA, 16 bp, Homo sapiens
caggggaacctgccat

SEQ ID NO: 6027916 - DNA, 16 bp, Homo sapiens
caggggaagccagtga

SEQ ID NO: 6027917 - DNA, 14 bp, Homo sapiens
caggggaagccttg

SEQ ID NO: 6027918 - DNA, 15 bp, Homo sapiens
caggggaagccttgc

SEQ ID NO: 6027919 - DNA, 15 bp, Homo sapiens
caggggaagctgcta

SEQ ID NO: 6027920 - DNA, 19 bp, Homo sapiens
caggggaaggccctgaggc

SEQ ID NO: 6027921 - DNA, 15 bp, Homo sapiens
caggggaagggcagg

SEQ ID NO: 6027922 - DNA, 20 bp, Homo sapiens
caggggaatgctaagccagt

SEQ ID NO: 6027923 - DNA, 20 bp, Homo sapiens
caggggaattccctccccct

SEQ ID NO: 6027924 - DNA, 21 bp, Homo sapiens
caggggaattccctccccctc

SEQ ID NO: 6027925 - DNA, 18 bp, Homo sapiens
caggggacaaaccagggg

SEQ ID NO: 6027926 - DNA, 17 bp, Homo sapiens
caggggacaagggaggc

SEQ ID NO: 6027927 - DNA, 21 bp, Homo sapiens
caggggacaagggaggcagtg

SEQ ID NO: 6027928 - DNA, 18 bp, Homo sapiens
caggggacacccagaaac

SEQ ID NO: 6027929 - DNA, 22 bp, Homo sapiens
caggggacactgaaccttgttg

SEQ ID NO: 6027930 - DNA, 15 bp, Homo sapiens
caggggacactttgt

SEQ ID NO: 6027931 - DNA, 16 bp, Homo sapiens
caggggacaggagtcc

SEQ ID NO: 6027932 - DNA, 16 bp, Homo sapiens
caggggacaggatggt

SEQ ID NO: 6027933 - DNA, 16 bp, Homo sapiens
caggggaccccactcc

SEQ ID NO: 6027934 - DNA, 16 bp, Homo sapiens
caggggacctcctggg

SEQ ID NO: 6027935 - DNA, 20 bp, Homo sapiens
caggggacctggagctgcca

SEQ ID NO: 6027936 - DNA, 17 bp, Homo sapiens
caggggacgtgggccct

SEQ ID NO: 6027937 - DNA, 15 bp, Homo sapiens
caggggactcagccc

SEQ ID NO: 6027938 - DNA, 17 bp, Homo sapiens
caggggactcagccctg

SEQ ID NO: 6027939 - DNA, 12 bp, Homo sapiens
caggggactggg

SEQ ID NO: 6027940 - DNA, 14 bp, Homo sapiens
caggggactgggcc

SEQ ID NO: 6027941 - DNA, 23 bp, Homo sapiens
caggggagaagctgaagcccccc

SEQ ID NO: 6027942 - DNA, 17 bp, Homo sapiens
caggggagacaggagcc

SEQ ID NO: 6027943 - DNA, 17 bp, Homo sapiens
caggggagacgaggcca

SEQ ID NO: 6027944 - DNA, 21 bp, Homo sapiens
caggggagacttaggccagag

SEQ ID NO: 6027945 - DNA, 13 bp, Homo sapiens
caggggagaggca

SEQ ID NO: 6027946 - DNA, 17 bp, Homo sapiens
caggggagagggtctgg

SEQ ID NO: 6027947 - DNA, 21 bp, Homo sapiens
caggggagagggtctggagaa

SEQ ID NO: 6027948 - DNA, 16 bp, Homo sapiens
caggggagatccttgt

SEQ ID NO: 6027949 - DNA, 16 bp, Homo sapiens
caggggagcagagggg

SEQ ID NO: 6027950 - DNA, 20 bp, Homo sapiens
caggggagcagaggggcaga

SEQ ID NO: 6027951 - DNA, 13 bp, Homo sapiens
caggggagccagc

SEQ ID NO: 6027952 - DNA, 15 bp, Homo sapiens
caggggagcttggga

SEQ ID NO: 6027953 - DNA, 19 bp, Homo sapiens
caggggagcttgggactca

SEQ ID NO: 6027954 - DNA, 14 bp, Homo sapiens
caggggaggaaaaa

SEQ ID NO: 6027955 - DNA, 18 bp, Homo sapiens
caggggaggaaaaaagaa

SEQ ID NO: 6027956 - DNA, 15 bp, Homo sapiens
caggggaggagcctg

SEQ ID NO: 6027957 - DNA, 17 bp, Homo sapiens
caggggaggagcctgtg

SEQ ID NO: 6027958 - DNA, 17 bp, Homo sapiens
caggggaggccatctgg

SEQ ID NO: 6027959 - DNA, 19 bp, Homo sapiens
caggggaggctgagacgca

SEQ ID NO: 6027960 - DNA, 14 bp, Homo sapiens
caggggagggaaaa

SEQ ID NO: 6027961 - DNA, 18 bp, Homo sapiens
caggggagggaaaagcta

SEQ ID NO: 6027962 - DNA, 15 bp, Homo sapiens
caggggatcaaagtt

SEQ ID NO: 6027963 - DNA, 16 bp, Homo sapiens
caggggatggggtggg

SEQ ID NO: 6027964 - DNA, 21 bp, Homo sapiens
caggggatggggtggggggac

SEQ ID NO: 6027965 - DNA, 18 bp, Homo sapiens
caggggatgtacatctct

SEQ ID NO: 6027966 - DNA, 20 bp, Homo sapiens
caggggatgtacatctctcc

SEQ ID NO: 6027967 - DNA, 21 bp, Homo sapiens
caggggatgtacatctctccc

SEQ ID NO: 6027968 - DNA, 14 bp, Homo sapiens
caggggattgaagc

SEQ ID NO: 6027969 - DNA, 17 bp, Homo sapiens
caggggattgaagccct

SEQ ID NO: 6027970 - DNA, 20 bp, Homo sapiens
caggggattgaagccctcca

SEQ ID NO: 6027971 - DNA, 21 bp, Homo sapiens
caggggattgtctcagggccg

SEQ ID NO: 6027972 - DNA, 17 bp, Homo sapiens
caggggcaaacacctgc

SEQ ID NO: 6027973 - DNA, 18 bp, Homo sapiens
caggggcaaacacctgct

SEQ ID NO: 6027974 - DNA, 20 bp, Homo sapiens
caggggcaaggggctggctg

SEQ ID NO: 6027975 - DNA, 21 bp, Homo sapiens
caggggcaaggggctggctgg

SEQ ID NO: 6027976 - DNA, 20 bp, Homo sapiens
caggggcacacttccccttg

SEQ ID NO: 6027977 - DNA, 18 bp, Homo sapiens
caggggcaccctccaaac

SEQ ID NO: 6027978 - DNA, 21 bp, Homo sapiens
caggggcaccctccaaacact

SEQ ID NO: 6027979 - DNA, 22 bp, Homo sapiens
caggggcacctatgagatggcc

SEQ ID NO: 6027980 - DNA, 13 bp, Homo sapiens
caggggcaccttc

SEQ ID NO: 6027981 - DNA, 15 bp, Homo sapiens
caggggcagaaggag

SEQ ID NO: 6027982 - DNA, 18 bp, Homo sapiens
caggggcagaaggaggaa

SEQ ID NO: 6027983 - DNA, 13 bp, Homo sapiens
caggggcagccac

SEQ ID NO: 6027984 - DNA, 22 bp, Homo sapiens
caggggcagccacaccactgcc

SEQ ID NO: 6027985 - DNA, 12 bp, Homo sapiens
caggggcagctc

SEQ ID NO: 6027986 - DNA, 14 bp, Homo sapiens
caggggcaggactg

SEQ ID NO: 6027987 - DNA, 14 bp, Homo sapiens
caggggcaggaggg

SEQ ID NO: 6027988 - DNA, 15 bp, Homo sapiens
caggggcaggcacag

SEQ ID NO: 6027989 - DNA, 16 bp, Homo sapiens
caggggcaggcacagc

SEQ ID NO: 6027990 - DNA, 23 bp, Homo sapiens
caggggcaggcgcagaggtccca

SEQ ID NO: 6027991 - DNA, 23 bp, Homo sapiens
caggggcaggtggtggaggggcg

SEQ ID NO: 6027992 - DNA, 15 bp, Homo sapiens
caggggcagtgcctt

SEQ ID NO: 6027993 - DNA, 14 bp, Homo sapiens
caggggcagtggcc

SEQ ID NO: 6027994 - DNA, 18 bp, Homo sapiens
caggggcagtggcctgga

SEQ ID NO: 6027995 - DNA, 22 bp, Homo sapiens
caggggcagttttagcagcact

SEQ ID NO: 6027996 - DNA, 13 bp, Homo sapiens
caggggcatctgt

SEQ ID NO: 6027997 - DNA, 16 bp, Homo sapiens
caggggcatctgtctg

SEQ ID NO: 6027998 - DNA, 20 bp, Homo sapiens
caggggcatgtattggcctg

SEQ ID NO: 6027999 - DNA, 21 bp, Homo sapiens
caggggcatgtattggcctgg

SEQ ID NO: 6028000 - DNA, 22 bp, Homo sapiens
caggggcatgtattggcctgga

SEQ ID NO: 6028001 - DNA, 18 bp, Homo sapiens
caggggccaacctcaggc

SEQ ID NO: 6028002 - DNA, 23 bp, Homo sapiens
caggggccaacctcaggctccta

SEQ ID NO: 6028003 - DNA, 14 bp, Homo sapiens
caggggccagagga

SEQ ID NO: 6028004 - DNA, 15 bp, Homo sapiens
caggggccagaggaa

SEQ ID NO: 6028005 - DNA, 23 bp, Homo sapiens
caggggccaggagtggggagagt

SEQ ID NO: 6028006 - DNA, 21 bp, Homo sapiens
caggggccagtgagggctggg

SEQ ID NO: 6028007 - DNA, 14 bp, Homo sapiens
caggggccatgccc

SEQ ID NO: 6028008 - DNA, 18 bp, Homo sapiens
caggggccatgccccacc

SEQ ID NO: 6028009 - DNA, 20 bp, Homo sapiens
caggggcccaaggcggcccc

SEQ ID NO: 6028010 - DNA, 21 bp, Homo sapiens
caggggcccaaggcggcccct

SEQ ID NO: 6028011 - DNA, 22 bp, Homo sapiens
caggggcccaaggcggcccctc

SEQ ID NO: 6028012 - DNA, 17 bp, Homo sapiens
caggggccccagatctg

SEQ ID NO: 6028013 - DNA, 23 bp, Homo sapiens
caggggccccagatctgcctggg

SEQ ID NO: 6028014 - DNA, 11 bp, Homo sapiens
caggggccccg

SEQ ID NO: 6028015 - DNA, 13 bp, Homo sapiens
caggggcccctcc

SEQ ID NO: 6028016 - DNA, 15 bp, Homo sapiens
caggggcccctcctc

SEQ ID NO: 6028017 - DNA, 18 bp, Homo sapiens
caggggcccctcctccag

SEQ ID NO: 6028018 - DNA, 18 bp, Homo sapiens
caggggcccctcctctgt

SEQ ID NO: 6028019 - DNA, 15 bp, Homo sapiens
caggggcccctgggg

SEQ ID NO: 6028020 - DNA, 17 bp, Homo sapiens
caggggcccgggaactc

SEQ ID NO: 6028021 - DNA, 22 bp, Homo sapiens
caggggcccgggaactcctgcc

SEQ ID NO: 6028022 - DNA, 17 bp, Homo sapiens
caggggccctacctggg

SEQ ID NO: 6028023 - DNA, 17 bp, Homo sapiens
caggggccctgagccaa

SEQ ID NO: 6028024 - DNA, 15 bp, Homo sapiens
caggggccctgcagc

SEQ ID NO: 6028025 - DNA, 16 bp, Homo sapiens
caggggccctgcagct

SEQ ID NO: 6028026 - DNA, 17 bp, Homo sapiens
caggggcccttgggaca

SEQ ID NO: 6028027 - DNA, 20 bp, Homo sapiens
caggggccgcttcgccatgt

SEQ ID NO: 6028028 - DNA, 17 bp, Homo sapiens
caggggccggccagtgg

SEQ ID NO: 6028029 - DNA, 22 bp, Homo sapiens
caggggccggccagtggccttc

SEQ ID NO: 6028030 - DNA, 19 bp, Homo sapiens
caggggccgtgcagggcca

SEQ ID NO: 6028031 - DNA, 17 bp, Homo sapiens
caggggcctctctcctg

SEQ ID NO: 6028032 - DNA, 13 bp, Homo sapiens
caggggcctctgt

SEQ ID NO: 6028033 - DNA, 22 bp, Homo sapiens
caggggcctgcagaaggaaaga

SEQ ID NO: 6028034 - DNA, 13 bp, Homo sapiens
caggggcctggag

SEQ ID NO: 6028035 - DNA, 23 bp, Homo sapiens
caggggcctggaggtctggctga

SEQ ID NO: 6028036 - DNA, 22 bp, Homo sapiens
caggggcctttgggtgctgttt

SEQ ID NO: 6028037 - DNA, 18 bp, Homo sapiens
caggggcgctggctgcac

SEQ ID NO: 6028038 - DNA, 22 bp, Homo sapiens
caggggcgtgaggtcccaggaa

SEQ ID NO: 6028039 - DNA, 18 bp, Homo sapiens
caggggcgtgtggctcac

SEQ ID NO: 6028040 - DNA, 23 bp, Homo sapiens
caggggctacgttagcagcccag

SEQ ID NO: 6028041 - DNA, 21 bp, Homo sapiens
cattgacctggaggggagagg

SEQ ID NO: 6028042 - DNA, 18 bp, Homo sapiens
cattgacgattccttctc

SEQ ID NO: 6028043 - DNA, 19 bp, Homo sapiens
cattgacgattccttctct

SEQ ID NO: 6028044 - DNA, 23 bp, Homo sapiens
cattgactatggagtcttgtgaa

SEQ ID NO: 6028045 - DNA, 23 bp, Homo sapiens
cattgactcctttccaatagaaa

SEQ ID NO: 6028046 - DNA, 20 bp, Homo sapiens
cattgactgaactgcacgtt

SEQ ID NO: 6028047 - DNA, 22 bp, Homo sapiens
cattgactggtttacaggccct

SEQ ID NO: 6028048 - DNA, 21 bp, Homo sapiens
cattgacttcaagatgcctct

SEQ ID NO: 6028049 - DNA, 12 bp, Homo sapiens
cattgacttcat

SEQ ID NO: 6028050 - DNA, 19 bp, Homo sapiens
cattgacttcattttatat

SEQ ID NO: 6028051 - DNA, 20 bp, Homo sapiens
cattgactttcagtaaacat

SEQ ID NO: 6028052 - DNA, 22 bp, Homo sapiens
cattgactttcagtaaacataa

SEQ ID NO: 6028053 - DNA, 21 bp, Homo sapiens
cattgactttccccaccagat

SEQ ID NO: 6028054 - DNA, 16 bp, Homo sapiens
cattgagaaactgaat

SEQ ID NO: 6028055 - DNA, 23 bp, Homo sapiens
cattgagaactgcatatgtttcg

SEQ ID NO: 6028056 - DNA, 14 bp, Homo sapiens
cattgagaaggaac

SEQ ID NO: 6028057 - DNA, 18 bp, Homo sapiens
cattgagatcttcctgct

SEQ ID NO: 6028058 - DNA, 19 bp, Homo sapiens
cattgagatcttcctgctg

SEQ ID NO: 6028059 - DNA, 22 bp, Homo sapiens
cattgagatgtgtttttaatgt

SEQ ID NO: 6028060 - DNA, 23 bp, Homo sapiens
cattgagattcacatgctggctc

SEQ ID NO: 6028061 - DNA, 19 bp, Homo sapiens
cattgagcagttagctcat

SEQ ID NO: 6028062 - DNA, 18 bp, Homo sapiens
cattgagctgatataaat

SEQ ID NO: 6028063 - DNA, 20 bp, Homo sapiens
cattgagctgcctccagcct

SEQ ID NO: 6028064 - DNA, 22 bp, Homo sapiens
cattgagctgcctccagcctgg

SEQ ID NO: 6028065 - DNA, 23 bp, Homo sapiens
cattgagctgcctccagcctggt

SEQ ID NO: 6028066 - DNA, 15 bp, Homo sapiens
cattgagctgtttcc

SEQ ID NO: 6028067 - DNA, 15 bp, Homo sapiens
cattgaggaaatatt

SEQ ID NO: 6028068 - DNA, 15 bp, Homo sapiens
cattgagtaatatag

SEQ ID NO: 6028069 - DNA, 13 bp, Homo sapiens
cattgagtagaca

SEQ ID NO: 6028070 - DNA, 10 bp, Homo sapiens
cattgagtat

SEQ ID NO: 6028071 - DNA, 22 bp, Homo sapiens
cattgagtattgtttaaaatgt

SEQ ID NO: 6028072 - DNA, 14 bp, Homo sapiens
cattgataatcttc

SEQ ID NO: 6028073 - DNA, 16 bp, Homo sapiens
cattgataatcttcag

SEQ ID NO: 6028074 - DNA, 20 bp, Homo sapiens
cattgatacaatcatagcat

SEQ ID NO: 6028075 - DNA, 17 bp, Homo sapiens
cattgatatgaaaaata

SEQ ID NO: 6028076 - DNA, 18 bp, Homo sapiens
cattgatatgaaaaatat

SEQ ID NO: 6028077 - DNA, 19 bp, Homo sapiens
cattgatatgaaaaatatg

SEQ ID NO: 6028078 - DNA, 14 bp, Homo sapiens
cattgatattgtga

SEQ ID NO: 6028079 - DNA, 16 bp, Homo sapiens
cattgatattgtgaac

SEQ ID NO: 6028080 - DNA, 22 bp, Homo sapiens
cattgatatttgtgcattttct

SEQ ID NO: 6028081 - DNA, 16 bp, Homo sapiens
cattgatcacagatgt

SEQ ID NO: 6028082 - DNA, 20 bp, Homo sapiens
cattgatcacagatgtgccc

SEQ ID NO: 6028083 - DNA, 23 bp, Homo sapiens
cattgatcatttttatatgaaat

SEQ ID NO: 6028084 - DNA, 18 bp, Homo sapiens
cattgatctgttttacag

SEQ ID NO: 6028085 - DNA, 22 bp, Homo sapiens
cattgatctgttttacaggaaa

SEQ ID NO: 6028086 - DNA, 23 bp, Homo sapiens
cattgatctgttttacaggaaac

SEQ ID NO: 6028087 - DNA, 14 bp, Homo sapiens
cattgatgagcact

SEQ ID NO: 6028088 - DNA, 20 bp, Homo sapiens
cattgatgagcactcctgat

SEQ ID NO: 6028089 - DNA, 21 bp, Homo sapiens
cattgatgagcactcctgatt

SEQ ID NO: 6028090 - DNA, 17 bp, Homo sapiens
cattgatggatgtcttc

SEQ ID NO: 6028091 - DNA, 19 bp, Homo sapiens
cattgatgggatttttgtt

SEQ ID NO: 6028092 - DNA, 13 bp, Homo sapiens
cattgatgtgttc

SEQ ID NO: 6028093 - DNA, 13 bp, Homo sapiens
cattgattggata

SEQ ID NO: 6028094 - DNA, 14 bp, Homo sapiens
cattgatttcctgt

SEQ ID NO: 6028095 - DNA, 15 bp, Homo sapiens
cattgatttctaatg

SEQ ID NO: 6028096 - DNA, 22 bp, Homo sapiens
cattgatttgatttttattatt

SEQ ID NO: 6028097 - DNA, 21 bp, Homo sapiens
cattgcaaaaggttaagccat

SEQ ID NO: 6028098 - DNA, 18 bp, Homo sapiens
cattgcaaaatagaagaa

SEQ ID NO: 6028099 - DNA, 20 bp, Homo sapiens
cattgcaaaatagaagaaga

SEQ ID NO: 6028100 - DNA, 21 bp, Homo sapiens
cattgcaacaaaatacattct

SEQ ID NO: 6028101 - DNA, 14 bp, Homo sapiens
cattgcaacctcca

SEQ ID NO: 6028102 - DNA, 14 bp, Homo sapiens
cattgcaataaatg

SEQ ID NO: 6028103 - DNA, 14 bp, Homo sapiens
cattgcacaatata

SEQ ID NO: 6028104 - DNA, 15 bp, Homo sapiens
cattgcacagagtga

SEQ ID NO: 6028105 - DNA, 21 bp, Homo sapiens
cattgcacataagcttccatt

SEQ ID NO: 6028106 - DNA, 18 bp, Homo sapiens
cattgcacccagcccaga

SEQ ID NO: 6028107 - DNA, 21 bp, Homo sapiens
cattgcacctatctcagccat

SEQ ID NO: 6028108 - DNA, 17 bp, Homo sapiens
cattgcacctgcaggct

SEQ ID NO: 6028109 - DNA, 18 bp, Homo sapiens
cattgcacctgcaggctt

SEQ ID NO: 6028110 - DNA, 23 bp, Homo sapiens
cattgcactaaaagtgatgtgat

SEQ ID NO: 6028111 - DNA, 21 bp, Homo sapiens
cattgcactcatcatattttg

SEQ ID NO: 6028112 - DNA, 19 bp, Homo sapiens
cattgcactccagcctggg

SEQ ID NO: 6028113 - DNA, 18 bp, Homo sapiens
cattgcactctagcctgg

SEQ ID NO: 6028114 - DNA, 23 bp, Homo sapiens
cattgcactctagcctggcaaca

SEQ ID NO: 6028115 - DNA, 20 bp, Homo sapiens
cattgcactctagcctgggc

SEQ ID NO: 6028116 - DNA, 15 bp, Homo sapiens
cattgcactttcctt

SEQ ID NO: 6028117 - DNA, 18 bp, Homo sapiens
cattgcagcagataactt

SEQ ID NO: 6028118 - DNA, 20 bp, Homo sapiens
cattgcagcagataactttt

SEQ ID NO: 6028119 - DNA, 14 bp, Homo sapiens
cattgcagccatga

SEQ ID NO: 6028120 - DNA, 15 bp, Homo sapiens
cattgcagccttgcg

SEQ ID NO: 6028121 - DNA, 22 bp, Homo sapiens
cattgcagccttgcgctgtccc

SEQ ID NO: 6028122 - DNA, 12 bp, Homo sapiens
cattgcaggcca

SEQ ID NO: 6028123 - DNA, 15 bp, Homo sapiens
cattgcagtatcaga

SEQ ID NO: 6028124 - DNA, 17 bp, Homo sapiens
cattgcagtcactttga

SEQ ID NO: 6028125 - DNA, 16 bp, Homo sapiens
cattgcatcaaagcat

SEQ ID NO: 6028126 - DNA, 21 bp, Homo sapiens
cattgcatgccgggtgcagca

SEQ ID NO: 6028127 - DNA, 17 bp, Homo sapiens
cattgcatgtattgtaa

SEQ ID NO: 6028128 - DNA, 19 bp, Homo sapiens
cattgcattcaaaatcttc

SEQ ID NO: 6028129 - DNA, 20 bp, Homo sapiens
cattgcattctattgccttc

SEQ ID NO: 6028130 - DNA, 19 bp, Homo sapiens
cattgccaaggcatcccca

SEQ ID NO: 6028131 - DNA, 15 bp, Homo sapiens
cattgccaagtgcca

SEQ ID NO: 6028132 - DNA, 16 bp, Homo sapiens
cattgccagtggtgtc

SEQ ID NO: 6028133 - DNA, 21 bp, Homo sapiens
cattgccatcaccatttggtg

SEQ ID NO: 6028134 - DNA, 20 bp, Homo sapiens
cattgccatgaatttctacc

SEQ ID NO: 6028135 - DNA, 17 bp, Homo sapiens
cattgccattccctgcc

SEQ ID NO: 6028136 - DNA, 22 bp, Homo sapiens
cattgcccacacctgcctctga

SEQ ID NO: 6028137 - DNA, 11 bp, Homo sapiens
cattgcccagt

SEQ ID NO: 6028138 - DNA, 17 bp, Homo sapiens
cattgcccagtctttca

SEQ ID NO: 6028139 - DNA, 15 bp, Homo sapiens
cattgccccaagata

SEQ ID NO: 6028140 - DNA, 21 bp, Homo sapiens
cattgccccagacctggaaga

SEQ ID NO: 6028141 - DNA, 18 bp, Homo sapiens
cattgcccccacctctgg

SEQ ID NO: 6028142 - DNA, 17 bp, Homo sapiens
cattgcccctctgcctt

SEQ ID NO: 6028143 - DNA, 14 bp, Homo sapiens
cattgccctgaggg

SEQ ID NO: 6028144 - DNA, 12 bp, Homo sapiens
cattgccctggt

SEQ ID NO: 6028145 - DNA, 17 bp, Homo sapiens
cattgccgctgtataaa

SEQ ID NO: 6028146 - DNA, 20 bp, Homo sapiens
cattgcctatttcagtggca

SEQ ID NO: 6028147 - DNA, 11 bp, Homo sapiens
cattgcctcca

SEQ ID NO: 6028148 - DNA, 23 bp, Homo sapiens
cattgcctcctgttctgcccacg

SEQ ID NO: 6028149 - DNA, 19 bp, Homo sapiens
cattgcctcttttcacatt

SEQ ID NO: 6028150 - DNA, 23 bp, Homo sapiens
cattgcctcttttcacatttttt

SEQ ID NO: 6028151 - DNA, 16 bp, Homo sapiens
cattgcctgactaaaa

SEQ ID NO: 6028152 - DNA, 14 bp, Homo sapiens
cattgcctgcggtc

SEQ ID NO: 6028153 - DNA, 17 bp, Homo sapiens
cattgcctggactgacc

SEQ ID NO: 6028154 - DNA, 17 bp, Homo sapiens
cattgcctggccttcct

SEQ ID NO: 6028155 - DNA, 20 bp, Homo sapiens
cattgcctgtaacaatgtaa

SEQ ID NO: 6028156 - DNA, 15 bp, Homo sapiens
cattgcctgttctgc

SEQ ID NO: 6028157 - DNA, 16 bp, Homo sapiens
cattgcctgttctgct

SEQ ID NO: 6028158 - DNA, 18 bp, Homo sapiens
cattgcctgttctgcttc

SEQ ID NO: 6028159 - DNA, 17 bp, Homo sapiens
cattgccttaactggag

SEQ ID NO: 6028160 - DNA, 21 bp, Homo sapiens
cattgccttaactggagcccc

SEQ ID NO: 6028161 - DNA, 13 bp, Homo sapiens
cattgccttcctc

SEQ ID NO: 6028162 - DNA, 23 bp, Homo sapiens
cattgccttctggagctgggaga

SEQ ID NO: 6028163 - DNA, 13 bp, Homo sapiens
cattgccttgagc

SEQ ID NO: 6028164 - DNA, 17 bp, Homo sapiens
cattgcctttgaatgtt

SEQ ID NO: 6028165 - DNA, 21 bp, Homo sapiens
cattgcgctctagcctgggca

SEQ ID NO: 6028166 - DNA, 14 bp, Homo sapiens
cattgcggacagcc

SEQ ID NO: 6028167 - DNA, 15 bp, Homo sapiens
cattgcggacagcca

SEQ ID NO: 6028168 - DNA, 21 bp, Homo sapiens
cattgcggacagccacggcca

SEQ ID NO: 6028169 - DNA, 15 bp, Homo sapiens
cattgcggccccagg

SEQ ID NO: 6028170 - DNA, 17 bp, Homo sapiens
cattgcggccccaggag

SEQ ID NO: 6028171 - DNA, 18 bp, Homo sapiens
cattgcggccccaggagg

SEQ ID NO: 6028172 - DNA, 12 bp, Homo sapiens
cattgctaaaaa

SEQ ID NO: 6028173 - DNA, 22 bp, Homo sapiens
cattgctaaccactgtctgtcc

SEQ ID NO: 6028174 - DNA, 16 bp, Homo sapiens
cattgctaccacagac

SEQ ID NO: 6028175 - DNA, 16 bp, Homo sapiens
cattgctacctcagtg

SEQ ID NO: 6028176 - DNA, 20 bp, Homo sapiens
cattgctactgctcagcttc

SEQ ID NO: 6028177 - DNA, 21 bp, Homo sapiens
cattgctactgctcagcttct

SEQ ID NO: 6028178 - DNA, 15 bp, Homo sapiens
cattgctagataaaa

SEQ ID NO: 6028179 - DNA, 20 bp, Homo sapiens
cattgctagcgagccgcctc

SEQ ID NO: 6028180 - DNA, 17 bp, Homo sapiens
cattgctcagcccgctt

SEQ ID NO: 6028181 - DNA, 16 bp, Homo sapiens
cattgctcccagtgcc

SEQ ID NO: 6028182 - DNA, 19 bp, Homo sapiens
cattgctccctaagactgt

SEQ ID NO: 6028183 - DNA, 11 bp, Homo sapiens
cattgctctct

SEQ ID NO: 6028184 - DNA, 15 bp, Homo sapiens
cattgctctctgggc

SEQ ID NO: 6028185 - DNA, 17 bp, Homo sapiens
cattgctctctgggctt

SEQ ID NO: 6028186 - DNA, 20 bp, Homo sapiens
cattgctcttagtcccaagc

SEQ ID NO: 6028187 - DNA, 17 bp, Homo sapiens
cattgctgagcctctgc

SEQ ID NO: 6028188 - DNA, 13 bp, Homo sapiens
cattgctgctcct

SEQ ID NO: 6028189 - DNA, 15 bp, Homo sapiens
cattgctgctgctac

SEQ ID NO: 6028190 - DNA, 18 bp, Homo sapiens
cattgctgctgctaccag

SEQ ID NO: 6028191 - DNA, 13 bp, Homo sapiens
cattgctggactg

SEQ ID NO: 6028192 - DNA, 13 bp, Homo sapiens
cattgctggctgc

SEQ ID NO: 6028193 - DNA, 18 bp, Homo sapiens
cattgctgggcttgtctg

SEQ ID NO: 6028194 - DNA, 19 bp, Homo sapiens
cattgctggtagagacccc

SEQ ID NO: 6028195 - DNA, 23 bp, Homo sapiens
cattgctggtagagacccccagg

SEQ ID NO: 6028196 - DNA, 16 bp, Homo sapiens
cattgctggtcaagat

SEQ ID NO: 6028197 - DNA, 15 bp, Homo sapiens
cattgctggttctat

SEQ ID NO: 6028198 - DNA, 15 bp, Homo sapiens
cattgctgtccttgg

SEQ ID NO: 6028199 - DNA, 17 bp, Homo sapiens
cattgctgtcttgcccc

SEQ ID NO: 6028200 - DNA, 20 bp, Homo sapiens
cattgctgtgtcacactctg

SEQ ID NO: 6028201 - DNA, 14 bp, Homo sapiens
cattgctgttatgt

SEQ ID NO: 6028202 - DNA, 17 bp, Homo sapiens
cattgctgttatgtctg

SEQ ID NO: 6028203 - DNA, 18 bp, Homo sapiens
cattgctgttgttgcagg

SEQ ID NO: 6028204 - DNA, 18 bp, Homo sapiens
cattgctgttttaatttg

SEQ ID NO: 6028205 - DNA, 21 bp, Homo sapiens
cattgcttattcttgagcaca

SEQ ID NO: 6028206 - DNA, 11 bp, Homo sapiens
cattgcttcac

SEQ ID NO: 6028207 - DNA, 17 bp, Homo sapiens
cattgcttcactaccca

SEQ ID NO: 6028208 - DNA, 14 bp, Homo sapiens
cattgcttcattaa

SEQ ID NO: 6028209 - DNA, 13 bp, Homo sapiens
cattgcttcttct

SEQ ID NO: 6028210 - DNA, 15 bp, Homo sapiens
cattgcttcttctga

SEQ ID NO: 6028211 - DNA, 17 bp, Homo sapiens
cattgctttactgtcaa

SEQ ID NO: 6028212 - DNA, 14 bp, Homo sapiens
cattgctttctgaa

SEQ ID NO: 6028213 - DNA, 18 bp, Homo sapiens
cattgctttgaagcagtt

SEQ ID NO: 6028214 - DNA, 13 bp, Homo sapiens
cattgcttttgaa

SEQ ID NO: 6028215 - DNA, 18 bp, Homo sapiens
cattgcttttgtttctta

SEQ ID NO: 6028216 - DNA, 21 bp, Homo sapiens
cattggaaatttagcattgta

SEQ ID NO: 6028217 - DNA, 16 bp, Homo sapiens
cattggaactggaggc

SEQ ID NO: 6028218 - DNA, 15 bp, Homo sapiens
cattggaagacccca

SEQ ID NO: 6028219 - DNA, 14 bp, Homo sapiens
caggggctcaggat

SEQ ID NO: 6028220 - DNA, 15 bp, Homo sapiens
caggggctcaggata

SEQ ID NO: 6028221 - DNA, 11 bp, Homo sapiens
caggggctcca

SEQ ID NO: 6028222 - DNA, 22 bp, Homo sapiens
caggggctccatgctgggtctg

SEQ ID NO: 6028223 - DNA, 23 bp, Homo sapiens
caggggctccatgctgggtctga

SEQ ID NO: 6028224 - DNA, 15 bp, Homo sapiens
caggggctccccggg

SEQ ID NO: 6028225 - DNA, 18 bp, Homo sapiens
caggggctccctccgccc

SEQ ID NO: 6028226 - DNA, 21 bp, Homo sapiens
caggggctcctgggttggagg

SEQ ID NO: 6028227 - DNA, 13 bp, Homo sapiens
caggggctctgct

SEQ ID NO: 6028228 - DNA, 19 bp, Homo sapiens
caggggctctgcttcctca

SEQ ID NO: 6028229 - DNA, 19 bp, Homo sapiens
caggggctctggagagaaa

SEQ ID NO: 6028230 - DNA, 13 bp, Homo sapiens
caggggctctgtg

SEQ ID NO: 6028231 - DNA, 14 bp, Homo sapiens
caggggctctgtgt

SEQ ID NO: 6028232 - DNA, 19 bp, Homo sapiens
caggggctgacacttcaag

SEQ ID NO: 6028233 - DNA, 21 bp, Homo sapiens
caggggctgactctccaggga

SEQ ID NO: 6028234 - DNA, 15 bp, Homo sapiens
caggggctgcagccc

SEQ ID NO: 6028235 - DNA, 19 bp, Homo sapiens
caggggctgcagccccctg

SEQ ID NO: 6028236 - DNA, 23 bp, Homo sapiens
caggggctgcagccccctgcttc

SEQ ID NO: 6028237 - DNA, 14 bp, Homo sapiens
caggggctgcccgc

SEQ ID NO: 6028238 - DNA, 19 bp, Homo sapiens
caggggctgcccgctccca

SEQ ID NO: 6028239 - DNA, 15 bp, Homo sapiens
caggggctgctcatc

SEQ ID NO: 6028240 - DNA, 13 bp, Homo sapiens
caggggctgctgc

SEQ ID NO: 6028241 - DNA, 14 bp, Homo sapiens
caggggctgctggg

SEQ ID NO: 6028242 - DNA, 15 bp, Homo sapiens
caggggctgctgggg

SEQ ID NO: 6028243 - DNA, 17 bp, Homo sapiens
caggggctgctgggggc

SEQ ID NO: 6028244 - DNA, 23 bp, Homo sapiens
caggggctgctgggggctcccct

SEQ ID NO: 6028245 - DNA, 13 bp, Homo sapiens
caggggctggctt

SEQ ID NO: 6028246 - DNA, 17 bp, Homo sapiens
caggggctggcttcagg

SEQ ID NO: 6028247 - DNA, 16 bp, Homo sapiens
caggggctgggcagag

SEQ ID NO: 6028248 - DNA, 20 bp, Homo sapiens
caggggctgggcagagggga

SEQ ID NO: 6028249 - DNA, 23 bp, Homo sapiens
caggggctgggcatcccagcttg

SEQ ID NO: 6028250 - DNA, 17 bp, Homo sapiens
caggggctgggctccct

SEQ ID NO: 6028251 - DNA, 23 bp, Homo sapiens
caggggctgggggtgctggatgg

SEQ ID NO: 6028252 - DNA, 12 bp, Homo sapiens
caggggctgttt

SEQ ID NO: 6028253 - DNA, 15 bp, Homo sapiens
caggggctgtttgag

SEQ ID NO: 6028254 - DNA, 16 bp, Homo sapiens
caggggcttgactttt

SEQ ID NO: 6028255 - DNA, 17 bp, Homo sapiens
caggggcttgagaaggt

SEQ ID NO: 6028256 - DNA, 14 bp, Homo sapiens
caggggcttggctg

SEQ ID NO: 6028257 - DNA, 18 bp, Homo sapiens
caggggcttggctgcccc

SEQ ID NO: 6028258 - DNA, 19 bp, Homo sapiens
caggggcttggctgcccca

SEQ ID NO: 6028259 - DNA, 18 bp, Homo sapiens
caggggctttgggcccaa

SEQ ID NO: 6028260 - DNA, 20 bp, Homo sapiens
caggggctttgggcccaaga

SEQ ID NO: 6028261 - DNA, 21 bp, Homo sapiens
cagggggaagaagcagagaga

SEQ ID NO: 6028262 - DNA, 15 bp, Homo sapiens
cagggggaagcacca

SEQ ID NO: 6028263 - DNA, 11 bp, Homo sapiens
cagggggaagg

SEQ ID NO: 6028264 - DNA, 18 bp, Homo sapiens
cagggggactagcccctg

SEQ ID NO: 6028265 - DNA, 22 bp, Homo sapiens
cagggggatatgggtcctctgg

SEQ ID NO: 6028266 - DNA, 22 bp, Homo sapiens
cagggggatgccactcctccct

SEQ ID NO: 6028267 - DNA, 16 bp, Homo sapiens
cagggggattctgagc

SEQ ID NO: 6028268 - DNA, 18 bp, Homo sapiens
cagggggcaactgacatt

SEQ ID NO: 6028269 - DNA, 12 bp, Homo sapiens
cagggggccagc

SEQ ID NO: 6028270 - DNA, 14 bp, Homo sapiens
cagggggccagctg

SEQ ID NO: 6028271 - DNA, 19 bp, Homo sapiens
cagggggccagctggggag

SEQ ID NO: 6028272 - DNA, 22 bp, Homo sapiens
cagggggccagctggggagatg

SEQ ID NO: 6028273 - DNA, 24 bp, Homo sapiens
cagggggccagctggggagatggg

SEQ ID NO: 6028274 - DNA, 13 bp, Homo sapiens
cagggggccaggt

SEQ ID NO: 6028275 - DNA, 19 bp, Homo sapiens
cagggggccaggtgcacag

SEQ ID NO: 6028276 - DNA, 21 bp, Homo sapiens
cagggggcccaccagagctgt

SEQ ID NO: 6028277 - DNA, 19 bp, Homo sapiens
cagggggccccgccagggc

SEQ ID NO: 6028278 - DNA, 21 bp, Homo sapiens
cagggggccccgccagggctg

SEQ ID NO: 6028279 - DNA, 23 bp, Homo sapiens
cagggggccccgccagggctggg

SEQ ID NO: 6028280 - DNA, 20 bp, Homo sapiens
cagggggcccgaacagggac

SEQ ID NO: 6028281 - DNA, 15 bp, Homo sapiens
cagggggccctgccc

SEQ ID NO: 6028282 - DNA, 14 bp, Homo sapiens
cagggggcctggag

SEQ ID NO: 6028283 - DNA, 15 bp, Homo sapiens
cagggggcctggagc

SEQ ID NO: 6028284 - DNA, 16 bp, Homo sapiens
cagggggcctggagca

SEQ ID NO: 6028285 - DNA, 21 bp, Homo sapiens
cagggggcctttaaagactta

SEQ ID NO: 6028286 - DNA, 12 bp, Homo sapiens
cagggggctgct

SEQ ID NO: 6028287 - DNA, 18 bp, Homo sapiens
cagggggctgctgctggg

SEQ ID NO: 6028288 - DNA, 23 bp, Homo sapiens
cagggggctgctgctgggctcag

SEQ ID NO: 6028289 - DNA, 12 bp, Homo sapiens
cagggggcttcc

SEQ ID NO: 6028290 - DNA, 13 bp, Homo sapiens
cagggggcttcct

SEQ ID NO: 6028291 - DNA, 14 bp, Homo sapiens
caggggggaggcac

SEQ ID NO: 6028292 - DNA, 14 bp, Homo sapiens
caggggggcctcct

SEQ ID NO: 6028293 - DNA, 19 bp, Homo sapiens
caggggggtgaggagctgg

SEQ ID NO: 6028294 - DNA, 21 bp, Homo sapiens
caggggggttgggttccagac

SEQ ID NO: 6028295 - DNA, 14 bp, Homo sapiens
cagggggtctggct

SEQ ID NO: 6028296 - DNA, 21 bp, Homo sapiens
cagggggtgaagaaccctctg

SEQ ID NO: 6028297 - DNA, 22 bp, Homo sapiens
cagggggtgaagaaccctctgt

SEQ ID NO: 6028298 - DNA, 16 bp, Homo sapiens
cagggggtgccctccc

SEQ ID NO: 6028299 - DNA, 22 bp, Homo sapiens
cagggggtgccctcccagaccc

SEQ ID NO: 6028300 - DNA, 20 bp, Homo sapiens
cagggggtgggaaggggatg

SEQ ID NO: 6028301 - DNA, 22 bp, Homo sapiens
cagggggtgggaaggggatgga

SEQ ID NO: 6028302 - DNA, 16 bp, Homo sapiens
cagggggtgtgtctgc

SEQ ID NO: 6028303 - DNA, 15 bp, Homo sapiens
cagggggtttgagga

SEQ ID NO: 6028304 - DNA, 16 bp, Homo sapiens
caggggtaacctggcc

SEQ ID NO: 6028305 - DNA, 17 bp, Homo sapiens
caggggtaacctggcca

SEQ ID NO: 6028306 - DNA, 16 bp, Homo sapiens
caggggtaccaggcac

SEQ ID NO: 6028307 - DNA, 19 bp, Homo sapiens
caggggtaccaggcacatg

SEQ ID NO: 6028308 - DNA, 19 bp, Homo sapiens
caggggtcaggtgtcaggc

SEQ ID NO: 6028309 - DNA, 20 bp, Homo sapiens
caggggtcaggtgtcaggcc

SEQ ID NO: 6028310 - DNA, 21 bp, Homo sapiens
caggggtcaggtgtcaggccc

SEQ ID NO: 6028311 - DNA, 21 bp, Homo sapiens
caggggtcccctggcagggga

SEQ ID NO: 6028312 - DNA, 16 bp, Homo sapiens
caggggtccctgctag

SEQ ID NO: 6028313 - DNA, 15 bp, Homo sapiens
caggggtcctgcagg

SEQ ID NO: 6028314 - DNA, 19 bp, Homo sapiens
caggggtcctgcaggtcct

SEQ ID NO: 6028315 - DNA, 13 bp, Homo sapiens
caggggtctccct

SEQ ID NO: 6028316 - DNA, 18 bp, Homo sapiens
caggggtctccctgagcc

SEQ ID NO: 6028317 - DNA, 20 bp, Homo sapiens
caggggtctccctgagcctg

SEQ ID NO: 6028318 - DNA, 17 bp, Homo sapiens
caggggtctccctggag

SEQ ID NO: 6028319 - DNA, 16 bp, Homo sapiens
caggggtctccctggc

SEQ ID NO: 6028320 - DNA, 17 bp, Homo sapiens
caggggtctccctggct

SEQ ID NO: 6028321 - DNA, 18 bp, Homo sapiens
caggggtctccctggctc

SEQ ID NO: 6028322 - DNA, 20 bp, Homo sapiens
caggggtctccctggctccc

SEQ ID NO: 6028323 - DNA, 13 bp, Homo sapiens
caggggtctgagc

SEQ ID NO: 6028324 - DNA, 19 bp, Homo sapiens
caggggtctgagctccagc

SEQ ID NO: 6028325 - DNA, 21 bp, Homo sapiens
caggggtctgagctccagctc

SEQ ID NO: 6028326 - DNA, 13 bp, Homo sapiens
caggggtctggga

SEQ ID NO: 6028327 - DNA, 18 bp, Homo sapiens
caggggtctgggagtcag

SEQ ID NO: 6028328 - DNA, 14 bp, Homo sapiens
caggggtctgtctg

SEQ ID NO: 6028329 - DNA, 16 bp, Homo sapiens
caggggtgacacagac

SEQ ID NO: 6028330 - DNA, 15 bp, Homo sapiens
caggggtgagacctg

SEQ ID NO: 6028331 - DNA, 13 bp, Homo sapiens
caggggtgagagc

SEQ ID NO: 6028332 - DNA, 14 bp, Homo sapiens
caggggtgagagca

SEQ ID NO: 6028333 - DNA, 20 bp, Homo sapiens
caggggtgagagcacccact

SEQ ID NO: 6028334 - DNA, 13 bp, Homo sapiens
caggggtgagccc

SEQ ID NO: 6028335 - DNA, 23 bp, Homo sapiens
caggggtgcacaataaagggggt

SEQ ID NO: 6028336 - DNA, 16 bp, Homo sapiens
caggggtgcacagtcc

SEQ ID NO: 6028337 - DNA, 15 bp, Homo sapiens
caggggtgccccctc

SEQ ID NO: 6028338 - DNA, 16 bp, Homo sapiens
caggggtgccccctcc

SEQ ID NO: 6028339 - DNA, 17 bp, Homo sapiens
caggggtgccccctcct

SEQ ID NO: 6028340 - DNA, 22 bp, Homo sapiens
caggggtgccccctcctctccc

SEQ ID NO: 6028341 - DNA, 23 bp, Homo sapiens
caggggtgccccctcctctccca

SEQ ID NO: 6028342 - DNA, 13 bp, Homo sapiens
caggggtgctcct

SEQ ID NO: 6028343 - DNA, 16 bp, Homo sapiens
caggggtgctcctgtg

SEQ ID NO: 6028344 - DNA, 15 bp, Homo sapiens
caggggtgctgtgga

SEQ ID NO: 6028345 - DNA, 13 bp, Homo sapiens
caggggtggagga

SEQ ID NO: 6028346 - DNA, 17 bp, Homo sapiens
caggggtggaggagagc

SEQ ID NO: 6028347 - DNA, 22 bp, Homo sapiens
caggggtggaggagagcctggt

SEQ ID NO: 6028348 - DNA, 18 bp, Homo sapiens
caggggtggagtttctga

SEQ ID NO: 6028349 - DNA, 22 bp, Homo sapiens
caggggtggctgcctcatttag

SEQ ID NO: 6028350 - DNA, 15 bp, Homo sapiens
caggggtgggacacc

SEQ ID NO: 6028351 - DNA, 21 bp, Homo sapiens
caggggtgggacaccctgtga

SEQ ID NO: 6028352 - DNA, 21 bp, Homo sapiens
caggggtgggagagccagctc

SEQ ID NO: 6028353 - DNA, 22 bp, Homo sapiens
caggggtgggagagccagctct

SEQ ID NO: 6028354 - DNA, 17 bp, Homo sapiens
caggggtgggaggctcc

SEQ ID NO: 6028355 - DNA, 20 bp, Homo sapiens
caggggtgggaggctcccag

SEQ ID NO: 6028356 - DNA, 17 bp, Homo sapiens
caggggtggggcccatg

SEQ ID NO: 6028357 - DNA, 22 bp, Homo sapiens
caggggtggggggtgcaggtgg

SEQ ID NO: 6028358 - DNA, 22 bp, Homo sapiens
caggggtgggggtggaggcttc

SEQ ID NO: 6028359 - DNA, 15 bp, Homo sapiens
caggggtggtggagg

SEQ ID NO: 6028360 - DNA, 22 bp, Homo sapiens
caggggtggtggagggggctgg

SEQ ID NO: 6028361 - DNA, 14 bp, Homo sapiens
caggggtgtcccag

SEQ ID NO: 6028362 - DNA, 21 bp, Homo sapiens
caggggttcgagaccagtctg

SEQ ID NO: 6028363 - DNA, 22 bp, Homo sapiens
caggggttgcagtgagcggaga

SEQ ID NO: 6028364 - DNA, 18 bp, Homo sapiens
caggggttggcagcgcct

SEQ ID NO: 6028365 - DNA, 15 bp, Homo sapiens
caggggttggtcaag

SEQ ID NO: 6028366 - DNA, 18 bp, Homo sapiens
caggggttggtcaaggcc

SEQ ID NO: 6028367 - DNA, 13 bp, Homo sapiens
caggggtttctcg

SEQ ID NO: 6028368 - DNA, 22 bp, Homo sapiens
caggggtttgggtgggggctgt

SEQ ID NO: 6028369 - DNA, 23 bp, Homo sapiens
caggggtttgggtgggggctgtg

SEQ ID NO: 6028370 - DNA, 21 bp, Homo sapiens
cagggtaagctgctctgaggt

SEQ ID NO: 6028371 - DNA, 22 bp, Homo sapiens
cagggtaagctggtgttataat

SEQ ID NO: 6028372 - DNA, 23 bp, Homo sapiens
cagggtacccgcctgagctcctg

SEQ ID NO: 6028373 - DNA, 19 bp, Homo sapiens
cagggtaccctttggggag

SEQ ID NO: 6028374 - DNA, 22 bp, Homo sapiens
cagggtaccctttggggagcag

SEQ ID NO: 6028375 - DNA, 14 bp, Homo sapiens
cagggtacctcaag

SEQ ID NO: 6028376 - DNA, 19 bp, Homo sapiens
cagggtagactaaaaaggc

SEQ ID NO: 6028377 - DNA, 15 bp, Homo sapiens
cagggtagagcaaag

SEQ ID NO: 6028378 - DNA, 19 bp, Homo sapiens
cagggtagatttctcttgg

SEQ ID NO: 6028379 - DNA, 19 bp, Homo sapiens
cagggtagcagcagaggca

SEQ ID NO: 6028380 - DNA, 16 bp, Homo sapiens
cagggtagcaggtacc

SEQ ID NO: 6028381 - DNA, 20 bp, Homo sapiens
cagggtagcccgcctgccag

SEQ ID NO: 6028382 - DNA, 13 bp, Homo sapiens
cagggtagcctga

SEQ ID NO: 6028383 - DNA, 18 bp, Homo sapiens
cagggtagggggcctgag

SEQ ID NO: 6028384 - DNA, 17 bp, Homo sapiens
cagggtaggtttgtgtc

SEQ ID NO: 6028385 - DNA, 15 bp, Homo sapiens
cagggtagtgcaggg

SEQ ID NO: 6028386 - DNA, 17 bp, Homo sapiens
cagggtatcccagaccc

SEQ ID NO: 6028387 - DNA, 21 bp, Homo sapiens
cagggtattccagagtgggga

SEQ ID NO: 6028388 - DNA, 21 bp, Homo sapiens
cagggtcaaagtgttttctct

SEQ ID NO: 6028389 - DNA, 14 bp, Homo sapiens
cagggtcaactggc

SEQ ID NO: 6028390 - DNA, 19 bp, Homo sapiens
cagggtcactgaaccactg

SEQ ID NO: 6028391 - DNA, 10 bp, Homo sapiens
cagggtcaga

SEQ ID NO: 6028392 - DNA, 14 bp, Homo sapiens
cagggtcaggcgga

SEQ ID NO: 6028393 - DNA, 21 bp, Homo sapiens
cagggtcataagtggggagag

SEQ ID NO: 6028394 - DNA, 18 bp, Homo sapiens
cagggtcatgtttgcagg

SEQ ID NO: 6028395 - DNA, 19 bp, Homo sapiens
cagggtcattatcagaaca

SEQ ID NO: 6028396 - DNA, 16 bp, Homo sapiens
cattggaagaccccac

SEQ ID NO: 6028397 - DNA, 20 bp, Homo sapiens
cattggaagaccccacccaa

SEQ ID NO: 6028398 - DNA, 20 bp, Homo sapiens
cattggaagagcagcacctc

SEQ ID NO: 6028399 - DNA, 14 bp, Homo sapiens
cattggaagagccc

SEQ ID NO: 6028400 - DNA, 17 bp, Homo sapiens
cattggaatgccttgga

SEQ ID NO: 6028401 - DNA, 16 bp, Homo sapiens
cattggacccttccat

SEQ ID NO: 6028402 - DNA, 16 bp, Homo sapiens
cattggagagctgtct

SEQ ID NO: 6028403 - DNA, 15 bp, Homo sapiens
cattggagcattttc

SEQ ID NO: 6028404 - DNA, 10 bp, Homo sapiens
cattggagct

SEQ ID NO: 6028405 - DNA, 16 bp, Homo sapiens
cattggagctgactgt

SEQ ID NO: 6028406 - DNA, 22 bp, Homo sapiens
cattggagctgactgttcttgg

SEQ ID NO: 6028407 - DNA, 23 bp, Homo sapiens
cattggagtctcatttgggctag

SEQ ID NO: 6028408 - DNA, 17 bp, Homo sapiens
cattggatacagcagta

SEQ ID NO: 6028409 - DNA, 14 bp, Homo sapiens
cattggatgcattt

SEQ ID NO: 6028410 - DNA, 18 bp, Homo sapiens
cattggatgcatttctat

SEQ ID NO: 6028411 - DNA, 17 bp, Homo sapiens
cattggattatcctgag

SEQ ID NO: 6028412 - DNA, 20 bp, Homo sapiens
cattggattctgagagctgt

SEQ ID NO: 6028413 - DNA, 14 bp, Homo sapiens
cattggatttttgt

SEQ ID NO: 6028414 - DNA, 12 bp, Homo sapiens
cattggcaaagt

SEQ ID NO: 6028415 - DNA, 18 bp, Homo sapiens
cattggcaagatgaaata

SEQ ID NO: 6028416 - DNA, 21 bp, Homo sapiens
cattggcaagatgaaataatt

SEQ ID NO: 6028417 - DNA, 21 bp, Homo sapiens
cattggcacctaatccaggca

SEQ ID NO: 6028418 - DNA, 14 bp, Homo sapiens
cattggcagcaggt

SEQ ID NO: 6028419 - DNA, 17 bp, Homo sapiens
cattggcagcaggtgct

SEQ ID NO: 6028420 - DNA, 23 bp, Homo sapiens
cattggcagcaggtgctgctacc

SEQ ID NO: 6028421 - DNA, 24 bp, Homo sapiens
cattggcagcaggtgctgctaccc

SEQ ID NO: 6028422 - DNA, 17 bp, Homo sapiens
cattggcatctgctttt

SEQ ID NO: 6028423 - DNA, 19 bp, Homo sapiens
cattggccagctcataaaa

SEQ ID NO: 6028424 - DNA, 15 bp, Homo sapiens
cattggcccctgagc

SEQ ID NO: 6028425 - DNA, 21 bp, Homo sapiens
cattggcccctgagcccagag

SEQ ID NO: 6028426 - DNA, 16 bp, Homo sapiens
cattggcctctgtacc

SEQ ID NO: 6028427 - DNA, 16 bp, Homo sapiens
cattggcctctgtctc

SEQ ID NO: 6028428 - DNA, 12 bp, Homo sapiens
cattggcctctt

SEQ ID NO: 6028429 - DNA, 15 bp, Homo sapiens
cattggcctcttgtc

SEQ ID NO: 6028430 - DNA, 19 bp, Homo sapiens
cattggcctcttgtccctt

SEQ ID NO: 6028431 - DNA, 15 bp, Homo sapiens
cattggcctggcctc

SEQ ID NO: 6028432 - DNA, 21 bp, Homo sapiens
cattggccttaactggccctc

SEQ ID NO: 6028433 - DNA, 22 bp, Homo sapiens
cattggccttaactggccctcg

SEQ ID NO: 6028434 - DNA, 23 bp, Homo sapiens
cattggccttaactggccctcgg

SEQ ID NO: 6028435 - DNA, 20 bp, Homo sapiens
cattggctatataaaatgtg

SEQ ID NO: 6028436 - DNA, 19 bp, Homo sapiens
cattggctatttaaaactt

SEQ ID NO: 6028437 - DNA, 14 bp, Homo sapiens
cattggctttctct

SEQ ID NO: 6028438 - DNA, 23 bp, Homo sapiens
cattgggaaggggacccccgccc

SEQ ID NO: 6028439 - DNA, 17 bp, Homo sapiens
cattgggaccctccagt

SEQ ID NO: 6028440 - DNA, 20 bp, Homo sapiens
cattgggaccctccagtgct

SEQ ID NO: 6028441 - DNA, 23 bp, Homo sapiens
cattgggcagcgcccttcctctc

SEQ ID NO: 6028442 - DNA, 15 bp, Homo sapiens
cattggggttcctct

SEQ ID NO: 6028443 - DNA, 18 bp, Homo sapiens
cattgggtctattccagc

SEQ ID NO: 6028444 - DNA, 21 bp, Homo sapiens
cattgggtctattccagctca

SEQ ID NO: 6028445 - DNA, 20 bp, Homo sapiens
cattgggtgaggtaataaac

SEQ ID NO: 6028446 - DNA, 15 bp, Homo sapiens
cattgggtggggctc

SEQ ID NO: 6028447 - DNA, 23 bp, Homo sapiens
cattgggttgtagccaaaggttc

SEQ ID NO: 6028448 - DNA, 17 bp, Homo sapiens
cattgggtttggggcca

SEQ ID NO: 6028449 - DNA, 21 bp, Homo sapiens
cattgggtttggggccatggt

SEQ ID NO: 6028450 - DNA, 23 bp, Homo sapiens
cattggtacacgtgtaacaagaa

SEQ ID NO: 6028451 - DNA, 13 bp, Homo sapiens
cattggtccaaga

SEQ ID NO: 6028452 - DNA, 14 bp, Homo sapiens
cattggtctgcatg

SEQ ID NO: 6028453 - DNA, 13 bp, Homo sapiens
cattggtcttctt

SEQ ID NO: 6028454 - DNA, 22 bp, Homo sapiens
cattggtgaagtaaattaggca

SEQ ID NO: 6028455 - DNA, 14 bp, Homo sapiens
cattggtgactcac

SEQ ID NO: 6028456 - DNA, 14 bp, Homo sapiens
cattggtggactac

SEQ ID NO: 6028457 - DNA, 16 bp, Homo sapiens
cattggtgtactgtgt

SEQ ID NO: 6028458 - DNA, 17 bp, Homo sapiens
cattggtgttgtactca

SEQ ID NO: 6028459 - DNA, 17 bp, Homo sapiens
cattggttaaaatatta

SEQ ID NO: 6028460 - DNA, 14 bp, Homo sapiens
cattggttacaaat

SEQ ID NO: 6028461 - DNA, 21 bp, Homo sapiens
cattggttacaaatttttact

SEQ ID NO: 6028462 - DNA, 16 bp, Homo sapiens
cattggttcacctgtg

SEQ ID NO: 6028463 - DNA, 21 bp, Homo sapiens
cattggttcttcctttccctg

SEQ ID NO: 6028464 - DNA, 23 bp, Homo sapiens
cattggttcttcctttccctgga

SEQ ID NO: 6028465 - DNA, 14 bp, Homo sapiens
cattggttcttgta

SEQ ID NO: 6028466 - DNA, 18 bp, Homo sapiens
cattggtttgagaaaggc

SEQ ID NO: 6028467 - DNA, 21 bp, Homo sapiens
cattgtaaaagcattttgtaa

SEQ ID NO: 6028468 - DNA, 15 bp, Homo sapiens
cattgtaaaataatt

SEQ ID NO: 6028469 - DNA, 16 bp, Homo sapiens
cattgtaaaataattc

SEQ ID NO: 6028470 - DNA, 15 bp, Homo sapiens
cattgtaaacaaact

SEQ ID NO: 6028471 - DNA, 13 bp, Homo sapiens
cattgtaaaccac

SEQ ID NO: 6028472 - DNA, 19 bp, Homo sapiens
cattgtaaagtatgtgagt

SEQ ID NO: 6028473 - DNA, 18 bp, Homo sapiens
cattgtaaataaattttg

SEQ ID NO: 6028474 - DNA, 15 bp, Homo sapiens
cattgtaaatctgaa

SEQ ID NO: 6028475 - DNA, 18 bp, Homo sapiens
cattgtaaatgaacataa

SEQ ID NO: 6028476 - DNA, 14 bp, Homo sapiens
cattgtaaattatt

SEQ ID NO: 6028477 - DNA, 21 bp, Homo sapiens
cattgtaagcgtatggcttta

SEQ ID NO: 6028478 - DNA, 20 bp, Homo sapiens
cattgtaatattaactaaat

SEQ ID NO: 6028479 - DNA, 15 bp, Homo sapiens
cattgtaatctgctt

SEQ ID NO: 6028480 - DNA, 22 bp, Homo sapiens
cattgtaatctttcatagccat

SEQ ID NO: 6028481 - DNA, 17 bp, Homo sapiens
cattgtaatgttactga

SEQ ID NO: 6028482 - DNA, 21 bp, Homo sapiens
cattgtaatgttactgatcat

SEQ ID NO: 6028483 - DNA, 16 bp, Homo sapiens
cattgtaattatgtaa

SEQ ID NO: 6028484 - DNA, 21 bp, Homo sapiens
cattgtaattatgtaaataac

SEQ ID NO: 6028485 - DNA, 19 bp, Homo sapiens
cattgtacagtttgtttac

SEQ ID NO: 6028486 - DNA, 20 bp, Homo sapiens
cattgtacagtttgtttaca

SEQ ID NO: 6028487 - DNA, 15 bp, Homo sapiens
cattgtactacctgt

SEQ ID NO: 6028488 - DNA, 22 bp, Homo sapiens
cattgtactccagcctgggtga

SEQ ID NO: 6028489 - DNA, 13 bp, Homo sapiens
cattgtactgttg

SEQ ID NO: 6028490 - DNA, 18 bp, Homo sapiens
cattgtactgttgcttta

SEQ ID NO: 6028491 - DNA, 21 bp, Homo sapiens
cattgtagaaacacagttttg

SEQ ID NO: 6028492 - DNA, 20 bp, Homo sapiens
cattgtagagcacatttagt

SEQ ID NO: 6028493 - DNA, 17 bp, Homo sapiens
cattgtagagcttctgg

SEQ ID NO: 6028494 - DNA, 19 bp, Homo sapiens
cattgtagagcttctggca

SEQ ID NO: 6028495 - DNA, 23 bp, Homo sapiens
cattgtagagcttggtggctgag

SEQ ID NO: 6028496 - DNA, 18 bp, Homo sapiens
cattgtagtgctttgaga

SEQ ID NO: 6028497 - DNA, 20 bp, Homo sapiens
cattgtagtgctttgagaga

SEQ ID NO: 6028498 - DNA, 15 bp, Homo sapiens
cattgtatatatgtg

SEQ ID NO: 6028499 - DNA, 16 bp, Homo sapiens
cattgtatatatgtgt

SEQ ID NO: 6028500 - DNA, 15 bp, Homo sapiens
cattgtatctgtctt

SEQ ID NO: 6028501 - DNA, 15 bp, Homo sapiens
cattgtatgatgtgt

SEQ ID NO: 6028502 - DNA, 16 bp, Homo sapiens
cattgtatgatgtgtt

SEQ ID NO: 6028503 - DNA, 17 bp, Homo sapiens
cattgtatgatgtgttg

SEQ ID NO: 6028504 - DNA, 18 bp, Homo sapiens
cattgtatgatgtgttgt

SEQ ID NO: 6028505 - DNA, 18 bp, Homo sapiens
cattgtatgcagggagca

SEQ ID NO: 6028506 - DNA, 15 bp, Homo sapiens
cattgtatgtatcta

SEQ ID NO: 6028507 - DNA, 16 bp, Homo sapiens
cattgtatgtatctat

SEQ ID NO: 6028508 - DNA, 13 bp, Homo sapiens
cattgtatgttaa

SEQ ID NO: 6028509 - DNA, 17 bp, Homo sapiens
cattgtatttaaaacat

SEQ ID NO: 6028510 - DNA, 22 bp, Homo sapiens
cattgtatttaaaacatttcat

SEQ ID NO: 6028511 - DNA, 18 bp, Homo sapiens
cattgtcaaagcttgccg

SEQ ID NO: 6028512 - DNA, 18 bp, Homo sapiens
cattgtcaccgcaggtgc

SEQ ID NO: 6028513 - DNA, 15 bp, Homo sapiens
cattgtcataagtaa

SEQ ID NO: 6028514 - DNA, 14 bp, Homo sapiens
cattgtccaaagtt

SEQ ID NO: 6028515 - DNA, 14 bp, Homo sapiens
cattgtccagagct

SEQ ID NO: 6028516 - DNA, 15 bp, Homo sapiens
cattgtccagagctg

SEQ ID NO: 6028517 - DNA, 18 bp, Homo sapiens
cattgtccctctgcccca

SEQ ID NO: 6028518 - DNA, 18 bp, Homo sapiens
cattgtccctcttcactc

SEQ ID NO: 6028519 - DNA, 19 bp, Homo sapiens
cattgtcctaagaacaatg

SEQ ID NO: 6028520 - DNA, 16 bp, Homo sapiens
cattgtcctccttttc

SEQ ID NO: 6028521 - DNA, 13 bp, Homo sapiens
cattgtcctgtga

SEQ ID NO: 6028522 - DNA, 22 bp, Homo sapiens
cattgtcgtataggcatgtaaa

SEQ ID NO: 6028523 - DNA, 14 bp, Homo sapiens
cattgtctcagagc

SEQ ID NO: 6028524 - DNA, 16 bp, Homo sapiens
cattgtctcagtgctg

SEQ ID NO: 6028525 - DNA, 12 bp, Homo sapiens
cattgtcttcca

SEQ ID NO: 6028526 - DNA, 13 bp, Homo sapiens
cattgtcttccaa

SEQ ID NO: 6028527 - DNA, 15 bp, Homo sapiens
cattgtcttccaacc

SEQ ID NO: 6028528 - DNA, 19 bp, Homo sapiens
cattgtcttccaaccccag

SEQ ID NO: 6028529 - DNA, 20 bp, Homo sapiens
cattgtcttccaaccccagc

SEQ ID NO: 6028530 - DNA, 23 bp, Homo sapiens
cattgtcttccaaccccagctgg

SEQ ID NO: 6028531 - DNA, 20 bp, Homo sapiens
cattgtcttgttatgtacaa

SEQ ID NO: 6028532 - DNA, 15 bp, Homo sapiens
cattgtcttgttctg

SEQ ID NO: 6028533 - DNA, 15 bp, Homo sapiens
cattgtctttatatg

SEQ ID NO: 6028534 - DNA, 16 bp, Homo sapiens
cattgtctttatatga

SEQ ID NO: 6028535 - DNA, 18 bp, Homo sapiens
cattgtctttcctccctt

SEQ ID NO: 6028536 - DNA, 13 bp, Homo sapiens
cattgtctttgct

SEQ ID NO: 6028537 - DNA, 20 bp, Homo sapiens
cattgtctttgctgtactct

SEQ ID NO: 6028538 - DNA, 18 bp, Homo sapiens
cattgtgaactgacaggc

SEQ ID NO: 6028539 - DNA, 12 bp, Homo sapiens
cattgtgaatgc

SEQ ID NO: 6028540 - DNA, 20 bp, Homo sapiens
cattgtgaattgcctgccat

SEQ ID NO: 6028541 - DNA, 18 bp, Homo sapiens
cattgtgacaaacagcta

SEQ ID NO: 6028542 - DNA, 19 bp, Homo sapiens
cattgtgactttgctttga

SEQ ID NO: 6028543 - DNA, 15 bp, Homo sapiens
cattgtgagctctgg

SEQ ID NO: 6028544 - DNA, 22 bp, Homo sapiens
cattgtgatgtatattcctttg

SEQ ID NO: 6028545 - DNA, 18 bp, Homo sapiens
cattgtgattggcctgta

SEQ ID NO: 6028546 - DNA, 15 bp, Homo sapiens
cattgtgccaagcct

SEQ ID NO: 6028547 - DNA, 18 bp, Homo sapiens
cattgtgccaagccttct

SEQ ID NO: 6028548 - DNA, 22 bp, Homo sapiens
cattgtgccaagccttctgtga

SEQ ID NO: 6028549 - DNA, 16 bp, Homo sapiens
cattgtgccctgtagc

SEQ ID NO: 6028550 - DNA, 23 bp, Homo sapiens
cattgtgcccttgatttttatct

SEQ ID NO: 6028551 - DNA, 17 bp, Homo sapiens
cattgtgcttctttctt

SEQ ID NO: 6028552 - DNA, 19 bp, Homo sapiens
cattgtgcttggcccctgg

SEQ ID NO: 6028553 - DNA, 20 bp, Homo sapiens
cattgtggatatgagctttc

SEQ ID NO: 6028554 - DNA, 17 bp, Homo sapiens
cattgtggcacattctt

SEQ ID NO: 6028555 - DNA, 19 bp, Homo sapiens
cattgtggctgtcagcagg

SEQ ID NO: 6028556 - DNA, 21 bp, Homo sapiens
cattgtgggatgttcagcact

SEQ ID NO: 6028557 - DNA, 22 bp, Homo sapiens
cattgtgggatgttcagcactg

SEQ ID NO: 6028558 - DNA, 17 bp, Homo sapiens
cattgtggttattttta

SEQ ID NO: 6028559 - DNA, 18 bp, Homo sapiens
cattgtggttatttttat

SEQ ID NO: 6028560 - DNA, 11 bp, Homo sapiens
cattgtggttt

SEQ ID NO: 6028561 - DNA, 23 bp, Homo sapiens
cattgtgtatgagactgtgtttc

SEQ ID NO: 6028562 - DNA, 17 bp, Homo sapiens
cattgtgtcagaaacat

SEQ ID NO: 6028563 - DNA, 22 bp, Homo sapiens
cattgtgtcagaaacatgaaat

SEQ ID NO: 6028564 - DNA, 13 bp, Homo sapiens
cattgtgtgtcac

SEQ ID NO: 6028565 - DNA, 15 bp, Homo sapiens
cattgtgttttccta

SEQ ID NO: 6028566 - DNA, 20 bp, Homo sapiens
cattgtgttttcctaaacac

SEQ ID NO: 6028567 - DNA, 16 bp, Homo sapiens
cattgttattgtggaa

SEQ ID NO: 6028568 - DNA, 19 bp, Homo sapiens
cattgttattgtggaagat

SEQ ID NO: 6028569 - DNA, 15 bp, Homo sapiens
cattgttattttcag

SEQ ID NO: 6028570 - DNA, 23 bp, Homo sapiens
cattgttcacttctaaaccaaaa

SEQ ID NO: 6028571 - DNA, 15 bp, Homo sapiens
cattgttcattcttg

SEQ ID NO: 6028572 - DNA, 14 bp, Homo sapiens
cattgttccacaca

SEQ ID NO: 6028573 - DNA, 20 bp, Homo sapiens
cattgttcccttcctcttcc

SEQ ID NO: 6028574 - DNA, 16 bp, Homo sapiens
cagggtccacgcctct

SEQ ID NO: 6028575 - DNA, 21 bp, Homo sapiens
cagggtccaggaatggtgctt

SEQ ID NO: 6028576 - DNA, 13 bp, Homo sapiens
cagggtcccacag

SEQ ID NO: 6028577 - DNA, 18 bp, Homo sapiens
cagggtcccacagccacg

SEQ ID NO: 6028578 - DNA, 14 bp, Homo sapiens
cagggtcccacccc

SEQ ID NO: 6028579 - DNA, 15 bp, Homo sapiens
cagggtcccaggaag

SEQ ID NO: 6028580 - DNA, 20 bp, Homo sapiens
cagggtccccgagtgcctag

SEQ ID NO: 6028581 - DNA, 14 bp, Homo sapiens
cagggtcccctgcc

SEQ ID NO: 6028582 - DNA, 16 bp, Homo sapiens
cagggtccctctgtgt

SEQ ID NO: 6028583 - DNA, 15 bp, Homo sapiens
cagggtccgcaccag

SEQ ID NO: 6028584 - DNA, 20 bp, Homo sapiens
cagggtccgcaccagctgct

SEQ ID NO: 6028585 - DNA, 22 bp, Homo sapiens
cagggtccgcaccagctgctct

SEQ ID NO: 6028586 - DNA, 15 bp, Homo sapiens
cagggtcctctcttc

SEQ ID NO: 6028587 - DNA, 16 bp, Homo sapiens
cagggtcctctcttcc

SEQ ID NO: 6028588 - DNA, 22 bp, Homo sapiens
cagggtcctctcttccacagtg

SEQ ID NO: 6028589 - DNA, 23 bp, Homo sapiens
cagggtcctctcttccacagtgg

SEQ ID NO: 6028590 - DNA, 14 bp, Homo sapiens
cagggtcctgccct

SEQ ID NO: 6028591 - DNA, 20 bp, Homo sapiens
cagggtcctgccctccggag

SEQ ID NO: 6028592 - DNA, 22 bp, Homo sapiens
cagggtcctgccctccggagga

SEQ ID NO: 6028593 - DNA, 14 bp, Homo sapiens
cagggtcctgctat

SEQ ID NO: 6028594 - DNA, 19 bp, Homo sapiens
cagggtcctgggggctgct

SEQ ID NO: 6028595 - DNA, 18 bp, Homo sapiens
cagggtcctgtagcccta

SEQ ID NO: 6028596 - DNA, 18 bp, Homo sapiens
cagggtccttgtttctgc

SEQ ID NO: 6028597 - DNA, 23 bp, Homo sapiens
cagggtccttttgacactgctct

SEQ ID NO: 6028598 - DNA, 14 bp, Homo sapiens
cagggtctaaagag

SEQ ID NO: 6028599 - DNA, 22 bp, Homo sapiens
cagggtctaaagagaacaagag

SEQ ID NO: 6028600 - DNA, 21 bp, Homo sapiens
cagggtctagccgctgccctg

SEQ ID NO: 6028601 - DNA, 12 bp, Homo sapiens
cagggtctcact

SEQ ID NO: 6028602 - DNA, 15 bp, Homo sapiens
cagggtctcactgtg

SEQ ID NO: 6028603 - DNA, 16 bp, Homo sapiens
cagggtctcactgtgt

SEQ ID NO: 6028604 - DNA, 21 bp, Homo sapiens
cagggtctcactgtgttgccc

SEQ ID NO: 6028605 - DNA, 23 bp, Homo sapiens
cagggtctcactgtgttgcccag

SEQ ID NO: 6028606 - DNA, 21 bp, Homo sapiens
cagggtctccctatgttgccc

SEQ ID NO: 6028607 - DNA, 19 bp, Homo sapiens
cagggtctcgtcaggaggt

SEQ ID NO: 6028608 - DNA, 22 bp, Homo sapiens
cagggtctctcagggatggagg

SEQ ID NO: 6028609 - DNA, 20 bp, Homo sapiens
cagggtctctccctcaggtg

SEQ ID NO: 6028610 - DNA, 21 bp, Homo sapiens
cagggtctctccctcaggtgt

SEQ ID NO: 6028611 - DNA, 14 bp, Homo sapiens
cagggtctctgctc

SEQ ID NO: 6028612 - DNA, 16 bp, Homo sapiens
cagggtctctgctgcc

SEQ ID NO: 6028613 - DNA, 18 bp, Homo sapiens
cagggtctctgctgccgc

SEQ ID NO: 6028614 - DNA, 22 bp, Homo sapiens
cagggtctcttccttcggtctt

SEQ ID NO: 6028615 - DNA, 12 bp, Homo sapiens
cagggtctgaaa

SEQ ID NO: 6028616 - DNA, 22 bp, Homo sapiens
cagggtctgagtgcaagttcat

SEQ ID NO: 6028617 - DNA, 15 bp, Homo sapiens
cagggtctgcctcca

SEQ ID NO: 6028618 - DNA, 14 bp, Homo sapiens
cagggtctgctctt

SEQ ID NO: 6028619 - DNA, 15 bp, Homo sapiens
cagggtctgggatga

SEQ ID NO: 6028620 - DNA, 14 bp, Homo sapiens
cagggtctgggcag

SEQ ID NO: 6028621 - DNA, 16 bp, Homo sapiens
cagggtctgggcagga

SEQ ID NO: 6028622 - DNA, 13 bp, Homo sapiens
cagggtctgggct

SEQ ID NO: 6028623 - DNA, 18 bp, Homo sapiens
cagggtctgggctgggca

SEQ ID NO: 6028624 - DNA, 14 bp, Homo sapiens
cagggtcttgctct

SEQ ID NO: 6028625 - DNA, 22 bp, Homo sapiens
cagggtcttggctgcctgtggg

SEQ ID NO: 6028626 - DNA, 14 bp, Homo sapiens
cagggtcttgggct

SEQ ID NO: 6028627 - DNA, 20 bp, Homo sapiens
cagggtcttgggctactggc

SEQ ID NO: 6028628 - DNA, 21 bp, Homo sapiens
cagggtcttgggctactggca

SEQ ID NO: 6028629 - DNA, 22 bp, Homo sapiens
cagggtctttctgatgacgcct

SEQ ID NO: 6028630 - DNA, 21 bp, Homo sapiens
cagggtcttttcatctgggaa

SEQ ID NO: 6028631 - DNA, 23 bp, Homo sapiens
cagggtcttttcatctgggaaag

SEQ ID NO: 6028632 - DNA, 17 bp, Homo sapiens
cagggtgaactgcaaag

SEQ ID NO: 6028633 - DNA, 20 bp, Homo sapiens
cagggtgaagcaccagggag

SEQ ID NO: 6028634 - DNA, 21 bp, Homo sapiens
cagggtgaagcaccagggaga

SEQ ID NO: 6028635 - DNA, 13 bp, Homo sapiens
cagggtgacaagg

SEQ ID NO: 6028636 - DNA, 17 bp, Homo sapiens
cagggtgacaaggcctg

SEQ ID NO: 6028637 - DNA, 21 bp, Homo sapiens
cagggtgacaaggcctgcttg

SEQ ID NO: 6028638 - DNA, 16 bp, Homo sapiens
cagggtgacagagtga

SEQ ID NO: 6028639 - DNA, 13 bp, Homo sapiens
cagggtgacctgc

SEQ ID NO: 6028640 - DNA, 15 bp, Homo sapiens
cagggtgacgcctga

SEQ ID NO: 6028641 - DNA, 16 bp, Homo sapiens
cagggtgacgcctgag

SEQ ID NO: 6028642 - DNA, 21 bp, Homo sapiens
cagggtgagaacgtgcccagc

SEQ ID NO: 6028643 - DNA, 23 bp, Homo sapiens
cagggtgagacgtgatgggctag

SEQ ID NO: 6028644 - DNA, 21 bp, Homo sapiens
cagggtgagagctgctctgga

SEQ ID NO: 6028645 - DNA, 22 bp, Homo sapiens
cagggtgagagctgctctggaa

SEQ ID NO: 6028646 - DNA, 19 bp, Homo sapiens
cagggtgagagtctgggtc

SEQ ID NO: 6028647 - DNA, 23 bp, Homo sapiens
cagggtgagcactctggggtggg

SEQ ID NO: 6028648 - DNA, 22 bp, Homo sapiens
cagggtgagcagggtcaagcct

SEQ ID NO: 6028649 - DNA, 22 bp, Homo sapiens
cagggtgaggtgcttgccccca

SEQ ID NO: 6028650 - DNA, 18 bp, Homo sapiens
cagggtgagttaaagaga

SEQ ID NO: 6028651 - DNA, 15 bp, Homo sapiens
cagggtgatgccagg

SEQ ID NO: 6028652 - DNA, 13 bp, Homo sapiens
cagggtgcagagg

SEQ ID NO: 6028653 - DNA, 22 bp, Homo sapiens
cagggtgcccagaacttccctg

SEQ ID NO: 6028654 - DNA, 21 bp, Homo sapiens
cagggtgctaaagccaaccag

SEQ ID NO: 6028655 - DNA, 20 bp, Homo sapiens
cagggtgctccctcctcagt

SEQ ID NO: 6028656 - DNA, 20 bp, Homo sapiens
cagggtgctgatgggaagga

SEQ ID NO: 6028657 - DNA, 17 bp, Homo sapiens
cagggtggacttagaaa

SEQ ID NO: 6028658 - DNA, 22 bp, Homo sapiens
cagggtggacttagaaagcagg

SEQ ID NO: 6028659 - DNA, 16 bp, Homo sapiens
cagggtggaggaaggt

SEQ ID NO: 6028660 - DNA, 20 bp, Homo sapiens
cagggtggagtgcagtggtg

SEQ ID NO: 6028661 - DNA, 18 bp, Homo sapiens
cagggtggcacccaccac

SEQ ID NO: 6028662 - DNA, 18 bp, Homo sapiens
cagggtggccacacaggc

SEQ ID NO: 6028663 - DNA, 20 bp, Homo sapiens
cagggtggccacacaggcag

SEQ ID NO: 6028664 - DNA, 22 bp, Homo sapiens
cagggtggccacacaggcaggg

SEQ ID NO: 6028665 - DNA, 23 bp, Homo sapiens
cagggtggccacacaggcagggc

SEQ ID NO: 6028666 - DNA, 16 bp, Homo sapiens
cagggtggccaggggt

SEQ ID NO: 6028667 - DNA, 22 bp, Homo sapiens
cagggtggccaggggtggtgag

SEQ ID NO: 6028668 - DNA, 14 bp, Homo sapiens
cagggtgggagccg

SEQ ID NO: 6028669 - DNA, 17 bp, Homo sapiens
cagggtgggagccggga

SEQ ID NO: 6028670 - DNA, 12 bp, Homo sapiens
cagggtgggagg

SEQ ID NO: 6028671 - DNA, 13 bp, Homo sapiens
cagggtgggaggg

SEQ ID NO: 6028672 - DNA, 15 bp, Homo sapiens
cagggtgggagggag

SEQ ID NO: 6028673 - DNA, 18 bp, Homo sapiens
cagggtgggatgagcctc

SEQ ID NO: 6028674 - DNA, 18 bp, Homo sapiens
cagggtgggatggaggag

SEQ ID NO: 6028675 - DNA, 20 bp, Homo sapiens
cagggtgggatggaggagaa

SEQ ID NO: 6028676 - DNA, 13 bp, Homo sapiens
cagggtgggcctc

SEQ ID NO: 6028677 - DNA, 15 bp, Homo sapiens
cagggtgggctgggg

SEQ ID NO: 6028678 - DNA, 17 bp, Homo sapiens
cagggtgggctggggac

SEQ ID NO: 6028679 - DNA, 21 bp, Homo sapiens
cagggtgggctggggactctg

SEQ ID NO: 6028680 - DNA, 14 bp, Homo sapiens
cagggtgggggagg

SEQ ID NO: 6028681 - DNA, 15 bp, Homo sapiens
cagggtgggtgagct

SEQ ID NO: 6028682 - DNA, 22 bp, Homo sapiens
cagggtggtctcttcttggggc

SEQ ID NO: 6028683 - DNA, 21 bp, Homo sapiens
cagggtggtcttcaagcctgg

SEQ ID NO: 6028684 - DNA, 21 bp, Homo sapiens
cagggtggtggtgcacacctg

SEQ ID NO: 6028685 - DNA, 23 bp, Homo sapiens
cagggtgtctgccccctcctgag

SEQ ID NO: 6028686 - DNA, 24 bp, Homo sapiens
cagggtgtctgccccctcctgagt

SEQ ID NO: 6028687 - DNA, 21 bp, Homo sapiens
cagggtgtgactcgggagctg

SEQ ID NO: 6028688 - DNA, 22 bp, Homo sapiens
cagggtgtgactcgggagctgc

SEQ ID NO: 6028689 - DNA, 12 bp, Homo sapiens
cagggtgtgagg

SEQ ID NO: 6028690 - DNA, 22 bp, Homo sapiens
cagggtgtggggccatgcctcc

SEQ ID NO: 6028691 - DNA, 13 bp, Homo sapiens
cagggtgtgtgct

SEQ ID NO: 6028692 - DNA, 23 bp, Homo sapiens
cagggtgttgggatactgcaggg

SEQ ID NO: 6028693 - DNA, 19 bp, Homo sapiens
cagggtgtttgcagctgtg

SEQ ID NO: 6028694 - DNA, 22 bp, Homo sapiens
cagggttaaactgcaggagcag

SEQ ID NO: 6028695 - DNA, 15 bp, Homo sapiens
cagggttaagaagac

SEQ ID NO: 6028696 - DNA, 19 bp, Homo sapiens
cagggttaggaatctcttc

SEQ ID NO: 6028697 - DNA, 18 bp, Homo sapiens
cagggttcaaaatgtctg

SEQ ID NO: 6028698 - DNA, 13 bp, Homo sapiens
cagggttcatctg

SEQ ID NO: 6028699 - DNA, 14 bp, Homo sapiens
cagggttcatctgt

SEQ ID NO: 6028700 - DNA, 16 bp, Homo sapiens
cagggttcatctgtcc

SEQ ID NO: 6028701 - DNA, 13 bp, Homo sapiens
cagggttccagac

SEQ ID NO: 6028702 - DNA, 23 bp, Homo sapiens
cagggttctccctcccaccttaa

SEQ ID NO: 6028703 - DNA, 20 bp, Homo sapiens
cagggttctcctctcccctc

SEQ ID NO: 6028704 - DNA, 20 bp, Homo sapiens
cagggttctgctcggcttct

SEQ ID NO: 6028705 - DNA, 20 bp, Homo sapiens
cagggttgaccccagaggat

SEQ ID NO: 6028706 - DNA, 13 bp, Homo sapiens
cagggttggcacc

SEQ ID NO: 6028707 - DNA, 14 bp, Homo sapiens
cagggttgggccca

SEQ ID NO: 6028708 - DNA, 16 bp, Homo sapiens
cagggttgggcccaga

SEQ ID NO: 6028709 - DNA, 18 bp, Homo sapiens
cagggttggtgtgctgag

SEQ ID NO: 6028710 - DNA, 16 bp, Homo sapiens
cagggttgtgctttct

SEQ ID NO: 6028711 - DNA, 18 bp, Homo sapiens
cagggtttacatgaagca

SEQ ID NO: 6028712 - DNA, 19 bp, Homo sapiens
cagggtttacatgaagcag

SEQ ID NO: 6028713 - DNA, 20 bp, Homo sapiens
cagggtttacatgaagcaga

SEQ ID NO: 6028714 - DNA, 19 bp, Homo sapiens
cagggtttacccagtggga

SEQ ID NO: 6028715 - DNA, 14 bp, Homo sapiens
cagggtttctctgc

SEQ ID NO: 6028716 - DNA, 19 bp, Homo sapiens
cagggtttctctgcagatg

SEQ ID NO: 6028717 - DNA, 20 bp, Homo sapiens
cagggtttgagcacaatctg

SEQ ID NO: 6028718 - DNA, 20 bp, Homo sapiens
cagggtttggctgtgtctaa

SEQ ID NO: 6028719 - DNA, 22 bp, Homo sapiens
cagggtttggctgtgtctaaac

SEQ ID NO: 6028720 - DNA, 16 bp, Homo sapiens
cagggttttaactttg

SEQ ID NO: 6028721 - DNA, 22 bp, Homo sapiens
cagggttttggggtcctgggct

SEQ ID NO: 6028722 - DNA, 14 bp, Homo sapiens
caggtaaaacaggg

SEQ ID NO: 6028723 - DNA, 15 bp, Homo sapiens
caggtaaaacagggc

SEQ ID NO: 6028724 - DNA, 20 bp, Homo sapiens
caggtaaaacagggccacat

SEQ ID NO: 6028725 - DNA, 23 bp, Homo sapiens
caggtaaaacagggccacataga

SEQ ID NO: 6028726 - DNA, 18 bp, Homo sapiens
caggtaaaatagtcatga

SEQ ID NO: 6028727 - DNA, 21 bp, Homo sapiens
caggtaaacacataaatgaaa

SEQ ID NO: 6028728 - DNA, 19 bp, Homo sapiens
caggtaaacagaaatcctt

SEQ ID NO: 6028729 - DNA, 22 bp, Homo sapiens
caggtaaagggcaaataatgat

SEQ ID NO: 6028730 - DNA, 18 bp, Homo sapiens
caggtaaatgggcagtgc

SEQ ID NO: 6028731 - DNA, 17 bp, Homo sapiens
caggtaaattaagacat

SEQ ID NO: 6028732 - DNA, 15 bp, Homo sapiens
caggtaacaggcaga

SEQ ID NO: 6028733 - DNA, 20 bp, Homo sapiens
caggtaacaggcagatacag

SEQ ID NO: 6028734 - DNA, 20 bp, Homo sapiens
caggtaacattataaatgac

SEQ ID NO: 6028735 - DNA, 12 bp, Homo sapiens
caggtaactttc

SEQ ID NO: 6028736 - DNA, 14 bp, Homo sapiens
caggtaagtggcag

SEQ ID NO: 6028737 - DNA, 13 bp, Homo sapiens
caggtaataataa

SEQ ID NO: 6028738 - DNA, 15 bp, Homo sapiens
caggtaatacaaact

SEQ ID NO: 6028739 - DNA, 20 bp, Homo sapiens
caggtaatatacctggttta

SEQ ID NO: 6028740 - DNA, 20 bp, Homo sapiens
caggtaatcgacctgcctcg

SEQ ID NO: 6028741 - DNA, 20 bp, Homo sapiens
caggtaatgagggactggaa

SEQ ID NO: 6028742 - DNA, 14 bp, Homo sapiens
caggtacacctccc

SEQ ID NO: 6028743 - DNA, 18 bp, Homo sapiens
caggtacacctccccctg

SEQ ID NO: 6028744 - DNA, 21 bp, Homo sapiens
caggtacacctccccctgcgc

SEQ ID NO: 6028745 - DNA, 14 bp, Homo sapiens
caggtacagaaaac

SEQ ID NO: 6028746 - DNA, 22 bp, Homo sapiens
caggtacagcgggctgtgcccg

SEQ ID NO: 6028747 - DNA, 15 bp, Homo sapiens
caggtacaggagagg

SEQ ID NO: 6028748 - DNA, 20 bp, Homo sapiens
caggtacaggagaggcagca

SEQ ID NO: 6028749 - DNA, 16 bp, Homo sapiens
caggtaccaaggaaat

SEQ ID NO: 6028750 - DNA, 11 bp, Homo sapiens
cattgttctcc

SEQ ID NO: 6028751 - DNA, 20 bp, Homo sapiens
cattgttgagctattgctgt

SEQ ID NO: 6028752 - DNA, 16 bp, Homo sapiens
cattgttgaggtggtc

SEQ ID NO: 6028753 - DNA, 18 bp, Homo sapiens
cattgttgaggtggtctg

SEQ ID NO: 6028754 - DNA, 21 bp, Homo sapiens
cattgttgaggtggtctgaat

SEQ ID NO: 6028755 - DNA, 20 bp, Homo sapiens
cattgttggagtgtaaacca

SEQ ID NO: 6028756 - DNA, 13 bp, Homo sapiens
cattgttggcagc

SEQ ID NO: 6028757 - DNA, 17 bp, Homo sapiens
cattgttggccaaagcc

SEQ ID NO: 6028758 - DNA, 18 bp, Homo sapiens
cattgttggccaaagcca

SEQ ID NO: 6028759 - DNA, 15 bp, Homo sapiens
cattgttggctattt

SEQ ID NO: 6028760 - DNA, 17 bp, Homo sapiens
cattgttggctatttga

SEQ ID NO: 6028761 - DNA, 17 bp, Homo sapiens
cattgttgtaaagtatt

SEQ ID NO: 6028762 - DNA, 16 bp, Homo sapiens
cattgttgtcaaggaa

SEQ ID NO: 6028763 - DNA, 18 bp, Homo sapiens
cattgttgtcttcactta

SEQ ID NO: 6028764 - DNA, 20 bp, Homo sapiens
cattgttgtgtataatttac

SEQ ID NO: 6028765 - DNA, 20 bp, Homo sapiens
cattgttgttttaacctccc

SEQ ID NO: 6028766 - DNA, 22 bp, Homo sapiens
cattgttgttttaacctcccct

SEQ ID NO: 6028767 - DNA, 19 bp, Homo sapiens
cattgttgtttttttaata

SEQ ID NO: 6028768 - DNA, 21 bp, Homo sapiens
cattgtttaaaaatacacatg

SEQ ID NO: 6028769 - DNA, 18 bp, Homo sapiens
cattgtttagaaagaata

SEQ ID NO: 6028770 - DNA, 20 bp, Homo sapiens
cattgtttagatgaggctca

SEQ ID NO: 6028771 - DNA, 19 bp, Homo sapiens
cattgtttaggggtgaagg

SEQ ID NO: 6028772 - DNA, 21 bp, Homo sapiens
cattgtttaggggtgaaggag

SEQ ID NO: 6028773 - DNA, 19 bp, Homo sapiens
cattgtttcaaaatagtca

SEQ ID NO: 6028774 - DNA, 13 bp, Homo sapiens
cattgtttccacc

SEQ ID NO: 6028775 - DNA, 17 bp, Homo sapiens
cattgtttcgtaacaca

SEQ ID NO: 6028776 - DNA, 12 bp, Homo sapiens
cattgtttctgt

SEQ ID NO: 6028777 - DNA, 18 bp, Homo sapiens
cattgtttgaaacaaaga

SEQ ID NO: 6028778 - DNA, 19 bp, Homo sapiens
cattgtttgaaacaaagaa

SEQ ID NO: 6028779 - DNA, 22 bp, Homo sapiens
cattgtttgcttattgttccaa

SEQ ID NO: 6028780 - DNA, 19 bp, Homo sapiens
cattgtttggatttccttt

SEQ ID NO: 6028781 - DNA, 17 bp, Homo sapiens
cattgttttaaaaagaa

SEQ ID NO: 6028782 - DNA, 14 bp, Homo sapiens
cattgttttccaga

SEQ ID NO: 6028783 - DNA, 16 bp, Homo sapiens
cattgttttccagaag

SEQ ID NO: 6028784 - DNA, 14 bp, Homo sapiens
cattgttttctttt

SEQ ID NO: 6028785 - DNA, 12 bp, Homo sapiens
cattgttttgaa

SEQ ID NO: 6028786 - DNA, 13 bp, Homo sapiens
cattgttttgaat

SEQ ID NO: 6028787 - DNA, 15 bp, Homo sapiens
cattgttttgcaaaa

SEQ ID NO: 6028788 - DNA, 16 bp, Homo sapiens
cattgttttgccaaca

SEQ ID NO: 6028789 - DNA, 13 bp, Homo sapiens
cattgtttttgta

SEQ ID NO: 6028790 - DNA, 18 bp, Homo sapiens
catttaaaaaacatttta

SEQ ID NO: 6028791 - DNA, 20 bp, Homo sapiens
catttaaaacattaaaatat

SEQ ID NO: 6028792 - DNA, 15 bp, Homo sapiens
catttaaaacatttg

SEQ ID NO: 6028793 - DNA, 14 bp, Homo sapiens
catttaaaagacag

SEQ ID NO: 6028794 - DNA, 22 bp, Homo sapiens
catttaaaagacagacattcct

SEQ ID NO: 6028795 - DNA, 16 bp, Homo sapiens
catttaaaagatacag

SEQ ID NO: 6028796 - DNA, 20 bp, Homo sapiens
catttaaaataccactgtaa

SEQ ID NO: 6028797 - DNA, 18 bp, Homo sapiens
catttaaaatagttttct

SEQ ID NO: 6028798 - DNA, 22 bp, Homo sapiens
catttaaaatagttttctaaat

SEQ ID NO: 6028799 - DNA, 17 bp, Homo sapiens
catttaaaatgattaga

SEQ ID NO: 6028800 - DNA, 14 bp, Homo sapiens
catttaaaatggaa

SEQ ID NO: 6028801 - DNA, 22 bp, Homo sapiens
catttaaaatggaaaagagaga

SEQ ID NO: 6028802 - DNA, 14 bp, Homo sapiens
catttaaaatggac

SEQ ID NO: 6028803 - DNA, 16 bp, Homo sapiens
catttaaaatggactt

SEQ ID NO: 6028804 - DNA, 22 bp, Homo sapiens
catttaaaatgtaaactcttca

SEQ ID NO: 6028805 - DNA, 15 bp, Homo sapiens
catttaaaattgcta

SEQ ID NO: 6028806 - DNA, 22 bp, Homo sapiens
catttaaaattgctatgttact

SEQ ID NO: 6028807 - DNA, 21 bp, Homo sapiens
catttaaacagatgtccatca

SEQ ID NO: 6028808 - DNA, 16 bp, Homo sapiens
catttaaacatgttta

SEQ ID NO: 6028809 - DNA, 23 bp, Homo sapiens
catttaaacccaatcagatgcct

SEQ ID NO: 6028810 - DNA, 15 bp, Homo sapiens
catttaaactaaatt

SEQ ID NO: 6028811 - DNA, 15 bp, Homo sapiens
catttaaactctgcc

SEQ ID NO: 6028812 - DNA, 16 bp, Homo sapiens
catttaaactctgcca

SEQ ID NO: 6028813 - DNA, 17 bp, Homo sapiens
catttaaagacaaagac

SEQ ID NO: 6028814 - DNA, 22 bp, Homo sapiens
catttaaagaccaataaacttc

SEQ ID NO: 6028815 - DNA, 16 bp, Homo sapiens
catttaaagatttaaa

SEQ ID NO: 6028816 - DNA, 16 bp, Homo sapiens
catttaaagcattgct

SEQ ID NO: 6028817 - DNA, 18 bp, Homo sapiens
catttaaagcattgctgt

SEQ ID NO: 6028818 - DNA, 16 bp, Homo sapiens
catttaaagctaaatt

SEQ ID NO: 6028819 - DNA, 19 bp, Homo sapiens
catttaaagctaaattttg

SEQ ID NO: 6028820 - DNA, 20 bp, Homo sapiens
catttaaatgtgtacaatgt

SEQ ID NO: 6028821 - DNA, 13 bp, Homo sapiens
catttaaattcca

SEQ ID NO: 6028822 - DNA, 18 bp, Homo sapiens
catttaaatttgatttcc

SEQ ID NO: 6028823 - DNA, 23 bp, Homo sapiens
catttaaattttaccctttagac

SEQ ID NO: 6028824 - DNA, 17 bp, Homo sapiens
catttaaattttttggc

SEQ ID NO: 6028825 - DNA, 18 bp, Homo sapiens
catttaaatttttttcct

SEQ ID NO: 6028826 - DNA, 20 bp, Homo sapiens
catttaacactgagtgaaat

SEQ ID NO: 6028827 - DNA, 11 bp, Homo sapiens
catttaacata

SEQ ID NO: 6028828 - DNA, 14 bp, Homo sapiens
catttaacattgtt

SEQ ID NO: 6028829 - DNA, 19 bp, Homo sapiens
catttaacccccctgtaca

SEQ ID NO: 6028830 - DNA, 14 bp, Homo sapiens
catttaactttata

SEQ ID NO: 6028831 - DNA, 17 bp, Homo sapiens
catttaacttttctacc

SEQ ID NO: 6028832 - DNA, 17 bp, Homo sapiens
catttaagaacaagaga

SEQ ID NO: 6028833 - DNA, 22 bp, Homo sapiens
catttaagaatttaccagaaat

SEQ ID NO: 6028834 - DNA, 17 bp, Homo sapiens
catttaagagacagtca

SEQ ID NO: 6028835 - DNA, 23 bp, Homo sapiens
catttaagagacagtcaccccag

SEQ ID NO: 6028836 - DNA, 16 bp, Homo sapiens
catttaagagactctt

SEQ ID NO: 6028837 - DNA, 18 bp, Homo sapiens
catttaagagactcttta

SEQ ID NO: 6028838 - DNA, 16 bp, Homo sapiens
catttaaggagattgg

SEQ ID NO: 6028839 - DNA, 16 bp, Homo sapiens
catttaagggaaaaat

SEQ ID NO: 6028840 - DNA, 19 bp, Homo sapiens
catttaagggaaaaatata

SEQ ID NO: 6028841 - DNA, 14 bp, Homo sapiens
catttaagtgacct

SEQ ID NO: 6028842 - DNA, 15 bp, Homo sapiens
catttaagttgtaaa

SEQ ID NO: 6028843 - DNA, 13 bp, Homo sapiens
catttaataaaac

SEQ ID NO: 6028844 - DNA, 14 bp, Homo sapiens
catttaataaagaa

SEQ ID NO: 6028845 - DNA, 15 bp, Homo sapiens
catttaataaagaaa

SEQ ID NO: 6028846 - DNA, 20 bp, Homo sapiens
catttaataaagaaatattt

SEQ ID NO: 6028847 - DNA, 17 bp, Homo sapiens
catttaataaagatgag

SEQ ID NO: 6028848 - DNA, 19 bp, Homo sapiens
catttaataaagatgagtt

SEQ ID NO: 6028849 - DNA, 18 bp, Homo sapiens
catttaataactttgctg

SEQ ID NO: 6028850 - DNA, 19 bp, Homo sapiens
catttaataactttgctgg

SEQ ID NO: 6028851 - DNA, 20 bp, Homo sapiens
catttaataactttgctgga

SEQ ID NO: 6028852 - DNA, 17 bp, Homo sapiens
catttaataatatactt

SEQ ID NO: 6028853 - DNA, 20 bp, Homo sapiens
catttaataatatacttgtg

SEQ ID NO: 6028854 - DNA, 22 bp, Homo sapiens
catttaataatatacttgtgga

SEQ ID NO: 6028855 - DNA, 14 bp, Homo sapiens
catttaataattat

SEQ ID NO: 6028856 - DNA, 21 bp, Homo sapiens
catttaatacagataagtgtt

SEQ ID NO: 6028857 - DNA, 17 bp, Homo sapiens
catttaatatttctgtg

SEQ ID NO: 6028858 - DNA, 16 bp, Homo sapiens
catttaatatttttca

SEQ ID NO: 6028859 - DNA, 15 bp, Homo sapiens
catttaatcaggagg

SEQ ID NO: 6028860 - DNA, 21 bp, Homo sapiens
catttaatggcagctagtgcc

SEQ ID NO: 6028861 - DNA, 20 bp, Homo sapiens
catttaatgtagccatggga

SEQ ID NO: 6028862 - DNA, 22 bp, Homo sapiens
catttaatgtagccatgggacc

SEQ ID NO: 6028863 - DNA, 12 bp, Homo sapiens
catttaattcat

SEQ ID NO: 6028864 - DNA, 14 bp, Homo sapiens
catttaattcataa

SEQ ID NO: 6028865 - DNA, 15 bp, Homo sapiens
catttacaaactgaa

SEQ ID NO: 6028866 - DNA, 17 bp, Homo sapiens
catttacaatttcaaaa

SEQ ID NO: 6028867 - DNA, 19 bp, Homo sapiens
catttacaatttcaaaaga

SEQ ID NO: 6028868 - DNA, 23 bp, Homo sapiens
catttacaggaaattgcaaagaa

SEQ ID NO: 6028869 - DNA, 20 bp, Homo sapiens
catttacaggagggcccgga

SEQ ID NO: 6028870 - DNA, 20 bp, Homo sapiens
catttacagtccttcaaaat

SEQ ID NO: 6028871 - DNA, 16 bp, Homo sapiens
catttacagtctcttt

SEQ ID NO: 6028872 - DNA, 19 bp, Homo sapiens
catttacagtctctttctt

SEQ ID NO: 6028873 - DNA, 15 bp, Homo sapiens
catttacatcaaatc

SEQ ID NO: 6028874 - DNA, 20 bp, Homo sapiens
catttacattaggtattaca

SEQ ID NO: 6028875 - DNA, 11 bp, Homo sapiens
catttaccaaa

SEQ ID NO: 6028876 - DNA, 13 bp, Homo sapiens
catttaccaaatt

SEQ ID NO: 6028877 - DNA, 15 bp, Homo sapiens
catttaccactgtat

SEQ ID NO: 6028878 - DNA, 16 bp, Homo sapiens
catttacctcgaggct

SEQ ID NO: 6028879 - DNA, 17 bp, Homo sapiens
catttacctcgcagtgt

SEQ ID NO: 6028880 - DNA, 15 bp, Homo sapiens
catttacctttttga

SEQ ID NO: 6028881 - DNA, 14 bp, Homo sapiens
catttacgaattat

SEQ ID NO: 6028882 - DNA, 19 bp, Homo sapiens
catttacgtaaaaagatat

SEQ ID NO: 6028883 - DNA, 15 bp, Homo sapiens
catttactaaacata

SEQ ID NO: 6028884 - DNA, 19 bp, Homo sapiens
catttactaaacatatgat

SEQ ID NO: 6028885 - DNA, 14 bp, Homo sapiens
catttactatgcac

SEQ ID NO: 6028886 - DNA, 18 bp, Homo sapiens
catttactctaaaaactg

SEQ ID NO: 6028887 - DNA, 17 bp, Homo sapiens
catttactcttcttcat

SEQ ID NO: 6028888 - DNA, 20 bp, Homo sapiens
catttactcttgagactact

SEQ ID NO: 6028889 - DNA, 21 bp, Homo sapiens
catttactgatcatctgctgt

SEQ ID NO: 6028890 - DNA, 14 bp, Homo sapiens
catttacttaagac

SEQ ID NO: 6028891 - DNA, 12 bp, Homo sapiens
catttactttta

SEQ ID NO: 6028892 - DNA, 22 bp, Homo sapiens
catttagaaaatagagctttta

SEQ ID NO: 6028893 - DNA, 17 bp, Homo sapiens
catttagaaatcaagca

SEQ ID NO: 6028894 - DNA, 15 bp, Homo sapiens
catttagaaatgttt

SEQ ID NO: 6028895 - DNA, 18 bp, Homo sapiens
catttagaaatgtttatt

SEQ ID NO: 6028896 - DNA, 12 bp, Homo sapiens
catttagaactt

SEQ ID NO: 6028897 - DNA, 21 bp, Homo sapiens
catttagaactttctgctttg

SEQ ID NO: 6028898 - DNA, 10 bp, Homo sapiens
catttagaat

SEQ ID NO: 6028899 - DNA, 13 bp, Homo sapiens
catttagaatcta

SEQ ID NO: 6028900 - DNA, 19 bp, Homo sapiens
catttagaatggtgatttt

SEQ ID NO: 6028901 - DNA, 20 bp, Homo sapiens
catttagaatggtgatttta

SEQ ID NO: 6028902 - DNA, 21 bp, Homo sapiens
catttagaatggtgattttaa

SEQ ID NO: 6028903 - DNA, 20 bp, Homo sapiens
catttagagaggaaaagtaa

SEQ ID NO: 6028904 - DNA, 21 bp, Homo sapiens
catttagagaggaaaagtaac

SEQ ID NO: 6028905 - DNA, 17 bp, Homo sapiens
catttagagggtgaagg

SEQ ID NO: 6028906 - DNA, 20 bp, Homo sapiens
catttagagggtgaaggaga

SEQ ID NO: 6028907 - DNA, 15 bp, Homo sapiens
catttagataatttg

SEQ ID NO: 6028908 - DNA, 16 bp, Homo sapiens
catttagataatttga

SEQ ID NO: 6028909 - DNA, 22 bp, Homo sapiens
catttagataatttgaaaaagt

SEQ ID NO: 6028910 - DNA, 15 bp, Homo sapiens
catttagcaataaat

SEQ ID NO: 6028911 - DNA, 24 bp, Homo sapiens
catttagcacaatttgagactgaa

SEQ ID NO: 6028912 - DNA, 21 bp, Homo sapiens
catttagcattgaaataataa

SEQ ID NO: 6028913 - DNA, 17 bp, Homo sapiens
catttagccaccatctt

SEQ ID NO: 6028914 - DNA, 22 bp, Homo sapiens
catttagccaccatctttgcag

SEQ ID NO: 6028915 - DNA, 16 bp, Homo sapiens
catttagcctgtcctg

SEQ ID NO: 6028916 - DNA, 18 bp, Homo sapiens
catttagcctgtcctgtc

SEQ ID NO: 6028917 - DNA, 16 bp, Homo sapiens
catttagctgtattca

SEQ ID NO: 6028918 - DNA, 12 bp, Homo sapiens
catttaggagaa

SEQ ID NO: 6028919 - DNA, 23 bp, Homo sapiens
catttaggagaatagcagagagc

SEQ ID NO: 6028920 - DNA, 20 bp, Homo sapiens
catttaggcaaataagcact

SEQ ID NO: 6028921 - DNA, 21 bp, Homo sapiens
catttagggagtattctaata

SEQ ID NO: 6028922 - DNA, 17 bp, Homo sapiens
catttagtaccctgcag

SEQ ID NO: 6028923 - DNA, 19 bp, Homo sapiens
catttagtaccctgcaggc

SEQ ID NO: 6028924 - DNA, 21 bp, Homo sapiens
catttagtaccctgcaggcca

SEQ ID NO: 6028925 - DNA, 15 bp, Homo sapiens
catttagtcatgtga

SEQ ID NO: 6028926 - DNA, 15 bp, Homo sapiens
catttagtcctcacc

SEQ ID NO: 6028927 - DNA, 16 bp, Homo sapiens
catttagtcctcacct

SEQ ID NO: 6028928 - DNA, 13 bp, Homo sapiens
caggtaccagctg

SEQ ID NO: 6028929 - DNA, 16 bp, Homo sapiens
caggtaccagctgcgc

SEQ ID NO: 6028930 - DNA, 19 bp, Homo sapiens
caggtaccagctgcgcttg

SEQ ID NO: 6028931 - DNA, 22 bp, Homo sapiens
caggtaccttgacctttgtaca

SEQ ID NO: 6028932 - DNA, 14 bp, Homo sapiens
caggtacgcacaga

SEQ ID NO: 6028933 - DNA, 15 bp, Homo sapiens
caggtacggagaaga

SEQ ID NO: 6028934 - DNA, 17 bp, Homo sapiens
caggtacggagaagaat

SEQ ID NO: 6028935 - DNA, 20 bp, Homo sapiens
caggtactcctgccagggaa

SEQ ID NO: 6028936 - DNA, 19 bp, Homo sapiens
caggtactctttaaacagt

SEQ ID NO: 6028937 - DNA, 16 bp, Homo sapiens
caggtacttcctcctg

SEQ ID NO: 6028938 - DNA, 19 bp, Homo sapiens
caggtacttcctcctgatg

SEQ ID NO: 6028939 - DNA, 13 bp, Homo sapiens
caggtactttggt

SEQ ID NO: 6028940 - DNA, 19 bp, Homo sapiens
caggtagaacacaaggtca

SEQ ID NO: 6028941 - DNA, 21 bp, Homo sapiens
caggtagaacgccagggaccc

SEQ ID NO: 6028942 - DNA, 22 bp, Homo sapiens
caggtagaaggttgacacagtt

SEQ ID NO: 6028943 - DNA, 20 bp, Homo sapiens
caggtagaattatctaattt

SEQ ID NO: 6028944 - DNA, 18 bp, Homo sapiens
caggtagacctgtctcct

SEQ ID NO: 6028945 - DNA, 14 bp, Homo sapiens
caggtagcaagaga

SEQ ID NO: 6028946 - DNA, 18 bp, Homo sapiens
caggtagcaagagagcag

SEQ ID NO: 6028947 - DNA, 19 bp, Homo sapiens
caggtagcaagagagcagc

SEQ ID NO: 6028948 - DNA, 21 bp, Homo sapiens
caggtagcagcaaatagcaaa

SEQ ID NO: 6028949 - DNA, 23 bp, Homo sapiens
caggtagctgcccctggctctga

SEQ ID NO: 6028950 - DNA, 14 bp, Homo sapiens
caggtaggaaacaa

SEQ ID NO: 6028951 - DNA, 19 bp, Homo sapiens
caggtaggaagcaacagct

SEQ ID NO: 6028952 - DNA, 12 bp, Homo sapiens
caggtaggccct

SEQ ID NO: 6028953 - DNA, 20 bp, Homo sapiens
caggtaggcccttgtcctgc

SEQ ID NO: 6028954 - DNA, 20 bp, Homo sapiens
caggtaggggcacagtgaat

SEQ ID NO: 6028955 - DNA, 13 bp, Homo sapiens
caggtagtactgg

SEQ ID NO: 6028956 - DNA, 18 bp, Homo sapiens
caggtagtgggctcacaa

SEQ ID NO: 6028957 - DNA, 23 bp, Homo sapiens
caggtagtgttgagacccaggcc

SEQ ID NO: 6028958 - DNA, 18 bp, Homo sapiens
caggtagttgcaattgaa

SEQ ID NO: 6028959 - DNA, 23 bp, Homo sapiens
caggtagttgcaattgaattaaa

SEQ ID NO: 6028960 - DNA, 20 bp, Homo sapiens
caggtagttggtgaacagag

SEQ ID NO: 6028961 - DNA, 23 bp, Homo sapiens
caggtagttggtgaacagagaga

SEQ ID NO: 6028962 - DNA, 22 bp, Homo sapiens
caggtatatactttgaaaggag

SEQ ID NO: 6028963 - DNA, 14 bp, Homo sapiens
caggtatcaactag

SEQ ID NO: 6028964 - DNA, 16 bp, Homo sapiens
caggtatcaggcacag

SEQ ID NO: 6028965 - DNA, 19 bp, Homo sapiens
caggtatcaggcacaggca

SEQ ID NO: 6028966 - DNA, 22 bp, Homo sapiens
caggtatcctgggggaagagga

SEQ ID NO: 6028967 - DNA, 14 bp, Homo sapiens
caggtatctccagg

SEQ ID NO: 6028968 - DNA, 16 bp, Homo sapiens
caggtatctccaggat

SEQ ID NO: 6028969 - DNA, 21 bp, Homo sapiens
caggtatctgatgatgttctg

SEQ ID NO: 6028970 - DNA, 22 bp, Homo sapiens
caggtatctgatgatgttctga

SEQ ID NO: 6028971 - DNA, 14 bp, Homo sapiens
caggtatggctctg

SEQ ID NO: 6028972 - DNA, 15 bp, Homo sapiens
caggtatgggacctg

SEQ ID NO: 6028973 - DNA, 16 bp, Homo sapiens
caggtatgttgccttt

SEQ ID NO: 6028974 - DNA, 14 bp, Homo sapiens
caggtattaaaggt

SEQ ID NO: 6028975 - DNA, 19 bp, Homo sapiens
caggtattacacaagccaa

SEQ ID NO: 6028976 - DNA, 18 bp, Homo sapiens
caggtatttagaagcaga

SEQ ID NO: 6028977 - DNA, 20 bp, Homo sapiens
caggtatttagaagcagagg

SEQ ID NO: 6028978 - DNA, 20 bp, Homo sapiens
caggtatttcagaaggagaa

SEQ ID NO: 6028979 - DNA, 11 bp, Homo sapiens
caggtattttc

SEQ ID NO: 6028980 - DNA, 20 bp, Homo sapiens
caggtattttgtttctttta

SEQ ID NO: 6028981 - DNA, 21 bp, Homo sapiens
caggtatttttattcatgtga

SEQ ID NO: 6028982 - DNA, 12 bp, Homo sapiens
caggtcaacaga

SEQ ID NO: 6028983 - DNA, 16 bp, Homo sapiens
caggtcaacagaatga

SEQ ID NO: 6028984 - DNA, 18 bp, Homo sapiens
caggtcaacagaatgaaa

SEQ ID NO: 6028985 - DNA, 23 bp, Homo sapiens
caggtcaacagaatgaaaaatga

SEQ ID NO: 6028986 - DNA, 16 bp, Homo sapiens
caggtcaataaactta

SEQ ID NO: 6028987 - DNA, 22 bp, Homo sapiens
caggtcaataaacttagaggaa

SEQ ID NO: 6028988 - DNA, 14 bp, Homo sapiens
caggtcaccatcct

SEQ ID NO: 6028989 - DNA, 22 bp, Homo sapiens
caggtcaccatcctcagaggct

SEQ ID NO: 6028990 - DNA, 11 bp, Homo sapiens
caggtcactgt

SEQ ID NO: 6028991 - DNA, 22 bp, Homo sapiens
caggtcagaagagggagaggag

SEQ ID NO: 6028992 - DNA, 15 bp, Homo sapiens
caggtcagccactgt

SEQ ID NO: 6028993 - DNA, 16 bp, Homo sapiens
caggtcagccactgtt

SEQ ID NO: 6028994 - DNA, 20 bp, Homo sapiens
caggtcagcccatggaggca

SEQ ID NO: 6028995 - DNA, 22 bp, Homo sapiens
caggtcagcccatggaggcaga

SEQ ID NO: 6028996 - DNA, 17 bp, Homo sapiens
caggtcagccctgtgtc

SEQ ID NO: 6028997 - DNA, 17 bp, Homo sapiens
caggtcagcctggaagg

SEQ ID NO: 6028998 - DNA, 21 bp, Homo sapiens
caggtcagcctggaagggaca

SEQ ID NO: 6028999 - DNA, 19 bp, Homo sapiens
caggtcagcgcggtcctga

SEQ ID NO: 6029000 - DNA, 12 bp, Homo sapiens
caggtcagctgg

SEQ ID NO: 6029001 - DNA, 14 bp, Homo sapiens
caggtcagctggga

SEQ ID NO: 6029002 - DNA, 17 bp, Homo sapiens
caggtcagctgggagcc

SEQ ID NO: 6029003 - DNA, 18 bp, Homo sapiens
caggtcagctgggagcca

SEQ ID NO: 6029004 - DNA, 19 bp, Homo sapiens
caggtcagctgggagccag

SEQ ID NO: 6029005 - DNA, 15 bp, Homo sapiens
caggtcaggatgcac

SEQ ID NO: 6029006 - DNA, 22 bp, Homo sapiens
caggtcagggacttggacagga

SEQ ID NO: 6029007 - DNA, 15 bp, Homo sapiens
caggtcagggctcag

SEQ ID NO: 6029008 - DNA, 18 bp, Homo sapiens
caggtcaggggctcccta

SEQ ID NO: 6029009 - DNA, 21 bp, Homo sapiens
caggtcaggggtgacacagac

SEQ ID NO: 6029010 - DNA, 17 bp, Homo sapiens
caggtcatcagatgcct

SEQ ID NO: 6029011 - DNA, 22 bp, Homo sapiens
caggtcatcagatgcctgcttg

SEQ ID NO: 6029012 - DNA, 19 bp, Homo sapiens
caggtcatctcctttcatc

SEQ ID NO: 6029013 - DNA, 17 bp, Homo sapiens
caggtcatctgctggga

SEQ ID NO: 6029014 - DNA, 20 bp, Homo sapiens
caggtcatgcagttcctggc

SEQ ID NO: 6029015 - DNA, 21 bp, Homo sapiens
caggtcatggagcagccccca

SEQ ID NO: 6029016 - DNA, 20 bp, Homo sapiens
caggtcattcttaagatttc

SEQ ID NO: 6029017 - DNA, 17 bp, Homo sapiens
caggtccaaacccttca

SEQ ID NO: 6029018 - DNA, 23 bp, Homo sapiens
caggtccaaacccttcaactcct

SEQ ID NO: 6029019 - DNA, 13 bp, Homo sapiens
caggtccaaggac

SEQ ID NO: 6029020 - DNA, 21 bp, Homo sapiens
caggtccaaggacaccctccc

SEQ ID NO: 6029021 - DNA, 14 bp, Homo sapiens
caggtccagctctg

SEQ ID NO: 6029022 - DNA, 16 bp, Homo sapiens
caggtccagctctgtg

SEQ ID NO: 6029023 - DNA, 17 bp, Homo sapiens
caggtccagctctgtgg

SEQ ID NO: 6029024 - DNA, 22 bp, Homo sapiens
caggtccagctttactgtggct

SEQ ID NO: 6029025 - DNA, 16 bp, Homo sapiens
caggtccaggctgtgt

SEQ ID NO: 6029026 - DNA, 16 bp, Homo sapiens
caggtccattctgttt

SEQ ID NO: 6029027 - DNA, 20 bp, Homo sapiens
caggtcccacctccagcccg

SEQ ID NO: 6029028 - DNA, 23 bp, Homo sapiens
caggtcccacctccagcccggga

SEQ ID NO: 6029029 - DNA, 20 bp, Homo sapiens
caggtcccagcccctcctcc

SEQ ID NO: 6029030 - DNA, 22 bp, Homo sapiens
caggtcccagcccctcctccct

SEQ ID NO: 6029031 - DNA, 18 bp, Homo sapiens
caggtccccatggcttgt

SEQ ID NO: 6029032 - DNA, 15 bp, Homo sapiens
caggtcccccgactg

SEQ ID NO: 6029033 - DNA, 18 bp, Homo sapiens
caggtcccccgactgcct

SEQ ID NO: 6029034 - DNA, 19 bp, Homo sapiens
caggtcccccgactgcctg

SEQ ID NO: 6029035 - DNA, 16 bp, Homo sapiens
caggtccccctgcagc

SEQ ID NO: 6029036 - DNA, 20 bp, Homo sapiens
caggtcccctggcccttcct

SEQ ID NO: 6029037 - DNA, 14 bp, Homo sapiens
caggtcccctttca

SEQ ID NO: 6029038 - DNA, 22 bp, Homo sapiens
caggtcccgagccccctgtcct

SEQ ID NO: 6029039 - DNA, 23 bp, Homo sapiens
caggtcccgagccccctgtcctt

SEQ ID NO: 6029040 - DNA, 16 bp, Homo sapiens
caggtccctaataaag

SEQ ID NO: 6029041 - DNA, 20 bp, Homo sapiens
caggtccctaataaagctgt

SEQ ID NO: 6029042 - DNA, 22 bp, Homo sapiens
caggtccctccgcggctggagc

SEQ ID NO: 6029043 - DNA, 23 bp, Homo sapiens
caggtccctcctttggaccctgt

SEQ ID NO: 6029044 - DNA, 16 bp, Homo sapiens
caggtccctggaccag

SEQ ID NO: 6029045 - DNA, 17 bp, Homo sapiens
caggtccctggaccagc

SEQ ID NO: 6029046 - DNA, 22 bp, Homo sapiens
caggtccctggaccagcctcct

SEQ ID NO: 6029047 - DNA, 16 bp, Homo sapiens
caggtccgtagctccc

SEQ ID NO: 6029048 - DNA, 19 bp, Homo sapiens
caggtccgtagctcccctg

SEQ ID NO: 6029049 - DNA, 21 bp, Homo sapiens
caggtcctcacagcagtcaca

SEQ ID NO: 6029050 - DNA, 22 bp, Homo sapiens
caggtcctcacagcagtcacag

SEQ ID NO: 6029051 - DNA, 15 bp, Homo sapiens
caggtcctcagagaa

SEQ ID NO: 6029052 - DNA, 20 bp, Homo sapiens
caggtcctcagtgtcctcag

SEQ ID NO: 6029053 - DNA, 22 bp, Homo sapiens
caggtcctctgatacccagagc

SEQ ID NO: 6029054 - DNA, 13 bp, Homo sapiens
caggtcctgccca

SEQ ID NO: 6029055 - DNA, 15 bp, Homo sapiens
caggtcctgctcagc

SEQ ID NO: 6029056 - DNA, 19 bp, Homo sapiens
caggtcctgctccgctgcc

SEQ ID NO: 6029057 - DNA, 22 bp, Homo sapiens
caggtcctgctccgctgcctgg

SEQ ID NO: 6029058 - DNA, 20 bp, Homo sapiens
caggtcctggtgggtcagcc

SEQ ID NO: 6029059 - DNA, 14 bp, Homo sapiens
caggtcctgtctct

SEQ ID NO: 6029060 - DNA, 16 bp, Homo sapiens
caggtcctgtctctgc

SEQ ID NO: 6029061 - DNA, 12 bp, Homo sapiens
caggtcctttcc

SEQ ID NO: 6029062 - DNA, 16 bp, Homo sapiens
caggtcctttccttct

SEQ ID NO: 6029063 - DNA, 16 bp, Homo sapiens
caggtcgcccacctgt

SEQ ID NO: 6029064 - DNA, 20 bp, Homo sapiens
caggtcggagtgcctggagt

SEQ ID NO: 6029065 - DNA, 17 bp, Homo sapiens
caggtcgggctcagctc

SEQ ID NO: 6029066 - DNA, 18 bp, Homo sapiens
caggtcgggctcagctct

SEQ ID NO: 6029067 - DNA, 17 bp, Homo sapiens
caggtcgggctgccagc

SEQ ID NO: 6029068 - DNA, 15 bp, Homo sapiens
caggtcgttcttatc

SEQ ID NO: 6029069 - DNA, 12 bp, Homo sapiens
caggtctagact

SEQ ID NO: 6029070 - DNA, 15 bp, Homo sapiens
caggtctagactttc

SEQ ID NO: 6029071 - DNA, 18 bp, Homo sapiens
caggtctagactttctca

SEQ ID NO: 6029072 - DNA, 14 bp, Homo sapiens
caggtctcactgct

SEQ ID NO: 6029073 - DNA, 13 bp, Homo sapiens
caggtctcagtga

SEQ ID NO: 6029074 - DNA, 12 bp, Homo sapiens
caggtctcccac

SEQ ID NO: 6029075 - DNA, 11 bp, Homo sapiens
caggtctcctc

SEQ ID NO: 6029076 - DNA, 13 bp, Homo sapiens
caggtctcctctt

SEQ ID NO: 6029077 - DNA, 14 bp, Homo sapiens
caggtctcctctta

SEQ ID NO: 6029078 - DNA, 22 bp, Homo sapiens
caggtctcctcttaaaaaataa

SEQ ID NO: 6029079 - DNA, 14 bp, Homo sapiens
caggtctcctgggc

SEQ ID NO: 6029080 - DNA, 15 bp, Homo sapiens
caggtctcctgggca

SEQ ID NO: 6029081 - DNA, 19 bp, Homo sapiens
caggtctcctgggcatctg

SEQ ID NO: 6029082 - DNA, 21 bp, Homo sapiens
caggtctcctgggcatctggc

SEQ ID NO: 6029083 - DNA, 22 bp, Homo sapiens
caggtctctccactgctctcag

SEQ ID NO: 6029084 - DNA, 20 bp, Homo sapiens
caggtctctgagacaggatc

SEQ ID NO: 6029085 - DNA, 19 bp, Homo sapiens
caggtctctggcagagaag

SEQ ID NO: 6029086 - DNA, 20 bp, Homo sapiens
caggtctctggcagagaagg

SEQ ID NO: 6029087 - DNA, 12 bp, Homo sapiens
caggtctctgtg

SEQ ID NO: 6029088 - DNA, 13 bp, Homo sapiens
caggtctctgtgg

SEQ ID NO: 6029089 - DNA, 15 bp, Homo sapiens
caggtctctgtttag

SEQ ID NO: 6029090 - DNA, 16 bp, Homo sapiens
caggtctcttctgggc

SEQ ID NO: 6029091 - DNA, 21 bp, Homo sapiens
caggtctgaagctcaactctc

SEQ ID NO: 6029092 - DNA, 20 bp, Homo sapiens
caggtctgaagttggccccc

SEQ ID NO: 6029093 - DNA, 14 bp, Homo sapiens
caggtctgactcca

SEQ ID NO: 6029094 - DNA, 17 bp, Homo sapiens
caggtctgactccaaag

SEQ ID NO: 6029095 - DNA, 14 bp, Homo sapiens
caggtctgatgcca

SEQ ID NO: 6029096 - DNA, 20 bp, Homo sapiens
caggtctgatgccaaagctg

SEQ ID NO: 6029097 - DNA, 21 bp, Homo sapiens
caggtctgatgccaaagctgc

SEQ ID NO: 6029098 - DNA, 13 bp, Homo sapiens
caggtctgcaagg

SEQ ID NO: 6029099 - DNA, 22 bp, Homo sapiens
caggtctgcaagggcccagagt

SEQ ID NO: 6029100 - DNA, 24 bp, Homo sapiens
caggtctgcaggccaccagctgct

SEQ ID NO: 6029101 - DNA, 15 bp, Homo sapiens
caggtctgcctggtt

SEQ ID NO: 6029102 - DNA, 12 bp, Homo sapiens
caggtctggcgc

SEQ ID NO: 6029103 - DNA, 16 bp, Homo sapiens
caggtctggcgccagg

SEQ ID NO: 6029104 - DNA, 22 bp, Homo sapiens
caggtctgggcaagtagcagga

SEQ ID NO: 6029105 - DNA, 20 bp, Homo sapiens
catttagtgaagttgtgcaa

SEQ ID NO: 6029106 - DNA, 19 bp, Homo sapiens
catttagtgagttattcct

SEQ ID NO: 6029107 - DNA, 17 bp, Homo sapiens
catttagtgctaaacaa

SEQ ID NO: 6029108 - DNA, 21 bp, Homo sapiens
catttagtggtggtagaaatg

SEQ ID NO: 6029109 - DNA, 23 bp, Homo sapiens
catttagttacaacctgaaggaa

SEQ ID NO: 6029110 - DNA, 15 bp, Homo sapiens
catttagttttatgg

SEQ ID NO: 6029111 - DNA, 15 bp, Homo sapiens
catttataaatgtgt

SEQ ID NO: 6029112 - DNA, 14 bp, Homo sapiens
catttataacccca

SEQ ID NO: 6029113 - DNA, 16 bp, Homo sapiens
catttataaccccagc

SEQ ID NO: 6029114 - DNA, 19 bp, Homo sapiens
catttataaccccagcctg

SEQ ID NO: 6029115 - DNA, 14 bp, Homo sapiens
catttataatgttt

SEQ ID NO: 6029116 - DNA, 17 bp, Homo sapiens
catttataatgtttgct

SEQ ID NO: 6029117 - DNA, 15 bp, Homo sapiens
catttataattgcat

SEQ ID NO: 6029118 - DNA, 20 bp, Homo sapiens
catttatacaaattagaaaa

SEQ ID NO: 6029119 - DNA, 19 bp, Homo sapiens
catttatacctttgaaata

SEQ ID NO: 6029120 - DNA, 17 bp, Homo sapiens
catttatactgtagcaa

SEQ ID NO: 6029121 - DNA, 21 bp, Homo sapiens
catttatactgtagcaatata

SEQ ID NO: 6029122 - DNA, 19 bp, Homo sapiens
catttatagatcatttcta

SEQ ID NO: 6029123 - DNA, 12 bp, Homo sapiens
catttatatatg

SEQ ID NO: 6029124 - DNA, 15 bp, Homo sapiens
catttatatatgaaa

SEQ ID NO: 6029125 - DNA, 13 bp, Homo sapiens
catttatattgat

SEQ ID NO: 6029126 - DNA, 14 bp, Homo sapiens
catttatattgata

SEQ ID NO: 6029127 - DNA, 20 bp, Homo sapiens
catttatattgataagatct

SEQ ID NO: 6029128 - DNA, 22 bp, Homo sapiens
catttatattgcagattgaata

SEQ ID NO: 6029129 - DNA, 16 bp, Homo sapiens
catttatatttgtgta

SEQ ID NO: 6029130 - DNA, 15 bp, Homo sapiens
catttatatttttaa

SEQ ID NO: 6029131 - DNA, 11 bp, Homo sapiens
catttatcaat

SEQ ID NO: 6029132 - DNA, 17 bp, Homo sapiens
catttatcactctgacc

SEQ ID NO: 6029133 - DNA, 19 bp, Homo sapiens
catttatcctagaaaattg

SEQ ID NO: 6029134 - DNA, 22 bp, Homo sapiens
catttatctaaaagaatttaaa

SEQ ID NO: 6029135 - DNA, 15 bp, Homo sapiens
catttatctactatt

SEQ ID NO: 6029136 - DNA, 16 bp, Homo sapiens
catttatctattaaaa

SEQ ID NO: 6029137 - DNA, 23 bp, Homo sapiens
catttatctattaaaattgccat

SEQ ID NO: 6029138 - DNA, 17 bp, Homo sapiens
catttatcttctgtttt

SEQ ID NO: 6029139 - DNA, 20 bp, Homo sapiens
catttatcttctgtttttct

SEQ ID NO: 6029140 - DNA, 23 bp, Homo sapiens
catttatcttctgtttttctcaa

SEQ ID NO: 6029141 - DNA, 12 bp, Homo sapiens
catttatcttga

SEQ ID NO: 6029142 - DNA, 16 bp, Homo sapiens
catttatcttgaagga

SEQ ID NO: 6029143 - DNA, 17 bp, Homo sapiens
catttatcttgaaggaa

SEQ ID NO: 6029144 - DNA, 17 bp, Homo sapiens
catttatctttctacag

SEQ ID NO: 6029145 - DNA, 21 bp, Homo sapiens
catttatctttgtattcttca

SEQ ID NO: 6029146 - DNA, 23 bp, Homo sapiens
catttatctttgtattcttcatg

SEQ ID NO: 6029147 - DNA, 19 bp, Homo sapiens
catttatgacaagctgtat

SEQ ID NO: 6029148 - DNA, 23 bp, Homo sapiens
catttatgagtaactattattat

SEQ ID NO: 6029149 - DNA, 16 bp, Homo sapiens
catttatgatttaata

SEQ ID NO: 6029150 - DNA, 21 bp, Homo sapiens
catttatgcatgagaactaaa

SEQ ID NO: 6029151 - DNA, 18 bp, Homo sapiens
catttatggaacttccct

SEQ ID NO: 6029152 - DNA, 14 bp, Homo sapiens
catttatgtacaaa

SEQ ID NO: 6029153 - DNA, 17 bp, Homo sapiens
catttatgtacaaaatg

SEQ ID NO: 6029154 - DNA, 19 bp, Homo sapiens
catttatgtacaaaatgaa

SEQ ID NO: 6029155 - DNA, 23 bp, Homo sapiens
catttatgtctcatgtaatttgc

SEQ ID NO: 6029156 - DNA, 22 bp, Homo sapiens
catttatgtgaggtaattattg

SEQ ID NO: 6029157 - DNA, 18 bp, Homo sapiens
catttatgtgtcagttca

SEQ ID NO: 6029158 - DNA, 13 bp, Homo sapiens
catttatgtgtga

SEQ ID NO: 6029159 - DNA, 20 bp, Homo sapiens
catttatgttatttatgatg

SEQ ID NO: 6029160 - DNA, 16 bp, Homo sapiens
catttattaagcagta

SEQ ID NO: 6029161 - DNA, 14 bp, Homo sapiens
catttattaagtat

SEQ ID NO: 6029162 - DNA, 21 bp, Homo sapiens
catttattaagtatatttgta

SEQ ID NO: 6029163 - DNA, 15 bp, Homo sapiens
catttattctgctca

SEQ ID NO: 6029164 - DNA, 13 bp, Homo sapiens
catttattgttta

SEQ ID NO: 6029165 - DNA, 20 bp, Homo sapiens
catttattgtttgaaatgtc

SEQ ID NO: 6029166 - DNA, 18 bp, Homo sapiens
catttatttaaaactacc

SEQ ID NO: 6029167 - DNA, 20 bp, Homo sapiens
catttatttatacagtgcct

SEQ ID NO: 6029168 - DNA, 23 bp, Homo sapiens
catttatttatccagaaaactgt

SEQ ID NO: 6029169 - DNA, 12 bp, Homo sapiens
catttatttatg

SEQ ID NO: 6029170 - DNA, 14 bp, Homo sapiens
catttatttattca

SEQ ID NO: 6029171 - DNA, 15 bp, Homo sapiens
catttatttattcat

SEQ ID NO: 6029172 - DNA, 12 bp, Homo sapiens
catttatttctc

SEQ ID NO: 6029173 - DNA, 13 bp, Homo sapiens
catttatttgtga

SEQ ID NO: 6029174 - DNA, 15 bp, Homo sapiens
catttattttataac

SEQ ID NO: 6029175 - DNA, 15 bp, Homo sapiens
catttattttatgag

SEQ ID NO: 6029176 - DNA, 18 bp, Homo sapiens
catttattttatgagaaa

SEQ ID NO: 6029177 - DNA, 22 bp, Homo sapiens
catttattttgactgtgattta

SEQ ID NO: 6029178 - DNA, 15 bp, Homo sapiens
catttattttgagaa

SEQ ID NO: 6029179 - DNA, 20 bp, Homo sapiens
catttatttttaaaataatt

SEQ ID NO: 6029180 - DNA, 21 bp, Homo sapiens
catttatttttagttaaaaat

SEQ ID NO: 6029181 - DNA, 17 bp, Homo sapiens
catttattttttacatt

SEQ ID NO: 6029182 - DNA, 22 bp, Homo sapiens
catttattttttttaaagaaaa

SEQ ID NO: 6029183 - DNA, 15 bp, Homo sapiens
catttcaaaatgctt

SEQ ID NO: 6029184 - DNA, 15 bp, Homo sapiens
catttcaaaattaat

SEQ ID NO: 6029185 - DNA, 17 bp, Homo sapiens
catttcaaataactgca

SEQ ID NO: 6029186 - DNA, 19 bp, Homo sapiens
catttcaaataactgcaga

SEQ ID NO: 6029187 - DNA, 14 bp, Homo sapiens
catttcaactccag

SEQ ID NO: 6029188 - DNA, 16 bp, Homo sapiens
catttcaactccagaa

SEQ ID NO: 6029189 - DNA, 14 bp, Homo sapiens
catttcaaggaaca

SEQ ID NO: 6029190 - DNA, 14 bp, Homo sapiens
catttcaaggcagt

SEQ ID NO: 6029191 - DNA, 14 bp, Homo sapiens
catttcaagtttac

SEQ ID NO: 6029192 - DNA, 22 bp, Homo sapiens
catttcaatgtcagcctttgtt

SEQ ID NO: 6029193 - DNA, 16 bp, Homo sapiens
catttcaattcctggc

SEQ ID NO: 6029194 - DNA, 15 bp, Homo sapiens
catttcaattgcttt

SEQ ID NO: 6029195 - DNA, 14 bp, Homo sapiens
catttcaatttata

SEQ ID NO: 6029196 - DNA, 20 bp, Homo sapiens
catttcaatttataacgttc

SEQ ID NO: 6029197 - DNA, 20 bp, Homo sapiens
catttcacaaaacagccttt

SEQ ID NO: 6029198 - DNA, 17 bp, Homo sapiens
catttcacacaggtcct

SEQ ID NO: 6029199 - DNA, 13 bp, Homo sapiens
catttcacacagt

SEQ ID NO: 6029200 - DNA, 15 bp, Homo sapiens
catttcacattcctg

SEQ ID NO: 6029201 - DNA, 20 bp, Homo sapiens
catttcacattcctgaccct

SEQ ID NO: 6029202 - DNA, 16 bp, Homo sapiens
catttcacattgaatc

SEQ ID NO: 6029203 - DNA, 15 bp, Homo sapiens
catttcaccatggcc

SEQ ID NO: 6029204 - DNA, 15 bp, Homo sapiens
catttcacccctccc

SEQ ID NO: 6029205 - DNA, 17 bp, Homo sapiens
catttcacccctccctt

SEQ ID NO: 6029206 - DNA, 18 bp, Homo sapiens
catttcacccctcccttt

SEQ ID NO: 6029207 - DNA, 21 bp, Homo sapiens
catttcacccctccctttctc

SEQ ID NO: 6029208 - DNA, 23 bp, Homo sapiens
catttcacccctccctttctccc

SEQ ID NO: 6029209 - DNA, 23 bp, Homo sapiens
catttcacgggcaacactcactg

SEQ ID NO: 6029210 - DNA, 20 bp, Homo sapiens
catttcactaagctcctcct

SEQ ID NO: 6029211 - DNA, 14 bp, Homo sapiens
catttcactgtcta

SEQ ID NO: 6029212 - DNA, 15 bp, Homo sapiens
catttcactgtctgt

SEQ ID NO: 6029213 - DNA, 19 bp, Homo sapiens
catttcacttgtcaggagt

SEQ ID NO: 6029214 - DNA, 17 bp, Homo sapiens
catttcactttaaagtc

SEQ ID NO: 6029215 - DNA, 15 bp, Homo sapiens
catttcacttttctg

SEQ ID NO: 6029216 - DNA, 17 bp, Homo sapiens
catttcagaaagccttt

SEQ ID NO: 6029217 - DNA, 20 bp, Homo sapiens
catttcagaaggtatcagtt

SEQ ID NO: 6029218 - DNA, 21 bp, Homo sapiens
catttcagaagttagtttgta

SEQ ID NO: 6029219 - DNA, 12 bp, Homo sapiens
catttcagattt

SEQ ID NO: 6029220 - DNA, 13 bp, Homo sapiens
catttcagatttt

SEQ ID NO: 6029221 - DNA, 19 bp, Homo sapiens
catttcagattttaaaaag

SEQ ID NO: 6029222 - DNA, 17 bp, Homo sapiens
catttcagcttgaacct

SEQ ID NO: 6029223 - DNA, 17 bp, Homo sapiens
catttcaggaatttaaa

SEQ ID NO: 6029224 - DNA, 15 bp, Homo sapiens
catttcaggactctc

SEQ ID NO: 6029225 - DNA, 21 bp, Homo sapiens
catttcaggactctctccagg

SEQ ID NO: 6029226 - DNA, 13 bp, Homo sapiens
catttcaggaggg

SEQ ID NO: 6029227 - DNA, 23 bp, Homo sapiens
catttcagggagaaactccaaag

SEQ ID NO: 6029228 - DNA, 15 bp, Homo sapiens
catttcagtggcttc

SEQ ID NO: 6029229 - DNA, 22 bp, Homo sapiens
catttcatattattttagtgtg

SEQ ID NO: 6029230 - DNA, 20 bp, Homo sapiens
catttcatattctttcaatt

SEQ ID NO: 6029231 - DNA, 18 bp, Homo sapiens
catttcatcattgtttct

SEQ ID NO: 6029232 - DNA, 19 bp, Homo sapiens
catttcatcattgtttctg

SEQ ID NO: 6029233 - DNA, 21 bp, Homo sapiens
catttcatccaccaatatcat

SEQ ID NO: 6029234 - DNA, 19 bp, Homo sapiens
catttcatccatatttctt

SEQ ID NO: 6029235 - DNA, 15 bp, Homo sapiens
catttcatctaattt

SEQ ID NO: 6029236 - DNA, 21 bp, Homo sapiens
catttcatctaccattttctg

SEQ ID NO: 6029237 - DNA, 15 bp, Homo sapiens
catttcatctatttc

SEQ ID NO: 6029238 - DNA, 15 bp, Homo sapiens
catttcatctcattt

SEQ ID NO: 6029239 - DNA, 15 bp, Homo sapiens
catttcatgaaaaag

SEQ ID NO: 6029240 - DNA, 17 bp, Homo sapiens
catttcatgaaaaagct

SEQ ID NO: 6029241 - DNA, 16 bp, Homo sapiens
catttcatgtatagtt

SEQ ID NO: 6029242 - DNA, 18 bp, Homo sapiens
catttcatgtccataaaa

SEQ ID NO: 6029243 - DNA, 16 bp, Homo sapiens
catttcatgtcctgtg

SEQ ID NO: 6029244 - DNA, 15 bp, Homo sapiens
catttcatgtgatct

SEQ ID NO: 6029245 - DNA, 22 bp, Homo sapiens
catttcatgtgatctattactc

SEQ ID NO: 6029246 - DNA, 15 bp, Homo sapiens
catttcattcctaac

SEQ ID NO: 6029247 - DNA, 18 bp, Homo sapiens
catttcattcctaacaca

SEQ ID NO: 6029248 - DNA, 12 bp, Homo sapiens
catttcattgta

SEQ ID NO: 6029249 - DNA, 20 bp, Homo sapiens
catttcattgtatgatgtgt

SEQ ID NO: 6029250 - DNA, 23 bp, Homo sapiens
catttcattgtatgatgtgttgt

SEQ ID NO: 6029251 - DNA, 22 bp, Homo sapiens
catttcatttatactgtagcaa

SEQ ID NO: 6029252 - DNA, 18 bp, Homo sapiens
catttcatttgtgccaga

SEQ ID NO: 6029253 - DNA, 19 bp, Homo sapiens
catttccaaaccatcagct

SEQ ID NO: 6029254 - DNA, 21 bp, Homo sapiens
catttccaaaccatcagctgc

SEQ ID NO: 6029255 - DNA, 17 bp, Homo sapiens
catttccaaacttgaaa

SEQ ID NO: 6029256 - DNA, 15 bp, Homo sapiens
catttccaaatgaac

SEQ ID NO: 6029257 - DNA, 22 bp, Homo sapiens
catttccaaatgtggcctccat

SEQ ID NO: 6029258 - DNA, 18 bp, Homo sapiens
catttccaacaccacaga

SEQ ID NO: 6029259 - DNA, 17 bp, Homo sapiens
catttccaactcaggtt

SEQ ID NO: 6029260 - DNA, 13 bp, Homo sapiens
catttccaagctg

SEQ ID NO: 6029261 - DNA, 21 bp, Homo sapiens
catttccaccaggccgtgcct

SEQ ID NO: 6029262 - DNA, 13 bp, Homo sapiens
catttccagcttc

SEQ ID NO: 6029263 - DNA, 14 bp, Homo sapiens
catttccagcttct

SEQ ID NO: 6029264 - DNA, 12 bp, Homo sapiens
catttccatgta

SEQ ID NO: 6029265 - DNA, 15 bp, Homo sapiens
catttccatgtatgc

SEQ ID NO: 6029266 - DNA, 17 bp, Homo sapiens
catttccatgtatgcat

SEQ ID NO: 6029267 - DNA, 21 bp, Homo sapiens
catttccatgtcccctcccag

SEQ ID NO: 6029268 - DNA, 19 bp, Homo sapiens
catttccatttaagcaatt

SEQ ID NO: 6029269 - DNA, 19 bp, Homo sapiens
catttcccaaagtcctctg

SEQ ID NO: 6029270 - DNA, 20 bp, Homo sapiens
catttcccaaagtcctctgc

SEQ ID NO: 6029271 - DNA, 22 bp, Homo sapiens
catttcccaaagtcctctgctc

SEQ ID NO: 6029272 - DNA, 18 bp, Homo sapiens
catttcccaacacaaaga

SEQ ID NO: 6029273 - DNA, 17 bp, Homo sapiens
catttcccacatctttc

SEQ ID NO: 6029274 - DNA, 15 bp, Homo sapiens
catttcccatctgca

SEQ ID NO: 6029275 - DNA, 17 bp, Homo sapiens
catttcccatctgcacc

SEQ ID NO: 6029276 - DNA, 20 bp, Homo sapiens
catttcccatctgcacccct

SEQ ID NO: 6029277 - DNA, 20 bp, Homo sapiens
catttccccagacctgagct

SEQ ID NO: 6029278 - DNA, 16 bp, Homo sapiens
catttccccagggcac

SEQ ID NO: 6029279 - DNA, 15 bp, Homo sapiens
catttcccccaaagg

SEQ ID NO: 6029280 - DNA, 23 bp, Homo sapiens
catttcccccgagctcttggcct

SEQ ID NO: 6029281 - DNA, 17 bp, Homo sapiens
catttccccctcctcag

SEQ ID NO: 6029282 - DNA, 22 bp, Homo sapiens
catttcccctcccaatcctctc

SEQ ID NO: 6029283 - DNA, 21 bp, Homo sapiens
caggtctggggcttttagagc

SEQ ID NO: 6029284 - DNA, 22 bp, Homo sapiens
caggtcttcatatttttgatca

SEQ ID NO: 6029285 - DNA, 20 bp, Homo sapiens
caggtcttcatcgaatctac

SEQ ID NO: 6029286 - DNA, 19 bp, Homo sapiens
caggtcttccagacctgct

SEQ ID NO: 6029287 - DNA, 22 bp, Homo sapiens
caggtcttccggggccatgggc

SEQ ID NO: 6029288 - DNA, 21 bp, Homo sapiens
caggtcttgaactcctggcct

SEQ ID NO: 6029289 - DNA, 22 bp, Homo sapiens
caggtcttgaactcctggcctc

SEQ ID NO: 6029290 - DNA, 23 bp, Homo sapiens
caggtcttgaactcctggcctca

SEQ ID NO: 6029291 - DNA, 16 bp, Homo sapiens
caggtcttgcccaaag

SEQ ID NO: 6029292 - DNA, 20 bp, Homo sapiens
caggtcttggagctgagcct

SEQ ID NO: 6029293 - DNA, 23 bp, Homo sapiens
caggtcttggagctgagcctctc

SEQ ID NO: 6029294 - DNA, 23 bp, Homo sapiens
caggtcttggggtcatgaagggc

SEQ ID NO: 6029295 - DNA, 12 bp, Homo sapiens
caggtctttgaa

SEQ ID NO: 6029296 - DNA, 21 bp, Homo sapiens
caggtctttgaaatatgcatg

SEQ ID NO: 6029297 - DNA, 16 bp, Homo sapiens
caggtctttgggaagc

SEQ ID NO: 6029298 - DNA, 16 bp, Homo sapiens
caggtcttttctttgg

SEQ ID NO: 6029299 - DNA, 17 bp, Homo sapiens
caggtgaaatccacacc

SEQ ID NO: 6029300 - DNA, 13 bp, Homo sapiens
caggtgaacactt

SEQ ID NO: 6029301 - DNA, 18 bp, Homo sapiens
caggtgaacgctcagcgc

SEQ ID NO: 6029302 - DNA, 23 bp, Homo sapiens
caggtgaaggaggctccaggcag

SEQ ID NO: 6029303 - DNA, 23 bp, Homo sapiens
caggtgacacgcttctgagcagg

SEQ ID NO: 6029304 - DNA, 15 bp, Homo sapiens
caggtgacagtgaag

SEQ ID NO: 6029305 - DNA, 20 bp, Homo sapiens
caggtgacagtggctgctct

SEQ ID NO: 6029306 - DNA, 12 bp, Homo sapiens
caggtgacatgt

SEQ ID NO: 6029307 - DNA, 17 bp, Homo sapiens
caggtgacatgtgaaac

SEQ ID NO: 6029308 - DNA, 21 bp, Homo sapiens
caggtgacatgtgaaaccttt

SEQ ID NO: 6029309 - DNA, 15 bp, Homo sapiens
caggtgaccagaatg

SEQ ID NO: 6029310 - DNA, 16 bp, Homo sapiens
caggtgaccagaatga

SEQ ID NO: 6029311 - DNA, 17 bp, Homo sapiens
caggtgaccagaatgag

SEQ ID NO: 6029312 - DNA, 21 bp, Homo sapiens
caggtgacggactcagactcc

SEQ ID NO: 6029313 - DNA, 21 bp, Homo sapiens
caggtgactaccctagttcaa

SEQ ID NO: 6029314 - DNA, 14 bp, Homo sapiens
caggtgactggagc

SEQ ID NO: 6029315 - DNA, 15 bp, Homo sapiens
caggtgactggagcc

SEQ ID NO: 6029316 - DNA, 18 bp, Homo sapiens
caggtgactgtgctgtgc

SEQ ID NO: 6029317 - DNA, 19 bp, Homo sapiens
caggtgacttctagcagag

SEQ ID NO: 6029318 - DNA, 20 bp, Homo sapiens
caggtgacttctagcagaga

SEQ ID NO: 6029319 - DNA, 22 bp, Homo sapiens
caggtgagaaactgtttgaaaa

SEQ ID NO: 6029320 - DNA, 17 bp, Homo sapiens
caggtgagaacatccat

SEQ ID NO: 6029321 - DNA, 18 bp, Homo sapiens
caggtgagaacccagaga

SEQ ID NO: 6029322 - DNA, 19 bp, Homo sapiens
caggtgagaacccagagag

SEQ ID NO: 6029323 - DNA, 13 bp, Homo sapiens
caggtgagaagca

SEQ ID NO: 6029324 - DNA, 20 bp, Homo sapiens
caggtgagaagcagaggaag

SEQ ID NO: 6029325 - DNA, 21 bp, Homo sapiens
caggtgagaagcagaggaagg

SEQ ID NO: 6029326 - DNA, 19 bp, Homo sapiens
caggtgagaagtgagggag

SEQ ID NO: 6029327 - DNA, 14 bp, Homo sapiens
caggtgagaattca

SEQ ID NO: 6029328 - DNA, 14 bp, Homo sapiens
caggtgagcagaca

SEQ ID NO: 6029329 - DNA, 14 bp, Homo sapiens
caggtgagccaagg

SEQ ID NO: 6029330 - DNA, 17 bp, Homo sapiens
caggtgagcccatggcc

SEQ ID NO: 6029331 - DNA, 19 bp, Homo sapiens
caggtgaggaatttgaagc

SEQ ID NO: 6029332 - DNA, 20 bp, Homo sapiens
caggtgaggcccaagagccc

SEQ ID NO: 6029333 - DNA, 14 bp, Homo sapiens
caggtgagggaagg

SEQ ID NO: 6029334 - DNA, 16 bp, Homo sapiens
caggtgagggaaggag

SEQ ID NO: 6029335 - DNA, 20 bp, Homo sapiens
caggtgaggggcaggacctg

SEQ ID NO: 6029336 - DNA, 16 bp, Homo sapiens
caggtgaggtctgttc

SEQ ID NO: 6029337 - DNA, 22 bp, Homo sapiens
caggtgagtcctagagctacag

SEQ ID NO: 6029338 - DNA, 15 bp, Homo sapiens
caggtgagtgtgagg

SEQ ID NO: 6029339 - DNA, 22 bp, Homo sapiens
caggtgatccacccacctcagc

SEQ ID NO: 6029340 - DNA, 23 bp, Homo sapiens
caggtgatccacccacctcagcc

SEQ ID NO: 6029341 - DNA, 14 bp, Homo sapiens
caggtgatccgccc

SEQ ID NO: 6029342 - DNA, 21 bp, Homo sapiens
caggtgattggaccaggccat

SEQ ID NO: 6029343 - DNA, 17 bp, Homo sapiens
caggtgatttcctctaa

SEQ ID NO: 6029344 - DNA, 22 bp, Homo sapiens
caggtgatttcctctaaagaaa

SEQ ID NO: 6029345 - DNA, 24 bp, Homo sapiens
caggtgcaaccagggagctgcagg

SEQ ID NO: 6029346 - DNA, 14 bp, Homo sapiens
caggtgcaagagac

SEQ ID NO: 6029347 - DNA, 15 bp, Homo sapiens
caggtgcaagagaca

SEQ ID NO: 6029348 - DNA, 17 bp, Homo sapiens
caggtgcaagagacaga

SEQ ID NO: 6029349 - DNA, 21 bp, Homo sapiens
caggtgcaagagacagagccc

SEQ ID NO: 6029350 - DNA, 20 bp, Homo sapiens
caggtgcacaagctccaagc

SEQ ID NO: 6029351 - DNA, 21 bp, Homo sapiens
caggtgcacaagctccaagct

SEQ ID NO: 6029352 - DNA, 20 bp, Homo sapiens
caggtgcacacatcaccagg

SEQ ID NO: 6029353 - DNA, 23 bp, Homo sapiens
caggtgcacagacgtccctccac

SEQ ID NO: 6029354 - DNA, 23 bp, Homo sapiens
caggtgcacgccaccacacctgg

SEQ ID NO: 6029355 - DNA, 13 bp, Homo sapiens
caggtgcagacct

SEQ ID NO: 6029356 - DNA, 17 bp, Homo sapiens
caggtgcagaccttggg

SEQ ID NO: 6029357 - DNA, 13 bp, Homo sapiens
caggtgcagaggt

SEQ ID NO: 6029358 - DNA, 14 bp, Homo sapiens
caggtgcagccaga

SEQ ID NO: 6029359 - DNA, 15 bp, Homo sapiens
caggtgcagccagag

SEQ ID NO: 6029360 - DNA, 18 bp, Homo sapiens
caggtgcagcccccactg

SEQ ID NO: 6029361 - DNA, 20 bp, Homo sapiens
caggtgcagcccccactgcc

SEQ ID NO: 6029362 - DNA, 14 bp, Homo sapiens
caggtgcagccctt

SEQ ID NO: 6029363 - DNA, 13 bp, Homo sapiens
caggtgcagtccc

SEQ ID NO: 6029364 - DNA, 13 bp, Homo sapiens
caggtgcatttct

SEQ ID NO: 6029365 - DNA, 15 bp, Homo sapiens
caggtgccaccaata

SEQ ID NO: 6029366 - DNA, 18 bp, Homo sapiens
caggtgccaccaataaaa

SEQ ID NO: 6029367 - DNA, 13 bp, Homo sapiens
caggtgccactcc

SEQ ID NO: 6029368 - DNA, 16 bp, Homo sapiens
caggtgccactccctg

SEQ ID NO: 6029369 - DNA, 12 bp, Homo sapiens
caggtgccactg

SEQ ID NO: 6029370 - DNA, 23 bp, Homo sapiens
caggtgccagcctgaggcagcca

SEQ ID NO: 6029371 - DNA, 15 bp, Homo sapiens
caggtgccaggaact

SEQ ID NO: 6029372 - DNA, 18 bp, Homo sapiens
caggtgccagggcccacc

SEQ ID NO: 6029373 - DNA, 19 bp, Homo sapiens
caggtgccagggcccaccc

SEQ ID NO: 6029374 - DNA, 14 bp, Homo sapiens
caggtgccatgcct

SEQ ID NO: 6029375 - DNA, 18 bp, Homo sapiens
caggtgccatgcctgctc

SEQ ID NO: 6029376 - DNA, 22 bp, Homo sapiens
caggtgccatgcctgctccctg

SEQ ID NO: 6029377 - DNA, 17 bp, Homo sapiens
caggtgcccatccctgg

SEQ ID NO: 6029378 - DNA, 20 bp, Homo sapiens
caggtgcccatccctggaag

SEQ ID NO: 6029379 - DNA, 14 bp, Homo sapiens
caggtgccccacct

SEQ ID NO: 6029380 - DNA, 15 bp, Homo sapiens
caggtgccccacctc

SEQ ID NO: 6029381 - DNA, 15 bp, Homo sapiens
caggtgcccccaggt

SEQ ID NO: 6029382 - DNA, 16 bp, Homo sapiens
caggtgcccccaggtg

SEQ ID NO: 6029383 - DNA, 17 bp, Homo sapiens
caggtgcccccaggtga

SEQ ID NO: 6029384 - DNA, 18 bp, Homo sapiens
caggtgcccccaggtgag

SEQ ID NO: 6029385 - DNA, 21 bp, Homo sapiens
caggtgccccgactgtgggac

SEQ ID NO: 6029386 - DNA, 15 bp, Homo sapiens
caggtgccccgtggt

SEQ ID NO: 6029387 - DNA, 18 bp, Homo sapiens
caggtgcccctcttccaa

SEQ ID NO: 6029388 - DNA, 19 bp, Homo sapiens
caggtgcccctcttccaaa

SEQ ID NO: 6029389 - DNA, 18 bp, Homo sapiens
caggtgcccgccaccaca

SEQ ID NO: 6029390 - DNA, 15 bp, Homo sapiens
caggtgccctgtggg

SEQ ID NO: 6029391 - DNA, 21 bp, Homo sapiens
caggtgccgacactgagctgt

SEQ ID NO: 6029392 - DNA, 19 bp, Homo sapiens
caggtgccgccagctgccg

SEQ ID NO: 6029393 - DNA, 12 bp, Homo sapiens
caggtgcctcca

SEQ ID NO: 6029394 - DNA, 17 bp, Homo sapiens
caggtgcctccaggtgt

SEQ ID NO: 6029395 - DNA, 18 bp, Homo sapiens
caggtgcctcccagccct

SEQ ID NO: 6029396 - DNA, 15 bp, Homo sapiens
caggtgcctcctgac

SEQ ID NO: 6029397 - DNA, 15 bp, Homo sapiens
caggtgcctgaacta

SEQ ID NO: 6029398 - DNA, 12 bp, Homo sapiens
caggtgcctgga

SEQ ID NO: 6029399 - DNA, 14 bp, Homo sapiens
caggtgcctggctt

SEQ ID NO: 6029400 - DNA, 22 bp, Homo sapiens
caggtgcctggcttgctgtggc

SEQ ID NO: 6029401 - DNA, 13 bp, Homo sapiens
caggtgcctgggg

SEQ ID NO: 6029402 - DNA, 18 bp, Homo sapiens
caggtgcctggggctggc

SEQ ID NO: 6029403 - DNA, 22 bp, Homo sapiens
caggtgcctggggctggctgca

SEQ ID NO: 6029404 - DNA, 14 bp, Homo sapiens
caggtgcctgtcct

SEQ ID NO: 6029405 - DNA, 14 bp, Homo sapiens
caggtgccttggag

SEQ ID NO: 6029406 - DNA, 15 bp, Homo sapiens
caggtgcctttcaaa

SEQ ID NO: 6029407 - DNA, 14 bp, Homo sapiens
caggtgcgaaagga

SEQ ID NO: 6029408 - DNA, 20 bp, Homo sapiens
caggtgcgcgccaccgtgcc

SEQ ID NO: 6029409 - DNA, 16 bp, Homo sapiens
caggtgcggcctgggg

SEQ ID NO: 6029410 - DNA, 17 bp, Homo sapiens
caggtgcggcctggggg

SEQ ID NO: 6029411 - DNA, 20 bp, Homo sapiens
caggtgcggcctggggggaa

SEQ ID NO: 6029412 - DNA, 22 bp, Homo sapiens
caggtgcggcctggggggaacg

SEQ ID NO: 6029413 - DNA, 20 bp, Homo sapiens
caggtgctaatttgttttgg

SEQ ID NO: 6029414 - DNA, 14 bp, Homo sapiens
caggtgctacaaca

SEQ ID NO: 6029415 - DNA, 19 bp, Homo sapiens
caggtgctacaacatgtga

SEQ ID NO: 6029416 - DNA, 21 bp, Homo sapiens
caggtgctacacccttttcca

SEQ ID NO: 6029417 - DNA, 18 bp, Homo sapiens
caggtgctaggaacactc

SEQ ID NO: 6029418 - DNA, 20 bp, Homo sapiens
caggtgctaggaacactcct

SEQ ID NO: 6029419 - DNA, 16 bp, Homo sapiens
caggtgctagggtgcc

SEQ ID NO: 6029420 - DNA, 18 bp, Homo sapiens
caggtgctagggtgcctg

SEQ ID NO: 6029421 - DNA, 19 bp, Homo sapiens
caggtgctagggtgcctgc

SEQ ID NO: 6029422 - DNA, 21 bp, Homo sapiens
caggtgctatgtcccaagagc

SEQ ID NO: 6029423 - DNA, 22 bp, Homo sapiens
caggtgctatgtcccaagagcc

SEQ ID NO: 6029424 - DNA, 18 bp, Homo sapiens
caggtgctattgttactc

SEQ ID NO: 6029425 - DNA, 17 bp, Homo sapiens
caggtgctcaaaatgca

SEQ ID NO: 6029426 - DNA, 22 bp, Homo sapiens
caggtgctcaataaacacttgt

SEQ ID NO: 6029427 - DNA, 21 bp, Homo sapiens
caggtgctcagcccaggcaca

SEQ ID NO: 6029428 - DNA, 11 bp, Homo sapiens
caggtgctcat

SEQ ID NO: 6029429 - DNA, 19 bp, Homo sapiens
caggtgctcatgctgctcc

SEQ ID NO: 6029430 - DNA, 14 bp, Homo sapiens
caggtgctcccctg

SEQ ID NO: 6029431 - DNA, 23 bp, Homo sapiens
caggtgctcccctgacagtccct

SEQ ID NO: 6029432 - DNA, 22 bp, Homo sapiens
caggtgctgacaatactgctgc

SEQ ID NO: 6029433 - DNA, 14 bp, Homo sapiens
caggtgctgccatc

SEQ ID NO: 6029434 - DNA, 13 bp, Homo sapiens
caggtgctgctac

SEQ ID NO: 6029435 - DNA, 21 bp, Homo sapiens
caggtgctgctgatgcgctgg

SEQ ID NO: 6029436 - DNA, 21 bp, Homo sapiens
caggtgctggagcactgggct

SEQ ID NO: 6029437 - DNA, 22 bp, Homo sapiens
caggtgctggagcactgggctc

SEQ ID NO: 6029438 - DNA, 20 bp, Homo sapiens
caggtgctggaggcagactc

SEQ ID NO: 6029439 - DNA, 20 bp, Homo sapiens
caggtgctggcccagcatgg

SEQ ID NO: 6029440 - DNA, 15 bp, Homo sapiens
caggtgctgggctgg

SEQ ID NO: 6029441 - DNA, 19 bp, Homo sapiens
caggtgctgggctggactg

SEQ ID NO: 6029442 - DNA, 18 bp, Homo sapiens
caggtgctggggcctggt

SEQ ID NO: 6029443 - DNA, 14 bp, Homo sapiens
caggtgctggtccc

SEQ ID NO: 6029444 - DNA, 19 bp, Homo sapiens
caggtggaacaaacagaaa

SEQ ID NO: 6029445 - DNA, 23 bp, Homo sapiens
caggtggaacaggaggaactggt

SEQ ID NO: 6029446 - DNA, 16 bp, Homo sapiens
caggtggactctggga

SEQ ID NO: 6029447 - DNA, 15 bp, Homo sapiens
caggtggactgactg

SEQ ID NO: 6029448 - DNA, 18 bp, Homo sapiens
caggtggagggcacagcc

SEQ ID NO: 6029449 - DNA, 23 bp, Homo sapiens
caggtggagggcacagccctccg

SEQ ID NO: 6029450 - DNA, 22 bp, Homo sapiens
caggtggagggtttgcactcca

SEQ ID NO: 6029451 - DNA, 18 bp, Homo sapiens
caggtggaggtgccagga

SEQ ID NO: 6029452 - DNA, 23 bp, Homo sapiens
caggtggaggtgtcaggctgctg

SEQ ID NO: 6029453 - DNA, 16 bp, Homo sapiens
caggtggaggtgtggg

SEQ ID NO: 6029454 - DNA, 15 bp, Homo sapiens
caggtggatctcctt

SEQ ID NO: 6029455 - DNA, 24 bp, Homo sapiens
caggtggattttgtggaggtgaga

SEQ ID NO: 6029456 - DNA, 16 bp, Homo sapiens
caggtggcaaagtact

SEQ ID NO: 6029457 - DNA, 12 bp, Homo sapiens
caggtggcacct

SEQ ID NO: 6029458 - DNA, 19 bp, Homo sapiens
caggtggccaagttcctct

SEQ ID NO: 6029459 - DNA, 16 bp, Homo sapiens
catttcccctcccgct

SEQ ID NO: 6029460 - DNA, 15 bp, Homo sapiens
catttcccctccttc

SEQ ID NO: 6029461 - DNA, 23 bp, Homo sapiens
catttcccctctgcacccagaac

SEQ ID NO: 6029462 - DNA, 18 bp, Homo sapiens
catttcccctgtggtttg

SEQ ID NO: 6029463 - DNA, 12 bp, Homo sapiens
catttccctcct

SEQ ID NO: 6029464 - DNA, 14 bp, Homo sapiens
catttccctcctgg

SEQ ID NO: 6029465 - DNA, 15 bp, Homo sapiens
catttccgaataaag

SEQ ID NO: 6029466 - DNA, 15 bp, Homo sapiens
catttccggctgctg

SEQ ID NO: 6029467 - DNA, 18 bp, Homo sapiens
catttccgtcccccccca

SEQ ID NO: 6029468 - DNA, 23 bp, Homo sapiens
catttccgttgtacatgttcctg

SEQ ID NO: 6029469 - DNA, 17 bp, Homo sapiens
catttcctatgtaactg

SEQ ID NO: 6029470 - DNA, 14 bp, Homo sapiens
catttcctcagact

SEQ ID NO: 6029471 - DNA, 22 bp, Homo sapiens
catttcctcagactctaagaaa

SEQ ID NO: 6029472 - DNA, 15 bp, Homo sapiens
catttcctctctatc

SEQ ID NO: 6029473 - DNA, 20 bp, Homo sapiens
catttcctgacagaaggact

SEQ ID NO: 6029474 - DNA, 19 bp, Homo sapiens
catttcctgagaccacaga

SEQ ID NO: 6029475 - DNA, 12 bp, Homo sapiens
catttcctgctg

SEQ ID NO: 6029476 - DNA, 14 bp, Homo sapiens
catttcctgctgaa

SEQ ID NO: 6029477 - DNA, 15 bp, Homo sapiens
catttcctgggagaa

SEQ ID NO: 6029478 - DNA, 21 bp, Homo sapiens
catttcctgtgtttgtcctgg

SEQ ID NO: 6029479 - DNA, 12 bp, Homo sapiens
catttccttcca

SEQ ID NO: 6029480 - DNA, 16 bp, Homo sapiens
catttccttggaggcc

SEQ ID NO: 6029481 - DNA, 23 bp, Homo sapiens
catttccttggaggccaccggga

SEQ ID NO: 6029482 - DNA, 15 bp, Homo sapiens
catttccttgtctaa

SEQ ID NO: 6029483 - DNA, 22 bp, Homo sapiens
catttcctttaccctccacaca

SEQ ID NO: 6029484 - DNA, 20 bp, Homo sapiens
catttcctttgttgtctaca

SEQ ID NO: 6029485 - DNA, 16 bp, Homo sapiens
catttccttttcacat

SEQ ID NO: 6029486 - DNA, 19 bp, Homo sapiens
catttcctttttctatttt

SEQ ID NO: 6029487 - DNA, 21 bp, Homo sapiens
catttcgcccctcatttatcc

SEQ ID NO: 6029488 - DNA, 20 bp, Homo sapiens
catttcgggaagggcatgca

SEQ ID NO: 6029489 - DNA, 15 bp, Homo sapiens
catttcggtggctag

SEQ ID NO: 6029490 - DNA, 21 bp, Homo sapiens
catttcgtgagccccatcttc

SEQ ID NO: 6029491 - DNA, 22 bp, Homo sapiens
catttcgtgagccccatcttca

SEQ ID NO: 6029492 - DNA, 22 bp, Homo sapiens
catttctaaaagaatattcaga

SEQ ID NO: 6029493 - DNA, 12 bp, Homo sapiens
catttctaaaat

SEQ ID NO: 6029494 - DNA, 20 bp, Homo sapiens
catttctaacatatgtatta

SEQ ID NO: 6029495 - DNA, 23 bp, Homo sapiens
catttctaactctgatgtaaatg

SEQ ID NO: 6029496 - DNA, 13 bp, Homo sapiens
catttctaagact

SEQ ID NO: 6029497 - DNA, 16 bp, Homo sapiens
catttctaagcctttg

SEQ ID NO: 6029498 - DNA, 11 bp, Homo sapiens
catttctaatt

SEQ ID NO: 6029499 - DNA, 13 bp, Homo sapiens
catttctaattaa

SEQ ID NO: 6029500 - DNA, 19 bp, Homo sapiens
catttctaattatgtagct

SEQ ID NO: 6029501 - DNA, 23 bp, Homo sapiens
catttctaattatgtagctcttt

SEQ ID NO: 6029502 - DNA, 17 bp, Homo sapiens
catttctaattttaagt

SEQ ID NO: 6029503 - DNA, 22 bp, Homo sapiens
catttctaccaaggcatatcat

SEQ ID NO: 6029504 - DNA, 16 bp, Homo sapiens
catttctactctagat

SEQ ID NO: 6029505 - DNA, 20 bp, Homo sapiens
catttctactctcccatggc

SEQ ID NO: 6029506 - DNA, 22 bp, Homo sapiens
catttctactctcccatggctt

SEQ ID NO: 6029507 - DNA, 20 bp, Homo sapiens
catttctactcttaagtttc

SEQ ID NO: 6029508 - DNA, 16 bp, Homo sapiens
catttctactgtataa

SEQ ID NO: 6029509 - DNA, 21 bp, Homo sapiens
catttctactgtataaacaaa

SEQ ID NO: 6029510 - DNA, 18 bp, Homo sapiens
catttctactgtgactga

SEQ ID NO: 6029511 - DNA, 13 bp, Homo sapiens
catttctaggcaa

SEQ ID NO: 6029512 - DNA, 21 bp, Homo sapiens
catttctaggcaaaattgtga

SEQ ID NO: 6029513 - DNA, 14 bp, Homo sapiens
catttctataaata

SEQ ID NO: 6029514 - DNA, 16 bp, Homo sapiens
catttctatagccaaa

SEQ ID NO: 6029515 - DNA, 19 bp, Homo sapiens
catttctatattcctccag

SEQ ID NO: 6029516 - DNA, 20 bp, Homo sapiens
catttctatgccatttttag

SEQ ID NO: 6029517 - DNA, 13 bp, Homo sapiens
catttctatttat

SEQ ID NO: 6029518 - DNA, 14 bp, Homo sapiens
catttctatttatt

SEQ ID NO: 6029519 - DNA, 20 bp, Homo sapiens
catttctcaaagtttttaca

SEQ ID NO: 6029520 - DNA, 22 bp, Homo sapiens
catttctcaatcagtgcagtga

SEQ ID NO: 6029521 - DNA, 23 bp, Homo sapiens
catttctcactagtgtcaggccc

SEQ ID NO: 6029522 - DNA, 22 bp, Homo sapiens
catttctcaggctaggccagca

SEQ ID NO: 6029523 - DNA, 15 bp, Homo sapiens
catttctcagggaag

SEQ ID NO: 6029524 - DNA, 12 bp, Homo sapiens
catttctcatgt

SEQ ID NO: 6029525 - DNA, 20 bp, Homo sapiens
catttctcatgtgctttgta

SEQ ID NO: 6029526 - DNA, 19 bp, Homo sapiens
catttctcatgttgaagct

SEQ ID NO: 6029527 - DNA, 21 bp, Homo sapiens
catttctcatgttttccattg

SEQ ID NO: 6029528 - DNA, 23 bp, Homo sapiens
catttctcattagcccagttaat

SEQ ID NO: 6029529 - DNA, 20 bp, Homo sapiens
catttctctaactcctgcca

SEQ ID NO: 6029530 - DNA, 15 bp, Homo sapiens
catttctctaagaga

SEQ ID NO: 6029531 - DNA, 14 bp, Homo sapiens
catttctctgctta

SEQ ID NO: 6029532 - DNA, 14 bp, Homo sapiens
catttctctggggt

SEQ ID NO: 6029533 - DNA, 15 bp, Homo sapiens
catttctcttactgc

SEQ ID NO: 6029534 - DNA, 15 bp, Homo sapiens
catttctcttcctaa

SEQ ID NO: 6029535 - DNA, 16 bp, Homo sapiens
catttctcttcctaaa

SEQ ID NO: 6029536 - DNA, 19 bp, Homo sapiens
catttctcttctcagctct

SEQ ID NO: 6029537 - DNA, 15 bp, Homo sapiens
catttctctttcaaa

SEQ ID NO: 6029538 - DNA, 14 bp, Homo sapiens
catttctgaagtgg

SEQ ID NO: 6029539 - DNA, 22 bp, Homo sapiens
catttctgaattgttggggttt

SEQ ID NO: 6029540 - DNA, 16 bp, Homo sapiens
catttctgatatagaa

SEQ ID NO: 6029541 - DNA, 21 bp, Homo sapiens
catttctgatatagaattgca

SEQ ID NO: 6029542 - DNA, 16 bp, Homo sapiens
catttctgatcagagg

SEQ ID NO: 6029543 - DNA, 17 bp, Homo sapiens
catttctgatcagaggt

SEQ ID NO: 6029544 - DNA, 22 bp, Homo sapiens
catttctgatcagaggtgtaca

SEQ ID NO: 6029545 - DNA, 15 bp, Homo sapiens
catttctgattctga

SEQ ID NO: 6029546 - DNA, 14 bp, Homo sapiens
catttctgccagcg

SEQ ID NO: 6029547 - DNA, 13 bp, Homo sapiens
catttctgcctcg

SEQ ID NO: 6029548 - DNA, 17 bp, Homo sapiens
catttctgctctcagct

SEQ ID NO: 6029549 - DNA, 22 bp, Homo sapiens
catttctgctctcagctccggg

SEQ ID NO: 6029550 - DNA, 14 bp, Homo sapiens
catttctgggggga

SEQ ID NO: 6029551 - DNA, 17 bp, Homo sapiens
catttctgtaaatacca

SEQ ID NO: 6029552 - DNA, 22 bp, Homo sapiens
catttctgtattttttgtttgt

SEQ ID NO: 6029553 - DNA, 10 bp, Homo sapiens
catttctgtc

SEQ ID NO: 6029554 - DNA, 14 bp, Homo sapiens
catttctgtctctc

SEQ ID NO: 6029555 - DNA, 21 bp, Homo sapiens
catttctgttgctggaggggc

SEQ ID NO: 6029556 - DNA, 16 bp, Homo sapiens
catttcttaaaacaca

SEQ ID NO: 6029557 - DNA, 14 bp, Homo sapiens
catttcttaaatta

SEQ ID NO: 6029558 - DNA, 20 bp, Homo sapiens
catttcttaccatgcatttc

SEQ ID NO: 6029559 - DNA, 21 bp, Homo sapiens
catttcttagatggagaagtt

SEQ ID NO: 6029560 - DNA, 16 bp, Homo sapiens
catttcttatgatttt

SEQ ID NO: 6029561 - DNA, 23 bp, Homo sapiens
catttcttcagtcagaaaacttt

SEQ ID NO: 6029562 - DNA, 12 bp, Homo sapiens
catttcttccca

SEQ ID NO: 6029563 - DNA, 15 bp, Homo sapiens
catttcttccccagt

SEQ ID NO: 6029564 - DNA, 13 bp, Homo sapiens
catttcttcctca

SEQ ID NO: 6029565 - DNA, 15 bp, Homo sapiens
catttcttcctcagc

SEQ ID NO: 6029566 - DNA, 16 bp, Homo sapiens
catttcttcctcagct

SEQ ID NO: 6029567 - DNA, 18 bp, Homo sapiens
catttcttcctcagctgg

SEQ ID NO: 6029568 - DNA, 15 bp, Homo sapiens
catttcttcctctgc

SEQ ID NO: 6029569 - DNA, 14 bp, Homo sapiens
catttcttctctct

SEQ ID NO: 6029570 - DNA, 20 bp, Homo sapiens
catttcttctctctgtgctg

SEQ ID NO: 6029571 - DNA, 17 bp, Homo sapiens
catttcttctctctgtt

SEQ ID NO: 6029572 - DNA, 20 bp, Homo sapiens
catttcttgaaaagccttgg

SEQ ID NO: 6029573 - DNA, 19 bp, Homo sapiens
catttcttggcattggaat

SEQ ID NO: 6029574 - DNA, 17 bp, Homo sapiens
catttcttgggccctcc

SEQ ID NO: 6029575 - DNA, 18 bp, Homo sapiens
catttcttgggccctcct

SEQ ID NO: 6029576 - DNA, 16 bp, Homo sapiens
catttctttatttctg

SEQ ID NO: 6029577 - DNA, 15 bp, Homo sapiens
catttctttcaagac

SEQ ID NO: 6029578 - DNA, 16 bp, Homo sapiens
catttctttcttccat

SEQ ID NO: 6029579 - DNA, 14 bp, Homo sapiens
catttctttcttgc

SEQ ID NO: 6029580 - DNA, 15 bp, Homo sapiens
catttctttcttgct

SEQ ID NO: 6029581 - DNA, 17 bp, Homo sapiens
catttctttcttgctgg

SEQ ID NO: 6029582 - DNA, 14 bp, Homo sapiens
catttctttggaaa

SEQ ID NO: 6029583 - DNA, 21 bp, Homo sapiens
catttctttgtctttttccta

SEQ ID NO: 6029584 - DNA, 21 bp, Homo sapiens
catttcttttactctgtgtaa

SEQ ID NO: 6029585 - DNA, 15 bp, Homo sapiens
catttcttttctctt

SEQ ID NO: 6029586 - DNA, 15 bp, Homo sapiens
catttcttttctttt

SEQ ID NO: 6029587 - DNA, 19 bp, Homo sapiens
catttgaaaaaaagttatt

SEQ ID NO: 6029588 - DNA, 19 bp, Homo sapiens
catttgaaaattttgatgt

SEQ ID NO: 6029589 - DNA, 18 bp, Homo sapiens
catttgaaagaaaggact

SEQ ID NO: 6029590 - DNA, 14 bp, Homo sapiens
catttgaaataaag

SEQ ID NO: 6029591 - DNA, 22 bp, Homo sapiens
catttgaacctggatccagcac

SEQ ID NO: 6029592 - DNA, 17 bp, Homo sapiens
catttgaatgagacctg

SEQ ID NO: 6029593 - DNA, 22 bp, Homo sapiens
catttgaatgagacctggaaca

SEQ ID NO: 6029594 - DNA, 11 bp, Homo sapiens
catttgaatgc

SEQ ID NO: 6029595 - DNA, 16 bp, Homo sapiens
catttgaattcatttg

SEQ ID NO: 6029596 - DNA, 21 bp, Homo sapiens
catttgaattcttgatctcta

SEQ ID NO: 6029597 - DNA, 14 bp, Homo sapiens
catttgacaacaca

SEQ ID NO: 6029598 - DNA, 23 bp, Homo sapiens
catttgacacaaagcttctaaag

SEQ ID NO: 6029599 - DNA, 23 bp, Homo sapiens
catttgacacacagttgttgaat

SEQ ID NO: 6029600 - DNA, 16 bp, Homo sapiens
catttgacacataaaa

SEQ ID NO: 6029601 - DNA, 22 bp, Homo sapiens
catttgacatgagtctccagat

SEQ ID NO: 6029602 - DNA, 17 bp, Homo sapiens
catttgagaaatgcata

SEQ ID NO: 6029603 - DNA, 13 bp, Homo sapiens
catttgagataaa

SEQ ID NO: 6029604 - DNA, 14 bp, Homo sapiens
catttgagcagctg

SEQ ID NO: 6029605 - DNA, 15 bp, Homo sapiens
catttgagcagctga

SEQ ID NO: 6029606 - DNA, 16 bp, Homo sapiens
catttgagcagggctc

SEQ ID NO: 6029607 - DNA, 20 bp, Homo sapiens
catttgagcagggctcagcg

SEQ ID NO: 6029608 - DNA, 19 bp, Homo sapiens
catttgagggcccagccag

SEQ ID NO: 6029609 - DNA, 20 bp, Homo sapiens
catttgagggcccagccagg

SEQ ID NO: 6029610 - DNA, 19 bp, Homo sapiens
catttgaggtctgttcttt

SEQ ID NO: 6029611 - DNA, 22 bp, Homo sapiens
catttgaggtctgttctttcca

SEQ ID NO: 6029612 - DNA, 22 bp, Homo sapiens
catttgagttattttaattatc

SEQ ID NO: 6029613 - DNA, 23 bp, Homo sapiens
catttgataatgataaaacacct

SEQ ID NO: 6029614 - DNA, 16 bp, Homo sapiens
catttgatacccctgg

SEQ ID NO: 6029615 - DNA, 13 bp, Homo sapiens
catttgatagaaa

SEQ ID NO: 6029616 - DNA, 20 bp, Homo sapiens
catttgatagcaatgtaagt

SEQ ID NO: 6029617 - DNA, 20 bp, Homo sapiens
catttgatattgtgtaggaa

SEQ ID NO: 6029618 - DNA, 18 bp, Homo sapiens
catttgatatttttccat

SEQ ID NO: 6029619 - DNA, 19 bp, Homo sapiens
catttgatgatagcagaca

SEQ ID NO: 6029620 - DNA, 16 bp, Homo sapiens
catttgatgcatgtct

SEQ ID NO: 6029621 - DNA, 15 bp, Homo sapiens
catttgatgctaaat

SEQ ID NO: 6029622 - DNA, 16 bp, Homo sapiens
catttgatgctaaata

SEQ ID NO: 6029623 - DNA, 14 bp, Homo sapiens
catttgatgtacat

SEQ ID NO: 6029624 - DNA, 20 bp, Homo sapiens
catttgatgtacatgtgtag

SEQ ID NO: 6029625 - DNA, 13 bp, Homo sapiens
catttgattaaat

SEQ ID NO: 6029626 - DNA, 21 bp, Homo sapiens
catttgattaaattatgaatg

SEQ ID NO: 6029627 - DNA, 14 bp, Homo sapiens
catttgattaataa

SEQ ID NO: 6029628 - DNA, 20 bp, Homo sapiens
catttgattaataaaatatc

SEQ ID NO: 6029629 - DNA, 13 bp, Homo sapiens
catttgatttgta

SEQ ID NO: 6029630 - DNA, 17 bp, Homo sapiens
catttgcaaacctcaga

SEQ ID NO: 6029631 - DNA, 19 bp, Homo sapiens
catttgcaaacctcagagg

SEQ ID NO: 6029632 - DNA, 20 bp, Homo sapiens
catttgcactggagttctat

SEQ ID NO: 6029633 - DNA, 22 bp, Homo sapiens
catttgcagaccaggaaggaag

SEQ ID NO: 6029634 - DNA, 13 bp, Homo sapiens
catttgcagctgc

SEQ ID NO: 6029635 - DNA, 16 bp, Homo sapiens
catttgcagctgctgg

SEQ ID NO: 6029636 - DNA, 19 bp, Homo sapiens
catttgcagggtcctcttc

SEQ ID NO: 6029637 - DNA, 16 bp, Homo sapiens
caggtggccactccag

SEQ ID NO: 6029638 - DNA, 19 bp, Homo sapiens
caggtggccactccagacc

SEQ ID NO: 6029639 - DNA, 19 bp, Homo sapiens
caggtggccagcctggatc

SEQ ID NO: 6029640 - DNA, 14 bp, Homo sapiens
caggtggccagggc

SEQ ID NO: 6029641 - DNA, 19 bp, Homo sapiens
caggtggccagggctccac

SEQ ID NO: 6029642 - DNA, 13 bp, Homo sapiens
caggtggccgccc

SEQ ID NO: 6029643 - DNA, 17 bp, Homo sapiens
caggtggcctaaggctg

SEQ ID NO: 6029644 - DNA, 15 bp, Homo sapiens
caggtggcctagcag

SEQ ID NO: 6029645 - DNA, 13 bp, Homo sapiens
caggtggcctccc

SEQ ID NO: 6029646 - DNA, 18 bp, Homo sapiens
caggtggcctccctccag

SEQ ID NO: 6029647 - DNA, 15 bp, Homo sapiens
caggtggcctctgct

SEQ ID NO: 6029648 - DNA, 17 bp, Homo sapiens
caggtggcctctgctgg

SEQ ID NO: 6029649 - DNA, 12 bp, Homo sapiens
caggtggcctgc

SEQ ID NO: 6029650 - DNA, 19 bp, Homo sapiens
caggtggcgtgagaggcaa

SEQ ID NO: 6029651 - DNA, 22 bp, Homo sapiens
caggtggctgacccagtccctg

SEQ ID NO: 6029652 - DNA, 17 bp, Homo sapiens
caggtggcttgttaagg

SEQ ID NO: 6029653 - DNA, 13 bp, Homo sapiens
caggtgggaaagc

SEQ ID NO: 6029654 - DNA, 15 bp, Homo sapiens
caggtgggacttagc

SEQ ID NO: 6029655 - DNA, 15 bp, Homo sapiens
caggtgggagagaca

SEQ ID NO: 6029656 - DNA, 15 bp, Homo sapiens
caggtgggagatgga

SEQ ID NO: 6029657 - DNA, 16 bp, Homo sapiens
caggtgggcagacagt

SEQ ID NO: 6029658 - DNA, 21 bp, Homo sapiens
caggtgggcctggcggcctgt

SEQ ID NO: 6029659 - DNA, 16 bp, Homo sapiens
caggtgggcctgggag

SEQ ID NO: 6029660 - DNA, 21 bp, Homo sapiens
caggtgggcgggcagcacagc

SEQ ID NO: 6029661 - DNA, 15 bp, Homo sapiens
caggtgggcggtgtg

SEQ ID NO: 6029662 - DNA, 21 bp, Homo sapiens
caggtgggcgtggtcactgct

SEQ ID NO: 6029663 - DNA, 23 bp, Homo sapiens
caggtgggcgtggtcactgctgt

SEQ ID NO: 6029664 - DNA, 16 bp, Homo sapiens
caggtgggctgcctgc

SEQ ID NO: 6029665 - DNA, 16 bp, Homo sapiens
caggtgggcttcccag

SEQ ID NO: 6029666 - DNA, 14 bp, Homo sapiens
caggtggggactgg

SEQ ID NO: 6029667 - DNA, 17 bp, Homo sapiens
caggtggggactgggca

SEQ ID NO: 6029668 - DNA, 23 bp, Homo sapiens
caggtggggactgggcacagctc

SEQ ID NO: 6029669 - DNA, 20 bp, Homo sapiens
caggtggggagactgggctg

SEQ ID NO: 6029670 - DNA, 15 bp, Homo sapiens
caggtggggaggggg

SEQ ID NO: 6029671 - DNA, 12 bp, Homo sapiens
caggtggggagt

SEQ ID NO: 6029672 - DNA, 16 bp, Homo sapiens
caggtggggcagcttg

SEQ ID NO: 6029673 - DNA, 16 bp, Homo sapiens
caggtggggcctcagc

SEQ ID NO: 6029674 - DNA, 20 bp, Homo sapiens
caggtggggcctcagcctgg

SEQ ID NO: 6029675 - DNA, 18 bp, Homo sapiens
caggtgggggctgcgtcc

SEQ ID NO: 6029676 - DNA, 17 bp, Homo sapiens
caggtgggggttgctgt

SEQ ID NO: 6029677 - DNA, 19 bp, Homo sapiens
caggtggggtcactctggc

SEQ ID NO: 6029678 - DNA, 22 bp, Homo sapiens
caggtggggtcactctggcagc

SEQ ID NO: 6029679 - DNA, 23 bp, Homo sapiens
caggtggggtcactctggcagct

SEQ ID NO: 6029680 - DNA, 21 bp, Homo sapiens
caggtggggtgatggccagag

SEQ ID NO: 6029681 - DNA, 22 bp, Homo sapiens
caggtggggtgatggccagagg

SEQ ID NO: 6029682 - DNA, 21 bp, Homo sapiens
caggtggggtggagtcccaga

SEQ ID NO: 6029683 - DNA, 22 bp, Homo sapiens
caggtggggtggagtcccagag

SEQ ID NO: 6029684 - DNA, 22 bp, Homo sapiens
caggtggggttttcacttccta

SEQ ID NO: 6029685 - DNA, 16 bp, Homo sapiens
caggtgggtgtctgcg

SEQ ID NO: 6029686 - DNA, 21 bp, Homo sapiens
caggtgggtgtgggacacctg

SEQ ID NO: 6029687 - DNA, 16 bp, Homo sapiens
caggtggtcccatagg

SEQ ID NO: 6029688 - DNA, 18 bp, Homo sapiens
caggtggtgaattttcca

SEQ ID NO: 6029689 - DNA, 17 bp, Homo sapiens
caggtggtggaggggcg

SEQ ID NO: 6029690 - DNA, 13 bp, Homo sapiens
caggtggtgtcct

SEQ ID NO: 6029691 - DNA, 18 bp, Homo sapiens
caggtggttatggagagg

SEQ ID NO: 6029692 - DNA, 15 bp, Homo sapiens
caggtgtaataagac

SEQ ID NO: 6029693 - DNA, 11 bp, Homo sapiens
caggtgtagct

SEQ ID NO: 6029694 - DNA, 15 bp, Homo sapiens
caggtgtagctgagc

SEQ ID NO: 6029695 - DNA, 17 bp, Homo sapiens
caggtgtagctgagctg

SEQ ID NO: 6029696 - DNA, 18 bp, Homo sapiens
caggtgtatttattgttt

SEQ ID NO: 6029697 - DNA, 17 bp, Homo sapiens
caggtgtcaccatcatt

SEQ ID NO: 6029698 - DNA, 16 bp, Homo sapiens
caggtgtcagccattg

SEQ ID NO: 6029699 - DNA, 14 bp, Homo sapiens
caggtgtccccagc

SEQ ID NO: 6029700 - DNA, 15 bp, Homo sapiens
caggtgtccccagcc

SEQ ID NO: 6029701 - DNA, 16 bp, Homo sapiens
caggtgtccccagccc

SEQ ID NO: 6029702 - DNA, 14 bp, Homo sapiens
caggtgtccctgca

SEQ ID NO: 6029703 - DNA, 19 bp, Homo sapiens
caggtgtcctgactgtcct

SEQ ID NO: 6029704 - DNA, 20 bp, Homo sapiens
caggtgtcctgactgtccta

SEQ ID NO: 6029705 - DNA, 22 bp, Homo sapiens
caggtgtctatccacctggggt

SEQ ID NO: 6029706 - DNA, 17 bp, Homo sapiens
caggtgtctgcctagat

SEQ ID NO: 6029707 - DNA, 21 bp, Homo sapiens
caggtgtcttggacccacctg

SEQ ID NO: 6029708 - DNA, 15 bp, Homo sapiens
caggtgtgagccacc

SEQ ID NO: 6029709 - DNA, 23 bp, Homo sapiens
caggtgtgagccaccgcgcccag

SEQ ID NO: 6029710 - DNA, 18 bp, Homo sapiens
caggtgtgagccactgcg

SEQ ID NO: 6029711 - DNA, 16 bp, Homo sapiens
caggtgtgagggcagt

SEQ ID NO: 6029712 - DNA, 20 bp, Homo sapiens
caggtgtgagggcagtgcaa

SEQ ID NO: 6029713 - DNA, 16 bp, Homo sapiens
caggtgtgagtcacca

SEQ ID NO: 6029714 - DNA, 22 bp, Homo sapiens
caggtgtgataaaatgttgaac

SEQ ID NO: 6029715 - DNA, 18 bp, Homo sapiens
caggtgtgcacagaaaac

SEQ ID NO: 6029716 - DNA, 13 bp, Homo sapiens
caggtgtgcacgt

SEQ ID NO: 6029717 - DNA, 12 bp, Homo sapiens
caggtgtgcctg

SEQ ID NO: 6029718 - DNA, 17 bp, Homo sapiens
caggtgtgcctggaaga

SEQ ID NO: 6029719 - DNA, 21 bp, Homo sapiens
caggtgtgcctgtgctcctgc

SEQ ID NO: 6029720 - DNA, 14 bp, Homo sapiens
caggtgtgcctgtt

SEQ ID NO: 6029721 - DNA, 21 bp, Homo sapiens
caggtgtgggatctggggaga

SEQ ID NO: 6029722 - DNA, 15 bp, Homo sapiens
caggtgtgggctccc

SEQ ID NO: 6029723 - DNA, 20 bp, Homo sapiens
caggtgtgtccacctgggca

SEQ ID NO: 6029724 - DNA, 23 bp, Homo sapiens
caggtgtgtgtgaactgggcaca

SEQ ID NO: 6029725 - DNA, 19 bp, Homo sapiens
caggtgttaaaaaccatta

SEQ ID NO: 6029726 - DNA, 17 bp, Homo sapiens
caggtgttaacattcca

SEQ ID NO: 6029727 - DNA, 18 bp, Homo sapiens
caggtgttaacattccaa

SEQ ID NO: 6029728 - DNA, 15 bp, Homo sapiens
caggtgttactagaa

SEQ ID NO: 6029729 - DNA, 21 bp, Homo sapiens
caggtgttcctcctcccctct

SEQ ID NO: 6029730 - DNA, 20 bp, Homo sapiens
caggtgttctacactcatct

SEQ ID NO: 6029731 - DNA, 15 bp, Homo sapiens
caggtgttggaagcc

SEQ ID NO: 6029732 - DNA, 19 bp, Homo sapiens
caggtgttggaagccagga

SEQ ID NO: 6029733 - DNA, 21 bp, Homo sapiens
caggtgttggaagccaggact

SEQ ID NO: 6029734 - DNA, 20 bp, Homo sapiens
caggtgttgggacctgctgc

SEQ ID NO: 6029735 - DNA, 22 bp, Homo sapiens
caggtgttgggacctgctgctc

SEQ ID NO: 6029736 - DNA, 12 bp, Homo sapiens
caggtgtttata

SEQ ID NO: 6029737 - DNA, 12 bp, Homo sapiens
caggtgtttgac

SEQ ID NO: 6029738 - DNA, 20 bp, Homo sapiens
caggtgtttggcacccaaat

SEQ ID NO: 6029739 - DNA, 21 bp, Homo sapiens
caggtgttttttatgaagtgc

SEQ ID NO: 6029740 - DNA, 12 bp, Homo sapiens
caggttaaaatt

SEQ ID NO: 6029741 - DNA, 11 bp, Homo sapiens
caggttacaac

SEQ ID NO: 6029742 - DNA, 12 bp, Homo sapiens
caggttacaaca

SEQ ID NO: 6029743 - DNA, 13 bp, Homo sapiens
caggttacaacag

SEQ ID NO: 6029744 - DNA, 17 bp, Homo sapiens
caggttacaacagattt

SEQ ID NO: 6029745 - DNA, 23 bp, Homo sapiens
caggttacaacagatttgtgaac

SEQ ID NO: 6029746 - DNA, 16 bp, Homo sapiens
caggttaggaaggcag

SEQ ID NO: 6029747 - DNA, 20 bp, Homo sapiens
caggttagtgacatttaatg

SEQ ID NO: 6029748 - DNA, 17 bp, Homo sapiens
caggttatactcctcct

SEQ ID NO: 6029749 - DNA, 19 bp, Homo sapiens
caggttatcgaaataacaa

SEQ ID NO: 6029750 - DNA, 17 bp, Homo sapiens
caggttatgcctcatgc

SEQ ID NO: 6029751 - DNA, 22 bp, Homo sapiens
caggttattgcaataaagtata

SEQ ID NO: 6029752 - DNA, 18 bp, Homo sapiens
caggttcaagctattctc

SEQ ID NO: 6029753 - DNA, 19 bp, Homo sapiens
caggttcacactcagaaag

SEQ ID NO: 6029754 - DNA, 13 bp, Homo sapiens
caggttcacagca

SEQ ID NO: 6029755 - DNA, 15 bp, Homo sapiens
caggttcacagcagc

SEQ ID NO: 6029756 - DNA, 18 bp, Homo sapiens
caggttcacagcagcttt

SEQ ID NO: 6029757 - DNA, 20 bp, Homo sapiens
caggttcacaggcgaggcct

SEQ ID NO: 6029758 - DNA, 22 bp, Homo sapiens
caggttcacaggcgaggcctgg

SEQ ID NO: 6029759 - DNA, 12 bp, Homo sapiens
caggttcagctt

SEQ ID NO: 6029760 - DNA, 16 bp, Homo sapiens
caggttcagtattatg

SEQ ID NO: 6029761 - DNA, 14 bp, Homo sapiens
caggttcatgaata

SEQ ID NO: 6029762 - DNA, 13 bp, Homo sapiens
caggttcatggat

SEQ ID NO: 6029763 - DNA, 15 bp, Homo sapiens
caggttccacagagg

SEQ ID NO: 6029764 - DNA, 19 bp, Homo sapiens
caggttccacagaggacac

SEQ ID NO: 6029765 - DNA, 17 bp, Homo sapiens
caggttccagtgcctga

SEQ ID NO: 6029766 - DNA, 15 bp, Homo sapiens
caggttccatccacc

SEQ ID NO: 6029767 - DNA, 18 bp, Homo sapiens
caggttccatccaccacc

SEQ ID NO: 6029768 - DNA, 22 bp, Homo sapiens
caggttccatccaccaccttgc

SEQ ID NO: 6029769 - DNA, 14 bp, Homo sapiens
caggttcccaagct

SEQ ID NO: 6029770 - DNA, 17 bp, Homo sapiens
caggttcccaagctcag

SEQ ID NO: 6029771 - DNA, 16 bp, Homo sapiens
caggttcccagcagct

SEQ ID NO: 6029772 - DNA, 17 bp, Homo sapiens
caggttcccagcagctg

SEQ ID NO: 6029773 - DNA, 18 bp, Homo sapiens
caggttcccagcagctgg

SEQ ID NO: 6029774 - DNA, 21 bp, Homo sapiens
caggttccccaagggccctgg

SEQ ID NO: 6029775 - DNA, 16 bp, Homo sapiens
caggttcccccagcaa

SEQ ID NO: 6029776 - DNA, 15 bp, Homo sapiens
caggttccctcccag

SEQ ID NO: 6029777 - DNA, 17 bp, Homo sapiens
caggttcctatggctgg

SEQ ID NO: 6029778 - DNA, 13 bp, Homo sapiens
caggttcctccta

SEQ ID NO: 6029779 - DNA, 23 bp, Homo sapiens
caggttcctgaaatatccaggaa

SEQ ID NO: 6029780 - DNA, 21 bp, Homo sapiens
caggttcctgtggagacactg

SEQ ID NO: 6029781 - DNA, 21 bp, Homo sapiens
caggttctatttggaatttat

SEQ ID NO: 6029782 - DNA, 22 bp, Homo sapiens
caggttctattttcttaaacca

SEQ ID NO: 6029783 - DNA, 13 bp, Homo sapiens
caggttctctttg

SEQ ID NO: 6029784 - DNA, 18 bp, Homo sapiens
caggttctgaaagagtct

SEQ ID NO: 6029785 - DNA, 15 bp, Homo sapiens
caggttctgcctgct

SEQ ID NO: 6029786 - DNA, 21 bp, Homo sapiens
caggttctgcgttacaacagt

SEQ ID NO: 6029787 - DNA, 12 bp, Homo sapiens
caggttcttgtt

SEQ ID NO: 6029788 - DNA, 18 bp, Homo sapiens
caggttcttgttggtgca

SEQ ID NO: 6029789 - DNA, 15 bp, Homo sapiens
caggttgaagaccta

SEQ ID NO: 6029790 - DNA, 16 bp, Homo sapiens
caggttgaagccatgt

SEQ ID NO: 6029791 - DNA, 18 bp, Homo sapiens
caggttgaagccatgtct

SEQ ID NO: 6029792 - DNA, 23 bp, Homo sapiens
caggttgacaccattctcctgcc

SEQ ID NO: 6029793 - DNA, 11 bp, Homo sapiens
caggttgacag

SEQ ID NO: 6029794 - DNA, 22 bp, Homo sapiens
caggttgaggggctcctggaaa

SEQ ID NO: 6029795 - DNA, 13 bp, Homo sapiens
caggttgataaat

SEQ ID NO: 6029796 - DNA, 15 bp, Homo sapiens
caggttgataaatca

SEQ ID NO: 6029797 - DNA, 14 bp, Homo sapiens
caggttgatcttga

SEQ ID NO: 6029798 - DNA, 15 bp, Homo sapiens
caggttgatcttgaa

SEQ ID NO: 6029799 - DNA, 13 bp, Homo sapiens
caggttgcagctg

SEQ ID NO: 6029800 - DNA, 13 bp, Homo sapiens
caggttgcctcaa

SEQ ID NO: 6029801 - DNA, 20 bp, Homo sapiens
caggttgcctcaacagcagg

SEQ ID NO: 6029802 - DNA, 21 bp, Homo sapiens
caggttgcctcaacagcagga

SEQ ID NO: 6029803 - DNA, 18 bp, Homo sapiens
caggttggaaaagaaatc

SEQ ID NO: 6029804 - DNA, 21 bp, Homo sapiens
caggttggaactatgcagtgt

SEQ ID NO: 6029805 - DNA, 15 bp, Homo sapiens
caggttggaggccct

SEQ ID NO: 6029806 - DNA, 21 bp, Homo sapiens
caggttggcggcagacacatt

SEQ ID NO: 6029807 - DNA, 16 bp, Homo sapiens
caggttggcttttttc

SEQ ID NO: 6029808 - DNA, 20 bp, Homo sapiens
caggttgggaatgaggcttg

SEQ ID NO: 6029809 - DNA, 15 bp, Homo sapiens
caggttgggatggga

SEQ ID NO: 6029810 - DNA, 17 bp, Homo sapiens
caggttgggccatactg

SEQ ID NO: 6029811 - DNA, 22 bp, Homo sapiens
caggttgggccatactggcctc

SEQ ID NO: 6029812 - DNA, 22 bp, Homo sapiens
caggttggggctgggtccaccc

SEQ ID NO: 6029813 - DNA, 22 bp, Homo sapiens
caggttgtctgaagtcactgca

SEQ ID NO: 6029814 - DNA, 23 bp, Homo sapiens
caggttgtctgaagtcactgcac

SEQ ID NO: 6029815 - DNA, 20 bp, Homo sapiens
caggttgttttctactttgc

SEQ ID NO: 6029816 - DNA, 21 bp, Homo sapiens
catttgcatatcacccttccc

SEQ ID NO: 6029817 - DNA, 18 bp, Homo sapiens
catttgcatgccttttgg

SEQ ID NO: 6029818 - DNA, 22 bp, Homo sapiens
catttgccaaaaattcatgccc

SEQ ID NO: 6029819 - DNA, 11 bp, Homo sapiens
catttgccaac

SEQ ID NO: 6029820 - DNA, 21 bp, Homo sapiens
catttgccaactaattttaaa

SEQ ID NO: 6029821 - DNA, 13 bp, Homo sapiens
catttgccaagtg

SEQ ID NO: 6029822 - DNA, 14 bp, Homo sapiens
catttgccagattg

SEQ ID NO: 6029823 - DNA, 17 bp, Homo sapiens
catttgccatgctgcta

SEQ ID NO: 6029824 - DNA, 17 bp, Homo sapiens
catttgccattcctgga

SEQ ID NO: 6029825 - DNA, 22 bp, Homo sapiens
catttgccccaacttaagttta

SEQ ID NO: 6029826 - DNA, 15 bp, Homo sapiens
catttgcctattccc

SEQ ID NO: 6029827 - DNA, 15 bp, Homo sapiens
catttgcctgcttct

SEQ ID NO: 6029828 - DNA, 16 bp, Homo sapiens
catttgcctgcttctt

SEQ ID NO: 6029829 - DNA, 15 bp, Homo sapiens
catttgccttgcaga

SEQ ID NO: 6029830 - DNA, 20 bp, Homo sapiens
catttgccttgcagaactgc

SEQ ID NO: 6029831 - DNA, 21 bp, Homo sapiens
catttgccttgcagaactgcc

SEQ ID NO: 6029832 - DNA, 22 bp, Homo sapiens
catttgccttgcagaactgcca

SEQ ID NO: 6029833 - DNA, 20 bp, Homo sapiens
catttgcctttctgggagca

SEQ ID NO: 6029834 - DNA, 20 bp, Homo sapiens
catttgcgtatgtaaacatt

SEQ ID NO: 6029835 - DNA, 16 bp, Homo sapiens
catttgctaaggcagc

SEQ ID NO: 6029836 - DNA, 12 bp, Homo sapiens
catttgctaatg

SEQ ID NO: 6029837 - DNA, 18 bp, Homo sapiens
catttgctactgttgtaa

SEQ ID NO: 6029838 - DNA, 19 bp, Homo sapiens
catttgctagttctgctgc

SEQ ID NO: 6029839 - DNA, 20 bp, Homo sapiens
catttgctagttctgctgcc

SEQ ID NO: 6029840 - DNA, 22 bp, Homo sapiens
catttgctagttctgctgccct

SEQ ID NO: 6029841 - DNA, 13 bp, Homo sapiens
catttgctccttt

SEQ ID NO: 6029842 - DNA, 14 bp, Homo sapiens
catttgctcctttc

SEQ ID NO: 6029843 - DNA, 12 bp, Homo sapiens
catttgctcttc

SEQ ID NO: 6029844 - DNA, 12 bp, Homo sapiens
catttgctgaat

SEQ ID NO: 6029845 - DNA, 14 bp, Homo sapiens
catttgctgatttc

SEQ ID NO: 6029846 - DNA, 20 bp, Homo sapiens
catttgctgatttctagtgt

SEQ ID NO: 6029847 - DNA, 11 bp, Homo sapiens
catttgctgcc

SEQ ID NO: 6029848 - DNA, 13 bp, Homo sapiens
catttgctgccct

SEQ ID NO: 6029849 - DNA, 16 bp, Homo sapiens
catttgctgccctggg

SEQ ID NO: 6029850 - DNA, 19 bp, Homo sapiens
catttgctggcctggcagg

SEQ ID NO: 6029851 - DNA, 18 bp, Homo sapiens
catttgctgttgtttcta

SEQ ID NO: 6029852 - DNA, 21 bp, Homo sapiens
catttgctgttgtttctataa

SEQ ID NO: 6029853 - DNA, 23 bp, Homo sapiens
catttgctgttgtttctataaat

SEQ ID NO: 6029854 - DNA, 17 bp, Homo sapiens
catttgctgttttaaac

SEQ ID NO: 6029855 - DNA, 12 bp, Homo sapiens
catttgctttaa

SEQ ID NO: 6029856 - DNA, 17 bp, Homo sapiens
catttgctttcctctga

SEQ ID NO: 6029857 - DNA, 16 bp, Homo sapiens
catttgctttttcacc

SEQ ID NO: 6029858 - DNA, 19 bp, Homo sapiens
catttgctttttgtgatat

SEQ ID NO: 6029859 - DNA, 10 bp, Homo sapiens
catttggaaa

SEQ ID NO: 6029860 - DNA, 18 bp, Homo sapiens
catttggaaatctttaaa

SEQ ID NO: 6029861 - DNA, 22 bp, Homo sapiens
catttggaaatctttaaaaaaa

SEQ ID NO: 6029862 - DNA, 18 bp, Homo sapiens
catttggaaccaaagtct

SEQ ID NO: 6029863 - DNA, 16 bp, Homo sapiens
catttggaaggaaagg

SEQ ID NO: 6029864 - DNA, 15 bp, Homo sapiens
catttggaatacttt

SEQ ID NO: 6029865 - DNA, 17 bp, Homo sapiens
catttggaatacttttt

SEQ ID NO: 6029866 - DNA, 14 bp, Homo sapiens
catttggaatcata

SEQ ID NO: 6029867 - DNA, 19 bp, Homo sapiens
catttggaatgcacacagc

SEQ ID NO: 6029868 - DNA, 15 bp, Homo sapiens
catttggaattacaa

SEQ ID NO: 6029869 - DNA, 21 bp, Homo sapiens
catttggagacacaactattt

SEQ ID NO: 6029870 - DNA, 15 bp, Homo sapiens
catttggagctcttg

SEQ ID NO: 6029871 - DNA, 13 bp, Homo sapiens
catttggaggaat

SEQ ID NO: 6029872 - DNA, 17 bp, Homo sapiens
catttggagggcctggg

SEQ ID NO: 6029873 - DNA, 23 bp, Homo sapiens
catttggagtgttccccttccac

SEQ ID NO: 6029874 - DNA, 21 bp, Homo sapiens
catttggatcctgtgtggaga

SEQ ID NO: 6029875 - DNA, 19 bp, Homo sapiens
catttggattttaaacaaa

SEQ ID NO: 6029876 - DNA, 23 bp, Homo sapiens
catttggcaaaatgtcttaacaa

SEQ ID NO: 6029877 - DNA, 16 bp, Homo sapiens
catttggcactatggt

SEQ ID NO: 6029878 - DNA, 21 bp, Homo sapiens
catttggcagaactgctgggg

SEQ ID NO: 6029879 - DNA, 19 bp, Homo sapiens
catttggcagagcttcttc

SEQ ID NO: 6029880 - DNA, 18 bp, Homo sapiens
catttggcaggaagatgt

SEQ ID NO: 6029881 - DNA, 12 bp, Homo sapiens
catttggccagg

SEQ ID NO: 6029882 - DNA, 20 bp, Homo sapiens
catttggccccaggggacgt

SEQ ID NO: 6029883 - DNA, 18 bp, Homo sapiens
catttggccggctctggt

SEQ ID NO: 6029884 - DNA, 15 bp, Homo sapiens
catttggctggagcc

SEQ ID NO: 6029885 - DNA, 14 bp, Homo sapiens
catttggcttcctc

SEQ ID NO: 6029886 - DNA, 20 bp, Homo sapiens
catttggcttcctctgctgc

SEQ ID NO: 6029887 - DNA, 21 bp, Homo sapiens
catttggcttcctctgctgca

SEQ ID NO: 6029888 - DNA, 14 bp, Homo sapiens
catttggcttgctg

SEQ ID NO: 6029889 - DNA, 16 bp, Homo sapiens
catttggcttgctgtt

SEQ ID NO: 6029890 - DNA, 18 bp, Homo sapiens
catttgggactgtcttga

SEQ ID NO: 6029891 - DNA, 16 bp, Homo sapiens
catttgggatggagaa

SEQ ID NO: 6029892 - DNA, 12 bp, Homo sapiens
catttgggcaga

SEQ ID NO: 6029893 - DNA, 16 bp, Homo sapiens
catttgggcagagagg

SEQ ID NO: 6029894 - DNA, 17 bp, Homo sapiens
catttggggcatttgta

SEQ ID NO: 6029895 - DNA, 20 bp, Homo sapiens
catttggggcatttgtaaaa

SEQ ID NO: 6029896 - DNA, 17 bp, Homo sapiens
catttggggtaatactt

SEQ ID NO: 6029897 - DNA, 14 bp, Homo sapiens
catttgggtatttt

SEQ ID NO: 6029898 - DNA, 20 bp, Homo sapiens
catttgggttggttccaagt

SEQ ID NO: 6029899 - DNA, 18 bp, Homo sapiens
catttggtctcaggcagc

SEQ ID NO: 6029900 - DNA, 20 bp, Homo sapiens
catttggtgctggtctattt

SEQ ID NO: 6029901 - DNA, 22 bp, Homo sapiens
catttggtggtactttattctt

SEQ ID NO: 6029902 - DNA, 15 bp, Homo sapiens
catttggtgttcctg

SEQ ID NO: 6029903 - DNA, 17 bp, Homo sapiens
catttggtgttcctgga

SEQ ID NO: 6029904 - DNA, 18 bp, Homo sapiens
catttggtgttcctggaa

SEQ ID NO: 6029905 - DNA, 22 bp, Homo sapiens
catttggtgttcctggaagcag

SEQ ID NO: 6029906 - DNA, 20 bp, Homo sapiens
catttggttcattaattcta

SEQ ID NO: 6029907 - DNA, 11 bp, Homo sapiens
catttgtaaaa

SEQ ID NO: 6029908 - DNA, 20 bp, Homo sapiens
catttgtaaaaatactgttt

SEQ ID NO: 6029909 - DNA, 14 bp, Homo sapiens
catttgtaaatgct

SEQ ID NO: 6029910 - DNA, 18 bp, Homo sapiens
catttgtaaatgctgtgt

SEQ ID NO: 6029911 - DNA, 13 bp, Homo sapiens
catttgtaacttt

SEQ ID NO: 6029912 - DNA, 14 bp, Homo sapiens
catttgtaacttta

SEQ ID NO: 6029913 - DNA, 12 bp, Homo sapiens
catttgtaataa

SEQ ID NO: 6029914 - DNA, 16 bp, Homo sapiens
catttgtaataaagta

SEQ ID NO: 6029915 - DNA, 18 bp, Homo sapiens
catttgtaatgtatctta

SEQ ID NO: 6029916 - DNA, 21 bp, Homo sapiens
catttgtaatgtatcttattt

SEQ ID NO: 6029917 - DNA, 12 bp, Homo sapiens
catttgtaattt

SEQ ID NO: 6029918 - DNA, 14 bp, Homo sapiens
catttgtaatttaa

SEQ ID NO: 6029919 - DNA, 21 bp, Homo sapiens
catttgtaatttttttctagt

SEQ ID NO: 6029920 - DNA, 23 bp, Homo sapiens
catttgtacaaggtaattgtttt

SEQ ID NO: 6029921 - DNA, 22 bp, Homo sapiens
catttgtacagaattttggaag

SEQ ID NO: 6029922 - DNA, 14 bp, Homo sapiens
catttgtacatctt

SEQ ID NO: 6029923 - DNA, 15 bp, Homo sapiens
catttgtacattcct

SEQ ID NO: 6029924 - DNA, 17 bp, Homo sapiens
catttgtacattcctga

SEQ ID NO: 6029925 - DNA, 18 bp, Homo sapiens
catttgtaccttattgat

SEQ ID NO: 6029926 - DNA, 13 bp, Homo sapiens
catttgtacttta

SEQ ID NO: 6029927 - DNA, 14 bp, Homo sapiens
catttgtataaaat

SEQ ID NO: 6029928 - DNA, 19 bp, Homo sapiens
catttgtataaaataattt

SEQ ID NO: 6029929 - DNA, 14 bp, Homo sapiens
catttgtatgttgt

SEQ ID NO: 6029930 - DNA, 14 bp, Homo sapiens
catttgtattctca

SEQ ID NO: 6029931 - DNA, 18 bp, Homo sapiens
catttgtattgcttattt

SEQ ID NO: 6029932 - DNA, 23 bp, Homo sapiens
catttgtattgtacataaaattt

SEQ ID NO: 6029933 - DNA, 18 bp, Homo sapiens
catttgtattttgtgatg

SEQ ID NO: 6029934 - DNA, 17 bp, Homo sapiens
catttgtattttgtgtg

SEQ ID NO: 6029935 - DNA, 18 bp, Homo sapiens
catttgtattttgtgtga

SEQ ID NO: 6029936 - DNA, 20 bp, Homo sapiens
catttgtcaaagcattgaga

SEQ ID NO: 6029937 - DNA, 17 bp, Homo sapiens
catttgtcacacacttt

SEQ ID NO: 6029938 - DNA, 14 bp, Homo sapiens
catttgtcacagaa

SEQ ID NO: 6029939 - DNA, 17 bp, Homo sapiens
catttgtcattttcatt

SEQ ID NO: 6029940 - DNA, 14 bp, Homo sapiens
catttgtcccaagt

SEQ ID NO: 6029941 - DNA, 16 bp, Homo sapiens
catttgtcccaagtgc

SEQ ID NO: 6029942 - DNA, 18 bp, Homo sapiens
catttgtcccaagtgcca

SEQ ID NO: 6029943 - DNA, 19 bp, Homo sapiens
catttgtcccaagtgccaa

SEQ ID NO: 6029944 - DNA, 22 bp, Homo sapiens
catttgtctattctccagctga

SEQ ID NO: 6029945 - DNA, 14 bp, Homo sapiens
catttgtctgtgtt

SEQ ID NO: 6029946 - DNA, 16 bp, Homo sapiens
catttgtctgtgtttg

SEQ ID NO: 6029947 - DNA, 16 bp, Homo sapiens
catttgtgaaatgatg

SEQ ID NO: 6029948 - DNA, 22 bp, Homo sapiens
catttgtgatatatgtattaat

SEQ ID NO: 6029949 - DNA, 18 bp, Homo sapiens
catttgtgcataaatttc

SEQ ID NO: 6029950 - DNA, 20 bp, Homo sapiens
catttgtgcataaatttcca

SEQ ID NO: 6029951 - DNA, 22 bp, Homo sapiens
catttgtgccacacgcatgggc

SEQ ID NO: 6029952 - DNA, 17 bp, Homo sapiens
catttgtgggtttttat

SEQ ID NO: 6029953 - DNA, 23 bp, Homo sapiens
catttgtggtaatctacaccaat

SEQ ID NO: 6029954 - DNA, 19 bp, Homo sapiens
catttgtgtacacagtcag

SEQ ID NO: 6029955 - DNA, 15 bp, Homo sapiens
catttgtgtcaatgg

SEQ ID NO: 6029956 - DNA, 15 bp, Homo sapiens
catttgtgtcactgt

SEQ ID NO: 6029957 - DNA, 14 bp, Homo sapiens
catttgtgtggaaa

SEQ ID NO: 6029958 - DNA, 13 bp, Homo sapiens
catttgtgtgtgt

SEQ ID NO: 6029959 - DNA, 20 bp, Homo sapiens
catttgtgttgaagaggttt

SEQ ID NO: 6029960 - DNA, 22 bp, Homo sapiens
catttgtgtttcagaaaggagt

SEQ ID NO: 6029961 - DNA, 22 bp, Homo sapiens
catttgtgttttgaaagcccaa

SEQ ID NO: 6029962 - DNA, 15 bp, Homo sapiens
catttgttaaaatta

SEQ ID NO: 6029963 - DNA, 20 bp, Homo sapiens
catttgttaatgattcttgt

SEQ ID NO: 6029964 - DNA, 14 bp, Homo sapiens
catttgttcactga

SEQ ID NO: 6029965 - DNA, 22 bp, Homo sapiens
catttgttcactgaaggtgatt

SEQ ID NO: 6029966 - DNA, 20 bp, Homo sapiens
catttgttcatattaagaat

SEQ ID NO: 6029967 - DNA, 19 bp, Homo sapiens
catttgttcatgagtggat

SEQ ID NO: 6029968 - DNA, 14 bp, Homo sapiens
catttgttcattaa

SEQ ID NO: 6029969 - DNA, 17 bp, Homo sapiens
catttgttcattaaacg

SEQ ID NO: 6029970 - DNA, 14 bp, Homo sapiens
catttgttcctgct

SEQ ID NO: 6029971 - DNA, 14 bp, Homo sapiens
catttgttctcaca

SEQ ID NO: 6029972 - DNA, 23 bp, Homo sapiens
catttgttctgggttaacagtaa

SEQ ID NO: 6029973 - DNA, 17 bp, Homo sapiens
catttgtttatgtaatt

SEQ ID NO: 6029974 - DNA, 23 bp, Homo sapiens
catttgtttctttctctgaggac

SEQ ID NO: 6029975 - DNA, 12 bp, Homo sapiens
catttgtttgac

SEQ ID NO: 6029976 - DNA, 21 bp, Homo sapiens
catttgtttgctgaaatttac

SEQ ID NO: 6029977 - DNA, 16 bp, Homo sapiens
catttgtttgttttcc

SEQ ID NO: 6029978 - DNA, 18 bp, Homo sapiens
catttgtttgttttcctt

SEQ ID NO: 6029979 - DNA, 12 bp, Homo sapiens
catttgttttag

SEQ ID NO: 6029980 - DNA, 13 bp, Homo sapiens
catttgttttagc

SEQ ID NO: 6029981 - DNA, 19 bp, Homo sapiens
catttgttttgcttttgtt

SEQ ID NO: 6029982 - DNA, 16 bp, Homo sapiens
catttgtttttctcac

SEQ ID NO: 6029983 - DNA, 13 bp, Homo sapiens
cattttaaaaaca

SEQ ID NO: 6029984 - DNA, 17 bp, Homo sapiens
cattttaaaaactttat

SEQ ID NO: 6029985 - DNA, 19 bp, Homo sapiens
cattttaaaatctgattta

SEQ ID NO: 6029986 - DNA, 14 bp, Homo sapiens
cattttaaaatgtc

SEQ ID NO: 6029987 - DNA, 16 bp, Homo sapiens
cattttaaaatgttta

SEQ ID NO: 6029988 - DNA, 17 bp, Homo sapiens
cattttaaacaaaatag

SEQ ID NO: 6029989 - DNA, 19 bp, Homo sapiens
cattttaaacaactttcca

SEQ ID NO: 6029990 - DNA, 14 bp, Homo sapiens
cattttaaaggata

SEQ ID NO: 6029991 - DNA, 16 bp, Homo sapiens
cattttaaaggataat

SEQ ID NO: 6029992 - DNA, 18 bp, Homo sapiens
cattttaaagttaaacat

SEQ ID NO: 6029993 - DNA, 13 bp, Homo sapiens
cattttaaataaa

SEQ ID NO: 6029994 - DNA, 15 bp, Homo sapiens
cattttaaataaaag

SEQ ID NO: 6029995 - DNA, 16 bp, Homo sapiens
cattttaaataaaaga

SEQ ID NO: 6029996 - DNA, 15 bp, Homo sapiens
caggtttaaaaatcc

SEQ ID NO: 6029997 - DNA, 16 bp, Homo sapiens
caggtttaagctgtta

SEQ ID NO: 6029998 - DNA, 23 bp, Homo sapiens
caggtttagtgaaaaactgctgt

SEQ ID NO: 6029999 - DNA, 23 bp, Homo sapiens
caggtttatattgggaagctgta

SEQ ID NO: 6030000 - DNA, 14 bp, Homo sapiens
caggtttatctgaa

SEQ ID NO: 6030001 - DNA, 15 bp, Homo sapiens
caggtttcatttctt

SEQ ID NO: 6030002 - DNA, 18 bp, Homo sapiens
caggtttctccttgaagc

SEQ ID NO: 6030003 - DNA, 18 bp, Homo sapiens
caggtttctggacaagaa

SEQ ID NO: 6030004 - DNA, 17 bp, Homo sapiens
caggtttcttaaaaaca

SEQ ID NO: 6030005 - DNA, 12 bp, Homo sapiens
caggtttcttct

SEQ ID NO: 6030006 - DNA, 23 bp, Homo sapiens
caggtttgggacccctggtggtt

SEQ ID NO: 6030007 - DNA, 23 bp, Homo sapiens
caggtttggggagggggaagaga

SEQ ID NO: 6030008 - DNA, 17 bp, Homo sapiens
caggtttgtcatcagat

SEQ ID NO: 6030009 - DNA, 13 bp, Homo sapiens
caggtttgttaca

SEQ ID NO: 6030010 - DNA, 20 bp, Homo sapiens
caggtttgtttcttgatagt

SEQ ID NO: 6030011 - DNA, 18 bp, Homo sapiens
caggttttatgtgttctt

SEQ ID NO: 6030012 - DNA, 20 bp, Homo sapiens
caggttttcacataaatgca

SEQ ID NO: 6030013 - DNA, 13 bp, Homo sapiens
caggttttctaat

SEQ ID NO: 6030014 - DNA, 11 bp, Homo sapiens
caggttttctg

SEQ ID NO: 6030015 - DNA, 14 bp, Homo sapiens
caggttttctgctc

SEQ ID NO: 6030016 - DNA, 24 bp, Homo sapiens
caggttttcttctaatcataacat

SEQ ID NO: 6030017 - DNA, 14 bp, Homo sapiens
caggtttttcaatt

SEQ ID NO: 6030018 - DNA, 21 bp, Homo sapiens
caggtttttcaattaaacgga

SEQ ID NO: 6030019 - DNA, 16 bp, Homo sapiens
caggtttttgaggaaa

SEQ ID NO: 6030020 - DNA, 20 bp, Homo sapiens
caggtttttgcccatcctcc

SEQ ID NO: 6030021 - DNA, 18 bp, Homo sapiens
cagtaaaaacttgtacta

SEQ ID NO: 6030022 - DNA, 12 bp, Homo sapiens
cagtaaaaataa

SEQ ID NO: 6030023 - DNA, 16 bp, Homo sapiens
cagtaaaacaggctgc

SEQ ID NO: 6030024 - DNA, 20 bp, Homo sapiens
cagtaaaagataaatttgtt

SEQ ID NO: 6030025 - DNA, 15 bp, Homo sapiens
cagtaaaagataacc

SEQ ID NO: 6030026 - DNA, 16 bp, Homo sapiens
cagtaaaatactattc

SEQ ID NO: 6030027 - DNA, 18 bp, Homo sapiens
cagtaaaattgccatatt

SEQ ID NO: 6030028 - DNA, 22 bp, Homo sapiens
cagtaaaatttcaggattaact

SEQ ID NO: 6030029 - DNA, 13 bp, Homo sapiens
cagtaaacaaatt

SEQ ID NO: 6030030 - DNA, 19 bp, Homo sapiens
cagtaaacaacttgtactt

SEQ ID NO: 6030031 - DNA, 13 bp, Homo sapiens
cagtaaacaccat

SEQ ID NO: 6030032 - DNA, 12 bp, Homo sapiens
cagtaaacactg

SEQ ID NO: 6030033 - DNA, 16 bp, Homo sapiens
cagtaaacagaggagt

SEQ ID NO: 6030034 - DNA, 10 bp, Homo sapiens
cagtaaacat

SEQ ID NO: 6030035 - DNA, 21 bp, Homo sapiens
cagtaaaccactgaaaaaata

SEQ ID NO: 6030036 - DNA, 21 bp, Homo sapiens
cagtaaacgggaacatgcccc

SEQ ID NO: 6030037 - DNA, 19 bp, Homo sapiens
cagtaaactttctctgcaa

SEQ ID NO: 6030038 - DNA, 16 bp, Homo sapiens
cagtaaagagaaactt

SEQ ID NO: 6030039 - DNA, 17 bp, Homo sapiens
cagtaaagagaaacttt

SEQ ID NO: 6030040 - DNA, 23 bp, Homo sapiens
cagtaaagaggcttccaagcatt

SEQ ID NO: 6030041 - DNA, 12 bp, Homo sapiens
cagtaaagagta

SEQ ID NO: 6030042 - DNA, 15 bp, Homo sapiens
cagtaaagtcttgtc

SEQ ID NO: 6030043 - DNA, 18 bp, Homo sapiens
cagtaaagtttaaaaaat

SEQ ID NO: 6030044 - DNA, 19 bp, Homo sapiens
cagtaaagtttaaaaaata

SEQ ID NO: 6030045 - DNA, 15 bp, Homo sapiens
cagtaaataaattgt

SEQ ID NO: 6030046 - DNA, 16 bp, Homo sapiens
cagtaaataaattgtt

SEQ ID NO: 6030047 - DNA, 14 bp, Homo sapiens
cagtaaataacagg

SEQ ID NO: 6030048 - DNA, 16 bp, Homo sapiens
cagtaaataactggaa

SEQ ID NO: 6030049 - DNA, 17 bp, Homo sapiens
cagtaaataactggaaa

SEQ ID NO: 6030050 - DNA, 23 bp, Homo sapiens
cagtaaatacttgcagttgtgat

SEQ ID NO: 6030051 - DNA, 12 bp, Homo sapiens
cagtaaatatac

SEQ ID NO: 6030052 - DNA, 20 bp, Homo sapiens
cagtaaatatacactttaca

SEQ ID NO: 6030053 - DNA, 17 bp, Homo sapiens
cagtaaatccacagcca

SEQ ID NO: 6030054 - DNA, 12 bp, Homo sapiens
cagtaaatcttt

SEQ ID NO: 6030055 - DNA, 20 bp, Homo sapiens
cagtaaatcttttacaactg

SEQ ID NO: 6030056 - DNA, 14 bp, Homo sapiens
cagtaaatgtatat

SEQ ID NO: 6030057 - DNA, 17 bp, Homo sapiens
cagtaaatgtatattga

SEQ ID NO: 6030058 - DNA, 12 bp, Homo sapiens
cagtaaatgtta

SEQ ID NO: 6030059 - DNA, 15 bp, Homo sapiens
cagtaaatttgctag

SEQ ID NO: 6030060 - DNA, 19 bp, Homo sapiens
cagtaacacagtgcagtgc

SEQ ID NO: 6030061 - DNA, 12 bp, Homo sapiens
cagtaacacgct

SEQ ID NO: 6030062 - DNA, 17 bp, Homo sapiens
cagtaacatttctgttc

SEQ ID NO: 6030063 - DNA, 17 bp, Homo sapiens
cagtaacctagtgaatt

SEQ ID NO: 6030064 - DNA, 19 bp, Homo sapiens
cagtaacgcgtcttcctga

SEQ ID NO: 6030065 - DNA, 20 bp, Homo sapiens
cagtaacgcgtcttcctgag

SEQ ID NO: 6030066 - DNA, 22 bp, Homo sapiens
cagtaacgggtcgtaatgactt

SEQ ID NO: 6030067 - DNA, 18 bp, Homo sapiens
cagtaacgtgctgctcaa

SEQ ID NO: 6030068 - DNA, 18 bp, Homo sapiens
cagtaactaagcacatta

SEQ ID NO: 6030069 - DNA, 16 bp, Homo sapiens
cagtaactcatctgtc

SEQ ID NO: 6030070 - DNA, 9 bp, Homo sapiens
cagtaactg

SEQ ID NO: 6030071 - DNA, 21 bp, Homo sapiens
cagtaactgagtgtggcggga

SEQ ID NO: 6030072 - DNA, 14 bp, Homo sapiens
cagtaactgccatt

SEQ ID NO: 6030073 - DNA, 18 bp, Homo sapiens
cagtaactgttttttaag

SEQ ID NO: 6030074 - DNA, 20 bp, Homo sapiens
cagtaacttatgtacaagga

SEQ ID NO: 6030075 - DNA, 23 bp, Homo sapiens
cagtaacttgcaaaaagtagact

SEQ ID NO: 6030076 - DNA, 14 bp, Homo sapiens
cagtaacttggtta

SEQ ID NO: 6030077 - DNA, 16 bp, Homo sapiens
cagtaactttatgtgt

SEQ ID NO: 6030078 - DNA, 18 bp, Homo sapiens
cagtaactttatgtgtaa

SEQ ID NO: 6030079 - DNA, 16 bp, Homo sapiens
cagtaacttttttgtg

SEQ ID NO: 6030080 - DNA, 19 bp, Homo sapiens
cagtaacttttttgtgtat

SEQ ID NO: 6030081 - DNA, 22 bp, Homo sapiens
cagtaacttttttgtgtatgta

SEQ ID NO: 6030082 - DNA, 17 bp, Homo sapiens
cagtaagaccggaagct

SEQ ID NO: 6030083 - DNA, 20 bp, Homo sapiens
cagtaagatatctcaatgaa

SEQ ID NO: 6030084 - DNA, 22 bp, Homo sapiens
cagtaagctggtttacagatgt

SEQ ID NO: 6030085 - DNA, 19 bp, Homo sapiens
cagtaaggcagctctgtcg

SEQ ID NO: 6030086 - DNA, 13 bp, Homo sapiens
cagtaaggcaggg

SEQ ID NO: 6030087 - DNA, 18 bp, Homo sapiens
cagtaagggaaatagaaa

SEQ ID NO: 6030088 - DNA, 21 bp, Homo sapiens
cagtaagggatattagataat

SEQ ID NO: 6030089 - DNA, 18 bp, Homo sapiens
cagtaaggtagaaataga

SEQ ID NO: 6030090 - DNA, 21 bp, Homo sapiens
cagtaagtagcaaccctgtga

SEQ ID NO: 6030091 - DNA, 22 bp, Homo sapiens
cagtaagtagcaaccctgtgat

SEQ ID NO: 6030092 - DNA, 19 bp, Homo sapiens
cagtaagtttattgttaat

SEQ ID NO: 6030093 - DNA, 19 bp, Homo sapiens
cagtaagtttcccctctgg

SEQ ID NO: 6030094 - DNA, 20 bp, Homo sapiens
cagtaagtttcccctctggc

SEQ ID NO: 6030095 - DNA, 23 bp, Homo sapiens
cagtaagtttcccctctggcttg

SEQ ID NO: 6030096 - DNA, 13 bp, Homo sapiens
cagtaataaaaca

SEQ ID NO: 6030097 - DNA, 23 bp, Homo sapiens
cagtaataagaatggaaaagaga

SEQ ID NO: 6030098 - DNA, 18 bp, Homo sapiens
cagtaatacattccattg

SEQ ID NO: 6030099 - DNA, 14 bp, Homo sapiens
cagtaatagctgaa

SEQ ID NO: 6030100 - DNA, 20 bp, Homo sapiens
cagtaatatttatatattta

SEQ ID NO: 6030101 - DNA, 17 bp, Homo sapiens
cagtaatcctgtaggaa

SEQ ID NO: 6030102 - DNA, 23 bp, Homo sapiens
cagtaatcctgtaggaaggtact

SEQ ID NO: 6030103 - DNA, 20 bp, Homo sapiens
cagtaatctatgtgtttctg

SEQ ID NO: 6030104 - DNA, 21 bp, Homo sapiens
cagtaatctttcggtctcctt

SEQ ID NO: 6030105 - DNA, 22 bp, Homo sapiens
cagtaatctttcggtctcctta

SEQ ID NO: 6030106 - DNA, 23 bp, Homo sapiens
cagtaatgcagtttttaaaaacc

SEQ ID NO: 6030107 - DNA, 21 bp, Homo sapiens
cagtaatgtagaaatgtttca

SEQ ID NO: 6030108 - DNA, 21 bp, Homo sapiens
cagtaattaatatctcctgga

SEQ ID NO: 6030109 - DNA, 17 bp, Homo sapiens
cagtaattactttcaga

SEQ ID NO: 6030110 - DNA, 19 bp, Homo sapiens
cagtaattactttcagaat

SEQ ID NO: 6030111 - DNA, 13 bp, Homo sapiens
cagtaattcaact

SEQ ID NO: 6030112 - DNA, 17 bp, Homo sapiens
cagtaattcaactggaa

SEQ ID NO: 6030113 - DNA, 18 bp, Homo sapiens
cagtaattgtgtcctctc

SEQ ID NO: 6030114 - DNA, 17 bp, Homo sapiens
cagtaatttgaggacaa

SEQ ID NO: 6030115 - DNA, 20 bp, Homo sapiens
cagtacaacccataatcatg

SEQ ID NO: 6030116 - DNA, 20 bp, Homo sapiens
cagtacaataaataaaagaa

SEQ ID NO: 6030117 - DNA, 13 bp, Homo sapiens
cagtacaataatg

SEQ ID NO: 6030118 - DNA, 14 bp, Homo sapiens
cagtacaattcttt

SEQ ID NO: 6030119 - DNA, 18 bp, Homo sapiens
cagtacacccaattttaa

SEQ ID NO: 6030120 - DNA, 16 bp, Homo sapiens
cagtacagagtgcagc

SEQ ID NO: 6030121 - DNA, 18 bp, Homo sapiens
cagtacagctatttctca

SEQ ID NO: 6030122 - DNA, 20 bp, Homo sapiens
cagtacagggcaggagctgc

SEQ ID NO: 6030123 - DNA, 12 bp, Homo sapiens
cagtacatatgt

SEQ ID NO: 6030124 - DNA, 14 bp, Homo sapiens
cagtacatatgtaa

SEQ ID NO: 6030125 - DNA, 16 bp, Homo sapiens
cagtacatcaaaggaa

SEQ ID NO: 6030126 - DNA, 15 bp, Homo sapiens
cagtacatcttgtgc

SEQ ID NO: 6030127 - DNA, 16 bp, Homo sapiens
cagtacattccaactt

SEQ ID NO: 6030128 - DNA, 22 bp, Homo sapiens
cagtacattctaaagagagtga

SEQ ID NO: 6030129 - DNA, 19 bp, Homo sapiens
cagtacattctcagttttt

SEQ ID NO: 6030130 - DNA, 15 bp, Homo sapiens
cagtacatttaaatt

SEQ ID NO: 6030131 - DNA, 20 bp, Homo sapiens
cagtacatttaaattttttg

SEQ ID NO: 6030132 - DNA, 22 bp, Homo sapiens
cagtacatttaaattttttggc

SEQ ID NO: 6030133 - DNA, 13 bp, Homo sapiens
cagtacatttttg

SEQ ID NO: 6030134 - DNA, 11 bp, Homo sapiens
cagtaccaaag

SEQ ID NO: 6030135 - DNA, 16 bp, Homo sapiens
cagtaccataatctta

SEQ ID NO: 6030136 - DNA, 22 bp, Homo sapiens
cagtaccataatcttagagaca

SEQ ID NO: 6030137 - DNA, 14 bp, Homo sapiens
cagtacccaccacc

SEQ ID NO: 6030138 - DNA, 19 bp, Homo sapiens
cagtacccacctgagcttt

SEQ ID NO: 6030139 - DNA, 23 bp, Homo sapiens
cagtaccccatggagctgggcta

SEQ ID NO: 6030140 - DNA, 16 bp, Homo sapiens
cagtaccctaccctga

SEQ ID NO: 6030141 - DNA, 20 bp, Homo sapiens
cagtacctagctggctctgt

SEQ ID NO: 6030142 - DNA, 15 bp, Homo sapiens
cagtacctccaagca

SEQ ID NO: 6030143 - DNA, 12 bp, Homo sapiens
cagtacctcctg

SEQ ID NO: 6030144 - DNA, 19 bp, Homo sapiens
cagtacctcgtttctacac

SEQ ID NO: 6030145 - DNA, 16 bp, Homo sapiens
cagtacctctcaagct

SEQ ID NO: 6030146 - DNA, 15 bp, Homo sapiens
cagtacctgagggtc

SEQ ID NO: 6030147 - DNA, 18 bp, Homo sapiens
cagtacctgggaaaggac

SEQ ID NO: 6030148 - DNA, 23 bp, Homo sapiens
cagtacctgggtccccagccctt

SEQ ID NO: 6030149 - DNA, 23 bp, Homo sapiens
cagtacctgtgcctgagaattta

SEQ ID NO: 6030150 - DNA, 21 bp, Homo sapiens
cagtaccttctgccagaagac

SEQ ID NO: 6030151 - DNA, 22 bp, Homo sapiens
cagtaccttctgccagaagact

SEQ ID NO: 6030152 - DNA, 13 bp, Homo sapiens
cagtaccttgctt

SEQ ID NO: 6030153 - DNA, 18 bp, Homo sapiens
cagtaccttgttgcagat

SEQ ID NO: 6030154 - DNA, 21 bp, Homo sapiens
cagtacgtcccgctgctgtgc

SEQ ID NO: 6030155 - DNA, 22 bp, Homo sapiens
cagtacgtcccgctgctgtgct

SEQ ID NO: 6030156 - DNA, 21 bp, Homo sapiens
cagtactaagggaacaatcca

SEQ ID NO: 6030157 - DNA, 18 bp, Homo sapiens
cagtactaaggtgacttt

SEQ ID NO: 6030158 - DNA, 15 bp, Homo sapiens
cagtactatgtaaat

SEQ ID NO: 6030159 - DNA, 12 bp, Homo sapiens
cagtactcactt

SEQ ID NO: 6030160 - DNA, 17 bp, Homo sapiens
cagtactcagtatagca

SEQ ID NO: 6030161 - DNA, 16 bp, Homo sapiens
cagtactcctccctgg

SEQ ID NO: 6030162 - DNA, 18 bp, Homo sapiens
cagtactgaggtggtgga

SEQ ID NO: 6030163 - DNA, 19 bp, Homo sapiens
cagtactggttactttcaa

SEQ ID NO: 6030164 - DNA, 21 bp, Homo sapiens
cagtactggttactttcaaaa

SEQ ID NO: 6030165 - DNA, 14 bp, Homo sapiens
cagtacttgctcaa

SEQ ID NO: 6030166 - DNA, 17 bp, Homo sapiens
cagtacttgctcaataa

SEQ ID NO: 6030167 - DNA, 12 bp, Homo sapiens
cagtacttgtca

SEQ ID NO: 6030168 - DNA, 20 bp, Homo sapiens
cagtactttattgtacagac

SEQ ID NO: 6030169 - DNA, 14 bp, Homo sapiens
cagtactttccagc

SEQ ID NO: 6030170 - DNA, 19 bp, Homo sapiens
cagtactttccagcagtca

SEQ ID NO: 6030171 - DNA, 15 bp, Homo sapiens
cagtactttctttct

SEQ ID NO: 6030172 - DNA, 19 bp, Homo sapiens
cagtactttctttctgtgt

SEQ ID NO: 6030173 - DNA, 16 bp, Homo sapiens
cagtactttggaggcc

SEQ ID NO: 6030174 - DNA, 17 bp, Homo sapiens
cattttaaataaaagaa

SEQ ID NO: 6030175 - DNA, 14 bp, Homo sapiens
cattttaaataggt

SEQ ID NO: 6030176 - DNA, 12 bp, Homo sapiens
cattttaaatgg

SEQ ID NO: 6030177 - DNA, 12 bp, Homo sapiens
cattttaacaag

SEQ ID NO: 6030178 - DNA, 16 bp, Homo sapiens
cattttaacaagaaga

SEQ ID NO: 6030179 - DNA, 12 bp, Homo sapiens
cattttaacagt

SEQ ID NO: 6030180 - DNA, 16 bp, Homo sapiens
cattttaacatctgag

SEQ ID NO: 6030181 - DNA, 16 bp, Homo sapiens
cattttaacgctgcct

SEQ ID NO: 6030182 - DNA, 17 bp, Homo sapiens
cattttaacgctgccta

SEQ ID NO: 6030183 - DNA, 18 bp, Homo sapiens
cattttaagaagacatga

SEQ ID NO: 6030184 - DNA, 17 bp, Homo sapiens
cattttaagtgtttaaa

SEQ ID NO: 6030185 - DNA, 20 bp, Homo sapiens
cattttaataactaaaccag

SEQ ID NO: 6030186 - DNA, 21 bp, Homo sapiens
cattttaatacagattgaaag

SEQ ID NO: 6030187 - DNA, 14 bp, Homo sapiens
cattttaatagaga

SEQ ID NO: 6030188 - DNA, 17 bp, Homo sapiens
cattttaatagtttcta

SEQ ID NO: 6030189 - DNA, 14 bp, Homo sapiens
cattttaatgtaaa

SEQ ID NO: 6030190 - DNA, 14 bp, Homo sapiens
cattttaattctct

SEQ ID NO: 6030191 - DNA, 18 bp, Homo sapiens
cattttaatttatatttg

SEQ ID NO: 6030192 - DNA, 21 bp, Homo sapiens
cattttaatttatatttgaaa

SEQ ID NO: 6030193 - DNA, 11 bp, Homo sapiens
cattttacaca

SEQ ID NO: 6030194 - DNA, 19 bp, Homo sapiens
cattttacacactgtacac

SEQ ID NO: 6030195 - DNA, 14 bp, Homo sapiens
cattttacacatgt

SEQ ID NO: 6030196 - DNA, 17 bp, Homo sapiens
cattttacacatgtgct

SEQ ID NO: 6030197 - DNA, 20 bp, Homo sapiens
cattttacacatgtgctgat

SEQ ID NO: 6030198 - DNA, 20 bp, Homo sapiens
cattttacagagaaagaaat

SEQ ID NO: 6030199 - DNA, 13 bp, Homo sapiens
cattttacagatt

SEQ ID NO: 6030200 - DNA, 21 bp, Homo sapiens
cattttacagtatcttcaaaa

SEQ ID NO: 6030201 - DNA, 22 bp, Homo sapiens
cattttacagttacttttcctt

SEQ ID NO: 6030202 - DNA, 18 bp, Homo sapiens
cattttacattaaatttt

SEQ ID NO: 6030203 - DNA, 22 bp, Homo sapiens
cattttaccatcacacatgttc

SEQ ID NO: 6030204 - DNA, 20 bp, Homo sapiens
cattttacccacacacagat

SEQ ID NO: 6030205 - DNA, 18 bp, Homo sapiens
cattttacgttttagaaa

SEQ ID NO: 6030206 - DNA, 12 bp, Homo sapiens
cattttactact

SEQ ID NO: 6030207 - DNA, 17 bp, Homo sapiens
cattttactacttgtta

SEQ ID NO: 6030208 - DNA, 18 bp, Homo sapiens
cattttactatttgccaa

SEQ ID NO: 6030209 - DNA, 16 bp, Homo sapiens
cattttactgattaac

SEQ ID NO: 6030210 - DNA, 14 bp, Homo sapiens
cattttactgtata

SEQ ID NO: 6030211 - DNA, 15 bp, Homo sapiens
cattttactgtctgt

SEQ ID NO: 6030212 - DNA, 22 bp, Homo sapiens
cattttactgttgtacaatcat

SEQ ID NO: 6030213 - DNA, 20 bp, Homo sapiens
cattttacttagctggagaa

SEQ ID NO: 6030214 - DNA, 22 bp, Homo sapiens
cattttacttagctggagaact

SEQ ID NO: 6030215 - DNA, 22 bp, Homo sapiens
cattttactttttcctggctca

SEQ ID NO: 6030216 - DNA, 21 bp, Homo sapiens
cattttagaaacggacagctt

SEQ ID NO: 6030217 - DNA, 20 bp, Homo sapiens
cattttagaagactctacca

SEQ ID NO: 6030218 - DNA, 17 bp, Homo sapiens
cattttagaattaaaat

SEQ ID NO: 6030219 - DNA, 20 bp, Homo sapiens
cattttagacactgggagaa

SEQ ID NO: 6030220 - DNA, 14 bp, Homo sapiens
cattttaggaaagg

SEQ ID NO: 6030221 - DNA, 13 bp, Homo sapiens
cattttaggcctc

SEQ ID NO: 6030222 - DNA, 15 bp, Homo sapiens
cattttaggcctcct

SEQ ID NO: 6030223 - DNA, 19 bp, Homo sapiens
cattttaggggtagcattt

SEQ ID NO: 6030224 - DNA, 16 bp, Homo sapiens
cattttagtcactttt

SEQ ID NO: 6030225 - DNA, 16 bp, Homo sapiens
cattttagtgtatctt

SEQ ID NO: 6030226 - DNA, 11 bp, Homo sapiens
cattttataaa

SEQ ID NO: 6030227 - DNA, 15 bp, Homo sapiens
cattttataaagtta

SEQ ID NO: 6030228 - DNA, 19 bp, Homo sapiens
cattttataaagtttatca

SEQ ID NO: 6030229 - DNA, 17 bp, Homo sapiens
cattttataaatcgctt

SEQ ID NO: 6030230 - DNA, 13 bp, Homo sapiens
cattttataatga

SEQ ID NO: 6030231 - DNA, 14 bp, Homo sapiens
cattttataatttc

SEQ ID NO: 6030232 - DNA, 15 bp, Homo sapiens
cattttatacaattt

SEQ ID NO: 6030233 - DNA, 15 bp, Homo sapiens
cattttataccaaag

SEQ ID NO: 6030234 - DNA, 17 bp, Homo sapiens
cattttatactgtacat

SEQ ID NO: 6030235 - DNA, 18 bp, Homo sapiens
cattttatactgtacatg

SEQ ID NO: 6030236 - DNA, 15 bp, Homo sapiens
cattttatagaaaat

SEQ ID NO: 6030237 - DNA, 18 bp, Homo sapiens
cattttatataaagaaaa

SEQ ID NO: 6030238 - DNA, 19 bp, Homo sapiens
cattttatatgtcaaagca

SEQ ID NO: 6030239 - DNA, 15 bp, Homo sapiens
cattttatatttaaa

SEQ ID NO: 6030240 - DNA, 15 bp, Homo sapiens
cattttatcattaaa

SEQ ID NO: 6030241 - DNA, 18 bp, Homo sapiens
cattttatcattaaaaat

SEQ ID NO: 6030242 - DNA, 20 bp, Homo sapiens
cattttatcattaaaaatta

SEQ ID NO: 6030243 - DNA, 15 bp, Homo sapiens
cattttatcttatct

SEQ ID NO: 6030244 - DNA, 22 bp, Homo sapiens
cattttatctttgaatggtctt

SEQ ID NO: 6030245 - DNA, 12 bp, Homo sapiens
cattttatgcta

SEQ ID NO: 6030246 - DNA, 17 bp, Homo sapiens
cattttatgctgtttat

SEQ ID NO: 6030247 - DNA, 14 bp, Homo sapiens
cattttatggtgcc

SEQ ID NO: 6030248 - DNA, 17 bp, Homo sapiens
cattttatggtgcctag

SEQ ID NO: 6030249 - DNA, 22 bp, Homo sapiens
cattttatgtctttcttgtaag

SEQ ID NO: 6030250 - DNA, 19 bp, Homo sapiens
cattttattaaaacagaaa

SEQ ID NO: 6030251 - DNA, 21 bp, Homo sapiens
cattttattaaacattttcat

SEQ ID NO: 6030252 - DNA, 15 bp, Homo sapiens
cattttattaaactt

SEQ ID NO: 6030253 - DNA, 22 bp, Homo sapiens
cattttattcacatatgtctta

SEQ ID NO: 6030254 - DNA, 11 bp, Homo sapiens
cattttattct

SEQ ID NO: 6030255 - DNA, 21 bp, Homo sapiens
cattttattgtcagaatttag

SEQ ID NO: 6030256 - DNA, 12 bp, Homo sapiens
cattttatttat

SEQ ID NO: 6030257 - DNA, 15 bp, Homo sapiens
cattttatttattag

SEQ ID NO: 6030258 - DNA, 20 bp, Homo sapiens
cattttattttttgggccat

SEQ ID NO: 6030259 - DNA, 22 bp, Homo sapiens
cattttcacagcactacttgct

SEQ ID NO: 6030260 - DNA, 17 bp, Homo sapiens
cattttcaccccaccct

SEQ ID NO: 6030261 - DNA, 16 bp, Homo sapiens
cattttcacttttaaa

SEQ ID NO: 6030262 - DNA, 19 bp, Homo sapiens
cattttcagaagttaacat

SEQ ID NO: 6030263 - DNA, 12 bp, Homo sapiens
cattttcagatc

SEQ ID NO: 6030264 - DNA, 21 bp, Homo sapiens
cattttcagattcaggcattt

SEQ ID NO: 6030265 - DNA, 17 bp, Homo sapiens
cattttcagttccctcc

SEQ ID NO: 6030266 - DNA, 16 bp, Homo sapiens
cattttcatatccaag

SEQ ID NO: 6030267 - DNA, 19 bp, Homo sapiens
cattttcatatgcttcaaa

SEQ ID NO: 6030268 - DNA, 19 bp, Homo sapiens
cattttcatattgtaatct

SEQ ID NO: 6030269 - DNA, 15 bp, Homo sapiens
cattttcatcactgg

SEQ ID NO: 6030270 - DNA, 16 bp, Homo sapiens
cattttcatgcttcca

SEQ ID NO: 6030271 - DNA, 18 bp, Homo sapiens
cattttcattaaaaggaa

SEQ ID NO: 6030272 - DNA, 14 bp, Homo sapiens
cattttcattccta

SEQ ID NO: 6030273 - DNA, 20 bp, Homo sapiens
cattttccacggaaacagaa

SEQ ID NO: 6030274 - DNA, 21 bp, Homo sapiens
cattttccatatcctggtgcc

SEQ ID NO: 6030275 - DNA, 23 bp, Homo sapiens
cattttcccatcatcctttgttc

SEQ ID NO: 6030276 - DNA, 17 bp, Homo sapiens
cattttccccccactct

SEQ ID NO: 6030277 - DNA, 22 bp, Homo sapiens
cattttcctacaggcagtctct

SEQ ID NO: 6030278 - DNA, 23 bp, Homo sapiens
cattttcctcacacccacctgct

SEQ ID NO: 6030279 - DNA, 20 bp, Homo sapiens
cattttcctcgcctaggcct

SEQ ID NO: 6030280 - DNA, 20 bp, Homo sapiens
cattttcctctgctttgaaa

SEQ ID NO: 6030281 - DNA, 12 bp, Homo sapiens
cattttcctgag

SEQ ID NO: 6030282 - DNA, 11 bp, Homo sapiens
cattttcctgt

SEQ ID NO: 6030283 - DNA, 12 bp, Homo sapiens
cattttcctgtg

SEQ ID NO: 6030284 - DNA, 19 bp, Homo sapiens
cattttcggcacttttcat

SEQ ID NO: 6030285 - DNA, 14 bp, Homo sapiens
cattttcgtcctgt

SEQ ID NO: 6030286 - DNA, 23 bp, Homo sapiens
cattttcgttacattgtgtcctg

SEQ ID NO: 6030287 - DNA, 11 bp, Homo sapiens
cattttctaaa

SEQ ID NO: 6030288 - DNA, 15 bp, Homo sapiens
cattttctaaactgt

SEQ ID NO: 6030289 - DNA, 23 bp, Homo sapiens
cattttctaaataaaaatatgta

SEQ ID NO: 6030290 - DNA, 17 bp, Homo sapiens
cattttctagatacaat

SEQ ID NO: 6030291 - DNA, 20 bp, Homo sapiens
cattttctagatacaataaa

SEQ ID NO: 6030292 - DNA, 11 bp, Homo sapiens
cattttctata

SEQ ID NO: 6030293 - DNA, 19 bp, Homo sapiens
cattttctataacagatat

SEQ ID NO: 6030294 - DNA, 15 bp, Homo sapiens
cattttctataacat

SEQ ID NO: 6030295 - DNA, 12 bp, Homo sapiens
cattttctctcc

SEQ ID NO: 6030296 - DNA, 14 bp, Homo sapiens
cattttctctcctc

SEQ ID NO: 6030297 - DNA, 13 bp, Homo sapiens
cattttctcttag

SEQ ID NO: 6030298 - DNA, 15 bp, Homo sapiens
cattttctcttagaa

SEQ ID NO: 6030299 - DNA, 17 bp, Homo sapiens
cattttctgaaactaat

SEQ ID NO: 6030300 - DNA, 21 bp, Homo sapiens
cattttctgacatgcattgtt

SEQ ID NO: 6030301 - DNA, 20 bp, Homo sapiens
cattttctgatgtattacat

SEQ ID NO: 6030302 - DNA, 11 bp, Homo sapiens
cattttctgca

SEQ ID NO: 6030303 - DNA, 21 bp, Homo sapiens
cattttctgggttctgggtgg

SEQ ID NO: 6030304 - DNA, 21 bp, Homo sapiens
cattttctggtactctgtgaa

SEQ ID NO: 6030305 - DNA, 18 bp, Homo sapiens
cattttctgttatacaca

SEQ ID NO: 6030306 - DNA, 13 bp, Homo sapiens
cattttctgttcc

SEQ ID NO: 6030307 - DNA, 14 bp, Homo sapiens
cattttctgttcca

SEQ ID NO: 6030308 - DNA, 15 bp, Homo sapiens
cattttctgttccag

SEQ ID NO: 6030309 - DNA, 14 bp, Homo sapiens
cattttcttcagaa

SEQ ID NO: 6030310 - DNA, 14 bp, Homo sapiens
cattttcttgcctg

SEQ ID NO: 6030311 - DNA, 13 bp, Homo sapiens
cattttcttgtat

SEQ ID NO: 6030312 - DNA, 22 bp, Homo sapiens
cattttcttgtcaatggaagaa

SEQ ID NO: 6030313 - DNA, 14 bp, Homo sapiens
cattttctttacag

SEQ ID NO: 6030314 - DNA, 12 bp, Homo sapiens
cattttctttca

SEQ ID NO: 6030315 - DNA, 19 bp, Homo sapiens
cattttctttctttttctg

SEQ ID NO: 6030316 - DNA, 22 bp, Homo sapiens
cattttctttttttaactggtg

SEQ ID NO: 6030317 - DNA, 14 bp, Homo sapiens
cattttgaaaatat

SEQ ID NO: 6030318 - DNA, 12 bp, Homo sapiens
cattttgaaagt

SEQ ID NO: 6030319 - DNA, 19 bp, Homo sapiens
cattttgaaagtctgtcct

SEQ ID NO: 6030320 - DNA, 11 bp, Homo sapiens
cattttgaaat

SEQ ID NO: 6030321 - DNA, 20 bp, Homo sapiens
cattttgaaattgttccttg

SEQ ID NO: 6030322 - DNA, 15 bp, Homo sapiens
cattttgaagctaat

SEQ ID NO: 6030323 - DNA, 16 bp, Homo sapiens
cattttgaagctaatt

SEQ ID NO: 6030324 - DNA, 15 bp, Homo sapiens
cattttgaaggaaaa

SEQ ID NO: 6030325 - DNA, 15 bp, Homo sapiens
cattttgaatcacat

SEQ ID NO: 6030326 - DNA, 18 bp, Homo sapiens
cattttgaatgtgatcat

SEQ ID NO: 6030327 - DNA, 18 bp, Homo sapiens
cattttgacaaagtgcct

SEQ ID NO: 6030328 - DNA, 14 bp, Homo sapiens
cattttgactggct

SEQ ID NO: 6030329 - DNA, 15 bp, Homo sapiens
cattttgagaacaaa

SEQ ID NO: 6030330 - DNA, 21 bp, Homo sapiens
cattttgagctgaaatgctgc

SEQ ID NO: 6030331 - DNA, 23 bp, Homo sapiens
cattttgagctgaaatgctgcat

SEQ ID NO: 6030332 - DNA, 20 bp, Homo sapiens
cattttgatgtattattata

SEQ ID NO: 6030333 - DNA, 20 bp, Homo sapiens
cattttgatttttttgttca

SEQ ID NO: 6030334 - DNA, 13 bp, Homo sapiens
cattttgcaaaat

SEQ ID NO: 6030335 - DNA, 15 bp, Homo sapiens
cattttgcaaaattt

SEQ ID NO: 6030336 - DNA, 16 bp, Homo sapiens
cattttgcacctgcag

SEQ ID NO: 6030337 - DNA, 18 bp, Homo sapiens
cattttgcagaaggaaat

SEQ ID NO: 6030338 - DNA, 18 bp, Homo sapiens
cattttgcagcagtgagt

SEQ ID NO: 6030339 - DNA, 22 bp, Homo sapiens
cattttgcagcagtgagtctct

SEQ ID NO: 6030340 - DNA, 15 bp, Homo sapiens
cattttgcattcaaa

SEQ ID NO: 6030341 - DNA, 18 bp, Homo sapiens
cattttgccacctttcct

SEQ ID NO: 6030342 - DNA, 14 bp, Homo sapiens
cattttgcctctgt

SEQ ID NO: 6030343 - DNA, 15 bp, Homo sapiens
cattttgcgatgtgt

SEQ ID NO: 6030344 - DNA, 16 bp, Homo sapiens
cattttgcgatgtgtt

SEQ ID NO: 6030345 - DNA, 18 bp, Homo sapiens
cattttgctaaatgtgaa

SEQ ID NO: 6030346 - DNA, 15 bp, Homo sapiens
cattttgctattgta

SEQ ID NO: 6030347 - DNA, 17 bp, Homo sapiens
cattttgctattgtaaa

SEQ ID NO: 6030348 - DNA, 18 bp, Homo sapiens
cattttgctctgtgaact

SEQ ID NO: 6030349 - DNA, 15 bp, Homo sapiens
cattttgcttcccat

SEQ ID NO: 6030350 - DNA, 13 bp, Homo sapiens
cattttgctttaa

SEQ ID NO: 6030351 - DNA, 14 bp, Homo sapiens
cattttgctttaat

SEQ ID NO: 6030352 - DNA, 18 bp, Homo sapiens
cattttggaagttttcag

SEQ ID NO: 6030353 - DNA, 22 bp, Homo sapiens
cattttggaagttttcaggact

SEQ ID NO: 6030354 - DNA, 16 bp, Homo sapiens
cattttggatgtcatt

SEQ ID NO: 6030355 - DNA, 19 bp, Homo sapiens
cagtactttggaggcccct

SEQ ID NO: 6030356 - DNA, 20 bp, Homo sapiens
cagtactttggaggccccta

SEQ ID NO: 6030357 - DNA, 17 bp, Homo sapiens
cagtacttttattaata

SEQ ID NO: 6030358 - DNA, 16 bp, Homo sapiens
cagtacttttgttgta

SEQ ID NO: 6030359 - DNA, 17 bp, Homo sapiens
cagtacttttgttgtat

SEQ ID NO: 6030360 - DNA, 21 bp, Homo sapiens
cagtacttttttaaatatttt

SEQ ID NO: 6030361 - DNA, 12 bp, Homo sapiens
cagtagaaagag

SEQ ID NO: 6030362 - DNA, 19 bp, Homo sapiens
cagtagaaagagtgttatc

SEQ ID NO: 6030363 - DNA, 13 bp, Homo sapiens
cagtagaaagcta

SEQ ID NO: 6030364 - DNA, 15 bp, Homo sapiens
cagtagaaagctaaa

SEQ ID NO: 6030365 - DNA, 19 bp, Homo sapiens
cagtagaaagctaaagtga

SEQ ID NO: 6030366 - DNA, 22 bp, Homo sapiens
cagtagaactccaggccctcct

SEQ ID NO: 6030367 - DNA, 12 bp, Homo sapiens
cagtagaactgt

SEQ ID NO: 6030368 - DNA, 23 bp, Homo sapiens
cagtagaaggtcggaggcttggg

SEQ ID NO: 6030369 - DNA, 15 bp, Homo sapiens
cagtagacattttaa

SEQ ID NO: 6030370 - DNA, 19 bp, Homo sapiens
cagtagacattttaacaag

SEQ ID NO: 6030371 - DNA, 22 bp, Homo sapiens
cagtagacattttaacaagaag

SEQ ID NO: 6030372 - DNA, 21 bp, Homo sapiens
cagtagacctgattttcaaaa

SEQ ID NO: 6030373 - DNA, 20 bp, Homo sapiens
cagtagaccttgttacttct

SEQ ID NO: 6030374 - DNA, 20 bp, Homo sapiens
cagtagagaaacatttggaa

SEQ ID NO: 6030375 - DNA, 12 bp, Homo sapiens
cagtagagccag

SEQ ID NO: 6030376 - DNA, 14 bp, Homo sapiens
cagtagagccagct

SEQ ID NO: 6030377 - DNA, 16 bp, Homo sapiens
cagtagagccagcttg

SEQ ID NO: 6030378 - DNA, 23 bp, Homo sapiens
cagtagaggcatgaacacacatg

SEQ ID NO: 6030379 - DNA, 12 bp, Homo sapiens
cagtagagttag

SEQ ID NO: 6030380 - DNA, 16 bp, Homo sapiens
cagtagagttagctga

SEQ ID NO: 6030381 - DNA, 16 bp, Homo sapiens
cagtagattgcagaaa

SEQ ID NO: 6030382 - DNA, 14 bp, Homo sapiens
cagtagatttcctt

SEQ ID NO: 6030383 - DNA, 16 bp, Homo sapiens
cagtagattttccaaa

SEQ ID NO: 6030384 - DNA, 18 bp, Homo sapiens
cagtagattttccaaatg

SEQ ID NO: 6030385 - DNA, 19 bp, Homo sapiens
cagtagattttctttaaaa

SEQ ID NO: 6030386 - DNA, 18 bp, Homo sapiens
cagtagcagcagaggcca

SEQ ID NO: 6030387 - DNA, 13 bp, Homo sapiens
cagtagcaggacc

SEQ ID NO: 6030388 - DNA, 12 bp, Homo sapiens
cagtagcaggga

SEQ ID NO: 6030389 - DNA, 18 bp, Homo sapiens
cagtagcatactgatgag

SEQ ID NO: 6030390 - DNA, 13 bp, Homo sapiens
cagtagccaaggc

SEQ ID NO: 6030391 - DNA, 16 bp, Homo sapiens
cagtagccaaggcccg

SEQ ID NO: 6030392 - DNA, 20 bp, Homo sapiens
cagtagccaagttatattga

SEQ ID NO: 6030393 - DNA, 13 bp, Homo sapiens
cagtagccagagt

SEQ ID NO: 6030394 - DNA, 22 bp, Homo sapiens
cagtagcccctaatcacatgtg

SEQ ID NO: 6030395 - DNA, 20 bp, Homo sapiens
cagtagctccgcgtgtctca

SEQ ID NO: 6030396 - DNA, 14 bp, Homo sapiens
cagtagctcctgga

SEQ ID NO: 6030397 - DNA, 17 bp, Homo sapiens
cagtagctccttggttt

SEQ ID NO: 6030398 - DNA, 14 bp, Homo sapiens
cagtagctcttaga

SEQ ID NO: 6030399 - DNA, 19 bp, Homo sapiens
cagtagctgagtgcactcc

SEQ ID NO: 6030400 - DNA, 22 bp, Homo sapiens
cagtagctgctacctaaaaaaa

SEQ ID NO: 6030401 - DNA, 20 bp, Homo sapiens
cagtagctgggaccacaggt

SEQ ID NO: 6030402 - DNA, 20 bp, Homo sapiens
cagtagctgtggcctcaccc

SEQ ID NO: 6030403 - DNA, 22 bp, Homo sapiens
cagtagctgtggggagctggtg

SEQ ID NO: 6030404 - DNA, 17 bp, Homo sapiens
cagtagcttaaataaat

SEQ ID NO: 6030405 - DNA, 18 bp, Homo sapiens
cagtagcttaagaaaaaa

SEQ ID NO: 6030406 - DNA, 19 bp, Homo sapiens
cagtaggaacaagctggct

SEQ ID NO: 6030407 - DNA, 20 bp, Homo sapiens
cagtaggaacaagctggctt

SEQ ID NO: 6030408 - DNA, 17 bp, Homo sapiens
cagtaggaacccagctc

SEQ ID NO: 6030409 - DNA, 22 bp, Homo sapiens
cagtaggaacccagctctcagg

SEQ ID NO: 6030410 - DNA, 22 bp, Homo sapiens
cagtaggacaaggtgcaggcag

SEQ ID NO: 6030411 - DNA, 24 bp, Homo sapiens
cagtaggacaaggtgcaggcaggc

SEQ ID NO: 6030412 - DNA, 17 bp, Homo sapiens
cagtaggactccttatt

SEQ ID NO: 6030413 - DNA, 21 bp, Homo sapiens
cagtaggagcccagctctgaa

SEQ ID NO: 6030414 - DNA, 22 bp, Homo sapiens
cagtaggagcccagctctgaaa

SEQ ID NO: 6030415 - DNA, 22 bp, Homo sapiens
cagtaggatttatgtattttga

SEQ ID NO: 6030416 - DNA, 23 bp, Homo sapiens
cagtaggcattctttagtctaca

SEQ ID NO: 6030417 - DNA, 18 bp, Homo sapiens
cagtaggctttatgctgt

SEQ ID NO: 6030418 - DNA, 20 bp, Homo sapiens
cagtaggctttatgctgtgt

SEQ ID NO: 6030419 - DNA, 12 bp, Homo sapiens
cagtaggggagg

SEQ ID NO: 6030420 - DNA, 15 bp, Homo sapiens
cagtagggtttgaca

SEQ ID NO: 6030421 - DNA, 17 bp, Homo sapiens
cagtagggtttgacatt

SEQ ID NO: 6030422 - DNA, 17 bp, Homo sapiens
cagtaggtccaagggcc

SEQ ID NO: 6030423 - DNA, 19 bp, Homo sapiens
cagtaggtccaagggccat

SEQ ID NO: 6030424 - DNA, 17 bp, Homo sapiens
cagtaggtcccggccag

SEQ ID NO: 6030425 - DNA, 20 bp, Homo sapiens
cagtaggtctgaaggcctcc

SEQ ID NO: 6030426 - DNA, 22 bp, Homo sapiens
cagtaggtgcccagaataagtt

SEQ ID NO: 6030427 - DNA, 18 bp, Homo sapiens
cagtaggtttgtgtggat

SEQ ID NO: 6030428 - DNA, 21 bp, Homo sapiens
cagtagtaattgatttgaccc

SEQ ID NO: 6030429 - DNA, 22 bp, Homo sapiens
cagtagtagcctccaggtttcc

SEQ ID NO: 6030430 - DNA, 19 bp, Homo sapiens
cagtagtataatgtatgaa

SEQ ID NO: 6030431 - DNA, 16 bp, Homo sapiens
cagtagtcgtcaagtt

SEQ ID NO: 6030432 - DNA, 23 bp, Homo sapiens
cagtagtcttgatgaccaaagtc

SEQ ID NO: 6030433 - DNA, 16 bp, Homo sapiens
cagtagtgagaagaat

SEQ ID NO: 6030434 - DNA, 22 bp, Homo sapiens
cagtagtgccaaaaggcccctt

SEQ ID NO: 6030435 - DNA, 14 bp, Homo sapiens
cagtagtgccagaa

SEQ ID NO: 6030436 - DNA, 18 bp, Homo sapiens
cagtagtgcctgtgatcg

SEQ ID NO: 6030437 - DNA, 20 bp, Homo sapiens
cagtagtgttgggtggagga

SEQ ID NO: 6030438 - DNA, 21 bp, Homo sapiens
cagtagtgttgggtggaggat

SEQ ID NO: 6030439 - DNA, 15 bp, Homo sapiens
cagtagttactgctg

SEQ ID NO: 6030440 - DNA, 16 bp, Homo sapiens
cagtagttgtattctt

SEQ ID NO: 6030441 - DNA, 17 bp, Homo sapiens
cagtagtttgagaccag

SEQ ID NO: 6030442 - DNA, 21 bp, Homo sapiens
cagtagtttgagaccagcctg

SEQ ID NO: 6030443 - DNA, 21 bp, Homo sapiens
cagtagttttgacacttccca

SEQ ID NO: 6030444 - DNA, 14 bp, Homo sapiens
cagtataaaagaca

SEQ ID NO: 6030445 - DNA, 15 bp, Homo sapiens
cagtataaaagacaa

SEQ ID NO: 6030446 - DNA, 13 bp, Homo sapiens
cagtataaaatta

SEQ ID NO: 6030447 - DNA, 15 bp, Homo sapiens
cagtataaagaatag

SEQ ID NO: 6030448 - DNA, 16 bp, Homo sapiens
cagtataaattacatg

SEQ ID NO: 6030449 - DNA, 21 bp, Homo sapiens
cagtataaattacatgcatga

SEQ ID NO: 6030450 - DNA, 22 bp, Homo sapiens
cagtataatctcctctgctcat

SEQ ID NO: 6030451 - DNA, 21 bp, Homo sapiens
cagtataattaacatgttaaa

SEQ ID NO: 6030452 - DNA, 19 bp, Homo sapiens
cagtataattctgtactga

SEQ ID NO: 6030453 - DNA, 22 bp, Homo sapiens
cagtataattctgtactgattt

SEQ ID NO: 6030454 - DNA, 15 bp, Homo sapiens
cagtataattttcta

SEQ ID NO: 6030455 - DNA, 14 bp, Homo sapiens
cagtatacagtcct

SEQ ID NO: 6030456 - DNA, 13 bp, Homo sapiens
cagtatacctcat

SEQ ID NO: 6030457 - DNA, 14 bp, Homo sapiens
cagtatactgtgtg

SEQ ID NO: 6030458 - DNA, 18 bp, Homo sapiens
cagtatagcattgaacat

SEQ ID NO: 6030459 - DNA, 18 bp, Homo sapiens
cagtatataataacttta

SEQ ID NO: 6030460 - DNA, 22 bp, Homo sapiens
cagtatataataactttattgc

SEQ ID NO: 6030461 - DNA, 15 bp, Homo sapiens
cagtatatttaaact

SEQ ID NO: 6030462 - DNA, 13 bp, Homo sapiens
cagtatatttata

SEQ ID NO: 6030463 - DNA, 20 bp, Homo sapiens
cagtatattttatttcaatg

SEQ ID NO: 6030464 - DNA, 13 bp, Homo sapiens
cagtatattttct

SEQ ID NO: 6030465 - DNA, 20 bp, Homo sapiens
cagtatattttctgtattta

SEQ ID NO: 6030466 - DNA, 19 bp, Homo sapiens
cagtatcaaggctgcctgg

SEQ ID NO: 6030467 - DNA, 23 bp, Homo sapiens
cagtatcaaggctgcctggagaa

SEQ ID NO: 6030468 - DNA, 14 bp, Homo sapiens
cagtatcactgtct

SEQ ID NO: 6030469 - DNA, 14 bp, Homo sapiens
cagtatcagagggt

SEQ ID NO: 6030470 - DNA, 14 bp, Homo sapiens
cagtatcaggcctg

SEQ ID NO: 6030471 - DNA, 20 bp, Homo sapiens
cagtatcaggcctgccagac

SEQ ID NO: 6030472 - DNA, 24 bp, Homo sapiens
cagtatcaggcctgccagacggca

SEQ ID NO: 6030473 - DNA, 13 bp, Homo sapiens
cagtatcatctcc

SEQ ID NO: 6030474 - DNA, 13 bp, Homo sapiens
cagtatcatgccc

SEQ ID NO: 6030475 - DNA, 16 bp, Homo sapiens
cagtatccactttgca

SEQ ID NO: 6030476 - DNA, 14 bp, Homo sapiens
cagtatcccacatc

SEQ ID NO: 6030477 - DNA, 14 bp, Homo sapiens
cagtatcggcactg

SEQ ID NO: 6030478 - DNA, 19 bp, Homo sapiens
cagtatctatatatgtgta

SEQ ID NO: 6030479 - DNA, 22 bp, Homo sapiens
cagtatctatatatgtgtatgt

SEQ ID NO: 6030480 - DNA, 23 bp, Homo sapiens
cagtatctccatccttaactgtc

SEQ ID NO: 6030481 - DNA, 15 bp, Homo sapiens
cagtatctcttcagt

SEQ ID NO: 6030482 - DNA, 21 bp, Homo sapiens
cagtatctcttgctgggaaca

SEQ ID NO: 6030483 - DNA, 15 bp, Homo sapiens
cagtatcttaaaatt

SEQ ID NO: 6030484 - DNA, 18 bp, Homo sapiens
cagtatcttcaaaaatac

SEQ ID NO: 6030485 - DNA, 21 bp, Homo sapiens
cagtatcttgaagacttttct

SEQ ID NO: 6030486 - DNA, 17 bp, Homo sapiens
cagtatcttttttcctt

SEQ ID NO: 6030487 - DNA, 23 bp, Homo sapiens
cagtatgaaaagctatcttaaaa

SEQ ID NO: 6030488 - DNA, 13 bp, Homo sapiens
cagtatgaactat

SEQ ID NO: 6030489 - DNA, 15 bp, Homo sapiens
cagtatgaatgatgt

SEQ ID NO: 6030490 - DNA, 19 bp, Homo sapiens
cagtatgaattattcaatt

SEQ ID NO: 6030491 - DNA, 15 bp, Homo sapiens
cagtatgacagagga

SEQ ID NO: 6030492 - DNA, 16 bp, Homo sapiens
cagtatgacagaggag

SEQ ID NO: 6030493 - DNA, 18 bp, Homo sapiens
cagtatgacagaggagga

SEQ ID NO: 6030494 - DNA, 16 bp, Homo sapiens
cagtatgagaagaaaa

SEQ ID NO: 6030495 - DNA, 19 bp, Homo sapiens
cagtatgatgaaaataatt

SEQ ID NO: 6030496 - DNA, 22 bp, Homo sapiens
cagtatgatggcaggagaatca

SEQ ID NO: 6030497 - DNA, 16 bp, Homo sapiens
cagtatgctgcccctg

SEQ ID NO: 6030498 - DNA, 19 bp, Homo sapiens
cagtatgctgttttaataa

SEQ ID NO: 6030499 - DNA, 17 bp, Homo sapiens
cagtatgcttgctctaa

SEQ ID NO: 6030500 - DNA, 18 bp, Homo sapiens
cagtatgctttccctgag

SEQ ID NO: 6030501 - DNA, 19 bp, Homo sapiens
cagtatgctttccctgagg

SEQ ID NO: 6030502 - DNA, 21 bp, Homo sapiens
cagtatgctttccctgaggaa

SEQ ID NO: 6030503 - DNA, 19 bp, Homo sapiens
cagtatggcaatatctaca

SEQ ID NO: 6030504 - DNA, 15 bp, Homo sapiens
cagtatggccatggg

SEQ ID NO: 6030505 - DNA, 21 bp, Homo sapiens
cagtatgggctacacagcagc

SEQ ID NO: 6030506 - DNA, 18 bp, Homo sapiens
cagtatggtacatttttc

SEQ ID NO: 6030507 - DNA, 20 bp, Homo sapiens
cagtatggtacatttttcaa

SEQ ID NO: 6030508 - DNA, 23 bp, Homo sapiens
cagtatggtacatttttcaactt

SEQ ID NO: 6030509 - DNA, 18 bp, Homo sapiens
cagtatggtgctaatgtg

SEQ ID NO: 6030510 - DNA, 16 bp, Homo sapiens
cagtatgtcccatagg

SEQ ID NO: 6030511 - DNA, 18 bp, Homo sapiens
cagtatgtctactcctca

SEQ ID NO: 6030512 - DNA, 12 bp, Homo sapiens
cagtatgtggaa

SEQ ID NO: 6030513 - DNA, 15 bp, Homo sapiens
cagtatgtgggggct

SEQ ID NO: 6030514 - DNA, 22 bp, Homo sapiens
cagtatgtgtctagcaaagcca

SEQ ID NO: 6030515 - DNA, 19 bp, Homo sapiens
cagtatgttcaaagtcaaa

SEQ ID NO: 6030516 - DNA, 19 bp, Homo sapiens
cagtatgttttaacaaaaa

SEQ ID NO: 6030517 - DNA, 17 bp, Homo sapiens
cagtatgttttacactg

SEQ ID NO: 6030518 - DNA, 21 bp, Homo sapiens
cagtattaaaggggggagggg

SEQ ID NO: 6030519 - DNA, 19 bp, Homo sapiens
cagtattaacatcaaagac

SEQ ID NO: 6030520 - DNA, 15 bp, Homo sapiens
cagtattaagctaat

SEQ ID NO: 6030521 - DNA, 17 bp, Homo sapiens
cagtattacagaggtcg

SEQ ID NO: 6030522 - DNA, 14 bp, Homo sapiens
cagtattacagtgt

SEQ ID NO: 6030523 - DNA, 18 bp, Homo sapiens
cagtattactgctgctgt

SEQ ID NO: 6030524 - DNA, 22 bp, Homo sapiens
cagtattactgctgctgtgctt

SEQ ID NO: 6030525 - DNA, 16 bp, Homo sapiens
cagtattacttctgct

SEQ ID NO: 6030526 - DNA, 20 bp, Homo sapiens
cagtattactttctgccgct

SEQ ID NO: 6030527 - DNA, 13 bp, Homo sapiens
cagtattatatgt

SEQ ID NO: 6030528 - DNA, 14 bp, Homo sapiens
cagtattatatgta

SEQ ID NO: 6030529 - DNA, 21 bp, Homo sapiens
cagtattatctaaatgaatga

SEQ ID NO: 6030530 - DNA, 12 bp, Homo sapiens
cagtattatgta

SEQ ID NO: 6030531 - DNA, 17 bp, Homo sapiens
cagtattatttagtaaa

SEQ ID NO: 6030532 - DNA, 22 bp, Homo sapiens
cattttgggacaattgttttaa

SEQ ID NO: 6030533 - DNA, 23 bp, Homo sapiens
cattttgggatccttcagcacag

SEQ ID NO: 6030534 - DNA, 22 bp, Homo sapiens
cattttggggtacccactgctc

SEQ ID NO: 6030535 - DNA, 19 bp, Homo sapiens
cattttgggttgtttaaaa

SEQ ID NO: 6030536 - DNA, 15 bp, Homo sapiens
cattttggtgagaaa

SEQ ID NO: 6030537 - DNA, 19 bp, Homo sapiens
cattttggtgcaatattct

SEQ ID NO: 6030538 - DNA, 21 bp, Homo sapiens
cattttggtttatttttgtaa

SEQ ID NO: 6030539 - DNA, 22 bp, Homo sapiens
cattttggtttatttttgtaat

SEQ ID NO: 6030540 - DNA, 13 bp, Homo sapiens
cattttgtaaaat

SEQ ID NO: 6030541 - DNA, 14 bp, Homo sapiens
cattttgtaaatct

SEQ ID NO: 6030542 - DNA, 18 bp, Homo sapiens
cattttgtaacaaatgaa

SEQ ID NO: 6030543 - DNA, 12 bp, Homo sapiens
cattttgtaata

SEQ ID NO: 6030544 - DNA, 14 bp, Homo sapiens
cattttgtaatatt

SEQ ID NO: 6030545 - DNA, 13 bp, Homo sapiens
cattttgtactct

SEQ ID NO: 6030546 - DNA, 13 bp, Homo sapiens
cattttgtagcta

SEQ ID NO: 6030547 - DNA, 20 bp, Homo sapiens
cattttgtataatcacagtt

SEQ ID NO: 6030548 - DNA, 17 bp, Homo sapiens
cattttgtataattgta

SEQ ID NO: 6030549 - DNA, 18 bp, Homo sapiens
cattttgtataattgtat

SEQ ID NO: 6030550 - DNA, 17 bp, Homo sapiens
cattttgtatgctgcat

SEQ ID NO: 6030551 - DNA, 23 bp, Homo sapiens
cattttgtcacaagctgtagata

SEQ ID NO: 6030552 - DNA, 21 bp, Homo sapiens
cattttgtccaccttttaagt

SEQ ID NO: 6030553 - DNA, 13 bp, Homo sapiens
cattttgtgaagc

SEQ ID NO: 6030554 - DNA, 15 bp, Homo sapiens
cattttgtgaatgga

SEQ ID NO: 6030555 - DNA, 18 bp, Homo sapiens
cattttgtgaatggattg

SEQ ID NO: 6030556 - DNA, 21 bp, Homo sapiens
cattttgtgaatggattggat

SEQ ID NO: 6030557 - DNA, 11 bp, Homo sapiens
cattttgtgtc

SEQ ID NO: 6030558 - DNA, 21 bp, Homo sapiens
cattttgtgtgagacttaaaa

SEQ ID NO: 6030559 - DNA, 16 bp, Homo sapiens
cattttgtgtgatgca

SEQ ID NO: 6030560 - DNA, 19 bp, Homo sapiens
cattttgtgtgatgcatgt

SEQ ID NO: 6030561 - DNA, 18 bp, Homo sapiens
cattttgtgttgaagagc

SEQ ID NO: 6030562 - DNA, 16 bp, Homo sapiens
cattttgttaaaatct

SEQ ID NO: 6030563 - DNA, 17 bp, Homo sapiens
cattttgttaagaagtt

SEQ ID NO: 6030564 - DNA, 18 bp, Homo sapiens
cattttgttaagaagttg

SEQ ID NO: 6030565 - DNA, 21 bp, Homo sapiens
cattttgttcttacacataca

SEQ ID NO: 6030566 - DNA, 16 bp, Homo sapiens
cattttgttgtaaaaa

SEQ ID NO: 6030567 - DNA, 23 bp, Homo sapiens
cattttgttgtgtgtatgctgct

SEQ ID NO: 6030568 - DNA, 19 bp, Homo sapiens
cattttgtttcactctttc

SEQ ID NO: 6030569 - DNA, 19 bp, Homo sapiens
cattttgtttttactgtat

SEQ ID NO: 6030570 - DNA, 19 bp, Homo sapiens
cattttgtttttattaaat

SEQ ID NO: 6030571 - DNA, 13 bp, Homo sapiens
catttttaaactt

SEQ ID NO: 6030572 - DNA, 15 bp, Homo sapiens
catttttaaaggaca

SEQ ID NO: 6030573 - DNA, 17 bp, Homo sapiens
catttttaaatgtgttt

SEQ ID NO: 6030574 - DNA, 18 bp, Homo sapiens
catttttaaatgtgtttt

SEQ ID NO: 6030575 - DNA, 14 bp, Homo sapiens
catttttaaattct

SEQ ID NO: 6030576 - DNA, 15 bp, Homo sapiens
catttttaaattctt

SEQ ID NO: 6030577 - DNA, 22 bp, Homo sapiens
catttttaaattcttactctgg

SEQ ID NO: 6030578 - DNA, 13 bp, Homo sapiens
catttttaacagc

SEQ ID NO: 6030579 - DNA, 23 bp, Homo sapiens
catttttaactactgtattccca

SEQ ID NO: 6030580 - DNA, 13 bp, Homo sapiens
catttttaagaat

SEQ ID NO: 6030581 - DNA, 18 bp, Homo sapiens
catttttaagatgcatgt

SEQ ID NO: 6030582 - DNA, 20 bp, Homo sapiens
catttttaaggctgtgtgaa

SEQ ID NO: 6030583 - DNA, 15 bp, Homo sapiens
catttttaagtgctg

SEQ ID NO: 6030584 - DNA, 21 bp, Homo sapiens
catttttaagtgctgcattta

SEQ ID NO: 6030585 - DNA, 14 bp, Homo sapiens
catttttaatgtat

SEQ ID NO: 6030586 - DNA, 15 bp, Homo sapiens
catttttaatgtatc

SEQ ID NO: 6030587 - DNA, 17 bp, Homo sapiens
catttttacaataaata

SEQ ID NO: 6030588 - DNA, 14 bp, Homo sapiens
catttttaccatta

SEQ ID NO: 6030589 - DNA, 12 bp, Homo sapiens
catttttactgt

SEQ ID NO: 6030590 - DNA, 15 bp, Homo sapiens
catttttagcactgg

SEQ ID NO: 6030591 - DNA, 18 bp, Homo sapiens
catttttagtagagacag

SEQ ID NO: 6030592 - DNA, 22 bp, Homo sapiens
catttttataacctggcaaaat

SEQ ID NO: 6030593 - DNA, 21 bp, Homo sapiens
catttttatacctgtttaaat

SEQ ID NO: 6030594 - DNA, 14 bp, Homo sapiens
catttttatgcaga

SEQ ID NO: 6030595 - DNA, 23 bp, Homo sapiens
catttttattaatatggtgactt

SEQ ID NO: 6030596 - DNA, 15 bp, Homo sapiens
catttttatttatga

SEQ ID NO: 6030597 - DNA, 14 bp, Homo sapiens
catttttcaaagca

SEQ ID NO: 6030598 - DNA, 17 bp, Homo sapiens
catttttcaaagcaatt

SEQ ID NO: 6030599 - DNA, 18 bp, Homo sapiens
catttttcaactttgaat

SEQ ID NO: 6030600 - DNA, 21 bp, Homo sapiens
catttttcaactttgaataaa

SEQ ID NO: 6030601 - DNA, 22 bp, Homo sapiens
catttttcaataaagtactgca

SEQ ID NO: 6030602 - DNA, 15 bp, Homo sapiens
catttttcaatatat

SEQ ID NO: 6030603 - DNA, 17 bp, Homo sapiens
catttttcactgtacat

SEQ ID NO: 6030604 - DNA, 21 bp, Homo sapiens
catttttcagaccttttaact

SEQ ID NO: 6030605 - DNA, 18 bp, Homo sapiens
catttttcagagttttct

SEQ ID NO: 6030606 - DNA, 19 bp, Homo sapiens
catttttcagtagcaggac

SEQ ID NO: 6030607 - DNA, 16 bp, Homo sapiens
catttttcattcatga

SEQ ID NO: 6030608 - DNA, 17 bp, Homo sapiens
catttttcattttctct

SEQ ID NO: 6030609 - DNA, 12 bp, Homo sapiens
catttttccaaa

SEQ ID NO: 6030610 - DNA, 15 bp, Homo sapiens
catttttccaggact

SEQ ID NO: 6030611 - DNA, 16 bp, Homo sapiens
catttttccatgacat

SEQ ID NO: 6030612 - DNA, 20 bp, Homo sapiens
catttttcccaggcaaataa

SEQ ID NO: 6030613 - DNA, 19 bp, Homo sapiens
catttttccgtttgctttt

SEQ ID NO: 6030614 - DNA, 16 bp, Homo sapiens
catttttccttccctt

SEQ ID NO: 6030615 - DNA, 15 bp, Homo sapiens
catttttctataaat

SEQ ID NO: 6030616 - DNA, 12 bp, Homo sapiens
catttttctggc

SEQ ID NO: 6030617 - DNA, 13 bp, Homo sapiens
catttttctgtta

SEQ ID NO: 6030618 - DNA, 13 bp, Homo sapiens
catttttcttcca

SEQ ID NO: 6030619 - DNA, 14 bp, Homo sapiens
catttttcttggat

SEQ ID NO: 6030620 - DNA, 19 bp, Homo sapiens
catttttgaaactgcattt

SEQ ID NO: 6030621 - DNA, 11 bp, Homo sapiens
catttttgaat

SEQ ID NO: 6030622 - DNA, 20 bp, Homo sapiens
catttttgaatacaggcata

SEQ ID NO: 6030623 - DNA, 22 bp, Homo sapiens
catttttgagcagatcttggaa

SEQ ID NO: 6030624 - DNA, 19 bp, Homo sapiens
catttttgccaaaatacca

SEQ ID NO: 6030625 - DNA, 15 bp, Homo sapiens
catttttgctaatta

SEQ ID NO: 6030626 - DNA, 15 bp, Homo sapiens
catttttgctgaatt

SEQ ID NO: 6030627 - DNA, 14 bp, Homo sapiens
catttttgcttcct

SEQ ID NO: 6030628 - DNA, 19 bp, Homo sapiens
catttttggatttctgtga

SEQ ID NO: 6030629 - DNA, 23 bp, Homo sapiens
catttttggtaggcttatcaaaa

SEQ ID NO: 6030630 - DNA, 13 bp, Homo sapiens
catttttgtaact

SEQ ID NO: 6030631 - DNA, 13 bp, Homo sapiens
catttttgtaata

SEQ ID NO: 6030632 - DNA, 15 bp, Homo sapiens
catttttgtaataac

SEQ ID NO: 6030633 - DNA, 19 bp, Homo sapiens
catttttgtaataacattt

SEQ ID NO: 6030634 - DNA, 15 bp, Homo sapiens
catttttgtaatata

SEQ ID NO: 6030635 - DNA, 14 bp, Homo sapiens
catttttgtacagt

SEQ ID NO: 6030636 - DNA, 20 bp, Homo sapiens
catttttgtacagtttgctg

SEQ ID NO: 6030637 - DNA, 21 bp, Homo sapiens
catttttgtacagtttgctgt

SEQ ID NO: 6030638 - DNA, 15 bp, Homo sapiens
catttttgtacatta

SEQ ID NO: 6030639 - DNA, 20 bp, Homo sapiens
catttttgtacattatgtta

SEQ ID NO: 6030640 - DNA, 12 bp, Homo sapiens
catttttgtagg

SEQ ID NO: 6030641 - DNA, 14 bp, Homo sapiens
catttttgtataaa

SEQ ID NO: 6030642 - DNA, 13 bp, Homo sapiens
catttttgtattt

SEQ ID NO: 6030643 - DNA, 14 bp, Homo sapiens
catttttgtatttt

SEQ ID NO: 6030644 - DNA, 15 bp, Homo sapiens
catttttgtgcacag

SEQ ID NO: 6030645 - DNA, 22 bp, Homo sapiens
catttttgtgggggctagaaaa

SEQ ID NO: 6030646 - DNA, 19 bp, Homo sapiens
catttttgtggttttgaga

SEQ ID NO: 6030647 - DNA, 21 bp, Homo sapiens
catttttgtggttttgagaaa

SEQ ID NO: 6030648 - DNA, 14 bp, Homo sapiens
catttttgtttatt

SEQ ID NO: 6030649 - DNA, 23 bp, Homo sapiens
catttttgtttctacctcccaga

SEQ ID NO: 6030650 - DNA, 14 bp, Homo sapiens
catttttgttttga

SEQ ID NO: 6030651 - DNA, 16 bp, Homo sapiens
catttttgttttgaaa

SEQ ID NO: 6030652 - DNA, 18 bp, Homo sapiens
cattttttaaaaaagcaa

SEQ ID NO: 6030653 - DNA, 20 bp, Homo sapiens
cattttttaaaaaagcaagg

SEQ ID NO: 6030654 - DNA, 14 bp, Homo sapiens
cattttttaaaaca

SEQ ID NO: 6030655 - DNA, 15 bp, Homo sapiens
cattttttaaatgca

SEQ ID NO: 6030656 - DNA, 16 bp, Homo sapiens
cattttttaaatgcac

SEQ ID NO: 6030657 - DNA, 19 bp, Homo sapiens
cattttttaaatgcacctg

SEQ ID NO: 6030658 - DNA, 13 bp, Homo sapiens
cattttttaagaa

SEQ ID NO: 6030659 - DNA, 15 bp, Homo sapiens
cattttttaagagac

SEQ ID NO: 6030660 - DNA, 13 bp, Homo sapiens
cattttttaagct

SEQ ID NO: 6030661 - DNA, 23 bp, Homo sapiens
cattttttaatttacttgttttg

SEQ ID NO: 6030662 - DNA, 17 bp, Homo sapiens
cattttttacttgaatc

SEQ ID NO: 6030663 - DNA, 23 bp, Homo sapiens
cattttttagtctgtaatacact

SEQ ID NO: 6030664 - DNA, 21 bp, Homo sapiens
cattttttataattttctaag

SEQ ID NO: 6030665 - DNA, 21 bp, Homo sapiens
cattttttatgggcattgaca

SEQ ID NO: 6030666 - DNA, 13 bp, Homo sapiens
cattttttcagtc

SEQ ID NO: 6030667 - DNA, 16 bp, Homo sapiens
cattttttcctgtttg

SEQ ID NO: 6030668 - DNA, 13 bp, Homo sapiens
cattttttctaat

SEQ ID NO: 6030669 - DNA, 14 bp, Homo sapiens
cattttttcttccc

SEQ ID NO: 6030670 - DNA, 23 bp, Homo sapiens
cattttttgtattttaactactt

SEQ ID NO: 6030671 - DNA, 20 bp, Homo sapiens
catttttttaatttattatt

SEQ ID NO: 6030672 - DNA, 20 bp, Homo sapiens
catttttttcactcagaatt

SEQ ID NO: 6030673 - DNA, 12 bp, Homo sapiens
catttttttcct

SEQ ID NO: 6030674 - DNA, 18 bp, Homo sapiens
catttttttcctttatgt

SEQ ID NO: 6030675 - DNA, 16 bp, Homo sapiens
catttttttctaccta

SEQ ID NO: 6030676 - DNA, 18 bp, Homo sapiens
catttttttctctctgga

SEQ ID NO: 6030677 - DNA, 21 bp, Homo sapiens
catttttttctctctggagcc

SEQ ID NO: 6030678 - DNA, 14 bp, Homo sapiens
catttttttgcatg

SEQ ID NO: 6030679 - DNA, 22 bp, Homo sapiens
cattttttttctttgaataaat

SEQ ID NO: 6030680 - DNA, 17 bp, Homo sapiens
cattttttttgtggtta

SEQ ID NO: 6030681 - DNA, 15 bp, Homo sapiens
catttttttttcaat

SEQ ID NO: 6030682 - DNA, 21 bp, Homo sapiens
catttttttttcaatcaactt

SEQ ID NO: 6030683 - DNA, 22 bp, Homo sapiens
catttttttttcaatcaacttt

SEQ ID NO: 6030684 - DNA, 14 bp, Homo sapiens
cattttttttttca

SEQ ID NO: 6030685 - DNA, 21 bp, Homo sapiens
catttttttttttgtttctga

SEQ ID NO: 6030686 - DNA, 21 bp, Homo sapiens
cattttttttttttaaaggaa

SEQ ID NO: 6030687 - DNA, 17 bp, Homo sapiens
cattttttttttttgag

SEQ ID NO: 6030688 - DNA, 16 bp, Homo sapiens
ccaaaaaaaaaaaagg

SEQ ID NO: 6030689 - DNA, 14 bp, Homo sapiens
ccaaaaaaaaaaga

SEQ ID NO: 6030690 - DNA, 15 bp, Homo sapiens
ccaaaaaaaggaaaa

SEQ ID NO: 6030691 - DNA, 17 bp, Homo sapiens
ccaaaaaaatccagaaa

SEQ ID NO: 6030692 - DNA, 10 bp, Homo sapiens
ccaaaaaagc

SEQ ID NO: 6030693 - DNA, 20 bp, Homo sapiens
ccaaaaaagctgtattttga

SEQ ID NO: 6030694 - DNA, 15 bp, Homo sapiens
ccaaaaaaggctgcc

SEQ ID NO: 6030695 - DNA, 12 bp, Homo sapiens
ccaaaaaatatc

SEQ ID NO: 6030696 - DNA, 23 bp, Homo sapiens
ccaaaaaatatctagtaatatat

SEQ ID NO: 6030697 - DNA, 11 bp, Homo sapiens
ccaaaaacatt

SEQ ID NO: 6030698 - DNA, 16 bp, Homo sapiens
ccaaaaaccagtattg

SEQ ID NO: 6030699 - DNA, 19 bp, Homo sapiens
ccaaaaaccagtattgtac

SEQ ID NO: 6030700 - DNA, 23 bp, Homo sapiens
ccaaaaagaatctgcatttagca

SEQ ID NO: 6030701 - DNA, 16 bp, Homo sapiens
ccaaaaagacaagtgc

SEQ ID NO: 6030702 - DNA, 19 bp, Homo sapiens
ccaaaaagagacccacaat

SEQ ID NO: 6030703 - DNA, 15 bp, Homo sapiens
ccaaaaagagactga

SEQ ID NO: 6030704 - DNA, 23 bp, Homo sapiens
ccaaaaagctctgaaaacaaggt

SEQ ID NO: 6030705 - DNA, 14 bp, Homo sapiens
ccaaaaaggcaaat

SEQ ID NO: 6030706 - DNA, 13 bp, Homo sapiens
ccaaaaatagaaa

SEQ ID NO: 6030707 - DNA, 15 bp, Homo sapiens
ccaaaaatagtcaaa

SEQ ID NO: 6030708 - DNA, 17 bp, Homo sapiens
ccaaaaatatctcctcc

SEQ ID NO: 6030709 - DNA, 18 bp, Homo sapiens
ccaaaaatatctcctcca

SEQ ID NO: 6030710 - DNA, 14 bp, Homo sapiens
ccaaaaattattat

SEQ ID NO: 6030711 - DNA, 18 bp, Homo sapiens
ccaaaacaaacaaacaga

SEQ ID NO: 6030712 - DNA, 19 bp, Homo sapiens
cagtattatttagtaaaat

SEQ ID NO: 6030713 - DNA, 22 bp, Homo sapiens
cagtattatttagtaaaattat

SEQ ID NO: 6030714 - DNA, 20 bp, Homo sapiens
cagtattatttctccatccc

SEQ ID NO: 6030715 - DNA, 15 bp, Homo sapiens
cagtattatttgtat

SEQ ID NO: 6030716 - DNA, 21 bp, Homo sapiens
cagtattatttgtatgtatta

SEQ ID NO: 6030717 - DNA, 15 bp, Homo sapiens
cagtattctaggtag

SEQ ID NO: 6030718 - DNA, 20 bp, Homo sapiens
cagtattctcagagcatgtg

SEQ ID NO: 6030719 - DNA, 17 bp, Homo sapiens
cagtattctcagtgctc

SEQ ID NO: 6030720 - DNA, 16 bp, Homo sapiens
cagtattctgacatgt

SEQ ID NO: 6030721 - DNA, 11 bp, Homo sapiens
cagtattctgt

SEQ ID NO: 6030722 - DNA, 22 bp, Homo sapiens
cagtattgaaaacttcaaagct

SEQ ID NO: 6030723 - DNA, 23 bp, Homo sapiens
cagtattgaaaacttcaaagctg

SEQ ID NO: 6030724 - DNA, 15 bp, Homo sapiens
cagtattgaagcatt

SEQ ID NO: 6030725 - DNA, 12 bp, Homo sapiens
cagtattgacac

SEQ ID NO: 6030726 - DNA, 14 bp, Homo sapiens
cagtattgacactg

SEQ ID NO: 6030727 - DNA, 13 bp, Homo sapiens
cagtattgccaca

SEQ ID NO: 6030728 - DNA, 20 bp, Homo sapiens
cagtattgccacaatgcctc

SEQ ID NO: 6030729 - DNA, 21 bp, Homo sapiens
cagtattgccacaatgcctct

SEQ ID NO: 6030730 - DNA, 15 bp, Homo sapiens
cagtattgctattta

SEQ ID NO: 6030731 - DNA, 15 bp, Homo sapiens
cagtattgctcaccc

SEQ ID NO: 6030732 - DNA, 16 bp, Homo sapiens
cagtattgctgatttt

SEQ ID NO: 6030733 - DNA, 23 bp, Homo sapiens
cagtattgctgattttaaaggca

SEQ ID NO: 6030734 - DNA, 18 bp, Homo sapiens
cagtattgggcaggagga

SEQ ID NO: 6030735 - DNA, 17 bp, Homo sapiens
cagtattgtacaaagta

SEQ ID NO: 6030736 - DNA, 18 bp, Homo sapiens
cagtattgtacaaagtat

SEQ ID NO: 6030737 - DNA, 14 bp, Homo sapiens
cagtattgtagaaa

SEQ ID NO: 6030738 - DNA, 22 bp, Homo sapiens
cagtattgttcttgtaaaactg

SEQ ID NO: 6030739 - DNA, 17 bp, Homo sapiens
cagtatttaactaatta

SEQ ID NO: 6030740 - DNA, 16 bp, Homo sapiens
cagtatttaacttctg

SEQ ID NO: 6030741 - DNA, 16 bp, Homo sapiens
cagtatttaagcttta

SEQ ID NO: 6030742 - DNA, 21 bp, Homo sapiens
cagtatttaagctttaaatga

SEQ ID NO: 6030743 - DNA, 19 bp, Homo sapiens
cagtatttacaagctattt

SEQ ID NO: 6030744 - DNA, 15 bp, Homo sapiens
cagtatttacagtat

SEQ ID NO: 6030745 - DNA, 19 bp, Homo sapiens
cagtatttaccttcctttg

SEQ ID NO: 6030746 - DNA, 22 bp, Homo sapiens
cagtatttaccttcctttgtct

SEQ ID NO: 6030747 - DNA, 16 bp, Homo sapiens
cagtatttagaagcca

SEQ ID NO: 6030748 - DNA, 21 bp, Homo sapiens
cagtatttattggtgggttga

SEQ ID NO: 6030749 - DNA, 17 bp, Homo sapiens
cagtatttattttgtaa

SEQ ID NO: 6030750 - DNA, 15 bp, Homo sapiens
cagtatttcaactgc

SEQ ID NO: 6030751 - DNA, 23 bp, Homo sapiens
cagtatttcaactgctgtaaaat

SEQ ID NO: 6030752 - DNA, 11 bp, Homo sapiens
cagtatttcag

SEQ ID NO: 6030753 - DNA, 15 bp, Homo sapiens
cagtatttcagactg

SEQ ID NO: 6030754 - DNA, 19 bp, Homo sapiens
cagtatttcattgcctgtg

SEQ ID NO: 6030755 - DNA, 16 bp, Homo sapiens
cagtatttccacttgt

SEQ ID NO: 6030756 - DNA, 12 bp, Homo sapiens
cagtatttcctt

SEQ ID NO: 6030757 - DNA, 18 bp, Homo sapiens
cagtatttccttccactg

SEQ ID NO: 6030758 - DNA, 23 bp, Homo sapiens
cagtatttctacattacagccat

SEQ ID NO: 6030759 - DNA, 20 bp, Homo sapiens
cagtatttctttgttataca

SEQ ID NO: 6030760 - DNA, 15 bp, Homo sapiens
cagtatttgtaatta

SEQ ID NO: 6030761 - DNA, 15 bp, Homo sapiens
cagtattttagtgga

SEQ ID NO: 6030762 - DNA, 14 bp, Homo sapiens
cagtattttcacac

SEQ ID NO: 6030763 - DNA, 17 bp, Homo sapiens
cagtattttctccactt

SEQ ID NO: 6030764 - DNA, 14 bp, Homo sapiens
cagtattttggaga

SEQ ID NO: 6030765 - DNA, 20 bp, Homo sapiens
cagtattttggagaaattat

SEQ ID NO: 6030766 - DNA, 21 bp, Homo sapiens
cagtattttggagaaattatt

SEQ ID NO: 6030767 - DNA, 18 bp, Homo sapiens
cagtattttgtgtcctcc

SEQ ID NO: 6030768 - DNA, 18 bp, Homo sapiens
cagtatttttaaaggcat

SEQ ID NO: 6030769 - DNA, 13 bp, Homo sapiens
cagtatttttgcc

SEQ ID NO: 6030770 - DNA, 18 bp, Homo sapiens
cagtatttttttttaatt

SEQ ID NO: 6030771 - DNA, 22 bp, Homo sapiens
cagtatttttttttaattttga

SEQ ID NO: 6030772 - DNA, 24 bp, Homo sapiens
cagtcaaaaccaagtcacttaggt

SEQ ID NO: 6030773 - DNA, 16 bp, Homo sapiens
cagtcaaatctgggct

SEQ ID NO: 6030774 - DNA, 17 bp, Homo sapiens
cagtcaaatttacattt

SEQ ID NO: 6030775 - DNA, 19 bp, Homo sapiens
cagtcaaatttacatttat

SEQ ID NO: 6030776 - DNA, 20 bp, Homo sapiens
cagtcaacagagaggggcag

SEQ ID NO: 6030777 - DNA, 15 bp, Homo sapiens
cagtcaacagattca

SEQ ID NO: 6030778 - DNA, 23 bp, Homo sapiens
cagtcaacagttcaaagaagtca

SEQ ID NO: 6030779 - DNA, 15 bp, Homo sapiens
cagtcaacatttaca

SEQ ID NO: 6030780 - DNA, 15 bp, Homo sapiens
cagtcaacctgggca

SEQ ID NO: 6030781 - DNA, 16 bp, Homo sapiens
cagtcaacggggggct

SEQ ID NO: 6030782 - DNA, 20 bp, Homo sapiens
cagtcaacggggggctcctg

SEQ ID NO: 6030783 - DNA, 21 bp, Homo sapiens
cagtcaacggggggctcctgc

SEQ ID NO: 6030784 - DNA, 15 bp, Homo sapiens
cagtcaagatacata

SEQ ID NO: 6030785 - DNA, 16 bp, Homo sapiens
cagtcaagctgttgaa

SEQ ID NO: 6030786 - DNA, 15 bp, Homo sapiens
cagtcaaggagtggc

SEQ ID NO: 6030787 - DNA, 18 bp, Homo sapiens
cagtcaagtgaggtgaca

SEQ ID NO: 6030788 - DNA, 22 bp, Homo sapiens
cagtcaagttccctcctgcagc

SEQ ID NO: 6030789 - DNA, 14 bp, Homo sapiens
cagtcaattaacaa

SEQ ID NO: 6030790 - DNA, 15 bp, Homo sapiens
cagtcaattttacaa

SEQ ID NO: 6030791 - DNA, 16 bp, Homo sapiens
cagtcacaaatttctc

SEQ ID NO: 6030792 - DNA, 14 bp, Homo sapiens
cagtcacactcccc

SEQ ID NO: 6030793 - DNA, 16 bp, Homo sapiens
cagtcacactgctggg

SEQ ID NO: 6030794 - DNA, 20 bp, Homo sapiens
cagtcacactgctgggaagt

SEQ ID NO: 6030795 - DNA, 21 bp, Homo sapiens
cagtcacactgttactccaca

SEQ ID NO: 6030796 - DNA, 12 bp, Homo sapiens
cagtcacagcca

SEQ ID NO: 6030797 - DNA, 13 bp, Homo sapiens
cagtcacagccac

SEQ ID NO: 6030798 - DNA, 16 bp, Homo sapiens
cagtcacaggcccagg

SEQ ID NO: 6030799 - DNA, 15 bp, Homo sapiens
cagtcacatcacaat

SEQ ID NO: 6030800 - DNA, 15 bp, Homo sapiens
cagtcacatgtgctc

SEQ ID NO: 6030801 - DNA, 12 bp, Homo sapiens
cagtcacattga

SEQ ID NO: 6030802 - DNA, 13 bp, Homo sapiens
cagtcaccaccca

SEQ ID NO: 6030803 - DNA, 15 bp, Homo sapiens
cagtcaccacccagc

SEQ ID NO: 6030804 - DNA, 18 bp, Homo sapiens
cagtcaccacccagccct

SEQ ID NO: 6030805 - DNA, 21 bp, Homo sapiens
cagtcaccacccagcccttcc

SEQ ID NO: 6030806 - DNA, 12 bp, Homo sapiens
cagtcaccccag

SEQ ID NO: 6030807 - DNA, 14 bp, Homo sapiens
cagtcaccccggcc

SEQ ID NO: 6030808 - DNA, 22 bp, Homo sapiens
cagtcaccccggccacctgcgg

SEQ ID NO: 6030809 - DNA, 23 bp, Homo sapiens
cagtcacccctccctccctcttt

SEQ ID NO: 6030810 - DNA, 15 bp, Homo sapiens
cagtcacccctgtct

SEQ ID NO: 6030811 - DNA, 17 bp, Homo sapiens
cagtcacccctgtctgc

SEQ ID NO: 6030812 - DNA, 18 bp, Homo sapiens
cagtcacccctgtctgcg

SEQ ID NO: 6030813 - DNA, 23 bp, Homo sapiens
cagtcacctaagcaatcactggg

SEQ ID NO: 6030814 - DNA, 15 bp, Homo sapiens
cagtcacctcatgga

SEQ ID NO: 6030815 - DNA, 14 bp, Homo sapiens
cagtcacctcccca

SEQ ID NO: 6030816 - DNA, 14 bp, Homo sapiens
cagtcacctcctgc

SEQ ID NO: 6030817 - DNA, 19 bp, Homo sapiens
cagtcacctcctgctcctt

SEQ ID NO: 6030818 - DNA, 13 bp, Homo sapiens
cagtcacctcttc

SEQ ID NO: 6030819 - DNA, 17 bp, Homo sapiens
cagtcacctcttctacc

SEQ ID NO: 6030820 - DNA, 15 bp, Homo sapiens
cagtcacgcctgaaa

SEQ ID NO: 6030821 - DNA, 16 bp, Homo sapiens
cagtcacgtgaggccc

SEQ ID NO: 6030822 - DNA, 23 bp, Homo sapiens
cagtcacgtggaggagcagtgca

SEQ ID NO: 6030823 - DNA, 15 bp, Homo sapiens
cagtcactaggaatt

SEQ ID NO: 6030824 - DNA, 22 bp, Homo sapiens
cagtcactcagccatttctaag

SEQ ID NO: 6030825 - DNA, 14 bp, Homo sapiens
cagtcactcctctc

SEQ ID NO: 6030826 - DNA, 15 bp, Homo sapiens
cagtcactctagtca

SEQ ID NO: 6030827 - DNA, 21 bp, Homo sapiens
cagtcactctagtcaatgaca

SEQ ID NO: 6030828 - DNA, 22 bp, Homo sapiens
cagtcactgccactttgcacat

SEQ ID NO: 6030829 - DNA, 20 bp, Homo sapiens
cagtcactgctgcaaggtgg

SEQ ID NO: 6030830 - DNA, 21 bp, Homo sapiens
cagtcactggcccaaccagaa

SEQ ID NO: 6030831 - DNA, 12 bp, Homo sapiens
cagtcactgtga

SEQ ID NO: 6030832 - DNA, 13 bp, Homo sapiens
cagtcactgtgat

SEQ ID NO: 6030833 - DNA, 13 bp, Homo sapiens
cagtcactttgac

SEQ ID NO: 6030834 - DNA, 15 bp, Homo sapiens
cagtcagaagatctt

SEQ ID NO: 6030835 - DNA, 18 bp, Homo sapiens
cagtcagaaggacggcag

SEQ ID NO: 6030836 - DNA, 15 bp, Homo sapiens
cagtcagagtccagt

SEQ ID NO: 6030837 - DNA, 18 bp, Homo sapiens
cagtcagagtccagtgct

SEQ ID NO: 6030838 - DNA, 23 bp, Homo sapiens
cagtcagatttccagtctccacc

SEQ ID NO: 6030839 - DNA, 16 bp, Homo sapiens
cagtcagcacagagag

SEQ ID NO: 6030840 - DNA, 13 bp, Homo sapiens
cagtcagcatgct

SEQ ID NO: 6030841 - DNA, 21 bp, Homo sapiens
cagtcagcctctctcccagtc

SEQ ID NO: 6030842 - DNA, 13 bp, Homo sapiens
cagtcagcctggc

SEQ ID NO: 6030843 - DNA, 20 bp, Homo sapiens
cagtcagcctggctgggctc

SEQ ID NO: 6030844 - DNA, 15 bp, Homo sapiens
cagtcagcggagagg

SEQ ID NO: 6030845 - DNA, 18 bp, Homo sapiens
cagtcagcggagaggacc

SEQ ID NO: 6030846 - DNA, 15 bp, Homo sapiens
cagtcagctcttcat

SEQ ID NO: 6030847 - DNA, 14 bp, Homo sapiens
cagtcagctgtggg

SEQ ID NO: 6030848 - DNA, 12 bp, Homo sapiens
cagtcaggaagc

SEQ ID NO: 6030849 - DNA, 22 bp, Homo sapiens
cagtcagggacagcagcctccc

SEQ ID NO: 6030850 - DNA, 13 bp, Homo sapiens
cagtcagggccca

SEQ ID NO: 6030851 - DNA, 14 bp, Homo sapiens
cagtcagggcccag

SEQ ID NO: 6030852 - DNA, 15 bp, Homo sapiens
cagtcagggcccaga

SEQ ID NO: 6030853 - DNA, 14 bp, Homo sapiens
cagtcagggccccc

SEQ ID NO: 6030854 - DNA, 17 bp, Homo sapiens
cagtcaggggcagctga

SEQ ID NO: 6030855 - DNA, 13 bp, Homo sapiens
cagtcaggggctg

SEQ ID NO: 6030856 - DNA, 24 bp, Homo sapiens
cagtcagggtttgtcagaggaaca

SEQ ID NO: 6030857 - DNA, 19 bp, Homo sapiens
cagtcaggtgggcggtgtg

SEQ ID NO: 6030858 - DNA, 17 bp, Homo sapiens
cagtcagtcacaaacca

SEQ ID NO: 6030859 - DNA, 22 bp, Homo sapiens
cagtcagtgctggagaaatctt

SEQ ID NO: 6030860 - DNA, 16 bp, Homo sapiens
cagtcagtggagcctg

SEQ ID NO: 6030861 - DNA, 18 bp, Homo sapiens
cagtcagtgtttctttta

SEQ ID NO: 6030862 - DNA, 22 bp, Homo sapiens
cagtcagttcccggagcacagc

SEQ ID NO: 6030863 - DNA, 23 bp, Homo sapiens
cagtcagttcccggagcacagcc

SEQ ID NO: 6030864 - DNA, 15 bp, Homo sapiens
cagtcataaagaggt

SEQ ID NO: 6030865 - DNA, 14 bp, Homo sapiens
cagtcatacctgct

SEQ ID NO: 6030866 - DNA, 20 bp, Homo sapiens
cagtcatagggctgataata

SEQ ID NO: 6030867 - DNA, 16 bp, Homo sapiens
cagtcatcaacaatga

SEQ ID NO: 6030868 - DNA, 16 bp, Homo sapiens
cagtcatcatcagggc

SEQ ID NO: 6030869 - DNA, 22 bp, Homo sapiens
cagtcatcatcagggcctgggg

SEQ ID NO: 6030870 - DNA, 16 bp, Homo sapiens
cagtcatcatctcttg

SEQ ID NO: 6030871 - DNA, 15 bp, Homo sapiens
cagtcatcatttatc

SEQ ID NO: 6030872 - DNA, 18 bp, Homo sapiens
cagtcatcctgccctgca

SEQ ID NO: 6030873 - DNA, 20 bp, Homo sapiens
cagtcatcctgccctgcagc

SEQ ID NO: 6030874 - DNA, 15 bp, Homo sapiens
cagtcatctcccctc

SEQ ID NO: 6030875 - DNA, 19 bp, Homo sapiens
cagtcatctcccctcctgg

SEQ ID NO: 6030876 - DNA, 19 bp, Homo sapiens
cagtcatgagaattacaga

SEQ ID NO: 6030877 - DNA, 14 bp, Homo sapiens
cagtcatgcataaa

SEQ ID NO: 6030878 - DNA, 18 bp, Homo sapiens
cagtcatgcataaatatg

SEQ ID NO: 6030879 - DNA, 20 bp, Homo sapiens
cagtcatgcataaatatgca

SEQ ID NO: 6030880 - DNA, 23 bp, Homo sapiens
cagtcatgcataaatatgcagtg

SEQ ID NO: 6030881 - DNA, 22 bp, Homo sapiens
cagtcatggagaaccacctacc

SEQ ID NO: 6030882 - DNA, 20 bp, Homo sapiens
cagtcatggctgtcccctgc

SEQ ID NO: 6030883 - DNA, 13 bp, Homo sapiens
cagtcatggtact

SEQ ID NO: 6030884 - DNA, 22 bp, Homo sapiens
cagtcatgttttaaatgtacag

SEQ ID NO: 6030885 - DNA, 18 bp, Homo sapiens
cagtcattagactcctcc

SEQ ID NO: 6030886 - DNA, 22 bp, Homo sapiens
cagtcattagactcctcctcca

SEQ ID NO: 6030887 - DNA, 19 bp, Homo sapiens
cagtcattatgttaatatt

SEQ ID NO: 6030888 - DNA, 17 bp, Homo sapiens
cagtcattcagatatga

SEQ ID NO: 6030889 - DNA, 13 bp, Homo sapiens
cagtcatttgtgg

SEQ ID NO: 6030890 - DNA, 20 bp, Homo sapiens
cagtcatttttcagaccttt

SEQ ID NO: 6030891 - DNA, 19 bp, Homo sapiens
ccaaaacaagccaaagagc

SEQ ID NO: 6030892 - DNA, 13 bp, Homo sapiens
ccaaaacacagga

SEQ ID NO: 6030893 - DNA, 17 bp, Homo sapiens
ccaaaacacttaggaag

SEQ ID NO: 6030894 - DNA, 16 bp, Homo sapiens
ccaaaacagcatagta

SEQ ID NO: 6030895 - DNA, 13 bp, Homo sapiens
ccaaaacagcttt

SEQ ID NO: 6030896 - DNA, 17 bp, Homo sapiens
ccaaaacagctttgtct

SEQ ID NO: 6030897 - DNA, 17 bp, Homo sapiens
ccaaaacataaaaacca

SEQ ID NO: 6030898 - DNA, 19 bp, Homo sapiens
ccaaaacataaaaaccaaa

SEQ ID NO: 6030899 - DNA, 22 bp, Homo sapiens
ccaaaacatccacttaagttct

SEQ ID NO: 6030900 - DNA, 21 bp, Homo sapiens
ccaaaacatcgtctaaacttt

SEQ ID NO: 6030901 - DNA, 18 bp, Homo sapiens
ccaaaaccacatgggctg

SEQ ID NO: 6030902 - DNA, 19 bp, Homo sapiens
ccaaaaccacatgggctgg

SEQ ID NO: 6030903 - DNA, 20 bp, Homo sapiens
ccaaaaccacatgggctggg

SEQ ID NO: 6030904 - DNA, 22 bp, Homo sapiens
ccaaaaccacatgggctggggg

SEQ ID NO: 6030905 - DNA, 15 bp, Homo sapiens
ccaaaaccagagggc

SEQ ID NO: 6030906 - DNA, 16 bp, Homo sapiens
ccaaaacccagggcaa

SEQ ID NO: 6030907 - DNA, 17 bp, Homo sapiens
ccaaaaccctgaagcca

SEQ ID NO: 6030908 - DNA, 15 bp, Homo sapiens
ccaaaaccgccagct

SEQ ID NO: 6030909 - DNA, 17 bp, Homo sapiens
ccaaaaccgccagctct

SEQ ID NO: 6030910 - DNA, 23 bp, Homo sapiens
ccaaaacctcatgacagccagag

SEQ ID NO: 6030911 - DNA, 15 bp, Homo sapiens
ccaaaacctgcttcc

SEQ ID NO: 6030912 - DNA, 16 bp, Homo sapiens
ccaaaacctttcccca

SEQ ID NO: 6030913 - DNA, 14 bp, Homo sapiens
ccaaaactcctgcc

SEQ ID NO: 6030914 - DNA, 17 bp, Homo sapiens
ccaaaactgtattgaaa

SEQ ID NO: 6030915 - DNA, 17 bp, Homo sapiens
ccaaaacttagacccat

SEQ ID NO: 6030916 - DNA, 20 bp, Homo sapiens
ccaaaacttagacccatgct

SEQ ID NO: 6030917 - DNA, 11 bp, Homo sapiens
ccaaaagaaaa

SEQ ID NO: 6030918 - DNA, 18 bp, Homo sapiens
ccaaaagaaaccatgaca

SEQ ID NO: 6030919 - DNA, 19 bp, Homo sapiens
ccaaaagaatgagtgcctt

SEQ ID NO: 6030920 - DNA, 12 bp, Homo sapiens
ccaaaagacatt

SEQ ID NO: 6030921 - DNA, 15 bp, Homo sapiens
ccaaaagatgccttg

SEQ ID NO: 6030922 - DNA, 19 bp, Homo sapiens
ccaaaagattgctgaaatt

SEQ ID NO: 6030923 - DNA, 22 bp, Homo sapiens
ccaaaagattgctgaaatttta

SEQ ID NO: 6030924 - DNA, 14 bp, Homo sapiens
ccaaaagcacttac

SEQ ID NO: 6030925 - DNA, 13 bp, Homo sapiens
ccaaaagcaggaa

SEQ ID NO: 6030926 - DNA, 15 bp, Homo sapiens
ccaaaagcagtaaat

SEQ ID NO: 6030927 - DNA, 20 bp, Homo sapiens
ccaaaagccaatggctgcag

SEQ ID NO: 6030928 - DNA, 16 bp, Homo sapiens
ccaaaagccagtcaag

SEQ ID NO: 6030929 - DNA, 22 bp, Homo sapiens
ccaaaagcgccctcactattct

SEQ ID NO: 6030930 - DNA, 22 bp, Homo sapiens
ccaaaagctagaggagattgct

SEQ ID NO: 6030931 - DNA, 13 bp, Homo sapiens
ccaaaaggccgtg

SEQ ID NO: 6030932 - DNA, 19 bp, Homo sapiens
ccaaaagggaaaaaataaa

SEQ ID NO: 6030933 - DNA, 16 bp, Homo sapiens
ccaaaagggcagccag

SEQ ID NO: 6030934 - DNA, 19 bp, Homo sapiens
ccaaaagggcagccagggg

SEQ ID NO: 6030935 - DNA, 22 bp, Homo sapiens
ccaaaagggcagccaggggctg

SEQ ID NO: 6030936 - DNA, 19 bp, Homo sapiens
ccaaaaggtttaagaaata

SEQ ID NO: 6030937 - DNA, 18 bp, Homo sapiens
ccaaaagtaaagatgcta

SEQ ID NO: 6030938 - DNA, 15 bp, Homo sapiens
ccaaaagtactagca

SEQ ID NO: 6030939 - DNA, 21 bp, Homo sapiens
ccaaaagtcaaaaggtgcctg

SEQ ID NO: 6030940 - DNA, 22 bp, Homo sapiens
ccaaaagtcaaaaggtgcctgt

SEQ ID NO: 6030941 - DNA, 22 bp, Homo sapiens
ccaaaagtccctccctgcctga

SEQ ID NO: 6030942 - DNA, 18 bp, Homo sapiens
ccaaaagtggcctctttg

SEQ ID NO: 6030943 - DNA, 21 bp, Homo sapiens
ccaaaagtggcctctttgtct

SEQ ID NO: 6030944 - DNA, 21 bp, Homo sapiens
ccaaaagtgtcaaggggccct

SEQ ID NO: 6030945 - DNA, 24 bp, Homo sapiens
ccaaaagtgtcaaggggccctagg

SEQ ID NO: 6030946 - DNA, 19 bp, Homo sapiens
ccaaaataaaaaccttcca

SEQ ID NO: 6030947 - DNA, 20 bp, Homo sapiens
ccaaaataaaacctcagcta

SEQ ID NO: 6030948 - DNA, 18 bp, Homo sapiens
ccaaaataaaacttttta

SEQ ID NO: 6030949 - DNA, 23 bp, Homo sapiens
ccaaaataaataaggaaaagctt

SEQ ID NO: 6030950 - DNA, 22 bp, Homo sapiens
ccaaaataatgtcttgttaata

SEQ ID NO: 6030951 - DNA, 14 bp, Homo sapiens
ccaaaatactccaa

SEQ ID NO: 6030952 - DNA, 18 bp, Homo sapiens
ccaaaatactccaaagat

SEQ ID NO: 6030953 - DNA, 19 bp, Homo sapiens
ccaaaatactccaaagatg

SEQ ID NO: 6030954 - DNA, 21 bp, Homo sapiens
ccaaaatactccaaagatgac

SEQ ID NO: 6030955 - DNA, 15 bp, Homo sapiens
ccaaaataggtgctg

SEQ ID NO: 6030956 - DNA, 11 bp, Homo sapiens
ccaaaatatat

SEQ ID NO: 6030957 - DNA, 12 bp, Homo sapiens
ccaaaatattaa

SEQ ID NO: 6030958 - DNA, 14 bp, Homo sapiens
ccaaaatcaagagt

SEQ ID NO: 6030959 - DNA, 14 bp, Homo sapiens
ccaaaatcagcttt

SEQ ID NO: 6030960 - DNA, 14 bp, Homo sapiens
ccaaaatcccctca

SEQ ID NO: 6030961 - DNA, 15 bp, Homo sapiens
ccaaaatcccctcag

SEQ ID NO: 6030962 - DNA, 18 bp, Homo sapiens
ccaaaatctaaaagctgt

SEQ ID NO: 6030963 - DNA, 17 bp, Homo sapiens
ccaaaatgaagacacgc

SEQ ID NO: 6030964 - DNA, 19 bp, Homo sapiens
ccaaaatgacatcttttta

SEQ ID NO: 6030965 - DNA, 23 bp, Homo sapiens
ccaaaatgtaggcttagtttgtg

SEQ ID NO: 6030966 - DNA, 15 bp, Homo sapiens
ccaaaatgtgcctat

SEQ ID NO: 6030967 - DNA, 17 bp, Homo sapiens
ccaaaatgttgctgaaa

SEQ ID NO: 6030968 - DNA, 15 bp, Homo sapiens
ccaaaattaaggtgt

SEQ ID NO: 6030969 - DNA, 16 bp, Homo sapiens
ccaaaattatttcaga

SEQ ID NO: 6030970 - DNA, 16 bp, Homo sapiens
ccaaaattccatccct

SEQ ID NO: 6030971 - DNA, 20 bp, Homo sapiens
ccaaaattgttttgagcttt

SEQ ID NO: 6030972 - DNA, 17 bp, Homo sapiens
ccaaaatttatatttta

SEQ ID NO: 6030973 - DNA, 21 bp, Homo sapiens
ccaaaatttattttataagaa

SEQ ID NO: 6030974 - DNA, 22 bp, Homo sapiens
ccaaaatttattttataagaaa

SEQ ID NO: 6030975 - DNA, 15 bp, Homo sapiens
ccaaaattttaaaaa

SEQ ID NO: 6030976 - DNA, 17 bp, Homo sapiens
ccaaacaaaaagcagga

SEQ ID NO: 6030977 - DNA, 16 bp, Homo sapiens
ccaaacaatgcagatc

SEQ ID NO: 6030978 - DNA, 15 bp, Homo sapiens
ccaaacacactgtaa

SEQ ID NO: 6030979 - DNA, 17 bp, Homo sapiens
ccaaacacactgtaaat

SEQ ID NO: 6030980 - DNA, 18 bp, Homo sapiens
ccaaacacactgtaaata

SEQ ID NO: 6030981 - DNA, 14 bp, Homo sapiens
ccaaacaccacttt

SEQ ID NO: 6030982 - DNA, 18 bp, Homo sapiens
ccaaacaccactttgtaa

SEQ ID NO: 6030983 - DNA, 18 bp, Homo sapiens
ccaaacaccatgaatctt

SEQ ID NO: 6030984 - DNA, 12 bp, Homo sapiens
ccaaacacccag

SEQ ID NO: 6030985 - DNA, 17 bp, Homo sapiens
ccaaacaccttcagtgc

SEQ ID NO: 6030986 - DNA, 19 bp, Homo sapiens
ccaaacaccttccagctcc

SEQ ID NO: 6030987 - DNA, 20 bp, Homo sapiens
ccaaacactttacagttctg

SEQ ID NO: 6030988 - DNA, 18 bp, Homo sapiens
ccaaacagacaagcaggc

SEQ ID NO: 6030989 - DNA, 15 bp, Homo sapiens
ccaaacagacaggtg

SEQ ID NO: 6030990 - DNA, 18 bp, Homo sapiens
ccaaacagcaagaagctg

SEQ ID NO: 6030991 - DNA, 16 bp, Homo sapiens
ccaaacagctgcctct

SEQ ID NO: 6030992 - DNA, 16 bp, Homo sapiens
ccaaacaggccctcct

SEQ ID NO: 6030993 - DNA, 18 bp, Homo sapiens
ccaaacaggccctcctcc

SEQ ID NO: 6030994 - DNA, 17 bp, Homo sapiens
ccaaacagtgctgtttc

SEQ ID NO: 6030995 - DNA, 22 bp, Homo sapiens
ccaaacagttgtaccactgcta

SEQ ID NO: 6030996 - DNA, 23 bp, Homo sapiens
ccaaacagttgtaccactgctaa

SEQ ID NO: 6030997 - DNA, 15 bp, Homo sapiens
ccaaacatagcccct

SEQ ID NO: 6030998 - DNA, 20 bp, Homo sapiens
ccaaacatagcccctgcccc

SEQ ID NO: 6030999 - DNA, 21 bp, Homo sapiens
ccaaacatcagacctgtcttc

SEQ ID NO: 6031000 - DNA, 12 bp, Homo sapiens
ccaaacatgcat

SEQ ID NO: 6031001 - DNA, 22 bp, Homo sapiens
ccaaacatgcttataacattaa

SEQ ID NO: 6031002 - DNA, 18 bp, Homo sapiens
ccaaacatgtatttatgt

SEQ ID NO: 6031003 - DNA, 22 bp, Homo sapiens
ccaaacattaatcaccaaagta

SEQ ID NO: 6031004 - DNA, 15 bp, Homo sapiens
ccaaacattaatgtt

SEQ ID NO: 6031005 - DNA, 14 bp, Homo sapiens
ccaaacatttctgt

SEQ ID NO: 6031006 - DNA, 17 bp, Homo sapiens
ccaaaccacatatgaaa

SEQ ID NO: 6031007 - DNA, 11 bp, Homo sapiens
ccaaaccactt

SEQ ID NO: 6031008 - DNA, 16 bp, Homo sapiens
ccaaaccaggaccctg

SEQ ID NO: 6031009 - DNA, 18 bp, Homo sapiens
ccaaacccaaaagaaact

SEQ ID NO: 6031010 - DNA, 20 bp, Homo sapiens
ccaaacccaccctttctact

SEQ ID NO: 6031011 - DNA, 18 bp, Homo sapiens
ccaaacccactcatgact

SEQ ID NO: 6031012 - DNA, 13 bp, Homo sapiens
ccaaacccagcca

SEQ ID NO: 6031013 - DNA, 14 bp, Homo sapiens
ccaaacccagccac

SEQ ID NO: 6031014 - DNA, 15 bp, Homo sapiens
ccaaacccagccact

SEQ ID NO: 6031015 - DNA, 16 bp, Homo sapiens
ccaaacccatcttcat

SEQ ID NO: 6031016 - DNA, 14 bp, Homo sapiens
ccaaaccccagccc

SEQ ID NO: 6031017 - DNA, 17 bp, Homo sapiens
ccaaaccccagccccaa

SEQ ID NO: 6031018 - DNA, 19 bp, Homo sapiens
ccaaacccccattctgtcc

SEQ ID NO: 6031019 - DNA, 15 bp, Homo sapiens
ccaaaccccctgcag

SEQ ID NO: 6031020 - DNA, 17 bp, Homo sapiens
ccaaaccccctgcagcc

SEQ ID NO: 6031021 - DNA, 13 bp, Homo sapiens
ccaaacccctaga

SEQ ID NO: 6031022 - DNA, 20 bp, Homo sapiens
ccaaacccctagagacagtg

SEQ ID NO: 6031023 - DNA, 14 bp, Homo sapiens
ccaaaccccttccc

SEQ ID NO: 6031024 - DNA, 12 bp, Homo sapiens
ccaaaccctagg

SEQ ID NO: 6031025 - DNA, 13 bp, Homo sapiens
ccaaaccctaggt

SEQ ID NO: 6031026 - DNA, 23 bp, Homo sapiens
ccaaaccctaggttcccggtccc

SEQ ID NO: 6031027 - DNA, 19 bp, Homo sapiens
ccaaaccctataaacctga

SEQ ID NO: 6031028 - DNA, 18 bp, Homo sapiens
ccaaaccctgtcctccca

SEQ ID NO: 6031029 - DNA, 14 bp, Homo sapiens
ccaaaccctgtctg

SEQ ID NO: 6031030 - DNA, 18 bp, Homo sapiens
ccaaacccttaactgaca

SEQ ID NO: 6031031 - DNA, 18 bp, Homo sapiens
ccaaacccttagcagccc

SEQ ID NO: 6031032 - DNA, 16 bp, Homo sapiens
ccaaacccttcaactc

SEQ ID NO: 6031033 - DNA, 20 bp, Homo sapiens
ccaaacccttcaactcctgg

SEQ ID NO: 6031034 - DNA, 22 bp, Homo sapiens
ccaaacccttcaactcctggct

SEQ ID NO: 6031035 - DNA, 13 bp, Homo sapiens
ccaaacctcaagt

SEQ ID NO: 6031036 - DNA, 13 bp, Homo sapiens
ccaaacctcacca

SEQ ID NO: 6031037 - DNA, 19 bp, Homo sapiens
ccaaacctccaaaactcct

SEQ ID NO: 6031038 - DNA, 13 bp, Homo sapiens
ccaaacctccagc

SEQ ID NO: 6031039 - DNA, 22 bp, Homo sapiens
ccaaacctcctgtcagtgagga

SEQ ID NO: 6031040 - DNA, 11 bp, Homo sapiens
ccaaacctctg

SEQ ID NO: 6031041 - DNA, 15 bp, Homo sapiens
ccaaacctgacagat

SEQ ID NO: 6031042 - DNA, 13 bp, Homo sapiens
ccaaacctggaga

SEQ ID NO: 6031043 - DNA, 14 bp, Homo sapiens
ccaaacctgtcttg

SEQ ID NO: 6031044 - DNA, 19 bp, Homo sapiens
ccaaaccttgggccctgga

SEQ ID NO: 6031045 - DNA, 20 bp, Homo sapiens
ccaaacgctgagccacctgc

SEQ ID NO: 6031046 - DNA, 13 bp, Homo sapiens
ccaaacgggagct

SEQ ID NO: 6031047 - DNA, 22 bp, Homo sapiens
ccaaactaacaagcaaaacctg

SEQ ID NO: 6031048 - DNA, 15 bp, Homo sapiens
ccaaactaccgttcc

SEQ ID NO: 6031049 - DNA, 19 bp, Homo sapiens
ccaaactagtatcatttta

SEQ ID NO: 6031050 - DNA, 20 bp, Homo sapiens
ccaaactcacctgcccctca

SEQ ID NO: 6031051 - DNA, 16 bp, Homo sapiens
ccaaactcaggcccag

SEQ ID NO: 6031052 - DNA, 14 bp, Homo sapiens
ccaaactcagttca

SEQ ID NO: 6031053 - DNA, 20 bp, Homo sapiens
ccaaactcagttcgaccaaa

SEQ ID NO: 6031054 - DNA, 13 bp, Homo sapiens
ccaaactcccctt

SEQ ID NO: 6031055 - DNA, 23 bp, Homo sapiens
ccaaactccccttccctggggag

SEQ ID NO: 6031056 - DNA, 14 bp, Homo sapiens
ccaaactcctgcct

SEQ ID NO: 6031057 - DNA, 13 bp, Homo sapiens
ccaaactctgtgt

SEQ ID NO: 6031058 - DNA, 13 bp, Homo sapiens
ccaaactgctgga

SEQ ID NO: 6031059 - DNA, 18 bp, Homo sapiens
ccaaactgggtcttcagc

SEQ ID NO: 6031060 - DNA, 21 bp, Homo sapiens
ccaaactgggtcttcagcttt

SEQ ID NO: 6031061 - DNA, 14 bp, Homo sapiens
ccaaactgtccctc

SEQ ID NO: 6031062 - DNA, 19 bp, Homo sapiens
ccaaactgtgccctgcctt

SEQ ID NO: 6031063 - DNA, 14 bp, Homo sapiens
ccaaactgttctga

SEQ ID NO: 6031064 - DNA, 12 bp, Homo sapiens
ccaaactgttgg

SEQ ID NO: 6031065 - DNA, 16 bp, Homo sapiens
ccaaacttggattttt

SEQ ID NO: 6031066 - DNA, 21 bp, Homo sapiens
ccaaactttaaaatgcgaaat

SEQ ID NO: 6031067 - DNA, 17 bp, Homo sapiens
ccaaactttatttttct

SEQ ID NO: 6031068 - DNA, 22 bp, Homo sapiens
ccaaactttctcataagcacct

SEQ ID NO: 6031069 - DNA, 20 bp, Homo sapiens
ccaaagaaaaagggctgccg

SEQ ID NO: 6031070 - DNA, 16 bp, Homo sapiens
cagtccaaaagtgttg

SEQ ID NO: 6031071 - DNA, 18 bp, Homo sapiens
cagtccaaatgtcctcca

SEQ ID NO: 6031072 - DNA, 22 bp, Homo sapiens
cagtccaaattgtctgtctgct

SEQ ID NO: 6031073 - DNA, 19 bp, Homo sapiens
cagtccaaccagaaacacc

SEQ ID NO: 6031074 - DNA, 19 bp, Homo sapiens
cagtccaaggaaaccacag

SEQ ID NO: 6031075 - DNA, 24 bp, Homo sapiens
cagtccaaggaaaccacagctgct

SEQ ID NO: 6031076 - DNA, 15 bp, Homo sapiens
cagtccacagctgaa

SEQ ID NO: 6031077 - DNA, 21 bp, Homo sapiens
cagtccacagctgaagagcaa

SEQ ID NO: 6031078 - DNA, 13 bp, Homo sapiens
cagtccacagggg

SEQ ID NO: 6031079 - DNA, 15 bp, Homo sapiens
cagtccacaggggcc

SEQ ID NO: 6031080 - DNA, 20 bp, Homo sapiens
cagtccacccccattgtgaa

SEQ ID NO: 6031081 - DNA, 22 bp, Homo sapiens
cagtccacccccattgtgaatg

SEQ ID NO: 6031082 - DNA, 18 bp, Homo sapiens
cagtccaccctgcctgcc

SEQ ID NO: 6031083 - DNA, 12 bp, Homo sapiens
cagtccactgtt

SEQ ID NO: 6031084 - DNA, 22 bp, Homo sapiens
cagtccactgttgagccccagt

SEQ ID NO: 6031085 - DNA, 20 bp, Homo sapiens
cagtccacttctgacagcct

SEQ ID NO: 6031086 - DNA, 16 bp, Homo sapiens
cagtccagaataagtg

SEQ ID NO: 6031087 - DNA, 18 bp, Homo sapiens
cagtccagaataagtgct

SEQ ID NO: 6031088 - DNA, 18 bp, Homo sapiens
cagtccagatgccttcct

SEQ ID NO: 6031089 - DNA, 19 bp, Homo sapiens
cagtccagatgccttcctg

SEQ ID NO: 6031090 - DNA, 22 bp, Homo sapiens
cagtccagatgccttcctgtct

SEQ ID NO: 6031091 - DNA, 13 bp, Homo sapiens
cagtccagccagc

SEQ ID NO: 6031092 - DNA, 15 bp, Homo sapiens
cagtccagccagctc

SEQ ID NO: 6031093 - DNA, 16 bp, Homo sapiens
cagtccagcctggaga

SEQ ID NO: 6031094 - DNA, 19 bp, Homo sapiens
cagtccagctctttagaat

SEQ ID NO: 6031095 - DNA, 21 bp, Homo sapiens
cagtccaggtggtgaattttc

SEQ ID NO: 6031096 - DNA, 22 bp, Homo sapiens
cagtccagtcctatctgggctt

SEQ ID NO: 6031097 - DNA, 17 bp, Homo sapiens
cagtccagtgtcacctc

SEQ ID NO: 6031098 - DNA, 22 bp, Homo sapiens
cagtccagttttgtgtgcttta

SEQ ID NO: 6031099 - DNA, 12 bp, Homo sapiens
cagtccatgcat

SEQ ID NO: 6031100 - DNA, 12 bp, Homo sapiens
cagtcccacact

SEQ ID NO: 6031101 - DNA, 18 bp, Homo sapiens
cagtcccacactgtgcag

SEQ ID NO: 6031102 - DNA, 19 bp, Homo sapiens
cagtcccacactgtgcaga

SEQ ID NO: 6031103 - DNA, 14 bp, Homo sapiens
cagtcccacggctc

SEQ ID NO: 6031104 - DNA, 17 bp, Homo sapiens
cagtcccacggctctgt

SEQ ID NO: 6031105 - DNA, 15 bp, Homo sapiens
cagtcccactgcacc

SEQ ID NO: 6031106 - DNA, 14 bp, Homo sapiens
cagtcccactgtgc

SEQ ID NO: 6031107 - DNA, 21 bp, Homo sapiens
cagtcccagaacacggcagct

SEQ ID NO: 6031108 - DNA, 22 bp, Homo sapiens
cagtcccagacaattccattca

SEQ ID NO: 6031109 - DNA, 14 bp, Homo sapiens
cagtcccagcacat

SEQ ID NO: 6031110 - DNA, 12 bp, Homo sapiens
cagtcccagcag

SEQ ID NO: 6031111 - DNA, 13 bp, Homo sapiens
cagtcccagcagc

SEQ ID NO: 6031112 - DNA, 14 bp, Homo sapiens
cagtcccagcagcc

SEQ ID NO: 6031113 - DNA, 15 bp, Homo sapiens
cagtcccagcctctg

SEQ ID NO: 6031114 - DNA, 21 bp, Homo sapiens
cagtcccagcctctggggcag

SEQ ID NO: 6031115 - DNA, 20 bp, Homo sapiens
cagtcccagcggtgggacct

SEQ ID NO: 6031116 - DNA, 15 bp, Homo sapiens
cagtcccatgctggc

SEQ ID NO: 6031117 - DNA, 15 bp, Homo sapiens
cagtccccacccctg

SEQ ID NO: 6031118 - DNA, 21 bp, Homo sapiens
cagtccccacccctgccccca

SEQ ID NO: 6031119 - DNA, 15 bp, Homo sapiens
cagtccccacccgcc

SEQ ID NO: 6031120 - DNA, 22 bp, Homo sapiens
cagtccccacccgcctgcagag

SEQ ID NO: 6031121 - DNA, 13 bp, Homo sapiens
cagtccccagact

SEQ ID NO: 6031122 - DNA, 17 bp, Homo sapiens
cagtccccagccctggg

SEQ ID NO: 6031123 - DNA, 15 bp, Homo sapiens
cagtccccagccctt

SEQ ID NO: 6031124 - DNA, 15 bp, Homo sapiens
cagtccccagtcacc

SEQ ID NO: 6031125 - DNA, 20 bp, Homo sapiens
cagtccccatttctgcctcg

SEQ ID NO: 6031126 - DNA, 18 bp, Homo sapiens
cagtccccattttctggt

SEQ ID NO: 6031127 - DNA, 16 bp, Homo sapiens
cagtcccccaacccca

SEQ ID NO: 6031128 - DNA, 16 bp, Homo sapiens
cagtcccccacccacc

SEQ ID NO: 6031129 - DNA, 20 bp, Homo sapiens
cagtcccccacccacctcct

SEQ ID NO: 6031130 - DNA, 22 bp, Homo sapiens
cagtcccccacccacctcctgc

SEQ ID NO: 6031131 - DNA, 20 bp, Homo sapiens
cagtccccccaccctcattc

SEQ ID NO: 6031132 - DNA, 23 bp, Homo sapiens
cagtccccctatccttggcacca

SEQ ID NO: 6031133 - DNA, 11 bp, Homo sapiens
cagtccccgct

SEQ ID NO: 6031134 - DNA, 18 bp, Homo sapiens
cagtccccgggaaaggcc

SEQ ID NO: 6031135 - DNA, 23 bp, Homo sapiens
cagtccccgtgaaggagagccct

SEQ ID NO: 6031136 - DNA, 23 bp, Homo sapiens
cagtccccgtggccatccctgtg

SEQ ID NO: 6031137 - DNA, 12 bp, Homo sapiens
cagtcccctccc

SEQ ID NO: 6031138 - DNA, 14 bp, Homo sapiens
cagtcccctcccat

SEQ ID NO: 6031139 - DNA, 22 bp, Homo sapiens
cagtcccctcccatctgggagt

SEQ ID NO: 6031140 - DNA, 16 bp, Homo sapiens
cagtcccctctctctg

SEQ ID NO: 6031141 - DNA, 20 bp, Homo sapiens
cagtcccctctctctgggtc

SEQ ID NO: 6031142 - DNA, 14 bp, Homo sapiens
cagtccccttcccg

SEQ ID NO: 6031143 - DNA, 22 bp, Homo sapiens
cagtccccttcccgtgacctgg

SEQ ID NO: 6031144 - DNA, 13 bp, Homo sapiens
cagtcccctttct

SEQ ID NO: 6031145 - DNA, 14 bp, Homo sapiens
cagtcccctttctc

SEQ ID NO: 6031146 - DNA, 23 bp, Homo sapiens
cagtcccgggagaaaagacggat

SEQ ID NO: 6031147 - DNA, 15 bp, Homo sapiens
cagtcccgtggaggg

SEQ ID NO: 6031148 - DNA, 15 bp, Homo sapiens
cagtccctactgagt

SEQ ID NO: 6031149 - DNA, 12 bp, Homo sapiens
cagtccctcacc

SEQ ID NO: 6031150 - DNA, 13 bp, Homo sapiens
cagtccctcacct

SEQ ID NO: 6031151 - DNA, 21 bp, Homo sapiens
cagtccctccctcctggctca

SEQ ID NO: 6031152 - DNA, 13 bp, Homo sapiens
cagtccctcctgt

SEQ ID NO: 6031153 - DNA, 21 bp, Homo sapiens
cagtccctcgccgtccctccc

SEQ ID NO: 6031154 - DNA, 23 bp, Homo sapiens
cagtccctcgccgtccctcccag

SEQ ID NO: 6031155 - DNA, 19 bp, Homo sapiens
cagtccctgagcagtctac

SEQ ID NO: 6031156 - DNA, 15 bp, Homo sapiens
cagtccctgccaatg

SEQ ID NO: 6031157 - DNA, 16 bp, Homo sapiens
cagtccctgccaatgg

SEQ ID NO: 6031158 - DNA, 13 bp, Homo sapiens
cagtccctgctgg

SEQ ID NO: 6031159 - DNA, 15 bp, Homo sapiens
cagtccctgctgggg

SEQ ID NO: 6031160 - DNA, 16 bp, Homo sapiens
cagtccctgctgggga

SEQ ID NO: 6031161 - DNA, 12 bp, Homo sapiens
cagtccctggag

SEQ ID NO: 6031162 - DNA, 22 bp, Homo sapiens
cagtccctggagaaggcatgtt

SEQ ID NO: 6031163 - DNA, 14 bp, Homo sapiens
cagtccctggagct

SEQ ID NO: 6031164 - DNA, 16 bp, Homo sapiens
cagtccctggagctgt

SEQ ID NO: 6031165 - DNA, 12 bp, Homo sapiens
cagtccctgggg

SEQ ID NO: 6031166 - DNA, 20 bp, Homo sapiens
cagtccctgggggaagccct

SEQ ID NO: 6031167 - DNA, 21 bp, Homo sapiens
cagtccctgggggaagccctg

SEQ ID NO: 6031168 - DNA, 21 bp, Homo sapiens
cagtcccttgctgacatggct

SEQ ID NO: 6031169 - DNA, 15 bp, Homo sapiens
cagtccctttggaca

SEQ ID NO: 6031170 - DNA, 18 bp, Homo sapiens
cagtccgcagtctggcct

SEQ ID NO: 6031171 - DNA, 15 bp, Homo sapiens
cagtccgcagttgta

SEQ ID NO: 6031172 - DNA, 20 bp, Homo sapiens
cagtccgccaaacactccac

SEQ ID NO: 6031173 - DNA, 20 bp, Homo sapiens
cagtccgccccgtgctcctc

SEQ ID NO: 6031174 - DNA, 15 bp, Homo sapiens
cagtccgcctggccg

SEQ ID NO: 6031175 - DNA, 14 bp, Homo sapiens
cagtccggtgcctt

SEQ ID NO: 6031176 - DNA, 14 bp, Homo sapiens
cagtcctaacaaat

SEQ ID NO: 6031177 - DNA, 15 bp, Homo sapiens
cagtcctaagaaaga

SEQ ID NO: 6031178 - DNA, 19 bp, Homo sapiens
cagtcctaagaaagaggag

SEQ ID NO: 6031179 - DNA, 21 bp, Homo sapiens
cagtcctactcaagcgggtgg

SEQ ID NO: 6031180 - DNA, 18 bp, Homo sapiens
cagtcctagaatgtttca

SEQ ID NO: 6031181 - DNA, 13 bp, Homo sapiens
cagtcctagctgc

SEQ ID NO: 6031182 - DNA, 23 bp, Homo sapiens
cagtcctagctgcacagggcagc

SEQ ID NO: 6031183 - DNA, 16 bp, Homo sapiens
cagtcctatctgggct

SEQ ID NO: 6031184 - DNA, 17 bp, Homo sapiens
cagtcctatctgggctt

SEQ ID NO: 6031185 - DNA, 22 bp, Homo sapiens
cagtcctatctgggcttcctgg

SEQ ID NO: 6031186 - DNA, 12 bp, Homo sapiens
cagtcctatttt

SEQ ID NO: 6031187 - DNA, 15 bp, Homo sapiens
cagtcctatttttca

SEQ ID NO: 6031188 - DNA, 22 bp, Homo sapiens
cagtcctcacagcctctccctt

SEQ ID NO: 6031189 - DNA, 20 bp, Homo sapiens
cagtcctccactcgacccag

SEQ ID NO: 6031190 - DNA, 23 bp, Homo sapiens
cagtcctccactcgacccagaat

SEQ ID NO: 6031191 - DNA, 16 bp, Homo sapiens
cagtcctccagcctcg

SEQ ID NO: 6031192 - DNA, 13 bp, Homo sapiens
cagtcctcccatc

SEQ ID NO: 6031193 - DNA, 13 bp, Homo sapiens
cagtcctcccctc

SEQ ID NO: 6031194 - DNA, 18 bp, Homo sapiens
cagtcctcccctcacagc

SEQ ID NO: 6031195 - DNA, 23 bp, Homo sapiens
cagtcctcccctcacagcctctg

SEQ ID NO: 6031196 - DNA, 15 bp, Homo sapiens
cagtcctccctagct

SEQ ID NO: 6031197 - DNA, 20 bp, Homo sapiens
cagtcctccggttgcatact

SEQ ID NO: 6031198 - DNA, 16 bp, Homo sapiens
cagtcctcctgggagc

SEQ ID NO: 6031199 - DNA, 13 bp, Homo sapiens
cagtcctctccac

SEQ ID NO: 6031200 - DNA, 20 bp, Homo sapiens
cagtcctctccacctagtgg

SEQ ID NO: 6031201 - DNA, 12 bp, Homo sapiens
cagtcctctgca

SEQ ID NO: 6031202 - DNA, 14 bp, Homo sapiens
cagtcctctgcctc

SEQ ID NO: 6031203 - DNA, 13 bp, Homo sapiens
cagtcctgaagca

SEQ ID NO: 6031204 - DNA, 22 bp, Homo sapiens
cagtcctgatcagagccgtggt

SEQ ID NO: 6031205 - DNA, 11 bp, Homo sapiens
cagtcctgcaa

SEQ ID NO: 6031206 - DNA, 12 bp, Homo sapiens
cagtcctgccac

SEQ ID NO: 6031207 - DNA, 13 bp, Homo sapiens
cagtcctgccacc

SEQ ID NO: 6031208 - DNA, 14 bp, Homo sapiens
cagtcctgcccgcc

SEQ ID NO: 6031209 - DNA, 15 bp, Homo sapiens
cagtcctgcccgcca

SEQ ID NO: 6031210 - DNA, 17 bp, Homo sapiens
cagtcctgcctcagcct

SEQ ID NO: 6031211 - DNA, 19 bp, Homo sapiens
cagtcctgcctcagcctcc

SEQ ID NO: 6031212 - DNA, 20 bp, Homo sapiens
cagtcctgcctgaacagccc

SEQ ID NO: 6031213 - DNA, 13 bp, Homo sapiens
cagtcctgcctgg

SEQ ID NO: 6031214 - DNA, 17 bp, Homo sapiens
cagtcctgcctggccag

SEQ ID NO: 6031215 - DNA, 18 bp, Homo sapiens
cagtcctgcctggccagg

SEQ ID NO: 6031216 - DNA, 21 bp, Homo sapiens
cagtcctgcctggccaggcag

SEQ ID NO: 6031217 - DNA, 13 bp, Homo sapiens
cagtcctgctctc

SEQ ID NO: 6031218 - DNA, 17 bp, Homo sapiens
cagtcctgctctctacc

SEQ ID NO: 6031219 - DNA, 12 bp, Homo sapiens
cagtcctggaag

SEQ ID NO: 6031220 - DNA, 12 bp, Homo sapiens
cagtcctggagg

SEQ ID NO: 6031221 - DNA, 13 bp, Homo sapiens
cagtcctggaggc

SEQ ID NO: 6031222 - DNA, 11 bp, Homo sapiens
cagtcctggcc

SEQ ID NO: 6031223 - DNA, 12 bp, Homo sapiens
cagtcctggcca

SEQ ID NO: 6031224 - DNA, 17 bp, Homo sapiens
cagtcctggccccctcg

SEQ ID NO: 6031225 - DNA, 13 bp, Homo sapiens
cagtcctgggaga

SEQ ID NO: 6031226 - DNA, 22 bp, Homo sapiens
cagtcctgggagaacctcaggc

SEQ ID NO: 6031227 - DNA, 23 bp, Homo sapiens
cagtcctgggagaacctcaggct

SEQ ID NO: 6031228 - DNA, 22 bp, Homo sapiens
cagtcctgggttgtttccagga

SEQ ID NO: 6031229 - DNA, 23 bp, Homo sapiens
cagtcctgggttgtttccaggag

SEQ ID NO: 6031230 - DNA, 10 bp, Homo sapiens
cagtcctggt

SEQ ID NO: 6031231 - DNA, 18 bp, Homo sapiens
cagtcctggtcctggctg

SEQ ID NO: 6031232 - DNA, 19 bp, Homo sapiens
cagtcctggtcctggctgc

SEQ ID NO: 6031233 - DNA, 23 bp, Homo sapiens
cagtcctggtcctggctgcactc

SEQ ID NO: 6031234 - DNA, 18 bp, Homo sapiens
cagtcctggtccttccac

SEQ ID NO: 6031235 - DNA, 14 bp, Homo sapiens
cagtcctggttcag

SEQ ID NO: 6031236 - DNA, 16 bp, Homo sapiens
cagtcctgtagtttta

SEQ ID NO: 6031237 - DNA, 12 bp, Homo sapiens
cagtcctgtcct

SEQ ID NO: 6031238 - DNA, 16 bp, Homo sapiens
cagtcctgtgtgagga

SEQ ID NO: 6031239 - DNA, 14 bp, Homo sapiens
cagtcctgttcaga

SEQ ID NO: 6031240 - DNA, 19 bp, Homo sapiens
cagtccttaccagcagagc

SEQ ID NO: 6031241 - DNA, 17 bp, Homo sapiens
cagtccttactccccca

SEQ ID NO: 6031242 - DNA, 21 bp, Homo sapiens
cagtccttccacacttccacc

SEQ ID NO: 6031243 - DNA, 13 bp, Homo sapiens
cagtccttggcct

SEQ ID NO: 6031244 - DNA, 16 bp, Homo sapiens
cagtcctttcccacca

SEQ ID NO: 6031245 - DNA, 21 bp, Homo sapiens
cagtcctttcccaccattcct

SEQ ID NO: 6031246 - DNA, 21 bp, Homo sapiens
cagtcctttgtaaacagtgtt

SEQ ID NO: 6031247 - DNA, 18 bp, Homo sapiens
cagtcctttgtctttctt

SEQ ID NO: 6031248 - DNA, 23 bp, Homo sapiens
cagtcctttgtctttctttgtca

SEQ ID NO: 6031249 - DNA, 19 bp, Homo sapiens
cagtcctttgttgctgttg

SEQ ID NO: 6031250 - DNA, 15 bp, Homo sapiens
ccaaagaaacaagct

SEQ ID NO: 6031251 - DNA, 22 bp, Homo sapiens
ccaaagaaacaccacttaatct

SEQ ID NO: 6031252 - DNA, 17 bp, Homo sapiens
ccaaagaaactcagaag

SEQ ID NO: 6031253 - DNA, 23 bp, Homo sapiens
ccaaagaaatagggcatggcttg

SEQ ID NO: 6031254 - DNA, 20 bp, Homo sapiens
ccaaagaaatgaacattcca

SEQ ID NO: 6031255 - DNA, 19 bp, Homo sapiens
ccaaagaaccaaagaagaa

SEQ ID NO: 6031256 - DNA, 20 bp, Homo sapiens
ccaaagaacttgatttgcat

SEQ ID NO: 6031257 - DNA, 11 bp, Homo sapiens
ccaaagaagat

SEQ ID NO: 6031258 - DNA, 17 bp, Homo sapiens
ccaaagaagatagctct

SEQ ID NO: 6031259 - DNA, 14 bp, Homo sapiens
ccaaagaaggcagg

SEQ ID NO: 6031260 - DNA, 21 bp, Homo sapiens
ccaaagaataagtgtctttct

SEQ ID NO: 6031261 - DNA, 16 bp, Homo sapiens
ccaaagaatattttga

SEQ ID NO: 6031262 - DNA, 11 bp, Homo sapiens
ccaaagaatgt

SEQ ID NO: 6031263 - DNA, 18 bp, Homo sapiens
ccaaagaatgttagagca

SEQ ID NO: 6031264 - DNA, 14 bp, Homo sapiens
ccaaagaattggaa

SEQ ID NO: 6031265 - DNA, 20 bp, Homo sapiens
ccaaagacctccacttgctt

SEQ ID NO: 6031266 - DNA, 16 bp, Homo sapiens
ccaaagacctcccaag

SEQ ID NO: 6031267 - DNA, 15 bp, Homo sapiens
ccaaagacctgcctg

SEQ ID NO: 6031268 - DNA, 15 bp, Homo sapiens
ccaaagactctggag

SEQ ID NO: 6031269 - DNA, 17 bp, Homo sapiens
ccaaagactctggaggt

SEQ ID NO: 6031270 - DNA, 14 bp, Homo sapiens
ccaaagacttgtta

SEQ ID NO: 6031271 - DNA, 14 bp, Homo sapiens
ccaaagagaaacct

SEQ ID NO: 6031272 - DNA, 17 bp, Homo sapiens
ccaaagagactggagca

SEQ ID NO: 6031273 - DNA, 20 bp, Homo sapiens
ccaaagagcctggagaagct

SEQ ID NO: 6031274 - DNA, 17 bp, Homo sapiens
ccaaagagcctttccaa

SEQ ID NO: 6031275 - DNA, 13 bp, Homo sapiens
ccaaagagctctt

SEQ ID NO: 6031276 - DNA, 14 bp, Homo sapiens
ccaaagagctcttt

SEQ ID NO: 6031277 - DNA, 16 bp, Homo sapiens
ccaaagagctgcctaa

SEQ ID NO: 6031278 - DNA, 13 bp, Homo sapiens
ccaaagaggcatt

SEQ ID NO: 6031279 - DNA, 12 bp, Homo sapiens
ccaaagaggctg

SEQ ID NO: 6031280 - DNA, 22 bp, Homo sapiens
ccaaagaggctgcccctctcac

SEQ ID NO: 6031281 - DNA, 21 bp, Homo sapiens
ccaaagaggggtcaccagggg

SEQ ID NO: 6031282 - DNA, 9 bp, Homo sapiens
ccaaagagt

SEQ ID NO: 6031283 - DNA, 18 bp, Homo sapiens
ccaaagagtattcagtga

SEQ ID NO: 6031284 - DNA, 16 bp, Homo sapiens
ccaaagagtctctggc

SEQ ID NO: 6031285 - DNA, 18 bp, Homo sapiens
ccaaagagtctctggctc

SEQ ID NO: 6031286 - DNA, 15 bp, Homo sapiens
ccaaagagtgtggaa

SEQ ID NO: 6031287 - DNA, 13 bp, Homo sapiens
ccaaagatgcagc

SEQ ID NO: 6031288 - DNA, 18 bp, Homo sapiens
ccaaagcaagcacctggg

SEQ ID NO: 6031289 - DNA, 16 bp, Homo sapiens
ccaaagcacagctggg

SEQ ID NO: 6031290 - DNA, 13 bp, Homo sapiens
ccaaagcacatgc

SEQ ID NO: 6031291 - DNA, 20 bp, Homo sapiens
ccaaagcacatgcttagctt

SEQ ID NO: 6031292 - DNA, 22 bp, Homo sapiens
ccaaagcacatgcttagcttat

SEQ ID NO: 6031293 - DNA, 13 bp, Homo sapiens
ccaaagcacattt

SEQ ID NO: 6031294 - DNA, 12 bp, Homo sapiens
ccaaagcagaca

SEQ ID NO: 6031295 - DNA, 13 bp, Homo sapiens
ccaaagcagacag

SEQ ID NO: 6031296 - DNA, 17 bp, Homo sapiens
ccaaagcagacattttc

SEQ ID NO: 6031297 - DNA, 21 bp, Homo sapiens
ccaaagcagacattttcctca

SEQ ID NO: 6031298 - DNA, 14 bp, Homo sapiens
ccaaagcaggtcag

SEQ ID NO: 6031299 - DNA, 23 bp, Homo sapiens
ccaaagcagtgcatgctgtccct

SEQ ID NO: 6031300 - DNA, 12 bp, Homo sapiens
ccaaagcatgcc

SEQ ID NO: 6031301 - DNA, 14 bp, Homo sapiens
ccaaagcattgcag

SEQ ID NO: 6031302 - DNA, 18 bp, Homo sapiens
ccaaagcattgcagaaca

SEQ ID NO: 6031303 - DNA, 19 bp, Homo sapiens
ccaaagcattgcctgccag

SEQ ID NO: 6031304 - DNA, 17 bp, Homo sapiens
ccaaagccaagaaagaa

SEQ ID NO: 6031305 - DNA, 22 bp, Homo sapiens
ccaaagccaccagactgacaaa

SEQ ID NO: 6031306 - DNA, 12 bp, Homo sapiens
ccaaagccacct

SEQ ID NO: 6031307 - DNA, 17 bp, Homo sapiens
ccaaagccactggaagg

SEQ ID NO: 6031308 - DNA, 19 bp, Homo sapiens
ccaaagccactggaaggag

SEQ ID NO: 6031309 - DNA, 15 bp, Homo sapiens
ccaaagccagacagc

SEQ ID NO: 6031310 - DNA, 13 bp, Homo sapiens
ccaaagccagtga

SEQ ID NO: 6031311 - DNA, 20 bp, Homo sapiens
ccaaagccagtgaaatgtga

SEQ ID NO: 6031312 - DNA, 21 bp, Homo sapiens
ccaaagccattctccccctct

SEQ ID NO: 6031313 - DNA, 11 bp, Homo sapiens
ccaaagcccag

SEQ ID NO: 6031314 - DNA, 16 bp, Homo sapiens
ccaaagcccagcccgg

SEQ ID NO: 6031315 - DNA, 23 bp, Homo sapiens
ccaaagccccttgctctcccctg

SEQ ID NO: 6031316 - DNA, 16 bp, Homo sapiens
ccaaagcctcttcaaa

SEQ ID NO: 6031317 - DNA, 17 bp, Homo sapiens
ccaaagcctgaggacag

SEQ ID NO: 6031318 - DNA, 18 bp, Homo sapiens
ccaaagcctgtcccagga

SEQ ID NO: 6031319 - DNA, 15 bp, Homo sapiens
ccaaagctaggcctg

SEQ ID NO: 6031320 - DNA, 21 bp, Homo sapiens
ccaaagctaggcctggccaga

SEQ ID NO: 6031321 - DNA, 18 bp, Homo sapiens
ccaaagctctgaatagtt

SEQ ID NO: 6031322 - DNA, 21 bp, Homo sapiens
ccaaagctgacgaggctgggc

SEQ ID NO: 6031323 - DNA, 20 bp, Homo sapiens
ccaaagctgagcctgcaggg

SEQ ID NO: 6031324 - DNA, 18 bp, Homo sapiens
ccaaagctgcccactgtt

SEQ ID NO: 6031325 - DNA, 20 bp, Homo sapiens
ccaaagctgcccactgtttc

SEQ ID NO: 6031326 - DNA, 13 bp, Homo sapiens
ccaaagctgcctg

SEQ ID NO: 6031327 - DNA, 16 bp, Homo sapiens
ccaaagctgcctgtgc

SEQ ID NO: 6031328 - DNA, 18 bp, Homo sapiens
ccaaagctgcctgtgcca

SEQ ID NO: 6031329 - DNA, 13 bp, Homo sapiens
ccaaagctgcttt

SEQ ID NO: 6031330 - DNA, 18 bp, Homo sapiens
ccaaagctgctttcttct

SEQ ID NO: 6031331 - DNA, 18 bp, Homo sapiens
ccaaagcttgccactttc

SEQ ID NO: 6031332 - DNA, 17 bp, Homo sapiens
ccaaagcttgtaaatat

SEQ ID NO: 6031333 - DNA, 12 bp, Homo sapiens
ccaaagctttat

SEQ ID NO: 6031334 - DNA, 16 bp, Homo sapiens
ccaaagctttcatgta

SEQ ID NO: 6031335 - DNA, 13 bp, Homo sapiens
ccaaagctttcct

SEQ ID NO: 6031336 - DNA, 20 bp, Homo sapiens
ccaaagctttcctgccccag

SEQ ID NO: 6031337 - DNA, 12 bp, Homo sapiens
ccaaaggaaaaa

SEQ ID NO: 6031338 - DNA, 17 bp, Homo sapiens
ccaaaggaacactgaca

SEQ ID NO: 6031339 - DNA, 17 bp, Homo sapiens
ccaaaggaactctagag

SEQ ID NO: 6031340 - DNA, 23 bp, Homo sapiens
ccaaaggaagcacatgcctctct

SEQ ID NO: 6031341 - DNA, 13 bp, Homo sapiens
ccaaaggaaggaa

SEQ ID NO: 6031342 - DNA, 14 bp, Homo sapiens
ccaaaggaaggaac

SEQ ID NO: 6031343 - DNA, 15 bp, Homo sapiens
ccaaaggaaggaacg

SEQ ID NO: 6031344 - DNA, 20 bp, Homo sapiens
ccaaaggaataacctttctg

SEQ ID NO: 6031345 - DNA, 17 bp, Homo sapiens
ccaaaggacagccgcct

SEQ ID NO: 6031346 - DNA, 15 bp, Homo sapiens
ccaaaggacgcctgc

SEQ ID NO: 6031347 - DNA, 21 bp, Homo sapiens
ccaaaggactccacccatcct

SEQ ID NO: 6031348 - DNA, 14 bp, Homo sapiens
ccaaaggaggatgg

SEQ ID NO: 6031349 - DNA, 22 bp, Homo sapiens
ccaaaggagtgcatggccacag

SEQ ID NO: 6031350 - DNA, 12 bp, Homo sapiens
ccaaaggcagcg

SEQ ID NO: 6031351 - DNA, 15 bp, Homo sapiens
ccaaaggcagcgtgc

SEQ ID NO: 6031352 - DNA, 23 bp, Homo sapiens
ccaaaggcatccaggccagggct

SEQ ID NO: 6031353 - DNA, 20 bp, Homo sapiens
ccaaaggcatcccagcctgg

SEQ ID NO: 6031354 - DNA, 21 bp, Homo sapiens
ccaaaggcatcccagcctggg

SEQ ID NO: 6031355 - DNA, 15 bp, Homo sapiens
ccaaaggcccaggga

SEQ ID NO: 6031356 - DNA, 17 bp, Homo sapiens
ccaaaggctcctgagac

SEQ ID NO: 6031357 - DNA, 13 bp, Homo sapiens
ccaaaggctggtg

SEQ ID NO: 6031358 - DNA, 15 bp, Homo sapiens
ccaaaggctggtggc

SEQ ID NO: 6031359 - DNA, 13 bp, Homo sapiens
ccaaagggagtct

SEQ ID NO: 6031360 - DNA, 18 bp, Homo sapiens
ccaaagggagtctgccag

SEQ ID NO: 6031361 - DNA, 20 bp, Homo sapiens
ccaaagggatggtattgaga

SEQ ID NO: 6031362 - DNA, 24 bp, Homo sapiens
ccaaagggcttattgactctttct

SEQ ID NO: 6031363 - DNA, 17 bp, Homo sapiens
ccaaaggggacaggcct

SEQ ID NO: 6031364 - DNA, 23 bp, Homo sapiens
ccaaaggggacaggcctcacctc

SEQ ID NO: 6031365 - DNA, 20 bp, Homo sapiens
ccaaaggggacccctatgaa

SEQ ID NO: 6031366 - DNA, 19 bp, Homo sapiens
ccaaaggggcctctccttt

SEQ ID NO: 6031367 - DNA, 19 bp, Homo sapiens
ccaaaggggctgctggggc

SEQ ID NO: 6031368 - DNA, 21 bp, Homo sapiens
ccaaagggtgaagctatttat

SEQ ID NO: 6031369 - DNA, 20 bp, Homo sapiens
ccaaaggttcagaaaattaa

SEQ ID NO: 6031370 - DNA, 23 bp, Homo sapiens
ccaaaggtttttaaagtaaatct

SEQ ID NO: 6031371 - DNA, 18 bp, Homo sapiens
ccaaagtacactgtttca

SEQ ID NO: 6031372 - DNA, 22 bp, Homo sapiens
ccaaagtacagaatttgaatta

SEQ ID NO: 6031373 - DNA, 15 bp, Homo sapiens
ccaaagtaccacact

SEQ ID NO: 6031374 - DNA, 18 bp, Homo sapiens
ccaaagtaccacactgag

SEQ ID NO: 6031375 - DNA, 21 bp, Homo sapiens
ccaaagtagtcctggcagctg

SEQ ID NO: 6031376 - DNA, 17 bp, Homo sapiens
ccaaagtcacaggaaga

SEQ ID NO: 6031377 - DNA, 13 bp, Homo sapiens
ccaaagtcataat

SEQ ID NO: 6031378 - DNA, 17 bp, Homo sapiens
ccaaagtcataattgca

SEQ ID NO: 6031379 - DNA, 13 bp, Homo sapiens
ccaaagtccaggc

SEQ ID NO: 6031380 - DNA, 19 bp, Homo sapiens
ccaaagtcctgggattaca

SEQ ID NO: 6031381 - DNA, 16 bp, Homo sapiens
ccaaagtctctaattc

SEQ ID NO: 6031382 - DNA, 13 bp, Homo sapiens
ccaaagtcttgat

SEQ ID NO: 6031383 - DNA, 14 bp, Homo sapiens
ccaaagtgaactct

SEQ ID NO: 6031384 - DNA, 23 bp, Homo sapiens
ccaaagtgcagcccttcctcctg

SEQ ID NO: 6031385 - DNA, 23 bp, Homo sapiens
ccaaagtgccactcattcctgta

SEQ ID NO: 6031386 - DNA, 13 bp, Homo sapiens
ccaaagtgctgag

SEQ ID NO: 6031387 - DNA, 15 bp, Homo sapiens
ccaaagtgctgagat

SEQ ID NO: 6031388 - DNA, 22 bp, Homo sapiens
ccaaagtgctgggattacaggc

SEQ ID NO: 6031389 - DNA, 14 bp, Homo sapiens
ccaaagttagttca

SEQ ID NO: 6031390 - DNA, 15 bp, Homo sapiens
ccaaagttagttcag

SEQ ID NO: 6031391 - DNA, 21 bp, Homo sapiens
ccaaagttagttcagtagctt

SEQ ID NO: 6031392 - DNA, 16 bp, Homo sapiens
ccaaagttcaacttgg

SEQ ID NO: 6031393 - DNA, 22 bp, Homo sapiens
ccaaagttcacattaactcagg

SEQ ID NO: 6031394 - DNA, 23 bp, Homo sapiens
ccaaagttgttgtaacctgctgt

SEQ ID NO: 6031395 - DNA, 24 bp, Homo sapiens
ccaaataaaatgtttacattttct

SEQ ID NO: 6031396 - DNA, 14 bp, Homo sapiens
ccaaataaagtctc

SEQ ID NO: 6031397 - DNA, 19 bp, Homo sapiens
ccaaataaatcatcctcat

SEQ ID NO: 6031398 - DNA, 13 bp, Homo sapiens
ccaaataaatgtg

SEQ ID NO: 6031399 - DNA, 18 bp, Homo sapiens
ccaaataaatgtgtaaat

SEQ ID NO: 6031400 - DNA, 19 bp, Homo sapiens
ccaaataaatgtgtaaatg

SEQ ID NO: 6031401 - DNA, 16 bp, Homo sapiens
ccaaataagaaaccta

SEQ ID NO: 6031402 - DNA, 17 bp, Homo sapiens
ccaaataagaaacctaa

SEQ ID NO: 6031403 - DNA, 14 bp, Homo sapiens
ccaaataagcatct

SEQ ID NO: 6031404 - DNA, 13 bp, Homo sapiens
ccaaataataaag

SEQ ID NO: 6031405 - DNA, 21 bp, Homo sapiens
ccaaataatatgtttccttcc

SEQ ID NO: 6031406 - DNA, 23 bp, Homo sapiens
ccaaataatattttagattacag

SEQ ID NO: 6031407 - DNA, 19 bp, Homo sapiens
ccaaatacaattcaaatgc

SEQ ID NO: 6031408 - DNA, 20 bp, Homo sapiens
ccaaatacaattcaaatgct

SEQ ID NO: 6031409 - DNA, 16 bp, Homo sapiens
ccaaatacctcaattt

SEQ ID NO: 6031410 - DNA, 21 bp, Homo sapiens
ccaaatacgaagccctcttgc

SEQ ID NO: 6031411 - DNA, 19 bp, Homo sapiens
ccaaatactaatgaaaaca

SEQ ID NO: 6031412 - DNA, 16 bp, Homo sapiens
ccaaatagccaccttg

SEQ ID NO: 6031413 - DNA, 21 bp, Homo sapiens
ccaaatagccaccttgatttt

SEQ ID NO: 6031414 - DNA, 14 bp, Homo sapiens
ccaaatagccccag

SEQ ID NO: 6031415 - DNA, 15 bp, Homo sapiens
ccaaatagccccaga

SEQ ID NO: 6031416 - DNA, 19 bp, Homo sapiens
ccaaatagccccagactgg

SEQ ID NO: 6031417 - DNA, 21 bp, Homo sapiens
ccaaatagcctctcctttgta

SEQ ID NO: 6031418 - DNA, 20 bp, Homo sapiens
ccaaataggagggagactgt

SEQ ID NO: 6031419 - DNA, 19 bp, Homo sapiens
ccaaatagtgtgaaatata

SEQ ID NO: 6031420 - DNA, 18 bp, Homo sapiens
ccaaatatcaccaggact

SEQ ID NO: 6031421 - DNA, 17 bp, Homo sapiens
ccaaatattacaacaag

SEQ ID NO: 6031422 - DNA, 21 bp, Homo sapiens
ccaaatattattcaagtgcct

SEQ ID NO: 6031423 - DNA, 23 bp, Homo sapiens
ccaaatattattcaagtgcctct

SEQ ID NO: 6031424 - DNA, 17 bp, Homo sapiens
ccaaatattcattttga

SEQ ID NO: 6031425 - DNA, 17 bp, Homo sapiens
ccaaatattctaaaaaa

SEQ ID NO: 6031426 - DNA, 20 bp, Homo sapiens
ccaaatattttagccttaaa

SEQ ID NO: 6031427 - DNA, 22 bp, Homo sapiens
ccaaatcaaaagactttttcct

SEQ ID NO: 6031428 - DNA, 15 bp, Homo sapiens
ccaaatcaaaatatg

SEQ ID NO: 6031429 - DNA, 13 bp, Homo sapiens
cagtcgaccccaa

SEQ ID NO: 6031430 - DNA, 17 bp, Homo sapiens
cagtcgaccgcacttat

SEQ ID NO: 6031431 - DNA, 22 bp, Homo sapiens
cagtcgaggaagaccacccggc

SEQ ID NO: 6031432 - DNA, 13 bp, Homo sapiens
cagtcgaggctgg

SEQ ID NO: 6031433 - DNA, 15 bp, Homo sapiens
cagtcgaggctggta

SEQ ID NO: 6031434 - DNA, 13 bp, Homo sapiens
cagtcgatattcc

SEQ ID NO: 6031435 - DNA, 16 bp, Homo sapiens
cagtcgatattcccag

SEQ ID NO: 6031436 - DNA, 23 bp, Homo sapiens
cagtcgcaggatccgctgccacc

SEQ ID NO: 6031437 - DNA, 18 bp, Homo sapiens
cagtcgcccaagcagaca

SEQ ID NO: 6031438 - DNA, 14 bp, Homo sapiens
cagtcgccctctgt

SEQ ID NO: 6031439 - DNA, 18 bp, Homo sapiens
cagtcgccctctgtgcct

SEQ ID NO: 6031440 - DNA, 21 bp, Homo sapiens
cagtcgccctctgtgcctaat

SEQ ID NO: 6031441 - DNA, 22 bp, Homo sapiens
cagtcgccctctgtgcctaata

SEQ ID NO: 6031442 - DNA, 12 bp, Homo sapiens
cagtcgccctgt

SEQ ID NO: 6031443 - DNA, 13 bp, Homo sapiens
cagtcgcctgcct

SEQ ID NO: 6031444 - DNA, 22 bp, Homo sapiens
cagtcgcctgcctgcagcaggc

SEQ ID NO: 6031445 - DNA, 16 bp, Homo sapiens
cagtcgcgctgcctgt

SEQ ID NO: 6031446 - DNA, 18 bp, Homo sapiens
cagtcgcgctgcctgtgt

SEQ ID NO: 6031447 - DNA, 15 bp, Homo sapiens
cagtcgctgcaggga

SEQ ID NO: 6031448 - DNA, 17 bp, Homo sapiens
cagtcgctgcagggagc

SEQ ID NO: 6031449 - DNA, 14 bp, Homo sapiens
cagtcggcatgcca

SEQ ID NO: 6031450 - DNA, 17 bp, Homo sapiens
cagtcggcatgccagga

SEQ ID NO: 6031451 - DNA, 14 bp, Homo sapiens
cagtcggccccatc

SEQ ID NO: 6031452 - DNA, 15 bp, Homo sapiens
cagtcgggagagcca

SEQ ID NO: 6031453 - DNA, 19 bp, Homo sapiens
cagtcgggggaactgaggc

SEQ ID NO: 6031454 - DNA, 14 bp, Homo sapiens
cagtcgggggctgg

SEQ ID NO: 6031455 - DNA, 16 bp, Homo sapiens
cagtcgggggctggcc

SEQ ID NO: 6031456 - DNA, 15 bp, Homo sapiens
cagtcgtcccaggct

SEQ ID NO: 6031457 - DNA, 17 bp, Homo sapiens
cagtcgtcccaggctgc

SEQ ID NO: 6031458 - DNA, 15 bp, Homo sapiens
cagtcgtccgctcag

SEQ ID NO: 6031459 - DNA, 18 bp, Homo sapiens
cagtcgtccgctcagcca

SEQ ID NO: 6031460 - DNA, 17 bp, Homo sapiens
cagtcgtcgcacagtct

SEQ ID NO: 6031461 - DNA, 12 bp, Homo sapiens
cagtcgtgatgt

SEQ ID NO: 6031462 - DNA, 13 bp, Homo sapiens
cagtcgtgcctgt

SEQ ID NO: 6031463 - DNA, 17 bp, Homo sapiens
cagtcgtgcctgtgtcc

SEQ ID NO: 6031464 - DNA, 20 bp, Homo sapiens
cagtcgtggggaacggagga

SEQ ID NO: 6031465 - DNA, 21 bp, Homo sapiens
cagtcgtggttgggaacacag

SEQ ID NO: 6031466 - DNA, 15 bp, Homo sapiens
cagtcgttatttctg

SEQ ID NO: 6031467 - DNA, 16 bp, Homo sapiens
cagtcgttcccagtgt

SEQ ID NO: 6031468 - DNA, 19 bp, Homo sapiens
cagtctaaaatgcttcagt

SEQ ID NO: 6031469 - DNA, 16 bp, Homo sapiens
cagtctaaacagagtc

SEQ ID NO: 6031470 - DNA, 18 bp, Homo sapiens
cagtctaagtaagtgtct

SEQ ID NO: 6031471 - DNA, 15 bp, Homo sapiens
cagtctaagtgtaaa

SEQ ID NO: 6031472 - DNA, 17 bp, Homo sapiens
cagtctaatttttattc

SEQ ID NO: 6031473 - DNA, 14 bp, Homo sapiens
cagtctacaggcct

SEQ ID NO: 6031474 - DNA, 21 bp, Homo sapiens
cagtctacattgagcatttga

SEQ ID NO: 6031475 - DNA, 21 bp, Homo sapiens
cagtctacccacctcagcctc

SEQ ID NO: 6031476 - DNA, 14 bp, Homo sapiens
cagtctacccagag

SEQ ID NO: 6031477 - DNA, 19 bp, Homo sapiens
cagtctacccagagaagcc

SEQ ID NO: 6031478 - DNA, 22 bp, Homo sapiens
cagtctacccagagaagcccct

SEQ ID NO: 6031479 - DNA, 18 bp, Homo sapiens
cagtctaccctgtccttt

SEQ ID NO: 6031480 - DNA, 22 bp, Homo sapiens
cagtctacgttctccagcccac

SEQ ID NO: 6031481 - DNA, 16 bp, Homo sapiens
cagtctacttctgtgt

SEQ ID NO: 6031482 - DNA, 18 bp, Homo sapiens
cagtctacttctgtgtct

SEQ ID NO: 6031483 - DNA, 16 bp, Homo sapiens
cagtctagtacttatt

SEQ ID NO: 6031484 - DNA, 15 bp, Homo sapiens
cagtctagtccgtcc

SEQ ID NO: 6031485 - DNA, 22 bp, Homo sapiens
cagtctagtccgtcctggcaca

SEQ ID NO: 6031486 - DNA, 14 bp, Homo sapiens
cagtctagtcctgg

SEQ ID NO: 6031487 - DNA, 14 bp, Homo sapiens
cagtctagttcctg

SEQ ID NO: 6031488 - DNA, 23 bp, Homo sapiens
cagtctatccacagagagtccca

SEQ ID NO: 6031489 - DNA, 13 bp, Homo sapiens
cagtctatgctgt

SEQ ID NO: 6031490 - DNA, 17 bp, Homo sapiens
cagtctcaaataataat

SEQ ID NO: 6031491 - DNA, 21 bp, Homo sapiens
cagtctcaagaggcagagttc

SEQ ID NO: 6031492 - DNA, 20 bp, Homo sapiens
cagtctcaattttgtattta

SEQ ID NO: 6031493 - DNA, 15 bp, Homo sapiens
cagtctcacagagaa

SEQ ID NO: 6031494 - DNA, 16 bp, Homo sapiens
cagtctcacagagaag

SEQ ID NO: 6031495 - DNA, 22 bp, Homo sapiens
cagtctcacagagaagctcctg

SEQ ID NO: 6031496 - DNA, 17 bp, Homo sapiens
cagtctcaccatttccc

SEQ ID NO: 6031497 - DNA, 21 bp, Homo sapiens
cagtctcaccatttccccagg

SEQ ID NO: 6031498 - DNA, 14 bp, Homo sapiens
cagtctcacccact

SEQ ID NO: 6031499 - DNA, 19 bp, Homo sapiens
cagtctcacctgccggctc

SEQ ID NO: 6031500 - DNA, 20 bp, Homo sapiens
cagtctcacctgccggctct

SEQ ID NO: 6031501 - DNA, 19 bp, Homo sapiens
cagtctcactgacacagga

SEQ ID NO: 6031502 - DNA, 19 bp, Homo sapiens
cagtctcactgtgggaagg

SEQ ID NO: 6031503 - DNA, 17 bp, Homo sapiens
cagtctcagagaccagc

SEQ ID NO: 6031504 - DNA, 14 bp, Homo sapiens
cagtctcagctgct

SEQ ID NO: 6031505 - DNA, 13 bp, Homo sapiens
cagtctcaggagc

SEQ ID NO: 6031506 - DNA, 13 bp, Homo sapiens
cagtctcagtcca

SEQ ID NO: 6031507 - DNA, 14 bp, Homo sapiens
cagtctcagtccag

SEQ ID NO: 6031508 - DNA, 18 bp, Homo sapiens
cagtctcagttctcttgc

SEQ ID NO: 6031509 - DNA, 19 bp, Homo sapiens
cagtctcagttctcttgct

SEQ ID NO: 6031510 - DNA, 22 bp, Homo sapiens
cagtctcatcctcccattgccc

SEQ ID NO: 6031511 - DNA, 20 bp, Homo sapiens
cagtctcatctcctgaccct

SEQ ID NO: 6031512 - DNA, 22 bp, Homo sapiens
cagtctcattacagatttagtt

SEQ ID NO: 6031513 - DNA, 15 bp, Homo sapiens
cagtctcattgtcac

SEQ ID NO: 6031514 - DNA, 16 bp, Homo sapiens
cagtctccaccaggaa

SEQ ID NO: 6031515 - DNA, 14 bp, Homo sapiens
cagtctccagggac

SEQ ID NO: 6031516 - DNA, 15 bp, Homo sapiens
cagtctccagggacc

SEQ ID NO: 6031517 - DNA, 22 bp, Homo sapiens
cagtctccataaggcagtggct

SEQ ID NO: 6031518 - DNA, 19 bp, Homo sapiens
cagtctccccttcctggca

SEQ ID NO: 6031519 - DNA, 12 bp, Homo sapiens
cagtctccctga

SEQ ID NO: 6031520 - DNA, 14 bp, Homo sapiens
cagtctccctgatg

SEQ ID NO: 6031521 - DNA, 17 bp, Homo sapiens
cagtctcccttctccca

SEQ ID NO: 6031522 - DNA, 22 bp, Homo sapiens
cagtctcccttctcccatgagg

SEQ ID NO: 6031523 - DNA, 18 bp, Homo sapiens
cagtctccctttcccttc

SEQ ID NO: 6031524 - DNA, 22 bp, Homo sapiens
cagtctccctttcccttcttgg

SEQ ID NO: 6031525 - DNA, 16 bp, Homo sapiens
cagtctccgcctcctg

SEQ ID NO: 6031526 - DNA, 15 bp, Homo sapiens
cagtctccggcctct

SEQ ID NO: 6031527 - DNA, 18 bp, Homo sapiens
cagtctccggcctctcca

SEQ ID NO: 6031528 - DNA, 18 bp, Homo sapiens
cagtctcctatacccagc

SEQ ID NO: 6031529 - DNA, 21 bp, Homo sapiens
cagtctcctatacccagcaga

SEQ ID NO: 6031530 - DNA, 19 bp, Homo sapiens
cagtctcctcactctgtcc

SEQ ID NO: 6031531 - DNA, 18 bp, Homo sapiens
cagtctcctctccatttt

SEQ ID NO: 6031532 - DNA, 22 bp, Homo sapiens
cagtctcgggtggctagtcaga

SEQ ID NO: 6031533 - DNA, 19 bp, Homo sapiens
cagtctctataccaataaa

SEQ ID NO: 6031534 - DNA, 18 bp, Homo sapiens
cagtctctcttaaagttg

SEQ ID NO: 6031535 - DNA, 12 bp, Homo sapiens
cagtctctgagc

SEQ ID NO: 6031536 - DNA, 20 bp, Homo sapiens
cagtctctgagggcttcctt

SEQ ID NO: 6031537 - DNA, 15 bp, Homo sapiens
cagtctctggaagaa

SEQ ID NO: 6031538 - DNA, 14 bp, Homo sapiens
cagtctctgggaga

SEQ ID NO: 6031539 - DNA, 24 bp, Homo sapiens
cagtctcttagaatttgtttcatc

SEQ ID NO: 6031540 - DNA, 15 bp, Homo sapiens
cagtctctttaatct

SEQ ID NO: 6031541 - DNA, 20 bp, Homo sapiens
cagtctctttattttactag

SEQ ID NO: 6031542 - DNA, 23 bp, Homo sapiens
cagtctctttattttactagaaa

SEQ ID NO: 6031543 - DNA, 20 bp, Homo sapiens
cagtctctttcttcctttct

SEQ ID NO: 6031544 - DNA, 13 bp, Homo sapiens
cagtctgaagttt

SEQ ID NO: 6031545 - DNA, 17 bp, Homo sapiens
cagtctgagagaggcca

SEQ ID NO: 6031546 - DNA, 22 bp, Homo sapiens
cagtctgagtcatcaaaaagag

SEQ ID NO: 6031547 - DNA, 20 bp, Homo sapiens
cagtctgattcccaagctct

SEQ ID NO: 6031548 - DNA, 22 bp, Homo sapiens
cagtctgattcccaagctctgc

SEQ ID NO: 6031549 - DNA, 21 bp, Homo sapiens
cagtctgcagagttctcctgg

SEQ ID NO: 6031550 - DNA, 21 bp, Homo sapiens
cagtctgcccacgcagaggac

SEQ ID NO: 6031551 - DNA, 12 bp, Homo sapiens
cagtctgctcca

SEQ ID NO: 6031552 - DNA, 13 bp, Homo sapiens
cagtctgctccac

SEQ ID NO: 6031553 - DNA, 18 bp, Homo sapiens
cagtctgctccaccaagg

SEQ ID NO: 6031554 - DNA, 13 bp, Homo sapiens
cagtctgctcctc

SEQ ID NO: 6031555 - DNA, 16 bp, Homo sapiens
cagtctgctcctcttg

SEQ ID NO: 6031556 - DNA, 14 bp, Homo sapiens
cagtctgctctcag

SEQ ID NO: 6031557 - DNA, 19 bp, Homo sapiens
cagtctgctctcagcttgt

SEQ ID NO: 6031558 - DNA, 22 bp, Homo sapiens
cagtctgctctcagcttgtgcc

SEQ ID NO: 6031559 - DNA, 12 bp, Homo sapiens
cagtctgctctg

SEQ ID NO: 6031560 - DNA, 16 bp, Homo sapiens
cagtctgctctgctgc

SEQ ID NO: 6031561 - DNA, 21 bp, Homo sapiens
cagtctgctctgctgctctga

SEQ ID NO: 6031562 - DNA, 14 bp, Homo sapiens
cagtctgcttagaa

SEQ ID NO: 6031563 - DNA, 19 bp, Homo sapiens
cagtctggaagaagaggag

SEQ ID NO: 6031564 - DNA, 15 bp, Homo sapiens
cagtctggaatgcag

SEQ ID NO: 6031565 - DNA, 17 bp, Homo sapiens
cagtctggaatgcagtg

SEQ ID NO: 6031566 - DNA, 19 bp, Homo sapiens
cagtctggaatgcagtggt

SEQ ID NO: 6031567 - DNA, 19 bp, Homo sapiens
cagtctggagcaaagcaga

SEQ ID NO: 6031568 - DNA, 16 bp, Homo sapiens
cagtctggaggggcat

SEQ ID NO: 6031569 - DNA, 20 bp, Homo sapiens
cagtctggccaatatggaga

SEQ ID NO: 6031570 - DNA, 15 bp, Homo sapiens
cagtctggcctgggc

SEQ ID NO: 6031571 - DNA, 20 bp, Homo sapiens
cagtctggctgagccctgct

SEQ ID NO: 6031572 - DNA, 21 bp, Homo sapiens
cagtctgggtaacagggagac

SEQ ID NO: 6031573 - DNA, 23 bp, Homo sapiens
cagtctgggtctgggtttggatc

SEQ ID NO: 6031574 - DNA, 23 bp, Homo sapiens
cagtctggtttatataaggcagt

SEQ ID NO: 6031575 - DNA, 18 bp, Homo sapiens
cagtctgtaaaatacatg

SEQ ID NO: 6031576 - DNA, 14 bp, Homo sapiens
cagtctgtagggag

SEQ ID NO: 6031577 - DNA, 15 bp, Homo sapiens
cagtctgtattttcc

SEQ ID NO: 6031578 - DNA, 21 bp, Homo sapiens
cagtctgtccacgtggagaga

SEQ ID NO: 6031579 - DNA, 16 bp, Homo sapiens
cagtctgtctactgtg

SEQ ID NO: 6031580 - DNA, 21 bp, Homo sapiens
cagtctgtcttctgtatataa

SEQ ID NO: 6031581 - DNA, 22 bp, Homo sapiens
cagtctgtggagcgtccttgtc

SEQ ID NO: 6031582 - DNA, 17 bp, Homo sapiens
cagtctgtgggagctca

SEQ ID NO: 6031583 - DNA, 18 bp, Homo sapiens
cagtctgtgggagctcag

SEQ ID NO: 6031584 - DNA, 19 bp, Homo sapiens
cagtctgtgggagctcagc

SEQ ID NO: 6031585 - DNA, 15 bp, Homo sapiens
cagtctgttatgcac

SEQ ID NO: 6031586 - DNA, 16 bp, Homo sapiens
cagtctgttcactgca

SEQ ID NO: 6031587 - DNA, 17 bp, Homo sapiens
cagtctgttcactgcat

SEQ ID NO: 6031588 - DNA, 15 bp, Homo sapiens
cagtctgttctcaca

SEQ ID NO: 6031589 - DNA, 18 bp, Homo sapiens
cagtctgttgctgctcca

SEQ ID NO: 6031590 - DNA, 17 bp, Homo sapiens
cagtcttaatactttat

SEQ ID NO: 6031591 - DNA, 11 bp, Homo sapiens
cagtcttccac

SEQ ID NO: 6031592 - DNA, 16 bp, Homo sapiens
cagtcttccacaaaga

SEQ ID NO: 6031593 - DNA, 18 bp, Homo sapiens
cagtcttccacctggaag

SEQ ID NO: 6031594 - DNA, 20 bp, Homo sapiens
cagtcttccctagggctggg

SEQ ID NO: 6031595 - DNA, 22 bp, Homo sapiens
cagtcttccctagggctgggtg

SEQ ID NO: 6031596 - DNA, 13 bp, Homo sapiens
cagtcttcctgac

SEQ ID NO: 6031597 - DNA, 17 bp, Homo sapiens
cagtcttcctgacactt

SEQ ID NO: 6031598 - DNA, 14 bp, Homo sapiens
cagtcttcctgccg

SEQ ID NO: 6031599 - DNA, 12 bp, Homo sapiens
cagtcttccttg

SEQ ID NO: 6031600 - DNA, 16 bp, Homo sapiens
cagtcttccttgtctc

SEQ ID NO: 6031601 - DNA, 17 bp, Homo sapiens
cagtcttccttgtctct

SEQ ID NO: 6031602 - DNA, 18 bp, Homo sapiens
cagtcttccttgtggaat

SEQ ID NO: 6031603 - DNA, 15 bp, Homo sapiens
cagtcttgaatttct

SEQ ID NO: 6031604 - DNA, 15 bp, Homo sapiens
cagtcttgagtgggc

SEQ ID NO: 6031605 - DNA, 18 bp, Homo sapiens
cagtcttgagtgggcccc

SEQ ID NO: 6031606 - DNA, 15 bp, Homo sapiens
cagtcttgcagcagg

SEQ ID NO: 6031607 - DNA, 15 bp, Homo sapiens
cagtcttgcctaggc

SEQ ID NO: 6031608 - DNA, 19 bp, Homo sapiens
ccaaatcaaaatctctcca

SEQ ID NO: 6031609 - DNA, 20 bp, Homo sapiens
ccaaatcaaaatctctccac

SEQ ID NO: 6031610 - DNA, 17 bp, Homo sapiens
ccaaatcacatctcacc

SEQ ID NO: 6031611 - DNA, 14 bp, Homo sapiens
ccaaatcacccaat

SEQ ID NO: 6031612 - DNA, 15 bp, Homo sapiens
ccaaatcacccaatc

SEQ ID NO: 6031613 - DNA, 16 bp, Homo sapiens
ccaaatcacccaatcc

SEQ ID NO: 6031614 - DNA, 23 bp, Homo sapiens
ccaaatcagctgctactactcct

SEQ ID NO: 6031615 - DNA, 18 bp, Homo sapiens
ccaaatcatactttttct

SEQ ID NO: 6031616 - DNA, 16 bp, Homo sapiens
ccaaatcatagtggct

SEQ ID NO: 6031617 - DNA, 19 bp, Homo sapiens
ccaaatcatcctgaatctg

SEQ ID NO: 6031618 - DNA, 17 bp, Homo sapiens
ccaaatccacaagccat

SEQ ID NO: 6031619 - DNA, 17 bp, Homo sapiens
ccaaatccatcctgctc

SEQ ID NO: 6031620 - DNA, 23 bp, Homo sapiens
ccaaatccgaacctcctctgtga

SEQ ID NO: 6031621 - DNA, 16 bp, Homo sapiens
ccaaatccgccagtgt

SEQ ID NO: 6031622 - DNA, 20 bp, Homo sapiens
ccaaatccgccagtgtttct

SEQ ID NO: 6031623 - DNA, 15 bp, Homo sapiens
ccaaatccgctctct

SEQ ID NO: 6031624 - DNA, 19 bp, Homo sapiens
ccaaatccgctctcttcct

SEQ ID NO: 6031625 - DNA, 13 bp, Homo sapiens
ccaaatcctctcc

SEQ ID NO: 6031626 - DNA, 21 bp, Homo sapiens
ccaaatccttagatctggcat

SEQ ID NO: 6031627 - DNA, 22 bp, Homo sapiens
ccaaatccttggagtcccaggg

SEQ ID NO: 6031628 - DNA, 19 bp, Homo sapiens
ccaaatctagaatttagtg

SEQ ID NO: 6031629 - DNA, 20 bp, Homo sapiens
ccaaatctagccagagccct

SEQ ID NO: 6031630 - DNA, 23 bp, Homo sapiens
ccaaatctagccagagcccttca

SEQ ID NO: 6031631 - DNA, 22 bp, Homo sapiens
ccaaatctcaatgaagccagct

SEQ ID NO: 6031632 - DNA, 15 bp, Homo sapiens
ccaaatctcagttgt

SEQ ID NO: 6031633 - DNA, 22 bp, Homo sapiens
ccaaatctcagttgtttgcttc

SEQ ID NO: 6031634 - DNA, 20 bp, Homo sapiens
ccaaatctgcctattgcagc

SEQ ID NO: 6031635 - DNA, 23 bp, Homo sapiens
ccaaatctgcctattgcagctgg

SEQ ID NO: 6031636 - DNA, 15 bp, Homo sapiens
ccaaatcttcctctg

SEQ ID NO: 6031637 - DNA, 16 bp, Homo sapiens
ccaaatgaaactcaaa

SEQ ID NO: 6031638 - DNA, 16 bp, Homo sapiens
ccaaatgaaatgccaa

SEQ ID NO: 6031639 - DNA, 18 bp, Homo sapiens
ccaaatgaccgagccctg

SEQ ID NO: 6031640 - DNA, 23 bp, Homo sapiens
ccaaatgaccgagccctggagag

SEQ ID NO: 6031641 - DNA, 15 bp, Homo sapiens
ccaaatgacttcatt

SEQ ID NO: 6031642 - DNA, 22 bp, Homo sapiens
ccaaatgagggtcttggttcca

SEQ ID NO: 6031643 - DNA, 19 bp, Homo sapiens
ccaaatgatagaactgtac

SEQ ID NO: 6031644 - DNA, 21 bp, Homo sapiens
ccaaatgcacaagctcagaat

SEQ ID NO: 6031645 - DNA, 12 bp, Homo sapiens
ccaaatgcagct

SEQ ID NO: 6031646 - DNA, 23 bp, Homo sapiens
ccaaatgcagggaggggaggcag

SEQ ID NO: 6031647 - DNA, 13 bp, Homo sapiens
ccaaatgcattca

SEQ ID NO: 6031648 - DNA, 13 bp, Homo sapiens
ccaaatgcccaag

SEQ ID NO: 6031649 - DNA, 14 bp, Homo sapiens
ccaaatgcccaagg

SEQ ID NO: 6031650 - DNA, 21 bp, Homo sapiens
ccaaatgcccaaggatgcctt

SEQ ID NO: 6031651 - DNA, 17 bp, Homo sapiens
ccaaatgcctctgcctt

SEQ ID NO: 6031652 - DNA, 16 bp, Homo sapiens
ccaaatgcctgttgta

SEQ ID NO: 6031653 - DNA, 21 bp, Homo sapiens
ccaaatgctctctcttcttat

SEQ ID NO: 6031654 - DNA, 20 bp, Homo sapiens
ccaaatggctgctttgacaa

SEQ ID NO: 6031655 - DNA, 23 bp, Homo sapiens
ccaaatggctgcttttgtctccc

SEQ ID NO: 6031656 - DNA, 19 bp, Homo sapiens
ccaaatggttaatccaact

SEQ ID NO: 6031657 - DNA, 14 bp, Homo sapiens
ccaaatgtaaaata

SEQ ID NO: 6031658 - DNA, 16 bp, Homo sapiens
ccaaatgtaaaatatt

SEQ ID NO: 6031659 - DNA, 19 bp, Homo sapiens
ccaaatgtaaaatatttat

SEQ ID NO: 6031660 - DNA, 12 bp, Homo sapiens
ccaaatgtattg

SEQ ID NO: 6031661 - DNA, 17 bp, Homo sapiens
ccaaatgtccaatataa

SEQ ID NO: 6031662 - DNA, 18 bp, Homo sapiens
ccaaatgtcctttctcag

SEQ ID NO: 6031663 - DNA, 14 bp, Homo sapiens
ccaaatgtgtcaga

SEQ ID NO: 6031664 - DNA, 21 bp, Homo sapiens
ccaaatgtgtcttgtattatc

SEQ ID NO: 6031665 - DNA, 18 bp, Homo sapiens
ccaaatgttcatcaatga

SEQ ID NO: 6031666 - DNA, 16 bp, Homo sapiens
ccaaatgttcatcctc

SEQ ID NO: 6031667 - DNA, 14 bp, Homo sapiens
ccaaatgtttattt

SEQ ID NO: 6031668 - DNA, 13 bp, Homo sapiens
ccaaattaaaaaa

SEQ ID NO: 6031669 - DNA, 15 bp, Homo sapiens
ccaaattaaaaaaga

SEQ ID NO: 6031670 - DNA, 12 bp, Homo sapiens
ccaaattaagag

SEQ ID NO: 6031671 - DNA, 21 bp, Homo sapiens
ccaaattacaagtattcagtt

SEQ ID NO: 6031672 - DNA, 23 bp, Homo sapiens
ccaaattacaagtattcagttcc

SEQ ID NO: 6031673 - DNA, 17 bp, Homo sapiens
ccaaattattaattgtc

SEQ ID NO: 6031674 - DNA, 18 bp, Homo sapiens
ccaaattattaattgtcc

SEQ ID NO: 6031675 - DNA, 20 bp, Homo sapiens
ccaaattattaattgtcctg

SEQ ID NO: 6031676 - DNA, 22 bp, Homo sapiens
ccaaattattaattgtcctgtg

SEQ ID NO: 6031677 - DNA, 23 bp, Homo sapiens
ccaaattattaattgtcctgtgt

SEQ ID NO: 6031678 - DNA, 14 bp, Homo sapiens
ccaaattatttgtg

SEQ ID NO: 6031679 - DNA, 17 bp, Homo sapiens
ccaaattatttgtgtaa

SEQ ID NO: 6031680 - DNA, 15 bp, Homo sapiens
ccaaattcagtttca

SEQ ID NO: 6031681 - DNA, 23 bp, Homo sapiens
ccaaattccttggcatgccttcc

SEQ ID NO: 6031682 - DNA, 20 bp, Homo sapiens
ccaaattctgtggctgccat

SEQ ID NO: 6031683 - DNA, 19 bp, Homo sapiens
ccaaattgagtttaacaat

SEQ ID NO: 6031684 - DNA, 23 bp, Homo sapiens
ccaaattgcactgaagtttttga

SEQ ID NO: 6031685 - DNA, 16 bp, Homo sapiens
ccaaattgcagaagaa

SEQ ID NO: 6031686 - DNA, 18 bp, Homo sapiens
ccaaattgccctgttgcc

SEQ ID NO: 6031687 - DNA, 13 bp, Homo sapiens
ccaaattgctgag

SEQ ID NO: 6031688 - DNA, 20 bp, Homo sapiens
ccaaattgctgggattacag

SEQ ID NO: 6031689 - DNA, 13 bp, Homo sapiens
ccaaattgggaga

SEQ ID NO: 6031690 - DNA, 17 bp, Homo sapiens
ccaaattgtgcttctcc

SEQ ID NO: 6031691 - DNA, 21 bp, Homo sapiens
ccaaattgtgcttctccccag

SEQ ID NO: 6031692 - DNA, 23 bp, Homo sapiens
ccaaattgtgcttctccccagaa

SEQ ID NO: 6031693 - DNA, 15 bp, Homo sapiens
ccaaattgtgtatat

SEQ ID NO: 6031694 - DNA, 19 bp, Homo sapiens
ccaaatttatatgccaccg

SEQ ID NO: 6031695 - DNA, 12 bp, Homo sapiens
ccaaatttatca

SEQ ID NO: 6031696 - DNA, 12 bp, Homo sapiens
ccaaatttcttt

SEQ ID NO: 6031697 - DNA, 13 bp, Homo sapiens
ccaaatttgagtt

SEQ ID NO: 6031698 - DNA, 20 bp, Homo sapiens
ccaaattttaatattccaga

SEQ ID NO: 6031699 - DNA, 23 bp, Homo sapiens
ccaaattttaatttttgctttta

SEQ ID NO: 6031700 - DNA, 19 bp, Homo sapiens
ccaaattttccttcctgtt

SEQ ID NO: 6031701 - DNA, 21 bp, Homo sapiens
ccaaattttccttcctgttct

SEQ ID NO: 6031702 - DNA, 13 bp, Homo sapiens
ccaacaaaccatc

SEQ ID NO: 6031703 - DNA, 16 bp, Homo sapiens
ccaacaaaccatccag

SEQ ID NO: 6031704 - DNA, 19 bp, Homo sapiens
ccaacaaagaacactaact

SEQ ID NO: 6031705 - DNA, 14 bp, Homo sapiens
ccaacaaagctgtt

SEQ ID NO: 6031706 - DNA, 21 bp, Homo sapiens
ccaacaaagggttttaatgta

SEQ ID NO: 6031707 - DNA, 17 bp, Homo sapiens
ccaacaacatccatgtc

SEQ ID NO: 6031708 - DNA, 17 bp, Homo sapiens
ccaacaactctgccttt

SEQ ID NO: 6031709 - DNA, 14 bp, Homo sapiens
ccaacaacttttcc

SEQ ID NO: 6031710 - DNA, 19 bp, Homo sapiens
ccaacaagaaccactcctt

SEQ ID NO: 6031711 - DNA, 14 bp, Homo sapiens
ccaacaagaagaaa

SEQ ID NO: 6031712 - DNA, 19 bp, Homo sapiens
ccaacaagaagaaatatga

SEQ ID NO: 6031713 - DNA, 22 bp, Homo sapiens
ccaacaagaagaaatatgaaat

SEQ ID NO: 6031714 - DNA, 21 bp, Homo sapiens
ccaacaagaagggactgagag

SEQ ID NO: 6031715 - DNA, 21 bp, Homo sapiens
ccaacaagaataaaggcagct

SEQ ID NO: 6031716 - DNA, 18 bp, Homo sapiens
ccaacaagaatgcattga

SEQ ID NO: 6031717 - DNA, 21 bp, Homo sapiens
ccaacaagattgcttaataaa

SEQ ID NO: 6031718 - DNA, 14 bp, Homo sapiens
ccaacaagggcagt

SEQ ID NO: 6031719 - DNA, 16 bp, Homo sapiens
ccaacaagggcagtgg

SEQ ID NO: 6031720 - DNA, 17 bp, Homo sapiens
ccaacaagggcagtgga

SEQ ID NO: 6031721 - DNA, 21 bp, Homo sapiens
ccaacaaggttggcaccccag

SEQ ID NO: 6031722 - DNA, 22 bp, Homo sapiens
ccaacaatactttgtgtctttt

SEQ ID NO: 6031723 - DNA, 21 bp, Homo sapiens
ccaacaatggggtgggcccat

SEQ ID NO: 6031724 - DNA, 23 bp, Homo sapiens
ccaacaattaggtctgcattttc

SEQ ID NO: 6031725 - DNA, 21 bp, Homo sapiens
ccaacacaatctttccttgtc

SEQ ID NO: 6031726 - DNA, 22 bp, Homo sapiens
ccaacacaatctttccttgtct

SEQ ID NO: 6031727 - DNA, 12 bp, Homo sapiens
ccaacacacagg

SEQ ID NO: 6031728 - DNA, 13 bp, Homo sapiens
ccaacacacagga

SEQ ID NO: 6031729 - DNA, 16 bp, Homo sapiens
ccaacaccaagcacag

SEQ ID NO: 6031730 - DNA, 17 bp, Homo sapiens
ccaacaccacagacaca

SEQ ID NO: 6031731 - DNA, 18 bp, Homo sapiens
ccaacaccaccccttgcc

SEQ ID NO: 6031732 - DNA, 16 bp, Homo sapiens
ccaacaccagcccctg

SEQ ID NO: 6031733 - DNA, 22 bp, Homo sapiens
ccaacaccagcccctgccccag

SEQ ID NO: 6031734 - DNA, 12 bp, Homo sapiens
ccaacaccaggg

SEQ ID NO: 6031735 - DNA, 22 bp, Homo sapiens
ccaacaccatcacagcttgttt

SEQ ID NO: 6031736 - DNA, 22 bp, Homo sapiens
ccaacacccaaagcatggacta

SEQ ID NO: 6031737 - DNA, 18 bp, Homo sapiens
ccaacacccatctgtttt

SEQ ID NO: 6031738 - DNA, 17 bp, Homo sapiens
ccaacaccccgcctgcc

SEQ ID NO: 6031739 - DNA, 19 bp, Homo sapiens
ccaacaccccgcctgcctc

SEQ ID NO: 6031740 - DNA, 21 bp, Homo sapiens
ccaacaccccgcctgcctcct

SEQ ID NO: 6031741 - DNA, 15 bp, Homo sapiens
ccaacacctgcctct

SEQ ID NO: 6031742 - DNA, 20 bp, Homo sapiens
ccaacacgcacctgcctcag

SEQ ID NO: 6031743 - DNA, 15 bp, Homo sapiens
ccaacacgcctggct

SEQ ID NO: 6031744 - DNA, 21 bp, Homo sapiens
ccaacactcaagaagcaggct

SEQ ID NO: 6031745 - DNA, 14 bp, Homo sapiens
ccaacactccaggc

SEQ ID NO: 6031746 - DNA, 21 bp, Homo sapiens
ccaacactccaggccctgccc

SEQ ID NO: 6031747 - DNA, 13 bp, Homo sapiens
ccaacactgagca

SEQ ID NO: 6031748 - DNA, 14 bp, Homo sapiens
ccaacactgccagc

SEQ ID NO: 6031749 - DNA, 16 bp, Homo sapiens
ccaacactgccagcat

SEQ ID NO: 6031750 - DNA, 19 bp, Homo sapiens
ccaacactgtgccctggtg

SEQ ID NO: 6031751 - DNA, 21 bp, Homo sapiens
ccaacacttgtgttgctttct

SEQ ID NO: 6031752 - DNA, 23 bp, Homo sapiens
ccaacacttgtgttgctttctga

SEQ ID NO: 6031753 - DNA, 16 bp, Homo sapiens
ccaacagaacccacag

SEQ ID NO: 6031754 - DNA, 19 bp, Homo sapiens
ccaacagaacccacagtag

SEQ ID NO: 6031755 - DNA, 22 bp, Homo sapiens
ccaacagaagcagacttttcag

SEQ ID NO: 6031756 - DNA, 18 bp, Homo sapiens
ccaacagaaggaaggagg

SEQ ID NO: 6031757 - DNA, 13 bp, Homo sapiens
ccaacagagtggt

SEQ ID NO: 6031758 - DNA, 17 bp, Homo sapiens
ccaacagcaaaggaact

SEQ ID NO: 6031759 - DNA, 20 bp, Homo sapiens
ccaacagcaagggagatttt

SEQ ID NO: 6031760 - DNA, 15 bp, Homo sapiens
ccaacagcacctccc

SEQ ID NO: 6031761 - DNA, 17 bp, Homo sapiens
ccaacagcattggcctg

SEQ ID NO: 6031762 - DNA, 15 bp, Homo sapiens
ccaacagcctctgtg

SEQ ID NO: 6031763 - DNA, 22 bp, Homo sapiens
ccaacagcgacatagcccatcc

SEQ ID NO: 6031764 - DNA, 23 bp, Homo sapiens
ccaacagctacaacagcctcact

SEQ ID NO: 6031765 - DNA, 18 bp, Homo sapiens
ccaacagctggaccctga

SEQ ID NO: 6031766 - DNA, 20 bp, Homo sapiens
ccaacagcttttcccaggag

SEQ ID NO: 6031767 - DNA, 15 bp, Homo sapiens
ccaacaggagctggg

SEQ ID NO: 6031768 - DNA, 18 bp, Homo sapiens
ccaacaggaggacaattc

SEQ ID NO: 6031769 - DNA, 22 bp, Homo sapiens
ccaacaggcacctctaatcaga

SEQ ID NO: 6031770 - DNA, 23 bp, Homo sapiens
ccaacaggtgctgaactgtgcat

SEQ ID NO: 6031771 - DNA, 19 bp, Homo sapiens
ccaacaggtggcaggacca

SEQ ID NO: 6031772 - DNA, 23 bp, Homo sapiens
ccaacaggtggcaggaccaggac

SEQ ID NO: 6031773 - DNA, 12 bp, Homo sapiens
ccaacagtgagt

SEQ ID NO: 6031774 - DNA, 12 bp, Homo sapiens
ccaacagtgtga

SEQ ID NO: 6031775 - DNA, 13 bp, Homo sapiens
ccaacagtgtgaa

SEQ ID NO: 6031776 - DNA, 21 bp, Homo sapiens
ccaacagtgttaggcctggca

SEQ ID NO: 6031777 - DNA, 20 bp, Homo sapiens
ccaacagttgtatgtttgct

SEQ ID NO: 6031778 - DNA, 13 bp, Homo sapiens
ccaacagtttatt

SEQ ID NO: 6031779 - DNA, 14 bp, Homo sapiens
ccaacataaaacaa

SEQ ID NO: 6031780 - DNA, 20 bp, Homo sapiens
ccaacatacccttctttaaa

SEQ ID NO: 6031781 - DNA, 14 bp, Homo sapiens
ccaacatactccca

SEQ ID NO: 6031782 - DNA, 17 bp, Homo sapiens
ccaacatatatttattg

SEQ ID NO: 6031783 - DNA, 13 bp, Homo sapiens
ccaacatcaacat

SEQ ID NO: 6031784 - DNA, 17 bp, Homo sapiens
cagtcttggtggttcta

SEQ ID NO: 6031785 - DNA, 13 bp, Homo sapiens
cagtcttgtgctt

SEQ ID NO: 6031786 - DNA, 15 bp, Homo sapiens
cagtctttcccccag

SEQ ID NO: 6031787 - DNA, 21 bp, Homo sapiens
cagtctttcttcactctggct

SEQ ID NO: 6031788 - DNA, 17 bp, Homo sapiens
cagtctttgatcatcat

SEQ ID NO: 6031789 - DNA, 15 bp, Homo sapiens
cagtctttgctcagt

SEQ ID NO: 6031790 - DNA, 20 bp, Homo sapiens
cagtctttgctcagtggatc

SEQ ID NO: 6031791 - DNA, 22 bp, Homo sapiens
cagtctttgggggattcaaatg

SEQ ID NO: 6031792 - DNA, 23 bp, Homo sapiens
cagtcttttctctgaaaagcaaa

SEQ ID NO: 6031793 - DNA, 14 bp, Homo sapiens
cagtcttttgctgt

SEQ ID NO: 6031794 - DNA, 19 bp, Homo sapiens
cagtctttttctgttgtaa

SEQ ID NO: 6031795 - DNA, 20 bp, Homo sapiens
cagtctttttctgttgtaac

SEQ ID NO: 6031796 - DNA, 17 bp, Homo sapiens
cagtgaaaaactattaa

SEQ ID NO: 6031797 - DNA, 18 bp, Homo sapiens
cagtgaaaaagatatttt

SEQ ID NO: 6031798 - DNA, 21 bp, Homo sapiens
cagtgaaaagattttatttat

SEQ ID NO: 6031799 - DNA, 22 bp, Homo sapiens
cagtgaaaataagccatgagaa

SEQ ID NO: 6031800 - DNA, 23 bp, Homo sapiens
cagtgaaaataagccatgagaat

SEQ ID NO: 6031801 - DNA, 13 bp, Homo sapiens
cagtgaaaatgaa

SEQ ID NO: 6031802 - DNA, 19 bp, Homo sapiens
cagtgaaaattgatgctaa

SEQ ID NO: 6031803 - DNA, 20 bp, Homo sapiens
cagtgaaagaaaataacaat

SEQ ID NO: 6031804 - DNA, 20 bp, Homo sapiens
cagtgaaagtcaattcagtg

SEQ ID NO: 6031805 - DNA, 17 bp, Homo sapiens
cagtgaaatacatcctt

SEQ ID NO: 6031806 - DNA, 20 bp, Homo sapiens
cagtgaaatcttttatgttt

SEQ ID NO: 6031807 - DNA, 16 bp, Homo sapiens
cagtgaaatgattact

SEQ ID NO: 6031808 - DNA, 14 bp, Homo sapiens
cagtgaaatgtgaa

SEQ ID NO: 6031809 - DNA, 13 bp, Homo sapiens
cagtgaaattttc

SEQ ID NO: 6031810 - DNA, 16 bp, Homo sapiens
cagtgaacaaatgtct

SEQ ID NO: 6031811 - DNA, 13 bp, Homo sapiens
cagtgaacacatt

SEQ ID NO: 6031812 - DNA, 16 bp, Homo sapiens
cagtgaacagtttgga

SEQ ID NO: 6031813 - DNA, 17 bp, Homo sapiens
cagtgaacataactgta

SEQ ID NO: 6031814 - DNA, 12 bp, Homo sapiens
cagtgaacattc

SEQ ID NO: 6031815 - DNA, 17 bp, Homo sapiens
cagtgaacattcccagc

SEQ ID NO: 6031816 - DNA, 23 bp, Homo sapiens
cagtgaacattcccagcccagcc

SEQ ID NO: 6031817 - DNA, 14 bp, Homo sapiens
cagtgaaccaaaga

SEQ ID NO: 6031818 - DNA, 22 bp, Homo sapiens
cagtgaactaagtccctataat

SEQ ID NO: 6031819 - DNA, 16 bp, Homo sapiens
cagtgaactcctgcca

SEQ ID NO: 6031820 - DNA, 17 bp, Homo sapiens
cagtgaactcctgccag

SEQ ID NO: 6031821 - DNA, 21 bp, Homo sapiens
cagtgaactcctgccaggcac

SEQ ID NO: 6031822 - DNA, 13 bp, Homo sapiens
cagtgaactcggc

SEQ ID NO: 6031823 - DNA, 18 bp, Homo sapiens
cagtgaactgagactgcg

SEQ ID NO: 6031824 - DNA, 20 bp, Homo sapiens
cagtgaacttacacttggag

SEQ ID NO: 6031825 - DNA, 23 bp, Homo sapiens
cagtgaacttacacttggagccc

SEQ ID NO: 6031826 - DNA, 15 bp, Homo sapiens
cagtgaacttgtctg

SEQ ID NO: 6031827 - DNA, 14 bp, Homo sapiens
cagtgaagaaagcc

SEQ ID NO: 6031828 - DNA, 19 bp, Homo sapiens
cagtgaagaaccctattta

SEQ ID NO: 6031829 - DNA, 15 bp, Homo sapiens
cagtgaagacagaag

SEQ ID NO: 6031830 - DNA, 21 bp, Homo sapiens
cagtgaagagccactgccatt

SEQ ID NO: 6031831 - DNA, 17 bp, Homo sapiens
cagtgaagatagaagaa

SEQ ID NO: 6031832 - DNA, 18 bp, Homo sapiens
cagtgaagcagcactgtg

SEQ ID NO: 6031833 - DNA, 16 bp, Homo sapiens
cagtgaagcccaggag

SEQ ID NO: 6031834 - DNA, 18 bp, Homo sapiens
cagtgaagggttttgtgt

SEQ ID NO: 6031835 - DNA, 22 bp, Homo sapiens
cagtgaaggtggggagaagctg

SEQ ID NO: 6031836 - DNA, 19 bp, Homo sapiens
cagtgaagtctagaatcat

SEQ ID NO: 6031837 - DNA, 19 bp, Homo sapiens
cagtgaagttgctgcttct

SEQ ID NO: 6031838 - DNA, 23 bp, Homo sapiens
cagtgaagttgctgcttctccca

SEQ ID NO: 6031839 - DNA, 15 bp, Homo sapiens
cagtgaatataaatg

SEQ ID NO: 6031840 - DNA, 17 bp, Homo sapiens
cagtgaatataaatgta

SEQ ID NO: 6031841 - DNA, 12 bp, Homo sapiens
cagtgaattgtc

SEQ ID NO: 6031842 - DNA, 18 bp, Homo sapiens
cagtgaatttaagcatga

SEQ ID NO: 6031843 - DNA, 20 bp, Homo sapiens
cagtgaatttgaataaatga

SEQ ID NO: 6031844 - DNA, 17 bp, Homo sapiens
cagtgaatttgtccatt

SEQ ID NO: 6031845 - DNA, 16 bp, Homo sapiens
cagtgaatttttgcaa

SEQ ID NO: 6031846 - DNA, 22 bp, Homo sapiens
cagtgacaaaatgggaggagga

SEQ ID NO: 6031847 - DNA, 16 bp, Homo sapiens
cagtgacaagtggagg

SEQ ID NO: 6031848 - DNA, 17 bp, Homo sapiens
cagtgacaagtggaggg

SEQ ID NO: 6031849 - DNA, 20 bp, Homo sapiens
cagtgacaagtggagggggt

SEQ ID NO: 6031850 - DNA, 21 bp, Homo sapiens
cagtgacacaatctcagctca

SEQ ID NO: 6031851 - DNA, 14 bp, Homo sapiens
cagtgacacccaga

SEQ ID NO: 6031852 - DNA, 17 bp, Homo sapiens
cagtgacactggaccag

SEQ ID NO: 6031853 - DNA, 21 bp, Homo sapiens
cagtgacactggaccaggtcc

SEQ ID NO: 6031854 - DNA, 17 bp, Homo sapiens
cagtgacacttcagaga

SEQ ID NO: 6031855 - DNA, 18 bp, Homo sapiens
cagtgacacttcagagag

SEQ ID NO: 6031856 - DNA, 22 bp, Homo sapiens
cagtgacacttcagagagctgg

SEQ ID NO: 6031857 - DNA, 16 bp, Homo sapiens
cagtgacagacaggct

SEQ ID NO: 6031858 - DNA, 17 bp, Homo sapiens
cagtgacagacaggctc

SEQ ID NO: 6031859 - DNA, 18 bp, Homo sapiens
cagtgacagacaggctct

SEQ ID NO: 6031860 - DNA, 12 bp, Homo sapiens
cagtgacagcta

SEQ ID NO: 6031861 - DNA, 20 bp, Homo sapiens
cagtgacatgattctgaact

SEQ ID NO: 6031862 - DNA, 15 bp, Homo sapiens
cagtgaccaagggaa

SEQ ID NO: 6031863 - DNA, 13 bp, Homo sapiens
cagtgaccccaga

SEQ ID NO: 6031864 - DNA, 15 bp, Homo sapiens
cagtgaccctggagc

SEQ ID NO: 6031865 - DNA, 17 bp, Homo sapiens
cagtgaccctggagcta

SEQ ID NO: 6031866 - DNA, 19 bp, Homo sapiens
cagtgaccctggagctagg

SEQ ID NO: 6031867 - DNA, 13 bp, Homo sapiens
cagtgaccctggc

SEQ ID NO: 6031868 - DNA, 17 bp, Homo sapiens
cagtgaccctggctcct

SEQ ID NO: 6031869 - DNA, 20 bp, Homo sapiens
cagtgacctgaccggcacct

SEQ ID NO: 6031870 - DNA, 19 bp, Homo sapiens
cagtgacctgaggaagcgt

SEQ ID NO: 6031871 - DNA, 23 bp, Homo sapiens
cagtgacctgccctacatatcta

SEQ ID NO: 6031872 - DNA, 20 bp, Homo sapiens
cagtgacctggaaggcccag

SEQ ID NO: 6031873 - DNA, 23 bp, Homo sapiens
cagtgacctggaaggcccagcac

SEQ ID NO: 6031874 - DNA, 19 bp, Homo sapiens
cagtgacctttgacctcgg

SEQ ID NO: 6031875 - DNA, 16 bp, Homo sapiens
cagtgacgaggaactc

SEQ ID NO: 6031876 - DNA, 19 bp, Homo sapiens
cagtgacgtgactcagagc

SEQ ID NO: 6031877 - DNA, 21 bp, Homo sapiens
cagtgacgtgactcagagctt

SEQ ID NO: 6031878 - DNA, 17 bp, Homo sapiens
cagtgacgtgcacctgt

SEQ ID NO: 6031879 - DNA, 18 bp, Homo sapiens
cagtgacgtgcacctgta

SEQ ID NO: 6031880 - DNA, 15 bp, Homo sapiens
cagtgactccaggag

SEQ ID NO: 6031881 - DNA, 18 bp, Homo sapiens
cagtgactccctgggagc

SEQ ID NO: 6031882 - DNA, 15 bp, Homo sapiens
cagtgactcctgctg

SEQ ID NO: 6031883 - DNA, 16 bp, Homo sapiens
cagtgactcctgctgg

SEQ ID NO: 6031884 - DNA, 19 bp, Homo sapiens
cagtgactcgggctcctgt

SEQ ID NO: 6031885 - DNA, 21 bp, Homo sapiens
cagtgactcgggctcctgtgc

SEQ ID NO: 6031886 - DNA, 14 bp, Homo sapiens
cagtgactgaaacc

SEQ ID NO: 6031887 - DNA, 18 bp, Homo sapiens
cagtgactgctgcgctgt

SEQ ID NO: 6031888 - DNA, 16 bp, Homo sapiens
cagtgactgtggatac

SEQ ID NO: 6031889 - DNA, 14 bp, Homo sapiens
cagtgacttaggag

SEQ ID NO: 6031890 - DNA, 13 bp, Homo sapiens
cagtgacttctga

SEQ ID NO: 6031891 - DNA, 17 bp, Homo sapiens
cagtgacttctgagatc

SEQ ID NO: 6031892 - DNA, 23 bp, Homo sapiens
cagtgacttcttccctaaaatgt

SEQ ID NO: 6031893 - DNA, 22 bp, Homo sapiens
cagtgacttggccccagacgca

SEQ ID NO: 6031894 - DNA, 15 bp, Homo sapiens
cagtgacttgttctg

SEQ ID NO: 6031895 - DNA, 11 bp, Homo sapiens
cagtgactttg

SEQ ID NO: 6031896 - DNA, 15 bp, Homo sapiens
cagtgactttgtata

SEQ ID NO: 6031897 - DNA, 19 bp, Homo sapiens
cagtgagaaaaagctcctg

SEQ ID NO: 6031898 - DNA, 22 bp, Homo sapiens
cagtgagaaattacaggttcct

SEQ ID NO: 6031899 - DNA, 22 bp, Homo sapiens
cagtgagaactctctccctggt

SEQ ID NO: 6031900 - DNA, 19 bp, Homo sapiens
cagtgagaagctgaggcct

SEQ ID NO: 6031901 - DNA, 21 bp, Homo sapiens
cagtgagaagctgaggcctat

SEQ ID NO: 6031902 - DNA, 13 bp, Homo sapiens
cagtgagacacag

SEQ ID NO: 6031903 - DNA, 13 bp, Homo sapiens
cagtgagacagac

SEQ ID NO: 6031904 - DNA, 13 bp, Homo sapiens
cagtgagacagcc

SEQ ID NO: 6031905 - DNA, 23 bp, Homo sapiens
cagtgagacagccggatcttgga

SEQ ID NO: 6031906 - DNA, 15 bp, Homo sapiens
cagtgagacagctct

SEQ ID NO: 6031907 - DNA, 16 bp, Homo sapiens
cagtgagacagtctgg

SEQ ID NO: 6031908 - DNA, 18 bp, Homo sapiens
cagtgagacagtctggaa

SEQ ID NO: 6031909 - DNA, 15 bp, Homo sapiens
cagtgagactgtaca

SEQ ID NO: 6031910 - DNA, 16 bp, Homo sapiens
cagtgagactgtacat

SEQ ID NO: 6031911 - DNA, 23 bp, Homo sapiens
cagtgagagacgccctatttcta

SEQ ID NO: 6031912 - DNA, 21 bp, Homo sapiens
cagtgagagagtggctggggc

SEQ ID NO: 6031913 - DNA, 22 bp, Homo sapiens
cagtgagagagtggctggggca

SEQ ID NO: 6031914 - DNA, 15 bp, Homo sapiens
cagtgagagcagatg

SEQ ID NO: 6031915 - DNA, 21 bp, Homo sapiens
cagtgagaggggagggctcct

SEQ ID NO: 6031916 - DNA, 15 bp, Homo sapiens
cagtgagagtgaggc

SEQ ID NO: 6031917 - DNA, 19 bp, Homo sapiens
cagtgagagtgaggccccc

SEQ ID NO: 6031918 - DNA, 16 bp, Homo sapiens
cagtgagatcaatgtg

SEQ ID NO: 6031919 - DNA, 17 bp, Homo sapiens
cagtgagatgacattgc

SEQ ID NO: 6031920 - DNA, 19 bp, Homo sapiens
cagtgagattacagaggaa

SEQ ID NO: 6031921 - DNA, 12 bp, Homo sapiens
cagtgagcactg

SEQ ID NO: 6031922 - DNA, 14 bp, Homo sapiens
cagtgagcagtgtt

SEQ ID NO: 6031923 - DNA, 18 bp, Homo sapiens
cagtgagccagaaattga

SEQ ID NO: 6031924 - DNA, 19 bp, Homo sapiens
cagtgagcccctccccagc

SEQ ID NO: 6031925 - DNA, 22 bp, Homo sapiens
cagtgagcccctccccagccag

SEQ ID NO: 6031926 - DNA, 15 bp, Homo sapiens
cagtgagccctgctc

SEQ ID NO: 6031927 - DNA, 17 bp, Homo sapiens
cagtgagccgagatggc

SEQ ID NO: 6031928 - DNA, 19 bp, Homo sapiens
cagtgagcctcctgtgcct

SEQ ID NO: 6031929 - DNA, 20 bp, Homo sapiens
cagtgagcctcctgtgcctg

SEQ ID NO: 6031930 - DNA, 12 bp, Homo sapiens
cagtgagcctct

SEQ ID NO: 6031931 - DNA, 20 bp, Homo sapiens
cagtgagcctctgcgcctct

SEQ ID NO: 6031932 - DNA, 23 bp, Homo sapiens
cagtgagcctctgcgcctctcca

SEQ ID NO: 6031933 - DNA, 16 bp, Homo sapiens
cagtgagcgcttgggc

SEQ ID NO: 6031934 - DNA, 20 bp, Homo sapiens
cagtgagctatgagcccagc

SEQ ID NO: 6031935 - DNA, 14 bp, Homo sapiens
cagtgagctcagga

SEQ ID NO: 6031936 - DNA, 12 bp, Homo sapiens
cagtgagctcta

SEQ ID NO: 6031937 - DNA, 16 bp, Homo sapiens
cagtgagctctagcaa

SEQ ID NO: 6031938 - DNA, 18 bp, Homo sapiens
cagtgagctgagatcaca

SEQ ID NO: 6031939 - DNA, 22 bp, Homo sapiens
cagtgagcttggaaaggaccag

SEQ ID NO: 6031940 - DNA, 20 bp, Homo sapiens
cagtgaggactcggccactg

SEQ ID NO: 6031941 - DNA, 15 bp, Homo sapiens
cagtgaggagggatg

SEQ ID NO: 6031942 - DNA, 19 bp, Homo sapiens
cagtgaggagggatgtggg

SEQ ID NO: 6031943 - DNA, 15 bp, Homo sapiens
cagtgaggagggtgg

SEQ ID NO: 6031944 - DNA, 19 bp, Homo sapiens
cagtgaggcatctctctgg

SEQ ID NO: 6031945 - DNA, 17 bp, Homo sapiens
cagtgaggcccagggag

SEQ ID NO: 6031946 - DNA, 21 bp, Homo sapiens
cagtgaggcccagggagaggc

SEQ ID NO: 6031947 - DNA, 19 bp, Homo sapiens
cagtgaggcggattgagaa

SEQ ID NO: 6031948 - DNA, 13 bp, Homo sapiens
cagtgaggctctg

SEQ ID NO: 6031949 - DNA, 15 bp, Homo sapiens
cagtgaggctctgcc

SEQ ID NO: 6031950 - DNA, 18 bp, Homo sapiens
cagtgaggctctgccctt

SEQ ID NO: 6031951 - DNA, 20 bp, Homo sapiens
cagtgaggctctgcccttgg

SEQ ID NO: 6031952 - DNA, 14 bp, Homo sapiens
cagtgaggctggga

SEQ ID NO: 6031953 - DNA, 15 bp, Homo sapiens
cagtgagggctgggc

SEQ ID NO: 6031954 - DNA, 16 bp, Homo sapiens
cagtgaggggagatgc

SEQ ID NO: 6031955 - DNA, 23 bp, Homo sapiens
cagtgaggggtatatctgggctg

SEQ ID NO: 6031956 - DNA, 22 bp, Homo sapiens
cagtgaggtatgatgtgctgct

SEQ ID NO: 6031957 - DNA, 23 bp, Homo sapiens
cagtgaggtatgatgtgctgctg

SEQ ID NO: 6031958 - DNA, 20 bp, Homo sapiens
cagtgagtaatcaatacaga

SEQ ID NO: 6031959 - DNA, 18 bp, Homo sapiens
cagtgagtcagaggcaga

SEQ ID NO: 6031960 - DNA, 18 bp, Homo sapiens
cagtgagtctctggggca

SEQ ID NO: 6031961 - DNA, 12 bp, Homo sapiens
ccaacatccaga

SEQ ID NO: 6031962 - DNA, 17 bp, Homo sapiens
ccaacatcccattgccc

SEQ ID NO: 6031963 - DNA, 16 bp, Homo sapiens
ccaacatctccctccc

SEQ ID NO: 6031964 - DNA, 12 bp, Homo sapiens
ccaacatctttg

SEQ ID NO: 6031965 - DNA, 16 bp, Homo sapiens
ccaacatgaggacaga

SEQ ID NO: 6031966 - DNA, 16 bp, Homo sapiens
ccaacatgatccccgt

SEQ ID NO: 6031967 - DNA, 23 bp, Homo sapiens
ccaacatgatccccgtctctgcc

SEQ ID NO: 6031968 - DNA, 21 bp, Homo sapiens
ccaacatgcactgatgttgtg

SEQ ID NO: 6031969 - DNA, 17 bp, Homo sapiens
ccaacatgggagggatc

SEQ ID NO: 6031970 - DNA, 13 bp, Homo sapiens
ccaacatggtcct

SEQ ID NO: 6031971 - DNA, 15 bp, Homo sapiens
ccaacatggtgaaac

SEQ ID NO: 6031972 - DNA, 22 bp, Homo sapiens
ccaacatgtggctcctcccagc

SEQ ID NO: 6031973 - DNA, 22 bp, Homo sapiens
ccaacattaaaactcataatta

SEQ ID NO: 6031974 - DNA, 19 bp, Homo sapiens
ccaacattgccttgcattt

SEQ ID NO: 6031975 - DNA, 17 bp, Homo sapiens
ccaacatttaatgagca

SEQ ID NO: 6031976 - DNA, 15 bp, Homo sapiens
ccaacatttcctcag

SEQ ID NO: 6031977 - DNA, 18 bp, Homo sapiens
ccaacattttaaaaataa

SEQ ID NO: 6031978 - DNA, 15 bp, Homo sapiens
ccaaccaaccagcag

SEQ ID NO: 6031979 - DNA, 15 bp, Homo sapiens
ccaaccaactttccc

SEQ ID NO: 6031980 - DNA, 18 bp, Homo sapiens
ccaaccaactttcccccc

SEQ ID NO: 6031981 - DNA, 18 bp, Homo sapiens
ccaaccaatgcacacagt

SEQ ID NO: 6031982 - DNA, 21 bp, Homo sapiens
ccaaccacacttgtcggctcc

SEQ ID NO: 6031983 - DNA, 13 bp, Homo sapiens
ccaaccacagaga

SEQ ID NO: 6031984 - DNA, 19 bp, Homo sapiens
ccaaccacctctggccctg

SEQ ID NO: 6031985 - DNA, 16 bp, Homo sapiens
ccaaccactgtgccac

SEQ ID NO: 6031986 - DNA, 17 bp, Homo sapiens
ccaaccactgtgccact

SEQ ID NO: 6031987 - DNA, 21 bp, Homo sapiens
ccaaccactgtgccactgact

SEQ ID NO: 6031988 - DNA, 15 bp, Homo sapiens
ccaaccagacagcac

SEQ ID NO: 6031989 - DNA, 21 bp, Homo sapiens
ccaaccagacagcacagggca

SEQ ID NO: 6031990 - DNA, 15 bp, Homo sapiens
ccaaccaggacccag

SEQ ID NO: 6031991 - DNA, 18 bp, Homo sapiens
ccaaccaggacccagggt

SEQ ID NO: 6031992 - DNA, 12 bp, Homo sapiens
ccaaccaggcag

SEQ ID NO: 6031993 - DNA, 20 bp, Homo sapiens
ccaaccaggccttcatcctc

SEQ ID NO: 6031994 - DNA, 22 bp, Homo sapiens
ccaaccaggccttcatcctcct

SEQ ID NO: 6031995 - DNA, 20 bp, Homo sapiens
ccaaccaggttgcagtagca

SEQ ID NO: 6031996 - DNA, 16 bp, Homo sapiens
ccaaccatcttcactg

SEQ ID NO: 6031997 - DNA, 17 bp, Homo sapiens
ccaacccaaacctggag

SEQ ID NO: 6031998 - DNA, 21 bp, Homo sapiens
ccaacccaactgacttctgct

SEQ ID NO: 6031999 - DNA, 16 bp, Homo sapiens
ccaacccaatccctct

SEQ ID NO: 6032000 - DNA, 18 bp, Homo sapiens
ccaacccaatccctctcc

SEQ ID NO: 6032001 - DNA, 14 bp, Homo sapiens
ccaacccacagcct

SEQ ID NO: 6032002 - DNA, 13 bp, Homo sapiens
ccaacccacctct

SEQ ID NO: 6032003 - DNA, 14 bp, Homo sapiens
ccaacccagccacg

SEQ ID NO: 6032004 - DNA, 12 bp, Homo sapiens
ccaacccagccg

SEQ ID NO: 6032005 - DNA, 21 bp, Homo sapiens
ccaacccagccgctgcccggc

SEQ ID NO: 6032006 - DNA, 15 bp, Homo sapiens
ccaacccagcctgag

SEQ ID NO: 6032007 - DNA, 12 bp, Homo sapiens
ccaacccaggaa

SEQ ID NO: 6032008 - DNA, 18 bp, Homo sapiens
ccaacccatgcatggcct

SEQ ID NO: 6032009 - DNA, 23 bp, Homo sapiens
ccaacccatgcatggcctcccag

SEQ ID NO: 6032010 - DNA, 17 bp, Homo sapiens
ccaacccatgcccctga

SEQ ID NO: 6032011 - DNA, 14 bp, Homo sapiens
ccaaccccaactcc

SEQ ID NO: 6032012 - DNA, 19 bp, Homo sapiens
ccaaccccaagaccaagct

SEQ ID NO: 6032013 - DNA, 15 bp, Homo sapiens
ccaaccccagacccc

SEQ ID NO: 6032014 - DNA, 23 bp, Homo sapiens
ccaaccccagcatcagcctgtag

SEQ ID NO: 6032015 - DNA, 12 bp, Homo sapiens
ccaaccccagct

SEQ ID NO: 6032016 - DNA, 18 bp, Homo sapiens
ccaaccccagctggcctc

SEQ ID NO: 6032017 - DNA, 19 bp, Homo sapiens
ccaaccccagctggcctct

SEQ ID NO: 6032018 - DNA, 17 bp, Homo sapiens
ccaacccccaccccaca

SEQ ID NO: 6032019 - DNA, 17 bp, Homo sapiens
ccaacccccacctcccg

SEQ ID NO: 6032020 - DNA, 13 bp, Homo sapiens
ccaacccccagag

SEQ ID NO: 6032021 - DNA, 14 bp, Homo sapiens
ccaacccccagagg

SEQ ID NO: 6032022 - DNA, 21 bp, Homo sapiens
ccaacccccagaggtggccct

SEQ ID NO: 6032023 - DNA, 14 bp, Homo sapiens
ccaacccccagcac

SEQ ID NO: 6032024 - DNA, 21 bp, Homo sapiens
ccaacccccagcacccgggct

SEQ ID NO: 6032025 - DNA, 19 bp, Homo sapiens
ccaacccccattctcatct

SEQ ID NO: 6032026 - DNA, 15 bp, Homo sapiens
ccaaccccccagcac

SEQ ID NO: 6032027 - DNA, 17 bp, Homo sapiens
ccaaccccccagcactg

SEQ ID NO: 6032028 - DNA, 20 bp, Homo sapiens
ccaaccccccagcactgagg

SEQ ID NO: 6032029 - DNA, 15 bp, Homo sapiens
ccaacccccctcctg

SEQ ID NO: 6032030 - DNA, 21 bp, Homo sapiens
ccaacccccctcctgctcctc

SEQ ID NO: 6032031 - DNA, 23 bp, Homo sapiens
ccaacccccctcctgctcctccc

SEQ ID NO: 6032032 - DNA, 20 bp, Homo sapiens
ccaacccccgccacctcagg

SEQ ID NO: 6032033 - DNA, 23 bp, Homo sapiens
ccaaccccctgtaaggttccatc

SEQ ID NO: 6032034 - DNA, 18 bp, Homo sapiens
ccaaccccgcggcccaga

SEQ ID NO: 6032035 - DNA, 17 bp, Homo sapiens
ccaaccccggaaaacat

SEQ ID NO: 6032036 - DNA, 15 bp, Homo sapiens
ccaaccccggggcat

SEQ ID NO: 6032037 - DNA, 19 bp, Homo sapiens
ccaacccctcctccctcag

SEQ ID NO: 6032038 - DNA, 21 bp, Homo sapiens
ccaacccctcctccctcagac

SEQ ID NO: 6032039 - DNA, 16 bp, Homo sapiens
ccaacccctccttccc

SEQ ID NO: 6032040 - DNA, 17 bp, Homo sapiens
ccaacccctcgcccagt

SEQ ID NO: 6032041 - DNA, 22 bp, Homo sapiens
ccaacccctcgcccagtcccag

SEQ ID NO: 6032042 - DNA, 16 bp, Homo sapiens
ccaacccctctccagg

SEQ ID NO: 6032043 - DNA, 21 bp, Homo sapiens
ccaacccctctccaggcctgt

SEQ ID NO: 6032044 - DNA, 21 bp, Homo sapiens
ccaacccctgacctaccccag

SEQ ID NO: 6032045 - DNA, 15 bp, Homo sapiens
ccaacccctgtggag

SEQ ID NO: 6032046 - DNA, 17 bp, Homo sapiens
ccaacccgaggcccgca

SEQ ID NO: 6032047 - DNA, 22 bp, Homo sapiens
ccaacccgtctggcccaccagg

SEQ ID NO: 6032048 - DNA, 20 bp, Homo sapiens
ccaacccgttgggtcccttg

SEQ ID NO: 6032049 - DNA, 22 bp, Homo sapiens
ccaaccctaggttccctgttct

SEQ ID NO: 6032050 - DNA, 19 bp, Homo sapiens
ccaaccctatctcctgaca

SEQ ID NO: 6032051 - DNA, 14 bp, Homo sapiens
ccaaccctcagggc

SEQ ID NO: 6032052 - DNA, 14 bp, Homo sapiens
ccaaccctcccggg

SEQ ID NO: 6032053 - DNA, 15 bp, Homo sapiens
ccaaccctcggagcc

SEQ ID NO: 6032054 - DNA, 21 bp, Homo sapiens
ccaaccctcggagccccccac

SEQ ID NO: 6032055 - DNA, 22 bp, Homo sapiens
ccaaccctcggagccccccact

SEQ ID NO: 6032056 - DNA, 21 bp, Homo sapiens
ccaaccctgccgtcaccacca

SEQ ID NO: 6032057 - DNA, 18 bp, Homo sapiens
ccaaccctgcctgccgct

SEQ ID NO: 6032058 - DNA, 12 bp, Homo sapiens
ccaaccctggga

SEQ ID NO: 6032059 - DNA, 17 bp, Homo sapiens
ccaaccctggggaagga

SEQ ID NO: 6032060 - DNA, 20 bp, Homo sapiens
ccaaccctggggaaggagcc

SEQ ID NO: 6032061 - DNA, 16 bp, Homo sapiens
ccaaccctgtcctccc

SEQ ID NO: 6032062 - DNA, 12 bp, Homo sapiens
ccaaccctgtct

SEQ ID NO: 6032063 - DNA, 18 bp, Homo sapiens
ccaaccctgtttcctgag

SEQ ID NO: 6032064 - DNA, 14 bp, Homo sapiens
ccaacccttcttca

SEQ ID NO: 6032065 - DNA, 17 bp, Homo sapiens
ccaacctaacctgtgtc

SEQ ID NO: 6032066 - DNA, 19 bp, Homo sapiens
ccaacctcaatgccctgcc

SEQ ID NO: 6032067 - DNA, 22 bp, Homo sapiens
ccaacctcaatgccctgccatt

SEQ ID NO: 6032068 - DNA, 16 bp, Homo sapiens
ccaacctcaggctcct

SEQ ID NO: 6032069 - DNA, 17 bp, Homo sapiens
ccaacctcaggctccta

SEQ ID NO: 6032070 - DNA, 14 bp, Homo sapiens
ccaacctccagact

SEQ ID NO: 6032071 - DNA, 12 bp, Homo sapiens
ccaacctccagt

SEQ ID NO: 6032072 - DNA, 23 bp, Homo sapiens
ccaacctccagtgtcagggtcca

SEQ ID NO: 6032073 - DNA, 24 bp, Homo sapiens
ccaacctcccctggtcctgcactg

SEQ ID NO: 6032074 - DNA, 12 bp, Homo sapiens
ccaacctcctgc

SEQ ID NO: 6032075 - DNA, 18 bp, Homo sapiens
ccaacctcgccctctctc

SEQ ID NO: 6032076 - DNA, 16 bp, Homo sapiens
ccaacctctcggcccc

SEQ ID NO: 6032077 - DNA, 17 bp, Homo sapiens
ccaacctctcggcccca

SEQ ID NO: 6032078 - DNA, 13 bp, Homo sapiens
ccaacctctggag

SEQ ID NO: 6032079 - DNA, 18 bp, Homo sapiens
ccaacctctttttcctcc

SEQ ID NO: 6032080 - DNA, 20 bp, Homo sapiens
ccaacctgaaggtcccctgg

SEQ ID NO: 6032081 - DNA, 23 bp, Homo sapiens
ccaacctgaaggtcccctggcag

SEQ ID NO: 6032082 - DNA, 12 bp, Homo sapiens
ccaacctgacca

SEQ ID NO: 6032083 - DNA, 22 bp, Homo sapiens
ccaacctgaccaacatggagaa

SEQ ID NO: 6032084 - DNA, 19 bp, Homo sapiens
ccaacctgcaaagatctgt

SEQ ID NO: 6032085 - DNA, 15 bp, Homo sapiens
ccaacctgctctcct

SEQ ID NO: 6032086 - DNA, 16 bp, Homo sapiens
ccaacctgctctcctc

SEQ ID NO: 6032087 - DNA, 20 bp, Homo sapiens
ccaacctgctctcctcttct

SEQ ID NO: 6032088 - DNA, 19 bp, Homo sapiens
ccaacctggacttcctgtc

SEQ ID NO: 6032089 - DNA, 18 bp, Homo sapiens
ccaacctggctccctccc

SEQ ID NO: 6032090 - DNA, 20 bp, Homo sapiens
ccaacctgtggcgctgcagc

SEQ ID NO: 6032091 - DNA, 21 bp, Homo sapiens
ccaacctgttcttagagtgta

SEQ ID NO: 6032092 - DNA, 22 bp, Homo sapiens
ccaacctgtttctacctatatg

SEQ ID NO: 6032093 - DNA, 19 bp, Homo sapiens
ccaacctttccctcacccc

SEQ ID NO: 6032094 - DNA, 22 bp, Homo sapiens
ccaacctttctgacatcagcac

SEQ ID NO: 6032095 - DNA, 14 bp, Homo sapiens
ccaacgaaaagcac

SEQ ID NO: 6032096 - DNA, 20 bp, Homo sapiens
ccaacgaagccggacacggc

SEQ ID NO: 6032097 - DNA, 21 bp, Homo sapiens
ccaacgagcctcctcaggggg

SEQ ID NO: 6032098 - DNA, 12 bp, Homo sapiens
ccaacgcccctg

SEQ ID NO: 6032099 - DNA, 14 bp, Homo sapiens
ccaacgcccctgtg

SEQ ID NO: 6032100 - DNA, 15 bp, Homo sapiens
ccaacgcccctgtgg

SEQ ID NO: 6032101 - DNA, 19 bp, Homo sapiens
ccaacgcccctgtggccaa

SEQ ID NO: 6032102 - DNA, 21 bp, Homo sapiens
ccaacggagagcgcctgcccc

SEQ ID NO: 6032103 - DNA, 15 bp, Homo sapiens
ccaacggccccagct

SEQ ID NO: 6032104 - DNA, 20 bp, Homo sapiens
ccaacggccctgcagccagc

SEQ ID NO: 6032105 - DNA, 16 bp, Homo sapiens
ccaacggggtggggag

SEQ ID NO: 6032106 - DNA, 19 bp, Homo sapiens
ccaacggggtggggagggt

SEQ ID NO: 6032107 - DNA, 21 bp, Homo sapiens
ccaacgggtctgtgggactgg

SEQ ID NO: 6032108 - DNA, 20 bp, Homo sapiens
ccaacgtggggcagcacaga

SEQ ID NO: 6032109 - DNA, 19 bp, Homo sapiens
ccaactaaataaaaaattc

SEQ ID NO: 6032110 - DNA, 15 bp, Homo sapiens
ccaactaagccctcg

SEQ ID NO: 6032111 - DNA, 17 bp, Homo sapiens
ccaactactaaactggg

SEQ ID NO: 6032112 - DNA, 14 bp, Homo sapiens
ccaactactaatag

SEQ ID NO: 6032113 - DNA, 22 bp, Homo sapiens
ccaactactaatagaataaagg

SEQ ID NO: 6032114 - DNA, 16 bp, Homo sapiens
ccaactagacattctg

SEQ ID NO: 6032115 - DNA, 17 bp, Homo sapiens
ccaactagacattctgt

SEQ ID NO: 6032116 - DNA, 18 bp, Homo sapiens
ccaactagacattctgtc

SEQ ID NO: 6032117 - DNA, 17 bp, Homo sapiens
ccaactagctgggacta

SEQ ID NO: 6032118 - DNA, 23 bp, Homo sapiens
ccaactataaaactaggtgctgc

SEQ ID NO: 6032119 - DNA, 17 bp, Homo sapiens
ccaactattaaagtgcc

SEQ ID NO: 6032120 - DNA, 13 bp, Homo sapiens
ccaactcacccca

SEQ ID NO: 6032121 - DNA, 14 bp, Homo sapiens
ccaactcaccccag

SEQ ID NO: 6032122 - DNA, 16 bp, Homo sapiens
ccaactcacccttggc

SEQ ID NO: 6032123 - DNA, 14 bp, Homo sapiens
ccaactcacctgag

SEQ ID NO: 6032124 - DNA, 19 bp, Homo sapiens
ccaactcagagcacagcca

SEQ ID NO: 6032125 - DNA, 16 bp, Homo sapiens
ccaactcagcctgttc

SEQ ID NO: 6032126 - DNA, 22 bp, Homo sapiens
ccaactccaaacaattctgatg

SEQ ID NO: 6032127 - DNA, 17 bp, Homo sapiens
ccaactccacagggctg

SEQ ID NO: 6032128 - DNA, 21 bp, Homo sapiens
ccaactccagaaagtgacaag

SEQ ID NO: 6032129 - DNA, 19 bp, Homo sapiens
ccaactccagctgagtcct

SEQ ID NO: 6032130 - DNA, 20 bp, Homo sapiens
ccaactccagctgagtcctg

SEQ ID NO: 6032131 - DNA, 23 bp, Homo sapiens
ccaactccagctgagtcctgggg

SEQ ID NO: 6032132 - DNA, 12 bp, Homo sapiens
ccaactccaggg

SEQ ID NO: 6032133 - DNA, 20 bp, Homo sapiens
ccaactccagtactggagct

SEQ ID NO: 6032134 - DNA, 21 bp, Homo sapiens
ccaactccagtactggagctt

SEQ ID NO: 6032135 - DNA, 17 bp, Homo sapiens
ccaactccatactccac

SEQ ID NO: 6032136 - DNA, 18 bp, Homo sapiens
ccaactccatactccact

SEQ ID NO: 6032137 - DNA, 22 bp, Homo sapiens
ccaactccatgaccaggccacc

SEQ ID NO: 6032138 - DNA, 15 bp, Homo sapiens
cagtgagtctcttca

SEQ ID NO: 6032139 - DNA, 18 bp, Homo sapiens
cagtgagtgagcctggct

SEQ ID NO: 6032140 - DNA, 14 bp, Homo sapiens
cagtgagtgtaaat

SEQ ID NO: 6032141 - DNA, 18 bp, Homo sapiens
cagtgagttacagcgaga

SEQ ID NO: 6032142 - DNA, 22 bp, Homo sapiens
cagtgagttacagcgagaggca

SEQ ID NO: 6032143 - DNA, 14 bp, Homo sapiens
cagtgataagagca

SEQ ID NO: 6032144 - DNA, 15 bp, Homo sapiens
cagtgataagagcag

SEQ ID NO: 6032145 - DNA, 19 bp, Homo sapiens
cagtgataatgttcatttt

SEQ ID NO: 6032146 - DNA, 23 bp, Homo sapiens
cagtgatacatgtactccagagg

SEQ ID NO: 6032147 - DNA, 19 bp, Homo sapiens
cagtgatagaacaaaagag

SEQ ID NO: 6032148 - DNA, 14 bp, Homo sapiens
cagtgatatactta

SEQ ID NO: 6032149 - DNA, 21 bp, Homo sapiens
cagtgatatggcagaagacac

SEQ ID NO: 6032150 - DNA, 23 bp, Homo sapiens
cagtgatatggcagaagacacca

SEQ ID NO: 6032151 - DNA, 18 bp, Homo sapiens
cagtgatattctttgtta

SEQ ID NO: 6032152 - DNA, 17 bp, Homo sapiens
cagtgatcaaagtccga

SEQ ID NO: 6032153 - DNA, 14 bp, Homo sapiens
cagtgatctatgtt

SEQ ID NO: 6032154 - DNA, 15 bp, Homo sapiens
cagtgatctccatat

SEQ ID NO: 6032155 - DNA, 17 bp, Homo sapiens
cagtgatgacttgctgt

SEQ ID NO: 6032156 - DNA, 21 bp, Homo sapiens
cagtgatgacttgctgtccag

SEQ ID NO: 6032157 - DNA, 11 bp, Homo sapiens
cagtgatgatg

SEQ ID NO: 6032158 - DNA, 16 bp, Homo sapiens
cagtgatgatgcatgg

SEQ ID NO: 6032159 - DNA, 13 bp, Homo sapiens
cagtgatgatgtt

SEQ ID NO: 6032160 - DNA, 21 bp, Homo sapiens
cagtgatgcaatcttggctca

SEQ ID NO: 6032161 - DNA, 13 bp, Homo sapiens
cagtgatgccggg

SEQ ID NO: 6032162 - DNA, 21 bp, Homo sapiens
cagtgatgccgggcgccagga

SEQ ID NO: 6032163 - DNA, 23 bp, Homo sapiens
cagtgatgccgggcgccaggaca

SEQ ID NO: 6032164 - DNA, 14 bp, Homo sapiens
cagtgatgcctgcc

SEQ ID NO: 6032165 - DNA, 20 bp, Homo sapiens
cagtgatgctggatgctcct

SEQ ID NO: 6032166 - DNA, 22 bp, Homo sapiens
cagtgatggaatatcatgaatg

SEQ ID NO: 6032167 - DNA, 12 bp, Homo sapiens
cagtgatggcat

SEQ ID NO: 6032168 - DNA, 17 bp, Homo sapiens
cagtgatggcattactc

SEQ ID NO: 6032169 - DNA, 18 bp, Homo sapiens
cagtgatggcattactct

SEQ ID NO: 6032170 - DNA, 15 bp, Homo sapiens
cagtgatgtgctgga

SEQ ID NO: 6032171 - DNA, 19 bp, Homo sapiens
cagtgattaaagcaagaga

SEQ ID NO: 6032172 - DNA, 21 bp, Homo sapiens
cagtgattaaggtctctcttt

SEQ ID NO: 6032173 - DNA, 23 bp, Homo sapiens
cagtgattagcctcgtctttcag

SEQ ID NO: 6032174 - DNA, 22 bp, Homo sapiens
cagtgattatttttccagctcc

SEQ ID NO: 6032175 - DNA, 15 bp, Homo sapiens
cagtgattcagcagg

SEQ ID NO: 6032176 - DNA, 18 bp, Homo sapiens
cagtgattcgagctatat

SEQ ID NO: 6032177 - DNA, 15 bp, Homo sapiens
cagtgattctctctt

SEQ ID NO: 6032178 - DNA, 16 bp, Homo sapiens
cagtgattttcaaacc

SEQ ID NO: 6032179 - DNA, 14 bp, Homo sapiens
cagtgatttttagt

SEQ ID NO: 6032180 - DNA, 14 bp, Homo sapiens
cagtgatttttatc

SEQ ID NO: 6032181 - DNA, 22 bp, Homo sapiens
cagtgatttttccccccacccc

SEQ ID NO: 6032182 - DNA, 18 bp, Homo sapiens
cagtgatttttttttaga

SEQ ID NO: 6032183 - DNA, 19 bp, Homo sapiens
cagtgcaaaatgtcttgtg

SEQ ID NO: 6032184 - DNA, 18 bp, Homo sapiens
cagtgcaaaccacttctc

SEQ ID NO: 6032185 - DNA, 18 bp, Homo sapiens
cagtgcaaatgcatgctt

SEQ ID NO: 6032186 - DNA, 15 bp, Homo sapiens
cagtgcaaatgtcag

SEQ ID NO: 6032187 - DNA, 17 bp, Homo sapiens
cagtgcaaattgtatct

SEQ ID NO: 6032188 - DNA, 15 bp, Homo sapiens
cagtgcaacactgaa

SEQ ID NO: 6032189 - DNA, 15 bp, Homo sapiens
cagtgcaacactggt

SEQ ID NO: 6032190 - DNA, 14 bp, Homo sapiens
cagtgcaacctctg

SEQ ID NO: 6032191 - DNA, 19 bp, Homo sapiens
cagtgcaacctctgcttcc

SEQ ID NO: 6032192 - DNA, 11 bp, Homo sapiens
cagtgcaagag

SEQ ID NO: 6032193 - DNA, 18 bp, Homo sapiens
cagtgcaagagactctgg

SEQ ID NO: 6032194 - DNA, 19 bp, Homo sapiens
cagtgcaagagactttgtc

SEQ ID NO: 6032195 - DNA, 23 bp, Homo sapiens
cagtgcaagagactttgtcactt

SEQ ID NO: 6032196 - DNA, 22 bp, Homo sapiens
cagtgcaatggtataaatttca

SEQ ID NO: 6032197 - DNA, 15 bp, Homo sapiens
cagtgcacacggatg

SEQ ID NO: 6032198 - DNA, 23 bp, Homo sapiens
cagtgcacacggatgcacagaga

SEQ ID NO: 6032199 - DNA, 20 bp, Homo sapiens
cagtgcacatctgacccaga

SEQ ID NO: 6032200 - DNA, 14 bp, Homo sapiens
cagtgcacatttca

SEQ ID NO: 6032201 - DNA, 15 bp, Homo sapiens
cagtgcacccactct

SEQ ID NO: 6032202 - DNA, 13 bp, Homo sapiens
cagtgcaccccct

SEQ ID NO: 6032203 - DNA, 18 bp, Homo sapiens
cagtgcaccccctaaaga

SEQ ID NO: 6032204 - DNA, 19 bp, Homo sapiens
cagtgcacctccctcccca

SEQ ID NO: 6032205 - DNA, 18 bp, Homo sapiens
cagtgcacctctcatcag

SEQ ID NO: 6032206 - DNA, 19 bp, Homo sapiens
cagtgcacctgcctcagct

SEQ ID NO: 6032207 - DNA, 22 bp, Homo sapiens
cagtgcactccggcctgggtga

SEQ ID NO: 6032208 - DNA, 15 bp, Homo sapiens
cagtgcactcgagcc

SEQ ID NO: 6032209 - DNA, 14 bp, Homo sapiens
cagtgcagaatgta

SEQ ID NO: 6032210 - DNA, 14 bp, Homo sapiens
cagtgcagacaggc

SEQ ID NO: 6032211 - DNA, 15 bp, Homo sapiens
cagtgcagacaggcc

SEQ ID NO: 6032212 - DNA, 21 bp, Homo sapiens
cagtgcagacaggccatgtga

SEQ ID NO: 6032213 - DNA, 16 bp, Homo sapiens
cagtgcagagccttct

SEQ ID NO: 6032214 - DNA, 22 bp, Homo sapiens
cagtgcagcaaccagagcactg

SEQ ID NO: 6032215 - DNA, 15 bp, Homo sapiens
cagtgcagccactgg

SEQ ID NO: 6032216 - DNA, 22 bp, Homo sapiens
cagtgcagcccgtgtggcccct

SEQ ID NO: 6032217 - DNA, 17 bp, Homo sapiens
cagtgcagcttgcagtc

SEQ ID NO: 6032218 - DNA, 20 bp, Homo sapiens
cagtgcagcttgcagtccgt

SEQ ID NO: 6032219 - DNA, 16 bp, Homo sapiens
cagtgcaggctggcca

SEQ ID NO: 6032220 - DNA, 19 bp, Homo sapiens
cagtgcaggctggccagcc

SEQ ID NO: 6032221 - DNA, 20 bp, Homo sapiens
cagtgcaggctggccagccg

SEQ ID NO: 6032222 - DNA, 22 bp, Homo sapiens
cagtgcaggctggccagccgct

SEQ ID NO: 6032223 - DNA, 15 bp, Homo sapiens
cagtgcagtttctaa

SEQ ID NO: 6032224 - DNA, 18 bp, Homo sapiens
cagtgcagtttcttttca

SEQ ID NO: 6032225 - DNA, 21 bp, Homo sapiens
cagtgcagtttcttttcacat

SEQ ID NO: 6032226 - DNA, 22 bp, Homo sapiens
cagtgcatagttgtagacaaag

SEQ ID NO: 6032227 - DNA, 17 bp, Homo sapiens
cagtgcatcacatctgc

SEQ ID NO: 6032228 - DNA, 12 bp, Homo sapiens
cagtgcatctca

SEQ ID NO: 6032229 - DNA, 14 bp, Homo sapiens
cagtgcatgctgtc

SEQ ID NO: 6032230 - DNA, 17 bp, Homo sapiens
cagtgcatgctgtccct

SEQ ID NO: 6032231 - DNA, 23 bp, Homo sapiens
cagtgcatgctgtcccttacgtg

SEQ ID NO: 6032232 - DNA, 16 bp, Homo sapiens
cagtgcatgtgaagca

SEQ ID NO: 6032233 - DNA, 18 bp, Homo sapiens
cagtgcatgtgaagcatg

SEQ ID NO: 6032234 - DNA, 15 bp, Homo sapiens
cagtgcatgtgcatg

SEQ ID NO: 6032235 - DNA, 15 bp, Homo sapiens
cagtgccaaaaacaa

SEQ ID NO: 6032236 - DNA, 13 bp, Homo sapiens
cagtgccaaactt

SEQ ID NO: 6032237 - DNA, 13 bp, Homo sapiens
cagtgccaaatgc

SEQ ID NO: 6032238 - DNA, 17 bp, Homo sapiens
cagtgccaaatgctggg

SEQ ID NO: 6032239 - DNA, 23 bp, Homo sapiens
cagtgccaaatgctggggcaggg

SEQ ID NO: 6032240 - DNA, 12 bp, Homo sapiens
cagtgccacaga

SEQ ID NO: 6032241 - DNA, 14 bp, Homo sapiens
cagtgccacagaga

SEQ ID NO: 6032242 - DNA, 16 bp, Homo sapiens
cagtgccacagagaag

SEQ ID NO: 6032243 - DNA, 19 bp, Homo sapiens
cagtgccacatactgcgga

SEQ ID NO: 6032244 - DNA, 16 bp, Homo sapiens
cagtgccaccaagctc

SEQ ID NO: 6032245 - DNA, 19 bp, Homo sapiens
cagtgccaccaagctcaca

SEQ ID NO: 6032246 - DNA, 23 bp, Homo sapiens
cagtgccaccaagctcacacctg

SEQ ID NO: 6032247 - DNA, 14 bp, Homo sapiens
cagtgccacccatg

SEQ ID NO: 6032248 - DNA, 20 bp, Homo sapiens
cagtgccacccatgcagctg

SEQ ID NO: 6032249 - DNA, 14 bp, Homo sapiens
cagtgccacgtcat

SEQ ID NO: 6032250 - DNA, 14 bp, Homo sapiens
cagtgccagcccct

SEQ ID NO: 6032251 - DNA, 20 bp, Homo sapiens
cagtgccagcccctgctggc

SEQ ID NO: 6032252 - DNA, 19 bp, Homo sapiens
cagtgccagctccagtgcc

SEQ ID NO: 6032253 - DNA, 21 bp, Homo sapiens
cagtgccagctggtgaatcca

SEQ ID NO: 6032254 - DNA, 15 bp, Homo sapiens
cagtgccaggaaaga

SEQ ID NO: 6032255 - DNA, 18 bp, Homo sapiens
cagtgccaggaaccctta

SEQ ID NO: 6032256 - DNA, 18 bp, Homo sapiens
cagtgccaggacagctgg

SEQ ID NO: 6032257 - DNA, 14 bp, Homo sapiens
cagtgccagggtgg

SEQ ID NO: 6032258 - DNA, 19 bp, Homo sapiens
cagtgccagggtgggctgg

SEQ ID NO: 6032259 - DNA, 15 bp, Homo sapiens
cagtgccatacatgt

SEQ ID NO: 6032260 - DNA, 10 bp, Homo sapiens
cagtgccatt

SEQ ID NO: 6032261 - DNA, 18 bp, Homo sapiens
cagtgccattgtctttat

SEQ ID NO: 6032262 - DNA, 17 bp, Homo sapiens
cagtgcccacaggatca

SEQ ID NO: 6032263 - DNA, 21 bp, Homo sapiens
cagtgcccacaggatcagtct

SEQ ID NO: 6032264 - DNA, 13 bp, Homo sapiens
cagtgcccaccgc

SEQ ID NO: 6032265 - DNA, 17 bp, Homo sapiens
cagtgcccaccgccctc

SEQ ID NO: 6032266 - DNA, 22 bp, Homo sapiens
cagtgcccaccgccctcctcca

SEQ ID NO: 6032267 - DNA, 15 bp, Homo sapiens
cagtgcccagctaat

SEQ ID NO: 6032268 - DNA, 18 bp, Homo sapiens
cagtgcccagtgatggca

SEQ ID NO: 6032269 - DNA, 16 bp, Homo sapiens
cagtgcccatgaatgg

SEQ ID NO: 6032270 - DNA, 15 bp, Homo sapiens
cagtgcccatgtgta

SEQ ID NO: 6032271 - DNA, 23 bp, Homo sapiens
cagtgcccatgtgtacattctgc

SEQ ID NO: 6032272 - DNA, 16 bp, Homo sapiens
cagtgcccatgtgtat

SEQ ID NO: 6032273 - DNA, 18 bp, Homo sapiens
cagtgcccattcctcacc

SEQ ID NO: 6032274 - DNA, 19 bp, Homo sapiens
cagtgccccagggagtcca

SEQ ID NO: 6032275 - DNA, 21 bp, Homo sapiens
cagtgccccagggagtccagg

SEQ ID NO: 6032276 - DNA, 14 bp, Homo sapiens
cagtgccccagtgg

SEQ ID NO: 6032277 - DNA, 15 bp, Homo sapiens
cagtgcccccactga

SEQ ID NO: 6032278 - DNA, 20 bp, Homo sapiens
cagtgcccccactgaccaga

SEQ ID NO: 6032279 - DNA, 22 bp, Homo sapiens
cagtgccccgtctacagctccc

SEQ ID NO: 6032280 - DNA, 18 bp, Homo sapiens
cagtgccctagaagggga

SEQ ID NO: 6032281 - DNA, 16 bp, Homo sapiens
cagtgccctccagccc

SEQ ID NO: 6032282 - DNA, 17 bp, Homo sapiens
cagtgccctctggacag

SEQ ID NO: 6032283 - DNA, 16 bp, Homo sapiens
cagtgccctgagccag

SEQ ID NO: 6032284 - DNA, 14 bp, Homo sapiens
cagtgcccttggtg

SEQ ID NO: 6032285 - DNA, 14 bp, Homo sapiens
cagtgccgaggaca

SEQ ID NO: 6032286 - DNA, 22 bp, Homo sapiens
cagtgccgatgatatagagtga

SEQ ID NO: 6032287 - DNA, 22 bp, Homo sapiens
cagtgccgccgcctcgcccacc

SEQ ID NO: 6032288 - DNA, 16 bp, Homo sapiens
cagtgccgcctgtgcc

SEQ ID NO: 6032289 - DNA, 15 bp, Homo sapiens
cagtgccgctcctgc

SEQ ID NO: 6032290 - DNA, 18 bp, Homo sapiens
cagtgccgctcctgcttc

SEQ ID NO: 6032291 - DNA, 21 bp, Homo sapiens
cagtgccgctcctgcttcccc

SEQ ID NO: 6032292 - DNA, 22 bp, Homo sapiens
cagtgccgctcctgcttcccct

SEQ ID NO: 6032293 - DNA, 19 bp, Homo sapiens
cagtgcctaaaataagaat

SEQ ID NO: 6032294 - DNA, 19 bp, Homo sapiens
cagtgcctaactccttaca

SEQ ID NO: 6032295 - DNA, 15 bp, Homo sapiens
cagtgcctcgaggca

SEQ ID NO: 6032296 - DNA, 19 bp, Homo sapiens
cagtgcctcgaggcaccgg

SEQ ID NO: 6032297 - DNA, 20 bp, Homo sapiens
cagtgcctcgaggcaccggc

SEQ ID NO: 6032298 - DNA, 14 bp, Homo sapiens
cagtgcctctttga

SEQ ID NO: 6032299 - DNA, 15 bp, Homo sapiens
cagtgcctctttgaa

SEQ ID NO: 6032300 - DNA, 12 bp, Homo sapiens
cagtgcctgcca

SEQ ID NO: 6032301 - DNA, 14 bp, Homo sapiens
cagtgcctgccact

SEQ ID NO: 6032302 - DNA, 18 bp, Homo sapiens
cagtgcctgccactctct

SEQ ID NO: 6032303 - DNA, 21 bp, Homo sapiens
cagtgcctgccactctctggg

SEQ ID NO: 6032304 - DNA, 12 bp, Homo sapiens
cagtgcctgctg

SEQ ID NO: 6032305 - DNA, 21 bp, Homo sapiens
cagtgcctggatcccctctgt

SEQ ID NO: 6032306 - DNA, 14 bp, Homo sapiens
cagtgcctggccca

SEQ ID NO: 6032307 - DNA, 18 bp, Homo sapiens
cagtgcctgggaatgtat

SEQ ID NO: 6032308 - DNA, 22 bp, Homo sapiens
cagtgcctgggtggatgggcca

SEQ ID NO: 6032309 - DNA, 19 bp, Homo sapiens
cagtgccttacctcctgcc

SEQ ID NO: 6032310 - DNA, 15 bp, Homo sapiens
cagtgccttatggaa

SEQ ID NO: 6032311 - DNA, 16 bp, Homo sapiens
cagtgccttatggaac

SEQ ID NO: 6032312 - DNA, 22 bp, Homo sapiens
cagtgccttatggaacactctg

SEQ ID NO: 6032313 - DNA, 22 bp, Homo sapiens
cagtgccttcaacaacgtgaga

SEQ ID NO: 6032314 - DNA, 15 bp, Homo sapiens
cagtgccttccataa

SEQ ID NO: 6032315 - DNA, 22 bp, Homo sapiens
cagtgccttcctgtttttcaca

SEQ ID NO: 6032316 - DNA, 16 bp, Homo sapiens
ccaactcccagccacc

SEQ ID NO: 6032317 - DNA, 22 bp, Homo sapiens
ccaactcccgggttcacgccat

SEQ ID NO: 6032318 - DNA, 22 bp, Homo sapiens
ccaactccgaaagtctgaatct

SEQ ID NO: 6032319 - DNA, 21 bp, Homo sapiens
ccaactccgcccagcctctcc

SEQ ID NO: 6032320 - DNA, 22 bp, Homo sapiens
ccaactccgtgtggtaagcaac

SEQ ID NO: 6032321 - DNA, 14 bp, Homo sapiens
ccaactcctccttg

SEQ ID NO: 6032322 - DNA, 13 bp, Homo sapiens
ccaactcctgatg

SEQ ID NO: 6032323 - DNA, 21 bp, Homo sapiens
ccaactcctgatgccctcttc

SEQ ID NO: 6032324 - DNA, 15 bp, Homo sapiens
ccaactccttccagc

SEQ ID NO: 6032325 - DNA, 16 bp, Homo sapiens
ccaactccttccagct

SEQ ID NO: 6032326 - DNA, 14 bp, Homo sapiens
ccaactccttcctc

SEQ ID NO: 6032327 - DNA, 17 bp, Homo sapiens
ccaactctaacaggcac

SEQ ID NO: 6032328 - DNA, 18 bp, Homo sapiens
ccaactctaacaggcact

SEQ ID NO: 6032329 - DNA, 14 bp, Homo sapiens
ccaactctagctgg

SEQ ID NO: 6032330 - DNA, 15 bp, Homo sapiens
ccaactctccccagt

SEQ ID NO: 6032331 - DNA, 20 bp, Homo sapiens
ccaactctccccagtgcctg

SEQ ID NO: 6032332 - DNA, 22 bp, Homo sapiens
ccaactctccccagtgcctgcc

SEQ ID NO: 6032333 - DNA, 23 bp, Homo sapiens
ccaactctccccagtgcctgcca

SEQ ID NO: 6032334 - DNA, 16 bp, Homo sapiens
ccaactctctctgccc

SEQ ID NO: 6032335 - DNA, 15 bp, Homo sapiens
ccaactctgagccca

SEQ ID NO: 6032336 - DNA, 16 bp, Homo sapiens
ccaactctgagcccat

SEQ ID NO: 6032337 - DNA, 16 bp, Homo sapiens
ccaactctgcactcca

SEQ ID NO: 6032338 - DNA, 20 bp, Homo sapiens
ccaactctgcactccatggc

SEQ ID NO: 6032339 - DNA, 17 bp, Homo sapiens
ccaactctggccttggt

SEQ ID NO: 6032340 - DNA, 15 bp, Homo sapiens
ccaactcttcatttt

SEQ ID NO: 6032341 - DNA, 20 bp, Homo sapiens
ccaactgaagccttcttctg

SEQ ID NO: 6032342 - DNA, 12 bp, Homo sapiens
ccaactgaaggc

SEQ ID NO: 6032343 - DNA, 18 bp, Homo sapiens
ccaactgacctgccagcc

SEQ ID NO: 6032344 - DNA, 20 bp, Homo sapiens
ccaactgacctgccagccgg

SEQ ID NO: 6032345 - DNA, 15 bp, Homo sapiens
ccaactgacttctgc

SEQ ID NO: 6032346 - DNA, 16 bp, Homo sapiens
ccaactgacttctgct

SEQ ID NO: 6032347 - DNA, 14 bp, Homo sapiens
ccaactgagccaaa

SEQ ID NO: 6032348 - DNA, 17 bp, Homo sapiens
ccaactgatcctgctcc

SEQ ID NO: 6032349 - DNA, 15 bp, Homo sapiens
ccaactgattttgta

SEQ ID NO: 6032350 - DNA, 16 bp, Homo sapiens
ccaactgattttgtat

SEQ ID NO: 6032351 - DNA, 22 bp, Homo sapiens
ccaactgcaaaaaaagcctcca

SEQ ID NO: 6032352 - DNA, 12 bp, Homo sapiens
ccaactgcagga

SEQ ID NO: 6032353 - DNA, 17 bp, Homo sapiens
ccaactgcatccaggcc

SEQ ID NO: 6032354 - DNA, 19 bp, Homo sapiens
ccaactgccaggctgcctc

SEQ ID NO: 6032355 - DNA, 22 bp, Homo sapiens
ccaactgcctccttgccagccc

SEQ ID NO: 6032356 - DNA, 21 bp, Homo sapiens
ccaactgccttaaccttctgg

SEQ ID NO: 6032357 - DNA, 17 bp, Homo sapiens
ccaactgctccagcctc

SEQ ID NO: 6032358 - DNA, 18 bp, Homo sapiens
ccaactgctccagcctct

SEQ ID NO: 6032359 - DNA, 15 bp, Homo sapiens
ccaactgctgcccca

SEQ ID NO: 6032360 - DNA, 14 bp, Homo sapiens
ccaactgctgcttt

SEQ ID NO: 6032361 - DNA, 23 bp, Homo sapiens
ccaactgctttgttttggctgct

SEQ ID NO: 6032362 - DNA, 16 bp, Homo sapiens
ccaactggaagcacag

SEQ ID NO: 6032363 - DNA, 16 bp, Homo sapiens
ccaactggcttctgtg

SEQ ID NO: 6032364 - DNA, 20 bp, Homo sapiens
ccaactgggcatttcaatcc

SEQ ID NO: 6032365 - DNA, 18 bp, Homo sapiens
ccaactgtaatgcaggat

SEQ ID NO: 6032366 - DNA, 13 bp, Homo sapiens
ccaactgtgagca

SEQ ID NO: 6032367 - DNA, 14 bp, Homo sapiens
ccaactgtggctgg

SEQ ID NO: 6032368 - DNA, 21 bp, Homo sapiens
ccaactgtggtagctccagcg

SEQ ID NO: 6032369 - DNA, 11 bp, Homo sapiens
ccaactgtgtt

SEQ ID NO: 6032370 - DNA, 18 bp, Homo sapiens
ccaactgtgttcattaga

SEQ ID NO: 6032371 - DNA, 23 bp, Homo sapiens
ccaactgtgttgtattaacaaaa

SEQ ID NO: 6032372 - DNA, 16 bp, Homo sapiens
ccaactgtttccctgc

SEQ ID NO: 6032373 - DNA, 19 bp, Homo sapiens
ccaactgtttccctgctga

SEQ ID NO: 6032374 - DNA, 17 bp, Homo sapiens
ccaacttcaccaccccc

SEQ ID NO: 6032375 - DNA, 13 bp, Homo sapiens
ccaacttcctgtg

SEQ ID NO: 6032376 - DNA, 18 bp, Homo sapiens
ccaacttcctgtggcctg

SEQ ID NO: 6032377 - DNA, 20 bp, Homo sapiens
ccaacttctcttgctttcta

SEQ ID NO: 6032378 - DNA, 13 bp, Homo sapiens
ccaacttgaagga

SEQ ID NO: 6032379 - DNA, 14 bp, Homo sapiens
ccaacttgaaggat

SEQ ID NO: 6032380 - DNA, 17 bp, Homo sapiens
ccaacttgatgtcaagc

SEQ ID NO: 6032381 - DNA, 14 bp, Homo sapiens
ccaacttggcagct

SEQ ID NO: 6032382 - DNA, 21 bp, Homo sapiens
ccaacttggcagctttttctg

SEQ ID NO: 6032383 - DNA, 13 bp, Homo sapiens
ccaacttggcttt

SEQ ID NO: 6032384 - DNA, 19 bp, Homo sapiens
ccaacttggttctgcttca

SEQ ID NO: 6032385 - DNA, 21 bp, Homo sapiens
ccaacttggttctgcttcaat

SEQ ID NO: 6032386 - DNA, 23 bp, Homo sapiens
ccaacttgtattaaagacagagg

SEQ ID NO: 6032387 - DNA, 16 bp, Homo sapiens
ccaacttgtctctgta

SEQ ID NO: 6032388 - DNA, 19 bp, Homo sapiens
ccaacttgttgtggctctt

SEQ ID NO: 6032389 - DNA, 18 bp, Homo sapiens
ccaactttattttgaatg

SEQ ID NO: 6032390 - DNA, 16 bp, Homo sapiens
ccaactttcaagaact

SEQ ID NO: 6032391 - DNA, 19 bp, Homo sapiens
ccaactttcaagaacttgt

SEQ ID NO: 6032392 - DNA, 14 bp, Homo sapiens
ccaactttcccccc

SEQ ID NO: 6032393 - DNA, 20 bp, Homo sapiens
ccaactttctcactgctgtc

SEQ ID NO: 6032394 - DNA, 14 bp, Homo sapiens
ccaacttttctatt

SEQ ID NO: 6032395 - DNA, 17 bp, Homo sapiens
ccaagaaaaagaaaaaa

SEQ ID NO: 6032396 - DNA, 19 bp, Homo sapiens
ccaagaaaaggcatggaga

SEQ ID NO: 6032397 - DNA, 18 bp, Homo sapiens
ccaagaaaatgaagggat

SEQ ID NO: 6032398 - DNA, 14 bp, Homo sapiens
ccaagaaacgtctt

SEQ ID NO: 6032399 - DNA, 18 bp, Homo sapiens
ccaagaaactgagaccaa

SEQ ID NO: 6032400 - DNA, 22 bp, Homo sapiens
ccaagaaagatgtatataggtg

SEQ ID NO: 6032401 - DNA, 23 bp, Homo sapiens
ccaagaaagcttcttcagagtga

SEQ ID NO: 6032402 - DNA, 13 bp, Homo sapiens
ccaagaaatttta

SEQ ID NO: 6032403 - DNA, 18 bp, Homo sapiens
ccaagaacagcaggccca

SEQ ID NO: 6032404 - DNA, 13 bp, Homo sapiens
ccaagaactgaaa

SEQ ID NO: 6032405 - DNA, 16 bp, Homo sapiens
ccaagaactgaaaaca

SEQ ID NO: 6032406 - DNA, 13 bp, Homo sapiens
ccaagaactgcag

SEQ ID NO: 6032407 - DNA, 23 bp, Homo sapiens
ccaagaactgcagatagcccagg

SEQ ID NO: 6032408 - DNA, 14 bp, Homo sapiens
ccaagaagcagtgg

SEQ ID NO: 6032409 - DNA, 14 bp, Homo sapiens
ccaagaagccctcc

SEQ ID NO: 6032410 - DNA, 17 bp, Homo sapiens
ccaagaagccctccttg

SEQ ID NO: 6032411 - DNA, 18 bp, Homo sapiens
ccaagaagccctccttgc

SEQ ID NO: 6032412 - DNA, 22 bp, Homo sapiens
ccaagaagccctccttgccacc

SEQ ID NO: 6032413 - DNA, 15 bp, Homo sapiens
ccaagaaggagacct

SEQ ID NO: 6032414 - DNA, 20 bp, Homo sapiens
ccaagaatagcatctgtaca

SEQ ID NO: 6032415 - DNA, 16 bp, Homo sapiens
ccaagaatattgcaaa

SEQ ID NO: 6032416 - DNA, 21 bp, Homo sapiens
ccaagaatattgcaaaataca

SEQ ID NO: 6032417 - DNA, 12 bp, Homo sapiens
ccaagaatctat

SEQ ID NO: 6032418 - DNA, 20 bp, Homo sapiens
ccaagaatgcaagatttcag

SEQ ID NO: 6032419 - DNA, 18 bp, Homo sapiens
ccaagaatggaagcctga

SEQ ID NO: 6032420 - DNA, 12 bp, Homo sapiens
ccaagaatgtac

SEQ ID NO: 6032421 - DNA, 14 bp, Homo sapiens
ccaagacaaatcaa

SEQ ID NO: 6032422 - DNA, 19 bp, Homo sapiens
ccaagacagatgccccaga

SEQ ID NO: 6032423 - DNA, 24 bp, Homo sapiens
ccaagacagatgccccagagctgt

SEQ ID NO: 6032424 - DNA, 13 bp, Homo sapiens
ccaagacagcagc

SEQ ID NO: 6032425 - DNA, 16 bp, Homo sapiens
ccaagacagcagcagc

SEQ ID NO: 6032426 - DNA, 23 bp, Homo sapiens
ccaagacagcagcagcctgcacc

SEQ ID NO: 6032427 - DNA, 16 bp, Homo sapiens
ccaagacagtgagaca

SEQ ID NO: 6032428 - DNA, 11 bp, Homo sapiens
ccaagacattg

SEQ ID NO: 6032429 - DNA, 14 bp, Homo sapiens
ccaagaccatccct

SEQ ID NO: 6032430 - DNA, 22 bp, Homo sapiens
ccaagaccatctctccctcctg

SEQ ID NO: 6032431 - DNA, 15 bp, Homo sapiens
ccaagaccccctggg

SEQ ID NO: 6032432 - DNA, 16 bp, Homo sapiens
ccaagacggaggaggg

SEQ ID NO: 6032433 - DNA, 19 bp, Homo sapiens
ccaagacggaggaggggaa

SEQ ID NO: 6032434 - DNA, 22 bp, Homo sapiens
ccaagacggaggaggggaaggg

SEQ ID NO: 6032435 - DNA, 19 bp, Homo sapiens
ccaagacgggatgattgct

SEQ ID NO: 6032436 - DNA, 12 bp, Homo sapiens
ccaagactccca

SEQ ID NO: 6032437 - DNA, 17 bp, Homo sapiens
ccaagactcctgcaaaa

SEQ ID NO: 6032438 - DNA, 18 bp, Homo sapiens
ccaagactctatgctctg

SEQ ID NO: 6032439 - DNA, 19 bp, Homo sapiens
ccaagactctatgctctgg

SEQ ID NO: 6032440 - DNA, 18 bp, Homo sapiens
ccaagactctgctctcct

SEQ ID NO: 6032441 - DNA, 18 bp, Homo sapiens
ccaagactgaagactgca

SEQ ID NO: 6032442 - DNA, 22 bp, Homo sapiens
ccaagactgctgtggccaggag

SEQ ID NO: 6032443 - DNA, 23 bp, Homo sapiens
ccaagactgtcattgcccctccg

SEQ ID NO: 6032444 - DNA, 18 bp, Homo sapiens
ccaagacttggcaacaga

SEQ ID NO: 6032445 - DNA, 19 bp, Homo sapiens
ccaagacttggtgtccttt

SEQ ID NO: 6032446 - DNA, 17 bp, Homo sapiens
ccaagagaaacttccta

SEQ ID NO: 6032447 - DNA, 13 bp, Homo sapiens
ccaagagaactcg

SEQ ID NO: 6032448 - DNA, 12 bp, Homo sapiens
ccaagagaaggg

SEQ ID NO: 6032449 - DNA, 21 bp, Homo sapiens
ccaagagagacagcacaggca

SEQ ID NO: 6032450 - DNA, 18 bp, Homo sapiens
ccaagagaggaaggaccc

SEQ ID NO: 6032451 - DNA, 19 bp, Homo sapiens
ccaagagatctgtgtggct

SEQ ID NO: 6032452 - DNA, 14 bp, Homo sapiens
ccaagagatgaaga

SEQ ID NO: 6032453 - DNA, 17 bp, Homo sapiens
ccaagagattgctaatt

SEQ ID NO: 6032454 - DNA, 15 bp, Homo sapiens
ccaagagcagagtct

SEQ ID NO: 6032455 - DNA, 16 bp, Homo sapiens
ccaagagcagagtctg

SEQ ID NO: 6032456 - DNA, 20 bp, Homo sapiens
ccaagagcagagtctgggcc

SEQ ID NO: 6032457 - DNA, 14 bp, Homo sapiens
ccaagagcaggagg

SEQ ID NO: 6032458 - DNA, 15 bp, Homo sapiens
ccaagagcaggaggt

SEQ ID NO: 6032459 - DNA, 18 bp, Homo sapiens
ccaagagcatcatgcctc

SEQ ID NO: 6032460 - DNA, 19 bp, Homo sapiens
ccaagagcatcatgcctct

SEQ ID NO: 6032461 - DNA, 22 bp, Homo sapiens
ccaagagcatcatgcctctgag

SEQ ID NO: 6032462 - DNA, 22 bp, Homo sapiens
ccaagagcccaaaagagggcac

SEQ ID NO: 6032463 - DNA, 22 bp, Homo sapiens
ccaagagcccgtgccaccccca

SEQ ID NO: 6032464 - DNA, 17 bp, Homo sapiens
ccaagagccctgtggcc

SEQ ID NO: 6032465 - DNA, 21 bp, Homo sapiens
ccaagagctactcccacagca

SEQ ID NO: 6032466 - DNA, 22 bp, Homo sapiens
ccaagagctgaggcaattctaa

SEQ ID NO: 6032467 - DNA, 21 bp, Homo sapiens
ccaagagcttccagagctctg

SEQ ID NO: 6032468 - DNA, 12 bp, Homo sapiens
ccaagaggaaaa

SEQ ID NO: 6032469 - DNA, 13 bp, Homo sapiens
ccaagaggaaaaa

SEQ ID NO: 6032470 - DNA, 19 bp, Homo sapiens
ccaagaggaagttcagatc

SEQ ID NO: 6032471 - DNA, 21 bp, Homo sapiens
ccaagaggaagttcagatctt

SEQ ID NO: 6032472 - DNA, 13 bp, Homo sapiens
ccaagaggctgca

SEQ ID NO: 6032473 - DNA, 15 bp, Homo sapiens
ccaagaggctggaaa

SEQ ID NO: 6032474 - DNA, 22 bp, Homo sapiens
ccaagaggggccgctgacttct

SEQ ID NO: 6032475 - DNA, 17 bp, Homo sapiens
ccaagaggggcgggctc

SEQ ID NO: 6032476 - DNA, 22 bp, Homo sapiens
ccaagaggggcgggctcagagc

SEQ ID NO: 6032477 - DNA, 19 bp, Homo sapiens
ccaagagggtcctttagta

SEQ ID NO: 6032478 - DNA, 12 bp, Homo sapiens
ccaagaggtggg

SEQ ID NO: 6032479 - DNA, 23 bp, Homo sapiens
ccaagaggtttggctcctgccca

SEQ ID NO: 6032480 - DNA, 17 bp, Homo sapiens
ccaagagtattccattt

SEQ ID NO: 6032481 - DNA, 11 bp, Homo sapiens
ccaagagtcta

SEQ ID NO: 6032482 - DNA, 16 bp, Homo sapiens
ccaagagtctaaagat

SEQ ID NO: 6032483 - DNA, 19 bp, Homo sapiens
ccaagagtggccccacctg

SEQ ID NO: 6032484 - DNA, 14 bp, Homo sapiens
ccaagagtgggctt

SEQ ID NO: 6032485 - DNA, 17 bp, Homo sapiens
ccaagataaatgagctg

SEQ ID NO: 6032486 - DNA, 18 bp, Homo sapiens
ccaagatcacataccaga

SEQ ID NO: 6032487 - DNA, 17 bp, Homo sapiens
ccaagatcattctacaa

SEQ ID NO: 6032488 - DNA, 17 bp, Homo sapiens
ccaagatcccctcagaa

SEQ ID NO: 6032489 - DNA, 16 bp, Homo sapiens
ccaagatcgcgccact

SEQ ID NO: 6032490 - DNA, 13 bp, Homo sapiens
ccaagatctgcca

SEQ ID NO: 6032491 - DNA, 20 bp, Homo sapiens
ccaagatgatcacatggaag

SEQ ID NO: 6032492 - DNA, 11 bp, Homo sapiens
ccaagatgcct

SEQ ID NO: 6032493 - DNA, 17 bp, Homo sapiens
ccaagatgcttttcaaa

SEQ ID NO: 6032494 - DNA, 23 bp, Homo sapiens
ccaagatggcatgaatcgggcta

SEQ ID NO: 6032495 - DNA, 11 bp, Homo sapiens
cagtgccttct

SEQ ID NO: 6032496 - DNA, 20 bp, Homo sapiens
cagtgccttctctcagctcc

SEQ ID NO: 6032497 - DNA, 23 bp, Homo sapiens
cagtgccttctctcagctcccag

SEQ ID NO: 6032498 - DNA, 11 bp, Homo sapiens
cagtgccttgc

SEQ ID NO: 6032499 - DNA, 12 bp, Homo sapiens
cagtgccttgct

SEQ ID NO: 6032500 - DNA, 13 bp, Homo sapiens
cagtgccttggag

SEQ ID NO: 6032501 - DNA, 23 bp, Homo sapiens
cagtgcctttcttctctccagtg

SEQ ID NO: 6032502 - DNA, 18 bp, Homo sapiens
cagtgcgattctggataa

SEQ ID NO: 6032503 - DNA, 20 bp, Homo sapiens
cagtgcgctcgttccggtcc

SEQ ID NO: 6032504 - DNA, 16 bp, Homo sapiens
cagtgcgggtgcagac

SEQ ID NO: 6032505 - DNA, 19 bp, Homo sapiens
cagtgctaaaaatgggact

SEQ ID NO: 6032506 - DNA, 22 bp, Homo sapiens
cagtgctaaaaatgggacttct

SEQ ID NO: 6032507 - DNA, 21 bp, Homo sapiens
cagtgctaagctgccctgagg

SEQ ID NO: 6032508 - DNA, 13 bp, Homo sapiens
cagtgctactgaa

SEQ ID NO: 6032509 - DNA, 16 bp, Homo sapiens
cagtgctagtgagctg

SEQ ID NO: 6032510 - DNA, 21 bp, Homo sapiens
cagtgctagtgagctgggcat

SEQ ID NO: 6032511 - DNA, 21 bp, Homo sapiens
cagtgctataaatgccagagc

SEQ ID NO: 6032512 - DNA, 22 bp, Homo sapiens
cagtgctataaatgccagagcc

SEQ ID NO: 6032513 - DNA, 22 bp, Homo sapiens
cagtgctcacacaatcagacca

SEQ ID NO: 6032514 - DNA, 12 bp, Homo sapiens
cagtgctcaccc

SEQ ID NO: 6032515 - DNA, 13 bp, Homo sapiens
cagtgctcaccca

SEQ ID NO: 6032516 - DNA, 19 bp, Homo sapiens
cagtgctcacccacaccat

SEQ ID NO: 6032517 - DNA, 13 bp, Homo sapiens
cagtgctcagctg

SEQ ID NO: 6032518 - DNA, 15 bp, Homo sapiens
cagtgctcagctgtg

SEQ ID NO: 6032519 - DNA, 24 bp, Homo sapiens
cagtgctcctggaaacttagcttt

SEQ ID NO: 6032520 - DNA, 15 bp, Homo sapiens
cagtgctcctggccc

SEQ ID NO: 6032521 - DNA, 13 bp, Homo sapiens
cagtgctcctgtg

SEQ ID NO: 6032522 - DNA, 14 bp, Homo sapiens
cagtgctcgctgtt

SEQ ID NO: 6032523 - DNA, 16 bp, Homo sapiens
cagtgctcgctgttgc

SEQ ID NO: 6032524 - DNA, 17 bp, Homo sapiens
cagtgctcgctgttgct

SEQ ID NO: 6032525 - DNA, 18 bp, Homo sapiens
cagtgctcgctgttgctg

SEQ ID NO: 6032526 - DNA, 20 bp, Homo sapiens
cagtgctcgctgttgctgaa

SEQ ID NO: 6032527 - DNA, 21 bp, Homo sapiens
cagtgctcgctgttgctgaat

SEQ ID NO: 6032528 - DNA, 22 bp, Homo sapiens
cagtgctcgctgttgctgaata

SEQ ID NO: 6032529 - DNA, 13 bp, Homo sapiens
cagtgctcggcag

SEQ ID NO: 6032530 - DNA, 14 bp, Homo sapiens
cagtgctcggcagt

SEQ ID NO: 6032531 - DNA, 18 bp, Homo sapiens
cagtgctctaggctgccc

SEQ ID NO: 6032532 - DNA, 14 bp, Homo sapiens
cagtgctctcagct

SEQ ID NO: 6032533 - DNA, 15 bp, Homo sapiens
cagtgctctgcctct

SEQ ID NO: 6032534 - DNA, 16 bp, Homo sapiens
cagtgctctgcctcta

SEQ ID NO: 6032535 - DNA, 18 bp, Homo sapiens
cagtgctctgcctctaac

SEQ ID NO: 6032536 - DNA, 15 bp, Homo sapiens
cagtgctctgtaaaa

SEQ ID NO: 6032537 - DNA, 18 bp, Homo sapiens
cagtgctctgtaaaacac

SEQ ID NO: 6032538 - DNA, 23 bp, Homo sapiens
cagtgctcttttctcctcactgt

SEQ ID NO: 6032539 - DNA, 18 bp, Homo sapiens
cagtgctgaagggggcat

SEQ ID NO: 6032540 - DNA, 23 bp, Homo sapiens
cagtgctgaccagacagcctccc

SEQ ID NO: 6032541 - DNA, 21 bp, Homo sapiens
cagtgctgaccccaggaagtg

SEQ ID NO: 6032542 - DNA, 15 bp, Homo sapiens
cagtgctgagggacc

SEQ ID NO: 6032543 - DNA, 16 bp, Homo sapiens
cagtgctgatctaaaa

SEQ ID NO: 6032544 - DNA, 17 bp, Homo sapiens
cagtgctgccacttaaa

SEQ ID NO: 6032545 - DNA, 14 bp, Homo sapiens
cagtgctgccatgc

SEQ ID NO: 6032546 - DNA, 15 bp, Homo sapiens
cagtgctgccatgcc

SEQ ID NO: 6032547 - DNA, 20 bp, Homo sapiens
cagtgctgccatgccactgc

SEQ ID NO: 6032548 - DNA, 23 bp, Homo sapiens
cagtgctgccatgccactgccag

SEQ ID NO: 6032549 - DNA, 17 bp, Homo sapiens
cagtgctgccccttgca

SEQ ID NO: 6032550 - DNA, 18 bp, Homo sapiens
cagtgctgccccttgcaa

SEQ ID NO: 6032551 - DNA, 20 bp, Homo sapiens
cagtgctgccccttgcaagc

SEQ ID NO: 6032552 - DNA, 16 bp, Homo sapiens
cagtgctgccctgcga

SEQ ID NO: 6032553 - DNA, 13 bp, Homo sapiens
cagtgctgcctgt

SEQ ID NO: 6032554 - DNA, 15 bp, Homo sapiens
cagtgctggagaaat

SEQ ID NO: 6032555 - DNA, 13 bp, Homo sapiens
cagtgctggattt

SEQ ID NO: 6032556 - DNA, 19 bp, Homo sapiens
cagtgctggatttgatgag

SEQ ID NO: 6032557 - DNA, 21 bp, Homo sapiens
cagtgctggatttgatgagtt

SEQ ID NO: 6032558 - DNA, 14 bp, Homo sapiens
cagtgctggctgct

SEQ ID NO: 6032559 - DNA, 16 bp, Homo sapiens
cagtgctgggaccaga

SEQ ID NO: 6032560 - DNA, 17 bp, Homo sapiens
cagtgctgggaccagag

SEQ ID NO: 6032561 - DNA, 18 bp, Homo sapiens
cagtgctgggaccagagc

SEQ ID NO: 6032562 - DNA, 19 bp, Homo sapiens
cagtgctgggaccagagcc

SEQ ID NO: 6032563 - DNA, 20 bp, Homo sapiens
cagtgctgggaccagagcca

SEQ ID NO: 6032564 - DNA, 22 bp, Homo sapiens
cagtgctgggaccagagccaga

SEQ ID NO: 6032565 - DNA, 23 bp, Homo sapiens
cagtgctgggaccagagccagat

SEQ ID NO: 6032566 - DNA, 18 bp, Homo sapiens
cagtgctgggattacagg

SEQ ID NO: 6032567 - DNA, 12 bp, Homo sapiens
cagtgctgggcc

SEQ ID NO: 6032568 - DNA, 16 bp, Homo sapiens
cagtgctgggcccagc

SEQ ID NO: 6032569 - DNA, 16 bp, Homo sapiens
cagtgctggttctcca

SEQ ID NO: 6032570 - DNA, 19 bp, Homo sapiens
cagtgctgtgctgtgctat

SEQ ID NO: 6032571 - DNA, 13 bp, Homo sapiens
cagtgctgtggcc

SEQ ID NO: 6032572 - DNA, 19 bp, Homo sapiens
cagtgctgtggcctgggca

SEQ ID NO: 6032573 - DNA, 14 bp, Homo sapiens
cagtgctgttctgg

SEQ ID NO: 6032574 - DNA, 15 bp, Homo sapiens
cagtgctgttgaaga

SEQ ID NO: 6032575 - DNA, 18 bp, Homo sapiens
cagtgcttaatgtgaact

SEQ ID NO: 6032576 - DNA, 15 bp, Homo sapiens
cagtgcttccacaga

SEQ ID NO: 6032577 - DNA, 22 bp, Homo sapiens
cagtgcttctacacatttcatc

SEQ ID NO: 6032578 - DNA, 20 bp, Homo sapiens
cagtgcttgagtttggggaa

SEQ ID NO: 6032579 - DNA, 23 bp, Homo sapiens
cagtgcttgcatcctatttggtg

SEQ ID NO: 6032580 - DNA, 15 bp, Homo sapiens
cagtgcttgccacag

SEQ ID NO: 6032581 - DNA, 18 bp, Homo sapiens
cagtgcttgccacagagc

SEQ ID NO: 6032582 - DNA, 17 bp, Homo sapiens
cagtgcttgcttgtgaa

SEQ ID NO: 6032583 - DNA, 16 bp, Homo sapiens
cagtgcttggcccagg

SEQ ID NO: 6032584 - DNA, 18 bp, Homo sapiens
cagtgcttggcccaggag

SEQ ID NO: 6032585 - DNA, 15 bp, Homo sapiens
cagtgcttggctgcc

SEQ ID NO: 6032586 - DNA, 22 bp, Homo sapiens
cagtgcttggctgccccacagg

SEQ ID NO: 6032587 - DNA, 19 bp, Homo sapiens
cagtgctttgcatgtatta

SEQ ID NO: 6032588 - DNA, 18 bp, Homo sapiens
cagtgctttgcccttgaa

SEQ ID NO: 6032589 - DNA, 20 bp, Homo sapiens
cagtgcttttaagtgaaaat

SEQ ID NO: 6032590 - DNA, 23 bp, Homo sapiens
cagtggaaaaatcagaagcacaa

SEQ ID NO: 6032591 - DNA, 14 bp, Homo sapiens
cagtggaaaacaaa

SEQ ID NO: 6032592 - DNA, 13 bp, Homo sapiens
cagtggaaatcaa

SEQ ID NO: 6032593 - DNA, 12 bp, Homo sapiens
cagtggaaattt

SEQ ID NO: 6032594 - DNA, 17 bp, Homo sapiens
cagtggaacacaaatga

SEQ ID NO: 6032595 - DNA, 21 bp, Homo sapiens
cagtggaacacaaatgaaaat

SEQ ID NO: 6032596 - DNA, 16 bp, Homo sapiens
cagtggaaccagccca

SEQ ID NO: 6032597 - DNA, 18 bp, Homo sapiens
cagtggaaccgttgccaa

SEQ ID NO: 6032598 - DNA, 12 bp, Homo sapiens
cagtggaagaaa

SEQ ID NO: 6032599 - DNA, 19 bp, Homo sapiens
cagtggaagagctgctgta

SEQ ID NO: 6032600 - DNA, 21 bp, Homo sapiens
cagtggaagagctgctgtatt

SEQ ID NO: 6032601 - DNA, 19 bp, Homo sapiens
cagtggaagttcttcaaga

SEQ ID NO: 6032602 - DNA, 22 bp, Homo sapiens
cagtggaagtttttttttcctc

SEQ ID NO: 6032603 - DNA, 15 bp, Homo sapiens
cagtggaattgtaca

SEQ ID NO: 6032604 - DNA, 19 bp, Homo sapiens
cagtggaattgtacaagag

SEQ ID NO: 6032605 - DNA, 22 bp, Homo sapiens
cagtggacaccaggagtccctg

SEQ ID NO: 6032606 - DNA, 16 bp, Homo sapiens
cagtggacagagggag

SEQ ID NO: 6032607 - DNA, 16 bp, Homo sapiens
cagtggacagtgctgt

SEQ ID NO: 6032608 - DNA, 17 bp, Homo sapiens
cagtggacagtgctgtt

SEQ ID NO: 6032609 - DNA, 23 bp, Homo sapiens
cagtggacatcgtaggcagccac

SEQ ID NO: 6032610 - DNA, 17 bp, Homo sapiens
cagtggaccctgtggcc

SEQ ID NO: 6032611 - DNA, 22 bp, Homo sapiens
cagtggaccgcccttttcccct

SEQ ID NO: 6032612 - DNA, 16 bp, Homo sapiens
cagtggacctagcctg

SEQ ID NO: 6032613 - DNA, 17 bp, Homo sapiens
cagtggactctgaggac

SEQ ID NO: 6032614 - DNA, 22 bp, Homo sapiens
cagtggagaagacattctggtg

SEQ ID NO: 6032615 - DNA, 15 bp, Homo sapiens
cagtggagagatgtt

SEQ ID NO: 6032616 - DNA, 12 bp, Homo sapiens
cagtggagaggg

SEQ ID NO: 6032617 - DNA, 14 bp, Homo sapiens
cagtggagagggga

SEQ ID NO: 6032618 - DNA, 13 bp, Homo sapiens
cagtggagcctgg

SEQ ID NO: 6032619 - DNA, 13 bp, Homo sapiens
cagtggagctggc

SEQ ID NO: 6032620 - DNA, 18 bp, Homo sapiens
cagtggagctggtctgcc

SEQ ID NO: 6032621 - DNA, 18 bp, Homo sapiens
cagtggaggctggcaggg

SEQ ID NO: 6032622 - DNA, 21 bp, Homo sapiens
cagtggaggctggcagggtcc

SEQ ID NO: 6032623 - DNA, 13 bp, Homo sapiens
cagtggagggaga

SEQ ID NO: 6032624 - DNA, 15 bp, Homo sapiens
cagtggaggtttgtc

SEQ ID NO: 6032625 - DNA, 22 bp, Homo sapiens
cagtggagtccagatggcaggc

SEQ ID NO: 6032626 - DNA, 23 bp, Homo sapiens
cagtggagtccagatggcaggct

SEQ ID NO: 6032627 - DNA, 11 bp, Homo sapiens
cagtggagtga

SEQ ID NO: 6032628 - DNA, 17 bp, Homo sapiens
cagtggatatgacccac

SEQ ID NO: 6032629 - DNA, 20 bp, Homo sapiens
cagtggatcatgaaaagtgc

SEQ ID NO: 6032630 - DNA, 15 bp, Homo sapiens
cagtggatcccctgc

SEQ ID NO: 6032631 - DNA, 13 bp, Homo sapiens
cagtggatcttca

SEQ ID NO: 6032632 - DNA, 19 bp, Homo sapiens
cagtggatcttcagaactg

SEQ ID NO: 6032633 - DNA, 17 bp, Homo sapiens
cagtggatgagggccac

SEQ ID NO: 6032634 - DNA, 12 bp, Homo sapiens
cagtggatggat

SEQ ID NO: 6032635 - DNA, 17 bp, Homo sapiens
cagtggattcccacagc

SEQ ID NO: 6032636 - DNA, 16 bp, Homo sapiens
cagtggattgcatttc

SEQ ID NO: 6032637 - DNA, 14 bp, Homo sapiens
cagtggcaaaatat

SEQ ID NO: 6032638 - DNA, 24 bp, Homo sapiens
cagtggcaaaatattatgttatga

SEQ ID NO: 6032639 - DNA, 20 bp, Homo sapiens
cagtggcacgatctcagctc

SEQ ID NO: 6032640 - DNA, 13 bp, Homo sapiens
cagtggcactaaa

SEQ ID NO: 6032641 - DNA, 19 bp, Homo sapiens
cagtggcactaaaatgttt

SEQ ID NO: 6032642 - DNA, 15 bp, Homo sapiens
cagtggcactctgtg

SEQ ID NO: 6032643 - DNA, 18 bp, Homo sapiens
cagtggcagacaaacaga

SEQ ID NO: 6032644 - DNA, 18 bp, Homo sapiens
cagtggcagagaatccaa

SEQ ID NO: 6032645 - DNA, 15 bp, Homo sapiens
cagtggcagcaaagg

SEQ ID NO: 6032646 - DNA, 12 bp, Homo sapiens
cagtggcagctg

SEQ ID NO: 6032647 - DNA, 14 bp, Homo sapiens
cagtggcagctgct

SEQ ID NO: 6032648 - DNA, 15 bp, Homo sapiens
cagtggcagctgctt

SEQ ID NO: 6032649 - DNA, 16 bp, Homo sapiens
cagtggcagctgcttt

SEQ ID NO: 6032650 - DNA, 17 bp, Homo sapiens
cagtggcaggacaggaa

SEQ ID NO: 6032651 - DNA, 16 bp, Homo sapiens
cagtggcagggcacag

SEQ ID NO: 6032652 - DNA, 17 bp, Homo sapiens
cagtggcagggcacagg

SEQ ID NO: 6032653 - DNA, 14 bp, Homo sapiens
cagtggcaggggag

SEQ ID NO: 6032654 - DNA, 16 bp, Homo sapiens
cagtggcaggggagca

SEQ ID NO: 6032655 - DNA, 17 bp, Homo sapiens
cagtggcaggggagcag

SEQ ID NO: 6032656 - DNA, 14 bp, Homo sapiens
cagtggcagtattg

SEQ ID NO: 6032657 - DNA, 15 bp, Homo sapiens
cagtggcagtattga

SEQ ID NO: 6032658 - DNA, 17 bp, Homo sapiens
cagtggccaagcctgct

SEQ ID NO: 6032659 - DNA, 12 bp, Homo sapiens
cagtggccaggc

SEQ ID NO: 6032660 - DNA, 13 bp, Homo sapiens
cagtggccaggca

SEQ ID NO: 6032661 - DNA, 14 bp, Homo sapiens
cagtggccaggcag

SEQ ID NO: 6032662 - DNA, 12 bp, Homo sapiens
cagtggccaggt

SEQ ID NO: 6032663 - DNA, 14 bp, Homo sapiens
cagtggccatcatc

SEQ ID NO: 6032664 - DNA, 16 bp, Homo sapiens
cagtggcccatggcat

SEQ ID NO: 6032665 - DNA, 21 bp, Homo sapiens
cagtggccccatccagcatgt

SEQ ID NO: 6032666 - DNA, 23 bp, Homo sapiens
cagtggccccatccagcatgtgt

SEQ ID NO: 6032667 - DNA, 21 bp, Homo sapiens
cagtggcccccgggcctgcac

SEQ ID NO: 6032668 - DNA, 22 bp, Homo sapiens
cagtggcccccgggcctgcaca

SEQ ID NO: 6032669 - DNA, 18 bp, Homo sapiens
cagtggccgaacccccca

SEQ ID NO: 6032670 - DNA, 18 bp, Homo sapiens
cagtggccggggctgaag

SEQ ID NO: 6032671 - DNA, 19 bp, Homo sapiens
cagtggccggggctgaagc

SEQ ID NO: 6032672 - DNA, 21 bp, Homo sapiens
cagtggccggggctgaagcca

SEQ ID NO: 6032673 - DNA, 14 bp, Homo sapiens
cagtggcctacaaa

SEQ ID NO: 6032674 - DNA, 19 bp, Homo sapiens
cagtggcctcaaccctccc

SEQ ID NO: 6032675 - DNA, 15 bp, Homo sapiens
ccaagatggcccatc

SEQ ID NO: 6032676 - DNA, 18 bp, Homo sapiens
ccaagatggcccatcctg

SEQ ID NO: 6032677 - DNA, 15 bp, Homo sapiens
ccaagatggctgctg

SEQ ID NO: 6032678 - DNA, 22 bp, Homo sapiens
ccaagatggctgctgcctgctc

SEQ ID NO: 6032679 - DNA, 19 bp, Homo sapiens
ccaagatgggcacatgagg

SEQ ID NO: 6032680 - DNA, 24 bp, Homo sapiens
ccaagatgggcacatgaggagggt

SEQ ID NO: 6032681 - DNA, 21 bp, Homo sapiens
ccaagatgtcaagctggccgt

SEQ ID NO: 6032682 - DNA, 17 bp, Homo sapiens
ccaagatgttctcctga

SEQ ID NO: 6032683 - DNA, 14 bp, Homo sapiens
ccaagattctactc

SEQ ID NO: 6032684 - DNA, 15 bp, Homo sapiens
ccaagatttaaaatt

SEQ ID NO: 6032685 - DNA, 16 bp, Homo sapiens
ccaagattttcctctt

SEQ ID NO: 6032686 - DNA, 19 bp, Homo sapiens
ccaagattttcctcttgtg

SEQ ID NO: 6032687 - DNA, 10 bp, Homo sapiens
ccaagcaaag

SEQ ID NO: 6032688 - DNA, 19 bp, Homo sapiens
ccaagcaaatgcctgccaa

SEQ ID NO: 6032689 - DNA, 18 bp, Homo sapiens
ccaagcaacagcctttga

SEQ ID NO: 6032690 - DNA, 20 bp, Homo sapiens
ccaagcacagagcctggccc

SEQ ID NO: 6032691 - DNA, 19 bp, Homo sapiens
ccaagcacagtggtggcag

SEQ ID NO: 6032692 - DNA, 18 bp, Homo sapiens
ccaagcacccagagcttt

SEQ ID NO: 6032693 - DNA, 20 bp, Homo sapiens
ccaagcacctgggattacaa

SEQ ID NO: 6032694 - DNA, 13 bp, Homo sapiens
ccaagcactgctc

SEQ ID NO: 6032695 - DNA, 15 bp, Homo sapiens
ccaagcactgctcac

SEQ ID NO: 6032696 - DNA, 23 bp, Homo sapiens
ccaagcactgctcacgtctctgc

SEQ ID NO: 6032697 - DNA, 14 bp, Homo sapiens
ccaagcactgtgct

SEQ ID NO: 6032698 - DNA, 21 bp, Homo sapiens
ccaagcagagcaatcagttag

SEQ ID NO: 6032699 - DNA, 18 bp, Homo sapiens
ccaagcagagcgggtaaa

SEQ ID NO: 6032700 - DNA, 21 bp, Homo sapiens
ccaagcagcattcagcacacc

SEQ ID NO: 6032701 - DNA, 11 bp, Homo sapiens
ccaagcagcca

SEQ ID NO: 6032702 - DNA, 16 bp, Homo sapiens
ccaagcagccaagctc

SEQ ID NO: 6032703 - DNA, 13 bp, Homo sapiens
ccaagcagccagc

SEQ ID NO: 6032704 - DNA, 18 bp, Homo sapiens
ccaagcagccagccagtc

SEQ ID NO: 6032705 - DNA, 20 bp, Homo sapiens
ccaagcaggaagctcagact

SEQ ID NO: 6032706 - DNA, 18 bp, Homo sapiens
ccaagcaggacagtgctt

SEQ ID NO: 6032707 - DNA, 20 bp, Homo sapiens
ccaagcaggacgaaaaagag

SEQ ID NO: 6032708 - DNA, 14 bp, Homo sapiens
ccaagcaggaggct

SEQ ID NO: 6032709 - DNA, 13 bp, Homo sapiens
ccaagcaggcact

SEQ ID NO: 6032710 - DNA, 20 bp, Homo sapiens
ccaagcagtgcctgcctatg

SEQ ID NO: 6032711 - DNA, 20 bp, Homo sapiens
ccaagcagtggcctttttct

SEQ ID NO: 6032712 - DNA, 21 bp, Homo sapiens
ccaagcatagagaagagtctg

SEQ ID NO: 6032713 - DNA, 18 bp, Homo sapiens
ccaagcatataaaatttt

SEQ ID NO: 6032714 - DNA, 13 bp, Homo sapiens
ccaagcatcttgg

SEQ ID NO: 6032715 - DNA, 23 bp, Homo sapiens
ccaagcatcttgggggggtggcc

SEQ ID NO: 6032716 - DNA, 14 bp, Homo sapiens
ccaagcattacttt

SEQ ID NO: 6032717 - DNA, 23 bp, Homo sapiens
ccaagcatttaatgtagccatgg

SEQ ID NO: 6032718 - DNA, 22 bp, Homo sapiens
ccaagcatttcatgaaaaagct

SEQ ID NO: 6032719 - DNA, 18 bp, Homo sapiens
ccaagccaagggaacctg

SEQ ID NO: 6032720 - DNA, 23 bp, Homo sapiens
ccaagccaagggaacctgtgtcc

SEQ ID NO: 6032721 - DNA, 16 bp, Homo sapiens
ccaagccaatgttata

SEQ ID NO: 6032722 - DNA, 13 bp, Homo sapiens
ccaagccaccgca

SEQ ID NO: 6032723 - DNA, 16 bp, Homo sapiens
ccaagccaccgcagct

SEQ ID NO: 6032724 - DNA, 17 bp, Homo sapiens
ccaagccaccgcagctg

SEQ ID NO: 6032725 - DNA, 19 bp, Homo sapiens
ccaagccaccgcagctgct

SEQ ID NO: 6032726 - DNA, 21 bp, Homo sapiens
ccaagccaccgcagctgctgc

SEQ ID NO: 6032727 - DNA, 11 bp, Homo sapiens
ccaagccagag

SEQ ID NO: 6032728 - DNA, 16 bp, Homo sapiens
ccaagccagaggctgg

SEQ ID NO: 6032729 - DNA, 19 bp, Homo sapiens
ccaagccagattctcttga

SEQ ID NO: 6032730 - DNA, 11 bp, Homo sapiens
ccaagccagct

SEQ ID NO: 6032731 - DNA, 14 bp, Homo sapiens
ccaagccagctgcc

SEQ ID NO: 6032732 - DNA, 15 bp, Homo sapiens
ccaagccagctgcct

SEQ ID NO: 6032733 - DNA, 22 bp, Homo sapiens
ccaagccagggttccagacagg

SEQ ID NO: 6032734 - DNA, 23 bp, Homo sapiens
ccaagccagggttccagacaggg

SEQ ID NO: 6032735 - DNA, 14 bp, Homo sapiens
ccaagccatcacag

SEQ ID NO: 6032736 - DNA, 18 bp, Homo sapiens
ccaagccatggcatgctc

SEQ ID NO: 6032737 - DNA, 18 bp, Homo sapiens
ccaagcccaccaggtgtc

SEQ ID NO: 6032738 - DNA, 17 bp, Homo sapiens
ccaagcccaccctggga

SEQ ID NO: 6032739 - DNA, 15 bp, Homo sapiens
ccaagcccagcccat

SEQ ID NO: 6032740 - DNA, 15 bp, Homo sapiens
ccaagccccccgagt

SEQ ID NO: 6032741 - DNA, 17 bp, Homo sapiens
ccaagccccctggcagc

SEQ ID NO: 6032742 - DNA, 18 bp, Homo sapiens
ccaagccccctggcagct

SEQ ID NO: 6032743 - DNA, 20 bp, Homo sapiens
ccaagcccctagtcttagag

SEQ ID NO: 6032744 - DNA, 22 bp, Homo sapiens
ccaagcccctgccctggggaga

SEQ ID NO: 6032745 - DNA, 21 bp, Homo sapiens
ccaagccccttggccctctcc

SEQ ID NO: 6032746 - DNA, 22 bp, Homo sapiens
ccaagccccttggccctctccc

SEQ ID NO: 6032747 - DNA, 22 bp, Homo sapiens
ccaagcccgacttgctgttttg

SEQ ID NO: 6032748 - DNA, 17 bp, Homo sapiens
ccaagccctaagcctgt

SEQ ID NO: 6032749 - DNA, 18 bp, Homo sapiens
ccaagccctaagcctgtc

SEQ ID NO: 6032750 - DNA, 12 bp, Homo sapiens
ccaagccctcag

SEQ ID NO: 6032751 - DNA, 15 bp, Homo sapiens
ccaagccctccgcct

SEQ ID NO: 6032752 - DNA, 20 bp, Homo sapiens
ccaagccctgaggcctgagg

SEQ ID NO: 6032753 - DNA, 15 bp, Homo sapiens
ccaagccctgcccct

SEQ ID NO: 6032754 - DNA, 13 bp, Homo sapiens
ccaagccctgggg

SEQ ID NO: 6032755 - DNA, 18 bp, Homo sapiens
ccaagccctggtgaccag

SEQ ID NO: 6032756 - DNA, 14 bp, Homo sapiens
ccaagccctttgct

SEQ ID NO: 6032757 - DNA, 15 bp, Homo sapiens
ccaagccctttgctg

SEQ ID NO: 6032758 - DNA, 21 bp, Homo sapiens
ccaagcccttttacagctctt

SEQ ID NO: 6032759 - DNA, 23 bp, Homo sapiens
ccaagccggcccaacccaaccac

SEQ ID NO: 6032760 - DNA, 21 bp, Homo sapiens
ccaagccgtggcttcccgctc

SEQ ID NO: 6032761 - DNA, 22 bp, Homo sapiens
ccaagcctacttttgccattga

SEQ ID NO: 6032762 - DNA, 11 bp, Homo sapiens
ccaagcctatc

SEQ ID NO: 6032763 - DNA, 15 bp, Homo sapiens
ccaagcctccacagc

SEQ ID NO: 6032764 - DNA, 16 bp, Homo sapiens
ccaagcctctgcccca

SEQ ID NO: 6032765 - DNA, 21 bp, Homo sapiens
ccaagcctctgccccaagggg

SEQ ID NO: 6032766 - DNA, 13 bp, Homo sapiens
ccaagcctctgga

SEQ ID NO: 6032767 - DNA, 14 bp, Homo sapiens
ccaagcctgcaact

SEQ ID NO: 6032768 - DNA, 13 bp, Homo sapiens
ccaagcctgcagc

SEQ ID NO: 6032769 - DNA, 14 bp, Homo sapiens
ccaagcctgccccg

SEQ ID NO: 6032770 - DNA, 15 bp, Homo sapiens
ccaagcctgccccgg

SEQ ID NO: 6032771 - DNA, 13 bp, Homo sapiens
ccaagcctgctgg

SEQ ID NO: 6032772 - DNA, 14 bp, Homo sapiens
ccaagcctgctggc

SEQ ID NO: 6032773 - DNA, 18 bp, Homo sapiens
ccaagcctgctggctgcg

SEQ ID NO: 6032774 - DNA, 12 bp, Homo sapiens
ccaagcctggag

SEQ ID NO: 6032775 - DNA, 16 bp, Homo sapiens
ccaagcctggagcccc

SEQ ID NO: 6032776 - DNA, 22 bp, Homo sapiens
ccaagcctggagcccctgtgtt

SEQ ID NO: 6032777 - DNA, 11 bp, Homo sapiens
ccaagcctggc

SEQ ID NO: 6032778 - DNA, 15 bp, Homo sapiens
ccaagcctggcaagg

SEQ ID NO: 6032779 - DNA, 13 bp, Homo sapiens
ccaagcctggcac

SEQ ID NO: 6032780 - DNA, 18 bp, Homo sapiens
ccaagcctggcacccacc

SEQ ID NO: 6032781 - DNA, 17 bp, Homo sapiens
ccaagcctgggccactg

SEQ ID NO: 6032782 - DNA, 19 bp, Homo sapiens
ccaagcctgggccactggc

SEQ ID NO: 6032783 - DNA, 19 bp, Homo sapiens
ccaagcctggtcagcccaa

SEQ ID NO: 6032784 - DNA, 12 bp, Homo sapiens
ccaagccttctg

SEQ ID NO: 6032785 - DNA, 22 bp, Homo sapiens
ccaagccttgattggtgttgcc

SEQ ID NO: 6032786 - DNA, 11 bp, Homo sapiens
ccaagccttgg

SEQ ID NO: 6032787 - DNA, 19 bp, Homo sapiens
ccaagccttggctctaccc

SEQ ID NO: 6032788 - DNA, 17 bp, Homo sapiens
ccaagcgccctggcccc

SEQ ID NO: 6032789 - DNA, 15 bp, Homo sapiens
ccaagctaatttata

SEQ ID NO: 6032790 - DNA, 15 bp, Homo sapiens
ccaagctatctaaag

SEQ ID NO: 6032791 - DNA, 13 bp, Homo sapiens
ccaagctattcct

SEQ ID NO: 6032792 - DNA, 17 bp, Homo sapiens
ccaagctattcctttcc

SEQ ID NO: 6032793 - DNA, 23 bp, Homo sapiens
ccaagctattcctttcccttcct

SEQ ID NO: 6032794 - DNA, 23 bp, Homo sapiens
ccaagctcacacctgtccttctc

SEQ ID NO: 6032795 - DNA, 14 bp, Homo sapiens
ccaagctcagaagg

SEQ ID NO: 6032796 - DNA, 17 bp, Homo sapiens
ccaagctcagagcagcc

SEQ ID NO: 6032797 - DNA, 14 bp, Homo sapiens
ccaagctccaaatc

SEQ ID NO: 6032798 - DNA, 13 bp, Homo sapiens
ccaagctccaagc

SEQ ID NO: 6032799 - DNA, 15 bp, Homo sapiens
ccaagctccaagccc

SEQ ID NO: 6032800 - DNA, 17 bp, Homo sapiens
ccaagctccaagcccca

SEQ ID NO: 6032801 - DNA, 12 bp, Homo sapiens
ccaagctcccag

SEQ ID NO: 6032802 - DNA, 14 bp, Homo sapiens
ccaagctcccaggc

SEQ ID NO: 6032803 - DNA, 15 bp, Homo sapiens
ccaagctccctgccc

SEQ ID NO: 6032804 - DNA, 21 bp, Homo sapiens
ccaagctccctgccccaaata

SEQ ID NO: 6032805 - DNA, 21 bp, Homo sapiens
ccaagctccctggagccctgt

SEQ ID NO: 6032806 - DNA, 22 bp, Homo sapiens
ccaagctcctcctcggaaccgc

SEQ ID NO: 6032807 - DNA, 14 bp, Homo sapiens
ccaagctccttggg

SEQ ID NO: 6032808 - DNA, 15 bp, Homo sapiens
ccaagctctctgcat

SEQ ID NO: 6032809 - DNA, 15 bp, Homo sapiens
ccaagctctgcagtc

SEQ ID NO: 6032810 - DNA, 12 bp, Homo sapiens
ccaagctctgct

SEQ ID NO: 6032811 - DNA, 13 bp, Homo sapiens
ccaagctctgctc

SEQ ID NO: 6032812 - DNA, 13 bp, Homo sapiens
ccaagctgaggag

SEQ ID NO: 6032813 - DNA, 12 bp, Homo sapiens
ccaagctgaggt

SEQ ID NO: 6032814 - DNA, 19 bp, Homo sapiens
ccaagctgaggtgcccagg

SEQ ID NO: 6032815 - DNA, 15 bp, Homo sapiens
ccaagctgagtttcc

SEQ ID NO: 6032816 - DNA, 18 bp, Homo sapiens
ccaagctgatggacatga

SEQ ID NO: 6032817 - DNA, 22 bp, Homo sapiens
ccaagctgatggacatgagagt

SEQ ID NO: 6032818 - DNA, 16 bp, Homo sapiens
ccaagctgcctctggg

SEQ ID NO: 6032819 - DNA, 18 bp, Homo sapiens
ccaagctgctctccttca

SEQ ID NO: 6032820 - DNA, 14 bp, Homo sapiens
ccaagctgctgccg

SEQ ID NO: 6032821 - DNA, 12 bp, Homo sapiens
ccaagctggcag

SEQ ID NO: 6032822 - DNA, 22 bp, Homo sapiens
ccaagctggcagctgtcattca

SEQ ID NO: 6032823 - DNA, 14 bp, Homo sapiens
ccaagctggctggg

SEQ ID NO: 6032824 - DNA, 17 bp, Homo sapiens
ccaagctggctggggtg

SEQ ID NO: 6032825 - DNA, 23 bp, Homo sapiens
ccaagctggctggggtggcctgt

SEQ ID NO: 6032826 - DNA, 19 bp, Homo sapiens
ccaagctgggccccagccc

SEQ ID NO: 6032827 - DNA, 20 bp, Homo sapiens
ccaagctgggccccagccca

SEQ ID NO: 6032828 - DNA, 22 bp, Homo sapiens
ccaagctgggccccagcccacc

SEQ ID NO: 6032829 - DNA, 16 bp, Homo sapiens
ccaagctgggccgagg

SEQ ID NO: 6032830 - DNA, 19 bp, Homo sapiens
ccaagctgggctcccttta

SEQ ID NO: 6032831 - DNA, 23 bp, Homo sapiens
ccaagctggtcttaaactcctgg

SEQ ID NO: 6032832 - DNA, 19 bp, Homo sapiens
ccaagctgtacccttgaga

SEQ ID NO: 6032833 - DNA, 13 bp, Homo sapiens
ccaagctgtcaca

SEQ ID NO: 6032834 - DNA, 11 bp, Homo sapiens
ccaagctgtgc

SEQ ID NO: 6032835 - DNA, 15 bp, Homo sapiens
ccaagctgtgccacc

SEQ ID NO: 6032836 - DNA, 14 bp, Homo sapiens
ccaagctgtgctgg

SEQ ID NO: 6032837 - DNA, 22 bp, Homo sapiens
ccaagctgtggcagccgtccca

SEQ ID NO: 6032838 - DNA, 23 bp, Homo sapiens
ccaagctgtggcagccgtcccag

SEQ ID NO: 6032839 - DNA, 21 bp, Homo sapiens
ccaagctgtgttaactgttca

SEQ ID NO: 6032840 - DNA, 13 bp, Homo sapiens
ccaagctgtgttc

SEQ ID NO: 6032841 - DNA, 15 bp, Homo sapiens
ccaagctgtgttcat

SEQ ID NO: 6032842 - DNA, 16 bp, Homo sapiens
ccaagctgtgttcatc

SEQ ID NO: 6032843 - DNA, 17 bp, Homo sapiens
ccaagctgttaaagata

SEQ ID NO: 6032844 - DNA, 20 bp, Homo sapiens
ccaagctgttaaagatattt

SEQ ID NO: 6032845 - DNA, 18 bp, Homo sapiens
ccaagctgttagttgctg

SEQ ID NO: 6032846 - DNA, 18 bp, Homo sapiens
ccaagctgttttcttcta

SEQ ID NO: 6032847 - DNA, 21 bp, Homo sapiens
ccaagcttaatagccctcccc

SEQ ID NO: 6032848 - DNA, 18 bp, Homo sapiens
ccaagcttagtcctggga

SEQ ID NO: 6032849 - DNA, 19 bp, Homo sapiens
ccaagcttagtcctgggag

SEQ ID NO: 6032850 - DNA, 21 bp, Homo sapiens
ccaagcttagtcctgggagag

SEQ ID NO: 6032851 - DNA, 18 bp, Homo sapiens
ccaagcttcaaccctcag

SEQ ID NO: 6032852 - DNA, 23 bp, Homo sapiens
ccaagcttcaaccctcagccttg

SEQ ID NO: 6032853 - DNA, 15 bp, Homo sapiens
ccaagcttcagagcc

SEQ ID NO: 6032854 - DNA, 20 bp, Homo sapiens
ccaagcttcagagcctagcc

SEQ ID NO: 6032855 - DNA, 23 bp, Homo sapiens
cagtggcctcaaccctccctcag

SEQ ID NO: 6032856 - DNA, 15 bp, Homo sapiens
cagtggcctcttgag

SEQ ID NO: 6032857 - DNA, 14 bp, Homo sapiens
cagtggcctggccg

SEQ ID NO: 6032858 - DNA, 13 bp, Homo sapiens
cagtggcctggct

SEQ ID NO: 6032859 - DNA, 18 bp, Homo sapiens
cagtggcctggctccgct

SEQ ID NO: 6032860 - DNA, 21 bp, Homo sapiens
cagtggcgaaatccctgctca

SEQ ID NO: 6032861 - DNA, 22 bp, Homo sapiens
cagtggcgaaatccctgctcac

SEQ ID NO: 6032862 - DNA, 23 bp, Homo sapiens
cagtggcgaaatccctgctcact

SEQ ID NO: 6032863 - DNA, 22 bp, Homo sapiens
cagtggcggcacgtccttgggc

SEQ ID NO: 6032864 - DNA, 19 bp, Homo sapiens
cagtggcgtgatcttggct

SEQ ID NO: 6032865 - DNA, 18 bp, Homo sapiens
cagtggctcacacctgta

SEQ ID NO: 6032866 - DNA, 20 bp, Homo sapiens
cagtggctcacacctgtaat

SEQ ID NO: 6032867 - DNA, 20 bp, Homo sapiens
cagtggctcccctgcccagc

SEQ ID NO: 6032868 - DNA, 13 bp, Homo sapiens
cagtggctcgctc

SEQ ID NO: 6032869 - DNA, 15 bp, Homo sapiens
cagtggctctcagag

SEQ ID NO: 6032870 - DNA, 20 bp, Homo sapiens
cagtggctctcagagcagca

SEQ ID NO: 6032871 - DNA, 13 bp, Homo sapiens
cagtggctctcca

SEQ ID NO: 6032872 - DNA, 13 bp, Homo sapiens
cagtggctctggg

SEQ ID NO: 6032873 - DNA, 23 bp, Homo sapiens
cagtggctgagtagctctgcctt

SEQ ID NO: 6032874 - DNA, 16 bp, Homo sapiens
cagtggctgctctggg

SEQ ID NO: 6032875 - DNA, 21 bp, Homo sapiens
cagtggctgctctgggaaggg

SEQ ID NO: 6032876 - DNA, 14 bp, Homo sapiens
cagtggctggggga

SEQ ID NO: 6032877 - DNA, 20 bp, Homo sapiens
cagtggctgggggactgctt

SEQ ID NO: 6032878 - DNA, 19 bp, Homo sapiens
cagtggctgggggtgctag

SEQ ID NO: 6032879 - DNA, 13 bp, Homo sapiens
cagtggctgggtg

SEQ ID NO: 6032880 - DNA, 20 bp, Homo sapiens
cagtggctggtgcccatgaa

SEQ ID NO: 6032881 - DNA, 21 bp, Homo sapiens
cagtggctggtgcccatgaag

SEQ ID NO: 6032882 - DNA, 21 bp, Homo sapiens
cagtggctgtgaaggagtaat

SEQ ID NO: 6032883 - DNA, 18 bp, Homo sapiens
cagtggcttagctgccat

SEQ ID NO: 6032884 - DNA, 16 bp, Homo sapiens
cagtggcttccatcaa

SEQ ID NO: 6032885 - DNA, 19 bp, Homo sapiens
cagtggcttcccagctctg

SEQ ID NO: 6032886 - DNA, 15 bp, Homo sapiens
cagtggcttctccag

SEQ ID NO: 6032887 - DNA, 17 bp, Homo sapiens
cagtggcttctccaggg

SEQ ID NO: 6032888 - DNA, 20 bp, Homo sapiens
cagtggcttctccatcctca

SEQ ID NO: 6032889 - DNA, 17 bp, Homo sapiens
cagtggcttctcccaac

SEQ ID NO: 6032890 - DNA, 20 bp, Homo sapiens
cagtggcttggagcagaggt

SEQ ID NO: 6032891 - DNA, 21 bp, Homo sapiens
cagtggcttggagcagaggtg

SEQ ID NO: 6032892 - DNA, 12 bp, Homo sapiens
cagtggcttttc

SEQ ID NO: 6032893 - DNA, 18 bp, Homo sapiens
cagtgggaaaaatgtagg

SEQ ID NO: 6032894 - DNA, 19 bp, Homo sapiens
cagtgggaaaaatgtagga

SEQ ID NO: 6032895 - DNA, 12 bp, Homo sapiens
cagtgggaaata

SEQ ID NO: 6032896 - DNA, 19 bp, Homo sapiens
cagtgggaacgtgactgcc

SEQ ID NO: 6032897 - DNA, 11 bp, Homo sapiens
cagtgggacaa

SEQ ID NO: 6032898 - DNA, 22 bp, Homo sapiens
cagtgggacaaaccagagcaga

SEQ ID NO: 6032899 - DNA, 16 bp, Homo sapiens
cagtgggaccacatgc

SEQ ID NO: 6032900 - DNA, 13 bp, Homo sapiens
cagtgggagccag

SEQ ID NO: 6032901 - DNA, 13 bp, Homo sapiens
cagtgggagccct

SEQ ID NO: 6032902 - DNA, 11 bp, Homo sapiens
cagtgggagct

SEQ ID NO: 6032903 - DNA, 13 bp, Homo sapiens
cagtgggagctga

SEQ ID NO: 6032904 - DNA, 16 bp, Homo sapiens
cagtgggaggacagag

SEQ ID NO: 6032905 - DNA, 17 bp, Homo sapiens
cagtgggagggaattcc

SEQ ID NO: 6032906 - DNA, 17 bp, Homo sapiens
cagtgggaggggcaggc

SEQ ID NO: 6032907 - DNA, 22 bp, Homo sapiens
cagtgggaggtgagaccacctc

SEQ ID NO: 6032908 - DNA, 23 bp, Homo sapiens
cagtgggatcttacccacttccc

SEQ ID NO: 6032909 - DNA, 20 bp, Homo sapiens
cagtgggatgggctctacct

SEQ ID NO: 6032910 - DNA, 18 bp, Homo sapiens
cagtgggatttggtaatg

SEQ ID NO: 6032911 - DNA, 20 bp, Homo sapiens
cagtgggcactaagggtgga

SEQ ID NO: 6032912 - DNA, 21 bp, Homo sapiens
cagtgggcactaagggtggag

SEQ ID NO: 6032913 - DNA, 23 bp, Homo sapiens
cagtgggcactaagggtggagag

SEQ ID NO: 6032914 - DNA, 16 bp, Homo sapiens
cagtgggcaggtggcc

SEQ ID NO: 6032915 - DNA, 18 bp, Homo sapiens
cagtgggcatcagcagca

SEQ ID NO: 6032916 - DNA, 16 bp, Homo sapiens
cagtgggcatgtatta

SEQ ID NO: 6032917 - DNA, 13 bp, Homo sapiens
cagtgggcccgga

SEQ ID NO: 6032918 - DNA, 19 bp, Homo sapiens
cagtgggccggccccaggc

SEQ ID NO: 6032919 - DNA, 22 bp, Homo sapiens
cagtgggccggccccaggctcc

SEQ ID NO: 6032920 - DNA, 15 bp, Homo sapiens
cagtgggcctgctga

SEQ ID NO: 6032921 - DNA, 16 bp, Homo sapiens
cagtgggcctgctgag

SEQ ID NO: 6032922 - DNA, 14 bp, Homo sapiens
cagtgggcctggcc

SEQ ID NO: 6032923 - DNA, 19 bp, Homo sapiens
cagtgggcggcttccctgc

SEQ ID NO: 6032924 - DNA, 20 bp, Homo sapiens
cagtgggcggcttccctgcg

SEQ ID NO: 6032925 - DNA, 18 bp, Homo sapiens
cagtgggcgggccatgag

SEQ ID NO: 6032926 - DNA, 22 bp, Homo sapiens
cagtgggcgttgggagcctagc

SEQ ID NO: 6032927 - DNA, 23 bp, Homo sapiens
cagtgggcgttgggagcctagct

SEQ ID NO: 6032928 - DNA, 13 bp, Homo sapiens
cagtgggctccct

SEQ ID NO: 6032929 - DNA, 20 bp, Homo sapiens
cagtgggctccctggcccag

SEQ ID NO: 6032930 - DNA, 22 bp, Homo sapiens
cagtgggctccctggcccagcc

SEQ ID NO: 6032931 - DNA, 19 bp, Homo sapiens
cagtgggctgcacgctccc

SEQ ID NO: 6032932 - DNA, 11 bp, Homo sapiens
cagtgggctgt

SEQ ID NO: 6032933 - DNA, 17 bp, Homo sapiens
cagtggggacagggagg

SEQ ID NO: 6032934 - DNA, 19 bp, Homo sapiens
cagtggggacagggagggg

SEQ ID NO: 6032935 - DNA, 14 bp, Homo sapiens
cagtggggccagca

SEQ ID NO: 6032936 - DNA, 15 bp, Homo sapiens
cagtggggcccatgg

SEQ ID NO: 6032937 - DNA, 19 bp, Homo sapiens
cagtggggcccatggcccc

SEQ ID NO: 6032938 - DNA, 16 bp, Homo sapiens
cagtggggcctgtgga

SEQ ID NO: 6032939 - DNA, 21 bp, Homo sapiens
cagtggggctctctgagtcct

SEQ ID NO: 6032940 - DNA, 15 bp, Homo sapiens
cagtggggctgcagg

SEQ ID NO: 6032941 - DNA, 19 bp, Homo sapiens
cagtggggctgcaggcagg

SEQ ID NO: 6032942 - DNA, 13 bp, Homo sapiens
cagtggggctgga

SEQ ID NO: 6032943 - DNA, 16 bp, Homo sapiens
cagtggggctggcatc

SEQ ID NO: 6032944 - DNA, 14 bp, Homo sapiens
cagtggggctgggg

SEQ ID NO: 6032945 - DNA, 15 bp, Homo sapiens
cagtgggggtgcctg

SEQ ID NO: 6032946 - DNA, 16 bp, Homo sapiens
cagtggggtaggctgc

SEQ ID NO: 6032947 - DNA, 18 bp, Homo sapiens
cagtggggtaggctgctg

SEQ ID NO: 6032948 - DNA, 18 bp, Homo sapiens
cagtggggtcaagctgag

SEQ ID NO: 6032949 - DNA, 22 bp, Homo sapiens
cagtggggtttcgcagcctgag

SEQ ID NO: 6032950 - DNA, 16 bp, Homo sapiens
cagtgggtaaaattag

SEQ ID NO: 6032951 - DNA, 17 bp, Homo sapiens
cagtgggtcccacttcc

SEQ ID NO: 6032952 - DNA, 13 bp, Homo sapiens
cagtgggtgcccc

SEQ ID NO: 6032953 - DNA, 16 bp, Homo sapiens
cagtgggtggcacctc

SEQ ID NO: 6032954 - DNA, 17 bp, Homo sapiens
cagtgggtggcacctcc

SEQ ID NO: 6032955 - DNA, 19 bp, Homo sapiens
cagtgggtggcacctcctg

SEQ ID NO: 6032956 - DNA, 20 bp, Homo sapiens
cagtgggtggcacctcctga

SEQ ID NO: 6032957 - DNA, 15 bp, Homo sapiens
cagtgggtggggctg

SEQ ID NO: 6032958 - DNA, 18 bp, Homo sapiens
cagtgggtggggctgtac

SEQ ID NO: 6032959 - DNA, 21 bp, Homo sapiens
cagtgggttaacatcagtttt

SEQ ID NO: 6032960 - DNA, 15 bp, Homo sapiens
cagtgggttaattat

SEQ ID NO: 6032961 - DNA, 17 bp, Homo sapiens
cagtgggttcagaacca

SEQ ID NO: 6032962 - DNA, 16 bp, Homo sapiens
cagtgggttcaggccc

SEQ ID NO: 6032963 - DNA, 16 bp, Homo sapiens
cagtggtaagaatagt

SEQ ID NO: 6032964 - DNA, 20 bp, Homo sapiens
cagtggtaagctctggcttt

SEQ ID NO: 6032965 - DNA, 16 bp, Homo sapiens
cagtggtaccagctca

SEQ ID NO: 6032966 - DNA, 17 bp, Homo sapiens
cagtggtagctctggct

SEQ ID NO: 6032967 - DNA, 18 bp, Homo sapiens
cagtggtcaaaccgcact

SEQ ID NO: 6032968 - DNA, 18 bp, Homo sapiens
cagtggtcatgctcagcc

SEQ ID NO: 6032969 - DNA, 16 bp, Homo sapiens
cagtggtcattgggca

SEQ ID NO: 6032970 - DNA, 22 bp, Homo sapiens
cagtggtccagggtccagccct

SEQ ID NO: 6032971 - DNA, 19 bp, Homo sapiens
cagtggtccatggaatgct

SEQ ID NO: 6032972 - DNA, 20 bp, Homo sapiens
cagtggtcccatttatatct

SEQ ID NO: 6032973 - DNA, 11 bp, Homo sapiens
cagtggtctta

SEQ ID NO: 6032974 - DNA, 21 bp, Homo sapiens
cagtggtgcgatcatggctca

SEQ ID NO: 6032975 - DNA, 20 bp, Homo sapiens
cagtggtgcgatctgggttc

SEQ ID NO: 6032976 - DNA, 15 bp, Homo sapiens
cagtggtgcgggcca

SEQ ID NO: 6032977 - DNA, 16 bp, Homo sapiens
cagtggtgcgggccag

SEQ ID NO: 6032978 - DNA, 23 bp, Homo sapiens
cagtggtgcgggccaggtctggc

SEQ ID NO: 6032979 - DNA, 22 bp, Homo sapiens
cagtggtggcaacattcattgc

SEQ ID NO: 6032980 - DNA, 12 bp, Homo sapiens
cagtggtggcag

SEQ ID NO: 6032981 - DNA, 16 bp, Homo sapiens
cagtggtggcagggcc

SEQ ID NO: 6032982 - DNA, 17 bp, Homo sapiens
cagtggtgggtaattgt

SEQ ID NO: 6032983 - DNA, 20 bp, Homo sapiens
cagtggtggttttctgttct

SEQ ID NO: 6032984 - DNA, 22 bp, Homo sapiens
cagtggtggttttctgttcttt

SEQ ID NO: 6032985 - DNA, 13 bp, Homo sapiens
cagtggtgttaca

SEQ ID NO: 6032986 - DNA, 22 bp, Homo sapiens
cagtggttcctaatcctctagg

SEQ ID NO: 6032987 - DNA, 22 bp, Homo sapiens
cagtggttctacaatctattta

SEQ ID NO: 6032988 - DNA, 16 bp, Homo sapiens
cagtggttgcctgggg

SEQ ID NO: 6032989 - DNA, 14 bp, Homo sapiens
cagtggttgctgtt

SEQ ID NO: 6032990 - DNA, 23 bp, Homo sapiens
cagtggttgttttttcattgtgt

SEQ ID NO: 6032991 - DNA, 23 bp, Homo sapiens
cagtggtttctacttcccctggg

SEQ ID NO: 6032992 - DNA, 11 bp, Homo sapiens
cagtgtaaaga

SEQ ID NO: 6032993 - DNA, 18 bp, Homo sapiens
cagtgtaaagaataaatg

SEQ ID NO: 6032994 - DNA, 21 bp, Homo sapiens
cagtgtaactggctgctccct

SEQ ID NO: 6032995 - DNA, 19 bp, Homo sapiens
cagtgtaatccaggggtgt

SEQ ID NO: 6032996 - DNA, 15 bp, Homo sapiens
cagtgtaatccccca

SEQ ID NO: 6032997 - DNA, 20 bp, Homo sapiens
cagtgtacaggtcacccatc

SEQ ID NO: 6032998 - DNA, 15 bp, Homo sapiens
cagtgtacagtcttg

SEQ ID NO: 6032999 - DNA, 17 bp, Homo sapiens
cagtgtacagtcttgta

SEQ ID NO: 6033000 - DNA, 18 bp, Homo sapiens
cagtgtacagtcttgtat

SEQ ID NO: 6033001 - DNA, 15 bp, Homo sapiens
cagtgtacatgtaca

SEQ ID NO: 6033002 - DNA, 15 bp, Homo sapiens
cagtgtaccattaaa

SEQ ID NO: 6033003 - DNA, 18 bp, Homo sapiens
cagtgtaccattaaaata

SEQ ID NO: 6033004 - DNA, 21 bp, Homo sapiens
cagtgtaccattaaaatatgc

SEQ ID NO: 6033005 - DNA, 22 bp, Homo sapiens
cagtgtaccattaaaatatgca

SEQ ID NO: 6033006 - DNA, 23 bp, Homo sapiens
cagtgtacccccgcccaggctgg

SEQ ID NO: 6033007 - DNA, 14 bp, Homo sapiens
cagtgtactgcttt

SEQ ID NO: 6033008 - DNA, 18 bp, Homo sapiens
cagtgtagacctgagctg

SEQ ID NO: 6033009 - DNA, 13 bp, Homo sapiens
cagtgtagatttt

SEQ ID NO: 6033010 - DNA, 16 bp, Homo sapiens
cagtgtagattttata

SEQ ID NO: 6033011 - DNA, 18 bp, Homo sapiens
cagtgtagcatcttcctc

SEQ ID NO: 6033012 - DNA, 20 bp, Homo sapiens
cagtgtagcatcttcctctg

SEQ ID NO: 6033013 - DNA, 14 bp, Homo sapiens
cagtgtagccccaa

SEQ ID NO: 6033014 - DNA, 19 bp, Homo sapiens
cagtgtagccttgcccgga

SEQ ID NO: 6033015 - DNA, 16 bp, Homo sapiens
cagtgtagcgggagga

SEQ ID NO: 6033016 - DNA, 17 bp, Homo sapiens
cagtgtagttaatttat

SEQ ID NO: 6033017 - DNA, 15 bp, Homo sapiens
cagtgtatcaggtca

SEQ ID NO: 6033018 - DNA, 17 bp, Homo sapiens
cagtgtatcaggtcagg

SEQ ID NO: 6033019 - DNA, 14 bp, Homo sapiens
cagtgtatctaatt

SEQ ID NO: 6033020 - DNA, 16 bp, Homo sapiens
cagtgtatggggcagc

SEQ ID NO: 6033021 - DNA, 14 bp, Homo sapiens
cagtgtatgtagaa

SEQ ID NO: 6033022 - DNA, 22 bp, Homo sapiens
cagtgtattagtcataaaacac

SEQ ID NO: 6033023 - DNA, 16 bp, Homo sapiens
cagtgtattgtttatt

SEQ ID NO: 6033024 - DNA, 19 bp, Homo sapiens
cagtgtattgtttattata

SEQ ID NO: 6033025 - DNA, 19 bp, Homo sapiens
cagtgtatttaatgtttgt

SEQ ID NO: 6033026 - DNA, 21 bp, Homo sapiens
cagtgtatttaatgtttgtaa

SEQ ID NO: 6033027 - DNA, 16 bp, Homo sapiens
cagtgtatttcagttc

SEQ ID NO: 6033028 - DNA, 14 bp, Homo sapiens
cagtgtattttaaa

SEQ ID NO: 6033029 - DNA, 18 bp, Homo sapiens
cagtgtattttaaattct

SEQ ID NO: 6033030 - DNA, 17 bp, Homo sapiens
cagtgtattttctgtgt

SEQ ID NO: 6033031 - DNA, 21 bp, Homo sapiens
cagtgtatttttgtaaaaaat

SEQ ID NO: 6033032 - DNA, 16 bp, Homo sapiens
cagtgtcaaataaaca

SEQ ID NO: 6033033 - DNA, 12 bp, Homo sapiens
ccaagcttccca

SEQ ID NO: 6033034 - DNA, 16 bp, Homo sapiens
ccaagcttcctgtgcc

SEQ ID NO: 6033035 - DNA, 18 bp, Homo sapiens
ccaagcttcctgtgccct

SEQ ID NO: 6033036 - DNA, 15 bp, Homo sapiens
ccaagcttggcagcc

SEQ ID NO: 6033037 - DNA, 17 bp, Homo sapiens
ccaagcttggcagccga

SEQ ID NO: 6033038 - DNA, 18 bp, Homo sapiens
ccaagctttaaattatgt

SEQ ID NO: 6033039 - DNA, 17 bp, Homo sapiens
ccaagctttgaataccc

SEQ ID NO: 6033040 - DNA, 23 bp, Homo sapiens
ccaagctttgaggctctgtcact

SEQ ID NO: 6033041 - DNA, 16 bp, Homo sapiens
ccaaggaaaattgaaa

SEQ ID NO: 6033042 - DNA, 19 bp, Homo sapiens
ccaaggaaaattgaaagta

SEQ ID NO: 6033043 - DNA, 18 bp, Homo sapiens
ccaaggaaaccacagctg

SEQ ID NO: 6033044 - DNA, 14 bp, Homo sapiens
ccaaggaaaggcac

SEQ ID NO: 6033045 - DNA, 18 bp, Homo sapiens
ccaaggaaaggcatgtac

SEQ ID NO: 6033046 - DNA, 23 bp, Homo sapiens
ccaaggaaataaggacagtctag

SEQ ID NO: 6033047 - DNA, 20 bp, Homo sapiens
ccaaggaacaagacccccag

SEQ ID NO: 6033048 - DNA, 14 bp, Homo sapiens
ccaaggaacaagag

SEQ ID NO: 6033049 - DNA, 12 bp, Homo sapiens
ccaaggaagcag

SEQ ID NO: 6033050 - DNA, 13 bp, Homo sapiens
ccaaggaagcagc

SEQ ID NO: 6033051 - DNA, 19 bp, Homo sapiens
ccaaggaagctccagatcc

SEQ ID NO: 6033052 - DNA, 20 bp, Homo sapiens
ccaaggaagctccttcctgt

SEQ ID NO: 6033053 - DNA, 18 bp, Homo sapiens
ccaaggaatgtgtccaag

SEQ ID NO: 6033054 - DNA, 18 bp, Homo sapiens
ccaaggacagttcagaga

SEQ ID NO: 6033055 - DNA, 19 bp, Homo sapiens
ccaaggacagttcagagat

SEQ ID NO: 6033056 - DNA, 20 bp, Homo sapiens
ccaaggacagttcagagatc

SEQ ID NO: 6033057 - DNA, 23 bp, Homo sapiens
ccaaggacatgagtctgtaggag

SEQ ID NO: 6033058 - DNA, 13 bp, Homo sapiens
ccaaggaccaggt

SEQ ID NO: 6033059 - DNA, 15 bp, Homo sapiens
ccaaggacccagccc

SEQ ID NO: 6033060 - DNA, 16 bp, Homo sapiens
ccaaggacccaggcgc

SEQ ID NO: 6033061 - DNA, 15 bp, Homo sapiens
ccaaggacccctcac

SEQ ID NO: 6033062 - DNA, 16 bp, Homo sapiens
ccaaggacccctcacc

SEQ ID NO: 6033063 - DNA, 22 bp, Homo sapiens
ccaaggacccctcaccttgcaa

SEQ ID NO: 6033064 - DNA, 20 bp, Homo sapiens
ccaaggactgactgagacac

SEQ ID NO: 6033065 - DNA, 13 bp, Homo sapiens
ccaaggactgccg

SEQ ID NO: 6033066 - DNA, 15 bp, Homo sapiens
ccaaggactgccgac

SEQ ID NO: 6033067 - DNA, 17 bp, Homo sapiens
ccaaggacttccacatt

SEQ ID NO: 6033068 - DNA, 18 bp, Homo sapiens
ccaaggagaaacagagac

SEQ ID NO: 6033069 - DNA, 21 bp, Homo sapiens
ccaaggagaccaagtcctggc

SEQ ID NO: 6033070 - DNA, 14 bp, Homo sapiens
ccaaggagatgaag

SEQ ID NO: 6033071 - DNA, 23 bp, Homo sapiens
ccaaggagatgaagcaaacacat

SEQ ID NO: 6033072 - DNA, 17 bp, Homo sapiens
ccaaggagcacaggtcc

SEQ ID NO: 6033073 - DNA, 13 bp, Homo sapiens
ccaaggagcagag

SEQ ID NO: 6033074 - DNA, 17 bp, Homo sapiens
ccaaggagcagagaggt

SEQ ID NO: 6033075 - DNA, 13 bp, Homo sapiens
ccaaggagccatt

SEQ ID NO: 6033076 - DNA, 22 bp, Homo sapiens
ccaaggagctgagaatagaagg

SEQ ID NO: 6033077 - DNA, 23 bp, Homo sapiens
ccaaggagctgatttccaggccc

SEQ ID NO: 6033078 - DNA, 12 bp, Homo sapiens
ccaaggagctgc

SEQ ID NO: 6033079 - DNA, 13 bp, Homo sapiens
ccaaggagctgct

SEQ ID NO: 6033080 - DNA, 14 bp, Homo sapiens
ccaaggagctgcta

SEQ ID NO: 6033081 - DNA, 13 bp, Homo sapiens
ccaaggaggaaaa

SEQ ID NO: 6033082 - DNA, 22 bp, Homo sapiens
ccaaggaggaaataactaagag

SEQ ID NO: 6033083 - DNA, 14 bp, Homo sapiens
ccaaggaggcagcc

SEQ ID NO: 6033084 - DNA, 15 bp, Homo sapiens
ccaaggaggcagcct

SEQ ID NO: 6033085 - DNA, 17 bp, Homo sapiens
ccaaggaggcagcctgg

SEQ ID NO: 6033086 - DNA, 13 bp, Homo sapiens
ccaaggaggcctg

SEQ ID NO: 6033087 - DNA, 14 bp, Homo sapiens
ccaaggaggcctgg

SEQ ID NO: 6033088 - DNA, 17 bp, Homo sapiens
ccaaggaggcctgggga

SEQ ID NO: 6033089 - DNA, 14 bp, Homo sapiens
ccaaggagggcacc

SEQ ID NO: 6033090 - DNA, 20 bp, Homo sapiens
ccaaggagggtgagtgcaag

SEQ ID NO: 6033091 - DNA, 23 bp, Homo sapiens
ccaaggaggtgaggagcagagca

SEQ ID NO: 6033092 - DNA, 17 bp, Homo sapiens
ccaaggagtcactgaga

SEQ ID NO: 6033093 - DNA, 22 bp, Homo sapiens
ccaaggagtcactgagaccaag

SEQ ID NO: 6033094 - DNA, 22 bp, Homo sapiens
ccaaggagtctgattgcaggaa

SEQ ID NO: 6033095 - DNA, 11 bp, Homo sapiens
ccaaggatccc

SEQ ID NO: 6033096 - DNA, 15 bp, Homo sapiens
ccaaggatcctctcc

SEQ ID NO: 6033097 - DNA, 22 bp, Homo sapiens
ccaaggatcctctccactccat

SEQ ID NO: 6033098 - DNA, 20 bp, Homo sapiens
ccaaggatcggactctgccc

SEQ ID NO: 6033099 - DNA, 18 bp, Homo sapiens
ccaaggatgccccgtccc

SEQ ID NO: 6033100 - DNA, 21 bp, Homo sapiens
ccaaggatgccttagcatgtg

SEQ ID NO: 6033101 - DNA, 13 bp, Homo sapiens
ccaaggcaaacaa

SEQ ID NO: 6033102 - DNA, 15 bp, Homo sapiens
ccaaggcaaatgtcc

SEQ ID NO: 6033103 - DNA, 18 bp, Homo sapiens
ccaaggcaaatgtccaag

SEQ ID NO: 6033104 - DNA, 21 bp, Homo sapiens
ccaaggcaaatgtccaagcat

SEQ ID NO: 6033105 - DNA, 22 bp, Homo sapiens
ccaaggcaaggcaggtgcctcc

SEQ ID NO: 6033106 - DNA, 13 bp, Homo sapiens
ccaaggcactgag

SEQ ID NO: 6033107 - DNA, 14 bp, Homo sapiens
ccaaggcactgagc

SEQ ID NO: 6033108 - DNA, 23 bp, Homo sapiens
ccaaggcagaataaaccggatcc

SEQ ID NO: 6033109 - DNA, 16 bp, Homo sapiens
ccaaggcagaggcctg

SEQ ID NO: 6033110 - DNA, 13 bp, Homo sapiens
ccaaggcagaggg

SEQ ID NO: 6033111 - DNA, 17 bp, Homo sapiens
ccaaggcagaggggagc

SEQ ID NO: 6033112 - DNA, 18 bp, Homo sapiens
ccaaggcagcctccagag

SEQ ID NO: 6033113 - DNA, 17 bp, Homo sapiens
ccaaggcagggcccagc

SEQ ID NO: 6033114 - DNA, 20 bp, Homo sapiens
ccaaggcagtgcatgcatgt

SEQ ID NO: 6033115 - DNA, 21 bp, Homo sapiens
ccaaggcagtgcatgcatgtt

SEQ ID NO: 6033116 - DNA, 20 bp, Homo sapiens
ccaaggcatatcatgctttg

SEQ ID NO: 6033117 - DNA, 14 bp, Homo sapiens
ccaaggcatcccca

SEQ ID NO: 6033118 - DNA, 20 bp, Homo sapiens
ccaaggcatccccagtgcca

SEQ ID NO: 6033119 - DNA, 21 bp, Homo sapiens
ccaaggcatccccagtgccag

SEQ ID NO: 6033120 - DNA, 17 bp, Homo sapiens
ccaaggccagcccacac

SEQ ID NO: 6033121 - DNA, 16 bp, Homo sapiens
ccaaggccagggacag

SEQ ID NO: 6033122 - DNA, 11 bp, Homo sapiens
ccaaggccagt

SEQ ID NO: 6033123 - DNA, 15 bp, Homo sapiens
ccaaggccccaggga

SEQ ID NO: 6033124 - DNA, 18 bp, Homo sapiens
ccaaggcccccacctctg

SEQ ID NO: 6033125 - DNA, 23 bp, Homo sapiens
ccaaggccctgcatctgtctgct

SEQ ID NO: 6033126 - DNA, 17 bp, Homo sapiens
ccaaggccctgtctctg

SEQ ID NO: 6033127 - DNA, 17 bp, Homo sapiens
ccaaggccgaagctctg

SEQ ID NO: 6033128 - DNA, 17 bp, Homo sapiens
ccaaggccgcccacctg

SEQ ID NO: 6033129 - DNA, 23 bp, Homo sapiens
ccaaggccggagacccacagccc

SEQ ID NO: 6033130 - DNA, 14 bp, Homo sapiens
ccaaggcctaggac

SEQ ID NO: 6033131 - DNA, 17 bp, Homo sapiens
ccaaggcctatgccacc

SEQ ID NO: 6033132 - DNA, 20 bp, Homo sapiens
ccaaggcctatgccacctgc

SEQ ID NO: 6033133 - DNA, 14 bp, Homo sapiens
ccaaggcctcagga

SEQ ID NO: 6033134 - DNA, 15 bp, Homo sapiens
ccaaggcctcaggag

SEQ ID NO: 6033135 - DNA, 17 bp, Homo sapiens
ccaaggcctccctcagg

SEQ ID NO: 6033136 - DNA, 16 bp, Homo sapiens
ccaaggcctcggcaga

SEQ ID NO: 6033137 - DNA, 15 bp, Homo sapiens
ccaaggcctctctct

SEQ ID NO: 6033138 - DNA, 19 bp, Homo sapiens
ccaaggcctctctctgcct

SEQ ID NO: 6033139 - DNA, 18 bp, Homo sapiens
ccaaggctagaaccacct

SEQ ID NO: 6033140 - DNA, 14 bp, Homo sapiens
ccaaggctcacatg

SEQ ID NO: 6033141 - DNA, 22 bp, Homo sapiens
ccaaggctcagaggagccaata

SEQ ID NO: 6033142 - DNA, 19 bp, Homo sapiens
ccaaggctgattaaaccaa

SEQ ID NO: 6033143 - DNA, 14 bp, Homo sapiens
ccaaggctgccaga

SEQ ID NO: 6033144 - DNA, 16 bp, Homo sapiens
ccaaggctgccagaca

SEQ ID NO: 6033145 - DNA, 18 bp, Homo sapiens
ccaaggctgccagacatg

SEQ ID NO: 6033146 - DNA, 18 bp, Homo sapiens
ccaaggctgcgtctggag

SEQ ID NO: 6033147 - DNA, 20 bp, Homo sapiens
ccaaggctgcgtctggaggg

SEQ ID NO: 6033148 - DNA, 14 bp, Homo sapiens
ccaaggctggcagg

SEQ ID NO: 6033149 - DNA, 13 bp, Homo sapiens
ccaaggctgtctt

SEQ ID NO: 6033150 - DNA, 20 bp, Homo sapiens
ccaaggctgtcttctcccag

SEQ ID NO: 6033151 - DNA, 21 bp, Homo sapiens
ccaaggctgtcttctcccaga

SEQ ID NO: 6033152 - DNA, 18 bp, Homo sapiens
ccaagggaacctgtgtcc

SEQ ID NO: 6033153 - DNA, 16 bp, Homo sapiens
ccaagggaatattgcc

SEQ ID NO: 6033154 - DNA, 13 bp, Homo sapiens
ccaagggacacag

SEQ ID NO: 6033155 - DNA, 15 bp, Homo sapiens
ccaagggacacagga

SEQ ID NO: 6033156 - DNA, 17 bp, Homo sapiens
ccaagggacacaggaga

SEQ ID NO: 6033157 - DNA, 16 bp, Homo sapiens
ccaagggacagcaagt

SEQ ID NO: 6033158 - DNA, 23 bp, Homo sapiens
ccaagggacagcaagtgagcaga

SEQ ID NO: 6033159 - DNA, 15 bp, Homo sapiens
ccaagggacagccca

SEQ ID NO: 6033160 - DNA, 20 bp, Homo sapiens
ccaagggacagcccacggtc

SEQ ID NO: 6033161 - DNA, 19 bp, Homo sapiens
ccaagggacaggtgggcct

SEQ ID NO: 6033162 - DNA, 18 bp, Homo sapiens
ccaagggagactgaccat

SEQ ID NO: 6033163 - DNA, 13 bp, Homo sapiens
ccaagggaggctg

SEQ ID NO: 6033164 - DNA, 14 bp, Homo sapiens
ccaagggagggaag

SEQ ID NO: 6033165 - DNA, 21 bp, Homo sapiens
ccaagggagggaagggccacc

SEQ ID NO: 6033166 - DNA, 22 bp, Homo sapiens
ccaagggagggaagggccaccc

SEQ ID NO: 6033167 - DNA, 24 bp, Homo sapiens
ccaagggagggaagggccaccctg

SEQ ID NO: 6033168 - DNA, 23 bp, Homo sapiens
ccaagggaggggagaaaggaact

SEQ ID NO: 6033169 - DNA, 24 bp, Homo sapiens
ccaagggagttaggctattcacaa

SEQ ID NO: 6033170 - DNA, 17 bp, Homo sapiens
ccaagggatctgcttga

SEQ ID NO: 6033171 - DNA, 20 bp, Homo sapiens
ccaagggatgaaagagaagg

SEQ ID NO: 6033172 - DNA, 17 bp, Homo sapiens
ccaagggatggcaccac

SEQ ID NO: 6033173 - DNA, 13 bp, Homo sapiens
ccaagggcagagg

SEQ ID NO: 6033174 - DNA, 19 bp, Homo sapiens
ccaagggcataaattattg

SEQ ID NO: 6033175 - DNA, 13 bp, Homo sapiens
ccaagggccaaac

SEQ ID NO: 6033176 - DNA, 16 bp, Homo sapiens
ccaagggccagacaga

SEQ ID NO: 6033177 - DNA, 12 bp, Homo sapiens
ccaagggccgtg

SEQ ID NO: 6033178 - DNA, 13 bp, Homo sapiens
ccaagggccgtgc

SEQ ID NO: 6033179 - DNA, 20 bp, Homo sapiens
ccaagggcctcccaccagag

SEQ ID NO: 6033180 - DNA, 19 bp, Homo sapiens
ccaagggcctggcctgagc

SEQ ID NO: 6033181 - DNA, 22 bp, Homo sapiens
ccaagggcggggctatgccttg

SEQ ID NO: 6033182 - DNA, 23 bp, Homo sapiens
ccaagggctgacttctccaggac

SEQ ID NO: 6033183 - DNA, 17 bp, Homo sapiens
ccaagggcttctgcacc

SEQ ID NO: 6033184 - DNA, 20 bp, Homo sapiens
ccaagggcttctgcaccctc

SEQ ID NO: 6033185 - DNA, 21 bp, Homo sapiens
ccaagggctttgttttgcaca

SEQ ID NO: 6033186 - DNA, 21 bp, Homo sapiens
ccaaggggagtcaccttccct

SEQ ID NO: 6033187 - DNA, 22 bp, Homo sapiens
ccaaggggatttttatgtctgg

SEQ ID NO: 6033188 - DNA, 15 bp, Homo sapiens
ccaaggggcagtctg

SEQ ID NO: 6033189 - DNA, 20 bp, Homo sapiens
ccaaggggcagtctggaggg

SEQ ID NO: 6033190 - DNA, 14 bp, Homo sapiens
ccaaggggccagct

SEQ ID NO: 6033191 - DNA, 21 bp, Homo sapiens
ccaaggggcccacaaagggga

SEQ ID NO: 6033192 - DNA, 12 bp, Homo sapiens
ccaaggggcccg

SEQ ID NO: 6033193 - DNA, 16 bp, Homo sapiens
ccaaggggcctgagca

SEQ ID NO: 6033194 - DNA, 22 bp, Homo sapiens
ccaaggggcctgagcagtcctt

SEQ ID NO: 6033195 - DNA, 23 bp, Homo sapiens
ccaaggggctgcgctagcagccc

SEQ ID NO: 6033196 - DNA, 18 bp, Homo sapiens
ccaagggggacctcgggc

SEQ ID NO: 6033197 - DNA, 16 bp, Homo sapiens
ccaagggggcggggac

SEQ ID NO: 6033198 - DNA, 17 bp, Homo sapiens
ccaagggggcggggact

SEQ ID NO: 6033199 - DNA, 16 bp, Homo sapiens
ccaagggggctgctgc

SEQ ID NO: 6033200 - DNA, 16 bp, Homo sapiens
ccaagggggtgactgg

SEQ ID NO: 6033201 - DNA, 17 bp, Homo sapiens
ccaaggggtctgctcct

SEQ ID NO: 6033202 - DNA, 19 bp, Homo sapiens
ccaaggggtctgctcctgt

SEQ ID NO: 6033203 - DNA, 22 bp, Homo sapiens
ccaaggggtctgctcctgtggc

SEQ ID NO: 6033204 - DNA, 21 bp, Homo sapiens
ccaaggggtggccgtcctgag

SEQ ID NO: 6033205 - DNA, 18 bp, Homo sapiens
ccaaggggtgggccacag

SEQ ID NO: 6033206 - DNA, 22 bp, Homo sapiens
ccaagggtaactcttggccaga

SEQ ID NO: 6033207 - DNA, 19 bp, Homo sapiens
ccaagggtatgggaagcca

SEQ ID NO: 6033208 - DNA, 20 bp, Homo sapiens
ccaagggttcagagactcag

SEQ ID NO: 6033209 - DNA, 17 bp, Homo sapiens
ccaagggttgagagcca

SEQ ID NO: 6033210 - DNA, 18 bp, Homo sapiens
ccaagggttgagagccag

SEQ ID NO: 6033211 - DNA, 21 bp, Homo sapiens
cagtgtcaaataaacactgtg

SEQ ID NO: 6033212 - DNA, 22 bp, Homo sapiens
cagtgtcaaatatatttaacta

SEQ ID NO: 6033213 - DNA, 20 bp, Homo sapiens
cagtgtcaagttgtgcttgt

SEQ ID NO: 6033214 - DNA, 14 bp, Homo sapiens
cagtgtcaatgcag

SEQ ID NO: 6033215 - DNA, 20 bp, Homo sapiens
cagtgtcacctctctcagag

SEQ ID NO: 6033216 - DNA, 21 bp, Homo sapiens
cagtgtcacctctctcagagc

SEQ ID NO: 6033217 - DNA, 17 bp, Homo sapiens
cagtgtcagcactcagg

SEQ ID NO: 6033218 - DNA, 15 bp, Homo sapiens
cagtgtcagcgggtg

SEQ ID NO: 6033219 - DNA, 14 bp, Homo sapiens
cagtgtcagtattt

SEQ ID NO: 6033220 - DNA, 14 bp, Homo sapiens
cagtgtcattatta

SEQ ID NO: 6033221 - DNA, 20 bp, Homo sapiens
cagtgtcatttatgaaaaga

SEQ ID NO: 6033222 - DNA, 22 bp, Homo sapiens
cagtgtccaaagcagggtctgg

SEQ ID NO: 6033223 - DNA, 24 bp, Homo sapiens
cagtgtccagagacccctcaatcc

SEQ ID NO: 6033224 - DNA, 15 bp, Homo sapiens
cagtgtccagcttcc

SEQ ID NO: 6033225 - DNA, 23 bp, Homo sapiens
cagtgtccagcttccaaagccta

SEQ ID NO: 6033226 - DNA, 22 bp, Homo sapiens
cagtgtccatggactcagaaac

SEQ ID NO: 6033227 - DNA, 16 bp, Homo sapiens
cagtgtcccagggccc

SEQ ID NO: 6033228 - DNA, 17 bp, Homo sapiens
cagtgtccccaggggca

SEQ ID NO: 6033229 - DNA, 20 bp, Homo sapiens
cagtgtccccaggggcacac

SEQ ID NO: 6033230 - DNA, 17 bp, Homo sapiens
cagtgtcccctccactg

SEQ ID NO: 6033231 - DNA, 20 bp, Homo sapiens
cagtgtcccctccactgtca

SEQ ID NO: 6033232 - DNA, 20 bp, Homo sapiens
cagtgtcccctgccccagag

SEQ ID NO: 6033233 - DNA, 22 bp, Homo sapiens
cagtgtcccctgccccagaggt

SEQ ID NO: 6033234 - DNA, 23 bp, Homo sapiens
cagtgtcccctgccccagaggtc

SEQ ID NO: 6033235 - DNA, 13 bp, Homo sapiens
cagtgtcctgagc

SEQ ID NO: 6033236 - DNA, 20 bp, Homo sapiens
cagtgtccttcacggcactg

SEQ ID NO: 6033237 - DNA, 19 bp, Homo sapiens
cagtgtcgccgtccctctg

SEQ ID NO: 6033238 - DNA, 13 bp, Homo sapiens
cagtgtctaggca

SEQ ID NO: 6033239 - DNA, 19 bp, Homo sapiens
cagtgtctataaaagaaac

SEQ ID NO: 6033240 - DNA, 16 bp, Homo sapiens
cagtgtctcacactgg

SEQ ID NO: 6033241 - DNA, 15 bp, Homo sapiens
cagtgtctcacagcc

SEQ ID NO: 6033242 - DNA, 14 bp, Homo sapiens
cagtgtctcggagg

SEQ ID NO: 6033243 - DNA, 20 bp, Homo sapiens
cagtgtctgaaccaccctgg

SEQ ID NO: 6033244 - DNA, 22 bp, Homo sapiens
cagtgtctgaaccaccctggaa

SEQ ID NO: 6033245 - DNA, 19 bp, Homo sapiens
cagtgtctgcctttaaata

SEQ ID NO: 6033246 - DNA, 14 bp, Homo sapiens
cagtgtctggccca

SEQ ID NO: 6033247 - DNA, 21 bp, Homo sapiens
cagtgtctggcccagccatgg

SEQ ID NO: 6033248 - DNA, 23 bp, Homo sapiens
cagtgtctgtatcggagacagtg

SEQ ID NO: 6033249 - DNA, 13 bp, Homo sapiens
cagtgtctgtcag

SEQ ID NO: 6033250 - DNA, 16 bp, Homo sapiens
cagtgtctgtcccggg

SEQ ID NO: 6033251 - DNA, 13 bp, Homo sapiens
cagtgtctgtgtt

SEQ ID NO: 6033252 - DNA, 23 bp, Homo sapiens
cagtgtctgttcttcatttctat

SEQ ID NO: 6033253 - DNA, 15 bp, Homo sapiens
cagtgtcttccataa

SEQ ID NO: 6033254 - DNA, 17 bp, Homo sapiens
cagtgtcttccataatg

SEQ ID NO: 6033255 - DNA, 20 bp, Homo sapiens
cagtgtcttccataatgtat

SEQ ID NO: 6033256 - DNA, 15 bp, Homo sapiens
cagtgtcttcctgtg

SEQ ID NO: 6033257 - DNA, 16 bp, Homo sapiens
cagtgtcttcctgtgg

SEQ ID NO: 6033258 - DNA, 19 bp, Homo sapiens
cagtgtcttgagctctaaa

SEQ ID NO: 6033259 - DNA, 19 bp, Homo sapiens
cagtgtctttctagccata

SEQ ID NO: 6033260 - DNA, 15 bp, Homo sapiens
cagtgtctttctttg

SEQ ID NO: 6033261 - DNA, 22 bp, Homo sapiens
cagtgtctttctttggtgcctt

SEQ ID NO: 6033262 - DNA, 17 bp, Homo sapiens
cagtgtctttttttgta

SEQ ID NO: 6033263 - DNA, 11 bp, Homo sapiens
cagtgtgaagc

SEQ ID NO: 6033264 - DNA, 16 bp, Homo sapiens
cagtgtgaagcctgtc

SEQ ID NO: 6033265 - DNA, 21 bp, Homo sapiens
cagtgtgaagtacaataattc

SEQ ID NO: 6033266 - DNA, 14 bp, Homo sapiens
cagtgtgaagttag

SEQ ID NO: 6033267 - DNA, 18 bp, Homo sapiens
cagtgtgaataaagtgct

SEQ ID NO: 6033268 - DNA, 17 bp, Homo sapiens
cagtgtgaatgctgggc

SEQ ID NO: 6033269 - DNA, 14 bp, Homo sapiens
cagtgtgacaagga

SEQ ID NO: 6033270 - DNA, 12 bp, Homo sapiens
cagtgtgactga

SEQ ID NO: 6033271 - DNA, 16 bp, Homo sapiens
cagtgtgaggccaggg

SEQ ID NO: 6033272 - DNA, 19 bp, Homo sapiens
cagtgtgaggccagggcag

SEQ ID NO: 6033273 - DNA, 14 bp, Homo sapiens
cagtgtgagtcaga

SEQ ID NO: 6033274 - DNA, 22 bp, Homo sapiens
cagtgtgatcccaagtgccagt

SEQ ID NO: 6033275 - DNA, 18 bp, Homo sapiens
cagtgtgcaaggcagccg

SEQ ID NO: 6033276 - DNA, 20 bp, Homo sapiens
cagtgtgcaaggcagccgtg

SEQ ID NO: 6033277 - DNA, 16 bp, Homo sapiens
cagtgtgcacccctcc

SEQ ID NO: 6033278 - DNA, 18 bp, Homo sapiens
cagtgtgcacgagtggga

SEQ ID NO: 6033279 - DNA, 20 bp, Homo sapiens
cagtgtgcacgcctgcaggc

SEQ ID NO: 6033280 - DNA, 19 bp, Homo sapiens
cagtgtgcagggtggaagg

SEQ ID NO: 6033281 - DNA, 15 bp, Homo sapiens
cagtgtgccaccctc

SEQ ID NO: 6033282 - DNA, 17 bp, Homo sapiens
cagtgtgccaccctctg

SEQ ID NO: 6033283 - DNA, 13 bp, Homo sapiens
cagtgtgcccccc

SEQ ID NO: 6033284 - DNA, 14 bp, Homo sapiens
cagtgtgcccccca

SEQ ID NO: 6033285 - DNA, 21 bp, Homo sapiens
cagtgtgcctgtcactactgg

SEQ ID NO: 6033286 - DNA, 18 bp, Homo sapiens
cagtgtgcgttggaatca

SEQ ID NO: 6033287 - DNA, 14 bp, Homo sapiens
cagtgtgctgatgg

SEQ ID NO: 6033288 - DNA, 21 bp, Homo sapiens
cagtgtggactctggactggg

SEQ ID NO: 6033289 - DNA, 22 bp, Homo sapiens
cagtgtggagaccctgccacag

SEQ ID NO: 6033290 - DNA, 13 bp, Homo sapiens
cagtgtggagagg

SEQ ID NO: 6033291 - DNA, 17 bp, Homo sapiens
cagtgtggagaggggtg

SEQ ID NO: 6033292 - DNA, 19 bp, Homo sapiens
cagtgtggaggccactgtt

SEQ ID NO: 6033293 - DNA, 13 bp, Homo sapiens
cagtgtggagtgg

SEQ ID NO: 6033294 - DNA, 13 bp, Homo sapiens
cagtgtggagttc

SEQ ID NO: 6033295 - DNA, 19 bp, Homo sapiens
cagtgtggatgtaaatttt

SEQ ID NO: 6033296 - DNA, 13 bp, Homo sapiens
cagtgtggctccc

SEQ ID NO: 6033297 - DNA, 17 bp, Homo sapiens
cagtgtggcttaaacat

SEQ ID NO: 6033298 - DNA, 20 bp, Homo sapiens
cagtgtggcttaaacatttt

SEQ ID NO: 6033299 - DNA, 18 bp, Homo sapiens
cagtgtggggagggcagg

SEQ ID NO: 6033300 - DNA, 21 bp, Homo sapiens
cagtgtggggggacagacagg

SEQ ID NO: 6033301 - DNA, 15 bp, Homo sapiens
cagtgtggtagttaa

SEQ ID NO: 6033302 - DNA, 18 bp, Homo sapiens
cagtgtggtttgggaaag

SEQ ID NO: 6033303 - DNA, 13 bp, Homo sapiens
cagtgtgtaaaca

SEQ ID NO: 6033304 - DNA, 15 bp, Homo sapiens
cagtgtgtaaagtaa

SEQ ID NO: 6033305 - DNA, 14 bp, Homo sapiens
cagtgtgtaaataa

SEQ ID NO: 6033306 - DNA, 16 bp, Homo sapiens
cagtgtgtcacactga

SEQ ID NO: 6033307 - DNA, 20 bp, Homo sapiens
cagtgtgtcagtttttcctc

SEQ ID NO: 6033308 - DNA, 21 bp, Homo sapiens
cagtgtgtcgagtcaaaatgt

SEQ ID NO: 6033309 - DNA, 23 bp, Homo sapiens
cagtgtgtctaaatttgaatgtt

SEQ ID NO: 6033310 - DNA, 13 bp, Homo sapiens
cagtgtgtctcct

SEQ ID NO: 6033311 - DNA, 15 bp, Homo sapiens
cagtgtgtctcctgc

SEQ ID NO: 6033312 - DNA, 17 bp, Homo sapiens
cagtgtgtctcctgcat

SEQ ID NO: 6033313 - DNA, 15 bp, Homo sapiens
cagtgtgtgctcagc

SEQ ID NO: 6033314 - DNA, 17 bp, Homo sapiens
cagtgtgtgctcagcag

SEQ ID NO: 6033315 - DNA, 21 bp, Homo sapiens
cagtgtgtgctcagcagcccc

SEQ ID NO: 6033316 - DNA, 23 bp, Homo sapiens
cagtgtgtgctcagcagccccac

SEQ ID NO: 6033317 - DNA, 21 bp, Homo sapiens
cagtgtgtggctttcagagcc

SEQ ID NO: 6033318 - DNA, 13 bp, Homo sapiens
cagtgtgtggggg

SEQ ID NO: 6033319 - DNA, 15 bp, Homo sapiens
cagtgtgtgggggag

SEQ ID NO: 6033320 - DNA, 20 bp, Homo sapiens
cagtgtgtggtcaacatttc

SEQ ID NO: 6033321 - DNA, 20 bp, Homo sapiens
cagtgtgtgtgtgtggtcca

SEQ ID NO: 6033322 - DNA, 17 bp, Homo sapiens
cagtgttaaatgaaatt

SEQ ID NO: 6033323 - DNA, 14 bp, Homo sapiens
cagtgttaaatgtg

SEQ ID NO: 6033324 - DNA, 19 bp, Homo sapiens
cagtgttagagaaatcctt

SEQ ID NO: 6033325 - DNA, 17 bp, Homo sapiens
cagtgttaggcctggca

SEQ ID NO: 6033326 - DNA, 14 bp, Homo sapiens
cagtgttagtattc

SEQ ID NO: 6033327 - DNA, 19 bp, Homo sapiens
cagtgttagtgctggtcag

SEQ ID NO: 6033328 - DNA, 16 bp, Homo sapiens
cagtgttagtgggaag

SEQ ID NO: 6033329 - DNA, 13 bp, Homo sapiens
cagtgttatccca

SEQ ID NO: 6033330 - DNA, 15 bp, Homo sapiens
cagtgttatcccaag

SEQ ID NO: 6033331 - DNA, 14 bp, Homo sapiens
cagtgttattttct

SEQ ID NO: 6033332 - DNA, 18 bp, Homo sapiens
cagtgttcaaattctgat

SEQ ID NO: 6033333 - DNA, 19 bp, Homo sapiens
cagtgttcaaattctgatt

SEQ ID NO: 6033334 - DNA, 18 bp, Homo sapiens
cagtgttcagcatagagc

SEQ ID NO: 6033335 - DNA, 23 bp, Homo sapiens
cagtgttcagccaaacagtatga

SEQ ID NO: 6033336 - DNA, 14 bp, Homo sapiens
cagtgttcatgcga

SEQ ID NO: 6033337 - DNA, 22 bp, Homo sapiens
cagtgttccaagtctctgtgta

SEQ ID NO: 6033338 - DNA, 23 bp, Homo sapiens
cagtgttccaagtctctgtgtaa

SEQ ID NO: 6033339 - DNA, 19 bp, Homo sapiens
cagtgttccccatctgggt

SEQ ID NO: 6033340 - DNA, 21 bp, Homo sapiens
cagtgttccccatctgggtcc

SEQ ID NO: 6033341 - DNA, 13 bp, Homo sapiens
cagtgttcccccc

SEQ ID NO: 6033342 - DNA, 21 bp, Homo sapiens
cagtgttcccttctggctgtc

SEQ ID NO: 6033343 - DNA, 19 bp, Homo sapiens
cagtgttcctcaccaataa

SEQ ID NO: 6033344 - DNA, 23 bp, Homo sapiens
cagtgttcctcaccaataacttc

SEQ ID NO: 6033345 - DNA, 19 bp, Homo sapiens
cagtgttcctgaagctgct

SEQ ID NO: 6033346 - DNA, 23 bp, Homo sapiens
cagtgttcgcttggctccatgct

SEQ ID NO: 6033347 - DNA, 16 bp, Homo sapiens
cagtgttctgagcccc

SEQ ID NO: 6033348 - DNA, 16 bp, Homo sapiens
cagtgttctgtttaat

SEQ ID NO: 6033349 - DNA, 22 bp, Homo sapiens
cagtgttctgtttaatactcat

SEQ ID NO: 6033350 - DNA, 19 bp, Homo sapiens
cagtgttgacatagccttt

SEQ ID NO: 6033351 - DNA, 20 bp, Homo sapiens
cagtgttgcatatgagcctg

SEQ ID NO: 6033352 - DNA, 13 bp, Homo sapiens
cagtgttgcctaa

SEQ ID NO: 6033353 - DNA, 18 bp, Homo sapiens
cagtgttgcctcctccca

SEQ ID NO: 6033354 - DNA, 19 bp, Homo sapiens
cagtgttgcctcctcccat

SEQ ID NO: 6033355 - DNA, 24 bp, Homo sapiens
cagtgttggccatgatgacaacta

SEQ ID NO: 6033356 - DNA, 23 bp, Homo sapiens
cagtgttggctgtgtgacagaat

SEQ ID NO: 6033357 - DNA, 18 bp, Homo sapiens
cagtgttggggatgcctt

SEQ ID NO: 6033358 - DNA, 16 bp, Homo sapiens
cagtgttggtatattt

SEQ ID NO: 6033359 - DNA, 19 bp, Homo sapiens
cagtgttgtgggcttcctg

SEQ ID NO: 6033360 - DNA, 17 bp, Homo sapiens
cagtgttgttccctccc

SEQ ID NO: 6033361 - DNA, 23 bp, Homo sapiens
cagtgttgttgctctaggaagac

SEQ ID NO: 6033362 - DNA, 14 bp, Homo sapiens
cagtgttgtttgta

SEQ ID NO: 6033363 - DNA, 16 bp, Homo sapiens
cagtgttgtttgtaaa

SEQ ID NO: 6033364 - DNA, 20 bp, Homo sapiens
cagtgttgtttgtaaataag

SEQ ID NO: 6033365 - DNA, 17 bp, Homo sapiens
cagtgtttactttaaat

SEQ ID NO: 6033366 - DNA, 18 bp, Homo sapiens
cagtgtttactttaaatc

SEQ ID NO: 6033367 - DNA, 20 bp, Homo sapiens
cagtgtttagaagagcctga

SEQ ID NO: 6033368 - DNA, 23 bp, Homo sapiens
cagtgtttagaagagcctgactg

SEQ ID NO: 6033369 - DNA, 13 bp, Homo sapiens
cagtgtttatgac

SEQ ID NO: 6033370 - DNA, 23 bp, Homo sapiens
cagtgtttatgtgctattaatat

SEQ ID NO: 6033371 - DNA, 12 bp, Homo sapiens
cagtgtttcaat

SEQ ID NO: 6033372 - DNA, 22 bp, Homo sapiens
cagtgtttcaattctgtaatta

SEQ ID NO: 6033373 - DNA, 14 bp, Homo sapiens
cagtgtttccacgg

SEQ ID NO: 6033374 - DNA, 14 bp, Homo sapiens
cagtgtttcccata

SEQ ID NO: 6033375 - DNA, 17 bp, Homo sapiens
cagtgtttcccataatt

SEQ ID NO: 6033376 - DNA, 15 bp, Homo sapiens
cagtgtttcctgagt

SEQ ID NO: 6033377 - DNA, 23 bp, Homo sapiens
cagtgtttcctgagtagcagtga

SEQ ID NO: 6033378 - DNA, 14 bp, Homo sapiens
cagtgtttcctttt

SEQ ID NO: 6033379 - DNA, 14 bp, Homo sapiens
cagtgtttctgaat

SEQ ID NO: 6033380 - DNA, 17 bp, Homo sapiens
cagtgtttgatttttat

SEQ ID NO: 6033381 - DNA, 13 bp, Homo sapiens
cagtgtttgctgt

SEQ ID NO: 6033382 - DNA, 15 bp, Homo sapiens
cagtgtttggacagg

SEQ ID NO: 6033383 - DNA, 15 bp, Homo sapiens
cagtgtttgtatacc

SEQ ID NO: 6033384 - DNA, 14 bp, Homo sapiens
cagtgtttgttgga

SEQ ID NO: 6033385 - DNA, 14 bp, Homo sapiens
cagtgttttaaatt

SEQ ID NO: 6033386 - DNA, 18 bp, Homo sapiens
cagtgttttaggtgcctg

SEQ ID NO: 6033387 - DNA, 22 bp, Homo sapiens
cagtgttttctgggataagtaa

SEQ ID NO: 6033388 - DNA, 15 bp, Homo sapiens
ccaagggtttcgact

SEQ ID NO: 6033389 - DNA, 20 bp, Homo sapiens
ccaagggtttcgactggtcc

SEQ ID NO: 6033390 - DNA, 15 bp, Homo sapiens
ccaaggtacagctgt

SEQ ID NO: 6033391 - DNA, 21 bp, Homo sapiens
ccaaggtaccgatttctgcta

SEQ ID NO: 6033392 - DNA, 22 bp, Homo sapiens
ccaaggtaccgatttctgctaa

SEQ ID NO: 6033393 - DNA, 14 bp, Homo sapiens
ccaaggtacctagg

SEQ ID NO: 6033394 - DNA, 21 bp, Homo sapiens
ccaaggtattctattctaata

SEQ ID NO: 6033395 - DNA, 15 bp, Homo sapiens
ccaaggtcaccaaac

SEQ ID NO: 6033396 - DNA, 15 bp, Homo sapiens
ccaaggtcactcttg

SEQ ID NO: 6033397 - DNA, 23 bp, Homo sapiens
ccaaggtcagggaggggcaacca

SEQ ID NO: 6033398 - DNA, 23 bp, Homo sapiens
ccaaggtccccccacagctccag

SEQ ID NO: 6033399 - DNA, 22 bp, Homo sapiens
ccaaggtccccgtggatggtct

SEQ ID NO: 6033400 - DNA, 14 bp, Homo sapiens
ccaaggtcccctcc

SEQ ID NO: 6033401 - DNA, 23 bp, Homo sapiens
ccaaggtcccctccacatcccag

SEQ ID NO: 6033402 - DNA, 16 bp, Homo sapiens
ccaaggtctaggtgga

SEQ ID NO: 6033403 - DNA, 19 bp, Homo sapiens
ccaaggtctcacactcctc

SEQ ID NO: 6033404 - DNA, 21 bp, Homo sapiens
ccaaggtctcacactcctcct

SEQ ID NO: 6033405 - DNA, 23 bp, Homo sapiens
ccaaggtctcacactcctcctgc

SEQ ID NO: 6033406 - DNA, 21 bp, Homo sapiens
ccaaggtctgagccacagcag

SEQ ID NO: 6033407 - DNA, 17 bp, Homo sapiens
ccaaggtcttcagccat

SEQ ID NO: 6033408 - DNA, 22 bp, Homo sapiens
ccaaggtgaagatggcctagga

SEQ ID NO: 6033409 - DNA, 20 bp, Homo sapiens
ccaaggtgaggtgaactcca

SEQ ID NO: 6033410 - DNA, 23 bp, Homo sapiens
ccaaggtgaggtgaactccaggc

SEQ ID NO: 6033411 - DNA, 14 bp, Homo sapiens
ccaaggtgctaaaa

SEQ ID NO: 6033412 - DNA, 20 bp, Homo sapiens
ccaaggtgctaggattacag

SEQ ID NO: 6033413 - DNA, 14 bp, Homo sapiens
ccaaggtgctctgt

SEQ ID NO: 6033414 - DNA, 14 bp, Homo sapiens
ccaaggtgctgatg

SEQ ID NO: 6033415 - DNA, 14 bp, Homo sapiens
ccaaggtggaggga

SEQ ID NO: 6033416 - DNA, 15 bp, Homo sapiens
ccaaggtggcacggt

SEQ ID NO: 6033417 - DNA, 22 bp, Homo sapiens
ccaaggtggcccggaagaacca

SEQ ID NO: 6033418 - DNA, 17 bp, Homo sapiens
ccaaggtgggctgagcc

SEQ ID NO: 6033419 - DNA, 20 bp, Homo sapiens
ccaaggtgggctgagccctg

SEQ ID NO: 6033420 - DNA, 23 bp, Homo sapiens
ccaaggtgggctgagccctggca

SEQ ID NO: 6033421 - DNA, 20 bp, Homo sapiens
ccaaggtgggtagatcacga

SEQ ID NO: 6033422 - DNA, 13 bp, Homo sapiens
ccaaggtggtctg

SEQ ID NO: 6033423 - DNA, 15 bp, Homo sapiens
ccaaggtggtctgct

SEQ ID NO: 6033424 - DNA, 23 bp, Homo sapiens
ccaaggtggtcttggagaggagg

SEQ ID NO: 6033425 - DNA, 15 bp, Homo sapiens
ccaaggtgtcctaca

SEQ ID NO: 6033426 - DNA, 16 bp, Homo sapiens
ccaaggtgtcctacag

SEQ ID NO: 6033427 - DNA, 21 bp, Homo sapiens
ccaaggtgtcctacagaaaaa

SEQ ID NO: 6033428 - DNA, 22 bp, Homo sapiens
ccaaggtgtcctacagaaaaac

SEQ ID NO: 6033429 - DNA, 20 bp, Homo sapiens
ccaaggttactcagcagcag

SEQ ID NO: 6033430 - DNA, 13 bp, Homo sapiens
ccaaggttccaga

SEQ ID NO: 6033431 - DNA, 20 bp, Homo sapiens
ccaaggttccagaggcccta

SEQ ID NO: 6033432 - DNA, 16 bp, Homo sapiens
ccaaggttgcacagca

SEQ ID NO: 6033433 - DNA, 19 bp, Homo sapiens
ccaaggtttaaagagtcta

SEQ ID NO: 6033434 - DNA, 20 bp, Homo sapiens
ccaaggtttaaagagtctag

SEQ ID NO: 6033435 - DNA, 14 bp, Homo sapiens
ccaaggtttataaa

SEQ ID NO: 6033436 - DNA, 18 bp, Homo sapiens
ccaaggtttataaagcag

SEQ ID NO: 6033437 - DNA, 14 bp, Homo sapiens
ccaaggtttcccag

SEQ ID NO: 6033438 - DNA, 21 bp, Homo sapiens
ccaaggtttcccagtgagcct

SEQ ID NO: 6033439 - DNA, 22 bp, Homo sapiens
ccaaggtttcccagtgagcctc

SEQ ID NO: 6033440 - DNA, 20 bp, Homo sapiens
ccaaggttttataaggctga

SEQ ID NO: 6033441 - DNA, 19 bp, Homo sapiens
ccaagtaaaggttaaaaat

SEQ ID NO: 6033442 - DNA, 18 bp, Homo sapiens
ccaagtaaatctatctct

SEQ ID NO: 6033443 - DNA, 22 bp, Homo sapiens
ccaagtaacaatgcatgctttg

SEQ ID NO: 6033444 - DNA, 20 bp, Homo sapiens
ccaagtaaccaggccccagc

SEQ ID NO: 6033445 - DNA, 15 bp, Homo sapiens
ccaagtaagacatct

SEQ ID NO: 6033446 - DNA, 15 bp, Homo sapiens
ccaagtaagaggctg

SEQ ID NO: 6033447 - DNA, 21 bp, Homo sapiens
ccaagtaagaggctggagttg

SEQ ID NO: 6033448 - DNA, 18 bp, Homo sapiens
ccaagtaagagtggtggc

SEQ ID NO: 6033449 - DNA, 14 bp, Homo sapiens
ccaagtagaggggc

SEQ ID NO: 6033450 - DNA, 20 bp, Homo sapiens
ccaagtagctgagactacag

SEQ ID NO: 6033451 - DNA, 14 bp, Homo sapiens
ccaagtagctggga

SEQ ID NO: 6033452 - DNA, 20 bp, Homo sapiens
ccaagtaggtgggattacag

SEQ ID NO: 6033453 - DNA, 22 bp, Homo sapiens
ccaagtaggtgggattacaggt

SEQ ID NO: 6033454 - DNA, 20 bp, Homo sapiens
ccaagtagtctgctcacagt

SEQ ID NO: 6033455 - DNA, 22 bp, Homo sapiens
ccaagtatatcagctactgtag

SEQ ID NO: 6033456 - DNA, 20 bp, Homo sapiens
ccaagtatgattgacataat

SEQ ID NO: 6033457 - DNA, 20 bp, Homo sapiens
ccaagtatgccttaagcaga

SEQ ID NO: 6033458 - DNA, 16 bp, Homo sapiens
ccaagtattaaactgt

SEQ ID NO: 6033459 - DNA, 14 bp, Homo sapiens
ccaagtatttatta

SEQ ID NO: 6033460 - DNA, 17 bp, Homo sapiens
ccaagtcaacactcttc

SEQ ID NO: 6033461 - DNA, 18 bp, Homo sapiens
ccaagtcaacactcttct

SEQ ID NO: 6033462 - DNA, 19 bp, Homo sapiens
ccaagtcaacactcttctt

SEQ ID NO: 6033463 - DNA, 20 bp, Homo sapiens
ccaagtcaagtgaaaaagga

SEQ ID NO: 6033464 - DNA, 14 bp, Homo sapiens
ccaagtcacacagc

SEQ ID NO: 6033465 - DNA, 17 bp, Homo sapiens
ccaagtcacacagctag

SEQ ID NO: 6033466 - DNA, 17 bp, Homo sapiens
ccaagtcacacccactc

SEQ ID NO: 6033467 - DNA, 20 bp, Homo sapiens
ccaagtcacacgcttttgaa

SEQ ID NO: 6033468 - DNA, 15 bp, Homo sapiens
ccaagtcactagaag

SEQ ID NO: 6033469 - DNA, 13 bp, Homo sapiens
ccaagtcagacag

SEQ ID NO: 6033470 - DNA, 16 bp, Homo sapiens
ccaagtcagacagatg

SEQ ID NO: 6033471 - DNA, 19 bp, Homo sapiens
ccaagtcagcccaacaggc

SEQ ID NO: 6033472 - DNA, 21 bp, Homo sapiens
ccaagtcagctttgccttcca

SEQ ID NO: 6033473 - DNA, 16 bp, Homo sapiens
ccaagtcaggccaggt

SEQ ID NO: 6033474 - DNA, 17 bp, Homo sapiens
ccaagtcaggccaggtg

SEQ ID NO: 6033475 - DNA, 16 bp, Homo sapiens
ccaagtcatgggagaa

SEQ ID NO: 6033476 - DNA, 21 bp, Homo sapiens
ccaagtcattaaaatggaagt

SEQ ID NO: 6033477 - DNA, 14 bp, Homo sapiens
ccaagtcattccta

SEQ ID NO: 6033478 - DNA, 18 bp, Homo sapiens
ccaagtcatttccgtccc

SEQ ID NO: 6033479 - DNA, 20 bp, Homo sapiens
ccaagtccaacctgcctgtg

SEQ ID NO: 6033480 - DNA, 16 bp, Homo sapiens
ccaagtccaagcccgt

SEQ ID NO: 6033481 - DNA, 11 bp, Homo sapiens
ccaagtccacc

SEQ ID NO: 6033482 - DNA, 18 bp, Homo sapiens
ccaagtccactgtcctcc

SEQ ID NO: 6033483 - DNA, 12 bp, Homo sapiens
ccaagtccctgt

SEQ ID NO: 6033484 - DNA, 21 bp, Homo sapiens
ccaagtccgcagaagccctga

SEQ ID NO: 6033485 - DNA, 14 bp, Homo sapiens
ccaagtcctcgccc

SEQ ID NO: 6033486 - DNA, 15 bp, Homo sapiens
ccaagtcctgccttt

SEQ ID NO: 6033487 - DNA, 14 bp, Homo sapiens
ccaagtcctgctcc

SEQ ID NO: 6033488 - DNA, 16 bp, Homo sapiens
ccaagtcctgctcctt

SEQ ID NO: 6033489 - DNA, 20 bp, Homo sapiens
ccaagtcctgctcctttctg

SEQ ID NO: 6033490 - DNA, 14 bp, Homo sapiens
ccaagtcctttaac

SEQ ID NO: 6033491 - DNA, 18 bp, Homo sapiens
ccaagtcggaacagcaga

SEQ ID NO: 6033492 - DNA, 21 bp, Homo sapiens
ccaagtctaatgaagagaaaa

SEQ ID NO: 6033493 - DNA, 16 bp, Homo sapiens
ccaagtctacttcact

SEQ ID NO: 6033494 - DNA, 17 bp, Homo sapiens
ccaagtctagctttcct

SEQ ID NO: 6033495 - DNA, 14 bp, Homo sapiens
ccaagtctcagtgg

SEQ ID NO: 6033496 - DNA, 21 bp, Homo sapiens
ccaagtctctctaagacaaat

SEQ ID NO: 6033497 - DNA, 16 bp, Homo sapiens
ccaagtctctctgtga

SEQ ID NO: 6033498 - DNA, 18 bp, Homo sapiens
ccaagtctctctgtgaat

SEQ ID NO: 6033499 - DNA, 18 bp, Homo sapiens
ccaagtctgacagccaga

SEQ ID NO: 6033500 - DNA, 14 bp, Homo sapiens
ccaagtctggcacc

SEQ ID NO: 6033501 - DNA, 18 bp, Homo sapiens
ccaagtctggcaccatgt

SEQ ID NO: 6033502 - DNA, 17 bp, Homo sapiens
ccaagtctgtacctcaa

SEQ ID NO: 6033503 - DNA, 14 bp, Homo sapiens
ccaagtcttcctga

SEQ ID NO: 6033504 - DNA, 23 bp, Homo sapiens
ccaagtctttcttcttttttaag

SEQ ID NO: 6033505 - DNA, 18 bp, Homo sapiens
ccaagtgaacactagcca

SEQ ID NO: 6033506 - DNA, 19 bp, Homo sapiens
ccaagtgaaggttcccaag

SEQ ID NO: 6033507 - DNA, 20 bp, Homo sapiens
ccaagtgaaggttcccaagg

SEQ ID NO: 6033508 - DNA, 22 bp, Homo sapiens
ccaagtgacctatacctgtgtt

SEQ ID NO: 6033509 - DNA, 15 bp, Homo sapiens
ccaagtgaggcagcc

SEQ ID NO: 6033510 - DNA, 21 bp, Homo sapiens
ccaagtgcagagttcagactt

SEQ ID NO: 6033511 - DNA, 14 bp, Homo sapiens
ccaagtgcaggctg

SEQ ID NO: 6033512 - DNA, 19 bp, Homo sapiens
ccaagtgcaggctggcacc

SEQ ID NO: 6033513 - DNA, 23 bp, Homo sapiens
ccaagtgccaaagaagcagacca

SEQ ID NO: 6033514 - DNA, 18 bp, Homo sapiens
ccaagtgccaagacacag

SEQ ID NO: 6033515 - DNA, 21 bp, Homo sapiens
ccaagtgccagaggtgggcag

SEQ ID NO: 6033516 - DNA, 18 bp, Homo sapiens
ccaagtgccccctcacct

SEQ ID NO: 6033517 - DNA, 12 bp, Homo sapiens
ccaagtgcctca

SEQ ID NO: 6033518 - DNA, 14 bp, Homo sapiens
ccaagtgcctcacc

SEQ ID NO: 6033519 - DNA, 14 bp, Homo sapiens
ccaagtgccttccg

SEQ ID NO: 6033520 - DNA, 16 bp, Homo sapiens
ccaagtgccttgagct

SEQ ID NO: 6033521 - DNA, 20 bp, Homo sapiens
ccaagtggaccttgagacca

SEQ ID NO: 6033522 - DNA, 23 bp, Homo sapiens
ccaagtggagcctgacagccaga

SEQ ID NO: 6033523 - DNA, 22 bp, Homo sapiens
ccaagtggatattttcttaaaa

SEQ ID NO: 6033524 - DNA, 15 bp, Homo sapiens
ccaagtggcagagct

SEQ ID NO: 6033525 - DNA, 18 bp, Homo sapiens
ccaagtggcagagcttgg

SEQ ID NO: 6033526 - DNA, 13 bp, Homo sapiens
ccaagtggctccc

SEQ ID NO: 6033527 - DNA, 12 bp, Homo sapiens
ccaagtggctct

SEQ ID NO: 6033528 - DNA, 20 bp, Homo sapiens
ccaagtgggcagtcaccacc

SEQ ID NO: 6033529 - DNA, 22 bp, Homo sapiens
ccaagtgggcagtcaccaccca

SEQ ID NO: 6033530 - DNA, 23 bp, Homo sapiens
ccaagtgggcagtcaccacccag

SEQ ID NO: 6033531 - DNA, 13 bp, Homo sapiens
ccaagtgggctgg

SEQ ID NO: 6033532 - DNA, 16 bp, Homo sapiens
ccaagtggggtgctgg

SEQ ID NO: 6033533 - DNA, 23 bp, Homo sapiens
ccaagtggtaatgaaatttcggt

SEQ ID NO: 6033534 - DNA, 14 bp, Homo sapiens
ccaagtggtcagga

SEQ ID NO: 6033535 - DNA, 14 bp, Homo sapiens
ccaagtggtgccta

SEQ ID NO: 6033536 - DNA, 17 bp, Homo sapiens
ccaagtgtacatttgat

SEQ ID NO: 6033537 - DNA, 12 bp, Homo sapiens
ccaagtgtataa

SEQ ID NO: 6033538 - DNA, 14 bp, Homo sapiens
ccaagtgtatttta

SEQ ID NO: 6033539 - DNA, 20 bp, Homo sapiens
ccaagtgtattttaaaatag

SEQ ID NO: 6033540 - DNA, 11 bp, Homo sapiens
ccaagtgtctt

SEQ ID NO: 6033541 - DNA, 19 bp, Homo sapiens
ccaagtgtgcatattgtac

SEQ ID NO: 6033542 - DNA, 15 bp, Homo sapiens
ccaagtgtgtgtgca

SEQ ID NO: 6033543 - DNA, 17 bp, Homo sapiens
ccaagtgtgtgtgcgtg

SEQ ID NO: 6033544 - DNA, 21 bp, Homo sapiens
ccaagtgtgttgggaattgca

SEQ ID NO: 6033545 - DNA, 17 bp, Homo sapiens
ccaagttacttgaaaaa

SEQ ID NO: 6033546 - DNA, 18 bp, Homo sapiens
ccaagttatctgtttcct

SEQ ID NO: 6033547 - DNA, 19 bp, Homo sapiens
ccaagttatctgtttcctg

SEQ ID NO: 6033548 - DNA, 19 bp, Homo sapiens
ccaagttatgcatccccat

SEQ ID NO: 6033549 - DNA, 11 bp, Homo sapiens
ccaagttcaaa

SEQ ID NO: 6033550 - DNA, 20 bp, Homo sapiens
ccaagttcattcatactcaa

SEQ ID NO: 6033551 - DNA, 18 bp, Homo sapiens
ccaagttcctgcactcca

SEQ ID NO: 6033552 - DNA, 19 bp, Homo sapiens
ccaagttcctgcactccag

SEQ ID NO: 6033553 - DNA, 17 bp, Homo sapiens
ccaagttcctttttcct

SEQ ID NO: 6033554 - DNA, 12 bp, Homo sapiens
ccaagttgcagt

SEQ ID NO: 6033555 - DNA, 16 bp, Homo sapiens
ccaagttgcagtgagc

SEQ ID NO: 6033556 - DNA, 22 bp, Homo sapiens
ccaagttgcagtgagcagggtg

SEQ ID NO: 6033557 - DNA, 23 bp, Homo sapiens
ccaagttggaagggaccccagat

SEQ ID NO: 6033558 - DNA, 17 bp, Homo sapiens
ccaagttgtgcttgagc

SEQ ID NO: 6033559 - DNA, 17 bp, Homo sapiens
ccaagtttactcaaccc

SEQ ID NO: 6033560 - DNA, 17 bp, Homo sapiens
ccaagtttccatagcaa

SEQ ID NO: 6033561 - DNA, 17 bp, Homo sapiens
ccaagttttgtgaaatt

SEQ ID NO: 6033562 - DNA, 22 bp, Homo sapiens
ccaagttttgtgaaatttttca

SEQ ID NO: 6033563 - DNA, 13 bp, Homo sapiens
ccaagtttttcag

SEQ ID NO: 6033564 - DNA, 18 bp, Homo sapiens
ccaagtttttcagaaagt

SEQ ID NO: 6033565 - DNA, 18 bp, Homo sapiens
cagtgttttctttgagga

SEQ ID NO: 6033566 - DNA, 21 bp, Homo sapiens
cagtgttttgcaagtgctgga

SEQ ID NO: 6033567 - DNA, 17 bp, Homo sapiens
cagtgttttgcacatca

SEQ ID NO: 6033568 - DNA, 21 bp, Homo sapiens
cagtgtttttagacctgtgtt

SEQ ID NO: 6033569 - DNA, 13 bp, Homo sapiens
cagtgtttttcct

SEQ ID NO: 6033570 - DNA, 18 bp, Homo sapiens
cagtgtttttgaaaccca

SEQ ID NO: 6033571 - DNA, 22 bp, Homo sapiens
cagtgtttttgaaacccacagt

SEQ ID NO: 6033572 - DNA, 14 bp, Homo sapiens
cagtgtttttgtaa

SEQ ID NO: 6033573 - DNA, 20 bp, Homo sapiens
cagtgtttttgtaaagtgtg

SEQ ID NO: 6033574 - DNA, 19 bp, Homo sapiens
cagttaaaatcacatttta

SEQ ID NO: 6033575 - DNA, 22 bp, Homo sapiens
cagttaaaatcacattttaagt

SEQ ID NO: 6033576 - DNA, 12 bp, Homo sapiens
cagttaaaatgt

SEQ ID NO: 6033577 - DNA, 14 bp, Homo sapiens
cagttaaaatgtga

SEQ ID NO: 6033578 - DNA, 16 bp, Homo sapiens
cagttaaagaagcaat

SEQ ID NO: 6033579 - DNA, 12 bp, Homo sapiens
cagttaaagatt

SEQ ID NO: 6033580 - DNA, 23 bp, Homo sapiens
cagttaacacaatgtgaatttct

SEQ ID NO: 6033581 - DNA, 24 bp, Homo sapiens
cagttaactattgcatttatatgt

SEQ ID NO: 6033582 - DNA, 19 bp, Homo sapiens
cagttaactttaagactga

SEQ ID NO: 6033583 - DNA, 20 bp, Homo sapiens
cagttaactttcagaagaga

SEQ ID NO: 6033584 - DNA, 15 bp, Homo sapiens
cagttaagaaaaaaa

SEQ ID NO: 6033585 - DNA, 19 bp, Homo sapiens
cagttaagaaaaaaataat

SEQ ID NO: 6033586 - DNA, 20 bp, Homo sapiens
cagttaagaaaaaaataatt

SEQ ID NO: 6033587 - DNA, 19 bp, Homo sapiens
cagttaagacaacaggcat

SEQ ID NO: 6033588 - DNA, 13 bp, Homo sapiens
cagttaaggaaag

SEQ ID NO: 6033589 - DNA, 17 bp, Homo sapiens
cagttaaggaagatcct

SEQ ID NO: 6033590 - DNA, 17 bp, Homo sapiens
cagttaaggaatataat

SEQ ID NO: 6033591 - DNA, 19 bp, Homo sapiens
cagttaagttcttctcccg

SEQ ID NO: 6033592 - DNA, 18 bp, Homo sapiens
cagttaatactccagaga

SEQ ID NO: 6033593 - DNA, 21 bp, Homo sapiens
cagttaatactccagagacag

SEQ ID NO: 6033594 - DNA, 15 bp, Homo sapiens
cagttaatgtgccaa

SEQ ID NO: 6033595 - DNA, 22 bp, Homo sapiens
cagttaattactcagcagaatg

SEQ ID NO: 6033596 - DNA, 21 bp, Homo sapiens
cagttaattagcattctggca

SEQ ID NO: 6033597 - DNA, 16 bp, Homo sapiens
cagttaattcaatgtg

SEQ ID NO: 6033598 - DNA, 14 bp, Homo sapiens
cagttaatttatat

SEQ ID NO: 6033599 - DNA, 12 bp, Homo sapiens
cagttaattttt

SEQ ID NO: 6033600 - DNA, 16 bp, Homo sapiens
cagttaatttttccaa

SEQ ID NO: 6033601 - DNA, 19 bp, Homo sapiens
cagttaatttttccaacta

SEQ ID NO: 6033602 - DNA, 11 bp, Homo sapiens
cagttacaaag

SEQ ID NO: 6033603 - DNA, 14 bp, Homo sapiens
cagttacaaattat

SEQ ID NO: 6033604 - DNA, 22 bp, Homo sapiens
cagttacaaattataatgtatt

SEQ ID NO: 6033605 - DNA, 15 bp, Homo sapiens
cagttacagaaagtg

SEQ ID NO: 6033606 - DNA, 17 bp, Homo sapiens
cagttacagaaagtggt

SEQ ID NO: 6033607 - DNA, 13 bp, Homo sapiens
cagttacagtggc

SEQ ID NO: 6033608 - DNA, 14 bp, Homo sapiens
cagttacagtggca

SEQ ID NO: 6033609 - DNA, 22 bp, Homo sapiens
cagttacataattcactctgag

SEQ ID NO: 6033610 - DNA, 22 bp, Homo sapiens
cagttacatgcatacttcaaaa

SEQ ID NO: 6033611 - DNA, 22 bp, Homo sapiens
cagttaccaaacattacaaaaa

SEQ ID NO: 6033612 - DNA, 17 bp, Homo sapiens
cagttaccacagcaact

SEQ ID NO: 6033613 - DNA, 18 bp, Homo sapiens
cagttaccattaaaccat

SEQ ID NO: 6033614 - DNA, 13 bp, Homo sapiens
cagttaccgagga

SEQ ID NO: 6033615 - DNA, 16 bp, Homo sapiens
cagttacctccaaaaa

SEQ ID NO: 6033616 - DNA, 21 bp, Homo sapiens
cagttacctctgcctcagaaa

SEQ ID NO: 6033617 - DNA, 19 bp, Homo sapiens
cagttacctttgctgtcac

SEQ ID NO: 6033618 - DNA, 20 bp, Homo sapiens
cagttacgtgagaagaggtc

SEQ ID NO: 6033619 - DNA, 19 bp, Homo sapiens
cagttactaagaagaaaat

SEQ ID NO: 6033620 - DNA, 22 bp, Homo sapiens
cagttactaagaagaaaattgc

SEQ ID NO: 6033621 - DNA, 16 bp, Homo sapiens
cagttactctgaaggg

SEQ ID NO: 6033622 - DNA, 22 bp, Homo sapiens
cagttactggtttcagttgaca

SEQ ID NO: 6033623 - DNA, 13 bp, Homo sapiens
cagttactgtgaa

SEQ ID NO: 6033624 - DNA, 23 bp, Homo sapiens
cagttacttaatgaccatgttat

SEQ ID NO: 6033625 - DNA, 17 bp, Homo sapiens
cagttacttccttcctg

SEQ ID NO: 6033626 - DNA, 15 bp, Homo sapiens
cagttacttgggctt

SEQ ID NO: 6033627 - DNA, 16 bp, Homo sapiens
cagttacttgggcttc

SEQ ID NO: 6033628 - DNA, 23 bp, Homo sapiens
cagttactttccaattctccttt

SEQ ID NO: 6033629 - DNA, 14 bp, Homo sapiens
cagttacttttcct

SEQ ID NO: 6033630 - DNA, 15 bp, Homo sapiens
cagttacttttcctt

SEQ ID NO: 6033631 - DNA, 16 bp, Homo sapiens
cagttacttttccttg

SEQ ID NO: 6033632 - DNA, 19 bp, Homo sapiens
cagttacttttccttgcat

SEQ ID NO: 6033633 - DNA, 12 bp, Homo sapiens
cagttagaaata

SEQ ID NO: 6033634 - DNA, 15 bp, Homo sapiens
cagttagagatgcct

SEQ ID NO: 6033635 - DNA, 18 bp, Homo sapiens
cagttagagatgcctccc

SEQ ID NO: 6033636 - DNA, 22 bp, Homo sapiens
cagttagagcccattaatcttg

SEQ ID NO: 6033637 - DNA, 13 bp, Homo sapiens
cagttagcaacaa

SEQ ID NO: 6033638 - DNA, 19 bp, Homo sapiens
cagttagcacagaggatgg

SEQ ID NO: 6033639 - DNA, 19 bp, Homo sapiens
cagttagggttgagttact

SEQ ID NO: 6033640 - DNA, 19 bp, Homo sapiens
cagttagggttttgcaata

SEQ ID NO: 6033641 - DNA, 20 bp, Homo sapiens
cagttagggttttgcaataa

SEQ ID NO: 6033642 - DNA, 16 bp, Homo sapiens
cagttagttgtgaaag

SEQ ID NO: 6033643 - DNA, 11 bp, Homo sapiens
cagttataaag

SEQ ID NO: 6033644 - DNA, 20 bp, Homo sapiens
cagttataaagaaagattgt

SEQ ID NO: 6033645 - DNA, 22 bp, Homo sapiens
cagttataaagaaagattgtaa

SEQ ID NO: 6033646 - DNA, 21 bp, Homo sapiens
cagttataagtagcaggccaa

SEQ ID NO: 6033647 - DNA, 15 bp, Homo sapiens
cagttatatattttg

SEQ ID NO: 6033648 - DNA, 15 bp, Homo sapiens
cagttatatgatatt

SEQ ID NO: 6033649 - DNA, 18 bp, Homo sapiens
cagttatattctttaaat

SEQ ID NO: 6033650 - DNA, 16 bp, Homo sapiens
cagttatattttgcag

SEQ ID NO: 6033651 - DNA, 14 bp, Homo sapiens
cagttatcagggat

SEQ ID NO: 6033652 - DNA, 16 bp, Homo sapiens
cagttatcctgcaagg

SEQ ID NO: 6033653 - DNA, 15 bp, Homo sapiens
cagttatcctttgtg

SEQ ID NO: 6033654 - DNA, 16 bp, Homo sapiens
cagttatctaagttaa

SEQ ID NO: 6033655 - DNA, 21 bp, Homo sapiens
cagttatctgtttgttactgc

SEQ ID NO: 6033656 - DNA, 14 bp, Homo sapiens
cagttatgaaaact

SEQ ID NO: 6033657 - DNA, 20 bp, Homo sapiens
cagttatggctataggtgct

SEQ ID NO: 6033658 - DNA, 19 bp, Homo sapiens
cagttatggtgatgactta

SEQ ID NO: 6033659 - DNA, 14 bp, Homo sapiens
cagttatgtagttt

SEQ ID NO: 6033660 - DNA, 13 bp, Homo sapiens
cagttatgtgacc

SEQ ID NO: 6033661 - DNA, 16 bp, Homo sapiens
cagttatgtgacctca

SEQ ID NO: 6033662 - DNA, 18 bp, Homo sapiens
cagttattacatgtaatt

SEQ ID NO: 6033663 - DNA, 17 bp, Homo sapiens
cagttattcattctgtg

SEQ ID NO: 6033664 - DNA, 20 bp, Homo sapiens
cagttattggtggaatcttt

SEQ ID NO: 6033665 - DNA, 19 bp, Homo sapiens
cagttatttaccagaagtt

SEQ ID NO: 6033666 - DNA, 15 bp, Homo sapiens
cagttatttctgttt

SEQ ID NO: 6033667 - DNA, 14 bp, Homo sapiens
cagttattttggat

SEQ ID NO: 6033668 - DNA, 16 bp, Homo sapiens
cagttattttggatat

SEQ ID NO: 6033669 - DNA, 22 bp, Homo sapiens
cagttcaaaaacaagacagact

SEQ ID NO: 6033670 - DNA, 13 bp, Homo sapiens
cagttcaaagaag

SEQ ID NO: 6033671 - DNA, 23 bp, Homo sapiens
cagttcaaagtcatgatgttttt

SEQ ID NO: 6033672 - DNA, 16 bp, Homo sapiens
cagttcaaagtgtata

SEQ ID NO: 6033673 - DNA, 20 bp, Homo sapiens
cagttcaaagtgtatattta

SEQ ID NO: 6033674 - DNA, 15 bp, Homo sapiens
cagttcaaatcctca

SEQ ID NO: 6033675 - DNA, 17 bp, Homo sapiens
cagttcaaatcctcacc

SEQ ID NO: 6033676 - DNA, 18 bp, Homo sapiens
cagttcaaatcctcacca

SEQ ID NO: 6033677 - DNA, 17 bp, Homo sapiens
cagttcaacctggtggc

SEQ ID NO: 6033678 - DNA, 20 bp, Homo sapiens
cagttcaactttcagaagtg

SEQ ID NO: 6033679 - DNA, 19 bp, Homo sapiens
cagttcaatctcccgctgc

SEQ ID NO: 6033680 - DNA, 22 bp, Homo sapiens
cagttcaatctcccgctgctgc

SEQ ID NO: 6033681 - DNA, 13 bp, Homo sapiens
cagttcaccctga

SEQ ID NO: 6033682 - DNA, 23 bp, Homo sapiens
cagttcacctatttcaaaaattt

SEQ ID NO: 6033683 - DNA, 21 bp, Homo sapiens
cagttcacttctttgcagagc

SEQ ID NO: 6033684 - DNA, 22 bp, Homo sapiens
cagttcacttctttgcagagcc

SEQ ID NO: 6033685 - DNA, 14 bp, Homo sapiens
cagttcacttgcag

SEQ ID NO: 6033686 - DNA, 20 bp, Homo sapiens
cagttcagagatcaggatca

SEQ ID NO: 6033687 - DNA, 24 bp, Homo sapiens
cagttcagagctgccctctcctgg

SEQ ID NO: 6033688 - DNA, 21 bp, Homo sapiens
cagttcagagttgtacactgt

SEQ ID NO: 6033689 - DNA, 15 bp, Homo sapiens
cagttcagcttgggg

SEQ ID NO: 6033690 - DNA, 20 bp, Homo sapiens
cagttcagctttaaaggcca

SEQ ID NO: 6033691 - DNA, 18 bp, Homo sapiens
cagttcaggaatttttgt

SEQ ID NO: 6033692 - DNA, 16 bp, Homo sapiens
cagttcagtacctgga

SEQ ID NO: 6033693 - DNA, 13 bp, Homo sapiens
cagttcagtttgt

SEQ ID NO: 6033694 - DNA, 13 bp, Homo sapiens
cagttcataaatt

SEQ ID NO: 6033695 - DNA, 18 bp, Homo sapiens
cagttcataaatttgttg

SEQ ID NO: 6033696 - DNA, 23 bp, Homo sapiens
cagttcataaatttgttgtcatg

SEQ ID NO: 6033697 - DNA, 16 bp, Homo sapiens
cagttcatatgcagaa

SEQ ID NO: 6033698 - DNA, 17 bp, Homo sapiens
cagttcatcaaatcatc

SEQ ID NO: 6033699 - DNA, 19 bp, Homo sapiens
cagttcatcaccatttcct

SEQ ID NO: 6033700 - DNA, 17 bp, Homo sapiens
cagttcatctatggcag

SEQ ID NO: 6033701 - DNA, 11 bp, Homo sapiens
cagttcatctc

SEQ ID NO: 6033702 - DNA, 23 bp, Homo sapiens
cagttcatctctgctgaacattt

SEQ ID NO: 6033703 - DNA, 22 bp, Homo sapiens
cagttcatgtatgttcagaaga

SEQ ID NO: 6033704 - DNA, 14 bp, Homo sapiens
cagttcatgttgct

SEQ ID NO: 6033705 - DNA, 22 bp, Homo sapiens
cagttcatgttgctcagaagag

SEQ ID NO: 6033706 - DNA, 17 bp, Homo sapiens
cagttcattagaaatat

SEQ ID NO: 6033707 - DNA, 13 bp, Homo sapiens
cagttccaagaaa

SEQ ID NO: 6033708 - DNA, 14 bp, Homo sapiens
cagttccacagcag

SEQ ID NO: 6033709 - DNA, 18 bp, Homo sapiens
cagttccacggttgctaa

SEQ ID NO: 6033710 - DNA, 22 bp, Homo sapiens
cagttccattcaactggaacat

SEQ ID NO: 6033711 - DNA, 14 bp, Homo sapiens
cagttcccagaatc

SEQ ID NO: 6033712 - DNA, 14 bp, Homo sapiens
cagttcccagagtg

SEQ ID NO: 6033713 - DNA, 16 bp, Homo sapiens
cagttcccagctcccc

SEQ ID NO: 6033714 - DNA, 18 bp, Homo sapiens
cagttcccccagtacctc

SEQ ID NO: 6033715 - DNA, 22 bp, Homo sapiens
cagttcccccagtacctccaag

SEQ ID NO: 6033716 - DNA, 19 bp, Homo sapiens
cagttcccctggagcccct

SEQ ID NO: 6033717 - DNA, 19 bp, Homo sapiens
cagttcccggagcacagcc

SEQ ID NO: 6033718 - DNA, 22 bp, Homo sapiens
cagttcccggagcacagccctg

SEQ ID NO: 6033719 - DNA, 20 bp, Homo sapiens
cagttcccgggccctcctgg

SEQ ID NO: 6033720 - DNA, 23 bp, Homo sapiens
cagttcccgggccctcctgggca

SEQ ID NO: 6033721 - DNA, 21 bp, Homo sapiens
cagttccctacgaggagtgtt

SEQ ID NO: 6033722 - DNA, 19 bp, Homo sapiens
cagttccctcctgcccagg

SEQ ID NO: 6033723 - DNA, 13 bp, Homo sapiens
cagttcccttggc

SEQ ID NO: 6033724 - DNA, 14 bp, Homo sapiens
cagttcccttggcc

SEQ ID NO: 6033725 - DNA, 15 bp, Homo sapiens
cagttcccttggcct

SEQ ID NO: 6033726 - DNA, 16 bp, Homo sapiens
cagttcccttggcctc

SEQ ID NO: 6033727 - DNA, 17 bp, Homo sapiens
cagttcccttggcctca

SEQ ID NO: 6033728 - DNA, 19 bp, Homo sapiens
cagttcccttggcctcaga

SEQ ID NO: 6033729 - DNA, 14 bp, Homo sapiens
cagttccctttatt

SEQ ID NO: 6033730 - DNA, 16 bp, Homo sapiens
cagttcctcccaggaa

SEQ ID NO: 6033731 - DNA, 14 bp, Homo sapiens
cagttcctcgccct

SEQ ID NO: 6033732 - DNA, 17 bp, Homo sapiens
cagttcctctttgcatg

SEQ ID NO: 6033733 - DNA, 18 bp, Homo sapiens
cagttcctctttgcatgg

SEQ ID NO: 6033734 - DNA, 14 bp, Homo sapiens
cagttcctgcagca

SEQ ID NO: 6033735 - DNA, 13 bp, Homo sapiens
cagttcctgctct

SEQ ID NO: 6033736 - DNA, 17 bp, Homo sapiens
cagttcctgctctctgc

SEQ ID NO: 6033737 - DNA, 19 bp, Homo sapiens
cagttcctgctctctgctc

SEQ ID NO: 6033738 - DNA, 20 bp, Homo sapiens
cagttcctgctctctgctca

SEQ ID NO: 6033739 - DNA, 15 bp, Homo sapiens
cagttcctgctgcct

SEQ ID NO: 6033740 - DNA, 13 bp, Homo sapiens
cagttcctggcat

SEQ ID NO: 6033741 - DNA, 18 bp, Homo sapiens
cagttcctgtggctccct

SEQ ID NO: 6033742 - DNA, 23 bp, Homo sapiens
cagttccttctctttaaatcaga

SEQ ID NO: 6033743 - DNA, 21 bp, Homo sapiens
ccaataaaaacattttgaagt

SEQ ID NO: 6033744 - DNA, 23 bp, Homo sapiens
ccaataaaaacattttgaagtgt

SEQ ID NO: 6033745 - DNA, 13 bp, Homo sapiens
ccaataaaaagtt

SEQ ID NO: 6033746 - DNA, 16 bp, Homo sapiens
ccaataaaaagttcag

SEQ ID NO: 6033747 - DNA, 16 bp, Homo sapiens
ccaataaaaatcagga

SEQ ID NO: 6033748 - DNA, 19 bp, Homo sapiens
ccaataaaaatcaggagcc

SEQ ID NO: 6033749 - DNA, 22 bp, Homo sapiens
ccaataaaaatcaggagcctgc

SEQ ID NO: 6033750 - DNA, 14 bp, Homo sapiens
ccaataaaaatcct

SEQ ID NO: 6033751 - DNA, 15 bp, Homo sapiens
ccaataaaactgatg

SEQ ID NO: 6033752 - DNA, 15 bp, Homo sapiens
ccaataaaagccaga

SEQ ID NO: 6033753 - DNA, 14 bp, Homo sapiens
ccaataaaagtgac

SEQ ID NO: 6033754 - DNA, 13 bp, Homo sapiens
ccaataaaagtgt

SEQ ID NO: 6033755 - DNA, 12 bp, Homo sapiens
ccaataaaatgt

SEQ ID NO: 6033756 - DNA, 9 bp, Homo sapiens
ccaataaac

SEQ ID NO: 6033757 - DNA, 10 bp, Homo sapiens
ccaataaacc

SEQ ID NO: 6033758 - DNA, 12 bp, Homo sapiens
ccaataaaccag

SEQ ID NO: 6033759 - DNA, 17 bp, Homo sapiens
ccaataaaccagtgtga

SEQ ID NO: 6033760 - DNA, 19 bp, Homo sapiens
ccaataaaccagtgtgaac

SEQ ID NO: 6033761 - DNA, 17 bp, Homo sapiens
ccaataaaccttgaaca

SEQ ID NO: 6033762 - DNA, 13 bp, Homo sapiens
ccaataaactgag

SEQ ID NO: 6033763 - DNA, 12 bp, Homo sapiens
ccaataaagcct

SEQ ID NO: 6033764 - DNA, 17 bp, Homo sapiens
ccaataaagctcacact

SEQ ID NO: 6033765 - DNA, 23 bp, Homo sapiens
ccaataaagctggacaagaagct

SEQ ID NO: 6033766 - DNA, 23 bp, Homo sapiens
ccaataaagcttttggaagccgg

SEQ ID NO: 6033767 - DNA, 12 bp, Homo sapiens
ccaataaaggca

SEQ ID NO: 6033768 - DNA, 13 bp, Homo sapiens
ccaataaaggcag

SEQ ID NO: 6033769 - DNA, 16 bp, Homo sapiens
ccaataaaggcagctg

SEQ ID NO: 6033770 - DNA, 22 bp, Homo sapiens
ccaataaaggcagctgcctctg

SEQ ID NO: 6033771 - DNA, 23 bp, Homo sapiens
ccaataaaggcagctgcctctgc

SEQ ID NO: 6033772 - DNA, 18 bp, Homo sapiens
ccaataaagtgccttctg

SEQ ID NO: 6033773 - DNA, 20 bp, Homo sapiens
ccaataaagtgccttctggg

SEQ ID NO: 6033774 - DNA, 20 bp, Homo sapiens
ccaataaatcaactccagct

SEQ ID NO: 6033775 - DNA, 14 bp, Homo sapiens
ccaataaatgtttg

SEQ ID NO: 6033776 - DNA, 11 bp, Homo sapiens
ccaataaattc

SEQ ID NO: 6033777 - DNA, 16 bp, Homo sapiens
ccaataaattctaaat

SEQ ID NO: 6033778 - DNA, 15 bp, Homo sapiens
ccaataaatttgtaa

SEQ ID NO: 6033779 - DNA, 16 bp, Homo sapiens
ccaataacacacagct

SEQ ID NO: 6033780 - DNA, 19 bp, Homo sapiens
ccaataacttcagagaagt

SEQ ID NO: 6033781 - DNA, 20 bp, Homo sapiens
ccaataacttcagagaagtc

SEQ ID NO: 6033782 - DNA, 15 bp, Homo sapiens
ccaataataaagaca

SEQ ID NO: 6033783 - DNA, 22 bp, Homo sapiens
ccaataataaagacatttccta

SEQ ID NO: 6033784 - DNA, 22 bp, Homo sapiens
ccaataataaatgccctcttct

SEQ ID NO: 6033785 - DNA, 19 bp, Homo sapiens
ccaataatggggcagacac

SEQ ID NO: 6033786 - DNA, 20 bp, Homo sapiens
ccaataatggggcagacaca

SEQ ID NO: 6033787 - DNA, 23 bp, Homo sapiens
ccaataattttaattatttatat

SEQ ID NO: 6033788 - DNA, 20 bp, Homo sapiens
ccaatacaagttacatacat

SEQ ID NO: 6033789 - DNA, 13 bp, Homo sapiens
ccaatacattatt

SEQ ID NO: 6033790 - DNA, 21 bp, Homo sapiens
ccaatacattgaacacatttc

SEQ ID NO: 6033791 - DNA, 14 bp, Homo sapiens
ccaatacatttgta

SEQ ID NO: 6033792 - DNA, 19 bp, Homo sapiens
ccaatacatttgtattttg

SEQ ID NO: 6033793 - DNA, 20 bp, Homo sapiens
ccaatacatttgtattttgt

SEQ ID NO: 6033794 - DNA, 22 bp, Homo sapiens
ccaatacatttgtattttgtga

SEQ ID NO: 6033795 - DNA, 16 bp, Homo sapiens
ccaataccccatggac

SEQ ID NO: 6033796 - DNA, 18 bp, Homo sapiens
ccaataccctactgtggg

SEQ ID NO: 6033797 - DNA, 14 bp, Homo sapiens
ccaataccctagaa

SEQ ID NO: 6033798 - DNA, 21 bp, Homo sapiens
ccaatactgagtgcctgcagc

SEQ ID NO: 6033799 - DNA, 19 bp, Homo sapiens
ccaatacttcattaatttc

SEQ ID NO: 6033800 - DNA, 18 bp, Homo sapiens
ccaatagattccccattg

SEQ ID NO: 6033801 - DNA, 21 bp, Homo sapiens
ccaatagcactttcattgcca

SEQ ID NO: 6033802 - DNA, 15 bp, Homo sapiens
ccaatagctgcccat

SEQ ID NO: 6033803 - DNA, 18 bp, Homo sapiens
ccaataggcaaattaatc

SEQ ID NO: 6033804 - DNA, 19 bp, Homo sapiens
ccaataggtgcaaaaataa

SEQ ID NO: 6033805 - DNA, 20 bp, Homo sapiens
ccaataggtgcaaaaataaa

SEQ ID NO: 6033806 - DNA, 13 bp, Homo sapiens
ccaatatattctg

SEQ ID NO: 6033807 - DNA, 18 bp, Homo sapiens
ccaatatcctaataaaaa

SEQ ID NO: 6033808 - DNA, 22 bp, Homo sapiens
ccaatatgaaaaccgtaaagtg

SEQ ID NO: 6033809 - DNA, 20 bp, Homo sapiens
ccaatatgccagcttggaca

SEQ ID NO: 6033810 - DNA, 21 bp, Homo sapiens
ccaatatggtggccctgggga

SEQ ID NO: 6033811 - DNA, 22 bp, Homo sapiens
ccaatatggtggccctggggaa

SEQ ID NO: 6033812 - DNA, 18 bp, Homo sapiens
ccaatattaaaagagacc

SEQ ID NO: 6033813 - DNA, 15 bp, Homo sapiens
ccaatattaaatctg

SEQ ID NO: 6033814 - DNA, 18 bp, Homo sapiens
ccaatattaaatctgctg

SEQ ID NO: 6033815 - DNA, 23 bp, Homo sapiens
ccaatattaacacgctgcctggt

SEQ ID NO: 6033816 - DNA, 17 bp, Homo sapiens
ccaatattaccatctta

SEQ ID NO: 6033817 - DNA, 13 bp, Homo sapiens
ccaatattataat

SEQ ID NO: 6033818 - DNA, 16 bp, Homo sapiens
ccaatattcatagcag

SEQ ID NO: 6033819 - DNA, 15 bp, Homo sapiens
ccaatattgtacagt

SEQ ID NO: 6033820 - DNA, 16 bp, Homo sapiens
ccaatattgtacagtt

SEQ ID NO: 6033821 - DNA, 21 bp, Homo sapiens
ccaatatttaatcttttatga

SEQ ID NO: 6033822 - DNA, 14 bp, Homo sapiens
ccaatatttataat

SEQ ID NO: 6033823 - DNA, 16 bp, Homo sapiens
ccaatatttataatta

SEQ ID NO: 6033824 - DNA, 19 bp, Homo sapiens
ccaatattttaataaagta

SEQ ID NO: 6033825 - DNA, 20 bp, Homo sapiens
ccaatattttctttaatgct

SEQ ID NO: 6033826 - DNA, 13 bp, Homo sapiens
ccaatatttttgg

SEQ ID NO: 6033827 - DNA, 20 bp, Homo sapiens
ccaatcaacagcatgtctac

SEQ ID NO: 6033828 - DNA, 22 bp, Homo sapiens
ccaatcaacagcatgtctactg

SEQ ID NO: 6033829 - DNA, 22 bp, Homo sapiens
ccaatcaataaaaaacaaatat

SEQ ID NO: 6033830 - DNA, 13 bp, Homo sapiens
ccaatcacaagga

SEQ ID NO: 6033831 - DNA, 15 bp, Homo sapiens
ccaatcacaaggata

SEQ ID NO: 6033832 - DNA, 13 bp, Homo sapiens
ccaatcacattca

SEQ ID NO: 6033833 - DNA, 20 bp, Homo sapiens
ccaatcacattcaggcatgc

SEQ ID NO: 6033834 - DNA, 16 bp, Homo sapiens
ccaatcagagagccta

SEQ ID NO: 6033835 - DNA, 15 bp, Homo sapiens
ccaatcagcactgaa

SEQ ID NO: 6033836 - DNA, 17 bp, Homo sapiens
ccaatcagcgctctgta

SEQ ID NO: 6033837 - DNA, 22 bp, Homo sapiens
ccaatcagcttttgttctagac

SEQ ID NO: 6033838 - DNA, 12 bp, Homo sapiens
ccaatcatttta

SEQ ID NO: 6033839 - DNA, 17 bp, Homo sapiens
ccaatccaacccatgca

SEQ ID NO: 6033840 - DNA, 21 bp, Homo sapiens
ccaatccaacccatgcatggc

SEQ ID NO: 6033841 - DNA, 21 bp, Homo sapiens
ccaatccagagaagcgctgtt

SEQ ID NO: 6033842 - DNA, 12 bp, Homo sapiens
ccaatccaggcc

SEQ ID NO: 6033843 - DNA, 13 bp, Homo sapiens
ccaatccaggccc

SEQ ID NO: 6033844 - DNA, 23 bp, Homo sapiens
ccaatccatttggcagaactgct

SEQ ID NO: 6033845 - DNA, 17 bp, Homo sapiens
ccaatcccagggctggc

SEQ ID NO: 6033846 - DNA, 21 bp, Homo sapiens
ccaatcccagggctggctctg

SEQ ID NO: 6033847 - DNA, 14 bp, Homo sapiens
ccaatcccagttct

SEQ ID NO: 6033848 - DNA, 18 bp, Homo sapiens
ccaatccccactcctccg

SEQ ID NO: 6033849 - DNA, 17 bp, Homo sapiens
ccaatcccggtcatgct

SEQ ID NO: 6033850 - DNA, 14 bp, Homo sapiens
ccaatcccgtgaaa

SEQ ID NO: 6033851 - DNA, 13 bp, Homo sapiens
ccaatccctctcc

SEQ ID NO: 6033852 - DNA, 16 bp, Homo sapiens
ccaatccctgccactg

SEQ ID NO: 6033853 - DNA, 20 bp, Homo sapiens
ccaatccctgccactgggct

SEQ ID NO: 6033854 - DNA, 23 bp, Homo sapiens
ccaatccctgccactgggctctg

SEQ ID NO: 6033855 - DNA, 14 bp, Homo sapiens
ccaatccctggcca

SEQ ID NO: 6033856 - DNA, 16 bp, Homo sapiens
ccaatcctactaataa

SEQ ID NO: 6033857 - DNA, 13 bp, Homo sapiens
ccaatcctatgtt

SEQ ID NO: 6033858 - DNA, 15 bp, Homo sapiens
ccaatcctcactggg

SEQ ID NO: 6033859 - DNA, 17 bp, Homo sapiens
ccaatcctcactgggtg

SEQ ID NO: 6033860 - DNA, 17 bp, Homo sapiens
ccaatcctccccgctct

SEQ ID NO: 6033861 - DNA, 15 bp, Homo sapiens
ccaatcctccctgga

SEQ ID NO: 6033862 - DNA, 18 bp, Homo sapiens
ccaatcctccctggagaa

SEQ ID NO: 6033863 - DNA, 16 bp, Homo sapiens
ccaatcctctctcccc

SEQ ID NO: 6033864 - DNA, 12 bp, Homo sapiens
ccaatcctgccc

SEQ ID NO: 6033865 - DNA, 18 bp, Homo sapiens
ccaatcgggtccagagac

SEQ ID NO: 6033866 - DNA, 23 bp, Homo sapiens
ccaatcgggtccagagaccacac

SEQ ID NO: 6033867 - DNA, 16 bp, Homo sapiens
ccaatcggtgtgtagt

SEQ ID NO: 6033868 - DNA, 16 bp, Homo sapiens
ccaatctaaaatggca

SEQ ID NO: 6033869 - DNA, 21 bp, Homo sapiens
ccaatctattctcaaagttaa

SEQ ID NO: 6033870 - DNA, 23 bp, Homo sapiens
ccaatctccggtgtgagcccacc

SEQ ID NO: 6033871 - DNA, 20 bp, Homo sapiens
ccaatctctacccctttctt

SEQ ID NO: 6033872 - DNA, 20 bp, Homo sapiens
ccaatctctgctctctatgt

SEQ ID NO: 6033873 - DNA, 13 bp, Homo sapiens
ccaatctctgtga

SEQ ID NO: 6033874 - DNA, 21 bp, Homo sapiens
ccaatctgccctttgcagtgt

SEQ ID NO: 6033875 - DNA, 18 bp, Homo sapiens
ccaatctgctcagcaggc

SEQ ID NO: 6033876 - DNA, 21 bp, Homo sapiens
ccaatctggcccttacacact

SEQ ID NO: 6033877 - DNA, 19 bp, Homo sapiens
ccaatctggctggtaaatg

SEQ ID NO: 6033878 - DNA, 15 bp, Homo sapiens
ccaatctgtgagaag

SEQ ID NO: 6033879 - DNA, 15 bp, Homo sapiens
ccaatcttactttgt

SEQ ID NO: 6033880 - DNA, 17 bp, Homo sapiens
ccaatcttgcccactgg

SEQ ID NO: 6033881 - DNA, 21 bp, Homo sapiens
ccaatcttgcccactggccgc

SEQ ID NO: 6033882 - DNA, 14 bp, Homo sapiens
ccaatcttgctttg

SEQ ID NO: 6033883 - DNA, 21 bp, Homo sapiens
ccaatcttgttttaagcaaat

SEQ ID NO: 6033884 - DNA, 20 bp, Homo sapiens
ccaatctttcctactttcta

SEQ ID NO: 6033885 - DNA, 16 bp, Homo sapiens
ccaatgaaaacatgta

SEQ ID NO: 6033886 - DNA, 14 bp, Homo sapiens
ccaatgaacatctc

SEQ ID NO: 6033887 - DNA, 18 bp, Homo sapiens
ccaatgaactctttcccc

SEQ ID NO: 6033888 - DNA, 12 bp, Homo sapiens
ccaatgaagaag

SEQ ID NO: 6033889 - DNA, 17 bp, Homo sapiens
ccaatgaagcaaacaca

SEQ ID NO: 6033890 - DNA, 23 bp, Homo sapiens
ccaatgaataatggaaaatgcca

SEQ ID NO: 6033891 - DNA, 14 bp, Homo sapiens
ccaatgactgagca

SEQ ID NO: 6033892 - DNA, 21 bp, Homo sapiens
ccaatgagactctagggtcca

SEQ ID NO: 6033893 - DNA, 18 bp, Homo sapiens
ccaatgagacttgccttc

SEQ ID NO: 6033894 - DNA, 20 bp, Homo sapiens
ccaatgagctttctgaacag

SEQ ID NO: 6033895 - DNA, 18 bp, Homo sapiens
ccaatgaggtggctcatg

SEQ ID NO: 6033896 - DNA, 15 bp, Homo sapiens
ccaatgatggtcacc

SEQ ID NO: 6033897 - DNA, 15 bp, Homo sapiens
ccaatgcaagacgcc

SEQ ID NO: 6033898 - DNA, 20 bp, Homo sapiens
ccaatgcactttgttctggc

SEQ ID NO: 6033899 - DNA, 17 bp, Homo sapiens
ccaatgcatagagccct

SEQ ID NO: 6033900 - DNA, 17 bp, Homo sapiens
ccaatgcatgcagccac

SEQ ID NO: 6033901 - DNA, 21 bp, Homo sapiens
ccaatgcatgcagccactgtg

SEQ ID NO: 6033902 - DNA, 22 bp, Homo sapiens
ccaatgcattggcctctgtacc

SEQ ID NO: 6033903 - DNA, 15 bp, Homo sapiens
ccaatgccacagcca

SEQ ID NO: 6033904 - DNA, 16 bp, Homo sapiens
ccaatgccacagccaa

SEQ ID NO: 6033905 - DNA, 19 bp, Homo sapiens
ccaatgccacctagactct

SEQ ID NO: 6033906 - DNA, 20 bp, Homo sapiens
ccaatgccatgactgctcag

SEQ ID NO: 6033907 - DNA, 22 bp, Homo sapiens
ccaatgccatgactgctcaggc

SEQ ID NO: 6033908 - DNA, 14 bp, Homo sapiens
ccaatgcccagcag

SEQ ID NO: 6033909 - DNA, 21 bp, Homo sapiens
ccaatgcggcccactttcctg

SEQ ID NO: 6033910 - DNA, 15 bp, Homo sapiens
ccaatgctccagctg

SEQ ID NO: 6033911 - DNA, 20 bp, Homo sapiens
ccaatgctccagctgtcgtc

SEQ ID NO: 6033912 - DNA, 13 bp, Homo sapiens
ccaatgctgtggg

SEQ ID NO: 6033913 - DNA, 15 bp, Homo sapiens
ccaatgcttctgcat

SEQ ID NO: 6033914 - DNA, 14 bp, Homo sapiens
ccaatggaaacctc

SEQ ID NO: 6033915 - DNA, 18 bp, Homo sapiens
ccaatggaacctcctttc

SEQ ID NO: 6033916 - DNA, 20 bp, Homo sapiens
ccaatggaatgtgatgttca

SEQ ID NO: 6033917 - DNA, 18 bp, Homo sapiens
ccaatggagaaaatgaat

SEQ ID NO: 6033918 - DNA, 16 bp, Homo sapiens
ccaatggagaaatgaa

SEQ ID NO: 6033919 - DNA, 21 bp, Homo sapiens
ccaatggattcatggagtagc

SEQ ID NO: 6033920 - DNA, 16 bp, Homo sapiens
ccaatgggctagaggg

SEQ ID NO: 6033921 - DNA, 15 bp, Homo sapiens
ccaatggggccagca

SEQ ID NO: 6033922 - DNA, 15 bp, Homo sapiens
cagttcctttcaaag

SEQ ID NO: 6033923 - DNA, 23 bp, Homo sapiens
cagttcgaccaaactcagttcaa

SEQ ID NO: 6033924 - DNA, 19 bp, Homo sapiens
cagttcgcagccaccctga

SEQ ID NO: 6033925 - DNA, 22 bp, Homo sapiens
cagttcgcagccaccctgagga

SEQ ID NO: 6033926 - DNA, 17 bp, Homo sapiens
cagttcgcctggagccc

SEQ ID NO: 6033927 - DNA, 18 bp, Homo sapiens
cagttcgcctggagccct

SEQ ID NO: 6033928 - DNA, 18 bp, Homo sapiens
cagttcgtgtttgattcc

SEQ ID NO: 6033929 - DNA, 12 bp, Homo sapiens
cagttctaggaa

SEQ ID NO: 6033930 - DNA, 15 bp, Homo sapiens
cagttctaggaaaat

SEQ ID NO: 6033931 - DNA, 19 bp, Homo sapiens
cagttctaggcctttcctc

SEQ ID NO: 6033932 - DNA, 20 bp, Homo sapiens
cagttctaggcctttcctct

SEQ ID NO: 6033933 - DNA, 13 bp, Homo sapiens
cagttctagttga

SEQ ID NO: 6033934 - DNA, 16 bp, Homo sapiens
cagttctagttgattg

SEQ ID NO: 6033935 - DNA, 17 bp, Homo sapiens
cagttctagtttgcatt

SEQ ID NO: 6033936 - DNA, 16 bp, Homo sapiens
cagttctcaaatgtgt

SEQ ID NO: 6033937 - DNA, 18 bp, Homo sapiens
cagttctcaaatgtgtgt

SEQ ID NO: 6033938 - DNA, 12 bp, Homo sapiens
cagttctcacaa

SEQ ID NO: 6033939 - DNA, 19 bp, Homo sapiens
cagttctcacgaaagtatt

SEQ ID NO: 6033940 - DNA, 20 bp, Homo sapiens
cagttctcactcctaggaga

SEQ ID NO: 6033941 - DNA, 16 bp, Homo sapiens
cagttctcatcttgta

SEQ ID NO: 6033942 - DNA, 21 bp, Homo sapiens
cagttctcatcttgtaaataa

SEQ ID NO: 6033943 - DNA, 16 bp, Homo sapiens
cagttctcatgactcc

SEQ ID NO: 6033944 - DNA, 12 bp, Homo sapiens
cagttctcccag

SEQ ID NO: 6033945 - DNA, 16 bp, Homo sapiens
cagttctcccagggag

SEQ ID NO: 6033946 - DNA, 19 bp, Homo sapiens
cagttctcctgcctcagcc

SEQ ID NO: 6033947 - DNA, 19 bp, Homo sapiens
cagttctcgtgcccttaga

SEQ ID NO: 6033948 - DNA, 23 bp, Homo sapiens
cagttctctcccttcctctctcc

SEQ ID NO: 6033949 - DNA, 13 bp, Homo sapiens
cagttctctcctt

SEQ ID NO: 6033950 - DNA, 18 bp, Homo sapiens
cagttctctcgaatactt

SEQ ID NO: 6033951 - DNA, 16 bp, Homo sapiens
cagttctctgccaaag

SEQ ID NO: 6033952 - DNA, 16 bp, Homo sapiens
cagttctcttcactca

SEQ ID NO: 6033953 - DNA, 12 bp, Homo sapiens
cagttctgaaga

SEQ ID NO: 6033954 - DNA, 13 bp, Homo sapiens
cagttctgaagaa

SEQ ID NO: 6033955 - DNA, 15 bp, Homo sapiens
cagttctgaagaaga

SEQ ID NO: 6033956 - DNA, 15 bp, Homo sapiens
cagttctgagctgta

SEQ ID NO: 6033957 - DNA, 13 bp, Homo sapiens
cagttctgatgag

SEQ ID NO: 6033958 - DNA, 12 bp, Homo sapiens
cagttctgatgc

SEQ ID NO: 6033959 - DNA, 11 bp, Homo sapiens
cagttctgcaa

SEQ ID NO: 6033960 - DNA, 17 bp, Homo sapiens
cagttctgcaaatagaa

SEQ ID NO: 6033961 - DNA, 19 bp, Homo sapiens
cagttctgcactcttgtac

SEQ ID NO: 6033962 - DNA, 20 bp, Homo sapiens
cagttctgcactttgacaca

SEQ ID NO: 6033963 - DNA, 17 bp, Homo sapiens
cagttctgctcctctcc

SEQ ID NO: 6033964 - DNA, 19 bp, Homo sapiens
cagttctgctcctctccag

SEQ ID NO: 6033965 - DNA, 13 bp, Homo sapiens
cagttctgcttgc

SEQ ID NO: 6033966 - DNA, 14 bp, Homo sapiens
cagttctggaggag

SEQ ID NO: 6033967 - DNA, 23 bp, Homo sapiens
cagttctggatggtgtgccttcc

SEQ ID NO: 6033968 - DNA, 18 bp, Homo sapiens
cagttctggggcccgcct

SEQ ID NO: 6033969 - DNA, 20 bp, Homo sapiens
cagttctggggcccgcctgc

SEQ ID NO: 6033970 - DNA, 22 bp, Homo sapiens
cagttctggggcccgcctgcca

SEQ ID NO: 6033971 - DNA, 17 bp, Homo sapiens
cagttctgggtgctccc

SEQ ID NO: 6033972 - DNA, 20 bp, Homo sapiens
cagttctgggtgctccctac

SEQ ID NO: 6033973 - DNA, 16 bp, Homo sapiens
cagttctgtgtacatt

SEQ ID NO: 6033974 - DNA, 19 bp, Homo sapiens
cagttctgtgtacatttta

SEQ ID NO: 6033975 - DNA, 18 bp, Homo sapiens
cagttctgtgtcctcgca

SEQ ID NO: 6033976 - DNA, 21 bp, Homo sapiens
cagttctgttatatcccctgc

SEQ ID NO: 6033977 - DNA, 20 bp, Homo sapiens
cagttcttagattcagggga

SEQ ID NO: 6033978 - DNA, 21 bp, Homo sapiens
cagttcttagattcaggggaa

SEQ ID NO: 6033979 - DNA, 12 bp, Homo sapiens
cagttcttagcc

SEQ ID NO: 6033980 - DNA, 13 bp, Homo sapiens
cagttcttcattt

SEQ ID NO: 6033981 - DNA, 14 bp, Homo sapiens
cagttcttcctgca

SEQ ID NO: 6033982 - DNA, 23 bp, Homo sapiens
cagttcttcctgcaaccactctg

SEQ ID NO: 6033983 - DNA, 18 bp, Homo sapiens
cagttcttcgactgttgt

SEQ ID NO: 6033984 - DNA, 19 bp, Homo sapiens
cagttcttcgggaagagag

SEQ ID NO: 6033985 - DNA, 23 bp, Homo sapiens
cagttcttcgggaagagaggagt

SEQ ID NO: 6033986 - DNA, 15 bp, Homo sapiens
cagttcttgcaataa

SEQ ID NO: 6033987 - DNA, 19 bp, Homo sapiens
cagttcttgccactttttt

SEQ ID NO: 6033988 - DNA, 18 bp, Homo sapiens
cagttcttggacccctga

SEQ ID NO: 6033989 - DNA, 13 bp, Homo sapiens
cagttcttggcct

SEQ ID NO: 6033990 - DNA, 21 bp, Homo sapiens
cagttcttggcctatgataag

SEQ ID NO: 6033991 - DNA, 15 bp, Homo sapiens
cagttcttggcctgc

SEQ ID NO: 6033992 - DNA, 17 bp, Homo sapiens
cagttcttggtgctctg

SEQ ID NO: 6033993 - DNA, 17 bp, Homo sapiens
cagttctttccatgggc

SEQ ID NO: 6033994 - DNA, 19 bp, Homo sapiens
cagttctttcctctttctg

SEQ ID NO: 6033995 - DNA, 18 bp, Homo sapiens
cagttctttgggccagac

SEQ ID NO: 6033996 - DNA, 20 bp, Homo sapiens
cagttctttgggccagacat

SEQ ID NO: 6033997 - DNA, 21 bp, Homo sapiens
cagttctttgggccagacatg

SEQ ID NO: 6033998 - DNA, 16 bp, Homo sapiens
cagttgaaaacttgta

SEQ ID NO: 6033999 - DNA, 17 bp, Homo sapiens
cagttgaaaacttgtaa

SEQ ID NO: 6034000 - DNA, 14 bp, Homo sapiens
cagttgaaaagact

SEQ ID NO: 6034001 - DNA, 22 bp, Homo sapiens
cagttgaaaagaggtggattca

SEQ ID NO: 6034002 - DNA, 21 bp, Homo sapiens
cagttgaatgacaacagaagc

SEQ ID NO: 6034003 - DNA, 22 bp, Homo sapiens
cagttgacacattgcacacaca

SEQ ID NO: 6034004 - DNA, 13 bp, Homo sapiens
cagttgacagaat

SEQ ID NO: 6034005 - DNA, 22 bp, Homo sapiens
cagttgaccctattttttgaca

SEQ ID NO: 6034006 - DNA, 17 bp, Homo sapiens
cagttgacttactgttt

SEQ ID NO: 6034007 - DNA, 19 bp, Homo sapiens
cagttgactttaagtgaaa

SEQ ID NO: 6034008 - DNA, 13 bp, Homo sapiens
cagttgagaaaca

SEQ ID NO: 6034009 - DNA, 17 bp, Homo sapiens
cagttgagaaacagttc

SEQ ID NO: 6034010 - DNA, 18 bp, Homo sapiens
cagttgagacaagaaaat

SEQ ID NO: 6034011 - DNA, 18 bp, Homo sapiens
cagttgagagagaatctc

SEQ ID NO: 6034012 - DNA, 20 bp, Homo sapiens
cagttgagtcgtcatcactt

SEQ ID NO: 6034013 - DNA, 14 bp, Homo sapiens
cagttgatctgctc

SEQ ID NO: 6034014 - DNA, 15 bp, Homo sapiens
cagttgatctgctct

SEQ ID NO: 6034015 - DNA, 14 bp, Homo sapiens
cagttgatggagcc

SEQ ID NO: 6034016 - DNA, 18 bp, Homo sapiens
cagttgatggagccccag

SEQ ID NO: 6034017 - DNA, 11 bp, Homo sapiens
cagttgattaa

SEQ ID NO: 6034018 - DNA, 14 bp, Homo sapiens
cagttgattacttc

SEQ ID NO: 6034019 - DNA, 16 bp, Homo sapiens
cagttgattagcagtt

SEQ ID NO: 6034020 - DNA, 17 bp, Homo sapiens
cagttgattctgaatct

SEQ ID NO: 6034021 - DNA, 23 bp, Homo sapiens
cagttgattgtacgtagccacag

SEQ ID NO: 6034022 - DNA, 16 bp, Homo sapiens
cagttgattttctgga

SEQ ID NO: 6034023 - DNA, 17 bp, Homo sapiens
cagttgattttctggat

SEQ ID NO: 6034024 - DNA, 19 bp, Homo sapiens
cagttgatttttcttattt

SEQ ID NO: 6034025 - DNA, 16 bp, Homo sapiens
cagttgcaataaaata

SEQ ID NO: 6034026 - DNA, 16 bp, Homo sapiens
cagttgcaattcataa

SEQ ID NO: 6034027 - DNA, 13 bp, Homo sapiens
cagttgcacagca

SEQ ID NO: 6034028 - DNA, 17 bp, Homo sapiens
cagttgcacagcatctc

SEQ ID NO: 6034029 - DNA, 21 bp, Homo sapiens
cagttgcacagcatctcagct

SEQ ID NO: 6034030 - DNA, 22 bp, Homo sapiens
cagttgcactacataatctctg

SEQ ID NO: 6034031 - DNA, 13 bp, Homo sapiens
cagttgcacttgg

SEQ ID NO: 6034032 - DNA, 16 bp, Homo sapiens
cagttgcacttggcct

SEQ ID NO: 6034033 - DNA, 19 bp, Homo sapiens
cagttgcaggagcgtgaag

SEQ ID NO: 6034034 - DNA, 21 bp, Homo sapiens
cagttgcaggtgccaatgact

SEQ ID NO: 6034035 - DNA, 19 bp, Homo sapiens
cagttgcagtcactctagt

SEQ ID NO: 6034036 - DNA, 15 bp, Homo sapiens
cagttgcagtgctgc

SEQ ID NO: 6034037 - DNA, 22 bp, Homo sapiens
cagttgcatttttatggagttc

SEQ ID NO: 6034038 - DNA, 16 bp, Homo sapiens
cagttgccaccacctc

SEQ ID NO: 6034039 - DNA, 21 bp, Homo sapiens
cagttgccaccacctctgtgg

SEQ ID NO: 6034040 - DNA, 23 bp, Homo sapiens
cagttgccagtcaccccggccac

SEQ ID NO: 6034041 - DNA, 12 bp, Homo sapiens
cagttgcccaga

SEQ ID NO: 6034042 - DNA, 13 bp, Homo sapiens
cagttgcccagag

SEQ ID NO: 6034043 - DNA, 17 bp, Homo sapiens
cagttgcccagagcact

SEQ ID NO: 6034044 - DNA, 21 bp, Homo sapiens
cagttgcccagagcactttag

SEQ ID NO: 6034045 - DNA, 16 bp, Homo sapiens
cagttgcccagcctct

SEQ ID NO: 6034046 - DNA, 17 bp, Homo sapiens
cagttgcccagcctctt

SEQ ID NO: 6034047 - DNA, 17 bp, Homo sapiens
cagttgccctagcccag

SEQ ID NO: 6034048 - DNA, 22 bp, Homo sapiens
cagttgccctagcccagactct

SEQ ID NO: 6034049 - DNA, 18 bp, Homo sapiens
cagttgccgtctaggatt

SEQ ID NO: 6034050 - DNA, 15 bp, Homo sapiens
cagttgctaaatttg

SEQ ID NO: 6034051 - DNA, 17 bp, Homo sapiens
cagttgctcaaaaagaa

SEQ ID NO: 6034052 - DNA, 23 bp, Homo sapiens
cagttgctcaaaaagaaatcaat

SEQ ID NO: 6034053 - DNA, 16 bp, Homo sapiens
cagttgctctatgctt

SEQ ID NO: 6034054 - DNA, 14 bp, Homo sapiens
cagttgctggtaaa

SEQ ID NO: 6034055 - DNA, 18 bp, Homo sapiens
cagttgctggtaaaatga

SEQ ID NO: 6034056 - DNA, 21 bp, Homo sapiens
cagttgctggtaaaatgaaga

SEQ ID NO: 6034057 - DNA, 23 bp, Homo sapiens
cagttgctggtaaaatgaagaat

SEQ ID NO: 6034058 - DNA, 13 bp, Homo sapiens
cagttgctgtcac

SEQ ID NO: 6034059 - DNA, 15 bp, Homo sapiens
cagttgctgtcacaa

SEQ ID NO: 6034060 - DNA, 20 bp, Homo sapiens
cagttgctgtgaactttcat

SEQ ID NO: 6034061 - DNA, 13 bp, Homo sapiens
cagttgcttgtct

SEQ ID NO: 6034062 - DNA, 21 bp, Homo sapiens
cagttggaaataataaaagat

SEQ ID NO: 6034063 - DNA, 14 bp, Homo sapiens
cagttggacagtaa

SEQ ID NO: 6034064 - DNA, 15 bp, Homo sapiens
cagttggactctcag

SEQ ID NO: 6034065 - DNA, 17 bp, Homo sapiens
cagttggactctcaggg

SEQ ID NO: 6034066 - DNA, 19 bp, Homo sapiens
cagttggactctcagggat

SEQ ID NO: 6034067 - DNA, 17 bp, Homo sapiens
cagttggactgtggcct

SEQ ID NO: 6034068 - DNA, 22 bp, Homo sapiens
cagttggactgtggcctcagga

SEQ ID NO: 6034069 - DNA, 13 bp, Homo sapiens
cagttggactttt

SEQ ID NO: 6034070 - DNA, 21 bp, Homo sapiens
cagttggagggaaagccagcc

SEQ ID NO: 6034071 - DNA, 22 bp, Homo sapiens
cagttggagggaaagccagcct

SEQ ID NO: 6034072 - DNA, 23 bp, Homo sapiens
cagttggagggaaagccagcctg

SEQ ID NO: 6034073 - DNA, 22 bp, Homo sapiens
cagttggatctctggttgtcta

SEQ ID NO: 6034074 - DNA, 16 bp, Homo sapiens
cagttggcagacagcc

SEQ ID NO: 6034075 - DNA, 20 bp, Homo sapiens
cagttggcagagaaggcctc

SEQ ID NO: 6034076 - DNA, 19 bp, Homo sapiens
cagttggcccttctgccct

SEQ ID NO: 6034077 - DNA, 17 bp, Homo sapiens
cagttggcctctgcccc

SEQ ID NO: 6034078 - DNA, 21 bp, Homo sapiens
cagttgggaagtctcagcctg

SEQ ID NO: 6034079 - DNA, 16 bp, Homo sapiens
cagttgggactcagga

SEQ ID NO: 6034080 - DNA, 14 bp, Homo sapiens
cagttgggagcact

SEQ ID NO: 6034081 - DNA, 18 bp, Homo sapiens
cagttgggagcactggag

SEQ ID NO: 6034082 - DNA, 15 bp, Homo sapiens
cagttgggagtacat

SEQ ID NO: 6034083 - DNA, 23 bp, Homo sapiens
cagttgggagtacatatggtaga

SEQ ID NO: 6034084 - DNA, 21 bp, Homo sapiens
cagttgggctcgcactgccca

SEQ ID NO: 6034085 - DNA, 19 bp, Homo sapiens
cagttggggaagccaggtg

SEQ ID NO: 6034086 - DNA, 15 bp, Homo sapiens
cagttggggccctct

SEQ ID NO: 6034087 - DNA, 16 bp, Homo sapiens
cagttggggccctctt

SEQ ID NO: 6034088 - DNA, 19 bp, Homo sapiens
cagttggggccctcttgcc

SEQ ID NO: 6034089 - DNA, 21 bp, Homo sapiens
cagttgggtagatgggtgggg

SEQ ID NO: 6034090 - DNA, 11 bp, Homo sapiens
cagttgggttt

SEQ ID NO: 6034091 - DNA, 18 bp, Homo sapiens
cagttgggttttttaagg

SEQ ID NO: 6034092 - DNA, 16 bp, Homo sapiens
cagttggtaacttttg

SEQ ID NO: 6034093 - DNA, 19 bp, Homo sapiens
cagttggtcccccttccat

SEQ ID NO: 6034094 - DNA, 17 bp, Homo sapiens
cagttggtggggccagg

SEQ ID NO: 6034095 - DNA, 19 bp, Homo sapiens
cagttggtggggccaggcc

SEQ ID NO: 6034096 - DNA, 20 bp, Homo sapiens
cagttggtggggccaggcca

SEQ ID NO: 6034097 - DNA, 22 bp, Homo sapiens
cagttggtggggccaggccagg

SEQ ID NO: 6034098 - DNA, 22 bp, Homo sapiens
cagttggtgttcaaatagcact

SEQ ID NO: 6034099 - DNA, 14 bp, Homo sapiens
cagttgtagaatgt

SEQ ID NO: 6034100 - DNA, 17 bp, Homo sapiens
ccaatggggccagcact

SEQ ID NO: 6034101 - DNA, 22 bp, Homo sapiens
ccaatggggccagcactggagg

SEQ ID NO: 6034102 - DNA, 14 bp, Homo sapiens
ccaatggggcgggg

SEQ ID NO: 6034103 - DNA, 22 bp, Homo sapiens
ccaatgggtttgccaagccctt

SEQ ID NO: 6034104 - DNA, 23 bp, Homo sapiens
ccaatgggtttgccaagcccttt

SEQ ID NO: 6034105 - DNA, 20 bp, Homo sapiens
ccaatgggtttttccctgta

SEQ ID NO: 6034106 - DNA, 15 bp, Homo sapiens
ccaatggtgagggct

SEQ ID NO: 6034107 - DNA, 16 bp, Homo sapiens
ccaatggtgatcctct

SEQ ID NO: 6034108 - DNA, 21 bp, Homo sapiens
ccaatggtgcttcccccaccc

SEQ ID NO: 6034109 - DNA, 22 bp, Homo sapiens
ccaatggtgtagctgtcctctc

SEQ ID NO: 6034110 - DNA, 15 bp, Homo sapiens
ccaatgtacccaccg

SEQ ID NO: 6034111 - DNA, 15 bp, Homo sapiens
ccaatgtcagcatca

SEQ ID NO: 6034112 - DNA, 17 bp, Homo sapiens
ccaatgtccaggtcaca

SEQ ID NO: 6034113 - DNA, 13 bp, Homo sapiens
ccaatgtctccca

SEQ ID NO: 6034114 - DNA, 14 bp, Homo sapiens
ccaatgtctcccac

SEQ ID NO: 6034115 - DNA, 16 bp, Homo sapiens
ccaatgtctcccacac

SEQ ID NO: 6034116 - DNA, 17 bp, Homo sapiens
ccaatgtctcccacacc

SEQ ID NO: 6034117 - DNA, 12 bp, Homo sapiens
ccaatgtcttga

SEQ ID NO: 6034118 - DNA, 15 bp, Homo sapiens
ccaatgtgaaagatt

SEQ ID NO: 6034119 - DNA, 19 bp, Homo sapiens
ccaatgtgacctggggcag

SEQ ID NO: 6034120 - DNA, 20 bp, Homo sapiens
ccaatgtgacctggggcaga

SEQ ID NO: 6034121 - DNA, 14 bp, Homo sapiens
ccaatgtgttttct

SEQ ID NO: 6034122 - DNA, 20 bp, Homo sapiens
ccaatgttagagactttttt

SEQ ID NO: 6034123 - DNA, 17 bp, Homo sapiens
ccaatgttatgccagct

SEQ ID NO: 6034124 - DNA, 20 bp, Homo sapiens
ccaatgttatgccagctcca

SEQ ID NO: 6034125 - DNA, 21 bp, Homo sapiens
ccaatgttatgccagctccat

SEQ ID NO: 6034126 - DNA, 18 bp, Homo sapiens
ccaatgttgtgtgttgca

SEQ ID NO: 6034127 - DNA, 20 bp, Homo sapiens
ccaatgttgtgtgttgcact

SEQ ID NO: 6034128 - DNA, 12 bp, Homo sapiens
ccaatgttttat

SEQ ID NO: 6034129 - DNA, 18 bp, Homo sapiens
ccaatgttttccacccat

SEQ ID NO: 6034130 - DNA, 12 bp, Homo sapiens
ccaattaaaata

SEQ ID NO: 6034131 - DNA, 14 bp, Homo sapiens
ccaattaaaatata

SEQ ID NO: 6034132 - DNA, 20 bp, Homo sapiens
ccaattaaaatatatataaa

SEQ ID NO: 6034133 - DNA, 22 bp, Homo sapiens
ccaattaaaatatatataaata

SEQ ID NO: 6034134 - DNA, 15 bp, Homo sapiens
ccaattaaccagaaa

SEQ ID NO: 6034135 - DNA, 15 bp, Homo sapiens
ccaattaatgtagct

SEQ ID NO: 6034136 - DNA, 14 bp, Homo sapiens
ccaattaattatca

SEQ ID NO: 6034137 - DNA, 22 bp, Homo sapiens
ccaattacagggtgactcacag

SEQ ID NO: 6034138 - DNA, 19 bp, Homo sapiens
ccaattactattccctttg

SEQ ID NO: 6034139 - DNA, 17 bp, Homo sapiens
ccaattaggaagtgtaa

SEQ ID NO: 6034140 - DNA, 16 bp, Homo sapiens
ccaattagtttccttt

SEQ ID NO: 6034141 - DNA, 20 bp, Homo sapiens
ccaattagtttcctttttaa

SEQ ID NO: 6034142 - DNA, 18 bp, Homo sapiens
ccaattatatctccccca

SEQ ID NO: 6034143 - DNA, 23 bp, Homo sapiens
ccaattatatctcccccactcca

SEQ ID NO: 6034144 - DNA, 22 bp, Homo sapiens
ccaattatatgagacgtttttg

SEQ ID NO: 6034145 - DNA, 16 bp, Homo sapiens
ccaattatcaaaaaac

SEQ ID NO: 6034146 - DNA, 17 bp, Homo sapiens
ccaattatcatcttttg

SEQ ID NO: 6034147 - DNA, 19 bp, Homo sapiens
ccaattatgtgacaacctt

SEQ ID NO: 6034148 - DNA, 15 bp, Homo sapiens
ccaattatgttaaac

SEQ ID NO: 6034149 - DNA, 22 bp, Homo sapiens
ccaattattgatatatattata

SEQ ID NO: 6034150 - DNA, 14 bp, Homo sapiens
ccaattcacccact

SEQ ID NO: 6034151 - DNA, 19 bp, Homo sapiens
ccaattcacccagaaaaaa

SEQ ID NO: 6034152 - DNA, 14 bp, Homo sapiens
ccaattcatttcat

SEQ ID NO: 6034153 - DNA, 19 bp, Homo sapiens
ccaattccaaaattccatc

SEQ ID NO: 6034154 - DNA, 14 bp, Homo sapiens
ccaattcctcattt

SEQ ID NO: 6034155 - DNA, 20 bp, Homo sapiens
ccaattccttgcacatagta

SEQ ID NO: 6034156 - DNA, 12 bp, Homo sapiens
ccaattccttgt

SEQ ID NO: 6034157 - DNA, 19 bp, Homo sapiens
ccaattcgaactttttcca

SEQ ID NO: 6034158 - DNA, 12 bp, Homo sapiens
ccaattctaaat

SEQ ID NO: 6034159 - DNA, 14 bp, Homo sapiens
ccaattctccttta

SEQ ID NO: 6034160 - DNA, 18 bp, Homo sapiens
ccaattctcgagcttggg

SEQ ID NO: 6034161 - DNA, 12 bp, Homo sapiens
ccaattgccctg

SEQ ID NO: 6034162 - DNA, 16 bp, Homo sapiens
ccaattgccctgccag

SEQ ID NO: 6034163 - DNA, 13 bp, Homo sapiens
ccaattgcctctt

SEQ ID NO: 6034164 - DNA, 21 bp, Homo sapiens
ccaattggtgcttcagccctg

SEQ ID NO: 6034165 - DNA, 14 bp, Homo sapiens
ccaattgtaaaaaa

SEQ ID NO: 6034166 - DNA, 17 bp, Homo sapiens
ccaattgtacattccct

SEQ ID NO: 6034167 - DNA, 19 bp, Homo sapiens
ccaattgtacattccctgc

SEQ ID NO: 6034168 - DNA, 15 bp, Homo sapiens
ccaattgtcaaatta

SEQ ID NO: 6034169 - DNA, 20 bp, Homo sapiens
ccaattgtgagaattactgt

SEQ ID NO: 6034170 - DNA, 15 bp, Homo sapiens
ccaattgtgctgcca

SEQ ID NO: 6034171 - DNA, 16 bp, Homo sapiens
ccaattgtgctgccat

SEQ ID NO: 6034172 - DNA, 22 bp, Homo sapiens
ccaattgttgacagttctgaag

SEQ ID NO: 6034173 - DNA, 11 bp, Homo sapiens
ccaatttaagg

SEQ ID NO: 6034174 - DNA, 15 bp, Homo sapiens
ccaatttcaaaatgt

SEQ ID NO: 6034175 - DNA, 17 bp, Homo sapiens
ccaatttcaaaatgtct

SEQ ID NO: 6034176 - DNA, 13 bp, Homo sapiens
ccaatttcccgga

SEQ ID NO: 6034177 - DNA, 14 bp, Homo sapiens
ccaatttcccggag

SEQ ID NO: 6034178 - DNA, 17 bp, Homo sapiens
ccaatttcccggagcca

SEQ ID NO: 6034179 - DNA, 12 bp, Homo sapiens
ccaatttcttcc

SEQ ID NO: 6034180 - DNA, 13 bp, Homo sapiens
ccaatttcttcct

SEQ ID NO: 6034181 - DNA, 23 bp, Homo sapiens
ccaatttggtaaaaatgctgctc

SEQ ID NO: 6034182 - DNA, 12 bp, Homo sapiens
ccaatttgtaat

SEQ ID NO: 6034183 - DNA, 18 bp, Homo sapiens
ccaattttaaaatgaaat

SEQ ID NO: 6034184 - DNA, 21 bp, Homo sapiens
ccaattttaaaatgaaatgca

SEQ ID NO: 6034185 - DNA, 23 bp, Homo sapiens
ccaattttaaaatgaaatgcatt

SEQ ID NO: 6034186 - DNA, 23 bp, Homo sapiens
ccaattttaatttagtaaatgtt

SEQ ID NO: 6034187 - DNA, 13 bp, Homo sapiens
ccaattttcaaag

SEQ ID NO: 6034188 - DNA, 15 bp, Homo sapiens
ccaattttgatcttt

SEQ ID NO: 6034189 - DNA, 18 bp, Homo sapiens
ccaattttgatcttttta

SEQ ID NO: 6034190 - DNA, 13 bp, Homo sapiens
ccaatttttctgc

SEQ ID NO: 6034191 - DNA, 14 bp, Homo sapiens
ccaatttttctgca

SEQ ID NO: 6034192 - DNA, 13 bp, Homo sapiens
ccaatttttgtac

SEQ ID NO: 6034193 - DNA, 15 bp, Homo sapiens
ccacaaaaaatactt

SEQ ID NO: 6034194 - DNA, 13 bp, Homo sapiens
ccacaaaaacagg

SEQ ID NO: 6034195 - DNA, 19 bp, Homo sapiens
ccacaaaaagagaagctgt

SEQ ID NO: 6034196 - DNA, 13 bp, Homo sapiens
ccacaaaaattga

SEQ ID NO: 6034197 - DNA, 17 bp, Homo sapiens
ccacaaaagcaaaattt

SEQ ID NO: 6034198 - DNA, 12 bp, Homo sapiens
ccacaaaatata

SEQ ID NO: 6034199 - DNA, 18 bp, Homo sapiens
ccacaaaatatttctaag

SEQ ID NO: 6034200 - DNA, 18 bp, Homo sapiens
ccacaaaattagaaagga

SEQ ID NO: 6034201 - DNA, 20 bp, Homo sapiens
ccacaaaattatgctgcatt

SEQ ID NO: 6034202 - DNA, 23 bp, Homo sapiens
ccacaaaattatgctgcatttgg

SEQ ID NO: 6034203 - DNA, 21 bp, Homo sapiens
ccacaaacacattataaagtt

SEQ ID NO: 6034204 - DNA, 21 bp, Homo sapiens
ccacaaacctggattttttat

SEQ ID NO: 6034205 - DNA, 22 bp, Homo sapiens
ccacaaacggagcccctgaaag

SEQ ID NO: 6034206 - DNA, 13 bp, Homo sapiens
ccacaaactccag

SEQ ID NO: 6034207 - DNA, 16 bp, Homo sapiens
ccacaaactccaggct

SEQ ID NO: 6034208 - DNA, 17 bp, Homo sapiens
ccacaaactccaggctg

SEQ ID NO: 6034209 - DNA, 18 bp, Homo sapiens
ccacaaactccaggctgg

SEQ ID NO: 6034210 - DNA, 15 bp, Homo sapiens
ccacaaagcaaaggc

SEQ ID NO: 6034211 - DNA, 17 bp, Homo sapiens
ccacaaagcaaaggcag

SEQ ID NO: 6034212 - DNA, 22 bp, Homo sapiens
ccacaaagcaaaggcagtcccg

SEQ ID NO: 6034213 - DNA, 19 bp, Homo sapiens
ccacaaagcattttcattt

SEQ ID NO: 6034214 - DNA, 23 bp, Homo sapiens
ccacaaagccttatcaagtgtct

SEQ ID NO: 6034215 - DNA, 22 bp, Homo sapiens
ccacaaagctaggatggttctg

SEQ ID NO: 6034216 - DNA, 17 bp, Homo sapiens
ccacaaataaatgacaa

SEQ ID NO: 6034217 - DNA, 12 bp, Homo sapiens
ccacaaatatga

SEQ ID NO: 6034218 - DNA, 19 bp, Homo sapiens
ccacaaatcaaagcaaggg

SEQ ID NO: 6034219 - DNA, 15 bp, Homo sapiens
ccacaaatgccttga

SEQ ID NO: 6034220 - DNA, 14 bp, Homo sapiens
ccacaaatgctatt

SEQ ID NO: 6034221 - DNA, 23 bp, Homo sapiens
ccacaaatgggcgcccccccctc

SEQ ID NO: 6034222 - DNA, 12 bp, Homo sapiens
ccacaaatgtcc

SEQ ID NO: 6034223 - DNA, 13 bp, Homo sapiens
ccacaaatgtcct

SEQ ID NO: 6034224 - DNA, 14 bp, Homo sapiens
ccacaaatgtcctc

SEQ ID NO: 6034225 - DNA, 20 bp, Homo sapiens
ccacaaatgtcctcagaggg

SEQ ID NO: 6034226 - DNA, 22 bp, Homo sapiens
ccacaaatgtgtcccagtgaac

SEQ ID NO: 6034227 - DNA, 14 bp, Homo sapiens
ccacaacaaagtgc

SEQ ID NO: 6034228 - DNA, 17 bp, Homo sapiens
ccacaacaaagtgcttc

SEQ ID NO: 6034229 - DNA, 16 bp, Homo sapiens
ccacaacactgtgtca

SEQ ID NO: 6034230 - DNA, 17 bp, Homo sapiens
ccacaacagcctggggt

SEQ ID NO: 6034231 - DNA, 12 bp, Homo sapiens
ccacaacatgag

SEQ ID NO: 6034232 - DNA, 22 bp, Homo sapiens
ccacaaccctctggaagtggcc

SEQ ID NO: 6034233 - DNA, 17 bp, Homo sapiens
ccacaaccctgttgcta

SEQ ID NO: 6034234 - DNA, 18 bp, Homo sapiens
ccacaaccctgttttata

SEQ ID NO: 6034235 - DNA, 15 bp, Homo sapiens
ccacaaccttgcagt

SEQ ID NO: 6034236 - DNA, 15 bp, Homo sapiens
ccacaactattttca

SEQ ID NO: 6034237 - DNA, 16 bp, Homo sapiens
ccacaactcccttgca

SEQ ID NO: 6034238 - DNA, 22 bp, Homo sapiens
ccacaactcctgtctaactgct

SEQ ID NO: 6034239 - DNA, 16 bp, Homo sapiens
ccacaactgacacagg

SEQ ID NO: 6034240 - DNA, 19 bp, Homo sapiens
ccacaactgacacaggaaa

SEQ ID NO: 6034241 - DNA, 16 bp, Homo sapiens
ccacaagaaatgaaag

SEQ ID NO: 6034242 - DNA, 15 bp, Homo sapiens
ccacaagaaatttga

SEQ ID NO: 6034243 - DNA, 21 bp, Homo sapiens
ccacaagaaatttgatttcta

SEQ ID NO: 6034244 - DNA, 23 bp, Homo sapiens
ccacaagactggtattctctttg

SEQ ID NO: 6034245 - DNA, 12 bp, Homo sapiens
ccacaagagaga

SEQ ID NO: 6034246 - DNA, 15 bp, Homo sapiens
ccacaagagagatga

SEQ ID NO: 6034247 - DNA, 20 bp, Homo sapiens
ccacaagagatcagcagtgg

SEQ ID NO: 6034248 - DNA, 21 bp, Homo sapiens
ccacaagagcccaggcctcct

SEQ ID NO: 6034249 - DNA, 15 bp, Homo sapiens
ccacaagagctcctt

SEQ ID NO: 6034250 - DNA, 18 bp, Homo sapiens
ccacaagcaccactctgg

SEQ ID NO: 6034251 - DNA, 13 bp, Homo sapiens
ccacaagcatctc

SEQ ID NO: 6034252 - DNA, 17 bp, Homo sapiens
ccacaagccataaacca

SEQ ID NO: 6034253 - DNA, 23 bp, Homo sapiens
ccacaagccattttttgaggaga

SEQ ID NO: 6034254 - DNA, 23 bp, Homo sapiens
ccacaagcccgtgacagatgcca

SEQ ID NO: 6034255 - DNA, 15 bp, Homo sapiens
ccacaagcctgagaa

SEQ ID NO: 6034256 - DNA, 12 bp, Homo sapiens
ccacaagcctgc

SEQ ID NO: 6034257 - DNA, 16 bp, Homo sapiens
ccacaagcctgcctcg

SEQ ID NO: 6034258 - DNA, 18 bp, Homo sapiens
ccacaagccttactcacc

SEQ ID NO: 6034259 - DNA, 21 bp, Homo sapiens
ccacaagccttactcacctct

SEQ ID NO: 6034260 - DNA, 17 bp, Homo sapiens
ccacaagctgagcagga

SEQ ID NO: 6034261 - DNA, 13 bp, Homo sapiens
ccacaagctgcac

SEQ ID NO: 6034262 - DNA, 14 bp, Homo sapiens
ccacaagctgcact

SEQ ID NO: 6034263 - DNA, 22 bp, Homo sapiens
ccacaagctgtccctgcagggc

SEQ ID NO: 6034264 - DNA, 21 bp, Homo sapiens
ccacaaggaaaaggaggaggt

SEQ ID NO: 6034265 - DNA, 18 bp, Homo sapiens
ccacaaggaaccctcagg

SEQ ID NO: 6034266 - DNA, 19 bp, Homo sapiens
ccacaaggaaccctcaggc

SEQ ID NO: 6034267 - DNA, 22 bp, Homo sapiens
ccacaaggaaccctcaggccac

SEQ ID NO: 6034268 - DNA, 19 bp, Homo sapiens
ccacaaggcccagccctgg

SEQ ID NO: 6034269 - DNA, 17 bp, Homo sapiens
ccacaaggcctggtctg

SEQ ID NO: 6034270 - DNA, 18 bp, Homo sapiens
ccacaaggctgaaaagtg

SEQ ID NO: 6034271 - DNA, 19 bp, Homo sapiens
ccacaaggctgaaaagtgc

SEQ ID NO: 6034272 - DNA, 20 bp, Homo sapiens
ccacaaggctgaaaagtgct

SEQ ID NO: 6034273 - DNA, 21 bp, Homo sapiens
ccacaaggctgaaaagtgctt

SEQ ID NO: 6034274 - DNA, 17 bp, Homo sapiens
ccacaaggctggccagc

SEQ ID NO: 6034275 - DNA, 17 bp, Homo sapiens
ccacaaggctgttgcat

SEQ ID NO: 6034276 - DNA, 14 bp, Homo sapiens
ccacaagggctctc

SEQ ID NO: 6034277 - DNA, 23 bp, Homo sapiens
ccacaaggtccactccctgctcc

SEQ ID NO: 6034278 - DNA, 15 bp, Homo sapiens
ccacaagtcttccag

SEQ ID NO: 6034279 - DNA, 18 bp, Homo sapiens
cagttgtagaatgtattg

SEQ ID NO: 6034280 - DNA, 21 bp, Homo sapiens
cagttgtagggttacagagac

SEQ ID NO: 6034281 - DNA, 19 bp, Homo sapiens
cagttgtataaactgtatt

SEQ ID NO: 6034282 - DNA, 14 bp, Homo sapiens
cagttgtatagttt

SEQ ID NO: 6034283 - DNA, 16 bp, Homo sapiens
cagttgtatgtttgct

SEQ ID NO: 6034284 - DNA, 18 bp, Homo sapiens
cagttgtcccgattgtaa

SEQ ID NO: 6034285 - DNA, 21 bp, Homo sapiens
cagttgtcccgattgtaactc

SEQ ID NO: 6034286 - DNA, 22 bp, Homo sapiens
cagttgtcccgattgtaactca

SEQ ID NO: 6034287 - DNA, 17 bp, Homo sapiens
cagttgtcctatggaca

SEQ ID NO: 6034288 - DNA, 11 bp, Homo sapiens
cagttgtctct

SEQ ID NO: 6034289 - DNA, 23 bp, Homo sapiens
cagttgtcttatgtgaaaaatta

SEQ ID NO: 6034290 - DNA, 14 bp, Homo sapiens
cagttgtgaaagca

SEQ ID NO: 6034291 - DNA, 16 bp, Homo sapiens
cagttgtgaatacatt

SEQ ID NO: 6034292 - DNA, 23 bp, Homo sapiens
cagttgtgaatacattctttgct

SEQ ID NO: 6034293 - DNA, 12 bp, Homo sapiens
cagttgtgattt

SEQ ID NO: 6034294 - DNA, 12 bp, Homo sapiens
cagttgtgcagc

SEQ ID NO: 6034295 - DNA, 13 bp, Homo sapiens
cagttgtggcctc

SEQ ID NO: 6034296 - DNA, 14 bp, Homo sapiens
cagttgtggcctca

SEQ ID NO: 6034297 - DNA, 19 bp, Homo sapiens
cagttgtggcctcattcag

SEQ ID NO: 6034298 - DNA, 18 bp, Homo sapiens
cagttgtgtggcccagca

SEQ ID NO: 6034299 - DNA, 20 bp, Homo sapiens
cagttgtgttagcctcttgc

SEQ ID NO: 6034300 - DNA, 13 bp, Homo sapiens
cagttgtgttcat

SEQ ID NO: 6034301 - DNA, 17 bp, Homo sapiens
cagttgtgtttgttgct

SEQ ID NO: 6034302 - DNA, 19 bp, Homo sapiens
cagttgttactgaagttat

SEQ ID NO: 6034303 - DNA, 21 bp, Homo sapiens
cagttgttagttactacctcc

SEQ ID NO: 6034304 - DNA, 13 bp, Homo sapiens
cagttgttattta

SEQ ID NO: 6034305 - DNA, 17 bp, Homo sapiens
cagttgttatttattga

SEQ ID NO: 6034306 - DNA, 16 bp, Homo sapiens
cagttgttctgagcac

SEQ ID NO: 6034307 - DNA, 12 bp, Homo sapiens
cagttgttcttt

SEQ ID NO: 6034308 - DNA, 15 bp, Homo sapiens
cagttgttcttttta

SEQ ID NO: 6034309 - DNA, 15 bp, Homo sapiens
cagttgttggcctcc

SEQ ID NO: 6034310 - DNA, 13 bp, Homo sapiens
cagttgttttccc

SEQ ID NO: 6034311 - DNA, 13 bp, Homo sapiens
cagtttaaaaaaa

SEQ ID NO: 6034312 - DNA, 12 bp, Homo sapiens
cagtttaacaga

SEQ ID NO: 6034313 - DNA, 22 bp, Homo sapiens
cagtttaagaagtggtgacatt

SEQ ID NO: 6034314 - DNA, 20 bp, Homo sapiens
cagtttaagagcagaacaga

SEQ ID NO: 6034315 - DNA, 18 bp, Homo sapiens
cagtttaagatgacactt

SEQ ID NO: 6034316 - DNA, 14 bp, Homo sapiens
cagtttaagccgca

SEQ ID NO: 6034317 - DNA, 16 bp, Homo sapiens
cagtttaagccgcaga

SEQ ID NO: 6034318 - DNA, 19 bp, Homo sapiens
cagtttaagtaattgccta

SEQ ID NO: 6034319 - DNA, 17 bp, Homo sapiens
cagtttaatattccaat

SEQ ID NO: 6034320 - DNA, 11 bp, Homo sapiens
cagtttaattc

SEQ ID NO: 6034321 - DNA, 15 bp, Homo sapiens
cagtttacagtattt

SEQ ID NO: 6034322 - DNA, 18 bp, Homo sapiens
cagtttacagtatttcta

SEQ ID NO: 6034323 - DNA, 18 bp, Homo sapiens
cagtttaccagttgcctt

SEQ ID NO: 6034324 - DNA, 16 bp, Homo sapiens
cagtttacccagcatg

SEQ ID NO: 6034325 - DNA, 15 bp, Homo sapiens
cagtttactttgcca

SEQ ID NO: 6034326 - DNA, 18 bp, Homo sapiens
cagtttagaacagaggga

SEQ ID NO: 6034327 - DNA, 21 bp, Homo sapiens
cagtttagaacagagggacca

SEQ ID NO: 6034328 - DNA, 15 bp, Homo sapiens
cagtttagagttcta

SEQ ID NO: 6034329 - DNA, 24 bp, Homo sapiens
cagtttagcccatctctccagaga

SEQ ID NO: 6034330 - DNA, 21 bp, Homo sapiens
cagtttagcccttccctgcct

SEQ ID NO: 6034331 - DNA, 22 bp, Homo sapiens
cagtttagcccttccctgcctt

SEQ ID NO: 6034332 - DNA, 14 bp, Homo sapiens
cagtttaggccttg

SEQ ID NO: 6034333 - DNA, 19 bp, Homo sapiens
cagtttaggtgatggccag

SEQ ID NO: 6034334 - DNA, 19 bp, Homo sapiens
cagtttatacagaactcac

SEQ ID NO: 6034335 - DNA, 17 bp, Homo sapiens
cagtttatattgtggaa

SEQ ID NO: 6034336 - DNA, 17 bp, Homo sapiens
cagtttatcatgaagcc

SEQ ID NO: 6034337 - DNA, 13 bp, Homo sapiens
cagtttatcattc

SEQ ID NO: 6034338 - DNA, 16 bp, Homo sapiens
cagtttatcattcaag

SEQ ID NO: 6034339 - DNA, 19 bp, Homo sapiens
cagtttatcctgacatatt

SEQ ID NO: 6034340 - DNA, 19 bp, Homo sapiens
cagtttatgaaacagaaaa

SEQ ID NO: 6034341 - DNA, 20 bp, Homo sapiens
cagtttatggatatgctgct

SEQ ID NO: 6034342 - DNA, 23 bp, Homo sapiens
cagtttattccagagctgccagt

SEQ ID NO: 6034343 - DNA, 15 bp, Homo sapiens
cagtttattctgtgg

SEQ ID NO: 6034344 - DNA, 18 bp, Homo sapiens
cagtttattgatattcaa

SEQ ID NO: 6034345 - DNA, 20 bp, Homo sapiens
cagtttattgtaatatatgg

SEQ ID NO: 6034346 - DNA, 22 bp, Homo sapiens
cagtttatttccactattttca

SEQ ID NO: 6034347 - DNA, 18 bp, Homo sapiens
cagtttcaattcagtgct

SEQ ID NO: 6034348 - DNA, 15 bp, Homo sapiens
cagtttcacagaaaa

SEQ ID NO: 6034349 - DNA, 16 bp, Homo sapiens
cagtttcactccctct

SEQ ID NO: 6034350 - DNA, 21 bp, Homo sapiens
cagtttcagagagtcaatgtc

SEQ ID NO: 6034351 - DNA, 15 bp, Homo sapiens
cagtttcagagatgg

SEQ ID NO: 6034352 - DNA, 16 bp, Homo sapiens
cagtttcagagatgga

SEQ ID NO: 6034353 - DNA, 19 bp, Homo sapiens
cagtttcagagatggacag

SEQ ID NO: 6034354 - DNA, 18 bp, Homo sapiens
cagtttcagataaatcat

SEQ ID NO: 6034355 - DNA, 20 bp, Homo sapiens
cagtttcagataaatcatgg

SEQ ID NO: 6034356 - DNA, 21 bp, Homo sapiens
cagtttcatcatttgcacaaa

SEQ ID NO: 6034357 - DNA, 16 bp, Homo sapiens
cagtttcatctggttg

SEQ ID NO: 6034358 - DNA, 15 bp, Homo sapiens
cagtttcatgtatgt

SEQ ID NO: 6034359 - DNA, 18 bp, Homo sapiens
cagtttcatgtatgtata

SEQ ID NO: 6034360 - DNA, 16 bp, Homo sapiens
cagtttcattcaacac

SEQ ID NO: 6034361 - DNA, 11 bp, Homo sapiens
cagtttccaag

SEQ ID NO: 6034362 - DNA, 23 bp, Homo sapiens
cagtttcccaaaaaccccagtgt

SEQ ID NO: 6034363 - DNA, 22 bp, Homo sapiens
cagtttccctctgtatacaagg

SEQ ID NO: 6034364 - DNA, 18 bp, Homo sapiens
cagtttcccttctatgca

SEQ ID NO: 6034365 - DNA, 14 bp, Homo sapiens
cagtttcctcagtg

SEQ ID NO: 6034366 - DNA, 16 bp, Homo sapiens
cagtttcctcagtgat

SEQ ID NO: 6034367 - DNA, 11 bp, Homo sapiens
cagtttctcct

SEQ ID NO: 6034368 - DNA, 14 bp, Homo sapiens
cagtttctccttga

SEQ ID NO: 6034369 - DNA, 19 bp, Homo sapiens
cagtttctctgccttcttc

SEQ ID NO: 6034370 - DNA, 21 bp, Homo sapiens
cagtttctcttaagctgccca

SEQ ID NO: 6034371 - DNA, 12 bp, Homo sapiens
cagtttctgagt

SEQ ID NO: 6034372 - DNA, 16 bp, Homo sapiens
cagtttctgcctgggc

SEQ ID NO: 6034373 - DNA, 15 bp, Homo sapiens
cagtttctgtcctgc

SEQ ID NO: 6034374 - DNA, 12 bp, Homo sapiens
cagtttctgttg

SEQ ID NO: 6034375 - DNA, 17 bp, Homo sapiens
cagtttctgttgtttct

SEQ ID NO: 6034376 - DNA, 15 bp, Homo sapiens
cagtttcttcatgca

SEQ ID NO: 6034377 - DNA, 22 bp, Homo sapiens
cagtttcttcatgcattactta

SEQ ID NO: 6034378 - DNA, 20 bp, Homo sapiens
cagtttcttgcaagctccag

SEQ ID NO: 6034379 - DNA, 16 bp, Homo sapiens
cagtttcttgtgtaga

SEQ ID NO: 6034380 - DNA, 22 bp, Homo sapiens
cagtttcttgtgtagatttgaa

SEQ ID NO: 6034381 - DNA, 23 bp, Homo sapiens
cagtttcttgtgtagatttgaaa

SEQ ID NO: 6034382 - DNA, 14 bp, Homo sapiens
cagtttcttttctt

SEQ ID NO: 6034383 - DNA, 18 bp, Homo sapiens
cagtttgaaaatattttg

SEQ ID NO: 6034384 - DNA, 20 bp, Homo sapiens
cagtttgaaataagctattt

SEQ ID NO: 6034385 - DNA, 13 bp, Homo sapiens
cagtttgaaattc

SEQ ID NO: 6034386 - DNA, 16 bp, Homo sapiens
cagtttgaagcctgtg

SEQ ID NO: 6034387 - DNA, 17 bp, Homo sapiens
cagtttgaagcctgtgc

SEQ ID NO: 6034388 - DNA, 18 bp, Homo sapiens
cagtttgaagcctgtgcc

SEQ ID NO: 6034389 - DNA, 15 bp, Homo sapiens
cagtttgaagtcaaa

SEQ ID NO: 6034390 - DNA, 19 bp, Homo sapiens
cagtttgactatgccgtct

SEQ ID NO: 6034391 - DNA, 13 bp, Homo sapiens
cagtttgactttt

SEQ ID NO: 6034392 - DNA, 21 bp, Homo sapiens
cagtttgaggaagtggctgtc

SEQ ID NO: 6034393 - DNA, 15 bp, Homo sapiens
cagtttgataactag

SEQ ID NO: 6034394 - DNA, 17 bp, Homo sapiens
cagtttgcaaaaaatgt

SEQ ID NO: 6034395 - DNA, 23 bp, Homo sapiens
cagtttgcagaaaagcacctgcc

SEQ ID NO: 6034396 - DNA, 13 bp, Homo sapiens
cagtttgcatgat

SEQ ID NO: 6034397 - DNA, 20 bp, Homo sapiens
cagtttgccacccctgtcca

SEQ ID NO: 6034398 - DNA, 21 bp, Homo sapiens
cagtttgccacccctgtccag

SEQ ID NO: 6034399 - DNA, 22 bp, Homo sapiens
cagtttgccacccctgtccaga

SEQ ID NO: 6034400 - DNA, 11 bp, Homo sapiens
cagtttgccca

SEQ ID NO: 6034401 - DNA, 14 bp, Homo sapiens
cagtttgcctctgc

SEQ ID NO: 6034402 - DNA, 16 bp, Homo sapiens
cagtttgcctctgcac

SEQ ID NO: 6034403 - DNA, 17 bp, Homo sapiens
cagtttgcctgctgtat

SEQ ID NO: 6034404 - DNA, 12 bp, Homo sapiens
cagtttgctttg

SEQ ID NO: 6034405 - DNA, 22 bp, Homo sapiens
cagtttggagagtcagatcttt

SEQ ID NO: 6034406 - DNA, 14 bp, Homo sapiens
cagtttggccctgg

SEQ ID NO: 6034407 - DNA, 20 bp, Homo sapiens
cagtttggccctggagccag

SEQ ID NO: 6034408 - DNA, 19 bp, Homo sapiens
cagtttggctgtaatttaa

SEQ ID NO: 6034409 - DNA, 20 bp, Homo sapiens
cagtttggggactcaggacc

SEQ ID NO: 6034410 - DNA, 17 bp, Homo sapiens
cagtttggggcaggggg

SEQ ID NO: 6034411 - DNA, 20 bp, Homo sapiens
cagtttgggtaaaatacttt

SEQ ID NO: 6034412 - DNA, 22 bp, Homo sapiens
cagtttgggtaaaatactttta

SEQ ID NO: 6034413 - DNA, 20 bp, Homo sapiens
cagtttggtagtgccccacc

SEQ ID NO: 6034414 - DNA, 21 bp, Homo sapiens
cagtttggttggtaactctgt

SEQ ID NO: 6034415 - DNA, 19 bp, Homo sapiens
cagtttggtttatattctt

SEQ ID NO: 6034416 - DNA, 15 bp, Homo sapiens
cagtttgtaaatgtt

SEQ ID NO: 6034417 - DNA, 16 bp, Homo sapiens
cagtttgtaaatgtta

SEQ ID NO: 6034418 - DNA, 12 bp, Homo sapiens
cagtttgtaact

SEQ ID NO: 6034419 - DNA, 13 bp, Homo sapiens
cagtttgtatata

SEQ ID NO: 6034420 - DNA, 21 bp, Homo sapiens
cagtttgtgatatagcagagg

SEQ ID NO: 6034421 - DNA, 13 bp, Homo sapiens
cagtttgtgcaag

SEQ ID NO: 6034422 - DNA, 23 bp, Homo sapiens
cagtttgtgttttaaaaaaactg

SEQ ID NO: 6034423 - DNA, 16 bp, Homo sapiens
cagtttgttgatcttt

SEQ ID NO: 6034424 - DNA, 16 bp, Homo sapiens
cagtttgtttacacac

SEQ ID NO: 6034425 - DNA, 18 bp, Homo sapiens
cagtttgtttcctgtctg

SEQ ID NO: 6034426 - DNA, 13 bp, Homo sapiens
cagttttaactgt

SEQ ID NO: 6034427 - DNA, 18 bp, Homo sapiens
cagttttaactgtggata

SEQ ID NO: 6034428 - DNA, 23 bp, Homo sapiens
cagttttaactgtggatattgtt

SEQ ID NO: 6034429 - DNA, 19 bp, Homo sapiens
cagttttaactttttctaa

SEQ ID NO: 6034430 - DNA, 13 bp, Homo sapiens
cagttttaagaat

SEQ ID NO: 6034431 - DNA, 12 bp, Homo sapiens
cagttttaatac

SEQ ID NO: 6034432 - DNA, 11 bp, Homo sapiens
cagttttactg

SEQ ID NO: 6034433 - DNA, 16 bp, Homo sapiens
cagttttactgcattt

SEQ ID NO: 6034434 - DNA, 23 bp, Homo sapiens
cagttttagttggtgctgatgga

SEQ ID NO: 6034435 - DNA, 15 bp, Homo sapiens
cagttttatcatttt

SEQ ID NO: 6034436 - DNA, 19 bp, Homo sapiens
cagttttatgaagctttct

SEQ ID NO: 6034437 - DNA, 21 bp, Homo sapiens
cagttttatgctcttttttac

SEQ ID NO: 6034438 - DNA, 19 bp, Homo sapiens
cagttttcagtcaagttcc

SEQ ID NO: 6034439 - DNA, 15 bp, Homo sapiens
cagttttcatagtat

SEQ ID NO: 6034440 - DNA, 20 bp, Homo sapiens
cagttttccaaactgtgtca

SEQ ID NO: 6034441 - DNA, 12 bp, Homo sapiens
cagttttccatg

SEQ ID NO: 6034442 - DNA, 16 bp, Homo sapiens
cagttttccatgaaaa

SEQ ID NO: 6034443 - DNA, 13 bp, Homo sapiens
cagttttccattg

SEQ ID NO: 6034444 - DNA, 14 bp, Homo sapiens
cagttttcccactt

SEQ ID NO: 6034445 - DNA, 16 bp, Homo sapiens
cagttttcccactttt

SEQ ID NO: 6034446 - DNA, 13 bp, Homo sapiens
cagttttcccctg

SEQ ID NO: 6034447 - DNA, 14 bp, Homo sapiens
cagttttcccctgg

SEQ ID NO: 6034448 - DNA, 18 bp, Homo sapiens
cagttttcccctggcctc

SEQ ID NO: 6034449 - DNA, 21 bp, Homo sapiens
cagttttccgaagtctctgat

SEQ ID NO: 6034450 - DNA, 19 bp, Homo sapiens
cagttttcctatgctttga

SEQ ID NO: 6034451 - DNA, 14 bp, Homo sapiens
cagttttccttctg

SEQ ID NO: 6034452 - DNA, 16 bp, Homo sapiens
cagttttcggaaacac

SEQ ID NO: 6034453 - DNA, 18 bp, Homo sapiens
cagttttcggaaacactg

SEQ ID NO: 6034454 - DNA, 15 bp, Homo sapiens
cagttttctgagaaa

SEQ ID NO: 6034455 - DNA, 20 bp, Homo sapiens
cagttttctggctggagcct

SEQ ID NO: 6034456 - DNA, 16 bp, Homo sapiens
cagttttgaaagaaaa

SEQ ID NO: 6034457 - DNA, 23 bp, Homo sapiens
cagttttgagtgtactgtgcctg

SEQ ID NO: 6034458 - DNA, 23 bp, Homo sapiens
cagttttgatatttatttatgct

SEQ ID NO: 6034459 - DNA, 19 bp, Homo sapiens
ccacaagtgaatctttctc

SEQ ID NO: 6034460 - DNA, 20 bp, Homo sapiens
ccacaagtgaatctttctcc

SEQ ID NO: 6034461 - DNA, 23 bp, Homo sapiens
ccacaagtgaatctttctcctgg

SEQ ID NO: 6034462 - DNA, 16 bp, Homo sapiens
ccacaagtgccctcca

SEQ ID NO: 6034463 - DNA, 13 bp, Homo sapiens
ccacaagtgtcta

SEQ ID NO: 6034464 - DNA, 19 bp, Homo sapiens
ccacaagttctttcccagc

SEQ ID NO: 6034465 - DNA, 22 bp, Homo sapiens
ccacaagttctttcccagcctc

SEQ ID NO: 6034466 - DNA, 17 bp, Homo sapiens
ccacaataatgaataat

SEQ ID NO: 6034467 - DNA, 12 bp, Homo sapiens
ccacaataggct

SEQ ID NO: 6034468 - DNA, 21 bp, Homo sapiens
ccacaatcactaaatatctag

SEQ ID NO: 6034469 - DNA, 16 bp, Homo sapiens
ccacaatcccacctag

SEQ ID NO: 6034470 - DNA, 18 bp, Homo sapiens
ccacaatcccacctagcc

SEQ ID NO: 6034471 - DNA, 21 bp, Homo sapiens
ccacaatctggcttagtgcca

SEQ ID NO: 6034472 - DNA, 20 bp, Homo sapiens
ccacaatcttaaggggcagc

SEQ ID NO: 6034473 - DNA, 23 bp, Homo sapiens
ccacaatgatgattaaacacctg

SEQ ID NO: 6034474 - DNA, 16 bp, Homo sapiens
ccacaatgcctctccc

SEQ ID NO: 6034475 - DNA, 21 bp, Homo sapiens
ccacaatgcctctcccacgat

SEQ ID NO: 6034476 - DNA, 18 bp, Homo sapiens
ccacaattattggcaaag

SEQ ID NO: 6034477 - DNA, 20 bp, Homo sapiens
ccacaattgaacttccagga

SEQ ID NO: 6034478 - DNA, 22 bp, Homo sapiens
ccacaatttctttaaaaaagaa

SEQ ID NO: 6034479 - DNA, 14 bp, Homo sapiens
ccacacaaaatgtc

SEQ ID NO: 6034480 - DNA, 17 bp, Homo sapiens
ccacacaaactatggga

SEQ ID NO: 6034481 - DNA, 20 bp, Homo sapiens
ccacacaacaccaggactta

SEQ ID NO: 6034482 - DNA, 22 bp, Homo sapiens
ccacacaataggatcccccttc

SEQ ID NO: 6034483 - DNA, 14 bp, Homo sapiens
ccacacaattattt

SEQ ID NO: 6034484 - DNA, 21 bp, Homo sapiens
ccacacacaacagccaacagc

SEQ ID NO: 6034485 - DNA, 22 bp, Homo sapiens
ccacacacaacagccaacagct

SEQ ID NO: 6034486 - DNA, 19 bp, Homo sapiens
ccacacacacaaggtgctc

SEQ ID NO: 6034487 - DNA, 13 bp, Homo sapiens
ccacacacacaca

SEQ ID NO: 6034488 - DNA, 15 bp, Homo sapiens
ccacacacacacaca

SEQ ID NO: 6034489 - DNA, 17 bp, Homo sapiens
ccacacacacacacatg

SEQ ID NO: 6034490 - DNA, 15 bp, Homo sapiens
ccacacacacagaaa

SEQ ID NO: 6034491 - DNA, 20 bp, Homo sapiens
ccacacacacagaaaatata

SEQ ID NO: 6034492 - DNA, 16 bp, Homo sapiens
ccacacacacccacac

SEQ ID NO: 6034493 - DNA, 14 bp, Homo sapiens
ccacacacacctgt

SEQ ID NO: 6034494 - DNA, 12 bp, Homo sapiens
ccacacacactc

SEQ ID NO: 6034495 - DNA, 18 bp, Homo sapiens
ccacacacagaggaagag

SEQ ID NO: 6034496 - DNA, 13 bp, Homo sapiens
ccacacacagcag

SEQ ID NO: 6034497 - DNA, 15 bp, Homo sapiens
ccacacacagcagct

SEQ ID NO: 6034498 - DNA, 13 bp, Homo sapiens
ccacacacagcct

SEQ ID NO: 6034499 - DNA, 20 bp, Homo sapiens
ccacacacagctgggctgtg

SEQ ID NO: 6034500 - DNA, 15 bp, Homo sapiens
ccacacacaggcctt

SEQ ID NO: 6034501 - DNA, 17 bp, Homo sapiens
ccacacacaggccttct

SEQ ID NO: 6034502 - DNA, 12 bp, Homo sapiens
ccacacacccca

SEQ ID NO: 6034503 - DNA, 18 bp, Homo sapiens
ccacacacgcaggaactc

SEQ ID NO: 6034504 - DNA, 22 bp, Homo sapiens
ccacacacgcaggaactcccag

SEQ ID NO: 6034505 - DNA, 23 bp, Homo sapiens
ccacacacgcaggaactcccagc

SEQ ID NO: 6034506 - DNA, 14 bp, Homo sapiens
ccacacactcgccc

SEQ ID NO: 6034507 - DNA, 19 bp, Homo sapiens
ccacacactttccatctct

SEQ ID NO: 6034508 - DNA, 21 bp, Homo sapiens
ccacacactttccatctctgc

SEQ ID NO: 6034509 - DNA, 15 bp, Homo sapiens
ccacacagaggacct

SEQ ID NO: 6034510 - DNA, 16 bp, Homo sapiens
ccacacagaggacctc

SEQ ID NO: 6034511 - DNA, 16 bp, Homo sapiens
ccacacagcacttcaa

SEQ ID NO: 6034512 - DNA, 12 bp, Homo sapiens
ccacacagcagt

SEQ ID NO: 6034513 - DNA, 16 bp, Homo sapiens
ccacacagcagtgtcc

SEQ ID NO: 6034514 - DNA, 19 bp, Homo sapiens
ccacacagcagtgtcccct

SEQ ID NO: 6034515 - DNA, 14 bp, Homo sapiens
ccacacagcccaga

SEQ ID NO: 6034516 - DNA, 14 bp, Homo sapiens
ccacacagcctcta

SEQ ID NO: 6034517 - DNA, 13 bp, Homo sapiens
ccacacagcctgt

SEQ ID NO: 6034518 - DNA, 19 bp, Homo sapiens
ccacacagctacagctttc

SEQ ID NO: 6034519 - DNA, 16 bp, Homo sapiens
ccacacagctgcccta

SEQ ID NO: 6034520 - DNA, 19 bp, Homo sapiens
ccacacagctgccctagct

SEQ ID NO: 6034521 - DNA, 13 bp, Homo sapiens
ccacacaggcagg

SEQ ID NO: 6034522 - DNA, 14 bp, Homo sapiens
ccacacaggcaggg

SEQ ID NO: 6034523 - DNA, 16 bp, Homo sapiens
ccacacaggcagggcc

SEQ ID NO: 6034524 - DNA, 13 bp, Homo sapiens
ccacacaggccca

SEQ ID NO: 6034525 - DNA, 22 bp, Homo sapiens
ccacacaggcctggcccagcca

SEQ ID NO: 6034526 - DNA, 14 bp, Homo sapiens
ccacacaggctggc

SEQ ID NO: 6034527 - DNA, 12 bp, Homo sapiens
ccacacagggca

SEQ ID NO: 6034528 - DNA, 13 bp, Homo sapiens
ccacacagggcac

SEQ ID NO: 6034529 - DNA, 14 bp, Homo sapiens
ccacacaggtggcc

SEQ ID NO: 6034530 - DNA, 15 bp, Homo sapiens
ccacacaggtggcca

SEQ ID NO: 6034531 - DNA, 20 bp, Homo sapiens
ccacacagtcacccctccct

SEQ ID NO: 6034532 - DNA, 16 bp, Homo sapiens
ccacacagtccccaga

SEQ ID NO: 6034533 - DNA, 21 bp, Homo sapiens
ccacacagtccccagactcag

SEQ ID NO: 6034534 - DNA, 13 bp, Homo sapiens
ccacacagtgggc

SEQ ID NO: 6034535 - DNA, 14 bp, Homo sapiens
ccacacagtgggcc

SEQ ID NO: 6034536 - DNA, 21 bp, Homo sapiens
ccacacatgaaccatccttcc

SEQ ID NO: 6034537 - DNA, 14 bp, Homo sapiens
ccacacatgcaagg

SEQ ID NO: 6034538 - DNA, 13 bp, Homo sapiens
ccacacattccag

SEQ ID NO: 6034539 - DNA, 18 bp, Homo sapiens
ccacacattccagccagg

SEQ ID NO: 6034540 - DNA, 21 bp, Homo sapiens
ccacacattccagccaggccc

SEQ ID NO: 6034541 - DNA, 22 bp, Homo sapiens
ccacacattccagccaggccca

SEQ ID NO: 6034542 - DNA, 15 bp, Homo sapiens
ccacacattccaggg

SEQ ID NO: 6034543 - DNA, 16 bp, Homo sapiens
ccacacattccagggc

SEQ ID NO: 6034544 - DNA, 17 bp, Homo sapiens
ccacacattccagggct

SEQ ID NO: 6034545 - DNA, 12 bp, Homo sapiens
ccacacatttaa

SEQ ID NO: 6034546 - DNA, 12 bp, Homo sapiens
ccacacatttta

SEQ ID NO: 6034547 - DNA, 14 bp, Homo sapiens
ccacaccaacactg

SEQ ID NO: 6034548 - DNA, 14 bp, Homo sapiens
ccacaccaaccagg

SEQ ID NO: 6034549 - DNA, 17 bp, Homo sapiens
ccacaccaaccaggcct

SEQ ID NO: 6034550 - DNA, 16 bp, Homo sapiens
ccacaccaacgaggtg

SEQ ID NO: 6034551 - DNA, 14 bp, Homo sapiens
ccacaccaagctgt

SEQ ID NO: 6034552 - DNA, 16 bp, Homo sapiens
ccacaccaatcagaga

SEQ ID NO: 6034553 - DNA, 17 bp, Homo sapiens
ccacaccaatcagagag

SEQ ID NO: 6034554 - DNA, 20 bp, Homo sapiens
ccacaccaatcagagagcct

SEQ ID NO: 6034555 - DNA, 13 bp, Homo sapiens
ccacaccacatct

SEQ ID NO: 6034556 - DNA, 18 bp, Homo sapiens
ccacaccaccgccctcct

SEQ ID NO: 6034557 - DNA, 14 bp, Homo sapiens
ccacaccagcctcc

SEQ ID NO: 6034558 - DNA, 16 bp, Homo sapiens
ccacaccagcctcctg

SEQ ID NO: 6034559 - DNA, 17 bp, Homo sapiens
ccacaccagcctcctgg

SEQ ID NO: 6034560 - DNA, 14 bp, Homo sapiens
ccacaccagccttg

SEQ ID NO: 6034561 - DNA, 17 bp, Homo sapiens
ccacaccagctgctgct

SEQ ID NO: 6034562 - DNA, 12 bp, Homo sapiens
ccacaccatctg

SEQ ID NO: 6034563 - DNA, 13 bp, Homo sapiens
ccacaccatctgg

SEQ ID NO: 6034564 - DNA, 17 bp, Homo sapiens
ccacaccatctggccca

SEQ ID NO: 6034565 - DNA, 20 bp, Homo sapiens
ccacaccatctggcccaggc

SEQ ID NO: 6034566 - DNA, 22 bp, Homo sapiens
ccacaccatctggcccaggctg

SEQ ID NO: 6034567 - DNA, 15 bp, Homo sapiens
ccacacccaaagctg

SEQ ID NO: 6034568 - DNA, 21 bp, Homo sapiens
ccacacccagccagctccttt

SEQ ID NO: 6034569 - DNA, 13 bp, Homo sapiens
ccacacccagccc

SEQ ID NO: 6034570 - DNA, 14 bp, Homo sapiens
ccacacccagccca

SEQ ID NO: 6034571 - DNA, 19 bp, Homo sapiens
ccacacccagcctcagtcc

SEQ ID NO: 6034572 - DNA, 15 bp, Homo sapiens
ccacacccagcctgt

SEQ ID NO: 6034573 - DNA, 14 bp, Homo sapiens
ccacacccaggaag

SEQ ID NO: 6034574 - DNA, 15 bp, Homo sapiens
ccacacccagggcta

SEQ ID NO: 6034575 - DNA, 19 bp, Homo sapiens
ccacaccccaacacttcca

SEQ ID NO: 6034576 - DNA, 16 bp, Homo sapiens
ccacaccccagcccac

SEQ ID NO: 6034577 - DNA, 17 bp, Homo sapiens
ccacaccccagcccacc

SEQ ID NO: 6034578 - DNA, 20 bp, Homo sapiens
ccacacccccaccccttgct

SEQ ID NO: 6034579 - DNA, 18 bp, Homo sapiens
ccacaccccgtctgcccc

SEQ ID NO: 6034580 - DNA, 17 bp, Homo sapiens
ccacacccggctccccc

SEQ ID NO: 6034581 - DNA, 17 bp, Homo sapiens
ccacaccctacagcaga

SEQ ID NO: 6034582 - DNA, 21 bp, Homo sapiens
ccacaccctacagcagatcca

SEQ ID NO: 6034583 - DNA, 16 bp, Homo sapiens
ccacaccctcactgct

SEQ ID NO: 6034584 - DNA, 12 bp, Homo sapiens
ccacaccctccc

SEQ ID NO: 6034585 - DNA, 13 bp, Homo sapiens
ccacaccctcccc

SEQ ID NO: 6034586 - DNA, 15 bp, Homo sapiens
ccacaccctctccca

SEQ ID NO: 6034587 - DNA, 19 bp, Homo sapiens
ccacaccctgtactgttct

SEQ ID NO: 6034588 - DNA, 18 bp, Homo sapiens
ccacaccgcagggacaag

SEQ ID NO: 6034589 - DNA, 18 bp, Homo sapiens
ccacaccgcgtcccagct

SEQ ID NO: 6034590 - DNA, 17 bp, Homo sapiens
ccacaccgctggctccg

SEQ ID NO: 6034591 - DNA, 18 bp, Homo sapiens
ccacaccgctggtccctg

SEQ ID NO: 6034592 - DNA, 22 bp, Homo sapiens
ccacaccgctggtccctgccct

SEQ ID NO: 6034593 - DNA, 23 bp, Homo sapiens
ccacaccgctggtccctgccctc

SEQ ID NO: 6034594 - DNA, 19 bp, Homo sapiens
ccacacctcagttcccttg

SEQ ID NO: 6034595 - DNA, 13 bp, Homo sapiens
ccacacctccacc

SEQ ID NO: 6034596 - DNA, 14 bp, Homo sapiens
ccacacctccaccc

SEQ ID NO: 6034597 - DNA, 20 bp, Homo sapiens
ccacacctccccctgctgct

SEQ ID NO: 6034598 - DNA, 14 bp, Homo sapiens
ccacacctccctac

SEQ ID NO: 6034599 - DNA, 15 bp, Homo sapiens
ccacacctccctact

SEQ ID NO: 6034600 - DNA, 14 bp, Homo sapiens
ccacacctccctga

SEQ ID NO: 6034601 - DNA, 17 bp, Homo sapiens
ccacacctccctgaacc

SEQ ID NO: 6034602 - DNA, 15 bp, Homo sapiens
ccacacctcctgggg

SEQ ID NO: 6034603 - DNA, 14 bp, Homo sapiens
ccacacctctgcca

SEQ ID NO: 6034604 - DNA, 16 bp, Homo sapiens
ccacacctctgccaga

SEQ ID NO: 6034605 - DNA, 19 bp, Homo sapiens
ccacacctgaacttgccta

SEQ ID NO: 6034606 - DNA, 19 bp, Homo sapiens
ccacacctgagcgctgtgg

SEQ ID NO: 6034607 - DNA, 17 bp, Homo sapiens
ccacacctgcagtgcca

SEQ ID NO: 6034608 - DNA, 12 bp, Homo sapiens
ccacacctgcct

SEQ ID NO: 6034609 - DNA, 14 bp, Homo sapiens
ccacacctggccct

SEQ ID NO: 6034610 - DNA, 13 bp, Homo sapiens
ccacacctggcct

SEQ ID NO: 6034611 - DNA, 12 bp, Homo sapiens
ccacacctggtc

SEQ ID NO: 6034612 - DNA, 22 bp, Homo sapiens
ccacaccttccagggccctagg

SEQ ID NO: 6034613 - DNA, 17 bp, Homo sapiens
ccacacgagaacctgaa

SEQ ID NO: 6034614 - DNA, 18 bp, Homo sapiens
ccacacgcactggtgcca

SEQ ID NO: 6034615 - DNA, 16 bp, Homo sapiens
ccacacgcaggcggcc

SEQ ID NO: 6034616 - DNA, 20 bp, Homo sapiens
ccacacgcaggcggccaggg

SEQ ID NO: 6034617 - DNA, 23 bp, Homo sapiens
ccacacgcatgggcattgcagcc

SEQ ID NO: 6034618 - DNA, 24 bp, Homo sapiens
ccacacgccccggtcccccagagc

SEQ ID NO: 6034619 - DNA, 17 bp, Homo sapiens
ccacacgccggggctgg

SEQ ID NO: 6034620 - DNA, 22 bp, Homo sapiens
ccacacgccggggctggccctg

SEQ ID NO: 6034621 - DNA, 19 bp, Homo sapiens
ccacacgctcactccaggt

SEQ ID NO: 6034622 - DNA, 14 bp, Homo sapiens
ccacacgctgccca

SEQ ID NO: 6034623 - DNA, 15 bp, Homo sapiens
ccacacgctgcccag

SEQ ID NO: 6034624 - DNA, 19 bp, Homo sapiens
ccacacggaagcaagcaga

SEQ ID NO: 6034625 - DNA, 16 bp, Homo sapiens
ccacacggactcccgg

SEQ ID NO: 6034626 - DNA, 16 bp, Homo sapiens
ccacacggagctcctg

SEQ ID NO: 6034627 - DNA, 20 bp, Homo sapiens
ccacacggagctcctggcag

SEQ ID NO: 6034628 - DNA, 14 bp, Homo sapiens
ccacacggcagccc

SEQ ID NO: 6034629 - DNA, 17 bp, Homo sapiens
ccacacgtttgccaaat

SEQ ID NO: 6034630 - DNA, 14 bp, Homo sapiens
ccacactagaaaga

SEQ ID NO: 6034631 - DNA, 22 bp, Homo sapiens
ccacactagaattcatgtgaga

SEQ ID NO: 6034632 - DNA, 21 bp, Homo sapiens
ccacactatgcacagagccca

SEQ ID NO: 6034633 - DNA, 22 bp, Homo sapiens
ccacactatgtgtgttgtttcc

SEQ ID NO: 6034634 - DNA, 24 bp, Homo sapiens
ccacactatgtgtgttgtttccat

SEQ ID NO: 6034635 - DNA, 22 bp, Homo sapiens
ccacactcaccccagcctcatt

SEQ ID NO: 6034636 - DNA, 17 bp, Homo sapiens
ccacactcactcctgag

SEQ ID NO: 6034637 - DNA, 22 bp, Homo sapiens
ccacactcagaaaattccctgg

SEQ ID NO: 6034638 - DNA, 12 bp, Homo sapiens
ccacactccact

SEQ ID NO: 6034639 - DNA, 13 bp, Homo sapiens
ccacactccactc

SEQ ID NO: 6034640 - DNA, 19 bp, Homo sapiens
cagttttgctgctataatt

SEQ ID NO: 6034641 - DNA, 14 bp, Homo sapiens
cagttttggaatct

SEQ ID NO: 6034642 - DNA, 18 bp, Homo sapiens
cagttttgtaaatgtact

SEQ ID NO: 6034643 - DNA, 19 bp, Homo sapiens
cagttttgtaaatgtactg

SEQ ID NO: 6034644 - DNA, 12 bp, Homo sapiens
cagttttgtaag

SEQ ID NO: 6034645 - DNA, 18 bp, Homo sapiens
cagttttgtggactgagc

SEQ ID NO: 6034646 - DNA, 20 bp, Homo sapiens
cagttttgtggactgagcga

SEQ ID NO: 6034647 - DNA, 11 bp, Homo sapiens
cagttttgtgt

SEQ ID NO: 6034648 - DNA, 12 bp, Homo sapiens
cagttttgtgta

SEQ ID NO: 6034649 - DNA, 15 bp, Homo sapiens
cagttttgtgtacag

SEQ ID NO: 6034650 - DNA, 15 bp, Homo sapiens
cagtttttaaaaacc

SEQ ID NO: 6034651 - DNA, 22 bp, Homo sapiens
cagtttttaaaaacctgtatct

SEQ ID NO: 6034652 - DNA, 16 bp, Homo sapiens
cagtttttactgagga

SEQ ID NO: 6034653 - DNA, 15 bp, Homo sapiens
cagtttttatatagt

SEQ ID NO: 6034654 - DNA, 14 bp, Homo sapiens
cagtttttcacttc

SEQ ID NO: 6034655 - DNA, 15 bp, Homo sapiens
cagtttttcacttct

SEQ ID NO: 6034656 - DNA, 12 bp, Homo sapiens
cagtttttcagg

SEQ ID NO: 6034657 - DNA, 15 bp, Homo sapiens
cagtttttcaggagc

SEQ ID NO: 6034658 - DNA, 21 bp, Homo sapiens
cagtttttcataagatatttt

SEQ ID NO: 6034659 - DNA, 23 bp, Homo sapiens
cagtttttcggtgggacagcccc

SEQ ID NO: 6034660 - DNA, 10 bp, Homo sapiens
cagtttttct

SEQ ID NO: 6034661 - DNA, 17 bp, Homo sapiens
cagtttttctgtatttt

SEQ ID NO: 6034662 - DNA, 13 bp, Homo sapiens
cagtttttcttaa

SEQ ID NO: 6034663 - DNA, 15 bp, Homo sapiens
cagtttttcttaata

SEQ ID NO: 6034664 - DNA, 19 bp, Homo sapiens
cagtttttcttaatatata

SEQ ID NO: 6034665 - DNA, 13 bp, Homo sapiens
cagtttttcttta

SEQ ID NO: 6034666 - DNA, 22 bp, Homo sapiens
cagtttttgctgattgctaagg

SEQ ID NO: 6034667 - DNA, 12 bp, Homo sapiens
cagtttttgtaa

SEQ ID NO: 6034668 - DNA, 20 bp, Homo sapiens
cagtttttgtaaagcccttg

SEQ ID NO: 6034669 - DNA, 14 bp, Homo sapiens
cagtttttgttctt

SEQ ID NO: 6034670 - DNA, 15 bp, Homo sapiens
cagtttttgttctta

SEQ ID NO: 6034671 - DNA, 17 bp, Homo sapiens
cagtttttgttcttaaa

SEQ ID NO: 6034672 - DNA, 17 bp, Homo sapiens
cagtttttgtttttact

SEQ ID NO: 6034673 - DNA, 21 bp, Homo sapiens
cagttttttgccactgcaaac

SEQ ID NO: 6034674 - DNA, 19 bp, Homo sapiens
cagttttttggaagaaaat

SEQ ID NO: 6034675 - DNA, 17 bp, Homo sapiens
cagtttttttctttgtg

SEQ ID NO: 6034676 - DNA, 14 bp, Homo sapiens
cataaaaaaatgat

SEQ ID NO: 6034677 - DNA, 21 bp, Homo sapiens
cataaaaaagaagcactttga

SEQ ID NO: 6034678 - DNA, 15 bp, Homo sapiens
cataaaaacaacttt

SEQ ID NO: 6034679 - DNA, 21 bp, Homo sapiens
cataaaaacaactttataccc

SEQ ID NO: 6034680 - DNA, 11 bp, Homo sapiens
cataaaaactg

SEQ ID NO: 6034681 - DNA, 14 bp, Homo sapiens
cataaaaagaaagc

SEQ ID NO: 6034682 - DNA, 22 bp, Homo sapiens
cataaaaagaaagctaatacta

SEQ ID NO: 6034683 - DNA, 18 bp, Homo sapiens
cataaaaagcagaatttt

SEQ ID NO: 6034684 - DNA, 19 bp, Homo sapiens
cataaaaagcagaatttta

SEQ ID NO: 6034685 - DNA, 22 bp, Homo sapiens
cataaaaagcagaattttaatg

SEQ ID NO: 6034686 - DNA, 22 bp, Homo sapiens
cataaaaaggaacaagactgac

SEQ ID NO: 6034687 - DNA, 22 bp, Homo sapiens
cataaaaaggacatcagcaaac

SEQ ID NO: 6034688 - DNA, 20 bp, Homo sapiens
cataaaaatccctcttcctc

SEQ ID NO: 6034689 - DNA, 22 bp, Homo sapiens
cataaaaatctagcacactctt

SEQ ID NO: 6034690 - DNA, 19 bp, Homo sapiens
cataaaaattgtttctata

SEQ ID NO: 6034691 - DNA, 15 bp, Homo sapiens
cataaaacaaaacca

SEQ ID NO: 6034692 - DNA, 18 bp, Homo sapiens
cataaaacacccttgaaa

SEQ ID NO: 6034693 - DNA, 22 bp, Homo sapiens
cataaaacacccttgaaaatat

SEQ ID NO: 6034694 - DNA, 11 bp, Homo sapiens
cataaaacatt

SEQ ID NO: 6034695 - DNA, 18 bp, Homo sapiens
cataaaacattaagaaaa

SEQ ID NO: 6034696 - DNA, 22 bp, Homo sapiens
cataaaactcatgactgagtct

SEQ ID NO: 6034697 - DNA, 15 bp, Homo sapiens
cataaaactttaaaa

SEQ ID NO: 6034698 - DNA, 18 bp, Homo sapiens
cataaaactttaaaaggc

SEQ ID NO: 6034699 - DNA, 22 bp, Homo sapiens
cataaaagagtggaactatcca

SEQ ID NO: 6034700 - DNA, 15 bp, Homo sapiens
cataaaagccccagc

SEQ ID NO: 6034701 - DNA, 23 bp, Homo sapiens
cataaaaggcttcacttttgact

SEQ ID NO: 6034702 - DNA, 20 bp, Homo sapiens
cataaaaggtgacccttctg

SEQ ID NO: 6034703 - DNA, 15 bp, Homo sapiens
cataaaataaataat

SEQ ID NO: 6034704 - DNA, 14 bp, Homo sapiens
cataaaatcaaaac

SEQ ID NO: 6034705 - DNA, 21 bp, Homo sapiens
cataaaatgcatactgttgat

SEQ ID NO: 6034706 - DNA, 12 bp, Homo sapiens
cataaaatgcta

SEQ ID NO: 6034707 - DNA, 22 bp, Homo sapiens
cataaaatgtccagtaagatca

SEQ ID NO: 6034708 - DNA, 23 bp, Homo sapiens
cataaaattgcagtttcatgtat

SEQ ID NO: 6034709 - DNA, 13 bp, Homo sapiens
cataaaattggat

SEQ ID NO: 6034710 - DNA, 20 bp, Homo sapiens
cataaaatttaaaaacttaa

SEQ ID NO: 6034711 - DNA, 13 bp, Homo sapiens
cataaaatttaca

SEQ ID NO: 6034712 - DNA, 22 bp, Homo sapiens
cataaaattttctactcttttt

SEQ ID NO: 6034713 - DNA, 20 bp, Homo sapiens
cataaacaaagacattgaca

SEQ ID NO: 6034714 - DNA, 14 bp, Homo sapiens
cataaacaaagagt

SEQ ID NO: 6034715 - DNA, 15 bp, Homo sapiens
cataaacaaagagta

SEQ ID NO: 6034716 - DNA, 21 bp, Homo sapiens
cataaacaagaccacgtttct

SEQ ID NO: 6034717 - DNA, 18 bp, Homo sapiens
cataaacaatgatgccct

SEQ ID NO: 6034718 - DNA, 19 bp, Homo sapiens
cataaacacttctccttaa

SEQ ID NO: 6034719 - DNA, 20 bp, Homo sapiens
cataaacacttctccttaac

SEQ ID NO: 6034720 - DNA, 13 bp, Homo sapiens
cataaacagcatt

SEQ ID NO: 6034721 - DNA, 14 bp, Homo sapiens
cataaacagcattt

SEQ ID NO: 6034722 - DNA, 14 bp, Homo sapiens
cataaacagtaatg

SEQ ID NO: 6034723 - DNA, 22 bp, Homo sapiens
cataaacatcaggttaggcagt

SEQ ID NO: 6034724 - DNA, 14 bp, Homo sapiens
cataaacatttgca

SEQ ID NO: 6034725 - DNA, 16 bp, Homo sapiens
cataaacatttgccaa

SEQ ID NO: 6034726 - DNA, 18 bp, Homo sapiens
cataaaccaataaaacaa

SEQ ID NO: 6034727 - DNA, 22 bp, Homo sapiens
cataaaccaatgagctgtatct

SEQ ID NO: 6034728 - DNA, 17 bp, Homo sapiens
cataaacccatctgtaa

SEQ ID NO: 6034729 - DNA, 17 bp, Homo sapiens
cataaacctgtgctgaa

SEQ ID NO: 6034730 - DNA, 15 bp, Homo sapiens
cataaacggttcctg

SEQ ID NO: 6034731 - DNA, 14 bp, Homo sapiens
cataaactaagaga

SEQ ID NO: 6034732 - DNA, 16 bp, Homo sapiens
cataaactatattctg

SEQ ID NO: 6034733 - DNA, 14 bp, Homo sapiens
cataaactgagcct

SEQ ID NO: 6034734 - DNA, 16 bp, Homo sapiens
cataaactgtacaaat

SEQ ID NO: 6034735 - DNA, 17 bp, Homo sapiens
cataaactgtacaaatg

SEQ ID NO: 6034736 - DNA, 14 bp, Homo sapiens
cataaactgtcact

SEQ ID NO: 6034737 - DNA, 16 bp, Homo sapiens
cataaacttcaggcaa

SEQ ID NO: 6034738 - DNA, 12 bp, Homo sapiens
cataaacttcat

SEQ ID NO: 6034739 - DNA, 13 bp, Homo sapiens
cataaacttcatc

SEQ ID NO: 6034740 - DNA, 15 bp, Homo sapiens
cataaactttctcca

SEQ ID NO: 6034741 - DNA, 13 bp, Homo sapiens
cataaagaaaaat

SEQ ID NO: 6034742 - DNA, 16 bp, Homo sapiens
cataaagaaacacttt

SEQ ID NO: 6034743 - DNA, 23 bp, Homo sapiens
cataaagaagaaacttgtaaata

SEQ ID NO: 6034744 - DNA, 18 bp, Homo sapiens
cataaagaagatgtttaa

SEQ ID NO: 6034745 - DNA, 21 bp, Homo sapiens
cataaagaagatgtttaactt

SEQ ID NO: 6034746 - DNA, 12 bp, Homo sapiens
cataaagaagca

SEQ ID NO: 6034747 - DNA, 17 bp, Homo sapiens
cataaagacaatcactg

SEQ ID NO: 6034748 - DNA, 21 bp, Homo sapiens
cataaagacaatcactgccaa

SEQ ID NO: 6034749 - DNA, 22 bp, Homo sapiens
cataaagaggcgttgctttcac

SEQ ID NO: 6034750 - DNA, 23 bp, Homo sapiens
cataaagatcacaccaatttaga

SEQ ID NO: 6034751 - DNA, 15 bp, Homo sapiens
cataaagatgttaaa

SEQ ID NO: 6034752 - DNA, 13 bp, Homo sapiens
cataaagcctctg

SEQ ID NO: 6034753 - DNA, 21 bp, Homo sapiens
cataaagctcaaatgaaatgt

SEQ ID NO: 6034754 - DNA, 17 bp, Homo sapiens
cataaaggacactggat

SEQ ID NO: 6034755 - DNA, 22 bp, Homo sapiens
cataaaggatatttcaaatgat

SEQ ID NO: 6034756 - DNA, 20 bp, Homo sapiens
cataaagggttgaaaatgtg

SEQ ID NO: 6034757 - DNA, 16 bp, Homo sapiens
cataaaggtatttaga

SEQ ID NO: 6034758 - DNA, 18 bp, Homo sapiens
cataaaggtttacagtga

SEQ ID NO: 6034759 - DNA, 22 bp, Homo sapiens
cataaagtaaatacatgcatat

SEQ ID NO: 6034760 - DNA, 22 bp, Homo sapiens
cataaagtaaatgctacctctg

SEQ ID NO: 6034761 - DNA, 12 bp, Homo sapiens
cataaagtactt

SEQ ID NO: 6034762 - DNA, 15 bp, Homo sapiens
cataaagtcagtgcc

SEQ ID NO: 6034763 - DNA, 14 bp, Homo sapiens
cataaagtcttgcc

SEQ ID NO: 6034764 - DNA, 19 bp, Homo sapiens
cataaagtgccagtttgct

SEQ ID NO: 6034765 - DNA, 18 bp, Homo sapiens
cataaagttagaatctat

SEQ ID NO: 6034766 - DNA, 14 bp, Homo sapiens
cataaataaaactg

SEQ ID NO: 6034767 - DNA, 17 bp, Homo sapiens
cataaataaaactgaat

SEQ ID NO: 6034768 - DNA, 22 bp, Homo sapiens
cataaataaattaaataaaata

SEQ ID NO: 6034769 - DNA, 19 bp, Homo sapiens
cataaataattttgtttta

SEQ ID NO: 6034770 - DNA, 20 bp, Homo sapiens
cataaatacaaaaatgaata

SEQ ID NO: 6034771 - DNA, 22 bp, Homo sapiens
cataaatactgtcaaacaataa

SEQ ID NO: 6034772 - DNA, 13 bp, Homo sapiens
cataaatatgcag

SEQ ID NO: 6034773 - DNA, 15 bp, Homo sapiens
cataaatatgcagtg

SEQ ID NO: 6034774 - DNA, 20 bp, Homo sapiens
cataaatatgcagtgatatg

SEQ ID NO: 6034775 - DNA, 18 bp, Homo sapiens
cataaatcaattcattgt

SEQ ID NO: 6034776 - DNA, 19 bp, Homo sapiens
cataaatcacagaaaattt

SEQ ID NO: 6034777 - DNA, 20 bp, Homo sapiens
cataaatctgtctgattcta

SEQ ID NO: 6034778 - DNA, 14 bp, Homo sapiens
cataaatctgtgaa

SEQ ID NO: 6034779 - DNA, 16 bp, Homo sapiens
cataaatctgtgaact

SEQ ID NO: 6034780 - DNA, 22 bp, Homo sapiens
cataaatctgtgaacttgaaat

SEQ ID NO: 6034781 - DNA, 16 bp, Homo sapiens
cataaatctgttagca

SEQ ID NO: 6034782 - DNA, 16 bp, Homo sapiens
cataaatcttccaaag

SEQ ID NO: 6034783 - DNA, 15 bp, Homo sapiens
cataaatgaaagaaa

SEQ ID NO: 6034784 - DNA, 13 bp, Homo sapiens
cataaatgaaatt

SEQ ID NO: 6034785 - DNA, 14 bp, Homo sapiens
cataaatgaagcag

SEQ ID NO: 6034786 - DNA, 18 bp, Homo sapiens
cataaatgcagcccattt

SEQ ID NO: 6034787 - DNA, 14 bp, Homo sapiens
cataaatgcccagc

SEQ ID NO: 6034788 - DNA, 17 bp, Homo sapiens
cataaatgtcacaataa

SEQ ID NO: 6034789 - DNA, 13 bp, Homo sapiens
cataaatgtgttc

SEQ ID NO: 6034790 - DNA, 20 bp, Homo sapiens
cataaatgttcagcttcaga

SEQ ID NO: 6034791 - DNA, 14 bp, Homo sapiens
cataaattaaaatg

SEQ ID NO: 6034792 - DNA, 16 bp, Homo sapiens
cataaattaatgattc

SEQ ID NO: 6034793 - DNA, 14 bp, Homo sapiens
cataaattacagtc

SEQ ID NO: 6034794 - DNA, 21 bp, Homo sapiens
cataaattactgttttgccaa

SEQ ID NO: 6034795 - DNA, 19 bp, Homo sapiens
cataaattcaactttgtaa

SEQ ID NO: 6034796 - DNA, 20 bp, Homo sapiens
cataaattcaactttgtaaa

SEQ ID NO: 6034797 - DNA, 19 bp, Homo sapiens
cataaattggctcctttcc

SEQ ID NO: 6034798 - DNA, 17 bp, Homo sapiens
cataaattgtaatttgg

SEQ ID NO: 6034799 - DNA, 14 bp, Homo sapiens
cataaatttaatgt

SEQ ID NO: 6034800 - DNA, 20 bp, Homo sapiens
cataaatttactttacacaa

SEQ ID NO: 6034801 - DNA, 20 bp, Homo sapiens
cataaatttagtattttgtt

SEQ ID NO: 6034802 - DNA, 22 bp, Homo sapiens
cataaatttctctttttgaaaa

SEQ ID NO: 6034803 - DNA, 12 bp, Homo sapiens
cataaatttgta

SEQ ID NO: 6034804 - DNA, 16 bp, Homo sapiens
cataaatttgtaatat

SEQ ID NO: 6034805 - DNA, 21 bp, Homo sapiens
cataaatttgtaatatatcct

SEQ ID NO: 6034806 - DNA, 16 bp, Homo sapiens
cataaatttgttgtca

SEQ ID NO: 6034807 - DNA, 20 bp, Homo sapiens
cataaattttaattcaagaa

SEQ ID NO: 6034808 - DNA, 22 bp, Homo sapiens
cataaattttaattcaagaaat

SEQ ID NO: 6034809 - DNA, 15 bp, Homo sapiens
cataacaaaccatct

SEQ ID NO: 6034810 - DNA, 17 bp, Homo sapiens
cataacaaaccatctgg

SEQ ID NO: 6034811 - DNA, 15 bp, Homo sapiens
cataacaacttcata

SEQ ID NO: 6034812 - DNA, 14 bp, Homo sapiens
cataacacacatca

SEQ ID NO: 6034813 - DNA, 22 bp, Homo sapiens
cataacaccaatcccagggctg

SEQ ID NO: 6034814 - DNA, 20 bp, Homo sapiens
cataacaccgtcccagggct

SEQ ID NO: 6034815 - DNA, 13 bp, Homo sapiens
cataacagaatgc

SEQ ID NO: 6034816 - DNA, 17 bp, Homo sapiens
cataacagaatgcacca

SEQ ID NO: 6034817 - DNA, 21 bp, Homo sapiens
cataacagagtagttttggtt

SEQ ID NO: 6034818 - DNA, 17 bp, Homo sapiens
cataacagcctctgtga

SEQ ID NO: 6034819 - DNA, 14 bp, Homo sapiens
ccacactccactct

SEQ ID NO: 6034820 - DNA, 17 bp, Homo sapiens
ccacactccactctgat

SEQ ID NO: 6034821 - DNA, 14 bp, Homo sapiens
ccacactccactga

SEQ ID NO: 6034822 - DNA, 16 bp, Homo sapiens
ccacactccactgaca

SEQ ID NO: 6034823 - DNA, 17 bp, Homo sapiens
ccacactccagctggga

SEQ ID NO: 6034824 - DNA, 23 bp, Homo sapiens
ccacactccccgccttagagcct

SEQ ID NO: 6034825 - DNA, 19 bp, Homo sapiens
ccacactcgccatctcctg

SEQ ID NO: 6034826 - DNA, 20 bp, Homo sapiens
ccacactcttctatgaccca

SEQ ID NO: 6034827 - DNA, 13 bp, Homo sapiens
ccacactgaaatt

SEQ ID NO: 6034828 - DNA, 17 bp, Homo sapiens
ccacactgaccaagtgc

SEQ ID NO: 6034829 - DNA, 18 bp, Homo sapiens
ccacactgaccaagtgct

SEQ ID NO: 6034830 - DNA, 21 bp, Homo sapiens
ccacactgctacacttctgat

SEQ ID NO: 6034831 - DNA, 14 bp, Homo sapiens
ccacactgcttggc

SEQ ID NO: 6034832 - DNA, 21 bp, Homo sapiens
ccacactgcttggcccttcaa

SEQ ID NO: 6034833 - DNA, 13 bp, Homo sapiens
ccacactggactc

SEQ ID NO: 6034834 - DNA, 14 bp, Homo sapiens
ccacactggactcc

SEQ ID NO: 6034835 - DNA, 21 bp, Homo sapiens
ccacactggactccggccctc

SEQ ID NO: 6034836 - DNA, 22 bp, Homo sapiens
ccacactggactccggccctcc

SEQ ID NO: 6034837 - DNA, 14 bp, Homo sapiens
ccacactgggcctg

SEQ ID NO: 6034838 - DNA, 12 bp, Homo sapiens
ccacactgtcag

SEQ ID NO: 6034839 - DNA, 13 bp, Homo sapiens
ccacactgtgaca

SEQ ID NO: 6034840 - DNA, 19 bp, Homo sapiens
ccacactgtggccaggcct

SEQ ID NO: 6034841 - DNA, 14 bp, Homo sapiens
ccacacttcaaact

SEQ ID NO: 6034842 - DNA, 17 bp, Homo sapiens
ccacacttcaaactact

SEQ ID NO: 6034843 - DNA, 20 bp, Homo sapiens
ccacacttcaggctcttctc

SEQ ID NO: 6034844 - DNA, 11 bp, Homo sapiens
ccacacttccc

SEQ ID NO: 6034845 - DNA, 20 bp, Homo sapiens
ccacacttcccacccccagg

SEQ ID NO: 6034846 - DNA, 21 bp, Homo sapiens
ccacacttcccacccccaggc

SEQ ID NO: 6034847 - DNA, 17 bp, Homo sapiens
ccacacttcgctcttga

SEQ ID NO: 6034848 - DNA, 19 bp, Homo sapiens
ccacacttcgctcttgagg

SEQ ID NO: 6034849 - DNA, 21 bp, Homo sapiens
ccacacttctcaggacacagg

SEQ ID NO: 6034850 - DNA, 23 bp, Homo sapiens
ccacacttctcaggacacaggcc

SEQ ID NO: 6034851 - DNA, 24 bp, Homo sapiens
ccacacttctcaggacacaggcct

SEQ ID NO: 6034852 - DNA, 12 bp, Homo sapiens
ccacacttctgg

SEQ ID NO: 6034853 - DNA, 14 bp, Homo sapiens
ccacacttctgggc

SEQ ID NO: 6034854 - DNA, 23 bp, Homo sapiens
ccacacttcttgaaacagcctgg

SEQ ID NO: 6034855 - DNA, 18 bp, Homo sapiens
ccacacttgctggggctc

SEQ ID NO: 6034856 - DNA, 16 bp, Homo sapiens
ccacacttgtgccagc

SEQ ID NO: 6034857 - DNA, 19 bp, Homo sapiens
ccacacttgtgccagcccg

SEQ ID NO: 6034858 - DNA, 18 bp, Homo sapiens
ccacacttgttttctttg

SEQ ID NO: 6034859 - DNA, 18 bp, Homo sapiens
ccacactttcactgggga

SEQ ID NO: 6034860 - DNA, 14 bp, Homo sapiens
ccacactttgaagc

SEQ ID NO: 6034861 - DNA, 17 bp, Homo sapiens
ccacactttgaagcaaa

SEQ ID NO: 6034862 - DNA, 19 bp, Homo sapiens
ccacactttgaagcaaata

SEQ ID NO: 6034863 - DNA, 21 bp, Homo sapiens
ccacactttgagaacctgtgc

SEQ ID NO: 6034864 - DNA, 13 bp, Homo sapiens
ccacagaaagaga

SEQ ID NO: 6034865 - DNA, 19 bp, Homo sapiens
ccacagaaagccaggagca

SEQ ID NO: 6034866 - DNA, 17 bp, Homo sapiens
ccacagaaaggccactc

SEQ ID NO: 6034867 - DNA, 21 bp, Homo sapiens
ccacagaaaggccactcagga

SEQ ID NO: 6034868 - DNA, 15 bp, Homo sapiens
ccacagaagacacgt

SEQ ID NO: 6034869 - DNA, 16 bp, Homo sapiens
ccacagaagacacgtg

SEQ ID NO: 6034870 - DNA, 21 bp, Homo sapiens
ccacagaagacacgtgttttt

SEQ ID NO: 6034871 - DNA, 21 bp, Homo sapiens
ccacagaagacttcccagctt

SEQ ID NO: 6034872 - DNA, 13 bp, Homo sapiens
ccacagacacaca

SEQ ID NO: 6034873 - DNA, 16 bp, Homo sapiens
ccacagacactcctgg

SEQ ID NO: 6034874 - DNA, 14 bp, Homo sapiens
ccacagaccacctg

SEQ ID NO: 6034875 - DNA, 21 bp, Homo sapiens
ccacagaccacctgcttctga

SEQ ID NO: 6034876 - DNA, 13 bp, Homo sapiens
ccacagaccccca

SEQ ID NO: 6034877 - DNA, 14 bp, Homo sapiens
ccacagacccctgg

SEQ ID NO: 6034878 - DNA, 17 bp, Homo sapiens
ccacagacccctgggag

SEQ ID NO: 6034879 - DNA, 13 bp, Homo sapiens
ccacagacctgca

SEQ ID NO: 6034880 - DNA, 15 bp, Homo sapiens
ccacagacctgcagt

SEQ ID NO: 6034881 - DNA, 16 bp, Homo sapiens
ccacagacctgcagtg

SEQ ID NO: 6034882 - DNA, 22 bp, Homo sapiens
ccacagacgccacctggcggcc

SEQ ID NO: 6034883 - DNA, 23 bp, Homo sapiens
ccacagacggaagggtaaacaat

SEQ ID NO: 6034884 - DNA, 20 bp, Homo sapiens
ccacagactccctcccctgc

SEQ ID NO: 6034885 - DNA, 19 bp, Homo sapiens
ccacagactccggcctgta

SEQ ID NO: 6034886 - DNA, 13 bp, Homo sapiens
ccacagactgccc

SEQ ID NO: 6034887 - DNA, 14 bp, Homo sapiens
ccacagactgcccc

SEQ ID NO: 6034888 - DNA, 15 bp, Homo sapiens
ccacagactgcccca

SEQ ID NO: 6034889 - DNA, 16 bp, Homo sapiens
ccacagactgccccag

SEQ ID NO: 6034890 - DNA, 17 bp, Homo sapiens
ccacagactgccccagc

SEQ ID NO: 6034891 - DNA, 16 bp, Homo sapiens
ccacagacttgcactg

SEQ ID NO: 6034892 - DNA, 22 bp, Homo sapiens
ccacagagaaagtacttctcca

SEQ ID NO: 6034893 - DNA, 17 bp, Homo sapiens
ccacagagaggagggga

SEQ ID NO: 6034894 - DNA, 14 bp, Homo sapiens
ccacagaggacagt

SEQ ID NO: 6034895 - DNA, 18 bp, Homo sapiens
ccacagaggacagtgctg

SEQ ID NO: 6034896 - DNA, 23 bp, Homo sapiens
ccacagaggatgctgacatcatt

SEQ ID NO: 6034897 - DNA, 13 bp, Homo sapiens
ccacagaggcccc

SEQ ID NO: 6034898 - DNA, 15 bp, Homo sapiens
ccacagaggccccac

SEQ ID NO: 6034899 - DNA, 21 bp, Homo sapiens
ccacagaggccccacctgaag

SEQ ID NO: 6034900 - DNA, 23 bp, Homo sapiens
ccacagaggccccacctgaaggg

SEQ ID NO: 6034901 - DNA, 23 bp, Homo sapiens
ccacagaggtgctgtagatgctg

SEQ ID NO: 6034902 - DNA, 16 bp, Homo sapiens
ccacagagtaagacat

SEQ ID NO: 6034903 - DNA, 17 bp, Homo sapiens
ccacagagtaagacatt

SEQ ID NO: 6034904 - DNA, 18 bp, Homo sapiens
ccacagagtaagacattg

SEQ ID NO: 6034905 - DNA, 22 bp, Homo sapiens
ccacagagtctgtgtgtagcca

SEQ ID NO: 6034906 - DNA, 15 bp, Homo sapiens
ccacagagtgagcca

SEQ ID NO: 6034907 - DNA, 16 bp, Homo sapiens
ccacagagtgagccag

SEQ ID NO: 6034908 - DNA, 17 bp, Homo sapiens
ccacagagtgagccagt

SEQ ID NO: 6034909 - DNA, 21 bp, Homo sapiens
ccacagagtgccatccctgag

SEQ ID NO: 6034910 - DNA, 17 bp, Homo sapiens
ccacagagtgctggact

SEQ ID NO: 6034911 - DNA, 18 bp, Homo sapiens
ccacagagtgctggactg

SEQ ID NO: 6034912 - DNA, 19 bp, Homo sapiens
ccacagagtgctggactgt

SEQ ID NO: 6034913 - DNA, 16 bp, Homo sapiens
ccacagagtgtagcca

SEQ ID NO: 6034914 - DNA, 17 bp, Homo sapiens
ccacagagtgtggtccc

SEQ ID NO: 6034915 - DNA, 18 bp, Homo sapiens
ccacagagtttttcagga

SEQ ID NO: 6034916 - DNA, 16 bp, Homo sapiens
ccacagataactgaaa

SEQ ID NO: 6034917 - DNA, 18 bp, Homo sapiens
ccacagataactgaaaat

SEQ ID NO: 6034918 - DNA, 21 bp, Homo sapiens
ccacagatccatccttttgct

SEQ ID NO: 6034919 - DNA, 18 bp, Homo sapiens
ccacagatgtctctgggg

SEQ ID NO: 6034920 - DNA, 15 bp, Homo sapiens
ccacagatttttttg

SEQ ID NO: 6034921 - DNA, 17 bp, Homo sapiens
ccacagcaattggctcc

SEQ ID NO: 6034922 - DNA, 19 bp, Homo sapiens
ccacagcacaaccggtccc

SEQ ID NO: 6034923 - DNA, 22 bp, Homo sapiens
ccacagcacaaccggtcccttc

SEQ ID NO: 6034924 - DNA, 20 bp, Homo sapiens
ccacagcacagctccctgcc

SEQ ID NO: 6034925 - DNA, 15 bp, Homo sapiens
ccacagcacccaggc

SEQ ID NO: 6034926 - DNA, 13 bp, Homo sapiens
ccacagcagacac

SEQ ID NO: 6034927 - DNA, 19 bp, Homo sapiens
ccacagcagccccaggaga

SEQ ID NO: 6034928 - DNA, 14 bp, Homo sapiens
ccacagcagctgaa

SEQ ID NO: 6034929 - DNA, 14 bp, Homo sapiens
ccacagcaggtcct

SEQ ID NO: 6034930 - DNA, 20 bp, Homo sapiens
ccacagcatcattttgcatt

SEQ ID NO: 6034931 - DNA, 22 bp, Homo sapiens
ccacagcatcgggagcacccag

SEQ ID NO: 6034932 - DNA, 15 bp, Homo sapiens
ccacagcatgaacct

SEQ ID NO: 6034933 - DNA, 12 bp, Homo sapiens
ccacagccacct

SEQ ID NO: 6034934 - DNA, 17 bp, Homo sapiens
ccacagccagcacctgg

SEQ ID NO: 6034935 - DNA, 20 bp, Homo sapiens
ccacagccagggctccacgg

SEQ ID NO: 6034936 - DNA, 13 bp, Homo sapiens
ccacagccataga

SEQ ID NO: 6034937 - DNA, 20 bp, Homo sapiens
ccacagccatcccagccttg

SEQ ID NO: 6034938 - DNA, 19 bp, Homo sapiens
ccacagcccacgtcctgtc

SEQ ID NO: 6034939 - DNA, 19 bp, Homo sapiens
ccacagcccagccacggac

SEQ ID NO: 6034940 - DNA, 16 bp, Homo sapiens
ccacagcccaggcctc

SEQ ID NO: 6034941 - DNA, 12 bp, Homo sapiens
ccacagccccaa

SEQ ID NO: 6034942 - DNA, 19 bp, Homo sapiens
ccacagccccaacctccca

SEQ ID NO: 6034943 - DNA, 14 bp, Homo sapiens
ccacagccccacag

SEQ ID NO: 6034944 - DNA, 15 bp, Homo sapiens
ccacagccccacagc

SEQ ID NO: 6034945 - DNA, 17 bp, Homo sapiens
ccacagccccacagcac

SEQ ID NO: 6034946 - DNA, 20 bp, Homo sapiens
ccacagcccccaccccagca

SEQ ID NO: 6034947 - DNA, 22 bp, Homo sapiens
ccacagcccccttgccctccgc

SEQ ID NO: 6034948 - DNA, 13 bp, Homo sapiens
ccacagcccctta

SEQ ID NO: 6034949 - DNA, 19 bp, Homo sapiens
ccacagcccgcatgcagca

SEQ ID NO: 6034950 - DNA, 13 bp, Homo sapiens
ccacagccctgaa

SEQ ID NO: 6034951 - DNA, 23 bp, Homo sapiens
ccacagccctgaaacgagaagtg

SEQ ID NO: 6034952 - DNA, 18 bp, Homo sapiens
ccacagcccttttgtctc

SEQ ID NO: 6034953 - DNA, 20 bp, Homo sapiens
ccacagccgcctttgggttc

SEQ ID NO: 6034954 - DNA, 12 bp, Homo sapiens
ccacagcctccc

SEQ ID NO: 6034955 - DNA, 19 bp, Homo sapiens
ccacagcctcccctgccag

SEQ ID NO: 6034956 - DNA, 17 bp, Homo sapiens
ccacagcctccccttcc

SEQ ID NO: 6034957 - DNA, 18 bp, Homo sapiens
ccacagcctccccttccc

SEQ ID NO: 6034958 - DNA, 20 bp, Homo sapiens
ccacagcctccccttcccag

SEQ ID NO: 6034959 - DNA, 22 bp, Homo sapiens
ccacagcctccccttcccagac

SEQ ID NO: 6034960 - DNA, 15 bp, Homo sapiens
ccacagcctccttct

SEQ ID NO: 6034961 - DNA, 16 bp, Homo sapiens
ccacagcctctggctc

SEQ ID NO: 6034962 - DNA, 18 bp, Homo sapiens
ccacagcctctggctcca

SEQ ID NO: 6034963 - DNA, 15 bp, Homo sapiens
ccacagcctcttcct

SEQ ID NO: 6034964 - DNA, 16 bp, Homo sapiens
ccacagcctcttcctc

SEQ ID NO: 6034965 - DNA, 12 bp, Homo sapiens
ccacagcctgct

SEQ ID NO: 6034966 - DNA, 13 bp, Homo sapiens
ccacagcctgctg

SEQ ID NO: 6034967 - DNA, 18 bp, Homo sapiens
ccacagcctgctggcagg

SEQ ID NO: 6034968 - DNA, 19 bp, Homo sapiens
ccacagcctgctggcaggg

SEQ ID NO: 6034969 - DNA, 20 bp, Homo sapiens
ccacagcctgctggcagggc

SEQ ID NO: 6034970 - DNA, 14 bp, Homo sapiens
ccacagccttccct

SEQ ID NO: 6034971 - DNA, 18 bp, Homo sapiens
ccacagcgagcctgtgcc

SEQ ID NO: 6034972 - DNA, 18 bp, Homo sapiens
ccacagcgccagcctcag

SEQ ID NO: 6034973 - DNA, 24 bp, Homo sapiens
ccacagcgccagcctcagactgga

SEQ ID NO: 6034974 - DNA, 18 bp, Homo sapiens
ccacagctacctgagacg

SEQ ID NO: 6034975 - DNA, 15 bp, Homo sapiens
ccacagctatttaga

SEQ ID NO: 6034976 - DNA, 14 bp, Homo sapiens
ccacagctcaactc

SEQ ID NO: 6034977 - DNA, 16 bp, Homo sapiens
ccacagctcagctgcc

SEQ ID NO: 6034978 - DNA, 17 bp, Homo sapiens
ccacagctcagctgccc

SEQ ID NO: 6034979 - DNA, 16 bp, Homo sapiens
ccacagctcccacccc

SEQ ID NO: 6034980 - DNA, 18 bp, Homo sapiens
ccacagctccttgcaaac

SEQ ID NO: 6034981 - DNA, 14 bp, Homo sapiens
ccacagctcctttt

SEQ ID NO: 6034982 - DNA, 15 bp, Homo sapiens
ccacagctccttttc

SEQ ID NO: 6034983 - DNA, 13 bp, Homo sapiens
ccacagctctgct

SEQ ID NO: 6034984 - DNA, 16 bp, Homo sapiens
ccacagctctgctgga

SEQ ID NO: 6034985 - DNA, 14 bp, Homo sapiens
ccacagctctgggc

SEQ ID NO: 6034986 - DNA, 16 bp, Homo sapiens
ccacagctgaagagca

SEQ ID NO: 6034987 - DNA, 16 bp, Homo sapiens
ccacagctgagaatgt

SEQ ID NO: 6034988 - DNA, 15 bp, Homo sapiens
ccacagctgcagctg

SEQ ID NO: 6034989 - DNA, 21 bp, Homo sapiens
ccacagctgcagctgatccat

SEQ ID NO: 6034990 - DNA, 13 bp, Homo sapiens
ccacagctgcctc

SEQ ID NO: 6034991 - DNA, 14 bp, Homo sapiens
ccacagctgcctcc

SEQ ID NO: 6034992 - DNA, 17 bp, Homo sapiens
ccacagctgcctccggg

SEQ ID NO: 6034993 - DNA, 16 bp, Homo sapiens
ccacagctgctggaga

SEQ ID NO: 6034994 - DNA, 17 bp, Homo sapiens
ccacagctgctggagaa

SEQ ID NO: 6034995 - DNA, 15 bp, Homo sapiens
ccacagctgctggcc

SEQ ID NO: 6034996 - DNA, 19 bp, Homo sapiens
ccacagctgctggccaggg

SEQ ID NO: 6034997 - DNA, 13 bp, Homo sapiens
ccacagctgctgt

SEQ ID NO: 6034998 - DNA, 14 bp, Homo sapiens
ccacagctgctgtt

SEQ ID NO: 6034999 - DNA, 13 bp, Homo sapiens
cataacaggcatt

SEQ ID NO: 6035000 - DNA, 14 bp, Homo sapiens
cataacagtgccat

SEQ ID NO: 6035001 - DNA, 16 bp, Homo sapiens
cataacagtgccattg

SEQ ID NO: 6035002 - DNA, 21 bp, Homo sapiens
cataacataaatctgtgaact

SEQ ID NO: 6035003 - DNA, 21 bp, Homo sapiens
cataacataagctagaaaaat

SEQ ID NO: 6035004 - DNA, 22 bp, Homo sapiens
cataacatagttgaaaaaagaa

SEQ ID NO: 6035005 - DNA, 16 bp, Homo sapiens
cataacattgatgact

SEQ ID NO: 6035006 - DNA, 22 bp, Homo sapiens
cataaccaacattttaaaaata

SEQ ID NO: 6035007 - DNA, 16 bp, Homo sapiens
cataaccaatttgtaa

SEQ ID NO: 6035008 - DNA, 17 bp, Homo sapiens
cataaccaatttgtaat

SEQ ID NO: 6035009 - DNA, 22 bp, Homo sapiens
cataacccaaggtaccatccta

SEQ ID NO: 6035010 - DNA, 12 bp, Homo sapiens
cataaccccacc

SEQ ID NO: 6035011 - DNA, 13 bp, Homo sapiens
cataaccccaccc

SEQ ID NO: 6035012 - DNA, 20 bp, Homo sapiens
cataaccccacccttgccca

SEQ ID NO: 6035013 - DNA, 21 bp, Homo sapiens
cataaccccaccctttacatt

SEQ ID NO: 6035014 - DNA, 14 bp, Homo sapiens
cataaccctgtcac

SEQ ID NO: 6035015 - DNA, 18 bp, Homo sapiens
cataaccctgtcacccac

SEQ ID NO: 6035016 - DNA, 20 bp, Homo sapiens
cataaccctgtcacccacag

SEQ ID NO: 6035017 - DNA, 16 bp, Homo sapiens
cataacctagccttag

SEQ ID NO: 6035018 - DNA, 18 bp, Homo sapiens
cataaccttaccagattt

SEQ ID NO: 6035019 - DNA, 13 bp, Homo sapiens
cataacggaaagt

SEQ ID NO: 6035020 - DNA, 17 bp, Homo sapiens
cataacggatcagaaat

SEQ ID NO: 6035021 - DNA, 21 bp, Homo sapiens
cataacggatcagaaatacag

SEQ ID NO: 6035022 - DNA, 23 bp, Homo sapiens
cataacggttaagaaagcactta

SEQ ID NO: 6035023 - DNA, 15 bp, Homo sapiens
cataacgtgccccca

SEQ ID NO: 6035024 - DNA, 17 bp, Homo sapiens
cataacgtgcccccaga

SEQ ID NO: 6035025 - DNA, 21 bp, Homo sapiens
cataacgtgcccccagagtgt

SEQ ID NO: 6035026 - DNA, 15 bp, Homo sapiens
cataacgtttttcct

SEQ ID NO: 6035027 - DNA, 18 bp, Homo sapiens
cataacgtttttccttta

SEQ ID NO: 6035028 - DNA, 20 bp, Homo sapiens
cataacgtttttcctttaaa

SEQ ID NO: 6035029 - DNA, 18 bp, Homo sapiens
cataactaaaattaagta

SEQ ID NO: 6035030 - DNA, 16 bp, Homo sapiens
cataactaaatttgat

SEQ ID NO: 6035031 - DNA, 19 bp, Homo sapiens
cataactaaatttgatact

SEQ ID NO: 6035032 - DNA, 14 bp, Homo sapiens
cataactatctttt

SEQ ID NO: 6035033 - DNA, 19 bp, Homo sapiens
cataactatctttttgaaa

SEQ ID NO: 6035034 - DNA, 20 bp, Homo sapiens
cataactatctttttgaaag

SEQ ID NO: 6035035 - DNA, 14 bp, Homo sapiens
cataactgaaaatg

SEQ ID NO: 6035036 - DNA, 18 bp, Homo sapiens
cataactggattttgaac

SEQ ID NO: 6035037 - DNA, 19 bp, Homo sapiens
cataactggattttgaacg

SEQ ID NO: 6035038 - DNA, 22 bp, Homo sapiens
cataactggcttctgcttgtca

SEQ ID NO: 6035039 - DNA, 14 bp, Homo sapiens
cataacttaataaa

SEQ ID NO: 6035040 - DNA, 21 bp, Homo sapiens
cataacttacctctgcttctg

SEQ ID NO: 6035041 - DNA, 19 bp, Homo sapiens
cataacttcagtgcaagag

SEQ ID NO: 6035042 - DNA, 14 bp, Homo sapiens
cataacttcctgta

SEQ ID NO: 6035043 - DNA, 23 bp, Homo sapiens
cataacttcctgtacttgaagtc

SEQ ID NO: 6035044 - DNA, 15 bp, Homo sapiens
cataacttgctgaat

SEQ ID NO: 6035045 - DNA, 19 bp, Homo sapiens
cataacttgctgaatttca

SEQ ID NO: 6035046 - DNA, 14 bp, Homo sapiens
cataactttatgaa

SEQ ID NO: 6035047 - DNA, 15 bp, Homo sapiens
cataactttatgaag

SEQ ID NO: 6035048 - DNA, 19 bp, Homo sapiens
cataagaaaactaagaaat

SEQ ID NO: 6035049 - DNA, 12 bp, Homo sapiens
cataagaaatgt

SEQ ID NO: 6035050 - DNA, 14 bp, Homo sapiens
cataagaaggcaat

SEQ ID NO: 6035051 - DNA, 15 bp, Homo sapiens
cataagacaaacact

SEQ ID NO: 6035052 - DNA, 20 bp, Homo sapiens
cataagacaaacactgccat

SEQ ID NO: 6035053 - DNA, 15 bp, Homo sapiens
cataagacacttaga

SEQ ID NO: 6035054 - DNA, 15 bp, Homo sapiens
cataagaccaatctc

SEQ ID NO: 6035055 - DNA, 11 bp, Homo sapiens
cataagaccat

SEQ ID NO: 6035056 - DNA, 21 bp, Homo sapiens
cataagaccataacagccaac

SEQ ID NO: 6035057 - DNA, 23 bp, Homo sapiens
cataagaccataacagccaacag

SEQ ID NO: 6035058 - DNA, 20 bp, Homo sapiens
cataagaccctaagcctcct

SEQ ID NO: 6035059 - DNA, 15 bp, Homo sapiens
cataagaccgtgtcc

SEQ ID NO: 6035060 - DNA, 21 bp, Homo sapiens
cataagaccgtgtcccaagga

SEQ ID NO: 6035061 - DNA, 23 bp, Homo sapiens
cataagactggacatttaacttt

SEQ ID NO: 6035062 - DNA, 17 bp, Homo sapiens
cataagagaaacctgcc

SEQ ID NO: 6035063 - DNA, 22 bp, Homo sapiens
cataagagaaacctgccaagga

SEQ ID NO: 6035064 - DNA, 12 bp, Homo sapiens
cataagagcttt

SEQ ID NO: 6035065 - DNA, 18 bp, Homo sapiens
cataagaggttctaactt

SEQ ID NO: 6035066 - DNA, 22 bp, Homo sapiens
cataagataaaatgatgttata

SEQ ID NO: 6035067 - DNA, 14 bp, Homo sapiens
cataagataaatgt

SEQ ID NO: 6035068 - DNA, 13 bp, Homo sapiens
cataagatattct

SEQ ID NO: 6035069 - DNA, 14 bp, Homo sapiens
cataagatattctt

SEQ ID NO: 6035070 - DNA, 15 bp, Homo sapiens
cataagatattcttt

SEQ ID NO: 6035071 - DNA, 17 bp, Homo sapiens
cataagatatttttcat

SEQ ID NO: 6035072 - DNA, 11 bp, Homo sapiens
cataagattaa

SEQ ID NO: 6035073 - DNA, 15 bp, Homo sapiens
cataagattaaagga

SEQ ID NO: 6035074 - DNA, 17 bp, Homo sapiens
cataagattaaaggaag

SEQ ID NO: 6035075 - DNA, 21 bp, Homo sapiens
cataagattaaaggaaggaaa

SEQ ID NO: 6035076 - DNA, 22 bp, Homo sapiens
cataagattatatacaaagctg

SEQ ID NO: 6035077 - DNA, 21 bp, Homo sapiens
cataagcaacaattttcagat

SEQ ID NO: 6035078 - DNA, 16 bp, Homo sapiens
cataagcaagtgagca

SEQ ID NO: 6035079 - DNA, 23 bp, Homo sapiens
cataagcaagtgagcagatggga

SEQ ID NO: 6035080 - DNA, 16 bp, Homo sapiens
cataagcaggttattt

SEQ ID NO: 6035081 - DNA, 16 bp, Homo sapiens
cataagcattacttta

SEQ ID NO: 6035082 - DNA, 20 bp, Homo sapiens
cataagccaaaactgagcat

SEQ ID NO: 6035083 - DNA, 15 bp, Homo sapiens
cataagccaattttt

SEQ ID NO: 6035084 - DNA, 18 bp, Homo sapiens
cataagccctgagactcc

SEQ ID NO: 6035085 - DNA, 16 bp, Homo sapiens
cataagcctcaggcct

SEQ ID NO: 6035086 - DNA, 14 bp, Homo sapiens
cataagctacacag

SEQ ID NO: 6035087 - DNA, 16 bp, Homo sapiens
cataagctactgccat

SEQ ID NO: 6035088 - DNA, 17 bp, Homo sapiens
cataagctactgccatc

SEQ ID NO: 6035089 - DNA, 17 bp, Homo sapiens
cataagcttccatttta

SEQ ID NO: 6035090 - DNA, 19 bp, Homo sapiens
cataagcttccattttaat

SEQ ID NO: 6035091 - DNA, 22 bp, Homo sapiens
cataaggaatgtagctggtttc

SEQ ID NO: 6035092 - DNA, 19 bp, Homo sapiens
cataaggagaatgtatctc

SEQ ID NO: 6035093 - DNA, 22 bp, Homo sapiens
cataaggagaatgtatctcctc

SEQ ID NO: 6035094 - DNA, 19 bp, Homo sapiens
cataaggagacttctgtct

SEQ ID NO: 6035095 - DNA, 22 bp, Homo sapiens
cataaggagttagaaccacagc

SEQ ID NO: 6035096 - DNA, 21 bp, Homo sapiens
cataaggccagtatgatttat

SEQ ID NO: 6035097 - DNA, 18 bp, Homo sapiens
cataaggcctgccctccc

SEQ ID NO: 6035098 - DNA, 19 bp, Homo sapiens
cataaggcctgccctccca

SEQ ID NO: 6035099 - DNA, 21 bp, Homo sapiens
cataagggagcgtagaatctg

SEQ ID NO: 6035100 - DNA, 18 bp, Homo sapiens
cataaggtcagctcagag

SEQ ID NO: 6035101 - DNA, 16 bp, Homo sapiens
cataaggtttttatgc

SEQ ID NO: 6035102 - DNA, 18 bp, Homo sapiens
cataagtaaatgtcttca

SEQ ID NO: 6035103 - DNA, 17 bp, Homo sapiens
cataagtaatatttaaa

SEQ ID NO: 6035104 - DNA, 18 bp, Homo sapiens
cataagtaatatttaaag

SEQ ID NO: 6035105 - DNA, 17 bp, Homo sapiens
cataagtaattcaagaa

SEQ ID NO: 6035106 - DNA, 18 bp, Homo sapiens
cataagtacctcagcatt

SEQ ID NO: 6035107 - DNA, 22 bp, Homo sapiens
cataagtatttggaattagaac

SEQ ID NO: 6035108 - DNA, 22 bp, Homo sapiens
cataagtcctctagtgaatgta

SEQ ID NO: 6035109 - DNA, 16 bp, Homo sapiens
cataagtctttggtac

SEQ ID NO: 6035110 - DNA, 14 bp, Homo sapiens
cataagtgacacca

SEQ ID NO: 6035111 - DNA, 22 bp, Homo sapiens
cataagtgacaccaataaatgt

SEQ ID NO: 6035112 - DNA, 17 bp, Homo sapiens
cataagttaatattgga

SEQ ID NO: 6035113 - DNA, 15 bp, Homo sapiens
cataagttgcattta

SEQ ID NO: 6035114 - DNA, 16 bp, Homo sapiens
cataagtttaactgta

SEQ ID NO: 6035115 - DNA, 21 bp, Homo sapiens
cataataaaaaattatgacaa

SEQ ID NO: 6035116 - DNA, 15 bp, Homo sapiens
cataataaacttctg

SEQ ID NO: 6035117 - DNA, 18 bp, Homo sapiens
cataataaacttctggtg

SEQ ID NO: 6035118 - DNA, 14 bp, Homo sapiens
cataataaaggttg

SEQ ID NO: 6035119 - DNA, 16 bp, Homo sapiens
cataataaaggttgtg

SEQ ID NO: 6035120 - DNA, 13 bp, Homo sapiens
cataataaagttg

SEQ ID NO: 6035121 - DNA, 14 bp, Homo sapiens
cataataaagttgt

SEQ ID NO: 6035122 - DNA, 14 bp, Homo sapiens
cataataaatagac

SEQ ID NO: 6035123 - DNA, 18 bp, Homo sapiens
cataataaatatctgtac

SEQ ID NO: 6035124 - DNA, 14 bp, Homo sapiens
cataataaatcaca

SEQ ID NO: 6035125 - DNA, 17 bp, Homo sapiens
cataataaatgcttcag

SEQ ID NO: 6035126 - DNA, 16 bp, Homo sapiens
cataataaattttcta

SEQ ID NO: 6035127 - DNA, 15 bp, Homo sapiens
cataataaccctgcc

SEQ ID NO: 6035128 - DNA, 23 bp, Homo sapiens
cataataaccctgccagtgccag

SEQ ID NO: 6035129 - DNA, 17 bp, Homo sapiens
cataataagctaaagag

SEQ ID NO: 6035130 - DNA, 18 bp, Homo sapiens
cataataattctgcttta

SEQ ID NO: 6035131 - DNA, 17 bp, Homo sapiens
cataatactgaaccact

SEQ ID NO: 6035132 - DNA, 23 bp, Homo sapiens
cataatagacttcccactctagg

SEQ ID NO: 6035133 - DNA, 22 bp, Homo sapiens
cataataggtagtttggatatt

SEQ ID NO: 6035134 - DNA, 17 bp, Homo sapiens
cataatagttagccctc

SEQ ID NO: 6035135 - DNA, 18 bp, Homo sapiens
cataatagttagccctca

SEQ ID NO: 6035136 - DNA, 21 bp, Homo sapiens
cataatatataaaagaaatat

SEQ ID NO: 6035137 - DNA, 19 bp, Homo sapiens
cataatatcttgaagaata

SEQ ID NO: 6035138 - DNA, 18 bp, Homo sapiens
cataatatgaagcctttg

SEQ ID NO: 6035139 - DNA, 17 bp, Homo sapiens
cataatatgcatatata

SEQ ID NO: 6035140 - DNA, 16 bp, Homo sapiens
cataatatttgaacaa

SEQ ID NO: 6035141 - DNA, 23 bp, Homo sapiens
cataatatttttcaattttgaaa

SEQ ID NO: 6035142 - DNA, 18 bp, Homo sapiens
cataatcacaacccttca

SEQ ID NO: 6035143 - DNA, 14 bp, Homo sapiens
cataatcagaacac

SEQ ID NO: 6035144 - DNA, 23 bp, Homo sapiens
cataatcagtaaatagtgtcata

SEQ ID NO: 6035145 - DNA, 17 bp, Homo sapiens
cataatcatcctttttt

SEQ ID NO: 6035146 - DNA, 23 bp, Homo sapiens
cataatcatggctcttagaaact

SEQ ID NO: 6035147 - DNA, 13 bp, Homo sapiens
cataatcattacc

SEQ ID NO: 6035148 - DNA, 17 bp, Homo sapiens
cataatccagtaaaata

SEQ ID NO: 6035149 - DNA, 18 bp, Homo sapiens
cataatcctagccccgag

SEQ ID NO: 6035150 - DNA, 19 bp, Homo sapiens
cataatctctttccatctt

SEQ ID NO: 6035151 - DNA, 22 bp, Homo sapiens
cataatctggactcctctgtcc

SEQ ID NO: 6035152 - DNA, 18 bp, Homo sapiens
cataatctggtctcttct

SEQ ID NO: 6035153 - DNA, 16 bp, Homo sapiens
cataatcttagagaca

SEQ ID NO: 6035154 - DNA, 19 bp, Homo sapiens
cataatcttagagacaaac

SEQ ID NO: 6035155 - DNA, 13 bp, Homo sapiens
cataatcttctgc

SEQ ID NO: 6035156 - DNA, 19 bp, Homo sapiens
cataatgaacagaatttat

SEQ ID NO: 6035157 - DNA, 19 bp, Homo sapiens
cataatgaaccgtttacag

SEQ ID NO: 6035158 - DNA, 20 bp, Homo sapiens
cataatgaataaagtgcaaa

SEQ ID NO: 6035159 - DNA, 20 bp, Homo sapiens
cataatgaatgctattgaaa

SEQ ID NO: 6035160 - DNA, 22 bp, Homo sapiens
cataatgaatgctattgaaaag

SEQ ID NO: 6035161 - DNA, 20 bp, Homo sapiens
cataatgagatgtgagcctt

SEQ ID NO: 6035162 - DNA, 15 bp, Homo sapiens
cataatgataaaata

SEQ ID NO: 6035163 - DNA, 17 bp, Homo sapiens
cataatgataaaataaa

SEQ ID NO: 6035164 - DNA, 22 bp, Homo sapiens
cataatgatactgaattgttat

SEQ ID NO: 6035165 - DNA, 14 bp, Homo sapiens
cataatgatggatt

SEQ ID NO: 6035166 - DNA, 20 bp, Homo sapiens
cataatgatggatttaacag

SEQ ID NO: 6035167 - DNA, 22 bp, Homo sapiens
cataatgcactggggtaccaca

SEQ ID NO: 6035168 - DNA, 13 bp, Homo sapiens
cataatgccactg

SEQ ID NO: 6035169 - DNA, 20 bp, Homo sapiens
cataatgctaatttaaagag

SEQ ID NO: 6035170 - DNA, 18 bp, Homo sapiens
cataatgcttaatttcta

SEQ ID NO: 6035171 - DNA, 19 bp, Homo sapiens
cataatgcttaatttctaa

SEQ ID NO: 6035172 - DNA, 15 bp, Homo sapiens
cataatgctttggaa

SEQ ID NO: 6035173 - DNA, 14 bp, Homo sapiens
cataatgctttgtt

SEQ ID NO: 6035174 - DNA, 21 bp, Homo sapiens
cataatgggccactgaaatct

SEQ ID NO: 6035175 - DNA, 17 bp, Homo sapiens
cataatggggattaatt

SEQ ID NO: 6035176 - DNA, 20 bp, Homo sapiens
ccacagctgctgttctcagg

SEQ ID NO: 6035177 - DNA, 13 bp, Homo sapiens
ccacagctggaaa

SEQ ID NO: 6035178 - DNA, 13 bp, Homo sapiens
ccacagctggcct

SEQ ID NO: 6035179 - DNA, 14 bp, Homo sapiens
ccacagctggcctg

SEQ ID NO: 6035180 - DNA, 22 bp, Homo sapiens
ccacagctggcctggtttcctc

SEQ ID NO: 6035181 - DNA, 16 bp, Homo sapiens
ccacagctggggccgg

SEQ ID NO: 6035182 - DNA, 17 bp, Homo sapiens
ccacagcttcctgaggg

SEQ ID NO: 6035183 - DNA, 19 bp, Homo sapiens
ccacagcttggggccatcg

SEQ ID NO: 6035184 - DNA, 13 bp, Homo sapiens
ccacagcttttgc

SEQ ID NO: 6035185 - DNA, 22 bp, Homo sapiens
ccacagctttttaccaagtttc

SEQ ID NO: 6035186 - DNA, 14 bp, Homo sapiens
ccacaggaaagtgt

SEQ ID NO: 6035187 - DNA, 20 bp, Homo sapiens
ccacaggaaccacaagactg

SEQ ID NO: 6035188 - DNA, 18 bp, Homo sapiens
ccacaggaacggccctgc

SEQ ID NO: 6035189 - DNA, 18 bp, Homo sapiens
ccacaggaagatgggagg

SEQ ID NO: 6035190 - DNA, 13 bp, Homo sapiens
ccacaggaagccg

SEQ ID NO: 6035191 - DNA, 23 bp, Homo sapiens
ccacaggaagccgcctagtgcag

SEQ ID NO: 6035192 - DNA, 19 bp, Homo sapiens
ccacaggaagctcagcctt

SEQ ID NO: 6035193 - DNA, 17 bp, Homo sapiens
ccacaggacacagtcag

SEQ ID NO: 6035194 - DNA, 14 bp, Homo sapiens
ccacaggaccacct

SEQ ID NO: 6035195 - DNA, 21 bp, Homo sapiens
ccacaggactgagccctctca

SEQ ID NO: 6035196 - DNA, 22 bp, Homo sapiens
ccacaggagccctgctatgaaa

SEQ ID NO: 6035197 - DNA, 16 bp, Homo sapiens
ccacaggagcgtgtac

SEQ ID NO: 6035198 - DNA, 18 bp, Homo sapiens
ccacaggagctccctttt

SEQ ID NO: 6035199 - DNA, 22 bp, Homo sapiens
ccacaggagctccctttttgaa

SEQ ID NO: 6035200 - DNA, 14 bp, Homo sapiens
ccacaggagggaga

SEQ ID NO: 6035201 - DNA, 19 bp, Homo sapiens
ccacaggagggccagcgct

SEQ ID NO: 6035202 - DNA, 20 bp, Homo sapiens
ccacaggagttgtgagccct

SEQ ID NO: 6035203 - DNA, 22 bp, Homo sapiens
ccacaggagttgtgagccctct

SEQ ID NO: 6035204 - DNA, 19 bp, Homo sapiens
ccacaggatgaactagcca

SEQ ID NO: 6035205 - DNA, 12 bp, Homo sapiens
ccacaggattcc

SEQ ID NO: 6035206 - DNA, 12 bp, Homo sapiens
ccacaggcagct

SEQ ID NO: 6035207 - DNA, 15 bp, Homo sapiens
ccacaggcagtccag

SEQ ID NO: 6035208 - DNA, 15 bp, Homo sapiens
ccacaggcataagct

SEQ ID NO: 6035209 - DNA, 19 bp, Homo sapiens
ccacaggcatctacacagc

SEQ ID NO: 6035210 - DNA, 22 bp, Homo sapiens
ccacaggcatctacacagcctg

SEQ ID NO: 6035211 - DNA, 14 bp, Homo sapiens
ccacaggccactgc

SEQ ID NO: 6035212 - DNA, 15 bp, Homo sapiens
ccacaggccctggct

SEQ ID NO: 6035213 - DNA, 22 bp, Homo sapiens
ccacaggcccttcctctccact

SEQ ID NO: 6035214 - DNA, 15 bp, Homo sapiens
ccacaggcccttggg

SEQ ID NO: 6035215 - DNA, 21 bp, Homo sapiens
ccacaggccctttcctcaggc

SEQ ID NO: 6035216 - DNA, 18 bp, Homo sapiens
ccacaggcctccctgttt

SEQ ID NO: 6035217 - DNA, 15 bp, Homo sapiens
ccacaggcctggcct

SEQ ID NO: 6035218 - DNA, 14 bp, Homo sapiens
ccacaggctgcaag

SEQ ID NO: 6035219 - DNA, 19 bp, Homo sapiens
ccacaggcttagggacagg

SEQ ID NO: 6035220 - DNA, 22 bp, Homo sapiens
ccacagggaacacattcctttg

SEQ ID NO: 6035221 - DNA, 11 bp, Homo sapiens
ccacagggacc

SEQ ID NO: 6035222 - DNA, 16 bp, Homo sapiens
ccacagggaccacatc

SEQ ID NO: 6035223 - DNA, 13 bp, Homo sapiens
ccacagggaccag

SEQ ID NO: 6035224 - DNA, 21 bp, Homo sapiens
ccacagggaccagggccaccg

SEQ ID NO: 6035225 - DNA, 19 bp, Homo sapiens
ccacagggcacctgccacc

SEQ ID NO: 6035226 - DNA, 17 bp, Homo sapiens
ccacagggccagaggga

SEQ ID NO: 6035227 - DNA, 20 bp, Homo sapiens
ccacagggccagagggagct

SEQ ID NO: 6035228 - DNA, 14 bp, Homo sapiens
ccacagggcctgac

SEQ ID NO: 6035229 - DNA, 15 bp, Homo sapiens
ccacagggcctgact

SEQ ID NO: 6035230 - DNA, 16 bp, Homo sapiens
ccacagggcctgactt

SEQ ID NO: 6035231 - DNA, 20 bp, Homo sapiens
ccacagggcctgacttttac

SEQ ID NO: 6035232 - DNA, 15 bp, Homo sapiens
ccacaggggcaggcc

SEQ ID NO: 6035233 - DNA, 22 bp, Homo sapiens
ccacaggggcaggcctgggacc

SEQ ID NO: 6035234 - DNA, 16 bp, Homo sapiens
ccacaggggccaccac

SEQ ID NO: 6035235 - DNA, 23 bp, Homo sapiens
ccacaggggctatcccttctcag

SEQ ID NO: 6035236 - DNA, 15 bp, Homo sapiens
ccacagggtctgcct

SEQ ID NO: 6035237 - DNA, 21 bp, Homo sapiens
ccacagggtgggatgagcctc

SEQ ID NO: 6035238 - DNA, 23 bp, Homo sapiens
ccacagggtgggatgagcctctc

SEQ ID NO: 6035239 - DNA, 18 bp, Homo sapiens
ccacagggttcaaaatgt

SEQ ID NO: 6035240 - DNA, 18 bp, Homo sapiens
ccacaggtcctccatcac

SEQ ID NO: 6035241 - DNA, 20 bp, Homo sapiens
ccacaggtcttcactgccca

SEQ ID NO: 6035242 - DNA, 16 bp, Homo sapiens
ccacaggtgtccccag

SEQ ID NO: 6035243 - DNA, 19 bp, Homo sapiens
ccacaggtgtccccagccc

SEQ ID NO: 6035244 - DNA, 21 bp, Homo sapiens
ccacaggtgtccccagcccac

SEQ ID NO: 6035245 - DNA, 14 bp, Homo sapiens
ccacaggtgtgagc

SEQ ID NO: 6035246 - DNA, 17 bp, Homo sapiens
ccacaggtgtgagccac

SEQ ID NO: 6035247 - DNA, 21 bp, Homo sapiens
ccacaggttctatgatttgta

SEQ ID NO: 6035248 - DNA, 12 bp, Homo sapiens
ccacagtacata

SEQ ID NO: 6035249 - DNA, 14 bp, Homo sapiens
ccacagtagcattt

SEQ ID NO: 6035250 - DNA, 15 bp, Homo sapiens
ccacagtagtcttga

SEQ ID NO: 6035251 - DNA, 16 bp, Homo sapiens
ccacagtattgttctt

SEQ ID NO: 6035252 - DNA, 16 bp, Homo sapiens
ccacagtcaaagaagg

SEQ ID NO: 6035253 - DNA, 18 bp, Homo sapiens
ccacagtcagtggagcct

SEQ ID NO: 6035254 - DNA, 23 bp, Homo sapiens
ccacagtcccccacccacctcct

SEQ ID NO: 6035255 - DNA, 15 bp, Homo sapiens
ccacagtccctcacc

SEQ ID NO: 6035256 - DNA, 15 bp, Homo sapiens
ccacagtcctcacag

SEQ ID NO: 6035257 - DNA, 17 bp, Homo sapiens
ccacagtctcccattct

SEQ ID NO: 6035258 - DNA, 18 bp, Homo sapiens
ccacagtctctccctggg

SEQ ID NO: 6035259 - DNA, 14 bp, Homo sapiens
ccacagtctctggg

SEQ ID NO: 6035260 - DNA, 14 bp, Homo sapiens
ccacagtgaaagtt

SEQ ID NO: 6035261 - DNA, 21 bp, Homo sapiens
ccacagtgactgggccctgtc

SEQ ID NO: 6035262 - DNA, 15 bp, Homo sapiens
ccacagtgccaccaa

SEQ ID NO: 6035263 - DNA, 14 bp, Homo sapiens
ccacagtgccaccc

SEQ ID NO: 6035264 - DNA, 20 bp, Homo sapiens
ccacagtgcctaataatact

SEQ ID NO: 6035265 - DNA, 14 bp, Homo sapiens
ccacagtgctcagt

SEQ ID NO: 6035266 - DNA, 17 bp, Homo sapiens
ccacagtgctcagttgt

SEQ ID NO: 6035267 - DNA, 20 bp, Homo sapiens
ccacagtgctcagttgtact

SEQ ID NO: 6035268 - DNA, 15 bp, Homo sapiens
ccacagtgctgcttc

SEQ ID NO: 6035269 - DNA, 21 bp, Homo sapiens
ccacagtggcgggcccactca

SEQ ID NO: 6035270 - DNA, 20 bp, Homo sapiens
ccacagtggggcccatggcc

SEQ ID NO: 6035271 - DNA, 23 bp, Homo sapiens
ccacagtggggcccatggcccca

SEQ ID NO: 6035272 - DNA, 24 bp, Homo sapiens
ccacagtggggcccatggccccag

SEQ ID NO: 6035273 - DNA, 17 bp, Homo sapiens
ccacagtggggctgcag

SEQ ID NO: 6035274 - DNA, 18 bp, Homo sapiens
ccacagtggggctgcagg

SEQ ID NO: 6035275 - DNA, 14 bp, Homo sapiens
ccacagtggtcagc

SEQ ID NO: 6035276 - DNA, 21 bp, Homo sapiens
ccacagtgttggcgagaggag

SEQ ID NO: 6035277 - DNA, 23 bp, Homo sapiens
ccacagtgttggcgagaggaggg

SEQ ID NO: 6035278 - DNA, 18 bp, Homo sapiens
ccacagtgttgtgcccct

SEQ ID NO: 6035279 - DNA, 19 bp, Homo sapiens
ccacagtgttgtgcccctt

SEQ ID NO: 6035280 - DNA, 17 bp, Homo sapiens
ccacagtgtttatattg

SEQ ID NO: 6035281 - DNA, 16 bp, Homo sapiens
ccacagtgtttttcct

SEQ ID NO: 6035282 - DNA, 21 bp, Homo sapiens
ccacagttctaagacccaaag

SEQ ID NO: 6035283 - DNA, 22 bp, Homo sapiens
ccacagttctgacgctgacaat

SEQ ID NO: 6035284 - DNA, 22 bp, Homo sapiens
ccacagttgccaccacctctgt

SEQ ID NO: 6035285 - DNA, 20 bp, Homo sapiens
ccacagttgctgctcctttg

SEQ ID NO: 6035286 - DNA, 17 bp, Homo sapiens
ccacagttgtcagttgt

SEQ ID NO: 6035287 - DNA, 21 bp, Homo sapiens
ccacagtttacctcaggtgtg

SEQ ID NO: 6035288 - DNA, 22 bp, Homo sapiens
ccacagtttcctcatctgtcca

SEQ ID NO: 6035289 - DNA, 21 bp, Homo sapiens
ccacagttttaataagaacag

SEQ ID NO: 6035290 - DNA, 20 bp, Homo sapiens
ccacataaaagccccagctt

SEQ ID NO: 6035291 - DNA, 12 bp, Homo sapiens
ccacataaacac

SEQ ID NO: 6035292 - DNA, 14 bp, Homo sapiens
ccacataaatgctc

SEQ ID NO: 6035293 - DNA, 15 bp, Homo sapiens
ccacataagttttct

SEQ ID NO: 6035294 - DNA, 17 bp, Homo sapiens
ccacataatttttgtac

SEQ ID NO: 6035295 - DNA, 15 bp, Homo sapiens
ccacatacactgcat

SEQ ID NO: 6035296 - DNA, 14 bp, Homo sapiens
ccacatacaggtgc

SEQ ID NO: 6035297 - DNA, 23 bp, Homo sapiens
ccacataccaggcaacctcccat

SEQ ID NO: 6035298 - DNA, 20 bp, Homo sapiens
ccacatagactttatgcaat

SEQ ID NO: 6035299 - DNA, 13 bp, Homo sapiens
ccacatagcatgc

SEQ ID NO: 6035300 - DNA, 20 bp, Homo sapiens
ccacatagcatgcttccttt

SEQ ID NO: 6035301 - DNA, 22 bp, Homo sapiens
ccacatagcatgcttcctttct

SEQ ID NO: 6035302 - DNA, 19 bp, Homo sapiens
ccacatagctcataagctg

SEQ ID NO: 6035303 - DNA, 23 bp, Homo sapiens
ccacatagtgatggttcccctgt

SEQ ID NO: 6035304 - DNA, 14 bp, Homo sapiens
ccacatataacact

SEQ ID NO: 6035305 - DNA, 22 bp, Homo sapiens
ccacatataagttgagaaggtg

SEQ ID NO: 6035306 - DNA, 15 bp, Homo sapiens
ccacatatcttacag

SEQ ID NO: 6035307 - DNA, 12 bp, Homo sapiens
ccacatatttca

SEQ ID NO: 6035308 - DNA, 14 bp, Homo sapiens
ccacatcaaacctt

SEQ ID NO: 6035309 - DNA, 19 bp, Homo sapiens
ccacatcaacattccaggg

SEQ ID NO: 6035310 - DNA, 22 bp, Homo sapiens
ccacatcaatattgtcattcct

SEQ ID NO: 6035311 - DNA, 18 bp, Homo sapiens
ccacatcagccccacagg

SEQ ID NO: 6035312 - DNA, 22 bp, Homo sapiens
ccacatcatctttatctcctgg

SEQ ID NO: 6035313 - DNA, 18 bp, Homo sapiens
ccacatccaacatttcct

SEQ ID NO: 6035314 - DNA, 23 bp, Homo sapiens
ccacatccaacatttcctcaggc

SEQ ID NO: 6035315 - DNA, 15 bp, Homo sapiens
ccacatccacacacg

SEQ ID NO: 6035316 - DNA, 12 bp, Homo sapiens
ccacatccacag

SEQ ID NO: 6035317 - DNA, 15 bp, Homo sapiens
ccacatccaccccag

SEQ ID NO: 6035318 - DNA, 16 bp, Homo sapiens
ccacatccaccccagc

SEQ ID NO: 6035319 - DNA, 18 bp, Homo sapiens
ccacatcccactggatct

SEQ ID NO: 6035320 - DNA, 19 bp, Homo sapiens
ccacatcccagcagcccaa

SEQ ID NO: 6035321 - DNA, 12 bp, Homo sapiens
ccacatcccagg

SEQ ID NO: 6035322 - DNA, 16 bp, Homo sapiens
ccacatcccatcgtct

SEQ ID NO: 6035323 - DNA, 22 bp, Homo sapiens
ccacatcccatgttgaagtaat

SEQ ID NO: 6035324 - DNA, 12 bp, Homo sapiens
ccacatccccaa

SEQ ID NO: 6035325 - DNA, 14 bp, Homo sapiens
ccacatccccagag

SEQ ID NO: 6035326 - DNA, 15 bp, Homo sapiens
ccacatccccagagc

SEQ ID NO: 6035327 - DNA, 19 bp, Homo sapiens
ccacatccccagagcccag

SEQ ID NO: 6035328 - DNA, 23 bp, Homo sapiens
ccacatccccagagcccagctct

SEQ ID NO: 6035329 - DNA, 13 bp, Homo sapiens
ccacatccccagc

SEQ ID NO: 6035330 - DNA, 14 bp, Homo sapiens
ccacatccctctct

SEQ ID NO: 6035331 - DNA, 13 bp, Homo sapiens
ccacatccctggg

SEQ ID NO: 6035332 - DNA, 14 bp, Homo sapiens
ccacatccctgggc

SEQ ID NO: 6035333 - DNA, 15 bp, Homo sapiens
ccacatccctgggcc

SEQ ID NO: 6035334 - DNA, 22 bp, Homo sapiens
ccacatccctgggcctgctgct

SEQ ID NO: 6035335 - DNA, 21 bp, Homo sapiens
ccacatccggggccagctccg

SEQ ID NO: 6035336 - DNA, 15 bp, Homo sapiens
ccacatccttctcac

SEQ ID NO: 6035337 - DNA, 16 bp, Homo sapiens
ccacatcgcagcccct

SEQ ID NO: 6035338 - DNA, 19 bp, Homo sapiens
ccacatctacgtttttggt

SEQ ID NO: 6035339 - DNA, 23 bp, Homo sapiens
ccacatctgcatcactcatggaa

SEQ ID NO: 6035340 - DNA, 14 bp, Homo sapiens
ccacatctgcctta

SEQ ID NO: 6035341 - DNA, 14 bp, Homo sapiens
ccacatctgtcctc

SEQ ID NO: 6035342 - DNA, 22 bp, Homo sapiens
ccacatctgtcctcaccctgtg

SEQ ID NO: 6035343 - DNA, 23 bp, Homo sapiens
ccacatctgtcctcaccctgtgg

SEQ ID NO: 6035344 - DNA, 14 bp, Homo sapiens
ccacatcttgaaaa

SEQ ID NO: 6035345 - DNA, 13 bp, Homo sapiens
ccacatcttgact

SEQ ID NO: 6035346 - DNA, 22 bp, Homo sapiens
ccacatcttgatctgctcagcc

SEQ ID NO: 6035347 - DNA, 23 bp, Homo sapiens
ccacatcttgatctgctcagccc

SEQ ID NO: 6035348 - DNA, 14 bp, Homo sapiens
ccacatcttgctct

SEQ ID NO: 6035349 - DNA, 16 bp, Homo sapiens
ccacatcttgctctgc

SEQ ID NO: 6035350 - DNA, 18 bp, Homo sapiens
ccacatcttgctctgcat

SEQ ID NO: 6035351 - DNA, 17 bp, Homo sapiens
ccacatcttgctctgct

SEQ ID NO: 6035352 - DNA, 13 bp, Homo sapiens
ccacatcttgtct

SEQ ID NO: 6035353 - DNA, 19 bp, Homo sapiens
ccacatcttgtcttttccc

SEQ ID NO: 6035354 - DNA, 18 bp, Homo sapiens
cataatggggattaatta

SEQ ID NO: 6035355 - DNA, 14 bp, Homo sapiens
cataatggggtcct

SEQ ID NO: 6035356 - DNA, 17 bp, Homo sapiens
cataatggtactcccaa

SEQ ID NO: 6035357 - DNA, 19 bp, Homo sapiens
cataatggttgtgaaatgt

SEQ ID NO: 6035358 - DNA, 21 bp, Homo sapiens
cataatggttgtgaaatgtaa

SEQ ID NO: 6035359 - DNA, 23 bp, Homo sapiens
cataatggttgtgaaatgtaaca

SEQ ID NO: 6035360 - DNA, 15 bp, Homo sapiens
cataatgtaactgaa

SEQ ID NO: 6035361 - DNA, 21 bp, Homo sapiens
cataatgtaactgaagcataa

SEQ ID NO: 6035362 - DNA, 21 bp, Homo sapiens
cataatgtagtgagtgtagac

SEQ ID NO: 6035363 - DNA, 12 bp, Homo sapiens
cataatgtgaaa

SEQ ID NO: 6035364 - DNA, 13 bp, Homo sapiens
cataatgtgaagt

SEQ ID NO: 6035365 - DNA, 15 bp, Homo sapiens
cataatgtgaagtgt

SEQ ID NO: 6035366 - DNA, 17 bp, Homo sapiens
cataatgtgaagtgtta

SEQ ID NO: 6035367 - DNA, 23 bp, Homo sapiens
cataatgttagtagcactgagac

SEQ ID NO: 6035368 - DNA, 14 bp, Homo sapiens
cataatgttcctta

SEQ ID NO: 6035369 - DNA, 22 bp, Homo sapiens
cataatgttgaacattcattca

SEQ ID NO: 6035370 - DNA, 15 bp, Homo sapiens
cataatgttgcttct

SEQ ID NO: 6035371 - DNA, 16 bp, Homo sapiens
cataattaaaatttat

SEQ ID NO: 6035372 - DNA, 13 bp, Homo sapiens
cataattacattc

SEQ ID NO: 6035373 - DNA, 19 bp, Homo sapiens
cataattacattcctaact

SEQ ID NO: 6035374 - DNA, 18 bp, Homo sapiens
cataattagatccattaa

SEQ ID NO: 6035375 - DNA, 21 bp, Homo sapiens
cataattatccaggaagggaa

SEQ ID NO: 6035376 - DNA, 15 bp, Homo sapiens
cataattatgaaaac

SEQ ID NO: 6035377 - DNA, 23 bp, Homo sapiens
cataattatgggaacaagtgtac

SEQ ID NO: 6035378 - DNA, 13 bp, Homo sapiens
cataattatttct

SEQ ID NO: 6035379 - DNA, 22 bp, Homo sapiens
cataattcaaagataacattgt

SEQ ID NO: 6035380 - DNA, 15 bp, Homo sapiens
cataattcaccaaaa

SEQ ID NO: 6035381 - DNA, 20 bp, Homo sapiens
cataattcaccaaaagttca

SEQ ID NO: 6035382 - DNA, 13 bp, Homo sapiens
cataattcattaa

SEQ ID NO: 6035383 - DNA, 15 bp, Homo sapiens
cataattcattaaaa

SEQ ID NO: 6035384 - DNA, 13 bp, Homo sapiens
cataattcattta

SEQ ID NO: 6035385 - DNA, 16 bp, Homo sapiens
cataattcatttaaga

SEQ ID NO: 6035386 - DNA, 23 bp, Homo sapiens
cataattccgaaacaaaactgtg

SEQ ID NO: 6035387 - DNA, 16 bp, Homo sapiens
cataattcctacagca

SEQ ID NO: 6035388 - DNA, 19 bp, Homo sapiens
cataattcctacagcacta

SEQ ID NO: 6035389 - DNA, 17 bp, Homo sapiens
cataattctgaagttat

SEQ ID NO: 6035390 - DNA, 18 bp, Homo sapiens
cataattctgaagttata

SEQ ID NO: 6035391 - DNA, 16 bp, Homo sapiens
cataattcttgtatat

SEQ ID NO: 6035392 - DNA, 17 bp, Homo sapiens
cataattgattaaaatc

SEQ ID NO: 6035393 - DNA, 13 bp, Homo sapiens
cataattgcaagg

SEQ ID NO: 6035394 - DNA, 15 bp, Homo sapiens
cataattgcatgaaa

SEQ ID NO: 6035395 - DNA, 19 bp, Homo sapiens
cataattgccaattgaaac

SEQ ID NO: 6035396 - DNA, 19 bp, Homo sapiens
cataattgctttgccaaaa

SEQ ID NO: 6035397 - DNA, 12 bp, Homo sapiens
cataattgtcaa

SEQ ID NO: 6035398 - DNA, 23 bp, Homo sapiens
cataattgtgaccaatacatttg

SEQ ID NO: 6035399 - DNA, 23 bp, Homo sapiens
cataattgtgagttaatttgata

SEQ ID NO: 6035400 - DNA, 13 bp, Homo sapiens
cataattgtggat

SEQ ID NO: 6035401 - DNA, 17 bp, Homo sapiens
cataattgtggattata

SEQ ID NO: 6035402 - DNA, 23 bp, Homo sapiens
cataattgtggattataaaaaat

SEQ ID NO: 6035403 - DNA, 13 bp, Homo sapiens
cataatttaaaaa

SEQ ID NO: 6035404 - DNA, 20 bp, Homo sapiens
cataatttaaaaatatattt

SEQ ID NO: 6035405 - DNA, 22 bp, Homo sapiens
cataatttaaaaatctccatta

SEQ ID NO: 6035406 - DNA, 19 bp, Homo sapiens
cataatttaaaataaataa

SEQ ID NO: 6035407 - DNA, 20 bp, Homo sapiens
cataatttagttgtttctag

SEQ ID NO: 6035408 - DNA, 20 bp, Homo sapiens
cataatttatacaggtcata

SEQ ID NO: 6035409 - DNA, 12 bp, Homo sapiens
cataatttatgg

SEQ ID NO: 6035410 - DNA, 19 bp, Homo sapiens
cataatttcagtgggaaat

SEQ ID NO: 6035411 - DNA, 17 bp, Homo sapiens
cataatttgcataaagg

SEQ ID NO: 6035412 - DNA, 20 bp, Homo sapiens
cataatttggtcatttggca

SEQ ID NO: 6035413 - DNA, 21 bp, Homo sapiens
cataatttgtacatatgtaaa

SEQ ID NO: 6035414 - DNA, 16 bp, Homo sapiens
cataatttgtttaaaa

SEQ ID NO: 6035415 - DNA, 19 bp, Homo sapiens
cataatttgtttaaaattc

SEQ ID NO: 6035416 - DNA, 16 bp, Homo sapiens
cataatttgtttccag

SEQ ID NO: 6035417 - DNA, 17 bp, Homo sapiens
cataattttcaaaagaa

SEQ ID NO: 6035418 - DNA, 21 bp, Homo sapiens
cataattttgtgttgtacaat

SEQ ID NO: 6035419 - DNA, 17 bp, Homo sapiens
cataatttttgtacatc

SEQ ID NO: 6035420 - DNA, 21 bp, Homo sapiens
cataatttttgtacatcccaa

SEQ ID NO: 6035421 - DNA, 17 bp, Homo sapiens
catacaaaaatatatta

SEQ ID NO: 6035422 - DNA, 17 bp, Homo sapiens
catacaaacaagcatat

SEQ ID NO: 6035423 - DNA, 14 bp, Homo sapiens
catacaaaccatga

SEQ ID NO: 6035424 - DNA, 16 bp, Homo sapiens
catacaaactctcacc

SEQ ID NO: 6035425 - DNA, 17 bp, Homo sapiens
catacaaactctcacca

SEQ ID NO: 6035426 - DNA, 11 bp, Homo sapiens
catacaaataa

SEQ ID NO: 6035427 - DNA, 19 bp, Homo sapiens
catacaaatgcatctttga

SEQ ID NO: 6035428 - DNA, 20 bp, Homo sapiens
catacaaatgcatctttgat

SEQ ID NO: 6035429 - DNA, 17 bp, Homo sapiens
catacaaatttataaag

SEQ ID NO: 6035430 - DNA, 13 bp, Homo sapiens
catacaacaaaga

SEQ ID NO: 6035431 - DNA, 16 bp, Homo sapiens
catacaacacaaagag

SEQ ID NO: 6035432 - DNA, 22 bp, Homo sapiens
catacaacagaaaccagaaaag

SEQ ID NO: 6035433 - DNA, 18 bp, Homo sapiens
catacaataaaagagctt

SEQ ID NO: 6035434 - DNA, 14 bp, Homo sapiens
catacaatgaaaag

SEQ ID NO: 6035435 - DNA, 13 bp, Homo sapiens
catacaatgtatg

SEQ ID NO: 6035436 - DNA, 18 bp, Homo sapiens
catacaatgtatgtacaa

SEQ ID NO: 6035437 - DNA, 20 bp, Homo sapiens
catacaatgtatgtacaata

SEQ ID NO: 6035438 - DNA, 13 bp, Homo sapiens
catacaatttact

SEQ ID NO: 6035439 - DNA, 17 bp, Homo sapiens
catacaatttactttta

SEQ ID NO: 6035440 - DNA, 19 bp, Homo sapiens
catacaatttacttttaat

SEQ ID NO: 6035441 - DNA, 12 bp, Homo sapiens
catacaatttgc

SEQ ID NO: 6035442 - DNA, 12 bp, Homo sapiens
catacacaacgt

SEQ ID NO: 6035443 - DNA, 10 bp, Homo sapiens
catacacaca

SEQ ID NO: 6035444 - DNA, 13 bp, Homo sapiens
catacacacacaa

SEQ ID NO: 6035445 - DNA, 20 bp, Homo sapiens
catacacacacacacacagc

SEQ ID NO: 6035446 - DNA, 22 bp, Homo sapiens
catacacacacacacacagcca

SEQ ID NO: 6035447 - DNA, 23 bp, Homo sapiens
catacacacacacacacagccac

SEQ ID NO: 6035448 - DNA, 21 bp, Homo sapiens
catacacacatgccctcctgg

SEQ ID NO: 6035449 - DNA, 17 bp, Homo sapiens
catacacacgctgcctt

SEQ ID NO: 6035450 - DNA, 19 bp, Homo sapiens
catacacacgctgccttcg

SEQ ID NO: 6035451 - DNA, 21 bp, Homo sapiens
catacacagaaatcctaacat

SEQ ID NO: 6035452 - DNA, 23 bp, Homo sapiens
catacacagaggagtgcagcctt

SEQ ID NO: 6035453 - DNA, 24 bp, Homo sapiens
catacacatccccagccagaagtt

SEQ ID NO: 6035454 - DNA, 19 bp, Homo sapiens
catacacatggtaacattg

SEQ ID NO: 6035455 - DNA, 15 bp, Homo sapiens
catacacatttttaa

SEQ ID NO: 6035456 - DNA, 14 bp, Homo sapiens
catacaccacaaaa

SEQ ID NO: 6035457 - DNA, 20 bp, Homo sapiens
catacaccagcattcctttt

SEQ ID NO: 6035458 - DNA, 20 bp, Homo sapiens
catacacctatgtcatttca

SEQ ID NO: 6035459 - DNA, 14 bp, Homo sapiens
catacacctcgtca

SEQ ID NO: 6035460 - DNA, 13 bp, Homo sapiens
catacacgaaaga

SEQ ID NO: 6035461 - DNA, 18 bp, Homo sapiens
catacacgcaaatacact

SEQ ID NO: 6035462 - DNA, 14 bp, Homo sapiens
catacactgcattc

SEQ ID NO: 6035463 - DNA, 17 bp, Homo sapiens
catacactgtgaactca

SEQ ID NO: 6035464 - DNA, 15 bp, Homo sapiens
catacacttccttct

SEQ ID NO: 6035465 - DNA, 16 bp, Homo sapiens
catacacttgtataaa

SEQ ID NO: 6035466 - DNA, 18 bp, Homo sapiens
catacacttgtataaatg

SEQ ID NO: 6035467 - DNA, 20 bp, Homo sapiens
catacactttgttgcaagat

SEQ ID NO: 6035468 - DNA, 14 bp, Homo sapiens
catacactttttct

SEQ ID NO: 6035469 - DNA, 21 bp, Homo sapiens
catacagaggatgccttttct

SEQ ID NO: 6035470 - DNA, 15 bp, Homo sapiens
catacagagtgggcc

SEQ ID NO: 6035471 - DNA, 17 bp, Homo sapiens
catacagagtgggcccc

SEQ ID NO: 6035472 - DNA, 22 bp, Homo sapiens
catacagagtgggccccgggct

SEQ ID NO: 6035473 - DNA, 20 bp, Homo sapiens
catacagatcaggcagtgtt

SEQ ID NO: 6035474 - DNA, 13 bp, Homo sapiens
catacagcctcta

SEQ ID NO: 6035475 - DNA, 21 bp, Homo sapiens
catacagctattaaaatgtaa

SEQ ID NO: 6035476 - DNA, 22 bp, Homo sapiens
catacaggggaggggcgcaccc

SEQ ID NO: 6035477 - DNA, 19 bp, Homo sapiens
catacagggtctcttcctt

SEQ ID NO: 6035478 - DNA, 12 bp, Homo sapiens
catacagtttta

SEQ ID NO: 6035479 - DNA, 13 bp, Homo sapiens
catacagttttat

SEQ ID NO: 6035480 - DNA, 13 bp, Homo sapiens
catacagttttct

SEQ ID NO: 6035481 - DNA, 13 bp, Homo sapiens
catacataaaaga

SEQ ID NO: 6035482 - DNA, 14 bp, Homo sapiens
catacataaactgt

SEQ ID NO: 6035483 - DNA, 19 bp, Homo sapiens
catacataagcagcatttc

SEQ ID NO: 6035484 - DNA, 13 bp, Homo sapiens
catacatacacat

SEQ ID NO: 6035485 - DNA, 14 bp, Homo sapiens
catacatacataca

SEQ ID NO: 6035486 - DNA, 16 bp, Homo sapiens
catacatacatacata

SEQ ID NO: 6035487 - DNA, 14 bp, Homo sapiens
catacatacatata

SEQ ID NO: 6035488 - DNA, 16 bp, Homo sapiens
catacatatatatctg

SEQ ID NO: 6035489 - DNA, 17 bp, Homo sapiens
catacatatatatctga

SEQ ID NO: 6035490 - DNA, 11 bp, Homo sapiens
catacatattt

SEQ ID NO: 6035491 - DNA, 17 bp, Homo sapiens
catacatgcaaaaagaa

SEQ ID NO: 6035492 - DNA, 19 bp, Homo sapiens
catacatgctgcgcatgtt

SEQ ID NO: 6035493 - DNA, 22 bp, Homo sapiens
catacatgtatctggtttgtca

SEQ ID NO: 6035494 - DNA, 20 bp, Homo sapiens
catacatgttgggcatgatt

SEQ ID NO: 6035495 - DNA, 21 bp, Homo sapiens
catacatgttgggcatgattc

SEQ ID NO: 6035496 - DNA, 12 bp, Homo sapiens
catacattaaaa

SEQ ID NO: 6035497 - DNA, 19 bp, Homo sapiens
catacattaaaactaggta

SEQ ID NO: 6035498 - DNA, 17 bp, Homo sapiens
catacattaaggagcag

SEQ ID NO: 6035499 - DNA, 16 bp, Homo sapiens
catacattaattaata

SEQ ID NO: 6035500 - DNA, 21 bp, Homo sapiens
catacattatttcttcccaga

SEQ ID NO: 6035501 - DNA, 23 bp, Homo sapiens
catacattatttcttcccagaat

SEQ ID NO: 6035502 - DNA, 20 bp, Homo sapiens
catacattcatactgtagaa

SEQ ID NO: 6035503 - DNA, 21 bp, Homo sapiens
catacattcttcaagatccca

SEQ ID NO: 6035504 - DNA, 22 bp, Homo sapiens
catacattgtataggccatctg

SEQ ID NO: 6035505 - DNA, 17 bp, Homo sapiens
catacatttataatgtt

SEQ ID NO: 6035506 - DNA, 23 bp, Homo sapiens
catacatttataatgtttgctat

SEQ ID NO: 6035507 - DNA, 22 bp, Homo sapiens
cataccaattccaactttcagg

SEQ ID NO: 6035508 - DNA, 23 bp, Homo sapiens
cataccacaagacatttctttct

SEQ ID NO: 6035509 - DNA, 14 bp, Homo sapiens
cataccacttttgt

SEQ ID NO: 6035510 - DNA, 15 bp, Homo sapiens
cataccacttttgtt

SEQ ID NO: 6035511 - DNA, 18 bp, Homo sapiens
cataccacttttgttctt

SEQ ID NO: 6035512 - DNA, 19 bp, Homo sapiens
cataccaggcaacctccca

SEQ ID NO: 6035513 - DNA, 19 bp, Homo sapiens
cataccagtcacctcctgc

SEQ ID NO: 6035514 - DNA, 20 bp, Homo sapiens
cataccagttcttgcaataa

SEQ ID NO: 6035515 - DNA, 13 bp, Homo sapiens
cataccagttgtt

SEQ ID NO: 6035516 - DNA, 16 bp, Homo sapiens
cataccatctgctgcc

SEQ ID NO: 6035517 - DNA, 18 bp, Homo sapiens
catacccacccccaccca

SEQ ID NO: 6035518 - DNA, 20 bp, Homo sapiens
catacccacccttacttcct

SEQ ID NO: 6035519 - DNA, 12 bp, Homo sapiens
catacccagtgt

SEQ ID NO: 6035520 - DNA, 20 bp, Homo sapiens
catacccatgcacagtacaa

SEQ ID NO: 6035521 - DNA, 16 bp, Homo sapiens
cataccccctgcccca

SEQ ID NO: 6035522 - DNA, 22 bp, Homo sapiens
catacccctgcctgggttttct

SEQ ID NO: 6035523 - DNA, 13 bp, Homo sapiens
cataccctccccc

SEQ ID NO: 6035524 - DNA, 14 bp, Homo sapiens
cataccctgacctg

SEQ ID NO: 6035525 - DNA, 21 bp, Homo sapiens
cataccgaccatcgtccagcc

SEQ ID NO: 6035526 - DNA, 16 bp, Homo sapiens
cataccgcctcgtgcc

SEQ ID NO: 6035527 - DNA, 19 bp, Homo sapiens
cataccgcctcgtgccagc

SEQ ID NO: 6035528 - DNA, 21 bp, Homo sapiens
cataccgcctcgtgccagcag

SEQ ID NO: 6035529 - DNA, 23 bp, Homo sapiens
cataccgcctcgtgccagcagcc

SEQ ID NO: 6035530 - DNA, 24 bp, Homo sapiens
cataccgcctcgtgccagcagcct

SEQ ID NO: 6035531 - DNA, 18 bp, Homo sapiens
cataccgtttggtgtctg

SEQ ID NO: 6035532 - DNA, 13 bp, Homo sapiens
ccacatgaggcca

SEQ ID NO: 6035533 - DNA, 17 bp, Homo sapiens
ccacatgaggccatctc

SEQ ID NO: 6035534 - DNA, 22 bp, Homo sapiens
ccacatgaggccatctcaggag

SEQ ID NO: 6035535 - DNA, 19 bp, Homo sapiens
ccacatgagtcccagtggg

SEQ ID NO: 6035536 - DNA, 22 bp, Homo sapiens
ccacatgagtcccagtgggagg

SEQ ID NO: 6035537 - DNA, 21 bp, Homo sapiens
ccacatgcacatgtattctgt

SEQ ID NO: 6035538 - DNA, 17 bp, Homo sapiens
ccacatgcatgtctgcc

SEQ ID NO: 6035539 - DNA, 17 bp, Homo sapiens
ccacatgccactgcctg

SEQ ID NO: 6035540 - DNA, 18 bp, Homo sapiens
ccacatgccactgcctgc

SEQ ID NO: 6035541 - DNA, 21 bp, Homo sapiens
ccacatgccactgcctgcacc

SEQ ID NO: 6035542 - DNA, 20 bp, Homo sapiens
ccacatgccatttgtactga

SEQ ID NO: 6035543 - DNA, 14 bp, Homo sapiens
ccacatgccccagg

SEQ ID NO: 6035544 - DNA, 15 bp, Homo sapiens
ccacatgccccaggc

SEQ ID NO: 6035545 - DNA, 17 bp, Homo sapiens
ccacatgccccaggctc

SEQ ID NO: 6035546 - DNA, 19 bp, Homo sapiens
ccacatgcctgcgcctgct

SEQ ID NO: 6035547 - DNA, 20 bp, Homo sapiens
ccacatgctctgcagtcctg

SEQ ID NO: 6035548 - DNA, 19 bp, Homo sapiens
ccacatgctgcctggcaca

SEQ ID NO: 6035549 - DNA, 23 bp, Homo sapiens
ccacatgctgcctggcacagacc

SEQ ID NO: 6035550 - DNA, 16 bp, Homo sapiens
ccacatggcagatgat

SEQ ID NO: 6035551 - DNA, 13 bp, Homo sapiens
ccacatggccatc

SEQ ID NO: 6035552 - DNA, 17 bp, Homo sapiens
ccacatggcttcctcct

SEQ ID NO: 6035553 - DNA, 12 bp, Homo sapiens
ccacatgggacc

SEQ ID NO: 6035554 - DNA, 14 bp, Homo sapiens
ccacatgggacctg

SEQ ID NO: 6035555 - DNA, 24 bp, Homo sapiens
ccacatgggagcagtccatgcatg

SEQ ID NO: 6035556 - DNA, 20 bp, Homo sapiens
ccacatgggaggaaggccca

SEQ ID NO: 6035557 - DNA, 12 bp, Homo sapiens
ccacatgggctg

SEQ ID NO: 6035558 - DNA, 13 bp, Homo sapiens
ccacatgggctgg

SEQ ID NO: 6035559 - DNA, 14 bp, Homo sapiens
ccacatgggctggg

SEQ ID NO: 6035560 - DNA, 20 bp, Homo sapiens
ccacatggtcttcgtccttg

SEQ ID NO: 6035561 - DNA, 22 bp, Homo sapiens
ccacatggtgtctcccaacatg

SEQ ID NO: 6035562 - DNA, 17 bp, Homo sapiens
ccacatggtgtggccat

SEQ ID NO: 6035563 - DNA, 20 bp, Homo sapiens
ccacatgtacagacatacat

SEQ ID NO: 6035564 - DNA, 14 bp, Homo sapiens
ccacatgtacataa

SEQ ID NO: 6035565 - DNA, 12 bp, Homo sapiens
ccacatgtccca

SEQ ID NO: 6035566 - DNA, 16 bp, Homo sapiens
ccacatgtcccagatc

SEQ ID NO: 6035567 - DNA, 15 bp, Homo sapiens
ccacatgtgacacat

SEQ ID NO: 6035568 - DNA, 17 bp, Homo sapiens
ccacatgtgtccatccc

SEQ ID NO: 6035569 - DNA, 13 bp, Homo sapiens
ccacattaaagaa

SEQ ID NO: 6035570 - DNA, 20 bp, Homo sapiens
ccacattaaagaagacctga

SEQ ID NO: 6035571 - DNA, 14 bp, Homo sapiens
ccacattagaactt

SEQ ID NO: 6035572 - DNA, 21 bp, Homo sapiens
ccacattcccatgaatatcaa

SEQ ID NO: 6035573 - DNA, 14 bp, Homo sapiens
ccacattctgctgc

SEQ ID NO: 6035574 - DNA, 16 bp, Homo sapiens
ccacattctgctgccc

SEQ ID NO: 6035575 - DNA, 21 bp, Homo sapiens
ccacattctgctgcccccaga

SEQ ID NO: 6035576 - DNA, 22 bp, Homo sapiens
ccacattctgctgcccccagac

SEQ ID NO: 6035577 - DNA, 17 bp, Homo sapiens
ccacattgatttttcta

SEQ ID NO: 6035578 - DNA, 15 bp, Homo sapiens
ccacattgcccacac

SEQ ID NO: 6035579 - DNA, 14 bp, Homo sapiens
ccacattgcctcat

SEQ ID NO: 6035580 - DNA, 13 bp, Homo sapiens
ccacattgctggc

SEQ ID NO: 6035581 - DNA, 17 bp, Homo sapiens
ccacattgctggctgcc

SEQ ID NO: 6035582 - DNA, 14 bp, Homo sapiens
ccacattggaagag

SEQ ID NO: 6035583 - DNA, 22 bp, Homo sapiens
ccacattgggcagcgcccttcc

SEQ ID NO: 6035584 - DNA, 22 bp, Homo sapiens
ccacattgtacttttttttact

SEQ ID NO: 6035585 - DNA, 16 bp, Homo sapiens
ccacatttagtcctgt

SEQ ID NO: 6035586 - DNA, 17 bp, Homo sapiens
ccacatttagtctcttt

SEQ ID NO: 6035587 - DNA, 23 bp, Homo sapiens
ccacatttagtctctttattcct

SEQ ID NO: 6035588 - DNA, 14 bp, Homo sapiens
ccacatttctaaaa

SEQ ID NO: 6035589 - DNA, 15 bp, Homo sapiens
ccacatttctaaaat

SEQ ID NO: 6035590 - DNA, 16 bp, Homo sapiens
ccacatttgggctcag

SEQ ID NO: 6035591 - DNA, 17 bp, Homo sapiens
ccacatttgtgccgaca

SEQ ID NO: 6035592 - DNA, 13 bp, Homo sapiens
ccacattttaaca

SEQ ID NO: 6035593 - DNA, 14 bp, Homo sapiens
ccacattttaacag

SEQ ID NO: 6035594 - DNA, 16 bp, Homo sapiens
ccacattttatattta

SEQ ID NO: 6035595 - DNA, 13 bp, Homo sapiens
ccacatttttcca

SEQ ID NO: 6035596 - DNA, 20 bp, Homo sapiens
ccacatttttgcacagatta

SEQ ID NO: 6035597 - DNA, 14 bp, Homo sapiens
ccaccaaaaacaaa

SEQ ID NO: 6035598 - DNA, 16 bp, Homo sapiens
ccaccaaaaactgggt

SEQ ID NO: 6035599 - DNA, 13 bp, Homo sapiens
ccaccaaacttta

SEQ ID NO: 6035600 - DNA, 12 bp, Homo sapiens
ccaccaaagctg

SEQ ID NO: 6035601 - DNA, 14 bp, Homo sapiens
ccaccaaagctgcc

SEQ ID NO: 6035602 - DNA, 18 bp, Homo sapiens
ccaccaaagctgcccact

SEQ ID NO: 6035603 - DNA, 20 bp, Homo sapiens
ccaccaaaggccagggtcac

SEQ ID NO: 6035604 - DNA, 20 bp, Homo sapiens
ccaccaaatacaattcaaat

SEQ ID NO: 6035605 - DNA, 16 bp, Homo sapiens
ccaccaaatctgtcta

SEQ ID NO: 6035606 - DNA, 15 bp, Homo sapiens
ccaccaacacacagg

SEQ ID NO: 6035607 - DNA, 13 bp, Homo sapiens
ccaccaaccctca

SEQ ID NO: 6035608 - DNA, 15 bp, Homo sapiens
ccaccaaccctcagg

SEQ ID NO: 6035609 - DNA, 18 bp, Homo sapiens
ccaccaaccctcagggca

SEQ ID NO: 6035610 - DNA, 22 bp, Homo sapiens
ccaccaactctctctgccccca

SEQ ID NO: 6035611 - DNA, 20 bp, Homo sapiens
ccaccaactttttccaagtc

SEQ ID NO: 6035612 - DNA, 13 bp, Homo sapiens
ccaccaagccttg

SEQ ID NO: 6035613 - DNA, 14 bp, Homo sapiens
ccaccaagccttga

SEQ ID NO: 6035614 - DNA, 13 bp, Homo sapiens
ccaccaaggctgc

SEQ ID NO: 6035615 - DNA, 21 bp, Homo sapiens
ccaccaaggctgcctgcccca

SEQ ID NO: 6035616 - DNA, 15 bp, Homo sapiens
ccaccaagggcctca

SEQ ID NO: 6035617 - DNA, 19 bp, Homo sapiens
ccaccaagggtatctgctg

SEQ ID NO: 6035618 - DNA, 19 bp, Homo sapiens
ccaccaaggtctcacactc

SEQ ID NO: 6035619 - DNA, 20 bp, Homo sapiens
ccaccaagtattaaactgta

SEQ ID NO: 6035620 - DNA, 11 bp, Homo sapiens
ccaccaataaa

SEQ ID NO: 6035621 - DNA, 21 bp, Homo sapiens
ccaccaataaatcagaccatg

SEQ ID NO: 6035622 - DNA, 17 bp, Homo sapiens
ccaccaatcctcaccta

SEQ ID NO: 6035623 - DNA, 15 bp, Homo sapiens
ccaccaatctgccct

SEQ ID NO: 6035624 - DNA, 16 bp, Homo sapiens
ccaccaatctgccctt

SEQ ID NO: 6035625 - DNA, 22 bp, Homo sapiens
ccaccacacacacccttcccca

SEQ ID NO: 6035626 - DNA, 13 bp, Homo sapiens
ccaccacaccaaa

SEQ ID NO: 6035627 - DNA, 13 bp, Homo sapiens
ccaccacactccc

SEQ ID NO: 6035628 - DNA, 13 bp, Homo sapiens
ccaccacaggcat

SEQ ID NO: 6035629 - DNA, 15 bp, Homo sapiens
ccaccacatctgcca

SEQ ID NO: 6035630 - DNA, 17 bp, Homo sapiens
ccaccaccaattgccaa

SEQ ID NO: 6035631 - DNA, 15 bp, Homo sapiens
ccaccaccactgtcc

SEQ ID NO: 6035632 - DNA, 19 bp, Homo sapiens
ccaccacccaacctgtcct

SEQ ID NO: 6035633 - DNA, 20 bp, Homo sapiens
ccaccacccaacctgtcctt

SEQ ID NO: 6035634 - DNA, 12 bp, Homo sapiens
ccaccaccccat

SEQ ID NO: 6035635 - DNA, 16 bp, Homo sapiens
ccaccaccccccactc

SEQ ID NO: 6035636 - DNA, 18 bp, Homo sapiens
ccaccacccgaaatgcca

SEQ ID NO: 6035637 - DNA, 18 bp, Homo sapiens
ccaccaccctcaggtgcc

SEQ ID NO: 6035638 - DNA, 22 bp, Homo sapiens
ccaccaccctcccaccatgcgc

SEQ ID NO: 6035639 - DNA, 13 bp, Homo sapiens
ccaccaccctgag

SEQ ID NO: 6035640 - DNA, 15 bp, Homo sapiens
ccaccaccctgtctt

SEQ ID NO: 6035641 - DNA, 21 bp, Homo sapiens
ccaccaccctgtcttcctctg

SEQ ID NO: 6035642 - DNA, 22 bp, Homo sapiens
ccaccaccctgtcttcctctgc

SEQ ID NO: 6035643 - DNA, 20 bp, Homo sapiens
ccaccaccctttgctgactc

SEQ ID NO: 6035644 - DNA, 18 bp, Homo sapiens
ccaccaccgcccgtctgt

SEQ ID NO: 6035645 - DNA, 18 bp, Homo sapiens
ccaccacctaggccactc

SEQ ID NO: 6035646 - DNA, 20 bp, Homo sapiens
ccaccacctaggccactcct

SEQ ID NO: 6035647 - DNA, 21 bp, Homo sapiens
ccaccacctaggccactcctc

SEQ ID NO: 6035648 - DNA, 22 bp, Homo sapiens
ccaccacctaggccactcctcc

SEQ ID NO: 6035649 - DNA, 14 bp, Homo sapiens
ccaccacctctgtg

SEQ ID NO: 6035650 - DNA, 15 bp, Homo sapiens
ccaccacctctgtgg

SEQ ID NO: 6035651 - DNA, 15 bp, Homo sapiens
ccaccacctttggct

SEQ ID NO: 6035652 - DNA, 13 bp, Homo sapiens
ccaccacgcagcc

SEQ ID NO: 6035653 - DNA, 16 bp, Homo sapiens
ccaccacgtctgccag

SEQ ID NO: 6035654 - DNA, 17 bp, Homo sapiens
ccaccacgtctgccagg

SEQ ID NO: 6035655 - DNA, 18 bp, Homo sapiens
ccaccacgtctgccaggc

SEQ ID NO: 6035656 - DNA, 22 bp, Homo sapiens
ccaccacgtctgccaggcccat

SEQ ID NO: 6035657 - DNA, 15 bp, Homo sapiens
ccaccactaaaaaac

SEQ ID NO: 6035658 - DNA, 14 bp, Homo sapiens
ccaccactagagct

SEQ ID NO: 6035659 - DNA, 12 bp, Homo sapiens
ccaccactcagg

SEQ ID NO: 6035660 - DNA, 14 bp, Homo sapiens
ccaccactcaggcc

SEQ ID NO: 6035661 - DNA, 16 bp, Homo sapiens
ccaccactcaggccac

SEQ ID NO: 6035662 - DNA, 15 bp, Homo sapiens
ccaccactccactcc

SEQ ID NO: 6035663 - DNA, 16 bp, Homo sapiens
ccaccactcctgcctg

SEQ ID NO: 6035664 - DNA, 18 bp, Homo sapiens
ccaccactcctgcctgcc

SEQ ID NO: 6035665 - DNA, 14 bp, Homo sapiens
ccaccactgtgtcc

SEQ ID NO: 6035666 - DNA, 16 bp, Homo sapiens
ccaccactgtgtccca

SEQ ID NO: 6035667 - DNA, 18 bp, Homo sapiens
ccaccactgtgtcccagt

SEQ ID NO: 6035668 - DNA, 19 bp, Homo sapiens
ccaccactgtgtcccagtg

SEQ ID NO: 6035669 - DNA, 21 bp, Homo sapiens
ccaccactgtgtcccagtgtc

SEQ ID NO: 6035670 - DNA, 15 bp, Homo sapiens
ccaccacttcagggg

SEQ ID NO: 6035671 - DNA, 13 bp, Homo sapiens
ccaccacttgatg

SEQ ID NO: 6035672 - DNA, 21 bp, Homo sapiens
ccaccagaacgcaccccactg

SEQ ID NO: 6035673 - DNA, 12 bp, Homo sapiens
ccaccagaagcc

SEQ ID NO: 6035674 - DNA, 13 bp, Homo sapiens
ccaccagaagccc

SEQ ID NO: 6035675 - DNA, 14 bp, Homo sapiens
ccaccagaagccca

SEQ ID NO: 6035676 - DNA, 16 bp, Homo sapiens
ccaccagaagcccaga

SEQ ID NO: 6035677 - DNA, 12 bp, Homo sapiens
ccaccagaccca

SEQ ID NO: 6035678 - DNA, 17 bp, Homo sapiens
ccaccagacccacctgg

SEQ ID NO: 6035679 - DNA, 20 bp, Homo sapiens
ccaccagacccacctggagc

SEQ ID NO: 6035680 - DNA, 23 bp, Homo sapiens
ccaccagactgacaaatgtgtat

SEQ ID NO: 6035681 - DNA, 22 bp, Homo sapiens
ccaccagagaccgtcctcaccc

SEQ ID NO: 6035682 - DNA, 14 bp, Homo sapiens
ccaccagagcaggg

SEQ ID NO: 6035683 - DNA, 19 bp, Homo sapiens
ccaccagagcaggggctgc

SEQ ID NO: 6035684 - DNA, 20 bp, Homo sapiens
ccaccagagcaggggctgct

SEQ ID NO: 6035685 - DNA, 12 bp, Homo sapiens
ccaccagagctg

SEQ ID NO: 6035686 - DNA, 18 bp, Homo sapiens
ccaccagatagcagaggg

SEQ ID NO: 6035687 - DNA, 20 bp, Homo sapiens
ccaccagcaaggggaccccg

SEQ ID NO: 6035688 - DNA, 17 bp, Homo sapiens
ccaccagcaatgccctg

SEQ ID NO: 6035689 - DNA, 12 bp, Homo sapiens
ccaccagcagaa

SEQ ID NO: 6035690 - DNA, 16 bp, Homo sapiens
ccaccagcagcacaat

SEQ ID NO: 6035691 - DNA, 15 bp, Homo sapiens
ccaccagcaggcagg

SEQ ID NO: 6035692 - DNA, 22 bp, Homo sapiens
ccaccagcaggcaggtggactg

SEQ ID NO: 6035693 - DNA, 17 bp, Homo sapiens
ccaccagccacctcttg

SEQ ID NO: 6035694 - DNA, 13 bp, Homo sapiens
ccaccagccatcc

SEQ ID NO: 6035695 - DNA, 20 bp, Homo sapiens
ccaccagccatcctccctcc

SEQ ID NO: 6035696 - DNA, 13 bp, Homo sapiens
ccaccagcccctc

SEQ ID NO: 6035697 - DNA, 20 bp, Homo sapiens
ccaccagccgccccagcccc

SEQ ID NO: 6035698 - DNA, 21 bp, Homo sapiens
ccaccagccgccccagcccct

SEQ ID NO: 6035699 - DNA, 13 bp, Homo sapiens
ccaccagcctaag

SEQ ID NO: 6035700 - DNA, 11 bp, Homo sapiens
ccaccagcctg

SEQ ID NO: 6035701 - DNA, 16 bp, Homo sapiens
ccaccagcctgctgac

SEQ ID NO: 6035702 - DNA, 12 bp, Homo sapiens
ccaccagccttg

SEQ ID NO: 6035703 - DNA, 16 bp, Homo sapiens
ccaccagccttgctct

SEQ ID NO: 6035704 - DNA, 18 bp, Homo sapiens
ccaccagccttgctctct

SEQ ID NO: 6035705 - DNA, 22 bp, Homo sapiens
ccaccagcgaactctcagaaat

SEQ ID NO: 6035706 - DNA, 13 bp, Homo sapiens
ccaccagcgcccc

SEQ ID NO: 6035707 - DNA, 15 bp, Homo sapiens
ccaccagcgccccca

SEQ ID NO: 6035708 - DNA, 17 bp, Homo sapiens
ccaccagcgcccccact

SEQ ID NO: 6035709 - DNA, 21 bp, Homo sapiens
ccaccagcgcccccactcctc

SEQ ID NO: 6035710 - DNA, 21 bp, Homo sapiens
ccaccagcggccttgaagagg

SEQ ID NO: 6035711 - DNA, 11 bp, Homo sapiens
ccaccagctcc

SEQ ID NO: 6035712 - DNA, 12 bp, Homo sapiens
ccaccagctcca

SEQ ID NO: 6035713 - DNA, 13 bp, Homo sapiens
ccaccagctccac

SEQ ID NO: 6035714 - DNA, 22 bp, Homo sapiens
cataccgtttggtgtctgatgt

SEQ ID NO: 6035715 - DNA, 21 bp, Homo sapiens
catacctcctatgggttgtca

SEQ ID NO: 6035716 - DNA, 15 bp, Homo sapiens
catacctctctctat

SEQ ID NO: 6035717 - DNA, 23 bp, Homo sapiens
catacctctctctatatatacat

SEQ ID NO: 6035718 - DNA, 13 bp, Homo sapiens
catacctctgacc

SEQ ID NO: 6035719 - DNA, 15 bp, Homo sapiens
catacctgcccctgc

SEQ ID NO: 6035720 - DNA, 17 bp, Homo sapiens
catacctgcccctgcct

SEQ ID NO: 6035721 - DNA, 19 bp, Homo sapiens
catacctgtgaatatagat

SEQ ID NO: 6035722 - DNA, 16 bp, Homo sapiens
cataccttccttccct

SEQ ID NO: 6035723 - DNA, 15 bp, Homo sapiens
cataccttctcccag

SEQ ID NO: 6035724 - DNA, 16 bp, Homo sapiens
cataccttctcccagg

SEQ ID NO: 6035725 - DNA, 18 bp, Homo sapiens
cataccttctcccaggcc

SEQ ID NO: 6035726 - DNA, 19 bp, Homo sapiens
cataccttctcccaggcct

SEQ ID NO: 6035727 - DNA, 16 bp, Homo sapiens
cataccttggactgac

SEQ ID NO: 6035728 - DNA, 14 bp, Homo sapiens
cataccttgtgcat

SEQ ID NO: 6035729 - DNA, 19 bp, Homo sapiens
cataccttgtgcattgtgg

SEQ ID NO: 6035730 - DNA, 23 bp, Homo sapiens
cataccttgtttttaatctcctg

SEQ ID NO: 6035731 - DNA, 14 bp, Homo sapiens
cataccttttctct

SEQ ID NO: 6035732 - DNA, 18 bp, Homo sapiens
cataccttttctcttttc

SEQ ID NO: 6035733 - DNA, 22 bp, Homo sapiens
catacgaaaaagtgattgtgaa

SEQ ID NO: 6035734 - DNA, 14 bp, Homo sapiens
catacgatttaagg

SEQ ID NO: 6035735 - DNA, 19 bp, Homo sapiens
catacgcaattgtatatat

SEQ ID NO: 6035736 - DNA, 18 bp, Homo sapiens
catacgcaccacatctct

SEQ ID NO: 6035737 - DNA, 21 bp, Homo sapiens
catacgcatcccatctctccc

SEQ ID NO: 6035738 - DNA, 16 bp, Homo sapiens
catacgggaagtttat

SEQ ID NO: 6035739 - DNA, 23 bp, Homo sapiens
catacggtcaggtttaacatttg

SEQ ID NO: 6035740 - DNA, 13 bp, Homo sapiens
catacgtacacat

SEQ ID NO: 6035741 - DNA, 16 bp, Homo sapiens
catacgtacacatttt

SEQ ID NO: 6035742 - DNA, 21 bp, Homo sapiens
catacgtctttagatgctatt

SEQ ID NO: 6035743 - DNA, 15 bp, Homo sapiens
catacgtgcacaggg

SEQ ID NO: 6035744 - DNA, 22 bp, Homo sapiens
catacgtgcccatttcacacaa

SEQ ID NO: 6035745 - DNA, 15 bp, Homo sapiens
catactaataaatat

SEQ ID NO: 6035746 - DNA, 19 bp, Homo sapiens
catactaataaatataatt

SEQ ID NO: 6035747 - DNA, 20 bp, Homo sapiens
catactaataaatataattt

SEQ ID NO: 6035748 - DNA, 21 bp, Homo sapiens
catactaataaatataattta

SEQ ID NO: 6035749 - DNA, 14 bp, Homo sapiens
catactaatgatga

SEQ ID NO: 6035750 - DNA, 23 bp, Homo sapiens
catactacattgagtagacacat

SEQ ID NO: 6035751 - DNA, 18 bp, Homo sapiens
catactacatttgaacag

SEQ ID NO: 6035752 - DNA, 16 bp, Homo sapiens
catactacctagaagt

SEQ ID NO: 6035753 - DNA, 18 bp, Homo sapiens
catactagaatcagatac

SEQ ID NO: 6035754 - DNA, 16 bp, Homo sapiens
catactaggtgccttt

SEQ ID NO: 6035755 - DNA, 19 bp, Homo sapiens
catactatttagattttct

SEQ ID NO: 6035756 - DNA, 23 bp, Homo sapiens
catactcaaagaggccagtactt

SEQ ID NO: 6035757 - DNA, 14 bp, Homo sapiens
catactcaaggtga

SEQ ID NO: 6035758 - DNA, 23 bp, Homo sapiens
catactcaatgcatatatgaaaa

SEQ ID NO: 6035759 - DNA, 18 bp, Homo sapiens
catactcagcctgctgcc

SEQ ID NO: 6035760 - DNA, 23 bp, Homo sapiens
catactccatcagttagagctga

SEQ ID NO: 6035761 - DNA, 18 bp, Homo sapiens
catactcccatctgtgaa

SEQ ID NO: 6035762 - DNA, 20 bp, Homo sapiens
catactcccatctgtgaaag

SEQ ID NO: 6035763 - DNA, 20 bp, Homo sapiens
catactccccaatttagtct

SEQ ID NO: 6035764 - DNA, 16 bp, Homo sapiens
catactcctgggctca

SEQ ID NO: 6035765 - DNA, 20 bp, Homo sapiens
catactccttccatcaaata

SEQ ID NO: 6035766 - DNA, 16 bp, Homo sapiens
catactccttgcttcc

SEQ ID NO: 6035767 - DNA, 23 bp, Homo sapiens
catactccttttggctggggagt

SEQ ID NO: 6035768 - DNA, 16 bp, Homo sapiens
catactcgagtctgag

SEQ ID NO: 6035769 - DNA, 18 bp, Homo sapiens
catactcgagtctgaggc

SEQ ID NO: 6035770 - DNA, 22 bp, Homo sapiens
catactctagattttgttttgc

SEQ ID NO: 6035771 - DNA, 13 bp, Homo sapiens
catactctccagg

SEQ ID NO: 6035772 - DNA, 19 bp, Homo sapiens
catactctgtgtaatctct

SEQ ID NO: 6035773 - DNA, 20 bp, Homo sapiens
catactctgttgcctcctct

SEQ ID NO: 6035774 - DNA, 22 bp, Homo sapiens
catactctgttgcctcctctct

SEQ ID NO: 6035775 - DNA, 15 bp, Homo sapiens
catactgaaaatcca

SEQ ID NO: 6035776 - DNA, 22 bp, Homo sapiens
catactgagaatctaggccacc

SEQ ID NO: 6035777 - DNA, 16 bp, Homo sapiens
catactgagcctgcca

SEQ ID NO: 6035778 - DNA, 15 bp, Homo sapiens
catactgagggacca

SEQ ID NO: 6035779 - DNA, 20 bp, Homo sapiens
catactgagggaccaactgg

SEQ ID NO: 6035780 - DNA, 17 bp, Homo sapiens
catactgatccctttcc

SEQ ID NO: 6035781 - DNA, 21 bp, Homo sapiens
catactgatgagacaacacac

SEQ ID NO: 6035782 - DNA, 22 bp, Homo sapiens
catactgatgagacaacacaca

SEQ ID NO: 6035783 - DNA, 23 bp, Homo sapiens
catactgatgagacaacacacac

SEQ ID NO: 6035784 - DNA, 22 bp, Homo sapiens
catactgccttgtttaatgtta

SEQ ID NO: 6035785 - DNA, 18 bp, Homo sapiens
catactggcctcgcctgg

SEQ ID NO: 6035786 - DNA, 19 bp, Homo sapiens
catactggcctcgcctggc

SEQ ID NO: 6035787 - DNA, 20 bp, Homo sapiens
catactggcctcgcctggcc

SEQ ID NO: 6035788 - DNA, 13 bp, Homo sapiens
catactggcctct

SEQ ID NO: 6035789 - DNA, 14 bp, Homo sapiens
catactggcctctg

SEQ ID NO: 6035790 - DNA, 16 bp, Homo sapiens
catactggcctctgtg

SEQ ID NO: 6035791 - DNA, 17 bp, Homo sapiens
catactggcctctgtga

SEQ ID NO: 6035792 - DNA, 18 bp, Homo sapiens
catactggcctctgtgat

SEQ ID NO: 6035793 - DNA, 23 bp, Homo sapiens
catactggcctctgtgattacat

SEQ ID NO: 6035794 - DNA, 15 bp, Homo sapiens
catactggcctggac

SEQ ID NO: 6035795 - DNA, 19 bp, Homo sapiens
catactgtaaggaaatgtt

SEQ ID NO: 6035796 - DNA, 11 bp, Homo sapiens
catactgtaca

SEQ ID NO: 6035797 - DNA, 14 bp, Homo sapiens
catactgtacacat

SEQ ID NO: 6035798 - DNA, 17 bp, Homo sapiens
catactgtatttttact

SEQ ID NO: 6035799 - DNA, 17 bp, Homo sapiens
catactgtcatataatg

SEQ ID NO: 6035800 - DNA, 14 bp, Homo sapiens
catactgtctctgg

SEQ ID NO: 6035801 - DNA, 15 bp, Homo sapiens
catactgtctgggat

SEQ ID NO: 6035802 - DNA, 11 bp, Homo sapiens
catactgtgta

SEQ ID NO: 6035803 - DNA, 17 bp, Homo sapiens
catactgtgtatgtttt

SEQ ID NO: 6035804 - DNA, 22 bp, Homo sapiens
catactgttgatccatctcagt

SEQ ID NO: 6035805 - DNA, 18 bp, Homo sapiens
catactgtttaatattta

SEQ ID NO: 6035806 - DNA, 13 bp, Homo sapiens
catacttaaaata

SEQ ID NO: 6035807 - DNA, 15 bp, Homo sapiens
catacttaagcaaaa

SEQ ID NO: 6035808 - DNA, 14 bp, Homo sapiens
catacttacatttc

SEQ ID NO: 6035809 - DNA, 15 bp, Homo sapiens
catacttacatttca

SEQ ID NO: 6035810 - DNA, 13 bp, Homo sapiens
catacttatctct

SEQ ID NO: 6035811 - DNA, 18 bp, Homo sapiens
catacttcaaaaataatg

SEQ ID NO: 6035812 - DNA, 22 bp, Homo sapiens
catacttcaaaagtattttcct

SEQ ID NO: 6035813 - DNA, 18 bp, Homo sapiens
catacttcatgaaatcct

SEQ ID NO: 6035814 - DNA, 15 bp, Homo sapiens
catacttcctggatt

SEQ ID NO: 6035815 - DNA, 14 bp, Homo sapiens
catacttcctggga

SEQ ID NO: 6035816 - DNA, 22 bp, Homo sapiens
catacttcctgggatgatgtgt

SEQ ID NO: 6035817 - DNA, 14 bp, Homo sapiens
catacttctctcag

SEQ ID NO: 6035818 - DNA, 20 bp, Homo sapiens
catacttcttacttgtctgt

SEQ ID NO: 6035819 - DNA, 13 bp, Homo sapiens
catacttctttca

SEQ ID NO: 6035820 - DNA, 20 bp, Homo sapiens
catacttgaacgttttctaa

SEQ ID NO: 6035821 - DNA, 22 bp, Homo sapiens
catacttgaacgttttctaatt

SEQ ID NO: 6035822 - DNA, 14 bp, Homo sapiens
catacttgaagggc

SEQ ID NO: 6035823 - DNA, 13 bp, Homo sapiens
catacttgtgaaa

SEQ ID NO: 6035824 - DNA, 14 bp, Homo sapiens
catacttgttctgt

SEQ ID NO: 6035825 - DNA, 12 bp, Homo sapiens
catactttattg

SEQ ID NO: 6035826 - DNA, 13 bp, Homo sapiens
catactttccaac

SEQ ID NO: 6035827 - DNA, 15 bp, Homo sapiens
catactttctctcta

SEQ ID NO: 6035828 - DNA, 17 bp, Homo sapiens
catactttgacaaggaa

SEQ ID NO: 6035829 - DNA, 18 bp, Homo sapiens
catactttgacaaggaaa

SEQ ID NO: 6035830 - DNA, 14 bp, Homo sapiens
catactttggatga

SEQ ID NO: 6035831 - DNA, 16 bp, Homo sapiens
catactttggctgtga

SEQ ID NO: 6035832 - DNA, 15 bp, Homo sapiens
catactttgtaaata

SEQ ID NO: 6035833 - DNA, 12 bp, Homo sapiens
catactttgtct

SEQ ID NO: 6035834 - DNA, 14 bp, Homo sapiens
catacttttcaaag

SEQ ID NO: 6035835 - DNA, 12 bp, Homo sapiens
catacttttgca

SEQ ID NO: 6035836 - DNA, 15 bp, Homo sapiens
catacttttggctcc

SEQ ID NO: 6035837 - DNA, 15 bp, Homo sapiens
catactttttaaaaa

SEQ ID NO: 6035838 - DNA, 17 bp, Homo sapiens
catactttttaaaaaac

SEQ ID NO: 6035839 - DNA, 16 bp, Homo sapiens
catactttttaaatgt

SEQ ID NO: 6035840 - DNA, 20 bp, Homo sapiens
catactttttaaatgtaaag

SEQ ID NO: 6035841 - DNA, 15 bp, Homo sapiens
catactttttcaaga

SEQ ID NO: 6035842 - DNA, 16 bp, Homo sapiens
catactttttgggttt

SEQ ID NO: 6035843 - DNA, 13 bp, Homo sapiens
catagaaaaatgt

SEQ ID NO: 6035844 - DNA, 19 bp, Homo sapiens
catagaaaacactacagtg

SEQ ID NO: 6035845 - DNA, 19 bp, Homo sapiens
catagaaaacttgacatgt

SEQ ID NO: 6035846 - DNA, 15 bp, Homo sapiens
catagaaacatgaca

SEQ ID NO: 6035847 - DNA, 15 bp, Homo sapiens
catagaaactgagga

SEQ ID NO: 6035848 - DNA, 22 bp, Homo sapiens
catagaaactgaggagtagctg

SEQ ID NO: 6035849 - DNA, 12 bp, Homo sapiens
catagaacactt

SEQ ID NO: 6035850 - DNA, 16 bp, Homo sapiens
catagaactgggtaaa

SEQ ID NO: 6035851 - DNA, 18 bp, Homo sapiens
catagaagaacagcagat

SEQ ID NO: 6035852 - DNA, 17 bp, Homo sapiens
catagaaggaagtgtgt

SEQ ID NO: 6035853 - DNA, 21 bp, Homo sapiens
catagaaggaagtgtgtttgc

SEQ ID NO: 6035854 - DNA, 15 bp, Homo sapiens
catagaaggagagcc

SEQ ID NO: 6035855 - DNA, 14 bp, Homo sapiens
catagaaggcaggt

SEQ ID NO: 6035856 - DNA, 14 bp, Homo sapiens
catagaataatgaa

SEQ ID NO: 6035857 - DNA, 14 bp, Homo sapiens
catagaatagcatg

SEQ ID NO: 6035858 - DNA, 20 bp, Homo sapiens
catagaattgcaatctataa

SEQ ID NO: 6035859 - DNA, 17 bp, Homo sapiens
catagacaaaggcctta

SEQ ID NO: 6035860 - DNA, 13 bp, Homo sapiens
catagacacagta

SEQ ID NO: 6035861 - DNA, 22 bp, Homo sapiens
catagacagatgtggacatgca

SEQ ID NO: 6035862 - DNA, 22 bp, Homo sapiens
catagaccctctttcttgtttg

SEQ ID NO: 6035863 - DNA, 21 bp, Homo sapiens
catagaccctgaggccctggg

SEQ ID NO: 6035864 - DNA, 16 bp, Homo sapiens
catagacctaactgtg

SEQ ID NO: 6035865 - DNA, 17 bp, Homo sapiens
catagaccttttcattt

SEQ ID NO: 6035866 - DNA, 21 bp, Homo sapiens
catagactgcaaaagaataat

SEQ ID NO: 6035867 - DNA, 18 bp, Homo sapiens
catagacttgaataactc

SEQ ID NO: 6035868 - DNA, 13 bp, Homo sapiens
catagagaacaaa

SEQ ID NO: 6035869 - DNA, 20 bp, Homo sapiens
catagagaactgtcaccctg

SEQ ID NO: 6035870 - DNA, 22 bp, Homo sapiens
catagagaactgtcaccctgag

SEQ ID NO: 6035871 - DNA, 23 bp, Homo sapiens
catagagaactgtcaccctgagg

SEQ ID NO: 6035872 - DNA, 22 bp, Homo sapiens
catagagaatacacatataaaa

SEQ ID NO: 6035873 - DNA, 21 bp, Homo sapiens
catagagagagacagttttcc

SEQ ID NO: 6035874 - DNA, 19 bp, Homo sapiens
catagagagggagaagaag

SEQ ID NO: 6035875 - DNA, 24 bp, Homo sapiens
catagagatatgcacacacagatg

SEQ ID NO: 6035876 - DNA, 17 bp, Homo sapiens
catagagatatttaaaa

SEQ ID NO: 6035877 - DNA, 20 bp, Homo sapiens
catagagcaatgttggtttt

SEQ ID NO: 6035878 - DNA, 20 bp, Homo sapiens
catagagcagtgcacatctg

SEQ ID NO: 6035879 - DNA, 21 bp, Homo sapiens
catagagccgggtgtccccaa

SEQ ID NO: 6035880 - DNA, 15 bp, Homo sapiens
catagagctttttaa

SEQ ID NO: 6035881 - DNA, 20 bp, Homo sapiens
catagaggatgatgtaatta

SEQ ID NO: 6035882 - DNA, 14 bp, Homo sapiens
catagaggcccagg

SEQ ID NO: 6035883 - DNA, 15 bp, Homo sapiens
catagaggcttctcc

SEQ ID NO: 6035884 - DNA, 19 bp, Homo sapiens
catagaggcttctccgcca

SEQ ID NO: 6035885 - DNA, 20 bp, Homo sapiens
catagaggcttctccgccag

SEQ ID NO: 6035886 - DNA, 22 bp, Homo sapiens
catagaggcttctccgccagcc

SEQ ID NO: 6035887 - DNA, 14 bp, Homo sapiens
catagagtccagat

SEQ ID NO: 6035888 - DNA, 17 bp, Homo sapiens
catagagtgacctttta

SEQ ID NO: 6035889 - DNA, 21 bp, Homo sapiens
catagagttctggatgtaaag

SEQ ID NO: 6035890 - DNA, 14 bp, Homo sapiens
catagagtttaaca

SEQ ID NO: 6035891 - DNA, 18 bp, Homo sapiens
catagataaaacatcttt

SEQ ID NO: 6035892 - DNA, 15 bp, Homo sapiens
ccaccagctccacac

SEQ ID NO: 6035893 - DNA, 19 bp, Homo sapiens
ccaccagctccactggcct

SEQ ID NO: 6035894 - DNA, 21 bp, Homo sapiens
ccaccagctccactggcctgc

SEQ ID NO: 6035895 - DNA, 19 bp, Homo sapiens
ccaccagctggctctgcag

SEQ ID NO: 6035896 - DNA, 21 bp, Homo sapiens
ccaccagctggctctgcagca

SEQ ID NO: 6035897 - DNA, 14 bp, Homo sapiens
ccaccagctgtgtc

SEQ ID NO: 6035898 - DNA, 17 bp, Homo sapiens
ccaccaggactgaaaga

SEQ ID NO: 6035899 - DNA, 13 bp, Homo sapiens
ccaccaggagaac

SEQ ID NO: 6035900 - DNA, 11 bp, Homo sapiens
ccaccaggagc

SEQ ID NO: 6035901 - DNA, 21 bp, Homo sapiens
ccaccaggagcacctggaccc

SEQ ID NO: 6035902 - DNA, 14 bp, Homo sapiens
ccaccaggagcagc

SEQ ID NO: 6035903 - DNA, 21 bp, Homo sapiens
ccaccaggagcagcagccagc

SEQ ID NO: 6035904 - DNA, 22 bp, Homo sapiens
ccaccaggagcagcagccagca

SEQ ID NO: 6035905 - DNA, 14 bp, Homo sapiens
ccaccaggatcagc

SEQ ID NO: 6035906 - DNA, 14 bp, Homo sapiens
ccaccaggccagct

SEQ ID NO: 6035907 - DNA, 14 bp, Homo sapiens
ccaccaggcctcac

SEQ ID NO: 6035908 - DNA, 21 bp, Homo sapiens
ccaccaggctggcgcagccaa

SEQ ID NO: 6035909 - DNA, 21 bp, Homo sapiens
ccaccagggagatgtctagag

SEQ ID NO: 6035910 - DNA, 19 bp, Homo sapiens
ccaccagggagcttcctgg

SEQ ID NO: 6035911 - DNA, 11 bp, Homo sapiens
ccaccagggca

SEQ ID NO: 6035912 - DNA, 17 bp, Homo sapiens
ccaccagggcactgtct

SEQ ID NO: 6035913 - DNA, 21 bp, Homo sapiens
ccaccagggcatctctgggct

SEQ ID NO: 6035914 - DNA, 14 bp, Homo sapiens
ccaccagggccaga

SEQ ID NO: 6035915 - DNA, 18 bp, Homo sapiens
ccaccagggccagagcag

SEQ ID NO: 6035916 - DNA, 20 bp, Homo sapiens
ccaccagggccagagcagct

SEQ ID NO: 6035917 - DNA, 18 bp, Homo sapiens
ccaccagggctcagctcc

SEQ ID NO: 6035918 - DNA, 13 bp, Homo sapiens
ccaccagggctcc

SEQ ID NO: 6035919 - DNA, 13 bp, Homo sapiens
ccaccagggtgga

SEQ ID NO: 6035920 - DNA, 15 bp, Homo sapiens
ccaccagggtggacc

SEQ ID NO: 6035921 - DNA, 16 bp, Homo sapiens
ccaccagggtggacca

SEQ ID NO: 6035922 - DNA, 17 bp, Homo sapiens
ccaccaggtctcccggg

SEQ ID NO: 6035923 - DNA, 16 bp, Homo sapiens
ccaccaggtgcctttc

SEQ ID NO: 6035924 - DNA, 14 bp, Homo sapiens
ccaccagtcatttt

SEQ ID NO: 6035925 - DNA, 13 bp, Homo sapiens
ccaccagtgcctc

SEQ ID NO: 6035926 - DNA, 14 bp, Homo sapiens
ccaccagtgcctct

SEQ ID NO: 6035927 - DNA, 15 bp, Homo sapiens
ccaccagtgcctctc

SEQ ID NO: 6035928 - DNA, 17 bp, Homo sapiens
ccaccagtgcctctccc

SEQ ID NO: 6035929 - DNA, 19 bp, Homo sapiens
ccaccagtgcctctccctg

SEQ ID NO: 6035930 - DNA, 24 bp, Homo sapiens
ccaccagtgcctctccctgctgct

SEQ ID NO: 6035931 - DNA, 21 bp, Homo sapiens
ccaccagtggacctagcctgg

SEQ ID NO: 6035932 - DNA, 22 bp, Homo sapiens
ccaccagtggacctagcctgga

SEQ ID NO: 6035933 - DNA, 15 bp, Homo sapiens
ccaccagtgtgtggg

SEQ ID NO: 6035934 - DNA, 21 bp, Homo sapiens
ccaccagtgtgtgggggagat

SEQ ID NO: 6035935 - DNA, 14 bp, Homo sapiens
ccaccagttaacgt

SEQ ID NO: 6035936 - DNA, 23 bp, Homo sapiens
ccaccatattcagtgctgtggcc

SEQ ID NO: 6035937 - DNA, 14 bp, Homo sapiens
ccaccatcaagcca

SEQ ID NO: 6035938 - DNA, 18 bp, Homo sapiens
ccaccatcaccaccgcct

SEQ ID NO: 6035939 - DNA, 15 bp, Homo sapiens
ccaccatccaataaa

SEQ ID NO: 6035940 - DNA, 17 bp, Homo sapiens
ccaccatccccagctgg

SEQ ID NO: 6035941 - DNA, 13 bp, Homo sapiens
ccaccatccttcc

SEQ ID NO: 6035942 - DNA, 16 bp, Homo sapiens
ccaccatgaccccttc

SEQ ID NO: 6035943 - DNA, 19 bp, Homo sapiens
ccaccatgcactgtaaata

SEQ ID NO: 6035944 - DNA, 21 bp, Homo sapiens
ccaccatgcactgtaaatatc

SEQ ID NO: 6035945 - DNA, 15 bp, Homo sapiens
ccaccatgcgctgct

SEQ ID NO: 6035946 - DNA, 16 bp, Homo sapiens
ccaccatgctctctca

SEQ ID NO: 6035947 - DNA, 22 bp, Homo sapiens
ccaccatgcttgcctgaagctt

SEQ ID NO: 6035948 - DNA, 13 bp, Homo sapiens
ccaccatggacca

SEQ ID NO: 6035949 - DNA, 19 bp, Homo sapiens
ccaccatggaccagcccat

SEQ ID NO: 6035950 - DNA, 16 bp, Homo sapiens
ccaccatggccagcca

SEQ ID NO: 6035951 - DNA, 21 bp, Homo sapiens
ccaccatggccagccaacttt

SEQ ID NO: 6035952 - DNA, 19 bp, Homo sapiens
ccaccatggggtcctacca

SEQ ID NO: 6035953 - DNA, 21 bp, Homo sapiens
ccaccatggtcatcaccaccc

SEQ ID NO: 6035954 - DNA, 14 bp, Homo sapiens
ccaccatgtctgcc

SEQ ID NO: 6035955 - DNA, 17 bp, Homo sapiens
ccaccattccacatccc

SEQ ID NO: 6035956 - DNA, 23 bp, Homo sapiens
ccaccattcctgcctttaagcca

SEQ ID NO: 6035957 - DNA, 15 bp, Homo sapiens
ccaccattcctggaa

SEQ ID NO: 6035958 - DNA, 16 bp, Homo sapiens
ccaccattcctggaaa

SEQ ID NO: 6035959 - DNA, 14 bp, Homo sapiens
ccaccattccttta

SEQ ID NO: 6035960 - DNA, 16 bp, Homo sapiens
ccaccatttggcatcc

SEQ ID NO: 6035961 - DNA, 18 bp, Homo sapiens
ccaccatttggcatccct

SEQ ID NO: 6035962 - DNA, 12 bp, Homo sapiens
ccaccatttttt

SEQ ID NO: 6035963 - DNA, 19 bp, Homo sapiens
ccacccaaaccccttccca

SEQ ID NO: 6035964 - DNA, 17 bp, Homo sapiens
ccacccaacagcaccaa

SEQ ID NO: 6035965 - DNA, 14 bp, Homo sapiens
ccacccaacagctc

SEQ ID NO: 6035966 - DNA, 16 bp, Homo sapiens
ccacccaaccctatct

SEQ ID NO: 6035967 - DNA, 19 bp, Homo sapiens
ccacccaaccctatctcct

SEQ ID NO: 6035968 - DNA, 15 bp, Homo sapiens
ccacccaacctcacc

SEQ ID NO: 6035969 - DNA, 17 bp, Homo sapiens
ccacccaagcccaaact

SEQ ID NO: 6035970 - DNA, 14 bp, Homo sapiens
ccacccaagcttgg

SEQ ID NO: 6035971 - DNA, 16 bp, Homo sapiens
ccacccaagcttggca

SEQ ID NO: 6035972 - DNA, 19 bp, Homo sapiens
ccacccaagggcctggcct

SEQ ID NO: 6035973 - DNA, 20 bp, Homo sapiens
ccacccaagggcctggcctg

SEQ ID NO: 6035974 - DNA, 18 bp, Homo sapiens
ccacccacaaactccagg

SEQ ID NO: 6035975 - DNA, 23 bp, Homo sapiens
ccacccacaatcacaagaagatt

SEQ ID NO: 6035976 - DNA, 14 bp, Homo sapiens
ccacccacacagct

SEQ ID NO: 6035977 - DNA, 16 bp, Homo sapiens
ccacccacacagctgc

SEQ ID NO: 6035978 - DNA, 24 bp, Homo sapiens
ccacccacacagctgccctagctg

SEQ ID NO: 6035979 - DNA, 21 bp, Homo sapiens
ccacccacaccccgtctgccc

SEQ ID NO: 6035980 - DNA, 22 bp, Homo sapiens
ccacccacaccccgtctgcccc

SEQ ID NO: 6035981 - DNA, 16 bp, Homo sapiens
ccacccaccaaatgcc

SEQ ID NO: 6035982 - DNA, 16 bp, Homo sapiens
ccacccacccccaggc

SEQ ID NO: 6035983 - DNA, 12 bp, Homo sapiens
ccacccaccctt

SEQ ID NO: 6035984 - DNA, 13 bp, Homo sapiens
ccacccacctcag

SEQ ID NO: 6035985 - DNA, 14 bp, Homo sapiens
ccacccacctcagc

SEQ ID NO: 6035986 - DNA, 15 bp, Homo sapiens
ccacccacctcagcc

SEQ ID NO: 6035987 - DNA, 19 bp, Homo sapiens
ccacccacctttgcaggga

SEQ ID NO: 6035988 - DNA, 14 bp, Homo sapiens
ccacccacgtggag

SEQ ID NO: 6035989 - DNA, 17 bp, Homo sapiens
ccacccactagccctct

SEQ ID NO: 6035990 - DNA, 15 bp, Homo sapiens
ccacccactgtccgc

SEQ ID NO: 6035991 - DNA, 14 bp, Homo sapiens
ccacccagaccctc

SEQ ID NO: 6035992 - DNA, 22 bp, Homo sapiens
ccacccagacctgcctgtctcc

SEQ ID NO: 6035993 - DNA, 14 bp, Homo sapiens
ccacccagagcacc

SEQ ID NO: 6035994 - DNA, 11 bp, Homo sapiens
ccacccagagg

SEQ ID NO: 6035995 - DNA, 17 bp, Homo sapiens
ccacccagaggcagcag

SEQ ID NO: 6035996 - DNA, 18 bp, Homo sapiens
ccacccagcaacacagag

SEQ ID NO: 6035997 - DNA, 13 bp, Homo sapiens
ccacccagcagcg

SEQ ID NO: 6035998 - DNA, 20 bp, Homo sapiens
ccacccagcagcgcccgagg

SEQ ID NO: 6035999 - DNA, 14 bp, Homo sapiens
ccacccagccagga

SEQ ID NO: 6036000 - DNA, 14 bp, Homo sapiens
ccacccagcccctg

SEQ ID NO: 6036001 - DNA, 12 bp, Homo sapiens
ccacccagctgg

SEQ ID NO: 6036002 - DNA, 16 bp, Homo sapiens
ccacccagctggtcct

SEQ ID NO: 6036003 - DNA, 11 bp, Homo sapiens
ccacccaggaa

SEQ ID NO: 6036004 - DNA, 13 bp, Homo sapiens
ccacccaggaaag

SEQ ID NO: 6036005 - DNA, 12 bp, Homo sapiens
ccacccaggagg

SEQ ID NO: 6036006 - DNA, 17 bp, Homo sapiens
ccacccaggagggaggg

SEQ ID NO: 6036007 - DNA, 18 bp, Homo sapiens
ccacccaggagggagggg

SEQ ID NO: 6036008 - DNA, 12 bp, Homo sapiens
ccacccaggcca

SEQ ID NO: 6036009 - DNA, 14 bp, Homo sapiens
ccacccaggccagg

SEQ ID NO: 6036010 - DNA, 14 bp, Homo sapiens
ccacccaggctgca

SEQ ID NO: 6036011 - DNA, 21 bp, Homo sapiens
ccacccaggctgcactgcagt

SEQ ID NO: 6036012 - DNA, 14 bp, Homo sapiens
ccacccagggagct

SEQ ID NO: 6036013 - DNA, 14 bp, Homo sapiens
ccacccagggcccg

SEQ ID NO: 6036014 - DNA, 15 bp, Homo sapiens
ccacccagggctccc

SEQ ID NO: 6036015 - DNA, 18 bp, Homo sapiens
ccacccagggctccctcc

SEQ ID NO: 6036016 - DNA, 21 bp, Homo sapiens
ccacccagggctccctcctgg

SEQ ID NO: 6036017 - DNA, 23 bp, Homo sapiens
ccacccagggctccctcctggag

SEQ ID NO: 6036018 - DNA, 23 bp, Homo sapiens
ccacccaggggaatgatctctga

SEQ ID NO: 6036019 - DNA, 17 bp, Homo sapiens
ccacccaggggcagccc

SEQ ID NO: 6036020 - DNA, 12 bp, Homo sapiens
ccacccaggtcc

SEQ ID NO: 6036021 - DNA, 13 bp, Homo sapiens
ccacccaggtccc

SEQ ID NO: 6036022 - DNA, 17 bp, Homo sapiens
ccacccaggtcccgagc

SEQ ID NO: 6036023 - DNA, 22 bp, Homo sapiens
ccacccagtccatgctccaggg

SEQ ID NO: 6036024 - DNA, 15 bp, Homo sapiens
ccacccagtctctgc

SEQ ID NO: 6036025 - DNA, 18 bp, Homo sapiens
ccacccagttacaggggc

SEQ ID NO: 6036026 - DNA, 23 bp, Homo sapiens
ccacccataatcctttctgccga

SEQ ID NO: 6036027 - DNA, 14 bp, Homo sapiens
ccacccatccctgt

SEQ ID NO: 6036028 - DNA, 12 bp, Homo sapiens
ccacccatctcc

SEQ ID NO: 6036029 - DNA, 13 bp, Homo sapiens
ccacccatctcca

SEQ ID NO: 6036030 - DNA, 18 bp, Homo sapiens
ccacccatcttcctgctg

SEQ ID NO: 6036031 - DNA, 17 bp, Homo sapiens
ccacccatgaccttttt

SEQ ID NO: 6036032 - DNA, 16 bp, Homo sapiens
ccacccatgcagctgc

SEQ ID NO: 6036033 - DNA, 22 bp, Homo sapiens
ccacccatgcgccttcgtgcct

SEQ ID NO: 6036034 - DNA, 15 bp, Homo sapiens
ccacccatggagagg

SEQ ID NO: 6036035 - DNA, 15 bp, Homo sapiens
ccacccatggggagg

SEQ ID NO: 6036036 - DNA, 21 bp, Homo sapiens
ccaccccaaaccccagcccca

SEQ ID NO: 6036037 - DNA, 13 bp, Homo sapiens
ccaccccaagaga

SEQ ID NO: 6036038 - DNA, 17 bp, Homo sapiens
ccaccccaagagaactc

SEQ ID NO: 6036039 - DNA, 12 bp, Homo sapiens
ccaccccacact

SEQ ID NO: 6036040 - DNA, 15 bp, Homo sapiens
ccaccccacccactt

SEQ ID NO: 6036041 - DNA, 13 bp, Homo sapiens
ccaccccaccctg

SEQ ID NO: 6036042 - DNA, 16 bp, Homo sapiens
ccaccccacctgcagg

SEQ ID NO: 6036043 - DNA, 17 bp, Homo sapiens
ccaccccactcagggga

SEQ ID NO: 6036044 - DNA, 16 bp, Homo sapiens
ccaccccactccagcc

SEQ ID NO: 6036045 - DNA, 23 bp, Homo sapiens
ccaccccactgagagctgctcct

SEQ ID NO: 6036046 - DNA, 19 bp, Homo sapiens
ccaccccagaaatcactgt

SEQ ID NO: 6036047 - DNA, 21 bp, Homo sapiens
ccaccccagaaatcactgtga

SEQ ID NO: 6036048 - DNA, 22 bp, Homo sapiens
ccaccccagaaatcactgtgaa

SEQ ID NO: 6036049 - DNA, 23 bp, Homo sapiens
ccaccccagaaatcactgtgaaa

SEQ ID NO: 6036050 - DNA, 13 bp, Homo sapiens
ccaccccagagtt

SEQ ID NO: 6036051 - DNA, 14 bp, Homo sapiens
ccaccccagcacag

SEQ ID NO: 6036052 - DNA, 15 bp, Homo sapiens
ccaccccagcacagc

SEQ ID NO: 6036053 - DNA, 22 bp, Homo sapiens
ccaccccagcacagccacctcc

SEQ ID NO: 6036054 - DNA, 23 bp, Homo sapiens
ccaccccagcacagccacctccg

SEQ ID NO: 6036055 - DNA, 12 bp, Homo sapiens
ccaccccaggac

SEQ ID NO: 6036056 - DNA, 13 bp, Homo sapiens
ccaccccaggccc

SEQ ID NO: 6036057 - DNA, 15 bp, Homo sapiens
ccaccccaggccctg

SEQ ID NO: 6036058 - DNA, 18 bp, Homo sapiens
ccaccccagggcagccag

SEQ ID NO: 6036059 - DNA, 20 bp, Homo sapiens
ccaccccagggcagccaggg

SEQ ID NO: 6036060 - DNA, 22 bp, Homo sapiens
ccaccccagtgcacccactctg

SEQ ID NO: 6036061 - DNA, 19 bp, Homo sapiens
ccaccccatccctggctga

SEQ ID NO: 6036062 - DNA, 15 bp, Homo sapiens
ccaccccatctggct

SEQ ID NO: 6036063 - DNA, 13 bp, Homo sapiens
ccaccccatgagc

SEQ ID NO: 6036064 - DNA, 17 bp, Homo sapiens
ccaccccatgagctcgg

SEQ ID NO: 6036065 - DNA, 18 bp, Homo sapiens
ccaccccattttctgtgg

SEQ ID NO: 6036066 - DNA, 19 bp, Homo sapiens
ccacccccaacccccagag

SEQ ID NO: 6036067 - DNA, 15 bp, Homo sapiens
ccacccccacccaag

SEQ ID NO: 6036068 - DNA, 17 bp, Homo sapiens
ccacccccagcagctca

SEQ ID NO: 6036069 - DNA, 13 bp, Homo sapiens
ccacccccagcca

SEQ ID NO: 6036070 - DNA, 17 bp, Homo sapiens
ccacccccagccaggct

SEQ ID NO: 6036071 - DNA, 16 bp, Homo sapiens
ccacccccagctcaat

SEQ ID NO: 6036072 - DNA, 16 bp, Homo sapiens
ccacccccaggacccc

SEQ ID NO: 6036073 - DNA, 23 bp, Homo sapiens
catagataatattgtttggtaaa

SEQ ID NO: 6036074 - DNA, 20 bp, Homo sapiens
catagatagatcccacgttg

SEQ ID NO: 6036075 - DNA, 19 bp, Homo sapiens
catagataggcccctgggg

SEQ ID NO: 6036076 - DNA, 19 bp, Homo sapiens
catagatataaagccattt

SEQ ID NO: 6036077 - DNA, 15 bp, Homo sapiens
catagatattttata

SEQ ID NO: 6036078 - DNA, 23 bp, Homo sapiens
catagatcagcaaaccggggcct

SEQ ID NO: 6036079 - DNA, 18 bp, Homo sapiens
catagatcagccattaaa

SEQ ID NO: 6036080 - DNA, 20 bp, Homo sapiens
catagatcagccattaaaat

SEQ ID NO: 6036081 - DNA, 14 bp, Homo sapiens
catagatcttctga

SEQ ID NO: 6036082 - DNA, 17 bp, Homo sapiens
catagatgagaaaactg

SEQ ID NO: 6036083 - DNA, 17 bp, Homo sapiens
catagatgcctgggcct

SEQ ID NO: 6036084 - DNA, 20 bp, Homo sapiens
catagatgcctgggcctgat

SEQ ID NO: 6036085 - DNA, 21 bp, Homo sapiens
catagatgcctgggcctgatg

SEQ ID NO: 6036086 - DNA, 21 bp, Homo sapiens
catagatgtatcattaatgta

SEQ ID NO: 6036087 - DNA, 19 bp, Homo sapiens
catagattaatggcactga

SEQ ID NO: 6036088 - DNA, 15 bp, Homo sapiens
catagattcacctgt

SEQ ID NO: 6036089 - DNA, 17 bp, Homo sapiens
catagattcacctgtaa

SEQ ID NO: 6036090 - DNA, 21 bp, Homo sapiens
catagatttatttttcagttc

SEQ ID NO: 6036091 - DNA, 22 bp, Homo sapiens
catagatttatttttcagttcc

SEQ ID NO: 6036092 - DNA, 21 bp, Homo sapiens
catagatttcttctctttagt

SEQ ID NO: 6036093 - DNA, 14 bp, Homo sapiens
catagcaagacaca

SEQ ID NO: 6036094 - DNA, 20 bp, Homo sapiens
catagcaagacacatcccta

SEQ ID NO: 6036095 - DNA, 15 bp, Homo sapiens
catagcacaagataa

SEQ ID NO: 6036096 - DNA, 14 bp, Homo sapiens
catagcacatgttt

SEQ ID NO: 6036097 - DNA, 23 bp, Homo sapiens
catagcagagaatgaaagggccc

SEQ ID NO: 6036098 - DNA, 23 bp, Homo sapiens
catagcagaggggccaggcccag

SEQ ID NO: 6036099 - DNA, 14 bp, Homo sapiens
catagcagatctgt

SEQ ID NO: 6036100 - DNA, 16 bp, Homo sapiens
catagcagattttaat

SEQ ID NO: 6036101 - DNA, 19 bp, Homo sapiens
catagcagcttattcacaa

SEQ ID NO: 6036102 - DNA, 20 bp, Homo sapiens
catagcagcttattcacaag

SEQ ID NO: 6036103 - DNA, 18 bp, Homo sapiens
catagcagctttgtctct

SEQ ID NO: 6036104 - DNA, 19 bp, Homo sapiens
catagcaggggcaccttcc

SEQ ID NO: 6036105 - DNA, 16 bp, Homo sapiens
catagcataatatgaa

SEQ ID NO: 6036106 - DNA, 20 bp, Homo sapiens
catagcataatatgaagcct

SEQ ID NO: 6036107 - DNA, 19 bp, Homo sapiens
catagcatagccagcattc

SEQ ID NO: 6036108 - DNA, 18 bp, Homo sapiens
catagcataggctgggga

SEQ ID NO: 6036109 - DNA, 19 bp, Homo sapiens
catagcatccaagtggcat

SEQ ID NO: 6036110 - DNA, 15 bp, Homo sapiens
catagcatgcttcct

SEQ ID NO: 6036111 - DNA, 23 bp, Homo sapiens
catagcatgcttcctttctctcc

SEQ ID NO: 6036112 - DNA, 11 bp, Homo sapiens
catagcattaa

SEQ ID NO: 6036113 - DNA, 15 bp, Homo sapiens
catagcattaactaa

SEQ ID NO: 6036114 - DNA, 14 bp, Homo sapiens
catagccaaaatgt

SEQ ID NO: 6036115 - DNA, 16 bp, Homo sapiens
catagccaaaatgtga

SEQ ID NO: 6036116 - DNA, 14 bp, Homo sapiens
catagccaaacagg

SEQ ID NO: 6036117 - DNA, 21 bp, Homo sapiens
catagccaaagccaggcctga

SEQ ID NO: 6036118 - DNA, 15 bp, Homo sapiens
catagccaccccaga

SEQ ID NO: 6036119 - DNA, 13 bp, Homo sapiens
catagccagcatt

SEQ ID NO: 6036120 - DNA, 15 bp, Homo sapiens
catagccagcatttt

SEQ ID NO: 6036121 - DNA, 13 bp, Homo sapiens
catagccaggagc

SEQ ID NO: 6036122 - DNA, 17 bp, Homo sapiens
catagccataaatgatg

SEQ ID NO: 6036123 - DNA, 15 bp, Homo sapiens
catagccattcattt

SEQ ID NO: 6036124 - DNA, 18 bp, Homo sapiens
catagcccagacacagaa

SEQ ID NO: 6036125 - DNA, 15 bp, Homo sapiens
catagcccagtagac

SEQ ID NO: 6036126 - DNA, 13 bp, Homo sapiens
catagcccatccc

SEQ ID NO: 6036127 - DNA, 17 bp, Homo sapiens
catagcccatccctgcc

SEQ ID NO: 6036128 - DNA, 18 bp, Homo sapiens
catagcccatccctgcct

SEQ ID NO: 6036129 - DNA, 16 bp, Homo sapiens
catagccccaggcccg

SEQ ID NO: 6036130 - DNA, 13 bp, Homo sapiens
catagccccagta

SEQ ID NO: 6036131 - DNA, 19 bp, Homo sapiens
catagccctggtgctcctg

SEQ ID NO: 6036132 - DNA, 23 bp, Homo sapiens
catagccctggtgctcctgccca

SEQ ID NO: 6036133 - DNA, 20 bp, Homo sapiens
catagccctgttgacctgcc

SEQ ID NO: 6036134 - DNA, 17 bp, Homo sapiens
catagccgattctctgc

SEQ ID NO: 6036135 - DNA, 18 bp, Homo sapiens
catagccgattctctgcc

SEQ ID NO: 6036136 - DNA, 19 bp, Homo sapiens
catagccgattctctgccc

SEQ ID NO: 6036137 - DNA, 17 bp, Homo sapiens
catagcctcatgttctg

SEQ ID NO: 6036138 - DNA, 11 bp, Homo sapiens
catagcctttc

SEQ ID NO: 6036139 - DNA, 12 bp, Homo sapiens
catagcctttcc

SEQ ID NO: 6036140 - DNA, 13 bp, Homo sapiens
catagcctttccc

SEQ ID NO: 6036141 - DNA, 16 bp, Homo sapiens
catagcgaaataaaaa

SEQ ID NO: 6036142 - DNA, 22 bp, Homo sapiens
catagcgccgtgctgtaaataa

SEQ ID NO: 6036143 - DNA, 19 bp, Homo sapiens
catagcgctggctcaggaa

SEQ ID NO: 6036144 - DNA, 18 bp, Homo sapiens
catagcgtcctgccctgc

SEQ ID NO: 6036145 - DNA, 21 bp, Homo sapiens
catagctaagaaataaaactg

SEQ ID NO: 6036146 - DNA, 22 bp, Homo sapiens
catagctaagaaataaaactgt

SEQ ID NO: 6036147 - DNA, 16 bp, Homo sapiens
catagctaataagtag

SEQ ID NO: 6036148 - DNA, 17 bp, Homo sapiens
catagctacaatttgtt

SEQ ID NO: 6036149 - DNA, 20 bp, Homo sapiens
catagctactatatgcataa

SEQ ID NO: 6036150 - DNA, 21 bp, Homo sapiens
catagctactatatgcataaa

SEQ ID NO: 6036151 - DNA, 20 bp, Homo sapiens
catagctatcaagtgtgctt

SEQ ID NO: 6036152 - DNA, 16 bp, Homo sapiens
catagctattttcctt

SEQ ID NO: 6036153 - DNA, 19 bp, Homo sapiens
catagctattttccttgct

SEQ ID NO: 6036154 - DNA, 14 bp, Homo sapiens
catagctcaataaa

SEQ ID NO: 6036155 - DNA, 16 bp, Homo sapiens
catagctcaataaaag

SEQ ID NO: 6036156 - DNA, 12 bp, Homo sapiens
catagctcactg

SEQ ID NO: 6036157 - DNA, 17 bp, Homo sapiens
catagctcactgcaccc

SEQ ID NO: 6036158 - DNA, 16 bp, Homo sapiens
catagctcataagctg

SEQ ID NO: 6036159 - DNA, 15 bp, Homo sapiens
catagctcctgctcc

SEQ ID NO: 6036160 - DNA, 17 bp, Homo sapiens
catagctccttctctct

SEQ ID NO: 6036161 - DNA, 14 bp, Homo sapiens
catagctccttgga

SEQ ID NO: 6036162 - DNA, 13 bp, Homo sapiens
catagctctgggg

SEQ ID NO: 6036163 - DNA, 18 bp, Homo sapiens
catagctcttcacttcct

SEQ ID NO: 6036164 - DNA, 19 bp, Homo sapiens
catagctcttcacttcctc

SEQ ID NO: 6036165 - DNA, 21 bp, Homo sapiens
catagctgggactacaggcgc

SEQ ID NO: 6036166 - DNA, 22 bp, Homo sapiens
catagctgggactacaggcgcc

SEQ ID NO: 6036167 - DNA, 20 bp, Homo sapiens
catagctgggatttgaactg

SEQ ID NO: 6036168 - DNA, 22 bp, Homo sapiens
catagctgttttagctgaggga

SEQ ID NO: 6036169 - DNA, 13 bp, Homo sapiens
catagcttccatg

SEQ ID NO: 6036170 - DNA, 22 bp, Homo sapiens
catagcttgcctaatggctttc

SEQ ID NO: 6036171 - DNA, 17 bp, Homo sapiens
catagcttttccctgtc

SEQ ID NO: 6036172 - DNA, 13 bp, Homo sapiens
cataggaaaagaa

SEQ ID NO: 6036173 - DNA, 12 bp, Homo sapiens
cataggaaaagt

SEQ ID NO: 6036174 - DNA, 18 bp, Homo sapiens
cataggaagaaaatgtca

SEQ ID NO: 6036175 - DNA, 17 bp, Homo sapiens
cataggaagacataaaa

SEQ ID NO: 6036176 - DNA, 14 bp, Homo sapiens
cataggaaggctgt

SEQ ID NO: 6036177 - DNA, 24 bp, Homo sapiens
cataggaagggaccaaggcaaggc

SEQ ID NO: 6036178 - DNA, 20 bp, Homo sapiens
cataggaagtggctggtctg

SEQ ID NO: 6036179 - DNA, 17 bp, Homo sapiens
cataggaattaaatgta

SEQ ID NO: 6036180 - DNA, 17 bp, Homo sapiens
cataggacatactgcat

SEQ ID NO: 6036181 - DNA, 16 bp, Homo sapiens
cataggacctgcatcc

SEQ ID NO: 6036182 - DNA, 16 bp, Homo sapiens
cataggacctttccac

SEQ ID NO: 6036183 - DNA, 23 bp, Homo sapiens
cataggactaccgcaggcccgga

SEQ ID NO: 6036184 - DNA, 13 bp, Homo sapiens
cataggagcagcc

SEQ ID NO: 6036185 - DNA, 16 bp, Homo sapiens
cataggaggggtctgg

SEQ ID NO: 6036186 - DNA, 20 bp, Homo sapiens
cataggagtttggaggaagt

SEQ ID NO: 6036187 - DNA, 22 bp, Homo sapiens
cataggattccaaggctttaaa

SEQ ID NO: 6036188 - DNA, 14 bp, Homo sapiens
cataggccaaggcc

SEQ ID NO: 6036189 - DNA, 21 bp, Homo sapiens
cataggcccacacacaggtgg

SEQ ID NO: 6036190 - DNA, 13 bp, Homo sapiens
cataggcccagcc

SEQ ID NO: 6036191 - DNA, 19 bp, Homo sapiens
cataggcctgggtgctggc

SEQ ID NO: 6036192 - DNA, 17 bp, Homo sapiens
cataggcggtcatgtgt

SEQ ID NO: 6036193 - DNA, 20 bp, Homo sapiens
cataggcggtcatgtgtgca

SEQ ID NO: 6036194 - DNA, 13 bp, Homo sapiens
cataggctccttc

SEQ ID NO: 6036195 - DNA, 16 bp, Homo sapiens
cataggctccttcctg

SEQ ID NO: 6036196 - DNA, 17 bp, Homo sapiens
cataggctggtggcctt

SEQ ID NO: 6036197 - DNA, 18 bp, Homo sapiens
cataggctggtggccttg

SEQ ID NO: 6036198 - DNA, 15 bp, Homo sapiens
cataggcttctatta

SEQ ID NO: 6036199 - DNA, 17 bp, Homo sapiens
catagggattgtccctg

SEQ ID NO: 6036200 - DNA, 20 bp, Homo sapiens
catagggtccactttggtaa

SEQ ID NO: 6036201 - DNA, 19 bp, Homo sapiens
catagggtctgcagcctgc

SEQ ID NO: 6036202 - DNA, 22 bp, Homo sapiens
catagggtgctctgaggtcaat

SEQ ID NO: 6036203 - DNA, 17 bp, Homo sapiens
cataggtaagctgtgcc

SEQ ID NO: 6036204 - DNA, 16 bp, Homo sapiens
cataggtatttcaaaa

SEQ ID NO: 6036205 - DNA, 15 bp, Homo sapiens
cataggtcactggct

SEQ ID NO: 6036206 - DNA, 22 bp, Homo sapiens
cataggtctctttgctttctgg

SEQ ID NO: 6036207 - DNA, 21 bp, Homo sapiens
cataggtctgaaatttttctt

SEQ ID NO: 6036208 - DNA, 21 bp, Homo sapiens
cataggtgatccatgtaactg

SEQ ID NO: 6036209 - DNA, 15 bp, Homo sapiens
cataggttaaaaaaa

SEQ ID NO: 6036210 - DNA, 16 bp, Homo sapiens
cataggtttaataatt

SEQ ID NO: 6036211 - DNA, 13 bp, Homo sapiens
cataggttttaaa

SEQ ID NO: 6036212 - DNA, 20 bp, Homo sapiens
catagtaaatggtatcattt

SEQ ID NO: 6036213 - DNA, 24 bp, Homo sapiens
catagtaacttcttatggaattga

SEQ ID NO: 6036214 - DNA, 14 bp, Homo sapiens
catagtaagattga

SEQ ID NO: 6036215 - DNA, 21 bp, Homo sapiens
catagtaagtgcgaagactga

SEQ ID NO: 6036216 - DNA, 21 bp, Homo sapiens
catagtaagttcagcacttgt

SEQ ID NO: 6036217 - DNA, 19 bp, Homo sapiens
catagtaataagatggctg

SEQ ID NO: 6036218 - DNA, 18 bp, Homo sapiens
catagtaccaatcatttt

SEQ ID NO: 6036219 - DNA, 16 bp, Homo sapiens
catagtaccatttata

SEQ ID NO: 6036220 - DNA, 22 bp, Homo sapiens
catagtaccatttatacaaatt

SEQ ID NO: 6036221 - DNA, 20 bp, Homo sapiens
catagtagtatgatgataca

SEQ ID NO: 6036222 - DNA, 20 bp, Homo sapiens
catagtagtttttacagctg

SEQ ID NO: 6036223 - DNA, 19 bp, Homo sapiens
catagtataaatctatgat

SEQ ID NO: 6036224 - DNA, 19 bp, Homo sapiens
catagtatattaaaaatgg

SEQ ID NO: 6036225 - DNA, 19 bp, Homo sapiens
catagtatccatattttat

SEQ ID NO: 6036226 - DNA, 16 bp, Homo sapiens
catagtatggtggctg

SEQ ID NO: 6036227 - DNA, 20 bp, Homo sapiens
catagtatggtggctgggtt

SEQ ID NO: 6036228 - DNA, 18 bp, Homo sapiens
catagtattcatgactat

SEQ ID NO: 6036229 - DNA, 18 bp, Homo sapiens
catagtattccattgtgt

SEQ ID NO: 6036230 - DNA, 18 bp, Homo sapiens
catagtcaatcaaacagg

SEQ ID NO: 6036231 - DNA, 14 bp, Homo sapiens
catagtcacaaaaa

SEQ ID NO: 6036232 - DNA, 23 bp, Homo sapiens
catagtcattctgcctgccctga

SEQ ID NO: 6036233 - DNA, 23 bp, Homo sapiens
catagtcccaccttggagcattt

SEQ ID NO: 6036234 - DNA, 13 bp, Homo sapiens
catagtcccagct

SEQ ID NO: 6036235 - DNA, 14 bp, Homo sapiens
catagtccccagag

SEQ ID NO: 6036236 - DNA, 17 bp, Homo sapiens
catagtccccagagctc

SEQ ID NO: 6036237 - DNA, 20 bp, Homo sapiens
catagtccccagagctcccc

SEQ ID NO: 6036238 - DNA, 19 bp, Homo sapiens
catagtctgtatccaaata

SEQ ID NO: 6036239 - DNA, 24 bp, Homo sapiens
catagtctgtatccaaataatgaa

SEQ ID NO: 6036240 - DNA, 20 bp, Homo sapiens
catagtcttgaaatgaaagg

SEQ ID NO: 6036241 - DNA, 21 bp, Homo sapiens
catagtcttgaaatgaaaggg

SEQ ID NO: 6036242 - DNA, 16 bp, Homo sapiens
catagtctttgtttac

SEQ ID NO: 6036243 - DNA, 22 bp, Homo sapiens
catagtctttgtttacatgagt

SEQ ID NO: 6036244 - DNA, 19 bp, Homo sapiens
catagtgaaaattgtttag

SEQ ID NO: 6036245 - DNA, 21 bp, Homo sapiens
catagtgaacacagcagacct

SEQ ID NO: 6036246 - DNA, 21 bp, Homo sapiens
catagtgacctgtgtttcact

SEQ ID NO: 6036247 - DNA, 14 bp, Homo sapiens
catagtgagacact

SEQ ID NO: 6036248 - DNA, 17 bp, Homo sapiens
catagtgagacactgtc

SEQ ID NO: 6036249 - DNA, 21 bp, Homo sapiens
catagtgagacccctgtctcc

SEQ ID NO: 6036250 - DNA, 13 bp, Homo sapiens
ccacccccaggcc

SEQ ID NO: 6036251 - DNA, 16 bp, Homo sapiens
ccacccccaggcctcc

SEQ ID NO: 6036252 - DNA, 17 bp, Homo sapiens
ccacccccaggcctcct

SEQ ID NO: 6036253 - DNA, 20 bp, Homo sapiens
ccacccccaggcctcctagg

SEQ ID NO: 6036254 - DNA, 19 bp, Homo sapiens
ccacccccaggtcttcctg

SEQ ID NO: 6036255 - DNA, 12 bp, Homo sapiens
ccacccccagtc

SEQ ID NO: 6036256 - DNA, 14 bp, Homo sapiens
ccacccccagtccc

SEQ ID NO: 6036257 - DNA, 19 bp, Homo sapiens
ccacccccagtctccaggg

SEQ ID NO: 6036258 - DNA, 14 bp, Homo sapiens
ccacccccatgcag

SEQ ID NO: 6036259 - DNA, 21 bp, Homo sapiens
ccaccccccagaacctgtcct

SEQ ID NO: 6036260 - DNA, 17 bp, Homo sapiens
ccaccccccagcctcca

SEQ ID NO: 6036261 - DNA, 18 bp, Homo sapiens
ccacccccgaccctgccc

SEQ ID NO: 6036262 - DNA, 16 bp, Homo sapiens
ccacccccgccacggc

SEQ ID NO: 6036263 - DNA, 14 bp, Homo sapiens
ccacccccgctggg

SEQ ID NO: 6036264 - DNA, 20 bp, Homo sapiens
ccacccccgctgggggtggg

SEQ ID NO: 6036265 - DNA, 20 bp, Homo sapiens
ccacccccgggatcctgccc

SEQ ID NO: 6036266 - DNA, 20 bp, Homo sapiens
ccacccccgtcaccccgctc

SEQ ID NO: 6036267 - DNA, 14 bp, Homo sapiens
ccaccccctccagc

SEQ ID NO: 6036268 - DNA, 18 bp, Homo sapiens
ccaccccctccagctcca

SEQ ID NO: 6036269 - DNA, 17 bp, Homo sapiens
ccaccccctccccaggg

SEQ ID NO: 6036270 - DNA, 13 bp, Homo sapiens
ccaccccctcctg

SEQ ID NO: 6036271 - DNA, 16 bp, Homo sapiens
ccaccccctctggaga

SEQ ID NO: 6036272 - DNA, 16 bp, Homo sapiens
ccaccccctgcccaca

SEQ ID NO: 6036273 - DNA, 13 bp, Homo sapiens
ccaccccctgggc

SEQ ID NO: 6036274 - DNA, 15 bp, Homo sapiens
ccaccccctgtccca

SEQ ID NO: 6036275 - DNA, 24 bp, Homo sapiens
ccaccccctgtcccattctagatc

SEQ ID NO: 6036276 - DNA, 13 bp, Homo sapiens
ccaccccctgttc

SEQ ID NO: 6036277 - DNA, 17 bp, Homo sapiens
ccacccccttcagtgcc

SEQ ID NO: 6036278 - DNA, 18 bp, Homo sapiens
ccacccccttccctggga

SEQ ID NO: 6036279 - DNA, 20 bp, Homo sapiens
ccacccccttccctgggagg

SEQ ID NO: 6036280 - DNA, 13 bp, Homo sapiens
ccacccccttctc

SEQ ID NO: 6036281 - DNA, 19 bp, Homo sapiens
ccacccccttctctgctcc

SEQ ID NO: 6036282 - DNA, 23 bp, Homo sapiens
ccaccccgaaatcagcccccagc

SEQ ID NO: 6036283 - DNA, 22 bp, Homo sapiens
ccaccccgcaccccgcgtgtcc

SEQ ID NO: 6036284 - DNA, 20 bp, Homo sapiens
ccaccccgccgttccctgcg

SEQ ID NO: 6036285 - DNA, 16 bp, Homo sapiens
ccaccccgcctctggg

SEQ ID NO: 6036286 - DNA, 14 bp, Homo sapiens
ccaccccgctgcct

SEQ ID NO: 6036287 - DNA, 15 bp, Homo sapiens
ccaccccgctgcctg

SEQ ID NO: 6036288 - DNA, 19 bp, Homo sapiens
ccaccccggccccctgccc

SEQ ID NO: 6036289 - DNA, 20 bp, Homo sapiens
ccaccccgggctctcctgcc

SEQ ID NO: 6036290 - DNA, 14 bp, Homo sapiens
ccaccccgtcccgg

SEQ ID NO: 6036291 - DNA, 21 bp, Homo sapiens
ccaccccgttgttgtccctgc

SEQ ID NO: 6036292 - DNA, 19 bp, Homo sapiens
ccacccctaagtgcccaaa

SEQ ID NO: 6036293 - DNA, 21 bp, Homo sapiens
ccacccctacacacacactcc

SEQ ID NO: 6036294 - DNA, 19 bp, Homo sapiens
ccacccctacagcctgcac

SEQ ID NO: 6036295 - DNA, 21 bp, Homo sapiens
ccacccctacagcctgcacac

SEQ ID NO: 6036296 - DNA, 13 bp, Homo sapiens
ccacccctacccc

SEQ ID NO: 6036297 - DNA, 18 bp, Homo sapiens
ccacccctagccaccagt

SEQ ID NO: 6036298 - DNA, 22 bp, Homo sapiens
ccacccctagccaccagtgtcc

SEQ ID NO: 6036299 - DNA, 13 bp, Homo sapiens
ccacccctcactc

SEQ ID NO: 6036300 - DNA, 13 bp, Homo sapiens
ccacccctccaga

SEQ ID NO: 6036301 - DNA, 12 bp, Homo sapiens
ccacccctccat

SEQ ID NO: 6036302 - DNA, 14 bp, Homo sapiens
ccacccctccccat

SEQ ID NO: 6036303 - DNA, 15 bp, Homo sapiens
ccacccctctggcac

SEQ ID NO: 6036304 - DNA, 22 bp, Homo sapiens
ccacccctctggcacctgggtt

SEQ ID NO: 6036305 - DNA, 14 bp, Homo sapiens
ccacccctcttccc

SEQ ID NO: 6036306 - DNA, 21 bp, Homo sapiens
ccacccctcttcccccttccc

SEQ ID NO: 6036307 - DNA, 17 bp, Homo sapiens
ccacccctgccactcac

SEQ ID NO: 6036308 - DNA, 20 bp, Homo sapiens
ccacccctgccactcaccct

SEQ ID NO: 6036309 - DNA, 16 bp, Homo sapiens
ccacccctgcctccac

SEQ ID NO: 6036310 - DNA, 22 bp, Homo sapiens
ccacccctgcctccaccctctg

SEQ ID NO: 6036311 - DNA, 17 bp, Homo sapiens
ccacccctgtgcgcgcg

SEQ ID NO: 6036312 - DNA, 14 bp, Homo sapiens
ccacccctgtgctc

SEQ ID NO: 6036313 - DNA, 13 bp, Homo sapiens
ccaccccttagat

SEQ ID NO: 6036314 - DNA, 14 bp, Homo sapiens
ccaccccttcccca

SEQ ID NO: 6036315 - DNA, 13 bp, Homo sapiens
ccaccccttcctc

SEQ ID NO: 6036316 - DNA, 21 bp, Homo sapiens
ccaccccttcctcagcctggg

SEQ ID NO: 6036317 - DNA, 22 bp, Homo sapiens
ccaccccttcgacatgctgcca

SEQ ID NO: 6036318 - DNA, 12 bp, Homo sapiens
ccaccccttgcc

SEQ ID NO: 6036319 - DNA, 15 bp, Homo sapiens
ccaccccttgctctc

SEQ ID NO: 6036320 - DNA, 20 bp, Homo sapiens
ccaccccttgctctcaaccc

SEQ ID NO: 6036321 - DNA, 22 bp, Homo sapiens
ccaccccttggaggagagagac

SEQ ID NO: 6036322 - DNA, 17 bp, Homo sapiens
ccaccccttggcccctc

SEQ ID NO: 6036323 - DNA, 19 bp, Homo sapiens
ccaccccttggcccctcac

SEQ ID NO: 6036324 - DNA, 21 bp, Homo sapiens
ccaccccttggcccctcacat

SEQ ID NO: 6036325 - DNA, 16 bp, Homo sapiens
ccacccgacctggctg

SEQ ID NO: 6036326 - DNA, 22 bp, Homo sapiens
ccacccgagtacctccagtcac

SEQ ID NO: 6036327 - DNA, 15 bp, Homo sapiens
ccacccgcccacccg

SEQ ID NO: 6036328 - DNA, 14 bp, Homo sapiens
ccacccgccccaga

SEQ ID NO: 6036329 - DNA, 15 bp, Homo sapiens
ccacccgccccagag

SEQ ID NO: 6036330 - DNA, 18 bp, Homo sapiens
ccacccgccccagagact

SEQ ID NO: 6036331 - DNA, 23 bp, Homo sapiens
ccacccgccccagagactgccca

SEQ ID NO: 6036332 - DNA, 18 bp, Homo sapiens
ccacccgccccgccccct

SEQ ID NO: 6036333 - DNA, 16 bp, Homo sapiens
ccacccgcctccctct

SEQ ID NO: 6036334 - DNA, 17 bp, Homo sapiens
ccacccgctgcccctcc

SEQ ID NO: 6036335 - DNA, 16 bp, Homo sapiens
ccacccggacaggtgg

SEQ ID NO: 6036336 - DNA, 17 bp, Homo sapiens
ccacccggatctccagg

SEQ ID NO: 6036337 - DNA, 20 bp, Homo sapiens
ccacccggatctccaggccc

SEQ ID NO: 6036338 - DNA, 21 bp, Homo sapiens
ccacccggcattctctgccca

SEQ ID NO: 6036339 - DNA, 20 bp, Homo sapiens
ccacccggcccggctgagcc

SEQ ID NO: 6036340 - DNA, 23 bp, Homo sapiens
ccacccggcggcggccagggacc

SEQ ID NO: 6036341 - DNA, 16 bp, Homo sapiens
ccacccgggggagccc

SEQ ID NO: 6036342 - DNA, 18 bp, Homo sapiens
ccacccgggggagcccag

SEQ ID NO: 6036343 - DNA, 23 bp, Homo sapiens
ccacccgtaggcagcctctctgc

SEQ ID NO: 6036344 - DNA, 15 bp, Homo sapiens
ccacccgtcctccct

SEQ ID NO: 6036345 - DNA, 23 bp, Homo sapiens
ccacccgtcctccctcagcctcc

SEQ ID NO: 6036346 - DNA, 21 bp, Homo sapiens
ccacccgtcttcaatctctgt

SEQ ID NO: 6036347 - DNA, 17 bp, Homo sapiens
ccaccctaactgagctg

SEQ ID NO: 6036348 - DNA, 15 bp, Homo sapiens
ccaccctaagggcag

SEQ ID NO: 6036349 - DNA, 19 bp, Homo sapiens
ccaccctaagggcagccct

SEQ ID NO: 6036350 - DNA, 18 bp, Homo sapiens
ccaccctaatttgccctt

SEQ ID NO: 6036351 - DNA, 19 bp, Homo sapiens
ccaccctaatttgcccttc

SEQ ID NO: 6036352 - DNA, 20 bp, Homo sapiens
ccaccctaatttgcccttca

SEQ ID NO: 6036353 - DNA, 12 bp, Homo sapiens
ccaccctacctg

SEQ ID NO: 6036354 - DNA, 21 bp, Homo sapiens
ccaccctagccaatgtctcct

SEQ ID NO: 6036355 - DNA, 15 bp, Homo sapiens
ccaccctatggccac

SEQ ID NO: 6036356 - DNA, 14 bp, Homo sapiens
ccaccctcacacac

SEQ ID NO: 6036357 - DNA, 12 bp, Homo sapiens
ccaccctcactg

SEQ ID NO: 6036358 - DNA, 17 bp, Homo sapiens
ccaccctcactggctct

SEQ ID NO: 6036359 - DNA, 19 bp, Homo sapiens
ccaccctcactggctctcc

SEQ ID NO: 6036360 - DNA, 20 bp, Homo sapiens
ccaccctcatttctgccagc

SEQ ID NO: 6036361 - DNA, 20 bp, Homo sapiens
ccaccctcatttttccttta

SEQ ID NO: 6036362 - DNA, 19 bp, Homo sapiens
ccaccctccaccttccatt

SEQ ID NO: 6036363 - DNA, 13 bp, Homo sapiens
ccaccctccactc

SEQ ID NO: 6036364 - DNA, 20 bp, Homo sapiens
ccaccctcccaccatgcgct

SEQ ID NO: 6036365 - DNA, 18 bp, Homo sapiens
ccaccctcccctatgctg

SEQ ID NO: 6036366 - DNA, 14 bp, Homo sapiens
ccaccctcccctct

SEQ ID NO: 6036367 - DNA, 15 bp, Homo sapiens
ccaccctccctggag

SEQ ID NO: 6036368 - DNA, 16 bp, Homo sapiens
ccaccctccctggagt

SEQ ID NO: 6036369 - DNA, 14 bp, Homo sapiens
ccaccctcctctag

SEQ ID NO: 6036370 - DNA, 16 bp, Homo sapiens
ccaccctcctcttgga

SEQ ID NO: 6036371 - DNA, 12 bp, Homo sapiens
ccaccctcctgc

SEQ ID NO: 6036372 - DNA, 22 bp, Homo sapiens
ccaccctcctgccccacactcc

SEQ ID NO: 6036373 - DNA, 23 bp, Homo sapiens
ccaccctcctgccccacactccc

SEQ ID NO: 6036374 - DNA, 23 bp, Homo sapiens
ccaccctcctgtcttcccagggt

SEQ ID NO: 6036375 - DNA, 22 bp, Homo sapiens
ccaccctccttgagactggagc

SEQ ID NO: 6036376 - DNA, 12 bp, Homo sapiens
ccaccctctcca

SEQ ID NO: 6036377 - DNA, 20 bp, Homo sapiens
ccaccctctccacacccagc

SEQ ID NO: 6036378 - DNA, 22 bp, Homo sapiens
ccaccctctccacacccagcct

SEQ ID NO: 6036379 - DNA, 15 bp, Homo sapiens
ccaccctctccatgc

SEQ ID NO: 6036380 - DNA, 16 bp, Homo sapiens
ccaccctctccatgcc

SEQ ID NO: 6036381 - DNA, 19 bp, Homo sapiens
ccaccctctgcagggcagc

SEQ ID NO: 6036382 - DNA, 21 bp, Homo sapiens
ccaccctctgcagggcagcct

SEQ ID NO: 6036383 - DNA, 15 bp, Homo sapiens
ccaccctctgctgca

SEQ ID NO: 6036384 - DNA, 15 bp, Homo sapiens
ccaccctctgggagt

SEQ ID NO: 6036385 - DNA, 15 bp, Homo sapiens
ccaccctctggggac

SEQ ID NO: 6036386 - DNA, 17 bp, Homo sapiens
ccaccctctggggacag

SEQ ID NO: 6036387 - DNA, 12 bp, Homo sapiens
ccaccctctggt

SEQ ID NO: 6036388 - DNA, 14 bp, Homo sapiens
ccaccctctggtcc

SEQ ID NO: 6036389 - DNA, 12 bp, Homo sapiens
ccaccctctgtg

SEQ ID NO: 6036390 - DNA, 13 bp, Homo sapiens
ccaccctctgtga

SEQ ID NO: 6036391 - DNA, 13 bp, Homo sapiens
ccaccctcttccc

SEQ ID NO: 6036392 - DNA, 17 bp, Homo sapiens
ccaccctgaaagccctg

SEQ ID NO: 6036393 - DNA, 13 bp, Homo sapiens
ccaccctgagctc

SEQ ID NO: 6036394 - DNA, 19 bp, Homo sapiens
ccaccctgagctcggggac

SEQ ID NO: 6036395 - DNA, 13 bp, Homo sapiens
ccaccctgaggag

SEQ ID NO: 6036396 - DNA, 20 bp, Homo sapiens
ccaccctgagttgcttttca

SEQ ID NO: 6036397 - DNA, 21 bp, Homo sapiens
ccaccctgagttgcttttcag

SEQ ID NO: 6036398 - DNA, 17 bp, Homo sapiens
ccaccctgatccttttc

SEQ ID NO: 6036399 - DNA, 18 bp, Homo sapiens
ccaccctgcattttcctc

SEQ ID NO: 6036400 - DNA, 12 bp, Homo sapiens
ccaccctgccat

SEQ ID NO: 6036401 - DNA, 13 bp, Homo sapiens
ccaccctgccatg

SEQ ID NO: 6036402 - DNA, 13 bp, Homo sapiens
ccaccctgcccac

SEQ ID NO: 6036403 - DNA, 14 bp, Homo sapiens
ccaccctgccctgg

SEQ ID NO: 6036404 - DNA, 14 bp, Homo sapiens
ccaccctgcctgca

SEQ ID NO: 6036405 - DNA, 13 bp, Homo sapiens
ccaccctgcctgt

SEQ ID NO: 6036406 - DNA, 16 bp, Homo sapiens
ccaccctgcctgtgga

SEQ ID NO: 6036407 - DNA, 20 bp, Homo sapiens
ccaccctgctcctcctgccc

SEQ ID NO: 6036408 - DNA, 12 bp, Homo sapiens
ccaccctgctct

SEQ ID NO: 6036409 - DNA, 13 bp, Homo sapiens
ccaccctgctctc

SEQ ID NO: 6036410 - DNA, 13 bp, Homo sapiens
ccaccctgctgca

SEQ ID NO: 6036411 - DNA, 16 bp, Homo sapiens
ccaccctgctgctgct

SEQ ID NO: 6036412 - DNA, 21 bp, Homo sapiens
ccaccctgctgctggtgcaca

SEQ ID NO: 6036413 - DNA, 14 bp, Homo sapiens
ccaccctgcttctg

SEQ ID NO: 6036414 - DNA, 15 bp, Homo sapiens
ccaccctgcttctgc

SEQ ID NO: 6036415 - DNA, 21 bp, Homo sapiens
ccaccctgcttctgctgcctg

SEQ ID NO: 6036416 - DNA, 19 bp, Homo sapiens
ccaccctgcttggcccagg

SEQ ID NO: 6036417 - DNA, 17 bp, Homo sapiens
ccaccctggaatgccaa

SEQ ID NO: 6036418 - DNA, 15 bp, Homo sapiens
ccaccctgggagaca

SEQ ID NO: 6036419 - DNA, 20 bp, Homo sapiens
ccaccctgggatgggccacc

SEQ ID NO: 6036420 - DNA, 12 bp, Homo sapiens
ccaccctgggcc

SEQ ID NO: 6036421 - DNA, 15 bp, Homo sapiens
ccaccctgggccctg

SEQ ID NO: 6036422 - DNA, 16 bp, Homo sapiens
ccaccctgggcctccc

SEQ ID NO: 6036423 - DNA, 17 bp, Homo sapiens
ccaccctgggcctcccg

SEQ ID NO: 6036424 - DNA, 18 bp, Homo sapiens
ccaccctgggctacagaa

SEQ ID NO: 6036425 - DNA, 13 bp, Homo sapiens
ccaccctgggctc

SEQ ID NO: 6036426 - DNA, 14 bp, Homo sapiens
ccaccctgggctcc

SEQ ID NO: 6036427 - DNA, 17 bp, Homo sapiens
ccaccctgggctccaca

SEQ ID NO: 6036428 - DNA, 18 bp, Homo sapiens
ccaccctgggctccacac

SEQ ID NO: 6036429 - DNA, 11 bp, Homo sapiens
ccaccctgggt

SEQ ID NO: 6036430 - DNA, 23 bp, Homo sapiens
ccaccctgggtttggcccctgga

SEQ ID NO: 6036431 - DNA, 17 bp, Homo sapiens
catagtgcaaaactgtg

SEQ ID NO: 6036432 - DNA, 20 bp, Homo sapiens
catagtgcaaaactgtgtca

SEQ ID NO: 6036433 - DNA, 18 bp, Homo sapiens
catagtgcacacttgtat

SEQ ID NO: 6036434 - DNA, 13 bp, Homo sapiens
catagtgccatag

SEQ ID NO: 6036435 - DNA, 15 bp, Homo sapiens
catagtgcctttttc

SEQ ID NO: 6036436 - DNA, 18 bp, Homo sapiens
catagtgcctttttcctt

SEQ ID NO: 6036437 - DNA, 18 bp, Homo sapiens
catagtgctaacatgaag

SEQ ID NO: 6036438 - DNA, 17 bp, Homo sapiens
catagtgctgggatgga

SEQ ID NO: 6036439 - DNA, 15 bp, Homo sapiens
catagtgctgggatt

SEQ ID NO: 6036440 - DNA, 19 bp, Homo sapiens
catagtgcttcacaaaatg

SEQ ID NO: 6036441 - DNA, 18 bp, Homo sapiens
catagtggatggacagat

SEQ ID NO: 6036442 - DNA, 22 bp, Homo sapiens
catagtggatggacagatggac

SEQ ID NO: 6036443 - DNA, 23 bp, Homo sapiens
catagtggatggacagatggacc

SEQ ID NO: 6036444 - DNA, 18 bp, Homo sapiens
catagtggggcctgggag

SEQ ID NO: 6036445 - DNA, 14 bp, Homo sapiens
catagtggtatttt

SEQ ID NO: 6036446 - DNA, 17 bp, Homo sapiens
catagtggtattttaac

SEQ ID NO: 6036447 - DNA, 23 bp, Homo sapiens
catagtggtattttaacatagca

SEQ ID NO: 6036448 - DNA, 15 bp, Homo sapiens
catagtggtgcagag

SEQ ID NO: 6036449 - DNA, 13 bp, Homo sapiens
catagtgtaatgt

SEQ ID NO: 6036450 - DNA, 17 bp, Homo sapiens
catagtgtcaagaagga

SEQ ID NO: 6036451 - DNA, 16 bp, Homo sapiens
catagtgtcacagaga

SEQ ID NO: 6036452 - DNA, 22 bp, Homo sapiens
catagtgtgctcggacacagtt

SEQ ID NO: 6036453 - DNA, 20 bp, Homo sapiens
catagttaaagaagacattt

SEQ ID NO: 6036454 - DNA, 13 bp, Homo sapiens
catagttactgta

SEQ ID NO: 6036455 - DNA, 15 bp, Homo sapiens
catagttactgtaaa

SEQ ID NO: 6036456 - DNA, 16 bp, Homo sapiens
catagttactgtgtaa

SEQ ID NO: 6036457 - DNA, 15 bp, Homo sapiens
catagttatgtgatt

SEQ ID NO: 6036458 - DNA, 18 bp, Homo sapiens
catagttatgtgattttc

SEQ ID NO: 6036459 - DNA, 18 bp, Homo sapiens
catagttatttacttgaa

SEQ ID NO: 6036460 - DNA, 22 bp, Homo sapiens
catagttatttacttgaaagat

SEQ ID NO: 6036461 - DNA, 20 bp, Homo sapiens
catagttctgagctgccagt

SEQ ID NO: 6036462 - DNA, 16 bp, Homo sapiens
catagttctgcaataa

SEQ ID NO: 6036463 - DNA, 18 bp, Homo sapiens
catagttctgcaataaca

SEQ ID NO: 6036464 - DNA, 19 bp, Homo sapiens
catagttgagattgtactg

SEQ ID NO: 6036465 - DNA, 13 bp, Homo sapiens
catagttggaaat

SEQ ID NO: 6036466 - DNA, 15 bp, Homo sapiens
catagttggaaatat

SEQ ID NO: 6036467 - DNA, 22 bp, Homo sapiens
catagttggggtcatagatgtt

SEQ ID NO: 6036468 - DNA, 21 bp, Homo sapiens
catagttgtagacaaagtaca

SEQ ID NO: 6036469 - DNA, 16 bp, Homo sapiens
catagtttaagttgat

SEQ ID NO: 6036470 - DNA, 20 bp, Homo sapiens
catagtttacaatattatgt

SEQ ID NO: 6036471 - DNA, 22 bp, Homo sapiens
catagtttattattattaaagt

SEQ ID NO: 6036472 - DNA, 14 bp, Homo sapiens
catagtttctgtaa

SEQ ID NO: 6036473 - DNA, 22 bp, Homo sapiens
catagtttcttggccactgaat

SEQ ID NO: 6036474 - DNA, 13 bp, Homo sapiens
catagtttggcat

SEQ ID NO: 6036475 - DNA, 17 bp, Homo sapiens
catagtttgggtatttt

SEQ ID NO: 6036476 - DNA, 19 bp, Homo sapiens
catagttttaaactcattt

SEQ ID NO: 6036477 - DNA, 14 bp, Homo sapiens
catagttttatatc

SEQ ID NO: 6036478 - DNA, 15 bp, Homo sapiens
catagttttatttat

SEQ ID NO: 6036479 - DNA, 19 bp, Homo sapiens
catagttttatttatattt

SEQ ID NO: 6036480 - DNA, 15 bp, Homo sapiens
catagttttgtttaa

SEQ ID NO: 6036481 - DNA, 13 bp, Homo sapiens
catagtttttcct

SEQ ID NO: 6036482 - DNA, 15 bp, Homo sapiens
catagtttttcctgg

SEQ ID NO: 6036483 - DNA, 17 bp, Homo sapiens
catagtttttcctgggt

SEQ ID NO: 6036484 - DNA, 19 bp, Homo sapiens
catataaaaacaatatatt

SEQ ID NO: 6036485 - DNA, 19 bp, Homo sapiens
catataaaaagcagcagag

SEQ ID NO: 6036486 - DNA, 17 bp, Homo sapiens
catataaaactgtttca

SEQ ID NO: 6036487 - DNA, 21 bp, Homo sapiens
catataaaaggtgagctcagc

SEQ ID NO: 6036488 - DNA, 18 bp, Homo sapiens
catataaaagttgcgttt

SEQ ID NO: 6036489 - DNA, 21 bp, Homo sapiens
catataaaatggcaacaaact

SEQ ID NO: 6036490 - DNA, 15 bp, Homo sapiens
catataaaatttcag

SEQ ID NO: 6036491 - DNA, 19 bp, Homo sapiens
catataaacacagtaagat

SEQ ID NO: 6036492 - DNA, 15 bp, Homo sapiens
catataaatagaatg

SEQ ID NO: 6036493 - DNA, 18 bp, Homo sapiens
catataaatatatttaac

SEQ ID NO: 6036494 - DNA, 13 bp, Homo sapiens
catataaattaat

SEQ ID NO: 6036495 - DNA, 14 bp, Homo sapiens
catataaattaata

SEQ ID NO: 6036496 - DNA, 13 bp, Homo sapiens
catataacatgca

SEQ ID NO: 6036497 - DNA, 20 bp, Homo sapiens
catataacttatattgtaag

SEQ ID NO: 6036498 - DNA, 23 bp, Homo sapiens
catataacttatattgtaagaaa

SEQ ID NO: 6036499 - DNA, 20 bp, Homo sapiens
catataagacaaatattcct

SEQ ID NO: 6036500 - DNA, 17 bp, Homo sapiens
catataagcccttgatt

SEQ ID NO: 6036501 - DNA, 19 bp, Homo sapiens
catataagggaagtagtta

SEQ ID NO: 6036502 - DNA, 23 bp, Homo sapiens
catataagggaagtagttatcat

SEQ ID NO: 6036503 - DNA, 22 bp, Homo sapiens
catataagtttgaaggaaacag

SEQ ID NO: 6036504 - DNA, 14 bp, Homo sapiens
catataatatatgt

SEQ ID NO: 6036505 - DNA, 17 bp, Homo sapiens
catataatatatgtttt

SEQ ID NO: 6036506 - DNA, 14 bp, Homo sapiens
catataatgaataa

SEQ ID NO: 6036507 - DNA, 16 bp, Homo sapiens
catataatgaataaat

SEQ ID NO: 6036508 - DNA, 16 bp, Homo sapiens
catataattatatgtt

SEQ ID NO: 6036509 - DNA, 12 bp, Homo sapiens
catataattctt

SEQ ID NO: 6036510 - DNA, 13 bp, Homo sapiens
catataattttca

SEQ ID NO: 6036511 - DNA, 20 bp, Homo sapiens
catatacaacaccaaaaaat

SEQ ID NO: 6036512 - DNA, 22 bp, Homo sapiens
catatacaacaccaaaaaatat

SEQ ID NO: 6036513 - DNA, 13 bp, Homo sapiens
catatacacacac

SEQ ID NO: 6036514 - DNA, 13 bp, Homo sapiens
catatacacttgg

SEQ ID NO: 6036515 - DNA, 16 bp, Homo sapiens
catatacatatatata

SEQ ID NO: 6036516 - DNA, 20 bp, Homo sapiens
catatacatatgatcaaata

SEQ ID NO: 6036517 - DNA, 22 bp, Homo sapiens
catatacatatgatcaaatact

SEQ ID NO: 6036518 - DNA, 16 bp, Homo sapiens
catatacatattgtat

SEQ ID NO: 6036519 - DNA, 17 bp, Homo sapiens
catatacatattgtata

SEQ ID NO: 6036520 - DNA, 14 bp, Homo sapiens
catatacatctagc

SEQ ID NO: 6036521 - DNA, 18 bp, Homo sapiens
catatacattatttctgt

SEQ ID NO: 6036522 - DNA, 21 bp, Homo sapiens
catatacattatttctgtata

SEQ ID NO: 6036523 - DNA, 22 bp, Homo sapiens
catatacattatttctgtatat

SEQ ID NO: 6036524 - DNA, 23 bp, Homo sapiens
catatacattatttctgtatata

SEQ ID NO: 6036525 - DNA, 22 bp, Homo sapiens
catataccaaaaacaagtctat

SEQ ID NO: 6036526 - DNA, 21 bp, Homo sapiens
catataccacccatagtgctt

SEQ ID NO: 6036527 - DNA, 18 bp, Homo sapiens
catatacctataatgtgt

SEQ ID NO: 6036528 - DNA, 19 bp, Homo sapiens
catatacctataatgtgtg

SEQ ID NO: 6036529 - DNA, 14 bp, Homo sapiens
catatacctcttga

SEQ ID NO: 6036530 - DNA, 20 bp, Homo sapiens
catatacctcttgaagaaga

SEQ ID NO: 6036531 - DNA, 21 bp, Homo sapiens
catatacctcttgaagaagaa

SEQ ID NO: 6036532 - DNA, 16 bp, Homo sapiens
catatactaaggagcc

SEQ ID NO: 6036533 - DNA, 17 bp, Homo sapiens
catatactataattgta

SEQ ID NO: 6036534 - DNA, 16 bp, Homo sapiens
catatactgattctgt

SEQ ID NO: 6036535 - DNA, 14 bp, Homo sapiens
catatagaaaacaa

SEQ ID NO: 6036536 - DNA, 14 bp, Homo sapiens
catatagaatatat

SEQ ID NO: 6036537 - DNA, 17 bp, Homo sapiens
catatagacacacatac

SEQ ID NO: 6036538 - DNA, 16 bp, Homo sapiens
catatagacacataca

SEQ ID NO: 6036539 - DNA, 18 bp, Homo sapiens
catatagaccaattgaag

SEQ ID NO: 6036540 - DNA, 22 bp, Homo sapiens
catatagaccaattgaagcatg

SEQ ID NO: 6036541 - DNA, 14 bp, Homo sapiens
catatagagatgaa

SEQ ID NO: 6036542 - DNA, 20 bp, Homo sapiens
catatagagatgaagtttgt

SEQ ID NO: 6036543 - DNA, 22 bp, Homo sapiens
catatagcaaaacttttaaact

SEQ ID NO: 6036544 - DNA, 23 bp, Homo sapiens
catatagcattgataatcttcag

SEQ ID NO: 6036545 - DNA, 14 bp, Homo sapiens
catatagctttgca

SEQ ID NO: 6036546 - DNA, 18 bp, Homo sapiens
catataggggcaaaaatt

SEQ ID NO: 6036547 - DNA, 19 bp, Homo sapiens
catataggggcaaaaattt

SEQ ID NO: 6036548 - DNA, 21 bp, Homo sapiens
catataggggcaaaaatttga

SEQ ID NO: 6036549 - DNA, 18 bp, Homo sapiens
catataggtgatgtttgc

SEQ ID NO: 6036550 - DNA, 19 bp, Homo sapiens
catataggtgatgtttgct

SEQ ID NO: 6036551 - DNA, 19 bp, Homo sapiens
catatagtaaacactcaat

SEQ ID NO: 6036552 - DNA, 14 bp, Homo sapiens
catatagtgccctt

SEQ ID NO: 6036553 - DNA, 14 bp, Homo sapiens
catatagtgtacag

SEQ ID NO: 6036554 - DNA, 22 bp, Homo sapiens
catatagttaaactgagagtaa

SEQ ID NO: 6036555 - DNA, 12 bp, Homo sapiens
catatataaaac

SEQ ID NO: 6036556 - DNA, 15 bp, Homo sapiens
catatataaaacaaa

SEQ ID NO: 6036557 - DNA, 12 bp, Homo sapiens
catatataaatt

SEQ ID NO: 6036558 - DNA, 13 bp, Homo sapiens
catatataaatta

SEQ ID NO: 6036559 - DNA, 20 bp, Homo sapiens
catatataacaatgctgtat

SEQ ID NO: 6036560 - DNA, 18 bp, Homo sapiens
catatataagactgctgc

SEQ ID NO: 6036561 - DNA, 20 bp, Homo sapiens
catatatacacacacaaaga

SEQ ID NO: 6036562 - DNA, 16 bp, Homo sapiens
catatatactacatga

SEQ ID NO: 6036563 - DNA, 12 bp, Homo sapiens
catatatacttg

SEQ ID NO: 6036564 - DNA, 19 bp, Homo sapiens
catatataggcagttgcat

SEQ ID NO: 6036565 - DNA, 16 bp, Homo sapiens
catatatataaaatac

SEQ ID NO: 6036566 - DNA, 21 bp, Homo sapiens
catatatataaaatacacgtg

SEQ ID NO: 6036567 - DNA, 17 bp, Homo sapiens
catatatatactattaa

SEQ ID NO: 6036568 - DNA, 11 bp, Homo sapiens
catatatatat

SEQ ID NO: 6036569 - DNA, 21 bp, Homo sapiens
catatatatatacacatacat

SEQ ID NO: 6036570 - DNA, 14 bp, Homo sapiens
catatatatctgat

SEQ ID NO: 6036571 - DNA, 23 bp, Homo sapiens
catatatatgttttaagaggcag

SEQ ID NO: 6036572 - DNA, 23 bp, Homo sapiens
catatatccttttcttctatgta

SEQ ID NO: 6036573 - DNA, 16 bp, Homo sapiens
catatatcttatgtta

SEQ ID NO: 6036574 - DNA, 17 bp, Homo sapiens
catatatgaggacttgt

SEQ ID NO: 6036575 - DNA, 23 bp, Homo sapiens
catatatgagggagtatgacgtt

SEQ ID NO: 6036576 - DNA, 14 bp, Homo sapiens
catatatgctgtat

SEQ ID NO: 6036577 - DNA, 22 bp, Homo sapiens
catatatgcttttttgcaataa

SEQ ID NO: 6036578 - DNA, 12 bp, Homo sapiens
catatatgtata

SEQ ID NO: 6036579 - DNA, 18 bp, Homo sapiens
catatatgtataatatat

SEQ ID NO: 6036580 - DNA, 22 bp, Homo sapiens
catatatgtataatatatatct

SEQ ID NO: 6036581 - DNA, 14 bp, Homo sapiens
catatattatcaaa

SEQ ID NO: 6036582 - DNA, 18 bp, Homo sapiens
catatattcatacctgtt

SEQ ID NO: 6036583 - DNA, 14 bp, Homo sapiens
catatattcatgta

SEQ ID NO: 6036584 - DNA, 18 bp, Homo sapiens
catatattgggttccatt

SEQ ID NO: 6036585 - DNA, 15 bp, Homo sapiens
catatatttaacaat

SEQ ID NO: 6036586 - DNA, 21 bp, Homo sapiens
catatatttaacaatgacaag

SEQ ID NO: 6036587 - DNA, 14 bp, Homo sapiens
catatatttattga

SEQ ID NO: 6036588 - DNA, 17 bp, Homo sapiens
catatattttattttca

SEQ ID NO: 6036589 - DNA, 18 bp, Homo sapiens
catatattttattttcat

SEQ ID NO: 6036590 - DNA, 22 bp, Homo sapiens
catatatttttaaaaaatgaaa

SEQ ID NO: 6036591 - DNA, 20 bp, Homo sapiens
catatattttttaaaataag

SEQ ID NO: 6036592 - DNA, 19 bp, Homo sapiens
catatcaaaacatcccaat

SEQ ID NO: 6036593 - DNA, 12 bp, Homo sapiens
catatcaaatag

SEQ ID NO: 6036594 - DNA, 20 bp, Homo sapiens
catatcaacttagtcaataa

SEQ ID NO: 6036595 - DNA, 11 bp, Homo sapiens
catatcaagaa

SEQ ID NO: 6036596 - DNA, 20 bp, Homo sapiens
catatcaagtccatgttatt

SEQ ID NO: 6036597 - DNA, 18 bp, Homo sapiens
catatcaagtcccgaggc

SEQ ID NO: 6036598 - DNA, 21 bp, Homo sapiens
catatcaagtcccgaggcagc

SEQ ID NO: 6036599 - DNA, 13 bp, Homo sapiens
catatcaattcaa

SEQ ID NO: 6036600 - DNA, 15 bp, Homo sapiens
catatcaattcaaca

SEQ ID NO: 6036601 - DNA, 16 bp, Homo sapiens
catatcacacacattg

SEQ ID NO: 6036602 - DNA, 22 bp, Homo sapiens
catatcacatgtcagccactgt

SEQ ID NO: 6036603 - DNA, 16 bp, Homo sapiens
catatcaccagtctta

SEQ ID NO: 6036604 - DNA, 15 bp, Homo sapiens
catatcacccttccc

SEQ ID NO: 6036605 - DNA, 16 bp, Homo sapiens
catatcacccttccct

SEQ ID NO: 6036606 - DNA, 21 bp, Homo sapiens
catatcacccttccctgctcc

SEQ ID NO: 6036607 - DNA, 15 bp, Homo sapiens
catatcagaaaagta

SEQ ID NO: 6036608 - DNA, 16 bp, Homo sapiens
catatcagaaaagtag

SEQ ID NO: 6036609 - DNA, 15 bp, Homo sapiens
ccaccctgtgcagaa

SEQ ID NO: 6036610 - DNA, 12 bp, Homo sapiens
ccaccctgtgcc

SEQ ID NO: 6036611 - DNA, 18 bp, Homo sapiens
ccaccctgttcctgctgc

SEQ ID NO: 6036612 - DNA, 14 bp, Homo sapiens
ccacccttcccctc

SEQ ID NO: 6036613 - DNA, 21 bp, Homo sapiens
ccacccttccctgcctccagc

SEQ ID NO: 6036614 - DNA, 12 bp, Homo sapiens
ccacccttcgca

SEQ ID NO: 6036615 - DNA, 12 bp, Homo sapiens
ccacccttgccc

SEQ ID NO: 6036616 - DNA, 20 bp, Homo sapiens
ccacccttggaggctgtctt

SEQ ID NO: 6036617 - DNA, 13 bp, Homo sapiens
ccacccttggcct

SEQ ID NO: 6036618 - DNA, 15 bp, Homo sapiens
ccacccttggcctgt

SEQ ID NO: 6036619 - DNA, 19 bp, Homo sapiens
ccacccttggtctcatgcc

SEQ ID NO: 6036620 - DNA, 21 bp, Homo sapiens
ccacccttggtctcatgcccc

SEQ ID NO: 6036621 - DNA, 15 bp, Homo sapiens
ccacccttgttccag

SEQ ID NO: 6036622 - DNA, 19 bp, Homo sapiens
ccaccctttcatagagagg

SEQ ID NO: 6036623 - DNA, 20 bp, Homo sapiens
ccaccctttcccccttctct

SEQ ID NO: 6036624 - DNA, 19 bp, Homo sapiens
ccaccctttggagaccagg

SEQ ID NO: 6036625 - DNA, 15 bp, Homo sapiens
ccaccctttgggggg

SEQ ID NO: 6036626 - DNA, 23 bp, Homo sapiens
ccaccctttggggggggcccgcc

SEQ ID NO: 6036627 - DNA, 18 bp, Homo sapiens
ccaccgaagagccctgag

SEQ ID NO: 6036628 - DNA, 21 bp, Homo sapiens
ccaccgaagaggaagcaagaa

SEQ ID NO: 6036629 - DNA, 18 bp, Homo sapiens
ccaccgaagccgcctgtg

SEQ ID NO: 6036630 - DNA, 23 bp, Homo sapiens
ccaccgaagtggactggcccctg

SEQ ID NO: 6036631 - DNA, 19 bp, Homo sapiens
ccaccgaccaactgcccta

SEQ ID NO: 6036632 - DNA, 16 bp, Homo sapiens
ccaccgactgcccagc

SEQ ID NO: 6036633 - DNA, 16 bp, Homo sapiens
ccaccgagctctgtgg

SEQ ID NO: 6036634 - DNA, 12 bp, Homo sapiens
ccaccgaggagc

SEQ ID NO: 6036635 - DNA, 18 bp, Homo sapiens
ccaccgaggagccccagc

SEQ ID NO: 6036636 - DNA, 17 bp, Homo sapiens
ccaccgatggagccccc

SEQ ID NO: 6036637 - DNA, 22 bp, Homo sapiens
ccaccgcagacaggaccaggga

SEQ ID NO: 6036638 - DNA, 19 bp, Homo sapiens
ccaccgcagcgtcccccgc

SEQ ID NO: 6036639 - DNA, 14 bp, Homo sapiens
ccaccgcagctact

SEQ ID NO: 6036640 - DNA, 12 bp, Homo sapiens
ccaccgcagctg

SEQ ID NO: 6036641 - DNA, 13 bp, Homo sapiens
ccaccgcagctgc

SEQ ID NO: 6036642 - DNA, 14 bp, Homo sapiens
ccaccgcagctgct

SEQ ID NO: 6036643 - DNA, 15 bp, Homo sapiens
ccaccgcagctgctg

SEQ ID NO: 6036644 - DNA, 16 bp, Homo sapiens
ccaccgcaggggactg

SEQ ID NO: 6036645 - DNA, 22 bp, Homo sapiens
ccaccgcaggggactgtctcag

SEQ ID NO: 6036646 - DNA, 19 bp, Homo sapiens
ccaccgcatatgcatgcca

SEQ ID NO: 6036647 - DNA, 20 bp, Homo sapiens
ccaccgcatatgcatgccag

SEQ ID NO: 6036648 - DNA, 16 bp, Homo sapiens
ccaccgcatcctcact

SEQ ID NO: 6036649 - DNA, 22 bp, Homo sapiens
ccaccgcatcctcactgggctc

SEQ ID NO: 6036650 - DNA, 16 bp, Homo sapiens
ccaccgcatgccccct

SEQ ID NO: 6036651 - DNA, 13 bp, Homo sapiens
ccaccgccacccc

SEQ ID NO: 6036652 - DNA, 13 bp, Homo sapiens
ccaccgccagagg

SEQ ID NO: 6036653 - DNA, 15 bp, Homo sapiens
ccaccgccagaggac

SEQ ID NO: 6036654 - DNA, 22 bp, Homo sapiens
ccaccgccagaggacaaggaag

SEQ ID NO: 6036655 - DNA, 13 bp, Homo sapiens
ccaccgccatggc

SEQ ID NO: 6036656 - DNA, 14 bp, Homo sapiens
ccaccgccatggct

SEQ ID NO: 6036657 - DNA, 18 bp, Homo sapiens
ccaccgccatggcttcca

SEQ ID NO: 6036658 - DNA, 14 bp, Homo sapiens
ccaccgcccactct

SEQ ID NO: 6036659 - DNA, 17 bp, Homo sapiens
ccaccgcccagagaccc

SEQ ID NO: 6036660 - DNA, 13 bp, Homo sapiens
ccaccgcccctgg

SEQ ID NO: 6036661 - DNA, 19 bp, Homo sapiens
ccaccgcccctggacaggc

SEQ ID NO: 6036662 - DNA, 12 bp, Homo sapiens
ccaccgccctcc

SEQ ID NO: 6036663 - DNA, 13 bp, Homo sapiens
ccaccgccctcct

SEQ ID NO: 6036664 - DNA, 19 bp, Homo sapiens
ccaccgccctcctccactt

SEQ ID NO: 6036665 - DNA, 21 bp, Homo sapiens
ccaccgccctcctcgctgtgc

SEQ ID NO: 6036666 - DNA, 22 bp, Homo sapiens
ccaccgccctcctcgctgtgcc

SEQ ID NO: 6036667 - DNA, 16 bp, Homo sapiens
ccaccgccctgcctct

SEQ ID NO: 6036668 - DNA, 12 bp, Homo sapiens
ccaccgccgggg

SEQ ID NO: 6036669 - DNA, 13 bp, Homo sapiens
ccaccgcctccta

SEQ ID NO: 6036670 - DNA, 14 bp, Homo sapiens
ccaccgcgcccctc

SEQ ID NO: 6036671 - DNA, 20 bp, Homo sapiens
ccaccgcgccctcctgccca

SEQ ID NO: 6036672 - DNA, 23 bp, Homo sapiens
ccaccgcgcctggcccaagccct

SEQ ID NO: 6036673 - DNA, 17 bp, Homo sapiens
ccaccgctcagtgtcag

SEQ ID NO: 6036674 - DNA, 17 bp, Homo sapiens
ccaccgctccccagccc

SEQ ID NO: 6036675 - DNA, 14 bp, Homo sapiens
ccaccgctgccagc

SEQ ID NO: 6036676 - DNA, 21 bp, Homo sapiens
ccaccgctgccagcacagagc

SEQ ID NO: 6036677 - DNA, 13 bp, Homo sapiens
ccaccgctgccta

SEQ ID NO: 6036678 - DNA, 15 bp, Homo sapiens
ccaccgctgcctcgt

SEQ ID NO: 6036679 - DNA, 13 bp, Homo sapiens
ccaccgctgctcc

SEQ ID NO: 6036680 - DNA, 20 bp, Homo sapiens
ccaccggaggtcactccacc

SEQ ID NO: 6036681 - DNA, 21 bp, Homo sapiens
ccaccggaggtcactccacca

SEQ ID NO: 6036682 - DNA, 15 bp, Homo sapiens
ccaccggcactcatg

SEQ ID NO: 6036683 - DNA, 18 bp, Homo sapiens
ccaccggcactcatgacg

SEQ ID NO: 6036684 - DNA, 19 bp, Homo sapiens
ccaccggcactcatgacgg

SEQ ID NO: 6036685 - DNA, 14 bp, Homo sapiens
ccaccggcccctgg

SEQ ID NO: 6036686 - DNA, 22 bp, Homo sapiens
ccaccggcccctggcagcacag

SEQ ID NO: 6036687 - DNA, 21 bp, Homo sapiens
ccaccgggacagacctggaca

SEQ ID NO: 6036688 - DNA, 22 bp, Homo sapiens
ccaccgggacagacctggacac

SEQ ID NO: 6036689 - DNA, 14 bp, Homo sapiens
ccaccgggagcctc

SEQ ID NO: 6036690 - DNA, 20 bp, Homo sapiens
ccaccgggcatgtctgcctg

SEQ ID NO: 6036691 - DNA, 24 bp, Homo sapiens
ccaccgggcatgtctgcctggagt

SEQ ID NO: 6036692 - DNA, 13 bp, Homo sapiens
ccaccgggccact

SEQ ID NO: 6036693 - DNA, 20 bp, Homo sapiens
ccaccgggccactccttcct

SEQ ID NO: 6036694 - DNA, 22 bp, Homo sapiens
ccaccgggcgcatgcctcccag

SEQ ID NO: 6036695 - DNA, 13 bp, Homo sapiens
ccaccgggctgca

SEQ ID NO: 6036696 - DNA, 16 bp, Homo sapiens
ccaccgggctgcaggt

SEQ ID NO: 6036697 - DNA, 16 bp, Homo sapiens
ccaccggggcacacgg

SEQ ID NO: 6036698 - DNA, 17 bp, Homo sapiens
ccaccggggcactggct

SEQ ID NO: 6036699 - DNA, 20 bp, Homo sapiens
ccaccggggcactggctgct

SEQ ID NO: 6036700 - DNA, 21 bp, Homo sapiens
ccaccggggcactggctgctc

SEQ ID NO: 6036701 - DNA, 18 bp, Homo sapiens
ccaccggtccagctggcc

SEQ ID NO: 6036702 - DNA, 21 bp, Homo sapiens
ccaccggtgccaaacccagcc

SEQ ID NO: 6036703 - DNA, 14 bp, Homo sapiens
ccaccggtgcctcc

SEQ ID NO: 6036704 - DNA, 17 bp, Homo sapiens
ccaccggttgcttctgg

SEQ ID NO: 6036705 - DNA, 18 bp, Homo sapiens
ccaccggttgcttctggg

SEQ ID NO: 6036706 - DNA, 21 bp, Homo sapiens
ccaccggttgcttctgggaag

SEQ ID NO: 6036707 - DNA, 14 bp, Homo sapiens
ccaccgtcccctcc

SEQ ID NO: 6036708 - DNA, 18 bp, Homo sapiens
ccaccgtctacagatggc

SEQ ID NO: 6036709 - DNA, 18 bp, Homo sapiens
ccaccgtgaaccagaggg

SEQ ID NO: 6036710 - DNA, 23 bp, Homo sapiens
ccaccgtgaaccagagggtgtgg

SEQ ID NO: 6036711 - DNA, 14 bp, Homo sapiens
ccaccgtgcccggc

SEQ ID NO: 6036712 - DNA, 13 bp, Homo sapiens
ccaccgtgcctgg

SEQ ID NO: 6036713 - DNA, 19 bp, Homo sapiens
ccaccgtgcctggccagat

SEQ ID NO: 6036714 - DNA, 13 bp, Homo sapiens
ccaccgtggagga

SEQ ID NO: 6036715 - DNA, 21 bp, Homo sapiens
ccaccgtgtgacctataattt

SEQ ID NO: 6036716 - DNA, 22 bp, Homo sapiens
ccaccgttaggattcaggcagc

SEQ ID NO: 6036717 - DNA, 14 bp, Homo sapiens
ccaccgttcagtca

SEQ ID NO: 6036718 - DNA, 21 bp, Homo sapiens
ccaccgtttcttcctgccagc

SEQ ID NO: 6036719 - DNA, 19 bp, Homo sapiens
ccacctaaagggaagccct

SEQ ID NO: 6036720 - DNA, 19 bp, Homo sapiens
ccacctaccttcaaagctg

SEQ ID NO: 6036721 - DNA, 14 bp, Homo sapiens
ccacctagaacact

SEQ ID NO: 6036722 - DNA, 16 bp, Homo sapiens
ccacctagaacactaa

SEQ ID NO: 6036723 - DNA, 23 bp, Homo sapiens
ccacctagaagtctccctgcaca

SEQ ID NO: 6036724 - DNA, 19 bp, Homo sapiens
ccacctaggcaatgaagaa

SEQ ID NO: 6036725 - DNA, 17 bp, Homo sapiens
ccacctaggccactcct

SEQ ID NO: 6036726 - DNA, 18 bp, Homo sapiens
ccacctaggccactcctc

SEQ ID NO: 6036727 - DNA, 18 bp, Homo sapiens
ccacctagtgccccagac

SEQ ID NO: 6036728 - DNA, 20 bp, Homo sapiens
ccacctagtgccccagactg

SEQ ID NO: 6036729 - DNA, 23 bp, Homo sapiens
ccacctagtggctgtccagtgcc

SEQ ID NO: 6036730 - DNA, 18 bp, Homo sapiens
ccacctatctcgtgggag

SEQ ID NO: 6036731 - DNA, 11 bp, Homo sapiens
ccacctatgcc

SEQ ID NO: 6036732 - DNA, 13 bp, Homo sapiens
ccacctatgcctg

SEQ ID NO: 6036733 - DNA, 14 bp, Homo sapiens
ccacctatgcctgt

SEQ ID NO: 6036734 - DNA, 16 bp, Homo sapiens
ccacctcactagctcc

SEQ ID NO: 6036735 - DNA, 17 bp, Homo sapiens
ccacctcactagctccc

SEQ ID NO: 6036736 - DNA, 15 bp, Homo sapiens
ccacctcactcctgt

SEQ ID NO: 6036737 - DNA, 19 bp, Homo sapiens
ccacctcagaaaggatttt

SEQ ID NO: 6036738 - DNA, 18 bp, Homo sapiens
ccacctcagaccccgggg

SEQ ID NO: 6036739 - DNA, 10 bp, Homo sapiens
ccacctcagc

SEQ ID NO: 6036740 - DNA, 13 bp, Homo sapiens
ccacctcagcctc

SEQ ID NO: 6036741 - DNA, 16 bp, Homo sapiens
ccacctcagcctcctg

SEQ ID NO: 6036742 - DNA, 14 bp, Homo sapiens
ccacctcagggcac

SEQ ID NO: 6036743 - DNA, 16 bp, Homo sapiens
ccacctcaggtgactt

SEQ ID NO: 6036744 - DNA, 15 bp, Homo sapiens
ccacctcatcactgg

SEQ ID NO: 6036745 - DNA, 16 bp, Homo sapiens
ccacctcatcactgga

SEQ ID NO: 6036746 - DNA, 17 bp, Homo sapiens
ccacctcatcactggac

SEQ ID NO: 6036747 - DNA, 20 bp, Homo sapiens
ccacctcatggattgccaca

SEQ ID NO: 6036748 - DNA, 21 bp, Homo sapiens
ccacctcatggattgccacag

SEQ ID NO: 6036749 - DNA, 22 bp, Homo sapiens
ccacctcatggattgccacagc

SEQ ID NO: 6036750 - DNA, 17 bp, Homo sapiens
ccacctccacacccacc

SEQ ID NO: 6036751 - DNA, 21 bp, Homo sapiens
ccacctccaccacatctgcca

SEQ ID NO: 6036752 - DNA, 15 bp, Homo sapiens
ccacctccacccact

SEQ ID NO: 6036753 - DNA, 16 bp, Homo sapiens
ccacctccacccagcc

SEQ ID NO: 6036754 - DNA, 17 bp, Homo sapiens
ccacctccacccagccc

SEQ ID NO: 6036755 - DNA, 18 bp, Homo sapiens
ccacctccacccagcccc

SEQ ID NO: 6036756 - DNA, 21 bp, Homo sapiens
ccacctccacccagcccctgg

SEQ ID NO: 6036757 - DNA, 23 bp, Homo sapiens
ccacctccacccccgccacggcc

SEQ ID NO: 6036758 - DNA, 14 bp, Homo sapiens
ccacctccacctgt

SEQ ID NO: 6036759 - DNA, 16 bp, Homo sapiens
ccacctccacctgtga

SEQ ID NO: 6036760 - DNA, 17 bp, Homo sapiens
ccacctccactcccacc

SEQ ID NO: 6036761 - DNA, 13 bp, Homo sapiens
ccacctccagccc

SEQ ID NO: 6036762 - DNA, 15 bp, Homo sapiens
ccacctccagcccac

SEQ ID NO: 6036763 - DNA, 14 bp, Homo sapiens
ccacctccagcccg

SEQ ID NO: 6036764 - DNA, 18 bp, Homo sapiens
ccacctccagcccgggag

SEQ ID NO: 6036765 - DNA, 14 bp, Homo sapiens
ccacctcccaagga

SEQ ID NO: 6036766 - DNA, 16 bp, Homo sapiens
ccacctcccaaggact

SEQ ID NO: 6036767 - DNA, 21 bp, Homo sapiens
ccacctcccaccccactccag

SEQ ID NO: 6036768 - DNA, 15 bp, Homo sapiens
ccacctcccaccctg

SEQ ID NO: 6036769 - DNA, 17 bp, Homo sapiens
ccacctcccaccctgac

SEQ ID NO: 6036770 - DNA, 15 bp, Homo sapiens
ccacctccccacaca

SEQ ID NO: 6036771 - DNA, 21 bp, Homo sapiens
ccacctccccacacacaggcc

SEQ ID NO: 6036772 - DNA, 23 bp, Homo sapiens
ccacctccccacacacaggcctt

SEQ ID NO: 6036773 - DNA, 18 bp, Homo sapiens
ccacctccccacgccctc

SEQ ID NO: 6036774 - DNA, 13 bp, Homo sapiens
ccacctccccact

SEQ ID NO: 6036775 - DNA, 20 bp, Homo sapiens
ccacctccccactccagcag

SEQ ID NO: 6036776 - DNA, 21 bp, Homo sapiens
ccacctccccagagccctgca

SEQ ID NO: 6036777 - DNA, 18 bp, Homo sapiens
ccacctcccccactccca

SEQ ID NO: 6036778 - DNA, 16 bp, Homo sapiens
ccacctccccccacaa

SEQ ID NO: 6036779 - DNA, 22 bp, Homo sapiens
ccacctcccctatccacccagc

SEQ ID NO: 6036780 - DNA, 15 bp, Homo sapiens
ccacctccccttgcc

SEQ ID NO: 6036781 - DNA, 18 bp, Homo sapiens
ccacctccccttgccagc

SEQ ID NO: 6036782 - DNA, 19 bp, Homo sapiens
ccacctccccttgccagct

SEQ ID NO: 6036783 - DNA, 20 bp, Homo sapiens
ccacctccccttgccagctg

SEQ ID NO: 6036784 - DNA, 13 bp, Homo sapiens
ccacctccctctg

SEQ ID NO: 6036785 - DNA, 19 bp, Homo sapiens
ccacctccctgcaataaaa

SEQ ID NO: 6036786 - DNA, 17 bp, Homo sapiens
ccacctccctgcagctt

SEQ ID NO: 6036787 - DNA, 13 bp, Homo sapiens
ccacctccctgcc

SEQ ID NO: 6036788 - DNA, 18 bp, Homo sapiens
ccacctccctgcccaggc

SEQ ID NO: 6036789 - DNA, 20 bp, Homo sapiens
catatcagaataggaagata

SEQ ID NO: 6036790 - DNA, 14 bp, Homo sapiens
catatcagacctct

SEQ ID NO: 6036791 - DNA, 23 bp, Homo sapiens
catatcagacttcaccaaatata

SEQ ID NO: 6036792 - DNA, 15 bp, Homo sapiens
catatcagctctgca

SEQ ID NO: 6036793 - DNA, 16 bp, Homo sapiens
catatcagtcatgact

SEQ ID NO: 6036794 - DNA, 13 bp, Homo sapiens
catatcagttgag

SEQ ID NO: 6036795 - DNA, 23 bp, Homo sapiens
catatcatcaatgtgacatttac

SEQ ID NO: 6036796 - DNA, 20 bp, Homo sapiens
catatcatgctaaaattcta

SEQ ID NO: 6036797 - DNA, 21 bp, Homo sapiens
catatcatttcactgtctagg

SEQ ID NO: 6036798 - DNA, 23 bp, Homo sapiens
catatcatttcactgtctaggct

SEQ ID NO: 6036799 - DNA, 15 bp, Homo sapiens
catatcatttcttaa

SEQ ID NO: 6036800 - DNA, 16 bp, Homo sapiens
catatccaagatcaat

SEQ ID NO: 6036801 - DNA, 22 bp, Homo sapiens
catatccaagatcaattccctc

SEQ ID NO: 6036802 - DNA, 18 bp, Homo sapiens
catatccagtattgttcc

SEQ ID NO: 6036803 - DNA, 18 bp, Homo sapiens
catatccatagtgacttt

SEQ ID NO: 6036804 - DNA, 19 bp, Homo sapiens
catatccatgttgctgact

SEQ ID NO: 6036805 - DNA, 15 bp, Homo sapiens
catatcccgggagca

SEQ ID NO: 6036806 - DNA, 16 bp, Homo sapiens
catatcccgggagcag

SEQ ID NO: 6036807 - DNA, 22 bp, Homo sapiens
catatccctgcccagcctgtgg

SEQ ID NO: 6036808 - DNA, 22 bp, Homo sapiens
catatccgggtgctcaataaac

SEQ ID NO: 6036809 - DNA, 14 bp, Homo sapiens
catatcctgagcca

SEQ ID NO: 6036810 - DNA, 23 bp, Homo sapiens
catatcctgagccatcggtgaaa

SEQ ID NO: 6036811 - DNA, 18 bp, Homo sapiens
catatcctttgccccaag

SEQ ID NO: 6036812 - DNA, 23 bp, Homo sapiens
catatcgctgggctcaacataga

SEQ ID NO: 6036813 - DNA, 18 bp, Homo sapiens
catatcggaggtggtgga

SEQ ID NO: 6036814 - DNA, 18 bp, Homo sapiens
catatcggctcacaaaga

SEQ ID NO: 6036815 - DNA, 13 bp, Homo sapiens
catatctaaatag

SEQ ID NO: 6036816 - DNA, 18 bp, Homo sapiens
catatctaaccagtgatt

SEQ ID NO: 6036817 - DNA, 15 bp, Homo sapiens
catatctaactttgt

SEQ ID NO: 6036818 - DNA, 15 bp, Homo sapiens
catatctaatttacc

SEQ ID NO: 6036819 - DNA, 21 bp, Homo sapiens
catatctacagtacttccaga

SEQ ID NO: 6036820 - DNA, 15 bp, Homo sapiens
catatctagatttct

SEQ ID NO: 6036821 - DNA, 20 bp, Homo sapiens
catatctagatttctagaaa

SEQ ID NO: 6036822 - DNA, 18 bp, Homo sapiens
catatctagtatgaaatt

SEQ ID NO: 6036823 - DNA, 19 bp, Homo sapiens
catatctagtcaataactc

SEQ ID NO: 6036824 - DNA, 16 bp, Homo sapiens
catatctatgggaaaa

SEQ ID NO: 6036825 - DNA, 22 bp, Homo sapiens
catatctccatggccctgtccc

SEQ ID NO: 6036826 - DNA, 15 bp, Homo sapiens
catatctccttcccc

SEQ ID NO: 6036827 - DNA, 13 bp, Homo sapiens
catatctccttta

SEQ ID NO: 6036828 - DNA, 15 bp, Homo sapiens
catatctctcccttc

SEQ ID NO: 6036829 - DNA, 19 bp, Homo sapiens
catatctctcccttcttta

SEQ ID NO: 6036830 - DNA, 12 bp, Homo sapiens
catatctctgcc

SEQ ID NO: 6036831 - DNA, 23 bp, Homo sapiens
catatctcttgcccttcctactc

SEQ ID NO: 6036832 - DNA, 12 bp, Homo sapiens
catatctgcctt

SEQ ID NO: 6036833 - DNA, 15 bp, Homo sapiens
catatctgcctttat

SEQ ID NO: 6036834 - DNA, 18 bp, Homo sapiens
catatctgcctttattgt

SEQ ID NO: 6036835 - DNA, 16 bp, Homo sapiens
catatctggagcctga

SEQ ID NO: 6036836 - DNA, 17 bp, Homo sapiens
catatctggagcctgat

SEQ ID NO: 6036837 - DNA, 14 bp, Homo sapiens
catatctgtgtgcc

SEQ ID NO: 6036838 - DNA, 15 bp, Homo sapiens
catatctgtgtgccc

SEQ ID NO: 6036839 - DNA, 16 bp, Homo sapiens
catatctgtgtgccct

SEQ ID NO: 6036840 - DNA, 18 bp, Homo sapiens
catatctgtgtgccctag

SEQ ID NO: 6036841 - DNA, 17 bp, Homo sapiens
catatcttacagccaga

SEQ ID NO: 6036842 - DNA, 15 bp, Homo sapiens
catatcttcctcatc

SEQ ID NO: 6036843 - DNA, 17 bp, Homo sapiens
catatcttcctcatcag

SEQ ID NO: 6036844 - DNA, 22 bp, Homo sapiens
catatcttctatatctgaagag

SEQ ID NO: 6036845 - DNA, 18 bp, Homo sapiens
catatcttctgtttcata

SEQ ID NO: 6036846 - DNA, 15 bp, Homo sapiens
catatcttgccttca

SEQ ID NO: 6036847 - DNA, 15 bp, Homo sapiens
catatctttatcttt

SEQ ID NO: 6036848 - DNA, 15 bp, Homo sapiens
catatgaaaggagag

SEQ ID NO: 6036849 - DNA, 16 bp, Homo sapiens
catatgaaaggtgcca

SEQ ID NO: 6036850 - DNA, 14 bp, Homo sapiens
catatgaaatataa

SEQ ID NO: 6036851 - DNA, 20 bp, Homo sapiens
catatgaaatataaattatc

SEQ ID NO: 6036852 - DNA, 23 bp, Homo sapiens
catatgaaatataaattatctga

SEQ ID NO: 6036853 - DNA, 21 bp, Homo sapiens
catatgaacagctgttcagtt

SEQ ID NO: 6036854 - DNA, 19 bp, Homo sapiens
catatgaatatatgttttg

SEQ ID NO: 6036855 - DNA, 13 bp, Homo sapiens
catatgaatgaaa

SEQ ID NO: 6036856 - DNA, 16 bp, Homo sapiens
catatgaatgaaaaaa

SEQ ID NO: 6036857 - DNA, 17 bp, Homo sapiens
catatgaatgaaacatg

SEQ ID NO: 6036858 - DNA, 22 bp, Homo sapiens
catatgaatgcagcactgctgc

SEQ ID NO: 6036859 - DNA, 18 bp, Homo sapiens
catatgaattagccaaaa

SEQ ID NO: 6036860 - DNA, 15 bp, Homo sapiens
catatgaattgtaca

SEQ ID NO: 6036861 - DNA, 20 bp, Homo sapiens
catatgacaagcctttgtgc

SEQ ID NO: 6036862 - DNA, 19 bp, Homo sapiens
catatgacatgccaccctc

SEQ ID NO: 6036863 - DNA, 16 bp, Homo sapiens
catatgacctcatgca

SEQ ID NO: 6036864 - DNA, 20 bp, Homo sapiens
catatgactcacatgatgca

SEQ ID NO: 6036865 - DNA, 22 bp, Homo sapiens
catatgactcacatgatgcata

SEQ ID NO: 6036866 - DNA, 22 bp, Homo sapiens
catatgagaatataccttattt

SEQ ID NO: 6036867 - DNA, 22 bp, Homo sapiens
catatgagccgtgaactgtgca

SEQ ID NO: 6036868 - DNA, 17 bp, Homo sapiens
catatgaggacctttat

SEQ ID NO: 6036869 - DNA, 22 bp, Homo sapiens
catatgagtaagggcactgacg

SEQ ID NO: 6036870 - DNA, 23 bp, Homo sapiens
catatgagtttcatagctaagaa

SEQ ID NO: 6036871 - DNA, 19 bp, Homo sapiens
catatgataggcagcactg

SEQ ID NO: 6036872 - DNA, 22 bp, Homo sapiens
catatgatccagttaacatcat

SEQ ID NO: 6036873 - DNA, 13 bp, Homo sapiens
catatgatctgtt

SEQ ID NO: 6036874 - DNA, 23 bp, Homo sapiens
catatgattctcttagacacttt

SEQ ID NO: 6036875 - DNA, 14 bp, Homo sapiens
catatgattctgct

SEQ ID NO: 6036876 - DNA, 19 bp, Homo sapiens
catatgattgaaaagaaga

SEQ ID NO: 6036877 - DNA, 20 bp, Homo sapiens
catatgatttcactagaaaa

SEQ ID NO: 6036878 - DNA, 18 bp, Homo sapiens
catatgatttcttgcttt

SEQ ID NO: 6036879 - DNA, 17 bp, Homo sapiens
catatgcaccttgtgtc

SEQ ID NO: 6036880 - DNA, 18 bp, Homo sapiens
catatgcaccttgtgtct

SEQ ID NO: 6036881 - DNA, 13 bp, Homo sapiens
catatgcagaaat

SEQ ID NO: 6036882 - DNA, 20 bp, Homo sapiens
catatgcatattttttttct

SEQ ID NO: 6036883 - DNA, 18 bp, Homo sapiens
catatgcatgcccttcct

SEQ ID NO: 6036884 - DNA, 21 bp, Homo sapiens
catatgccaccccatgtgcct

SEQ ID NO: 6036885 - DNA, 15 bp, Homo sapiens
catatgcccacattt

SEQ ID NO: 6036886 - DNA, 22 bp, Homo sapiens
catatgcctacaaagctctgaa

SEQ ID NO: 6036887 - DNA, 15 bp, Homo sapiens
catatgcctacttgt

SEQ ID NO: 6036888 - DNA, 21 bp, Homo sapiens
catatgcctacttgtaatttc

SEQ ID NO: 6036889 - DNA, 21 bp, Homo sapiens
catatgcctgaccccttgctc

SEQ ID NO: 6036890 - DNA, 20 bp, Homo sapiens
catatgctacacatatgtgc

SEQ ID NO: 6036891 - DNA, 22 bp, Homo sapiens
catatgcttcaaactaacacat

SEQ ID NO: 6036892 - DNA, 15 bp, Homo sapiens
catatgcttctttaa

SEQ ID NO: 6036893 - DNA, 15 bp, Homo sapiens
catatggaaaagatt

SEQ ID NO: 6036894 - DNA, 13 bp, Homo sapiens
catatggaaatgt

SEQ ID NO: 6036895 - DNA, 22 bp, Homo sapiens
catatggaaatgttactgtctg

SEQ ID NO: 6036896 - DNA, 21 bp, Homo sapiens
catatggacactgtgacaatg

SEQ ID NO: 6036897 - DNA, 12 bp, Homo sapiens
catatggaggac

SEQ ID NO: 6036898 - DNA, 21 bp, Homo sapiens
catatggagtgcctgtacaag

SEQ ID NO: 6036899 - DNA, 14 bp, Homo sapiens
catatggataaata

SEQ ID NO: 6036900 - DNA, 15 bp, Homo sapiens
catatggatgttact

SEQ ID NO: 6036901 - DNA, 22 bp, Homo sapiens
catatggattgccaagtcagca

SEQ ID NO: 6036902 - DNA, 18 bp, Homo sapiens
catatggattttctattg

SEQ ID NO: 6036903 - DNA, 20 bp, Homo sapiens
catatggattttctattgtt

SEQ ID NO: 6036904 - DNA, 15 bp, Homo sapiens
catatggcccagtgt

SEQ ID NO: 6036905 - DNA, 16 bp, Homo sapiens
catatggcccagtgtc

SEQ ID NO: 6036906 - DNA, 18 bp, Homo sapiens
catatgggaactatgagg

SEQ ID NO: 6036907 - DNA, 22 bp, Homo sapiens
catatgggatattcccaagccg

SEQ ID NO: 6036908 - DNA, 14 bp, Homo sapiens
catatggtagacaa

SEQ ID NO: 6036909 - DNA, 16 bp, Homo sapiens
catatggtaggaccct

SEQ ID NO: 6036910 - DNA, 18 bp, Homo sapiens
catatggttgaataaata

SEQ ID NO: 6036911 - DNA, 14 bp, Homo sapiens
catatgtaaacata

SEQ ID NO: 6036912 - DNA, 13 bp, Homo sapiens
catatgtacagaa

SEQ ID NO: 6036913 - DNA, 15 bp, Homo sapiens
catatgtacagaaga

SEQ ID NO: 6036914 - DNA, 15 bp, Homo sapiens
catatgtacataaat

SEQ ID NO: 6036915 - DNA, 16 bp, Homo sapiens
catatgtacataaatt

SEQ ID NO: 6036916 - DNA, 23 bp, Homo sapiens
catatgtagaaacatttagattt

SEQ ID NO: 6036917 - DNA, 17 bp, Homo sapiens
catatgtagactatata

SEQ ID NO: 6036918 - DNA, 19 bp, Homo sapiens
catatgtagactatataca

SEQ ID NO: 6036919 - DNA, 13 bp, Homo sapiens
catatgtagccct

SEQ ID NO: 6036920 - DNA, 15 bp, Homo sapiens
catatgtagccctca

SEQ ID NO: 6036921 - DNA, 17 bp, Homo sapiens
catatgtagccctcatg

SEQ ID NO: 6036922 - DNA, 17 bp, Homo sapiens
catatgtagccttcaca

SEQ ID NO: 6036923 - DNA, 19 bp, Homo sapiens
catatgtaggaaaattttc

SEQ ID NO: 6036924 - DNA, 21 bp, Homo sapiens
catatgtaggaaaattttctt

SEQ ID NO: 6036925 - DNA, 15 bp, Homo sapiens
catatgtatacatgt

SEQ ID NO: 6036926 - DNA, 14 bp, Homo sapiens
catatgtatctttg

SEQ ID NO: 6036927 - DNA, 14 bp, Homo sapiens
catatgtatgtgtg

SEQ ID NO: 6036928 - DNA, 17 bp, Homo sapiens
catatgtattcctgatc

SEQ ID NO: 6036929 - DNA, 21 bp, Homo sapiens
catatgtctataacaaaagca

SEQ ID NO: 6036930 - DNA, 16 bp, Homo sapiens
catatgtctgtctttg

SEQ ID NO: 6036931 - DNA, 23 bp, Homo sapiens
catatgtcttactactttaaatc

SEQ ID NO: 6036932 - DNA, 14 bp, Homo sapiens
catatgtgatctgt

SEQ ID NO: 6036933 - DNA, 16 bp, Homo sapiens
catatgtgatctgtct

SEQ ID NO: 6036934 - DNA, 20 bp, Homo sapiens
catatgtgatctgtcttgta

SEQ ID NO: 6036935 - DNA, 14 bp, Homo sapiens
catatgtgcttctc

SEQ ID NO: 6036936 - DNA, 16 bp, Homo sapiens
catatgtggaaatata

SEQ ID NO: 6036937 - DNA, 13 bp, Homo sapiens
catatgtgtgtgt

SEQ ID NO: 6036938 - DNA, 17 bp, Homo sapiens
catatgtgttacttcaa

SEQ ID NO: 6036939 - DNA, 18 bp, Homo sapiens
catatgtgttacttcaag

SEQ ID NO: 6036940 - DNA, 17 bp, Homo sapiens
catatgttccatgcctg

SEQ ID NO: 6036941 - DNA, 19 bp, Homo sapiens
catatgttccatgcctggc

SEQ ID NO: 6036942 - DNA, 17 bp, Homo sapiens
catatgtttattcaaaa

SEQ ID NO: 6036943 - DNA, 19 bp, Homo sapiens
catatgtttattcaaaata

SEQ ID NO: 6036944 - DNA, 13 bp, Homo sapiens
catatgtttcccc

SEQ ID NO: 6036945 - DNA, 19 bp, Homo sapiens
catatgtttccccatctct

SEQ ID NO: 6036946 - DNA, 22 bp, Homo sapiens
catatgtttcgctgatatatgt

SEQ ID NO: 6036947 - DNA, 14 bp, Homo sapiens
catatgtttggtaa

SEQ ID NO: 6036948 - DNA, 15 bp, Homo sapiens
catattaaaatcaca

SEQ ID NO: 6036949 - DNA, 20 bp, Homo sapiens
catattaaaattacagatgt

SEQ ID NO: 6036950 - DNA, 22 bp, Homo sapiens
catattaaacaaaaacaaagaa

SEQ ID NO: 6036951 - DNA, 18 bp, Homo sapiens
catattaaacttctgatt

SEQ ID NO: 6036952 - DNA, 19 bp, Homo sapiens
catattaaagataagactt

SEQ ID NO: 6036953 - DNA, 13 bp, Homo sapiens
catattaaaggct

SEQ ID NO: 6036954 - DNA, 21 bp, Homo sapiens
catattaacatattctaaata

SEQ ID NO: 6036955 - DNA, 15 bp, Homo sapiens
catattaagaatgat

SEQ ID NO: 6036956 - DNA, 18 bp, Homo sapiens
catattaagacagtgtac

SEQ ID NO: 6036957 - DNA, 21 bp, Homo sapiens
catattaagacagtgtacaaa

SEQ ID NO: 6036958 - DNA, 23 bp, Homo sapiens
catattaatacaatgatgctatt

SEQ ID NO: 6036959 - DNA, 15 bp, Homo sapiens
catattaatatattt

SEQ ID NO: 6036960 - DNA, 19 bp, Homo sapiens
catattaatatatttccat

SEQ ID NO: 6036961 - DNA, 14 bp, Homo sapiens
catattacaagaaa

SEQ ID NO: 6036962 - DNA, 21 bp, Homo sapiens
catattaccagaaaatgagtt

SEQ ID NO: 6036963 - DNA, 19 bp, Homo sapiens
catattactgtacatggga

SEQ ID NO: 6036964 - DNA, 13 bp, Homo sapiens
catattagaaaac

SEQ ID NO: 6036965 - DNA, 17 bp, Homo sapiens
catattagaaaactttg

SEQ ID NO: 6036966 - DNA, 15 bp, Homo sapiens
ccacctccctgccct

SEQ ID NO: 6036967 - DNA, 13 bp, Homo sapiens
ccacctccctgcg

SEQ ID NO: 6036968 - DNA, 16 bp, Homo sapiens
ccacctcccttcccac

SEQ ID NO: 6036969 - DNA, 18 bp, Homo sapiens
ccacctcctaaaaggccc

SEQ ID NO: 6036970 - DNA, 21 bp, Homo sapiens
ccacctcctaaaaggcccaga

SEQ ID NO: 6036971 - DNA, 21 bp, Homo sapiens
ccacctcctaccccttcctgt

SEQ ID NO: 6036972 - DNA, 11 bp, Homo sapiens
ccacctcctcc

SEQ ID NO: 6036973 - DNA, 13 bp, Homo sapiens
ccacctcctcccc

SEQ ID NO: 6036974 - DNA, 17 bp, Homo sapiens
ccacctcctccccctgt

SEQ ID NO: 6036975 - DNA, 20 bp, Homo sapiens
ccacctcctccccctgttct

SEQ ID NO: 6036976 - DNA, 14 bp, Homo sapiens
ccacctcctctctt

SEQ ID NO: 6036977 - DNA, 20 bp, Homo sapiens
ccacctcctctgccagcagg

SEQ ID NO: 6036978 - DNA, 21 bp, Homo sapiens
ccacctcctgacacccttctc

SEQ ID NO: 6036979 - DNA, 11 bp, Homo sapiens
ccacctcctgc

SEQ ID NO: 6036980 - DNA, 18 bp, Homo sapiens
ccacctcctgcggctcag

SEQ ID NO: 6036981 - DNA, 14 bp, Homo sapiens
ccacctcctgggtt

SEQ ID NO: 6036982 - DNA, 20 bp, Homo sapiens
ccacctccttccagcactga

SEQ ID NO: 6036983 - DNA, 21 bp, Homo sapiens
ccacctcgcaggttcaagcaa

SEQ ID NO: 6036984 - DNA, 19 bp, Homo sapiens
ccacctcgcggcgcagccc

SEQ ID NO: 6036985 - DNA, 22 bp, Homo sapiens
ccacctcgctcccctctggaat

SEQ ID NO: 6036986 - DNA, 17 bp, Homo sapiens
ccacctcggacaccatc

SEQ ID NO: 6036987 - DNA, 13 bp, Homo sapiens
ccacctcggagca

SEQ ID NO: 6036988 - DNA, 21 bp, Homo sapiens
ccacctcggagcatggtgttt

SEQ ID NO: 6036989 - DNA, 19 bp, Homo sapiens
ccacctcggatcccactga

SEQ ID NO: 6036990 - DNA, 14 bp, Homo sapiens
ccacctcggcctcc

SEQ ID NO: 6036991 - DNA, 14 bp, Homo sapiens
ccacctcggtcact

SEQ ID NO: 6036992 - DNA, 15 bp, Homo sapiens
ccacctctaacagca

SEQ ID NO: 6036993 - DNA, 12 bp, Homo sapiens
ccacctctccaa

SEQ ID NO: 6036994 - DNA, 13 bp, Homo sapiens
ccacctctccaag

SEQ ID NO: 6036995 - DNA, 14 bp, Homo sapiens
ccacctctccaagg

SEQ ID NO: 6036996 - DNA, 15 bp, Homo sapiens
ccacctctccaaggg

SEQ ID NO: 6036997 - DNA, 21 bp, Homo sapiens
ccacctctccaagtctctctg

SEQ ID NO: 6036998 - DNA, 23 bp, Homo sapiens
ccacctctccaagtctctctgtg

SEQ ID NO: 6036999 - DNA, 17 bp, Homo sapiens
ccacctctccctgaccc

SEQ ID NO: 6037000 - DNA, 24 bp, Homo sapiens
ccacctctccctgcatcctgaggc

SEQ ID NO: 6037001 - DNA, 17 bp, Homo sapiens
ccacctctctcctttgc

SEQ ID NO: 6037002 - DNA, 19 bp, Homo sapiens
ccacctctctcctttgctg

SEQ ID NO: 6037003 - DNA, 24 bp, Homo sapiens
ccacctctctcctttgctgaggcc

SEQ ID NO: 6037004 - DNA, 18 bp, Homo sapiens
ccacctctctgcctgttc

SEQ ID NO: 6037005 - DNA, 19 bp, Homo sapiens
ccacctctctgcctgttcc

SEQ ID NO: 6037006 - DNA, 13 bp, Homo sapiens
ccacctctctgtc

SEQ ID NO: 6037007 - DNA, 17 bp, Homo sapiens
ccacctctctgtctttt

SEQ ID NO: 6037008 - DNA, 23 bp, Homo sapiens
ccacctctcttttcctctctgtc

SEQ ID NO: 6037009 - DNA, 23 bp, Homo sapiens
ccacctctgacgcaccactgcca

SEQ ID NO: 6037010 - DNA, 12 bp, Homo sapiens
ccacctctgcca

SEQ ID NO: 6037011 - DNA, 11 bp, Homo sapiens
ccacctctgcg

SEQ ID NO: 6037012 - DNA, 14 bp, Homo sapiens
ccacctctggccct

SEQ ID NO: 6037013 - DNA, 17 bp, Homo sapiens
ccacctctggccctgtg

SEQ ID NO: 6037014 - DNA, 18 bp, Homo sapiens
ccacctctggccctgtgt

SEQ ID NO: 6037015 - DNA, 18 bp, Homo sapiens
ccacctctgtcatttgtt

SEQ ID NO: 6037016 - DNA, 11 bp, Homo sapiens
ccacctctgtg

SEQ ID NO: 6037017 - DNA, 14 bp, Homo sapiens
ccacctctgtgacc

SEQ ID NO: 6037018 - DNA, 17 bp, Homo sapiens
ccacctctgtgcagggc

SEQ ID NO: 6037019 - DNA, 19 bp, Homo sapiens
ccacctctgtgcagggcac

SEQ ID NO: 6037020 - DNA, 13 bp, Homo sapiens
ccacctctgtggg

SEQ ID NO: 6037021 - DNA, 13 bp, Homo sapiens
ccacctcttcctg

SEQ ID NO: 6037022 - DNA, 17 bp, Homo sapiens
ccacctcttcctggccg

SEQ ID NO: 6037023 - DNA, 19 bp, Homo sapiens
ccacctcttgggcatgctc

SEQ ID NO: 6037024 - DNA, 17 bp, Homo sapiens
ccacctctttcttcaat

SEQ ID NO: 6037025 - DNA, 20 bp, Homo sapiens
ccacctgaaagcctgtctct

SEQ ID NO: 6037026 - DNA, 16 bp, Homo sapiens
ccacctgaagggtgga

SEQ ID NO: 6037027 - DNA, 20 bp, Homo sapiens
ccacctgaataaagaatgaa

SEQ ID NO: 6037028 - DNA, 18 bp, Homo sapiens
ccacctgacaatggcagc

SEQ ID NO: 6037029 - DNA, 21 bp, Homo sapiens
ccacctgacaatggcagctag

SEQ ID NO: 6037030 - DNA, 16 bp, Homo sapiens
ccacctgacacaccag

SEQ ID NO: 6037031 - DNA, 17 bp, Homo sapiens
ccacctgacgctgcatg

SEQ ID NO: 6037032 - DNA, 15 bp, Homo sapiens
ccacctgaggcagga

SEQ ID NO: 6037033 - DNA, 16 bp, Homo sapiens
ccacctgaggcaggag

SEQ ID NO: 6037034 - DNA, 22 bp, Homo sapiens
ccacctgaggcaggagggcatg

SEQ ID NO: 6037035 - DNA, 20 bp, Homo sapiens
ccacctgaggctcagcccta

SEQ ID NO: 6037036 - DNA, 15 bp, Homo sapiens
ccacctgaggtgggc

SEQ ID NO: 6037037 - DNA, 21 bp, Homo sapiens
ccacctgaggtgggctggggc

SEQ ID NO: 6037038 - DNA, 11 bp, Homo sapiens
ccacctgcaag

SEQ ID NO: 6037039 - DNA, 13 bp, Homo sapiens
ccacctgcaagtg

SEQ ID NO: 6037040 - DNA, 20 bp, Homo sapiens
ccacctgcaagtgcccgccc

SEQ ID NO: 6037041 - DNA, 22 bp, Homo sapiens
ccacctgcacaaacatagacag

SEQ ID NO: 6037042 - DNA, 17 bp, Homo sapiens
ccacctgcagggctgcc

SEQ ID NO: 6037043 - DNA, 15 bp, Homo sapiens
ccacctgcatcagcc

SEQ ID NO: 6037044 - DNA, 18 bp, Homo sapiens
ccacctgcatctggggcc

SEQ ID NO: 6037045 - DNA, 20 bp, Homo sapiens
ccacctgccacccccaggtc

SEQ ID NO: 6037046 - DNA, 15 bp, Homo sapiens
ccacctgccagccat

SEQ ID NO: 6037047 - DNA, 15 bp, Homo sapiens
ccacctgccaggcct

SEQ ID NO: 6037048 - DNA, 15 bp, Homo sapiens
ccacctgccagggac

SEQ ID NO: 6037049 - DNA, 16 bp, Homo sapiens
ccacctgccagggaca

SEQ ID NO: 6037050 - DNA, 14 bp, Homo sapiens
ccacctgcccaacc

SEQ ID NO: 6037051 - DNA, 13 bp, Homo sapiens
ccacctgcccagt

SEQ ID NO: 6037052 - DNA, 21 bp, Homo sapiens
ccacctgcccagttagcccgg

SEQ ID NO: 6037053 - DNA, 14 bp, Homo sapiens
ccacctgcccatca

SEQ ID NO: 6037054 - DNA, 20 bp, Homo sapiens
ccacctgcccatcacagggt

SEQ ID NO: 6037055 - DNA, 20 bp, Homo sapiens
ccacctgcccccttctccca

SEQ ID NO: 6037056 - DNA, 14 bp, Homo sapiens
ccacctgcctatcc

SEQ ID NO: 6037057 - DNA, 12 bp, Homo sapiens
ccacctgcctgc

SEQ ID NO: 6037058 - DNA, 13 bp, Homo sapiens
ccacctgcctggc

SEQ ID NO: 6037059 - DNA, 15 bp, Homo sapiens
ccacctgcctggccg

SEQ ID NO: 6037060 - DNA, 16 bp, Homo sapiens
ccacctgcctggccgg

SEQ ID NO: 6037061 - DNA, 15 bp, Homo sapiens
ccacctgcctggtgc

SEQ ID NO: 6037062 - DNA, 20 bp, Homo sapiens
ccacctgcgcttctgctgga

SEQ ID NO: 6037063 - DNA, 22 bp, Homo sapiens
ccacctgcgcttctgctggagg

SEQ ID NO: 6037064 - DNA, 15 bp, Homo sapiens
ccacctgctctgctg

SEQ ID NO: 6037065 - DNA, 12 bp, Homo sapiens
ccacctgctctt

SEQ ID NO: 6037066 - DNA, 14 bp, Homo sapiens
ccacctgctgcccg

SEQ ID NO: 6037067 - DNA, 15 bp, Homo sapiens
ccacctgctgcccgt

SEQ ID NO: 6037068 - DNA, 17 bp, Homo sapiens
ccacctgctgcccgtga

SEQ ID NO: 6037069 - DNA, 14 bp, Homo sapiens
ccacctgcttctga

SEQ ID NO: 6037070 - DNA, 23 bp, Homo sapiens
ccacctgcttgtgttgggcccca

SEQ ID NO: 6037071 - DNA, 19 bp, Homo sapiens
ccacctgctttctcctggg

SEQ ID NO: 6037072 - DNA, 21 bp, Homo sapiens
ccacctggaaactgctcagac

SEQ ID NO: 6037073 - DNA, 12 bp, Homo sapiens
ccacctggaaag

SEQ ID NO: 6037074 - DNA, 16 bp, Homo sapiens
ccacctggaaagccag

SEQ ID NO: 6037075 - DNA, 16 bp, Homo sapiens
ccacctggaagccgcg

SEQ ID NO: 6037076 - DNA, 16 bp, Homo sapiens
ccacctggacacacac

SEQ ID NO: 6037077 - DNA, 17 bp, Homo sapiens
ccacctggacacacact

SEQ ID NO: 6037078 - DNA, 22 bp, Homo sapiens
ccacctggacacacactcacca

SEQ ID NO: 6037079 - DNA, 11 bp, Homo sapiens
ccacctggacc

SEQ ID NO: 6037080 - DNA, 12 bp, Homo sapiens
ccacctggaccc

SEQ ID NO: 6037081 - DNA, 20 bp, Homo sapiens
ccacctggacccctgcattg

SEQ ID NO: 6037082 - DNA, 21 bp, Homo sapiens
ccacctggacccctgcattgg

SEQ ID NO: 6037083 - DNA, 19 bp, Homo sapiens
ccacctggacgaagagcag

SEQ ID NO: 6037084 - DNA, 11 bp, Homo sapiens
ccacctggaga

SEQ ID NO: 6037085 - DNA, 23 bp, Homo sapiens
ccacctggatctatccctgcggc

SEQ ID NO: 6037086 - DNA, 20 bp, Homo sapiens
ccacctggatggatctgctc

SEQ ID NO: 6037087 - DNA, 22 bp, Homo sapiens
ccacctggcagggctcacactc

SEQ ID NO: 6037088 - DNA, 15 bp, Homo sapiens
ccacctggccacctg

SEQ ID NO: 6037089 - DNA, 12 bp, Homo sapiens
ccacctggccct

SEQ ID NO: 6037090 - DNA, 14 bp, Homo sapiens
ccacctggcctctg

SEQ ID NO: 6037091 - DNA, 15 bp, Homo sapiens
ccacctggcctctgc

SEQ ID NO: 6037092 - DNA, 16 bp, Homo sapiens
ccacctggcctctgca

SEQ ID NO: 6037093 - DNA, 17 bp, Homo sapiens
ccacctggcctctgcac

SEQ ID NO: 6037094 - DNA, 13 bp, Homo sapiens
ccacctggcggag

SEQ ID NO: 6037095 - DNA, 13 bp, Homo sapiens
ccacctggctccc

SEQ ID NO: 6037096 - DNA, 18 bp, Homo sapiens
ccacctggctctcacctc

SEQ ID NO: 6037097 - DNA, 19 bp, Homo sapiens
ccacctggctctcacctct

SEQ ID NO: 6037098 - DNA, 14 bp, Homo sapiens
ccacctggctgcca

SEQ ID NO: 6037099 - DNA, 13 bp, Homo sapiens
ccacctgggagat

SEQ ID NO: 6037100 - DNA, 18 bp, Homo sapiens
ccacctgggagatgctgg

SEQ ID NO: 6037101 - DNA, 19 bp, Homo sapiens
ccacctgggccctaggcat

SEQ ID NO: 6037102 - DNA, 17 bp, Homo sapiens
ccacctgggctgggaga

SEQ ID NO: 6037103 - DNA, 21 bp, Homo sapiens
ccacctggggtctctctccct

SEQ ID NO: 6037104 - DNA, 15 bp, Homo sapiens
ccacctggtggccct

SEQ ID NO: 6037105 - DNA, 16 bp, Homo sapiens
ccacctggtggccctg

SEQ ID NO: 6037106 - DNA, 17 bp, Homo sapiens
ccacctggtggccctgc

SEQ ID NO: 6037107 - DNA, 21 bp, Homo sapiens
ccacctggttccggaatcctg

SEQ ID NO: 6037108 - DNA, 13 bp, Homo sapiens
ccacctgtacata

SEQ ID NO: 6037109 - DNA, 21 bp, Homo sapiens
ccacctgtagccatctgcaca

SEQ ID NO: 6037110 - DNA, 12 bp, Homo sapiens
ccacctgtagct

SEQ ID NO: 6037111 - DNA, 20 bp, Homo sapiens
ccacctgtcaaacaaagcca

SEQ ID NO: 6037112 - DNA, 15 bp, Homo sapiens
ccacctgtcccacct

SEQ ID NO: 6037113 - DNA, 16 bp, Homo sapiens
ccacctgtcccacctc

SEQ ID NO: 6037114 - DNA, 23 bp, Homo sapiens
ccacctgtctcagcctcccagag

SEQ ID NO: 6037115 - DNA, 12 bp, Homo sapiens
ccacctgtctgt

SEQ ID NO: 6037116 - DNA, 14 bp, Homo sapiens
ccacctgtctgtct

SEQ ID NO: 6037117 - DNA, 16 bp, Homo sapiens
ccacctgtctgtctgt

SEQ ID NO: 6037118 - DNA, 22 bp, Homo sapiens
ccacctgtctgtctgtctgtcc

SEQ ID NO: 6037119 - DNA, 18 bp, Homo sapiens
ccacctgtcttggcctcc

SEQ ID NO: 6037120 - DNA, 15 bp, Homo sapiens
ccacctgtggggcct

SEQ ID NO: 6037121 - DNA, 16 bp, Homo sapiens
ccacctgtggggcctg

SEQ ID NO: 6037122 - DNA, 19 bp, Homo sapiens
ccacctgtggggcctgggg

SEQ ID NO: 6037123 - DNA, 20 bp, Homo sapiens
ccacctgtggggcctgggga

SEQ ID NO: 6037124 - DNA, 19 bp, Homo sapiens
ccacctgttcaggagctga

SEQ ID NO: 6037125 - DNA, 16 bp, Homo sapiens
ccaccttaaattaaac

SEQ ID NO: 6037126 - DNA, 22 bp, Homo sapiens
ccaccttaaattaaacaattta

SEQ ID NO: 6037127 - DNA, 21 bp, Homo sapiens
ccaccttaccctactggctgt

SEQ ID NO: 6037128 - DNA, 17 bp, Homo sapiens
ccaccttatacatcact

SEQ ID NO: 6037129 - DNA, 17 bp, Homo sapiens
ccaccttcaattcctgg

SEQ ID NO: 6037130 - DNA, 19 bp, Homo sapiens
ccaccttcaattcctgggc

SEQ ID NO: 6037131 - DNA, 20 bp, Homo sapiens
ccaccttcaattcctgggcc

SEQ ID NO: 6037132 - DNA, 16 bp, Homo sapiens
ccaccttccagtgagc

SEQ ID NO: 6037133 - DNA, 14 bp, Homo sapiens
ccaccttcccagct

SEQ ID NO: 6037134 - DNA, 21 bp, Homo sapiens
ccaccttcccagctctccctc

SEQ ID NO: 6037135 - DNA, 12 bp, Homo sapiens
ccaccttcccca

SEQ ID NO: 6037136 - DNA, 20 bp, Homo sapiens
ccaccttccccagactcagc

SEQ ID NO: 6037137 - DNA, 22 bp, Homo sapiens
ccaccttccccagactcagctc

SEQ ID NO: 6037138 - DNA, 11 bp, Homo sapiens
ccaccttccct

SEQ ID NO: 6037139 - DNA, 12 bp, Homo sapiens
ccaccttccctt

SEQ ID NO: 6037140 - DNA, 24 bp, Homo sapiens
ccaccttcccttcctcagcaggcc

SEQ ID NO: 6037141 - DNA, 13 bp, Homo sapiens
ccaccttccgttc

SEQ ID NO: 6037142 - DNA, 19 bp, Homo sapiens
ccaccttccgttccccgct

SEQ ID NO: 6037143 - DNA, 22 bp, Homo sapiens
ccaccttcgggcagtcctgtgt

SEQ ID NO: 6037144 - DNA, 23 bp, Homo sapiens
ccaccttcgggcagtcctgtgtg

SEQ ID NO: 6037145 - DNA, 21 bp, Homo sapiens
ccaccttctcacatggaatga

SEQ ID NO: 6037146 - DNA, 14 bp, Homo sapiens
catattaggaaaat

SEQ ID NO: 6037147 - DNA, 19 bp, Homo sapiens
catattaggtggttctctt

SEQ ID NO: 6037148 - DNA, 17 bp, Homo sapiens
catattataaaggataa

SEQ ID NO: 6037149 - DNA, 13 bp, Homo sapiens
catattataaata

SEQ ID NO: 6037150 - DNA, 17 bp, Homo sapiens
catattataaataaatg

SEQ ID NO: 6037151 - DNA, 16 bp, Homo sapiens
catattatatcagact

SEQ ID NO: 6037152 - DNA, 23 bp, Homo sapiens
catattatatcagactgctttga

SEQ ID NO: 6037153 - DNA, 22 bp, Homo sapiens
catattatcatcctataaagaa

SEQ ID NO: 6037154 - DNA, 13 bp, Homo sapiens
catattatgtctt

SEQ ID NO: 6037155 - DNA, 13 bp, Homo sapiens
catattatttcat

SEQ ID NO: 6037156 - DNA, 23 bp, Homo sapiens
catattattttagtgtgtaaaat

SEQ ID NO: 6037157 - DNA, 16 bp, Homo sapiens
catattcaaagtatat

SEQ ID NO: 6037158 - DNA, 14 bp, Homo sapiens
catattcaaatcag

SEQ ID NO: 6037159 - DNA, 15 bp, Homo sapiens
catattcaacacact

SEQ ID NO: 6037160 - DNA, 15 bp, Homo sapiens
catattcaactattc

SEQ ID NO: 6037161 - DNA, 16 bp, Homo sapiens
catattcaactattct

SEQ ID NO: 6037162 - DNA, 18 bp, Homo sapiens
catattcaactattcttc

SEQ ID NO: 6037163 - DNA, 18 bp, Homo sapiens
catattcaaggagcaaga

SEQ ID NO: 6037164 - DNA, 16 bp, Homo sapiens
catattcaatgcaagt

SEQ ID NO: 6037165 - DNA, 12 bp, Homo sapiens
catattcaatgt

SEQ ID NO: 6037166 - DNA, 16 bp, Homo sapiens
catattcagacatcaa

SEQ ID NO: 6037167 - DNA, 14 bp, Homo sapiens
catattcaggaagc

SEQ ID NO: 6037168 - DNA, 20 bp, Homo sapiens
catattcaggaagctcaggg

SEQ ID NO: 6037169 - DNA, 17 bp, Homo sapiens
catattcatgaaatgtg

SEQ ID NO: 6037170 - DNA, 14 bp, Homo sapiens
catattcattcatg

SEQ ID NO: 6037171 - DNA, 16 bp, Homo sapiens
catattccatatttat

SEQ ID NO: 6037172 - DNA, 17 bp, Homo sapiens
catattccatatttatt

SEQ ID NO: 6037173 - DNA, 17 bp, Homo sapiens
catattccctgcacaca

SEQ ID NO: 6037174 - DNA, 23 bp, Homo sapiens
catattccctgcacacacatgca

SEQ ID NO: 6037175 - DNA, 18 bp, Homo sapiens
catattcctgcagcctgg

SEQ ID NO: 6037176 - DNA, 15 bp, Homo sapiens
catattctaaattca

SEQ ID NO: 6037177 - DNA, 21 bp, Homo sapiens
catattctaacttattaaatt

SEQ ID NO: 6037178 - DNA, 21 bp, Homo sapiens
catattctagtgtaacactgc

SEQ ID NO: 6037179 - DNA, 13 bp, Homo sapiens
catattctattgt

SEQ ID NO: 6037180 - DNA, 20 bp, Homo sapiens
catattctattgtattattt

SEQ ID NO: 6037181 - DNA, 18 bp, Homo sapiens
catattctggttcttgaa

SEQ ID NO: 6037182 - DNA, 21 bp, Homo sapiens
catattctggttcttgaaaat

SEQ ID NO: 6037183 - DNA, 15 bp, Homo sapiens
catattctgttggaa

SEQ ID NO: 6037184 - DNA, 21 bp, Homo sapiens
catattcttgctttcacaaat

SEQ ID NO: 6037185 - DNA, 13 bp, Homo sapiens
catattcttggag

SEQ ID NO: 6037186 - DNA, 17 bp, Homo sapiens
catattcttggagaact

SEQ ID NO: 6037187 - DNA, 19 bp, Homo sapiens
catattcttggagaacttt

SEQ ID NO: 6037188 - DNA, 22 bp, Homo sapiens
catattcttggagaactttcca

SEQ ID NO: 6037189 - DNA, 20 bp, Homo sapiens
catattgaaaagcacagagg

SEQ ID NO: 6037190 - DNA, 12 bp, Homo sapiens
catattgagaat

SEQ ID NO: 6037191 - DNA, 21 bp, Homo sapiens
catattgagcacttgctgtat

SEQ ID NO: 6037192 - DNA, 18 bp, Homo sapiens
catattgataataaaatt

SEQ ID NO: 6037193 - DNA, 22 bp, Homo sapiens
catattgataataaaattcatt

SEQ ID NO: 6037194 - DNA, 20 bp, Homo sapiens
catattgcacatgtcttaat

SEQ ID NO: 6037195 - DNA, 22 bp, Homo sapiens
catattgcacatgtcttaatga

SEQ ID NO: 6037196 - DNA, 22 bp, Homo sapiens
catattgcaggagacattttca

SEQ ID NO: 6037197 - DNA, 17 bp, Homo sapiens
catattgctcttaaaaa

SEQ ID NO: 6037198 - DNA, 17 bp, Homo sapiens
catattgctgagagaaa

SEQ ID NO: 6037199 - DNA, 16 bp, Homo sapiens
catattggaaagtgat

SEQ ID NO: 6037200 - DNA, 14 bp, Homo sapiens
catattggtattca

SEQ ID NO: 6037201 - DNA, 16 bp, Homo sapiens
catattggtattcact

SEQ ID NO: 6037202 - DNA, 14 bp, Homo sapiens
catattgtaatcta

SEQ ID NO: 6037203 - DNA, 12 bp, Homo sapiens
catattgtacac

SEQ ID NO: 6037204 - DNA, 13 bp, Homo sapiens
catattgtacact

SEQ ID NO: 6037205 - DNA, 20 bp, Homo sapiens
catattgtacacttttttgg

SEQ ID NO: 6037206 - DNA, 21 bp, Homo sapiens
catattgtgcttcacagtaga

SEQ ID NO: 6037207 - DNA, 17 bp, Homo sapiens
catattgtggcacaagc

SEQ ID NO: 6037208 - DNA, 18 bp, Homo sapiens
catattgtggcacaagca

SEQ ID NO: 6037209 - DNA, 13 bp, Homo sapiens
catattgttactg

SEQ ID NO: 6037210 - DNA, 16 bp, Homo sapiens
catattgttggcacag

SEQ ID NO: 6037211 - DNA, 18 bp, Homo sapiens
catattgttggcacagaa

SEQ ID NO: 6037212 - DNA, 15 bp, Homo sapiens
catattgtttgatct

SEQ ID NO: 6037213 - DNA, 22 bp, Homo sapiens
catattgttttaaaataagaat

SEQ ID NO: 6037214 - DNA, 12 bp, Homo sapiens
catatttaagaa

SEQ ID NO: 6037215 - DNA, 11 bp, Homo sapiens
catatttaagg

SEQ ID NO: 6037216 - DNA, 14 bp, Homo sapiens
catatttaatgttt

SEQ ID NO: 6037217 - DNA, 16 bp, Homo sapiens
catatttaatgtttta

SEQ ID NO: 6037218 - DNA, 20 bp, Homo sapiens
catatttaatgttttaaatg

SEQ ID NO: 6037219 - DNA, 18 bp, Homo sapiens
catatttaatttgaagat

SEQ ID NO: 6037220 - DNA, 17 bp, Homo sapiens
catatttaatttgaagg

SEQ ID NO: 6037221 - DNA, 19 bp, Homo sapiens
catatttacattctagttc

SEQ ID NO: 6037222 - DNA, 18 bp, Homo sapiens
catatttacctcagcctg

SEQ ID NO: 6037223 - DNA, 16 bp, Homo sapiens
catatttacctgtgaa

SEQ ID NO: 6037224 - DNA, 13 bp, Homo sapiens
catatttactacc

SEQ ID NO: 6037225 - DNA, 17 bp, Homo sapiens
catatttacttcttata

SEQ ID NO: 6037226 - DNA, 13 bp, Homo sapiens
catatttagtata

SEQ ID NO: 6037227 - DNA, 21 bp, Homo sapiens
catatttagtataccagagaa

SEQ ID NO: 6037228 - DNA, 15 bp, Homo sapiens
catatttataagaga

SEQ ID NO: 6037229 - DNA, 17 bp, Homo sapiens
catatttataagagaag

SEQ ID NO: 6037230 - DNA, 13 bp, Homo sapiens
catatttatactt

SEQ ID NO: 6037231 - DNA, 14 bp, Homo sapiens
catatttatacttt

SEQ ID NO: 6037232 - DNA, 19 bp, Homo sapiens
catatttatattgtatatt

SEQ ID NO: 6037233 - DNA, 22 bp, Homo sapiens
catatttatccaaaatgtgtat

SEQ ID NO: 6037234 - DNA, 17 bp, Homo sapiens
catatttatccatttgt

SEQ ID NO: 6037235 - DNA, 16 bp, Homo sapiens
catatttattgcattg

SEQ ID NO: 6037236 - DNA, 13 bp, Homo sapiens
catatttatttca

SEQ ID NO: 6037237 - DNA, 14 bp, Homo sapiens
catatttattttct

SEQ ID NO: 6037238 - DNA, 20 bp, Homo sapiens
catatttatttttacctgct

SEQ ID NO: 6037239 - DNA, 22 bp, Homo sapiens
catatttatttttacctgcttt

SEQ ID NO: 6037240 - DNA, 21 bp, Homo sapiens
catatttcaaaaacatgcttt

SEQ ID NO: 6037241 - DNA, 13 bp, Homo sapiens
catatttcatttt

SEQ ID NO: 6037242 - DNA, 16 bp, Homo sapiens
catatttctgtatatt

SEQ ID NO: 6037243 - DNA, 14 bp, Homo sapiens
catatttctttggc

SEQ ID NO: 6037244 - DNA, 12 bp, Homo sapiens
catatttgaaaa

SEQ ID NO: 6037245 - DNA, 22 bp, Homo sapiens
catatttgactctttcaaagaa

SEQ ID NO: 6037246 - DNA, 10 bp, Homo sapiens
catatttgag

SEQ ID NO: 6037247 - DNA, 12 bp, Homo sapiens
catatttgagaa

SEQ ID NO: 6037248 - DNA, 14 bp, Homo sapiens
catatttgatttct

SEQ ID NO: 6037249 - DNA, 12 bp, Homo sapiens
catatttgcact

SEQ ID NO: 6037250 - DNA, 14 bp, Homo sapiens
catatttgcactaa

SEQ ID NO: 6037251 - DNA, 17 bp, Homo sapiens
catatttgcatatgtat

SEQ ID NO: 6037252 - DNA, 19 bp, Homo sapiens
catatttgcatatgtatga

SEQ ID NO: 6037253 - DNA, 16 bp, Homo sapiens
catatttgccaataaa

SEQ ID NO: 6037254 - DNA, 18 bp, Homo sapiens
catatttgctaagaatgt

SEQ ID NO: 6037255 - DNA, 13 bp, Homo sapiens
catatttggaaga

SEQ ID NO: 6037256 - DNA, 23 bp, Homo sapiens
catatttggaataaaaattccag

SEQ ID NO: 6037257 - DNA, 21 bp, Homo sapiens
catatttggtgatgagactta

SEQ ID NO: 6037258 - DNA, 16 bp, Homo sapiens
catatttgtaaaatga

SEQ ID NO: 6037259 - DNA, 19 bp, Homo sapiens
catatttgtaaaatgacaa

SEQ ID NO: 6037260 - DNA, 14 bp, Homo sapiens
catatttgtagcta

SEQ ID NO: 6037261 - DNA, 18 bp, Homo sapiens
catatttgtctttgaatc

SEQ ID NO: 6037262 - DNA, 14 bp, Homo sapiens
catatttgtggaat

SEQ ID NO: 6037263 - DNA, 15 bp, Homo sapiens
catatttgtgttcag

SEQ ID NO: 6037264 - DNA, 18 bp, Homo sapiens
catatttgtgttcagttc

SEQ ID NO: 6037265 - DNA, 14 bp, Homo sapiens
catatttgttaaat

SEQ ID NO: 6037266 - DNA, 19 bp, Homo sapiens
catattttaaaaaatcaaa

SEQ ID NO: 6037267 - DNA, 13 bp, Homo sapiens
catattttaaaat

SEQ ID NO: 6037268 - DNA, 18 bp, Homo sapiens
catattttaaacagagga

SEQ ID NO: 6037269 - DNA, 16 bp, Homo sapiens
catattttaaattctc

SEQ ID NO: 6037270 - DNA, 15 bp, Homo sapiens
catattttaatcatt

SEQ ID NO: 6037271 - DNA, 18 bp, Homo sapiens
catattttaatcattatt

SEQ ID NO: 6037272 - DNA, 23 bp, Homo sapiens
catattttacttggaaatattaa

SEQ ID NO: 6037273 - DNA, 17 bp, Homo sapiens
catattttattactgtt

SEQ ID NO: 6037274 - DNA, 18 bp, Homo sapiens
catattttattgtatttt

SEQ ID NO: 6037275 - DNA, 22 bp, Homo sapiens
catattttattgtattttgatg

SEQ ID NO: 6037276 - DNA, 23 bp, Homo sapiens
catattttattgtattttgatga

SEQ ID NO: 6037277 - DNA, 18 bp, Homo sapiens
catattttcaccatttga

SEQ ID NO: 6037278 - DNA, 12 bp, Homo sapiens
catattttcatg

SEQ ID NO: 6037279 - DNA, 19 bp, Homo sapiens
catattttccccctgtttt

SEQ ID NO: 6037280 - DNA, 17 bp, Homo sapiens
catattttctgtccagt

SEQ ID NO: 6037281 - DNA, 13 bp, Homo sapiens
catattttcttac

SEQ ID NO: 6037282 - DNA, 20 bp, Homo sapiens
catattttgattattgtatt

SEQ ID NO: 6037283 - DNA, 12 bp, Homo sapiens
catattttgctg

SEQ ID NO: 6037284 - DNA, 14 bp, Homo sapiens
catatttttcacat

SEQ ID NO: 6037285 - DNA, 14 bp, Homo sapiens
catatttttctgtg

SEQ ID NO: 6037286 - DNA, 13 bp, Homo sapiens
catatttttgcac

SEQ ID NO: 6037287 - DNA, 18 bp, Homo sapiens
catcaaaaactttggagt

SEQ ID NO: 6037288 - DNA, 21 bp, Homo sapiens
catcaaaaagaaaaatcaaag

SEQ ID NO: 6037289 - DNA, 18 bp, Homo sapiens
catcaaaaagccttattt

SEQ ID NO: 6037290 - DNA, 22 bp, Homo sapiens
catcaaaacctaccctgtccta

SEQ ID NO: 6037291 - DNA, 19 bp, Homo sapiens
catcaaaagacaattcttt

SEQ ID NO: 6037292 - DNA, 16 bp, Homo sapiens
catcaaacaaatcatt

SEQ ID NO: 6037293 - DNA, 13 bp, Homo sapiens
catcaaacatgaa

SEQ ID NO: 6037294 - DNA, 17 bp, Homo sapiens
catcaaacctttgagta

SEQ ID NO: 6037295 - DNA, 11 bp, Homo sapiens
catcaaagact

SEQ ID NO: 6037296 - DNA, 22 bp, Homo sapiens
catcaaagcagaagtctggctt

SEQ ID NO: 6037297 - DNA, 12 bp, Homo sapiens
catcaaagccct

SEQ ID NO: 6037298 - DNA, 14 bp, Homo sapiens
catcaaagccctcc

SEQ ID NO: 6037299 - DNA, 14 bp, Homo sapiens
catcaaagcctggc

SEQ ID NO: 6037300 - DNA, 17 bp, Homo sapiens
catcaaagcctggccta

SEQ ID NO: 6037301 - DNA, 22 bp, Homo sapiens
catcaaaggaatataagaaaag

SEQ ID NO: 6037302 - DNA, 16 bp, Homo sapiens
catcaaagtggcaaaa

SEQ ID NO: 6037303 - DNA, 24 bp, Homo sapiens
catcaaagtggggtacagtaaaga

SEQ ID NO: 6037304 - DNA, 14 bp, Homo sapiens
catcaaataaattt

SEQ ID NO: 6037305 - DNA, 13 bp, Homo sapiens
catcaaataagaa

SEQ ID NO: 6037306 - DNA, 14 bp, Homo sapiens
catcaaataataca

SEQ ID NO: 6037307 - DNA, 14 bp, Homo sapiens
catcaaatatttct

SEQ ID NO: 6037308 - DNA, 20 bp, Homo sapiens
catcaaatgctgtagaatgc

SEQ ID NO: 6037309 - DNA, 21 bp, Homo sapiens
catcaacaaaagggagaacat

SEQ ID NO: 6037310 - DNA, 16 bp, Homo sapiens
catcaacaaagaaata

SEQ ID NO: 6037311 - DNA, 15 bp, Homo sapiens
catcaacaagaagaa

SEQ ID NO: 6037312 - DNA, 16 bp, Homo sapiens
catcaacaagatttcc

SEQ ID NO: 6037313 - DNA, 13 bp, Homo sapiens
catcaacaatgat

SEQ ID NO: 6037314 - DNA, 20 bp, Homo sapiens
catcaacaatgattaatcag

SEQ ID NO: 6037315 - DNA, 15 bp, Homo sapiens
catcaacattccagg

SEQ ID NO: 6037316 - DNA, 21 bp, Homo sapiens
catcaacattcttgtgtctgt

SEQ ID NO: 6037317 - DNA, 16 bp, Homo sapiens
catcaactaaagttgt

SEQ ID NO: 6037318 - DNA, 10 bp, Homo sapiens
catcaactga

SEQ ID NO: 6037319 - DNA, 14 bp, Homo sapiens
catcaactgaatga

SEQ ID NO: 6037320 - DNA, 15 bp, Homo sapiens
catcaagaaaacagc

SEQ ID NO: 6037321 - DNA, 12 bp, Homo sapiens
catcaagaaata

SEQ ID NO: 6037322 - DNA, 17 bp, Homo sapiens
catcaagaaatactttc

SEQ ID NO: 6037323 - DNA, 15 bp, Homo sapiens
catcaagaactattg

SEQ ID NO: 6037324 - DNA, 21 bp, Homo sapiens
catcaagaactattgtgtttt

SEQ ID NO: 6037325 - DNA, 16 bp, Homo sapiens
catcaagaagggctgc

SEQ ID NO: 6037326 - DNA, 20 bp, Homo sapiens
catcaagactatctacaaaa

SEQ ID NO: 6037327 - DNA, 21 bp, Homo sapiens
catcaagactatctacaaaaa

SEQ ID NO: 6037328 - DNA, 14 bp, Homo sapiens
ccaccttctcacct

SEQ ID NO: 6037329 - DNA, 13 bp, Homo sapiens
ccaccttctgcca

SEQ ID NO: 6037330 - DNA, 18 bp, Homo sapiens
ccaccttctgccaaggcc

SEQ ID NO: 6037331 - DNA, 12 bp, Homo sapiens
ccaccttctggg

SEQ ID NO: 6037332 - DNA, 20 bp, Homo sapiens
ccaccttctgtccccagccc

SEQ ID NO: 6037333 - DNA, 22 bp, Homo sapiens
ccaccttcttgggactgctgtg

SEQ ID NO: 6037334 - DNA, 15 bp, Homo sapiens
ccaccttgagcacta

SEQ ID NO: 6037335 - DNA, 21 bp, Homo sapiens
ccaccttgcactattggactt

SEQ ID NO: 6037336 - DNA, 18 bp, Homo sapiens
ccaccttgccagggcagg

SEQ ID NO: 6037337 - DNA, 19 bp, Homo sapiens
ccaccttgccagggcaggg

SEQ ID NO: 6037338 - DNA, 14 bp, Homo sapiens
ccaccttgcgggga

SEQ ID NO: 6037339 - DNA, 13 bp, Homo sapiens
ccaccttgctctt

SEQ ID NO: 6037340 - DNA, 16 bp, Homo sapiens
ccaccttggaccctgg

SEQ ID NO: 6037341 - DNA, 20 bp, Homo sapiens
ccaccttggaccctggtgac

SEQ ID NO: 6037342 - DNA, 19 bp, Homo sapiens
ccaccttggactcctccca

SEQ ID NO: 6037343 - DNA, 20 bp, Homo sapiens
ccaccttggactcctcccac

SEQ ID NO: 6037344 - DNA, 22 bp, Homo sapiens
ccaccttggactcctcccacaa

SEQ ID NO: 6037345 - DNA, 16 bp, Homo sapiens
ccaccttggagcattt

SEQ ID NO: 6037346 - DNA, 17 bp, Homo sapiens
ccaccttggagcattta

SEQ ID NO: 6037347 - DNA, 19 bp, Homo sapiens
ccaccttggagcatttatg

SEQ ID NO: 6037348 - DNA, 13 bp, Homo sapiens
ccaccttggagga

SEQ ID NO: 6037349 - DNA, 14 bp, Homo sapiens
ccaccttggcctcc

SEQ ID NO: 6037350 - DNA, 14 bp, Homo sapiens
ccaccttggctgca

SEQ ID NO: 6037351 - DNA, 14 bp, Homo sapiens
ccaccttgggtctg

SEQ ID NO: 6037352 - DNA, 21 bp, Homo sapiens
ccaccttgggtctgtgtcact

SEQ ID NO: 6037353 - DNA, 20 bp, Homo sapiens
ccaccttggtccctctcaga

SEQ ID NO: 6037354 - DNA, 13 bp, Homo sapiens
ccaccttgttaca

SEQ ID NO: 6037355 - DNA, 22 bp, Homo sapiens
ccaccttgttggagcctgcagg

SEQ ID NO: 6037356 - DNA, 13 bp, Homo sapiens
ccacctttactgt

SEQ ID NO: 6037357 - DNA, 20 bp, Homo sapiens
ccacctttatgttttaatat

SEQ ID NO: 6037358 - DNA, 17 bp, Homo sapiens
ccacctttattaaaatc

SEQ ID NO: 6037359 - DNA, 20 bp, Homo sapiens
ccacctttattaaaatctta

SEQ ID NO: 6037360 - DNA, 23 bp, Homo sapiens
ccacctttcagataactgttatt

SEQ ID NO: 6037361 - DNA, 21 bp, Homo sapiens
ccacctttgaagaagtaagga

SEQ ID NO: 6037362 - DNA, 19 bp, Homo sapiens
ccacctttgggatcagcct

SEQ ID NO: 6037363 - DNA, 16 bp, Homo sapiens
ccacctttgtttctcc

SEQ ID NO: 6037364 - DNA, 14 bp, Homo sapiens
ccaccttttcagcg

SEQ ID NO: 6037365 - DNA, 14 bp, Homo sapiens
ccaccttttctgat

SEQ ID NO: 6037366 - DNA, 18 bp, Homo sapiens
ccaccttttgtttttcca

SEQ ID NO: 6037367 - DNA, 17 bp, Homo sapiens
ccacgaaactgccctgg

SEQ ID NO: 6037368 - DNA, 22 bp, Homo sapiens
ccacgaacacgcatgcctcagc

SEQ ID NO: 6037369 - DNA, 20 bp, Homo sapiens
ccacgaagctgtgaactcag

SEQ ID NO: 6037370 - DNA, 18 bp, Homo sapiens
ccacgaatttctgtgccc

SEQ ID NO: 6037371 - DNA, 15 bp, Homo sapiens
ccacgaatttgctgg

SEQ ID NO: 6037372 - DNA, 16 bp, Homo sapiens
ccacgacactgcagcc

SEQ ID NO: 6037373 - DNA, 16 bp, Homo sapiens
ccacgaccagcccctt

SEQ ID NO: 6037374 - DNA, 22 bp, Homo sapiens
ccacgacccctgcctcgagggc

SEQ ID NO: 6037375 - DNA, 15 bp, Homo sapiens
ccacgacctcgtcca

SEQ ID NO: 6037376 - DNA, 15 bp, Homo sapiens
ccacgactgccatgt

SEQ ID NO: 6037377 - DNA, 15 bp, Homo sapiens
ccacgactggccagg

SEQ ID NO: 6037378 - DNA, 15 bp, Homo sapiens
ccacgactgtctcca

SEQ ID NO: 6037379 - DNA, 18 bp, Homo sapiens
ccacgactgttgtacaag

SEQ ID NO: 6037380 - DNA, 15 bp, Homo sapiens
ccacgagagcgcagc

SEQ ID NO: 6037381 - DNA, 19 bp, Homo sapiens
ccacgaggaaaagaacaaa

SEQ ID NO: 6037382 - DNA, 15 bp, Homo sapiens
ccacgaggagcagca

SEQ ID NO: 6037383 - DNA, 16 bp, Homo sapiens
ccacgaggagcagcag

SEQ ID NO: 6037384 - DNA, 20 bp, Homo sapiens
ccacgaggagcttccagtgc

SEQ ID NO: 6037385 - DNA, 15 bp, Homo sapiens
ccacgaggctgcccc

SEQ ID NO: 6037386 - DNA, 17 bp, Homo sapiens
ccacgaggctgccccca

SEQ ID NO: 6037387 - DNA, 16 bp, Homo sapiens
ccacgagggtgccgtg

SEQ ID NO: 6037388 - DNA, 20 bp, Homo sapiens
ccacgaggtggtagctctga

SEQ ID NO: 6037389 - DNA, 22 bp, Homo sapiens
ccacgaggttaaagaagctgca

SEQ ID NO: 6037390 - DNA, 22 bp, Homo sapiens
ccacgagtaagatattatttaa

SEQ ID NO: 6037391 - DNA, 16 bp, Homo sapiens
ccacgagtcacctgca

SEQ ID NO: 6037392 - DNA, 18 bp, Homo sapiens
ccacgagtcacctgcaag

SEQ ID NO: 6037393 - DNA, 14 bp, Homo sapiens
ccacgatcccctcc

SEQ ID NO: 6037394 - DNA, 16 bp, Homo sapiens
ccacgatcctgccacc

SEQ ID NO: 6037395 - DNA, 19 bp, Homo sapiens
ccacgatcctgccaccctg

SEQ ID NO: 6037396 - DNA, 19 bp, Homo sapiens
ccacgatgacgcctctgga

SEQ ID NO: 6037397 - DNA, 13 bp, Homo sapiens
ccacgatgtcaag

SEQ ID NO: 6037398 - DNA, 13 bp, Homo sapiens
ccacgattggcca

SEQ ID NO: 6037399 - DNA, 23 bp, Homo sapiens
ccacgattggtatgatgctgccg

SEQ ID NO: 6037400 - DNA, 15 bp, Homo sapiens
ccacgcaaggctgtg

SEQ ID NO: 6037401 - DNA, 14 bp, Homo sapiens
ccacgcacacatgg

SEQ ID NO: 6037402 - DNA, 17 bp, Homo sapiens
ccacgcacacatggaca

SEQ ID NO: 6037403 - DNA, 14 bp, Homo sapiens
ccacgcacttcctc

SEQ ID NO: 6037404 - DNA, 15 bp, Homo sapiens
ccacgcagagccccg

SEQ ID NO: 6037405 - DNA, 13 bp, Homo sapiens
ccacgcagaggac

SEQ ID NO: 6037406 - DNA, 15 bp, Homo sapiens
ccacgcagccaggac

SEQ ID NO: 6037407 - DNA, 15 bp, Homo sapiens
ccacgcagccgccgc

SEQ ID NO: 6037408 - DNA, 12 bp, Homo sapiens
ccacgcaggcca

SEQ ID NO: 6037409 - DNA, 21 bp, Homo sapiens
ccacgcagggccatccactgt

SEQ ID NO: 6037410 - DNA, 19 bp, Homo sapiens
ccacgcaggggccctgagc

SEQ ID NO: 6037411 - DNA, 18 bp, Homo sapiens
ccacgcagtgcctggagt

SEQ ID NO: 6037412 - DNA, 13 bp, Homo sapiens
ccacgcagttctt

SEQ ID NO: 6037413 - DNA, 15 bp, Homo sapiens
ccacgcatacacaca

SEQ ID NO: 6037414 - DNA, 19 bp, Homo sapiens
ccacgcatacacacatgcc

SEQ ID NO: 6037415 - DNA, 17 bp, Homo sapiens
ccacgcatgctcagtgc

SEQ ID NO: 6037416 - DNA, 12 bp, Homo sapiens
ccacgccacagc

SEQ ID NO: 6037417 - DNA, 14 bp, Homo sapiens
ccacgccacagccc

SEQ ID NO: 6037418 - DNA, 15 bp, Homo sapiens
ccacgccagctggcc

SEQ ID NO: 6037419 - DNA, 15 bp, Homo sapiens
ccacgccaggccagc

SEQ ID NO: 6037420 - DNA, 13 bp, Homo sapiens
ccacgccatgagg

SEQ ID NO: 6037421 - DNA, 15 bp, Homo sapiens
ccacgcccaccagcc

SEQ ID NO: 6037422 - DNA, 18 bp, Homo sapiens
ccacgcccaccagccttg

SEQ ID NO: 6037423 - DNA, 13 bp, Homo sapiens
ccacgccccagcc

SEQ ID NO: 6037424 - DNA, 14 bp, Homo sapiens
ccacgccccaggac

SEQ ID NO: 6037425 - DNA, 16 bp, Homo sapiens
ccacgcccccactggt

SEQ ID NO: 6037426 - DNA, 15 bp, Homo sapiens
ccacgccccgtgtct

SEQ ID NO: 6037427 - DNA, 15 bp, Homo sapiens
ccacgcccctgcctg

SEQ ID NO: 6037428 - DNA, 17 bp, Homo sapiens
ccacgcccgcacccccg

SEQ ID NO: 6037429 - DNA, 15 bp, Homo sapiens
ccacgcccgtcctgc

SEQ ID NO: 6037430 - DNA, 18 bp, Homo sapiens
ccacgcccgtcctgcctg

SEQ ID NO: 6037431 - DNA, 23 bp, Homo sapiens
ccacgcccgtcctgcctgtggcg

SEQ ID NO: 6037432 - DNA, 15 bp, Homo sapiens
ccacgccctcctccc

SEQ ID NO: 6037433 - DNA, 16 bp, Homo sapiens
ccacgccctctcctcc

SEQ ID NO: 6037434 - DNA, 12 bp, Homo sapiens
ccacgccctggg

SEQ ID NO: 6037435 - DNA, 13 bp, Homo sapiens
ccacgccctgggg

SEQ ID NO: 6037436 - DNA, 14 bp, Homo sapiens
ccacgccctgggga

SEQ ID NO: 6037437 - DNA, 19 bp, Homo sapiens
ccacgccctggggagtgag

SEQ ID NO: 6037438 - DNA, 17 bp, Homo sapiens
ccacgcccttggagcct

SEQ ID NO: 6037439 - DNA, 22 bp, Homo sapiens
ccacgcccttggagccttccac

SEQ ID NO: 6037440 - DNA, 22 bp, Homo sapiens
ccacgccgatataagccatagc

SEQ ID NO: 6037441 - DNA, 23 bp, Homo sapiens
ccacgccgatataagccatagcc

SEQ ID NO: 6037442 - DNA, 14 bp, Homo sapiens
ccacgccgccctcc

SEQ ID NO: 6037443 - DNA, 17 bp, Homo sapiens
ccacgccgccctccatc

SEQ ID NO: 6037444 - DNA, 15 bp, Homo sapiens
ccacgccggcctctg

SEQ ID NO: 6037445 - DNA, 17 bp, Homo sapiens
ccacgccggcctctgct

SEQ ID NO: 6037446 - DNA, 18 bp, Homo sapiens
ccacgccggcctctgctg

SEQ ID NO: 6037447 - DNA, 12 bp, Homo sapiens
ccacgcctcacc

SEQ ID NO: 6037448 - DNA, 19 bp, Homo sapiens
ccacgcctctctcagccca

SEQ ID NO: 6037449 - DNA, 21 bp, Homo sapiens
ccacgcctctctcagcccagg

SEQ ID NO: 6037450 - DNA, 14 bp, Homo sapiens
ccacgcctgcttct

SEQ ID NO: 6037451 - DNA, 14 bp, Homo sapiens
ccacgcctggaagg

SEQ ID NO: 6037452 - DNA, 20 bp, Homo sapiens
ccacgcctgtcctcctggaa

SEQ ID NO: 6037453 - DNA, 21 bp, Homo sapiens
ccacgcctgtcctcctggaag

SEQ ID NO: 6037454 - DNA, 16 bp, Homo sapiens
ccacgcggctgctgct

SEQ ID NO: 6037455 - DNA, 18 bp, Homo sapiens
ccacgcgggggccttgag

SEQ ID NO: 6037456 - DNA, 15 bp, Homo sapiens
ccacgcgtgccgtgg

SEQ ID NO: 6037457 - DNA, 18 bp, Homo sapiens
ccacgctagggctggctc

SEQ ID NO: 6037458 - DNA, 14 bp, Homo sapiens
ccacgctcctgccc

SEQ ID NO: 6037459 - DNA, 16 bp, Homo sapiens
ccacgctcctgccctc

SEQ ID NO: 6037460 - DNA, 13 bp, Homo sapiens
ccacgctggagtg

SEQ ID NO: 6037461 - DNA, 16 bp, Homo sapiens
ccacgctggagtgcag

SEQ ID NO: 6037462 - DNA, 13 bp, Homo sapiens
ccacgctgtcctc

SEQ ID NO: 6037463 - DNA, 15 bp, Homo sapiens
ccacgcttctctttg

SEQ ID NO: 6037464 - DNA, 13 bp, Homo sapiens
ccacgcttctgga

SEQ ID NO: 6037465 - DNA, 15 bp, Homo sapiens
ccacgcttctggagg

SEQ ID NO: 6037466 - DNA, 20 bp, Homo sapiens
ccacggaaaatgccaatctc

SEQ ID NO: 6037467 - DNA, 17 bp, Homo sapiens
ccacggaaacagaactc

SEQ ID NO: 6037468 - DNA, 22 bp, Homo sapiens
ccacggaccaaagggagtctgc

SEQ ID NO: 6037469 - DNA, 19 bp, Homo sapiens
ccacggaccgcatcctcca

SEQ ID NO: 6037470 - DNA, 20 bp, Homo sapiens
ccacggaccgcatcctccag

SEQ ID NO: 6037471 - DNA, 20 bp, Homo sapiens
ccacggacgtttccatcagg

SEQ ID NO: 6037472 - DNA, 20 bp, Homo sapiens
ccacggagccactcctctga

SEQ ID NO: 6037473 - DNA, 23 bp, Homo sapiens
ccacggagggaggcaccatgcaa

SEQ ID NO: 6037474 - DNA, 18 bp, Homo sapiens
ccacggatgcgtgggcag

SEQ ID NO: 6037475 - DNA, 21 bp, Homo sapiens
ccacggatgcgtgggcagagg

SEQ ID NO: 6037476 - DNA, 22 bp, Homo sapiens
ccacggatgcgtgggcagagga

SEQ ID NO: 6037477 - DNA, 18 bp, Homo sapiens
ccacggatgttgtcagga

SEQ ID NO: 6037478 - DNA, 15 bp, Homo sapiens
ccacggcacctgggc

SEQ ID NO: 6037479 - DNA, 19 bp, Homo sapiens
ccacggcacctgggccctg

SEQ ID NO: 6037480 - DNA, 14 bp, Homo sapiens
ccacggcactccag

SEQ ID NO: 6037481 - DNA, 19 bp, Homo sapiens
ccacggcagccaccctgcc

SEQ ID NO: 6037482 - DNA, 20 bp, Homo sapiens
ccacggcagccaccctgcca

SEQ ID NO: 6037483 - DNA, 22 bp, Homo sapiens
ccacggcagccaccctgccatg

SEQ ID NO: 6037484 - DNA, 14 bp, Homo sapiens
ccacggccaccact

SEQ ID NO: 6037485 - DNA, 14 bp, Homo sapiens
ccacggccacccac

SEQ ID NO: 6037486 - DNA, 14 bp, Homo sapiens
ccacggccaccctc

SEQ ID NO: 6037487 - DNA, 15 bp, Homo sapiens
ccacggccaccctcc

SEQ ID NO: 6037488 - DNA, 16 bp, Homo sapiens
ccacggccaccctcct

SEQ ID NO: 6037489 - DNA, 22 bp, Homo sapiens
ccacggccaccctccttcccgc

SEQ ID NO: 6037490 - DNA, 17 bp, Homo sapiens
ccacggccactgcagtc

SEQ ID NO: 6037491 - DNA, 16 bp, Homo sapiens
ccacggccactggcca

SEQ ID NO: 6037492 - DNA, 19 bp, Homo sapiens
ccacggccccgggtccagg

SEQ ID NO: 6037493 - DNA, 14 bp, Homo sapiens
ccacggccctgtca

SEQ ID NO: 6037494 - DNA, 20 bp, Homo sapiens
ccacggccgctccaggggtg

SEQ ID NO: 6037495 - DNA, 23 bp, Homo sapiens
ccacggcctggctggtgggaagg

SEQ ID NO: 6037496 - DNA, 15 bp, Homo sapiens
ccacggcctgggagg

SEQ ID NO: 6037497 - DNA, 17 bp, Homo sapiens
ccacggctaagaggctg

SEQ ID NO: 6037498 - DNA, 21 bp, Homo sapiens
ccacggctaagaggctgctga

SEQ ID NO: 6037499 - DNA, 18 bp, Homo sapiens
ccacggctctaggtgggg

SEQ ID NO: 6037500 - DNA, 21 bp, Homo sapiens
ccacggctctcgtccctctgc

SEQ ID NO: 6037501 - DNA, 14 bp, Homo sapiens
ccacggctgagcct

SEQ ID NO: 6037502 - DNA, 14 bp, Homo sapiens
ccacgggcctcagt

SEQ ID NO: 6037503 - DNA, 19 bp, Homo sapiens
ccacgggcctcagtttccc

SEQ ID NO: 6037504 - DNA, 14 bp, Homo sapiens
ccacgggcgaggac

SEQ ID NO: 6037505 - DNA, 18 bp, Homo sapiens
ccacggggaccactgggc

SEQ ID NO: 6037506 - DNA, 20 bp, Homo sapiens
ccacggggcaaagctgctgg

SEQ ID NO: 6037507 - DNA, 21 bp, Homo sapiens
ccacggggcaaagctgctggg

SEQ ID NO: 6037508 - DNA, 13 bp, Homo sapiens
catcaagactgga

SEQ ID NO: 6037509 - DNA, 21 bp, Homo sapiens
catcaagacttcaatcctgat

SEQ ID NO: 6037510 - DNA, 15 bp, Homo sapiens
catcaagactttgct

SEQ ID NO: 6037511 - DNA, 12 bp, Homo sapiens
catcaagagaat

SEQ ID NO: 6037512 - DNA, 14 bp, Homo sapiens
catcaagatgtgac

SEQ ID NO: 6037513 - DNA, 23 bp, Homo sapiens
catcaagcacagaaggaggagga

SEQ ID NO: 6037514 - DNA, 13 bp, Homo sapiens
catcaagcacttc

SEQ ID NO: 6037515 - DNA, 20 bp, Homo sapiens
catcaagcaggaattatgtc

SEQ ID NO: 6037516 - DNA, 22 bp, Homo sapiens
catcaagctccaccctcctggc

SEQ ID NO: 6037517 - DNA, 12 bp, Homo sapiens
catcaagggaga

SEQ ID NO: 6037518 - DNA, 14 bp, Homo sapiens
catcaagtaataca

SEQ ID NO: 6037519 - DNA, 19 bp, Homo sapiens
catcaagtaatcatggcca

SEQ ID NO: 6037520 - DNA, 21 bp, Homo sapiens
catcaagtccatctgacaaaa

SEQ ID NO: 6037521 - DNA, 15 bp, Homo sapiens
catcaagtctccacg

SEQ ID NO: 6037522 - DNA, 13 bp, Homo sapiens
catcaagtgcagt

SEQ ID NO: 6037523 - DNA, 20 bp, Homo sapiens
catcaagtgtaattagcttt

SEQ ID NO: 6037524 - DNA, 21 bp, Homo sapiens
catcaagttattgacaaactc

SEQ ID NO: 6037525 - DNA, 18 bp, Homo sapiens
catcaataatattgtata

SEQ ID NO: 6037526 - DNA, 17 bp, Homo sapiens
catcaatacaaccagcc

SEQ ID NO: 6037527 - DNA, 23 bp, Homo sapiens
catcaatagaaagtcatctttga

SEQ ID NO: 6037528 - DNA, 22 bp, Homo sapiens
catcaatagtgtcctatgcaat

SEQ ID NO: 6037529 - DNA, 21 bp, Homo sapiens
catcaatatccctcttgtaag

SEQ ID NO: 6037530 - DNA, 13 bp, Homo sapiens
catcaatatgtat

SEQ ID NO: 6037531 - DNA, 14 bp, Homo sapiens
catcaatatgtata

SEQ ID NO: 6037532 - DNA, 21 bp, Homo sapiens
catcaatatgtatatatgtat

SEQ ID NO: 6037533 - DNA, 19 bp, Homo sapiens
catcaatcaaataagtatt

SEQ ID NO: 6037534 - DNA, 20 bp, Homo sapiens
catcaatccaggatgttatt

SEQ ID NO: 6037535 - DNA, 21 bp, Homo sapiens
catcaatcctgattcctctct

SEQ ID NO: 6037536 - DNA, 21 bp, Homo sapiens
catcaatcctggtaaccaaat

SEQ ID NO: 6037537 - DNA, 14 bp, Homo sapiens
catcaatgaagatt

SEQ ID NO: 6037538 - DNA, 19 bp, Homo sapiens
catcaatgaagattaacac

SEQ ID NO: 6037539 - DNA, 18 bp, Homo sapiens
catcaatgtgacatttac

SEQ ID NO: 6037540 - DNA, 18 bp, Homo sapiens
catcaatgttcattgtaa

SEQ ID NO: 6037541 - DNA, 16 bp, Homo sapiens
catcaattaaaggcaa

SEQ ID NO: 6037542 - DNA, 16 bp, Homo sapiens
catcaattaacatcgt

SEQ ID NO: 6037543 - DNA, 18 bp, Homo sapiens
catcaattaacatcgtgg

SEQ ID NO: 6037544 - DNA, 14 bp, Homo sapiens
catcaattcccatt

SEQ ID NO: 6037545 - DNA, 22 bp, Homo sapiens
catcaattgaatggtcagcgtt

SEQ ID NO: 6037546 - DNA, 12 bp, Homo sapiens
catcaatttaaa

SEQ ID NO: 6037547 - DNA, 17 bp, Homo sapiens
catcaattttaacattt

SEQ ID NO: 6037548 - DNA, 22 bp, Homo sapiens
catcaattttaacatttgatgt

SEQ ID NO: 6037549 - DNA, 17 bp, Homo sapiens
catcaatttttatacat

SEQ ID NO: 6037550 - DNA, 19 bp, Homo sapiens
catcaatttttatacatat

SEQ ID NO: 6037551 - DNA, 23 bp, Homo sapiens
catcaatttttatacatatcaga

SEQ ID NO: 6037552 - DNA, 24 bp, Homo sapiens
catcaatttttatacatatcagaa

SEQ ID NO: 6037553 - DNA, 13 bp, Homo sapiens
catcacaaaatgt

SEQ ID NO: 6037554 - DNA, 13 bp, Homo sapiens
catcacaaatggc

SEQ ID NO: 6037555 - DNA, 17 bp, Homo sapiens
catcacaaatggctaca

SEQ ID NO: 6037556 - DNA, 22 bp, Homo sapiens
catcacaacctaaatggagaaa

SEQ ID NO: 6037557 - DNA, 17 bp, Homo sapiens
catcacaagaacacaca

SEQ ID NO: 6037558 - DNA, 15 bp, Homo sapiens
catcacaatacagat

SEQ ID NO: 6037559 - DNA, 17 bp, Homo sapiens
catcacaatttgttgaa

SEQ ID NO: 6037560 - DNA, 13 bp, Homo sapiens
catcacacccatt

SEQ ID NO: 6037561 - DNA, 20 bp, Homo sapiens
catcacacttatattttatg

SEQ ID NO: 6037562 - DNA, 22 bp, Homo sapiens
catcacacttatattttatgaa

SEQ ID NO: 6037563 - DNA, 12 bp, Homo sapiens
catcacagaatg

SEQ ID NO: 6037564 - DNA, 18 bp, Homo sapiens
catcacagaccccagctg

SEQ ID NO: 6037565 - DNA, 20 bp, Homo sapiens
catcacagcaatatttaaca

SEQ ID NO: 6037566 - DNA, 20 bp, Homo sapiens
catcacagcagaatgaagac

SEQ ID NO: 6037567 - DNA, 16 bp, Homo sapiens
catcacagcagcctcc

SEQ ID NO: 6037568 - DNA, 16 bp, Homo sapiens
catcacagccagccca

SEQ ID NO: 6037569 - DNA, 22 bp, Homo sapiens
catcacagccagcccagctcca

SEQ ID NO: 6037570 - DNA, 14 bp, Homo sapiens
catcacagcttgtt

SEQ ID NO: 6037571 - DNA, 22 bp, Homo sapiens
catcacaggacacggggcagtg

SEQ ID NO: 6037572 - DNA, 17 bp, Homo sapiens
catcacaggatgccagc

SEQ ID NO: 6037573 - DNA, 18 bp, Homo sapiens
catcacaggatgccagcc

SEQ ID NO: 6037574 - DNA, 15 bp, Homo sapiens
catcacagggcctca

SEQ ID NO: 6037575 - DNA, 22 bp, Homo sapiens
catcacagggcctcagtttccc

SEQ ID NO: 6037576 - DNA, 13 bp, Homo sapiens
catcacagggtgg

SEQ ID NO: 6037577 - DNA, 21 bp, Homo sapiens
catcacagggtgggcctcggc

SEQ ID NO: 6037578 - DNA, 19 bp, Homo sapiens
catcacagtgggaagaata

SEQ ID NO: 6037579 - DNA, 15 bp, Homo sapiens
catcacataaagaaa

SEQ ID NO: 6037580 - DNA, 16 bp, Homo sapiens
catcacatctgcacac

SEQ ID NO: 6037581 - DNA, 20 bp, Homo sapiens
catcacatctgcacactctc

SEQ ID NO: 6037582 - DNA, 13 bp, Homo sapiens
catcacatcttat

SEQ ID NO: 6037583 - DNA, 15 bp, Homo sapiens
catcacatcttattt

SEQ ID NO: 6037584 - DNA, 21 bp, Homo sapiens
catcacatcttatttatttta

SEQ ID NO: 6037585 - DNA, 23 bp, Homo sapiens
catcacatgagacaattttgctt

SEQ ID NO: 6037586 - DNA, 16 bp, Homo sapiens
catcacatggcatgtt

SEQ ID NO: 6037587 - DNA, 21 bp, Homo sapiens
catcacattccagtctgaagt

SEQ ID NO: 6037588 - DNA, 20 bp, Homo sapiens
catcaccaacgtctgtgcca

SEQ ID NO: 6037589 - DNA, 14 bp, Homo sapiens
catcaccacagctg

SEQ ID NO: 6037590 - DNA, 15 bp, Homo sapiens
catcaccacagctgc

SEQ ID NO: 6037591 - DNA, 16 bp, Homo sapiens
catcaccacagctgca

SEQ ID NO: 6037592 - DNA, 13 bp, Homo sapiens
catcaccacagtt

SEQ ID NO: 6037593 - DNA, 19 bp, Homo sapiens
catcaccaccacacccctg

SEQ ID NO: 6037594 - DNA, 13 bp, Homo sapiens
catcaccaccctt

SEQ ID NO: 6037595 - DNA, 15 bp, Homo sapiens
catcaccaccgcctc

SEQ ID NO: 6037596 - DNA, 20 bp, Homo sapiens
catcaccaccgcctctggcc

SEQ ID NO: 6037597 - DNA, 21 bp, Homo sapiens
catcaccagtgccacgtcatg

SEQ ID NO: 6037598 - DNA, 23 bp, Homo sapiens
catcaccatgggaggtggggcct

SEQ ID NO: 6037599 - DNA, 13 bp, Homo sapiens
catcacccacctt

SEQ ID NO: 6037600 - DNA, 16 bp, Homo sapiens
catcacccagtcctgg

SEQ ID NO: 6037601 - DNA, 17 bp, Homo sapiens
catcacccagtcctggc

SEQ ID NO: 6037602 - DNA, 15 bp, Homo sapiens
catcaccccagaggc

SEQ ID NO: 6037603 - DNA, 20 bp, Homo sapiens
catcaccccagaggccttgt

SEQ ID NO: 6037604 - DNA, 12 bp, Homo sapiens
catcaccccttc

SEQ ID NO: 6037605 - DNA, 15 bp, Homo sapiens
catcaccccttcccc

SEQ ID NO: 6037606 - DNA, 17 bp, Homo sapiens
catcaccccttccccat

SEQ ID NO: 6037607 - DNA, 23 bp, Homo sapiens
catcacccgcccctggacttctt

SEQ ID NO: 6037608 - DNA, 12 bp, Homo sapiens
catcacccgcta

SEQ ID NO: 6037609 - DNA, 14 bp, Homo sapiens
catcaccctatata

SEQ ID NO: 6037610 - DNA, 15 bp, Homo sapiens
catcaccctcaccca

SEQ ID NO: 6037611 - DNA, 17 bp, Homo sapiens
catcaccctcacccact

SEQ ID NO: 6037612 - DNA, 20 bp, Homo sapiens
catcaccctctgggcagctg

SEQ ID NO: 6037613 - DNA, 21 bp, Homo sapiens
catcaccctgggagtttcctg

SEQ ID NO: 6037614 - DNA, 13 bp, Homo sapiens
catcacccttccg

SEQ ID NO: 6037615 - DNA, 13 bp, Homo sapiens
catcaccctttgc

SEQ ID NO: 6037616 - DNA, 19 bp, Homo sapiens
catcaccgacgcgtctcct

SEQ ID NO: 6037617 - DNA, 19 bp, Homo sapiens
catcaccgattcttccttg

SEQ ID NO: 6037618 - DNA, 13 bp, Homo sapiens
catcaccgctggg

SEQ ID NO: 6037619 - DNA, 16 bp, Homo sapiens
catcaccgctgggtgg

SEQ ID NO: 6037620 - DNA, 21 bp, Homo sapiens
catcacctactcacacaggca

SEQ ID NO: 6037621 - DNA, 18 bp, Homo sapiens
catcacctatttaatgtt

SEQ ID NO: 6037622 - DNA, 20 bp, Homo sapiens
catcacctcagatggcagct

SEQ ID NO: 6037623 - DNA, 13 bp, Homo sapiens
catcacctccacc

SEQ ID NO: 6037624 - DNA, 16 bp, Homo sapiens
catcacctctactgtc

SEQ ID NO: 6037625 - DNA, 15 bp, Homo sapiens
catcaccttagacca

SEQ ID NO: 6037626 - DNA, 17 bp, Homo sapiens
catcaccttagaccacc

SEQ ID NO: 6037627 - DNA, 23 bp, Homo sapiens
catcaccttagaccaccaagcct

SEQ ID NO: 6037628 - DNA, 22 bp, Homo sapiens
catcaccttaggcagggaagtg

SEQ ID NO: 6037629 - DNA, 23 bp, Homo sapiens
catcaccttaggcagggaagtgt

SEQ ID NO: 6037630 - DNA, 20 bp, Homo sapiens
catcacgaaggaaaactgcc

SEQ ID NO: 6037631 - DNA, 14 bp, Homo sapiens
catcacgcctgtgc

SEQ ID NO: 6037632 - DNA, 15 bp, Homo sapiens
catcacgcctgtgca

SEQ ID NO: 6037633 - DNA, 18 bp, Homo sapiens
catcacgtaccccactgg

SEQ ID NO: 6037634 - DNA, 24 bp, Homo sapiens
catcacgtaccccactgggccagc

SEQ ID NO: 6037635 - DNA, 21 bp, Homo sapiens
catcactaaaccgataatgca

SEQ ID NO: 6037636 - DNA, 20 bp, Homo sapiens
catcactacaaaaagaagag

SEQ ID NO: 6037637 - DNA, 23 bp, Homo sapiens
catcactacctttatagctctca

SEQ ID NO: 6037638 - DNA, 15 bp, Homo sapiens
catcactagaagaaa

SEQ ID NO: 6037639 - DNA, 18 bp, Homo sapiens
catcactagaagaaaagc

SEQ ID NO: 6037640 - DNA, 23 bp, Homo sapiens
catcactagaagaaaagcccatt

SEQ ID NO: 6037641 - DNA, 22 bp, Homo sapiens
catcactatccatgcaccaaac

SEQ ID NO: 6037642 - DNA, 17 bp, Homo sapiens
catcactcagcccctac

SEQ ID NO: 6037643 - DNA, 13 bp, Homo sapiens
catcactcccctc

SEQ ID NO: 6037644 - DNA, 15 bp, Homo sapiens
catcactcgcaggac

SEQ ID NO: 6037645 - DNA, 13 bp, Homo sapiens
catcactcggctg

SEQ ID NO: 6037646 - DNA, 16 bp, Homo sapiens
catcactctgctgctt

SEQ ID NO: 6037647 - DNA, 16 bp, Homo sapiens
catcactgagtggctt

SEQ ID NO: 6037648 - DNA, 17 bp, Homo sapiens
catcactgagttttcca

SEQ ID NO: 6037649 - DNA, 23 bp, Homo sapiens
catcactgagttttccatggcag

SEQ ID NO: 6037650 - DNA, 22 bp, Homo sapiens
catcactgatgggaataaaagt

SEQ ID NO: 6037651 - DNA, 15 bp, Homo sapiens
catcactgattccct

SEQ ID NO: 6037652 - DNA, 20 bp, Homo sapiens
catcactgattccctctccc

SEQ ID NO: 6037653 - DNA, 16 bp, Homo sapiens
catcactggctctcta

SEQ ID NO: 6037654 - DNA, 13 bp, Homo sapiens
catcactgtaaag

SEQ ID NO: 6037655 - DNA, 18 bp, Homo sapiens
catcactgtaaagacaaa

SEQ ID NO: 6037656 - DNA, 21 bp, Homo sapiens
catcactgtaaagacaaataa

SEQ ID NO: 6037657 - DNA, 12 bp, Homo sapiens
catcactgtatc

SEQ ID NO: 6037658 - DNA, 20 bp, Homo sapiens
catcactgtcaaactttgtc

SEQ ID NO: 6037659 - DNA, 14 bp, Homo sapiens
catcactgtgcctt

SEQ ID NO: 6037660 - DNA, 15 bp, Homo sapiens
catcacttctccccg

SEQ ID NO: 6037661 - DNA, 17 bp, Homo sapiens
catcacttctccccgca

SEQ ID NO: 6037662 - DNA, 20 bp, Homo sapiens
catcacttggggtcaccacc

SEQ ID NO: 6037663 - DNA, 19 bp, Homo sapiens
catcacttgtacaaaataa

SEQ ID NO: 6037664 - DNA, 15 bp, Homo sapiens
catcactttgaccta

SEQ ID NO: 6037665 - DNA, 13 bp, Homo sapiens
catcactttgtga

SEQ ID NO: 6037666 - DNA, 17 bp, Homo sapiens
catcagaaaaccaaagg

SEQ ID NO: 6037667 - DNA, 22 bp, Homo sapiens
catcagaaaaccaaagggtgct

SEQ ID NO: 6037668 - DNA, 14 bp, Homo sapiens
catcagaaaataaa

SEQ ID NO: 6037669 - DNA, 17 bp, Homo sapiens
catcagaaaataaaata

SEQ ID NO: 6037670 - DNA, 15 bp, Homo sapiens
catcagaaagaattg

SEQ ID NO: 6037671 - DNA, 15 bp, Homo sapiens
catcagaaagcttta

SEQ ID NO: 6037672 - DNA, 11 bp, Homo sapiens
catcagaaagg

SEQ ID NO: 6037673 - DNA, 21 bp, Homo sapiens
catcagaaagggagggctctg

SEQ ID NO: 6037674 - DNA, 22 bp, Homo sapiens
catcagaaagggagggctctga

SEQ ID NO: 6037675 - DNA, 11 bp, Homo sapiens
catcagaaatg

SEQ ID NO: 6037676 - DNA, 12 bp, Homo sapiens
catcagaaatgt

SEQ ID NO: 6037677 - DNA, 20 bp, Homo sapiens
catcagaacctcaattgaca

SEQ ID NO: 6037678 - DNA, 21 bp, Homo sapiens
catcagaactcttcctcctcc

SEQ ID NO: 6037679 - DNA, 17 bp, Homo sapiens
catcagaactgaaataa

SEQ ID NO: 6037680 - DNA, 18 bp, Homo sapiens
catcagaagcctattgta

SEQ ID NO: 6037681 - DNA, 20 bp, Homo sapiens
catcagaagcctattgtaaa

SEQ ID NO: 6037682 - DNA, 15 bp, Homo sapiens
catcagaaggagaag

SEQ ID NO: 6037683 - DNA, 23 bp, Homo sapiens
catcagaagtaactcccactcct

SEQ ID NO: 6037684 - DNA, 15 bp, Homo sapiens
catcagaagtttgca

SEQ ID NO: 6037685 - DNA, 18 bp, Homo sapiens
catcagaagtttgcatct

SEQ ID NO: 6037686 - DNA, 17 bp, Homo sapiens
ccacgggggaggccgag

SEQ ID NO: 6037687 - DNA, 17 bp, Homo sapiens
ccacgggggcagtgtga

SEQ ID NO: 6037688 - DNA, 14 bp, Homo sapiens
ccacggggtccccg

SEQ ID NO: 6037689 - DNA, 23 bp, Homo sapiens
ccacggggtcgggggaggagcac

SEQ ID NO: 6037690 - DNA, 15 bp, Homo sapiens
ccacgggtctgccat

SEQ ID NO: 6037691 - DNA, 21 bp, Homo sapiens
ccacgggtctgccatgctctg

SEQ ID NO: 6037692 - DNA, 19 bp, Homo sapiens
ccacggtccaatccagcct

SEQ ID NO: 6037693 - DNA, 18 bp, Homo sapiens
ccacggtccgcggcctgc

SEQ ID NO: 6037694 - DNA, 19 bp, Homo sapiens
ccacggtccgcggcctgca

SEQ ID NO: 6037695 - DNA, 22 bp, Homo sapiens
ccacggtccgcggcctgcaccg

SEQ ID NO: 6037696 - DNA, 15 bp, Homo sapiens
ccacggtctggaggc

SEQ ID NO: 6037697 - DNA, 15 bp, Homo sapiens
ccacggtcttctgca

SEQ ID NO: 6037698 - DNA, 21 bp, Homo sapiens
ccacggtgaaagtgctgctct

SEQ ID NO: 6037699 - DNA, 22 bp, Homo sapiens
ccacggtggacttagctctgag

SEQ ID NO: 6037700 - DNA, 17 bp, Homo sapiens
ccacggtggtcactgga

SEQ ID NO: 6037701 - DNA, 21 bp, Homo sapiens
ccacggttgctaaattataaa

SEQ ID NO: 6037702 - DNA, 21 bp, Homo sapiens
ccacggtttatcctcttggtg

SEQ ID NO: 6037703 - DNA, 16 bp, Homo sapiens
ccacggtttcagctag

SEQ ID NO: 6037704 - DNA, 14 bp, Homo sapiens
ccacggtttttctt

SEQ ID NO: 6037705 - DNA, 17 bp, Homo sapiens
ccacgtaagtcactgaa

SEQ ID NO: 6037706 - DNA, 20 bp, Homo sapiens
ccacgtaccaagccaccgca

SEQ ID NO: 6037707 - DNA, 21 bp, Homo sapiens
ccacgtagggggcaggggcag

SEQ ID NO: 6037708 - DNA, 22 bp, Homo sapiens
ccacgtcaggcctggcctcatc

SEQ ID NO: 6037709 - DNA, 12 bp, Homo sapiens
ccacgtcccacc

SEQ ID NO: 6037710 - DNA, 21 bp, Homo sapiens
ccacgtcccagcatccctgga

SEQ ID NO: 6037711 - DNA, 15 bp, Homo sapiens
ccacgtccccctggg

SEQ ID NO: 6037712 - DNA, 16 bp, Homo sapiens
ccacgtccctcgagct

SEQ ID NO: 6037713 - DNA, 21 bp, Homo sapiens
ccacgtcctcgaattctcaga

SEQ ID NO: 6037714 - DNA, 19 bp, Homo sapiens
ccacgtcctgtcagtgccg

SEQ ID NO: 6037715 - DNA, 20 bp, Homo sapiens
ccacgtcgggcttccctggc

SEQ ID NO: 6037716 - DNA, 23 bp, Homo sapiens
ccacgtctatttcatcagaacag

SEQ ID NO: 6037717 - DNA, 14 bp, Homo sapiens
ccacgtctcctcct

SEQ ID NO: 6037718 - DNA, 23 bp, Homo sapiens
ccacgtctcctcctcgaagccat

SEQ ID NO: 6037719 - DNA, 16 bp, Homo sapiens
ccacgtctctctgcct

SEQ ID NO: 6037720 - DNA, 20 bp, Homo sapiens
ccacgtctctctgcctgctg

SEQ ID NO: 6037721 - DNA, 22 bp, Homo sapiens
ccacgtctctctgcctgctggg

SEQ ID NO: 6037722 - DNA, 18 bp, Homo sapiens
ccacgtctgccaggccca

SEQ ID NO: 6037723 - DNA, 22 bp, Homo sapiens
ccacgtctgcgccgccgccgga

SEQ ID NO: 6037724 - DNA, 12 bp, Homo sapiens
ccacgtctggct

SEQ ID NO: 6037725 - DNA, 16 bp, Homo sapiens
ccacgtctgtgctctg

SEQ ID NO: 6037726 - DNA, 13 bp, Homo sapiens
ccacgtcttcctc

SEQ ID NO: 6037727 - DNA, 23 bp, Homo sapiens
ccacgtcttcttgctgcagcctg

SEQ ID NO: 6037728 - DNA, 19 bp, Homo sapiens
ccacgtctttcctgctaca

SEQ ID NO: 6037729 - DNA, 18 bp, Homo sapiens
ccacgtgaaactgctgtt

SEQ ID NO: 6037730 - DNA, 21 bp, Homo sapiens
ccacgtgaaatttgcctctgt

SEQ ID NO: 6037731 - DNA, 22 bp, Homo sapiens
ccacgtgaaatttgcctctgtc

SEQ ID NO: 6037732 - DNA, 23 bp, Homo sapiens
ccacgtgaatggccctagaactg

SEQ ID NO: 6037733 - DNA, 18 bp, Homo sapiens
ccacgtgagagaatctgc

SEQ ID NO: 6037734 - DNA, 21 bp, Homo sapiens
ccacgtgagagaatctgcctg

SEQ ID NO: 6037735 - DNA, 23 bp, Homo sapiens
ccacgtgagagaatctgcctgtg

SEQ ID NO: 6037736 - DNA, 15 bp, Homo sapiens
ccacgtgcacagctt

SEQ ID NO: 6037737 - DNA, 16 bp, Homo sapiens
ccacgtgcagcacctg

SEQ ID NO: 6037738 - DNA, 15 bp, Homo sapiens
ccacgtgccaggccc

SEQ ID NO: 6037739 - DNA, 17 bp, Homo sapiens
ccacgtgcgacagagag

SEQ ID NO: 6037740 - DNA, 15 bp, Homo sapiens
ccacgtgctcgcctc

SEQ ID NO: 6037741 - DNA, 16 bp, Homo sapiens
ccacgtgctggagagt

SEQ ID NO: 6037742 - DNA, 14 bp, Homo sapiens
ccacgtggagacag

SEQ ID NO: 6037743 - DNA, 14 bp, Homo sapiens
ccacgtggagagaa

SEQ ID NO: 6037744 - DNA, 14 bp, Homo sapiens
ccacgtggatgggc

SEQ ID NO: 6037745 - DNA, 18 bp, Homo sapiens
ccacgtggccgctgccca

SEQ ID NO: 6037746 - DNA, 13 bp, Homo sapiens
ccacgtggcctct

SEQ ID NO: 6037747 - DNA, 13 bp, Homo sapiens
ccacgtggggcca

SEQ ID NO: 6037748 - DNA, 23 bp, Homo sapiens
ccacgtggggccatgctgagagc

SEQ ID NO: 6037749 - DNA, 15 bp, Homo sapiens
ccacgtggggtggaa

SEQ ID NO: 6037750 - DNA, 22 bp, Homo sapiens
ccacgtggtcactgtgcactgc

SEQ ID NO: 6037751 - DNA, 23 bp, Homo sapiens
ccacgtggtcactgtgcactgcc

SEQ ID NO: 6037752 - DNA, 18 bp, Homo sapiens
ccacgtggtgtccctgcg

SEQ ID NO: 6037753 - DNA, 14 bp, Homo sapiens
ccacgtgtccgtcc

SEQ ID NO: 6037754 - DNA, 20 bp, Homo sapiens
ccacgtgtccgtccaccctt

SEQ ID NO: 6037755 - DNA, 23 bp, Homo sapiens
ccacgtgtccgtccacccttcca

SEQ ID NO: 6037756 - DNA, 16 bp, Homo sapiens
ccacgtgtgcagactg

SEQ ID NO: 6037757 - DNA, 16 bp, Homo sapiens
ccacgtgtgctgtggc

SEQ ID NO: 6037758 - DNA, 20 bp, Homo sapiens
ccacgtgtgctgtggccagg

SEQ ID NO: 6037759 - DNA, 16 bp, Homo sapiens
ccacgtgtggcctccg

SEQ ID NO: 6037760 - DNA, 20 bp, Homo sapiens
ccacgtgtttcgggccaggg

SEQ ID NO: 6037761 - DNA, 15 bp, Homo sapiens
ccacgttaagtccaa

SEQ ID NO: 6037762 - DNA, 15 bp, Homo sapiens
ccacgttactcccct

SEQ ID NO: 6037763 - DNA, 15 bp, Homo sapiens
ccacgttcacccctc

SEQ ID NO: 6037764 - DNA, 14 bp, Homo sapiens
ccacgttcagggag

SEQ ID NO: 6037765 - DNA, 16 bp, Homo sapiens
ccacgttccacagttg

SEQ ID NO: 6037766 - DNA, 16 bp, Homo sapiens
ccacgttctcacaccc

SEQ ID NO: 6037767 - DNA, 17 bp, Homo sapiens
ccacgttctcacaccca

SEQ ID NO: 6037768 - DNA, 21 bp, Homo sapiens
ccacgttggagaagcccgtgt

SEQ ID NO: 6037769 - DNA, 17 bp, Homo sapiens
ccacgttgtccctgaga

SEQ ID NO: 6037770 - DNA, 13 bp, Homo sapiens
ccacgtttctaaa

SEQ ID NO: 6037771 - DNA, 16 bp, Homo sapiens
ccactaaaaatattgt

SEQ ID NO: 6037772 - DNA, 21 bp, Homo sapiens
ccactaaaacaaaacaaaaaa

SEQ ID NO: 6037773 - DNA, 13 bp, Homo sapiens
ccactaaagcttc

SEQ ID NO: 6037774 - DNA, 17 bp, Homo sapiens
ccactaaagtgtcaagg

SEQ ID NO: 6037775 - DNA, 18 bp, Homo sapiens
ccactaaatgagctcctg

SEQ ID NO: 6037776 - DNA, 17 bp, Homo sapiens
ccactaaccttgcctgg

SEQ ID NO: 6037777 - DNA, 20 bp, Homo sapiens
ccactaactagagcagccct

SEQ ID NO: 6037778 - DNA, 17 bp, Homo sapiens
ccactaacttctaaaga

SEQ ID NO: 6037779 - DNA, 21 bp, Homo sapiens
ccactaagcagaggaggggcc

SEQ ID NO: 6037780 - DNA, 21 bp, Homo sapiens
ccactaagctttctcctttga

SEQ ID NO: 6037781 - DNA, 15 bp, Homo sapiens
ccactaagtaacctc

SEQ ID NO: 6037782 - DNA, 17 bp, Homo sapiens
ccactaagtacagctga

SEQ ID NO: 6037783 - DNA, 13 bp, Homo sapiens
ccactaagtagaa

SEQ ID NO: 6037784 - DNA, 14 bp, Homo sapiens
ccactaataaagtg

SEQ ID NO: 6037785 - DNA, 19 bp, Homo sapiens
ccactaatattcagtcctg

SEQ ID NO: 6037786 - DNA, 19 bp, Homo sapiens
ccactaatccattatcctt

SEQ ID NO: 6037787 - DNA, 23 bp, Homo sapiens
ccactaattgtaaggtattgcaa

SEQ ID NO: 6037788 - DNA, 16 bp, Homo sapiens
ccactaatttgtcact

SEQ ID NO: 6037789 - DNA, 20 bp, Homo sapiens
ccactaatttgtcactggaa

SEQ ID NO: 6037790 - DNA, 11 bp, Homo sapiens
ccactaatttt

SEQ ID NO: 6037791 - DNA, 15 bp, Homo sapiens
ccactacactccagc

SEQ ID NO: 6037792 - DNA, 21 bp, Homo sapiens
ccactacactccagcctgagc

SEQ ID NO: 6037793 - DNA, 16 bp, Homo sapiens
ccactaccaaaagaca

SEQ ID NO: 6037794 - DNA, 17 bp, Homo sapiens
ccactaccaaaagacat

SEQ ID NO: 6037795 - DNA, 19 bp, Homo sapiens
ccactaccaaaagacatta

SEQ ID NO: 6037796 - DNA, 20 bp, Homo sapiens
ccactaccagccagcctcag

SEQ ID NO: 6037797 - DNA, 17 bp, Homo sapiens
ccactacccttctcctt

SEQ ID NO: 6037798 - DNA, 18 bp, Homo sapiens
ccactacccttctccttt

SEQ ID NO: 6037799 - DNA, 20 bp, Homo sapiens
ccactaccttctgacctccc

SEQ ID NO: 6037800 - DNA, 17 bp, Homo sapiens
ccactacgctcctgtct

SEQ ID NO: 6037801 - DNA, 19 bp, Homo sapiens
ccactacgctcctgtctcc

SEQ ID NO: 6037802 - DNA, 21 bp, Homo sapiens
ccactactcaatactacctct

SEQ ID NO: 6037803 - DNA, 14 bp, Homo sapiens
ccactactgcagca

SEQ ID NO: 6037804 - DNA, 20 bp, Homo sapiens
ccactactgcagcacctcca

SEQ ID NO: 6037805 - DNA, 21 bp, Homo sapiens
ccactagaactctccatctta

SEQ ID NO: 6037806 - DNA, 19 bp, Homo sapiens
ccactagagctgagagtct

SEQ ID NO: 6037807 - DNA, 23 bp, Homo sapiens
ccactagagctgagagtctgaaa

SEQ ID NO: 6037808 - DNA, 13 bp, Homo sapiens
ccactagagggcc

SEQ ID NO: 6037809 - DNA, 16 bp, Homo sapiens
ccactagagggcccat

SEQ ID NO: 6037810 - DNA, 20 bp, Homo sapiens
ccactagagggcccatcagg

SEQ ID NO: 6037811 - DNA, 19 bp, Homo sapiens
ccactagccctctttctct

SEQ ID NO: 6037812 - DNA, 22 bp, Homo sapiens
ccactagccctctttctctctg

SEQ ID NO: 6037813 - DNA, 20 bp, Homo sapiens
ccactaggactctgaggctc

SEQ ID NO: 6037814 - DNA, 18 bp, Homo sapiens
ccactaggatcccactgg

SEQ ID NO: 6037815 - DNA, 14 bp, Homo sapiens
ccactaggccctgg

SEQ ID NO: 6037816 - DNA, 18 bp, Homo sapiens
ccactaggcctgaaatga

SEQ ID NO: 6037817 - DNA, 14 bp, Homo sapiens
ccactaggctgggt

SEQ ID NO: 6037818 - DNA, 15 bp, Homo sapiens
ccactaggctgggtg

SEQ ID NO: 6037819 - DNA, 16 bp, Homo sapiens
ccactaggctgggtgc

SEQ ID NO: 6037820 - DNA, 22 bp, Homo sapiens
ccactagggtcctggccctctt

SEQ ID NO: 6037821 - DNA, 20 bp, Homo sapiens
ccactaggtgaacagcagga

SEQ ID NO: 6037822 - DNA, 21 bp, Homo sapiens
ccactaggtgcccagtcttga

SEQ ID NO: 6037823 - DNA, 14 bp, Homo sapiens
ccactaggtgtccc

SEQ ID NO: 6037824 - DNA, 16 bp, Homo sapiens
ccactaggtgtcccca

SEQ ID NO: 6037825 - DNA, 21 bp, Homo sapiens
ccactaggtgtccccaacgtc

SEQ ID NO: 6037826 - DNA, 22 bp, Homo sapiens
ccactagtaagtaattatgcac

SEQ ID NO: 6037827 - DNA, 17 bp, Homo sapiens
ccactagtggggtcctg

SEQ ID NO: 6037828 - DNA, 20 bp, Homo sapiens
ccactataaaatgtcttcaa

SEQ ID NO: 6037829 - DNA, 17 bp, Homo sapiens
ccactatacaattcagt

SEQ ID NO: 6037830 - DNA, 21 bp, Homo sapiens
ccactatcccaatcaaagaat

SEQ ID NO: 6037831 - DNA, 19 bp, Homo sapiens
ccactatgggaagctctgt

SEQ ID NO: 6037832 - DNA, 21 bp, Homo sapiens
ccactatgggaagctctgtgt

SEQ ID NO: 6037833 - DNA, 21 bp, Homo sapiens
ccactatgtccagctagccaa

SEQ ID NO: 6037834 - DNA, 17 bp, Homo sapiens
ccactcaaaatatgtca

SEQ ID NO: 6037835 - DNA, 19 bp, Homo sapiens
ccactcaaaatatgtcaac

SEQ ID NO: 6037836 - DNA, 16 bp, Homo sapiens
ccactcaaaggccaga

SEQ ID NO: 6037837 - DNA, 13 bp, Homo sapiens
ccactcaagacca

SEQ ID NO: 6037838 - DNA, 20 bp, Homo sapiens
ccactcaatgacatcatgtt

SEQ ID NO: 6037839 - DNA, 23 bp, Homo sapiens
ccactcaatgtcttaggtcagga

SEQ ID NO: 6037840 - DNA, 20 bp, Homo sapiens
ccactcacaacagctgcctg

SEQ ID NO: 6037841 - DNA, 13 bp, Homo sapiens
ccactcacacagc

SEQ ID NO: 6037842 - DNA, 11 bp, Homo sapiens
ccactcacagg

SEQ ID NO: 6037843 - DNA, 15 bp, Homo sapiens
ccactcaccagccct

SEQ ID NO: 6037844 - DNA, 17 bp, Homo sapiens
ccactcaccagggtccg

SEQ ID NO: 6037845 - DNA, 11 bp, Homo sapiens
ccactcacccc

SEQ ID NO: 6037846 - DNA, 12 bp, Homo sapiens
ccactcaccccc

SEQ ID NO: 6037847 - DNA, 13 bp, Homo sapiens
ccactcaccccct

SEQ ID NO: 6037848 - DNA, 18 bp, Homo sapiens
ccactcactaggccccca

SEQ ID NO: 6037849 - DNA, 15 bp, Homo sapiens
ccactcactccagcc

SEQ ID NO: 6037850 - DNA, 14 bp, Homo sapiens
ccactcactgcatt

SEQ ID NO: 6037851 - DNA, 22 bp, Homo sapiens
ccactcactgctgtgagtgcgc

SEQ ID NO: 6037852 - DNA, 13 bp, Homo sapiens
ccactcagagaca

SEQ ID NO: 6037853 - DNA, 15 bp, Homo sapiens
ccactcagaggcccc

SEQ ID NO: 6037854 - DNA, 20 bp, Homo sapiens
ccactcagaggcccccagtg

SEQ ID NO: 6037855 - DNA, 11 bp, Homo sapiens
ccactcagcac

SEQ ID NO: 6037856 - DNA, 17 bp, Homo sapiens
ccactcagcactctgga

SEQ ID NO: 6037857 - DNA, 17 bp, Homo sapiens
ccactcagccatttccc

SEQ ID NO: 6037858 - DNA, 15 bp, Homo sapiens
ccactcagcccctag

SEQ ID NO: 6037859 - DNA, 13 bp, Homo sapiens
ccactcagccttt

SEQ ID NO: 6037860 - DNA, 16 bp, Homo sapiens
ccactcagcttggttc

SEQ ID NO: 6037861 - DNA, 22 bp, Homo sapiens
ccactcagcttggttcctgccc

SEQ ID NO: 6037862 - DNA, 18 bp, Homo sapiens
ccactcaggcagcctgtg

SEQ ID NO: 6037863 - DNA, 18 bp, Homo sapiens
catcagaatgttaattta

SEQ ID NO: 6037864 - DNA, 20 bp, Homo sapiens
catcagacccaacccatgaa

SEQ ID NO: 6037865 - DNA, 15 bp, Homo sapiens
catcagacctgtctt

SEQ ID NO: 6037866 - DNA, 19 bp, Homo sapiens
catcagactgtgaacccca

SEQ ID NO: 6037867 - DNA, 17 bp, Homo sapiens
catcagacttgcggcca

SEQ ID NO: 6037868 - DNA, 16 bp, Homo sapiens
catcagagcaaatttg

SEQ ID NO: 6037869 - DNA, 14 bp, Homo sapiens
catcagagggctga

SEQ ID NO: 6037870 - DNA, 23 bp, Homo sapiens
catcagataagacatatctctaa

SEQ ID NO: 6037871 - DNA, 19 bp, Homo sapiens
catcagatggaaatatttt

SEQ ID NO: 6037872 - DNA, 17 bp, Homo sapiens
catcagattctgtgaga

SEQ ID NO: 6037873 - DNA, 15 bp, Homo sapiens
catcagatttcttaa

SEQ ID NO: 6037874 - DNA, 19 bp, Homo sapiens
catcagcaagactttataa

SEQ ID NO: 6037875 - DNA, 14 bp, Homo sapiens
catcagcactgcca

SEQ ID NO: 6037876 - DNA, 22 bp, Homo sapiens
catcagcagcccatggcctctg

SEQ ID NO: 6037877 - DNA, 13 bp, Homo sapiens
catcagcatacct

SEQ ID NO: 6037878 - DNA, 20 bp, Homo sapiens
catcagcatacctttattgt

SEQ ID NO: 6037879 - DNA, 16 bp, Homo sapiens
catcagcatgttttct

SEQ ID NO: 6037880 - DNA, 20 bp, Homo sapiens
catcagcatttaataaatgt

SEQ ID NO: 6037881 - DNA, 12 bp, Homo sapiens
catcagccagct

SEQ ID NO: 6037882 - DNA, 15 bp, Homo sapiens
catcagccagctgcc

SEQ ID NO: 6037883 - DNA, 21 bp, Homo sapiens
catcagccagtgaatctgttt

SEQ ID NO: 6037884 - DNA, 18 bp, Homo sapiens
catcagccccacaggact

SEQ ID NO: 6037885 - DNA, 13 bp, Homo sapiens
catcagcccctgc

SEQ ID NO: 6037886 - DNA, 18 bp, Homo sapiens
catcagcccggtgtgagg

SEQ ID NO: 6037887 - DNA, 16 bp, Homo sapiens
catcagccctagggaa

SEQ ID NO: 6037888 - DNA, 16 bp, Homo sapiens
catcagcctccttctt

SEQ ID NO: 6037889 - DNA, 16 bp, Homo sapiens
catcagcctctggcca

SEQ ID NO: 6037890 - DNA, 11 bp, Homo sapiens
catcagccttc

SEQ ID NO: 6037891 - DNA, 14 bp, Homo sapiens
catcagccttggga

SEQ ID NO: 6037892 - DNA, 11 bp, Homo sapiens
catcagccttt

SEQ ID NO: 6037893 - DNA, 18 bp, Homo sapiens
catcagctaaacaccacg

SEQ ID NO: 6037894 - DNA, 21 bp, Homo sapiens
catcagctacccctgcagctg

SEQ ID NO: 6037895 - DNA, 13 bp, Homo sapiens
catcagctagcaa

SEQ ID NO: 6037896 - DNA, 13 bp, Homo sapiens
catcagctcccaa

SEQ ID NO: 6037897 - DNA, 12 bp, Homo sapiens
catcagctccct

SEQ ID NO: 6037898 - DNA, 17 bp, Homo sapiens
catcagctctgccttgc

SEQ ID NO: 6037899 - DNA, 15 bp, Homo sapiens
catcagctgaattca

SEQ ID NO: 6037900 - DNA, 21 bp, Homo sapiens
catcagctgaattcacttaag

SEQ ID NO: 6037901 - DNA, 16 bp, Homo sapiens
catcagctgctcagat

SEQ ID NO: 6037902 - DNA, 18 bp, Homo sapiens
catcagctgctcagatcc

SEQ ID NO: 6037903 - DNA, 19 bp, Homo sapiens
catcagctgctcagatccc

SEQ ID NO: 6037904 - DNA, 17 bp, Homo sapiens
catcagctgtaagaaga

SEQ ID NO: 6037905 - DNA, 23 bp, Homo sapiens
catcagctgtaagaagagactgg

SEQ ID NO: 6037906 - DNA, 20 bp, Homo sapiens
catcagctgtctgtcatctg

SEQ ID NO: 6037907 - DNA, 15 bp, Homo sapiens
catcagcttaattta

SEQ ID NO: 6037908 - DNA, 16 bp, Homo sapiens
catcagcttaatttaa

SEQ ID NO: 6037909 - DNA, 17 bp, Homo sapiens
catcagctttataataa

SEQ ID NO: 6037910 - DNA, 16 bp, Homo sapiens
catcagctttctaatg

SEQ ID NO: 6037911 - DNA, 18 bp, Homo sapiens
catcagctttttgtatta

SEQ ID NO: 6037912 - DNA, 15 bp, Homo sapiens
catcaggaaagagag

SEQ ID NO: 6037913 - DNA, 22 bp, Homo sapiens
catcaggaattgtcaaatgatg

SEQ ID NO: 6037914 - DNA, 18 bp, Homo sapiens
catcaggaccctggacct

SEQ ID NO: 6037915 - DNA, 15 bp, Homo sapiens
catcaggactcttgt

SEQ ID NO: 6037916 - DNA, 22 bp, Homo sapiens
catcaggagaaaaagcctccag

SEQ ID NO: 6037917 - DNA, 14 bp, Homo sapiens
catcaggagactgg

SEQ ID NO: 6037918 - DNA, 18 bp, Homo sapiens
catcaggagctgctcagg

SEQ ID NO: 6037919 - DNA, 18 bp, Homo sapiens
catcaggagttccagtgc

SEQ ID NO: 6037920 - DNA, 20 bp, Homo sapiens
catcaggatactcaaagtgg

SEQ ID NO: 6037921 - DNA, 15 bp, Homo sapiens
catcaggccaggccc

SEQ ID NO: 6037922 - DNA, 16 bp, Homo sapiens
catcaggccaggccct

SEQ ID NO: 6037923 - DNA, 19 bp, Homo sapiens
catcaggccaggccctctg

SEQ ID NO: 6037924 - DNA, 20 bp, Homo sapiens
catcaggccaggccctctgc

SEQ ID NO: 6037925 - DNA, 19 bp, Homo sapiens
catcaggcctagaggcctg

SEQ ID NO: 6037926 - DNA, 18 bp, Homo sapiens
catcaggctaagaccctg

SEQ ID NO: 6037927 - DNA, 15 bp, Homo sapiens
catcaggctttcttt

SEQ ID NO: 6037928 - DNA, 17 bp, Homo sapiens
catcagggagtaagtga

SEQ ID NO: 6037929 - DNA, 20 bp, Homo sapiens
catcagggatctcagaggct

SEQ ID NO: 6037930 - DNA, 15 bp, Homo sapiens
catcagggccctgcc

SEQ ID NO: 6037931 - DNA, 18 bp, Homo sapiens
catcagggccctgcccca

SEQ ID NO: 6037932 - DNA, 11 bp, Homo sapiens
catcagggcct

SEQ ID NO: 6037933 - DNA, 22 bp, Homo sapiens
catcagggcctttctcctcccc

SEQ ID NO: 6037934 - DNA, 17 bp, Homo sapiens
catcagggggaagaagc

SEQ ID NO: 6037935 - DNA, 18 bp, Homo sapiens
catcagggggaagaagca

SEQ ID NO: 6037936 - DNA, 17 bp, Homo sapiens
catcagggtagcagcag

SEQ ID NO: 6037937 - DNA, 19 bp, Homo sapiens
catcagggtagcagcagag

SEQ ID NO: 6037938 - DNA, 13 bp, Homo sapiens
catcagggtgggc

SEQ ID NO: 6037939 - DNA, 16 bp, Homo sapiens
catcaggtctgggcaa

SEQ ID NO: 6037940 - DNA, 16 bp, Homo sapiens
catcaggttccatccc

SEQ ID NO: 6037941 - DNA, 15 bp, Homo sapiens
catcagtaacagtat

SEQ ID NO: 6037942 - DNA, 15 bp, Homo sapiens
catcagtagatttct

SEQ ID NO: 6037943 - DNA, 16 bp, Homo sapiens
catcagtagcattttt

SEQ ID NO: 6037944 - DNA, 20 bp, Homo sapiens
catcagtagcatttttctaa

SEQ ID NO: 6037945 - DNA, 22 bp, Homo sapiens
catcagtattgaagcattttat

SEQ ID NO: 6037946 - DNA, 18 bp, Homo sapiens
catcagtattgtgtaaag

SEQ ID NO: 6037947 - DNA, 15 bp, Homo sapiens
catcagtcaatggaa

SEQ ID NO: 6037948 - DNA, 21 bp, Homo sapiens
catcagtcattcccacgcttg

SEQ ID NO: 6037949 - DNA, 14 bp, Homo sapiens
catcagtgaggagg

SEQ ID NO: 6037950 - DNA, 18 bp, Homo sapiens
catcagtgccagcccctg

SEQ ID NO: 6037951 - DNA, 15 bp, Homo sapiens
catcagtgcctcttt

SEQ ID NO: 6037952 - DNA, 18 bp, Homo sapiens
catcagtggatggcagga

SEQ ID NO: 6037953 - DNA, 22 bp, Homo sapiens
catcagtggcatggctccagtc

SEQ ID NO: 6037954 - DNA, 18 bp, Homo sapiens
catcagtgtgtaaataat

SEQ ID NO: 6037955 - DNA, 22 bp, Homo sapiens
catcagtgttaaaaaatttttg

SEQ ID NO: 6037956 - DNA, 14 bp, Homo sapiens
catcagtgtttgtt

SEQ ID NO: 6037957 - DNA, 21 bp, Homo sapiens
catcagttacagagaatttct

SEQ ID NO: 6037958 - DNA, 22 bp, Homo sapiens
catcagttactctgaagggcat

SEQ ID NO: 6037959 - DNA, 16 bp, Homo sapiens
catcagttagagctga

SEQ ID NO: 6037960 - DNA, 14 bp, Homo sapiens
catcagttcattga

SEQ ID NO: 6037961 - DNA, 15 bp, Homo sapiens
catcagttccagcct

SEQ ID NO: 6037962 - DNA, 17 bp, Homo sapiens
catcagttcctttgatc

SEQ ID NO: 6037963 - DNA, 16 bp, Homo sapiens
catcagtttaggcctt

SEQ ID NO: 6037964 - DNA, 13 bp, Homo sapiens
catcataaaataa

SEQ ID NO: 6037965 - DNA, 18 bp, Homo sapiens
catcataaaataaagtat

SEQ ID NO: 6037966 - DNA, 21 bp, Homo sapiens
catcataaacaaagagtagaa

SEQ ID NO: 6037967 - DNA, 14 bp, Homo sapiens
catcataattacat

SEQ ID NO: 6037968 - DNA, 19 bp, Homo sapiens
catcataattacattccta

SEQ ID NO: 6037969 - DNA, 22 bp, Homo sapiens
catcataattacattcctaact

SEQ ID NO: 6037970 - DNA, 14 bp, Homo sapiens
catcatacttaact

SEQ ID NO: 6037971 - DNA, 19 bp, Homo sapiens
catcatagaacagaaatat

SEQ ID NO: 6037972 - DNA, 22 bp, Homo sapiens
catcatagaaggagagcccagg

SEQ ID NO: 6037973 - DNA, 22 bp, Homo sapiens
catcatagcaagacctcatctc

SEQ ID NO: 6037974 - DNA, 23 bp, Homo sapiens
catcataggaagggaccaaggca

SEQ ID NO: 6037975 - DNA, 20 bp, Homo sapiens
catcatagtaaaagaaatga

SEQ ID NO: 6037976 - DNA, 15 bp, Homo sapiens
catcatatacctctt

SEQ ID NO: 6037977 - DNA, 19 bp, Homo sapiens
catcatatacctcttgaag

SEQ ID NO: 6037978 - DNA, 13 bp, Homo sapiens
catcatatattta

SEQ ID NO: 6037979 - DNA, 18 bp, Homo sapiens
catcatatcataggtaca

SEQ ID NO: 6037980 - DNA, 22 bp, Homo sapiens
catcatatcctttgccccaagg

SEQ ID NO: 6037981 - DNA, 17 bp, Homo sapiens
catcatatgaatgttct

SEQ ID NO: 6037982 - DNA, 20 bp, Homo sapiens
catcatatgacatgccaccc

SEQ ID NO: 6037983 - DNA, 21 bp, Homo sapiens
catcatatgacatgccaccct

SEQ ID NO: 6037984 - DNA, 18 bp, Homo sapiens
catcatatgttagataca

SEQ ID NO: 6037985 - DNA, 20 bp, Homo sapiens
catcatatgttagatacaca

SEQ ID NO: 6037986 - DNA, 21 bp, Homo sapiens
catcatattaaaaatatacaa

SEQ ID NO: 6037987 - DNA, 22 bp, Homo sapiens
catcatattccaacccagccac

SEQ ID NO: 6037988 - DNA, 20 bp, Homo sapiens
catcatattctattgtttac

SEQ ID NO: 6037989 - DNA, 20 bp, Homo sapiens
catcatcaaggcactgcctg

SEQ ID NO: 6037990 - DNA, 21 bp, Homo sapiens
catcatcaaggcactgcctga

SEQ ID NO: 6037991 - DNA, 19 bp, Homo sapiens
catcatcagacttgcggcc

SEQ ID NO: 6037992 - DNA, 21 bp, Homo sapiens
catcatcagacttgcggccac

SEQ ID NO: 6037993 - DNA, 22 bp, Homo sapiens
catcatcaggcttggaatgaat

SEQ ID NO: 6037994 - DNA, 23 bp, Homo sapiens
catcatcaggcttggaatgaatt

SEQ ID NO: 6037995 - DNA, 17 bp, Homo sapiens
catcatcagtggagcca

SEQ ID NO: 6037996 - DNA, 18 bp, Homo sapiens
catcatcatggccagctg

SEQ ID NO: 6037997 - DNA, 24 bp, Homo sapiens
catcatcatggccagctggaggca

SEQ ID NO: 6037998 - DNA, 16 bp, Homo sapiens
catcatccctccctgc

SEQ ID NO: 6037999 - DNA, 18 bp, Homo sapiens
catcatccggtttagtca

SEQ ID NO: 6038000 - DNA, 14 bp, Homo sapiens
catcatcctcactg

SEQ ID NO: 6038001 - DNA, 14 bp, Homo sapiens
catcatcctcctta

SEQ ID NO: 6038002 - DNA, 21 bp, Homo sapiens
catcatcgttgttattaaaga

SEQ ID NO: 6038003 - DNA, 10 bp, Homo sapiens
catcatctct

SEQ ID NO: 6038004 - DNA, 14 bp, Homo sapiens
catcatctctgcct

SEQ ID NO: 6038005 - DNA, 18 bp, Homo sapiens
catcatctctgcctttga

SEQ ID NO: 6038006 - DNA, 17 bp, Homo sapiens
catcatctcttgataaa

SEQ ID NO: 6038007 - DNA, 14 bp, Homo sapiens
catcatctgctgca

SEQ ID NO: 6038008 - DNA, 13 bp, Homo sapiens
catcatctgtaag

SEQ ID NO: 6038009 - DNA, 19 bp, Homo sapiens
catcatctgtaagctgttt

SEQ ID NO: 6038010 - DNA, 21 bp, Homo sapiens
catcatgaactggcttgtaca

SEQ ID NO: 6038011 - DNA, 22 bp, Homo sapiens
catcatgaactggcttgtacat

SEQ ID NO: 6038012 - DNA, 23 bp, Homo sapiens
catcatgaactggcttgtacatt

SEQ ID NO: 6038013 - DNA, 18 bp, Homo sapiens
catcatgagccgttgcta

SEQ ID NO: 6038014 - DNA, 13 bp, Homo sapiens
catcatgcagctc

SEQ ID NO: 6038015 - DNA, 12 bp, Homo sapiens
catcatgcatgt

SEQ ID NO: 6038016 - DNA, 17 bp, Homo sapiens
catcatgccaacttgtg

SEQ ID NO: 6038017 - DNA, 18 bp, Homo sapiens
catcatgcctctgaggcc

SEQ ID NO: 6038018 - DNA, 13 bp, Homo sapiens
catcatgcctgac

SEQ ID NO: 6038019 - DNA, 20 bp, Homo sapiens
catcatgcttatgttaaact

SEQ ID NO: 6038020 - DNA, 13 bp, Homo sapiens
catcatggaccaa

SEQ ID NO: 6038021 - DNA, 21 bp, Homo sapiens
catcatggattcattacagct

SEQ ID NO: 6038022 - DNA, 23 bp, Homo sapiens
catcatggctgcttgattttgta

SEQ ID NO: 6038023 - DNA, 23 bp, Homo sapiens
catcatgggggatttttcattct

SEQ ID NO: 6038024 - DNA, 14 bp, Homo sapiens
catcatggtggata

SEQ ID NO: 6038025 - DNA, 23 bp, Homo sapiens
catcatggtggatatggtgcaga

SEQ ID NO: 6038026 - DNA, 14 bp, Homo sapiens
catcatgtatctgt

SEQ ID NO: 6038027 - DNA, 21 bp, Homo sapiens
catcatgtccccaaacctgca

SEQ ID NO: 6038028 - DNA, 14 bp, Homo sapiens
catcatgtctattg

SEQ ID NO: 6038029 - DNA, 15 bp, Homo sapiens
catcatgtctggcta

SEQ ID NO: 6038030 - DNA, 13 bp, Homo sapiens
catcatgtctgta

SEQ ID NO: 6038031 - DNA, 16 bp, Homo sapiens
catcatgtgcctggaa

SEQ ID NO: 6038032 - DNA, 19 bp, Homo sapiens
catcatgtggcccaactct

SEQ ID NO: 6038033 - DNA, 18 bp, Homo sapiens
catcatgttgaccaggct

SEQ ID NO: 6038034 - DNA, 12 bp, Homo sapiens
catcatgtttca

SEQ ID NO: 6038035 - DNA, 20 bp, Homo sapiens
catcatgtttcagtgaagat

SEQ ID NO: 6038036 - DNA, 15 bp, Homo sapiens
catcattaaattttt

SEQ ID NO: 6038037 - DNA, 15 bp, Homo sapiens
catcattaataagtg

SEQ ID NO: 6038038 - DNA, 16 bp, Homo sapiens
catcattaataagtga

SEQ ID NO: 6038039 - DNA, 21 bp, Homo sapiens
catcattaatgactttatgta

SEQ ID NO: 6038040 - DNA, 18 bp, Homo sapiens
catcattacaatacagta

SEQ ID NO: 6038041 - DNA, 19 bp, Homo sapiens
ccactcagggctggcccgg

SEQ ID NO: 6038042 - DNA, 19 bp, Homo sapiens
ccactcaggggaccccact

SEQ ID NO: 6038043 - DNA, 14 bp, Homo sapiens
ccactcaggggtca

SEQ ID NO: 6038044 - DNA, 18 bp, Homo sapiens
ccactcaggttcttcagg

SEQ ID NO: 6038045 - DNA, 21 bp, Homo sapiens
ccactcagtactgtacagggt

SEQ ID NO: 6038046 - DNA, 18 bp, Homo sapiens
ccactcagtccatagcag

SEQ ID NO: 6038047 - DNA, 16 bp, Homo sapiens
ccactcagtgcctcca

SEQ ID NO: 6038048 - DNA, 20 bp, Homo sapiens
ccactcatgttgttcccaca

SEQ ID NO: 6038049 - DNA, 14 bp, Homo sapiens
ccactcattccttc

SEQ ID NO: 6038050 - DNA, 18 bp, Homo sapiens
ccactccaagccccctgg

SEQ ID NO: 6038051 - DNA, 16 bp, Homo sapiens
ccactccaagtgcccc

SEQ ID NO: 6038052 - DNA, 15 bp, Homo sapiens
ccactccacaaatga

SEQ ID NO: 6038053 - DNA, 18 bp, Homo sapiens
ccactccacatctgcatc

SEQ ID NO: 6038054 - DNA, 20 bp, Homo sapiens
ccactccacctccacccact

SEQ ID NO: 6038055 - DNA, 19 bp, Homo sapiens
ccactccagacccctggct

SEQ ID NO: 6038056 - DNA, 20 bp, Homo sapiens
ccactccagacccctggctt

SEQ ID NO: 6038057 - DNA, 13 bp, Homo sapiens
ccactccagcaga

SEQ ID NO: 6038058 - DNA, 11 bp, Homo sapiens
ccactccagcc

SEQ ID NO: 6038059 - DNA, 13 bp, Homo sapiens
ccactccagcccg

SEQ ID NO: 6038060 - DNA, 15 bp, Homo sapiens
ccactccagcccgca

SEQ ID NO: 6038061 - DNA, 14 bp, Homo sapiens
ccactccagccctg

SEQ ID NO: 6038062 - DNA, 20 bp, Homo sapiens
ccactccagctccttcgctt

SEQ ID NO: 6038063 - DNA, 13 bp, Homo sapiens
ccactccagctct

SEQ ID NO: 6038064 - DNA, 13 bp, Homo sapiens
ccactccagctga

SEQ ID NO: 6038065 - DNA, 24 bp, Homo sapiens
ccactccaggctttacagatgact

SEQ ID NO: 6038066 - DNA, 14 bp, Homo sapiens
ccactccagtcctg

SEQ ID NO: 6038067 - DNA, 21 bp, Homo sapiens
ccactccagttttctcctctg

SEQ ID NO: 6038068 - DNA, 13 bp, Homo sapiens
ccactccatctgg

SEQ ID NO: 6038069 - DNA, 16 bp, Homo sapiens
ccactccatctggtag

SEQ ID NO: 6038070 - DNA, 13 bp, Homo sapiens
ccactccattccc

SEQ ID NO: 6038071 - DNA, 17 bp, Homo sapiens
ccactcccaaagctcag

SEQ ID NO: 6038072 - DNA, 14 bp, Homo sapiens
ccactcccaagcca

SEQ ID NO: 6038073 - DNA, 16 bp, Homo sapiens
ccactcccacctcacc

SEQ ID NO: 6038074 - DNA, 12 bp, Homo sapiens
ccactcccactt

SEQ ID NO: 6038075 - DNA, 17 bp, Homo sapiens
ccactcccacttccctg

SEQ ID NO: 6038076 - DNA, 21 bp, Homo sapiens
ccactcccacttccctgacac

SEQ ID NO: 6038077 - DNA, 12 bp, Homo sapiens
ccactcccagca

SEQ ID NO: 6038078 - DNA, 14 bp, Homo sapiens
ccactcccagtccc

SEQ ID NO: 6038079 - DNA, 21 bp, Homo sapiens
ccactcccatggctctgggcg

SEQ ID NO: 6038080 - DNA, 17 bp, Homo sapiens
ccactccccaacccctc

SEQ ID NO: 6038081 - DNA, 13 bp, Homo sapiens
ccactccccagcc

SEQ ID NO: 6038082 - DNA, 22 bp, Homo sapiens
ccactccccagccagcctggct

SEQ ID NO: 6038083 - DNA, 15 bp, Homo sapiens
ccactccccagtgct

SEQ ID NO: 6038084 - DNA, 21 bp, Homo sapiens
ccactccccagtgctcctgtg

SEQ ID NO: 6038085 - DNA, 11 bp, Homo sapiens
ccactccccca

SEQ ID NO: 6038086 - DNA, 22 bp, Homo sapiens
ccactcccccacccatggggag

SEQ ID NO: 6038087 - DNA, 15 bp, Homo sapiens
ccactcccccacctg

SEQ ID NO: 6038088 - DNA, 14 bp, Homo sapiens
ccactcccccagga

SEQ ID NO: 6038089 - DNA, 12 bp, Homo sapiens
ccactcccctca

SEQ ID NO: 6038090 - DNA, 15 bp, Homo sapiens
ccactcccctcacac

SEQ ID NO: 6038091 - DNA, 13 bp, Homo sapiens
ccactcccctcat

SEQ ID NO: 6038092 - DNA, 17 bp, Homo sapiens
ccactcccctcatccac

SEQ ID NO: 6038093 - DNA, 17 bp, Homo sapiens
ccactcccgccacacgc

SEQ ID NO: 6038094 - DNA, 23 bp, Homo sapiens
ccactcccgggccaagacagatg

SEQ ID NO: 6038095 - DNA, 22 bp, Homo sapiens
ccactccctacccaatgtctcc

SEQ ID NO: 6038096 - DNA, 13 bp, Homo sapiens
ccactccctatct

SEQ ID NO: 6038097 - DNA, 14 bp, Homo sapiens
ccactccctatctc

SEQ ID NO: 6038098 - DNA, 17 bp, Homo sapiens
ccactccctatctcctt

SEQ ID NO: 6038099 - DNA, 12 bp, Homo sapiens
ccactccctcac

SEQ ID NO: 6038100 - DNA, 14 bp, Homo sapiens
ccactccctcacaa

SEQ ID NO: 6038101 - DNA, 14 bp, Homo sapiens
ccactccctcccag

SEQ ID NO: 6038102 - DNA, 13 bp, Homo sapiens
ccactccctgagc

SEQ ID NO: 6038103 - DNA, 15 bp, Homo sapiens
ccactccctgcaacc

SEQ ID NO: 6038104 - DNA, 14 bp, Homo sapiens
ccactccctgccta

SEQ ID NO: 6038105 - DNA, 15 bp, Homo sapiens
ccactccctgctcta

SEQ ID NO: 6038106 - DNA, 14 bp, Homo sapiens
ccactccctgtctg

SEQ ID NO: 6038107 - DNA, 15 bp, Homo sapiens
ccactccctgtctga

SEQ ID NO: 6038108 - DNA, 20 bp, Homo sapiens
ccactcccttgctggcccca

SEQ ID NO: 6038109 - DNA, 13 bp, Homo sapiens
ccactcccttggt

SEQ ID NO: 6038110 - DNA, 23 bp, Homo sapiens
ccactccctttgcgtcaggagca

SEQ ID NO: 6038111 - DNA, 17 bp, Homo sapiens
ccactccgagaggtggg

SEQ ID NO: 6038112 - DNA, 19 bp, Homo sapiens
ccactccgagaggtgggcc

SEQ ID NO: 6038113 - DNA, 22 bp, Homo sapiens
ccactccgccagccacaggacc

SEQ ID NO: 6038114 - DNA, 23 bp, Homo sapiens
ccactccggattccggccctggc

SEQ ID NO: 6038115 - DNA, 17 bp, Homo sapiens
ccactcctatggaaaag

SEQ ID NO: 6038116 - DNA, 17 bp, Homo sapiens
ccactcctcaaccttga

SEQ ID NO: 6038117 - DNA, 22 bp, Homo sapiens
ccactcctcagtaaaagtcttc

SEQ ID NO: 6038118 - DNA, 23 bp, Homo sapiens
ccactcctcagtaaaagtcttct

SEQ ID NO: 6038119 - DNA, 12 bp, Homo sapiens
ccactcctccaa

SEQ ID NO: 6038120 - DNA, 13 bp, Homo sapiens
ccactcctcccaa

SEQ ID NO: 6038121 - DNA, 14 bp, Homo sapiens
ccactcctcctagc

SEQ ID NO: 6038122 - DNA, 14 bp, Homo sapiens
ccactcctctaaga

SEQ ID NO: 6038123 - DNA, 21 bp, Homo sapiens
ccactcctctcaactgcctca

SEQ ID NO: 6038124 - DNA, 23 bp, Homo sapiens
ccactcctctcaactgcctcagc

SEQ ID NO: 6038125 - DNA, 17 bp, Homo sapiens
ccactcctctcccacag

SEQ ID NO: 6038126 - DNA, 14 bp, Homo sapiens
ccactcctctgact

SEQ ID NO: 6038127 - DNA, 22 bp, Homo sapiens
ccactcctctgctgacctgctg

SEQ ID NO: 6038128 - DNA, 14 bp, Homo sapiens
ccactcctcttcac

SEQ ID NO: 6038129 - DNA, 15 bp, Homo sapiens
ccactcctgccagcc

SEQ ID NO: 6038130 - DNA, 16 bp, Homo sapiens
ccactcctgctctgct

SEQ ID NO: 6038131 - DNA, 12 bp, Homo sapiens
ccactcctgctg

SEQ ID NO: 6038132 - DNA, 14 bp, Homo sapiens
ccactcctgctgca

SEQ ID NO: 6038133 - DNA, 20 bp, Homo sapiens
ccactcctgcttctctgggg

SEQ ID NO: 6038134 - DNA, 15 bp, Homo sapiens
ccactcctgtacact

SEQ ID NO: 6038135 - DNA, 13 bp, Homo sapiens
ccactccttccat

SEQ ID NO: 6038136 - DNA, 16 bp, Homo sapiens
ccactccttcctgccc

SEQ ID NO: 6038137 - DNA, 22 bp, Homo sapiens
ccactccttccttcaggactct

SEQ ID NO: 6038138 - DNA, 11 bp, Homo sapiens
ccactccttgt

SEQ ID NO: 6038139 - DNA, 18 bp, Homo sapiens
ccactcctttacaaccat

SEQ ID NO: 6038140 - DNA, 20 bp, Homo sapiens
ccactcgacccagaatggag

SEQ ID NO: 6038141 - DNA, 17 bp, Homo sapiens
ccactcgaggcctgcaa

SEQ ID NO: 6038142 - DNA, 16 bp, Homo sapiens
ccactcgatgatgctt

SEQ ID NO: 6038143 - DNA, 14 bp, Homo sapiens
ccactcgcagtcgc

SEQ ID NO: 6038144 - DNA, 18 bp, Homo sapiens
ccactcgcagtcgcagga

SEQ ID NO: 6038145 - DNA, 13 bp, Homo sapiens
ccactcgcttccc

SEQ ID NO: 6038146 - DNA, 18 bp, Homo sapiens
ccactcgcttcccccata

SEQ ID NO: 6038147 - DNA, 20 bp, Homo sapiens
ccactcggggcccccatctt

SEQ ID NO: 6038148 - DNA, 23 bp, Homo sapiens
ccactcgtccaagggacagccca

SEQ ID NO: 6038149 - DNA, 15 bp, Homo sapiens
ccactctaccagtgc

SEQ ID NO: 6038150 - DNA, 23 bp, Homo sapiens
ccactctaccagtgcaggctggc

SEQ ID NO: 6038151 - DNA, 14 bp, Homo sapiens
ccactctactgccc

SEQ ID NO: 6038152 - DNA, 21 bp, Homo sapiens
ccactctaggggtcaggctcc

SEQ ID NO: 6038153 - DNA, 15 bp, Homo sapiens
ccactctcactccac

SEQ ID NO: 6038154 - DNA, 15 bp, Homo sapiens
ccactctcagaggcc

SEQ ID NO: 6038155 - DNA, 17 bp, Homo sapiens
ccactctcagaggcccc

SEQ ID NO: 6038156 - DNA, 14 bp, Homo sapiens
ccactctcaggacc

SEQ ID NO: 6038157 - DNA, 16 bp, Homo sapiens
ccactctcattcccca

SEQ ID NO: 6038158 - DNA, 14 bp, Homo sapiens
ccactctccacctc

SEQ ID NO: 6038159 - DNA, 15 bp, Homo sapiens
ccactctccacctca

SEQ ID NO: 6038160 - DNA, 13 bp, Homo sapiens
ccactctccccac

SEQ ID NO: 6038161 - DNA, 16 bp, Homo sapiens
ccactctccccacact

SEQ ID NO: 6038162 - DNA, 13 bp, Homo sapiens
ccactctcctagg

SEQ ID NO: 6038163 - DNA, 13 bp, Homo sapiens
ccactctcctgag

SEQ ID NO: 6038164 - DNA, 11 bp, Homo sapiens
ccactctcctt

SEQ ID NO: 6038165 - DNA, 18 bp, Homo sapiens
ccactctcggggcccttg

SEQ ID NO: 6038166 - DNA, 14 bp, Homo sapiens
ccactctctgggac

SEQ ID NO: 6038167 - DNA, 22 bp, Homo sapiens
ccactctgaagtcccttcctgt

SEQ ID NO: 6038168 - DNA, 20 bp, Homo sapiens
ccactctgattcacctcttc

SEQ ID NO: 6038169 - DNA, 19 bp, Homo sapiens
ccactctgcccagccggag

SEQ ID NO: 6038170 - DNA, 16 bp, Homo sapiens
ccactctgcctctgcc

SEQ ID NO: 6038171 - DNA, 15 bp, Homo sapiens
ccactctgcctgcct

SEQ ID NO: 6038172 - DNA, 16 bp, Homo sapiens
ccactctgctcagggc

SEQ ID NO: 6038173 - DNA, 18 bp, Homo sapiens
ccactctgctctgatgca

SEQ ID NO: 6038174 - DNA, 12 bp, Homo sapiens
ccactctgctga

SEQ ID NO: 6038175 - DNA, 15 bp, Homo sapiens
ccactctgctgaggc

SEQ ID NO: 6038176 - DNA, 17 bp, Homo sapiens
ccactctgctgcctgta

SEQ ID NO: 6038177 - DNA, 12 bp, Homo sapiens
ccactctgcttc

SEQ ID NO: 6038178 - DNA, 13 bp, Homo sapiens
ccactctgcttct

SEQ ID NO: 6038179 - DNA, 14 bp, Homo sapiens
ccactctgcttctc

SEQ ID NO: 6038180 - DNA, 20 bp, Homo sapiens
ccactctggattcagccttc

SEQ ID NO: 6038181 - DNA, 12 bp, Homo sapiens
ccactctggcag

SEQ ID NO: 6038182 - DNA, 16 bp, Homo sapiens
ccactctggcagccac

SEQ ID NO: 6038183 - DNA, 19 bp, Homo sapiens
ccactctggcagccacact

SEQ ID NO: 6038184 - DNA, 21 bp, Homo sapiens
ccactctggcagccacacttc

SEQ ID NO: 6038185 - DNA, 14 bp, Homo sapiens
ccactctggtggcc

SEQ ID NO: 6038186 - DNA, 17 bp, Homo sapiens
ccactctggtggccact

SEQ ID NO: 6038187 - DNA, 17 bp, Homo sapiens
ccactctgtggccagcc

SEQ ID NO: 6038188 - DNA, 19 bp, Homo sapiens
ccactctgtggccagcctg

SEQ ID NO: 6038189 - DNA, 22 bp, Homo sapiens
ccactctgtggccagcctggca

SEQ ID NO: 6038190 - DNA, 13 bp, Homo sapiens
ccactcttcctgt

SEQ ID NO: 6038191 - DNA, 12 bp, Homo sapiens
ccactcttctct

SEQ ID NO: 6038192 - DNA, 16 bp, Homo sapiens
ccactcttctctcctt

SEQ ID NO: 6038193 - DNA, 22 bp, Homo sapiens
ccactcttctctcctttctccc

SEQ ID NO: 6038194 - DNA, 20 bp, Homo sapiens
ccactcttctttaagccata

SEQ ID NO: 6038195 - DNA, 13 bp, Homo sapiens
ccactctttgaat

SEQ ID NO: 6038196 - DNA, 12 bp, Homo sapiens
ccactctttgct

SEQ ID NO: 6038197 - DNA, 20 bp, Homo sapiens
ccactgaaaagctttcctga

SEQ ID NO: 6038198 - DNA, 16 bp, Homo sapiens
ccactgaaacctctgt

SEQ ID NO: 6038199 - DNA, 13 bp, Homo sapiens
ccactgaacaaaa

SEQ ID NO: 6038200 - DNA, 11 bp, Homo sapiens
ccactgaagag

SEQ ID NO: 6038201 - DNA, 14 bp, Homo sapiens
ccactgaagaggag

SEQ ID NO: 6038202 - DNA, 18 bp, Homo sapiens
ccactgaagatagaagaa

SEQ ID NO: 6038203 - DNA, 19 bp, Homo sapiens
ccactgaagatagaagaaa

SEQ ID NO: 6038204 - DNA, 14 bp, Homo sapiens
ccactgaagctggg

SEQ ID NO: 6038205 - DNA, 15 bp, Homo sapiens
ccactgaagctggga

SEQ ID NO: 6038206 - DNA, 22 bp, Homo sapiens
ccactgaattgacatgaccctc

SEQ ID NO: 6038207 - DNA, 20 bp, Homo sapiens
ccactgacaaacgtccccag

SEQ ID NO: 6038208 - DNA, 16 bp, Homo sapiens
ccactgacagcctcca

SEQ ID NO: 6038209 - DNA, 16 bp, Homo sapiens
ccactgacagcctccc

SEQ ID NO: 6038210 - DNA, 19 bp, Homo sapiens
ccactgacagcctcccacc

SEQ ID NO: 6038211 - DNA, 16 bp, Homo sapiens
ccactgacccacctgc

SEQ ID NO: 6038212 - DNA, 15 bp, Homo sapiens
ccactgacctgccca

SEQ ID NO: 6038213 - DNA, 13 bp, Homo sapiens
ccactgacctgga

SEQ ID NO: 6038214 - DNA, 20 bp, Homo sapiens
ccactgacctggaagagctg

SEQ ID NO: 6038215 - DNA, 21 bp, Homo sapiens
ccactgacctggaagagctgg

SEQ ID NO: 6038216 - DNA, 16 bp, Homo sapiens
ccactgacctggttgt

SEQ ID NO: 6038217 - DNA, 21 bp, Homo sapiens
ccactgacctggttgtccagg

SEQ ID NO: 6038218 - DNA, 23 bp, Homo sapiens
ccactgactaggcatgttaggaa

SEQ ID NO: 6038219 - DNA, 16 bp, Homo sapiens
ccactgactgcaggga

SEQ ID NO: 6038220 - DNA, 17 bp, Homo sapiens
ccactgactgcagggac

SEQ ID NO: 6038221 - DNA, 15 bp, Homo sapiens
ccactgacttgctgt

SEQ ID NO: 6038222 - DNA, 17 bp, Homo sapiens
ccactgacttgctgtgt

SEQ ID NO: 6038223 - DNA, 18 bp, Homo sapiens
ccactgagacggcagaga

SEQ ID NO: 6038224 - DNA, 20 bp, Homo sapiens
catcattacccttccctgca

SEQ ID NO: 6038225 - DNA, 17 bp, Homo sapiens
catcattactggtaaag

SEQ ID NO: 6038226 - DNA, 14 bp, Homo sapiens
catcattactgttc

SEQ ID NO: 6038227 - DNA, 16 bp, Homo sapiens
catcattactgttcca

SEQ ID NO: 6038228 - DNA, 19 bp, Homo sapiens
catcattactgttccagat

SEQ ID NO: 6038229 - DNA, 12 bp, Homo sapiens
catcattacttg

SEQ ID NO: 6038230 - DNA, 14 bp, Homo sapiens
catcattataagct

SEQ ID NO: 6038231 - DNA, 15 bp, Homo sapiens
catcattatttatgt

SEQ ID NO: 6038232 - DNA, 21 bp, Homo sapiens
catcattatttgcagagacag

SEQ ID NO: 6038233 - DNA, 18 bp, Homo sapiens
catcattcatgctactgc

SEQ ID NO: 6038234 - DNA, 13 bp, Homo sapiens
catcattcattca

SEQ ID NO: 6038235 - DNA, 16 bp, Homo sapiens
catcattcattcactg

SEQ ID NO: 6038236 - DNA, 22 bp, Homo sapiens
catcattcctttttatttatat

SEQ ID NO: 6038237 - DNA, 12 bp, Homo sapiens
catcattctctg

SEQ ID NO: 6038238 - DNA, 21 bp, Homo sapiens
catcattctctgtctcatcca

SEQ ID NO: 6038239 - DNA, 19 bp, Homo sapiens
catcattgcacctgcaggc

SEQ ID NO: 6038240 - DNA, 14 bp, Homo sapiens
catcattgcactct

SEQ ID NO: 6038241 - DNA, 21 bp, Homo sapiens
catcattgctgtctgcagcct

SEQ ID NO: 6038242 - DNA, 12 bp, Homo sapiens
catcattggata

SEQ ID NO: 6038243 - DNA, 18 bp, Homo sapiens
catcattggataaatttg

SEQ ID NO: 6038244 - DNA, 20 bp, Homo sapiens
catcattggataaatttgaa

SEQ ID NO: 6038245 - DNA, 17 bp, Homo sapiens
catcattgtattaacgc

SEQ ID NO: 6038246 - DNA, 18 bp, Homo sapiens
catcattgtcagccttgc

SEQ ID NO: 6038247 - DNA, 23 bp, Homo sapiens
catcattgtccccatgcaacaac

SEQ ID NO: 6038248 - DNA, 15 bp, Homo sapiens
catcattgttgtgta

SEQ ID NO: 6038249 - DNA, 19 bp, Homo sapiens
catcattgttgtgtataat

SEQ ID NO: 6038250 - DNA, 22 bp, Homo sapiens
catcattgttgtgtataattta

SEQ ID NO: 6038251 - DNA, 23 bp, Homo sapiens
catcattgtttagatgaggctca

SEQ ID NO: 6038252 - DNA, 20 bp, Homo sapiens
catcattgtttaggggtgaa

SEQ ID NO: 6038253 - DNA, 13 bp, Homo sapiens
catcattgtttct

SEQ ID NO: 6038254 - DNA, 13 bp, Homo sapiens
catcatttaaaca

SEQ ID NO: 6038255 - DNA, 21 bp, Homo sapiens
catcatttaaacatgcagaag

SEQ ID NO: 6038256 - DNA, 12 bp, Homo sapiens
catcatttcact

SEQ ID NO: 6038257 - DNA, 14 bp, Homo sapiens
catcatttcagcca

SEQ ID NO: 6038258 - DNA, 15 bp, Homo sapiens
catcatttcagccaa

SEQ ID NO: 6038259 - DNA, 15 bp, Homo sapiens
catcatttcccctcc

SEQ ID NO: 6038260 - DNA, 18 bp, Homo sapiens
catcatttcccctcccgc

SEQ ID NO: 6038261 - DNA, 13 bp, Homo sapiens
catcatttctagt

SEQ ID NO: 6038262 - DNA, 20 bp, Homo sapiens
catcatttctagtatattag

SEQ ID NO: 6038263 - DNA, 12 bp, Homo sapiens
catcatttctgg

SEQ ID NO: 6038264 - DNA, 13 bp, Homo sapiens
catcatttgggat

SEQ ID NO: 6038265 - DNA, 19 bp, Homo sapiens
catcattttaacaggtgcc

SEQ ID NO: 6038266 - DNA, 20 bp, Homo sapiens
catcattttccatatcctgg

SEQ ID NO: 6038267 - DNA, 20 bp, Homo sapiens
catcattttgcattcaaatt

SEQ ID NO: 6038268 - DNA, 18 bp, Homo sapiens
catcatttttccttccct

SEQ ID NO: 6038269 - DNA, 23 bp, Homo sapiens
catccaaaatagttaagacatga

SEQ ID NO: 6038270 - DNA, 23 bp, Homo sapiens
catccaaaatcttgatcagttaa

SEQ ID NO: 6038271 - DNA, 16 bp, Homo sapiens
catccaaacctacctt

SEQ ID NO: 6038272 - DNA, 16 bp, Homo sapiens
catccaaagcagacag

SEQ ID NO: 6038273 - DNA, 20 bp, Homo sapiens
catccaaaggctcctgagac

SEQ ID NO: 6038274 - DNA, 12 bp, Homo sapiens
catccaaatcta

SEQ ID NO: 6038275 - DNA, 23 bp, Homo sapiens
catccaacaagaagaaatatgaa

SEQ ID NO: 6038276 - DNA, 22 bp, Homo sapiens
catccaacagacctggtgctct

SEQ ID NO: 6038277 - DNA, 15 bp, Homo sapiens
catccaaccccccac

SEQ ID NO: 6038278 - DNA, 21 bp, Homo sapiens
catccaaccccccacctgcca

SEQ ID NO: 6038279 - DNA, 13 bp, Homo sapiens
catccaacctctt

SEQ ID NO: 6038280 - DNA, 14 bp, Homo sapiens
catccaaccttccc

SEQ ID NO: 6038281 - DNA, 16 bp, Homo sapiens
catccaactccagcaa

SEQ ID NO: 6038282 - DNA, 18 bp, Homo sapiens
catccaactccagcaact

SEQ ID NO: 6038283 - DNA, 21 bp, Homo sapiens
catccaactcctggagatttc

SEQ ID NO: 6038284 - DNA, 18 bp, Homo sapiens
catccaactggaaggctt

SEQ ID NO: 6038285 - DNA, 13 bp, Homo sapiens
catccaagccaga

SEQ ID NO: 6038286 - DNA, 14 bp, Homo sapiens
catccaagccagag

SEQ ID NO: 6038287 - DNA, 14 bp, Homo sapiens
catccaaggaacct

SEQ ID NO: 6038288 - DNA, 15 bp, Homo sapiens
catccaaggaaccta

SEQ ID NO: 6038289 - DNA, 22 bp, Homo sapiens
catccaaggaacctaattgaaa

SEQ ID NO: 6038290 - DNA, 21 bp, Homo sapiens
catccaaggaacttcatgctt

SEQ ID NO: 6038291 - DNA, 20 bp, Homo sapiens
catccaaggcactgtcacta

SEQ ID NO: 6038292 - DNA, 23 bp, Homo sapiens
catccaaggccttctcaggctgg

SEQ ID NO: 6038293 - DNA, 22 bp, Homo sapiens
catccaaggttctagtctctgt

SEQ ID NO: 6038294 - DNA, 14 bp, Homo sapiens
catccaagtggcct

SEQ ID NO: 6038295 - DNA, 14 bp, Homo sapiens
catccaagttaaat

SEQ ID NO: 6038296 - DNA, 14 bp, Homo sapiens
catccaataaaaat

SEQ ID NO: 6038297 - DNA, 15 bp, Homo sapiens
catccaatcctcact

SEQ ID NO: 6038298 - DNA, 19 bp, Homo sapiens
catccaatctaaccacatc

SEQ ID NO: 6038299 - DNA, 14 bp, Homo sapiens
catccaatgctcaa

SEQ ID NO: 6038300 - DNA, 15 bp, Homo sapiens
catccaatgtgaagt

SEQ ID NO: 6038301 - DNA, 16 bp, Homo sapiens
catccaatgtgaagtt

SEQ ID NO: 6038302 - DNA, 16 bp, Homo sapiens
catccaattagcttat

SEQ ID NO: 6038303 - DNA, 22 bp, Homo sapiens
catccacacaacaccaggactt

SEQ ID NO: 6038304 - DNA, 21 bp, Homo sapiens
catccacacacagcagctcca

SEQ ID NO: 6038305 - DNA, 13 bp, Homo sapiens
catccacaggatt

SEQ ID NO: 6038306 - DNA, 14 bp, Homo sapiens
catccacagtctcc

SEQ ID NO: 6038307 - DNA, 18 bp, Homo sapiens
catccacataaccctgtc

SEQ ID NO: 6038308 - DNA, 19 bp, Homo sapiens
catccacataaccctgtca

SEQ ID NO: 6038309 - DNA, 20 bp, Homo sapiens
catccacataccctgacctg

SEQ ID NO: 6038310 - DNA, 16 bp, Homo sapiens
catccacatgctctgc

SEQ ID NO: 6038311 - DNA, 18 bp, Homo sapiens
catccacattgttttaaa

SEQ ID NO: 6038312 - DNA, 14 bp, Homo sapiens
catccaccaatctc

SEQ ID NO: 6038313 - DNA, 12 bp, Homo sapiens
catccaccacct

SEQ ID NO: 6038314 - DNA, 16 bp, Homo sapiens
catccacccagtgctg

SEQ ID NO: 6038315 - DNA, 18 bp, Homo sapiens
catccacccagtgctgcc

SEQ ID NO: 6038316 - DNA, 12 bp, Homo sapiens
catccaccccag

SEQ ID NO: 6038317 - DNA, 13 bp, Homo sapiens
catccaccccagc

SEQ ID NO: 6038318 - DNA, 22 bp, Homo sapiens
catccacccctgcgtcgagctg

SEQ ID NO: 6038319 - DNA, 18 bp, Homo sapiens
catccacccgctgcccct

SEQ ID NO: 6038320 - DNA, 21 bp, Homo sapiens
catccacccgggggagcccag

SEQ ID NO: 6038321 - DNA, 23 bp, Homo sapiens
catccaccctcatttttccttta

SEQ ID NO: 6038322 - DNA, 14 bp, Homo sapiens
catccaccctgagg

SEQ ID NO: 6038323 - DNA, 16 bp, Homo sapiens
catccaccgccacccc

SEQ ID NO: 6038324 - DNA, 18 bp, Homo sapiens
catccaccgccaccccac

SEQ ID NO: 6038325 - DNA, 20 bp, Homo sapiens
catccaccgtcccctcccag

SEQ ID NO: 6038326 - DNA, 13 bp, Homo sapiens
catccacctcctt

SEQ ID NO: 6038327 - DNA, 15 bp, Homo sapiens
catccaccttcctgc

SEQ ID NO: 6038328 - DNA, 17 bp, Homo sapiens
catccaccttcctgccc

SEQ ID NO: 6038329 - DNA, 15 bp, Homo sapiens
catccaccttggctc

SEQ ID NO: 6038330 - DNA, 23 bp, Homo sapiens
catccaccttggctctgccagtg

SEQ ID NO: 6038331 - DNA, 17 bp, Homo sapiens
catccacgcacacatgg

SEQ ID NO: 6038332 - DNA, 13 bp, Homo sapiens
catccacgccaag

SEQ ID NO: 6038333 - DNA, 14 bp, Homo sapiens
catccactagtgca

SEQ ID NO: 6038334 - DNA, 20 bp, Homo sapiens
catccactagtgcaaatcat

SEQ ID NO: 6038335 - DNA, 17 bp, Homo sapiens
catccactctaccctcc

SEQ ID NO: 6038336 - DNA, 19 bp, Homo sapiens
catccactctaccctccca

SEQ ID NO: 6038337 - DNA, 12 bp, Homo sapiens
catccactgtga

SEQ ID NO: 6038338 - DNA, 12 bp, Homo sapiens
catccactgtta

SEQ ID NO: 6038339 - DNA, 18 bp, Homo sapiens
catccacttaagttcttt

SEQ ID NO: 6038340 - DNA, 19 bp, Homo sapiens
catccacttaagttctttg

SEQ ID NO: 6038341 - DNA, 21 bp, Homo sapiens
catccacttacatatattttt

SEQ ID NO: 6038342 - DNA, 17 bp, Homo sapiens
catccacttcaggagcc

SEQ ID NO: 6038343 - DNA, 12 bp, Homo sapiens
catccagacagt

SEQ ID NO: 6038344 - DNA, 15 bp, Homo sapiens
catccagacctgagc

SEQ ID NO: 6038345 - DNA, 16 bp, Homo sapiens
catccagacctggctc

SEQ ID NO: 6038346 - DNA, 21 bp, Homo sapiens
catccagactcagagctctct

SEQ ID NO: 6038347 - DNA, 20 bp, Homo sapiens
catccagagtccctgcctgg

SEQ ID NO: 6038348 - DNA, 14 bp, Homo sapiens
catccagatgtggc

SEQ ID NO: 6038349 - DNA, 15 bp, Homo sapiens
catccagatgtggct

SEQ ID NO: 6038350 - DNA, 14 bp, Homo sapiens
catccagcagcagc

SEQ ID NO: 6038351 - DNA, 17 bp, Homo sapiens
catccagcagcagcact

SEQ ID NO: 6038352 - DNA, 13 bp, Homo sapiens
catccagcatgtg

SEQ ID NO: 6038353 - DNA, 14 bp, Homo sapiens
catccagcatgtgt

SEQ ID NO: 6038354 - DNA, 15 bp, Homo sapiens
catccagccacggag

SEQ ID NO: 6038355 - DNA, 17 bp, Homo sapiens
catccagccgtgctgag

SEQ ID NO: 6038356 - DNA, 12 bp, Homo sapiens
catccagcctcc

SEQ ID NO: 6038357 - DNA, 13 bp, Homo sapiens
catccagcctcca

SEQ ID NO: 6038358 - DNA, 18 bp, Homo sapiens
catccagcctccagggca

SEQ ID NO: 6038359 - DNA, 23 bp, Homo sapiens
catccagcctccagggcattgct

SEQ ID NO: 6038360 - DNA, 13 bp, Homo sapiens
catccagcctgtg

SEQ ID NO: 6038361 - DNA, 15 bp, Homo sapiens
catccagctacttag

SEQ ID NO: 6038362 - DNA, 20 bp, Homo sapiens
catccagctacttagctggc

SEQ ID NO: 6038363 - DNA, 16 bp, Homo sapiens
catccagcttctcatg

SEQ ID NO: 6038364 - DNA, 19 bp, Homo sapiens
catccaggccagggctcct

SEQ ID NO: 6038365 - DNA, 20 bp, Homo sapiens
catccaggccagggctcctg

SEQ ID NO: 6038366 - DNA, 15 bp, Homo sapiens
catccaggcctgagg

SEQ ID NO: 6038367 - DNA, 20 bp, Homo sapiens
catccaggcctgaggctgct

SEQ ID NO: 6038368 - DNA, 19 bp, Homo sapiens
catccagggctctgaccag

SEQ ID NO: 6038369 - DNA, 19 bp, Homo sapiens
catccagggtctggcagag

SEQ ID NO: 6038370 - DNA, 20 bp, Homo sapiens
catccaggtcctttccttct

SEQ ID NO: 6038371 - DNA, 18 bp, Homo sapiens
catccagtagagatttcc

SEQ ID NO: 6038372 - DNA, 14 bp, Homo sapiens
catccagtctattc

SEQ ID NO: 6038373 - DNA, 23 bp, Homo sapiens
catccagtctcccaacttgtatt

SEQ ID NO: 6038374 - DNA, 17 bp, Homo sapiens
catccagtggactctgg

SEQ ID NO: 6038375 - DNA, 11 bp, Homo sapiens
catccagtggg

SEQ ID NO: 6038376 - DNA, 15 bp, Homo sapiens
catccagtgggcccg

SEQ ID NO: 6038377 - DNA, 20 bp, Homo sapiens
catccagttgcaataaaata

SEQ ID NO: 6038378 - DNA, 23 bp, Homo sapiens
catccatactgtttaatatttat

SEQ ID NO: 6038379 - DNA, 20 bp, Homo sapiens
catccatagtgcactagcat

SEQ ID NO: 6038380 - DNA, 20 bp, Homo sapiens
catccatatttgctaagaat

SEQ ID NO: 6038381 - DNA, 19 bp, Homo sapiens
catccatcagcaccccagt

SEQ ID NO: 6038382 - DNA, 14 bp, Homo sapiens
catccatccctaga

SEQ ID NO: 6038383 - DNA, 17 bp, Homo sapiens
catccatccctccattc

SEQ ID NO: 6038384 - DNA, 17 bp, Homo sapiens
catccatccctggtgaa

SEQ ID NO: 6038385 - DNA, 23 bp, Homo sapiens
catccatccctggtgaaagagta

SEQ ID NO: 6038386 - DNA, 12 bp, Homo sapiens
catccatcctga

SEQ ID NO: 6038387 - DNA, 13 bp, Homo sapiens
catccatcctgag

SEQ ID NO: 6038388 - DNA, 14 bp, Homo sapiens
catccatctctctc

SEQ ID NO: 6038389 - DNA, 16 bp, Homo sapiens
catccatctctctctt

SEQ ID NO: 6038390 - DNA, 20 bp, Homo sapiens
catccatctctctcttgcct

SEQ ID NO: 6038391 - DNA, 22 bp, Homo sapiens
catccatgcactttaattgaag

SEQ ID NO: 6038392 - DNA, 23 bp, Homo sapiens
catccatgcactttaattgaaga

SEQ ID NO: 6038393 - DNA, 17 bp, Homo sapiens
catccatgccctcccag

SEQ ID NO: 6038394 - DNA, 21 bp, Homo sapiens
catccatgccctcccaggacc

SEQ ID NO: 6038395 - DNA, 14 bp, Homo sapiens
catccatgcctcag

SEQ ID NO: 6038396 - DNA, 23 bp, Homo sapiens
catccatgcctcagaagtgcatc

SEQ ID NO: 6038397 - DNA, 22 bp, Homo sapiens
catccatgcggccggcctgggg

SEQ ID NO: 6038398 - DNA, 18 bp, Homo sapiens
catccatggagcacgagg

SEQ ID NO: 6038399 - DNA, 22 bp, Homo sapiens
catccatggagcacgaggcctt

SEQ ID NO: 6038400 - DNA, 19 bp, Homo sapiens
catccatggatgcagaaat

SEQ ID NO: 6038401 - DNA, 14 bp, Homo sapiens
catccatggccagc

SEQ ID NO: 6038402 - DNA, 19 bp, Homo sapiens
catccatggggtctctcac

SEQ ID NO: 6038403 - DNA, 18 bp, Homo sapiens
ccactgagagctgctcct

SEQ ID NO: 6038404 - DNA, 19 bp, Homo sapiens
ccactgagagctgctcctt

SEQ ID NO: 6038405 - DNA, 17 bp, Homo sapiens
ccactgagaggacagag

SEQ ID NO: 6038406 - DNA, 14 bp, Homo sapiens
ccactgagcccttg

SEQ ID NO: 6038407 - DNA, 20 bp, Homo sapiens
ccactgagcccttgcacagg

SEQ ID NO: 6038408 - DNA, 16 bp, Homo sapiens
ccactgagcctggccc

SEQ ID NO: 6038409 - DNA, 12 bp, Homo sapiens
ccactgagctgg

SEQ ID NO: 6038410 - DNA, 16 bp, Homo sapiens
ccactgagctggctga

SEQ ID NO: 6038411 - DNA, 17 bp, Homo sapiens
ccactgagctggctgac

SEQ ID NO: 6038412 - DNA, 13 bp, Homo sapiens
ccactgagggcag

SEQ ID NO: 6038413 - DNA, 14 bp, Homo sapiens
ccactgagtaccag

SEQ ID NO: 6038414 - DNA, 16 bp, Homo sapiens
ccactgagtaccaggg

SEQ ID NO: 6038415 - DNA, 18 bp, Homo sapiens
ccactgagtaccaggggc

SEQ ID NO: 6038416 - DNA, 22 bp, Homo sapiens
ccactgatatcacgggcccgct

SEQ ID NO: 6038417 - DNA, 24 bp, Homo sapiens
ccactgatatcacgggcccgctca

SEQ ID NO: 6038418 - DNA, 15 bp, Homo sapiens
ccactgatggaaaca

SEQ ID NO: 6038419 - DNA, 19 bp, Homo sapiens
ccactgcaaaccctgctgc

SEQ ID NO: 6038420 - DNA, 17 bp, Homo sapiens
ccactgcaacttgtgaa

SEQ ID NO: 6038421 - DNA, 17 bp, Homo sapiens
ccactgcaagagggggg

SEQ ID NO: 6038422 - DNA, 23 bp, Homo sapiens
ccactgcaagtccttttgtaaag

SEQ ID NO: 6038423 - DNA, 16 bp, Homo sapiens
ccactgcaagtctgtg

SEQ ID NO: 6038424 - DNA, 13 bp, Homo sapiens
ccactgcacacac

SEQ ID NO: 6038425 - DNA, 16 bp, Homo sapiens
ccactgcacacagggt

SEQ ID NO: 6038426 - DNA, 16 bp, Homo sapiens
ccactgcacaccagcc

SEQ ID NO: 6038427 - DNA, 23 bp, Homo sapiens
ccactgcacccccctgtgcctgc

SEQ ID NO: 6038428 - DNA, 18 bp, Homo sapiens
ccactgcaccccctcctg

SEQ ID NO: 6038429 - DNA, 20 bp, Homo sapiens
ccactgcaccccctcctgct

SEQ ID NO: 6038430 - DNA, 21 bp, Homo sapiens
ccactgcaccccctcctgctg

SEQ ID NO: 6038431 - DNA, 18 bp, Homo sapiens
ccactgcaccgcctcagg

SEQ ID NO: 6038432 - DNA, 14 bp, Homo sapiens
ccactgcaccgggc

SEQ ID NO: 6038433 - DNA, 20 bp, Homo sapiens
ccactgcacctgacctgctg

SEQ ID NO: 6038434 - DNA, 18 bp, Homo sapiens
ccactgcacctgcccagc

SEQ ID NO: 6038435 - DNA, 14 bp, Homo sapiens
ccactgcactccag

SEQ ID NO: 6038436 - DNA, 18 bp, Homo sapiens
ccactgcactccagcctg

SEQ ID NO: 6038437 - DNA, 22 bp, Homo sapiens
ccactgcacttggtgctgcttt

SEQ ID NO: 6038438 - DNA, 13 bp, Homo sapiens
ccactgcagaaga

SEQ ID NO: 6038439 - DNA, 14 bp, Homo sapiens
ccactgcagcacag

SEQ ID NO: 6038440 - DNA, 18 bp, Homo sapiens
ccactgcagcacctgcca

SEQ ID NO: 6038441 - DNA, 14 bp, Homo sapiens
ccactgcagcagaa

SEQ ID NO: 6038442 - DNA, 13 bp, Homo sapiens
ccactgcagtcac

SEQ ID NO: 6038443 - DNA, 23 bp, Homo sapiens
ccactgcagtcacccctgtctgc

SEQ ID NO: 6038444 - DNA, 20 bp, Homo sapiens
ccactgccaagcttcctgtg

SEQ ID NO: 6038445 - DNA, 21 bp, Homo sapiens
ccactgccaagcttcctgtgc

SEQ ID NO: 6038446 - DNA, 21 bp, Homo sapiens
ccactgccaatgctgtacgta

SEQ ID NO: 6038447 - DNA, 17 bp, Homo sapiens
ccactgccacaccctcc

SEQ ID NO: 6038448 - DNA, 23 bp, Homo sapiens
ccactgccacacgtctgaccctc

SEQ ID NO: 6038449 - DNA, 14 bp, Homo sapiens
ccactgccactcca

SEQ ID NO: 6038450 - DNA, 15 bp, Homo sapiens
ccactgccactccag

SEQ ID NO: 6038451 - DNA, 17 bp, Homo sapiens
ccactgccactccagtc

SEQ ID NO: 6038452 - DNA, 16 bp, Homo sapiens
ccactgccagcagcag

SEQ ID NO: 6038453 - DNA, 20 bp, Homo sapiens
ccactgccagcagcagcagg

SEQ ID NO: 6038454 - DNA, 22 bp, Homo sapiens
ccactgccaggcacctggcctg

SEQ ID NO: 6038455 - DNA, 16 bp, Homo sapiens
ccactgccataaaaca

SEQ ID NO: 6038456 - DNA, 19 bp, Homo sapiens
ccactgccattacccagtg

SEQ ID NO: 6038457 - DNA, 16 bp, Homo sapiens
ccactgcccaccccct

SEQ ID NO: 6038458 - DNA, 15 bp, Homo sapiens
ccactgcccactggc

SEQ ID NO: 6038459 - DNA, 19 bp, Homo sapiens
ccactgccccccgaggctg

SEQ ID NO: 6038460 - DNA, 21 bp, Homo sapiens
ccactgccccccgaggctgct

SEQ ID NO: 6038461 - DNA, 20 bp, Homo sapiens
ccactgccccctgctgccat

SEQ ID NO: 6038462 - DNA, 16 bp, Homo sapiens
ccactgccccgtgtga

SEQ ID NO: 6038463 - DNA, 14 bp, Homo sapiens
ccactgcccctgca

SEQ ID NO: 6038464 - DNA, 19 bp, Homo sapiens
ccactgccccttcattgat

SEQ ID NO: 6038465 - DNA, 23 bp, Homo sapiens
ccactgcccgagctggtgcatta

SEQ ID NO: 6038466 - DNA, 15 bp, Homo sapiens
ccactgccctctcca

SEQ ID NO: 6038467 - DNA, 16 bp, Homo sapiens
ccactgccctctccac

SEQ ID NO: 6038468 - DNA, 17 bp, Homo sapiens
ccactgccctgcctgcc

SEQ ID NO: 6038469 - DNA, 19 bp, Homo sapiens
ccactgccctgcctgccca

SEQ ID NO: 6038470 - DNA, 16 bp, Homo sapiens
ccactgcccttctcat

SEQ ID NO: 6038471 - DNA, 17 bp, Homo sapiens
ccactgcccttctcatt

SEQ ID NO: 6038472 - DNA, 22 bp, Homo sapiens
ccactgccgcctactggacgct

SEQ ID NO: 6038473 - DNA, 15 bp, Homo sapiens
ccactgccgcctcct

SEQ ID NO: 6038474 - DNA, 15 bp, Homo sapiens
ccactgcctcctccc

SEQ ID NO: 6038475 - DNA, 23 bp, Homo sapiens
ccactgcctcctccctggctgca

SEQ ID NO: 6038476 - DNA, 19 bp, Homo sapiens
ccactgcctcctgcctggg

SEQ ID NO: 6038477 - DNA, 13 bp, Homo sapiens
ccactgcctctcc

SEQ ID NO: 6038478 - DNA, 19 bp, Homo sapiens
ccactgcctctccctctgg

SEQ ID NO: 6038479 - DNA, 21 bp, Homo sapiens
ccactgcctctgccttagagg

SEQ ID NO: 6038480 - DNA, 20 bp, Homo sapiens
ccactgcctctggaattgct

SEQ ID NO: 6038481 - DNA, 21 bp, Homo sapiens
ccactgcctgcacctttcggc

SEQ ID NO: 6038482 - DNA, 13 bp, Homo sapiens
ccactgcctgccc

SEQ ID NO: 6038483 - DNA, 21 bp, Homo sapiens
ccactgcctgcctcccctccg

SEQ ID NO: 6038484 - DNA, 12 bp, Homo sapiens
ccactgccttcg

SEQ ID NO: 6038485 - DNA, 16 bp, Homo sapiens
ccactgccttcgcttc

SEQ ID NO: 6038486 - DNA, 22 bp, Homo sapiens
ccactgccttcgcttcttgcct

SEQ ID NO: 6038487 - DNA, 16 bp, Homo sapiens
ccactgcgaccacaag

SEQ ID NO: 6038488 - DNA, 18 bp, Homo sapiens
ccactgcgcccagcctga

SEQ ID NO: 6038489 - DNA, 17 bp, Homo sapiens
ccactgcggaacaggag

SEQ ID NO: 6038490 - DNA, 13 bp, Homo sapiens
ccactgcgttgtc

SEQ ID NO: 6038491 - DNA, 16 bp, Homo sapiens
ccactgctaaggctgc

SEQ ID NO: 6038492 - DNA, 19 bp, Homo sapiens
ccactgctaataaatgacc

SEQ ID NO: 6038493 - DNA, 21 bp, Homo sapiens
ccactgctaataaatgaccag

SEQ ID NO: 6038494 - DNA, 19 bp, Homo sapiens
ccactgctccgtggaggag

SEQ ID NO: 6038495 - DNA, 14 bp, Homo sapiens
ccactgctctcagc

SEQ ID NO: 6038496 - DNA, 22 bp, Homo sapiens
ccactgctgaaaaagaaaaaaa

SEQ ID NO: 6038497 - DNA, 13 bp, Homo sapiens
ccactgctgagga

SEQ ID NO: 6038498 - DNA, 17 bp, Homo sapiens
ccactgctgaggagtct

SEQ ID NO: 6038499 - DNA, 14 bp, Homo sapiens
ccactgctggacat

SEQ ID NO: 6038500 - DNA, 22 bp, Homo sapiens
ccactgctgggggtgagctgta

SEQ ID NO: 6038501 - DNA, 23 bp, Homo sapiens
ccactgctgggggtgagctgtac

SEQ ID NO: 6038502 - DNA, 22 bp, Homo sapiens
ccactgctggtgccagggtggg

SEQ ID NO: 6038503 - DNA, 22 bp, Homo sapiens
ccactgctggtgtttatgtgaa

SEQ ID NO: 6038504 - DNA, 15 bp, Homo sapiens
ccactgcttcccact

SEQ ID NO: 6038505 - DNA, 13 bp, Homo sapiens
ccactgcttctct

SEQ ID NO: 6038506 - DNA, 21 bp, Homo sapiens
ccactgcttgcactgatgtcc

SEQ ID NO: 6038507 - DNA, 11 bp, Homo sapiens
ccactggaagg

SEQ ID NO: 6038508 - DNA, 16 bp, Homo sapiens
ccactggaaggaacat

SEQ ID NO: 6038509 - DNA, 14 bp, Homo sapiens
ccactggaaggagc

SEQ ID NO: 6038510 - DNA, 16 bp, Homo sapiens
ccactggaaggagcac

SEQ ID NO: 6038511 - DNA, 20 bp, Homo sapiens
ccactggaaggagcacatac

SEQ ID NO: 6038512 - DNA, 13 bp, Homo sapiens
ccactggacagac

SEQ ID NO: 6038513 - DNA, 18 bp, Homo sapiens
ccactggacagacccagg

SEQ ID NO: 6038514 - DNA, 21 bp, Homo sapiens
ccactggacagacccaggtct

SEQ ID NO: 6038515 - DNA, 11 bp, Homo sapiens
ccactggacca

SEQ ID NO: 6038516 - DNA, 13 bp, Homo sapiens
ccactggaccctt

SEQ ID NO: 6038517 - DNA, 16 bp, Homo sapiens
ccactggacttgagct

SEQ ID NO: 6038518 - DNA, 11 bp, Homo sapiens
ccactggagaa

SEQ ID NO: 6038519 - DNA, 17 bp, Homo sapiens
ccactggatcagaaaga

SEQ ID NO: 6038520 - DNA, 18 bp, Homo sapiens
ccactggcacatttttct

SEQ ID NO: 6038521 - DNA, 19 bp, Homo sapiens
ccactggcacttgcctgct

SEQ ID NO: 6038522 - DNA, 22 bp, Homo sapiens
ccactggcacttgcctgctgct

SEQ ID NO: 6038523 - DNA, 22 bp, Homo sapiens
ccactggcatagccctcctgag

SEQ ID NO: 6038524 - DNA, 18 bp, Homo sapiens
ccactggcatctctggag

SEQ ID NO: 6038525 - DNA, 20 bp, Homo sapiens
ccactggccaccaggctggc

SEQ ID NO: 6038526 - DNA, 13 bp, Homo sapiens
ccactggccagct

SEQ ID NO: 6038527 - DNA, 18 bp, Homo sapiens
ccactggccagctctggc

SEQ ID NO: 6038528 - DNA, 13 bp, Homo sapiens
ccactggccagtc

SEQ ID NO: 6038529 - DNA, 19 bp, Homo sapiens
ccactggccagtcctagag

SEQ ID NO: 6038530 - DNA, 16 bp, Homo sapiens
ccactggctcctccca

SEQ ID NO: 6038531 - DNA, 22 bp, Homo sapiens
ccactggctcctcccagcacag

SEQ ID NO: 6038532 - DNA, 20 bp, Homo sapiens
ccactggctgagaatctggg

SEQ ID NO: 6038533 - DNA, 23 bp, Homo sapiens
ccactggctgagaatctgggggt

SEQ ID NO: 6038534 - DNA, 16 bp, Homo sapiens
ccactggctggacaaa

SEQ ID NO: 6038535 - DNA, 14 bp, Homo sapiens
ccactggctgtggg

SEQ ID NO: 6038536 - DNA, 19 bp, Homo sapiens
ccactggctgtgggctccc

SEQ ID NO: 6038537 - DNA, 16 bp, Homo sapiens
ccactgggacagctgg

SEQ ID NO: 6038538 - DNA, 18 bp, Homo sapiens
ccactgggacagctggct

SEQ ID NO: 6038539 - DNA, 20 bp, Homo sapiens
ccactgggacagctggctgg

SEQ ID NO: 6038540 - DNA, 17 bp, Homo sapiens
ccactgggaccaaccct

SEQ ID NO: 6038541 - DNA, 11 bp, Homo sapiens
ccactgggcac

SEQ ID NO: 6038542 - DNA, 16 bp, Homo sapiens
ccactgggcacctgcg

SEQ ID NO: 6038543 - DNA, 13 bp, Homo sapiens
ccactgggccagc

SEQ ID NO: 6038544 - DNA, 14 bp, Homo sapiens
ccactgggcccctg

SEQ ID NO: 6038545 - DNA, 18 bp, Homo sapiens
ccactgggcccctgtccc

SEQ ID NO: 6038546 - DNA, 15 bp, Homo sapiens
ccactgggccctggg

SEQ ID NO: 6038547 - DNA, 18 bp, Homo sapiens
ccactgggccctggggct

SEQ ID NO: 6038548 - DNA, 21 bp, Homo sapiens
ccactgggccctggggctgcc

SEQ ID NO: 6038549 - DNA, 18 bp, Homo sapiens
ccactgggctctggacct

SEQ ID NO: 6038550 - DNA, 23 bp, Homo sapiens
ccactggggaggaatcctggacc

SEQ ID NO: 6038551 - DNA, 14 bp, Homo sapiens
ccactggggctcag

SEQ ID NO: 6038552 - DNA, 15 bp, Homo sapiens
ccactggggctcaga

SEQ ID NO: 6038553 - DNA, 19 bp, Homo sapiens
ccactggggtccagggagc

SEQ ID NO: 6038554 - DNA, 23 bp, Homo sapiens
ccactggggtgccttcactgggc

SEQ ID NO: 6038555 - DNA, 13 bp, Homo sapiens
ccactggggtggg

SEQ ID NO: 6038556 - DNA, 18 bp, Homo sapiens
ccactggggtgggagggg

SEQ ID NO: 6038557 - DNA, 21 bp, Homo sapiens
ccactgggtctcactcctgag

SEQ ID NO: 6038558 - DNA, 21 bp, Homo sapiens
ccactgggtttaaagatgtta

SEQ ID NO: 6038559 - DNA, 23 bp, Homo sapiens
ccactggtgtaaaaaacaaacat

SEQ ID NO: 6038560 - DNA, 16 bp, Homo sapiens
ccactggttccttctt

SEQ ID NO: 6038561 - DNA, 16 bp, Homo sapiens
ccactggtttctcaga

SEQ ID NO: 6038562 - DNA, 17 bp, Homo sapiens
ccactggtttctcagaa

SEQ ID NO: 6038563 - DNA, 18 bp, Homo sapiens
ccactgtaacaatactgg

SEQ ID NO: 6038564 - DNA, 20 bp, Homo sapiens
ccactgtaattaaaactatt

SEQ ID NO: 6038565 - DNA, 17 bp, Homo sapiens
ccactgtacttgctctt

SEQ ID NO: 6038566 - DNA, 19 bp, Homo sapiens
ccactgtacttgctcttga

SEQ ID NO: 6038567 - DNA, 16 bp, Homo sapiens
ccactgtatatttttt

SEQ ID NO: 6038568 - DNA, 21 bp, Homo sapiens
ccactgtatgatttataaaca

SEQ ID NO: 6038569 - DNA, 15 bp, Homo sapiens
ccactgtatttgtta

SEQ ID NO: 6038570 - DNA, 14 bp, Homo sapiens
ccactgtcaccctc

SEQ ID NO: 6038571 - DNA, 17 bp, Homo sapiens
ccactgtcaccctccac

SEQ ID NO: 6038572 - DNA, 19 bp, Homo sapiens
ccactgtcactgtttctct

SEQ ID NO: 6038573 - DNA, 14 bp, Homo sapiens
ccactgtcagccct

SEQ ID NO: 6038574 - DNA, 15 bp, Homo sapiens
ccactgtcagccctc

SEQ ID NO: 6038575 - DNA, 23 bp, Homo sapiens
ccactgtcataatctctttccat

SEQ ID NO: 6038576 - DNA, 19 bp, Homo sapiens
ccactgtccctaccactga

SEQ ID NO: 6038577 - DNA, 23 bp, Homo sapiens
ccactgtccctaccactgagccc

SEQ ID NO: 6038578 - DNA, 23 bp, Homo sapiens
ccactgtccgcctctgcccgcag

SEQ ID NO: 6038579 - DNA, 21 bp, Homo sapiens
ccactgtccgctgtctccctc

SEQ ID NO: 6038580 - DNA, 13 bp, Homo sapiens
ccactgtcctcct

SEQ ID NO: 6038581 - DNA, 20 bp, Homo sapiens
catccatggggtctctcaca

SEQ ID NO: 6038582 - DNA, 23 bp, Homo sapiens
catccatgtacttccctcttgaa

SEQ ID NO: 6038583 - DNA, 20 bp, Homo sapiens
catccatgtcctatgtgtga

SEQ ID NO: 6038584 - DNA, 23 bp, Homo sapiens
catccatgtgctagtcactggca

SEQ ID NO: 6038585 - DNA, 18 bp, Homo sapiens
catccatgtgtggactca

SEQ ID NO: 6038586 - DNA, 13 bp, Homo sapiens
catccatgtgttc

SEQ ID NO: 6038587 - DNA, 15 bp, Homo sapiens
catccatgtttgtaa

SEQ ID NO: 6038588 - DNA, 20 bp, Homo sapiens
catccattaggccagcaacg

SEQ ID NO: 6038589 - DNA, 21 bp, Homo sapiens
catccattccagagctgcaga

SEQ ID NO: 6038590 - DNA, 16 bp, Homo sapiens
catccattctcctgag

SEQ ID NO: 6038591 - DNA, 15 bp, Homo sapiens
catccattctctctg

SEQ ID NO: 6038592 - DNA, 17 bp, Homo sapiens
catccattctctctgcc

SEQ ID NO: 6038593 - DNA, 16 bp, Homo sapiens
catccattgtctcttc

SEQ ID NO: 6038594 - DNA, 23 bp, Homo sapiens
catccatttcagtttgtttactt

SEQ ID NO: 6038595 - DNA, 19 bp, Homo sapiens
catccatttcatctatttc

SEQ ID NO: 6038596 - DNA, 23 bp, Homo sapiens
catccatttcatctatttctgag

SEQ ID NO: 6038597 - DNA, 20 bp, Homo sapiens
catccatttgttttcacact

SEQ ID NO: 6038598 - DNA, 23 bp, Homo sapiens
catcccaaaatcataagatattt

SEQ ID NO: 6038599 - DNA, 22 bp, Homo sapiens
catcccaaactttaaaatgcga

SEQ ID NO: 6038600 - DNA, 23 bp, Homo sapiens
catcccaaactttaaaatgcgaa

SEQ ID NO: 6038601 - DNA, 14 bp, Homo sapiens
catcccaacagcca

SEQ ID NO: 6038602 - DNA, 20 bp, Homo sapiens
catcccaaccagtgccaagg

SEQ ID NO: 6038603 - DNA, 21 bp, Homo sapiens
catcccaacctctttttcctc

SEQ ID NO: 6038604 - DNA, 20 bp, Homo sapiens
catcccaagacctcatctgc

SEQ ID NO: 6038605 - DNA, 17 bp, Homo sapiens
catcccaataaagtcct

SEQ ID NO: 6038606 - DNA, 23 bp, Homo sapiens
catcccaataaagtcctcttccc

SEQ ID NO: 6038607 - DNA, 13 bp, Homo sapiens
catcccacagcca

SEQ ID NO: 6038608 - DNA, 13 bp, Homo sapiens
catcccacagtgg

SEQ ID NO: 6038609 - DNA, 21 bp, Homo sapiens
catcccacattcggaccctgc

SEQ ID NO: 6038610 - DNA, 20 bp, Homo sapiens
catcccacccccgaccctgc

SEQ ID NO: 6038611 - DNA, 21 bp, Homo sapiens
catcccacccccgaccctgcc

SEQ ID NO: 6038612 - DNA, 21 bp, Homo sapiens
catcccacgatcggccttggt

SEQ ID NO: 6038613 - DNA, 15 bp, Homo sapiens
catcccactgactgt

SEQ ID NO: 6038614 - DNA, 13 bp, Homo sapiens
catcccactgata

SEQ ID NO: 6038615 - DNA, 15 bp, Homo sapiens
catcccactggatct

SEQ ID NO: 6038616 - DNA, 16 bp, Homo sapiens
catcccacttcctttc

SEQ ID NO: 6038617 - DNA, 17 bp, Homo sapiens
catcccacttcctttcc

SEQ ID NO: 6038618 - DNA, 21 bp, Homo sapiens
catcccagacaggtccctccc

SEQ ID NO: 6038619 - DNA, 23 bp, Homo sapiens
catcccagacaggtccctcccct

SEQ ID NO: 6038620 - DNA, 16 bp, Homo sapiens
catcccagaccagcca

SEQ ID NO: 6038621 - DNA, 13 bp, Homo sapiens
catcccagcacct

SEQ ID NO: 6038622 - DNA, 15 bp, Homo sapiens
catcccagcacctgc

SEQ ID NO: 6038623 - DNA, 18 bp, Homo sapiens
catcccagcacctgccag

SEQ ID NO: 6038624 - DNA, 14 bp, Homo sapiens
catcccagcagccc

SEQ ID NO: 6038625 - DNA, 12 bp, Homo sapiens
catcccagcccc

SEQ ID NO: 6038626 - DNA, 17 bp, Homo sapiens
catcccagccccaatga

SEQ ID NO: 6038627 - DNA, 21 bp, Homo sapiens
catcccagcctcagaagcctt

SEQ ID NO: 6038628 - DNA, 15 bp, Homo sapiens
catcccagccttgag

SEQ ID NO: 6038629 - DNA, 13 bp, Homo sapiens
catcccagctgct

SEQ ID NO: 6038630 - DNA, 13 bp, Homo sapiens
catcccaggacac

SEQ ID NO: 6038631 - DNA, 16 bp, Homo sapiens
catcccaggaggggcc

SEQ ID NO: 6038632 - DNA, 21 bp, Homo sapiens
catcccaggaggggcctctga

SEQ ID NO: 6038633 - DNA, 22 bp, Homo sapiens
catcccaggaggggcctctgaa

SEQ ID NO: 6038634 - DNA, 22 bp, Homo sapiens
catcccaggcgggcggcacgcc

SEQ ID NO: 6038635 - DNA, 13 bp, Homo sapiens
catcccaggggac

SEQ ID NO: 6038636 - DNA, 11 bp, Homo sapiens
catcccagggt

SEQ ID NO: 6038637 - DNA, 19 bp, Homo sapiens
catcccagggtcccacccc

SEQ ID NO: 6038638 - DNA, 14 bp, Homo sapiens
catcccagtgtcct

SEQ ID NO: 6038639 - DNA, 11 bp, Homo sapiens
catcccatccc

SEQ ID NO: 6038640 - DNA, 20 bp, Homo sapiens
catcccatctaagcattcca

SEQ ID NO: 6038641 - DNA, 20 bp, Homo sapiens
catcccatctaagctgcagc

SEQ ID NO: 6038642 - DNA, 21 bp, Homo sapiens
catcccatctctcccacttcc

SEQ ID NO: 6038643 - DNA, 24 bp, Homo sapiens
catcccatctctcccacttcctcc

SEQ ID NO: 6038644 - DNA, 18 bp, Homo sapiens
catcccatgagaccctgg

SEQ ID NO: 6038645 - DNA, 20 bp, Homo sapiens
catcccatgatgtagtgcct

SEQ ID NO: 6038646 - DNA, 17 bp, Homo sapiens
catcccatgtaacagaa

SEQ ID NO: 6038647 - DNA, 22 bp, Homo sapiens
catcccattccaggcagcctct

SEQ ID NO: 6038648 - DNA, 14 bp, Homo sapiens
catccccaactcca

SEQ ID NO: 6038649 - DNA, 15 bp, Homo sapiens
catccccaactccat

SEQ ID NO: 6038650 - DNA, 20 bp, Homo sapiens
catccccaccactgatatca

SEQ ID NO: 6038651 - DNA, 16 bp, Homo sapiens
catccccacccttgga

SEQ ID NO: 6038652 - DNA, 20 bp, Homo sapiens
catccccacgacccctgcct

SEQ ID NO: 6038653 - DNA, 17 bp, Homo sapiens
catccccagagcccagc

SEQ ID NO: 6038654 - DNA, 23 bp, Homo sapiens
catccccagagcccagctcttgc

SEQ ID NO: 6038655 - DNA, 18 bp, Homo sapiens
catccccaggggtcccag

SEQ ID NO: 6038656 - DNA, 22 bp, Homo sapiens
catccccaggtctctccactgc

SEQ ID NO: 6038657 - DNA, 14 bp, Homo sapiens
catccccagtgcca

SEQ ID NO: 6038658 - DNA, 16 bp, Homo sapiens
catccccatcctccag

SEQ ID NO: 6038659 - DNA, 17 bp, Homo sapiens
catccccatcctccaga

SEQ ID NO: 6038660 - DNA, 17 bp, Homo sapiens
catccccatcctccagc

SEQ ID NO: 6038661 - DNA, 18 bp, Homo sapiens
catccccatcctccagct

SEQ ID NO: 6038662 - DNA, 16 bp, Homo sapiens
catccccatcggccct

SEQ ID NO: 6038663 - DNA, 19 bp, Homo sapiens
catccccatcggccctgtc

SEQ ID NO: 6038664 - DNA, 22 bp, Homo sapiens
catccccatcggccctgtcccc

SEQ ID NO: 6038665 - DNA, 14 bp, Homo sapiens
catcccccactgcc

SEQ ID NO: 6038666 - DNA, 17 bp, Homo sapiens
catcccccactgccaca

SEQ ID NO: 6038667 - DNA, 13 bp, Homo sapiens
catccccccaccc

SEQ ID NO: 6038668 - DNA, 17 bp, Homo sapiens
catcccccctcaccagg

SEQ ID NO: 6038669 - DNA, 18 bp, Homo sapiens
catcccccctcaccaggg

SEQ ID NO: 6038670 - DNA, 17 bp, Homo sapiens
catcccccctgctcagc

SEQ ID NO: 6038671 - DNA, 17 bp, Homo sapiens
catcccccctgctgccc

SEQ ID NO: 6038672 - DNA, 19 bp, Homo sapiens
catcccccctgctgcccag

SEQ ID NO: 6038673 - DNA, 16 bp, Homo sapiens
catcccccggcacctc

SEQ ID NO: 6038674 - DNA, 11 bp, Homo sapiens
catccccctcc

SEQ ID NO: 6038675 - DNA, 15 bp, Homo sapiens
catccccctccttgc

SEQ ID NO: 6038676 - DNA, 16 bp, Homo sapiens
catccccctctcacgc

SEQ ID NO: 6038677 - DNA, 20 bp, Homo sapiens
catccccctctcacgccacc

SEQ ID NO: 6038678 - DNA, 21 bp, Homo sapiens
catccccctctcacgccaccc

SEQ ID NO: 6038679 - DNA, 11 bp, Homo sapiens
catccccctgc

SEQ ID NO: 6038680 - DNA, 13 bp, Homo sapiens
catccccctgccc

SEQ ID NO: 6038681 - DNA, 14 bp, Homo sapiens
catccccctgccct

SEQ ID NO: 6038682 - DNA, 19 bp, Homo sapiens
catccccctgccctcgtgg

SEQ ID NO: 6038683 - DNA, 13 bp, Homo sapiens
catccccctgtgg

SEQ ID NO: 6038684 - DNA, 21 bp, Homo sapiens
catcccccttcttcctcccct

SEQ ID NO: 6038685 - DNA, 19 bp, Homo sapiens
catccccgcagtgtgcact

SEQ ID NO: 6038686 - DNA, 16 bp, Homo sapiens
catccccgctggctgg

SEQ ID NO: 6038687 - DNA, 22 bp, Homo sapiens
catccccgtgttgggtggaccc

SEQ ID NO: 6038688 - DNA, 22 bp, Homo sapiens
catcccctcaacaccctgcttc

SEQ ID NO: 6038689 - DNA, 22 bp, Homo sapiens
catcccctccctgcctgctcct

SEQ ID NO: 6038690 - DNA, 19 bp, Homo sapiens
catcccctcgtcctgtccc

SEQ ID NO: 6038691 - DNA, 20 bp, Homo sapiens
catcccctcgtcctgtccca

SEQ ID NO: 6038692 - DNA, 17 bp, Homo sapiens
catcccctctcaggaga

SEQ ID NO: 6038693 - DNA, 14 bp, Homo sapiens
catcccctgcctct

SEQ ID NO: 6038694 - DNA, 23 bp, Homo sapiens
catcccctgcctctatccctggc

SEQ ID NO: 6038695 - DNA, 15 bp, Homo sapiens
catcccctgtgggaa

SEQ ID NO: 6038696 - DNA, 20 bp, Homo sapiens
catccccttacccttagaat

SEQ ID NO: 6038697 - DNA, 23 bp, Homo sapiens
catccccttagaggacctgagtt

SEQ ID NO: 6038698 - DNA, 13 bp, Homo sapiens
catccccttccag

SEQ ID NO: 6038699 - DNA, 18 bp, Homo sapiens
catccccttccagctccc

SEQ ID NO: 6038700 - DNA, 20 bp, Homo sapiens
catccccttcccccatccct

SEQ ID NO: 6038701 - DNA, 15 bp, Homo sapiens
catcccctttcctcc

SEQ ID NO: 6038702 - DNA, 19 bp, Homo sapiens
catcccctttcctccccac

SEQ ID NO: 6038703 - DNA, 21 bp, Homo sapiens
catcccctttcctccccacct

SEQ ID NO: 6038704 - DNA, 18 bp, Homo sapiens
catcccgatgaacctgca

SEQ ID NO: 6038705 - DNA, 14 bp, Homo sapiens
catcccgccttctc

SEQ ID NO: 6038706 - DNA, 16 bp, Homo sapiens
catcccgccttctcca

SEQ ID NO: 6038707 - DNA, 15 bp, Homo sapiens
catcccgctcctgct

SEQ ID NO: 6038708 - DNA, 16 bp, Homo sapiens
catcccgctcttttcc

SEQ ID NO: 6038709 - DNA, 14 bp, Homo sapiens
catcccgcttagcc

SEQ ID NO: 6038710 - DNA, 15 bp, Homo sapiens
catcccgcttagcct

SEQ ID NO: 6038711 - DNA, 17 bp, Homo sapiens
catcccgcttagcctgc

SEQ ID NO: 6038712 - DNA, 21 bp, Homo sapiens
catcccgcttagcctgcctca

SEQ ID NO: 6038713 - DNA, 23 bp, Homo sapiens
catcccgcttagcgctctggaca

SEQ ID NO: 6038714 - DNA, 20 bp, Homo sapiens
catcccgcttctgaagctgc

SEQ ID NO: 6038715 - DNA, 19 bp, Homo sapiens
catcccggaggaaatctgc

SEQ ID NO: 6038716 - DNA, 17 bp, Homo sapiens
catcccggcccatgttg

SEQ ID NO: 6038717 - DNA, 17 bp, Homo sapiens
catcccggctgaccctg

SEQ ID NO: 6038718 - DNA, 20 bp, Homo sapiens
catcccggggccatggaagc

SEQ ID NO: 6038719 - DNA, 22 bp, Homo sapiens
catcccggggccatggaagctg

SEQ ID NO: 6038720 - DNA, 18 bp, Homo sapiens
catcccgtatcacagtgt

SEQ ID NO: 6038721 - DNA, 20 bp, Homo sapiens
catcccgtatcacagtgttt

SEQ ID NO: 6038722 - DNA, 16 bp, Homo sapiens
catcccgtcttctcca

SEQ ID NO: 6038723 - DNA, 21 bp, Homo sapiens
catcccgtgcaaaacatgcta

SEQ ID NO: 6038724 - DNA, 19 bp, Homo sapiens
catccctaagaattcccag

SEQ ID NO: 6038725 - DNA, 15 bp, Homo sapiens
catccctaccactgt

SEQ ID NO: 6038726 - DNA, 17 bp, Homo sapiens
catccctcaactgaggg

SEQ ID NO: 6038727 - DNA, 22 bp, Homo sapiens
catccctcaactgagggccagg

SEQ ID NO: 6038728 - DNA, 23 bp, Homo sapiens
catccctcaactgagggccaggg

SEQ ID NO: 6038729 - DNA, 21 bp, Homo sapiens
catccctcagtttcttaaaat

SEQ ID NO: 6038730 - DNA, 17 bp, Homo sapiens
catccctcccccagcag

SEQ ID NO: 6038731 - DNA, 22 bp, Homo sapiens
catccctccctccacctccctg

SEQ ID NO: 6038732 - DNA, 23 bp, Homo sapiens
catccctccctccacctccctgc

SEQ ID NO: 6038733 - DNA, 14 bp, Homo sapiens
catccctccctgcc

SEQ ID NO: 6038734 - DNA, 15 bp, Homo sapiens
catccctctggggct

SEQ ID NO: 6038735 - DNA, 15 bp, Homo sapiens
catccctgaaacatt

SEQ ID NO: 6038736 - DNA, 11 bp, Homo sapiens
catccctgaag

SEQ ID NO: 6038737 - DNA, 13 bp, Homo sapiens
catccctgaagac

SEQ ID NO: 6038738 - DNA, 19 bp, Homo sapiens
catccctgaaggccccgcc

SEQ ID NO: 6038739 - DNA, 23 bp, Homo sapiens
catccctgagacagggagggaag

SEQ ID NO: 6038740 - DNA, 17 bp, Homo sapiens
catccctgaggagccag

SEQ ID NO: 6038741 - DNA, 20 bp, Homo sapiens
catccctgatggcagaactc

SEQ ID NO: 6038742 - DNA, 19 bp, Homo sapiens
catccctgattcctgttgt

SEQ ID NO: 6038743 - DNA, 18 bp, Homo sapiens
catccctgccaagaactc

SEQ ID NO: 6038744 - DNA, 22 bp, Homo sapiens
catccctgccacatacaggtgc

SEQ ID NO: 6038745 - DNA, 16 bp, Homo sapiens
catccctgcctggagg

SEQ ID NO: 6038746 - DNA, 20 bp, Homo sapiens
catccctgcctggaggctcc

SEQ ID NO: 6038747 - DNA, 23 bp, Homo sapiens
catccctgcttatttttaatttg

SEQ ID NO: 6038748 - DNA, 18 bp, Homo sapiens
catccctgcttgcccgct

SEQ ID NO: 6038749 - DNA, 14 bp, Homo sapiens
catccctggaaggt

SEQ ID NO: 6038750 - DNA, 21 bp, Homo sapiens
catccctggacttctgggaga

SEQ ID NO: 6038751 - DNA, 12 bp, Homo sapiens
catccctggccc

SEQ ID NO: 6038752 - DNA, 13 bp, Homo sapiens
catccctggcccc

SEQ ID NO: 6038753 - DNA, 19 bp, Homo sapiens
catccctggctgacctgct

SEQ ID NO: 6038754 - DNA, 19 bp, Homo sapiens
catccctgggcctgctgct

SEQ ID NO: 6038755 - DNA, 22 bp, Homo sapiens
catccctgggcctgctgctgag

SEQ ID NO: 6038756 - DNA, 22 bp, Homo sapiens
catccctgggccttgggctccg

SEQ ID NO: 6038757 - DNA, 21 bp, Homo sapiens
ccactgtcctccttggcggca

SEQ ID NO: 6038758 - DNA, 11 bp, Homo sapiens
ccactgtcctg

SEQ ID NO: 6038759 - DNA, 14 bp, Homo sapiens
ccactgtcctggct

SEQ ID NO: 6038760 - DNA, 19 bp, Homo sapiens
ccactgtcctggctgctct

SEQ ID NO: 6038761 - DNA, 15 bp, Homo sapiens
ccactgtcctgggcc

SEQ ID NO: 6038762 - DNA, 21 bp, Homo sapiens
ccactgtcctgggcctgcaga

SEQ ID NO: 6038763 - DNA, 13 bp, Homo sapiens
ccactgtcctttc

SEQ ID NO: 6038764 - DNA, 17 bp, Homo sapiens
ccactgtctgtccctga

SEQ ID NO: 6038765 - DNA, 14 bp, Homo sapiens
ccactgtcttgcag

SEQ ID NO: 6038766 - DNA, 16 bp, Homo sapiens
ccactgtcttgcagtg

SEQ ID NO: 6038767 - DNA, 17 bp, Homo sapiens
ccactgtcttgtgtttt

SEQ ID NO: 6038768 - DNA, 22 bp, Homo sapiens
ccactgtgacgtcggccgacca

SEQ ID NO: 6038769 - DNA, 23 bp, Homo sapiens
ccactgtgacgtcggccgaccag

SEQ ID NO: 6038770 - DNA, 11 bp, Homo sapiens
ccactgtgcag

SEQ ID NO: 6038771 - DNA, 13 bp, Homo sapiens
ccactgtgcagga

SEQ ID NO: 6038772 - DNA, 20 bp, Homo sapiens
ccactgtgcagtggagcaga

SEQ ID NO: 6038773 - DNA, 14 bp, Homo sapiens
ccactgtgccactg

SEQ ID NO: 6038774 - DNA, 14 bp, Homo sapiens
ccactgtgcccagc

SEQ ID NO: 6038775 - DNA, 16 bp, Homo sapiens
ccactgtgcccagcag

SEQ ID NO: 6038776 - DNA, 14 bp, Homo sapiens
ccactgtgcccggc

SEQ ID NO: 6038777 - DNA, 14 bp, Homo sapiens
ccactgtgcctcag

SEQ ID NO: 6038778 - DNA, 18 bp, Homo sapiens
ccactgtgcctcagagac

SEQ ID NO: 6038779 - DNA, 22 bp, Homo sapiens
ccactgtgcctcagagaccagg

SEQ ID NO: 6038780 - DNA, 21 bp, Homo sapiens
ccactgtgcctttgcaaatca

SEQ ID NO: 6038781 - DNA, 19 bp, Homo sapiens
ccactgtgctgaattctgc

SEQ ID NO: 6038782 - DNA, 12 bp, Homo sapiens
ccactgtgctta

SEQ ID NO: 6038783 - DNA, 16 bp, Homo sapiens
ccactgtggcactggc

SEQ ID NO: 6038784 - DNA, 15 bp, Homo sapiens
ccactgtggccagag

SEQ ID NO: 6038785 - DNA, 18 bp, Homo sapiens
ccactgtggccagagctg

SEQ ID NO: 6038786 - DNA, 19 bp, Homo sapiens
ccactgtggccccaagagg

SEQ ID NO: 6038787 - DNA, 18 bp, Homo sapiens
ccactgtggggcaagcct

SEQ ID NO: 6038788 - DNA, 14 bp, Homo sapiens
ccactgtgggtgaa

SEQ ID NO: 6038789 - DNA, 13 bp, Homo sapiens
ccactgtggtggc

SEQ ID NO: 6038790 - DNA, 21 bp, Homo sapiens
ccactgtgtcccagtgtctgg

SEQ ID NO: 6038791 - DNA, 13 bp, Homo sapiens
ccactgtgtgaat

SEQ ID NO: 6038792 - DNA, 11 bp, Homo sapiens
ccactgtgtgc

SEQ ID NO: 6038793 - DNA, 14 bp, Homo sapiens
ccactgtgtgcctt

SEQ ID NO: 6038794 - DNA, 22 bp, Homo sapiens
ccactgtgtgccttctgccaac

SEQ ID NO: 6038795 - DNA, 14 bp, Homo sapiens
ccactgttatcaaa

SEQ ID NO: 6038796 - DNA, 21 bp, Homo sapiens
ccactgttctgaaaggagaca

SEQ ID NO: 6038797 - DNA, 22 bp, Homo sapiens
ccactgttctgaaaggagacat

SEQ ID NO: 6038798 - DNA, 21 bp, Homo sapiens
ccactgttgagccccagtgct

SEQ ID NO: 6038799 - DNA, 22 bp, Homo sapiens
ccactgttgagccccagtgctg

SEQ ID NO: 6038800 - DNA, 15 bp, Homo sapiens
ccactgttgggtggg

SEQ ID NO: 6038801 - DNA, 18 bp, Homo sapiens
ccactgttgggtgggtgg

SEQ ID NO: 6038802 - DNA, 23 bp, Homo sapiens
ccactgttgggtgggtgggccct

SEQ ID NO: 6038803 - DNA, 16 bp, Homo sapiens
ccactgtttcatgagc

SEQ ID NO: 6038804 - DNA, 19 bp, Homo sapiens
ccactgtttctcttgagct

SEQ ID NO: 6038805 - DNA, 17 bp, Homo sapiens
ccactgtttcttgcttg

SEQ ID NO: 6038806 - DNA, 21 bp, Homo sapiens
ccacttaaaaaatgtccatga

SEQ ID NO: 6038807 - DNA, 14 bp, Homo sapiens
ccacttaaaaagac

SEQ ID NO: 6038808 - DNA, 13 bp, Homo sapiens
ccacttaaaatgt

SEQ ID NO: 6038809 - DNA, 17 bp, Homo sapiens
ccacttaatgtatgtta

SEQ ID NO: 6038810 - DNA, 18 bp, Homo sapiens
ccacttacatatattttt

SEQ ID NO: 6038811 - DNA, 20 bp, Homo sapiens
ccacttacatatatttttaa

SEQ ID NO: 6038812 - DNA, 19 bp, Homo sapiens
ccacttacctcaaattaag

SEQ ID NO: 6038813 - DNA, 13 bp, Homo sapiens
ccacttaccttca

SEQ ID NO: 6038814 - DNA, 21 bp, Homo sapiens
ccacttaccttcaataaagta

SEQ ID NO: 6038815 - DNA, 22 bp, Homo sapiens
ccacttaccttcaataaagtat

SEQ ID NO: 6038816 - DNA, 18 bp, Homo sapiens
ccacttactataatggtt

SEQ ID NO: 6038817 - DNA, 19 bp, Homo sapiens
ccacttagccgtccatggc

SEQ ID NO: 6038818 - DNA, 22 bp, Homo sapiens
ccacttagccgtccatggcacc

SEQ ID NO: 6038819 - DNA, 18 bp, Homo sapiens
ccacttagggagtgtgcc

SEQ ID NO: 6038820 - DNA, 14 bp, Homo sapiens
ccacttagtccact

SEQ ID NO: 6038821 - DNA, 18 bp, Homo sapiens
ccacttagtcgtcttttt

SEQ ID NO: 6038822 - DNA, 22 bp, Homo sapiens
ccacttagttaaaattgatttc

SEQ ID NO: 6038823 - DNA, 17 bp, Homo sapiens
ccacttatccctctcca

SEQ ID NO: 6038824 - DNA, 16 bp, Homo sapiens
ccacttatttattgtt

SEQ ID NO: 6038825 - DNA, 22 bp, Homo sapiens
ccacttatttattgttgccttt

SEQ ID NO: 6038826 - DNA, 13 bp, Homo sapiens
ccacttatttcta

SEQ ID NO: 6038827 - DNA, 17 bp, Homo sapiens
ccacttcacagctggag

SEQ ID NO: 6038828 - DNA, 13 bp, Homo sapiens
ccacttcactgtg

SEQ ID NO: 6038829 - DNA, 13 bp, Homo sapiens
ccacttcagaagg

SEQ ID NO: 6038830 - DNA, 15 bp, Homo sapiens
ccacttcagcccagc

SEQ ID NO: 6038831 - DNA, 14 bp, Homo sapiens
ccacttcagctgac

SEQ ID NO: 6038832 - DNA, 14 bp, Homo sapiens
ccacttcaggggat

SEQ ID NO: 6038833 - DNA, 17 bp, Homo sapiens
ccacttcaggggatggg

SEQ ID NO: 6038834 - DNA, 16 bp, Homo sapiens
ccacttcatgcccact

SEQ ID NO: 6038835 - DNA, 12 bp, Homo sapiens
ccacttcatttt

SEQ ID NO: 6038836 - DNA, 15 bp, Homo sapiens
ccacttccagagggg

SEQ ID NO: 6038837 - DNA, 19 bp, Homo sapiens
ccacttccaggtctgcctg

SEQ ID NO: 6038838 - DNA, 20 bp, Homo sapiens
ccacttccaggtctgcctgg

SEQ ID NO: 6038839 - DNA, 18 bp, Homo sapiens
ccacttccattgtattgt

SEQ ID NO: 6038840 - DNA, 18 bp, Homo sapiens
ccacttcccatctccagg

SEQ ID NO: 6038841 - DNA, 18 bp, Homo sapiens
ccacttccccatctgtgt

SEQ ID NO: 6038842 - DNA, 12 bp, Homo sapiens
ccacttcccctc

SEQ ID NO: 6038843 - DNA, 13 bp, Homo sapiens
ccacttcccctcc

SEQ ID NO: 6038844 - DNA, 14 bp, Homo sapiens
ccacttcccctcct

SEQ ID NO: 6038845 - DNA, 17 bp, Homo sapiens
ccacttccctgacactg

SEQ ID NO: 6038846 - DNA, 12 bp, Homo sapiens
ccacttcctaat

SEQ ID NO: 6038847 - DNA, 17 bp, Homo sapiens
ccacttcctcctacctg

SEQ ID NO: 6038848 - DNA, 13 bp, Homo sapiens
ccacttcctgcta

SEQ ID NO: 6038849 - DNA, 18 bp, Homo sapiens
ccacttcctgctacagga

SEQ ID NO: 6038850 - DNA, 14 bp, Homo sapiens
ccacttccttaaca

SEQ ID NO: 6038851 - DNA, 20 bp, Homo sapiens
ccacttcctttgtgtttata

SEQ ID NO: 6038852 - DNA, 13 bp, Homo sapiens
ccacttcctttta

SEQ ID NO: 6038853 - DNA, 19 bp, Homo sapiens
ccacttctaactccactgg

SEQ ID NO: 6038854 - DNA, 23 bp, Homo sapiens
ccacttctcatcacacacatgga

SEQ ID NO: 6038855 - DNA, 16 bp, Homo sapiens
ccacttctccatgctg

SEQ ID NO: 6038856 - DNA, 18 bp, Homo sapiens
ccacttctccatgctgca

SEQ ID NO: 6038857 - DNA, 19 bp, Homo sapiens
ccacttctccatgctgcaa

SEQ ID NO: 6038858 - DNA, 11 bp, Homo sapiens
ccacttctccc

SEQ ID NO: 6038859 - DNA, 21 bp, Homo sapiens
ccacttctctactctggaagt

SEQ ID NO: 6038860 - DNA, 11 bp, Homo sapiens
ccacttctctc

SEQ ID NO: 6038861 - DNA, 12 bp, Homo sapiens
ccacttctctcc

SEQ ID NO: 6038862 - DNA, 14 bp, Homo sapiens
ccacttctctgctg

SEQ ID NO: 6038863 - DNA, 17 bp, Homo sapiens
ccacttctctgctgcct

SEQ ID NO: 6038864 - DNA, 19 bp, Homo sapiens
ccacttctgacagcctcag

SEQ ID NO: 6038865 - DNA, 19 bp, Homo sapiens
ccacttctgccagatgtcc

SEQ ID NO: 6038866 - DNA, 16 bp, Homo sapiens
ccacttctgcgggctc

SEQ ID NO: 6038867 - DNA, 20 bp, Homo sapiens
ccacttctgcgggctccctc

SEQ ID NO: 6038868 - DNA, 20 bp, Homo sapiens
ccacttctggcttcagcccc

SEQ ID NO: 6038869 - DNA, 14 bp, Homo sapiens
ccacttctggtata

SEQ ID NO: 6038870 - DNA, 18 bp, Homo sapiens
ccacttctggtataattg

SEQ ID NO: 6038871 - DNA, 15 bp, Homo sapiens
ccacttctggtcccc

SEQ ID NO: 6038872 - DNA, 17 bp, Homo sapiens
ccacttctggtcccctg

SEQ ID NO: 6038873 - DNA, 12 bp, Homo sapiens
ccacttctgtgg

SEQ ID NO: 6038874 - DNA, 17 bp, Homo sapiens
ccacttctgtgggcatg

SEQ ID NO: 6038875 - DNA, 20 bp, Homo sapiens
ccacttctgtgggcatggcc

SEQ ID NO: 6038876 - DNA, 19 bp, Homo sapiens
ccacttctgtgtagacatg

SEQ ID NO: 6038877 - DNA, 21 bp, Homo sapiens
ccacttctgtgtagacatggt

SEQ ID NO: 6038878 - DNA, 16 bp, Homo sapiens
ccacttcttggttcct

SEQ ID NO: 6038879 - DNA, 19 bp, Homo sapiens
ccacttcttgttccccact

SEQ ID NO: 6038880 - DNA, 16 bp, Homo sapiens
ccacttcttttataac

SEQ ID NO: 6038881 - DNA, 17 bp, Homo sapiens
ccacttgaaatgttagt

SEQ ID NO: 6038882 - DNA, 19 bp, Homo sapiens
ccacttgactaataccttg

SEQ ID NO: 6038883 - DNA, 13 bp, Homo sapiens
ccacttgaggcct

SEQ ID NO: 6038884 - DNA, 14 bp, Homo sapiens
ccacttgaggcctg

SEQ ID NO: 6038885 - DNA, 22 bp, Homo sapiens
ccacttgaggcctgatctgccc

SEQ ID NO: 6038886 - DNA, 24 bp, Homo sapiens
ccacttgaggcctgatctgcccat

SEQ ID NO: 6038887 - DNA, 17 bp, Homo sapiens
ccacttgaggctggcac

SEQ ID NO: 6038888 - DNA, 17 bp, Homo sapiens
ccacttgattgagaaag

SEQ ID NO: 6038889 - DNA, 13 bp, Homo sapiens
ccacttgcactgt

SEQ ID NO: 6038890 - DNA, 19 bp, Homo sapiens
ccacttgccagggctctgg

SEQ ID NO: 6038891 - DNA, 23 bp, Homo sapiens
ccacttgccagggctctgggggc

SEQ ID NO: 6038892 - DNA, 13 bp, Homo sapiens
ccacttgcctctt

SEQ ID NO: 6038893 - DNA, 17 bp, Homo sapiens
ccacttgcctcttcctt

SEQ ID NO: 6038894 - DNA, 19 bp, Homo sapiens
ccacttgcctcttccttga

SEQ ID NO: 6038895 - DNA, 12 bp, Homo sapiens
ccacttgcctgt

SEQ ID NO: 6038896 - DNA, 15 bp, Homo sapiens
ccacttgcctgtcac

SEQ ID NO: 6038897 - DNA, 24 bp, Homo sapiens
ccacttgcctgtcaccccagtcac

SEQ ID NO: 6038898 - DNA, 21 bp, Homo sapiens
ccacttggaggcctttcatcc

SEQ ID NO: 6038899 - DNA, 12 bp, Homo sapiens
ccacttggcatt

SEQ ID NO: 6038900 - DNA, 21 bp, Homo sapiens
ccacttggctacacagggatg

SEQ ID NO: 6038901 - DNA, 23 bp, Homo sapiens
ccacttggggccttcccccttgt

SEQ ID NO: 6038902 - DNA, 20 bp, Homo sapiens
ccacttggtctgtgagatgc

SEQ ID NO: 6038903 - DNA, 17 bp, Homo sapiens
ccacttgtagatttgat

SEQ ID NO: 6038904 - DNA, 17 bp, Homo sapiens
ccacttgtcaagttcag

SEQ ID NO: 6038905 - DNA, 15 bp, Homo sapiens
ccacttgtccgctgg

SEQ ID NO: 6038906 - DNA, 18 bp, Homo sapiens
ccacttgtccttagcctg

SEQ ID NO: 6038907 - DNA, 21 bp, Homo sapiens
ccacttgtgggtcctggggtc

SEQ ID NO: 6038908 - DNA, 18 bp, Homo sapiens
ccacttgtttgcactgtg

SEQ ID NO: 6038909 - DNA, 20 bp, Homo sapiens
ccactttaaaatatctacat

SEQ ID NO: 6038910 - DNA, 19 bp, Homo sapiens
ccactttcacgtggcctcc

SEQ ID NO: 6038911 - DNA, 12 bp, Homo sapiens
ccactttcagct

SEQ ID NO: 6038912 - DNA, 19 bp, Homo sapiens
ccactttcatctacctttt

SEQ ID NO: 6038913 - DNA, 13 bp, Homo sapiens
ccactttcattca

SEQ ID NO: 6038914 - DNA, 23 bp, Homo sapiens
ccactttcccttcccctgtgact

SEQ ID NO: 6038915 - DNA, 12 bp, Homo sapiens
ccactttcctct

SEQ ID NO: 6038916 - DNA, 14 bp, Homo sapiens
ccactttcctctct

SEQ ID NO: 6038917 - DNA, 15 bp, Homo sapiens
ccactttcctgagct

SEQ ID NO: 6038918 - DNA, 16 bp, Homo sapiens
ccactttcctgagctg

SEQ ID NO: 6038919 - DNA, 17 bp, Homo sapiens
ccactttcctgagctgt

SEQ ID NO: 6038920 - DNA, 15 bp, Homo sapiens
ccactttcgcctcct

SEQ ID NO: 6038921 - DNA, 13 bp, Homo sapiens
ccactttctagcc

SEQ ID NO: 6038922 - DNA, 18 bp, Homo sapiens
ccactttctagccagagg

SEQ ID NO: 6038923 - DNA, 19 bp, Homo sapiens
ccactttctagccagagga

SEQ ID NO: 6038924 - DNA, 18 bp, Homo sapiens
ccactttctcaggcttct

SEQ ID NO: 6038925 - DNA, 12 bp, Homo sapiens
ccactttctgtt

SEQ ID NO: 6038926 - DNA, 17 bp, Homo sapiens
ccactttcttattctgt

SEQ ID NO: 6038927 - DNA, 13 bp, Homo sapiens
ccactttgaaggg

SEQ ID NO: 6038928 - DNA, 19 bp, Homo sapiens
ccactttgaagggcaagaa

SEQ ID NO: 6038929 - DNA, 21 bp, Homo sapiens
ccactttgcacgacgccctct

SEQ ID NO: 6038930 - DNA, 20 bp, Homo sapiens
ccactttgcagacctgggac

SEQ ID NO: 6038931 - DNA, 15 bp, Homo sapiens
ccactttggagactg

SEQ ID NO: 6038932 - DNA, 21 bp, Homo sapiens
ccactttggagactggggtgg

SEQ ID NO: 6038933 - DNA, 14 bp, Homo sapiens
ccactttggcttct

SEQ ID NO: 6038934 - DNA, 18 bp, Homo sapiens
ccactttgtaatttttgc

SEQ ID NO: 6038935 - DNA, 16 bp, Homo sapiens
ccactttgtctgtaca

SEQ ID NO: 6038936 - DNA, 20 bp, Homo sapiens
ccactttgtctgtacatact

SEQ ID NO: 6038937 - DNA, 23 bp, Homo sapiens
ccacttttaaaggaatgtgaaat

SEQ ID NO: 6038938 - DNA, 20 bp, Homo sapiens
catccctgggggccttgggt

SEQ ID NO: 6038939 - DNA, 13 bp, Homo sapiens
catcccttcaacc

SEQ ID NO: 6038940 - DNA, 12 bp, Homo sapiens
catcccttccca

SEQ ID NO: 6038941 - DNA, 13 bp, Homo sapiens
catcccttcccac

SEQ ID NO: 6038942 - DNA, 14 bp, Homo sapiens
catcccttccccag

SEQ ID NO: 6038943 - DNA, 11 bp, Homo sapiens
catcccttcct

SEQ ID NO: 6038944 - DNA, 16 bp, Homo sapiens
catcccttcctcctct

SEQ ID NO: 6038945 - DNA, 23 bp, Homo sapiens
catcccttcctcctctcctggaa

SEQ ID NO: 6038946 - DNA, 14 bp, Homo sapiens
catcccttcctgga

SEQ ID NO: 6038947 - DNA, 15 bp, Homo sapiens
catcccttcctggaa

SEQ ID NO: 6038948 - DNA, 21 bp, Homo sapiens
catcccttcctggaaacagca

SEQ ID NO: 6038949 - DNA, 15 bp, Homo sapiens
catcccttctcttcc

SEQ ID NO: 6038950 - DNA, 22 bp, Homo sapiens
catcccttctcttccaggcagc

SEQ ID NO: 6038951 - DNA, 19 bp, Homo sapiens
catcccttgcttaagaatc

SEQ ID NO: 6038952 - DNA, 13 bp, Homo sapiens
catcccttggccc

SEQ ID NO: 6038953 - DNA, 16 bp, Homo sapiens
catcccttggggaagg

SEQ ID NO: 6038954 - DNA, 20 bp, Homo sapiens
catcccttgtttataaatag

SEQ ID NO: 6038955 - DNA, 13 bp, Homo sapiens
catccctttccag

SEQ ID NO: 6038956 - DNA, 14 bp, Homo sapiens
catccctttccctt

SEQ ID NO: 6038957 - DNA, 15 bp, Homo sapiens
catccctttctccca

SEQ ID NO: 6038958 - DNA, 19 bp, Homo sapiens
catccctttggttaataaa

SEQ ID NO: 6038959 - DNA, 16 bp, Homo sapiens
catccctttttttaca

SEQ ID NO: 6038960 - DNA, 20 bp, Homo sapiens
catccgaccaggttgtcact

SEQ ID NO: 6038961 - DNA, 20 bp, Homo sapiens
catccgactgcccctgctgt

SEQ ID NO: 6038962 - DNA, 18 bp, Homo sapiens
catccgagcccctgtttc

SEQ ID NO: 6038963 - DNA, 14 bp, Homo sapiens
catccgaggcaggg

SEQ ID NO: 6038964 - DNA, 16 bp, Homo sapiens
catccgaggcagggtc

SEQ ID NO: 6038965 - DNA, 22 bp, Homo sapiens
catccgaggcagggtcaggaga

SEQ ID NO: 6038966 - DNA, 13 bp, Homo sapiens
catccgcactgta

SEQ ID NO: 6038967 - DNA, 20 bp, Homo sapiens
catccgcagactgcttggcc

SEQ ID NO: 6038968 - DNA, 23 bp, Homo sapiens
catccgcagactgcttggccaga

SEQ ID NO: 6038969 - DNA, 13 bp, Homo sapiens
catccgcaggtgc

SEQ ID NO: 6038970 - DNA, 14 bp, Homo sapiens
catccgcaggtgct

SEQ ID NO: 6038971 - DNA, 13 bp, Homo sapiens
catccgcctctga

SEQ ID NO: 6038972 - DNA, 15 bp, Homo sapiens
catccgcctctgagc

SEQ ID NO: 6038973 - DNA, 15 bp, Homo sapiens
catccgcctgtgggc

SEQ ID NO: 6038974 - DNA, 16 bp, Homo sapiens
catccgcgtgtgcctg

SEQ ID NO: 6038975 - DNA, 18 bp, Homo sapiens
catccggaacagccaaag

SEQ ID NO: 6038976 - DNA, 21 bp, Homo sapiens
catccggaacagccaaagaaa

SEQ ID NO: 6038977 - DNA, 16 bp, Homo sapiens
catccggcagcctgga

SEQ ID NO: 6038978 - DNA, 22 bp, Homo sapiens
catccggcatgagggctgagat

SEQ ID NO: 6038979 - DNA, 13 bp, Homo sapiens
catccgggacgct

SEQ ID NO: 6038980 - DNA, 18 bp, Homo sapiens
catccgggacgcttccag

SEQ ID NO: 6038981 - DNA, 20 bp, Homo sapiens
catccgggacgcttccagac

SEQ ID NO: 6038982 - DNA, 23 bp, Homo sapiens
catccgggacgcttccagaccac

SEQ ID NO: 6038983 - DNA, 17 bp, Homo sapiens
catccggggccagctcc

SEQ ID NO: 6038984 - DNA, 16 bp, Homo sapiens
catccggtcccctgcc

SEQ ID NO: 6038985 - DNA, 21 bp, Homo sapiens
catccggtcccctgcctggaa

SEQ ID NO: 6038986 - DNA, 22 bp, Homo sapiens
catccgtaccatcggtcagcag

SEQ ID NO: 6038987 - DNA, 13 bp, Homo sapiens
catccgtcaccag

SEQ ID NO: 6038988 - DNA, 12 bp, Homo sapiens
catccgtccagc

SEQ ID NO: 6038989 - DNA, 14 bp, Homo sapiens
catccgtccagcca

SEQ ID NO: 6038990 - DNA, 15 bp, Homo sapiens
catccgtctcccctc

SEQ ID NO: 6038991 - DNA, 21 bp, Homo sapiens
catccgtgcctctttttaaag

SEQ ID NO: 6038992 - DNA, 18 bp, Homo sapiens
catccgtttgccaatcat

SEQ ID NO: 6038993 - DNA, 19 bp, Homo sapiens
catcctaaagaacaaagta

SEQ ID NO: 6038994 - DNA, 14 bp, Homo sapiens
catcctaagaaata

SEQ ID NO: 6038995 - DNA, 15 bp, Homo sapiens
catcctaagaaatat

SEQ ID NO: 6038996 - DNA, 20 bp, Homo sapiens
catcctaagaaatatgtgag

SEQ ID NO: 6038997 - DNA, 22 bp, Homo sapiens
catcctaagaaatatgtgagat

SEQ ID NO: 6038998 - DNA, 17 bp, Homo sapiens
catcctaagacagagga

SEQ ID NO: 6038999 - DNA, 22 bp, Homo sapiens
catcctaaggttcttgctttct

SEQ ID NO: 6039000 - DNA, 23 bp, Homo sapiens
catcctaagtgggaagtgaagcc

SEQ ID NO: 6039001 - DNA, 20 bp, Homo sapiens
catcctaatcatccaatgct

SEQ ID NO: 6039002 - DNA, 21 bp, Homo sapiens
catcctacaactcacattaga

SEQ ID NO: 6039003 - DNA, 16 bp, Homo sapiens
catcctacaagacaca

SEQ ID NO: 6039004 - DNA, 14 bp, Homo sapiens
catcctaccaatgc

SEQ ID NO: 6039005 - DNA, 17 bp, Homo sapiens
catcctactcctacctg

SEQ ID NO: 6039006 - DNA, 20 bp, Homo sapiens
catcctagaggtagagaaac

SEQ ID NO: 6039007 - DNA, 12 bp, Homo sapiens
catcctagcccc

SEQ ID NO: 6039008 - DNA, 13 bp, Homo sapiens
catcctagcccca

SEQ ID NO: 6039009 - DNA, 16 bp, Homo sapiens
catcctagccccaccc

SEQ ID NO: 6039010 - DNA, 19 bp, Homo sapiens
catcctagccccacccaga

SEQ ID NO: 6039011 - DNA, 20 bp, Homo sapiens
catcctagccccacccagag

SEQ ID NO: 6039012 - DNA, 14 bp, Homo sapiens
catcctaggaacca

SEQ ID NO: 6039013 - DNA, 18 bp, Homo sapiens
catcctaggaaccagcca

SEQ ID NO: 6039014 - DNA, 22 bp, Homo sapiens
catcctatgcttaataaaagaa

SEQ ID NO: 6039015 - DNA, 19 bp, Homo sapiens
catcctattacttttcatc

SEQ ID NO: 6039016 - DNA, 16 bp, Homo sapiens
catcctattttgtaat

SEQ ID NO: 6039017 - DNA, 18 bp, Homo sapiens
catcctcaaacactgcag

SEQ ID NO: 6039018 - DNA, 14 bp, Homo sapiens
catcctcaaagaaa

SEQ ID NO: 6039019 - DNA, 19 bp, Homo sapiens
catcctcaagatcattcag

SEQ ID NO: 6039020 - DNA, 18 bp, Homo sapiens
catcctcacccagatcag

SEQ ID NO: 6039021 - DNA, 23 bp, Homo sapiens
catcctcacccagatcaggaacc

SEQ ID NO: 6039022 - DNA, 17 bp, Homo sapiens
catcctcactgggctca

SEQ ID NO: 6039023 - DNA, 22 bp, Homo sapiens
catcctcactgggctcactgca

SEQ ID NO: 6039024 - DNA, 14 bp, Homo sapiens
catcctcagaaagt

SEQ ID NO: 6039025 - DNA, 19 bp, Homo sapiens
catcctcagaaagtgcagc

SEQ ID NO: 6039026 - DNA, 12 bp, Homo sapiens
catcctcagagg

SEQ ID NO: 6039027 - DNA, 15 bp, Homo sapiens
catcctcagaggctg

SEQ ID NO: 6039028 - DNA, 14 bp, Homo sapiens
catcctcagcaagt

SEQ ID NO: 6039029 - DNA, 16 bp, Homo sapiens
catcctcagcaagtgc

SEQ ID NO: 6039030 - DNA, 12 bp, Homo sapiens
catcctcagccc

SEQ ID NO: 6039031 - DNA, 15 bp, Homo sapiens
catcctcatacccac

SEQ ID NO: 6039032 - DNA, 17 bp, Homo sapiens
catcctcatacccaccc

SEQ ID NO: 6039033 - DNA, 16 bp, Homo sapiens
catcctcatccctgac

SEQ ID NO: 6039034 - DNA, 20 bp, Homo sapiens
catcctcatccctgactggc

SEQ ID NO: 6039035 - DNA, 20 bp, Homo sapiens
catcctcattgcctcctgtt

SEQ ID NO: 6039036 - DNA, 21 bp, Homo sapiens
catcctcattgcctcctgttc

SEQ ID NO: 6039037 - DNA, 18 bp, Homo sapiens
catcctccacgttctgct

SEQ ID NO: 6039038 - DNA, 17 bp, Homo sapiens
catcctccagatagtgt

SEQ ID NO: 6039039 - DNA, 13 bp, Homo sapiens
catcctccagcag

SEQ ID NO: 6039040 - DNA, 14 bp, Homo sapiens
catcctccagcagg

SEQ ID NO: 6039041 - DNA, 16 bp, Homo sapiens
catcctccagcaggga

SEQ ID NO: 6039042 - DNA, 13 bp, Homo sapiens
catcctccagctt

SEQ ID NO: 6039043 - DNA, 11 bp, Homo sapiens
catcctccagg

SEQ ID NO: 6039044 - DNA, 13 bp, Homo sapiens
catcctccagggc

SEQ ID NO: 6039045 - DNA, 14 bp, Homo sapiens
catcctcccaatct

SEQ ID NO: 6039046 - DNA, 15 bp, Homo sapiens
catcctcccattgcc

SEQ ID NO: 6039047 - DNA, 13 bp, Homo sapiens
catcctccccacc

SEQ ID NO: 6039048 - DNA, 18 bp, Homo sapiens
catcctccccaccagagc

SEQ ID NO: 6039049 - DNA, 20 bp, Homo sapiens
catcctccccttccctgcaa

SEQ ID NO: 6039050 - DNA, 19 bp, Homo sapiens
catcctccctgaccctgct

SEQ ID NO: 6039051 - DNA, 21 bp, Homo sapiens
catcctccctgaccctgctcc

SEQ ID NO: 6039052 - DNA, 21 bp, Homo sapiens
catcctcccttgccccaggcc

SEQ ID NO: 6039053 - DNA, 23 bp, Homo sapiens
catcctcccttgccccaggccag

SEQ ID NO: 6039054 - DNA, 20 bp, Homo sapiens
catcctccgcctcccgggtt

SEQ ID NO: 6039055 - DNA, 11 bp, Homo sapiens
catcctcctca

SEQ ID NO: 6039056 - DNA, 12 bp, Homo sapiens
catcctcctcag

SEQ ID NO: 6039057 - DNA, 16 bp, Homo sapiens
catcctcctcagatct

SEQ ID NO: 6039058 - DNA, 18 bp, Homo sapiens
catcctcctcagccccca

SEQ ID NO: 6039059 - DNA, 19 bp, Homo sapiens
catcctcctcagcccccag

SEQ ID NO: 6039060 - DNA, 11 bp, Homo sapiens
catcctcctcc

SEQ ID NO: 6039061 - DNA, 14 bp, Homo sapiens
catcctcctcctca

SEQ ID NO: 6039062 - DNA, 11 bp, Homo sapiens
catcctcctct

SEQ ID NO: 6039063 - DNA, 12 bp, Homo sapiens
catcctcctctc

SEQ ID NO: 6039064 - DNA, 19 bp, Homo sapiens
catcctcctctccatgcaa

SEQ ID NO: 6039065 - DNA, 20 bp, Homo sapiens
catcctcctctccatgcaag

SEQ ID NO: 6039066 - DNA, 14 bp, Homo sapiens
catcctcctgccca

SEQ ID NO: 6039067 - DNA, 16 bp, Homo sapiens
catcctcctgcccagc

SEQ ID NO: 6039068 - DNA, 21 bp, Homo sapiens
catcctcctggaaccttgctg

SEQ ID NO: 6039069 - DNA, 22 bp, Homo sapiens
catcctcctggaaccttgctgt

SEQ ID NO: 6039070 - DNA, 15 bp, Homo sapiens
catcctcctggaccc

SEQ ID NO: 6039071 - DNA, 12 bp, Homo sapiens
catcctcctgtg

SEQ ID NO: 6039072 - DNA, 17 bp, Homo sapiens
catcctctaaagcagag

SEQ ID NO: 6039073 - DNA, 20 bp, Homo sapiens
catcctctaaagcagaggca

SEQ ID NO: 6039074 - DNA, 13 bp, Homo sapiens
catcctctccaaa

SEQ ID NO: 6039075 - DNA, 22 bp, Homo sapiens
catcctctccaaagttggagct

SEQ ID NO: 6039076 - DNA, 13 bp, Homo sapiens
catcctctccccc

SEQ ID NO: 6039077 - DNA, 14 bp, Homo sapiens
catcctctccccca

SEQ ID NO: 6039078 - DNA, 11 bp, Homo sapiens
catcctctgac

SEQ ID NO: 6039079 - DNA, 12 bp, Homo sapiens
catcctctgact

SEQ ID NO: 6039080 - DNA, 14 bp, Homo sapiens
catcctctgactcc

SEQ ID NO: 6039081 - DNA, 13 bp, Homo sapiens
catcctctgcctc

SEQ ID NO: 6039082 - DNA, 20 bp, Homo sapiens
catcctctgcctcccgggtt

SEQ ID NO: 6039083 - DNA, 12 bp, Homo sapiens
catcctctgctg

SEQ ID NO: 6039084 - DNA, 19 bp, Homo sapiens
catcctctgtacagagccc

SEQ ID NO: 6039085 - DNA, 22 bp, Homo sapiens
catcctctgtacagagcccacg

SEQ ID NO: 6039086 - DNA, 12 bp, Homo sapiens
catcctctgtta

SEQ ID NO: 6039087 - DNA, 21 bp, Homo sapiens
catcctcttatatgtgcccct

SEQ ID NO: 6039088 - DNA, 14 bp, Homo sapiens
catcctcttctgct

SEQ ID NO: 6039089 - DNA, 20 bp, Homo sapiens
catcctctttctcttttcta

SEQ ID NO: 6039090 - DNA, 23 bp, Homo sapiens
catcctcttttaatggcatttct

SEQ ID NO: 6039091 - DNA, 13 bp, Homo sapiens
catcctgaaagcc

SEQ ID NO: 6039092 - DNA, 15 bp, Homo sapiens
catcctgaaagccag

SEQ ID NO: 6039093 - DNA, 23 bp, Homo sapiens
catcctgaaagccagcaaagcct

SEQ ID NO: 6039094 - DNA, 13 bp, Homo sapiens
catcctgacagga

SEQ ID NO: 6039095 - DNA, 18 bp, Homo sapiens
catcctgaccaagactga

SEQ ID NO: 6039096 - DNA, 20 bp, Homo sapiens
catcctgaccaagactgagc

SEQ ID NO: 6039097 - DNA, 19 bp, Homo sapiens
catcctgactctgccccct

SEQ ID NO: 6039098 - DNA, 19 bp, Homo sapiens
catcctgagccagggaaca

SEQ ID NO: 6039099 - DNA, 13 bp, Homo sapiens
catcctgagcccc

SEQ ID NO: 6039100 - DNA, 19 bp, Homo sapiens
catcctgagccccgccctc

SEQ ID NO: 6039101 - DNA, 20 bp, Homo sapiens
catcctgagccccgccctct

SEQ ID NO: 6039102 - DNA, 21 bp, Homo sapiens
catcctgagccccgccctctt

SEQ ID NO: 6039103 - DNA, 21 bp, Homo sapiens
catcctgaggaccgccccaac

SEQ ID NO: 6039104 - DNA, 18 bp, Homo sapiens
catcctgaggccagtggc

SEQ ID NO: 6039105 - DNA, 19 bp, Homo sapiens
catcctgaggccagtggcc

SEQ ID NO: 6039106 - DNA, 14 bp, Homo sapiens
catcctgaggtgcc

SEQ ID NO: 6039107 - DNA, 15 bp, Homo sapiens
catcctgatcccaga

SEQ ID NO: 6039108 - DNA, 19 bp, Homo sapiens
catcctgatggacctgccc

SEQ ID NO: 6039109 - DNA, 20 bp, Homo sapiens
catcctgcagcctcctcctg

SEQ ID NO: 6039110 - DNA, 14 bp, Homo sapiens
catcctgcatggga

SEQ ID NO: 6039111 - DNA, 15 bp, Homo sapiens
catcctgccacagga

SEQ ID NO: 6039112 - DNA, 21 bp, Homo sapiens
catcctgccagccccacacag

SEQ ID NO: 6039113 - DNA, 16 bp, Homo sapiens
catcctgccaggagca

SEQ ID NO: 6039114 - DNA, 12 bp, Homo sapiens
catcctgcctgg

SEQ ID NO: 6039115 - DNA, 20 bp, Homo sapiens
catcctgcctgggtgggaca

SEQ ID NO: 6039116 - DNA, 23 bp, Homo sapiens
catcctgcctgggtgggacagcc

SEQ ID NO: 6039117 - DNA, 21 bp, Homo sapiens
catcctgccttagagccaggc

SEQ ID NO: 6039118 - DNA, 16 bp, Homo sapiens
catcctgccttcatgg

SEQ ID NO: 6039119 - DNA, 16 bp, Homo sapiens
ccacttttattcattt

SEQ ID NO: 6039120 - DNA, 23 bp, Homo sapiens
ccacttttgaagtcttccctcag

SEQ ID NO: 6039121 - DNA, 14 bp, Homo sapiens
ccacttttgttctt

SEQ ID NO: 6039122 - DNA, 22 bp, Homo sapiens
ccacttttgttcttggtttgta

SEQ ID NO: 6039123 - DNA, 14 bp, Homo sapiens
ccactttttagaaa

SEQ ID NO: 6039124 - DNA, 14 bp, Homo sapiens
ccactttttcttat

SEQ ID NO: 6039125 - DNA, 15 bp, Homo sapiens
ccacttttttttccc

SEQ ID NO: 6039126 - DNA, 20 bp, Homo sapiens
ccactttttttttttctgcc

SEQ ID NO: 6039127 - DNA, 19 bp, Homo sapiens
ccagaaaaaaaaaaactta

SEQ ID NO: 6039128 - DNA, 16 bp, Homo sapiens
ccagaaaaaaataact

SEQ ID NO: 6039129 - DNA, 15 bp, Homo sapiens
ccagaaaaaaggact

SEQ ID NO: 6039130 - DNA, 19 bp, Homo sapiens
ccagaaaaaagtgtttata

SEQ ID NO: 6039131 - DNA, 23 bp, Homo sapiens
ccagaaaaaataaatgttcatga

SEQ ID NO: 6039132 - DNA, 23 bp, Homo sapiens
ccagaaaaatcaatcattttcta

SEQ ID NO: 6039133 - DNA, 15 bp, Homo sapiens
ccagaaaaccccagc

SEQ ID NO: 6039134 - DNA, 16 bp, Homo sapiens
ccagaaaaggacagaa

SEQ ID NO: 6039135 - DNA, 15 bp, Homo sapiens
ccagaaaaggcagcc

SEQ ID NO: 6039136 - DNA, 16 bp, Homo sapiens
ccagaaaaggcagcca

SEQ ID NO: 6039137 - DNA, 14 bp, Homo sapiens
ccagaaaatataaa

SEQ ID NO: 6039138 - DNA, 15 bp, Homo sapiens
ccagaaaatataaat

SEQ ID NO: 6039139 - DNA, 18 bp, Homo sapiens
ccagaaaatgtaaggcaa

SEQ ID NO: 6039140 - DNA, 20 bp, Homo sapiens
ccagaaacacccctctgtct

SEQ ID NO: 6039141 - DNA, 20 bp, Homo sapiens
ccagaaacacctagatcaga

SEQ ID NO: 6039142 - DNA, 14 bp, Homo sapiens
ccagaaacagctgc

SEQ ID NO: 6039143 - DNA, 20 bp, Homo sapiens
ccagaaacagctgcttctcc

SEQ ID NO: 6039144 - DNA, 23 bp, Homo sapiens
ccagaaacagctgcttctccccc

SEQ ID NO: 6039145 - DNA, 17 bp, Homo sapiens
ccagaaacctgggagag

SEQ ID NO: 6039146 - DNA, 17 bp, Homo sapiens
ccagaaaccttccagag

SEQ ID NO: 6039147 - DNA, 18 bp, Homo sapiens
ccagaaacgccacatccc

SEQ ID NO: 6039148 - DNA, 16 bp, Homo sapiens
ccagaaactccttttg

SEQ ID NO: 6039149 - DNA, 23 bp, Homo sapiens
ccagaaactccttttgctgtctt

SEQ ID NO: 6039150 - DNA, 22 bp, Homo sapiens
ccagaaactgaactggccgctg

SEQ ID NO: 6039151 - DNA, 22 bp, Homo sapiens
ccagaaagaaggacacttgtat

SEQ ID NO: 6039152 - DNA, 21 bp, Homo sapiens
ccagaaagcaaggactgccct

SEQ ID NO: 6039153 - DNA, 20 bp, Homo sapiens
ccagaaagcaggagcagctg

SEQ ID NO: 6039154 - DNA, 22 bp, Homo sapiens
ccagaaagcaggagcagctgtg

SEQ ID NO: 6039155 - DNA, 20 bp, Homo sapiens
ccagaaagccctcttggggg

SEQ ID NO: 6039156 - DNA, 20 bp, Homo sapiens
ccagaaagcctcctgccccc

SEQ ID NO: 6039157 - DNA, 15 bp, Homo sapiens
ccagaaagcctctct

SEQ ID NO: 6039158 - DNA, 20 bp, Homo sapiens
ccagaaagctctacatttgc

SEQ ID NO: 6039159 - DNA, 18 bp, Homo sapiens
ccagaaagctgccagagc

SEQ ID NO: 6039160 - DNA, 14 bp, Homo sapiens
ccagaaaggagact

SEQ ID NO: 6039161 - DNA, 16 bp, Homo sapiens
ccagaaaggagactag

SEQ ID NO: 6039162 - DNA, 20 bp, Homo sapiens
ccagaaaggatatttaagaa

SEQ ID NO: 6039163 - DNA, 22 bp, Homo sapiens
ccagaaagtcccccctcgcccc

SEQ ID NO: 6039164 - DNA, 15 bp, Homo sapiens
ccagaaagtgggggt

SEQ ID NO: 6039165 - DNA, 22 bp, Homo sapiens
ccagaaagttgtgtaggcacca

SEQ ID NO: 6039166 - DNA, 21 bp, Homo sapiens
ccagaaataaagttggtgaca

SEQ ID NO: 6039167 - DNA, 23 bp, Homo sapiens
ccagaaataaagttggtgacaga

SEQ ID NO: 6039168 - DNA, 12 bp, Homo sapiens
ccagaaatcact

SEQ ID NO: 6039169 - DNA, 16 bp, Homo sapiens
ccagaaatcattttac

SEQ ID NO: 6039170 - DNA, 14 bp, Homo sapiens
ccagaaatgccaca

SEQ ID NO: 6039171 - DNA, 14 bp, Homo sapiens
ccagaaatgggcag

SEQ ID NO: 6039172 - DNA, 22 bp, Homo sapiens
ccagaaatgggcagttctccca

SEQ ID NO: 6039173 - DNA, 22 bp, Homo sapiens
ccagaaatgtccctttcttctc

SEQ ID NO: 6039174 - DNA, 13 bp, Homo sapiens
ccagaaattagaa

SEQ ID NO: 6039175 - DNA, 17 bp, Homo sapiens
ccagaaattagaaacct

SEQ ID NO: 6039176 - DNA, 17 bp, Homo sapiens
ccagaaattccagtaaa

SEQ ID NO: 6039177 - DNA, 16 bp, Homo sapiens
ccagaaattccttccc

SEQ ID NO: 6039178 - DNA, 18 bp, Homo sapiens
ccagaaattctggcccag

SEQ ID NO: 6039179 - DNA, 15 bp, Homo sapiens
ccagaaattcttcaa

SEQ ID NO: 6039180 - DNA, 17 bp, Homo sapiens
ccagaacaacaactatc

SEQ ID NO: 6039181 - DNA, 22 bp, Homo sapiens
ccagaacacccctaatgagggt

SEQ ID NO: 6039182 - DNA, 16 bp, Homo sapiens
ccagaacagcatggcc

SEQ ID NO: 6039183 - DNA, 17 bp, Homo sapiens
ccagaacagccctcggc

SEQ ID NO: 6039184 - DNA, 15 bp, Homo sapiens
ccagaacatacactg

SEQ ID NO: 6039185 - DNA, 16 bp, Homo sapiens
ccagaaccaattattt

SEQ ID NO: 6039186 - DNA, 15 bp, Homo sapiens
ccagaaccacactgt

SEQ ID NO: 6039187 - DNA, 22 bp, Homo sapiens
ccagaaccacacttgaaacctt

SEQ ID NO: 6039188 - DNA, 16 bp, Homo sapiens
ccagaacccagtgttt

SEQ ID NO: 6039189 - DNA, 13 bp, Homo sapiens
ccagaacccattt

SEQ ID NO: 6039190 - DNA, 20 bp, Homo sapiens
ccagaaccccaactcccagc

SEQ ID NO: 6039191 - DNA, 21 bp, Homo sapiens
ccagaaccttactggcactgt

SEQ ID NO: 6039192 - DNA, 23 bp, Homo sapiens
ccagaaccttactggcactgtgg

SEQ ID NO: 6039193 - DNA, 18 bp, Homo sapiens
ccagaacgcaccccactg

SEQ ID NO: 6039194 - DNA, 14 bp, Homo sapiens
ccagaacgccctgt

SEQ ID NO: 6039195 - DNA, 18 bp, Homo sapiens
ccagaacgccctgtgtcc

SEQ ID NO: 6039196 - DNA, 20 bp, Homo sapiens
ccagaacgggcctccccggg

SEQ ID NO: 6039197 - DNA, 20 bp, Homo sapiens
ccagaacgtagtgagccttg

SEQ ID NO: 6039198 - DNA, 16 bp, Homo sapiens
ccagaacgtctctcac

SEQ ID NO: 6039199 - DNA, 21 bp, Homo sapiens
ccagaacgtggctctgctggc

SEQ ID NO: 6039200 - DNA, 21 bp, Homo sapiens
ccagaacgtggtttgcctgag

SEQ ID NO: 6039201 - DNA, 19 bp, Homo sapiens
ccagaactattctgggggc

SEQ ID NO: 6039202 - DNA, 17 bp, Homo sapiens
ccagaactctgcctgcc

SEQ ID NO: 6039203 - DNA, 19 bp, Homo sapiens
ccagaactctgcctgccct

SEQ ID NO: 6039204 - DNA, 15 bp, Homo sapiens
ccagaactctgtgtc

SEQ ID NO: 6039205 - DNA, 15 bp, Homo sapiens
ccagaactcttcctc

SEQ ID NO: 6039206 - DNA, 24 bp, Homo sapiens
ccagaactcttcctccaaggacag

SEQ ID NO: 6039207 - DNA, 23 bp, Homo sapiens
ccagaactgaggtcactgggttc

SEQ ID NO: 6039208 - DNA, 14 bp, Homo sapiens
ccagaactgcacaa

SEQ ID NO: 6039209 - DNA, 22 bp, Homo sapiens
ccagaactgcacaatgaccagc

SEQ ID NO: 6039210 - DNA, 17 bp, Homo sapiens
ccagaactgcccccact

SEQ ID NO: 6039211 - DNA, 19 bp, Homo sapiens
ccagaactgcccccactgt

SEQ ID NO: 6039212 - DNA, 21 bp, Homo sapiens
ccagaactgcccccactgtcc

SEQ ID NO: 6039213 - DNA, 12 bp, Homo sapiens
ccagaactggac

SEQ ID NO: 6039214 - DNA, 23 bp, Homo sapiens
ccagaactggctgggcccctggg

SEQ ID NO: 6039215 - DNA, 17 bp, Homo sapiens
ccagaacttagccttta

SEQ ID NO: 6039216 - DNA, 19 bp, Homo sapiens
ccagaacttcaagatgagc

SEQ ID NO: 6039217 - DNA, 21 bp, Homo sapiens
ccagaacttcaagatgagcct

SEQ ID NO: 6039218 - DNA, 15 bp, Homo sapiens
ccagaacttccctga

SEQ ID NO: 6039219 - DNA, 15 bp, Homo sapiens
ccagaactttctgtc

SEQ ID NO: 6039220 - DNA, 19 bp, Homo sapiens
ccagaactttgggaggcca

SEQ ID NO: 6039221 - DNA, 16 bp, Homo sapiens
ccagaactttttcctc

SEQ ID NO: 6039222 - DNA, 15 bp, Homo sapiens
ccagaagaaaatttg

SEQ ID NO: 6039223 - DNA, 17 bp, Homo sapiens
ccagaagaaattattta

SEQ ID NO: 6039224 - DNA, 18 bp, Homo sapiens
ccagaagaactttgcctt

SEQ ID NO: 6039225 - DNA, 21 bp, Homo sapiens
ccagaagaagagaagctgctg

SEQ ID NO: 6039226 - DNA, 18 bp, Homo sapiens
ccagaagaatattcagga

SEQ ID NO: 6039227 - DNA, 19 bp, Homo sapiens
ccagaagaatattcaggac

SEQ ID NO: 6039228 - DNA, 17 bp, Homo sapiens
ccagaagacaaacaata

SEQ ID NO: 6039229 - DNA, 15 bp, Homo sapiens
ccagaagaccccact

SEQ ID NO: 6039230 - DNA, 16 bp, Homo sapiens
ccagaagaccccactt

SEQ ID NO: 6039231 - DNA, 24 bp, Homo sapiens
ccagaagatcccctcaggactgca

SEQ ID NO: 6039232 - DNA, 20 bp, Homo sapiens
ccagaagatgaacagactga

SEQ ID NO: 6039233 - DNA, 18 bp, Homo sapiens
ccagaagatgccagcttc

SEQ ID NO: 6039234 - DNA, 16 bp, Homo sapiens
ccagaagatgccctcc

SEQ ID NO: 6039235 - DNA, 15 bp, Homo sapiens
ccagaagcagcagct

SEQ ID NO: 6039236 - DNA, 20 bp, Homo sapiens
ccagaagccacccaaagcag

SEQ ID NO: 6039237 - DNA, 12 bp, Homo sapiens
ccagaagcccag

SEQ ID NO: 6039238 - DNA, 11 bp, Homo sapiens
ccagaagcctc

SEQ ID NO: 6039239 - DNA, 23 bp, Homo sapiens
ccagaagcctccttacattaaaa

SEQ ID NO: 6039240 - DNA, 16 bp, Homo sapiens
ccagaagcctctggct

SEQ ID NO: 6039241 - DNA, 19 bp, Homo sapiens
ccagaagcctgatctttgg

SEQ ID NO: 6039242 - DNA, 14 bp, Homo sapiens
ccagaagccttgga

SEQ ID NO: 6039243 - DNA, 19 bp, Homo sapiens
ccagaagccttggaaccag

SEQ ID NO: 6039244 - DNA, 18 bp, Homo sapiens
ccagaagctcaaggctgc

SEQ ID NO: 6039245 - DNA, 19 bp, Homo sapiens
ccagaagctcaaggctgca

SEQ ID NO: 6039246 - DNA, 20 bp, Homo sapiens
ccagaagctcccccagcaaa

SEQ ID NO: 6039247 - DNA, 13 bp, Homo sapiens
ccagaagctgctc

SEQ ID NO: 6039248 - DNA, 12 bp, Homo sapiens
ccagaaggaagc

SEQ ID NO: 6039249 - DNA, 20 bp, Homo sapiens
ccagaaggaagccctctcag

SEQ ID NO: 6039250 - DNA, 22 bp, Homo sapiens
ccagaaggagggcagagccatg

SEQ ID NO: 6039251 - DNA, 14 bp, Homo sapiens
ccagaaggaggggg

SEQ ID NO: 6039252 - DNA, 17 bp, Homo sapiens
ccagaaggatttcttgt

SEQ ID NO: 6039253 - DNA, 18 bp, Homo sapiens
ccagaaggatttcttgta

SEQ ID NO: 6039254 - DNA, 13 bp, Homo sapiens
ccagaaggcagca

SEQ ID NO: 6039255 - DNA, 12 bp, Homo sapiens
ccagaaggcagg

SEQ ID NO: 6039256 - DNA, 20 bp, Homo sapiens
ccagaaggctgggtccaggg

SEQ ID NO: 6039257 - DNA, 12 bp, Homo sapiens
ccagaagggctt

SEQ ID NO: 6039258 - DNA, 13 bp, Homo sapiens
ccagaaggggagc

SEQ ID NO: 6039259 - DNA, 17 bp, Homo sapiens
ccagaaggggagctttt

SEQ ID NO: 6039260 - DNA, 18 bp, Homo sapiens
ccagaaggggcacgcctg

SEQ ID NO: 6039261 - DNA, 23 bp, Homo sapiens
ccagaaggggcacgcctgcccag

SEQ ID NO: 6039262 - DNA, 20 bp, Homo sapiens
ccagaaggggctgcttgctt

SEQ ID NO: 6039263 - DNA, 14 bp, Homo sapiens
ccagaagggtagct

SEQ ID NO: 6039264 - DNA, 16 bp, Homo sapiens
ccagaagggtagctgg

SEQ ID NO: 6039265 - DNA, 20 bp, Homo sapiens
ccagaagggtagctgggcgg

SEQ ID NO: 6039266 - DNA, 22 bp, Homo sapiens
ccagaagtaaagtttatttcat

SEQ ID NO: 6039267 - DNA, 16 bp, Homo sapiens
ccagaagtaccagact

SEQ ID NO: 6039268 - DNA, 20 bp, Homo sapiens
ccagaagtaccagactagat

SEQ ID NO: 6039269 - DNA, 18 bp, Homo sapiens
ccagaagtcaaggcttag

SEQ ID NO: 6039270 - DNA, 16 bp, Homo sapiens
ccagaagtccacagga

SEQ ID NO: 6039271 - DNA, 17 bp, Homo sapiens
ccagaagtccacaggac

SEQ ID NO: 6039272 - DNA, 22 bp, Homo sapiens
ccagaagtcccttcaatttcta

SEQ ID NO: 6039273 - DNA, 17 bp, Homo sapiens
ccagaagtgaatgggaa

SEQ ID NO: 6039274 - DNA, 19 bp, Homo sapiens
ccagaagtggggctctggg

SEQ ID NO: 6039275 - DNA, 13 bp, Homo sapiens
ccagaataagtgc

SEQ ID NO: 6039276 - DNA, 22 bp, Homo sapiens
ccagaataattggcatgtctcc

SEQ ID NO: 6039277 - DNA, 23 bp, Homo sapiens
ccagaatactgatggaatttttt

SEQ ID NO: 6039278 - DNA, 22 bp, Homo sapiens
ccagaatactgggttcttagtt

SEQ ID NO: 6039279 - DNA, 21 bp, Homo sapiens
ccagaatcagattcaggagct

SEQ ID NO: 6039280 - DNA, 23 bp, Homo sapiens
ccagaatccataaatgtgttcct

SEQ ID NO: 6039281 - DNA, 15 bp, Homo sapiens
ccagaatcccagccg

SEQ ID NO: 6039282 - DNA, 17 bp, Homo sapiens
ccagaatcccctgggga

SEQ ID NO: 6039283 - DNA, 15 bp, Homo sapiens
ccagaatctctgagc

SEQ ID NO: 6039284 - DNA, 14 bp, Homo sapiens
ccagaatctgctgt

SEQ ID NO: 6039285 - DNA, 10 bp, Homo sapiens
ccagaatctt

SEQ ID NO: 6039286 - DNA, 16 bp, Homo sapiens
ccagaatcttgacttt

SEQ ID NO: 6039287 - DNA, 19 bp, Homo sapiens
ccagaatcttgactttctg

SEQ ID NO: 6039288 - DNA, 11 bp, Homo sapiens
ccagaatgaag

SEQ ID NO: 6039289 - DNA, 15 bp, Homo sapiens
ccagaatggaaaaaa

SEQ ID NO: 6039290 - DNA, 15 bp, Homo sapiens
ccagaatggagcctg

SEQ ID NO: 6039291 - DNA, 23 bp, Homo sapiens
ccagaatggtctttctaatgtgt

SEQ ID NO: 6039292 - DNA, 23 bp, Homo sapiens
ccagaatgtcagattcctttccc

SEQ ID NO: 6039293 - DNA, 16 bp, Homo sapiens
ccagaatgtgctgcct

SEQ ID NO: 6039294 - DNA, 23 bp, Homo sapiens
ccagaatgtttcctgtggaaata

SEQ ID NO: 6039295 - DNA, 22 bp, Homo sapiens
ccagaattaaggtttgttttcc

SEQ ID NO: 6039296 - DNA, 15 bp, Homo sapiens
catcctgctcttcca

SEQ ID NO: 6039297 - DNA, 21 bp, Homo sapiens
catcctgctcttttgtgatga

SEQ ID NO: 6039298 - DNA, 22 bp, Homo sapiens
catcctgctgcccttaggccac

SEQ ID NO: 6039299 - DNA, 14 bp, Homo sapiens
catcctgctgctta

SEQ ID NO: 6039300 - DNA, 11 bp, Homo sapiens
catcctgctgg

SEQ ID NO: 6039301 - DNA, 12 bp, Homo sapiens
catcctgcttcc

SEQ ID NO: 6039302 - DNA, 14 bp, Homo sapiens
catcctgcttcctg

SEQ ID NO: 6039303 - DNA, 19 bp, Homo sapiens
catcctgctttccctcccc

SEQ ID NO: 6039304 - DNA, 15 bp, Homo sapiens
catcctgctttgatt

SEQ ID NO: 6039305 - DNA, 12 bp, Homo sapiens
catcctggaaat

SEQ ID NO: 6039306 - DNA, 11 bp, Homo sapiens
catcctggccc

SEQ ID NO: 6039307 - DNA, 23 bp, Homo sapiens
catcctggcccctccagaccctg

SEQ ID NO: 6039308 - DNA, 12 bp, Homo sapiens
catcctggcctc

SEQ ID NO: 6039309 - DNA, 16 bp, Homo sapiens
catcctggcctccttt

SEQ ID NO: 6039310 - DNA, 21 bp, Homo sapiens
catcctggcctggcacatcag

SEQ ID NO: 6039311 - DNA, 17 bp, Homo sapiens
catcctggctggagaat

SEQ ID NO: 6039312 - DNA, 14 bp, Homo sapiens
catcctgggcagct

SEQ ID NO: 6039313 - DNA, 20 bp, Homo sapiens
catcctggggcagcactccc

SEQ ID NO: 6039314 - DNA, 13 bp, Homo sapiens
catcctgggtaat

SEQ ID NO: 6039315 - DNA, 15 bp, Homo sapiens
catcctggtcagctg

SEQ ID NO: 6039316 - DNA, 14 bp, Homo sapiens
catcctgtacaagt

SEQ ID NO: 6039317 - DNA, 18 bp, Homo sapiens
catcctgtagggcaccca

SEQ ID NO: 6039318 - DNA, 19 bp, Homo sapiens
catcctgtataagcactga

SEQ ID NO: 6039319 - DNA, 19 bp, Homo sapiens
catcctgtcatctgagaat

SEQ ID NO: 6039320 - DNA, 12 bp, Homo sapiens
catcctgtgaag

SEQ ID NO: 6039321 - DNA, 22 bp, Homo sapiens
catcctgtgtcccctgacctgt

SEQ ID NO: 6039322 - DNA, 23 bp, Homo sapiens
catcctgtgtgttaagctctgct

SEQ ID NO: 6039323 - DNA, 15 bp, Homo sapiens
catcctgtgtttcta

SEQ ID NO: 6039324 - DNA, 21 bp, Homo sapiens
catcctgtgtttctagggaaa

SEQ ID NO: 6039325 - DNA, 22 bp, Homo sapiens
catcctgtgtttctagggaaat

SEQ ID NO: 6039326 - DNA, 20 bp, Homo sapiens
catcctgttggctgctgcca

SEQ ID NO: 6039327 - DNA, 14 bp, Homo sapiens
catcctgtttgaaa

SEQ ID NO: 6039328 - DNA, 17 bp, Homo sapiens
catcctgtttgtatgaa

SEQ ID NO: 6039329 - DNA, 19 bp, Homo sapiens
catcctgtttgtatgaaat

SEQ ID NO: 6039330 - DNA, 15 bp, Homo sapiens
catccttaaatgtct

SEQ ID NO: 6039331 - DNA, 14 bp, Homo sapiens
catccttaactgtc

SEQ ID NO: 6039332 - DNA, 15 bp, Homo sapiens
catccttaagagaag

SEQ ID NO: 6039333 - DNA, 17 bp, Homo sapiens
catccttagcaacagcc

SEQ ID NO: 6039334 - DNA, 20 bp, Homo sapiens
catccttatccttcatcttt

SEQ ID NO: 6039335 - DNA, 16 bp, Homo sapiens
catccttccatccatc

SEQ ID NO: 6039336 - DNA, 22 bp, Homo sapiens
catccttccctgtctgccaggg

SEQ ID NO: 6039337 - DNA, 23 bp, Homo sapiens
catccttccgccaatctggccct

SEQ ID NO: 6039338 - DNA, 18 bp, Homo sapiens
catccttcctcacaccag

SEQ ID NO: 6039339 - DNA, 15 bp, Homo sapiens
catccttcctgggga

SEQ ID NO: 6039340 - DNA, 14 bp, Homo sapiens
catccttccttccc

SEQ ID NO: 6039341 - DNA, 15 bp, Homo sapiens
catccttccttccca

SEQ ID NO: 6039342 - DNA, 17 bp, Homo sapiens
catccttccttcccacc

SEQ ID NO: 6039343 - DNA, 14 bp, Homo sapiens
catccttctcactg

SEQ ID NO: 6039344 - DNA, 15 bp, Homo sapiens
catccttctcactgc

SEQ ID NO: 6039345 - DNA, 17 bp, Homo sapiens
catccttctccccaagg

SEQ ID NO: 6039346 - DNA, 12 bp, Homo sapiens
catccttctgcc

SEQ ID NO: 6039347 - DNA, 18 bp, Homo sapiens
catccttcttggcttcct

SEQ ID NO: 6039348 - DNA, 19 bp, Homo sapiens
catccttcttggcttcctg

SEQ ID NO: 6039349 - DNA, 15 bp, Homo sapiens
catccttctttcctt

SEQ ID NO: 6039350 - DNA, 14 bp, Homo sapiens
catccttgaactgt

SEQ ID NO: 6039351 - DNA, 17 bp, Homo sapiens
catccttgagattctga

SEQ ID NO: 6039352 - DNA, 19 bp, Homo sapiens
catccttgagattctgaag

SEQ ID NO: 6039353 - DNA, 14 bp, Homo sapiens
catccttgaggacc

SEQ ID NO: 6039354 - DNA, 14 bp, Homo sapiens
catccttgagtcaa

SEQ ID NO: 6039355 - DNA, 20 bp, Homo sapiens
catccttgattacttccact

SEQ ID NO: 6039356 - DNA, 17 bp, Homo sapiens
catccttgcacttctgt

SEQ ID NO: 6039357 - DNA, 19 bp, Homo sapiens
catccttgcacttctgtta

SEQ ID NO: 6039358 - DNA, 14 bp, Homo sapiens
catccttgcctgtc

SEQ ID NO: 6039359 - DNA, 15 bp, Homo sapiens
catccttggcctggc

SEQ ID NO: 6039360 - DNA, 20 bp, Homo sapiens
catccttggtctttgtatct

SEQ ID NO: 6039361 - DNA, 16 bp, Homo sapiens
catccttggtgctctt

SEQ ID NO: 6039362 - DNA, 17 bp, Homo sapiens
catccttggtgctcttg

SEQ ID NO: 6039363 - DNA, 19 bp, Homo sapiens
catccttggtgctcttgct

SEQ ID NO: 6039364 - DNA, 13 bp, Homo sapiens
catccttgtaata

SEQ ID NO: 6039365 - DNA, 22 bp, Homo sapiens
catccttgtcttattcccttcc

SEQ ID NO: 6039366 - DNA, 13 bp, Homo sapiens
catccttgtcttt

SEQ ID NO: 6039367 - DNA, 16 bp, Homo sapiens
catccttgtcttttga

SEQ ID NO: 6039368 - DNA, 20 bp, Homo sapiens
catccttgtcttttgagcta

SEQ ID NO: 6039369 - DNA, 21 bp, Homo sapiens
catcctttagggttctgcctc

SEQ ID NO: 6039370 - DNA, 17 bp, Homo sapiens
catcctttcacttcttt

SEQ ID NO: 6039371 - DNA, 12 bp, Homo sapiens
catcctttccct

SEQ ID NO: 6039372 - DNA, 23 bp, Homo sapiens
catcctttcctctagcttttcta

SEQ ID NO: 6039373 - DNA, 16 bp, Homo sapiens
catcctttctgcctct

SEQ ID NO: 6039374 - DNA, 18 bp, Homo sapiens
catcctttctgcctctca

SEQ ID NO: 6039375 - DNA, 21 bp, Homo sapiens
catcctttgtcttggaaccac

SEQ ID NO: 6039376 - DNA, 17 bp, Homo sapiens
catccttttctgcagag

SEQ ID NO: 6039377 - DNA, 19 bp, Homo sapiens
catccttttctgcagaggg

SEQ ID NO: 6039378 - DNA, 23 bp, Homo sapiens
catccttttgcttcatctggagt

SEQ ID NO: 6039379 - DNA, 13 bp, Homo sapiens
catcctttttctg

SEQ ID NO: 6039380 - DNA, 22 bp, Homo sapiens
catccttttttaaaaaaaagaa

SEQ ID NO: 6039381 - DNA, 23 bp, Homo sapiens
catccttttttctcttctgtcca

SEQ ID NO: 6039382 - DNA, 12 bp, Homo sapiens
catcgaaatgta

SEQ ID NO: 6039383 - DNA, 21 bp, Homo sapiens
catcgaatctactaattccac

SEQ ID NO: 6039384 - DNA, 15 bp, Homo sapiens
catcgagatggagct

SEQ ID NO: 6039385 - DNA, 21 bp, Homo sapiens
catcgattgtgtacttttcct

SEQ ID NO: 6039386 - DNA, 22 bp, Homo sapiens
catcgattgtgtacttttcctt

SEQ ID NO: 6039387 - DNA, 23 bp, Homo sapiens
catcgattgtgtacttttccttt

SEQ ID NO: 6039388 - DNA, 13 bp, Homo sapiens
catcgcacactgg

SEQ ID NO: 6039389 - DNA, 16 bp, Homo sapiens
catcgcacactggggc

SEQ ID NO: 6039390 - DNA, 17 bp, Homo sapiens
catcgcacactggggcc

SEQ ID NO: 6039391 - DNA, 14 bp, Homo sapiens
catcgcacagttta

SEQ ID NO: 6039392 - DNA, 16 bp, Homo sapiens
catcgcaccattctga

SEQ ID NO: 6039393 - DNA, 14 bp, Homo sapiens
catcgcactgtgga

SEQ ID NO: 6039394 - DNA, 13 bp, Homo sapiens
catcgcagcttcc

SEQ ID NO: 6039395 - DNA, 12 bp, Homo sapiens
catcgcaggagt

SEQ ID NO: 6039396 - DNA, 18 bp, Homo sapiens
catcgccaaggactgact

SEQ ID NO: 6039397 - DNA, 13 bp, Homo sapiens
catcgccagacaa

SEQ ID NO: 6039398 - DNA, 17 bp, Homo sapiens
catcgccatcttcttcc

SEQ ID NO: 6039399 - DNA, 17 bp, Homo sapiens
catcgcctctgtctcct

SEQ ID NO: 6039400 - DNA, 21 bp, Homo sapiens
catcgcctgggacgccccttt

SEQ ID NO: 6039401 - DNA, 14 bp, Homo sapiens
catcgccttctggc

SEQ ID NO: 6039402 - DNA, 22 bp, Homo sapiens
catcgccttctggctgctgcag

SEQ ID NO: 6039403 - DNA, 18 bp, Homo sapiens
catcgcgggatggtgcag

SEQ ID NO: 6039404 - DNA, 14 bp, Homo sapiens
catcggaagagagg

SEQ ID NO: 6039405 - DNA, 18 bp, Homo sapiens
catcggaagagagggctg

SEQ ID NO: 6039406 - DNA, 19 bp, Homo sapiens
catcggacaagacccccag

SEQ ID NO: 6039407 - DNA, 15 bp, Homo sapiens
catcggacaggagga

SEQ ID NO: 6039408 - DNA, 21 bp, Homo sapiens
catcggactaaactatctgta

SEQ ID NO: 6039409 - DNA, 23 bp, Homo sapiens
catcggaggctgggcccctggga

SEQ ID NO: 6039410 - DNA, 21 bp, Homo sapiens
catcggagttgacagtgaaac

SEQ ID NO: 6039411 - DNA, 14 bp, Homo sapiens
catcggcctagggc

SEQ ID NO: 6039412 - DNA, 19 bp, Homo sapiens
catcgggagcacccagagc

SEQ ID NO: 6039413 - DNA, 14 bp, Homo sapiens
catcgggattgtct

SEQ ID NO: 6039414 - DNA, 16 bp, Homo sapiens
catcgggcccagggac

SEQ ID NO: 6039415 - DNA, 14 bp, Homo sapiens
catcgggctgtcgc

SEQ ID NO: 6039416 - DNA, 21 bp, Homo sapiens
catcggggccatttggccggc

SEQ ID NO: 6039417 - DNA, 14 bp, Homo sapiens
catcgggggcagag

SEQ ID NO: 6039418 - DNA, 20 bp, Homo sapiens
catcggggggtgggagggat

SEQ ID NO: 6039419 - DNA, 18 bp, Homo sapiens
catcggggtggcccactg

SEQ ID NO: 6039420 - DNA, 22 bp, Homo sapiens
catcgggtgtaggtgaaaggca

SEQ ID NO: 6039421 - DNA, 17 bp, Homo sapiens
catcggtcctgtctccc

SEQ ID NO: 6039422 - DNA, 22 bp, Homo sapiens
catcggtgaaactaacagataa

SEQ ID NO: 6039423 - DNA, 16 bp, Homo sapiens
catcggttcaggagga

SEQ ID NO: 6039424 - DNA, 17 bp, Homo sapiens
catcgtaggcagccacg

SEQ ID NO: 6039425 - DNA, 19 bp, Homo sapiens
catcgtaggcagccacggc

SEQ ID NO: 6039426 - DNA, 21 bp, Homo sapiens
catcgtataacacaatatgaa

SEQ ID NO: 6039427 - DNA, 12 bp, Homo sapiens
catcgtccagcc

SEQ ID NO: 6039428 - DNA, 13 bp, Homo sapiens
catcgtccagccc

SEQ ID NO: 6039429 - DNA, 15 bp, Homo sapiens
catcgtccagccctc

SEQ ID NO: 6039430 - DNA, 15 bp, Homo sapiens
catcgtccttcctct

SEQ ID NO: 6039431 - DNA, 18 bp, Homo sapiens
catcgtctcatcctcctt

SEQ ID NO: 6039432 - DNA, 20 bp, Homo sapiens
catcgtctcatcctcctttc

SEQ ID NO: 6039433 - DNA, 15 bp, Homo sapiens
catcgtcttttagtt

SEQ ID NO: 6039434 - DNA, 16 bp, Homo sapiens
catcgtgaagaagcct

SEQ ID NO: 6039435 - DNA, 13 bp, Homo sapiens
catcgtgaccctt

SEQ ID NO: 6039436 - DNA, 18 bp, Homo sapiens
catcgtgacccttcaggg

SEQ ID NO: 6039437 - DNA, 19 bp, Homo sapiens
catcgtgacccttcagggc

SEQ ID NO: 6039438 - DNA, 21 bp, Homo sapiens
catcgtgacccttcagggcca

SEQ ID NO: 6039439 - DNA, 15 bp, Homo sapiens
catcgtggctgggaa

SEQ ID NO: 6039440 - DNA, 22 bp, Homo sapiens
catcgtggtgggggaggagcct

SEQ ID NO: 6039441 - DNA, 15 bp, Homo sapiens
catcgttccccaccc

SEQ ID NO: 6039442 - DNA, 13 bp, Homo sapiens
catcgttctaaaa

SEQ ID NO: 6039443 - DNA, 21 bp, Homo sapiens
catcgttttctttgctgtgcc

SEQ ID NO: 6039444 - DNA, 19 bp, Homo sapiens
catctaaaaatatacatgt

SEQ ID NO: 6039445 - DNA, 20 bp, Homo sapiens
catctaaaccagaaggaagc

SEQ ID NO: 6039446 - DNA, 21 bp, Homo sapiens
catctaaaccagaaggaagcc

SEQ ID NO: 6039447 - DNA, 18 bp, Homo sapiens
catctaaactaagatgtg

SEQ ID NO: 6039448 - DNA, 21 bp, Homo sapiens
catctaaactgccccctctgc

SEQ ID NO: 6039449 - DNA, 22 bp, Homo sapiens
catctaaactttaatatgtatt

SEQ ID NO: 6039450 - DNA, 16 bp, Homo sapiens
catctaaagcagcagg

SEQ ID NO: 6039451 - DNA, 17 bp, Homo sapiens
catctaaagctttatct

SEQ ID NO: 6039452 - DNA, 15 bp, Homo sapiens
catctaaattctgat

SEQ ID NO: 6039453 - DNA, 18 bp, Homo sapiens
catctaacctcatcttct

SEQ ID NO: 6039454 - DNA, 19 bp, Homo sapiens
catctaacctcatcttctt

SEQ ID NO: 6039455 - DNA, 22 bp, Homo sapiens
catctaacgtgcattataattt

SEQ ID NO: 6039456 - DNA, 12 bp, Homo sapiens
catctaagcctg

SEQ ID NO: 6039457 - DNA, 23 bp, Homo sapiens
catctaagctgcagcttcctgtc

SEQ ID NO: 6039458 - DNA, 14 bp, Homo sapiens
catctaataaaaaa

SEQ ID NO: 6039459 - DNA, 23 bp, Homo sapiens
catctaatagcgggttactttca

SEQ ID NO: 6039460 - DNA, 20 bp, Homo sapiens
catctaatgaaaaacaaaaa

SEQ ID NO: 6039461 - DNA, 12 bp, Homo sapiens
catctaattcaa

SEQ ID NO: 6039462 - DNA, 14 bp, Homo sapiens
catctaattctgat

SEQ ID NO: 6039463 - DNA, 19 bp, Homo sapiens
catctaatttaatattcct

SEQ ID NO: 6039464 - DNA, 23 bp, Homo sapiens
catctaattttattttgtgaagt

SEQ ID NO: 6039465 - DNA, 20 bp, Homo sapiens
catctacaaaacattaaact

SEQ ID NO: 6039466 - DNA, 15 bp, Homo sapiens
catctacacagcctg

SEQ ID NO: 6039467 - DNA, 12 bp, Homo sapiens
catctacacata

SEQ ID NO: 6039468 - DNA, 23 bp, Homo sapiens
catctacacatataaacacagta

SEQ ID NO: 6039469 - DNA, 15 bp, Homo sapiens
catctaccctccgat

SEQ ID NO: 6039470 - DNA, 21 bp, Homo sapiens
catctacctatacttaatcta

SEQ ID NO: 6039471 - DNA, 19 bp, Homo sapiens
catctacgaagccacaggc

SEQ ID NO: 6039472 - DNA, 22 bp, Homo sapiens
catctacgaagccacaggcctg

SEQ ID NO: 6039473 - DNA, 22 bp, Homo sapiens
catctacgtatggctccacacc

SEQ ID NO: 6039474 - DNA, 14 bp, Homo sapiens
catctactcccaag

SEQ ID NO: 6039475 - DNA, 18 bp, Homo sapiens
ccagaattacccttcctc

SEQ ID NO: 6039476 - DNA, 19 bp, Homo sapiens
ccagaattagtcctcacag

SEQ ID NO: 6039477 - DNA, 17 bp, Homo sapiens
ccagaattcccttgaat

SEQ ID NO: 6039478 - DNA, 17 bp, Homo sapiens
ccagaattgcagttcag

SEQ ID NO: 6039479 - DNA, 22 bp, Homo sapiens
ccagaattgcattctgaatgaa

SEQ ID NO: 6039480 - DNA, 20 bp, Homo sapiens
ccagaattgcttgaacccag

SEQ ID NO: 6039481 - DNA, 21 bp, Homo sapiens
ccagaatttattagtttaaaa

SEQ ID NO: 6039482 - DNA, 21 bp, Homo sapiens
ccagaatttcccaaagcagtg

SEQ ID NO: 6039483 - DNA, 13 bp, Homo sapiens
ccagaatttggaa

SEQ ID NO: 6039484 - DNA, 18 bp, Homo sapiens
ccagacaaaatttgagaa

SEQ ID NO: 6039485 - DNA, 19 bp, Homo sapiens
ccagacaaataggagtgag

SEQ ID NO: 6039486 - DNA, 17 bp, Homo sapiens
ccagacaacagcccagg

SEQ ID NO: 6039487 - DNA, 13 bp, Homo sapiens
ccagacaaccaaa

SEQ ID NO: 6039488 - DNA, 16 bp, Homo sapiens
ccagacaaccaaaaca

SEQ ID NO: 6039489 - DNA, 23 bp, Homo sapiens
ccagacaacgggcccatggcctt

SEQ ID NO: 6039490 - DNA, 14 bp, Homo sapiens
ccagacaagccctg

SEQ ID NO: 6039491 - DNA, 23 bp, Homo sapiens
ccagacaagctgttgaccaggca

SEQ ID NO: 6039492 - DNA, 13 bp, Homo sapiens
ccagacaaggaga

SEQ ID NO: 6039493 - DNA, 15 bp, Homo sapiens
ccagacaaggagagc

SEQ ID NO: 6039494 - DNA, 17 bp, Homo sapiens
ccagacaattccattca

SEQ ID NO: 6039495 - DNA, 19 bp, Homo sapiens
ccagacacaccccccagtc

SEQ ID NO: 6039496 - DNA, 20 bp, Homo sapiens
ccagacacagactggcaata

SEQ ID NO: 6039497 - DNA, 16 bp, Homo sapiens
ccagacacagagacat

SEQ ID NO: 6039498 - DNA, 15 bp, Homo sapiens
ccagacacagataca

SEQ ID NO: 6039499 - DNA, 14 bp, Homo sapiens
ccagacacaggccc

SEQ ID NO: 6039500 - DNA, 15 bp, Homo sapiens
ccagacacatgggct

SEQ ID NO: 6039501 - DNA, 16 bp, Homo sapiens
ccagacacatgggctt

SEQ ID NO: 6039502 - DNA, 20 bp, Homo sapiens
ccagacacatgtccaagaag

SEQ ID NO: 6039503 - DNA, 14 bp, Homo sapiens
ccagacaccacaga

SEQ ID NO: 6039504 - DNA, 16 bp, Homo sapiens
ccagacaccacagacg

SEQ ID NO: 6039505 - DNA, 13 bp, Homo sapiens
ccagacacccagg

SEQ ID NO: 6039506 - DNA, 16 bp, Homo sapiens
ccagacacccaggact

SEQ ID NO: 6039507 - DNA, 20 bp, Homo sapiens
ccagacaccttgacagggca

SEQ ID NO: 6039508 - DNA, 13 bp, Homo sapiens
ccagacactctgc

SEQ ID NO: 6039509 - DNA, 17 bp, Homo sapiens
ccagacagacaacactg

SEQ ID NO: 6039510 - DNA, 19 bp, Homo sapiens
ccagacagacatctctgca

SEQ ID NO: 6039511 - DNA, 22 bp, Homo sapiens
ccagacagacatctctgcaccc

SEQ ID NO: 6039512 - DNA, 19 bp, Homo sapiens
ccagacagaccttcacaga

SEQ ID NO: 6039513 - DNA, 15 bp, Homo sapiens
ccagacagagatcag

SEQ ID NO: 6039514 - DNA, 19 bp, Homo sapiens
ccagacagaggcagggcag

SEQ ID NO: 6039515 - DNA, 20 bp, Homo sapiens
ccagacagaggcagggcagc

SEQ ID NO: 6039516 - DNA, 15 bp, Homo sapiens
ccagacagagtggat

SEQ ID NO: 6039517 - DNA, 13 bp, Homo sapiens
ccagacagataca

SEQ ID NO: 6039518 - DNA, 15 bp, Homo sapiens
ccagacagcacaggg

SEQ ID NO: 6039519 - DNA, 18 bp, Homo sapiens
ccagacagcacagggcag

SEQ ID NO: 6039520 - DNA, 18 bp, Homo sapiens
ccagacagccccaagctt

SEQ ID NO: 6039521 - DNA, 14 bp, Homo sapiens
ccagacagcctgta

SEQ ID NO: 6039522 - DNA, 16 bp, Homo sapiens
ccagacagcctgtttc

SEQ ID NO: 6039523 - DNA, 13 bp, Homo sapiens
ccagacaggccct

SEQ ID NO: 6039524 - DNA, 15 bp, Homo sapiens
ccagacaggccctcc

SEQ ID NO: 6039525 - DNA, 21 bp, Homo sapiens
ccagacaggccctccctgtct

SEQ ID NO: 6039526 - DNA, 12 bp, Homo sapiens
ccagacagggct

SEQ ID NO: 6039527 - DNA, 21 bp, Homo sapiens
ccagacagggctccagcctgt

SEQ ID NO: 6039528 - DNA, 17 bp, Homo sapiens
ccagacagggtggggct

SEQ ID NO: 6039529 - DNA, 22 bp, Homo sapiens
ccagacagtggatatgacccac

SEQ ID NO: 6039530 - DNA, 16 bp, Homo sapiens
ccagacagtgtgctgt

SEQ ID NO: 6039531 - DNA, 18 bp, Homo sapiens
ccagacagttcttttcta

SEQ ID NO: 6039532 - DNA, 22 bp, Homo sapiens
ccagacagtttatgagaatgac

SEQ ID NO: 6039533 - DNA, 18 bp, Homo sapiens
ccagacatacgaaacaca

SEQ ID NO: 6039534 - DNA, 20 bp, Homo sapiens
ccagacatacgaaacacaaa

SEQ ID NO: 6039535 - DNA, 19 bp, Homo sapiens
ccagacatcatgaatttta

SEQ ID NO: 6039536 - DNA, 20 bp, Homo sapiens
ccagacatgccacaaggact

SEQ ID NO: 6039537 - DNA, 18 bp, Homo sapiens
ccagacatgctgcccacc

SEQ ID NO: 6039538 - DNA, 17 bp, Homo sapiens
ccagacatggacctcca

SEQ ID NO: 6039539 - DNA, 14 bp, Homo sapiens
ccagacatggaggg

SEQ ID NO: 6039540 - DNA, 14 bp, Homo sapiens
ccagacatggtgtc

SEQ ID NO: 6039541 - DNA, 20 bp, Homo sapiens
ccagacatggtgtctcacac

SEQ ID NO: 6039542 - DNA, 13 bp, Homo sapiens
ccagacattgtat

SEQ ID NO: 6039543 - DNA, 18 bp, Homo sapiens
ccagaccaaccctgggac

SEQ ID NO: 6039544 - DNA, 20 bp, Homo sapiens
ccagaccaaccctgggacct

SEQ ID NO: 6039545 - DNA, 21 bp, Homo sapiens
ccagaccaacgttactcaggg

SEQ ID NO: 6039546 - DNA, 23 bp, Homo sapiens
ccagaccaacgttactcagggct

SEQ ID NO: 6039547 - DNA, 15 bp, Homo sapiens
ccagaccacctgcca

SEQ ID NO: 6039548 - DNA, 19 bp, Homo sapiens
ccagaccacctgccagcca

SEQ ID NO: 6039549 - DNA, 18 bp, Homo sapiens
ccagaccacgcccctgcc

SEQ ID NO: 6039550 - DNA, 13 bp, Homo sapiens
ccagaccagagct

SEQ ID NO: 6039551 - DNA, 14 bp, Homo sapiens
ccagaccagagctc

SEQ ID NO: 6039552 - DNA, 16 bp, Homo sapiens
ccagaccagagctctg

SEQ ID NO: 6039553 - DNA, 14 bp, Homo sapiens
ccagaccagtagtg

SEQ ID NO: 6039554 - DNA, 14 bp, Homo sapiens
ccagaccatggaca

SEQ ID NO: 6039555 - DNA, 15 bp, Homo sapiens
ccagaccatggacac

SEQ ID NO: 6039556 - DNA, 12 bp, Homo sapiens
ccagaccatggg

SEQ ID NO: 6039557 - DNA, 18 bp, Homo sapiens
ccagaccattgtctcaga

SEQ ID NO: 6039558 - DNA, 22 bp, Homo sapiens
ccagaccattgtcttccaaccc

SEQ ID NO: 6039559 - DNA, 18 bp, Homo sapiens
ccagacccacctggagcc

SEQ ID NO: 6039560 - DNA, 20 bp, Homo sapiens
ccagacccacctggagcccg

SEQ ID NO: 6039561 - DNA, 17 bp, Homo sapiens
ccagacccactgaaatg

SEQ ID NO: 6039562 - DNA, 17 bp, Homo sapiens
ccagacccagaggccct

SEQ ID NO: 6039563 - DNA, 19 bp, Homo sapiens
ccagacccagaggtccagg

SEQ ID NO: 6039564 - DNA, 18 bp, Homo sapiens
ccagacccagcccagcct

SEQ ID NO: 6039565 - DNA, 15 bp, Homo sapiens
ccagacccagggcag

SEQ ID NO: 6039566 - DNA, 17 bp, Homo sapiens
ccagacccatgtgctgg

SEQ ID NO: 6039567 - DNA, 18 bp, Homo sapiens
ccagacccatgtgctggg

SEQ ID NO: 6039568 - DNA, 14 bp, Homo sapiens
ccagaccccatcca

SEQ ID NO: 6039569 - DNA, 17 bp, Homo sapiens
ccagaccccatccagcc

SEQ ID NO: 6039570 - DNA, 14 bp, Homo sapiens
ccagacccccaccc

SEQ ID NO: 6039571 - DNA, 15 bp, Homo sapiens
ccagaccccccagcc

SEQ ID NO: 6039572 - DNA, 18 bp, Homo sapiens
ccagaccccccagcccct

SEQ ID NO: 6039573 - DNA, 23 bp, Homo sapiens
ccagaccccccagcccctcctcc

SEQ ID NO: 6039574 - DNA, 12 bp, Homo sapiens
ccagaccccctg

SEQ ID NO: 6039575 - DNA, 16 bp, Homo sapiens
ccagaccccctggaga

SEQ ID NO: 6039576 - DNA, 18 bp, Homo sapiens
ccagaccccctggagact

SEQ ID NO: 6039577 - DNA, 17 bp, Homo sapiens
ccagacccccttgccca

SEQ ID NO: 6039578 - DNA, 15 bp, Homo sapiens
ccagaccccgtggct

SEQ ID NO: 6039579 - DNA, 18 bp, Homo sapiens
ccagacccctctggccag

SEQ ID NO: 6039580 - DNA, 19 bp, Homo sapiens
ccagacccctctggccagg

SEQ ID NO: 6039581 - DNA, 24 bp, Homo sapiens
ccagacccctctggccaggatgga

SEQ ID NO: 6039582 - DNA, 18 bp, Homo sapiens
ccagacccctggcttttc

SEQ ID NO: 6039583 - DNA, 16 bp, Homo sapiens
ccagacccggctgcgt

SEQ ID NO: 6039584 - DNA, 17 bp, Homo sapiens
ccagacccggctgcgtg

SEQ ID NO: 6039585 - DNA, 15 bp, Homo sapiens
ccagaccctccttcc

SEQ ID NO: 6039586 - DNA, 20 bp, Homo sapiens
ccagaccctccttccccacc

SEQ ID NO: 6039587 - DNA, 22 bp, Homo sapiens
ccagaccctccttccccacccc

SEQ ID NO: 6039588 - DNA, 12 bp, Homo sapiens
ccagaccctgaa

SEQ ID NO: 6039589 - DNA, 19 bp, Homo sapiens
ccagaccctgaagatttca

SEQ ID NO: 6039590 - DNA, 21 bp, Homo sapiens
ccagaccctgaagatttcaga

SEQ ID NO: 6039591 - DNA, 18 bp, Homo sapiens
ccagaccctgcctgagcc

SEQ ID NO: 6039592 - DNA, 13 bp, Homo sapiens
ccagaccctgggc

SEQ ID NO: 6039593 - DNA, 21 bp, Homo sapiens
ccagacccttcttgcctgctg

SEQ ID NO: 6039594 - DNA, 23 bp, Homo sapiens
ccagaccgaaaagttgctgaaag

SEQ ID NO: 6039595 - DNA, 19 bp, Homo sapiens
ccagaccgtcgcacccaca

SEQ ID NO: 6039596 - DNA, 19 bp, Homo sapiens
ccagacctagacctgggcc

SEQ ID NO: 6039597 - DNA, 18 bp, Homo sapiens
ccagacctagcaggctgt

SEQ ID NO: 6039598 - DNA, 22 bp, Homo sapiens
ccagacctatatctggagtgag

SEQ ID NO: 6039599 - DNA, 17 bp, Homo sapiens
ccagacctcacctccat

SEQ ID NO: 6039600 - DNA, 21 bp, Homo sapiens
ccagacctctgaatgtcccag

SEQ ID NO: 6039601 - DNA, 15 bp, Homo sapiens
ccagacctgagctcc

SEQ ID NO: 6039602 - DNA, 15 bp, Homo sapiens
ccagacctgatcctg

SEQ ID NO: 6039603 - DNA, 21 bp, Homo sapiens
ccagacctgatcctggaggcc

SEQ ID NO: 6039604 - DNA, 24 bp, Homo sapiens
ccagacctgatcctggaggcccag

SEQ ID NO: 6039605 - DNA, 14 bp, Homo sapiens
ccagacctgcatgg

SEQ ID NO: 6039606 - DNA, 13 bp, Homo sapiens
ccagacctgcccc

SEQ ID NO: 6039607 - DNA, 18 bp, Homo sapiens
ccagacctgcccctccct

SEQ ID NO: 6039608 - DNA, 18 bp, Homo sapiens
ccagacctgcctgtctcc

SEQ ID NO: 6039609 - DNA, 12 bp, Homo sapiens
ccagacctggcc

SEQ ID NO: 6039610 - DNA, 19 bp, Homo sapiens
ccagacctggcctctgcca

SEQ ID NO: 6039611 - DNA, 13 bp, Homo sapiens
ccagacctggctc

SEQ ID NO: 6039612 - DNA, 13 bp, Homo sapiens
ccagacctgggcc

SEQ ID NO: 6039613 - DNA, 15 bp, Homo sapiens
ccagacctgtcgtct

SEQ ID NO: 6039614 - DNA, 23 bp, Homo sapiens
ccagacctgttagcagacaggcc

SEQ ID NO: 6039615 - DNA, 13 bp, Homo sapiens
ccagacctgttct

SEQ ID NO: 6039616 - DNA, 23 bp, Homo sapiens
ccagaccttaagacactgtgaga

SEQ ID NO: 6039617 - DNA, 15 bp, Homo sapiens
ccagaccttaataaa

SEQ ID NO: 6039618 - DNA, 14 bp, Homo sapiens
ccagaccttttatc

SEQ ID NO: 6039619 - DNA, 20 bp, Homo sapiens
ccagacgatgtcttcatacc

SEQ ID NO: 6039620 - DNA, 16 bp, Homo sapiens
ccagacgccttcctct

SEQ ID NO: 6039621 - DNA, 19 bp, Homo sapiens
ccagacgctcattcagcat

SEQ ID NO: 6039622 - DNA, 24 bp, Homo sapiens
ccagacgctgccgctgccgctgca

SEQ ID NO: 6039623 - DNA, 16 bp, Homo sapiens
ccagacggcacccacc

SEQ ID NO: 6039624 - DNA, 15 bp, Homo sapiens
ccagacggggctgga

SEQ ID NO: 6039625 - DNA, 18 bp, Homo sapiens
ccagacggttcaccagcc

SEQ ID NO: 6039626 - DNA, 17 bp, Homo sapiens
ccagacgtcaggccctg

SEQ ID NO: 6039627 - DNA, 19 bp, Homo sapiens
ccagacgtggtgcttctca

SEQ ID NO: 6039628 - DNA, 23 bp, Homo sapiens
ccagactaaaggatccagagagc

SEQ ID NO: 6039629 - DNA, 23 bp, Homo sapiens
ccagactaacatgtcagttttat

SEQ ID NO: 6039630 - DNA, 12 bp, Homo sapiens
ccagactacagg

SEQ ID NO: 6039631 - DNA, 22 bp, Homo sapiens
ccagactagatgtagtattttt

SEQ ID NO: 6039632 - DNA, 12 bp, Homo sapiens
ccagactattcc

SEQ ID NO: 6039633 - DNA, 16 bp, Homo sapiens
ccagactattccctag

SEQ ID NO: 6039634 - DNA, 16 bp, Homo sapiens
ccagactcacttgcca

SEQ ID NO: 6039635 - DNA, 23 bp, Homo sapiens
ccagactcagagctctctctaca

SEQ ID NO: 6039636 - DNA, 14 bp, Homo sapiens
ccagactcagcaga

SEQ ID NO: 6039637 - DNA, 15 bp, Homo sapiens
ccagactcagcagag

SEQ ID NO: 6039638 - DNA, 13 bp, Homo sapiens
ccagactcagctc

SEQ ID NO: 6039639 - DNA, 14 bp, Homo sapiens
ccagactcagctcc

SEQ ID NO: 6039640 - DNA, 17 bp, Homo sapiens
ccagactcaggttccag

SEQ ID NO: 6039641 - DNA, 18 bp, Homo sapiens
ccagactccaccaagcct

SEQ ID NO: 6039642 - DNA, 13 bp, Homo sapiens
ccagactccaggc

SEQ ID NO: 6039643 - DNA, 15 bp, Homo sapiens
ccagactccaggccc

SEQ ID NO: 6039644 - DNA, 16 bp, Homo sapiens
ccagactccaggcccc

SEQ ID NO: 6039645 - DNA, 18 bp, Homo sapiens
ccagactccaggcccccg

SEQ ID NO: 6039646 - DNA, 21 bp, Homo sapiens
ccagactccgcctgaggccag

SEQ ID NO: 6039647 - DNA, 19 bp, Homo sapiens
ccagactcctttcctctga

SEQ ID NO: 6039648 - DNA, 16 bp, Homo sapiens
ccagactcgagagggc

SEQ ID NO: 6039649 - DNA, 13 bp, Homo sapiens
ccagactctgcct

SEQ ID NO: 6039650 - DNA, 14 bp, Homo sapiens
ccagactctgccta

SEQ ID NO: 6039651 - DNA, 15 bp, Homo sapiens
ccagactcttgcctg

SEQ ID NO: 6039652 - DNA, 18 bp, Homo sapiens
ccagactctttttttgag

SEQ ID NO: 6039653 - DNA, 24 bp, Homo sapiens
ccagactgagctctccaggccagg

SEQ ID NO: 6039654 - DNA, 17 bp, Homo sapiens
catctactctaaagaaa

SEQ ID NO: 6039655 - DNA, 16 bp, Homo sapiens
catctactcttttgaa

SEQ ID NO: 6039656 - DNA, 19 bp, Homo sapiens
catctactggataaacttg

SEQ ID NO: 6039657 - DNA, 14 bp, Homo sapiens
catctacttcaggc

SEQ ID NO: 6039658 - DNA, 19 bp, Homo sapiens
catctacttggcaaggtca

SEQ ID NO: 6039659 - DNA, 21 bp, Homo sapiens
catctagagattttcttggca

SEQ ID NO: 6039660 - DNA, 20 bp, Homo sapiens
catctagaggcttccttcat

SEQ ID NO: 6039661 - DNA, 18 bp, Homo sapiens
catctagcaaatgttatg

SEQ ID NO: 6039662 - DNA, 12 bp, Homo sapiens
catctagcccct

SEQ ID NO: 6039663 - DNA, 15 bp, Homo sapiens
catctaggatgattt

SEQ ID NO: 6039664 - DNA, 19 bp, Homo sapiens
catctaggggagccttgat

SEQ ID NO: 6039665 - DNA, 18 bp, Homo sapiens
catctaggtaaattacag

SEQ ID NO: 6039666 - DNA, 18 bp, Homo sapiens
catctaggtcctggctgg

SEQ ID NO: 6039667 - DNA, 16 bp, Homo sapiens
catctagtcttgacct

SEQ ID NO: 6039668 - DNA, 18 bp, Homo sapiens
catctagtcttgacctct

SEQ ID NO: 6039669 - DNA, 14 bp, Homo sapiens
catctagtgagcag

SEQ ID NO: 6039670 - DNA, 17 bp, Homo sapiens
catctagttaagtcgct

SEQ ID NO: 6039671 - DNA, 22 bp, Homo sapiens
catctagttaagtcgctgaaca

SEQ ID NO: 6039672 - DNA, 23 bp, Homo sapiens
catctagtttccctggtgccctt

SEQ ID NO: 6039673 - DNA, 22 bp, Homo sapiens
catctataatgtcagcttatcc

SEQ ID NO: 6039674 - DNA, 20 bp, Homo sapiens
catctatagataacggctct

SEQ ID NO: 6039675 - DNA, 23 bp, Homo sapiens
catctatagataacggctctcca

SEQ ID NO: 6039676 - DNA, 13 bp, Homo sapiens
catctatcactgc

SEQ ID NO: 6039677 - DNA, 14 bp, Homo sapiens
catctatcactgca

SEQ ID NO: 6039678 - DNA, 15 bp, Homo sapiens
catctatcactgcat

SEQ ID NO: 6039679 - DNA, 19 bp, Homo sapiens
catctatcactgcattatc

SEQ ID NO: 6039680 - DNA, 16 bp, Homo sapiens
catctatccacactgt

SEQ ID NO: 6039681 - DNA, 17 bp, Homo sapiens
catctatctagttctaa

SEQ ID NO: 6039682 - DNA, 15 bp, Homo sapiens
catctatctcaatcc

SEQ ID NO: 6039683 - DNA, 20 bp, Homo sapiens
catctatctcatctatctca

SEQ ID NO: 6039684 - DNA, 19 bp, Homo sapiens
catctatctggtgatttct

SEQ ID NO: 6039685 - DNA, 19 bp, Homo sapiens
catctatgagggtgtttcc

SEQ ID NO: 6039686 - DNA, 20 bp, Homo sapiens
catctatgagggtgtttcct

SEQ ID NO: 6039687 - DNA, 20 bp, Homo sapiens
catctatgctctttcctgtc

SEQ ID NO: 6039688 - DNA, 21 bp, Homo sapiens
catctatgctctttcctgtct

SEQ ID NO: 6039689 - DNA, 22 bp, Homo sapiens
catctatggcagtccagccagc

SEQ ID NO: 6039690 - DNA, 16 bp, Homo sapiens
catctatggttctaaa

SEQ ID NO: 6039691 - DNA, 21 bp, Homo sapiens
catctatggttctaaatattg

SEQ ID NO: 6039692 - DNA, 19 bp, Homo sapiens
catctatgtcccttgctgt

SEQ ID NO: 6039693 - DNA, 14 bp, Homo sapiens
catctatgtgaata

SEQ ID NO: 6039694 - DNA, 21 bp, Homo sapiens
catctatgtgaatatttgtaa

SEQ ID NO: 6039695 - DNA, 19 bp, Homo sapiens
catctattataaaaccatg

SEQ ID NO: 6039696 - DNA, 14 bp, Homo sapiens
catctattcccaaa

SEQ ID NO: 6039697 - DNA, 17 bp, Homo sapiens
catctattcccaaagaa

SEQ ID NO: 6039698 - DNA, 17 bp, Homo sapiens
catctattctttcccta

SEQ ID NO: 6039699 - DNA, 23 bp, Homo sapiens
catctattctttccctagaggca

SEQ ID NO: 6039700 - DNA, 16 bp, Homo sapiens
catctattttatttta

SEQ ID NO: 6039701 - DNA, 14 bp, Homo sapiens
catctattttctca

SEQ ID NO: 6039702 - DNA, 20 bp, Homo sapiens
catctattttctcagaatct

SEQ ID NO: 6039703 - DNA, 11 bp, Homo sapiens
catctattttg

SEQ ID NO: 6039704 - DNA, 15 bp, Homo sapiens
catctcaaaacaaaa

SEQ ID NO: 6039705 - DNA, 18 bp, Homo sapiens
catctcaaaacagagggc

SEQ ID NO: 6039706 - DNA, 17 bp, Homo sapiens
catctcaaacactgctt

SEQ ID NO: 6039707 - DNA, 15 bp, Homo sapiens
catctcaaatgtttt

SEQ ID NO: 6039708 - DNA, 16 bp, Homo sapiens
catctcaaatgttttc

SEQ ID NO: 6039709 - DNA, 17 bp, Homo sapiens
catctcaaatgttttct

SEQ ID NO: 6039710 - DNA, 15 bp, Homo sapiens
catctcaacaggcct

SEQ ID NO: 6039711 - DNA, 22 bp, Homo sapiens
catctcaacaggcctcagggct

SEQ ID NO: 6039712 - DNA, 14 bp, Homo sapiens
catctcaaccatcc

SEQ ID NO: 6039713 - DNA, 19 bp, Homo sapiens
catctcaacctacctcgag

SEQ ID NO: 6039714 - DNA, 21 bp, Homo sapiens
catctcaagatgtttatctga

SEQ ID NO: 6039715 - DNA, 22 bp, Homo sapiens
catctcaagcaagtttaatcaa

SEQ ID NO: 6039716 - DNA, 17 bp, Homo sapiens
catctcaatggaaacat

SEQ ID NO: 6039717 - DNA, 22 bp, Homo sapiens
catctcaatggaaacatcactg

SEQ ID NO: 6039718 - DNA, 16 bp, Homo sapiens
catctcaattgtgctt

SEQ ID NO: 6039719 - DNA, 16 bp, Homo sapiens
catctcacacatgagc

SEQ ID NO: 6039720 - DNA, 17 bp, Homo sapiens
catctcactttaataat

SEQ ID NO: 6039721 - DNA, 12 bp, Homo sapiens
catctcagaaga

SEQ ID NO: 6039722 - DNA, 13 bp, Homo sapiens
catctcagaccct

SEQ ID NO: 6039723 - DNA, 15 bp, Homo sapiens
catctcagaccctgc

SEQ ID NO: 6039724 - DNA, 18 bp, Homo sapiens
catctcagaccctttagc

SEQ ID NO: 6039725 - DNA, 13 bp, Homo sapiens
catctcagatgcc

SEQ ID NO: 6039726 - DNA, 15 bp, Homo sapiens
catctcagattctgt

SEQ ID NO: 6039727 - DNA, 19 bp, Homo sapiens
catctcagcctcctgagcc

SEQ ID NO: 6039728 - DNA, 22 bp, Homo sapiens
catctcagcctcctgagcctgt

SEQ ID NO: 6039729 - DNA, 20 bp, Homo sapiens
catctcagctcactgcaacc

SEQ ID NO: 6039730 - DNA, 21 bp, Homo sapiens
catctcagctcatcttcactg

SEQ ID NO: 6039731 - DNA, 22 bp, Homo sapiens
catctcagcttttctgtccctt

SEQ ID NO: 6039732 - DNA, 13 bp, Homo sapiens
catctcaggaggg

SEQ ID NO: 6039733 - DNA, 21 bp, Homo sapiens
catctcaggaggggcagcgca

SEQ ID NO: 6039734 - DNA, 14 bp, Homo sapiens
catctcaggccaga

SEQ ID NO: 6039735 - DNA, 17 bp, Homo sapiens
catctcaggccagagcc

SEQ ID NO: 6039736 - DNA, 18 bp, Homo sapiens
catctcaggccagagcca

SEQ ID NO: 6039737 - DNA, 12 bp, Homo sapiens
catctcagggaa

SEQ ID NO: 6039738 - DNA, 12 bp, Homo sapiens
catctcaggggc

SEQ ID NO: 6039739 - DNA, 14 bp, Homo sapiens
catctcaggtgcca

SEQ ID NO: 6039740 - DNA, 16 bp, Homo sapiens
catctcaggtgccact

SEQ ID NO: 6039741 - DNA, 17 bp, Homo sapiens
catctcaggtgccactc

SEQ ID NO: 6039742 - DNA, 16 bp, Homo sapiens
catctcagtcctcaaa

SEQ ID NO: 6039743 - DNA, 17 bp, Homo sapiens
catctcatcctggcacg

SEQ ID NO: 6039744 - DNA, 18 bp, Homo sapiens
catctcatcctggcacgc

SEQ ID NO: 6039745 - DNA, 21 bp, Homo sapiens
catctcatcctggcacgccct

SEQ ID NO: 6039746 - DNA, 20 bp, Homo sapiens
catctcattacccttttctg

SEQ ID NO: 6039747 - DNA, 20 bp, Homo sapiens
catctcatttaagggaaaaa

SEQ ID NO: 6039748 - DNA, 16 bp, Homo sapiens
catctccaaaaacagt

SEQ ID NO: 6039749 - DNA, 16 bp, Homo sapiens
catctccaagaatgct

SEQ ID NO: 6039750 - DNA, 17 bp, Homo sapiens
catctccaagaatgctg

SEQ ID NO: 6039751 - DNA, 21 bp, Homo sapiens
catctccaagataagcctgag

SEQ ID NO: 6039752 - DNA, 19 bp, Homo sapiens
catctccaccctgagcctg

SEQ ID NO: 6039753 - DNA, 16 bp, Homo sapiens
catctccacctgctcc

SEQ ID NO: 6039754 - DNA, 20 bp, Homo sapiens
catctccacctgctcccagg

SEQ ID NO: 6039755 - DNA, 23 bp, Homo sapiens
catctccagcattctcagccaca

SEQ ID NO: 6039756 - DNA, 17 bp, Homo sapiens
catctccagctggatcc

SEQ ID NO: 6039757 - DNA, 11 bp, Homo sapiens
catctccaggg

SEQ ID NO: 6039758 - DNA, 12 bp, Homo sapiens
catctccaggga

SEQ ID NO: 6039759 - DNA, 17 bp, Homo sapiens
catctccagggagtccc

SEQ ID NO: 6039760 - DNA, 21 bp, Homo sapiens
catctccagggagtcccctcc

SEQ ID NO: 6039761 - DNA, 20 bp, Homo sapiens
catctccagtatcctgctgg

SEQ ID NO: 6039762 - DNA, 14 bp, Homo sapiens
catctccatcagct

SEQ ID NO: 6039763 - DNA, 15 bp, Homo sapiens
catctccatcagctg

SEQ ID NO: 6039764 - DNA, 19 bp, Homo sapiens
catctccatcatatgcctg

SEQ ID NO: 6039765 - DNA, 14 bp, Homo sapiens
catctccatgctct

SEQ ID NO: 6039766 - DNA, 21 bp, Homo sapiens
catctccatgtagaataaatg

SEQ ID NO: 6039767 - DNA, 22 bp, Homo sapiens
catctccatgtagaataaatga

SEQ ID NO: 6039768 - DNA, 23 bp, Homo sapiens
catctccatttcacacaggtcct

SEQ ID NO: 6039769 - DNA, 16 bp, Homo sapiens
catctcccaaggctgc

SEQ ID NO: 6039770 - DNA, 21 bp, Homo sapiens
catctcccacgaactcaaggg

SEQ ID NO: 6039771 - DNA, 22 bp, Homo sapiens
catctcccacgaactcaagggt

SEQ ID NO: 6039772 - DNA, 20 bp, Homo sapiens
catctcccaggccccagggg

SEQ ID NO: 6039773 - DNA, 18 bp, Homo sapiens
catctccccaggcctcca

SEQ ID NO: 6039774 - DNA, 19 bp, Homo sapiens
catctccccaggcctccag

SEQ ID NO: 6039775 - DNA, 22 bp, Homo sapiens
catctccccaggcctccagcct

SEQ ID NO: 6039776 - DNA, 16 bp, Homo sapiens
catctcccccaccctg

SEQ ID NO: 6039777 - DNA, 17 bp, Homo sapiens
catctcccccaccctgt

SEQ ID NO: 6039778 - DNA, 21 bp, Homo sapiens
catctcccccaccctgtgccc

SEQ ID NO: 6039779 - DNA, 15 bp, Homo sapiens
catctcccctagctc

SEQ ID NO: 6039780 - DNA, 17 bp, Homo sapiens
catctcccctagctcac

SEQ ID NO: 6039781 - DNA, 13 bp, Homo sapiens
catctcccctcag

SEQ ID NO: 6039782 - DNA, 17 bp, Homo sapiens
catctcccctcagctcg

SEQ ID NO: 6039783 - DNA, 17 bp, Homo sapiens
catctcccctttgctaa

SEQ ID NO: 6039784 - DNA, 15 bp, Homo sapiens
catctccctcccaca

SEQ ID NO: 6039785 - DNA, 17 bp, Homo sapiens
catctccctcctccagg

SEQ ID NO: 6039786 - DNA, 23 bp, Homo sapiens
catctccctcgaacccacactgc

SEQ ID NO: 6039787 - DNA, 21 bp, Homo sapiens
catctccctgaccttctccag

SEQ ID NO: 6039788 - DNA, 18 bp, Homo sapiens
catctccctgccatcccc

SEQ ID NO: 6039789 - DNA, 13 bp, Homo sapiens
catctccctgcct

SEQ ID NO: 6039790 - DNA, 19 bp, Homo sapiens
catctccctgcctggcccc

SEQ ID NO: 6039791 - DNA, 12 bp, Homo sapiens
catctccctgct

SEQ ID NO: 6039792 - DNA, 14 bp, Homo sapiens
catctcccttcatt

SEQ ID NO: 6039793 - DNA, 15 bp, Homo sapiens
catctcccttccacc

SEQ ID NO: 6039794 - DNA, 22 bp, Homo sapiens
catctcccttcctgtgggagca

SEQ ID NO: 6039795 - DNA, 23 bp, Homo sapiens
catctcctcccatggccttccct

SEQ ID NO: 6039796 - DNA, 13 bp, Homo sapiens
catctcctctccc

SEQ ID NO: 6039797 - DNA, 16 bp, Homo sapiens
catctcctgaccctcc

SEQ ID NO: 6039798 - DNA, 17 bp, Homo sapiens
catctcctgaccctccc

SEQ ID NO: 6039799 - DNA, 21 bp, Homo sapiens
catctcctgaccctcccactc

SEQ ID NO: 6039800 - DNA, 22 bp, Homo sapiens
catctcctgaggatcagaaagt

SEQ ID NO: 6039801 - DNA, 14 bp, Homo sapiens
catctcctgatttc

SEQ ID NO: 6039802 - DNA, 15 bp, Homo sapiens
catctcctgatttct

SEQ ID NO: 6039803 - DNA, 14 bp, Homo sapiens
catctcctgctcac

SEQ ID NO: 6039804 - DNA, 15 bp, Homo sapiens
catctcctgctcacc

SEQ ID NO: 6039805 - DNA, 17 bp, Homo sapiens
catctcctgctcaccac

SEQ ID NO: 6039806 - DNA, 20 bp, Homo sapiens
catctcctgctcaccacctg

SEQ ID NO: 6039807 - DNA, 12 bp, Homo sapiens
catctcctggct

SEQ ID NO: 6039808 - DNA, 13 bp, Homo sapiens
catctcctggcta

SEQ ID NO: 6039809 - DNA, 20 bp, Homo sapiens
catctcctggctaagcctct

SEQ ID NO: 6039810 - DNA, 21 bp, Homo sapiens
catctcctggctaagcctctg

SEQ ID NO: 6039811 - DNA, 12 bp, Homo sapiens
catctcctgtcc

SEQ ID NO: 6039812 - DNA, 20 bp, Homo sapiens
catctcctgtgcatgggtga

SEQ ID NO: 6039813 - DNA, 12 bp, Homo sapiens
catctccttccc

SEQ ID NO: 6039814 - DNA, 19 bp, Homo sapiens
catctccttcccccagccc

SEQ ID NO: 6039815 - DNA, 22 bp, Homo sapiens
catctccttcccccagcccaat

SEQ ID NO: 6039816 - DNA, 16 bp, Homo sapiens
catctccttgactgcc

SEQ ID NO: 6039817 - DNA, 13 bp, Homo sapiens
catctcctttgct

SEQ ID NO: 6039818 - DNA, 22 bp, Homo sapiens
catctcgccacccctccttcct

SEQ ID NO: 6039819 - DNA, 14 bp, Homo sapiens
catctcgctccctc

SEQ ID NO: 6039820 - DNA, 15 bp, Homo sapiens
catctcggagcatcc

SEQ ID NO: 6039821 - DNA, 15 bp, Homo sapiens
catctcggctcactg

SEQ ID NO: 6039822 - DNA, 16 bp, Homo sapiens
catctcggctcactgc

SEQ ID NO: 6039823 - DNA, 22 bp, Homo sapiens
catctcgggagtcctctagcag

SEQ ID NO: 6039824 - DNA, 16 bp, Homo sapiens
catctcggggctgctg

SEQ ID NO: 6039825 - DNA, 21 bp, Homo sapiens
catctctaacagctcaggatc

SEQ ID NO: 6039826 - DNA, 15 bp, Homo sapiens
catctctaaggctaa

SEQ ID NO: 6039827 - DNA, 18 bp, Homo sapiens
catctctaaggctaagga

SEQ ID NO: 6039828 - DNA, 19 bp, Homo sapiens
catctctaattggaagaaa

SEQ ID NO: 6039829 - DNA, 16 bp, Homo sapiens
catctctaattttgga

SEQ ID NO: 6039830 - DNA, 15 bp, Homo sapiens
catctctaccatcat

SEQ ID NO: 6039831 - DNA, 21 bp, Homo sapiens
catctctaccatcatccggtt

SEQ ID NO: 6039832 - DNA, 13 bp, Homo sapiens
ccagactgcaggt

SEQ ID NO: 6039833 - DNA, 13 bp, Homo sapiens
ccagactggaaga

SEQ ID NO: 6039834 - DNA, 12 bp, Homo sapiens
ccagactggctg

SEQ ID NO: 6039835 - DNA, 14 bp, Homo sapiens
ccagactggctgca

SEQ ID NO: 6039836 - DNA, 18 bp, Homo sapiens
ccagactggctgcacagc

SEQ ID NO: 6039837 - DNA, 19 bp, Homo sapiens
ccagactggctgcacagcc

SEQ ID NO: 6039838 - DNA, 22 bp, Homo sapiens
ccagactggctgcacagcccaa

SEQ ID NO: 6039839 - DNA, 23 bp, Homo sapiens
ccagactggctgcacagcccaac

SEQ ID NO: 6039840 - DNA, 13 bp, Homo sapiens
ccagactgggccc

SEQ ID NO: 6039841 - DNA, 17 bp, Homo sapiens
ccagactgggcccaggc

SEQ ID NO: 6039842 - DNA, 20 bp, Homo sapiens
ccagactgggcccaggcagg

SEQ ID NO: 6039843 - DNA, 14 bp, Homo sapiens
ccagactgtccagg

SEQ ID NO: 6039844 - DNA, 18 bp, Homo sapiens
ccagactgtggagaaata

SEQ ID NO: 6039845 - DNA, 13 bp, Homo sapiens
ccagacttcaaga

SEQ ID NO: 6039846 - DNA, 20 bp, Homo sapiens
ccagacttcgctattcccag

SEQ ID NO: 6039847 - DNA, 21 bp, Homo sapiens
ccagacttcgctattcccagg

SEQ ID NO: 6039848 - DNA, 24 bp, Homo sapiens
ccagacttcgctattcccaggcag

SEQ ID NO: 6039849 - DNA, 23 bp, Homo sapiens
ccagacttctaaaataaatgttt

SEQ ID NO: 6039850 - DNA, 16 bp, Homo sapiens
ccagacttctggagga

SEQ ID NO: 6039851 - DNA, 17 bp, Homo sapiens
ccagacttgggagcttt

SEQ ID NO: 6039852 - DNA, 18 bp, Homo sapiens
ccagacttgtttcctgtg

SEQ ID NO: 6039853 - DNA, 22 bp, Homo sapiens
ccagactttacatgacacagct

SEQ ID NO: 6039854 - DNA, 17 bp, Homo sapiens
ccagactttagtgccct

SEQ ID NO: 6039855 - DNA, 16 bp, Homo sapiens
ccagactttctacacc

SEQ ID NO: 6039856 - DNA, 20 bp, Homo sapiens
ccagactttctacacctgtt

SEQ ID NO: 6039857 - DNA, 15 bp, Homo sapiens
ccagagaaaattaat

SEQ ID NO: 6039858 - DNA, 18 bp, Homo sapiens
ccagagaaaattaattat

SEQ ID NO: 6039859 - DNA, 18 bp, Homo sapiens
ccagagaaacccagggag

SEQ ID NO: 6039860 - DNA, 12 bp, Homo sapiens
ccagagaaagca

SEQ ID NO: 6039861 - DNA, 23 bp, Homo sapiens
ccagagaaaggggagcccactgt

SEQ ID NO: 6039862 - DNA, 23 bp, Homo sapiens
ccagagaacccagcccacccccg

SEQ ID NO: 6039863 - DNA, 16 bp, Homo sapiens
ccagagaactgcagac

SEQ ID NO: 6039864 - DNA, 15 bp, Homo sapiens
ccagagaagccccgc

SEQ ID NO: 6039865 - DNA, 23 bp, Homo sapiens
ccagagaagccccgcacgggctg

SEQ ID NO: 6039866 - DNA, 16 bp, Homo sapiens
ccagagaagcgctgtt

SEQ ID NO: 6039867 - DNA, 20 bp, Homo sapiens
ccagagaagctggaagcctg

SEQ ID NO: 6039868 - DNA, 18 bp, Homo sapiens
ccagagaagtctggtcag

SEQ ID NO: 6039869 - DNA, 21 bp, Homo sapiens
ccagagaagtctggtcagagc

SEQ ID NO: 6039870 - DNA, 18 bp, Homo sapiens
ccagagaatcagggcagg

SEQ ID NO: 6039871 - DNA, 16 bp, Homo sapiens
ccagagaattcttaga

SEQ ID NO: 6039872 - DNA, 13 bp, Homo sapiens
ccagagacactga

SEQ ID NO: 6039873 - DNA, 17 bp, Homo sapiens
ccagagacactgagcca

SEQ ID NO: 6039874 - DNA, 20 bp, Homo sapiens
ccagagacactgagccagtc

SEQ ID NO: 6039875 - DNA, 22 bp, Homo sapiens
ccagagacactgagccagtctt

SEQ ID NO: 6039876 - DNA, 12 bp, Homo sapiens
ccagagacagga

SEQ ID NO: 6039877 - DNA, 14 bp, Homo sapiens
ccagagacaggaaa

SEQ ID NO: 6039878 - DNA, 23 bp, Homo sapiens
ccagagacaggaaaatcctctgg

SEQ ID NO: 6039879 - DNA, 18 bp, Homo sapiens
ccagagacaggaaagaat

SEQ ID NO: 6039880 - DNA, 10 bp, Homo sapiens
ccagagacat

SEQ ID NO: 6039881 - DNA, 23 bp, Homo sapiens
ccagagacatacttgaagggcca

SEQ ID NO: 6039882 - DNA, 13 bp, Homo sapiens
ccagagacatgtg

SEQ ID NO: 6039883 - DNA, 16 bp, Homo sapiens
ccagagaccacaccac

SEQ ID NO: 6039884 - DNA, 17 bp, Homo sapiens
ccagagaccccttcctt

SEQ ID NO: 6039885 - DNA, 20 bp, Homo sapiens
ccagagaccccttcctttcc

SEQ ID NO: 6039886 - DNA, 21 bp, Homo sapiens
ccagagaccccttcctttcct

SEQ ID NO: 6039887 - DNA, 19 bp, Homo sapiens
ccagagacctcatcagcct

SEQ ID NO: 6039888 - DNA, 16 bp, Homo sapiens
ccagagacctgctcca

SEQ ID NO: 6039889 - DNA, 19 bp, Homo sapiens
ccagagacctgctccagat

SEQ ID NO: 6039890 - DNA, 20 bp, Homo sapiens
ccagagacctgctccagatc

SEQ ID NO: 6039891 - DNA, 14 bp, Homo sapiens
ccagagaccttctg

SEQ ID NO: 6039892 - DNA, 22 bp, Homo sapiens
ccagagaccttttctctcccat

SEQ ID NO: 6039893 - DNA, 19 bp, Homo sapiens
ccagagacgcccagcccca

SEQ ID NO: 6039894 - DNA, 19 bp, Homo sapiens
ccagagactcgagtcccca

SEQ ID NO: 6039895 - DNA, 13 bp, Homo sapiens
ccagagactgccc

SEQ ID NO: 6039896 - DNA, 16 bp, Homo sapiens
ccagagactgcccacc

SEQ ID NO: 6039897 - DNA, 17 bp, Homo sapiens
ccagagactgcccaccc

SEQ ID NO: 6039898 - DNA, 18 bp, Homo sapiens
ccagagactgcccaccct

SEQ ID NO: 6039899 - DNA, 17 bp, Homo sapiens
ccagagagaaaaagaga

SEQ ID NO: 6039900 - DNA, 21 bp, Homo sapiens
ccagagagaaaaagagagagc

SEQ ID NO: 6039901 - DNA, 20 bp, Homo sapiens
ccagagagaaatcaggcctg

SEQ ID NO: 6039902 - DNA, 21 bp, Homo sapiens
ccagagagaacaacaggcagg

SEQ ID NO: 6039903 - DNA, 22 bp, Homo sapiens
ccagagagaagagccccactct

SEQ ID NO: 6039904 - DNA, 14 bp, Homo sapiens
ccagagagagaagt

SEQ ID NO: 6039905 - DNA, 19 bp, Homo sapiens
ccagagagagaagtgcccc

SEQ ID NO: 6039906 - DNA, 22 bp, Homo sapiens
ccagagagcaaacataggaata

SEQ ID NO: 6039907 - DNA, 23 bp, Homo sapiens
ccagagagcaaacataggaatat

SEQ ID NO: 6039908 - DNA, 20 bp, Homo sapiens
ccagagagcaggcaggggca

SEQ ID NO: 6039909 - DNA, 21 bp, Homo sapiens
ccagagagcaggcaggggcat

SEQ ID NO: 6039910 - DNA, 17 bp, Homo sapiens
ccagagagcaggggagc

SEQ ID NO: 6039911 - DNA, 19 bp, Homo sapiens
ccagagagcaggggagctt

SEQ ID NO: 6039912 - DNA, 15 bp, Homo sapiens
ccagagagcctccct

SEQ ID NO: 6039913 - DNA, 21 bp, Homo sapiens
ccagagagcctggtgctgctg

SEQ ID NO: 6039914 - DNA, 16 bp, Homo sapiens
ccagagaggaatcaga

SEQ ID NO: 6039915 - DNA, 13 bp, Homo sapiens
ccagagaggacct

SEQ ID NO: 6039916 - DNA, 14 bp, Homo sapiens
ccagagaggagcac

SEQ ID NO: 6039917 - DNA, 17 bp, Homo sapiens
ccagagaggagcacctg

SEQ ID NO: 6039918 - DNA, 16 bp, Homo sapiens
ccagagaggcactcag

SEQ ID NO: 6039919 - DNA, 14 bp, Homo sapiens
ccagagagggaaaa

SEQ ID NO: 6039920 - DNA, 16 bp, Homo sapiens
ccagagagggcccagc

SEQ ID NO: 6039921 - DNA, 21 bp, Homo sapiens
ccagagaggggacatttccct

SEQ ID NO: 6039922 - DNA, 22 bp, Homo sapiens
ccagagaggggacatttccctc

SEQ ID NO: 6039923 - DNA, 14 bp, Homo sapiens
ccagagagggtggt

SEQ ID NO: 6039924 - DNA, 21 bp, Homo sapiens
ccagagagggtggtgacctct

SEQ ID NO: 6039925 - DNA, 15 bp, Homo sapiens
ccagagagtcctctg

SEQ ID NO: 6039926 - DNA, 18 bp, Homo sapiens
ccagagagtcctctggat

SEQ ID NO: 6039927 - DNA, 16 bp, Homo sapiens
ccagagagtggagaga

SEQ ID NO: 6039928 - DNA, 18 bp, Homo sapiens
ccagagagtggagagagc

SEQ ID NO: 6039929 - DNA, 18 bp, Homo sapiens
ccagagagtggctcctcc

SEQ ID NO: 6039930 - DNA, 14 bp, Homo sapiens
ccagagataaaaat

SEQ ID NO: 6039931 - DNA, 23 bp, Homo sapiens
ccagagatgactattacttttct

SEQ ID NO: 6039932 - DNA, 14 bp, Homo sapiens
ccagagatgcaata

SEQ ID NO: 6039933 - DNA, 19 bp, Homo sapiens
ccagagatgccagcccttc

SEQ ID NO: 6039934 - DNA, 20 bp, Homo sapiens
ccagagatgccagcccttca

SEQ ID NO: 6039935 - DNA, 18 bp, Homo sapiens
ccagagatgcctccaccg

SEQ ID NO: 6039936 - DNA, 12 bp, Homo sapiens
ccagagatgtca

SEQ ID NO: 6039937 - DNA, 13 bp, Homo sapiens
ccagagattagcc

SEQ ID NO: 6039938 - DNA, 19 bp, Homo sapiens
ccagagcaaccagaaggag

SEQ ID NO: 6039939 - DNA, 15 bp, Homo sapiens
ccagagcaacctctc

SEQ ID NO: 6039940 - DNA, 16 bp, Homo sapiens
ccagagcaacctctca

SEQ ID NO: 6039941 - DNA, 20 bp, Homo sapiens
ccagagcacaagaaggccag

SEQ ID NO: 6039942 - DNA, 16 bp, Homo sapiens
ccagagcacaggagct

SEQ ID NO: 6039943 - DNA, 19 bp, Homo sapiens
ccagagcacccagatcaga

SEQ ID NO: 6039944 - DNA, 23 bp, Homo sapiens
ccagagcaccccctgctccacca

SEQ ID NO: 6039945 - DNA, 16 bp, Homo sapiens
ccagagcacctcagga

SEQ ID NO: 6039946 - DNA, 19 bp, Homo sapiens
ccagagcacctgctgtctg

SEQ ID NO: 6039947 - DNA, 12 bp, Homo sapiens
ccagagcactgt

SEQ ID NO: 6039948 - DNA, 24 bp, Homo sapiens
ccagagcagagcctacagaagggc

SEQ ID NO: 6039949 - DNA, 12 bp, Homo sapiens
ccagagcagagt

SEQ ID NO: 6039950 - DNA, 18 bp, Homo sapiens
ccagagcagatgcagaga

SEQ ID NO: 6039951 - DNA, 22 bp, Homo sapiens
ccagagcagatgcagagagcca

SEQ ID NO: 6039952 - DNA, 14 bp, Homo sapiens
ccagagcaggaagc

SEQ ID NO: 6039953 - DNA, 12 bp, Homo sapiens
ccagagcaggag

SEQ ID NO: 6039954 - DNA, 16 bp, Homo sapiens
ccagagcaggagcccc

SEQ ID NO: 6039955 - DNA, 21 bp, Homo sapiens
ccagagcaggaggcccctggc

SEQ ID NO: 6039956 - DNA, 20 bp, Homo sapiens
ccagagcaggggctgctggg

SEQ ID NO: 6039957 - DNA, 21 bp, Homo sapiens
ccagagcaggggctgctgggg

SEQ ID NO: 6039958 - DNA, 23 bp, Homo sapiens
ccagagcaggggctgctgggggc

SEQ ID NO: 6039959 - DNA, 22 bp, Homo sapiens
ccagagcattacgtgagccagg

SEQ ID NO: 6039960 - DNA, 18 bp, Homo sapiens
ccagagcattccagtcag

SEQ ID NO: 6039961 - DNA, 21 bp, Homo sapiens
ccagagcattccagtcaggct

SEQ ID NO: 6039962 - DNA, 18 bp, Homo sapiens
ccagagcatttccaacac

SEQ ID NO: 6039963 - DNA, 15 bp, Homo sapiens
ccagagccaaatttt

SEQ ID NO: 6039964 - DNA, 11 bp, Homo sapiens
ccagagccaac

SEQ ID NO: 6039965 - DNA, 18 bp, Homo sapiens
ccagagccaacctggact

SEQ ID NO: 6039966 - DNA, 13 bp, Homo sapiens
ccagagccaaggg

SEQ ID NO: 6039967 - DNA, 16 bp, Homo sapiens
ccagagccacacatgg

SEQ ID NO: 6039968 - DNA, 18 bp, Homo sapiens
ccagagccacctggatct

SEQ ID NO: 6039969 - DNA, 21 bp, Homo sapiens
ccagagccagatgcaggacag

SEQ ID NO: 6039970 - DNA, 12 bp, Homo sapiens
ccagagccagcc

SEQ ID NO: 6039971 - DNA, 18 bp, Homo sapiens
ccagagccagcctgggac

SEQ ID NO: 6039972 - DNA, 20 bp, Homo sapiens
ccagagccagcctgggactc

SEQ ID NO: 6039973 - DNA, 12 bp, Homo sapiens
ccagagccaggg

SEQ ID NO: 6039974 - DNA, 13 bp, Homo sapiens
ccagagccagggc

SEQ ID NO: 6039975 - DNA, 18 bp, Homo sapiens
ccagagccagggctgtcc

SEQ ID NO: 6039976 - DNA, 21 bp, Homo sapiens
ccagagccagggctgtcctta

SEQ ID NO: 6039977 - DNA, 15 bp, Homo sapiens
ccagagccatactgc

SEQ ID NO: 6039978 - DNA, 15 bp, Homo sapiens
ccagagcccaaggtc

SEQ ID NO: 6039979 - DNA, 16 bp, Homo sapiens
ccagagcccaagtgcc

SEQ ID NO: 6039980 - DNA, 19 bp, Homo sapiens
ccagagcccaagtgccatc

SEQ ID NO: 6039981 - DNA, 20 bp, Homo sapiens
ccagagcccaagtgccatcc

SEQ ID NO: 6039982 - DNA, 23 bp, Homo sapiens
ccagagcccaagtgccatcccac

SEQ ID NO: 6039983 - DNA, 24 bp, Homo sapiens
ccagagcccaagtgccatcccaca

SEQ ID NO: 6039984 - DNA, 13 bp, Homo sapiens
ccagagcccagct

SEQ ID NO: 6039985 - DNA, 16 bp, Homo sapiens
ccagagcccagctctt

SEQ ID NO: 6039986 - DNA, 22 bp, Homo sapiens
ccagagcccagctcttgctctc

SEQ ID NO: 6039987 - DNA, 14 bp, Homo sapiens
ccagagcccagggc

SEQ ID NO: 6039988 - DNA, 17 bp, Homo sapiens
ccagagcccatgctcaa

SEQ ID NO: 6039989 - DNA, 15 bp, Homo sapiens
ccagagccccaagca

SEQ ID NO: 6039990 - DNA, 19 bp, Homo sapiens
ccagagccccacacggagg

SEQ ID NO: 6039991 - DNA, 17 bp, Homo sapiens
ccagagccccacagccc

SEQ ID NO: 6039992 - DNA, 15 bp, Homo sapiens
ccagagccccactcc

SEQ ID NO: 6039993 - DNA, 21 bp, Homo sapiens
ccagagccccccacaatgatg

SEQ ID NO: 6039994 - DNA, 18 bp, Homo sapiens
ccagagcccctcatgcca

SEQ ID NO: 6039995 - DNA, 13 bp, Homo sapiens
ccagagccccttt

SEQ ID NO: 6039996 - DNA, 17 bp, Homo sapiens
ccagagccctctgagcc

SEQ ID NO: 6039997 - DNA, 17 bp, Homo sapiens
ccagagccctgcagtca

SEQ ID NO: 6039998 - DNA, 21 bp, Homo sapiens
ccagagcccttgactgtacag

SEQ ID NO: 6039999 - DNA, 18 bp, Homo sapiens
ccagagccgcaccctggc

SEQ ID NO: 6040000 - DNA, 22 bp, Homo sapiens
ccagagccggggcactttcaga

SEQ ID NO: 6040001 - DNA, 19 bp, Homo sapiens
ccagagcctatggaaaggg

SEQ ID NO: 6040002 - DNA, 20 bp, Homo sapiens
ccagagcctcaaatgagaaa

SEQ ID NO: 6040003 - DNA, 15 bp, Homo sapiens
ccagagcctccctca

SEQ ID NO: 6040004 - DNA, 22 bp, Homo sapiens
ccagagcctccctcagccacgc

SEQ ID NO: 6040005 - DNA, 22 bp, Homo sapiens
ccagagcctctggcccctcacc

SEQ ID NO: 6040006 - DNA, 11 bp, Homo sapiens
ccagagcctgg

SEQ ID NO: 6040007 - DNA, 19 bp, Homo sapiens
ccagagcctggctgcccat

SEQ ID NO: 6040008 - DNA, 13 bp, Homo sapiens
ccagagcctgggg

SEQ ID NO: 6040009 - DNA, 18 bp, Homo sapiens
catctctaccttctcccc

SEQ ID NO: 6040010 - DNA, 21 bp, Homo sapiens
catctctaccttctccccagc

SEQ ID NO: 6040011 - DNA, 15 bp, Homo sapiens
catctctcagaaggg

SEQ ID NO: 6040012 - DNA, 18 bp, Homo sapiens
catctctcccacttcctc

SEQ ID NO: 6040013 - DNA, 12 bp, Homo sapiens
catctctcccca

SEQ ID NO: 6040014 - DNA, 20 bp, Homo sapiens
catctctccctcccctgcca

SEQ ID NO: 6040015 - DNA, 13 bp, Homo sapiens
catctctcctaag

SEQ ID NO: 6040016 - DNA, 13 bp, Homo sapiens
catctctcctccc

SEQ ID NO: 6040017 - DNA, 16 bp, Homo sapiens
catctctcctgtgtct

SEQ ID NO: 6040018 - DNA, 17 bp, Homo sapiens
catctctctacctccac

SEQ ID NO: 6040019 - DNA, 19 bp, Homo sapiens
catctctctacctccaccc

SEQ ID NO: 6040020 - DNA, 20 bp, Homo sapiens
catctctctacctccaccct

SEQ ID NO: 6040021 - DNA, 23 bp, Homo sapiens
catctctctactcctacctcagc

SEQ ID NO: 6040022 - DNA, 17 bp, Homo sapiens
catctctctactgctgg

SEQ ID NO: 6040023 - DNA, 14 bp, Homo sapiens
catctctctccctt

SEQ ID NO: 6040024 - DNA, 15 bp, Homo sapiens
catctctctccctta

SEQ ID NO: 6040025 - DNA, 16 bp, Homo sapiens
catctctctcttgcct

SEQ ID NO: 6040026 - DNA, 23 bp, Homo sapiens
catctctctcttgcctgagggga

SEQ ID NO: 6040027 - DNA, 18 bp, Homo sapiens
catctctctgcccaaccc

SEQ ID NO: 6040028 - DNA, 16 bp, Homo sapiens
catctctctgccctct

SEQ ID NO: 6040029 - DNA, 12 bp, Homo sapiens
catctctctggc

SEQ ID NO: 6040030 - DNA, 15 bp, Homo sapiens
catctctctggcttc

SEQ ID NO: 6040031 - DNA, 14 bp, Homo sapiens
catctctctggggc

SEQ ID NO: 6040032 - DNA, 21 bp, Homo sapiens
catctctctggggccctgggc

SEQ ID NO: 6040033 - DNA, 12 bp, Homo sapiens
catctctgaaaa

SEQ ID NO: 6040034 - DNA, 15 bp, Homo sapiens
catctctgaaaacaa

SEQ ID NO: 6040035 - DNA, 19 bp, Homo sapiens
catctctgaaaacaagaga

SEQ ID NO: 6040036 - DNA, 12 bp, Homo sapiens
catctctgagtg

SEQ ID NO: 6040037 - DNA, 15 bp, Homo sapiens
catctctgagtgtct

SEQ ID NO: 6040038 - DNA, 21 bp, Homo sapiens
catctctgagtgtctctgcct

SEQ ID NO: 6040039 - DNA, 23 bp, Homo sapiens
catctctgagtgtctctgcctgg

SEQ ID NO: 6040040 - DNA, 13 bp, Homo sapiens
catctctgcctcc

SEQ ID NO: 6040041 - DNA, 18 bp, Homo sapiens
catctctgcctgacaagg

SEQ ID NO: 6040042 - DNA, 19 bp, Homo sapiens
catctctgcctgacaaggc

SEQ ID NO: 6040043 - DNA, 13 bp, Homo sapiens
catctctgcctgt

SEQ ID NO: 6040044 - DNA, 14 bp, Homo sapiens
catctctgcctgtc

SEQ ID NO: 6040045 - DNA, 13 bp, Homo sapiens
catctctgccttt

SEQ ID NO: 6040046 - DNA, 15 bp, Homo sapiens
catctctgcctttga

SEQ ID NO: 6040047 - DNA, 17 bp, Homo sapiens
catctctgctgaacatt

SEQ ID NO: 6040048 - DNA, 18 bp, Homo sapiens
catctctgctgaacattt

SEQ ID NO: 6040049 - DNA, 13 bp, Homo sapiens
catctctgctgct

SEQ ID NO: 6040050 - DNA, 19 bp, Homo sapiens
catctctgctgcttctggg

SEQ ID NO: 6040051 - DNA, 23 bp, Homo sapiens
catctctgctgcttctgggcctg

SEQ ID NO: 6040052 - DNA, 12 bp, Homo sapiens
catctctgcttg

SEQ ID NO: 6040053 - DNA, 11 bp, Homo sapiens
catctctggaa

SEQ ID NO: 6040054 - DNA, 18 bp, Homo sapiens
catctctggaaggggcag

SEQ ID NO: 6040055 - DNA, 21 bp, Homo sapiens
catctctggaaggggcagccc

SEQ ID NO: 6040056 - DNA, 14 bp, Homo sapiens
catctctggagcca

SEQ ID NO: 6040057 - DNA, 14 bp, Homo sapiens
catctctggatgcc

SEQ ID NO: 6040058 - DNA, 16 bp, Homo sapiens
catctctggatgcctg

SEQ ID NO: 6040059 - DNA, 15 bp, Homo sapiens
catctctggcccaga

SEQ ID NO: 6040060 - DNA, 12 bp, Homo sapiens
catctctgggct

SEQ ID NO: 6040061 - DNA, 23 bp, Homo sapiens
catctctgggctggatgagctcc

SEQ ID NO: 6040062 - DNA, 17 bp, Homo sapiens
catctctgtaaaaagca

SEQ ID NO: 6040063 - DNA, 21 bp, Homo sapiens
catctctgtagatacaggggc

SEQ ID NO: 6040064 - DNA, 15 bp, Homo sapiens
catctctgtcagtgt

SEQ ID NO: 6040065 - DNA, 22 bp, Homo sapiens
catctctgtcccattccctggg

SEQ ID NO: 6040066 - DNA, 17 bp, Homo sapiens
catctctgtctggggct

SEQ ID NO: 6040067 - DNA, 23 bp, Homo sapiens
catctctgttcttttcccgcctc

SEQ ID NO: 6040068 - DNA, 17 bp, Homo sapiens
catctcttaaattttgt

SEQ ID NO: 6040069 - DNA, 22 bp, Homo sapiens
catctcttaaattttgttttct

SEQ ID NO: 6040070 - DNA, 23 bp, Homo sapiens
catctcttagctcccctccaacc

SEQ ID NO: 6040071 - DNA, 15 bp, Homo sapiens
catctcttcaatcac

SEQ ID NO: 6040072 - DNA, 23 bp, Homo sapiens
catctcttcctacccaaccactc

SEQ ID NO: 6040073 - DNA, 21 bp, Homo sapiens
catctcttcctccgaggccag

SEQ ID NO: 6040074 - DNA, 16 bp, Homo sapiens
catctcttccttcaga

SEQ ID NO: 6040075 - DNA, 14 bp, Homo sapiens
catctcttcctttc

SEQ ID NO: 6040076 - DNA, 15 bp, Homo sapiens
catctcttcctttcc

SEQ ID NO: 6040077 - DNA, 22 bp, Homo sapiens
catctcttgaaacctgttaaaa

SEQ ID NO: 6040078 - DNA, 19 bp, Homo sapiens
catctcttgagtgtctatt

SEQ ID NO: 6040079 - DNA, 20 bp, Homo sapiens
catctcttgtaccagcccag

SEQ ID NO: 6040080 - DNA, 14 bp, Homo sapiens
catctctttaaaaa

SEQ ID NO: 6040081 - DNA, 12 bp, Homo sapiens
catctctttaga

SEQ ID NO: 6040082 - DNA, 15 bp, Homo sapiens
catctctttgaattt

SEQ ID NO: 6040083 - DNA, 19 bp, Homo sapiens
catctctttgaattttctg

SEQ ID NO: 6040084 - DNA, 22 bp, Homo sapiens
catctctttgaattttctgtgt

SEQ ID NO: 6040085 - DNA, 15 bp, Homo sapiens
catctcttttcccac

SEQ ID NO: 6040086 - DNA, 22 bp, Homo sapiens
catctcttttcccactcccttt

SEQ ID NO: 6040087 - DNA, 12 bp, Homo sapiens
catctgaaaaga

SEQ ID NO: 6040088 - DNA, 15 bp, Homo sapiens
catctgaaaagcagt

SEQ ID NO: 6040089 - DNA, 16 bp, Homo sapiens
catctgaaaagcagtt

SEQ ID NO: 6040090 - DNA, 16 bp, Homo sapiens
catctgaaacccacag

SEQ ID NO: 6040091 - DNA, 19 bp, Homo sapiens
catctgaaacccacagatg

SEQ ID NO: 6040092 - DNA, 22 bp, Homo sapiens
catctgaaacccacagatgtct

SEQ ID NO: 6040093 - DNA, 16 bp, Homo sapiens
catctgaaagccacgt

SEQ ID NO: 6040094 - DNA, 16 bp, Homo sapiens
catctgaaagttttga

SEQ ID NO: 6040095 - DNA, 21 bp, Homo sapiens
catctgaaatctacaacataa

SEQ ID NO: 6040096 - DNA, 16 bp, Homo sapiens
catctgaacacaacca

SEQ ID NO: 6040097 - DNA, 21 bp, Homo sapiens
catctgaagccacctctctgc

SEQ ID NO: 6040098 - DNA, 20 bp, Homo sapiens
catctgaatcccgggctaag

SEQ ID NO: 6040099 - DNA, 18 bp, Homo sapiens
catctgaatgaaaataac

SEQ ID NO: 6040100 - DNA, 18 bp, Homo sapiens
catctgaatttgccctgg

SEQ ID NO: 6040101 - DNA, 20 bp, Homo sapiens
catctgaatttgccctggga

SEQ ID NO: 6040102 - DNA, 21 bp, Homo sapiens
catctgacaaattcaaaagag

SEQ ID NO: 6040103 - DNA, 15 bp, Homo sapiens
catctgacacaaaaa

SEQ ID NO: 6040104 - DNA, 16 bp, Homo sapiens
catctgacagcaggcc

SEQ ID NO: 6040105 - DNA, 17 bp, Homo sapiens
catctgaccagcagcgc

SEQ ID NO: 6040106 - DNA, 13 bp, Homo sapiens
catctgacccaga

SEQ ID NO: 6040107 - DNA, 23 bp, Homo sapiens
catctgaccccaagggggctgct

SEQ ID NO: 6040108 - DNA, 24 bp, Homo sapiens
catctgaccgttttcacttgtctc

SEQ ID NO: 6040109 - DNA, 12 bp, Homo sapiens
catctgactcac

SEQ ID NO: 6040110 - DNA, 23 bp, Homo sapiens
catctgagaaaagctttgaaccc

SEQ ID NO: 6040111 - DNA, 20 bp, Homo sapiens
catctgagaaacctgttgaa

SEQ ID NO: 6040112 - DNA, 23 bp, Homo sapiens
catctgagaaggccctgtgccct

SEQ ID NO: 6040113 - DNA, 18 bp, Homo sapiens
catctgagaggctctccg

SEQ ID NO: 6040114 - DNA, 15 bp, Homo sapiens
catctgagcaagagc

SEQ ID NO: 6040115 - DNA, 15 bp, Homo sapiens
catctgagctggggg

SEQ ID NO: 6040116 - DNA, 17 bp, Homo sapiens
catctgaggaaaatgga

SEQ ID NO: 6040117 - DNA, 11 bp, Homo sapiens
catctgaggag

SEQ ID NO: 6040118 - DNA, 15 bp, Homo sapiens
catctgaggagtcca

SEQ ID NO: 6040119 - DNA, 20 bp, Homo sapiens
catctgaggtcctgtgatct

SEQ ID NO: 6040120 - DNA, 21 bp, Homo sapiens
catctgaggttttatttcatt

SEQ ID NO: 6040121 - DNA, 17 bp, Homo sapiens
catctgagtccagctcc

SEQ ID NO: 6040122 - DNA, 14 bp, Homo sapiens
catctgatatcagg

SEQ ID NO: 6040123 - DNA, 22 bp, Homo sapiens
catctgatatcaggaaatatct

SEQ ID NO: 6040124 - DNA, 14 bp, Homo sapiens
catctgatatctat

SEQ ID NO: 6040125 - DNA, 23 bp, Homo sapiens
catctgatctgtataaaaatgta

SEQ ID NO: 6040126 - DNA, 13 bp, Homo sapiens
catctgattaaaa

SEQ ID NO: 6040127 - DNA, 15 bp, Homo sapiens
catctgattaaaaca

SEQ ID NO: 6040128 - DNA, 20 bp, Homo sapiens
catctgattgagtcagtgtt

SEQ ID NO: 6040129 - DNA, 23 bp, Homo sapiens
catctgcaaaaggcctcttgtaa

SEQ ID NO: 6040130 - DNA, 19 bp, Homo sapiens
catctgcaaagcatggaga

SEQ ID NO: 6040131 - DNA, 12 bp, Homo sapiens
catctgcaaagg

SEQ ID NO: 6040132 - DNA, 15 bp, Homo sapiens
catctgcaacaaaaa

SEQ ID NO: 6040133 - DNA, 16 bp, Homo sapiens
catctgcaacaaaaag

SEQ ID NO: 6040134 - DNA, 21 bp, Homo sapiens
catctgcacactctcttctcc

SEQ ID NO: 6040135 - DNA, 22 bp, Homo sapiens
catctgcacccagggtcccagc

SEQ ID NO: 6040136 - DNA, 19 bp, Homo sapiens
catctgcacccccctgggc

SEQ ID NO: 6040137 - DNA, 23 bp, Homo sapiens
catctgcaccccttctctcctcc

SEQ ID NO: 6040138 - DNA, 22 bp, Homo sapiens
catctgcacccttcttttctca

SEQ ID NO: 6040139 - DNA, 14 bp, Homo sapiens
catctgcagaatgg

SEQ ID NO: 6040140 - DNA, 13 bp, Homo sapiens
catctgcagcctc

SEQ ID NO: 6040141 - DNA, 15 bp, Homo sapiens
catctgcagctcttt

SEQ ID NO: 6040142 - DNA, 15 bp, Homo sapiens
catctgcaggacaga

SEQ ID NO: 6040143 - DNA, 16 bp, Homo sapiens
catctgcaggacagag

SEQ ID NO: 6040144 - DNA, 19 bp, Homo sapiens
catctgcaggcaccgggct

SEQ ID NO: 6040145 - DNA, 22 bp, Homo sapiens
catctgcagtgttctgtgaata

SEQ ID NO: 6040146 - DNA, 16 bp, Homo sapiens
catctgcatgggtctt

SEQ ID NO: 6040147 - DNA, 13 bp, Homo sapiens
catctgccagacc

SEQ ID NO: 6040148 - DNA, 19 bp, Homo sapiens
catctgccatttatttcct

SEQ ID NO: 6040149 - DNA, 22 bp, Homo sapiens
catctgcccaactgtgtagcat

SEQ ID NO: 6040150 - DNA, 14 bp, Homo sapiens
catctgcccaggac

SEQ ID NO: 6040151 - DNA, 15 bp, Homo sapiens
catctgcccaggggt

SEQ ID NO: 6040152 - DNA, 16 bp, Homo sapiens
catctgcccaggggtg

SEQ ID NO: 6040153 - DNA, 11 bp, Homo sapiens
catctgcccct

SEQ ID NO: 6040154 - DNA, 17 bp, Homo sapiens
catctgcccctccccca

SEQ ID NO: 6040155 - DNA, 18 bp, Homo sapiens
catctgcccctcccccaa

SEQ ID NO: 6040156 - DNA, 19 bp, Homo sapiens
catctgcccctcccccaac

SEQ ID NO: 6040157 - DNA, 23 bp, Homo sapiens
catctgcccgcctgcccacctgc

SEQ ID NO: 6040158 - DNA, 11 bp, Homo sapiens
catctgcctcc

SEQ ID NO: 6040159 - DNA, 16 bp, Homo sapiens
catctgcctcctctcc

SEQ ID NO: 6040160 - DNA, 23 bp, Homo sapiens
catctgcctctattcaatttaat

SEQ ID NO: 6040161 - DNA, 18 bp, Homo sapiens
catctgcctgcagtgtca

SEQ ID NO: 6040162 - DNA, 16 bp, Homo sapiens
catctgcctggagcct

SEQ ID NO: 6040163 - DNA, 17 bp, Homo sapiens
catctgcggggcttctg

SEQ ID NO: 6040164 - DNA, 18 bp, Homo sapiens
catctgcggggcttctgg

SEQ ID NO: 6040165 - DNA, 16 bp, Homo sapiens
catctgcgtgacaata

SEQ ID NO: 6040166 - DNA, 14 bp, Homo sapiens
catctgctcatctg

SEQ ID NO: 6040167 - DNA, 10 bp, Homo sapiens
catctgctcc

SEQ ID NO: 6040168 - DNA, 14 bp, Homo sapiens
catctgctctcctt

SEQ ID NO: 6040169 - DNA, 15 bp, Homo sapiens
catctgctctccttc

SEQ ID NO: 6040170 - DNA, 18 bp, Homo sapiens
catctgctctccttcctg

SEQ ID NO: 6040171 - DNA, 15 bp, Homo sapiens
catctgctgcacata

SEQ ID NO: 6040172 - DNA, 22 bp, Homo sapiens
catctgctgcacatagcagact

SEQ ID NO: 6040173 - DNA, 14 bp, Homo sapiens
catctgctgcagtt

SEQ ID NO: 6040174 - DNA, 11 bp, Homo sapiens
catctgctgcg

SEQ ID NO: 6040175 - DNA, 14 bp, Homo sapiens
catctgctgtcttt

SEQ ID NO: 6040176 - DNA, 12 bp, Homo sapiens
catctgctgtgt

SEQ ID NO: 6040177 - DNA, 21 bp, Homo sapiens
catctgctgtgtggaaaaaaa

SEQ ID NO: 6040178 - DNA, 17 bp, Homo sapiens
catctgctgttatcacc

SEQ ID NO: 6040179 - DNA, 19 bp, Homo sapiens
catctgcttgtattttcca

SEQ ID NO: 6040180 - DNA, 20 bp, Homo sapiens
catctgctttattgcctctg

SEQ ID NO: 6040181 - DNA, 16 bp, Homo sapiens
catctggaaaataaaa

SEQ ID NO: 6040182 - DNA, 22 bp, Homo sapiens
catctggaagagctaggcaggg

SEQ ID NO: 6040183 - DNA, 21 bp, Homo sapiens
catctggaaggggatcccacc

SEQ ID NO: 6040184 - DNA, 17 bp, Homo sapiens
catctggaatctgaggc

SEQ ID NO: 6040185 - DNA, 19 bp, Homo sapiens
catctggaatctgaggcat

SEQ ID NO: 6040186 - DNA, 17 bp, Homo sapiens
catctggagagaacagg

SEQ ID NO: 6040187 - DNA, 13 bp, Homo sapiens
catctggaggctg

SEQ ID NO: 6040188 - DNA, 15 bp, Homo sapiens
catctggaggctgcg

SEQ ID NO: 6040189 - DNA, 14 bp, Homo sapiens
ccagagcctggggc

SEQ ID NO: 6040190 - DNA, 18 bp, Homo sapiens
ccagagcctggggctcta

SEQ ID NO: 6040191 - DNA, 23 bp, Homo sapiens
ccagagcctgtctttcagcattc

SEQ ID NO: 6040192 - DNA, 15 bp, Homo sapiens
ccagagccttaataa

SEQ ID NO: 6040193 - DNA, 17 bp, Homo sapiens
ccagagccttcaagtgc

SEQ ID NO: 6040194 - DNA, 18 bp, Homo sapiens
ccagagccttcaagtgcc

SEQ ID NO: 6040195 - DNA, 13 bp, Homo sapiens
ccagagccttctc

SEQ ID NO: 6040196 - DNA, 18 bp, Homo sapiens
ccagagccttggaggaca

SEQ ID NO: 6040197 - DNA, 18 bp, Homo sapiens
ccagagcgatgtgttctt

SEQ ID NO: 6040198 - DNA, 19 bp, Homo sapiens
ccagagcggaggctgtgtg

SEQ ID NO: 6040199 - DNA, 19 bp, Homo sapiens
ccagagcgtgggagacggt

SEQ ID NO: 6040200 - DNA, 18 bp, Homo sapiens
ccagagctagggctgctg

SEQ ID NO: 6040201 - DNA, 19 bp, Homo sapiens
ccagagctagggctgctgc

SEQ ID NO: 6040202 - DNA, 23 bp, Homo sapiens
ccagagctagggctgctgcttct

SEQ ID NO: 6040203 - DNA, 21 bp, Homo sapiens
ccagagctcatcccccctgct

SEQ ID NO: 6040204 - DNA, 14 bp, Homo sapiens
ccagagctcccagg

SEQ ID NO: 6040205 - DNA, 15 bp, Homo sapiens
ccagagctcccagga

SEQ ID NO: 6040206 - DNA, 11 bp, Homo sapiens
ccagagctccg

SEQ ID NO: 6040207 - DNA, 18 bp, Homo sapiens
ccagagctctgacccaca

SEQ ID NO: 6040208 - DNA, 23 bp, Homo sapiens
ccagagctgaagagttgccccgt

SEQ ID NO: 6040209 - DNA, 11 bp, Homo sapiens
ccagagctgag

SEQ ID NO: 6040210 - DNA, 15 bp, Homo sapiens
ccagagctgcacagg

SEQ ID NO: 6040211 - DNA, 13 bp, Homo sapiens
ccagagctgcaga

SEQ ID NO: 6040212 - DNA, 15 bp, Homo sapiens
ccagagctgccacct

SEQ ID NO: 6040213 - DNA, 16 bp, Homo sapiens
ccagagctgccacctg

SEQ ID NO: 6040214 - DNA, 13 bp, Homo sapiens
ccagagctgccag

SEQ ID NO: 6040215 - DNA, 20 bp, Homo sapiens
ccagagctgcctatgcccag

SEQ ID NO: 6040216 - DNA, 13 bp, Homo sapiens
ccagagctgcctc

SEQ ID NO: 6040217 - DNA, 17 bp, Homo sapiens
ccagagctgcctcccca

SEQ ID NO: 6040218 - DNA, 20 bp, Homo sapiens
ccagagctgcctccccaatc

SEQ ID NO: 6040219 - DNA, 14 bp, Homo sapiens
ccagagctgcttct

SEQ ID NO: 6040220 - DNA, 20 bp, Homo sapiens
ccagagctgcttctgtctgg

SEQ ID NO: 6040221 - DNA, 18 bp, Homo sapiens
ccagagctggaaggcagg

SEQ ID NO: 6040222 - DNA, 13 bp, Homo sapiens
ccagagctggcct

SEQ ID NO: 6040223 - DNA, 19 bp, Homo sapiens
ccagagctggcgctcagca

SEQ ID NO: 6040224 - DNA, 21 bp, Homo sapiens
ccagagctgggaggcatggcc

SEQ ID NO: 6040225 - DNA, 14 bp, Homo sapiens
ccagagctgggtga

SEQ ID NO: 6040226 - DNA, 12 bp, Homo sapiens
ccagagctgtgc

SEQ ID NO: 6040227 - DNA, 13 bp, Homo sapiens
ccagagctgtgcc

SEQ ID NO: 6040228 - DNA, 17 bp, Homo sapiens
ccagagctgtgccagca

SEQ ID NO: 6040229 - DNA, 18 bp, Homo sapiens
ccagagctgtgccagcag

SEQ ID NO: 6040230 - DNA, 21 bp, Homo sapiens
ccagagctgtgcctgctcagc

SEQ ID NO: 6040231 - DNA, 20 bp, Homo sapiens
ccagagctgtttatggcctc

SEQ ID NO: 6040232 - DNA, 24 bp, Homo sapiens
ccagagctgtttatggcctcagct

SEQ ID NO: 6040233 - DNA, 19 bp, Homo sapiens
ccagagctgtttggataca

SEQ ID NO: 6040234 - DNA, 18 bp, Homo sapiens
ccagagcttattggccac

SEQ ID NO: 6040235 - DNA, 19 bp, Homo sapiens
ccagagcttcagggctggg

SEQ ID NO: 6040236 - DNA, 16 bp, Homo sapiens
ccagagcttcccagga

SEQ ID NO: 6040237 - DNA, 13 bp, Homo sapiens
ccagagcttctct

SEQ ID NO: 6040238 - DNA, 14 bp, Homo sapiens
ccagagcttctctg

SEQ ID NO: 6040239 - DNA, 20 bp, Homo sapiens
ccagagcttctctgggctga

SEQ ID NO: 6040240 - DNA, 19 bp, Homo sapiens
ccagaggaaatctgaatgt

SEQ ID NO: 6040241 - DNA, 20 bp, Homo sapiens
ccagaggaactgtccagaga

SEQ ID NO: 6040242 - DNA, 23 bp, Homo sapiens
ccagaggaactgtccagagagca

SEQ ID NO: 6040243 - DNA, 15 bp, Homo sapiens
ccagaggaagcccct

SEQ ID NO: 6040244 - DNA, 17 bp, Homo sapiens
ccagaggaaggaaaagg

SEQ ID NO: 6040245 - DNA, 15 bp, Homo sapiens
ccagaggaagggagg

SEQ ID NO: 6040246 - DNA, 18 bp, Homo sapiens
ccagaggaagggaggcct

SEQ ID NO: 6040247 - DNA, 23 bp, Homo sapiens
ccagaggaagggaggcctgaggg

SEQ ID NO: 6040248 - DNA, 18 bp, Homo sapiens
ccagaggaatcctggcag

SEQ ID NO: 6040249 - DNA, 22 bp, Homo sapiens
ccagaggaatcctggcagccca

SEQ ID NO: 6040250 - DNA, 23 bp, Homo sapiens
ccagaggaatcctggcagcccag

SEQ ID NO: 6040251 - DNA, 23 bp, Homo sapiens
ccagaggaatgatgggcttttgt

SEQ ID NO: 6040252 - DNA, 22 bp, Homo sapiens
ccagaggaattgattgtcagcc

SEQ ID NO: 6040253 - DNA, 13 bp, Homo sapiens
ccagaggacaagg

SEQ ID NO: 6040254 - DNA, 14 bp, Homo sapiens
ccagaggacacagg

SEQ ID NO: 6040255 - DNA, 15 bp, Homo sapiens
ccagaggaccgagag

SEQ ID NO: 6040256 - DNA, 16 bp, Homo sapiens
ccagaggaccgagaga

SEQ ID NO: 6040257 - DNA, 12 bp, Homo sapiens
ccagaggacctg

SEQ ID NO: 6040258 - DNA, 18 bp, Homo sapiens
ccagaggactctgcttaa

SEQ ID NO: 6040259 - DNA, 22 bp, Homo sapiens
ccagaggagagaggaccccctg

SEQ ID NO: 6040260 - DNA, 18 bp, Homo sapiens
ccagaggagagtggcctg

SEQ ID NO: 6040261 - DNA, 21 bp, Homo sapiens
ccagaggagagtggcctgggt

SEQ ID NO: 6040262 - DNA, 21 bp, Homo sapiens
ccagaggagccaccagttctc

SEQ ID NO: 6040263 - DNA, 16 bp, Homo sapiens
ccagaggagccttttt

SEQ ID NO: 6040264 - DNA, 22 bp, Homo sapiens
ccagaggagctgggagccgggc

SEQ ID NO: 6040265 - DNA, 16 bp, Homo sapiens
ccagaggagggcagag

SEQ ID NO: 6040266 - DNA, 13 bp, Homo sapiens
ccagaggagggga

SEQ ID NO: 6040267 - DNA, 21 bp, Homo sapiens
ccagaggattgctgccccatc

SEQ ID NO: 6040268 - DNA, 22 bp, Homo sapiens
ccagaggcacctcaagaagaag

SEQ ID NO: 6040269 - DNA, 17 bp, Homo sapiens
ccagaggcagaaccctg

SEQ ID NO: 6040270 - DNA, 23 bp, Homo sapiens
ccagaggcagctaaggggcagga

SEQ ID NO: 6040271 - DNA, 19 bp, Homo sapiens
ccagaggcagcttctttgc

SEQ ID NO: 6040272 - DNA, 13 bp, Homo sapiens
ccagaggccagga

SEQ ID NO: 6040273 - DNA, 22 bp, Homo sapiens
ccagaggccaggaatctgccat

SEQ ID NO: 6040274 - DNA, 15 bp, Homo sapiens
ccagaggccaggatg

SEQ ID NO: 6040275 - DNA, 15 bp, Homo sapiens
ccagaggcccccagc

SEQ ID NO: 6040276 - DNA, 22 bp, Homo sapiens
ccagaggccctaggcgggatgg

SEQ ID NO: 6040277 - DNA, 18 bp, Homo sapiens
ccagaggccctgaagcct

SEQ ID NO: 6040278 - DNA, 20 bp, Homo sapiens
ccagaggccctgaagcctcc

SEQ ID NO: 6040279 - DNA, 15 bp, Homo sapiens
ccagaggccctggag

SEQ ID NO: 6040280 - DNA, 17 bp, Homo sapiens
ccagaggccctggaggg

SEQ ID NO: 6040281 - DNA, 18 bp, Homo sapiens
ccagaggccctggaggga

SEQ ID NO: 6040282 - DNA, 21 bp, Homo sapiens
ccagaggccctggagggaagg

SEQ ID NO: 6040283 - DNA, 18 bp, Homo sapiens
ccagaggccgaaggtgcc

SEQ ID NO: 6040284 - DNA, 22 bp, Homo sapiens
ccagaggcctcttttcctgaag

SEQ ID NO: 6040285 - DNA, 18 bp, Homo sapiens
ccagaggcctggtgccct

SEQ ID NO: 6040286 - DNA, 19 bp, Homo sapiens
ccagaggctattattttca

SEQ ID NO: 6040287 - DNA, 12 bp, Homo sapiens
ccagaggctccc

SEQ ID NO: 6040288 - DNA, 16 bp, Homo sapiens
ccagaggctcccaatc

SEQ ID NO: 6040289 - DNA, 19 bp, Homo sapiens
ccagaggctcctggagcca

SEQ ID NO: 6040290 - DNA, 15 bp, Homo sapiens
ccagaggctgcccca

SEQ ID NO: 6040291 - DNA, 12 bp, Homo sapiens
ccagaggctggg

SEQ ID NO: 6040292 - DNA, 14 bp, Homo sapiens
ccagaggctgggag

SEQ ID NO: 6040293 - DNA, 18 bp, Homo sapiens
ccagaggctgggagtccc

SEQ ID NO: 6040294 - DNA, 16 bp, Homo sapiens
ccagaggctgggttca

SEQ ID NO: 6040295 - DNA, 18 bp, Homo sapiens
ccagagggaccagctggg

SEQ ID NO: 6040296 - DNA, 20 bp, Homo sapiens
ccagagggactggacagcca

SEQ ID NO: 6040297 - DNA, 21 bp, Homo sapiens
ccagagggactggacagccag

SEQ ID NO: 6040298 - DNA, 14 bp, Homo sapiens
ccagagggagcagg

SEQ ID NO: 6040299 - DNA, 22 bp, Homo sapiens
ccagagggagcaggccggaacc

SEQ ID NO: 6040300 - DNA, 22 bp, Homo sapiens
ccagagggagtgacagaggcag

SEQ ID NO: 6040301 - DNA, 18 bp, Homo sapiens
ccagagggcactcagaag

SEQ ID NO: 6040302 - DNA, 13 bp, Homo sapiens
ccagagggcagtc

SEQ ID NO: 6040303 - DNA, 16 bp, Homo sapiens
ccagagggcagtctag

SEQ ID NO: 6040304 - DNA, 21 bp, Homo sapiens
ccagagggcagtctagtcctg

SEQ ID NO: 6040305 - DNA, 21 bp, Homo sapiens
ccagagggccagcaggctcct

SEQ ID NO: 6040306 - DNA, 22 bp, Homo sapiens
ccagagggccagcaggctcctg

SEQ ID NO: 6040307 - DNA, 23 bp, Homo sapiens
ccagagggcccctcactggctgg

SEQ ID NO: 6040308 - DNA, 18 bp, Homo sapiens
ccagagggcctgcaaggg

SEQ ID NO: 6040309 - DNA, 20 bp, Homo sapiens
ccagagggcctgcaagggag

SEQ ID NO: 6040310 - DNA, 14 bp, Homo sapiens
ccagaggggaagga

SEQ ID NO: 6040311 - DNA, 18 bp, Homo sapiens
ccagaggggacgctgagg

SEQ ID NO: 6040312 - DNA, 13 bp, Homo sapiens
ccagaggggcctg

SEQ ID NO: 6040313 - DNA, 15 bp, Homo sapiens
ccagaggggcctgcc

SEQ ID NO: 6040314 - DNA, 17 bp, Homo sapiens
ccagaggggcctgccac

SEQ ID NO: 6040315 - DNA, 23 bp, Homo sapiens
ccagaggggcctgccacctggac

SEQ ID NO: 6040316 - DNA, 17 bp, Homo sapiens
ccagaggggcggggcca

SEQ ID NO: 6040317 - DNA, 16 bp, Homo sapiens
ccagagggtagggcag

SEQ ID NO: 6040318 - DNA, 20 bp, Homo sapiens
ccagagggtagggcagcaga

SEQ ID NO: 6040319 - DNA, 21 bp, Homo sapiens
ccagagggtagggcagcagat

SEQ ID NO: 6040320 - DNA, 17 bp, Homo sapiens
ccagagggtctgggggc

SEQ ID NO: 6040321 - DNA, 18 bp, Homo sapiens
ccagagggtctgggggca

SEQ ID NO: 6040322 - DNA, 21 bp, Homo sapiens
ccagagggtgggaggggccat

SEQ ID NO: 6040323 - DNA, 15 bp, Homo sapiens
ccagagggtgtggct

SEQ ID NO: 6040324 - DNA, 20 bp, Homo sapiens
ccagagggtgtggctttcca

SEQ ID NO: 6040325 - DNA, 23 bp, Homo sapiens
ccagagggttgctggtcctgcac

SEQ ID NO: 6040326 - DNA, 18 bp, Homo sapiens
ccagaggtaacagaacag

SEQ ID NO: 6040327 - DNA, 21 bp, Homo sapiens
ccagaggtaacagaacagctt

SEQ ID NO: 6040328 - DNA, 21 bp, Homo sapiens
ccagaggtattcctctcttaa

SEQ ID NO: 6040329 - DNA, 20 bp, Homo sapiens
ccagaggtcacacagcctgt

SEQ ID NO: 6040330 - DNA, 15 bp, Homo sapiens
ccagaggtccagccc

SEQ ID NO: 6040331 - DNA, 16 bp, Homo sapiens
ccagaggtccagccca

SEQ ID NO: 6040332 - DNA, 17 bp, Homo sapiens
ccagaggtccagcccat

SEQ ID NO: 6040333 - DNA, 16 bp, Homo sapiens
ccagaggtccaggtcc

SEQ ID NO: 6040334 - DNA, 19 bp, Homo sapiens
ccagaggtccaggtcccag

SEQ ID NO: 6040335 - DNA, 13 bp, Homo sapiens
ccagaggtctccc

SEQ ID NO: 6040336 - DNA, 16 bp, Homo sapiens
ccagaggtgagggagg

SEQ ID NO: 6040337 - DNA, 20 bp, Homo sapiens
ccagaggtgagggaggcctg

SEQ ID NO: 6040338 - DNA, 11 bp, Homo sapiens
ccagaggtgga

SEQ ID NO: 6040339 - DNA, 18 bp, Homo sapiens
ccagaggtggagccaagt

SEQ ID NO: 6040340 - DNA, 24 bp, Homo sapiens
ccagaggtggagccaagtggtcca

SEQ ID NO: 6040341 - DNA, 21 bp, Homo sapiens
ccagaggtggaggtgggctga

SEQ ID NO: 6040342 - DNA, 22 bp, Homo sapiens
ccagaggtggatactggggggc

SEQ ID NO: 6040343 - DNA, 16 bp, Homo sapiens
ccagaggtggatgtta

SEQ ID NO: 6040344 - DNA, 20 bp, Homo sapiens
ccagaggtggccctcccagg

SEQ ID NO: 6040345 - DNA, 16 bp, Homo sapiens
ccagaggtggcccttg

SEQ ID NO: 6040346 - DNA, 14 bp, Homo sapiens
ccagaggtgggagg

SEQ ID NO: 6040347 - DNA, 20 bp, Homo sapiens
ccagaggtgggaggcccctg

SEQ ID NO: 6040348 - DNA, 21 bp, Homo sapiens
ccagaggtgggaggcccctgg

SEQ ID NO: 6040349 - DNA, 20 bp, Homo sapiens
ccagaggtgggatcctccct

SEQ ID NO: 6040350 - DNA, 14 bp, Homo sapiens
ccagaggtgggcag

SEQ ID NO: 6040351 - DNA, 17 bp, Homo sapiens
ccagaggtgggcaggtg

SEQ ID NO: 6040352 - DNA, 18 bp, Homo sapiens
ccagaggtgggcaggtgg

SEQ ID NO: 6040353 - DNA, 15 bp, Homo sapiens
ccagaggtggggaag

SEQ ID NO: 6040354 - DNA, 21 bp, Homo sapiens
ccagaggtggggaagagagcc

SEQ ID NO: 6040355 - DNA, 18 bp, Homo sapiens
ccagaggttatctgcctg

SEQ ID NO: 6040356 - DNA, 19 bp, Homo sapiens
ccagaggttgtgcactgtt

SEQ ID NO: 6040357 - DNA, 20 bp, Homo sapiens
ccagagtagagccaggtgct

SEQ ID NO: 6040358 - DNA, 14 bp, Homo sapiens
ccagagtagccatg

SEQ ID NO: 6040359 - DNA, 23 bp, Homo sapiens
ccagagtagggttgccagtcctg

SEQ ID NO: 6040360 - DNA, 21 bp, Homo sapiens
ccagagtaggtgggtcttgga

SEQ ID NO: 6040361 - DNA, 15 bp, Homo sapiens
ccagagtcaggaaga

SEQ ID NO: 6040362 - DNA, 16 bp, Homo sapiens
ccagagtcatgggaga

SEQ ID NO: 6040363 - DNA, 14 bp, Homo sapiens
ccagagtcccaggc

SEQ ID NO: 6040364 - DNA, 21 bp, Homo sapiens
ccagagtccccccactcccag

SEQ ID NO: 6040365 - DNA, 23 bp, Homo sapiens
ccagagtccccccactcccagca

SEQ ID NO: 6040366 - DNA, 21 bp, Homo sapiens
catctggagggttctaagtgg

SEQ ID NO: 6040367 - DNA, 23 bp, Homo sapiens
catctggattctgcctaataaaa

SEQ ID NO: 6040368 - DNA, 20 bp, Homo sapiens
catctggcacgtggccagga

SEQ ID NO: 6040369 - DNA, 13 bp, Homo sapiens
catctggcccagg

SEQ ID NO: 6040370 - DNA, 16 bp, Homo sapiens
catctggcccaggctg

SEQ ID NO: 6040371 - DNA, 17 bp, Homo sapiens
catctggcccaggctgg

SEQ ID NO: 6040372 - DNA, 13 bp, Homo sapiens
catctggccctga

SEQ ID NO: 6040373 - DNA, 14 bp, Homo sapiens
catctggccctgac

SEQ ID NO: 6040374 - DNA, 15 bp, Homo sapiens
catctggccctgctg

SEQ ID NO: 6040375 - DNA, 19 bp, Homo sapiens
catctggccctgctgcccc

SEQ ID NO: 6040376 - DNA, 23 bp, Homo sapiens
catctggcctatgaccctgtgcc

SEQ ID NO: 6040377 - DNA, 12 bp, Homo sapiens
catctggcctgg

SEQ ID NO: 6040378 - DNA, 13 bp, Homo sapiens
catctggcctggc

SEQ ID NO: 6040379 - DNA, 16 bp, Homo sapiens
catctggcctggcctg

SEQ ID NO: 6040380 - DNA, 11 bp, Homo sapiens
catctggcctt

SEQ ID NO: 6040381 - DNA, 14 bp, Homo sapiens
catctggccttaca

SEQ ID NO: 6040382 - DNA, 18 bp, Homo sapiens
catctggcggaggtctct

SEQ ID NO: 6040383 - DNA, 20 bp, Homo sapiens
catctggcggaggtctctgg

SEQ ID NO: 6040384 - DNA, 18 bp, Homo sapiens
catctggctctaattcac

SEQ ID NO: 6040385 - DNA, 15 bp, Homo sapiens
catctggctgcacag

SEQ ID NO: 6040386 - DNA, 15 bp, Homo sapiens
catctggctggaaag

SEQ ID NO: 6040387 - DNA, 16 bp, Homo sapiens
catctggctgtctaga

SEQ ID NO: 6040388 - DNA, 14 bp, Homo sapiens
catctggctgttta

SEQ ID NO: 6040389 - DNA, 18 bp, Homo sapiens
catctggcttattttaat

SEQ ID NO: 6040390 - DNA, 17 bp, Homo sapiens
catctggctttttctgc

SEQ ID NO: 6040391 - DNA, 22 bp, Homo sapiens
catctggctttttctgccactg

SEQ ID NO: 6040392 - DNA, 14 bp, Homo sapiens
catctgggaaagac

SEQ ID NO: 6040393 - DNA, 20 bp, Homo sapiens
catctgggaacttgtcacag

SEQ ID NO: 6040394 - DNA, 16 bp, Homo sapiens
catctgggattcccac

SEQ ID NO: 6040395 - DNA, 16 bp, Homo sapiens
catctgggctcctcca

SEQ ID NO: 6040396 - DNA, 18 bp, Homo sapiens
catctggggagcaggcag

SEQ ID NO: 6040397 - DNA, 19 bp, Homo sapiens
catctggggagcaggcagc

SEQ ID NO: 6040398 - DNA, 23 bp, Homo sapiens
catctggggagcaggcagccagc

SEQ ID NO: 6040399 - DNA, 17 bp, Homo sapiens
catctggggatgacaat

SEQ ID NO: 6040400 - DNA, 24 bp, Homo sapiens
catctggggttggcaacaggacag

SEQ ID NO: 6040401 - DNA, 18 bp, Homo sapiens
catctgggtagctgtaag

SEQ ID NO: 6040402 - DNA, 20 bp, Homo sapiens
catctgggtctcccaggaca

SEQ ID NO: 6040403 - DNA, 19 bp, Homo sapiens
catctgggtgccctgaaag

SEQ ID NO: 6040404 - DNA, 23 bp, Homo sapiens
catctgggttgccatggcaatgg

SEQ ID NO: 6040405 - DNA, 20 bp, Homo sapiens
catctggtagaagggaaagc

SEQ ID NO: 6040406 - DNA, 13 bp, Homo sapiens
catctggtgcctt

SEQ ID NO: 6040407 - DNA, 23 bp, Homo sapiens
catctggtttttaaaagataaac

SEQ ID NO: 6040408 - DNA, 19 bp, Homo sapiens
catctgtaaaaccaggctg

SEQ ID NO: 6040409 - DNA, 16 bp, Homo sapiens
catctgtaaaatagtc

SEQ ID NO: 6040410 - DNA, 22 bp, Homo sapiens
catctgtaaaatggagacacca

SEQ ID NO: 6040411 - DNA, 12 bp, Homo sapiens
catctgtaaaga

SEQ ID NO: 6040412 - DNA, 15 bp, Homo sapiens
catctgtaaatatcc

SEQ ID NO: 6040413 - DNA, 18 bp, Homo sapiens
catctgtaaatatcccag

SEQ ID NO: 6040414 - DNA, 13 bp, Homo sapiens
catctgtaaattt

SEQ ID NO: 6040415 - DNA, 19 bp, Homo sapiens
catctgtaagagcttgctc

SEQ ID NO: 6040416 - DNA, 23 bp, Homo sapiens
catctgtaagagcttgctccaga

SEQ ID NO: 6040417 - DNA, 15 bp, Homo sapiens
catctgtaagctgtt

SEQ ID NO: 6040418 - DNA, 13 bp, Homo sapiens
catctgtacatga

SEQ ID NO: 6040419 - DNA, 17 bp, Homo sapiens
catctgtaccctgcttc

SEQ ID NO: 6040420 - DNA, 12 bp, Homo sapiens
catctgtagata

SEQ ID NO: 6040421 - DNA, 22 bp, Homo sapiens
catctgtataagtaagaaaata

SEQ ID NO: 6040422 - DNA, 19 bp, Homo sapiens
catctgtataccctctgtt

SEQ ID NO: 6040423 - DNA, 20 bp, Homo sapiens
catctgtcagtgagtcagag

SEQ ID NO: 6040424 - DNA, 17 bp, Homo sapiens
catctgtcattatattc

SEQ ID NO: 6040425 - DNA, 20 bp, Homo sapiens
catctgtcattatattctaa

SEQ ID NO: 6040426 - DNA, 22 bp, Homo sapiens
catctgtccacatccccagagc

SEQ ID NO: 6040427 - DNA, 13 bp, Homo sapiens
catctgtccatcc

SEQ ID NO: 6040428 - DNA, 18 bp, Homo sapiens
catctgtccatggccttt

SEQ ID NO: 6040429 - DNA, 19 bp, Homo sapiens
catctgtccatggcctttc

SEQ ID NO: 6040430 - DNA, 21 bp, Homo sapiens
catctgtccatggcctttcta

SEQ ID NO: 6040431 - DNA, 18 bp, Homo sapiens
catctgtcccactgggac

SEQ ID NO: 6040432 - DNA, 13 bp, Homo sapiens
catctgtccccct

SEQ ID NO: 6040433 - DNA, 15 bp, Homo sapiens
catctgtcccccttt

SEQ ID NO: 6040434 - DNA, 12 bp, Homo sapiens
catctgtcctca

SEQ ID NO: 6040435 - DNA, 15 bp, Homo sapiens
catctgtcctcaccc

SEQ ID NO: 6040436 - DNA, 12 bp, Homo sapiens
catctgtcctga

SEQ ID NO: 6040437 - DNA, 18 bp, Homo sapiens
catctgtctaaagataga

SEQ ID NO: 6040438 - DNA, 22 bp, Homo sapiens
catctgtctccctccccaaatg

SEQ ID NO: 6040439 - DNA, 11 bp, Homo sapiens
catctgtctcg

SEQ ID NO: 6040440 - DNA, 20 bp, Homo sapiens
catctgtctcggctctgcat

SEQ ID NO: 6040441 - DNA, 23 bp, Homo sapiens
catctgtctgccaacctaaaact

SEQ ID NO: 6040442 - DNA, 13 bp, Homo sapiens
catctgtctgctc

SEQ ID NO: 6040443 - DNA, 16 bp, Homo sapiens
catctgtctgctctgc

SEQ ID NO: 6040444 - DNA, 16 bp, Homo sapiens
catctgtctggagggg

SEQ ID NO: 6040445 - DNA, 23 bp, Homo sapiens
catctgtctggaggggagctctg

SEQ ID NO: 6040446 - DNA, 11 bp, Homo sapiens
catctgtctgt

SEQ ID NO: 6040447 - DNA, 14 bp, Homo sapiens
catctgtctgtcct

SEQ ID NO: 6040448 - DNA, 15 bp, Homo sapiens
catctgtctgtccta

SEQ ID NO: 6040449 - DNA, 23 bp, Homo sapiens
catctgtctgtctgtgggcttca

SEQ ID NO: 6040450 - DNA, 22 bp, Homo sapiens
catctgtctttcactggaatga

SEQ ID NO: 6040451 - DNA, 11 bp, Homo sapiens
catctgtgaat

SEQ ID NO: 6040452 - DNA, 13 bp, Homo sapiens
catctgtgaataa

SEQ ID NO: 6040453 - DNA, 18 bp, Homo sapiens
catctgtgactataaagc

SEQ ID NO: 6040454 - DNA, 21 bp, Homo sapiens
catctgtgactataaagctgt

SEQ ID NO: 6040455 - DNA, 21 bp, Homo sapiens
catctgtgcacactaagaaat

SEQ ID NO: 6040456 - DNA, 15 bp, Homo sapiens
catctgtgcacgcag

SEQ ID NO: 6040457 - DNA, 21 bp, Homo sapiens
catctgtgcactgcccatgga

SEQ ID NO: 6040458 - DNA, 21 bp, Homo sapiens
catctgtgccatacttgttct

SEQ ID NO: 6040459 - DNA, 21 bp, Homo sapiens
catctgtgcctgtctgtccaa

SEQ ID NO: 6040460 - DNA, 10 bp, Homo sapiens
catctgtgcg

SEQ ID NO: 6040461 - DNA, 15 bp, Homo sapiens
catctgtggacaaga

SEQ ID NO: 6040462 - DNA, 17 bp, Homo sapiens
catctgtggagatgccc

SEQ ID NO: 6040463 - DNA, 19 bp, Homo sapiens
catctgtggagctgccaca

SEQ ID NO: 6040464 - DNA, 17 bp, Homo sapiens
catctgtggcctggggc

SEQ ID NO: 6040465 - DNA, 17 bp, Homo sapiens
catctgtgggcacgctg

SEQ ID NO: 6040466 - DNA, 11 bp, Homo sapiens
catctgtgtct

SEQ ID NO: 6040467 - DNA, 10 bp, Homo sapiens
catctgtgtg

SEQ ID NO: 6040468 - DNA, 17 bp, Homo sapiens
catctgtgtgcagcaac

SEQ ID NO: 6040469 - DNA, 13 bp, Homo sapiens
catctgtgtgtgt

SEQ ID NO: 6040470 - DNA, 11 bp, Homo sapiens
catctgtgttc

SEQ ID NO: 6040471 - DNA, 18 bp, Homo sapiens
catctgttatcctgctag

SEQ ID NO: 6040472 - DNA, 18 bp, Homo sapiens
catctgttgacaatttgc

SEQ ID NO: 6040473 - DNA, 19 bp, Homo sapiens
catctgtttaatttacaca

SEQ ID NO: 6040474 - DNA, 18 bp, Homo sapiens
catctgtttacctggcag

SEQ ID NO: 6040475 - DNA, 17 bp, Homo sapiens
catctgtttcaaactga

SEQ ID NO: 6040476 - DNA, 13 bp, Homo sapiens
catctgtttgtaa

SEQ ID NO: 6040477 - DNA, 14 bp, Homo sapiens
catcttaaaaacaa

SEQ ID NO: 6040478 - DNA, 14 bp, Homo sapiens
catcttaaaaatat

SEQ ID NO: 6040479 - DNA, 18 bp, Homo sapiens
catcttaaaaatattgtc

SEQ ID NO: 6040480 - DNA, 13 bp, Homo sapiens
catcttaaaagct

SEQ ID NO: 6040481 - DNA, 19 bp, Homo sapiens
catcttaaatcttaaaagt

SEQ ID NO: 6040482 - DNA, 16 bp, Homo sapiens
catcttaaatgacagt

SEQ ID NO: 6040483 - DNA, 13 bp, Homo sapiens
catcttaactctt

SEQ ID NO: 6040484 - DNA, 14 bp, Homo sapiens
catcttaatcttta

SEQ ID NO: 6040485 - DNA, 15 bp, Homo sapiens
catcttacagagact

SEQ ID NO: 6040486 - DNA, 18 bp, Homo sapiens
catcttacattagtgatt

SEQ ID NO: 6040487 - DNA, 23 bp, Homo sapiens
catcttacatttctcaccctact

SEQ ID NO: 6040488 - DNA, 21 bp, Homo sapiens
catcttacctctcatgcgtgt

SEQ ID NO: 6040489 - DNA, 22 bp, Homo sapiens
catcttactgtacctgttcctt

SEQ ID NO: 6040490 - DNA, 19 bp, Homo sapiens
catcttacttgagccttta

SEQ ID NO: 6040491 - DNA, 18 bp, Homo sapiens
catcttagctttccacag

SEQ ID NO: 6040492 - DNA, 21 bp, Homo sapiens
catcttaggcactttttaaca

SEQ ID NO: 6040493 - DNA, 19 bp, Homo sapiens
catcttagggtaggggaag

SEQ ID NO: 6040494 - DNA, 19 bp, Homo sapiens
catcttagtatttgcatat

SEQ ID NO: 6040495 - DNA, 14 bp, Homo sapiens
catcttagtgcctg

SEQ ID NO: 6040496 - DNA, 18 bp, Homo sapiens
catcttatagcactttga

SEQ ID NO: 6040497 - DNA, 15 bp, Homo sapiens
catcttattgaataa

SEQ ID NO: 6040498 - DNA, 19 bp, Homo sapiens
catcttattgaataaagag

SEQ ID NO: 6040499 - DNA, 19 bp, Homo sapiens
catcttatttattttagca

SEQ ID NO: 6040500 - DNA, 19 bp, Homo sapiens
catcttcaatatgaatcta

SEQ ID NO: 6040501 - DNA, 18 bp, Homo sapiens
catcttcacccaggccta

SEQ ID NO: 6040502 - DNA, 18 bp, Homo sapiens
catcttcacgcctgggtg

SEQ ID NO: 6040503 - DNA, 13 bp, Homo sapiens
catcttcactctt

SEQ ID NO: 6040504 - DNA, 19 bp, Homo sapiens
catcttcactcttcacttg

SEQ ID NO: 6040505 - DNA, 14 bp, Homo sapiens
catcttcacttcta

SEQ ID NO: 6040506 - DNA, 15 bp, Homo sapiens
catcttcagctccca

SEQ ID NO: 6040507 - DNA, 16 bp, Homo sapiens
catcttcagctcccat

SEQ ID NO: 6040508 - DNA, 18 bp, Homo sapiens
catcttcagctcccatag

SEQ ID NO: 6040509 - DNA, 14 bp, Homo sapiens
catcttcagttgtc

SEQ ID NO: 6040510 - DNA, 15 bp, Homo sapiens
catcttcagttgtct

SEQ ID NO: 6040511 - DNA, 20 bp, Homo sapiens
catcttcagttgtctctgat

SEQ ID NO: 6040512 - DNA, 17 bp, Homo sapiens
catcttcagtttctgaa

SEQ ID NO: 6040513 - DNA, 22 bp, Homo sapiens
catcttccacaggtctcagaat

SEQ ID NO: 6040514 - DNA, 22 bp, Homo sapiens
catcttccacctcacctctttg

SEQ ID NO: 6040515 - DNA, 14 bp, Homo sapiens
catcttccacctgt

SEQ ID NO: 6040516 - DNA, 17 bp, Homo sapiens
catcttccacctgtgcc

SEQ ID NO: 6040517 - DNA, 15 bp, Homo sapiens
catcttccaggatgg

SEQ ID NO: 6040518 - DNA, 20 bp, Homo sapiens
catcttccatatccgggtgc

SEQ ID NO: 6040519 - DNA, 12 bp, Homo sapiens
catcttcccagc

SEQ ID NO: 6040520 - DNA, 20 bp, Homo sapiens
catcttccccagccctcccc

SEQ ID NO: 6040521 - DNA, 13 bp, Homo sapiens
catcttcccgaga

SEQ ID NO: 6040522 - DNA, 18 bp, Homo sapiens
catcttcccgcctcagcc

SEQ ID NO: 6040523 - DNA, 21 bp, Homo sapiens
catcttcccgcctcagcctct

SEQ ID NO: 6040524 - DNA, 20 bp, Homo sapiens
catcttccctacccttcctg

SEQ ID NO: 6040525 - DNA, 21 bp, Homo sapiens
catcttccctacccttcctgc

SEQ ID NO: 6040526 - DNA, 22 bp, Homo sapiens
catcttccctagagggttcctg

SEQ ID NO: 6040527 - DNA, 12 bp, Homo sapiens
catcttccctgc

SEQ ID NO: 6040528 - DNA, 13 bp, Homo sapiens
catcttccctgcc

SEQ ID NO: 6040529 - DNA, 14 bp, Homo sapiens
catcttccctgccc

SEQ ID NO: 6040530 - DNA, 13 bp, Homo sapiens
catcttccctggc

SEQ ID NO: 6040531 - DNA, 20 bp, Homo sapiens
catcttcctgagctagcaaa

SEQ ID NO: 6040532 - DNA, 16 bp, Homo sapiens
catcttcctgcctact

SEQ ID NO: 6040533 - DNA, 15 bp, Homo sapiens
catcttcctgctgct

SEQ ID NO: 6040534 - DNA, 13 bp, Homo sapiens
catcttcctgtgt

SEQ ID NO: 6040535 - DNA, 15 bp, Homo sapiens
catcttcgggaccag

SEQ ID NO: 6040536 - DNA, 15 bp, Homo sapiens
catcttcgtcttcac

SEQ ID NO: 6040537 - DNA, 17 bp, Homo sapiens
catcttctcactccctt

SEQ ID NO: 6040538 - DNA, 13 bp, Homo sapiens
catcttctcagct

SEQ ID NO: 6040539 - DNA, 18 bp, Homo sapiens
catcttctcagctcccat

SEQ ID NO: 6040540 - DNA, 14 bp, Homo sapiens
catcttctcagtgt

SEQ ID NO: 6040541 - DNA, 23 bp, Homo sapiens
catcttctcattcccatgtggaa

SEQ ID NO: 6040542 - DNA, 16 bp, Homo sapiens
catcttctccatctgg

SEQ ID NO: 6040543 - DNA, 20 bp, Homo sapiens
catcttctccccgaggctgc

SEQ ID NO: 6040544 - DNA, 13 bp, Homo sapiens
catcttctgcctt

SEQ ID NO: 6040545 - DNA, 14 bp, Homo sapiens
catcttctggaata

SEQ ID NO: 6040546 - DNA, 18 bp, Homo sapiens
ccagagtccctgcctgga

SEQ ID NO: 6040547 - DNA, 18 bp, Homo sapiens
ccagagtccggaggcagc

SEQ ID NO: 6040548 - DNA, 14 bp, Homo sapiens
ccagagtcctggcc

SEQ ID NO: 6040549 - DNA, 16 bp, Homo sapiens
ccagagtcctggccct

SEQ ID NO: 6040550 - DNA, 21 bp, Homo sapiens
ccagagtcctttccaaggctt

SEQ ID NO: 6040551 - DNA, 23 bp, Homo sapiens
ccagagtctagcgtagtgcagca

SEQ ID NO: 6040552 - DNA, 18 bp, Homo sapiens
ccagagtctcccagtggg

SEQ ID NO: 6040553 - DNA, 16 bp, Homo sapiens
ccagagtctggagctg

SEQ ID NO: 6040554 - DNA, 22 bp, Homo sapiens
ccagagtgaaagggctatggca

SEQ ID NO: 6040555 - DNA, 23 bp, Homo sapiens
ccagagtgactgacggctgtgta

SEQ ID NO: 6040556 - DNA, 18 bp, Homo sapiens
ccagagtgctgaaggaat

SEQ ID NO: 6040557 - DNA, 15 bp, Homo sapiens
ccagagtgctgggat

SEQ ID NO: 6040558 - DNA, 14 bp, Homo sapiens
ccagagtgctgtcg

SEQ ID NO: 6040559 - DNA, 15 bp, Homo sapiens
ccagagtggagtctg

SEQ ID NO: 6040560 - DNA, 18 bp, Homo sapiens
ccagagtggagtctgagt

SEQ ID NO: 6040561 - DNA, 16 bp, Homo sapiens
ccagagtggccacggc

SEQ ID NO: 6040562 - DNA, 13 bp, Homo sapiens
ccagagtggccca

SEQ ID NO: 6040563 - DNA, 14 bp, Homo sapiens
ccagagtggcctgg

SEQ ID NO: 6040564 - DNA, 16 bp, Homo sapiens
ccagagtgggatccac

SEQ ID NO: 6040565 - DNA, 17 bp, Homo sapiens
ccagagtgtagggggcc

SEQ ID NO: 6040566 - DNA, 18 bp, Homo sapiens
ccagagtgtagggggcct

SEQ ID NO: 6040567 - DNA, 17 bp, Homo sapiens
ccagagtgtatgcatac

SEQ ID NO: 6040568 - DNA, 20 bp, Homo sapiens
ccagagtgtcctgctacctt

SEQ ID NO: 6040569 - DNA, 12 bp, Homo sapiens
ccagagtgtgaa

SEQ ID NO: 6040570 - DNA, 20 bp, Homo sapiens
ccagagtgtgcagactgatg

SEQ ID NO: 6040571 - DNA, 16 bp, Homo sapiens
ccagagttaaaatgtt

SEQ ID NO: 6040572 - DNA, 20 bp, Homo sapiens
ccagagttaaaatgtttact

SEQ ID NO: 6040573 - DNA, 22 bp, Homo sapiens
ccagagttaaaatgtttactgt

SEQ ID NO: 6040574 - DNA, 17 bp, Homo sapiens
ccagagttcctgcggag

SEQ ID NO: 6040575 - DNA, 15 bp, Homo sapiens
ccagagttgctggga

SEQ ID NO: 6040576 - DNA, 21 bp, Homo sapiens
ccagagttgctgggagctgaa

SEQ ID NO: 6040577 - DNA, 15 bp, Homo sapiens
ccagagttgctgtgc

SEQ ID NO: 6040578 - DNA, 14 bp, Homo sapiens
ccagagttgggggc

SEQ ID NO: 6040579 - DNA, 15 bp, Homo sapiens
ccagagttgggggct

SEQ ID NO: 6040580 - DNA, 17 bp, Homo sapiens
ccagagttgttctcagg

SEQ ID NO: 6040581 - DNA, 15 bp, Homo sapiens
ccagagtttgcctcc

SEQ ID NO: 6040582 - DNA, 16 bp, Homo sapiens
ccagagtttgcctccc

SEQ ID NO: 6040583 - DNA, 19 bp, Homo sapiens
ccagagtttgcctccctgc

SEQ ID NO: 6040584 - DNA, 21 bp, Homo sapiens
ccagagtttttaaagccttct

SEQ ID NO: 6040585 - DNA, 17 bp, Homo sapiens
ccagataaatagaacta

SEQ ID NO: 6040586 - DNA, 16 bp, Homo sapiens
ccagataactgaggag

SEQ ID NO: 6040587 - DNA, 14 bp, Homo sapiens
ccagataaggcaag

SEQ ID NO: 6040588 - DNA, 21 bp, Homo sapiens
ccagataaggcaagccagtca

SEQ ID NO: 6040589 - DNA, 12 bp, Homo sapiens
ccagataagtaa

SEQ ID NO: 6040590 - DNA, 13 bp, Homo sapiens
ccagataccagcc

SEQ ID NO: 6040591 - DNA, 20 bp, Homo sapiens
ccagataccagcccctgtat

SEQ ID NO: 6040592 - DNA, 21 bp, Homo sapiens
ccagatacccatcttgaaaaa

SEQ ID NO: 6040593 - DNA, 13 bp, Homo sapiens
ccagatacctgtg

SEQ ID NO: 6040594 - DNA, 16 bp, Homo sapiens
ccagatacctgtgagg

SEQ ID NO: 6040595 - DNA, 13 bp, Homo sapiens
ccagatagagaaa

SEQ ID NO: 6040596 - DNA, 15 bp, Homo sapiens
ccagatagcctaggg

SEQ ID NO: 6040597 - DNA, 20 bp, Homo sapiens
ccagatagtgtagctgagga

SEQ ID NO: 6040598 - DNA, 17 bp, Homo sapiens
ccagatataactgtctt

SEQ ID NO: 6040599 - DNA, 21 bp, Homo sapiens
ccagatatgaacagggcccag

SEQ ID NO: 6040600 - DNA, 22 bp, Homo sapiens
ccagatatgaacagggcccagg

SEQ ID NO: 6040601 - DNA, 17 bp, Homo sapiens
ccagatatggaaacaga

SEQ ID NO: 6040602 - DNA, 19 bp, Homo sapiens
ccagatattcaagtcacct

SEQ ID NO: 6040603 - DNA, 14 bp, Homo sapiens
ccagatatttatgt

SEQ ID NO: 6040604 - DNA, 23 bp, Homo sapiens
ccagatatttatgtatcttgatg

SEQ ID NO: 6040605 - DNA, 19 bp, Homo sapiens
ccagatcaccaatctagat

SEQ ID NO: 6040606 - DNA, 18 bp, Homo sapiens
ccagatcaccagcccggc

SEQ ID NO: 6040607 - DNA, 21 bp, Homo sapiens
ccagatcaccagcccggcctg

SEQ ID NO: 6040608 - DNA, 20 bp, Homo sapiens
ccagatcactgccacactct

SEQ ID NO: 6040609 - DNA, 14 bp, Homo sapiens
ccagatcaggaacc

SEQ ID NO: 6040610 - DNA, 20 bp, Homo sapiens
ccagatcaggaaccagggcc

SEQ ID NO: 6040611 - DNA, 16 bp, Homo sapiens
ccagatccagactgta

SEQ ID NO: 6040612 - DNA, 13 bp, Homo sapiens
ccagatccagcct

SEQ ID NO: 6040613 - DNA, 16 bp, Homo sapiens
ccagatccagcctggg

SEQ ID NO: 6040614 - DNA, 18 bp, Homo sapiens
ccagatccaggaacacat

SEQ ID NO: 6040615 - DNA, 20 bp, Homo sapiens
ccagatccaggaacacatgc

SEQ ID NO: 6040616 - DNA, 18 bp, Homo sapiens
ccagatccagtatcttgt

SEQ ID NO: 6040617 - DNA, 16 bp, Homo sapiens
ccagatcccagaagga

SEQ ID NO: 6040618 - DNA, 17 bp, Homo sapiens
ccagatcccagaaggac

SEQ ID NO: 6040619 - DNA, 13 bp, Homo sapiens
ccagatcccaggc

SEQ ID NO: 6040620 - DNA, 13 bp, Homo sapiens
ccagatccccagg

SEQ ID NO: 6040621 - DNA, 20 bp, Homo sapiens
ccagatccccagggcagcct

SEQ ID NO: 6040622 - DNA, 15 bp, Homo sapiens
ccagatccgctccag

SEQ ID NO: 6040623 - DNA, 16 bp, Homo sapiens
ccagatcctctctggg

SEQ ID NO: 6040624 - DNA, 18 bp, Homo sapiens
ccagatcctctgctgact

SEQ ID NO: 6040625 - DNA, 15 bp, Homo sapiens
ccagatcctcttggt

SEQ ID NO: 6040626 - DNA, 15 bp, Homo sapiens
ccagatcctggaaat

SEQ ID NO: 6040627 - DNA, 13 bp, Homo sapiens
ccagatcctgggt

SEQ ID NO: 6040628 - DNA, 20 bp, Homo sapiens
ccagatccttttccatccca

SEQ ID NO: 6040629 - DNA, 20 bp, Homo sapiens
ccagatcgctcccttggctt

SEQ ID NO: 6040630 - DNA, 12 bp, Homo sapiens
ccagatctccca

SEQ ID NO: 6040631 - DNA, 23 bp, Homo sapiens
ccagatctgatttgtaacccact

SEQ ID NO: 6040632 - DNA, 13 bp, Homo sapiens
ccagatctgcctg

SEQ ID NO: 6040633 - DNA, 19 bp, Homo sapiens
ccagatctgcctgggcctg

SEQ ID NO: 6040634 - DNA, 21 bp, Homo sapiens
ccagatctgcctgggcctgtg

SEQ ID NO: 6040635 - DNA, 22 bp, Homo sapiens
ccagatctgcctgggcctgtgc

SEQ ID NO: 6040636 - DNA, 24 bp, Homo sapiens
ccagatctgcctgggcctgtgcag

SEQ ID NO: 6040637 - DNA, 19 bp, Homo sapiens
ccagatctggtcccttgca

SEQ ID NO: 6040638 - DNA, 13 bp, Homo sapiens
ccagatctgtcct

SEQ ID NO: 6040639 - DNA, 15 bp, Homo sapiens
ccagatctgtcctgg

SEQ ID NO: 6040640 - DNA, 16 bp, Homo sapiens
ccagatctgtcctggg

SEQ ID NO: 6040641 - DNA, 15 bp, Homo sapiens
ccagatctttctctt

SEQ ID NO: 6040642 - DNA, 16 bp, Homo sapiens
ccagatctttctcttc

SEQ ID NO: 6040643 - DNA, 22 bp, Homo sapiens
ccagatctttctcttccctgaa

SEQ ID NO: 6040644 - DNA, 23 bp, Homo sapiens
ccagatgacagggagctggggaa

SEQ ID NO: 6040645 - DNA, 23 bp, Homo sapiens
ccagatgagaagttaagcagcct

SEQ ID NO: 6040646 - DNA, 20 bp, Homo sapiens
ccagatgatccttgcacaga

SEQ ID NO: 6040647 - DNA, 18 bp, Homo sapiens
ccagatgattttcctccc

SEQ ID NO: 6040648 - DNA, 17 bp, Homo sapiens
ccagatgcaacctcact

SEQ ID NO: 6040649 - DNA, 13 bp, Homo sapiens
ccagatgcaccag

SEQ ID NO: 6040650 - DNA, 23 bp, Homo sapiens
ccagatgcaccagcccttagcag

SEQ ID NO: 6040651 - DNA, 15 bp, Homo sapiens
ccagatgcaggacag

SEQ ID NO: 6040652 - DNA, 16 bp, Homo sapiens
ccagatgcaggacagg

SEQ ID NO: 6040653 - DNA, 17 bp, Homo sapiens
ccagatgcaggacagga

SEQ ID NO: 6040654 - DNA, 18 bp, Homo sapiens
ccagatgcccctttctgg

SEQ ID NO: 6040655 - DNA, 20 bp, Homo sapiens
ccagatgcctccccaagact

SEQ ID NO: 6040656 - DNA, 16 bp, Homo sapiens
ccagatgccttcctgt

SEQ ID NO: 6040657 - DNA, 20 bp, Homo sapiens
ccagatgccttcctgtcttt

SEQ ID NO: 6040658 - DNA, 18 bp, Homo sapiens
ccagatgccttctccaga

SEQ ID NO: 6040659 - DNA, 13 bp, Homo sapiens
ccagatgcgggga

SEQ ID NO: 6040660 - DNA, 16 bp, Homo sapiens
ccagatgcggggacag

SEQ ID NO: 6040661 - DNA, 17 bp, Homo sapiens
ccagatgctagagcctc

SEQ ID NO: 6040662 - DNA, 22 bp, Homo sapiens
ccagatgctagagcctctgcct

SEQ ID NO: 6040663 - DNA, 19 bp, Homo sapiens
ccagatgctgatgttcagt

SEQ ID NO: 6040664 - DNA, 14 bp, Homo sapiens
ccagatgctgcaga

SEQ ID NO: 6040665 - DNA, 14 bp, Homo sapiens
ccagatgctttcct

SEQ ID NO: 6040666 - DNA, 17 bp, Homo sapiens
ccagatggactccagcc

SEQ ID NO: 6040667 - DNA, 14 bp, Homo sapiens
ccagatggcaggct

SEQ ID NO: 6040668 - DNA, 17 bp, Homo sapiens
ccagatggcccctccac

SEQ ID NO: 6040669 - DNA, 19 bp, Homo sapiens
ccagatggcccctccactg

SEQ ID NO: 6040670 - DNA, 23 bp, Homo sapiens
ccagatggcccggatgctgcttc

SEQ ID NO: 6040671 - DNA, 21 bp, Homo sapiens
ccagatggcctgaagcaactg

SEQ ID NO: 6040672 - DNA, 14 bp, Homo sapiens
ccagatggctccct

SEQ ID NO: 6040673 - DNA, 19 bp, Homo sapiens
ccagatggcttcggagggc

SEQ ID NO: 6040674 - DNA, 22 bp, Homo sapiens
ccagatgggccacggctgagcc

SEQ ID NO: 6040675 - DNA, 14 bp, Homo sapiens
ccagatggggcctc

SEQ ID NO: 6040676 - DNA, 16 bp, Homo sapiens
ccagatggtcatccag

SEQ ID NO: 6040677 - DNA, 20 bp, Homo sapiens
ccagatgtccgtctctcttg

SEQ ID NO: 6040678 - DNA, 18 bp, Homo sapiens
ccagatgtcgctgggtcc

SEQ ID NO: 6040679 - DNA, 23 bp, Homo sapiens
ccagatgtcgctgggtcctctgc

SEQ ID NO: 6040680 - DNA, 23 bp, Homo sapiens
ccagatgtgacggggtgtgtggc

SEQ ID NO: 6040681 - DNA, 21 bp, Homo sapiens
ccagatgtgagggcaccacca

SEQ ID NO: 6040682 - DNA, 13 bp, Homo sapiens
ccagatgtggcta

SEQ ID NO: 6040683 - DNA, 22 bp, Homo sapiens
ccagatgttgcttttgaaaagt

SEQ ID NO: 6040684 - DNA, 17 bp, Homo sapiens
ccagatgttgttcctgg

SEQ ID NO: 6040685 - DNA, 21 bp, Homo sapiens
ccagatgttttacgtctggga

SEQ ID NO: 6040686 - DNA, 19 bp, Homo sapiens
ccagatgttttatttatga

SEQ ID NO: 6040687 - DNA, 22 bp, Homo sapiens
ccagattacaggaatgaagaac

SEQ ID NO: 6040688 - DNA, 18 bp, Homo sapiens
ccagattaggcctggagt

SEQ ID NO: 6040689 - DNA, 18 bp, Homo sapiens
ccagattattggctgctt

SEQ ID NO: 6040690 - DNA, 19 bp, Homo sapiens
ccagattattggctgcttt

SEQ ID NO: 6040691 - DNA, 19 bp, Homo sapiens
ccagattcacttctgaatt

SEQ ID NO: 6040692 - DNA, 22 bp, Homo sapiens
ccagattcagggagaatgttgt

SEQ ID NO: 6040693 - DNA, 13 bp, Homo sapiens
ccagattcccagg

SEQ ID NO: 6040694 - DNA, 13 bp, Homo sapiens
ccagattctgatg

SEQ ID NO: 6040695 - DNA, 14 bp, Homo sapiens
ccagattctgcctc

SEQ ID NO: 6040696 - DNA, 15 bp, Homo sapiens
ccagattctgcctct

SEQ ID NO: 6040697 - DNA, 18 bp, Homo sapiens
ccagattctgcctctctg

SEQ ID NO: 6040698 - DNA, 14 bp, Homo sapiens
ccagattcttcagc

SEQ ID NO: 6040699 - DNA, 19 bp, Homo sapiens
ccagattcttccactggct

SEQ ID NO: 6040700 - DNA, 19 bp, Homo sapiens
ccagattctttcctgaggc

SEQ ID NO: 6040701 - DNA, 23 bp, Homo sapiens
ccagattctttcctgaggctggg

SEQ ID NO: 6040702 - DNA, 18 bp, Homo sapiens
ccagattgacgacaagtg

SEQ ID NO: 6040703 - DNA, 18 bp, Homo sapiens
ccagattgcaacaggctg

SEQ ID NO: 6040704 - DNA, 19 bp, Homo sapiens
ccagattgcaacaggctgg

SEQ ID NO: 6040705 - DNA, 22 bp, Homo sapiens
ccagattgcaacaggctgggct

SEQ ID NO: 6040706 - DNA, 21 bp, Homo sapiens
ccagattggctcacactgaga

SEQ ID NO: 6040707 - DNA, 19 bp, Homo sapiens
ccagattgggggccctggg

SEQ ID NO: 6040708 - DNA, 13 bp, Homo sapiens
ccagattgtagct

SEQ ID NO: 6040709 - DNA, 19 bp, Homo sapiens
ccagattgttctgtccagt

SEQ ID NO: 6040710 - DNA, 17 bp, Homo sapiens
ccagatttattttaaac

SEQ ID NO: 6040711 - DNA, 12 bp, Homo sapiens
ccagatttcact

SEQ ID NO: 6040712 - DNA, 15 bp, Homo sapiens
ccagatttcactctc

SEQ ID NO: 6040713 - DNA, 17 bp, Homo sapiens
ccagatttgaggctggt

SEQ ID NO: 6040714 - DNA, 16 bp, Homo sapiens
ccagatttgtttcctt

SEQ ID NO: 6040715 - DNA, 18 bp, Homo sapiens
ccagatttttcggaggcc

SEQ ID NO: 6040716 - DNA, 22 bp, Homo sapiens
ccagattttttaaaatttatat

SEQ ID NO: 6040717 - DNA, 18 bp, Homo sapiens
ccagcaaaaactgtggga

SEQ ID NO: 6040718 - DNA, 17 bp, Homo sapiens
ccagcaaaatccaaact

SEQ ID NO: 6040719 - DNA, 23 bp, Homo sapiens
ccagcaaaatccaaactgctgtc

SEQ ID NO: 6040720 - DNA, 13 bp, Homo sapiens
ccagcaaaatgga

SEQ ID NO: 6040721 - DNA, 14 bp, Homo sapiens
ccagcaaaatggaa

SEQ ID NO: 6040722 - DNA, 23 bp, Homo sapiens
ccagcaaaatggaagcaaagaca

SEQ ID NO: 6040723 - DNA, 15 bp, Homo sapiens
ccagcaaacaaaatg

SEQ ID NO: 6040724 - DNA, 19 bp, Homo sapiens
catcttctggagtctccag

SEQ ID NO: 6040725 - DNA, 12 bp, Homo sapiens
catcttctggct

SEQ ID NO: 6040726 - DNA, 21 bp, Homo sapiens
catcttcttcccagtaagttt

SEQ ID NO: 6040727 - DNA, 21 bp, Homo sapiens
catcttcttgcatctaatgaa

SEQ ID NO: 6040728 - DNA, 16 bp, Homo sapiens
catcttgaaaatgcca

SEQ ID NO: 6040729 - DNA, 14 bp, Homo sapiens
catcttgaagtgat

SEQ ID NO: 6040730 - DNA, 22 bp, Homo sapiens
catcttgaatactctgccctct

SEQ ID NO: 6040731 - DNA, 17 bp, Homo sapiens
catcttgaatatttgct

SEQ ID NO: 6040732 - DNA, 19 bp, Homo sapiens
catcttgaatatttgctta

SEQ ID NO: 6040733 - DNA, 18 bp, Homo sapiens
catcttgaatccttccat

SEQ ID NO: 6040734 - DNA, 23 bp, Homo sapiens
catcttgaatccttccattccac

SEQ ID NO: 6040735 - DNA, 15 bp, Homo sapiens
catcttgacagagcc

SEQ ID NO: 6040736 - DNA, 20 bp, Homo sapiens
catcttgacagagcctgccc

SEQ ID NO: 6040737 - DNA, 22 bp, Homo sapiens
catcttgacagagcctgcccca

SEQ ID NO: 6040738 - DNA, 20 bp, Homo sapiens
catcttgaccaagcaggaag

SEQ ID NO: 6040739 - DNA, 21 bp, Homo sapiens
catcttgaccaagcaggaagc

SEQ ID NO: 6040740 - DNA, 24 bp, Homo sapiens
catcttgaccaagcaggaagctca

SEQ ID NO: 6040741 - DNA, 11 bp, Homo sapiens
catcttgagct

SEQ ID NO: 6040742 - DNA, 23 bp, Homo sapiens
catcttgatctgctcagccctgg

SEQ ID NO: 6040743 - DNA, 21 bp, Homo sapiens
catcttgatctttgagcccat

SEQ ID NO: 6040744 - DNA, 18 bp, Homo sapiens
catcttgcagcatttact

SEQ ID NO: 6040745 - DNA, 20 bp, Homo sapiens
catcttgcagcatttactat

SEQ ID NO: 6040746 - DNA, 12 bp, Homo sapiens
catcttgccccc

SEQ ID NO: 6040747 - DNA, 18 bp, Homo sapiens
catcttgccccctcatct

SEQ ID NO: 6040748 - DNA, 20 bp, Homo sapiens
catcttgccccctcatctca

SEQ ID NO: 6040749 - DNA, 20 bp, Homo sapiens
catcttgcccgctcaggctg

SEQ ID NO: 6040750 - DNA, 18 bp, Homo sapiens
catcttgcctccaggtgc

SEQ ID NO: 6040751 - DNA, 12 bp, Homo sapiens
catcttgctacc

SEQ ID NO: 6040752 - DNA, 23 bp, Homo sapiens
catcttgctaccagtatttagaa

SEQ ID NO: 6040753 - DNA, 15 bp, Homo sapiens
catcttgctctgctg

SEQ ID NO: 6040754 - DNA, 17 bp, Homo sapiens
catcttgctctgtggcc

SEQ ID NO: 6040755 - DNA, 14 bp, Homo sapiens
catcttgcttccaa

SEQ ID NO: 6040756 - DNA, 14 bp, Homo sapiens
catcttgcttccct

SEQ ID NO: 6040757 - DNA, 12 bp, Homo sapiens
catcttggaaat

SEQ ID NO: 6040758 - DNA, 18 bp, Homo sapiens
catcttggccctcctcag

SEQ ID NO: 6040759 - DNA, 20 bp, Homo sapiens
catcttggccctcctcagct

SEQ ID NO: 6040760 - DNA, 22 bp, Homo sapiens
catcttggccctcctcagctcc

SEQ ID NO: 6040761 - DNA, 20 bp, Homo sapiens
catcttggggacatctcttt

SEQ ID NO: 6040762 - DNA, 18 bp, Homo sapiens
catcttgggggtcaccca

SEQ ID NO: 6040763 - DNA, 23 bp, Homo sapiens
catcttggtagttctgtgcctcc

SEQ ID NO: 6040764 - DNA, 15 bp, Homo sapiens
catcttggtcctgtc

SEQ ID NO: 6040765 - DNA, 17 bp, Homo sapiens
catcttggtcctgtcac

SEQ ID NO: 6040766 - DNA, 19 bp, Homo sapiens
catcttggtcctgtcaccc

SEQ ID NO: 6040767 - DNA, 23 bp, Homo sapiens
catcttggttatttctgaaggta

SEQ ID NO: 6040768 - DNA, 12 bp, Homo sapiens
catcttgtacaa

SEQ ID NO: 6040769 - DNA, 13 bp, Homo sapiens
catcttgtgaaat

SEQ ID NO: 6040770 - DNA, 12 bp, Homo sapiens
catcttgtgcat

SEQ ID NO: 6040771 - DNA, 18 bp, Homo sapiens
catcttgtgcatgcaaaa

SEQ ID NO: 6040772 - DNA, 20 bp, Homo sapiens
catcttgtgcatgcaaaaat

SEQ ID NO: 6040773 - DNA, 15 bp, Homo sapiens
catcttgtggggcca

SEQ ID NO: 6040774 - DNA, 17 bp, Homo sapiens
catcttgtggggccagg

SEQ ID NO: 6040775 - DNA, 18 bp, Homo sapiens
catcttgtggggccagga

SEQ ID NO: 6040776 - DNA, 20 bp, Homo sapiens
catcttgttggtacctttct

SEQ ID NO: 6040777 - DNA, 20 bp, Homo sapiens
catcttgtttcatttgcttg

SEQ ID NO: 6040778 - DNA, 22 bp, Homo sapiens
catctttaaggtattgtgcatc

SEQ ID NO: 6040779 - DNA, 21 bp, Homo sapiens
catctttacgtactgtaactg

SEQ ID NO: 6040780 - DNA, 22 bp, Homo sapiens
catctttacgtactgtaactgc

SEQ ID NO: 6040781 - DNA, 17 bp, Homo sapiens
catctttagcgctggct

SEQ ID NO: 6040782 - DNA, 22 bp, Homo sapiens
catctttatagaaggaatttgt

SEQ ID NO: 6040783 - DNA, 13 bp, Homo sapiens
catctttatcatc

SEQ ID NO: 6040784 - DNA, 16 bp, Homo sapiens
catctttatctcctgg

SEQ ID NO: 6040785 - DNA, 12 bp, Homo sapiens
catctttcacat

SEQ ID NO: 6040786 - DNA, 13 bp, Homo sapiens
catctttcagaaa

SEQ ID NO: 6040787 - DNA, 18 bp, Homo sapiens
catctttcatagttctgt

SEQ ID NO: 6040788 - DNA, 17 bp, Homo sapiens
catctttcatcaatcat

SEQ ID NO: 6040789 - DNA, 20 bp, Homo sapiens
catctttccaaattgatggg

SEQ ID NO: 6040790 - DNA, 18 bp, Homo sapiens
catctttcccaaaaccca

SEQ ID NO: 6040791 - DNA, 23 bp, Homo sapiens
catctttcctcaagtatcttcta

SEQ ID NO: 6040792 - DNA, 19 bp, Homo sapiens
catctttcctttgctctgg

SEQ ID NO: 6040793 - DNA, 15 bp, Homo sapiens
catctttctcttccc

SEQ ID NO: 6040794 - DNA, 20 bp, Homo sapiens
catctttctcttttctaaaa

SEQ ID NO: 6040795 - DNA, 21 bp, Homo sapiens
catctttcttctattttattc

SEQ ID NO: 6040796 - DNA, 15 bp, Homo sapiens
catctttgaaaagaa

SEQ ID NO: 6040797 - DNA, 17 bp, Homo sapiens
catctttgaaaagaaaa

SEQ ID NO: 6040798 - DNA, 18 bp, Homo sapiens
catctttgaaattatgta

SEQ ID NO: 6040799 - DNA, 15 bp, Homo sapiens
catctttgatgtgtt

SEQ ID NO: 6040800 - DNA, 17 bp, Homo sapiens
catctttgcaggttgct

SEQ ID NO: 6040801 - DNA, 12 bp, Homo sapiens
catctttgctga

SEQ ID NO: 6040802 - DNA, 19 bp, Homo sapiens
catctttggcaaaggtccc

SEQ ID NO: 6040803 - DNA, 15 bp, Homo sapiens
catctttggggaggt

SEQ ID NO: 6040804 - DNA, 18 bp, Homo sapiens
catctttggggaggtgtt

SEQ ID NO: 6040805 - DNA, 21 bp, Homo sapiens
catctttgttggctcagaaaa

SEQ ID NO: 6040806 - DNA, 17 bp, Homo sapiens
catcttttaatcatgag

SEQ ID NO: 6040807 - DNA, 21 bp, Homo sapiens
catcttttaatcatgagcctg

SEQ ID NO: 6040808 - DNA, 23 bp, Homo sapiens
catcttttaatcatgagcctgtt

SEQ ID NO: 6040809 - DNA, 17 bp, Homo sapiens
catcttttattttggaa

SEQ ID NO: 6040810 - DNA, 22 bp, Homo sapiens
catcttttattttggaactatg

SEQ ID NO: 6040811 - DNA, 23 bp, Homo sapiens
catcttttcctcccattttagaa

SEQ ID NO: 6040812 - DNA, 20 bp, Homo sapiens
catcttttctagagacacat

SEQ ID NO: 6040813 - DNA, 22 bp, Homo sapiens
catcttttctagagacacattg

SEQ ID NO: 6040814 - DNA, 14 bp, Homo sapiens
catcttttcttgcc

SEQ ID NO: 6040815 - DNA, 14 bp, Homo sapiens
catcttttgaagag

SEQ ID NO: 6040816 - DNA, 14 bp, Homo sapiens
catcttttgggaag

SEQ ID NO: 6040817 - DNA, 23 bp, Homo sapiens
catcttttgggaagccaggaaag

SEQ ID NO: 6040818 - DNA, 23 bp, Homo sapiens
catcttttgttaagttcaccgta

SEQ ID NO: 6040819 - DNA, 11 bp, Homo sapiens
catctttttaa

SEQ ID NO: 6040820 - DNA, 22 bp, Homo sapiens
catctttttaaagcttatccat

SEQ ID NO: 6040821 - DNA, 23 bp, Homo sapiens
catctttttaaagcttatccata

SEQ ID NO: 6040822 - DNA, 21 bp, Homo sapiens
catctttttcctccctttccc

SEQ ID NO: 6040823 - DNA, 14 bp, Homo sapiens
catctttttctaga

SEQ ID NO: 6040824 - DNA, 16 bp, Homo sapiens
catctttttcttgggt

SEQ ID NO: 6040825 - DNA, 14 bp, Homo sapiens
catctttttctttt

SEQ ID NO: 6040826 - DNA, 18 bp, Homo sapiens
catcttttttgttaactg

SEQ ID NO: 6040827 - DNA, 18 bp, Homo sapiens
catgaaaaaaggacaatt

SEQ ID NO: 6040828 - DNA, 16 bp, Homo sapiens
catgaaaaacaaacaa

SEQ ID NO: 6040829 - DNA, 20 bp, Homo sapiens
catgaaaaacacggcagctg

SEQ ID NO: 6040830 - DNA, 21 bp, Homo sapiens
catgaaaaacacggcagctgt

SEQ ID NO: 6040831 - DNA, 13 bp, Homo sapiens
catgaaaaagcag

SEQ ID NO: 6040832 - DNA, 19 bp, Homo sapiens
catgaaaaagcagctacca

SEQ ID NO: 6040833 - DNA, 20 bp, Homo sapiens
catgaaaaatcatgggccag

SEQ ID NO: 6040834 - DNA, 13 bp, Homo sapiens
catgaaaacacat

SEQ ID NO: 6040835 - DNA, 19 bp, Homo sapiens
catgaaaacacatttttct

SEQ ID NO: 6040836 - DNA, 13 bp, Homo sapiens
catgaaaacgttt

SEQ ID NO: 6040837 - DNA, 21 bp, Homo sapiens
catgaaaacgttttattgtgt

SEQ ID NO: 6040838 - DNA, 15 bp, Homo sapiens
catgaaaactatttt

SEQ ID NO: 6040839 - DNA, 21 bp, Homo sapiens
catgaaaagttttcaagcatt

SEQ ID NO: 6040840 - DNA, 23 bp, Homo sapiens
catgaaaatagctatttttttcc

SEQ ID NO: 6040841 - DNA, 21 bp, Homo sapiens
catgaaaatcctaccaacctc

SEQ ID NO: 6040842 - DNA, 22 bp, Homo sapiens
catgaaaatgcaacaacatgta

SEQ ID NO: 6040843 - DNA, 17 bp, Homo sapiens
catgaaaattttaaaaa

SEQ ID NO: 6040844 - DNA, 13 bp, Homo sapiens
catgaaacagaaa

SEQ ID NO: 6040845 - DNA, 15 bp, Homo sapiens
catgaaacagaaaca

SEQ ID NO: 6040846 - DNA, 14 bp, Homo sapiens
catgaaacagcagc

SEQ ID NO: 6040847 - DNA, 15 bp, Homo sapiens
catgaaacagcagct

SEQ ID NO: 6040848 - DNA, 12 bp, Homo sapiens
catgaaacatta

SEQ ID NO: 6040849 - DNA, 22 bp, Homo sapiens
catgaaaccttattttttccca

SEQ ID NO: 6040850 - DNA, 15 bp, Homo sapiens
catgaaactccacct

SEQ ID NO: 6040851 - DNA, 12 bp, Homo sapiens
catgaaagaaaa

SEQ ID NO: 6040852 - DNA, 12 bp, Homo sapiens
catgaaagcatt

SEQ ID NO: 6040853 - DNA, 22 bp, Homo sapiens
catgaaagccctggaattttag

SEQ ID NO: 6040854 - DNA, 19 bp, Homo sapiens
catgaaaggttaaaaaagc

SEQ ID NO: 6040855 - DNA, 22 bp, Homo sapiens
catgaaagtagcagtgtgaagt

SEQ ID NO: 6040856 - DNA, 23 bp, Homo sapiens
catgaaagtcaagtctacctgcc

SEQ ID NO: 6040857 - DNA, 16 bp, Homo sapiens
catgaaagttttgcaa

SEQ ID NO: 6040858 - DNA, 20 bp, Homo sapiens
catgaaagttttgcaaaggg

SEQ ID NO: 6040859 - DNA, 16 bp, Homo sapiens
catgaaataaagaatt

SEQ ID NO: 6040860 - DNA, 21 bp, Homo sapiens
catgaaatatattttctcttt

SEQ ID NO: 6040861 - DNA, 15 bp, Homo sapiens
catgaaatatgcatc

SEQ ID NO: 6040862 - DNA, 13 bp, Homo sapiens
catgaaatgaaca

SEQ ID NO: 6040863 - DNA, 13 bp, Homo sapiens
catgaaatgtgaa

SEQ ID NO: 6040864 - DNA, 14 bp, Homo sapiens
catgaaatgtgaat

SEQ ID NO: 6040865 - DNA, 20 bp, Homo sapiens
catgaaatgtgaatttttat

SEQ ID NO: 6040866 - DNA, 14 bp, Homo sapiens
catgaaattaataa

SEQ ID NO: 6040867 - DNA, 24 bp, Homo sapiens
catgaaattgtctagcagagcagg

SEQ ID NO: 6040868 - DNA, 16 bp, Homo sapiens
catgaaatttttgtaa

SEQ ID NO: 6040869 - DNA, 12 bp, Homo sapiens
catgaacaaaat

SEQ ID NO: 6040870 - DNA, 21 bp, Homo sapiens
catgaacaaattctttagtac

SEQ ID NO: 6040871 - DNA, 14 bp, Homo sapiens
catgaacacacatg

SEQ ID NO: 6040872 - DNA, 18 bp, Homo sapiens
catgaacacacatggatg

SEQ ID NO: 6040873 - DNA, 16 bp, Homo sapiens
catgaacacactgtgt

SEQ ID NO: 6040874 - DNA, 18 bp, Homo sapiens
catgaacacactgtgtcc

SEQ ID NO: 6040875 - DNA, 19 bp, Homo sapiens
catgaacacatcagctagc

SEQ ID NO: 6040876 - DNA, 22 bp, Homo sapiens
catgaacagaaaacattctgat

SEQ ID NO: 6040877 - DNA, 23 bp, Homo sapiens
catgaacagaaaacattctgatt

SEQ ID NO: 6040878 - DNA, 13 bp, Homo sapiens
catgaacatgtac

SEQ ID NO: 6040879 - DNA, 16 bp, Homo sapiens
catgaacatgttcctg

SEQ ID NO: 6040880 - DNA, 15 bp, Homo sapiens
catgaaccaaatggt

SEQ ID NO: 6040881 - DNA, 17 bp, Homo sapiens
catgaaccctcttgcca

SEQ ID NO: 6040882 - DNA, 19 bp, Homo sapiens
catgaaccctcttgccatc

SEQ ID NO: 6040883 - DNA, 13 bp, Homo sapiens
catgaaccctgcc

SEQ ID NO: 6040884 - DNA, 14 bp, Homo sapiens
catgaaccctgccc

SEQ ID NO: 6040885 - DNA, 20 bp, Homo sapiens
catgaacctcaagctgcatc

SEQ ID NO: 6040886 - DNA, 17 bp, Homo sapiens
catgaacgttattatat

SEQ ID NO: 6040887 - DNA, 18 bp, Homo sapiens
catgaactcatcattttt

SEQ ID NO: 6040888 - DNA, 20 bp, Homo sapiens
catgaactggcttgtacatt

SEQ ID NO: 6040889 - DNA, 20 bp, Homo sapiens
catgaacttagattttacat

SEQ ID NO: 6040890 - DNA, 14 bp, Homo sapiens
catgaagaagctgg

SEQ ID NO: 6040891 - DNA, 20 bp, Homo sapiens
catgaagaatgcattcaaaa

SEQ ID NO: 6040892 - DNA, 12 bp, Homo sapiens
catgaagacaga

SEQ ID NO: 6040893 - DNA, 17 bp, Homo sapiens
catgaagaccacatcca

SEQ ID NO: 6040894 - DNA, 19 bp, Homo sapiens
catgaagacctttttctgc

SEQ ID NO: 6040895 - DNA, 20 bp, Homo sapiens
catgaagacctttttctgca

SEQ ID NO: 6040896 - DNA, 12 bp, Homo sapiens
catgaagagaag

SEQ ID NO: 6040897 - DNA, 21 bp, Homo sapiens
catgaagagaagcaattttgg

SEQ ID NO: 6040898 - DNA, 14 bp, Homo sapiens
catgaagagactct

SEQ ID NO: 6040899 - DNA, 19 bp, Homo sapiens
catgaagagcaaaaatatc

SEQ ID NO: 6040900 - DNA, 18 bp, Homo sapiens
catgaagaggatgctgtg

SEQ ID NO: 6040901 - DNA, 15 bp, Homo sapiens
ccagcaaacagctga

SEQ ID NO: 6040902 - DNA, 18 bp, Homo sapiens
ccagcaaaccaggactct

SEQ ID NO: 6040903 - DNA, 16 bp, Homo sapiens
ccagcaaagcccccag

SEQ ID NO: 6040904 - DNA, 21 bp, Homo sapiens
ccagcaaagcccccagagccc

SEQ ID NO: 6040905 - DNA, 15 bp, Homo sapiens
ccagcaaagcctcca

SEQ ID NO: 6040906 - DNA, 15 bp, Homo sapiens
ccagcaaatgggcat

SEQ ID NO: 6040907 - DNA, 14 bp, Homo sapiens
ccagcaacacagcc

SEQ ID NO: 6040908 - DNA, 15 bp, Homo sapiens
ccagcaacacagcct

SEQ ID NO: 6040909 - DNA, 16 bp, Homo sapiens
ccagcaacacagcctg

SEQ ID NO: 6040910 - DNA, 19 bp, Homo sapiens
ccagcaacacagcctgggc

SEQ ID NO: 6040911 - DNA, 20 bp, Homo sapiens
ccagcaacacagcctgggcc

SEQ ID NO: 6040912 - DNA, 23 bp, Homo sapiens
ccagcaacactccggtcagcccc

SEQ ID NO: 6040913 - DNA, 20 bp, Homo sapiens
ccagcaacatctcgagcccc

SEQ ID NO: 6040914 - DNA, 15 bp, Homo sapiens
ccagcaacgcccctc

SEQ ID NO: 6040915 - DNA, 18 bp, Homo sapiens
ccagcaacgcccctccaa

SEQ ID NO: 6040916 - DNA, 15 bp, Homo sapiens
ccagcaactccaact

SEQ ID NO: 6040917 - DNA, 13 bp, Homo sapiens
ccagcaactgaat

SEQ ID NO: 6040918 - DNA, 17 bp, Homo sapiens
ccagcaactgaataaat

SEQ ID NO: 6040919 - DNA, 16 bp, Homo sapiens
ccagcaactgcccttc

SEQ ID NO: 6040920 - DNA, 14 bp, Homo sapiens
ccagcaacttcttc

SEQ ID NO: 6040921 - DNA, 23 bp, Homo sapiens
ccagcaacttcttctccatccct

SEQ ID NO: 6040922 - DNA, 21 bp, Homo sapiens
ccagcaacttgtctttttctg

SEQ ID NO: 6040923 - DNA, 19 bp, Homo sapiens
ccagcaagaataaaaaaga

SEQ ID NO: 6040924 - DNA, 21 bp, Homo sapiens
ccagcaagaccaaatcattgt

SEQ ID NO: 6040925 - DNA, 17 bp, Homo sapiens
ccagcaagagaaccccg

SEQ ID NO: 6040926 - DNA, 17 bp, Homo sapiens
ccagcaagaggaagggg

SEQ ID NO: 6040927 - DNA, 20 bp, Homo sapiens
ccagcaagcgggagcccgtg

SEQ ID NO: 6040928 - DNA, 20 bp, Homo sapiens
ccagcaagcggggatgtccc

SEQ ID NO: 6040929 - DNA, 23 bp, Homo sapiens
ccagcaaggcagaagcttggagg

SEQ ID NO: 6040930 - DNA, 14 bp, Homo sapiens
ccagcaaggcaggt

SEQ ID NO: 6040931 - DNA, 15 bp, Homo sapiens
ccagcaaggcaggtt

SEQ ID NO: 6040932 - DNA, 18 bp, Homo sapiens
ccagcaaggtggagtgga

SEQ ID NO: 6040933 - DNA, 17 bp, Homo sapiens
ccagcaagtcccagaca

SEQ ID NO: 6040934 - DNA, 18 bp, Homo sapiens
ccagcaagtgagagctgg

SEQ ID NO: 6040935 - DNA, 20 bp, Homo sapiens
ccagcaagtgagagctgggt

SEQ ID NO: 6040936 - DNA, 13 bp, Homo sapiens
ccagcaataaaaa

SEQ ID NO: 6040937 - DNA, 17 bp, Homo sapiens
ccagcaataagaaatga

SEQ ID NO: 6040938 - DNA, 20 bp, Homo sapiens
ccagcaataagaaatgaaca

SEQ ID NO: 6040939 - DNA, 20 bp, Homo sapiens
ccagcaatctccatgtgtac

SEQ ID NO: 6040940 - DNA, 21 bp, Homo sapiens
ccagcaatgacatctcagggg

SEQ ID NO: 6040941 - DNA, 14 bp, Homo sapiens
ccagcaatgccctg

SEQ ID NO: 6040942 - DNA, 19 bp, Homo sapiens
ccagcaatgccctgccttg

SEQ ID NO: 6040943 - DNA, 15 bp, Homo sapiens
ccagcaattatgaaa

SEQ ID NO: 6040944 - DNA, 13 bp, Homo sapiens
ccagcacaaacac

SEQ ID NO: 6040945 - DNA, 21 bp, Homo sapiens
ccagcacaaagcactggcctt

SEQ ID NO: 6040946 - DNA, 23 bp, Homo sapiens
ccagcacaaccttcaagctgctt

SEQ ID NO: 6040947 - DNA, 20 bp, Homo sapiens
ccagcacaactcagtctgtg

SEQ ID NO: 6040948 - DNA, 20 bp, Homo sapiens
ccagcacactatttacaaga

SEQ ID NO: 6040949 - DNA, 14 bp, Homo sapiens
ccagcacactcccg

SEQ ID NO: 6040950 - DNA, 17 bp, Homo sapiens
ccagcacactcccgaga

SEQ ID NO: 6040951 - DNA, 21 bp, Homo sapiens
ccagcacactgcttctcggag

SEQ ID NO: 6040952 - DNA, 17 bp, Homo sapiens
ccagcacagccacctcc

SEQ ID NO: 6040953 - DNA, 15 bp, Homo sapiens
ccagcacagctcctc

SEQ ID NO: 6040954 - DNA, 16 bp, Homo sapiens
ccagcacagctcctcc

SEQ ID NO: 6040955 - DNA, 22 bp, Homo sapiens
ccagcacagctcctcccctgcc

SEQ ID NO: 6040956 - DNA, 18 bp, Homo sapiens
ccagcacagctgaggacc

SEQ ID NO: 6040957 - DNA, 22 bp, Homo sapiens
ccagcacagctgaggaccctca

SEQ ID NO: 6040958 - DNA, 13 bp, Homo sapiens
ccagcacagcttg

SEQ ID NO: 6040959 - DNA, 15 bp, Homo sapiens
ccagcacaggggccc

SEQ ID NO: 6040960 - DNA, 17 bp, Homo sapiens
ccagcacaggggcccca

SEQ ID NO: 6040961 - DNA, 22 bp, Homo sapiens
ccagcacaggggccccagatct

SEQ ID NO: 6040962 - DNA, 18 bp, Homo sapiens
ccagcacagtaggtcccg

SEQ ID NO: 6040963 - DNA, 19 bp, Homo sapiens
ccagcacagtaggtcccgg

SEQ ID NO: 6040964 - DNA, 16 bp, Homo sapiens
ccagcacatccccctc

SEQ ID NO: 6040965 - DNA, 15 bp, Homo sapiens
ccagcacatctctga

SEQ ID NO: 6040966 - DNA, 22 bp, Homo sapiens
ccagcacatggccatagaggcc

SEQ ID NO: 6040967 - DNA, 24 bp, Homo sapiens
ccagcacatggccatagaggccca

SEQ ID NO: 6040968 - DNA, 20 bp, Homo sapiens
ccagcacattatcttcatat

SEQ ID NO: 6040969 - DNA, 17 bp, Homo sapiens
ccagcacatttcctctc

SEQ ID NO: 6040970 - DNA, 18 bp, Homo sapiens
ccagcaccaccaggtctc

SEQ ID NO: 6040971 - DNA, 19 bp, Homo sapiens
ccagcaccaccaggtctcc

SEQ ID NO: 6040972 - DNA, 13 bp, Homo sapiens
ccagcaccaccct

SEQ ID NO: 6040973 - DNA, 20 bp, Homo sapiens
ccagcaccaccctccttccc

SEQ ID NO: 6040974 - DNA, 20 bp, Homo sapiens
ccagcaccacctacacagga

SEQ ID NO: 6040975 - DNA, 18 bp, Homo sapiens
ccagcaccatctctcctc

SEQ ID NO: 6040976 - DNA, 15 bp, Homo sapiens
ccagcacccaaaggg

SEQ ID NO: 6040977 - DNA, 14 bp, Homo sapiens
ccagcacccacctg

SEQ ID NO: 6040978 - DNA, 14 bp, Homo sapiens
ccagcacccatgcc

SEQ ID NO: 6040979 - DNA, 20 bp, Homo sapiens
ccagcacccatgccccactc

SEQ ID NO: 6040980 - DNA, 13 bp, Homo sapiens
ccagcacccccac

SEQ ID NO: 6040981 - DNA, 21 bp, Homo sapiens
ccagcaccccctctcctggag

SEQ ID NO: 6040982 - DNA, 20 bp, Homo sapiens
ccagcaccccttcctcgtgg

SEQ ID NO: 6040983 - DNA, 14 bp, Homo sapiens
ccagcacccgggct

SEQ ID NO: 6040984 - DNA, 20 bp, Homo sapiens
ccagcacccgggctcaggga

SEQ ID NO: 6040985 - DNA, 23 bp, Homo sapiens
ccagcacccgggctcagggacca

SEQ ID NO: 6040986 - DNA, 11 bp, Homo sapiens
ccagcaccctc

SEQ ID NO: 6040987 - DNA, 12 bp, Homo sapiens
ccagcaccctct

SEQ ID NO: 6040988 - DNA, 23 bp, Homo sapiens
ccagcaccctctcctgggggtgg

SEQ ID NO: 6040989 - DNA, 15 bp, Homo sapiens
ccagcaccgccggct

SEQ ID NO: 6040990 - DNA, 16 bp, Homo sapiens
ccagcacctaggtggg

SEQ ID NO: 6040991 - DNA, 18 bp, Homo sapiens
ccagcacctcagcctgca

SEQ ID NO: 6040992 - DNA, 14 bp, Homo sapiens
ccagcacctcctcc

SEQ ID NO: 6040993 - DNA, 16 bp, Homo sapiens
ccagcacctcctccgt

SEQ ID NO: 6040994 - DNA, 13 bp, Homo sapiens
ccagcacctgcca

SEQ ID NO: 6040995 - DNA, 17 bp, Homo sapiens
ccagcacctgctcccag

SEQ ID NO: 6040996 - DNA, 17 bp, Homo sapiens
ccagcaccttctttctg

SEQ ID NO: 6040997 - DNA, 21 bp, Homo sapiens
ccagcaccttctttctggact

SEQ ID NO: 6040998 - DNA, 18 bp, Homo sapiens
ccagcaccttgtgcctgg

SEQ ID NO: 6040999 - DNA, 19 bp, Homo sapiens
ccagcaccttgtgcctggg

SEQ ID NO: 6041000 - DNA, 17 bp, Homo sapiens
ccagcactaaagcagtg

SEQ ID NO: 6041001 - DNA, 15 bp, Homo sapiens
ccagcactcagcctc

SEQ ID NO: 6041002 - DNA, 14 bp, Homo sapiens
ccagcactccatca

SEQ ID NO: 6041003 - DNA, 19 bp, Homo sapiens
ccagcactccatcactgag

SEQ ID NO: 6041004 - DNA, 16 bp, Homo sapiens
ccagcactcccagggc

SEQ ID NO: 6041005 - DNA, 19 bp, Homo sapiens
ccagcactccccttgcctt

SEQ ID NO: 6041006 - DNA, 23 bp, Homo sapiens
ccagcactccccttgccttcccc

SEQ ID NO: 6041007 - DNA, 14 bp, Homo sapiens
ccagcactcctctg

SEQ ID NO: 6041008 - DNA, 15 bp, Homo sapiens
ccagcactcctctgt

SEQ ID NO: 6041009 - DNA, 12 bp, Homo sapiens
ccagcactgagg

SEQ ID NO: 6041010 - DNA, 17 bp, Homo sapiens
ccagcactgaggaagaa

SEQ ID NO: 6041011 - DNA, 22 bp, Homo sapiens
ccagcactgaggaagaacgggg

SEQ ID NO: 6041012 - DNA, 20 bp, Homo sapiens
ccagcactgcccatcccacc

SEQ ID NO: 6041013 - DNA, 16 bp, Homo sapiens
ccagcactgcctcctg

SEQ ID NO: 6041014 - DNA, 18 bp, Homo sapiens
ccagcactgcttgaggaa

SEQ ID NO: 6041015 - DNA, 22 bp, Homo sapiens
ccagcactgcttgaggaaaaca

SEQ ID NO: 6041016 - DNA, 22 bp, Homo sapiens
ccagcactggaggggcccaccc

SEQ ID NO: 6041017 - DNA, 23 bp, Homo sapiens
ccagcactggaggggcccaccca

SEQ ID NO: 6041018 - DNA, 15 bp, Homo sapiens
ccagcactgtctcag

SEQ ID NO: 6041019 - DNA, 12 bp, Homo sapiens
ccagcactgtga

SEQ ID NO: 6041020 - DNA, 16 bp, Homo sapiens
ccagcacttgtccagc

SEQ ID NO: 6041021 - DNA, 11 bp, Homo sapiens
ccagcactttg

SEQ ID NO: 6041022 - DNA, 20 bp, Homo sapiens
ccagcactttgagaggctga

SEQ ID NO: 6041023 - DNA, 17 bp, Homo sapiens
ccagcactttgggaagc

SEQ ID NO: 6041024 - DNA, 18 bp, Homo sapiens
ccagcactttgggaagct

SEQ ID NO: 6041025 - DNA, 23 bp, Homo sapiens
ccagcactttgggaagctgaggc

SEQ ID NO: 6041026 - DNA, 15 bp, Homo sapiens
ccagcactttgggag

SEQ ID NO: 6041027 - DNA, 17 bp, Homo sapiens
ccagcactttgggaggc

SEQ ID NO: 6041028 - DNA, 23 bp, Homo sapiens
ccagcactttgggaggccaagga

SEQ ID NO: 6041029 - DNA, 19 bp, Homo sapiens
ccagcactttgggaggccg

SEQ ID NO: 6041030 - DNA, 13 bp, Homo sapiens
ccagcagaaaagt

SEQ ID NO: 6041031 - DNA, 14 bp, Homo sapiens
ccagcagaaaagtg

SEQ ID NO: 6041032 - DNA, 16 bp, Homo sapiens
ccagcagaaaagtgct

SEQ ID NO: 6041033 - DNA, 17 bp, Homo sapiens
ccagcagaaaagtgctt

SEQ ID NO: 6041034 - DNA, 17 bp, Homo sapiens
ccagcagaaatgcctta

SEQ ID NO: 6041035 - DNA, 22 bp, Homo sapiens
ccagcagaaatgccttaccctc

SEQ ID NO: 6041036 - DNA, 22 bp, Homo sapiens
ccagcagaacaaactcagatct

SEQ ID NO: 6041037 - DNA, 12 bp, Homo sapiens
ccagcagaacag

SEQ ID NO: 6041038 - DNA, 14 bp, Homo sapiens
ccagcagaagaggg

SEQ ID NO: 6041039 - DNA, 18 bp, Homo sapiens
ccagcagaagccagaggg

SEQ ID NO: 6041040 - DNA, 19 bp, Homo sapiens
ccagcagaatggaggcagg

SEQ ID NO: 6041041 - DNA, 21 bp, Homo sapiens
ccagcagacagagccaggaga

SEQ ID NO: 6041042 - DNA, 23 bp, Homo sapiens
ccagcagacatcaagctcaaggc

SEQ ID NO: 6041043 - DNA, 14 bp, Homo sapiens
ccagcagacattgt

SEQ ID NO: 6041044 - DNA, 15 bp, Homo sapiens
ccagcagacattgtc

SEQ ID NO: 6041045 - DNA, 17 bp, Homo sapiens
ccagcagacattgtcag

SEQ ID NO: 6041046 - DNA, 12 bp, Homo sapiens
ccagcagagcac

SEQ ID NO: 6041047 - DNA, 13 bp, Homo sapiens
ccagcagagcacc

SEQ ID NO: 6041048 - DNA, 17 bp, Homo sapiens
ccagcagagccagggca

SEQ ID NO: 6041049 - DNA, 18 bp, Homo sapiens
ccagcagagccagggcag

SEQ ID NO: 6041050 - DNA, 19 bp, Homo sapiens
ccagcagagcccaccagcc

SEQ ID NO: 6041051 - DNA, 22 bp, Homo sapiens
ccagcagagcccaccagccagc

SEQ ID NO: 6041052 - DNA, 23 bp, Homo sapiens
ccagcagagcccaccagccagcc

SEQ ID NO: 6041053 - DNA, 14 bp, Homo sapiens
ccagcagaggcagg

SEQ ID NO: 6041054 - DNA, 18 bp, Homo sapiens
ccagcagaggcaggctgg

SEQ ID NO: 6041055 - DNA, 22 bp, Homo sapiens
ccagcagaggcgtactacccag

SEQ ID NO: 6041056 - DNA, 18 bp, Homo sapiens
ccagcagataaggccgag

SEQ ID NO: 6041057 - DNA, 19 bp, Homo sapiens
ccagcagatcccagctcac

SEQ ID NO: 6041058 - DNA, 21 bp, Homo sapiens
ccagcagatcccagctcacgt

SEQ ID NO: 6041059 - DNA, 16 bp, Homo sapiens
ccagcagattattcac

SEQ ID NO: 6041060 - DNA, 20 bp, Homo sapiens
ccagcagcacacctcagccc

SEQ ID NO: 6041061 - DNA, 20 bp, Homo sapiens
ccagcagcacctgccctacc

SEQ ID NO: 6041062 - DNA, 13 bp, Homo sapiens
ccagcagcagcac

SEQ ID NO: 6041063 - DNA, 15 bp, Homo sapiens
ccagcagcagcactt

SEQ ID NO: 6041064 - DNA, 15 bp, Homo sapiens
ccagcagcagcccaa

SEQ ID NO: 6041065 - DNA, 23 bp, Homo sapiens
ccagcagcaggatgggctgagct

SEQ ID NO: 6041066 - DNA, 12 bp, Homo sapiens
ccagcagccagc

SEQ ID NO: 6041067 - DNA, 15 bp, Homo sapiens
ccagcagccagctct

SEQ ID NO: 6041068 - DNA, 12 bp, Homo sapiens
ccagcagccccg

SEQ ID NO: 6041069 - DNA, 16 bp, Homo sapiens
ccagcagcccctgaga

SEQ ID NO: 6041070 - DNA, 12 bp, Homo sapiens
ccagcagcccta

SEQ ID NO: 6041071 - DNA, 12 bp, Homo sapiens
ccagcagcctcg

SEQ ID NO: 6041072 - DNA, 14 bp, Homo sapiens
ccagcagcctcgca

SEQ ID NO: 6041073 - DNA, 19 bp, Homo sapiens
ccagcagcctctgatctgt

SEQ ID NO: 6041074 - DNA, 15 bp, Homo sapiens
ccagcagcctgccag

SEQ ID NO: 6041075 - DNA, 12 bp, Homo sapiens
ccagcagcctgg

SEQ ID NO: 6041076 - DNA, 13 bp, Homo sapiens
ccagcagcctgga

SEQ ID NO: 6041077 - DNA, 12 bp, Homo sapiens
ccagcagccttc

SEQ ID NO: 6041078 - DNA, 22 bp, Homo sapiens
ccagcagccttccagtggcttc

SEQ ID NO: 6041079 - DNA, 23 bp, Homo sapiens
ccagcagccttccagtggcttct

SEQ ID NO: 6041080 - DNA, 18 bp, Homo sapiens
ccagcagcgcccgaggcc

SEQ ID NO: 6041081 - DNA, 12 bp, Homo sapiens
ccagcagcgcct

SEQ ID NO: 6041082 - DNA, 17 bp, Homo sapiens
ccagcagcgcctttccc

SEQ ID NO: 6041083 - DNA, 16 bp, Homo sapiens
ccagcagcggcccaga

SEQ ID NO: 6041084 - DNA, 10 bp, Homo sapiens
ccagcagctg

SEQ ID NO: 6041085 - DNA, 11 bp, Homo sapiens
ccagcagctgc

SEQ ID NO: 6041086 - DNA, 12 bp, Homo sapiens
ccagcagctgca

SEQ ID NO: 6041087 - DNA, 15 bp, Homo sapiens
ccagcagctgcaccc

SEQ ID NO: 6041088 - DNA, 20 bp, Homo sapiens
ccagcagctgccaggagcac

SEQ ID NO: 6041089 - DNA, 23 bp, Homo sapiens
ccagcagctgccaggagcacggc

SEQ ID NO: 6041090 - DNA, 14 bp, Homo sapiens
ccagcagctgggcc

SEQ ID NO: 6041091 - DNA, 22 bp, Homo sapiens
ccagcagctgggccggccagcc

SEQ ID NO: 6041092 - DNA, 23 bp, Homo sapiens
ccagcagcttaagtccagctcat

SEQ ID NO: 6041093 - DNA, 16 bp, Homo sapiens
ccagcagcttggctga

SEQ ID NO: 6041094 - DNA, 20 bp, Homo sapiens
ccagcaggaagccaggctga

SEQ ID NO: 6041095 - DNA, 18 bp, Homo sapiens
ccagcaggaaggacccca

SEQ ID NO: 6041096 - DNA, 22 bp, Homo sapiens
ccagcaggaaggaccccacatc

SEQ ID NO: 6041097 - DNA, 15 bp, Homo sapiens
ccagcaggaataaag

SEQ ID NO: 6041098 - DNA, 16 bp, Homo sapiens
ccagcaggaataaaga

SEQ ID NO: 6041099 - DNA, 22 bp, Homo sapiens
ccagcaggagagactgagcagc

SEQ ID NO: 6041100 - DNA, 23 bp, Homo sapiens
ccagcaggagagactgagcagcc

SEQ ID NO: 6041101 - DNA, 16 bp, Homo sapiens
ccagcaggaggacaga

SEQ ID NO: 6041102 - DNA, 15 bp, Homo sapiens
ccagcaggcagcgcc

SEQ ID NO: 6041103 - DNA, 17 bp, Homo sapiens
ccagcaggcagcgcctg

SEQ ID NO: 6041104 - DNA, 19 bp, Homo sapiens
ccagcaggcaggcactgtg

SEQ ID NO: 6041105 - DNA, 20 bp, Homo sapiens
ccagcaggcaggcactgtgg

SEQ ID NO: 6041106 - DNA, 22 bp, Homo sapiens
ccagcaggccagggactcagcg

SEQ ID NO: 6041107 - DNA, 12 bp, Homo sapiens
ccagcaggccca

SEQ ID NO: 6041108 - DNA, 13 bp, Homo sapiens
ccagcaggcccag

SEQ ID NO: 6041109 - DNA, 14 bp, Homo sapiens
ccagcaggcccagc

SEQ ID NO: 6041110 - DNA, 18 bp, Homo sapiens
ccagcaggcccagcatgc

SEQ ID NO: 6041111 - DNA, 20 bp, Homo sapiens
ccagcaggcctccctgaaac

SEQ ID NO: 6041112 - DNA, 15 bp, Homo sapiens
ccagcaggctcctca

SEQ ID NO: 6041113 - DNA, 22 bp, Homo sapiens
ccagcaggctcctggctgtgcc

SEQ ID NO: 6041114 - DNA, 16 bp, Homo sapiens
ccagcaggctctcagg

SEQ ID NO: 6041115 - DNA, 21 bp, Homo sapiens
ccagcagggagttagcactga

SEQ ID NO: 6041116 - DNA, 16 bp, Homo sapiens
ccagcagggcgggcca

SEQ ID NO: 6041117 - DNA, 19 bp, Homo sapiens
ccagcagggcgggccagga

SEQ ID NO: 6041118 - DNA, 16 bp, Homo sapiens
ccagcagggctgtgat

SEQ ID NO: 6041119 - DNA, 21 bp, Homo sapiens
ccagcaggggggctgtgccaa

SEQ ID NO: 6041120 - DNA, 21 bp, Homo sapiens
ccagcagggtcttttcatctg

SEQ ID NO: 6041121 - DNA, 22 bp, Homo sapiens
ccagcagggtcttttcatctgg

SEQ ID NO: 6041122 - DNA, 17 bp, Homo sapiens
ccagcaggtgtggtggc

SEQ ID NO: 6041123 - DNA, 18 bp, Homo sapiens
ccagcaggttctctcctg

SEQ ID NO: 6041124 - DNA, 21 bp, Homo sapiens
ccagcagtacaataaaagtaa

SEQ ID NO: 6041125 - DNA, 19 bp, Homo sapiens
ccagcagtcctgggccccc

SEQ ID NO: 6041126 - DNA, 21 bp, Homo sapiens
ccagcagtctctgccttgcct

SEQ ID NO: 6041127 - DNA, 23 bp, Homo sapiens
ccagcagtctctgccttgccttt

SEQ ID NO: 6041128 - DNA, 14 bp, Homo sapiens
ccagcagtgaatgc

SEQ ID NO: 6041129 - DNA, 13 bp, Homo sapiens
ccagcagtgctgg

SEQ ID NO: 6041130 - DNA, 15 bp, Homo sapiens
ccagcagtgctgggc

SEQ ID NO: 6041131 - DNA, 15 bp, Homo sapiens
ccagcagtgtggaga

SEQ ID NO: 6041132 - DNA, 19 bp, Homo sapiens
ccagcagtgttgctcagct

SEQ ID NO: 6041133 - DNA, 21 bp, Homo sapiens
ccagcagtgttgctcagctcc

SEQ ID NO: 6041134 - DNA, 21 bp, Homo sapiens
ccagcagttcagagctgccct

SEQ ID NO: 6041135 - DNA, 16 bp, Homo sapiens
ccagcagttctctgcc

SEQ ID NO: 6041136 - DNA, 17 bp, Homo sapiens
ccagcagttctctgcca

SEQ ID NO: 6041137 - DNA, 18 bp, Homo sapiens
ccagcagttctctgccaa

SEQ ID NO: 6041138 - DNA, 14 bp, Homo sapiens
ccagcagttctgtt

SEQ ID NO: 6041139 - DNA, 23 bp, Homo sapiens
ccagcataatacttgctttggaa

SEQ ID NO: 6041140 - DNA, 20 bp, Homo sapiens
ccagcataccagttcttgca

SEQ ID NO: 6041141 - DNA, 18 bp, Homo sapiens
ccagcataggggggaggg

SEQ ID NO: 6041142 - DNA, 14 bp, Homo sapiens
ccagcatagttctg

SEQ ID NO: 6041143 - DNA, 18 bp, Homo sapiens
ccagcatagttctgcaat

SEQ ID NO: 6041144 - DNA, 20 bp, Homo sapiens
ccagcatagttctgcaataa

SEQ ID NO: 6041145 - DNA, 15 bp, Homo sapiens
ccagcatcacctgcc

SEQ ID NO: 6041146 - DNA, 14 bp, Homo sapiens
ccagcatcactccc

SEQ ID NO: 6041147 - DNA, 16 bp, Homo sapiens
ccagcatcactcccca

SEQ ID NO: 6041148 - DNA, 20 bp, Homo sapiens
ccagcatccaccttggctct

SEQ ID NO: 6041149 - DNA, 14 bp, Homo sapiens
ccagcatccagcct

SEQ ID NO: 6041150 - DNA, 14 bp, Homo sapiens
ccagcatcccaaga

SEQ ID NO: 6041151 - DNA, 13 bp, Homo sapiens
ccagcatcccagc

SEQ ID NO: 6041152 - DNA, 17 bp, Homo sapiens
ccagcatcccagcctca

SEQ ID NO: 6041153 - DNA, 18 bp, Homo sapiens
ccagcatcccagcctcag

SEQ ID NO: 6041154 - DNA, 20 bp, Homo sapiens
ccagcatcccagcctcagaa

SEQ ID NO: 6041155 - DNA, 13 bp, Homo sapiens
ccagcatccctgg

SEQ ID NO: 6041156 - DNA, 20 bp, Homo sapiens
ccagcatcctgattaaatgt

SEQ ID NO: 6041157 - DNA, 18 bp, Homo sapiens
ccagcatcgcactctggc

SEQ ID NO: 6041158 - DNA, 15 bp, Homo sapiens
ccagcatctcagagt

SEQ ID NO: 6041159 - DNA, 18 bp, Homo sapiens
ccagcatctcagcgccag

SEQ ID NO: 6041160 - DNA, 14 bp, Homo sapiens
ccagcatctggaag

SEQ ID NO: 6041161 - DNA, 12 bp, Homo sapiens
ccagcatctggg

SEQ ID NO: 6041162 - DNA, 15 bp, Homo sapiens
ccagcatctgggcct

SEQ ID NO: 6041163 - DNA, 21 bp, Homo sapiens
ccagcatcttttccatcctga

SEQ ID NO: 6041164 - DNA, 23 bp, Homo sapiens
ccagcatcttttccatcctgagg

SEQ ID NO: 6041165 - DNA, 20 bp, Homo sapiens
ccagcatgacataacagtgc

SEQ ID NO: 6041166 - DNA, 19 bp, Homo sapiens
ccagcatgactttccttag

SEQ ID NO: 6041167 - DNA, 21 bp, Homo sapiens
ccagcatggaatctgatgaaa

SEQ ID NO: 6041168 - DNA, 18 bp, Homo sapiens
ccagcatggatgaaacct

SEQ ID NO: 6041169 - DNA, 16 bp, Homo sapiens
ccagcatggttgcaga

SEQ ID NO: 6041170 - DNA, 17 bp, Homo sapiens
ccagcatgtgtgtgtct

SEQ ID NO: 6041171 - DNA, 16 bp, Homo sapiens
ccagcattccagactt

SEQ ID NO: 6041172 - DNA, 19 bp, Homo sapiens
ccagcattccagacttcaa

SEQ ID NO: 6041173 - DNA, 13 bp, Homo sapiens
ccagcattccagc

SEQ ID NO: 6041174 - DNA, 17 bp, Homo sapiens
ccagcattccagcccct

SEQ ID NO: 6041175 - DNA, 15 bp, Homo sapiens
ccagcattccagctc

SEQ ID NO: 6041176 - DNA, 19 bp, Homo sapiens
ccagcattccagctctgcc

SEQ ID NO: 6041177 - DNA, 17 bp, Homo sapiens
ccagcattcccaggtag

SEQ ID NO: 6041178 - DNA, 19 bp, Homo sapiens
ccagcattcccaggtaggc

SEQ ID NO: 6041179 - DNA, 16 bp, Homo sapiens
ccagcattctcagcca

SEQ ID NO: 6041180 - DNA, 18 bp, Homo sapiens
ccagcattctcagccaca

SEQ ID NO: 6041181 - DNA, 20 bp, Homo sapiens
ccagcatttaagtgaccttc

SEQ ID NO: 6041182 - DNA, 22 bp, Homo sapiens
ccagcatttaagtgaccttctg

SEQ ID NO: 6041183 - DNA, 17 bp, Homo sapiens
ccagcatttagctggcc

SEQ ID NO: 6041184 - DNA, 13 bp, Homo sapiens
ccagcatttggtt

SEQ ID NO: 6041185 - DNA, 17 bp, Homo sapiens
ccagcattttactactt

SEQ ID NO: 6041186 - DNA, 18 bp, Homo sapiens
ccagccaaacacacagaa

SEQ ID NO: 6041187 - DNA, 18 bp, Homo sapiens
ccagccaaaccctgtctg

SEQ ID NO: 6041188 - DNA, 16 bp, Homo sapiens
ccagccaaacgggagc

SEQ ID NO: 6041189 - DNA, 20 bp, Homo sapiens
ccagccaaacgggagctttt

SEQ ID NO: 6041190 - DNA, 20 bp, Homo sapiens
ccagccaaagaaatgggcct

SEQ ID NO: 6041191 - DNA, 21 bp, Homo sapiens
ccagccaacatttaatgagca

SEQ ID NO: 6041192 - DNA, 19 bp, Homo sapiens
ccagccaacctgggggctt

SEQ ID NO: 6041193 - DNA, 18 bp, Homo sapiens
ccagccaagagctcttca

SEQ ID NO: 6041194 - DNA, 18 bp, Homo sapiens
ccagccaagggtcctcac

SEQ ID NO: 6041195 - DNA, 22 bp, Homo sapiens
ccagccaagggtcctcacccct

SEQ ID NO: 6041196 - DNA, 14 bp, Homo sapiens
ccagccaagtgcct

SEQ ID NO: 6041197 - DNA, 15 bp, Homo sapiens
ccagccaagtgcctt

SEQ ID NO: 6041198 - DNA, 16 bp, Homo sapiens
ccagccaagtgccttc

SEQ ID NO: 6041199 - DNA, 17 bp, Homo sapiens
ccagccaagtgccttcc

SEQ ID NO: 6041200 - DNA, 24 bp, Homo sapiens
ccagccaatctagaggcaagcctg

SEQ ID NO: 6041201 - DNA, 15 bp, Homo sapiens
ccagccacacagagc

SEQ ID NO: 6041202 - DNA, 22 bp, Homo sapiens
ccagccacacagagcctgcctc

SEQ ID NO: 6041203 - DNA, 23 bp, Homo sapiens
ccagccacacagagcctgcctca

SEQ ID NO: 6041204 - DNA, 19 bp, Homo sapiens
ccagccacacttgaaccta

SEQ ID NO: 6041205 - DNA, 17 bp, Homo sapiens
ccagccacagacccctg

SEQ ID NO: 6041206 - DNA, 20 bp, Homo sapiens
ccagccacaggaccacctcc

SEQ ID NO: 6041207 - DNA, 14 bp, Homo sapiens
ccagccaccaccac

SEQ ID NO: 6041208 - DNA, 22 bp, Homo sapiens
ccagccaccaccctcaggtgcc

SEQ ID NO: 6041209 - DNA, 16 bp, Homo sapiens
ccagccacccagccag

SEQ ID NO: 6041210 - DNA, 17 bp, Homo sapiens
ccagccacccccaggca

SEQ ID NO: 6041211 - DNA, 20 bp, Homo sapiens
ccagccacccctcctctagc

SEQ ID NO: 6041212 - DNA, 22 bp, Homo sapiens
ccagccacccctcctctagctc

SEQ ID NO: 6041213 - DNA, 20 bp, Homo sapiens
ccagccacccctgccactca

SEQ ID NO: 6041214 - DNA, 22 bp, Homo sapiens
ccagccacccctgccactcacc

SEQ ID NO: 6041215 - DNA, 19 bp, Homo sapiens
ccagccacccggatctcca

SEQ ID NO: 6041216 - DNA, 20 bp, Homo sapiens
ccagccacccggatctccag

SEQ ID NO: 6041217 - DNA, 12 bp, Homo sapiens
ccagccacctag

SEQ ID NO: 6041218 - DNA, 18 bp, Homo sapiens
ccagccacctcccaagga

SEQ ID NO: 6041219 - DNA, 20 bp, Homo sapiens
ccagccacctcccaaggact

SEQ ID NO: 6041220 - DNA, 15 bp, Homo sapiens
ccagccacctcttgg

SEQ ID NO: 6041221 - DNA, 15 bp, Homo sapiens
ccagccaccttcctg

SEQ ID NO: 6041222 - DNA, 16 bp, Homo sapiens
ccagccacgactgcca

SEQ ID NO: 6041223 - DNA, 17 bp, Homo sapiens
ccagccacgactgccat

SEQ ID NO: 6041224 - DNA, 15 bp, Homo sapiens
ccagccacgcagggc

SEQ ID NO: 6041225 - DNA, 16 bp, Homo sapiens
ccagccacggagggag

SEQ ID NO: 6041226 - DNA, 12 bp, Homo sapiens
ccagccactcca

SEQ ID NO: 6041227 - DNA, 20 bp, Homo sapiens
ccagccactccaagccccct

SEQ ID NO: 6041228 - DNA, 14 bp, Homo sapiens
ccagccactcctca

SEQ ID NO: 6041229 - DNA, 21 bp, Homo sapiens
ccagccactcgggaggctgag

SEQ ID NO: 6041230 - DNA, 22 bp, Homo sapiens
ccagccactcgggaggctgaga

SEQ ID NO: 6041231 - DNA, 21 bp, Homo sapiens
ccagccactctaccagtgcag

SEQ ID NO: 6041232 - DNA, 14 bp, Homo sapiens
ccagccactgccaa

SEQ ID NO: 6041233 - DNA, 13 bp, Homo sapiens
ccagccactgccc

SEQ ID NO: 6041234 - DNA, 16 bp, Homo sapiens
ccagccacttccccct

SEQ ID NO: 6041235 - DNA, 22 bp, Homo sapiens
ccagccagaacgtggctctgct

SEQ ID NO: 6041236 - DNA, 23 bp, Homo sapiens
ccagccagaacgtggctctgctg

SEQ ID NO: 6041237 - DNA, 21 bp, Homo sapiens
ccagccagaagcctctgcctc

SEQ ID NO: 6041238 - DNA, 21 bp, Homo sapiens
ccagccagagtttgcctccct

SEQ ID NO: 6041239 - DNA, 21 bp, Homo sapiens
ccagccagatggactccagcc

SEQ ID NO: 6041240 - DNA, 16 bp, Homo sapiens
ccagccagcagcagcc

SEQ ID NO: 6041241 - DNA, 19 bp, Homo sapiens
ccagccagcagcagcccaa

SEQ ID NO: 6041242 - DNA, 15 bp, Homo sapiens
ccagccagcagccag

SEQ ID NO: 6041243 - DNA, 22 bp, Homo sapiens
ccagccagcagttcagagctgc

SEQ ID NO: 6041244 - DNA, 16 bp, Homo sapiens
ccagccagccacccct

SEQ ID NO: 6041245 - DNA, 13 bp, Homo sapiens
ccagccagccact

SEQ ID NO: 6041246 - DNA, 15 bp, Homo sapiens
ccagccagcccttcc

SEQ ID NO: 6041247 - DNA, 14 bp, Homo sapiens
ccagccagcctggc

SEQ ID NO: 6041248 - DNA, 16 bp, Homo sapiens
ccagccagcctggctg

SEQ ID NO: 6041249 - DNA, 13 bp, Homo sapiens
ccagccagcgcct

SEQ ID NO: 6041250 - DNA, 15 bp, Homo sapiens
ccagccagcgcctcc

SEQ ID NO: 6041251 - DNA, 16 bp, Homo sapiens
ccagccagcgcctccc

SEQ ID NO: 6041252 - DNA, 17 bp, Homo sapiens
ccagccagcgcctccct

SEQ ID NO: 6041253 - DNA, 14 bp, Homo sapiens
ccagccagcgtccc

SEQ ID NO: 6041254 - DNA, 12 bp, Homo sapiens
ccagccagctcc

SEQ ID NO: 6041255 - DNA, 15 bp, Homo sapiens
ccagccagctcctgc

SEQ ID NO: 6041256 - DNA, 12 bp, Homo sapiens
ccagccagctgc

SEQ ID NO: 6041257 - DNA, 13 bp, Homo sapiens
ccagccagctgca

SEQ ID NO: 6041258 - DNA, 20 bp, Homo sapiens
catgaagataaacacagctg

SEQ ID NO: 6041259 - DNA, 22 bp, Homo sapiens
catgaagatttggtttttgtct

SEQ ID NO: 6041260 - DNA, 15 bp, Homo sapiens
catgaagattttctt

SEQ ID NO: 6041261 - DNA, 16 bp, Homo sapiens
catgaagcagaacctt

SEQ ID NO: 6041262 - DNA, 21 bp, Homo sapiens
catgaagcagaaccttctttg

SEQ ID NO: 6041263 - DNA, 14 bp, Homo sapiens
catgaagcaggagg

SEQ ID NO: 6041264 - DNA, 15 bp, Homo sapiens
catgaagcaggaggc

SEQ ID NO: 6041265 - DNA, 14 bp, Homo sapiens
catgaagcataatt

SEQ ID NO: 6041266 - DNA, 22 bp, Homo sapiens
catgaagccacgggtgccagaa

SEQ ID NO: 6041267 - DNA, 12 bp, Homo sapiens
catgaagccctt

SEQ ID NO: 6041268 - DNA, 11 bp, Homo sapiens
catgaagcctt

SEQ ID NO: 6041269 - DNA, 13 bp, Homo sapiens
catgaagccttgc

SEQ ID NO: 6041270 - DNA, 19 bp, Homo sapiens
catgaagccttgctgaact

SEQ ID NO: 6041271 - DNA, 16 bp, Homo sapiens
catgaagctggaagca

SEQ ID NO: 6041272 - DNA, 21 bp, Homo sapiens
catgaagctggaagcactgct

SEQ ID NO: 6041273 - DNA, 15 bp, Homo sapiens
catgaagctggccct

SEQ ID NO: 6041274 - DNA, 15 bp, Homo sapiens
catgaagctgttgtg

SEQ ID NO: 6041275 - DNA, 17 bp, Homo sapiens
catgaaggagacagcag

SEQ ID NO: 6041276 - DNA, 22 bp, Homo sapiens
catgaaggagcgggggtgtggc

SEQ ID NO: 6041277 - DNA, 13 bp, Homo sapiens
catgaaggctgga

SEQ ID NO: 6041278 - DNA, 15 bp, Homo sapiens
catgaaggctggaag

SEQ ID NO: 6041279 - DNA, 21 bp, Homo sapiens
catgaaggtaggtaaataggt

SEQ ID NO: 6041280 - DNA, 20 bp, Homo sapiens
catgaaggtctacctgaaaa

SEQ ID NO: 6041281 - DNA, 19 bp, Homo sapiens
catgaagtaaattgaaagc

SEQ ID NO: 6041282 - DNA, 23 bp, Homo sapiens
catgaagtaatatgcacacattt

SEQ ID NO: 6041283 - DNA, 13 bp, Homo sapiens
catgaagtatttt

SEQ ID NO: 6041284 - DNA, 14 bp, Homo sapiens
catgaagtattttt

SEQ ID NO: 6041285 - DNA, 19 bp, Homo sapiens
catgaagtcgttgtgaggg

SEQ ID NO: 6041286 - DNA, 19 bp, Homo sapiens
catgaagttgtaagaaaag

SEQ ID NO: 6041287 - DNA, 21 bp, Homo sapiens
catgaagttgtaagaaaagct

SEQ ID NO: 6041288 - DNA, 20 bp, Homo sapiens
catgaataaaaataaagttt

SEQ ID NO: 6041289 - DNA, 16 bp, Homo sapiens
catgaataaaacactc

SEQ ID NO: 6041290 - DNA, 16 bp, Homo sapiens
catgaataaaattagg

SEQ ID NO: 6041291 - DNA, 21 bp, Homo sapiens
catgaataaaattaggttaaa

SEQ ID NO: 6041292 - DNA, 18 bp, Homo sapiens
catgaataacatttaaat

SEQ ID NO: 6041293 - DNA, 19 bp, Homo sapiens
catgaataacatttaaatt

SEQ ID NO: 6041294 - DNA, 15 bp, Homo sapiens
catgaatatcaagaa

SEQ ID NO: 6041295 - DNA, 22 bp, Homo sapiens
catgaatatttcaaaataaact

SEQ ID NO: 6041296 - DNA, 14 bp, Homo sapiens
catgaatatttctt

SEQ ID NO: 6041297 - DNA, 14 bp, Homo sapiens
catgaatattttca

SEQ ID NO: 6041298 - DNA, 21 bp, Homo sapiens
catgaatcccacccacatgtg

SEQ ID NO: 6041299 - DNA, 15 bp, Homo sapiens
catgaatcgcttctc

SEQ ID NO: 6041300 - DNA, 16 bp, Homo sapiens
catgaatcgcttctct

SEQ ID NO: 6041301 - DNA, 18 bp, Homo sapiens
catgaatcgcttctcttt

SEQ ID NO: 6041302 - DNA, 17 bp, Homo sapiens
catgaatctctgcctct

SEQ ID NO: 6041303 - DNA, 13 bp, Homo sapiens
catgaatctttca

SEQ ID NO: 6041304 - DNA, 18 bp, Homo sapiens
catgaatctttcatacat

SEQ ID NO: 6041305 - DNA, 17 bp, Homo sapiens
catgaatctttgtttca

SEQ ID NO: 6041306 - DNA, 14 bp, Homo sapiens
catgaatgtaaatt

SEQ ID NO: 6041307 - DNA, 17 bp, Homo sapiens
catgaatgtaaatttgt

SEQ ID NO: 6041308 - DNA, 22 bp, Homo sapiens
catgaatgtaaatttgtactat

SEQ ID NO: 6041309 - DNA, 17 bp, Homo sapiens
catgaatgtatcaggaa

SEQ ID NO: 6041310 - DNA, 23 bp, Homo sapiens
catgaatgtgagtcattatgtag

SEQ ID NO: 6041311 - DNA, 13 bp, Homo sapiens
catgaatgtgctg

SEQ ID NO: 6041312 - DNA, 16 bp, Homo sapiens
catgaatgtgctggtg

SEQ ID NO: 6041313 - DNA, 18 bp, Homo sapiens
catgaattactgtatata

SEQ ID NO: 6041314 - DNA, 18 bp, Homo sapiens
catgaattagaagaaaat

SEQ ID NO: 6041315 - DNA, 17 bp, Homo sapiens
catgaattatataattt

SEQ ID NO: 6041316 - DNA, 18 bp, Homo sapiens
catgaattatataatttt

SEQ ID NO: 6041317 - DNA, 18 bp, Homo sapiens
catgaattattacagtgt

SEQ ID NO: 6041318 - DNA, 18 bp, Homo sapiens
catgaattcatactctgt

SEQ ID NO: 6041319 - DNA, 20 bp, Homo sapiens
catgaattcatactctgttg

SEQ ID NO: 6041320 - DNA, 12 bp, Homo sapiens
catgaattccct

SEQ ID NO: 6041321 - DNA, 22 bp, Homo sapiens
catgaattggaactgcaatgaa

SEQ ID NO: 6041322 - DNA, 18 bp, Homo sapiens
catgaatttagaaatatt

SEQ ID NO: 6041323 - DNA, 18 bp, Homo sapiens
catgaatttattgcacat

SEQ ID NO: 6041324 - DNA, 22 bp, Homo sapiens
catgaatttgtaatgtcttgag

SEQ ID NO: 6041325 - DNA, 14 bp, Homo sapiens
catgaatttgtgaa

SEQ ID NO: 6041326 - DNA, 21 bp, Homo sapiens
catgaattttaaagtatgcat

SEQ ID NO: 6041327 - DNA, 15 bp, Homo sapiens
catgaattttaaata

SEQ ID NO: 6041328 - DNA, 15 bp, Homo sapiens
catgaattttagctt

SEQ ID NO: 6041329 - DNA, 16 bp, Homo sapiens
catgaattttagcttt

SEQ ID NO: 6041330 - DNA, 17 bp, Homo sapiens
catgaatttttatgatt

SEQ ID NO: 6041331 - DNA, 19 bp, Homo sapiens
catgacaaaaataacactg

SEQ ID NO: 6041332 - DNA, 14 bp, Homo sapiens
catgacaaacctag

SEQ ID NO: 6041333 - DNA, 16 bp, Homo sapiens
catgacaaacctagct

SEQ ID NO: 6041334 - DNA, 16 bp, Homo sapiens
catgacaacttctaat

SEQ ID NO: 6041335 - DNA, 23 bp, Homo sapiens
catgacaacttttaaagaaaaat

SEQ ID NO: 6041336 - DNA, 17 bp, Homo sapiens
catgacaagatgggaca

SEQ ID NO: 6041337 - DNA, 17 bp, Homo sapiens
catgacaagtactgtat

SEQ ID NO: 6041338 - DNA, 12 bp, Homo sapiens
catgacaagtgg

SEQ ID NO: 6041339 - DNA, 21 bp, Homo sapiens
catgacacccaagggtcgcct

SEQ ID NO: 6041340 - DNA, 14 bp, Homo sapiens
catgacacgaatat

SEQ ID NO: 6041341 - DNA, 17 bp, Homo sapiens
catgacacgaatattgc

SEQ ID NO: 6041342 - DNA, 15 bp, Homo sapiens
catgacactgaaatg

SEQ ID NO: 6041343 - DNA, 12 bp, Homo sapiens
catgacactgac

SEQ ID NO: 6041344 - DNA, 15 bp, Homo sapiens
catgacagaaaatat

SEQ ID NO: 6041345 - DNA, 19 bp, Homo sapiens
catgacagaaaatatgtat

SEQ ID NO: 6041346 - DNA, 16 bp, Homo sapiens
catgacagatatttta

SEQ ID NO: 6041347 - DNA, 13 bp, Homo sapiens
catgacagccaga

SEQ ID NO: 6041348 - DNA, 16 bp, Homo sapiens
catgacagccagagcc

SEQ ID NO: 6041349 - DNA, 19 bp, Homo sapiens
catgacagccagagcctgt

SEQ ID NO: 6041350 - DNA, 13 bp, Homo sapiens
catgacagcctcc

SEQ ID NO: 6041351 - DNA, 16 bp, Homo sapiens
catgacagctactaac

SEQ ID NO: 6041352 - DNA, 18 bp, Homo sapiens
catgacaggcctgaagat

SEQ ID NO: 6041353 - DNA, 13 bp, Homo sapiens
catgacagtgctt

SEQ ID NO: 6041354 - DNA, 18 bp, Homo sapiens
catgacataacagtgcag

SEQ ID NO: 6041355 - DNA, 18 bp, Homo sapiens
catgacatatgacttgat

SEQ ID NO: 6041356 - DNA, 20 bp, Homo sapiens
catgacatccacatgcacat

SEQ ID NO: 6041357 - DNA, 16 bp, Homo sapiens
catgacatgttatata

SEQ ID NO: 6041358 - DNA, 17 bp, Homo sapiens
catgacatttaccagca

SEQ ID NO: 6041359 - DNA, 15 bp, Homo sapiens
catgacatttcatct

SEQ ID NO: 6041360 - DNA, 16 bp, Homo sapiens
catgacatttcatctg

SEQ ID NO: 6041361 - DNA, 14 bp, Homo sapiens
catgacatttctca

SEQ ID NO: 6041362 - DNA, 22 bp, Homo sapiens
catgacatttctcaaagttttt

SEQ ID NO: 6041363 - DNA, 20 bp, Homo sapiens
catgacatttgtcctgcaga

SEQ ID NO: 6041364 - DNA, 12 bp, Homo sapiens
catgacattttt

SEQ ID NO: 6041365 - DNA, 17 bp, Homo sapiens
catgaccaaaaaccaaa

SEQ ID NO: 6041366 - DNA, 17 bp, Homo sapiens
catgaccactgggcctg

SEQ ID NO: 6041367 - DNA, 18 bp, Homo sapiens
catgaccactgggcctgc

SEQ ID NO: 6041368 - DNA, 15 bp, Homo sapiens
catgaccagcaaata

SEQ ID NO: 6041369 - DNA, 12 bp, Homo sapiens
catgaccaggcc

SEQ ID NO: 6041370 - DNA, 13 bp, Homo sapiens
catgaccaggcca

SEQ ID NO: 6041371 - DNA, 15 bp, Homo sapiens
catgacccacccctg

SEQ ID NO: 6041372 - DNA, 17 bp, Homo sapiens
catgacccacccctgtg

SEQ ID NO: 6041373 - DNA, 19 bp, Homo sapiens
catgacccacccctgtgct

SEQ ID NO: 6041374 - DNA, 12 bp, Homo sapiens
catgacccagcc

SEQ ID NO: 6041375 - DNA, 21 bp, Homo sapiens
catgacccctcgtccaccccc

SEQ ID NO: 6041376 - DNA, 18 bp, Homo sapiens
catgaccccttctctctc

SEQ ID NO: 6041377 - DNA, 19 bp, Homo sapiens
catgaccccttctctctcc

SEQ ID NO: 6041378 - DNA, 13 bp, Homo sapiens
catgaccctctgt

SEQ ID NO: 6041379 - DNA, 14 bp, Homo sapiens
catgaccctctgtc

SEQ ID NO: 6041380 - DNA, 15 bp, Homo sapiens
catgaccctctgtcc

SEQ ID NO: 6041381 - DNA, 17 bp, Homo sapiens
catgaccctctgtcccc

SEQ ID NO: 6041382 - DNA, 15 bp, Homo sapiens
catgaccctggagcc

SEQ ID NO: 6041383 - DNA, 19 bp, Homo sapiens
catgacctagttttccatg

SEQ ID NO: 6041384 - DNA, 18 bp, Homo sapiens
catgacctcacccctcct

SEQ ID NO: 6041385 - DNA, 19 bp, Homo sapiens
catgacctcacccctcctt

SEQ ID NO: 6041386 - DNA, 13 bp, Homo sapiens
catgacctccagc

SEQ ID NO: 6041387 - DNA, 22 bp, Homo sapiens
catgacctccagctttcctgta

SEQ ID NO: 6041388 - DNA, 14 bp, Homo sapiens
catgacctccaggg

SEQ ID NO: 6041389 - DNA, 12 bp, Homo sapiens
catgacctcccc

SEQ ID NO: 6041390 - DNA, 23 bp, Homo sapiens
catgacctgatcactagcctgtc

SEQ ID NO: 6041391 - DNA, 17 bp, Homo sapiens
catgacctgtgaccagc

SEQ ID NO: 6041392 - DNA, 20 bp, Homo sapiens
catgaccttatccttcctct

SEQ ID NO: 6041393 - DNA, 21 bp, Homo sapiens
catgacgcaccagttacaggg

SEQ ID NO: 6041394 - DNA, 22 bp, Homo sapiens
catgacgccagataaaatgttc

SEQ ID NO: 6041395 - DNA, 19 bp, Homo sapiens
catgacgtggtaaaatgtg

SEQ ID NO: 6041396 - DNA, 21 bp, Homo sapiens
catgactaatgctttttagaa

SEQ ID NO: 6041397 - DNA, 14 bp, Homo sapiens
catgactaattttt

SEQ ID NO: 6041398 - DNA, 19 bp, Homo sapiens
catgactagggtcctcagg

SEQ ID NO: 6041399 - DNA, 20 bp, Homo sapiens
catgactagggtcctcaggc

SEQ ID NO: 6041400 - DNA, 23 bp, Homo sapiens
catgactagtgcctagaaagcaa

SEQ ID NO: 6041401 - DNA, 23 bp, Homo sapiens
catgactcgtatatgtctcaggt

SEQ ID NO: 6041402 - DNA, 13 bp, Homo sapiens
catgactctgcct

SEQ ID NO: 6041403 - DNA, 18 bp, Homo sapiens
catgactctgcctaacca

SEQ ID NO: 6041404 - DNA, 24 bp, Homo sapiens
catgactctgcctaaccatgggct

SEQ ID NO: 6041405 - DNA, 18 bp, Homo sapiens
catgactcttgactcttg

SEQ ID NO: 6041406 - DNA, 21 bp, Homo sapiens
catgactcttggagcctcttt

SEQ ID NO: 6041407 - DNA, 22 bp, Homo sapiens
catgactcttggagcctctttt

SEQ ID NO: 6041408 - DNA, 17 bp, Homo sapiens
catgactctttattgtc

SEQ ID NO: 6041409 - DNA, 20 bp, Homo sapiens
catgactgaggaccaatgac

SEQ ID NO: 6041410 - DNA, 15 bp, Homo sapiens
catgactgcaactgt

SEQ ID NO: 6041411 - DNA, 11 bp, Homo sapiens
catgactgcac

SEQ ID NO: 6041412 - DNA, 13 bp, Homo sapiens
catgactgcattt

SEQ ID NO: 6041413 - DNA, 21 bp, Homo sapiens
catgactgccccttgcttctc

SEQ ID NO: 6041414 - DNA, 15 bp, Homo sapiens
catgactgctcaggc

SEQ ID NO: 6041415 - DNA, 14 bp, Homo sapiens
catgactgcttgcc

SEQ ID NO: 6041416 - DNA, 16 bp, Homo sapiens
catgactgcttgccct

SEQ ID NO: 6041417 - DNA, 21 bp, Homo sapiens
catgactgcttgccctaagca

SEQ ID NO: 6041418 - DNA, 14 bp, Homo sapiens
catgactggacagc

SEQ ID NO: 6041419 - DNA, 18 bp, Homo sapiens
catgactggctgtctgcc

SEQ ID NO: 6041420 - DNA, 21 bp, Homo sapiens
catgactgtcgccacacgcct

SEQ ID NO: 6041421 - DNA, 20 bp, Homo sapiens
catgactgtgaccaccttct

SEQ ID NO: 6041422 - DNA, 16 bp, Homo sapiens
catgacttccctccac

SEQ ID NO: 6041423 - DNA, 18 bp, Homo sapiens
catgacttccttatttct

SEQ ID NO: 6041424 - DNA, 22 bp, Homo sapiens
catgacttgagaaacaaataat

SEQ ID NO: 6041425 - DNA, 20 bp, Homo sapiens
catgacttgaggcacaaatc

SEQ ID NO: 6041426 - DNA, 21 bp, Homo sapiens
catgacttgtagcatattctt

SEQ ID NO: 6041427 - DNA, 20 bp, Homo sapiens
catgactttcagattgtatc

SEQ ID NO: 6041428 - DNA, 22 bp, Homo sapiens
catgactttcagattgtatctg

SEQ ID NO: 6041429 - DNA, 23 bp, Homo sapiens
catgacttttccattgaccagct

SEQ ID NO: 6041430 - DNA, 19 bp, Homo sapiens
catgagaaaaactgttctt

SEQ ID NO: 6041431 - DNA, 18 bp, Homo sapiens
catgagaaagggagagga

SEQ ID NO: 6041432 - DNA, 21 bp, Homo sapiens
catgagaaagggagaggaaga

SEQ ID NO: 6041433 - DNA, 17 bp, Homo sapiens
catgagaagagggcctg

SEQ ID NO: 6041434 - DNA, 22 bp, Homo sapiens
catgagaagagggcctgtggga

SEQ ID NO: 6041435 - DNA, 21 bp, Homo sapiens
catgagaagccaagcgctcat

SEQ ID NO: 6041436 - DNA, 22 bp, Homo sapiens
catgagaagttgatatagaaca

SEQ ID NO: 6041437 - DNA, 16 bp, Homo sapiens
ccagccagctgcaggg

SEQ ID NO: 6041438 - DNA, 11 bp, Homo sapiens
ccagccaggac

SEQ ID NO: 6041439 - DNA, 17 bp, Homo sapiens
ccagccaggactcctta

SEQ ID NO: 6041440 - DNA, 17 bp, Homo sapiens
ccagccaggaggggctg

SEQ ID NO: 6041441 - DNA, 13 bp, Homo sapiens
ccagccaggagtg

SEQ ID NO: 6041442 - DNA, 10 bp, Homo sapiens
ccagccaggc

SEQ ID NO: 6041443 - DNA, 16 bp, Homo sapiens
ccagccaggccaacag

SEQ ID NO: 6041444 - DNA, 17 bp, Homo sapiens
ccagccaggccaacagc

SEQ ID NO: 6041445 - DNA, 21 bp, Homo sapiens
ccagccaggcccagccgaccc

SEQ ID NO: 6041446 - DNA, 16 bp, Homo sapiens
ccagccaggcccaggc

SEQ ID NO: 6041447 - DNA, 18 bp, Homo sapiens
ccagccaggctcctacct

SEQ ID NO: 6041448 - DNA, 15 bp, Homo sapiens
ccagccagggaaggc

SEQ ID NO: 6041449 - DNA, 19 bp, Homo sapiens
ccagccagggcaagagagc

SEQ ID NO: 6041450 - DNA, 13 bp, Homo sapiens
ccagccagggctg

SEQ ID NO: 6041451 - DNA, 15 bp, Homo sapiens
ccagccagggctgct

SEQ ID NO: 6041452 - DNA, 21 bp, Homo sapiens
ccagccagttggtggggccag

SEQ ID NO: 6041453 - DNA, 22 bp, Homo sapiens
ccagccagttggtggggccagg

SEQ ID NO: 6041454 - DNA, 16 bp, Homo sapiens
ccagccataaaagcat

SEQ ID NO: 6041455 - DNA, 18 bp, Homo sapiens
ccagccataaaagcattg

SEQ ID NO: 6041456 - DNA, 21 bp, Homo sapiens
ccagccatacttatctctctg

SEQ ID NO: 6041457 - DNA, 18 bp, Homo sapiens
ccagccatcaaaatgctt

SEQ ID NO: 6041458 - DNA, 21 bp, Homo sapiens
ccagccatcatgtgcctggaa

SEQ ID NO: 6041459 - DNA, 19 bp, Homo sapiens
ccagccatcggaagagagg

SEQ ID NO: 6041460 - DNA, 20 bp, Homo sapiens
ccagccatcggaagagaggg

SEQ ID NO: 6041461 - DNA, 23 bp, Homo sapiens
ccagccatcggaagagagggctg

SEQ ID NO: 6041462 - DNA, 16 bp, Homo sapiens
ccagccatctgcccag

SEQ ID NO: 6041463 - DNA, 19 bp, Homo sapiens
ccagccatctgcccagggg

SEQ ID NO: 6041464 - DNA, 20 bp, Homo sapiens
ccagccatctgcccaggggt

SEQ ID NO: 6041465 - DNA, 21 bp, Homo sapiens
ccagccatctgcccaggggtg

SEQ ID NO: 6041466 - DNA, 14 bp, Homo sapiens
ccagccatgccagc

SEQ ID NO: 6041467 - DNA, 15 bp, Homo sapiens
ccagccatgcccagg

SEQ ID NO: 6041468 - DNA, 17 bp, Homo sapiens
ccagccatgcccaggac

SEQ ID NO: 6041469 - DNA, 14 bp, Homo sapiens
ccagccatggctgg

SEQ ID NO: 6041470 - DNA, 19 bp, Homo sapiens
ccagccatggctggatgtg

SEQ ID NO: 6041471 - DNA, 17 bp, Homo sapiens
ccagccatgtctgcatt

SEQ ID NO: 6041472 - DNA, 23 bp, Homo sapiens
ccagcccaaaccttgggccctgg

SEQ ID NO: 6041473 - DNA, 22 bp, Homo sapiens
ccagcccaaaggggacaggcct

SEQ ID NO: 6041474 - DNA, 23 bp, Homo sapiens
ccagcccaaaggggacaggcctc

SEQ ID NO: 6041475 - DNA, 21 bp, Homo sapiens
ccagcccaaccgggaaaggca

SEQ ID NO: 6041476 - DNA, 18 bp, Homo sapiens
ccagcccaatccaggtac

SEQ ID NO: 6041477 - DNA, 19 bp, Homo sapiens
ccagcccacacagcccgag

SEQ ID NO: 6041478 - DNA, 15 bp, Homo sapiens
ccagcccacacccct

SEQ ID NO: 6041479 - DNA, 17 bp, Homo sapiens
ccagcccacacccctcc

SEQ ID NO: 6041480 - DNA, 18 bp, Homo sapiens
ccagcccacagtgctcag

SEQ ID NO: 6041481 - DNA, 17 bp, Homo sapiens
ccagcccacccccggca

SEQ ID NO: 6041482 - DNA, 23 bp, Homo sapiens
ccagcccaccccctttgactctg

SEQ ID NO: 6041483 - DNA, 18 bp, Homo sapiens
ccagcccaccctcctgtc

SEQ ID NO: 6041484 - DNA, 19 bp, Homo sapiens
ccagcccaccctcctgtct

SEQ ID NO: 6041485 - DNA, 16 bp, Homo sapiens
ccagcccaccctgctc

SEQ ID NO: 6041486 - DNA, 13 bp, Homo sapiens
ccagcccacgctg

SEQ ID NO: 6041487 - DNA, 17 bp, Homo sapiens
ccagcccactgcctcct

SEQ ID NO: 6041488 - DNA, 13 bp, Homo sapiens
ccagcccactggg

SEQ ID NO: 6041489 - DNA, 14 bp, Homo sapiens
ccagcccagagaca

SEQ ID NO: 6041490 - DNA, 14 bp, Homo sapiens
ccagcccagagccc

SEQ ID NO: 6041491 - DNA, 13 bp, Homo sapiens
ccagcccagaggc

SEQ ID NO: 6041492 - DNA, 12 bp, Homo sapiens
ccagcccagatg

SEQ ID NO: 6041493 - DNA, 18 bp, Homo sapiens
ccagcccagatggctccc

SEQ ID NO: 6041494 - DNA, 21 bp, Homo sapiens
ccagcccagatggctccctgg

SEQ ID NO: 6041495 - DNA, 23 bp, Homo sapiens
ccagcccagatggctccctgggc

SEQ ID NO: 6041496 - DNA, 12 bp, Homo sapiens
ccagcccagcac

SEQ ID NO: 6041497 - DNA, 16 bp, Homo sapiens
ccagcccagcacccct

SEQ ID NO: 6041498 - DNA, 12 bp, Homo sapiens
ccagcccagcca

SEQ ID NO: 6041499 - DNA, 14 bp, Homo sapiens
ccagcccagccagg

SEQ ID NO: 6041500 - DNA, 14 bp, Homo sapiens
ccagcccagcccag

SEQ ID NO: 6041501 - DNA, 15 bp, Homo sapiens
ccagcccagcccagc

SEQ ID NO: 6041502 - DNA, 16 bp, Homo sapiens
ccagcccagcccagct

SEQ ID NO: 6041503 - DNA, 12 bp, Homo sapiens
ccagcccagcct

SEQ ID NO: 6041504 - DNA, 14 bp, Homo sapiens
ccagcccagcctgc

SEQ ID NO: 6041505 - DNA, 20 bp, Homo sapiens
ccagcccagctccactcagg

SEQ ID NO: 6041506 - DNA, 19 bp, Homo sapiens
ccagcccagctgctctgcc

SEQ ID NO: 6041507 - DNA, 15 bp, Homo sapiens
ccagcccagctggcc

SEQ ID NO: 6041508 - DNA, 23 bp, Homo sapiens
ccagcccaggaaaaactggaagc

SEQ ID NO: 6041509 - DNA, 12 bp, Homo sapiens
ccagcccaggag

SEQ ID NO: 6041510 - DNA, 23 bp, Homo sapiens
ccagcccaggagtttgaggctgc

SEQ ID NO: 6041511 - DNA, 12 bp, Homo sapiens
ccagcccaggcc

SEQ ID NO: 6041512 - DNA, 13 bp, Homo sapiens
ccagcccaggcct

SEQ ID NO: 6041513 - DNA, 14 bp, Homo sapiens
ccagcccagggctc

SEQ ID NO: 6041514 - DNA, 22 bp, Homo sapiens
ccagcccatccattaggccagc

SEQ ID NO: 6041515 - DNA, 18 bp, Homo sapiens
ccagcccatcttgcctcc

SEQ ID NO: 6041516 - DNA, 14 bp, Homo sapiens
ccagcccatgctgg

SEQ ID NO: 6041517 - DNA, 14 bp, Homo sapiens
ccagcccatggaga

SEQ ID NO: 6041518 - DNA, 17 bp, Homo sapiens
ccagcccatggccccca

SEQ ID NO: 6041519 - DNA, 22 bp, Homo sapiens
ccagcccatggcccccaataaa

SEQ ID NO: 6041520 - DNA, 19 bp, Homo sapiens
ccagcccattctctctcct

SEQ ID NO: 6041521 - DNA, 21 bp, Homo sapiens
ccagcccattttgaggccaga

SEQ ID NO: 6041522 - DNA, 13 bp, Homo sapiens
ccagccccaactc

SEQ ID NO: 6041523 - DNA, 16 bp, Homo sapiens
ccagccccaaggggtg

SEQ ID NO: 6041524 - DNA, 18 bp, Homo sapiens
ccagccccaatccagaga

SEQ ID NO: 6041525 - DNA, 12 bp, Homo sapiens
ccagccccacac

SEQ ID NO: 6041526 - DNA, 21 bp, Homo sapiens
ccagccccacacagctacagc

SEQ ID NO: 6041527 - DNA, 15 bp, Homo sapiens
ccagccccacagccc

SEQ ID NO: 6041528 - DNA, 19 bp, Homo sapiens
ccagccccacagcccacgt

SEQ ID NO: 6041529 - DNA, 21 bp, Homo sapiens
ccagccccacagcccacgtcc

SEQ ID NO: 6041530 - DNA, 16 bp, Homo sapiens
ccagccccacccagga

SEQ ID NO: 6041531 - DNA, 18 bp, Homo sapiens
ccagccccacccaggagg

SEQ ID NO: 6041532 - DNA, 18 bp, Homo sapiens
ccagccccacccccagcc

SEQ ID NO: 6041533 - DNA, 20 bp, Homo sapiens
ccagccccacccccagccag

SEQ ID NO: 6041534 - DNA, 22 bp, Homo sapiens
ccagccccacccctaagtgccc

SEQ ID NO: 6041535 - DNA, 18 bp, Homo sapiens
ccagccccactcctctgc

SEQ ID NO: 6041536 - DNA, 23 bp, Homo sapiens
ccagccccactgccagcagcagc

SEQ ID NO: 6041537 - DNA, 15 bp, Homo sapiens
ccagccccactgccc

SEQ ID NO: 6041538 - DNA, 22 bp, Homo sapiens
ccagccccagacaacagcccag

SEQ ID NO: 6041539 - DNA, 15 bp, Homo sapiens
ccagccccagccagg

SEQ ID NO: 6041540 - DNA, 17 bp, Homo sapiens
ccagccccagccccttc

SEQ ID NO: 6041541 - DNA, 12 bp, Homo sapiens
ccagccccaggc

SEQ ID NO: 6041542 - DNA, 15 bp, Homo sapiens
ccagccccaggcctg

SEQ ID NO: 6041543 - DNA, 17 bp, Homo sapiens
ccagccccagtgcccac

SEQ ID NO: 6041544 - DNA, 14 bp, Homo sapiens
ccagccccatccct

SEQ ID NO: 6041545 - DNA, 17 bp, Homo sapiens
ccagccccatcctctgt

SEQ ID NO: 6041546 - DNA, 18 bp, Homo sapiens
ccagccccatcctctgta

SEQ ID NO: 6041547 - DNA, 23 bp, Homo sapiens
ccagccccatcctctgtacagag

SEQ ID NO: 6041548 - DNA, 13 bp, Homo sapiens
ccagcccccacag

SEQ ID NO: 6041549 - DNA, 16 bp, Homo sapiens
ccagcccccacagtgc

SEQ ID NO: 6041550 - DNA, 24 bp, Homo sapiens
ccagcccccacccatgccagcgca

SEQ ID NO: 6041551 - DNA, 15 bp, Homo sapiens
ccagcccccaccccc

SEQ ID NO: 6041552 - DNA, 16 bp, Homo sapiens
ccagcccccacccccg

SEQ ID NO: 6041553 - DNA, 13 bp, Homo sapiens
ccagcccccaggg

SEQ ID NO: 6041554 - DNA, 16 bp, Homo sapiens
ccagcccccagggccc

SEQ ID NO: 6041555 - DNA, 18 bp, Homo sapiens
ccagccccccaccccaca

SEQ ID NO: 6041556 - DNA, 23 bp, Homo sapiens
ccagccccccaccccacagatca

SEQ ID NO: 6041557 - DNA, 21 bp, Homo sapiens
ccagccccccaggctgcccag

SEQ ID NO: 6041558 - DNA, 14 bp, Homo sapiens
ccagcccccccacc

SEQ ID NO: 6041559 - DNA, 16 bp, Homo sapiens
ccagcccccccaccca

SEQ ID NO: 6041560 - DNA, 23 bp, Homo sapiens
ccagcccccccacccacccccag

SEQ ID NO: 6041561 - DNA, 16 bp, Homo sapiens
ccagcccccgccccag

SEQ ID NO: 6041562 - DNA, 18 bp, Homo sapiens
ccagcccccgccccagag

SEQ ID NO: 6041563 - DNA, 15 bp, Homo sapiens
ccagccccctccagc

SEQ ID NO: 6041564 - DNA, 16 bp, Homo sapiens
ccagccccctccagct

SEQ ID NO: 6041565 - DNA, 23 bp, Homo sapiens
ccagccccctgaccactcagaga

SEQ ID NO: 6041566 - DNA, 13 bp, Homo sapiens
ccagccccctgga

SEQ ID NO: 6041567 - DNA, 15 bp, Homo sapiens
ccagccccctggatg

SEQ ID NO: 6041568 - DNA, 22 bp, Homo sapiens
ccagccccctggatgggcattg

SEQ ID NO: 6041569 - DNA, 23 bp, Homo sapiens
ccagccccctggatgggcattgg

SEQ ID NO: 6041570 - DNA, 16 bp, Homo sapiens
ccagccccgactccag

SEQ ID NO: 6041571 - DNA, 16 bp, Homo sapiens
ccagccccgctcaggc

SEQ ID NO: 6041572 - DNA, 14 bp, Homo sapiens
ccagccccgctccc

SEQ ID NO: 6041573 - DNA, 16 bp, Homo sapiens
ccagccccgctcccac

SEQ ID NO: 6041574 - DNA, 17 bp, Homo sapiens
ccagccccggcaagcca

SEQ ID NO: 6041575 - DNA, 19 bp, Homo sapiens
ccagccccggcaagccaca

SEQ ID NO: 6041576 - DNA, 18 bp, Homo sapiens
ccagccccggccctgggc

SEQ ID NO: 6041577 - DNA, 18 bp, Homo sapiens
ccagccccggccttgctt

SEQ ID NO: 6041578 - DNA, 20 bp, Homo sapiens
ccagccccggtggctgggca

SEQ ID NO: 6041579 - DNA, 21 bp, Homo sapiens
ccagccccgtcccagaggccg

SEQ ID NO: 6041580 - DNA, 16 bp, Homo sapiens
ccagccccgtgccagg

SEQ ID NO: 6041581 - DNA, 23 bp, Homo sapiens
ccagccccgttttaaggacatta

SEQ ID NO: 6041582 - DNA, 23 bp, Homo sapiens
ccagcccctagaaacccaagctc

SEQ ID NO: 6041583 - DNA, 14 bp, Homo sapiens
ccagcccctagccc

SEQ ID NO: 6041584 - DNA, 16 bp, Homo sapiens
ccagcccctagcccag

SEQ ID NO: 6041585 - DNA, 19 bp, Homo sapiens
ccagcccctagcccaggag

SEQ ID NO: 6041586 - DNA, 15 bp, Homo sapiens
ccagcccctcccacc

SEQ ID NO: 6041587 - DNA, 20 bp, Homo sapiens
ccagcccctcccaccacagc

SEQ ID NO: 6041588 - DNA, 21 bp, Homo sapiens
ccagcccctcccaccacagca

SEQ ID NO: 6041589 - DNA, 17 bp, Homo sapiens
ccagcccctcctcccct

SEQ ID NO: 6041590 - DNA, 23 bp, Homo sapiens
ccagcccctcctccctcagaccc

SEQ ID NO: 6041591 - DNA, 21 bp, Homo sapiens
ccagcccctcctccctcaggc

SEQ ID NO: 6041592 - DNA, 15 bp, Homo sapiens
ccagcccctcttccc

SEQ ID NO: 6041593 - DNA, 18 bp, Homo sapiens
ccagcccctgcagattct

SEQ ID NO: 6041594 - DNA, 15 bp, Homo sapiens
ccagcccctgcccca

SEQ ID NO: 6041595 - DNA, 16 bp, Homo sapiens
ccagcccctgcctggg

SEQ ID NO: 6041596 - DNA, 18 bp, Homo sapiens
ccagcccctgcctgggtt

SEQ ID NO: 6041597 - DNA, 15 bp, Homo sapiens
ccagcccctgcggcc

SEQ ID NO: 6041598 - DNA, 21 bp, Homo sapiens
ccagcccctgcggccgtcacc

SEQ ID NO: 6041599 - DNA, 23 bp, Homo sapiens
ccagcccctgctggctggtgcct

SEQ ID NO: 6041600 - DNA, 12 bp, Homo sapiens
ccagcccctgga

SEQ ID NO: 6041601 - DNA, 13 bp, Homo sapiens
ccagcccctggac

SEQ ID NO: 6041602 - DNA, 14 bp, Homo sapiens
ccagcccctggatg

SEQ ID NO: 6041603 - DNA, 13 bp, Homo sapiens
ccagcccctggcc

SEQ ID NO: 6041604 - DNA, 19 bp, Homo sapiens
ccagcccctgtagaactca

SEQ ID NO: 6041605 - DNA, 19 bp, Homo sapiens
ccagccccttagacagagg

SEQ ID NO: 6041606 - DNA, 12 bp, Homo sapiens
ccagccccttcc

SEQ ID NO: 6041607 - DNA, 15 bp, Homo sapiens
ccagccccttcccct

SEQ ID NO: 6041608 - DNA, 17 bp, Homo sapiens
ccagccccttcccctgg

SEQ ID NO: 6041609 - DNA, 22 bp, Homo sapiens
ccagccccttcccctgggaact

SEQ ID NO: 6041610 - DNA, 14 bp, Homo sapiens
ccagccccttcctg

SEQ ID NO: 6041611 - DNA, 17 bp, Homo sapiens
ccagccccttctcccag

SEQ ID NO: 6041612 - DNA, 24 bp, Homo sapiens
ccagccccttctgacccatgctgc

SEQ ID NO: 6041613 - DNA, 14 bp, Homo sapiens
ccagccccttgaga

SEQ ID NO: 6041614 - DNA, 15 bp, Homo sapiens
ccagcccctttccaa

SEQ ID NO: 6041615 - DNA, 22 bp, Homo sapiens
ccagcccctttgcctctgtcct

SEQ ID NO: 6041616 - DNA, 22 bp, Homo sapiens
catgagaatgctagcaggctgt

SEQ ID NO: 6041617 - DNA, 19 bp, Homo sapiens
catgagacaattttgcttc

SEQ ID NO: 6041618 - DNA, 18 bp, Homo sapiens
catgagacattgacacca

SEQ ID NO: 6041619 - DNA, 17 bp, Homo sapiens
catgagaccactgttat

SEQ ID NO: 6041620 - DNA, 14 bp, Homo sapiens
catgagactgccct

SEQ ID NO: 6041621 - DNA, 18 bp, Homo sapiens
catgagactgccctgccc

SEQ ID NO: 6041622 - DNA, 23 bp, Homo sapiens
catgagagaattgtatcatttga

SEQ ID NO: 6041623 - DNA, 16 bp, Homo sapiens
catgagaggactgatg

SEQ ID NO: 6041624 - DNA, 16 bp, Homo sapiens
catgagaggaggcagc

SEQ ID NO: 6041625 - DNA, 19 bp, Homo sapiens
catgagagtagggccctga

SEQ ID NO: 6041626 - DNA, 18 bp, Homo sapiens
catgagataatatgcaga

SEQ ID NO: 6041627 - DNA, 16 bp, Homo sapiens
catgagatcagggcct

SEQ ID NO: 6041628 - DNA, 20 bp, Homo sapiens
catgagatcagggcctgccc

SEQ ID NO: 6041629 - DNA, 20 bp, Homo sapiens
catgagatctaggtgaggat

SEQ ID NO: 6041630 - DNA, 22 bp, Homo sapiens
catgagatgatacatccaaagc

SEQ ID NO: 6041631 - DNA, 18 bp, Homo sapiens
catgagatggagaggctg

SEQ ID NO: 6041632 - DNA, 12 bp, Homo sapiens
catgagatgtgt

SEQ ID NO: 6041633 - DNA, 14 bp, Homo sapiens
catgagatgtgtgg

SEQ ID NO: 6041634 - DNA, 16 bp, Homo sapiens
catgagcaagcctagg

SEQ ID NO: 6041635 - DNA, 21 bp, Homo sapiens
catgagcacctttctggcttt

SEQ ID NO: 6041636 - DNA, 19 bp, Homo sapiens
catgagcactactctacca

SEQ ID NO: 6041637 - DNA, 21 bp, Homo sapiens
catgagcatcaggccaggccc

SEQ ID NO: 6041638 - DNA, 17 bp, Homo sapiens
catgagcattggataca

SEQ ID NO: 6041639 - DNA, 14 bp, Homo sapiens
catgagccaccgcg

SEQ ID NO: 6041640 - DNA, 21 bp, Homo sapiens
catgagccactgtgcttggcc

SEQ ID NO: 6041641 - DNA, 20 bp, Homo sapiens
catgagcccaaacaccctcc

SEQ ID NO: 6041642 - DNA, 16 bp, Homo sapiens
catgagccgcccaagg

SEQ ID NO: 6041643 - DNA, 21 bp, Homo sapiens
catgagccgcccaaggccttc

SEQ ID NO: 6041644 - DNA, 15 bp, Homo sapiens
catgagcctcagcat

SEQ ID NO: 6041645 - DNA, 20 bp, Homo sapiens
catgagcctcagcatcctgg

SEQ ID NO: 6041646 - DNA, 22 bp, Homo sapiens
catgagcctcagcatcctggca

SEQ ID NO: 6041647 - DNA, 13 bp, Homo sapiens
catgagcctgccc

SEQ ID NO: 6041648 - DNA, 16 bp, Homo sapiens
catgagcctgcccgct

SEQ ID NO: 6041649 - DNA, 16 bp, Homo sapiens
catgagcctgctggaa

SEQ ID NO: 6041650 - DNA, 20 bp, Homo sapiens
catgagcctgctggaagccc

SEQ ID NO: 6041651 - DNA, 23 bp, Homo sapiens
catgagcctgctggaagcccagc

SEQ ID NO: 6041652 - DNA, 14 bp, Homo sapiens
catgagcctgttta

SEQ ID NO: 6041653 - DNA, 19 bp, Homo sapiens
catgagcctgtttattgcc

SEQ ID NO: 6041654 - DNA, 21 bp, Homo sapiens
catgagcctgtttattgccat

SEQ ID NO: 6041655 - DNA, 22 bp, Homo sapiens
catgagccttcagtcagggttt

SEQ ID NO: 6041656 - DNA, 23 bp, Homo sapiens
catgagcgtcaaagaaaatgcct

SEQ ID NO: 6041657 - DNA, 22 bp, Homo sapiens
catgagctatttccattccaga

SEQ ID NO: 6041658 - DNA, 23 bp, Homo sapiens
catgagctatttccattccagaa

SEQ ID NO: 6041659 - DNA, 16 bp, Homo sapiens
catgagctccagaccc

SEQ ID NO: 6041660 - DNA, 19 bp, Homo sapiens
catgagctccagaccccca

SEQ ID NO: 6041661 - DNA, 23 bp, Homo sapiens
catgagctccagacccccagcaa

SEQ ID NO: 6041662 - DNA, 18 bp, Homo sapiens
catgagctcctgatcaga

SEQ ID NO: 6041663 - DNA, 21 bp, Homo sapiens
catgagctcctgatcagaggc

SEQ ID NO: 6041664 - DNA, 23 bp, Homo sapiens
catgagctccttaaggctctttt

SEQ ID NO: 6041665 - DNA, 22 bp, Homo sapiens
catgagctcggggtccaccagt

SEQ ID NO: 6041666 - DNA, 12 bp, Homo sapiens
catgagctctgt

SEQ ID NO: 6041667 - DNA, 20 bp, Homo sapiens
catgagctgatcagcctgtg

SEQ ID NO: 6041668 - DNA, 11 bp, Homo sapiens
catgagctgct

SEQ ID NO: 6041669 - DNA, 23 bp, Homo sapiens
catgagctgctcattacagttct

SEQ ID NO: 6041670 - DNA, 13 bp, Homo sapiens
catgagctgctgt

SEQ ID NO: 6041671 - DNA, 14 bp, Homo sapiens
catgagctgctgtg

SEQ ID NO: 6041672 - DNA, 15 bp, Homo sapiens
catgagctgctgtgc

SEQ ID NO: 6041673 - DNA, 19 bp, Homo sapiens
catgagctgctgtgcccag

SEQ ID NO: 6041674 - DNA, 21 bp, Homo sapiens
catgagctggcaaccagccag

SEQ ID NO: 6041675 - DNA, 14 bp, Homo sapiens
catgagcttttata

SEQ ID NO: 6041676 - DNA, 12 bp, Homo sapiens
catgaggaacta

SEQ ID NO: 6041677 - DNA, 14 bp, Homo sapiens
catgaggacagaag

SEQ ID NO: 6041678 - DNA, 21 bp, Homo sapiens
catgaggacatgatggagcgc

SEQ ID NO: 6041679 - DNA, 15 bp, Homo sapiens
catgaggaccagggt

SEQ ID NO: 6041680 - DNA, 21 bp, Homo sapiens
catgaggactctattctttaa

SEQ ID NO: 6041681 - DNA, 19 bp, Homo sapiens
catgaggagaaaaaaagca

SEQ ID NO: 6041682 - DNA, 19 bp, Homo sapiens
catgaggagattctgcctt

SEQ ID NO: 6041683 - DNA, 19 bp, Homo sapiens
catgaggaggcagagaggg

SEQ ID NO: 6041684 - DNA, 22 bp, Homo sapiens
catgaggaggggcccccctgcc

SEQ ID NO: 6041685 - DNA, 18 bp, Homo sapiens
catgaggataacttcctt

SEQ ID NO: 6041686 - DNA, 21 bp, Homo sapiens
catgaggataacttccttgcc

SEQ ID NO: 6041687 - DNA, 23 bp, Homo sapiens
catgaggcaatgtcaggaacaga

SEQ ID NO: 6041688 - DNA, 16 bp, Homo sapiens
catgaggccactgctg

SEQ ID NO: 6041689 - DNA, 17 bp, Homo sapiens
catgaggccatctcagg

SEQ ID NO: 6041690 - DNA, 19 bp, Homo sapiens
catgaggccccgaggctcg

SEQ ID NO: 6041691 - DNA, 19 bp, Homo sapiens
catgaggcctttccccagt

SEQ ID NO: 6041692 - DNA, 20 bp, Homo sapiens
catgaggctgaggcaggaga

SEQ ID NO: 6041693 - DNA, 15 bp, Homo sapiens
catgagggaagaata

SEQ ID NO: 6041694 - DNA, 15 bp, Homo sapiens
catgagggacagggt

SEQ ID NO: 6041695 - DNA, 16 bp, Homo sapiens
catgagggacagggtc

SEQ ID NO: 6041696 - DNA, 18 bp, Homo sapiens
catgagggagatgccatg

SEQ ID NO: 6041697 - DNA, 17 bp, Homo sapiens
catgagggatcacaggg

SEQ ID NO: 6041698 - DNA, 20 bp, Homo sapiens
catgagggatcacagggccc

SEQ ID NO: 6041699 - DNA, 20 bp, Homo sapiens
catgagggcaggcacatgtt

SEQ ID NO: 6041700 - DNA, 18 bp, Homo sapiens
catgaggggagaggagac

SEQ ID NO: 6041701 - DNA, 14 bp, Homo sapiens
catgagggtgtttt

SEQ ID NO: 6041702 - DNA, 19 bp, Homo sapiens
catgaggtactgagagtga

SEQ ID NO: 6041703 - DNA, 20 bp, Homo sapiens
catgaggtactggtcccttc

SEQ ID NO: 6041704 - DNA, 19 bp, Homo sapiens
catgaggtgttgtgcattt

SEQ ID NO: 6041705 - DNA, 22 bp, Homo sapiens
catgagtagataatttcagggt

SEQ ID NO: 6041706 - DNA, 15 bp, Homo sapiens
catgagtatctgtgg

SEQ ID NO: 6041707 - DNA, 18 bp, Homo sapiens
catgagtatctgtgggag

SEQ ID NO: 6041708 - DNA, 20 bp, Homo sapiens
catgagtccttgaaaatatt

SEQ ID NO: 6041709 - DNA, 22 bp, Homo sapiens
catgagtctacctgagcattca

SEQ ID NO: 6041710 - DNA, 13 bp, Homo sapiens
catgagtctccag

SEQ ID NO: 6041711 - DNA, 15 bp, Homo sapiens
catgagtctccagat

SEQ ID NO: 6041712 - DNA, 22 bp, Homo sapiens
catgagtctccagatagatgtc

SEQ ID NO: 6041713 - DNA, 14 bp, Homo sapiens
catgagtctgtttc

SEQ ID NO: 6041714 - DNA, 18 bp, Homo sapiens
catgagtctgtttcccaa

SEQ ID NO: 6041715 - DNA, 20 bp, Homo sapiens
catgagtctgtttcccaagc

SEQ ID NO: 6041716 - DNA, 20 bp, Homo sapiens
catgagtgctaagagcctct

SEQ ID NO: 6041717 - DNA, 22 bp, Homo sapiens
catgagtgctaagagcctctgg

SEQ ID NO: 6041718 - DNA, 22 bp, Homo sapiens
catgagtggagtttccaacaga

SEQ ID NO: 6041719 - DNA, 13 bp, Homo sapiens
catgagtggatgg

SEQ ID NO: 6041720 - DNA, 14 bp, Homo sapiens
catgagtggatgga

SEQ ID NO: 6041721 - DNA, 17 bp, Homo sapiens
catgagtggatggatgg

SEQ ID NO: 6041722 - DNA, 22 bp, Homo sapiens
catgagtgtcaactccaggact

SEQ ID NO: 6041723 - DNA, 14 bp, Homo sapiens
catgagtgtgcccc

SEQ ID NO: 6041724 - DNA, 12 bp, Homo sapiens
catgagttattc

SEQ ID NO: 6041725 - DNA, 15 bp, Homo sapiens
catgagttcaaatac

SEQ ID NO: 6041726 - DNA, 18 bp, Homo sapiens
catgagttccagaaagta

SEQ ID NO: 6041727 - DNA, 19 bp, Homo sapiens
catgagttggctgggaata

SEQ ID NO: 6041728 - DNA, 21 bp, Homo sapiens
catgagttggggtctggcagc

SEQ ID NO: 6041729 - DNA, 21 bp, Homo sapiens
catgagttgtcagctttgact

SEQ ID NO: 6041730 - DNA, 16 bp, Homo sapiens
catgagtttaaatcaa

SEQ ID NO: 6041731 - DNA, 16 bp, Homo sapiens
catgagtttgccctgg

SEQ ID NO: 6041732 - DNA, 19 bp, Homo sapiens
catgagttttttctcttgg

SEQ ID NO: 6041733 - DNA, 13 bp, Homo sapiens
catgataaaataa

SEQ ID NO: 6041734 - DNA, 21 bp, Homo sapiens
catgataaaataagtaacata

SEQ ID NO: 6041735 - DNA, 23 bp, Homo sapiens
catgataaaataagtaacatata

SEQ ID NO: 6041736 - DNA, 22 bp, Homo sapiens
catgataatgagttttacatta

SEQ ID NO: 6041737 - DNA, 16 bp, Homo sapiens
catgataattcagcag

SEQ ID NO: 6041738 - DNA, 12 bp, Homo sapiens
catgatacaaag

SEQ ID NO: 6041739 - DNA, 14 bp, Homo sapiens
catgatacccctta

SEQ ID NO: 6041740 - DNA, 14 bp, Homo sapiens
catgatacctatta

SEQ ID NO: 6041741 - DNA, 21 bp, Homo sapiens
catgatacgcttaaggtggaa

SEQ ID NO: 6041742 - DNA, 17 bp, Homo sapiens
catgatactcatttctt

SEQ ID NO: 6041743 - DNA, 14 bp, Homo sapiens
catgatactccact

SEQ ID NO: 6041744 - DNA, 16 bp, Homo sapiens
catgatactgctgctt

SEQ ID NO: 6041745 - DNA, 22 bp, Homo sapiens
catgatactgctgcttgtcaaa

SEQ ID NO: 6041746 - DNA, 13 bp, Homo sapiens
catgatagaaaga

SEQ ID NO: 6041747 - DNA, 18 bp, Homo sapiens
catgatagaaagaataaa

SEQ ID NO: 6041748 - DNA, 21 bp, Homo sapiens
catgatagaaagaataaaatg

SEQ ID NO: 6041749 - DNA, 22 bp, Homo sapiens
catgatagtgtgatttttttca

SEQ ID NO: 6041750 - DNA, 15 bp, Homo sapiens
catgatagttaaact

SEQ ID NO: 6041751 - DNA, 16 bp, Homo sapiens
catgatatcttcaagc

SEQ ID NO: 6041752 - DNA, 14 bp, Homo sapiens
catgatatgtcagg

SEQ ID NO: 6041753 - DNA, 13 bp, Homo sapiens
catgatattgtat

SEQ ID NO: 6041754 - DNA, 14 bp, Homo sapiens
catgatattttcag

SEQ ID NO: 6041755 - DNA, 20 bp, Homo sapiens
catgatattttgtttttccc

SEQ ID NO: 6041756 - DNA, 20 bp, Homo sapiens
catgatcaagatatatgtgt

SEQ ID NO: 6041757 - DNA, 15 bp, Homo sapiens
catgatcacacagct

SEQ ID NO: 6041758 - DNA, 17 bp, Homo sapiens
catgatcacttatcagt

SEQ ID NO: 6041759 - DNA, 23 bp, Homo sapiens
catgatcagacatacagctgcct

SEQ ID NO: 6041760 - DNA, 21 bp, Homo sapiens
catgatccacccacctcagcc

SEQ ID NO: 6041761 - DNA, 16 bp, Homo sapiens
catgatctccctgccg

SEQ ID NO: 6041762 - DNA, 18 bp, Homo sapiens
catgatctccctgccgcc

SEQ ID NO: 6041763 - DNA, 15 bp, Homo sapiens
catgatctcggctta

SEQ ID NO: 6041764 - DNA, 19 bp, Homo sapiens
catgatcttggtttatcat

SEQ ID NO: 6041765 - DNA, 20 bp, Homo sapiens
catgatgactcttcttatca

SEQ ID NO: 6041766 - DNA, 18 bp, Homo sapiens
catgatgagctcctcttc

SEQ ID NO: 6041767 - DNA, 19 bp, Homo sapiens
catgatgagctcctcttcc

SEQ ID NO: 6041768 - DNA, 14 bp, Homo sapiens
catgatgatgatga

SEQ ID NO: 6041769 - DNA, 17 bp, Homo sapiens
catgatgcaagccagct

SEQ ID NO: 6041770 - DNA, 12 bp, Homo sapiens
catgatgcacag

SEQ ID NO: 6041771 - DNA, 20 bp, Homo sapiens
catgatgcacagtatctgct

SEQ ID NO: 6041772 - DNA, 11 bp, Homo sapiens
catgatgcagt

SEQ ID NO: 6041773 - DNA, 15 bp, Homo sapiens
catgatgcagtctcc

SEQ ID NO: 6041774 - DNA, 23 bp, Homo sapiens
catgatgcagtctcctctttaaa

SEQ ID NO: 6041775 - DNA, 22 bp, Homo sapiens
catgatgcctctgtcttctgga

SEQ ID NO: 6041776 - DNA, 15 bp, Homo sapiens
catgatgcgggccag

SEQ ID NO: 6041777 - DNA, 20 bp, Homo sapiens
catgatgcgggccagtgctc

SEQ ID NO: 6041778 - DNA, 18 bp, Homo sapiens
catgatgctagttcttac

SEQ ID NO: 6041779 - DNA, 21 bp, Homo sapiens
catgatggacaaaggcctggc

SEQ ID NO: 6041780 - DNA, 23 bp, Homo sapiens
catgatggactttggtttgaaca

SEQ ID NO: 6041781 - DNA, 13 bp, Homo sapiens
catgatggagctg

SEQ ID NO: 6041782 - DNA, 14 bp, Homo sapiens
catgatggagctga

SEQ ID NO: 6041783 - DNA, 13 bp, Homo sapiens
catgatggccagg

SEQ ID NO: 6041784 - DNA, 16 bp, Homo sapiens
catgatgggaaaatat

SEQ ID NO: 6041785 - DNA, 17 bp, Homo sapiens
catgatgggaaaatatt

SEQ ID NO: 6041786 - DNA, 23 bp, Homo sapiens
catgatgggaaaatatttcctga

SEQ ID NO: 6041787 - DNA, 23 bp, Homo sapiens
catgatgggaatagggagacagg

SEQ ID NO: 6041788 - DNA, 17 bp, Homo sapiens
catgatgtaaaaaatac

SEQ ID NO: 6041789 - DNA, 21 bp, Homo sapiens
catgatgtaaaaaatattaaa

SEQ ID NO: 6041790 - DNA, 18 bp, Homo sapiens
catgatgtccttgttatt

SEQ ID NO: 6041791 - DNA, 18 bp, Homo sapiens
catgatgtcgttcatttt

SEQ ID NO: 6041792 - DNA, 20 bp, Homo sapiens
ccagccccttttctctgctc

SEQ ID NO: 6041793 - DNA, 22 bp, Homo sapiens
ccagccccttttctctgctctt

SEQ ID NO: 6041794 - DNA, 19 bp, Homo sapiens
ccagcccgagtggtctcct

SEQ ID NO: 6041795 - DNA, 15 bp, Homo sapiens
ccagcccgcagaggt

SEQ ID NO: 6041796 - DNA, 16 bp, Homo sapiens
ccagcccgcagaggtg

SEQ ID NO: 6041797 - DNA, 17 bp, Homo sapiens
ccagcccggaggggact

SEQ ID NO: 6041798 - DNA, 17 bp, Homo sapiens
ccagcccggcctgctcc

SEQ ID NO: 6041799 - DNA, 20 bp, Homo sapiens
ccagcccggctcggcccagc

SEQ ID NO: 6041800 - DNA, 15 bp, Homo sapiens
ccagcccggctgacc

SEQ ID NO: 6041801 - DNA, 20 bp, Homo sapiens
ccagcccgggagcctaggac

SEQ ID NO: 6041802 - DNA, 13 bp, Homo sapiens
ccagccctagctg

SEQ ID NO: 6041803 - DNA, 16 bp, Homo sapiens
ccagccctatggatgt

SEQ ID NO: 6041804 - DNA, 16 bp, Homo sapiens
ccagccctcagcattg

SEQ ID NO: 6041805 - DNA, 12 bp, Homo sapiens
ccagccctcagg

SEQ ID NO: 6041806 - DNA, 13 bp, Homo sapiens
ccagccctcaggc

SEQ ID NO: 6041807 - DNA, 14 bp, Homo sapiens
ccagccctcaggcc

SEQ ID NO: 6041808 - DNA, 18 bp, Homo sapiens
ccagccctcaggccagtg

SEQ ID NO: 6041809 - DNA, 20 bp, Homo sapiens
ccagccctcaggccagtgcc

SEQ ID NO: 6041810 - DNA, 13 bp, Homo sapiens
ccagccctccaga

SEQ ID NO: 6041811 - DNA, 16 bp, Homo sapiens
ccagccctccagagca

SEQ ID NO: 6041812 - DNA, 13 bp, Homo sapiens
ccagccctcccag

SEQ ID NO: 6041813 - DNA, 15 bp, Homo sapiens
ccagccctcccagca

SEQ ID NO: 6041814 - DNA, 19 bp, Homo sapiens
ccagccctccccacctgct

SEQ ID NO: 6041815 - DNA, 21 bp, Homo sapiens
ccagccctccccgcagtggga

SEQ ID NO: 6041816 - DNA, 18 bp, Homo sapiens
ccagccctccctggctgt

SEQ ID NO: 6041817 - DNA, 20 bp, Homo sapiens
ccagccctccctggctgtga

SEQ ID NO: 6041818 - DNA, 15 bp, Homo sapiens
ccagccctccctgtc

SEQ ID NO: 6041819 - DNA, 17 bp, Homo sapiens
ccagccctccctgtcct

SEQ ID NO: 6041820 - DNA, 18 bp, Homo sapiens
ccagccctccctgtcctc

SEQ ID NO: 6041821 - DNA, 21 bp, Homo sapiens
ccagccctccgccagccctgt

SEQ ID NO: 6041822 - DNA, 16 bp, Homo sapiens
ccagccctcctacgca

SEQ ID NO: 6041823 - DNA, 14 bp, Homo sapiens
ccagccctgaacaa

SEQ ID NO: 6041824 - DNA, 15 bp, Homo sapiens
ccagccctgactaaa

SEQ ID NO: 6041825 - DNA, 16 bp, Homo sapiens
ccagccctgaggggtg

SEQ ID NO: 6041826 - DNA, 15 bp, Homo sapiens
ccagccctgccagga

SEQ ID NO: 6041827 - DNA, 19 bp, Homo sapiens
ccagccctgccaggaggct

SEQ ID NO: 6041828 - DNA, 21 bp, Homo sapiens
ccagccctgccaggaggctgc

SEQ ID NO: 6041829 - DNA, 13 bp, Homo sapiens
ccagccctgccca

SEQ ID NO: 6041830 - DNA, 16 bp, Homo sapiens
ccagccctgcccaccc

SEQ ID NO: 6041831 - DNA, 13 bp, Homo sapiens
ccagccctgcctg

SEQ ID NO: 6041832 - DNA, 14 bp, Homo sapiens
ccagccctgcctgg

SEQ ID NO: 6041833 - DNA, 17 bp, Homo sapiens
ccagccctgcctggagg

SEQ ID NO: 6041834 - DNA, 12 bp, Homo sapiens
ccagccctgctg

SEQ ID NO: 6041835 - DNA, 19 bp, Homo sapiens
ccagccctgctgcttccta

SEQ ID NO: 6041836 - DNA, 13 bp, Homo sapiens
ccagccctgctgg

SEQ ID NO: 6041837 - DNA, 18 bp, Homo sapiens
ccagccctgctggccgcc

SEQ ID NO: 6041838 - DNA, 24 bp, Homo sapiens
ccagccctgctggccgcctcaccc

SEQ ID NO: 6041839 - DNA, 14 bp, Homo sapiens
ccagccctgctggg

SEQ ID NO: 6041840 - DNA, 22 bp, Homo sapiens
ccagccctgctggggatccccg

SEQ ID NO: 6041841 - DNA, 14 bp, Homo sapiens
ccagccctggaggc

SEQ ID NO: 6041842 - DNA, 14 bp, Homo sapiens
ccagccctggccca

SEQ ID NO: 6041843 - DNA, 16 bp, Homo sapiens
ccagccctggcccacc

SEQ ID NO: 6041844 - DNA, 13 bp, Homo sapiens
ccagccctggctc

SEQ ID NO: 6041845 - DNA, 14 bp, Homo sapiens
ccagccctggctga

SEQ ID NO: 6041846 - DNA, 18 bp, Homo sapiens
ccagccctggctgaagga

SEQ ID NO: 6041847 - DNA, 21 bp, Homo sapiens
ccagccctggctgaaggactg

SEQ ID NO: 6041848 - DNA, 15 bp, Homo sapiens
ccagccctggcttcc

SEQ ID NO: 6041849 - DNA, 13 bp, Homo sapiens
ccagccctgggca

SEQ ID NO: 6041850 - DNA, 14 bp, Homo sapiens
ccagccctgggctt

SEQ ID NO: 6041851 - DNA, 20 bp, Homo sapiens
ccagccctgggcttggctct

SEQ ID NO: 6041852 - DNA, 12 bp, Homo sapiens
ccagccctgggg

SEQ ID NO: 6041853 - DNA, 23 bp, Homo sapiens
ccagccctgggggattcctgagc

SEQ ID NO: 6041854 - DNA, 19 bp, Homo sapiens
ccagccctggttctggctg

SEQ ID NO: 6041855 - DNA, 23 bp, Homo sapiens
ccagccctgttccgcctcactgg

SEQ ID NO: 6041856 - DNA, 24 bp, Homo sapiens
ccagccctgttccgcctcactggg

SEQ ID NO: 6041857 - DNA, 13 bp, Homo sapiens
ccagccctgttct

SEQ ID NO: 6041858 - DNA, 16 bp, Homo sapiens
ccagcccttagcacag

SEQ ID NO: 6041859 - DNA, 22 bp, Homo sapiens
ccagcccttagcacagagaggg

SEQ ID NO: 6041860 - DNA, 17 bp, Homo sapiens
ccagcccttcagacgag

SEQ ID NO: 6041861 - DNA, 17 bp, Homo sapiens
ccagcccttcatgggtg

SEQ ID NO: 6041862 - DNA, 12 bp, Homo sapiens
ccagcccttccc

SEQ ID NO: 6041863 - DNA, 13 bp, Homo sapiens
ccagcccttccca

SEQ ID NO: 6041864 - DNA, 24 bp, Homo sapiens
ccagcccttcccaggccagcgagg

SEQ ID NO: 6041865 - DNA, 19 bp, Homo sapiens
ccagcccttccctggcccc

SEQ ID NO: 6041866 - DNA, 14 bp, Homo sapiens
ccagcccttcctct

SEQ ID NO: 6041867 - DNA, 15 bp, Homo sapiens
ccagcccttcctctg

SEQ ID NO: 6041868 - DNA, 22 bp, Homo sapiens
ccagcccttccttgggcgtctc

SEQ ID NO: 6041869 - DNA, 20 bp, Homo sapiens
ccagcccttgctctacctgg

SEQ ID NO: 6041870 - DNA, 15 bp, Homo sapiens
ccagccctttccagg

SEQ ID NO: 6041871 - DNA, 17 bp, Homo sapiens
ccagccgaagctgcagg

SEQ ID NO: 6041872 - DNA, 22 bp, Homo sapiens
ccagccgaccccctctccctgc

SEQ ID NO: 6041873 - DNA, 17 bp, Homo sapiens
ccagccgaccctcctgg

SEQ ID NO: 6041874 - DNA, 19 bp, Homo sapiens
ccagccgaccggccctgcc

SEQ ID NO: 6041875 - DNA, 13 bp, Homo sapiens
ccagccgattcct

SEQ ID NO: 6041876 - DNA, 19 bp, Homo sapiens
ccagccgcaaatccatacc

SEQ ID NO: 6041877 - DNA, 19 bp, Homo sapiens
ccagccgccatcagcccaa

SEQ ID NO: 6041878 - DNA, 22 bp, Homo sapiens
ccagccgcccagatcatgccgc

SEQ ID NO: 6041879 - DNA, 17 bp, Homo sapiens
ccagccgccccagcccc

SEQ ID NO: 6041880 - DNA, 17 bp, Homo sapiens
ccagccgccctgggctg

SEQ ID NO: 6041881 - DNA, 19 bp, Homo sapiens
ccagccgccggctgtgcag

SEQ ID NO: 6041882 - DNA, 23 bp, Homo sapiens
ccagccgccggctgtgcagtcct

SEQ ID NO: 6041883 - DNA, 16 bp, Homo sapiens
ccagccgctcggaggc

SEQ ID NO: 6041884 - DNA, 19 bp, Homo sapiens
ccagccgctcggaggcccc

SEQ ID NO: 6041885 - DNA, 17 bp, Homo sapiens
ccagccgctctcctgcc

SEQ ID NO: 6041886 - DNA, 19 bp, Homo sapiens
ccagccgctctcctgccac

SEQ ID NO: 6041887 - DNA, 20 bp, Homo sapiens
ccagccgctctcctgccaca

SEQ ID NO: 6041888 - DNA, 15 bp, Homo sapiens
ccagccgctgcaggg

SEQ ID NO: 6041889 - DNA, 14 bp, Homo sapiens
ccagccgctgcccg

SEQ ID NO: 6041890 - DNA, 13 bp, Homo sapiens
ccagccggcatgg

SEQ ID NO: 6041891 - DNA, 16 bp, Homo sapiens
ccagccgggagcttgg

SEQ ID NO: 6041892 - DNA, 13 bp, Homo sapiens
ccagccggggcct

SEQ ID NO: 6041893 - DNA, 21 bp, Homo sapiens
ccagccggggcgagtggcacg

SEQ ID NO: 6041894 - DNA, 23 bp, Homo sapiens
ccagccgggtacctcagtttctc

SEQ ID NO: 6041895 - DNA, 22 bp, Homo sapiens
ccagccggtacctgggaagggg

SEQ ID NO: 6041896 - DNA, 14 bp, Homo sapiens
ccagccggtgcctg

SEQ ID NO: 6041897 - DNA, 16 bp, Homo sapiens
ccagccgtaatgggga

SEQ ID NO: 6041898 - DNA, 14 bp, Homo sapiens
ccagccgtatttta

SEQ ID NO: 6041899 - DNA, 20 bp, Homo sapiens
ccagccgtgatgctcaggct

SEQ ID NO: 6041900 - DNA, 21 bp, Homo sapiens
ccagccgtgtgtgcatgtgcc

SEQ ID NO: 6041901 - DNA, 16 bp, Homo sapiens
ccagcctaagaagctc

SEQ ID NO: 6041902 - DNA, 21 bp, Homo sapiens
ccagcctaagaagctctggcc

SEQ ID NO: 6041903 - DNA, 17 bp, Homo sapiens
ccagcctaagatgaaga

SEQ ID NO: 6041904 - DNA, 14 bp, Homo sapiens
ccagcctaagggag

SEQ ID NO: 6041905 - DNA, 20 bp, Homo sapiens
ccagcctaagggagacaggc

SEQ ID NO: 6041906 - DNA, 17 bp, Homo sapiens
ccagcctacaagctggc

SEQ ID NO: 6041907 - DNA, 15 bp, Homo sapiens
ccagcctacactgcc

SEQ ID NO: 6041908 - DNA, 17 bp, Homo sapiens
ccagcctacactgccag

SEQ ID NO: 6041909 - DNA, 21 bp, Homo sapiens
ccagcctacccctcctgcgct

SEQ ID NO: 6041910 - DNA, 12 bp, Homo sapiens
ccagcctagccc

SEQ ID NO: 6041911 - DNA, 17 bp, Homo sapiens
ccagcctagcccttgtc

SEQ ID NO: 6041912 - DNA, 16 bp, Homo sapiens
ccagcctagcctggct

SEQ ID NO: 6041913 - DNA, 15 bp, Homo sapiens
ccagcctagtcaggg

SEQ ID NO: 6041914 - DNA, 17 bp, Homo sapiens
ccagcctatagcagaag

SEQ ID NO: 6041915 - DNA, 21 bp, Homo sapiens
ccagcctcacagatgctggcc

SEQ ID NO: 6041916 - DNA, 22 bp, Homo sapiens
ccagcctcacagatgctggcct

SEQ ID NO: 6041917 - DNA, 12 bp, Homo sapiens
ccagcctcactc

SEQ ID NO: 6041918 - DNA, 15 bp, Homo sapiens
ccagcctcactccat

SEQ ID NO: 6041919 - DNA, 16 bp, Homo sapiens
ccagcctcagctcagc

SEQ ID NO: 6041920 - DNA, 17 bp, Homo sapiens
ccagcctcagctcagcc

SEQ ID NO: 6041921 - DNA, 18 bp, Homo sapiens
ccagcctcagctcagcct

SEQ ID NO: 6041922 - DNA, 22 bp, Homo sapiens
ccagcctcagctcagcctcccc

SEQ ID NO: 6041923 - DNA, 11 bp, Homo sapiens
ccagcctcagt

SEQ ID NO: 6041924 - DNA, 19 bp, Homo sapiens
ccagcctcagtcctcccct

SEQ ID NO: 6041925 - DNA, 22 bp, Homo sapiens
ccagcctcagtcctcccctcac

SEQ ID NO: 6041926 - DNA, 15 bp, Homo sapiens
ccagcctcagtgcag

SEQ ID NO: 6041927 - DNA, 18 bp, Homo sapiens
ccagcctcagtgcagccc

SEQ ID NO: 6041928 - DNA, 17 bp, Homo sapiens
ccagcctcagtgccact

SEQ ID NO: 6041929 - DNA, 18 bp, Homo sapiens
ccagcctcagtgccactt

SEQ ID NO: 6041930 - DNA, 19 bp, Homo sapiens
ccagcctcagtgccacttg

SEQ ID NO: 6041931 - DNA, 19 bp, Homo sapiens
ccagcctcatctctttgtt

SEQ ID NO: 6041932 - DNA, 21 bp, Homo sapiens
ccagcctcatgggaagtcctg

SEQ ID NO: 6041933 - DNA, 16 bp, Homo sapiens
ccagcctccatgctgc

SEQ ID NO: 6041934 - DNA, 14 bp, Homo sapiens
ccagcctcccctcc

SEQ ID NO: 6041935 - DNA, 17 bp, Homo sapiens
ccagcctcccctcccct

SEQ ID NO: 6041936 - DNA, 21 bp, Homo sapiens
ccagcctcccctcccctgggg

SEQ ID NO: 6041937 - DNA, 13 bp, Homo sapiens
ccagcctccctga

SEQ ID NO: 6041938 - DNA, 15 bp, Homo sapiens
ccagcctccctgaag

SEQ ID NO: 6041939 - DNA, 18 bp, Homo sapiens
ccagcctccctgtctcca

SEQ ID NO: 6041940 - DNA, 20 bp, Homo sapiens
ccagcctccctgtctccagc

SEQ ID NO: 6041941 - DNA, 21 bp, Homo sapiens
ccagcctccctgtctccagct

SEQ ID NO: 6041942 - DNA, 23 bp, Homo sapiens
ccagcctccctgtctccagctgc

SEQ ID NO: 6041943 - DNA, 24 bp, Homo sapiens
ccagcctccctgtctccagctgcc

SEQ ID NO: 6041944 - DNA, 16 bp, Homo sapiens
ccagcctcctcccacc

SEQ ID NO: 6041945 - DNA, 14 bp, Homo sapiens
ccagcctcctctgg

SEQ ID NO: 6041946 - DNA, 23 bp, Homo sapiens
ccagcctcctctggacggcaggc

SEQ ID NO: 6041947 - DNA, 12 bp, Homo sapiens
ccagcctcctgg

SEQ ID NO: 6041948 - DNA, 17 bp, Homo sapiens
ccagcctcctgtttgca

SEQ ID NO: 6041949 - DNA, 20 bp, Homo sapiens
ccagcctccttgctgacccc

SEQ ID NO: 6041950 - DNA, 14 bp, Homo sapiens
ccagcctccttgtg

SEQ ID NO: 6041951 - DNA, 13 bp, Homo sapiens
ccagcctcgcctg

SEQ ID NO: 6041952 - DNA, 17 bp, Homo sapiens
ccagcctcgcctgtcac

SEQ ID NO: 6041953 - DNA, 20 bp, Homo sapiens
ccagcctctagggacccctc

SEQ ID NO: 6041954 - DNA, 15 bp, Homo sapiens
ccagcctctcccctg

SEQ ID NO: 6041955 - DNA, 20 bp, Homo sapiens
ccagcctctcccggctgcct

SEQ ID NO: 6041956 - DNA, 15 bp, Homo sapiens
ccagcctctctggct

SEQ ID NO: 6041957 - DNA, 18 bp, Homo sapiens
ccagcctctctggctcag

SEQ ID NO: 6041958 - DNA, 15 bp, Homo sapiens
ccagcctctcttcct

SEQ ID NO: 6041959 - DNA, 22 bp, Homo sapiens
ccagcctctcttggtttccttc

SEQ ID NO: 6041960 - DNA, 22 bp, Homo sapiens
ccagcctctgccccacccatca

SEQ ID NO: 6041961 - DNA, 13 bp, Homo sapiens
ccagcctctgccg

SEQ ID NO: 6041962 - DNA, 14 bp, Homo sapiens
ccagcctctgccgc

SEQ ID NO: 6041963 - DNA, 13 bp, Homo sapiens
ccagcctctgggg

SEQ ID NO: 6041964 - DNA, 17 bp, Homo sapiens
ccagcctctggggcaga

SEQ ID NO: 6041965 - DNA, 11 bp, Homo sapiens
ccagcctctgt

SEQ ID NO: 6041966 - DNA, 12 bp, Homo sapiens
ccagcctctgtc

SEQ ID NO: 6041967 - DNA, 20 bp, Homo sapiens
ccagcctcttgctcagagct

SEQ ID NO: 6041968 - DNA, 18 bp, Homo sapiens
ccagcctgaaagatacag

SEQ ID NO: 6041969 - DNA, 21 bp, Homo sapiens
ccagcctgacaacagcctgag

SEQ ID NO: 6041970 - DNA, 14 bp, Homo sapiens
ccagcctgacctga

SEQ ID NO: 6041971 - DNA, 14 bp, Homo sapiens
ccagcctgactaga

SEQ ID NO: 6041972 - DNA, 16 bp, Homo sapiens
catgatgtctgcaaag

SEQ ID NO: 6041973 - DNA, 18 bp, Homo sapiens
catgatgtctgcaaagga

SEQ ID NO: 6041974 - DNA, 22 bp, Homo sapiens
catgatgtctgcaaaggagggc

SEQ ID NO: 6041975 - DNA, 12 bp, Homo sapiens
catgatgtggag

SEQ ID NO: 6041976 - DNA, 20 bp, Homo sapiens
catgatgtggagtggggcag

SEQ ID NO: 6041977 - DNA, 14 bp, Homo sapiens
catgatgttaactt

SEQ ID NO: 6041978 - DNA, 23 bp, Homo sapiens
catgatgttaatgggttatctca

SEQ ID NO: 6041979 - DNA, 14 bp, Homo sapiens
catgatgtttagaa

SEQ ID NO: 6041980 - DNA, 17 bp, Homo sapiens
catgatgtttccctctc

SEQ ID NO: 6041981 - DNA, 12 bp, Homo sapiens
catgatgtttgc

SEQ ID NO: 6041982 - DNA, 17 bp, Homo sapiens
catgatgtttgcccaaa

SEQ ID NO: 6041983 - DNA, 17 bp, Homo sapiens
catgatgtttttaaaat

SEQ ID NO: 6041984 - DNA, 21 bp, Homo sapiens
catgatgtttttaaaatctta

SEQ ID NO: 6041985 - DNA, 22 bp, Homo sapiens
catgatgtttttaaaatcttat

SEQ ID NO: 6041986 - DNA, 14 bp, Homo sapiens
catgattagacaat

SEQ ID NO: 6041987 - DNA, 12 bp, Homo sapiens
catgattagcaa

SEQ ID NO: 6041988 - DNA, 22 bp, Homo sapiens
catgattagcagaagaaaggaa

SEQ ID NO: 6041989 - DNA, 22 bp, Homo sapiens
catgattatagcaactaatgtt

SEQ ID NO: 6041990 - DNA, 22 bp, Homo sapiens
catgattcacaactaggacctc

SEQ ID NO: 6041991 - DNA, 16 bp, Homo sapiens
catgattccttcctgt

SEQ ID NO: 6041992 - DNA, 19 bp, Homo sapiens
catgattccttcctgttct

SEQ ID NO: 6041993 - DNA, 17 bp, Homo sapiens
catgattcctttaacaa

SEQ ID NO: 6041994 - DNA, 20 bp, Homo sapiens
catgattctatgtaatgtaa

SEQ ID NO: 6041995 - DNA, 18 bp, Homo sapiens
catgattcttctcttgtg

SEQ ID NO: 6041996 - DNA, 19 bp, Homo sapiens
catgattggcttaaagtga

SEQ ID NO: 6041997 - DNA, 21 bp, Homo sapiens
catgattggtttctaggcagt

SEQ ID NO: 6041998 - DNA, 13 bp, Homo sapiens
catgatttaaaga

SEQ ID NO: 6041999 - DNA, 19 bp, Homo sapiens
catgatttagcaagcaact

SEQ ID NO: 6042000 - DNA, 19 bp, Homo sapiens
catgatttagggaagcagg

SEQ ID NO: 6042001 - DNA, 20 bp, Homo sapiens
catgatttagggaagcaggg

SEQ ID NO: 6042002 - DNA, 22 bp, Homo sapiens
catgatttagggaagcagggac

SEQ ID NO: 6042003 - DNA, 18 bp, Homo sapiens
catgatttatatatggca

SEQ ID NO: 6042004 - DNA, 17 bp, Homo sapiens
catgatttcaatgattg

SEQ ID NO: 6042005 - DNA, 19 bp, Homo sapiens
catgatttcacaaatatta

SEQ ID NO: 6042006 - DNA, 16 bp, Homo sapiens
catgatttcccactgc

SEQ ID NO: 6042007 - DNA, 22 bp, Homo sapiens
catgatttcccactgcactcca

SEQ ID NO: 6042008 - DNA, 20 bp, Homo sapiens
catgatttgaaaaaaagcat

SEQ ID NO: 6042009 - DNA, 21 bp, Homo sapiens
catgatttgcaactttagaaa

SEQ ID NO: 6042010 - DNA, 18 bp, Homo sapiens
catgatttgtcccagcct

SEQ ID NO: 6042011 - DNA, 24 bp, Homo sapiens
catgattttaagtttctctgcaga

SEQ ID NO: 6042012 - DNA, 12 bp, Homo sapiens
catgattttaca

SEQ ID NO: 6042013 - DNA, 17 bp, Homo sapiens
catgattttacaagtat

SEQ ID NO: 6042014 - DNA, 16 bp, Homo sapiens
catgattttacagaga

SEQ ID NO: 6042015 - DNA, 14 bp, Homo sapiens
catgattttataca

SEQ ID NO: 6042016 - DNA, 18 bp, Homo sapiens
catgattttatacatagt

SEQ ID NO: 6042017 - DNA, 12 bp, Homo sapiens
catgattttctt

SEQ ID NO: 6042018 - DNA, 19 bp, Homo sapiens
catgatttttccactgaga

SEQ ID NO: 6042019 - DNA, 16 bp, Homo sapiens
catgcaaaaagaaatg

SEQ ID NO: 6042020 - DNA, 18 bp, Homo sapiens
catgcaaaagaaagcaaa

SEQ ID NO: 6042021 - DNA, 20 bp, Homo sapiens
catgcaaaagcaatcataga

SEQ ID NO: 6042022 - DNA, 14 bp, Homo sapiens
catgcaaacaggtt

SEQ ID NO: 6042023 - DNA, 17 bp, Homo sapiens
catgcaaaccaggagca

SEQ ID NO: 6042024 - DNA, 15 bp, Homo sapiens
catgcaaactgcttt

SEQ ID NO: 6042025 - DNA, 14 bp, Homo sapiens
catgcaaaggctgg

SEQ ID NO: 6042026 - DNA, 16 bp, Homo sapiens
catgcaaagtcctttc

SEQ ID NO: 6042027 - DNA, 16 bp, Homo sapiens
catgcaaatgctgtat

SEQ ID NO: 6042028 - DNA, 22 bp, Homo sapiens
catgcaaatgctgtattcttct

SEQ ID NO: 6042029 - DNA, 19 bp, Homo sapiens
catgcaaatgtcttccagg

SEQ ID NO: 6042030 - DNA, 13 bp, Homo sapiens
catgcaacaaaaa

SEQ ID NO: 6042031 - DNA, 15 bp, Homo sapiens
catgcaacaccctct

SEQ ID NO: 6042032 - DNA, 16 bp, Homo sapiens
catgcaacaccctctt

SEQ ID NO: 6042033 - DNA, 21 bp, Homo sapiens
catgcaacagaagtgacttct

SEQ ID NO: 6042034 - DNA, 14 bp, Homo sapiens
catgcaacatggat

SEQ ID NO: 6042035 - DNA, 22 bp, Homo sapiens
catgcaaccgggccctctctct

SEQ ID NO: 6042036 - DNA, 18 bp, Homo sapiens
catgcaactccatgccta

SEQ ID NO: 6042037 - DNA, 15 bp, Homo sapiens
catgcaactggagtt

SEQ ID NO: 6042038 - DNA, 22 bp, Homo sapiens
catgcaagaactcatcactgtg

SEQ ID NO: 6042039 - DNA, 23 bp, Homo sapiens
catgcaagaatttctggaagaaa

SEQ ID NO: 6042040 - DNA, 22 bp, Homo sapiens
catgcaagcagaggaccagggc

SEQ ID NO: 6042041 - DNA, 23 bp, Homo sapiens
catgcaagcagaggaccagggcc

SEQ ID NO: 6042042 - DNA, 14 bp, Homo sapiens
catgcaagctcagg

SEQ ID NO: 6042043 - DNA, 17 bp, Homo sapiens
catgcaagcttggtcaa

SEQ ID NO: 6042044 - DNA, 22 bp, Homo sapiens
catgcaagcttggtcaaacttt

SEQ ID NO: 6042045 - DNA, 17 bp, Homo sapiens
catgcaagtgagaaaga

SEQ ID NO: 6042046 - DNA, 13 bp, Homo sapiens
catgcaagtgctg

SEQ ID NO: 6042047 - DNA, 15 bp, Homo sapiens
catgcaagtgctgtt

SEQ ID NO: 6042048 - DNA, 18 bp, Homo sapiens
catgcaagtggagctgtc

SEQ ID NO: 6042049 - DNA, 17 bp, Homo sapiens
catgcaataatgtgcaa

SEQ ID NO: 6042050 - DNA, 21 bp, Homo sapiens
catgcaattggggaagaaaaa

SEQ ID NO: 6042051 - DNA, 16 bp, Homo sapiens
catgcaatttgaagta

SEQ ID NO: 6042052 - DNA, 18 bp, Homo sapiens
catgcacaactctccaaa

SEQ ID NO: 6042053 - DNA, 10 bp, Homo sapiens
catgcacaca

SEQ ID NO: 6042054 - DNA, 21 bp, Homo sapiens
catgcacacaaacacctccta

SEQ ID NO: 6042055 - DNA, 22 bp, Homo sapiens
catgcacacaattagatttctc

SEQ ID NO: 6042056 - DNA, 15 bp, Homo sapiens
catgcacacacacac

SEQ ID NO: 6042057 - DNA, 14 bp, Homo sapiens
catgcacacacttg

SEQ ID NO: 6042058 - DNA, 23 bp, Homo sapiens
catgcacacggctggtcactctg

SEQ ID NO: 6042059 - DNA, 14 bp, Homo sapiens
catgcacagctgct

SEQ ID NO: 6042060 - DNA, 16 bp, Homo sapiens
catgcacagctgcttg

SEQ ID NO: 6042061 - DNA, 15 bp, Homo sapiens
catgcacagtacaat

SEQ ID NO: 6042062 - DNA, 21 bp, Homo sapiens
catgcacagtacaataatgta

SEQ ID NO: 6042063 - DNA, 21 bp, Homo sapiens
catgcacagtagattcaagtt

SEQ ID NO: 6042064 - DNA, 21 bp, Homo sapiens
catgcacatgctgtctggccc

SEQ ID NO: 6042065 - DNA, 12 bp, Homo sapiens
catgcacatgta

SEQ ID NO: 6042066 - DNA, 15 bp, Homo sapiens
catgcacatgtattc

SEQ ID NO: 6042067 - DNA, 20 bp, Homo sapiens
catgcacattcatcctcaca

SEQ ID NO: 6042068 - DNA, 13 bp, Homo sapiens
catgcacatttat

SEQ ID NO: 6042069 - DNA, 14 bp, Homo sapiens
catgcaccagtgcc

SEQ ID NO: 6042070 - DNA, 22 bp, Homo sapiens
catgcacccctgagccagcagg

SEQ ID NO: 6042071 - DNA, 23 bp, Homo sapiens
catgcacccctgagccagcaggg

SEQ ID NO: 6042072 - DNA, 17 bp, Homo sapiens
catgcacccctgatgtt

SEQ ID NO: 6042073 - DNA, 20 bp, Homo sapiens
catgcaccctcatacacaga

SEQ ID NO: 6042074 - DNA, 14 bp, Homo sapiens
catgcacctcaggg

SEQ ID NO: 6042075 - DNA, 22 bp, Homo sapiens
catgcaccttatatttctgtgt

SEQ ID NO: 6042076 - DNA, 22 bp, Homo sapiens
catgcaccttccagcccggggc

SEQ ID NO: 6042077 - DNA, 23 bp, Homo sapiens
catgcacgcaccccgcccctgca

SEQ ID NO: 6042078 - DNA, 16 bp, Homo sapiens
catgcacgggcatgca

SEQ ID NO: 6042079 - DNA, 21 bp, Homo sapiens
catgcacgggcatgcacacgg

SEQ ID NO: 6042080 - DNA, 16 bp, Homo sapiens
catgcacgtgtgtgca

SEQ ID NO: 6042081 - DNA, 13 bp, Homo sapiens
catgcactactga

SEQ ID NO: 6042082 - DNA, 19 bp, Homo sapiens
catgcactcacccctagcc

SEQ ID NO: 6042083 - DNA, 15 bp, Homo sapiens
catgcactcagctct

SEQ ID NO: 6042084 - DNA, 18 bp, Homo sapiens
catgcactgacccttcca

SEQ ID NO: 6042085 - DNA, 19 bp, Homo sapiens
catgcactgacccttccag

SEQ ID NO: 6042086 - DNA, 20 bp, Homo sapiens
catgcactgacccttccaga

SEQ ID NO: 6042087 - DNA, 12 bp, Homo sapiens
catgcactgagg

SEQ ID NO: 6042088 - DNA, 20 bp, Homo sapiens
catgcactgatgttgtgttt

SEQ ID NO: 6042089 - DNA, 17 bp, Homo sapiens
catgcactgtgaaggac

SEQ ID NO: 6042090 - DNA, 18 bp, Homo sapiens
catgcactgtgaaggacc

SEQ ID NO: 6042091 - DNA, 23 bp, Homo sapiens
catgcactgttccccctgtgcag

SEQ ID NO: 6042092 - DNA, 17 bp, Homo sapiens
catgcacttggctgcat

SEQ ID NO: 6042093 - DNA, 21 bp, Homo sapiens
catgcactttatgtggagact

SEQ ID NO: 6042094 - DNA, 18 bp, Homo sapiens
catgcagaaagggagcag

SEQ ID NO: 6042095 - DNA, 19 bp, Homo sapiens
catgcagaacaaatgaaga

SEQ ID NO: 6042096 - DNA, 18 bp, Homo sapiens
catgcagacaaagccctg

SEQ ID NO: 6042097 - DNA, 18 bp, Homo sapiens
catgcagactcctcagat

SEQ ID NO: 6042098 - DNA, 19 bp, Homo sapiens
catgcagactcctcagatc

SEQ ID NO: 6042099 - DNA, 19 bp, Homo sapiens
catgcagatctagccaggc

SEQ ID NO: 6042100 - DNA, 20 bp, Homo sapiens
catgcagatctagccaggcc

SEQ ID NO: 6042101 - DNA, 21 bp, Homo sapiens
catgcagatctagccaggcct

SEQ ID NO: 6042102 - DNA, 17 bp, Homo sapiens
catgcagcagcttgctg

SEQ ID NO: 6042103 - DNA, 17 bp, Homo sapiens
catgcagccactgtgct

SEQ ID NO: 6042104 - DNA, 16 bp, Homo sapiens
catgcagcccatgccc

SEQ ID NO: 6042105 - DNA, 20 bp, Homo sapiens
catgcagcccatgcccacct

SEQ ID NO: 6042106 - DNA, 23 bp, Homo sapiens
catgcagcccatgcccacctgcc

SEQ ID NO: 6042107 - DNA, 18 bp, Homo sapiens
catgcagcccctgggccc

SEQ ID NO: 6042108 - DNA, 15 bp, Homo sapiens
catgcagccgtgatc

SEQ ID NO: 6042109 - DNA, 21 bp, Homo sapiens
catgcagccgtgatcaaggga

SEQ ID NO: 6042110 - DNA, 23 bp, Homo sapiens
catgcagcctaaagtacagcctg

SEQ ID NO: 6042111 - DNA, 12 bp, Homo sapiens
catgcagccttg

SEQ ID NO: 6042112 - DNA, 22 bp, Homo sapiens
catgcagcgaattcagaaagag

SEQ ID NO: 6042113 - DNA, 15 bp, Homo sapiens
catgcagctgcctgg

SEQ ID NO: 6042114 - DNA, 17 bp, Homo sapiens
catgcagctgcctgggg

SEQ ID NO: 6042115 - DNA, 14 bp, Homo sapiens
catgcagctgctcc

SEQ ID NO: 6042116 - DNA, 18 bp, Homo sapiens
catgcagctgctccccag

SEQ ID NO: 6042117 - DNA, 22 bp, Homo sapiens
catgcagctgctccccaggcca

SEQ ID NO: 6042118 - DNA, 23 bp, Homo sapiens
catgcagctgctccccaggccac

SEQ ID NO: 6042119 - DNA, 22 bp, Homo sapiens
catgcagcttcatcaattttta

SEQ ID NO: 6042120 - DNA, 13 bp, Homo sapiens
catgcaggaactg

SEQ ID NO: 6042121 - DNA, 16 bp, Homo sapiens
catgcaggaaggaaaa

SEQ ID NO: 6042122 - DNA, 21 bp, Homo sapiens
catgcaggacgttagactgtt

SEQ ID NO: 6042123 - DNA, 12 bp, Homo sapiens
catgcaggaggt

SEQ ID NO: 6042124 - DNA, 15 bp, Homo sapiens
catgcaggaggtgga

SEQ ID NO: 6042125 - DNA, 23 bp, Homo sapiens
catgcaggtagttggtgaacaga

SEQ ID NO: 6042126 - DNA, 17 bp, Homo sapiens
catgcaggtctccatga

SEQ ID NO: 6042127 - DNA, 21 bp, Homo sapiens
catgcaggtggtgggacactg

SEQ ID NO: 6042128 - DNA, 22 bp, Homo sapiens
catgcaggtggtgggacactgg

SEQ ID NO: 6042129 - DNA, 16 bp, Homo sapiens
catgcagtacttttgt

SEQ ID NO: 6042130 - DNA, 12 bp, Homo sapiens
catgcagtattt

SEQ ID NO: 6042131 - DNA, 19 bp, Homo sapiens
catgcagtcttgtactgtg

SEQ ID NO: 6042132 - DNA, 18 bp, Homo sapiens
catgcagttattagaact

SEQ ID NO: 6042133 - DNA, 19 bp, Homo sapiens
catgcagttattagaactt

SEQ ID NO: 6042134 - DNA, 17 bp, Homo sapiens
catgcagttcattattt

SEQ ID NO: 6042135 - DNA, 16 bp, Homo sapiens
catgcagtttgaaatt

SEQ ID NO: 6042136 - DNA, 15 bp, Homo sapiens
catgcataaaagggt

SEQ ID NO: 6042137 - DNA, 12 bp, Homo sapiens
catgcataaata

SEQ ID NO: 6042138 - DNA, 13 bp, Homo sapiens
catgcataaatat

SEQ ID NO: 6042139 - DNA, 17 bp, Homo sapiens
catgcataaatatgcag

SEQ ID NO: 6042140 - DNA, 22 bp, Homo sapiens
catgcataaatcaatggttcaa

SEQ ID NO: 6042141 - DNA, 14 bp, Homo sapiens
catgcataacacac

SEQ ID NO: 6042142 - DNA, 23 bp, Homo sapiens
catgcataagaaatgtagctgaa

SEQ ID NO: 6042143 - DNA, 15 bp, Homo sapiens
catgcatacacacac

SEQ ID NO: 6042144 - DNA, 17 bp, Homo sapiens
catgcatacttcaaaag

SEQ ID NO: 6042145 - DNA, 19 bp, Homo sapiens
catgcatagtgctaagaaa

SEQ ID NO: 6042146 - DNA, 12 bp, Homo sapiens
catgcatataat

SEQ ID NO: 6042147 - DNA, 20 bp, Homo sapiens
catgcatataatgaataaat

SEQ ID NO: 6042148 - DNA, 14 bp, Homo sapiens
catgcatcaagtta

SEQ ID NO: 6042149 - DNA, 21 bp, Homo sapiens
ccagcctgactagaactcctg

SEQ ID NO: 6042150 - DNA, 14 bp, Homo sapiens
ccagcctgactgca

SEQ ID NO: 6042151 - DNA, 11 bp, Homo sapiens
ccagcctgagc

SEQ ID NO: 6042152 - DNA, 12 bp, Homo sapiens
ccagcctgagca

SEQ ID NO: 6042153 - DNA, 13 bp, Homo sapiens
ccagcctgagcca

SEQ ID NO: 6042154 - DNA, 17 bp, Homo sapiens
ccagcctgagccacagt

SEQ ID NO: 6042155 - DNA, 18 bp, Homo sapiens
ccagcctgaggtgcccac

SEQ ID NO: 6042156 - DNA, 21 bp, Homo sapiens
ccagcctgagtgacagagcga

SEQ ID NO: 6042157 - DNA, 16 bp, Homo sapiens
ccagcctgcacccctc

SEQ ID NO: 6042158 - DNA, 10 bp, Homo sapiens
ccagcctgcc

SEQ ID NO: 6042159 - DNA, 13 bp, Homo sapiens
ccagcctgccagg

SEQ ID NO: 6042160 - DNA, 17 bp, Homo sapiens
ccagcctgccaggccct

SEQ ID NO: 6042161 - DNA, 15 bp, Homo sapiens
ccagcctgccctcca

SEQ ID NO: 6042162 - DNA, 16 bp, Homo sapiens
ccagcctgccctccag

SEQ ID NO: 6042163 - DNA, 16 bp, Homo sapiens
ccagcctgcctggcag

SEQ ID NO: 6042164 - DNA, 18 bp, Homo sapiens
ccagcctgcctggcaggc

SEQ ID NO: 6042165 - DNA, 20 bp, Homo sapiens
ccagcctgcctggcaggctg

SEQ ID NO: 6042166 - DNA, 13 bp, Homo sapiens
ccagcctgcgcct

SEQ ID NO: 6042167 - DNA, 16 bp, Homo sapiens
ccagcctgcgcctgct

SEQ ID NO: 6042168 - DNA, 23 bp, Homo sapiens
ccagcctgcgggaagctgacctt

SEQ ID NO: 6042169 - DNA, 13 bp, Homo sapiens
ccagcctgctagc

SEQ ID NO: 6042170 - DNA, 13 bp, Homo sapiens
ccagcctgctgac

SEQ ID NO: 6042171 - DNA, 17 bp, Homo sapiens
ccagcctgctgacagac

SEQ ID NO: 6042172 - DNA, 21 bp, Homo sapiens
ccagcctgctgagagccccca

SEQ ID NO: 6042173 - DNA, 16 bp, Homo sapiens
ccagcctgcttcccac

SEQ ID NO: 6042174 - DNA, 21 bp, Homo sapiens
ccagcctggaaacctgtctga

SEQ ID NO: 6042175 - DNA, 20 bp, Homo sapiens
ccagcctggagatgaaatct

SEQ ID NO: 6042176 - DNA, 13 bp, Homo sapiens
ccagcctggcaca

SEQ ID NO: 6042177 - DNA, 14 bp, Homo sapiens
ccagcctggcatca

SEQ ID NO: 6042178 - DNA, 18 bp, Homo sapiens
ccagcctggcatcagttt

SEQ ID NO: 6042179 - DNA, 11 bp, Homo sapiens
ccagcctggcc

SEQ ID NO: 6042180 - DNA, 19 bp, Homo sapiens
ccagcctggccacgcagcc

SEQ ID NO: 6042181 - DNA, 13 bp, Homo sapiens
ccagcctggccag

SEQ ID NO: 6042182 - DNA, 14 bp, Homo sapiens
ccagcctggccaga

SEQ ID NO: 6042183 - DNA, 12 bp, Homo sapiens
ccagcctggccc

SEQ ID NO: 6042184 - DNA, 17 bp, Homo sapiens
ccagcctggcccagctc

SEQ ID NO: 6042185 - DNA, 14 bp, Homo sapiens
ccagcctggcccca

SEQ ID NO: 6042186 - DNA, 18 bp, Homo sapiens
ccagcctggccccaagca

SEQ ID NO: 6042187 - DNA, 19 bp, Homo sapiens
ccagcctggcctcctgcct

SEQ ID NO: 6042188 - DNA, 23 bp, Homo sapiens
ccagcctggcctgtggctgccct

SEQ ID NO: 6042189 - DNA, 21 bp, Homo sapiens
ccagcctggctcccacaggca

SEQ ID NO: 6042190 - DNA, 21 bp, Homo sapiens
ccagcctggctctgccccctc

SEQ ID NO: 6042191 - DNA, 17 bp, Homo sapiens
ccagcctggcttctgga

SEQ ID NO: 6042192 - DNA, 15 bp, Homo sapiens
ccagcctgggacaca

SEQ ID NO: 6042193 - DNA, 20 bp, Homo sapiens
ccagcctgggaggcacagca

SEQ ID NO: 6042194 - DNA, 23 bp, Homo sapiens
ccagcctgggaggcacagcaaac

SEQ ID NO: 6042195 - DNA, 13 bp, Homo sapiens
ccagcctgggcca

SEQ ID NO: 6042196 - DNA, 23 bp, Homo sapiens
ccagcctgggcccatctccctgc

SEQ ID NO: 6042197 - DNA, 17 bp, Homo sapiens
ccagcctgggcctatgg

SEQ ID NO: 6042198 - DNA, 22 bp, Homo sapiens
ccagcctgggcctatggagagc

SEQ ID NO: 6042199 - DNA, 19 bp, Homo sapiens
ccagcctgggcgacagagc

SEQ ID NO: 6042200 - DNA, 23 bp, Homo sapiens
ccagcctgggcgacagagcaaga

SEQ ID NO: 6042201 - DNA, 22 bp, Homo sapiens
ccagcctggggaccccacttca

SEQ ID NO: 6042202 - DNA, 14 bp, Homo sapiens
ccagcctggggcct

SEQ ID NO: 6042203 - DNA, 15 bp, Homo sapiens
ccagcctggggcctt

SEQ ID NO: 6042204 - DNA, 16 bp, Homo sapiens
ccagcctggggctccc

SEQ ID NO: 6042205 - DNA, 17 bp, Homo sapiens
ccagcctggggctccct

SEQ ID NO: 6042206 - DNA, 18 bp, Homo sapiens
ccagcctggggctccctc

SEQ ID NO: 6042207 - DNA, 19 bp, Homo sapiens
ccagcctggggctccctct

SEQ ID NO: 6042208 - DNA, 13 bp, Homo sapiens
ccagcctgggggc

SEQ ID NO: 6042209 - DNA, 16 bp, Homo sapiens
ccagcctgggggccag

SEQ ID NO: 6042210 - DNA, 19 bp, Homo sapiens
ccagcctgggggccagtgg

SEQ ID NO: 6042211 - DNA, 20 bp, Homo sapiens
ccagcctgggggccagtggg

SEQ ID NO: 6042212 - DNA, 22 bp, Homo sapiens
ccagcctggtgcccatcctccc

SEQ ID NO: 6042213 - DNA, 14 bp, Homo sapiens
ccagcctggtggcc

SEQ ID NO: 6042214 - DNA, 16 bp, Homo sapiens
ccagcctgtcacccag

SEQ ID NO: 6042215 - DNA, 20 bp, Homo sapiens
ccagcctgtcccactggctc

SEQ ID NO: 6042216 - DNA, 18 bp, Homo sapiens
ccagcctgtcctggtaca

SEQ ID NO: 6042217 - DNA, 18 bp, Homo sapiens
ccagcctgtcggccacac

SEQ ID NO: 6042218 - DNA, 20 bp, Homo sapiens
ccagcctgtcgtgtccagcc

SEQ ID NO: 6042219 - DNA, 13 bp, Homo sapiens
ccagcctgtggcc

SEQ ID NO: 6042220 - DNA, 12 bp, Homo sapiens
ccagcctgtggt

SEQ ID NO: 6042221 - DNA, 19 bp, Homo sapiens
ccagcctgtggttacagtg

SEQ ID NO: 6042222 - DNA, 18 bp, Homo sapiens
ccagcctgtgtgttctgt

SEQ ID NO: 6042223 - DNA, 16 bp, Homo sapiens
ccagccttcctctgca

SEQ ID NO: 6042224 - DNA, 21 bp, Homo sapiens
ccagccttcctctgcagctga

SEQ ID NO: 6042225 - DNA, 15 bp, Homo sapiens
ccagccttctctctc

SEQ ID NO: 6042226 - DNA, 16 bp, Homo sapiens
ccagccttctctctct

SEQ ID NO: 6042227 - DNA, 23 bp, Homo sapiens
ccagccttgaactgtggccacct

SEQ ID NO: 6042228 - DNA, 20 bp, Homo sapiens
ccagccttgaccattctcca

SEQ ID NO: 6042229 - DNA, 20 bp, Homo sapiens
ccagccttgagccctggctg

SEQ ID NO: 6042230 - DNA, 14 bp, Homo sapiens
ccagccttgcccag

SEQ ID NO: 6042231 - DNA, 13 bp, Homo sapiens
ccagccttgctct

SEQ ID NO: 6042232 - DNA, 15 bp, Homo sapiens
ccagccttggaggat

SEQ ID NO: 6042233 - DNA, 23 bp, Homo sapiens
ccagccttggtgggggagcctct

SEQ ID NO: 6042234 - DNA, 15 bp, Homo sapiens
ccagcctttctccca

SEQ ID NO: 6042235 - DNA, 19 bp, Homo sapiens
ccagcctttctcccaggcc

SEQ ID NO: 6042236 - DNA, 21 bp, Homo sapiens
ccagcctttctcccaggccag

SEQ ID NO: 6042237 - DNA, 19 bp, Homo sapiens
ccagcctttggccttggct

SEQ ID NO: 6042238 - DNA, 16 bp, Homo sapiens
ccagcctttgttcccc

SEQ ID NO: 6042239 - DNA, 16 bp, Homo sapiens
ccagccttttgagagt

SEQ ID NO: 6042240 - DNA, 14 bp, Homo sapiens
ccagcgagccacag

SEQ ID NO: 6042241 - DNA, 14 bp, Homo sapiens
ccagcgagccctgg

SEQ ID NO: 6042242 - DNA, 20 bp, Homo sapiens
ccagcgagcgcccagctcct

SEQ ID NO: 6042243 - DNA, 16 bp, Homo sapiens
ccagcgaggaggctcc

SEQ ID NO: 6042244 - DNA, 14 bp, Homo sapiens
ccagcgaggcgagg

SEQ ID NO: 6042245 - DNA, 19 bp, Homo sapiens
ccagcgaggcgaggctgcc

SEQ ID NO: 6042246 - DNA, 21 bp, Homo sapiens
ccagcgaggcgaggctgcctc

SEQ ID NO: 6042247 - DNA, 23 bp, Homo sapiens
ccagcgaggcgaggctgcctctg

SEQ ID NO: 6042248 - DNA, 17 bp, Homo sapiens
ccagcgagggcgtgtct

SEQ ID NO: 6042249 - DNA, 22 bp, Homo sapiens
ccagcgaggtgggagaggcctc

SEQ ID NO: 6042250 - DNA, 23 bp, Homo sapiens
ccagcgaggtgggagaggcctca

SEQ ID NO: 6042251 - DNA, 19 bp, Homo sapiens
ccagcgagtaccccagcca

SEQ ID NO: 6042252 - DNA, 22 bp, Homo sapiens
ccagcgagtaccccagccactc

SEQ ID NO: 6042253 - DNA, 17 bp, Homo sapiens
ccagcgagtctggagac

SEQ ID NO: 6042254 - DNA, 21 bp, Homo sapiens
ccagcgatggtgctgcccagg

SEQ ID NO: 6042255 - DNA, 21 bp, Homo sapiens
ccagcgattccctctcccagg

SEQ ID NO: 6042256 - DNA, 20 bp, Homo sapiens
ccagcgcagcgccagggctc

SEQ ID NO: 6042257 - DNA, 17 bp, Homo sapiens
ccagcgcatggcgcccc

SEQ ID NO: 6042258 - DNA, 23 bp, Homo sapiens
ccagcgccaaatgttcatcctca

SEQ ID NO: 6042259 - DNA, 12 bp, Homo sapiens
ccagcgccaggg

SEQ ID NO: 6042260 - DNA, 13 bp, Homo sapiens
ccagcgccagggc

SEQ ID NO: 6042261 - DNA, 23 bp, Homo sapiens
ccagcgccagggcccaggccatg

SEQ ID NO: 6042262 - DNA, 16 bp, Homo sapiens
ccagcgcccccactcc

SEQ ID NO: 6042263 - DNA, 22 bp, Homo sapiens
ccagcgcccctcagcctctgcc

SEQ ID NO: 6042264 - DNA, 18 bp, Homo sapiens
ccagcgcccgctgggctg

SEQ ID NO: 6042265 - DNA, 15 bp, Homo sapiens
ccagcgcctccctcc

SEQ ID NO: 6042266 - DNA, 19 bp, Homo sapiens
ccagcgcctccctccaccc

SEQ ID NO: 6042267 - DNA, 23 bp, Homo sapiens
ccagcgcctccctccaccccagg

SEQ ID NO: 6042268 - DNA, 20 bp, Homo sapiens
ccagcgcctgtgctgaggac

SEQ ID NO: 6042269 - DNA, 23 bp, Homo sapiens
ccagcgcggctcccgccaccctc

SEQ ID NO: 6042270 - DNA, 12 bp, Homo sapiens
ccagcgcggctt

SEQ ID NO: 6042271 - DNA, 12 bp, Homo sapiens
ccagcgctcgcc

SEQ ID NO: 6042272 - DNA, 13 bp, Homo sapiens
ccagcgctcgcca

SEQ ID NO: 6042273 - DNA, 19 bp, Homo sapiens
ccagcgctctcctggacgc

SEQ ID NO: 6042274 - DNA, 15 bp, Homo sapiens
ccagcgctctgcctc

SEQ ID NO: 6042275 - DNA, 13 bp, Homo sapiens
ccagcgctctggg

SEQ ID NO: 6042276 - DNA, 18 bp, Homo sapiens
ccagcggaaacaggtgtg

SEQ ID NO: 6042277 - DNA, 19 bp, Homo sapiens
ccagcggaaacaggtgtgt

SEQ ID NO: 6042278 - DNA, 13 bp, Homo sapiens
ccagcggacacac

SEQ ID NO: 6042279 - DNA, 14 bp, Homo sapiens
ccagcggacacacg

SEQ ID NO: 6042280 - DNA, 18 bp, Homo sapiens
ccagcggacagtggcagg

SEQ ID NO: 6042281 - DNA, 19 bp, Homo sapiens
ccagcggacagtggcagga

SEQ ID NO: 6042282 - DNA, 17 bp, Homo sapiens
ccagcggatgctgccag

SEQ ID NO: 6042283 - DNA, 14 bp, Homo sapiens
ccagcggcccaaga

SEQ ID NO: 6042284 - DNA, 17 bp, Homo sapiens
ccagcggcccaagagcc

SEQ ID NO: 6042285 - DNA, 20 bp, Homo sapiens
ccagcggccccccgcacagc

SEQ ID NO: 6042286 - DNA, 23 bp, Homo sapiens
ccagcggccccccgcacagccac

SEQ ID NO: 6042287 - DNA, 12 bp, Homo sapiens
ccagcggccctc

SEQ ID NO: 6042288 - DNA, 13 bp, Homo sapiens
ccagcggccctcc

SEQ ID NO: 6042289 - DNA, 15 bp, Homo sapiens
ccagcggccctgtca

SEQ ID NO: 6042290 - DNA, 14 bp, Homo sapiens
ccagcggcctcagg

SEQ ID NO: 6042291 - DNA, 16 bp, Homo sapiens
ccagcggcctcagggt

SEQ ID NO: 6042292 - DNA, 20 bp, Homo sapiens
ccagcggcggaggcgcaggc

SEQ ID NO: 6042293 - DNA, 18 bp, Homo sapiens
ccagcggctccaactcct

SEQ ID NO: 6042294 - DNA, 16 bp, Homo sapiens
ccagcggctgctcaag

SEQ ID NO: 6042295 - DNA, 17 bp, Homo sapiens
ccagcggctgctcaagc

SEQ ID NO: 6042296 - DNA, 22 bp, Homo sapiens
ccagcggctggtgcagggcctc

SEQ ID NO: 6042297 - DNA, 20 bp, Homo sapiens
ccagcggcttagccaagccc

SEQ ID NO: 6042298 - DNA, 13 bp, Homo sapiens
ccagcgggcacag

SEQ ID NO: 6042299 - DNA, 20 bp, Homo sapiens
ccagcgggcacagggcacca

SEQ ID NO: 6042300 - DNA, 21 bp, Homo sapiens
ccagcgggcacagggcaccag

SEQ ID NO: 6042301 - DNA, 13 bp, Homo sapiens
ccagcgggcagat

SEQ ID NO: 6042302 - DNA, 15 bp, Homo sapiens
ccagcgggcagatgg

SEQ ID NO: 6042303 - DNA, 14 bp, Homo sapiens
ccagcgggccctct

SEQ ID NO: 6042304 - DNA, 16 bp, Homo sapiens
ccagcgggccctctgc

SEQ ID NO: 6042305 - DNA, 13 bp, Homo sapiens
ccagcgggctggc

SEQ ID NO: 6042306 - DNA, 17 bp, Homo sapiens
ccagcggggcttctggg

SEQ ID NO: 6042307 - DNA, 21 bp, Homo sapiens
ccagcggtccaacgccgcctt

SEQ ID NO: 6042308 - DNA, 20 bp, Homo sapiens
ccagcggtccctgcagaagc

SEQ ID NO: 6042309 - DNA, 14 bp, Homo sapiens
ccagcggtgaccag

SEQ ID NO: 6042310 - DNA, 16 bp, Homo sapiens
ccagcggttcctgtgc

SEQ ID NO: 6042311 - DNA, 18 bp, Homo sapiens
ccagcggtttccacttgt

SEQ ID NO: 6042312 - DNA, 15 bp, Homo sapiens
ccagcggtttcctgg

SEQ ID NO: 6042313 - DNA, 16 bp, Homo sapiens
ccagcggtttcctggt

SEQ ID NO: 6042314 - DNA, 23 bp, Homo sapiens
ccagcgtatatataagaaagaca

SEQ ID NO: 6042315 - DNA, 15 bp, Homo sapiens
ccagcgtcactccag

SEQ ID NO: 6042316 - DNA, 18 bp, Homo sapiens
ccagcgtcactccagtgc

SEQ ID NO: 6042317 - DNA, 21 bp, Homo sapiens
ccagcgtcactccagtgctca

SEQ ID NO: 6042318 - DNA, 21 bp, Homo sapiens
ccagcgtcagaggccctggag

SEQ ID NO: 6042319 - DNA, 14 bp, Homo sapiens
ccagcgtcaggcct

SEQ ID NO: 6042320 - DNA, 14 bp, Homo sapiens
ccagcgtcccttgg

SEQ ID NO: 6042321 - DNA, 16 bp, Homo sapiens
ccagcgtcctcagcac

SEQ ID NO: 6042322 - DNA, 17 bp, Homo sapiens
ccagcgtcctcagcacc

SEQ ID NO: 6042323 - DNA, 21 bp, Homo sapiens
ccagcgtcctcgttcaaaaca

SEQ ID NO: 6042324 - DNA, 16 bp, Homo sapiens
ccagcgtcggtctgtg

SEQ ID NO: 6042325 - DNA, 18 bp, Homo sapiens
ccagcgtcggtctgtgcc

SEQ ID NO: 6042326 - DNA, 14 bp, Homo sapiens
ccagcgtctgcagg

SEQ ID NO: 6042327 - DNA, 14 bp, Homo sapiens
ccagcgtctgctgt

SEQ ID NO: 6042328 - DNA, 21 bp, Homo sapiens
catgcatccatttactgacac

SEQ ID NO: 6042329 - DNA, 17 bp, Homo sapiens
catgcatctccacctgc

SEQ ID NO: 6042330 - DNA, 16 bp, Homo sapiens
catgcatcttactgaa

SEQ ID NO: 6042331 - DNA, 20 bp, Homo sapiens
catgcatctttaattcctta

SEQ ID NO: 6042332 - DNA, 21 bp, Homo sapiens
catgcatctttaattccttat

SEQ ID NO: 6042333 - DNA, 13 bp, Homo sapiens
catgcatgagcac

SEQ ID NO: 6042334 - DNA, 14 bp, Homo sapiens
catgcatgagcacc

SEQ ID NO: 6042335 - DNA, 23 bp, Homo sapiens
catgcatgatgggtaaagcaata

SEQ ID NO: 6042336 - DNA, 15 bp, Homo sapiens
catgcatggcctccc

SEQ ID NO: 6042337 - DNA, 16 bp, Homo sapiens
catgcatggcctccca

SEQ ID NO: 6042338 - DNA, 19 bp, Homo sapiens
catgcatggcctcccagcc

SEQ ID NO: 6042339 - DNA, 15 bp, Homo sapiens
catgcatgtctgcct

SEQ ID NO: 6042340 - DNA, 18 bp, Homo sapiens
catgcatgttatgcttta

SEQ ID NO: 6042341 - DNA, 21 bp, Homo sapiens
catgcatgttggggtttcctt

SEQ ID NO: 6042342 - DNA, 21 bp, Homo sapiens
catgcattacttactgttaaa

SEQ ID NO: 6042343 - DNA, 14 bp, Homo sapiens
catgcattcataca

SEQ ID NO: 6042344 - DNA, 18 bp, Homo sapiens
catgcattgagctgcctc

SEQ ID NO: 6042345 - DNA, 17 bp, Homo sapiens
catgcattgttgaggtg

SEQ ID NO: 6042346 - DNA, 20 bp, Homo sapiens
catgcattgttgaggtggtc

SEQ ID NO: 6042347 - DNA, 17 bp, Homo sapiens
catgcattgttggctat

SEQ ID NO: 6042348 - DNA, 15 bp, Homo sapiens
catgcatttagcatg

SEQ ID NO: 6042349 - DNA, 17 bp, Homo sapiens
catgcatttgaggtcaa

SEQ ID NO: 6042350 - DNA, 18 bp, Homo sapiens
catgcatttgatttgttt

SEQ ID NO: 6042351 - DNA, 20 bp, Homo sapiens
catgcattttaggatattct

SEQ ID NO: 6042352 - DNA, 13 bp, Homo sapiens
catgcattttctt

SEQ ID NO: 6042353 - DNA, 14 bp, Homo sapiens
catgcattttgcag

SEQ ID NO: 6042354 - DNA, 22 bp, Homo sapiens
catgcattttgctttggacaca

SEQ ID NO: 6042355 - DNA, 17 bp, Homo sapiens
catgcatttttaaaact

SEQ ID NO: 6042356 - DNA, 18 bp, Homo sapiens
catgccaaagcaaaagaa

SEQ ID NO: 6042357 - DNA, 15 bp, Homo sapiens
catgccaacacttaa

SEQ ID NO: 6042358 - DNA, 18 bp, Homo sapiens
catgccaagcactgtgct

SEQ ID NO: 6042359 - DNA, 12 bp, Homo sapiens
catgccaaggcc

SEQ ID NO: 6042360 - DNA, 14 bp, Homo sapiens
catgccaaggcctc

SEQ ID NO: 6042361 - DNA, 22 bp, Homo sapiens
catgccaagtactaaagcacct

SEQ ID NO: 6042362 - DNA, 17 bp, Homo sapiens
catgccacaaggacttc

SEQ ID NO: 6042363 - DNA, 16 bp, Homo sapiens
catgccaccacccacc

SEQ ID NO: 6042364 - DNA, 21 bp, Homo sapiens
catgccaccatggccagccaa

SEQ ID NO: 6042365 - DNA, 12 bp, Homo sapiens
catgccaccctc

SEQ ID NO: 6042366 - DNA, 14 bp, Homo sapiens
catgccaccctctc

SEQ ID NO: 6042367 - DNA, 19 bp, Homo sapiens
catgccaccctctccatgc

SEQ ID NO: 6042368 - DNA, 21 bp, Homo sapiens
catgccaccctctccatgccc

SEQ ID NO: 6042369 - DNA, 17 bp, Homo sapiens
catgccacgttccacag

SEQ ID NO: 6042370 - DNA, 15 bp, Homo sapiens
catgccactgccagg

SEQ ID NO: 6042371 - DNA, 18 bp, Homo sapiens
catgccactgccaggcac

SEQ ID NO: 6042372 - DNA, 19 bp, Homo sapiens
catgccactgccaggcacc

SEQ ID NO: 6042373 - DNA, 21 bp, Homo sapiens
catgccactgccaggcacctg

SEQ ID NO: 6042374 - DNA, 14 bp, Homo sapiens
catgccactgcctg

SEQ ID NO: 6042375 - DNA, 18 bp, Homo sapiens
catgccagattctgcctc

SEQ ID NO: 6042376 - DNA, 16 bp, Homo sapiens
catgccagcagcacgt

SEQ ID NO: 6042377 - DNA, 18 bp, Homo sapiens
catgccagcgcagcgcca

SEQ ID NO: 6042378 - DNA, 13 bp, Homo sapiens
catgccagctggc

SEQ ID NO: 6042379 - DNA, 13 bp, Homo sapiens
catgccaggaacc

SEQ ID NO: 6042380 - DNA, 21 bp, Homo sapiens
catgccaggctgggcacggct

SEQ ID NO: 6042381 - DNA, 20 bp, Homo sapiens
catgccagggccatgtcaga

SEQ ID NO: 6042382 - DNA, 16 bp, Homo sapiens
catgccagtaactgtg

SEQ ID NO: 6042383 - DNA, 22 bp, Homo sapiens
catgccagtgcatgccaggaag

SEQ ID NO: 6042384 - DNA, 14 bp, Homo sapiens
catgccagtgcctt

SEQ ID NO: 6042385 - DNA, 23 bp, Homo sapiens
catgccagtttttaaaatgctgc

SEQ ID NO: 6042386 - DNA, 18 bp, Homo sapiens
catgccatttgtactgac

SEQ ID NO: 6042387 - DNA, 19 bp, Homo sapiens
catgccatttgtactgacc

SEQ ID NO: 6042388 - DNA, 12 bp, Homo sapiens
catgcccaacct

SEQ ID NO: 6042389 - DNA, 11 bp, Homo sapiens
catgcccacaa

SEQ ID NO: 6042390 - DNA, 13 bp, Homo sapiens
catgcccaccccc

SEQ ID NO: 6042391 - DNA, 17 bp, Homo sapiens
catgcccaccccctgcc

SEQ ID NO: 6042392 - DNA, 18 bp, Homo sapiens
catgcccaccccctgccc

SEQ ID NO: 6042393 - DNA, 22 bp, Homo sapiens
catgcccaccccctgccctgca

SEQ ID NO: 6042394 - DNA, 23 bp, Homo sapiens
catgcccaccccctgccctgcac

SEQ ID NO: 6042395 - DNA, 14 bp, Homo sapiens
catgcccaccgccc

SEQ ID NO: 6042396 - DNA, 19 bp, Homo sapiens
catgcccaccgcccctgga

SEQ ID NO: 6042397 - DNA, 16 bp, Homo sapiens
catgcccacctgccca

SEQ ID NO: 6042398 - DNA, 16 bp, Homo sapiens
catgcccactccccca

SEQ ID NO: 6042399 - DNA, 12 bp, Homo sapiens
catgcccactgc

SEQ ID NO: 6042400 - DNA, 19 bp, Homo sapiens
catgcccactgccgatgcc

SEQ ID NO: 6042401 - DNA, 14 bp, Homo sapiens
catgcccactgctg

SEQ ID NO: 6042402 - DNA, 15 bp, Homo sapiens
catgcccactgctgg

SEQ ID NO: 6042403 - DNA, 17 bp, Homo sapiens
catgcccactgctggtg

SEQ ID NO: 6042404 - DNA, 15 bp, Homo sapiens
catgcccagagaatc

SEQ ID NO: 6042405 - DNA, 18 bp, Homo sapiens
catgcccagagacccagc

SEQ ID NO: 6042406 - DNA, 13 bp, Homo sapiens
catgcccagctct

SEQ ID NO: 6042407 - DNA, 12 bp, Homo sapiens
catgcccagctt

SEQ ID NO: 6042408 - DNA, 17 bp, Homo sapiens
catgcccatattttact

SEQ ID NO: 6042409 - DNA, 12 bp, Homo sapiens
catgcccatccc

SEQ ID NO: 6042410 - DNA, 14 bp, Homo sapiens
catgccccactctg

SEQ ID NO: 6042411 - DNA, 18 bp, Homo sapiens
catgccccactctgctga

SEQ ID NO: 6042412 - DNA, 13 bp, Homo sapiens
catgccccaggat

SEQ ID NO: 6042413 - DNA, 15 bp, Homo sapiens
catgccccaggctct

SEQ ID NO: 6042414 - DNA, 12 bp, Homo sapiens
catgccccagtc

SEQ ID NO: 6042415 - DNA, 22 bp, Homo sapiens
catgccccagtcggccccatct

SEQ ID NO: 6042416 - DNA, 23 bp, Homo sapiens
catgcccccctcaaacctcctct

SEQ ID NO: 6042417 - DNA, 14 bp, Homo sapiens
catgccccctccct

SEQ ID NO: 6042418 - DNA, 19 bp, Homo sapiens
catgccccctcccttcaca

SEQ ID NO: 6042419 - DNA, 14 bp, Homo sapiens
catgcccccttcgc

SEQ ID NO: 6042420 - DNA, 15 bp, Homo sapiens
catgccccctttcag

SEQ ID NO: 6042421 - DNA, 16 bp, Homo sapiens
catgccccggccacct

SEQ ID NO: 6042422 - DNA, 18 bp, Homo sapiens
catgccccggccacctct

SEQ ID NO: 6042423 - DNA, 21 bp, Homo sapiens
catgccccggccacctctgcg

SEQ ID NO: 6042424 - DNA, 13 bp, Homo sapiens
catgccccggctg

SEQ ID NO: 6042425 - DNA, 23 bp, Homo sapiens
catgccccgtttttgagactgat

SEQ ID NO: 6042426 - DNA, 11 bp, Homo sapiens
catgcccctcc

SEQ ID NO: 6042427 - DNA, 14 bp, Homo sapiens
catgcccctccccc

SEQ ID NO: 6042428 - DNA, 21 bp, Homo sapiens
catgcccctcccccagctgcg

SEQ ID NO: 6042429 - DNA, 13 bp, Homo sapiens
catgcccctgaca

SEQ ID NO: 6042430 - DNA, 14 bp, Homo sapiens
catgcccctggctg

SEQ ID NO: 6042431 - DNA, 14 bp, Homo sapiens
catgccccttggct

SEQ ID NO: 6042432 - DNA, 13 bp, Homo sapiens
catgccccttggg

SEQ ID NO: 6042433 - DNA, 16 bp, Homo sapiens
catgccccttggtcct

SEQ ID NO: 6042434 - DNA, 17 bp, Homo sapiens
catgccccttggtcctg

SEQ ID NO: 6042435 - DNA, 21 bp, Homo sapiens
catgcccgagtccgcccatcc

SEQ ID NO: 6042436 - DNA, 17 bp, Homo sapiens
catgcccggtcccaccc

SEQ ID NO: 6042437 - DNA, 20 bp, Homo sapiens
catgccctagaccctcccca

SEQ ID NO: 6042438 - DNA, 12 bp, Homo sapiens
catgccctcagg

SEQ ID NO: 6042439 - DNA, 23 bp, Homo sapiens
catgccctccactccactgcctt

SEQ ID NO: 6042440 - DNA, 19 bp, Homo sapiens
catgccctcccaggaccct

SEQ ID NO: 6042441 - DNA, 14 bp, Homo sapiens
catgccctcccttc

SEQ ID NO: 6042442 - DNA, 21 bp, Homo sapiens
catgccctcccttctccctgg

SEQ ID NO: 6042443 - DNA, 12 bp, Homo sapiens
catgccctcctg

SEQ ID NO: 6042444 - DNA, 14 bp, Homo sapiens
catgccctcctgga

SEQ ID NO: 6042445 - DNA, 14 bp, Homo sapiens
catgccctctcagg

SEQ ID NO: 6042446 - DNA, 18 bp, Homo sapiens
catgccctctctgagtct

SEQ ID NO: 6042447 - DNA, 19 bp, Homo sapiens
catgccctgagctctctga

SEQ ID NO: 6042448 - DNA, 20 bp, Homo sapiens
catgccctgccaagcctgga

SEQ ID NO: 6042449 - DNA, 23 bp, Homo sapiens
catgccctgccaagcctggagcc

SEQ ID NO: 6042450 - DNA, 23 bp, Homo sapiens
catgccctgccgtggtggcagct

SEQ ID NO: 6042451 - DNA, 19 bp, Homo sapiens
catgccctgggatgcctca

SEQ ID NO: 6042452 - DNA, 21 bp, Homo sapiens
catgccctgggatgcctcacc

SEQ ID NO: 6042453 - DNA, 18 bp, Homo sapiens
catgccctgtgcaacctc

SEQ ID NO: 6042454 - DNA, 18 bp, Homo sapiens
catgccgcagggagggct

SEQ ID NO: 6042455 - DNA, 21 bp, Homo sapiens
catgccgccgcagctggttgg

SEQ ID NO: 6042456 - DNA, 18 bp, Homo sapiens
catgccgcgggcggccag

SEQ ID NO: 6042457 - DNA, 20 bp, Homo sapiens
catgccgcggtaggtaaggg

SEQ ID NO: 6042458 - DNA, 18 bp, Homo sapiens
catgccgcgtccctgccc

SEQ ID NO: 6042459 - DNA, 15 bp, Homo sapiens
catgccgctgtgtct

SEQ ID NO: 6042460 - DNA, 16 bp, Homo sapiens
catgccgctgtgtcta

SEQ ID NO: 6042461 - DNA, 24 bp, Homo sapiens
catgccgctgtgtctatgaactag

SEQ ID NO: 6042462 - DNA, 23 bp, Homo sapiens
catgccgggcccctccatccacc

SEQ ID NO: 6042463 - DNA, 22 bp, Homo sapiens
catgccgggggagccaccagcc

SEQ ID NO: 6042464 - DNA, 19 bp, Homo sapiens
catgcctacagataattta

SEQ ID NO: 6042465 - DNA, 18 bp, Homo sapiens
catgcctagcagagtgct

SEQ ID NO: 6042466 - DNA, 19 bp, Homo sapiens
catgcctatgggccagagt

SEQ ID NO: 6042467 - DNA, 22 bp, Homo sapiens
catgcctatttactggaaacct

SEQ ID NO: 6042468 - DNA, 20 bp, Homo sapiens
catgcctcagccagccctgg

SEQ ID NO: 6042469 - DNA, 22 bp, Homo sapiens
catgcctcagccagccctggag

SEQ ID NO: 6042470 - DNA, 16 bp, Homo sapiens
catgcctcagccctga

SEQ ID NO: 6042471 - DNA, 12 bp, Homo sapiens
catgcctcagtt

SEQ ID NO: 6042472 - DNA, 14 bp, Homo sapiens
catgcctcatgcca

SEQ ID NO: 6042473 - DNA, 14 bp, Homo sapiens
catgcctcccaggc

SEQ ID NO: 6042474 - DNA, 11 bp, Homo sapiens
catgcctccct

SEQ ID NO: 6042475 - DNA, 20 bp, Homo sapiens
catgcctccctgggccacct

SEQ ID NO: 6042476 - DNA, 15 bp, Homo sapiens
catgcctcctcctgc

SEQ ID NO: 6042477 - DNA, 17 bp, Homo sapiens
catgcctcctcctgccc

SEQ ID NO: 6042478 - DNA, 21 bp, Homo sapiens
catgcctcctcctgccctccg

SEQ ID NO: 6042479 - DNA, 12 bp, Homo sapiens
catgcctctgag

SEQ ID NO: 6042480 - DNA, 13 bp, Homo sapiens
catgcctctgagc

SEQ ID NO: 6042481 - DNA, 15 bp, Homo sapiens
catgcctctgaggcc

SEQ ID NO: 6042482 - DNA, 18 bp, Homo sapiens
catgcctctgaggccagc

SEQ ID NO: 6042483 - DNA, 19 bp, Homo sapiens
catgcctctgaggccagcc

SEQ ID NO: 6042484 - DNA, 20 bp, Homo sapiens
catgcctctgaggccagcct

SEQ ID NO: 6042485 - DNA, 21 bp, Homo sapiens
catgcctctgatatgggactg

SEQ ID NO: 6042486 - DNA, 16 bp, Homo sapiens
catgcctctggaggcc

SEQ ID NO: 6042487 - DNA, 17 bp, Homo sapiens
catgcctctggaggcct

SEQ ID NO: 6042488 - DNA, 11 bp, Homo sapiens
catgcctgaga

SEQ ID NO: 6042489 - DNA, 13 bp, Homo sapiens
catgcctgatgaa

SEQ ID NO: 6042490 - DNA, 10 bp, Homo sapiens
catgcctgca

SEQ ID NO: 6042491 - DNA, 13 bp, Homo sapiens
catgcctgccaaa

SEQ ID NO: 6042492 - DNA, 13 bp, Homo sapiens
catgcctgcctga

SEQ ID NO: 6042493 - DNA, 16 bp, Homo sapiens
catgcctgcgcctgct

SEQ ID NO: 6042494 - DNA, 15 bp, Homo sapiens
catgcctgctccctg

SEQ ID NO: 6042495 - DNA, 16 bp, Homo sapiens
catgcctgctccctgt

SEQ ID NO: 6042496 - DNA, 18 bp, Homo sapiens
catgcctgctccctgtct

SEQ ID NO: 6042497 - DNA, 22 bp, Homo sapiens
catgcctgctccctgtctgtgt

SEQ ID NO: 6042498 - DNA, 12 bp, Homo sapiens
catgcctgctga

SEQ ID NO: 6042499 - DNA, 17 bp, Homo sapiens
catgcctgctttagaat

SEQ ID NO: 6042500 - DNA, 17 bp, Homo sapiens
catgcctggacaaaccc

SEQ ID NO: 6042501 - DNA, 19 bp, Homo sapiens
catgcctggacaaaccctt

SEQ ID NO: 6042502 - DNA, 18 bp, Homo sapiens
catgcctggatggggctg

SEQ ID NO: 6042503 - DNA, 23 bp, Homo sapiens
catgcctggatggggctgcaccg

SEQ ID NO: 6042504 - DNA, 17 bp, Homo sapiens
catgcctggcccccctc

SEQ ID NO: 6042505 - DNA, 22 bp, Homo sapiens
catgcctggcccccctccaggc

SEQ ID NO: 6042506 - DNA, 17 bp, Homo sapiens
catgcctggcccttgcc

SEQ ID NO: 6042507 - DNA, 21 bp, Homo sapiens
catgcctgggaatcctgctgc

SEQ ID NO: 6042508 - DNA, 13 bp, Homo sapiens
ccagcgtcttgct

SEQ ID NO: 6042509 - DNA, 16 bp, Homo sapiens
ccagcgtgcaccccgc

SEQ ID NO: 6042510 - DNA, 22 bp, Homo sapiens
ccagcgtgggggtggccactcc

SEQ ID NO: 6042511 - DNA, 15 bp, Homo sapiens
ccagcgtgtggagca

SEQ ID NO: 6042512 - DNA, 16 bp, Homo sapiens
ccagcgtgtggagcag

SEQ ID NO: 6042513 - DNA, 22 bp, Homo sapiens
ccagcgtgtggagcagagctct

SEQ ID NO: 6042514 - DNA, 13 bp, Homo sapiens
ccagcgtgtgtat

SEQ ID NO: 6042515 - DNA, 21 bp, Homo sapiens
ccagcgttcccttctccccct

SEQ ID NO: 6042516 - DNA, 23 bp, Homo sapiens
ccagcgttcttcaggagatgatg

SEQ ID NO: 6042517 - DNA, 21 bp, Homo sapiens
ccagctaaagcagtcctccag

SEQ ID NO: 6042518 - DNA, 15 bp, Homo sapiens
ccagctaagaacctg

SEQ ID NO: 6042519 - DNA, 18 bp, Homo sapiens
ccagctaagaacctggaa

SEQ ID NO: 6042520 - DNA, 23 bp, Homo sapiens
ccagctaaggacatttcccaggg

SEQ ID NO: 6042521 - DNA, 15 bp, Homo sapiens
ccagctaataaacca

SEQ ID NO: 6042522 - DNA, 18 bp, Homo sapiens
ccagctaataactgatct

SEQ ID NO: 6042523 - DNA, 17 bp, Homo sapiens
ccagctaatctgtaggg

SEQ ID NO: 6042524 - DNA, 23 bp, Homo sapiens
ccagctaatctgtagggctggac

SEQ ID NO: 6042525 - DNA, 20 bp, Homo sapiens
ccagctaatttttgtatttt

SEQ ID NO: 6042526 - DNA, 20 bp, Homo sapiens
ccagctacacctttctcctt

SEQ ID NO: 6042527 - DNA, 16 bp, Homo sapiens
ccagctacaggcttga

SEQ ID NO: 6042528 - DNA, 20 bp, Homo sapiens
ccagctacaggggaggctga

SEQ ID NO: 6042529 - DNA, 15 bp, Homo sapiens
ccagctacattcctc

SEQ ID NO: 6042530 - DNA, 17 bp, Homo sapiens
ccagctacattcctcag

SEQ ID NO: 6042531 - DNA, 19 bp, Homo sapiens
ccagctacattcctcagct

SEQ ID NO: 6042532 - DNA, 20 bp, Homo sapiens
ccagctaccccttctttgca

SEQ ID NO: 6042533 - DNA, 15 bp, Homo sapiens
ccagctaccctgtgt

SEQ ID NO: 6042534 - DNA, 17 bp, Homo sapiens
ccagctacgtgggaggc

SEQ ID NO: 6042535 - DNA, 23 bp, Homo sapiens
ccagctactagggaggctgaggc

SEQ ID NO: 6042536 - DNA, 20 bp, Homo sapiens
ccagctactcgggaggctga

SEQ ID NO: 6042537 - DNA, 15 bp, Homo sapiens
ccagctactctgatc

SEQ ID NO: 6042538 - DNA, 21 bp, Homo sapiens
ccagctactctgtccaggcca

SEQ ID NO: 6042539 - DNA, 23 bp, Homo sapiens
ccagctactctgtccaggccact

SEQ ID NO: 6042540 - DNA, 21 bp, Homo sapiens
ccagctactggggaggctgag

SEQ ID NO: 6042541 - DNA, 23 bp, Homo sapiens
ccagctactggggaggctgaggc

SEQ ID NO: 6042542 - DNA, 19 bp, Homo sapiens
ccagctacttagctggcca

SEQ ID NO: 6042543 - DNA, 22 bp, Homo sapiens
ccagctacttagctggccaagg

SEQ ID NO: 6042544 - DNA, 16 bp, Homo sapiens
ccagctacttgggaag

SEQ ID NO: 6042545 - DNA, 17 bp, Homo sapiens
ccagctacttgggaagc

SEQ ID NO: 6042546 - DNA, 20 bp, Homo sapiens
ccagctacttgggagcctga

SEQ ID NO: 6042547 - DNA, 21 bp, Homo sapiens
ccagctacttgggagcctgag

SEQ ID NO: 6042548 - DNA, 22 bp, Homo sapiens
ccagctacttgggagcctgagg

SEQ ID NO: 6042549 - DNA, 17 bp, Homo sapiens
ccagctacttgggaggc

SEQ ID NO: 6042550 - DNA, 23 bp, Homo sapiens
ccagctagaaagtggcagagcca

SEQ ID NO: 6042551 - DNA, 17 bp, Homo sapiens
ccagctagagcttccac

SEQ ID NO: 6042552 - DNA, 22 bp, Homo sapiens
ccagctagagcttccactgtca

SEQ ID NO: 6042553 - DNA, 23 bp, Homo sapiens
ccagctaggaagagcaggactcc

SEQ ID NO: 6042554 - DNA, 17 bp, Homo sapiens
ccagctaggaagcaaga

SEQ ID NO: 6042555 - DNA, 21 bp, Homo sapiens
ccagctagtgacccacatgcc

SEQ ID NO: 6042556 - DNA, 22 bp, Homo sapiens
ccagctagtgacccacatgcca

SEQ ID NO: 6042557 - DNA, 21 bp, Homo sapiens
ccagctagtgccaaataattg

SEQ ID NO: 6042558 - DNA, 14 bp, Homo sapiens
ccagctatctgtca

SEQ ID NO: 6042559 - DNA, 19 bp, Homo sapiens
ccagctatggccccagggt

SEQ ID NO: 6042560 - DNA, 22 bp, Homo sapiens
ccagctatgttatattgaaaaa

SEQ ID NO: 6042561 - DNA, 15 bp, Homo sapiens
ccagctattaccaca

SEQ ID NO: 6042562 - DNA, 23 bp, Homo sapiens
ccagctattcaggaggctgaggc

SEQ ID NO: 6042563 - DNA, 22 bp, Homo sapiens
ccagctattgatataaataaaa

SEQ ID NO: 6042564 - DNA, 15 bp, Homo sapiens
ccagctattttctga

SEQ ID NO: 6042565 - DNA, 16 bp, Homo sapiens
ccagctattttctgac

SEQ ID NO: 6042566 - DNA, 17 bp, Homo sapiens
ccagctatttttactag

SEQ ID NO: 6042567 - DNA, 17 bp, Homo sapiens
ccagctcaccccccaca

SEQ ID NO: 6042568 - DNA, 14 bp, Homo sapiens
ccagctcacccctg

SEQ ID NO: 6042569 - DNA, 12 bp, Homo sapiens
ccagctcactgc

SEQ ID NO: 6042570 - DNA, 18 bp, Homo sapiens
ccagctcactgcagcctc

SEQ ID NO: 6042571 - DNA, 17 bp, Homo sapiens
ccagctcagaacccagg

SEQ ID NO: 6042572 - DNA, 18 bp, Homo sapiens
ccagctcagaacccaggg

SEQ ID NO: 6042573 - DNA, 15 bp, Homo sapiens
ccagctcagaggccc

SEQ ID NO: 6042574 - DNA, 13 bp, Homo sapiens
ccagctcagaggg

SEQ ID NO: 6042575 - DNA, 11 bp, Homo sapiens
ccagctcagca

SEQ ID NO: 6042576 - DNA, 13 bp, Homo sapiens
ccagctcagcact

SEQ ID NO: 6042577 - DNA, 12 bp, Homo sapiens
ccagctcagccc

SEQ ID NO: 6042578 - DNA, 21 bp, Homo sapiens
ccagctcagccccggccactc

SEQ ID NO: 6042579 - DNA, 12 bp, Homo sapiens
ccagctcaggaa

SEQ ID NO: 6042580 - DNA, 20 bp, Homo sapiens
ccagctcaggctactgccac

SEQ ID NO: 6042581 - DNA, 14 bp, Homo sapiens
ccagctcaggggca

SEQ ID NO: 6042582 - DNA, 18 bp, Homo sapiens
ccagctcaggggcagctc

SEQ ID NO: 6042583 - DNA, 15 bp, Homo sapiens
ccagctcaggtgact

SEQ ID NO: 6042584 - DNA, 20 bp, Homo sapiens
ccagctcagtcccacagccc

SEQ ID NO: 6042585 - DNA, 15 bp, Homo sapiens
ccagctcagtcccat

SEQ ID NO: 6042586 - DNA, 17 bp, Homo sapiens
ccagctcagtcttccct

SEQ ID NO: 6042587 - DNA, 13 bp, Homo sapiens
ccagctcagtgcc

SEQ ID NO: 6042588 - DNA, 16 bp, Homo sapiens
ccagctcatctccaag

SEQ ID NO: 6042589 - DNA, 17 bp, Homo sapiens
ccagctcatctccaagg

SEQ ID NO: 6042590 - DNA, 20 bp, Homo sapiens
ccagctcatgtaggtgagcc

SEQ ID NO: 6042591 - DNA, 16 bp, Homo sapiens
ccagctcatttcagtt

SEQ ID NO: 6042592 - DNA, 20 bp, Homo sapiens
ccagctccaacctgcaaaga

SEQ ID NO: 6042593 - DNA, 19 bp, Homo sapiens
ccagctccaagacctgttg

SEQ ID NO: 6042594 - DNA, 21 bp, Homo sapiens
ccagctccaagacctgttggt

SEQ ID NO: 6042595 - DNA, 15 bp, Homo sapiens
ccagctccacacatt

SEQ ID NO: 6042596 - DNA, 17 bp, Homo sapiens
ccagctccacacattcc

SEQ ID NO: 6042597 - DNA, 16 bp, Homo sapiens
ccagctccactcaggg

SEQ ID NO: 6042598 - DNA, 19 bp, Homo sapiens
ccagctccactcagggctg

SEQ ID NO: 6042599 - DNA, 17 bp, Homo sapiens
ccagctccactggcctg

SEQ ID NO: 6042600 - DNA, 13 bp, Homo sapiens
ccagctccaggca

SEQ ID NO: 6042601 - DNA, 14 bp, Homo sapiens
ccagctccaggcag

SEQ ID NO: 6042602 - DNA, 15 bp, Homo sapiens
ccagctccaggcagg

SEQ ID NO: 6042603 - DNA, 22 bp, Homo sapiens
ccagctccagtgccgctcctgc

SEQ ID NO: 6042604 - DNA, 23 bp, Homo sapiens
ccagctccagtgccgctcctgct

SEQ ID NO: 6042605 - DNA, 14 bp, Homo sapiens
ccagctccagtttc

SEQ ID NO: 6042606 - DNA, 20 bp, Homo sapiens
ccagctccatgttctcccaa

SEQ ID NO: 6042607 - DNA, 15 bp, Homo sapiens
ccagctcccacctcc

SEQ ID NO: 6042608 - DNA, 12 bp, Homo sapiens
ccagctcccagg

SEQ ID NO: 6042609 - DNA, 13 bp, Homo sapiens
ccagctcccagga

SEQ ID NO: 6042610 - DNA, 21 bp, Homo sapiens
ccagctcccaggaccacaggc

SEQ ID NO: 6042611 - DNA, 19 bp, Homo sapiens
ccagctccccagcccacct

SEQ ID NO: 6042612 - DNA, 17 bp, Homo sapiens
ccagctccccaggactc

SEQ ID NO: 6042613 - DNA, 19 bp, Homo sapiens
ccagctccccaggactcac

SEQ ID NO: 6042614 - DNA, 17 bp, Homo sapiens
ccagctcccccaggcag

SEQ ID NO: 6042615 - DNA, 18 bp, Homo sapiens
ccagctcccccaggcaga

SEQ ID NO: 6042616 - DNA, 19 bp, Homo sapiens
ccagctccccccacctccc

SEQ ID NO: 6042617 - DNA, 14 bp, Homo sapiens
ccagctccccccgc

SEQ ID NO: 6042618 - DNA, 21 bp, Homo sapiens
ccagctccccccgcccaccca

SEQ ID NO: 6042619 - DNA, 17 bp, Homo sapiens
ccagctcccccgggagg

SEQ ID NO: 6042620 - DNA, 16 bp, Homo sapiens
ccagctccccctccct

SEQ ID NO: 6042621 - DNA, 18 bp, Homo sapiens
ccagctccctagactgca

SEQ ID NO: 6042622 - DNA, 14 bp, Homo sapiens
ccagctccctagga

SEQ ID NO: 6042623 - DNA, 13 bp, Homo sapiens
ccagctccctccc

SEQ ID NO: 6042624 - DNA, 16 bp, Homo sapiens
ccagctccctcccctg

SEQ ID NO: 6042625 - DNA, 15 bp, Homo sapiens
ccagctcccttggga

SEQ ID NO: 6042626 - DNA, 17 bp, Homo sapiens
ccagctccgacctctct

SEQ ID NO: 6042627 - DNA, 17 bp, Homo sapiens
ccagctccgcctgctgg

SEQ ID NO: 6042628 - DNA, 20 bp, Homo sapiens
ccagctccgtgtttctctaa

SEQ ID NO: 6042629 - DNA, 12 bp, Homo sapiens
ccagctcctcac

SEQ ID NO: 6042630 - DNA, 14 bp, Homo sapiens
ccagctcctcacat

SEQ ID NO: 6042631 - DNA, 13 bp, Homo sapiens
ccagctcctccag

SEQ ID NO: 6042632 - DNA, 17 bp, Homo sapiens
ccagctcctccagccct

SEQ ID NO: 6042633 - DNA, 14 bp, Homo sapiens
ccagctcctccctt

SEQ ID NO: 6042634 - DNA, 22 bp, Homo sapiens
ccagctcctcgtctttgaactg

SEQ ID NO: 6042635 - DNA, 12 bp, Homo sapiens
ccagctcctctc

SEQ ID NO: 6042636 - DNA, 16 bp, Homo sapiens
ccagctcctctccaga

SEQ ID NO: 6042637 - DNA, 18 bp, Homo sapiens
ccagctcctctccagaca

SEQ ID NO: 6042638 - DNA, 20 bp, Homo sapiens
ccagctcctctccagacaca

SEQ ID NO: 6042639 - DNA, 14 bp, Homo sapiens
ccagctcctctctg

SEQ ID NO: 6042640 - DNA, 13 bp, Homo sapiens
ccagctcctctga

SEQ ID NO: 6042641 - DNA, 18 bp, Homo sapiens
ccagctcctctgagccat

SEQ ID NO: 6042642 - DNA, 13 bp, Homo sapiens
ccagctcctgccc

SEQ ID NO: 6042643 - DNA, 18 bp, Homo sapiens
ccagctcctgggcagctt

SEQ ID NO: 6042644 - DNA, 17 bp, Homo sapiens
ccagctccttaaactga

SEQ ID NO: 6042645 - DNA, 13 bp, Homo sapiens
ccagctccttggc

SEQ ID NO: 6042646 - DNA, 15 bp, Homo sapiens
ccagctccttggctg

SEQ ID NO: 6042647 - DNA, 19 bp, Homo sapiens
ccagctccttggctgcagc

SEQ ID NO: 6042648 - DNA, 22 bp, Homo sapiens
ccagctcctttcccttttccat

SEQ ID NO: 6042649 - DNA, 18 bp, Homo sapiens
ccagctcctttctcctgt

SEQ ID NO: 6042650 - DNA, 13 bp, Homo sapiens
ccagctcctttgg

SEQ ID NO: 6042651 - DNA, 14 bp, Homo sapiens
ccagctcctttggg

SEQ ID NO: 6042652 - DNA, 22 bp, Homo sapiens
ccagctccttttgtccccaggg

SEQ ID NO: 6042653 - DNA, 23 bp, Homo sapiens
ccagctccttttgtccccagggc

SEQ ID NO: 6042654 - DNA, 12 bp, Homo sapiens
ccagctcgctgg

SEQ ID NO: 6042655 - DNA, 17 bp, Homo sapiens
ccagctcgctggctttc

SEQ ID NO: 6042656 - DNA, 23 bp, Homo sapiens
ccagctcgctggctttctctctg

SEQ ID NO: 6042657 - DNA, 20 bp, Homo sapiens
ccagctcgtgtgtcctcatg

SEQ ID NO: 6042658 - DNA, 21 bp, Homo sapiens
ccagctctaagcagccaggag

SEQ ID NO: 6042659 - DNA, 19 bp, Homo sapiens
ccagctctacattctgctc

SEQ ID NO: 6042660 - DNA, 20 bp, Homo sapiens
ccagctctaccctgcatggc

SEQ ID NO: 6042661 - DNA, 18 bp, Homo sapiens
ccagctctacgtcccaca

SEQ ID NO: 6042662 - DNA, 16 bp, Homo sapiens
ccagctctactaccta

SEQ ID NO: 6042663 - DNA, 13 bp, Homo sapiens
ccagctctactcc

SEQ ID NO: 6042664 - DNA, 17 bp, Homo sapiens
ccagctctactccaggc

SEQ ID NO: 6042665 - DNA, 17 bp, Homo sapiens
ccagctctagacaaccc

SEQ ID NO: 6042666 - DNA, 18 bp, Homo sapiens
ccagctctataattgttt

SEQ ID NO: 6042667 - DNA, 14 bp, Homo sapiens
ccagctctcagggc

SEQ ID NO: 6042668 - DNA, 13 bp, Homo sapiens
ccagctctcagta

SEQ ID NO: 6042669 - DNA, 13 bp, Homo sapiens
ccagctctcccat

SEQ ID NO: 6042670 - DNA, 22 bp, Homo sapiens
ccagctctcccctgcgcaggcc

SEQ ID NO: 6042671 - DNA, 17 bp, Homo sapiens
ccagctctccctctggc

SEQ ID NO: 6042672 - DNA, 14 bp, Homo sapiens
ccagctctctctac

SEQ ID NO: 6042673 - DNA, 15 bp, Homo sapiens
ccagctctctctcct

SEQ ID NO: 6042674 - DNA, 18 bp, Homo sapiens
ccagctctctctcctgga

SEQ ID NO: 6042675 - DNA, 17 bp, Homo sapiens
ccagctctcttcctgtc

SEQ ID NO: 6042676 - DNA, 18 bp, Homo sapiens
ccagctctcttctggctt

SEQ ID NO: 6042677 - DNA, 15 bp, Homo sapiens
ccagctctgacatcc

SEQ ID NO: 6042678 - DNA, 16 bp, Homo sapiens
ccagctctgacatccc

SEQ ID NO: 6042679 - DNA, 22 bp, Homo sapiens
ccagctctgacatcccttcctg

SEQ ID NO: 6042680 - DNA, 23 bp, Homo sapiens
ccagctctgacatcccttcctgg

SEQ ID NO: 6042681 - DNA, 12 bp, Homo sapiens
ccagctctgacc

SEQ ID NO: 6042682 - DNA, 12 bp, Homo sapiens
ccagctctgagg

SEQ ID NO: 6042683 - DNA, 14 bp, Homo sapiens
ccagctctgagggg

SEQ ID NO: 6042684 - DNA, 16 bp, Homo sapiens
ccagctctgaggggag

SEQ ID NO: 6042685 - DNA, 21 bp, Homo sapiens
ccagctctgaggggaggcacc

SEQ ID NO: 6042686 - DNA, 13 bp, Homo sapiens
ccagctctgcccc

SEQ ID NO: 6042687 - DNA, 24 bp, Homo sapiens
catgcctgggaatcctgctgccag

SEQ ID NO: 6042688 - DNA, 19 bp, Homo sapiens
catgcctgggcccaggccc

SEQ ID NO: 6042689 - DNA, 21 bp, Homo sapiens
catgcctgggcccaggcccag

SEQ ID NO: 6042690 - DNA, 11 bp, Homo sapiens
catgcctgggg

SEQ ID NO: 6042691 - DNA, 18 bp, Homo sapiens
catgcctgtaatcccagc

SEQ ID NO: 6042692 - DNA, 19 bp, Homo sapiens
catgcctgtaatcccagca

SEQ ID NO: 6042693 - DNA, 20 bp, Homo sapiens
catgcctgtaatcccagcac

SEQ ID NO: 6042694 - DNA, 21 bp, Homo sapiens
catgcctgtaatcccagcact

SEQ ID NO: 6042695 - DNA, 16 bp, Homo sapiens
catgcctgtagtctca

SEQ ID NO: 6042696 - DNA, 20 bp, Homo sapiens
catgcctgtagtctcagcta

SEQ ID NO: 6042697 - DNA, 17 bp, Homo sapiens
catgcctgtccagcctg

SEQ ID NO: 6042698 - DNA, 21 bp, Homo sapiens
catgcctgtccagcctgggca

SEQ ID NO: 6042699 - DNA, 12 bp, Homo sapiens
catgcctgtcct

SEQ ID NO: 6042700 - DNA, 18 bp, Homo sapiens
catgcctgtcctgaaagc

SEQ ID NO: 6042701 - DNA, 15 bp, Homo sapiens
catgcctgtcctttc

SEQ ID NO: 6042702 - DNA, 16 bp, Homo sapiens
catgcctgtcctttca

SEQ ID NO: 6042703 - DNA, 13 bp, Homo sapiens
catgcctgtctct

SEQ ID NO: 6042704 - DNA, 14 bp, Homo sapiens
catgcctgtctctg

SEQ ID NO: 6042705 - DNA, 13 bp, Homo sapiens
catgcctgtggct

SEQ ID NO: 6042706 - DNA, 15 bp, Homo sapiens
catgcctgtggctgc

SEQ ID NO: 6042707 - DNA, 20 bp, Homo sapiens
catgccttaaacctacctcc

SEQ ID NO: 6042708 - DNA, 23 bp, Homo sapiens
catgccttaaatttgtttaatta

SEQ ID NO: 6042709 - DNA, 21 bp, Homo sapiens
catgccttccagcaccctgca

SEQ ID NO: 6042710 - DNA, 18 bp, Homo sapiens
catgcctttcatagttta

SEQ ID NO: 6042711 - DNA, 18 bp, Homo sapiens
catgcgaatgagctgggc

SEQ ID NO: 6042712 - DNA, 15 bp, Homo sapiens
catgcgaattcttgc

SEQ ID NO: 6042713 - DNA, 15 bp, Homo sapiens
catgcgacagcgtcc

SEQ ID NO: 6042714 - DNA, 13 bp, Homo sapiens
catgcgaggggcc

SEQ ID NO: 6042715 - DNA, 20 bp, Homo sapiens
catgcgaggggccagcagag

SEQ ID NO: 6042716 - DNA, 18 bp, Homo sapiens
catgcgcacagagggaag

SEQ ID NO: 6042717 - DNA, 22 bp, Homo sapiens
catgcgcacagagggaagccat

SEQ ID NO: 6042718 - DNA, 15 bp, Homo sapiens
catgcgcagaggcca

SEQ ID NO: 6042719 - DNA, 23 bp, Homo sapiens
catgcgcagatgaggggccactg

SEQ ID NO: 6042720 - DNA, 19 bp, Homo sapiens
catgcgccttcgtgcctga

SEQ ID NO: 6042721 - DNA, 13 bp, Homo sapiens
catgcgcgctgtg

SEQ ID NO: 6042722 - DNA, 15 bp, Homo sapiens
catgcgctcagggcc

SEQ ID NO: 6042723 - DNA, 13 bp, Homo sapiens
catgcgctcctgg

SEQ ID NO: 6042724 - DNA, 16 bp, Homo sapiens
catgcggagccagcag

SEQ ID NO: 6042725 - DNA, 13 bp, Homo sapiens
catgcggcccagc

SEQ ID NO: 6042726 - DNA, 15 bp, Homo sapiens
catgcggcccagcca

SEQ ID NO: 6042727 - DNA, 16 bp, Homo sapiens
catgcggcccagccat

SEQ ID NO: 6042728 - DNA, 16 bp, Homo sapiens
catgcggcccagcccg

SEQ ID NO: 6042729 - DNA, 16 bp, Homo sapiens
catgcggcccaggatg

SEQ ID NO: 6042730 - DNA, 16 bp, Homo sapiens
catgcggccggcctgg

SEQ ID NO: 6042731 - DNA, 18 bp, Homo sapiens
catgcggccggcctgggg

SEQ ID NO: 6042732 - DNA, 19 bp, Homo sapiens
catgcggccggcctggggc

SEQ ID NO: 6042733 - DNA, 16 bp, Homo sapiens
catgcggctgcccacg

SEQ ID NO: 6042734 - DNA, 19 bp, Homo sapiens
catgcgggctgggcagctg

SEQ ID NO: 6042735 - DNA, 17 bp, Homo sapiens
catgcgggcttcctcct

SEQ ID NO: 6042736 - DNA, 15 bp, Homo sapiens
catgcggtagccagc

SEQ ID NO: 6042737 - DNA, 19 bp, Homo sapiens
catgcggtagccagcacac

SEQ ID NO: 6042738 - DNA, 13 bp, Homo sapiens
catgcggtcgggc

SEQ ID NO: 6042739 - DNA, 18 bp, Homo sapiens
catgcggtgggtgctgcc

SEQ ID NO: 6042740 - DNA, 16 bp, Homo sapiens
catgcggtttccaagg

SEQ ID NO: 6042741 - DNA, 17 bp, Homo sapiens
catgcgtatatgtgcgt

SEQ ID NO: 6042742 - DNA, 19 bp, Homo sapiens
catgcgtatatgtgcgtct

SEQ ID NO: 6042743 - DNA, 15 bp, Homo sapiens
catgcgtcaggggcc

SEQ ID NO: 6042744 - DNA, 16 bp, Homo sapiens
catgcgtcaggggcct

SEQ ID NO: 6042745 - DNA, 21 bp, Homo sapiens
catgcgtctctggccctcgtg

SEQ ID NO: 6042746 - DNA, 20 bp, Homo sapiens
catgcgtgccgcctgctcct

SEQ ID NO: 6042747 - DNA, 23 bp, Homo sapiens
catgcgtggccacgggggcagtg

SEQ ID NO: 6042748 - DNA, 14 bp, Homo sapiens
catgcgtgtgtcag

SEQ ID NO: 6042749 - DNA, 17 bp, Homo sapiens
catgcgtgtttctgact

SEQ ID NO: 6042750 - DNA, 14 bp, Homo sapiens
catgctaaataact

SEQ ID NO: 6042751 - DNA, 19 bp, Homo sapiens
catgctaacctctctgaac

SEQ ID NO: 6042752 - DNA, 13 bp, Homo sapiens
catgctaagagaa

SEQ ID NO: 6042753 - DNA, 13 bp, Homo sapiens
catgctaatgacg

SEQ ID NO: 6042754 - DNA, 19 bp, Homo sapiens
catgctaatgacgacacct

SEQ ID NO: 6042755 - DNA, 14 bp, Homo sapiens
catgctacacactg

SEQ ID NO: 6042756 - DNA, 14 bp, Homo sapiens
catgctactaaatt

SEQ ID NO: 6042757 - DNA, 21 bp, Homo sapiens
catgctacttggggacataat

SEQ ID NO: 6042758 - DNA, 19 bp, Homo sapiens
catgctagtgttgtatttc

SEQ ID NO: 6042759 - DNA, 21 bp, Homo sapiens
catgctagtgttgtatttcta

SEQ ID NO: 6042760 - DNA, 22 bp, Homo sapiens
catgctagtgttgtatttctat

SEQ ID NO: 6042761 - DNA, 17 bp, Homo sapiens
catgctatatatctttt

SEQ ID NO: 6042762 - DNA, 21 bp, Homo sapiens
catgctatatatcttttgtaa

SEQ ID NO: 6042763 - DNA, 17 bp, Homo sapiens
catgctatcagaaacag

SEQ ID NO: 6042764 - DNA, 23 bp, Homo sapiens
catgctatccaatctcatctctt

SEQ ID NO: 6042765 - DNA, 23 bp, Homo sapiens
catgctatctctgtgtgcacaaa

SEQ ID NO: 6042766 - DNA, 16 bp, Homo sapiens
catgctatctgttcct

SEQ ID NO: 6042767 - DNA, 17 bp, Homo sapiens
catgctatctgttccta

SEQ ID NO: 6042768 - DNA, 15 bp, Homo sapiens
catgctatggcattt

SEQ ID NO: 6042769 - DNA, 16 bp, Homo sapiens
catgctatgttctgtc

SEQ ID NO: 6042770 - DNA, 18 bp, Homo sapiens
catgctatgttctgtctt

SEQ ID NO: 6042771 - DNA, 22 bp, Homo sapiens
catgctatgttctgtcttccca

SEQ ID NO: 6042772 - DNA, 13 bp, Homo sapiens
catgctattgtct

SEQ ID NO: 6042773 - DNA, 15 bp, Homo sapiens
catgctcaaccactg

SEQ ID NO: 6042774 - DNA, 14 bp, Homo sapiens
catgctcaatgaaa

SEQ ID NO: 6042775 - DNA, 18 bp, Homo sapiens
catgctcacacattacaa

SEQ ID NO: 6042776 - DNA, 15 bp, Homo sapiens
catgctcaccgccct

SEQ ID NO: 6042777 - DNA, 13 bp, Homo sapiens
catgctcagcctt

SEQ ID NO: 6042778 - DNA, 19 bp, Homo sapiens
catgctcagccttgctgct

SEQ ID NO: 6042779 - DNA, 21 bp, Homo sapiens
catgctcagccttgctgctct

SEQ ID NO: 6042780 - DNA, 15 bp, Homo sapiens
catgctcagtattga

SEQ ID NO: 6042781 - DNA, 18 bp, Homo sapiens
catgctcatctgctggtc

SEQ ID NO: 6042782 - DNA, 22 bp, Homo sapiens
catgctcatgtgtacacacgct

SEQ ID NO: 6042783 - DNA, 15 bp, Homo sapiens
catgctccagggtca

SEQ ID NO: 6042784 - DNA, 20 bp, Homo sapiens
catgctcccaaatgcagctt

SEQ ID NO: 6042785 - DNA, 14 bp, Homo sapiens
catgctcccaactc

SEQ ID NO: 6042786 - DNA, 15 bp, Homo sapiens
catgctcccaactcc

SEQ ID NO: 6042787 - DNA, 16 bp, Homo sapiens
catgctcccaactccc

SEQ ID NO: 6042788 - DNA, 17 bp, Homo sapiens
catgctcccagcatttg

SEQ ID NO: 6042789 - DNA, 18 bp, Homo sapiens
catgctcccagcatttgt

SEQ ID NO: 6042790 - DNA, 20 bp, Homo sapiens
catgctcccagcatttgtcc

SEQ ID NO: 6042791 - DNA, 16 bp, Homo sapiens
catgctcccctgtgcc

SEQ ID NO: 6042792 - DNA, 18 bp, Homo sapiens
catgctcccctgtgccag

SEQ ID NO: 6042793 - DNA, 14 bp, Homo sapiens
catgctcctcacct

SEQ ID NO: 6042794 - DNA, 14 bp, Homo sapiens
catgctcctcactg

SEQ ID NO: 6042795 - DNA, 17 bp, Homo sapiens
catgctcctcactgccc

SEQ ID NO: 6042796 - DNA, 12 bp, Homo sapiens
catgctcctctg

SEQ ID NO: 6042797 - DNA, 14 bp, Homo sapiens
catgctcctctgcc

SEQ ID NO: 6042798 - DNA, 15 bp, Homo sapiens
catgctcctctgcct

SEQ ID NO: 6042799 - DNA, 21 bp, Homo sapiens
catgctcctctgcctgtgccc

SEQ ID NO: 6042800 - DNA, 19 bp, Homo sapiens
catgctcctcttccccaga

SEQ ID NO: 6042801 - DNA, 16 bp, Homo sapiens
catgctcctggcccac

SEQ ID NO: 6042802 - DNA, 20 bp, Homo sapiens
catgctcctggcccactgca

SEQ ID NO: 6042803 - DNA, 20 bp, Homo sapiens
catgctctcatatatatttt

SEQ ID NO: 6042804 - DNA, 20 bp, Homo sapiens
catgctctccaaaccacttt

SEQ ID NO: 6042805 - DNA, 13 bp, Homo sapiens
catgctctctgca

SEQ ID NO: 6042806 - DNA, 15 bp, Homo sapiens
catgctctctgcagc

SEQ ID NO: 6042807 - DNA, 21 bp, Homo sapiens
catgctctgagaagaggagcc

SEQ ID NO: 6042808 - DNA, 15 bp, Homo sapiens
catgctctgatgcag

SEQ ID NO: 6042809 - DNA, 16 bp, Homo sapiens
catgctctgccccaag

SEQ ID NO: 6042810 - DNA, 18 bp, Homo sapiens
catgctctgccccaagcc

SEQ ID NO: 6042811 - DNA, 13 bp, Homo sapiens
catgctctggaag

SEQ ID NO: 6042812 - DNA, 19 bp, Homo sapiens
catgctcttgttctgttcc

SEQ ID NO: 6042813 - DNA, 15 bp, Homo sapiens
catgctgaaaaatat

SEQ ID NO: 6042814 - DNA, 20 bp, Homo sapiens
catgctgaaaaatatagcct

SEQ ID NO: 6042815 - DNA, 15 bp, Homo sapiens
catgctgaagccaaa

SEQ ID NO: 6042816 - DNA, 18 bp, Homo sapiens
catgctgaagggaccttg

SEQ ID NO: 6042817 - DNA, 17 bp, Homo sapiens
catgctgaatccacctc

SEQ ID NO: 6042818 - DNA, 22 bp, Homo sapiens
catgctgaatccacctcggagc

SEQ ID NO: 6042819 - DNA, 13 bp, Homo sapiens
catgctgaatgcc

SEQ ID NO: 6042820 - DNA, 21 bp, Homo sapiens
catgctgaatgccccctgctt

SEQ ID NO: 6042821 - DNA, 22 bp, Homo sapiens
catgctgaatgccccctgctta

SEQ ID NO: 6042822 - DNA, 15 bp, Homo sapiens
catgctgaattattt

SEQ ID NO: 6042823 - DNA, 15 bp, Homo sapiens
catgctgagacatcc

SEQ ID NO: 6042824 - DNA, 20 bp, Homo sapiens
catgctgagacatccctcat

SEQ ID NO: 6042825 - DNA, 18 bp, Homo sapiens
catgctgagagctgggct

SEQ ID NO: 6042826 - DNA, 15 bp, Homo sapiens
catgctgaggcctgg

SEQ ID NO: 6042827 - DNA, 16 bp, Homo sapiens
catgctgaggcctggg

SEQ ID NO: 6042828 - DNA, 21 bp, Homo sapiens
catgctgagtcatgtctttcc

SEQ ID NO: 6042829 - DNA, 19 bp, Homo sapiens
catgctgagtctcccaagg

SEQ ID NO: 6042830 - DNA, 21 bp, Homo sapiens
catgctgagtctcccaaggct

SEQ ID NO: 6042831 - DNA, 18 bp, Homo sapiens
catgctgcaaaggagaag

SEQ ID NO: 6042832 - DNA, 13 bp, Homo sapiens
catgctgcagtgg

SEQ ID NO: 6042833 - DNA, 13 bp, Homo sapiens
catgctgcccacc

SEQ ID NO: 6042834 - DNA, 15 bp, Homo sapiens
catgctgcccacccc

SEQ ID NO: 6042835 - DNA, 22 bp, Homo sapiens
catgctgcccaccccctgctgg

SEQ ID NO: 6042836 - DNA, 17 bp, Homo sapiens
catgctgcccagccact

SEQ ID NO: 6042837 - DNA, 18 bp, Homo sapiens
catgctgcccagccactc

SEQ ID NO: 6042838 - DNA, 12 bp, Homo sapiens
catgctgcctcc

SEQ ID NO: 6042839 - DNA, 12 bp, Homo sapiens
catgctgcctgc

SEQ ID NO: 6042840 - DNA, 21 bp, Homo sapiens
catgctgcctggcacagacca

SEQ ID NO: 6042841 - DNA, 22 bp, Homo sapiens
catgctgccttattcagggaag

SEQ ID NO: 6042842 - DNA, 23 bp, Homo sapiens
catgctgctatacacaagcaatg

SEQ ID NO: 6042843 - DNA, 22 bp, Homo sapiens
catgctgctcccctaaagccag

SEQ ID NO: 6042844 - DNA, 23 bp, Homo sapiens
catgctgctcccctaaagccagg

SEQ ID NO: 6042845 - DNA, 14 bp, Homo sapiens
catgctgctttaat

SEQ ID NO: 6042846 - DNA, 12 bp, Homo sapiens
catgctgctttg

SEQ ID NO: 6042847 - DNA, 19 bp, Homo sapiens
catgctgctttttggcaca

SEQ ID NO: 6042848 - DNA, 20 bp, Homo sapiens
catgctgctttttggcacag

SEQ ID NO: 6042849 - DNA, 21 bp, Homo sapiens
catgctgctttttggcacagt

SEQ ID NO: 6042850 - DNA, 17 bp, Homo sapiens
catgctggaaaataata

SEQ ID NO: 6042851 - DNA, 14 bp, Homo sapiens
catgctggaaataa

SEQ ID NO: 6042852 - DNA, 18 bp, Homo sapiens
catgctggaaataaaaca

SEQ ID NO: 6042853 - DNA, 18 bp, Homo sapiens
catgctggaacctgcaaa

SEQ ID NO: 6042854 - DNA, 22 bp, Homo sapiens
catgctggaacctgcaaaaaat

SEQ ID NO: 6042855 - DNA, 15 bp, Homo sapiens
catgctggagcctgt

SEQ ID NO: 6042856 - DNA, 16 bp, Homo sapiens
catgctggagggaggc

SEQ ID NO: 6042857 - DNA, 21 bp, Homo sapiens
catgctggagtacccagccta

SEQ ID NO: 6042858 - DNA, 18 bp, Homo sapiens
catgctggatactggaca

SEQ ID NO: 6042859 - DNA, 20 bp, Homo sapiens
catgctggatactggacaca

SEQ ID NO: 6042860 - DNA, 17 bp, Homo sapiens
catgctggccagcctgg

SEQ ID NO: 6042861 - DNA, 16 bp, Homo sapiens
catgctggcctcccaa

SEQ ID NO: 6042862 - DNA, 22 bp, Homo sapiens
catgctggcctcccaataaagc

SEQ ID NO: 6042863 - DNA, 13 bp, Homo sapiens
catgctggcctgt

SEQ ID NO: 6042864 - DNA, 19 bp, Homo sapiens
catgctggcctgtggcagg

SEQ ID NO: 6042865 - DNA, 20 bp, Homo sapiens
catgctggcctgtggcaggc

SEQ ID NO: 6042866 - DNA, 14 bp, Homo sapiens
ccagctctgccccc

SEQ ID NO: 6042867 - DNA, 21 bp, Homo sapiens
ccagctctgccgtctctggag

SEQ ID NO: 6042868 - DNA, 22 bp, Homo sapiens
ccagctctgccgtctctggagc

SEQ ID NO: 6042869 - DNA, 15 bp, Homo sapiens
ccagctctgcttgcc

SEQ ID NO: 6042870 - DNA, 21 bp, Homo sapiens
ccagctctggatgaaggcaaa

SEQ ID NO: 6042871 - DNA, 15 bp, Homo sapiens
ccagctctggcacag

SEQ ID NO: 6042872 - DNA, 14 bp, Homo sapiens
ccagctctggcttc

SEQ ID NO: 6042873 - DNA, 18 bp, Homo sapiens
ccagctctgggaactgaa

SEQ ID NO: 6042874 - DNA, 14 bp, Homo sapiens
ccagctctgggagc

SEQ ID NO: 6042875 - DNA, 12 bp, Homo sapiens
ccagctctggtc

SEQ ID NO: 6042876 - DNA, 22 bp, Homo sapiens
ccagctctggtccatagagagc

SEQ ID NO: 6042877 - DNA, 18 bp, Homo sapiens
ccagctctgtatcaggac

SEQ ID NO: 6042878 - DNA, 13 bp, Homo sapiens
ccagctctgtcac

SEQ ID NO: 6042879 - DNA, 21 bp, Homo sapiens
ccagctctgtcaccctggcca

SEQ ID NO: 6042880 - DNA, 24 bp, Homo sapiens
ccagctctgtcctcttggccatcc

SEQ ID NO: 6042881 - DNA, 13 bp, Homo sapiens
ccagctctgtggg

SEQ ID NO: 6042882 - DNA, 13 bp, Homo sapiens
ccagctctgttct

SEQ ID NO: 6042883 - DNA, 17 bp, Homo sapiens
ccagctctgttcttcct

SEQ ID NO: 6042884 - DNA, 17 bp, Homo sapiens
ccagctcttctcttcct

SEQ ID NO: 6042885 - DNA, 19 bp, Homo sapiens
ccagctcttctcttcctag

SEQ ID NO: 6042886 - DNA, 17 bp, Homo sapiens
ccagctcttgctctctt

SEQ ID NO: 6042887 - DNA, 19 bp, Homo sapiens
ccagctcttggcccctgtg

SEQ ID NO: 6042888 - DNA, 22 bp, Homo sapiens
ccagctctttattacatagctc

SEQ ID NO: 6042889 - DNA, 16 bp, Homo sapiens
ccagctctttgttcag

SEQ ID NO: 6042890 - DNA, 13 bp, Homo sapiens
ccagctgaaggca

SEQ ID NO: 6042891 - DNA, 16 bp, Homo sapiens
ccagctgaaggcagtg

SEQ ID NO: 6042892 - DNA, 19 bp, Homo sapiens
ccagctgaaggcagtggca

SEQ ID NO: 6042893 - DNA, 17 bp, Homo sapiens
ccagctgacagccacac

SEQ ID NO: 6042894 - DNA, 14 bp, Homo sapiens
ccagctgactaaac

SEQ ID NO: 6042895 - DNA, 12 bp, Homo sapiens
ccagctgactgt

SEQ ID NO: 6042896 - DNA, 18 bp, Homo sapiens
ccagctgactgttggctc

SEQ ID NO: 6042897 - DNA, 20 bp, Homo sapiens
ccagctgactgttggctctc

SEQ ID NO: 6042898 - DNA, 15 bp, Homo sapiens
ccagctgagcgccag

SEQ ID NO: 6042899 - DNA, 15 bp, Homo sapiens
ccagctgagtcctgg

SEQ ID NO: 6042900 - DNA, 15 bp, Homo sapiens
ccagctgagtgagtg

SEQ ID NO: 6042901 - DNA, 21 bp, Homo sapiens
ccagctgagtgagtgggagag

SEQ ID NO: 6042902 - DNA, 16 bp, Homo sapiens
ccagctgatgactcaa

SEQ ID NO: 6042903 - DNA, 22 bp, Homo sapiens
ccagctgatgactcaagattcc

SEQ ID NO: 6042904 - DNA, 23 bp, Homo sapiens
ccagctgatgactcaagattccc

SEQ ID NO: 6042905 - DNA, 16 bp, Homo sapiens
ccagctgcaaagtgtt

SEQ ID NO: 6042906 - DNA, 17 bp, Homo sapiens
ccagctgcaaagtgttt

SEQ ID NO: 6042907 - DNA, 13 bp, Homo sapiens
ccagctgcaccag

SEQ ID NO: 6042908 - DNA, 21 bp, Homo sapiens
ccagctgcaccccttcctggg

SEQ ID NO: 6042909 - DNA, 17 bp, Homo sapiens
ccagctgcacctgccag

SEQ ID NO: 6042910 - DNA, 18 bp, Homo sapiens
ccagctgcacctgccagc

SEQ ID NO: 6042911 - DNA, 23 bp, Homo sapiens
ccagctgcacctgccagcctggc

SEQ ID NO: 6042912 - DNA, 23 bp, Homo sapiens
ccagctgcagatgccacacctgc

SEQ ID NO: 6042913 - DNA, 12 bp, Homo sapiens
ccagctgcagcc

SEQ ID NO: 6042914 - DNA, 15 bp, Homo sapiens
ccagctgcagcccct

SEQ ID NO: 6042915 - DNA, 15 bp, Homo sapiens
ccagctgcagcctgg

SEQ ID NO: 6042916 - DNA, 20 bp, Homo sapiens
ccagctgcagcctggttggc

SEQ ID NO: 6042917 - DNA, 12 bp, Homo sapiens
ccagctgcaggg

SEQ ID NO: 6042918 - DNA, 13 bp, Homo sapiens
ccagctgcagggc

SEQ ID NO: 6042919 - DNA, 18 bp, Homo sapiens
ccagctgccaagtgctct

SEQ ID NO: 6042920 - DNA, 14 bp, Homo sapiens
ccagctgccaggga

SEQ ID NO: 6042921 - DNA, 23 bp, Homo sapiens
ccagctgccagggaagacagagc

SEQ ID NO: 6042922 - DNA, 22 bp, Homo sapiens
ccagctgcccccagagccacag

SEQ ID NO: 6042923 - DNA, 21 bp, Homo sapiens
ccagctgcccctccctcaggg

SEQ ID NO: 6042924 - DNA, 16 bp, Homo sapiens
ccagctgccctatggg

SEQ ID NO: 6042925 - DNA, 18 bp, Homo sapiens
ccagctgccgaccagagc

SEQ ID NO: 6042926 - DNA, 20 bp, Homo sapiens
ccagctgccgaccagagccc

SEQ ID NO: 6042927 - DNA, 17 bp, Homo sapiens
ccagctgccggcagtgc

SEQ ID NO: 6042928 - DNA, 18 bp, Homo sapiens
ccagctgccggcagtgct

SEQ ID NO: 6042929 - DNA, 20 bp, Homo sapiens
ccagctgccggcagtgctgg

SEQ ID NO: 6042930 - DNA, 10 bp, Homo sapiens
ccagctgcct

SEQ ID NO: 6042931 - DNA, 12 bp, Homo sapiens
ccagctgcctcc

SEQ ID NO: 6042932 - DNA, 23 bp, Homo sapiens
ccagctgcctctttgctgctttg

SEQ ID NO: 6042933 - DNA, 11 bp, Homo sapiens
ccagctgcctg

SEQ ID NO: 6042934 - DNA, 12 bp, Homo sapiens
ccagctgcctgg

SEQ ID NO: 6042935 - DNA, 19 bp, Homo sapiens
ccagctgcctggagagggt

SEQ ID NO: 6042936 - DNA, 15 bp, Homo sapiens
ccagctgcctgggcc

SEQ ID NO: 6042937 - DNA, 20 bp, Homo sapiens
ccagctgcctgtgcctgcca

SEQ ID NO: 6042938 - DNA, 22 bp, Homo sapiens
ccagctgcctgtgcctgccatg

SEQ ID NO: 6042939 - DNA, 17 bp, Homo sapiens
ccagctgcgcttgcttt

SEQ ID NO: 6042940 - DNA, 16 bp, Homo sapiens
ccagctgctcccctcc

SEQ ID NO: 6042941 - DNA, 20 bp, Homo sapiens
ccagctgctcccctgccacg

SEQ ID NO: 6042942 - DNA, 22 bp, Homo sapiens
ccagctgctccgaggacccagg

SEQ ID NO: 6042943 - DNA, 17 bp, Homo sapiens
ccagctgctcctcgcag

SEQ ID NO: 6042944 - DNA, 20 bp, Homo sapiens
ccagctgctcctcgcagttc

SEQ ID NO: 6042945 - DNA, 14 bp, Homo sapiens
ccagctgctctaag

SEQ ID NO: 6042946 - DNA, 17 bp, Homo sapiens
ccagctgctctaagccc

SEQ ID NO: 6042947 - DNA, 19 bp, Homo sapiens
ccagctgctctaagcccag

SEQ ID NO: 6042948 - DNA, 16 bp, Homo sapiens
ccagctgctctgccca

SEQ ID NO: 6042949 - DNA, 21 bp, Homo sapiens
ccagctgctgagatcctggac

SEQ ID NO: 6042950 - DNA, 23 bp, Homo sapiens
ccagctgctgagatcctggactg

SEQ ID NO: 6042951 - DNA, 15 bp, Homo sapiens
ccagctgctgagccg

SEQ ID NO: 6042952 - DNA, 18 bp, Homo sapiens
ccagctgctgagccgcag

SEQ ID NO: 6042953 - DNA, 23 bp, Homo sapiens
ccagctgctgagccgcagagaag

SEQ ID NO: 6042954 - DNA, 14 bp, Homo sapiens
ccagctgctgaggc

SEQ ID NO: 6042955 - DNA, 16 bp, Homo sapiens
ccagctgctgaggcga

SEQ ID NO: 6042956 - DNA, 15 bp, Homo sapiens
ccagctgctgctctc

SEQ ID NO: 6042957 - DNA, 17 bp, Homo sapiens
ccagctgctgctctccc

SEQ ID NO: 6042958 - DNA, 19 bp, Homo sapiens
ccagctgctgctctcccct

SEQ ID NO: 6042959 - DNA, 11 bp, Homo sapiens
ccagctgctgt

SEQ ID NO: 6042960 - DNA, 13 bp, Homo sapiens
ccagctgctgtct

SEQ ID NO: 6042961 - DNA, 14 bp, Homo sapiens
ccagctgctgtctt

SEQ ID NO: 6042962 - DNA, 20 bp, Homo sapiens
ccagctgctgtgctgggtgc

SEQ ID NO: 6042963 - DNA, 13 bp, Homo sapiens
ccagctgcttctg

SEQ ID NO: 6042964 - DNA, 19 bp, Homo sapiens
ccagctgcttctgcccacc

SEQ ID NO: 6042965 - DNA, 16 bp, Homo sapiens
ccagctgcttgggctt

SEQ ID NO: 6042966 - DNA, 18 bp, Homo sapiens
ccagctgcttgggcttca

SEQ ID NO: 6042967 - DNA, 15 bp, Homo sapiens
ccagctggaattgct

SEQ ID NO: 6042968 - DNA, 19 bp, Homo sapiens
ccagctggaattgctgctc

SEQ ID NO: 6042969 - DNA, 15 bp, Homo sapiens
ccagctggacttcct

SEQ ID NO: 6042970 - DNA, 13 bp, Homo sapiens
ccagctggaggca

SEQ ID NO: 6042971 - DNA, 15 bp, Homo sapiens
ccagctggaggcagg

SEQ ID NO: 6042972 - DNA, 23 bp, Homo sapiens
ccagctggaggcaggggcttcct

SEQ ID NO: 6042973 - DNA, 14 bp, Homo sapiens
ccagctggcagcag

SEQ ID NO: 6042974 - DNA, 18 bp, Homo sapiens
ccagctggcagcgcctcc

SEQ ID NO: 6042975 - DNA, 19 bp, Homo sapiens
ccagctggcagcgcctccc

SEQ ID NO: 6042976 - DNA, 12 bp, Homo sapiens
ccagctggccca

SEQ ID NO: 6042977 - DNA, 13 bp, Homo sapiens
ccagctggcccag

SEQ ID NO: 6042978 - DNA, 19 bp, Homo sapiens
ccagctggcccgtgacaga

SEQ ID NO: 6042979 - DNA, 22 bp, Homo sapiens
ccagctggccggaaggagactg

SEQ ID NO: 6042980 - DNA, 12 bp, Homo sapiens
ccagctggcctc

SEQ ID NO: 6042981 - DNA, 16 bp, Homo sapiens
ccagctggcctctaga

SEQ ID NO: 6042982 - DNA, 20 bp, Homo sapiens
ccagctggcctctagaacac

SEQ ID NO: 6042983 - DNA, 14 bp, Homo sapiens
ccagctggcctggg

SEQ ID NO: 6042984 - DNA, 16 bp, Homo sapiens
ccagctggcctttgta

SEQ ID NO: 6042985 - DNA, 12 bp, Homo sapiens
ccagctggctct

SEQ ID NO: 6042986 - DNA, 19 bp, Homo sapiens
ccagctggctctgcagcac

SEQ ID NO: 6042987 - DNA, 13 bp, Homo sapiens
ccagctggctggg

SEQ ID NO: 6042988 - DNA, 16 bp, Homo sapiens
ccagctggctgggtcg

SEQ ID NO: 6042989 - DNA, 23 bp, Homo sapiens
ccagctggctgggtcgcccctcc

SEQ ID NO: 6042990 - DNA, 17 bp, Homo sapiens
ccagctgggaagccctt

SEQ ID NO: 6042991 - DNA, 20 bp, Homo sapiens
ccagctgggacctaatgctg

SEQ ID NO: 6042992 - DNA, 14 bp, Homo sapiens
ccagctgggaggca

SEQ ID NO: 6042993 - DNA, 16 bp, Homo sapiens
ccagctgggaggcaag

SEQ ID NO: 6042994 - DNA, 22 bp, Homo sapiens
ccagctgggaggcaagaggggt

SEQ ID NO: 6042995 - DNA, 18 bp, Homo sapiens
ccagctgggatctgactg

SEQ ID NO: 6042996 - DNA, 23 bp, Homo sapiens
ccagctgggatctgactgcacgt

SEQ ID NO: 6042997 - DNA, 18 bp, Homo sapiens
ccagctgggctctgcaat

SEQ ID NO: 6042998 - DNA, 21 bp, Homo sapiens
ccagctgggctctgccaccct

SEQ ID NO: 6042999 - DNA, 23 bp, Homo sapiens
ccagctgggctctgccaccctac

SEQ ID NO: 6043000 - DNA, 12 bp, Homo sapiens
ccagctgggctg

SEQ ID NO: 6043001 - DNA, 17 bp, Homo sapiens
ccagctggggccagagg

SEQ ID NO: 6043002 - DNA, 20 bp, Homo sapiens
ccagctggggccaggctggg

SEQ ID NO: 6043003 - DNA, 16 bp, Homo sapiens
ccagctggggcccctc

SEQ ID NO: 6043004 - DNA, 21 bp, Homo sapiens
ccagctggggcccctcggcta

SEQ ID NO: 6043005 - DNA, 21 bp, Homo sapiens
ccagctggggcgtggggaggg

SEQ ID NO: 6043006 - DNA, 16 bp, Homo sapiens
ccagctgggtcaggca

SEQ ID NO: 6043007 - DNA, 17 bp, Homo sapiens
ccagctgggtcaggcag

SEQ ID NO: 6043008 - DNA, 18 bp, Homo sapiens
ccagctgggtcaggcagg

SEQ ID NO: 6043009 - DNA, 23 bp, Homo sapiens
ccagctgggtctaatccttctca

SEQ ID NO: 6043010 - DNA, 18 bp, Homo sapiens
ccagctgggtgccccagg

SEQ ID NO: 6043011 - DNA, 21 bp, Homo sapiens
ccagctgggtgccccagggac

SEQ ID NO: 6043012 - DNA, 18 bp, Homo sapiens
ccagctggtgcccccaga

SEQ ID NO: 6043013 - DNA, 24 bp, Homo sapiens
ccagctggtggccctgtgcctggg

SEQ ID NO: 6043014 - DNA, 22 bp, Homo sapiens
ccagctgtaccggccactgcaa

SEQ ID NO: 6043015 - DNA, 18 bp, Homo sapiens
ccagctgtagccatggct

SEQ ID NO: 6043016 - DNA, 19 bp, Homo sapiens
ccagctgtagccatggctc

SEQ ID NO: 6043017 - DNA, 22 bp, Homo sapiens
ccagctgtagccatggctcagg

SEQ ID NO: 6043018 - DNA, 15 bp, Homo sapiens
ccagctgtcagcctg

SEQ ID NO: 6043019 - DNA, 15 bp, Homo sapiens
ccagctgtcgcatct

SEQ ID NO: 6043020 - DNA, 18 bp, Homo sapiens
ccagctgtcgtctgactc

SEQ ID NO: 6043021 - DNA, 20 bp, Homo sapiens
ccagctgtcgtctgactctg

SEQ ID NO: 6043022 - DNA, 14 bp, Homo sapiens
ccagctgtgagcct

SEQ ID NO: 6043023 - DNA, 15 bp, Homo sapiens
ccagctgtgcacttt

SEQ ID NO: 6043024 - DNA, 20 bp, Homo sapiens
ccagctgtgcccctccccca

SEQ ID NO: 6043025 - DNA, 22 bp, Homo sapiens
ccagctgtgctctggacaggca

SEQ ID NO: 6043026 - DNA, 16 bp, Homo sapiens
ccagctgtgctgggag

SEQ ID NO: 6043027 - DNA, 16 bp, Homo sapiens
ccagctgtgctgtgga

SEQ ID NO: 6043028 - DNA, 17 bp, Homo sapiens
ccagctgtgctgtggag

SEQ ID NO: 6043029 - DNA, 23 bp, Homo sapiens
ccagctgtgggcggctcctggtg

SEQ ID NO: 6043030 - DNA, 15 bp, Homo sapiens
ccagctgtggttttc

SEQ ID NO: 6043031 - DNA, 12 bp, Homo sapiens
ccagctgtgtcc

SEQ ID NO: 6043032 - DNA, 14 bp, Homo sapiens
ccagctgtgtccaa

SEQ ID NO: 6043033 - DNA, 16 bp, Homo sapiens
ccagctgttcagctgg

SEQ ID NO: 6043034 - DNA, 14 bp, Homo sapiens
ccagctgttcttag

SEQ ID NO: 6043035 - DNA, 23 bp, Homo sapiens
ccagcttaaacccatacaatgta

SEQ ID NO: 6043036 - DNA, 16 bp, Homo sapiens
ccagcttaatagctgt

SEQ ID NO: 6043037 - DNA, 18 bp, Homo sapiens
ccagcttaatagctgtag

SEQ ID NO: 6043038 - DNA, 22 bp, Homo sapiens
ccagcttagcaactgctgggga

SEQ ID NO: 6043039 - DNA, 14 bp, Homo sapiens
ccagcttatctcct

SEQ ID NO: 6043040 - DNA, 21 bp, Homo sapiens
ccagcttattgtgtgcgctgc

SEQ ID NO: 6043041 - DNA, 22 bp, Homo sapiens
ccagcttattgtgtgcgctgcc

SEQ ID NO: 6043042 - DNA, 13 bp, Homo sapiens
ccagcttcacgat

SEQ ID NO: 6043043 - DNA, 19 bp, Homo sapiens
ccagcttcacttctgactc

SEQ ID NO: 6043044 - DNA, 16 bp, Homo sapiens
ccagcttcaggcacca

SEQ ID NO: 6043045 - DNA, 22 bp, Homo sapiens
catgctggcctgtggcaggcct

SEQ ID NO: 6043046 - DNA, 16 bp, Homo sapiens
catgctggcggcgcag

SEQ ID NO: 6043047 - DNA, 22 bp, Homo sapiens
catgctggcggcgcagagggaa

SEQ ID NO: 6043048 - DNA, 22 bp, Homo sapiens
catgctggctcccagggccatg

SEQ ID NO: 6043049 - DNA, 20 bp, Homo sapiens
catgctgggaagacgcctga

SEQ ID NO: 6043050 - DNA, 14 bp, Homo sapiens
catgctgggccact

SEQ ID NO: 6043051 - DNA, 20 bp, Homo sapiens
catgctgggccactggggac

SEQ ID NO: 6043052 - DNA, 12 bp, Homo sapiens
catgctgggccg

SEQ ID NO: 6043053 - DNA, 15 bp, Homo sapiens
catgctgggctcact

SEQ ID NO: 6043054 - DNA, 14 bp, Homo sapiens
catgctgggtctga

SEQ ID NO: 6043055 - DNA, 17 bp, Homo sapiens
catgctgggttctgcac

SEQ ID NO: 6043056 - DNA, 21 bp, Homo sapiens
catgctggtcagagacggcag

SEQ ID NO: 6043057 - DNA, 17 bp, Homo sapiens
catgctggtgagtgcca

SEQ ID NO: 6043058 - DNA, 20 bp, Homo sapiens
catgctggtgggttagctaa

SEQ ID NO: 6043059 - DNA, 15 bp, Homo sapiens
catgctggttacctg

SEQ ID NO: 6043060 - DNA, 19 bp, Homo sapiens
catgctgtacatacttttt

SEQ ID NO: 6043061 - DNA, 16 bp, Homo sapiens
catgctgtacttgtgg

SEQ ID NO: 6043062 - DNA, 17 bp, Homo sapiens
catgctgtccctgcact

SEQ ID NO: 6043063 - DNA, 17 bp, Homo sapiens
catgctgtccctgtggg

SEQ ID NO: 6043064 - DNA, 17 bp, Homo sapiens
catgctgtcccttacgt

SEQ ID NO: 6043065 - DNA, 21 bp, Homo sapiens
catgctgtccgtgcttgctgg

SEQ ID NO: 6043066 - DNA, 19 bp, Homo sapiens
catgctgtgattgtgccta

SEQ ID NO: 6043067 - DNA, 22 bp, Homo sapiens
catgctgtgctctttgaagaga

SEQ ID NO: 6043068 - DNA, 12 bp, Homo sapiens
catgctgtgtaa

SEQ ID NO: 6043069 - DNA, 14 bp, Homo sapiens
catgctgtgtgact

SEQ ID NO: 6043070 - DNA, 20 bp, Homo sapiens
catgctgttgattgctaaat

SEQ ID NO: 6043071 - DNA, 23 bp, Homo sapiens
catgctgttgattgctaaatgta

SEQ ID NO: 6043072 - DNA, 15 bp, Homo sapiens
catgctgttggcctc

SEQ ID NO: 6043073 - DNA, 23 bp, Homo sapiens
catgcttacaaagaaagcacttc

SEQ ID NO: 6043074 - DNA, 18 bp, Homo sapiens
catgcttaccttctgctg

SEQ ID NO: 6043075 - DNA, 13 bp, Homo sapiens
catgcttactttt

SEQ ID NO: 6043076 - DNA, 16 bp, Homo sapiens
catgcttactttttaa

SEQ ID NO: 6043077 - DNA, 17 bp, Homo sapiens
catgcttactttttaat

SEQ ID NO: 6043078 - DNA, 22 bp, Homo sapiens
catgcttactttttaattttta

SEQ ID NO: 6043079 - DNA, 13 bp, Homo sapiens
catgcttagagca

SEQ ID NO: 6043080 - DNA, 23 bp, Homo sapiens
catgcttagcagtccccttccct

SEQ ID NO: 6043081 - DNA, 18 bp, Homo sapiens
catgcttagcttatcttt

SEQ ID NO: 6043082 - DNA, 19 bp, Homo sapiens
catgcttagcttatctttc

SEQ ID NO: 6043083 - DNA, 16 bp, Homo sapiens
catgcttagtcactgc

SEQ ID NO: 6043084 - DNA, 18 bp, Homo sapiens
catgcttagtcactgcct

SEQ ID NO: 6043085 - DNA, 22 bp, Homo sapiens
catgcttattagcagctgggtt

SEQ ID NO: 6043086 - DNA, 16 bp, Homo sapiens
catgcttcccagaggg

SEQ ID NO: 6043087 - DNA, 20 bp, Homo sapiens
catgcttcccagagggagca

SEQ ID NO: 6043088 - DNA, 21 bp, Homo sapiens
catgcttcccagagggagcag

SEQ ID NO: 6043089 - DNA, 16 bp, Homo sapiens
catgcttccctgcagc

SEQ ID NO: 6043090 - DNA, 20 bp, Homo sapiens
catgcttccctgcagctgac

SEQ ID NO: 6043091 - DNA, 14 bp, Homo sapiens
catgcttcctttct

SEQ ID NO: 6043092 - DNA, 18 bp, Homo sapiens
catgcttctactgtgaca

SEQ ID NO: 6043093 - DNA, 20 bp, Homo sapiens
catgcttctcatcttgtgaa

SEQ ID NO: 6043094 - DNA, 21 bp, Homo sapiens
catgcttctcatcttgtgaaa

SEQ ID NO: 6043095 - DNA, 22 bp, Homo sapiens
catgcttctcatcttgtgaaat

SEQ ID NO: 6043096 - DNA, 17 bp, Homo sapiens
catgcttcttctcatgg

SEQ ID NO: 6043097 - DNA, 13 bp, Homo sapiens
catgcttcttgcc

SEQ ID NO: 6043098 - DNA, 21 bp, Homo sapiens
catgcttcttgccccttgggc

SEQ ID NO: 6043099 - DNA, 18 bp, Homo sapiens
catgcttgacatacctac

SEQ ID NO: 6043100 - DNA, 17 bp, Homo sapiens
catgcttgatggtttat

SEQ ID NO: 6043101 - DNA, 19 bp, Homo sapiens
catgcttgatgtttggcct

SEQ ID NO: 6043102 - DNA, 17 bp, Homo sapiens
catgcttgcctgaagct

SEQ ID NO: 6043103 - DNA, 18 bp, Homo sapiens
catgcttgcctgaagctt

SEQ ID NO: 6043104 - DNA, 14 bp, Homo sapiens
catgcttggttttc

SEQ ID NO: 6043105 - DNA, 18 bp, Homo sapiens
catgctttaaagtgtaat

SEQ ID NO: 6043106 - DNA, 19 bp, Homo sapiens
catgctttaaagtgtaata

SEQ ID NO: 6043107 - DNA, 14 bp, Homo sapiens
catgctttatgtgg

SEQ ID NO: 6043108 - DNA, 16 bp, Homo sapiens
catgctttccatattt

SEQ ID NO: 6043109 - DNA, 13 bp, Homo sapiens
catgctttccatt

SEQ ID NO: 6043110 - DNA, 14 bp, Homo sapiens
catgctttcccacc

SEQ ID NO: 6043111 - DNA, 15 bp, Homo sapiens
catgctttcccacca

SEQ ID NO: 6043112 - DNA, 14 bp, Homo sapiens
catgctttctcctt

SEQ ID NO: 6043113 - DNA, 21 bp, Homo sapiens
catgctttgagaccagaagaa

SEQ ID NO: 6043114 - DNA, 12 bp, Homo sapiens
catgctttgagt

SEQ ID NO: 6043115 - DNA, 14 bp, Homo sapiens
catgctttgctgct

SEQ ID NO: 6043116 - DNA, 16 bp, Homo sapiens
catgctttggaaattt

SEQ ID NO: 6043117 - DNA, 17 bp, Homo sapiens
catgcttttctcatggt

SEQ ID NO: 6043118 - DNA, 20 bp, Homo sapiens
catgcttttcttcctagtta

SEQ ID NO: 6043119 - DNA, 16 bp, Homo sapiens
catggaaaaatgccat

SEQ ID NO: 6043120 - DNA, 15 bp, Homo sapiens
catggaaaagcccag

SEQ ID NO: 6043121 - DNA, 17 bp, Homo sapiens
catggaaaagccttctt

SEQ ID NO: 6043122 - DNA, 18 bp, Homo sapiens
catggaaaagccttctta

SEQ ID NO: 6043123 - DNA, 16 bp, Homo sapiens
catggaaaccaaaagg

SEQ ID NO: 6043124 - DNA, 18 bp, Homo sapiens
catggaaacctgaaaaaa

SEQ ID NO: 6043125 - DNA, 17 bp, Homo sapiens
catggaaatattatgca

SEQ ID NO: 6043126 - DNA, 22 bp, Homo sapiens
catggaaatattatgcaaattc

SEQ ID NO: 6043127 - DNA, 18 bp, Homo sapiens
catggaaatgaagcaggg

SEQ ID NO: 6043128 - DNA, 17 bp, Homo sapiens
catggaaatttaaagca

SEQ ID NO: 6043129 - DNA, 18 bp, Homo sapiens
catggaaatttaaagcag

SEQ ID NO: 6043130 - DNA, 21 bp, Homo sapiens
catggaaatttaaagcaggtt

SEQ ID NO: 6043131 - DNA, 17 bp, Homo sapiens
catggaacaaagcatgt

SEQ ID NO: 6043132 - DNA, 13 bp, Homo sapiens
catggaacacaaa

SEQ ID NO: 6043133 - DNA, 23 bp, Homo sapiens
catggaacacaaacacattgtta

SEQ ID NO: 6043134 - DNA, 15 bp, Homo sapiens
catggaacagccctg

SEQ ID NO: 6043135 - DNA, 16 bp, Homo sapiens
catggaacagccctgc

SEQ ID NO: 6043136 - DNA, 23 bp, Homo sapiens
catggaacagtgtaaatcccaga

SEQ ID NO: 6043137 - DNA, 19 bp, Homo sapiens
catggaacgcgttgaaatt

SEQ ID NO: 6043138 - DNA, 17 bp, Homo sapiens
catggaactcattcctg

SEQ ID NO: 6043139 - DNA, 19 bp, Homo sapiens
catggaacttaaaacatat

SEQ ID NO: 6043140 - DNA, 18 bp, Homo sapiens
catggaagcaataaagct

SEQ ID NO: 6043141 - DNA, 13 bp, Homo sapiens
catggaaggcaag

SEQ ID NO: 6043142 - DNA, 14 bp, Homo sapiens
catggaaggcaaga

SEQ ID NO: 6043143 - DNA, 23 bp, Homo sapiens
catggaaggcggcacagaggcag

SEQ ID NO: 6043144 - DNA, 18 bp, Homo sapiens
catggaaggggcttctgg

SEQ ID NO: 6043145 - DNA, 24 bp, Homo sapiens
catggaaggttaggtttgtcaaca

SEQ ID NO: 6043146 - DNA, 13 bp, Homo sapiens
catggaagtaatt

SEQ ID NO: 6043147 - DNA, 22 bp, Homo sapiens
catggaagtaattaaggtacat

SEQ ID NO: 6043148 - DNA, 22 bp, Homo sapiens
catggaagtactataatttacc

SEQ ID NO: 6043149 - DNA, 23 bp, Homo sapiens
catggaatatttataggccaggg

SEQ ID NO: 6043150 - DNA, 18 bp, Homo sapiens
catggaatcgaagtgttt

SEQ ID NO: 6043151 - DNA, 19 bp, Homo sapiens
catggaatcttgctgcagg

SEQ ID NO: 6043152 - DNA, 23 bp, Homo sapiens
catggaatcttgctgcaggccct

SEQ ID NO: 6043153 - DNA, 13 bp, Homo sapiens
catggaatgactg

SEQ ID NO: 6043154 - DNA, 14 bp, Homo sapiens
catggaatgagggt

SEQ ID NO: 6043155 - DNA, 17 bp, Homo sapiens
catggaatgcaatttga

SEQ ID NO: 6043156 - DNA, 18 bp, Homo sapiens
catggaatggacatcctg

SEQ ID NO: 6043157 - DNA, 23 bp, Homo sapiens
catggaatggcaggtgtcatatg

SEQ ID NO: 6043158 - DNA, 17 bp, Homo sapiens
catggaatggttataaa

SEQ ID NO: 6043159 - DNA, 22 bp, Homo sapiens
catggaatggttataaaagtga

SEQ ID NO: 6043160 - DNA, 17 bp, Homo sapiens
catggaattccctcctg

SEQ ID NO: 6043161 - DNA, 18 bp, Homo sapiens
catggaatttaatttatg

SEQ ID NO: 6043162 - DNA, 19 bp, Homo sapiens
catggaatttgtaagttta

SEQ ID NO: 6043163 - DNA, 20 bp, Homo sapiens
catggaattttttgaatatg

SEQ ID NO: 6043164 - DNA, 16 bp, Homo sapiens
catggacaaggagctg

SEQ ID NO: 6043165 - DNA, 19 bp, Homo sapiens
catggacaatataaactga

SEQ ID NO: 6043166 - DNA, 21 bp, Homo sapiens
catggacaatataaactgaaa

SEQ ID NO: 6043167 - DNA, 14 bp, Homo sapiens
catggacaatggac

SEQ ID NO: 6043168 - DNA, 20 bp, Homo sapiens
catggacaatggaccggaga

SEQ ID NO: 6043169 - DNA, 23 bp, Homo sapiens
catggacaatggaccggagagtg

SEQ ID NO: 6043170 - DNA, 13 bp, Homo sapiens
catggacacagac

SEQ ID NO: 6043171 - DNA, 19 bp, Homo sapiens
catggacacagacccacac

SEQ ID NO: 6043172 - DNA, 22 bp, Homo sapiens
catggacacattttctcctagg

SEQ ID NO: 6043173 - DNA, 21 bp, Homo sapiens
catggacaccccttatccagg

SEQ ID NO: 6043174 - DNA, 23 bp, Homo sapiens
catggacaccccttatccaggac

SEQ ID NO: 6043175 - DNA, 16 bp, Homo sapiens
catggacactacaccc

SEQ ID NO: 6043176 - DNA, 17 bp, Homo sapiens
catggacactacaccca

SEQ ID NO: 6043177 - DNA, 12 bp, Homo sapiens
catggacactcc

SEQ ID NO: 6043178 - DNA, 14 bp, Homo sapiens
catggacactccag

SEQ ID NO: 6043179 - DNA, 14 bp, Homo sapiens
catggacagaattt

SEQ ID NO: 6043180 - DNA, 16 bp, Homo sapiens
catggacaggctggct

SEQ ID NO: 6043181 - DNA, 14 bp, Homo sapiens
catggacagggcca

SEQ ID NO: 6043182 - DNA, 12 bp, Homo sapiens
catggacagtgt

SEQ ID NO: 6043183 - DNA, 18 bp, Homo sapiens
catggacatgatcttctt

SEQ ID NO: 6043184 - DNA, 15 bp, Homo sapiens
catggacatttagaa

SEQ ID NO: 6043185 - DNA, 18 bp, Homo sapiens
catggaccactgtttctt

SEQ ID NO: 6043186 - DNA, 16 bp, Homo sapiens
catggaccagcatctg

SEQ ID NO: 6043187 - DNA, 17 bp, Homo sapiens
catggaccagtggctgg

SEQ ID NO: 6043188 - DNA, 21 bp, Homo sapiens
catggaccagtggctggtctc

SEQ ID NO: 6043189 - DNA, 20 bp, Homo sapiens
catggaccatgctgtctggc

SEQ ID NO: 6043190 - DNA, 15 bp, Homo sapiens
catggacccactacc

SEQ ID NO: 6043191 - DNA, 17 bp, Homo sapiens
catggacccctcgccca

SEQ ID NO: 6043192 - DNA, 12 bp, Homo sapiens
catggacccgga

SEQ ID NO: 6043193 - DNA, 21 bp, Homo sapiens
catggaccgaggttcccactc

SEQ ID NO: 6043194 - DNA, 16 bp, Homo sapiens
catggacctccaggct

SEQ ID NO: 6043195 - DNA, 23 bp, Homo sapiens
catggacctccaggctccagcac

SEQ ID NO: 6043196 - DNA, 14 bp, Homo sapiens
catggacctgcact

SEQ ID NO: 6043197 - DNA, 22 bp, Homo sapiens
catggacctggtgcccctgctc

SEQ ID NO: 6043198 - DNA, 17 bp, Homo sapiens
catggaccttctctcca

SEQ ID NO: 6043199 - DNA, 19 bp, Homo sapiens
catggaccttctctccaga

SEQ ID NO: 6043200 - DNA, 13 bp, Homo sapiens
catggacgcctgg

SEQ ID NO: 6043201 - DNA, 20 bp, Homo sapiens
catggacgtgtctgcacagg

SEQ ID NO: 6043202 - DNA, 19 bp, Homo sapiens
catggacgttcggggcatg

SEQ ID NO: 6043203 - DNA, 16 bp, Homo sapiens
catggactctgtcctg

SEQ ID NO: 6043204 - DNA, 17 bp, Homo sapiens
catggactctgtcctga

SEQ ID NO: 6043205 - DNA, 23 bp, Homo sapiens
catggactctgtcctgaaggcct

SEQ ID NO: 6043206 - DNA, 19 bp, Homo sapiens
catggactgagctggggga

SEQ ID NO: 6043207 - DNA, 13 bp, Homo sapiens
catggactttata

SEQ ID NO: 6043208 - DNA, 16 bp, Homo sapiens
catggagaaaccctgt

SEQ ID NO: 6043209 - DNA, 20 bp, Homo sapiens
catggagaaaccctgtctct

SEQ ID NO: 6043210 - DNA, 14 bp, Homo sapiens
catggagaaagctg

SEQ ID NO: 6043211 - DNA, 20 bp, Homo sapiens
catggagaaagctgacttgg

SEQ ID NO: 6043212 - DNA, 17 bp, Homo sapiens
catggagacaataaaca

SEQ ID NO: 6043213 - DNA, 13 bp, Homo sapiens
catggagacagca

SEQ ID NO: 6043214 - DNA, 15 bp, Homo sapiens
catggagacagcagt

SEQ ID NO: 6043215 - DNA, 13 bp, Homo sapiens
catggagactctg

SEQ ID NO: 6043216 - DNA, 23 bp, Homo sapiens
catggagagagactcaaagagac

SEQ ID NO: 6043217 - DNA, 13 bp, Homo sapiens
catggagagctgg

SEQ ID NO: 6043218 - DNA, 16 bp, Homo sapiens
catggagagctggagc

SEQ ID NO: 6043219 - DNA, 13 bp, Homo sapiens
catggagagctgt

SEQ ID NO: 6043220 - DNA, 16 bp, Homo sapiens
catggagatctgaagg

SEQ ID NO: 6043221 - DNA, 16 bp, Homo sapiens
catggagatgtaaaat

SEQ ID NO: 6043222 - DNA, 12 bp, Homo sapiens
catggagcagcc

SEQ ID NO: 6043223 - DNA, 17 bp, Homo sapiens
ccagcttcaggcaccag

SEQ ID NO: 6043224 - DNA, 23 bp, Homo sapiens
ccagcttcattatgcagctgagg

SEQ ID NO: 6043225 - DNA, 14 bp, Homo sapiens
ccagcttccaaagc

SEQ ID NO: 6043226 - DNA, 13 bp, Homo sapiens
ccagcttccagca

SEQ ID NO: 6043227 - DNA, 22 bp, Homo sapiens
ccagcttcccctcgctgtcctg

SEQ ID NO: 6043228 - DNA, 13 bp, Homo sapiens
ccagcttcccgag

SEQ ID NO: 6043229 - DNA, 13 bp, Homo sapiens
ccagcttcctccc

SEQ ID NO: 6043230 - DNA, 14 bp, Homo sapiens
ccagcttcctctga

SEQ ID NO: 6043231 - DNA, 19 bp, Homo sapiens
ccagcttcctctgagccgc

SEQ ID NO: 6043232 - DNA, 12 bp, Homo sapiens
ccagcttcctgt

SEQ ID NO: 6043233 - DNA, 14 bp, Homo sapiens
ccagcttcctgtgc

SEQ ID NO: 6043234 - DNA, 15 bp, Homo sapiens
ccagcttcctgtgca

SEQ ID NO: 6043235 - DNA, 23 bp, Homo sapiens
ccagcttccttcagagagcagtg

SEQ ID NO: 6043236 - DNA, 17 bp, Homo sapiens
ccagcttcgtcagctcc

SEQ ID NO: 6043237 - DNA, 19 bp, Homo sapiens
ccagcttcgtgctggagga

SEQ ID NO: 6043238 - DNA, 15 bp, Homo sapiens
ccagcttctcctgcg

SEQ ID NO: 6043239 - DNA, 18 bp, Homo sapiens
ccagcttctctctccagg

SEQ ID NO: 6043240 - DNA, 19 bp, Homo sapiens
ccagcttctctctccaggg

SEQ ID NO: 6043241 - DNA, 18 bp, Homo sapiens
ccagcttctctctccctg

SEQ ID NO: 6043242 - DNA, 20 bp, Homo sapiens
ccagcttctctctccctgtc

SEQ ID NO: 6043243 - DNA, 15 bp, Homo sapiens
ccagcttctttctcg

SEQ ID NO: 6043244 - DNA, 20 bp, Homo sapiens
ccagcttctttctcggtggc

SEQ ID NO: 6043245 - DNA, 13 bp, Homo sapiens
ccagcttgaggga

SEQ ID NO: 6043246 - DNA, 18 bp, Homo sapiens
ccagcttgccagatgctg

SEQ ID NO: 6043247 - DNA, 22 bp, Homo sapiens
ccagcttgccagatgctgcaga

SEQ ID NO: 6043248 - DNA, 17 bp, Homo sapiens
ccagcttgcgaataaca

SEQ ID NO: 6043249 - DNA, 14 bp, Homo sapiens
ccagcttgctcttc

SEQ ID NO: 6043250 - DNA, 16 bp, Homo sapiens
ccagcttgctcttcag

SEQ ID NO: 6043251 - DNA, 16 bp, Homo sapiens
ccagcttgctgagggg

SEQ ID NO: 6043252 - DNA, 20 bp, Homo sapiens
ccagcttggacatcagtgtt

SEQ ID NO: 6043253 - DNA, 20 bp, Homo sapiens
ccagcttggagtgccacgtg

SEQ ID NO: 6043254 - DNA, 13 bp, Homo sapiens
ccagcttggctca

SEQ ID NO: 6043255 - DNA, 14 bp, Homo sapiens
ccagcttgggcaga

SEQ ID NO: 6043256 - DNA, 18 bp, Homo sapiens
ccagcttgggcccagctg

SEQ ID NO: 6043257 - DNA, 21 bp, Homo sapiens
ccagcttgggcccagctgggc

SEQ ID NO: 6043258 - DNA, 22 bp, Homo sapiens
ccagcttgggcccagctgggct

SEQ ID NO: 6043259 - DNA, 23 bp, Homo sapiens
ccagcttgggcccagctgggctc

SEQ ID NO: 6043260 - DNA, 21 bp, Homo sapiens
ccagcttggtggttatgtccc

SEQ ID NO: 6043261 - DNA, 14 bp, Homo sapiens
ccagcttggttcca

SEQ ID NO: 6043262 - DNA, 16 bp, Homo sapiens
ccagcttgttatttat

SEQ ID NO: 6043263 - DNA, 17 bp, Homo sapiens
ccagcttgttatttata

SEQ ID NO: 6043264 - DNA, 14 bp, Homo sapiens
ccagcttgtttaca

SEQ ID NO: 6043265 - DNA, 19 bp, Homo sapiens
ccagcttgtttacatgctt

SEQ ID NO: 6043266 - DNA, 16 bp, Homo sapiens
ccagctttaaaaagaa

SEQ ID NO: 6043267 - DNA, 17 bp, Homo sapiens
ccagctttaaaaagaaa

SEQ ID NO: 6043268 - DNA, 19 bp, Homo sapiens
ccagctttaaaaagaaaaa

SEQ ID NO: 6043269 - DNA, 12 bp, Homo sapiens
ccagctttattt

SEQ ID NO: 6043270 - DNA, 16 bp, Homo sapiens
ccagctttatttttta

SEQ ID NO: 6043271 - DNA, 21 bp, Homo sapiens
ccagctttccctccccagagt

SEQ ID NO: 6043272 - DNA, 14 bp, Homo sapiens
ccagctttccctgc

SEQ ID NO: 6043273 - DNA, 17 bp, Homo sapiens
ccagctttccctgccag

SEQ ID NO: 6043274 - DNA, 18 bp, Homo sapiens
ccagctttccctgcctct

SEQ ID NO: 6043275 - DNA, 18 bp, Homo sapiens
ccagctttccttctgccc

SEQ ID NO: 6043276 - DNA, 19 bp, Homo sapiens
ccagctttccttctgccct

SEQ ID NO: 6043277 - DNA, 20 bp, Homo sapiens
ccagctttccttctgccctt

SEQ ID NO: 6043278 - DNA, 21 bp, Homo sapiens
ccagctttccttctgcccttc

SEQ ID NO: 6043279 - DNA, 20 bp, Homo sapiens
ccagctttctctttgttctt

SEQ ID NO: 6043280 - DNA, 17 bp, Homo sapiens
ccagctttctgtgtgca

SEQ ID NO: 6043281 - DNA, 18 bp, Homo sapiens
ccagctttgcccaacacc

SEQ ID NO: 6043282 - DNA, 16 bp, Homo sapiens
ccagcttttcattgct

SEQ ID NO: 6043283 - DNA, 13 bp, Homo sapiens
ccaggaaaaagga

SEQ ID NO: 6043284 - DNA, 16 bp, Homo sapiens
ccaggaaaactgtttt

SEQ ID NO: 6043285 - DNA, 15 bp, Homo sapiens
ccaggaaaagcacaa

SEQ ID NO: 6043286 - DNA, 22 bp, Homo sapiens
ccaggaaacaagggaaggggcc

SEQ ID NO: 6043287 - DNA, 20 bp, Homo sapiens
ccaggaaacatgaagcataa

SEQ ID NO: 6043288 - DNA, 22 bp, Homo sapiens
ccaggaaactccacatctgcct

SEQ ID NO: 6043289 - DNA, 17 bp, Homo sapiens
ccaggaaactcttgcta

SEQ ID NO: 6043290 - DNA, 16 bp, Homo sapiens
ccaggaaagatgtccc

SEQ ID NO: 6043291 - DNA, 18 bp, Homo sapiens
ccaggaaagatgtcccac

SEQ ID NO: 6043292 - DNA, 16 bp, Homo sapiens
ccaggaaaggcttggc

SEQ ID NO: 6043293 - DNA, 13 bp, Homo sapiens
ccaggaacaagct

SEQ ID NO: 6043294 - DNA, 14 bp, Homo sapiens
ccaggaacacatgc

SEQ ID NO: 6043295 - DNA, 19 bp, Homo sapiens
ccaggaacagcaaatgcaa

SEQ ID NO: 6043296 - DNA, 19 bp, Homo sapiens
ccaggaacagggaccagct

SEQ ID NO: 6043297 - DNA, 20 bp, Homo sapiens
ccaggaacagggaccagctc

SEQ ID NO: 6043298 - DNA, 21 bp, Homo sapiens
ccaggaacagggaccagctcc

SEQ ID NO: 6043299 - DNA, 20 bp, Homo sapiens
ccaggaacgtttctgaacaa

SEQ ID NO: 6043300 - DNA, 20 bp, Homo sapiens
ccaggaactcgcacctgtgc

SEQ ID NO: 6043301 - DNA, 21 bp, Homo sapiens
ccaggaactcgcacctgtgct

SEQ ID NO: 6043302 - DNA, 16 bp, Homo sapiens
ccaggaactggctcct

SEQ ID NO: 6043303 - DNA, 20 bp, Homo sapiens
ccaggaactggctcctttgc

SEQ ID NO: 6043304 - DNA, 14 bp, Homo sapiens
ccaggaagaagcag

SEQ ID NO: 6043305 - DNA, 15 bp, Homo sapiens
ccaggaagaaggtgt

SEQ ID NO: 6043306 - DNA, 19 bp, Homo sapiens
ccaggaagaaggtgtgtcc

SEQ ID NO: 6043307 - DNA, 22 bp, Homo sapiens
ccaggaagaatggtgtgtttcc

SEQ ID NO: 6043308 - DNA, 23 bp, Homo sapiens
ccaggaagaatggtgtgtttccc

SEQ ID NO: 6043309 - DNA, 15 bp, Homo sapiens
ccaggaagaggggcg

SEQ ID NO: 6043310 - DNA, 14 bp, Homo sapiens
ccaggaagcacagg

SEQ ID NO: 6043311 - DNA, 15 bp, Homo sapiens
ccaggaagcacaggc

SEQ ID NO: 6043312 - DNA, 18 bp, Homo sapiens
ccaggaagcacaggccag

SEQ ID NO: 6043313 - DNA, 19 bp, Homo sapiens
ccaggaagcacaggccagg

SEQ ID NO: 6043314 - DNA, 21 bp, Homo sapiens
ccaggaagcacgttcactaga

SEQ ID NO: 6043315 - DNA, 14 bp, Homo sapiens
ccaggaagcaggga

SEQ ID NO: 6043316 - DNA, 15 bp, Homo sapiens
ccaggaagcagggag

SEQ ID NO: 6043317 - DNA, 16 bp, Homo sapiens
ccaggaagcagggaga

SEQ ID NO: 6043318 - DNA, 17 bp, Homo sapiens
ccaggaagcagggagag

SEQ ID NO: 6043319 - DNA, 15 bp, Homo sapiens
ccaggaagccagagc

SEQ ID NO: 6043320 - DNA, 17 bp, Homo sapiens
ccaggaagccagagccc

SEQ ID NO: 6043321 - DNA, 18 bp, Homo sapiens
ccaggaagccagagcccc

SEQ ID NO: 6043322 - DNA, 13 bp, Homo sapiens
ccaggaagccagc

SEQ ID NO: 6043323 - DNA, 14 bp, Homo sapiens
ccaggaagccagca

SEQ ID NO: 6043324 - DNA, 15 bp, Homo sapiens
ccaggaagccagcag

SEQ ID NO: 6043325 - DNA, 15 bp, Homo sapiens
ccaggaagcccacac

SEQ ID NO: 6043326 - DNA, 16 bp, Homo sapiens
ccaggaagcccacact

SEQ ID NO: 6043327 - DNA, 15 bp, Homo sapiens
ccaggaagccccgct

SEQ ID NO: 6043328 - DNA, 16 bp, Homo sapiens
ccaggaagccgtcctg

SEQ ID NO: 6043329 - DNA, 15 bp, Homo sapiens
ccaggaagctccctc

SEQ ID NO: 6043330 - DNA, 13 bp, Homo sapiens
ccaggaaggaaac

SEQ ID NO: 6043331 - DNA, 19 bp, Homo sapiens
ccaggaaggaagagcaagc

SEQ ID NO: 6043332 - DNA, 22 bp, Homo sapiens
ccaggaaggaagagcaagctgt

SEQ ID NO: 6043333 - DNA, 18 bp, Homo sapiens
ccaggaaggacagactgg

SEQ ID NO: 6043334 - DNA, 14 bp, Homo sapiens
ccaggaaggcagct

SEQ ID NO: 6043335 - DNA, 18 bp, Homo sapiens
ccaggaaggcagctgctc

SEQ ID NO: 6043336 - DNA, 20 bp, Homo sapiens
ccaggaaggcagctgctctt

SEQ ID NO: 6043337 - DNA, 22 bp, Homo sapiens
ccaggaaggccaaaatcaagag

SEQ ID NO: 6043338 - DNA, 16 bp, Homo sapiens
ccaggaaggcctaggc

SEQ ID NO: 6043339 - DNA, 15 bp, Homo sapiens
ccaggaaggcggggc

SEQ ID NO: 6043340 - DNA, 21 bp, Homo sapiens
ccaggaagggaaagcgggcag

SEQ ID NO: 6043341 - DNA, 16 bp, Homo sapiens
ccaggaagggagtgag

SEQ ID NO: 6043342 - DNA, 13 bp, Homo sapiens
ccaggaaggggac

SEQ ID NO: 6043343 - DNA, 15 bp, Homo sapiens
ccaggaaggggacag

SEQ ID NO: 6043344 - DNA, 22 bp, Homo sapiens
ccaggaaggtagcccagcactg

SEQ ID NO: 6043345 - DNA, 23 bp, Homo sapiens
ccaggaaggtagcccagcactgt

SEQ ID NO: 6043346 - DNA, 12 bp, Homo sapiens
ccaggaagtaat

SEQ ID NO: 6043347 - DNA, 19 bp, Homo sapiens
ccaggaagtagcacaggct

SEQ ID NO: 6043348 - DNA, 21 bp, Homo sapiens
ccaggaagtagcacaggctga

SEQ ID NO: 6043349 - DNA, 18 bp, Homo sapiens
ccaggaagtcatcctgca

SEQ ID NO: 6043350 - DNA, 20 bp, Homo sapiens
ccaggaagtcatcctgcaat

SEQ ID NO: 6043351 - DNA, 14 bp, Homo sapiens
ccaggaagtctcat

SEQ ID NO: 6043352 - DNA, 15 bp, Homo sapiens
ccaggaagtctcatc

SEQ ID NO: 6043353 - DNA, 18 bp, Homo sapiens
ccaggaagtgcttattct

SEQ ID NO: 6043354 - DNA, 23 bp, Homo sapiens
ccaggaagtgcttattctctcat

SEQ ID NO: 6043355 - DNA, 23 bp, Homo sapiens
ccaggaagtgggagaagtggccc

SEQ ID NO: 6043356 - DNA, 21 bp, Homo sapiens
ccaggaagtgtttatgaggaa

SEQ ID NO: 6043357 - DNA, 15 bp, Homo sapiens
ccaggaatgctgggc

SEQ ID NO: 6043358 - DNA, 17 bp, Homo sapiens
ccaggaatgtttcagct

SEQ ID NO: 6043359 - DNA, 23 bp, Homo sapiens
ccaggaatgtttcagctgcagtt

SEQ ID NO: 6043360 - DNA, 18 bp, Homo sapiens
ccaggaattagagaagct

SEQ ID NO: 6043361 - DNA, 20 bp, Homo sapiens
ccaggaattagagaagctga

SEQ ID NO: 6043362 - DNA, 22 bp, Homo sapiens
ccaggaattagagaagctgaaa

SEQ ID NO: 6043363 - DNA, 16 bp, Homo sapiens
ccaggaattctcacag

SEQ ID NO: 6043364 - DNA, 19 bp, Homo sapiens
ccaggaatttcccaggacc

SEQ ID NO: 6043365 - DNA, 23 bp, Homo sapiens
ccaggaatttcccaggaccctga

SEQ ID NO: 6043366 - DNA, 19 bp, Homo sapiens
ccaggaatttgggaccctg

SEQ ID NO: 6043367 - DNA, 22 bp, Homo sapiens
ccaggaatttgggaccctgctt

SEQ ID NO: 6043368 - DNA, 21 bp, Homo sapiens
ccaggacaagcacgaggcctc

SEQ ID NO: 6043369 - DNA, 14 bp, Homo sapiens
ccaggacacactga

SEQ ID NO: 6043370 - DNA, 17 bp, Homo sapiens
ccaggacaccacaccca

SEQ ID NO: 6043371 - DNA, 17 bp, Homo sapiens
ccaggacaccagtccag

SEQ ID NO: 6043372 - DNA, 12 bp, Homo sapiens
ccaggacacctg

SEQ ID NO: 6043373 - DNA, 17 bp, Homo sapiens
ccaggacacctgcccca

SEQ ID NO: 6043374 - DNA, 18 bp, Homo sapiens
ccaggacacctgccccag

SEQ ID NO: 6043375 - DNA, 22 bp, Homo sapiens
ccaggacacctgccccagcgcg

SEQ ID NO: 6043376 - DNA, 18 bp, Homo sapiens
ccaggacactaccctgag

SEQ ID NO: 6043377 - DNA, 14 bp, Homo sapiens
ccaggacactgcct

SEQ ID NO: 6043378 - DNA, 21 bp, Homo sapiens
ccaggacactgcctttgctgc

SEQ ID NO: 6043379 - DNA, 22 bp, Homo sapiens
ccaggacactgcctttgctgcc

SEQ ID NO: 6043380 - DNA, 14 bp, Homo sapiens
ccaggacagcacac

SEQ ID NO: 6043381 - DNA, 13 bp, Homo sapiens
ccaggacagcagc

SEQ ID NO: 6043382 - DNA, 14 bp, Homo sapiens
ccaggacagcagca

SEQ ID NO: 6043383 - DNA, 15 bp, Homo sapiens
ccaggacagcagcac

SEQ ID NO: 6043384 - DNA, 17 bp, Homo sapiens
ccaggacagcagcactc

SEQ ID NO: 6043385 - DNA, 18 bp, Homo sapiens
ccaggacagcagcactcc

SEQ ID NO: 6043386 - DNA, 13 bp, Homo sapiens
ccaggacagctgc

SEQ ID NO: 6043387 - DNA, 14 bp, Homo sapiens
ccaggacagctgca

SEQ ID NO: 6043388 - DNA, 22 bp, Homo sapiens
ccaggacagctgcaggtgccca

SEQ ID NO: 6043389 - DNA, 14 bp, Homo sapiens
ccaggacagctggc

SEQ ID NO: 6043390 - DNA, 15 bp, Homo sapiens
ccaggacagctggct

SEQ ID NO: 6043391 - DNA, 18 bp, Homo sapiens
ccaggacagctggctgct

SEQ ID NO: 6043392 - DNA, 21 bp, Homo sapiens
ccaggacagctggctgctgac

SEQ ID NO: 6043393 - DNA, 14 bp, Homo sapiens
ccaggacaggcccg

SEQ ID NO: 6043394 - DNA, 14 bp, Homo sapiens
ccaggacagtttat

SEQ ID NO: 6043395 - DNA, 15 bp, Homo sapiens
ccaggacatctcctg

SEQ ID NO: 6043396 - DNA, 16 bp, Homo sapiens
ccaggacatctcctgg

SEQ ID NO: 6043397 - DNA, 17 bp, Homo sapiens
ccaggacatctctgccc

SEQ ID NO: 6043398 - DNA, 20 bp, Homo sapiens
ccaggacatgcaataaaatt

SEQ ID NO: 6043399 - DNA, 21 bp, Homo sapiens
ccaggaccaagcttaaggaga

SEQ ID NO: 6043400 - DNA, 17 bp, Homo sapiens
ccaggaccaagggcaga

SEQ ID NO: 6043401 - DNA, 15 bp, Homo sapiens
ccaggaccacacagt

SEQ ID NO: 6043402 - DNA, 14 bp, Homo sapiens
catggagcagcccc

SEQ ID NO: 6043403 - DNA, 16 bp, Homo sapiens
catggagcagccccca

SEQ ID NO: 6043404 - DNA, 18 bp, Homo sapiens
catggagcagcccccaaa

SEQ ID NO: 6043405 - DNA, 16 bp, Homo sapiens
catggagccccagccc

SEQ ID NO: 6043406 - DNA, 13 bp, Homo sapiens
catggagcctgga

SEQ ID NO: 6043407 - DNA, 13 bp, Homo sapiens
catggagctgagg

SEQ ID NO: 6043408 - DNA, 13 bp, Homo sapiens
catggagctggcc

SEQ ID NO: 6043409 - DNA, 18 bp, Homo sapiens
catggagctgtcacctct

SEQ ID NO: 6043410 - DNA, 15 bp, Homo sapiens
catggagctgtcatc

SEQ ID NO: 6043411 - DNA, 14 bp, Homo sapiens
catggaggactctc

SEQ ID NO: 6043412 - DNA, 17 bp, Homo sapiens
catggaggagacaggaa

SEQ ID NO: 6043413 - DNA, 23 bp, Homo sapiens
catggaggagacaggaagcctca

SEQ ID NO: 6043414 - DNA, 22 bp, Homo sapiens
catggaggagacgtccaccctg

SEQ ID NO: 6043415 - DNA, 19 bp, Homo sapiens
catggaggaggagggaggc

SEQ ID NO: 6043416 - DNA, 21 bp, Homo sapiens
catggaggaggtgtcccaagc

SEQ ID NO: 6043417 - DNA, 16 bp, Homo sapiens
catggaggcactgaag

SEQ ID NO: 6043418 - DNA, 18 bp, Homo sapiens
catggaggcactgaagcc

SEQ ID NO: 6043419 - DNA, 22 bp, Homo sapiens
catggaggcagatgcccttgct

SEQ ID NO: 6043420 - DNA, 23 bp, Homo sapiens
catggaggcagatgcccttgctg

SEQ ID NO: 6043421 - DNA, 16 bp, Homo sapiens
catggaggcaggctcc

SEQ ID NO: 6043422 - DNA, 17 bp, Homo sapiens
catggaggccctcctgt

SEQ ID NO: 6043423 - DNA, 16 bp, Homo sapiens
catggaggcgccttcc

SEQ ID NO: 6043424 - DNA, 18 bp, Homo sapiens
catggaggcgccttcctg

SEQ ID NO: 6043425 - DNA, 21 bp, Homo sapiens
catggaggcgccttcctgggt

SEQ ID NO: 6043426 - DNA, 22 bp, Homo sapiens
catggagggagggagtggtttg

SEQ ID NO: 6043427 - DNA, 16 bp, Homo sapiens
catggaggttctaagg

SEQ ID NO: 6043428 - DNA, 16 bp, Homo sapiens
catggagtagcctgga

SEQ ID NO: 6043429 - DNA, 18 bp, Homo sapiens
catggagtagcctggact

SEQ ID NO: 6043430 - DNA, 14 bp, Homo sapiens
catggagtgagcag

SEQ ID NO: 6043431 - DNA, 18 bp, Homo sapiens
catggagtgcttctggaa

SEQ ID NO: 6043432 - DNA, 22 bp, Homo sapiens
catggagtggcagcccagccag

SEQ ID NO: 6043433 - DNA, 20 bp, Homo sapiens
catggatatccacgcagcag

SEQ ID NO: 6043434 - DNA, 22 bp, Homo sapiens
catggatatgttatactgaacc

SEQ ID NO: 6043435 - DNA, 23 bp, Homo sapiens
catggatatgttgtattaactgg

SEQ ID NO: 6043436 - DNA, 14 bp, Homo sapiens
catggatcctggat

SEQ ID NO: 6043437 - DNA, 14 bp, Homo sapiens
catggatcttgctg

SEQ ID NO: 6043438 - DNA, 22 bp, Homo sapiens
catggatgaattttccagacct

SEQ ID NO: 6043439 - DNA, 15 bp, Homo sapiens
catggatgagagtcc

SEQ ID NO: 6043440 - DNA, 22 bp, Homo sapiens
catggatgagtaaactgtttct

SEQ ID NO: 6043441 - DNA, 20 bp, Homo sapiens
catggatgcacgcacatgcc

SEQ ID NO: 6043442 - DNA, 16 bp, Homo sapiens
catggatgcatgccct

SEQ ID NO: 6043443 - DNA, 15 bp, Homo sapiens
catggatgcatttca

SEQ ID NO: 6043444 - DNA, 16 bp, Homo sapiens
catggatgcatttcaa

SEQ ID NO: 6043445 - DNA, 17 bp, Homo sapiens
catggatgcgaggacca

SEQ ID NO: 6043446 - DNA, 22 bp, Homo sapiens
catggattaatagagttggagt

SEQ ID NO: 6043447 - DNA, 23 bp, Homo sapiens
catggattaatagagttggagtt

SEQ ID NO: 6043448 - DNA, 21 bp, Homo sapiens
catggattatttatgagagct

SEQ ID NO: 6043449 - DNA, 16 bp, Homo sapiens
catggattgccacagc

SEQ ID NO: 6043450 - DNA, 18 bp, Homo sapiens
catggattgccacagctc

SEQ ID NO: 6043451 - DNA, 15 bp, Homo sapiens
catggattgtacata

SEQ ID NO: 6043452 - DNA, 16 bp, Homo sapiens
catggatttccactgc

SEQ ID NO: 6043453 - DNA, 17 bp, Homo sapiens
catggatttccactgct

SEQ ID NO: 6043454 - DNA, 16 bp, Homo sapiens
catggatttgatgaaa

SEQ ID NO: 6043455 - DNA, 13 bp, Homo sapiens
catggatttggtt

SEQ ID NO: 6043456 - DNA, 20 bp, Homo sapiens
catggattttggataaatca

SEQ ID NO: 6043457 - DNA, 22 bp, Homo sapiens
catggatttttacaagatccat

SEQ ID NO: 6043458 - DNA, 23 bp, Homo sapiens
catggatttttacaagatccatt

SEQ ID NO: 6043459 - DNA, 16 bp, Homo sapiens
catggcaaatcagggg

SEQ ID NO: 6043460 - DNA, 22 bp, Homo sapiens
catggcaaatcaggggccagag

SEQ ID NO: 6043461 - DNA, 17 bp, Homo sapiens
catggcaaatcctgtcg

SEQ ID NO: 6043462 - DNA, 21 bp, Homo sapiens
catggcaacccctaagaatag

SEQ ID NO: 6043463 - DNA, 19 bp, Homo sapiens
catggcaagagagaaagaa

SEQ ID NO: 6043464 - DNA, 18 bp, Homo sapiens
catggcaagtggggctgg

SEQ ID NO: 6043465 - DNA, 20 bp, Homo sapiens
catggcaatgaaaattttaa

SEQ ID NO: 6043466 - DNA, 19 bp, Homo sapiens
catggcaattctggaagct

SEQ ID NO: 6043467 - DNA, 17 bp, Homo sapiens
catggcaattgcactca

SEQ ID NO: 6043468 - DNA, 18 bp, Homo sapiens
catggcaattgcactcat

SEQ ID NO: 6043469 - DNA, 19 bp, Homo sapiens
catggcaccaaagccacca

SEQ ID NO: 6043470 - DNA, 19 bp, Homo sapiens
catggcacctttgagagag

SEQ ID NO: 6043471 - DNA, 20 bp, Homo sapiens
catggcacctttgagagagg

SEQ ID NO: 6043472 - DNA, 13 bp, Homo sapiens
catggcactccct

SEQ ID NO: 6043473 - DNA, 18 bp, Homo sapiens
catggcactccctccagc

SEQ ID NO: 6043474 - DNA, 20 bp, Homo sapiens
catggcactccctccagcac

SEQ ID NO: 6043475 - DNA, 22 bp, Homo sapiens
catggcactccctccagcacaa

SEQ ID NO: 6043476 - DNA, 16 bp, Homo sapiens
catggcacttgcatct

SEQ ID NO: 6043477 - DNA, 21 bp, Homo sapiens
catggcagaaagggggcatct

SEQ ID NO: 6043478 - DNA, 21 bp, Homo sapiens
catggcagaataatctttggg

SEQ ID NO: 6043479 - DNA, 14 bp, Homo sapiens
catggcagatgatt

SEQ ID NO: 6043480 - DNA, 14 bp, Homo sapiens
catggcagcagcca

SEQ ID NO: 6043481 - DNA, 16 bp, Homo sapiens
catggcagcagccagg

SEQ ID NO: 6043482 - DNA, 21 bp, Homo sapiens
catggcagcagccagggaccc

SEQ ID NO: 6043483 - DNA, 15 bp, Homo sapiens
catggcagccctcgg

SEQ ID NO: 6043484 - DNA, 13 bp, Homo sapiens
catggcagctggg

SEQ ID NO: 6043485 - DNA, 15 bp, Homo sapiens
catggcagctgggcc

SEQ ID NO: 6043486 - DNA, 16 bp, Homo sapiens
catggcagctgggccc

SEQ ID NO: 6043487 - DNA, 17 bp, Homo sapiens
catggcagctgggccca

SEQ ID NO: 6043488 - DNA, 18 bp, Homo sapiens
catggcagctgggcccac

SEQ ID NO: 6043489 - DNA, 20 bp, Homo sapiens
catggcagctgggcccacag

SEQ ID NO: 6043490 - DNA, 22 bp, Homo sapiens
catggcagctgggcccacagcc

SEQ ID NO: 6043491 - DNA, 23 bp, Homo sapiens
catggcagctgggcccacagccc

SEQ ID NO: 6043492 - DNA, 23 bp, Homo sapiens
catggcagctggttgctccattt

SEQ ID NO: 6043493 - DNA, 12 bp, Homo sapiens
catggcagctgt

SEQ ID NO: 6043494 - DNA, 19 bp, Homo sapiens
catggcagctgtttctcat

SEQ ID NO: 6043495 - DNA, 14 bp, Homo sapiens
catggcaggaaggc

SEQ ID NO: 6043496 - DNA, 17 bp, Homo sapiens
catggcaggctgggtga

SEQ ID NO: 6043497 - DNA, 22 bp, Homo sapiens
catggcagggcctcatctcacc

SEQ ID NO: 6043498 - DNA, 14 bp, Homo sapiens
catggcagtgcctg

SEQ ID NO: 6043499 - DNA, 17 bp, Homo sapiens
catggcatagccccggc

SEQ ID NO: 6043500 - DNA, 13 bp, Homo sapiens
catggcatatttt

SEQ ID NO: 6043501 - DNA, 17 bp, Homo sapiens
catggcatattttaatc

SEQ ID NO: 6043502 - DNA, 21 bp, Homo sapiens
catggcatcatccattctctc

SEQ ID NO: 6043503 - DNA, 22 bp, Homo sapiens
catggcatcatccattctctct

SEQ ID NO: 6043504 - DNA, 15 bp, Homo sapiens
catggcatccaagac

SEQ ID NO: 6043505 - DNA, 17 bp, Homo sapiens
catggcatccctttttc

SEQ ID NO: 6043506 - DNA, 23 bp, Homo sapiens
catggcatccctttttcataaat

SEQ ID NO: 6043507 - DNA, 21 bp, Homo sapiens
catggcatcttcgtcttcact

SEQ ID NO: 6043508 - DNA, 23 bp, Homo sapiens
catggcatgttttgtcattgttt

SEQ ID NO: 6043509 - DNA, 21 bp, Homo sapiens
catggccaaggggccagctgc

SEQ ID NO: 6043510 - DNA, 22 bp, Homo sapiens
catggccacaaagggacacaca

SEQ ID NO: 6043511 - DNA, 14 bp, Homo sapiens
catggccacactgt

SEQ ID NO: 6043512 - DNA, 19 bp, Homo sapiens
catggccacactgtgacac

SEQ ID NO: 6043513 - DNA, 20 bp, Homo sapiens
catggccacactgtgacaca

SEQ ID NO: 6043514 - DNA, 16 bp, Homo sapiens
catggccacagccacc

SEQ ID NO: 6043515 - DNA, 17 bp, Homo sapiens
catggccacagccacct

SEQ ID NO: 6043516 - DNA, 22 bp, Homo sapiens
catggccacatcctcatggccc

SEQ ID NO: 6043517 - DNA, 22 bp, Homo sapiens
catggccacttgggtcttccct

SEQ ID NO: 6043518 - DNA, 17 bp, Homo sapiens
catggccagactccctt

SEQ ID NO: 6043519 - DNA, 15 bp, Homo sapiens
catggccagcaaata

SEQ ID NO: 6043520 - DNA, 22 bp, Homo sapiens
catggccagcagcacctgccct

SEQ ID NO: 6043521 - DNA, 20 bp, Homo sapiens
catggccagcgcccctcagc

SEQ ID NO: 6043522 - DNA, 13 bp, Homo sapiens
catggccaggtgg

SEQ ID NO: 6043523 - DNA, 19 bp, Homo sapiens
catggccatagaggcccag

SEQ ID NO: 6043524 - DNA, 23 bp, Homo sapiens
catggccatagaggcccaggcac

SEQ ID NO: 6043525 - DNA, 15 bp, Homo sapiens
catggccatttctgt

SEQ ID NO: 6043526 - DNA, 14 bp, Homo sapiens
catggcccagcagc

SEQ ID NO: 6043527 - DNA, 15 bp, Homo sapiens
catggcccagcagct

SEQ ID NO: 6043528 - DNA, 18 bp, Homo sapiens
catggcccagcagcttgg

SEQ ID NO: 6043529 - DNA, 22 bp, Homo sapiens
catggcccagcagcttggctga

SEQ ID NO: 6043530 - DNA, 14 bp, Homo sapiens
catggcccagcctg

SEQ ID NO: 6043531 - DNA, 15 bp, Homo sapiens
catggcccagcctgg

SEQ ID NO: 6043532 - DNA, 16 bp, Homo sapiens
catggcccagcctgga

SEQ ID NO: 6043533 - DNA, 18 bp, Homo sapiens
catggcccagcctggagc

SEQ ID NO: 6043534 - DNA, 19 bp, Homo sapiens
catggcccagcctggagcc

SEQ ID NO: 6043535 - DNA, 17 bp, Homo sapiens
catggcccatcaggggc

SEQ ID NO: 6043536 - DNA, 12 bp, Homo sapiens
catggccccagc

SEQ ID NO: 6043537 - DNA, 18 bp, Homo sapiens
catggccccagctggctg

SEQ ID NO: 6043538 - DNA, 20 bp, Homo sapiens
catggccccatcccagttgg

SEQ ID NO: 6043539 - DNA, 12 bp, Homo sapiens
catggcccccaa

SEQ ID NO: 6043540 - DNA, 14 bp, Homo sapiens
catggcccccaggg

SEQ ID NO: 6043541 - DNA, 15 bp, Homo sapiens
catggccccccactc

SEQ ID NO: 6043542 - DNA, 15 bp, Homo sapiens
catggcccctccagg

SEQ ID NO: 6043543 - DNA, 17 bp, Homo sapiens
catggcccctccaggaa

SEQ ID NO: 6043544 - DNA, 12 bp, Homo sapiens
catggcccctct

SEQ ID NO: 6043545 - DNA, 16 bp, Homo sapiens
catggcccctctgacc

SEQ ID NO: 6043546 - DNA, 18 bp, Homo sapiens
catggcccctctgacctg

SEQ ID NO: 6043547 - DNA, 17 bp, Homo sapiens
catggcccgcagtggct

SEQ ID NO: 6043548 - DNA, 23 bp, Homo sapiens
catggccctcccagtacctcctg

SEQ ID NO: 6043549 - DNA, 15 bp, Homo sapiens
catggccctgagcca

SEQ ID NO: 6043550 - DNA, 15 bp, Homo sapiens
catggccctgagcga

SEQ ID NO: 6043551 - DNA, 17 bp, Homo sapiens
catggccctgagcgagt

SEQ ID NO: 6043552 - DNA, 16 bp, Homo sapiens
catggccctgccatgc

SEQ ID NO: 6043553 - DNA, 14 bp, Homo sapiens
catggccctgctgc

SEQ ID NO: 6043554 - DNA, 20 bp, Homo sapiens
catggccctgctgcccctcc

SEQ ID NO: 6043555 - DNA, 18 bp, Homo sapiens
catggccctgtcccaggc

SEQ ID NO: 6043556 - DNA, 17 bp, Homo sapiens
catggccgcaacttccc

SEQ ID NO: 6043557 - DNA, 23 bp, Homo sapiens
catggccgcgtcacttctctgat

SEQ ID NO: 6043558 - DNA, 16 bp, Homo sapiens
catggccgctgcccac

SEQ ID NO: 6043559 - DNA, 16 bp, Homo sapiens
catggccgcttctaga

SEQ ID NO: 6043560 - DNA, 18 bp, Homo sapiens
catggccggctttcagga

SEQ ID NO: 6043561 - DNA, 14 bp, Homo sapiens
catggccgtgaact

SEQ ID NO: 6043562 - DNA, 21 bp, Homo sapiens
catggccgtgtagaccctaac

SEQ ID NO: 6043563 - DNA, 22 bp, Homo sapiens
catggccgttgcctctctgcca

SEQ ID NO: 6043564 - DNA, 17 bp, Homo sapiens
catggcctatgcacata

SEQ ID NO: 6043565 - DNA, 12 bp, Homo sapiens
catggcctcaga

SEQ ID NO: 6043566 - DNA, 13 bp, Homo sapiens
catggcctcagcc

SEQ ID NO: 6043567 - DNA, 13 bp, Homo sapiens
catggcctcccag

SEQ ID NO: 6043568 - DNA, 13 bp, Homo sapiens
catggcctctgga

SEQ ID NO: 6043569 - DNA, 14 bp, Homo sapiens
catggcctctggaa

SEQ ID NO: 6043570 - DNA, 18 bp, Homo sapiens
catggcctctggccaggc

SEQ ID NO: 6043571 - DNA, 20 bp, Homo sapiens
catggcctcttgaagagaaa

SEQ ID NO: 6043572 - DNA, 20 bp, Homo sapiens
catggcctgagatgcaggtg

SEQ ID NO: 6043573 - DNA, 16 bp, Homo sapiens
catggcctgcaaactg

SEQ ID NO: 6043574 - DNA, 20 bp, Homo sapiens
catggcctgcagtctggcag

SEQ ID NO: 6043575 - DNA, 13 bp, Homo sapiens
catggcctgctgg

SEQ ID NO: 6043576 - DNA, 18 bp, Homo sapiens
catggcctgctgggcttg

SEQ ID NO: 6043577 - DNA, 23 bp, Homo sapiens
catggcctggactgactgcagcc

SEQ ID NO: 6043578 - DNA, 24 bp, Homo sapiens
catggcctggactgactgcagccc

SEQ ID NO: 6043579 - DNA, 23 bp, Homo sapiens
ccaggaccacacagtccccagac

SEQ ID NO: 6043580 - DNA, 10 bp, Homo sapiens
ccaggaccag

SEQ ID NO: 6043581 - DNA, 15 bp, Homo sapiens
ccaggaccagcctgt

SEQ ID NO: 6043582 - DNA, 13 bp, Homo sapiens
ccaggaccagttt

SEQ ID NO: 6043583 - DNA, 20 bp, Homo sapiens
ccaggaccatcctggagggc

SEQ ID NO: 6043584 - DNA, 14 bp, Homo sapiens
ccaggacccagggt

SEQ ID NO: 6043585 - DNA, 17 bp, Homo sapiens
ccaggacccagggtccc

SEQ ID NO: 6043586 - DNA, 19 bp, Homo sapiens
ccaggacccagggtcccct

SEQ ID NO: 6043587 - DNA, 21 bp, Homo sapiens
ccaggacccagggtcccctcc

SEQ ID NO: 6043588 - DNA, 20 bp, Homo sapiens
ccaggacccctcagctcccc

SEQ ID NO: 6043589 - DNA, 16 bp, Homo sapiens
ccaggacccgcctgct

SEQ ID NO: 6043590 - DNA, 17 bp, Homo sapiens
ccaggacccgcctgctc

SEQ ID NO: 6043591 - DNA, 15 bp, Homo sapiens
ccaggaccctccact

SEQ ID NO: 6043592 - DNA, 21 bp, Homo sapiens
ccaggaccctgacctccgccc

SEQ ID NO: 6043593 - DNA, 13 bp, Homo sapiens
ccaggaccctgcc

SEQ ID NO: 6043594 - DNA, 23 bp, Homo sapiens
ccaggaccctgccaggcacaggc

SEQ ID NO: 6043595 - DNA, 19 bp, Homo sapiens
ccaggaccctggacccagc

SEQ ID NO: 6043596 - DNA, 13 bp, Homo sapiens
ccaggaccctggg

SEQ ID NO: 6043597 - DNA, 19 bp, Homo sapiens
ccaggacctcggatgacca

SEQ ID NO: 6043598 - DNA, 12 bp, Homo sapiens
ccaggacctctg

SEQ ID NO: 6043599 - DNA, 13 bp, Homo sapiens
ccaggacctgagc

SEQ ID NO: 6043600 - DNA, 18 bp, Homo sapiens
ccaggacctggagacagg

SEQ ID NO: 6043601 - DNA, 18 bp, Homo sapiens
ccaggacctggctgccat

SEQ ID NO: 6043602 - DNA, 23 bp, Homo sapiens
ccaggaccttgcttccttctcat

SEQ ID NO: 6043603 - DNA, 16 bp, Homo sapiens
ccaggacgaattgaga

SEQ ID NO: 6043604 - DNA, 20 bp, Homo sapiens
ccaggacgcagggagaccct

SEQ ID NO: 6043605 - DNA, 16 bp, Homo sapiens
ccaggacgccactcat

SEQ ID NO: 6043606 - DNA, 21 bp, Homo sapiens
ccaggacgccactcatttcat

SEQ ID NO: 6043607 - DNA, 22 bp, Homo sapiens
ccaggacgccactcatttcatc

SEQ ID NO: 6043608 - DNA, 23 bp, Homo sapiens
ccaggacgccactcatttcatct

SEQ ID NO: 6043609 - DNA, 20 bp, Homo sapiens
ccaggacgcttctgaatgct

SEQ ID NO: 6043610 - DNA, 23 bp, Homo sapiens
ccaggacgcttctgaatgctgct

SEQ ID NO: 6043611 - DNA, 14 bp, Homo sapiens
ccaggacgggccac

SEQ ID NO: 6043612 - DNA, 22 bp, Homo sapiens
ccaggacgggccacacgtggct

SEQ ID NO: 6043613 - DNA, 22 bp, Homo sapiens
ccaggacgtcctatctccccca

SEQ ID NO: 6043614 - DNA, 19 bp, Homo sapiens
ccaggacgtctggggtgtg

SEQ ID NO: 6043615 - DNA, 20 bp, Homo sapiens
ccaggacgtctggggtgtgg

SEQ ID NO: 6043616 - DNA, 20 bp, Homo sapiens
ccaggactaatgcatgtggt

SEQ ID NO: 6043617 - DNA, 20 bp, Homo sapiens
ccaggactatatttgggcct

SEQ ID NO: 6043618 - DNA, 14 bp, Homo sapiens
ccaggactcaggga

SEQ ID NO: 6043619 - DNA, 14 bp, Homo sapiens
ccaggactccactg

SEQ ID NO: 6043620 - DNA, 15 bp, Homo sapiens
ccaggactccactgg

SEQ ID NO: 6043621 - DNA, 17 bp, Homo sapiens
ccaggactccactggac

SEQ ID NO: 6043622 - DNA, 23 bp, Homo sapiens
ccaggactccactggacagaccc

SEQ ID NO: 6043623 - DNA, 14 bp, Homo sapiens
ccaggactccctcc

SEQ ID NO: 6043624 - DNA, 16 bp, Homo sapiens
ccaggactccctcctc

SEQ ID NO: 6043625 - DNA, 22 bp, Homo sapiens
ccaggactccctcctcacctct

SEQ ID NO: 6043626 - DNA, 23 bp, Homo sapiens
ccaggactccctcctcacctctg

SEQ ID NO: 6043627 - DNA, 17 bp, Homo sapiens
ccaggactcctccccac

SEQ ID NO: 6043628 - DNA, 19 bp, Homo sapiens
ccaggactccttagactga

SEQ ID NO: 6043629 - DNA, 13 bp, Homo sapiens
ccaggactctctt

SEQ ID NO: 6043630 - DNA, 18 bp, Homo sapiens
ccaggactctgaccccag

SEQ ID NO: 6043631 - DNA, 22 bp, Homo sapiens
ccaggactctgaccccagcatt

SEQ ID NO: 6043632 - DNA, 18 bp, Homo sapiens
ccaggactctgcagcctc

SEQ ID NO: 6043633 - DNA, 19 bp, Homo sapiens
ccaggactctgcagcctca

SEQ ID NO: 6043634 - DNA, 21 bp, Homo sapiens
ccaggactgagatgcaaatgt

SEQ ID NO: 6043635 - DNA, 15 bp, Homo sapiens
ccaggactgagcccc

SEQ ID NO: 6043636 - DNA, 16 bp, Homo sapiens
ccaggactgagccccg

SEQ ID NO: 6043637 - DNA, 15 bp, Homo sapiens
ccaggactggggctt

SEQ ID NO: 6043638 - DNA, 20 bp, Homo sapiens
ccaggactggggcttgccag

SEQ ID NO: 6043639 - DNA, 14 bp, Homo sapiens
ccaggactgggtct

SEQ ID NO: 6043640 - DNA, 21 bp, Homo sapiens
ccaggactgggtctgacctgg

SEQ ID NO: 6043641 - DNA, 21 bp, Homo sapiens
ccaggacttatttaaactctg

SEQ ID NO: 6043642 - DNA, 15 bp, Homo sapiens
ccaggacttggggtc

SEQ ID NO: 6043643 - DNA, 22 bp, Homo sapiens
ccaggagaaagaaggcttaaca

SEQ ID NO: 6043644 - DNA, 16 bp, Homo sapiens
ccaggagaaagccggg

SEQ ID NO: 6043645 - DNA, 21 bp, Homo sapiens
ccaggagaaatcaacaggagg

SEQ ID NO: 6043646 - DNA, 21 bp, Homo sapiens
ccaggagaaccactacatgca

SEQ ID NO: 6043647 - DNA, 23 bp, Homo sapiens
ccaggagaaccactacatgcagc

SEQ ID NO: 6043648 - DNA, 15 bp, Homo sapiens
ccaggagaagaaaga

SEQ ID NO: 6043649 - DNA, 18 bp, Homo sapiens
ccaggagaagacccctgc

SEQ ID NO: 6043650 - DNA, 19 bp, Homo sapiens
ccaggagaagacccctgcc

SEQ ID NO: 6043651 - DNA, 11 bp, Homo sapiens
ccaggagaagc

SEQ ID NO: 6043652 - DNA, 19 bp, Homo sapiens
ccaggagaaggggcccaag

SEQ ID NO: 6043653 - DNA, 22 bp, Homo sapiens
ccaggagaagggggctctgccc

SEQ ID NO: 6043654 - DNA, 19 bp, Homo sapiens
ccaggagaagtgctccctg

SEQ ID NO: 6043655 - DNA, 20 bp, Homo sapiens
ccaggagaataaaagaaatt

SEQ ID NO: 6043656 - DNA, 18 bp, Homo sapiens
ccaggagacaaacagccc

SEQ ID NO: 6043657 - DNA, 16 bp, Homo sapiens
ccaggagacagacaga

SEQ ID NO: 6043658 - DNA, 17 bp, Homo sapiens
ccaggagacagaccact

SEQ ID NO: 6043659 - DNA, 13 bp, Homo sapiens
ccaggagacaggt

SEQ ID NO: 6043660 - DNA, 15 bp, Homo sapiens
ccaggagacatatat

SEQ ID NO: 6043661 - DNA, 23 bp, Homo sapiens
ccaggagacatatataggggaac

SEQ ID NO: 6043662 - DNA, 12 bp, Homo sapiens
ccaggagaccct

SEQ ID NO: 6043663 - DNA, 16 bp, Homo sapiens
ccaggagaccctgtct

SEQ ID NO: 6043664 - DNA, 12 bp, Homo sapiens
ccaggagagaga

SEQ ID NO: 6043665 - DNA, 21 bp, Homo sapiens
ccaggagagagaaagccaggc

SEQ ID NO: 6043666 - DNA, 18 bp, Homo sapiens
ccaggagagccagccctc

SEQ ID NO: 6043667 - DNA, 20 bp, Homo sapiens
ccaggagagccagccctccc

SEQ ID NO: 6043668 - DNA, 22 bp, Homo sapiens
ccaggagagcccccaccagcag

SEQ ID NO: 6043669 - DNA, 24 bp, Homo sapiens
ccaggagagcccccaccagcagca

SEQ ID NO: 6043670 - DNA, 14 bp, Homo sapiens
ccaggagagcctgg

SEQ ID NO: 6043671 - DNA, 16 bp, Homo sapiens
ccaggagagcctgggg

SEQ ID NO: 6043672 - DNA, 21 bp, Homo sapiens
ccaggagagcttagggtctca

SEQ ID NO: 6043673 - DNA, 22 bp, Homo sapiens
ccaggagagcttagggtctcag

SEQ ID NO: 6043674 - DNA, 21 bp, Homo sapiens
ccaggagaggagcgggacctg

SEQ ID NO: 6043675 - DNA, 13 bp, Homo sapiens
ccaggagataatt

SEQ ID NO: 6043676 - DNA, 18 bp, Homo sapiens
ccaggagcaaatgctgga

SEQ ID NO: 6043677 - DNA, 19 bp, Homo sapiens
ccaggagcaaccgtgcagc

SEQ ID NO: 6043678 - DNA, 19 bp, Homo sapiens
ccaggagcaatgggactgg

SEQ ID NO: 6043679 - DNA, 23 bp, Homo sapiens
ccaggagcaatgggactggagtc

SEQ ID NO: 6043680 - DNA, 20 bp, Homo sapiens
ccaggagcacacggccctgc

SEQ ID NO: 6043681 - DNA, 18 bp, Homo sapiens
ccaggagcacggctctgt

SEQ ID NO: 6043682 - DNA, 23 bp, Homo sapiens
ccaggagcagcagccagcaccac

SEQ ID NO: 6043683 - DNA, 15 bp, Homo sapiens
ccaggagcagccaca

SEQ ID NO: 6043684 - DNA, 14 bp, Homo sapiens
ccaggagcagccct

SEQ ID NO: 6043685 - DNA, 20 bp, Homo sapiens
ccaggagcagccctggcccc

SEQ ID NO: 6043686 - DNA, 18 bp, Homo sapiens
ccaggagcagcctccaag

SEQ ID NO: 6043687 - DNA, 17 bp, Homo sapiens
ccaggagcagctggcac

SEQ ID NO: 6043688 - DNA, 16 bp, Homo sapiens
ccaggagcaggcacgg

SEQ ID NO: 6043689 - DNA, 21 bp, Homo sapiens
ccaggagcatagaagccacat

SEQ ID NO: 6043690 - DNA, 18 bp, Homo sapiens
ccaggagcattttgtgtc

SEQ ID NO: 6043691 - DNA, 15 bp, Homo sapiens
ccaggagcccagagg

SEQ ID NO: 6043692 - DNA, 12 bp, Homo sapiens
ccaggagcccat

SEQ ID NO: 6043693 - DNA, 14 bp, Homo sapiens
ccaggagccccagc

SEQ ID NO: 6043694 - DNA, 18 bp, Homo sapiens
ccaggagccccagccagc

SEQ ID NO: 6043695 - DNA, 16 bp, Homo sapiens
ccaggagcccgtcagg

SEQ ID NO: 6043696 - DNA, 24 bp, Homo sapiens
ccaggagcccgtcaggccacagcc

SEQ ID NO: 6043697 - DNA, 16 bp, Homo sapiens
ccaggagccctggccc

SEQ ID NO: 6043698 - DNA, 18 bp, Homo sapiens
ccaggagcctaccccctg

SEQ ID NO: 6043699 - DNA, 20 bp, Homo sapiens
ccaggagcctaccccctgaa

SEQ ID NO: 6043700 - DNA, 20 bp, Homo sapiens
ccaggagcctcatccagcct

SEQ ID NO: 6043701 - DNA, 23 bp, Homo sapiens
ccaggagcctcatccagcctcag

SEQ ID NO: 6043702 - DNA, 13 bp, Homo sapiens
ccaggagcctcct

SEQ ID NO: 6043703 - DNA, 19 bp, Homo sapiens
ccaggagcctcctgaccct

SEQ ID NO: 6043704 - DNA, 22 bp, Homo sapiens
ccaggagcctcctgaccctgtg

SEQ ID NO: 6043705 - DNA, 18 bp, Homo sapiens
ccaggagcctcctgccct

SEQ ID NO: 6043706 - DNA, 17 bp, Homo sapiens
ccaggagcctgcccagc

SEQ ID NO: 6043707 - DNA, 14 bp, Homo sapiens
ccaggagcgcagct

SEQ ID NO: 6043708 - DNA, 16 bp, Homo sapiens
ccaggagctagcccag

SEQ ID NO: 6043709 - DNA, 21 bp, Homo sapiens
ccaggagctagcccagtccct

SEQ ID NO: 6043710 - DNA, 14 bp, Homo sapiens
ccaggagctcagcc

SEQ ID NO: 6043711 - DNA, 12 bp, Homo sapiens
ccaggagctcca

SEQ ID NO: 6043712 - DNA, 13 bp, Homo sapiens
ccaggagctccag

SEQ ID NO: 6043713 - DNA, 21 bp, Homo sapiens
ccaggagctccagtgtcctga

SEQ ID NO: 6043714 - DNA, 23 bp, Homo sapiens
ccaggagctccagtgtcctgagc

SEQ ID NO: 6043715 - DNA, 13 bp, Homo sapiens
ccaggagctctct

SEQ ID NO: 6043716 - DNA, 14 bp, Homo sapiens
ccaggagctctctg

SEQ ID NO: 6043717 - DNA, 17 bp, Homo sapiens
ccaggagctctctgctg

SEQ ID NO: 6043718 - DNA, 23 bp, Homo sapiens
ccaggagctctctgctgagcagc

SEQ ID NO: 6043719 - DNA, 15 bp, Homo sapiens
ccaggagctctgcgc

SEQ ID NO: 6043720 - DNA, 23 bp, Homo sapiens
ccaggagctctgcgccaggcaga

SEQ ID NO: 6043721 - DNA, 20 bp, Homo sapiens
ccaggagctgagtcacctcc

SEQ ID NO: 6043722 - DNA, 15 bp, Homo sapiens
ccaggagctggagga

SEQ ID NO: 6043723 - DNA, 21 bp, Homo sapiens
ccaggagctgggcagaaggcc

SEQ ID NO: 6043724 - DNA, 21 bp, Homo sapiens
ccaggagcttcttgtttcctt

SEQ ID NO: 6043725 - DNA, 22 bp, Homo sapiens
ccaggaggaaactacaccacac

SEQ ID NO: 6043726 - DNA, 15 bp, Homo sapiens
ccaggaggacccagg

SEQ ID NO: 6043727 - DNA, 19 bp, Homo sapiens
ccaggaggacccagggctc

SEQ ID NO: 6043728 - DNA, 20 bp, Homo sapiens
ccaggaggacccagggctct

SEQ ID NO: 6043729 - DNA, 20 bp, Homo sapiens
ccaggaggaccgcctgccct

SEQ ID NO: 6043730 - DNA, 13 bp, Homo sapiens
ccaggaggacctg

SEQ ID NO: 6043731 - DNA, 22 bp, Homo sapiens
ccaggaggagaccctcccctgc

SEQ ID NO: 6043732 - DNA, 19 bp, Homo sapiens
ccaggaggagttagccaaa

SEQ ID NO: 6043733 - DNA, 16 bp, Homo sapiens
ccaggaggcagctcag

SEQ ID NO: 6043734 - DNA, 15 bp, Homo sapiens
ccaggaggcagtgga

SEQ ID NO: 6043735 - DNA, 19 bp, Homo sapiens
ccaggaggcagtggacatc

SEQ ID NO: 6043736 - DNA, 12 bp, Homo sapiens
ccaggaggccag

SEQ ID NO: 6043737 - DNA, 20 bp, Homo sapiens
ccaggaggccagccttgacc

SEQ ID NO: 6043738 - DNA, 16 bp, Homo sapiens
ccaggaggcctgcacc

SEQ ID NO: 6043739 - DNA, 17 bp, Homo sapiens
ccaggaggcctgggaga

SEQ ID NO: 6043740 - DNA, 14 bp, Homo sapiens
ccaggaggcggcag

SEQ ID NO: 6043741 - DNA, 15 bp, Homo sapiens
ccaggaggctggcag

SEQ ID NO: 6043742 - DNA, 20 bp, Homo sapiens
ccaggaggctggcagtacag

SEQ ID NO: 6043743 - DNA, 21 bp, Homo sapiens
ccaggaggctggcagtacaga

SEQ ID NO: 6043744 - DNA, 21 bp, Homo sapiens
ccaggaggctttaagctccag

SEQ ID NO: 6043745 - DNA, 21 bp, Homo sapiens
ccaggagggacaaaggagcct

SEQ ID NO: 6043746 - DNA, 20 bp, Homo sapiens
ccaggagggagagcctctgt

SEQ ID NO: 6043747 - DNA, 17 bp, Homo sapiens
ccaggagggagcagagg

SEQ ID NO: 6043748 - DNA, 21 bp, Homo sapiens
ccaggagggaggcaggggagg

SEQ ID NO: 6043749 - DNA, 22 bp, Homo sapiens
ccaggagggaggcaggggaggg

SEQ ID NO: 6043750 - DNA, 15 bp, Homo sapiens
ccaggagggcacagc

SEQ ID NO: 6043751 - DNA, 23 bp, Homo sapiens
ccaggagggcacagcaggggagc

SEQ ID NO: 6043752 - DNA, 18 bp, Homo sapiens
ccaggagggcatccatac

SEQ ID NO: 6043753 - DNA, 17 bp, Homo sapiens
ccaggaggggaacactg

SEQ ID NO: 6043754 - DNA, 14 bp, Homo sapiens
ccaggaggggcctc

SEQ ID NO: 6043755 - DNA, 12 bp, Homo sapiens
catggcctttct

SEQ ID NO: 6043756 - DNA, 22 bp, Homo sapiens
catggcctttgcttgaaagaaa

SEQ ID NO: 6043757 - DNA, 20 bp, Homo sapiens
catggcgagatactgcatgt

SEQ ID NO: 6043758 - DNA, 20 bp, Homo sapiens
catggcgccctgcctcctgg

SEQ ID NO: 6043759 - DNA, 22 bp, Homo sapiens
catggcgccctgcctcctggag

SEQ ID NO: 6043760 - DNA, 13 bp, Homo sapiens
catggcggcccct

SEQ ID NO: 6043761 - DNA, 14 bp, Homo sapiens
catggcgggactgg

SEQ ID NO: 6043762 - DNA, 23 bp, Homo sapiens
catggcgtaatgggcctgcccaa

SEQ ID NO: 6043763 - DNA, 19 bp, Homo sapiens
catggcgtgtccctctcgg

SEQ ID NO: 6043764 - DNA, 14 bp, Homo sapiens
catggctaactggc

SEQ ID NO: 6043765 - DNA, 16 bp, Homo sapiens
catggctaactggcga

SEQ ID NO: 6043766 - DNA, 16 bp, Homo sapiens
catggctaagctttat

SEQ ID NO: 6043767 - DNA, 19 bp, Homo sapiens
catggctacctcagaaaga

SEQ ID NO: 6043768 - DNA, 18 bp, Homo sapiens
catggctacttgctttga

SEQ ID NO: 6043769 - DNA, 18 bp, Homo sapiens
catggctagcctttcttg

SEQ ID NO: 6043770 - DNA, 15 bp, Homo sapiens
catggctcagagctt

SEQ ID NO: 6043771 - DNA, 22 bp, Homo sapiens
catggctcagatcggccacagg

SEQ ID NO: 6043772 - DNA, 17 bp, Homo sapiens
catggctcaggcaagcc

SEQ ID NO: 6043773 - DNA, 16 bp, Homo sapiens
catggctcagggtggt

SEQ ID NO: 6043774 - DNA, 14 bp, Homo sapiens
catggctccagtct

SEQ ID NO: 6043775 - DNA, 16 bp, Homo sapiens
catggctccggcctct

SEQ ID NO: 6043776 - DNA, 14 bp, Homo sapiens
catggctctatttc

SEQ ID NO: 6043777 - DNA, 17 bp, Homo sapiens
catggctctgaactgca

SEQ ID NO: 6043778 - DNA, 13 bp, Homo sapiens
catggctctgggc

SEQ ID NO: 6043779 - DNA, 19 bp, Homo sapiens
catggctgaagctggagca

SEQ ID NO: 6043780 - DNA, 16 bp, Homo sapiens
catggctgaagttggc

SEQ ID NO: 6043781 - DNA, 18 bp, Homo sapiens
catggctgaagttggcca

SEQ ID NO: 6043782 - DNA, 15 bp, Homo sapiens
catggctgagagggt

SEQ ID NO: 6043783 - DNA, 20 bp, Homo sapiens
catggctgagctgcccacag

SEQ ID NO: 6043784 - DNA, 18 bp, Homo sapiens
catggctggatgtgcatc

SEQ ID NO: 6043785 - DNA, 14 bp, Homo sapiens
catggctggcagag

SEQ ID NO: 6043786 - DNA, 13 bp, Homo sapiens
catggctggcctg

SEQ ID NO: 6043787 - DNA, 14 bp, Homo sapiens
catggctggcctgg

SEQ ID NO: 6043788 - DNA, 16 bp, Homo sapiens
catggctggcctggta

SEQ ID NO: 6043789 - DNA, 22 bp, Homo sapiens
catggctgggaacatgacccag

SEQ ID NO: 6043790 - DNA, 24 bp, Homo sapiens
catggctgggaactgcagacctgt

SEQ ID NO: 6043791 - DNA, 18 bp, Homo sapiens
catggctgggggagggac

SEQ ID NO: 6043792 - DNA, 23 bp, Homo sapiens
catggctgggggagggactgctg

SEQ ID NO: 6043793 - DNA, 12 bp, Homo sapiens
catggctggggt

SEQ ID NO: 6043794 - DNA, 15 bp, Homo sapiens
catggctggtgcctg

SEQ ID NO: 6043795 - DNA, 17 bp, Homo sapiens
catggctgtcccctgca

SEQ ID NO: 6043796 - DNA, 18 bp, Homo sapiens
catggctgtcccctgcaa

SEQ ID NO: 6043797 - DNA, 21 bp, Homo sapiens
catggctgtcccctgcaagtg

SEQ ID NO: 6043798 - DNA, 14 bp, Homo sapiens
catggctgtctgca

SEQ ID NO: 6043799 - DNA, 21 bp, Homo sapiens
catggctgtgacacagacgga

SEQ ID NO: 6043800 - DNA, 12 bp, Homo sapiens
catggctgtgtt

SEQ ID NO: 6043801 - DNA, 21 bp, Homo sapiens
catggctgttatctgtcttta

SEQ ID NO: 6043802 - DNA, 15 bp, Homo sapiens
catggcttaatgttt

SEQ ID NO: 6043803 - DNA, 16 bp, Homo sapiens
catggcttcctaaatg

SEQ ID NO: 6043804 - DNA, 20 bp, Homo sapiens
catggcttctcctttggcat

SEQ ID NO: 6043805 - DNA, 15 bp, Homo sapiens
catggcttgccacag

SEQ ID NO: 6043806 - DNA, 18 bp, Homo sapiens
catggcttgccacagctc

SEQ ID NO: 6043807 - DNA, 19 bp, Homo sapiens
catggcttggggagcagag

SEQ ID NO: 6043808 - DNA, 19 bp, Homo sapiens
catggcttgttctctggaa

SEQ ID NO: 6043809 - DNA, 17 bp, Homo sapiens
catggctttcatcctgt

SEQ ID NO: 6043810 - DNA, 18 bp, Homo sapiens
catggctttcatcctgtg

SEQ ID NO: 6043811 - DNA, 21 bp, Homo sapiens
catggctttcatcctgtgtcc

SEQ ID NO: 6043812 - DNA, 19 bp, Homo sapiens
catggcttttgctttccct

SEQ ID NO: 6043813 - DNA, 23 bp, Homo sapiens
catgggaaactgttgtgggcgct

SEQ ID NO: 6043814 - DNA, 21 bp, Homo sapiens
catgggaaaggaggcatgcct

SEQ ID NO: 6043815 - DNA, 22 bp, Homo sapiens
catgggaaaggaggcatgcctc

SEQ ID NO: 6043816 - DNA, 20 bp, Homo sapiens
catgggaaatagcggccctg

SEQ ID NO: 6043817 - DNA, 21 bp, Homo sapiens
catgggaagatgtctcagagc

SEQ ID NO: 6043818 - DNA, 22 bp, Homo sapiens
catgggaagatgtctcagagcc

SEQ ID NO: 6043819 - DNA, 13 bp, Homo sapiens
catgggaagggga

SEQ ID NO: 6043820 - DNA, 14 bp, Homo sapiens
catgggaaggggag

SEQ ID NO: 6043821 - DNA, 17 bp, Homo sapiens
catgggaaggggaggac

SEQ ID NO: 6043822 - DNA, 20 bp, Homo sapiens
catgggaatacaaaaggttt

SEQ ID NO: 6043823 - DNA, 19 bp, Homo sapiens
catgggaatgatagcccag

SEQ ID NO: 6043824 - DNA, 17 bp, Homo sapiens
catgggacagggaggac

SEQ ID NO: 6043825 - DNA, 23 bp, Homo sapiens
catgggacagggaggacgctctc

SEQ ID NO: 6043826 - DNA, 19 bp, Homo sapiens
catgggacctcctccctca

SEQ ID NO: 6043827 - DNA, 18 bp, Homo sapiens
catgggactttccttccc

SEQ ID NO: 6043828 - DNA, 13 bp, Homo sapiens
catgggagaacct

SEQ ID NO: 6043829 - DNA, 18 bp, Homo sapiens
catgggagagtccaggcc

SEQ ID NO: 6043830 - DNA, 19 bp, Homo sapiens
catgggagagtccaggcct

SEQ ID NO: 6043831 - DNA, 15 bp, Homo sapiens
catgggagcaaatat

SEQ ID NO: 6043832 - DNA, 15 bp, Homo sapiens
catgggagcagtcca

SEQ ID NO: 6043833 - DNA, 13 bp, Homo sapiens
catgggagccggg

SEQ ID NO: 6043834 - DNA, 22 bp, Homo sapiens
catgggagccgggtctgcctct

SEQ ID NO: 6043835 - DNA, 13 bp, Homo sapiens
catgggaggaaga

SEQ ID NO: 6043836 - DNA, 19 bp, Homo sapiens
catgggaggcctttcccta

SEQ ID NO: 6043837 - DNA, 14 bp, Homo sapiens
catgggaggctcac

SEQ ID NO: 6043838 - DNA, 18 bp, Homo sapiens
catgggagggatcagccc

SEQ ID NO: 6043839 - DNA, 20 bp, Homo sapiens
catgggagggatcagccccg

SEQ ID NO: 6043840 - DNA, 14 bp, Homo sapiens
catgggagggggct

SEQ ID NO: 6043841 - DNA, 23 bp, Homo sapiens
catgggaggtgaggattccaaaa

SEQ ID NO: 6043842 - DNA, 20 bp, Homo sapiens
catgggagtaagttcttcaa

SEQ ID NO: 6043843 - DNA, 22 bp, Homo sapiens
catgggagtcagggagccctgg

SEQ ID NO: 6043844 - DNA, 23 bp, Homo sapiens
catgggagtcagggagccctggg

SEQ ID NO: 6043845 - DNA, 15 bp, Homo sapiens
catgggagtggggag

SEQ ID NO: 6043846 - DNA, 16 bp, Homo sapiens
catgggagtggggagc

SEQ ID NO: 6043847 - DNA, 17 bp, Homo sapiens
catgggataaatgccat

SEQ ID NO: 6043848 - DNA, 18 bp, Homo sapiens
catgggatgtctgaaatc

SEQ ID NO: 6043849 - DNA, 19 bp, Homo sapiens
catgggcacaaagggccca

SEQ ID NO: 6043850 - DNA, 17 bp, Homo sapiens
catgggcactgctgggt

SEQ ID NO: 6043851 - DNA, 20 bp, Homo sapiens
catgggcatctatgggagag

SEQ ID NO: 6043852 - DNA, 14 bp, Homo sapiens
catgggcatggccg

SEQ ID NO: 6043853 - DNA, 12 bp, Homo sapiens
catgggccagcc

SEQ ID NO: 6043854 - DNA, 15 bp, Homo sapiens
catgggccagcccct

SEQ ID NO: 6043855 - DNA, 16 bp, Homo sapiens
catgggccagcccctc

SEQ ID NO: 6043856 - DNA, 14 bp, Homo sapiens
catgggccagccct

SEQ ID NO: 6043857 - DNA, 16 bp, Homo sapiens
catgggccagcctagc

SEQ ID NO: 6043858 - DNA, 17 bp, Homo sapiens
catgggcccaggaatgc

SEQ ID NO: 6043859 - DNA, 18 bp, Homo sapiens
catgggccccaccattta

SEQ ID NO: 6043860 - DNA, 19 bp, Homo sapiens
catgggccccccatgcata

SEQ ID NO: 6043861 - DNA, 16 bp, Homo sapiens
catgggcccctctgac

SEQ ID NO: 6043862 - DNA, 16 bp, Homo sapiens
catgggcccgctgcct

SEQ ID NO: 6043863 - DNA, 19 bp, Homo sapiens
catgggcccgctgcctctt

SEQ ID NO: 6043864 - DNA, 13 bp, Homo sapiens
catgggccctcag

SEQ ID NO: 6043865 - DNA, 15 bp, Homo sapiens
catgggccctcagcg

SEQ ID NO: 6043866 - DNA, 13 bp, Homo sapiens
catgggccctctg

SEQ ID NO: 6043867 - DNA, 17 bp, Homo sapiens
catgggccctctgagca

SEQ ID NO: 6043868 - DNA, 15 bp, Homo sapiens
catgggcctcctgtg

SEQ ID NO: 6043869 - DNA, 16 bp, Homo sapiens
catgggcctcctgtgt

SEQ ID NO: 6043870 - DNA, 12 bp, Homo sapiens
catgggcctctc

SEQ ID NO: 6043871 - DNA, 14 bp, Homo sapiens
catgggcctctctg

SEQ ID NO: 6043872 - DNA, 17 bp, Homo sapiens
catgggcctctctgggg

SEQ ID NO: 6043873 - DNA, 10 bp, Homo sapiens
catgggcctg

SEQ ID NO: 6043874 - DNA, 12 bp, Homo sapiens
catgggcctggg

SEQ ID NO: 6043875 - DNA, 18 bp, Homo sapiens
catgggcctgggcctgct

SEQ ID NO: 6043876 - DNA, 18 bp, Homo sapiens
catgggcctgtggggact

SEQ ID NO: 6043877 - DNA, 16 bp, Homo sapiens
catgggcgaccagggc

SEQ ID NO: 6043878 - DNA, 21 bp, Homo sapiens
catgggcgaccagggccatct

SEQ ID NO: 6043879 - DNA, 16 bp, Homo sapiens
catgggcgcaggccca

SEQ ID NO: 6043880 - DNA, 20 bp, Homo sapiens
catgggcgcaggcccagtga

SEQ ID NO: 6043881 - DNA, 13 bp, Homo sapiens
catgggctcaggg

SEQ ID NO: 6043882 - DNA, 17 bp, Homo sapiens
catgggctcagggccag

SEQ ID NO: 6043883 - DNA, 15 bp, Homo sapiens
catgggctcctgccc

SEQ ID NO: 6043884 - DNA, 13 bp, Homo sapiens
catgggctctgac

SEQ ID NO: 6043885 - DNA, 15 bp, Homo sapiens
catgggctgggggcc

SEQ ID NO: 6043886 - DNA, 13 bp, Homo sapiens
catgggcttcact

SEQ ID NO: 6043887 - DNA, 15 bp, Homo sapiens
catgggcttcactgt

SEQ ID NO: 6043888 - DNA, 23 bp, Homo sapiens
catgggcttggacttcctggggc

SEQ ID NO: 6043889 - DNA, 18 bp, Homo sapiens
catggggaaaaaaatcat

SEQ ID NO: 6043890 - DNA, 21 bp, Homo sapiens
catggggaaaccctggagcca

SEQ ID NO: 6043891 - DNA, 22 bp, Homo sapiens
catggggaaaccctggagccat

SEQ ID NO: 6043892 - DNA, 14 bp, Homo sapiens
catggggaaggcag

SEQ ID NO: 6043893 - DNA, 15 bp, Homo sapiens
catggggaggaggag

SEQ ID NO: 6043894 - DNA, 19 bp, Homo sapiens
catggggaggaggagggtc

SEQ ID NO: 6043895 - DNA, 13 bp, Homo sapiens
catggggaggcag

SEQ ID NO: 6043896 - DNA, 14 bp, Homo sapiens
catggggaggcagc

SEQ ID NO: 6043897 - DNA, 11 bp, Homo sapiens
catggggaggg

SEQ ID NO: 6043898 - DNA, 14 bp, Homo sapiens
catggggaggggag

SEQ ID NO: 6043899 - DNA, 17 bp, Homo sapiens
catggggaggggagaga

SEQ ID NO: 6043900 - DNA, 18 bp, Homo sapiens
catggggaggggagagaa

SEQ ID NO: 6043901 - DNA, 23 bp, Homo sapiens
catggggaggttgtggggcctca

SEQ ID NO: 6043902 - DNA, 22 bp, Homo sapiens
catggggagtaataggaccaga

SEQ ID NO: 6043903 - DNA, 15 bp, Homo sapiens
catggggatctgggg

SEQ ID NO: 6043904 - DNA, 19 bp, Homo sapiens
catggggatctggggggtg

SEQ ID NO: 6043905 - DNA, 19 bp, Homo sapiens
catggggcaagccagggcc

SEQ ID NO: 6043906 - DNA, 20 bp, Homo sapiens
catggggcaagccagggccc

SEQ ID NO: 6043907 - DNA, 23 bp, Homo sapiens
catggggcaagccagggcccaga

SEQ ID NO: 6043908 - DNA, 15 bp, Homo sapiens
catggggcagcctcc

SEQ ID NO: 6043909 - DNA, 16 bp, Homo sapiens
catggggcagcctcca

SEQ ID NO: 6043910 - DNA, 18 bp, Homo sapiens
catggggcagcctccagt

SEQ ID NO: 6043911 - DNA, 21 bp, Homo sapiens
catggggcagcctccagtctg

SEQ ID NO: 6043912 - DNA, 18 bp, Homo sapiens
catggggcatagaaactg

SEQ ID NO: 6043913 - DNA, 23 bp, Homo sapiens
catggggcatagaaactgaggag

SEQ ID NO: 6043914 - DNA, 20 bp, Homo sapiens
catggggcatgtcctttcca

SEQ ID NO: 6043915 - DNA, 14 bp, Homo sapiens
catggggccaggaa

SEQ ID NO: 6043916 - DNA, 14 bp, Homo sapiens
catggggcccctgg

SEQ ID NO: 6043917 - DNA, 15 bp, Homo sapiens
catggggccctccca

SEQ ID NO: 6043918 - DNA, 19 bp, Homo sapiens
catggggctgattgtattt

SEQ ID NO: 6043919 - DNA, 14 bp, Homo sapiens
catgggggacccct

SEQ ID NO: 6043920 - DNA, 20 bp, Homo sapiens
catgggggaccccttcccac

SEQ ID NO: 6043921 - DNA, 12 bp, Homo sapiens
catgggggagag

SEQ ID NO: 6043922 - DNA, 18 bp, Homo sapiens
catgggggaggctctgaa

SEQ ID NO: 6043923 - DNA, 21 bp, Homo sapiens
catgggggaggctctgaagag

SEQ ID NO: 6043924 - DNA, 17 bp, Homo sapiens
catgggggagggggcag

SEQ ID NO: 6043925 - DNA, 22 bp, Homo sapiens
catgggggcaccgggctccatg

SEQ ID NO: 6043926 - DNA, 14 bp, Homo sapiens
catgggggcagggc

SEQ ID NO: 6043927 - DNA, 14 bp, Homo sapiens
catgggggcccaaa

SEQ ID NO: 6043928 - DNA, 18 bp, Homo sapiens
catgggggctcagccagg

SEQ ID NO: 6043929 - DNA, 13 bp, Homo sapiens
catgggggctgcc

SEQ ID NO: 6043930 - DNA, 20 bp, Homo sapiens
catgggggctgccagcgtct

SEQ ID NO: 6043931 - DNA, 20 bp, Homo sapiens
catggggggagcaccctgag

SEQ ID NO: 6043932 - DNA, 23 bp, Homo sapiens
catgggggtgagaccctcgcaga

SEQ ID NO: 6043933 - DNA, 23 bp, Homo sapiens
catgggggtgctgcagccaggag

SEQ ID NO: 6043934 - DNA, 18 bp, Homo sapiens
ccaggaggggcctgggca

SEQ ID NO: 6043935 - DNA, 20 bp, Homo sapiens
ccaggaggggcctgggcagc

SEQ ID NO: 6043936 - DNA, 15 bp, Homo sapiens
ccaggaggggcttct

SEQ ID NO: 6043937 - DNA, 22 bp, Homo sapiens
ccaggaggggcttctgggcaga

SEQ ID NO: 6043938 - DNA, 18 bp, Homo sapiens
ccaggaggggtctgcctc

SEQ ID NO: 6043939 - DNA, 14 bp, Homo sapiens
ccaggagggtaaca

SEQ ID NO: 6043940 - DNA, 17 bp, Homo sapiens
ccaggaggtagtttctc

SEQ ID NO: 6043941 - DNA, 15 bp, Homo sapiens
ccaggaggtcctcct

SEQ ID NO: 6043942 - DNA, 16 bp, Homo sapiens
ccaggaggtcctcctc

SEQ ID NO: 6043943 - DNA, 18 bp, Homo sapiens
ccaggaggtcgaccccaa

SEQ ID NO: 6043944 - DNA, 22 bp, Homo sapiens
ccaggaggtgcagtggaggggg

SEQ ID NO: 6043945 - DNA, 22 bp, Homo sapiens
ccaggaggtggaggttgcagtg

SEQ ID NO: 6043946 - DNA, 19 bp, Homo sapiens
ccaggaggttggtgactga

SEQ ID NO: 6043947 - DNA, 21 bp, Homo sapiens
ccaggaggtttttttgtcaac

SEQ ID NO: 6043948 - DNA, 16 bp, Homo sapiens
ccaggagtaagcccaa

SEQ ID NO: 6043949 - DNA, 17 bp, Homo sapiens
ccaggagtaagcccaag

SEQ ID NO: 6043950 - DNA, 19 bp, Homo sapiens
ccaggagtaagcccaagct

SEQ ID NO: 6043951 - DNA, 12 bp, Homo sapiens
ccaggagtccag

SEQ ID NO: 6043952 - DNA, 14 bp, Homo sapiens
ccaggagtccagac

SEQ ID NO: 6043953 - DNA, 16 bp, Homo sapiens
ccaggagtccagaccc

SEQ ID NO: 6043954 - DNA, 14 bp, Homo sapiens
ccaggagtccagcc

SEQ ID NO: 6043955 - DNA, 22 bp, Homo sapiens
ccaggagtccagcccctcctcc

SEQ ID NO: 6043956 - DNA, 19 bp, Homo sapiens
ccaggagtcccactccaag

SEQ ID NO: 6043957 - DNA, 13 bp, Homo sapiens
ccaggagtctgtg

SEQ ID NO: 6043958 - DNA, 14 bp, Homo sapiens
ccaggagtctgtgc

SEQ ID NO: 6043959 - DNA, 16 bp, Homo sapiens
ccaggagtctgtgctc

SEQ ID NO: 6043960 - DNA, 18 bp, Homo sapiens
ccaggagtctgtgctctt

SEQ ID NO: 6043961 - DNA, 17 bp, Homo sapiens
ccaggagtgcccccggg

SEQ ID NO: 6043962 - DNA, 21 bp, Homo sapiens
ccaggagtgggtgggacacag

SEQ ID NO: 6043963 - DNA, 23 bp, Homo sapiens
ccaggagtgggtgggacacagag

SEQ ID NO: 6043964 - DNA, 21 bp, Homo sapiens
ccaggagtgtggccacgtggg

SEQ ID NO: 6043965 - DNA, 15 bp, Homo sapiens
ccaggagttctgctc

SEQ ID NO: 6043966 - DNA, 17 bp, Homo sapiens
ccaggagtttgagacaa

SEQ ID NO: 6043967 - DNA, 17 bp, Homo sapiens
ccaggagtttgaggctg

SEQ ID NO: 6043968 - DNA, 21 bp, Homo sapiens
ccaggagtttgaggctgcagc

SEQ ID NO: 6043969 - DNA, 22 bp, Homo sapiens
ccaggagtttgaggctgcagcg

SEQ ID NO: 6043970 - DNA, 16 bp, Homo sapiens
ccaggagtttggccag

SEQ ID NO: 6043971 - DNA, 17 bp, Homo sapiens
ccaggagtttggccaga

SEQ ID NO: 6043972 - DNA, 18 bp, Homo sapiens
ccaggagtttgtgtgtct

SEQ ID NO: 6043973 - DNA, 19 bp, Homo sapiens
ccaggagttttaagtccag

SEQ ID NO: 6043974 - DNA, 17 bp, Homo sapiens
ccaggataaggagactg

SEQ ID NO: 6043975 - DNA, 15 bp, Homo sapiens
ccaggatactggcac

SEQ ID NO: 6043976 - DNA, 20 bp, Homo sapiens
ccaggatactggcacagagg

SEQ ID NO: 6043977 - DNA, 14 bp, Homo sapiens
ccaggatcactctc

SEQ ID NO: 6043978 - DNA, 16 bp, Homo sapiens
ccaggatcactctctg

SEQ ID NO: 6043979 - DNA, 20 bp, Homo sapiens
ccaggatcactctctgctgg

SEQ ID NO: 6043980 - DNA, 14 bp, Homo sapiens
ccaggatcagattg

SEQ ID NO: 6043981 - DNA, 14 bp, Homo sapiens
ccaggatcatggtg

SEQ ID NO: 6043982 - DNA, 23 bp, Homo sapiens
ccaggatcatggtgtaataagac

SEQ ID NO: 6043983 - DNA, 19 bp, Homo sapiens
ccaggatcccaagcctcct

SEQ ID NO: 6043984 - DNA, 13 bp, Homo sapiens
ccaggatcccctg

SEQ ID NO: 6043985 - DNA, 20 bp, Homo sapiens
ccaggatcccctgctactcc

SEQ ID NO: 6043986 - DNA, 14 bp, Homo sapiens
ccaggatcctcctg

SEQ ID NO: 6043987 - DNA, 15 bp, Homo sapiens
ccaggatcctgcagg

SEQ ID NO: 6043988 - DNA, 16 bp, Homo sapiens
ccaggatcctgcagga

SEQ ID NO: 6043989 - DNA, 17 bp, Homo sapiens
ccaggatcctgcaggaa

SEQ ID NO: 6043990 - DNA, 18 bp, Homo sapiens
ccaggatcgttttttccc

SEQ ID NO: 6043991 - DNA, 14 bp, Homo sapiens
ccaggatctctttc

SEQ ID NO: 6043992 - DNA, 23 bp, Homo sapiens
ccaggatctctttccccaaggac

SEQ ID NO: 6043993 - DNA, 16 bp, Homo sapiens
ccaggatctgctccaa

SEQ ID NO: 6043994 - DNA, 13 bp, Homo sapiens
ccaggatctgggt

SEQ ID NO: 6043995 - DNA, 19 bp, Homo sapiens
ccaggatctttgactgaaa

SEQ ID NO: 6043996 - DNA, 16 bp, Homo sapiens
ccaggatgaaggcgtg

SEQ ID NO: 6043997 - DNA, 18 bp, Homo sapiens
ccaggatgacccctgggc

SEQ ID NO: 6043998 - DNA, 14 bp, Homo sapiens
ccaggatgcatgca

SEQ ID NO: 6043999 - DNA, 14 bp, Homo sapiens
ccaggatgcccaga

SEQ ID NO: 6044000 - DNA, 16 bp, Homo sapiens
ccaggatgcctgagcc

SEQ ID NO: 6044001 - DNA, 17 bp, Homo sapiens
ccaggatgcctgagccc

SEQ ID NO: 6044002 - DNA, 15 bp, Homo sapiens
ccaggatggaattct

SEQ ID NO: 6044003 - DNA, 23 bp, Homo sapiens
ccaggatggaattcttcctcctc

SEQ ID NO: 6044004 - DNA, 23 bp, Homo sapiens
ccaggatggactcttctcggctc

SEQ ID NO: 6044005 - DNA, 24 bp, Homo sapiens
ccaggatggagcaagctcttccct

SEQ ID NO: 6044006 - DNA, 18 bp, Homo sapiens
ccaggatggagggtccaa

SEQ ID NO: 6044007 - DNA, 23 bp, Homo sapiens
ccaggatggcccttcccactgga

SEQ ID NO: 6044008 - DNA, 16 bp, Homo sapiens
ccaggatggcgcagga

SEQ ID NO: 6044009 - DNA, 23 bp, Homo sapiens
ccaggatggggaggggctctgcg

SEQ ID NO: 6044010 - DNA, 20 bp, Homo sapiens
ccaggatggtctcgatctcc

SEQ ID NO: 6044011 - DNA, 15 bp, Homo sapiens
ccaggatggtctgga

SEQ ID NO: 6044012 - DNA, 22 bp, Homo sapiens
ccaggatgtacaaggacagccc

SEQ ID NO: 6044013 - DNA, 16 bp, Homo sapiens
ccaggattcaaccctg

SEQ ID NO: 6044014 - DNA, 22 bp, Homo sapiens
ccaggattcaggcctctgagga

SEQ ID NO: 6044015 - DNA, 17 bp, Homo sapiens
ccaggattcccagagag

SEQ ID NO: 6044016 - DNA, 15 bp, Homo sapiens
ccaggattcccccag

SEQ ID NO: 6044017 - DNA, 18 bp, Homo sapiens
ccaggattcccccagcca

SEQ ID NO: 6044018 - DNA, 18 bp, Homo sapiens
ccaggattcctctctcag

SEQ ID NO: 6044019 - DNA, 19 bp, Homo sapiens
ccaggattccttaaacctg

SEQ ID NO: 6044020 - DNA, 21 bp, Homo sapiens
ccaggattccttaaacctgaa

SEQ ID NO: 6044021 - DNA, 18 bp, Homo sapiens
ccaggattgcactgacat

SEQ ID NO: 6044022 - DNA, 19 bp, Homo sapiens
ccaggattggcctgtgtct

SEQ ID NO: 6044023 - DNA, 16 bp, Homo sapiens
ccaggattgtccacaa

SEQ ID NO: 6044024 - DNA, 20 bp, Homo sapiens
ccaggatttaggccttaaca

SEQ ID NO: 6044025 - DNA, 15 bp, Homo sapiens
ccaggatttataaag

SEQ ID NO: 6044026 - DNA, 17 bp, Homo sapiens
ccaggatttgcacagaa

SEQ ID NO: 6044027 - DNA, 14 bp, Homo sapiens
ccaggattttgtat

SEQ ID NO: 6044028 - DNA, 16 bp, Homo sapiens
ccaggattttgtattg

SEQ ID NO: 6044029 - DNA, 23 bp, Homo sapiens
ccaggcaaagctggagatgaggc

SEQ ID NO: 6044030 - DNA, 16 bp, Homo sapiens
ccaggcaaataaaatt

SEQ ID NO: 6044031 - DNA, 18 bp, Homo sapiens
ccaggcaaataaaattcc

SEQ ID NO: 6044032 - DNA, 19 bp, Homo sapiens
ccaggcaaatcagttacta

SEQ ID NO: 6044033 - DNA, 13 bp, Homo sapiens
ccaggcaacctcc

SEQ ID NO: 6044034 - DNA, 20 bp, Homo sapiens
ccaggcaagaaaagcgcaga

SEQ ID NO: 6044035 - DNA, 21 bp, Homo sapiens
ccaggcaagaaaagcgcagag

SEQ ID NO: 6044036 - DNA, 22 bp, Homo sapiens
ccaggcaagaaaagcgcagaga

SEQ ID NO: 6044037 - DNA, 11 bp, Homo sapiens
ccaggcaagga

SEQ ID NO: 6044038 - DNA, 15 bp, Homo sapiens
ccaggcaaggaacag

SEQ ID NO: 6044039 - DNA, 16 bp, Homo sapiens
ccaggcaaggaacaga

SEQ ID NO: 6044040 - DNA, 12 bp, Homo sapiens
ccaggcaaggct

SEQ ID NO: 6044041 - DNA, 16 bp, Homo sapiens
ccaggcaaggctgact

SEQ ID NO: 6044042 - DNA, 14 bp, Homo sapiens
ccaggcaaggctgt

SEQ ID NO: 6044043 - DNA, 13 bp, Homo sapiens
ccaggcaatggcc

SEQ ID NO: 6044044 - DNA, 21 bp, Homo sapiens
ccaggcacaacttcagcaggg

SEQ ID NO: 6044045 - DNA, 22 bp, Homo sapiens
ccaggcacaacttcagcagggg

SEQ ID NO: 6044046 - DNA, 19 bp, Homo sapiens
ccaggcacacacagcccct

SEQ ID NO: 6044047 - DNA, 11 bp, Homo sapiens
ccaggcacagg

SEQ ID NO: 6044048 - DNA, 13 bp, Homo sapiens
ccaggcacaggca

SEQ ID NO: 6044049 - DNA, 19 bp, Homo sapiens
ccaggcacaggcagggcag

SEQ ID NO: 6044050 - DNA, 17 bp, Homo sapiens
ccaggcaccaaaagaag

SEQ ID NO: 6044051 - DNA, 16 bp, Homo sapiens
ccaggcaccaccagga

SEQ ID NO: 6044052 - DNA, 17 bp, Homo sapiens
ccaggcaccaccaggag

SEQ ID NO: 6044053 - DNA, 18 bp, Homo sapiens
ccaggcaccaccaggagc

SEQ ID NO: 6044054 - DNA, 19 bp, Homo sapiens
ccaggcaccaccaggagca

SEQ ID NO: 6044055 - DNA, 17 bp, Homo sapiens
ccaggcaccaggactag

SEQ ID NO: 6044056 - DNA, 15 bp, Homo sapiens
ccaggcacccacatc

SEQ ID NO: 6044057 - DNA, 16 bp, Homo sapiens
ccaggcacccacatcc

SEQ ID NO: 6044058 - DNA, 17 bp, Homo sapiens
ccaggcacccacatccc

SEQ ID NO: 6044059 - DNA, 19 bp, Homo sapiens
ccaggcacccacatcccca

SEQ ID NO: 6044060 - DNA, 20 bp, Homo sapiens
ccaggcacccatgtgggcgc

SEQ ID NO: 6044061 - DNA, 23 bp, Homo sapiens
ccaggcacccatgtgggcgccca

SEQ ID NO: 6044062 - DNA, 21 bp, Homo sapiens
ccaggcaccccctggagagaa

SEQ ID NO: 6044063 - DNA, 15 bp, Homo sapiens
ccaggcaccctcagg

SEQ ID NO: 6044064 - DNA, 22 bp, Homo sapiens
ccaggcacccttctttcctctt

SEQ ID NO: 6044065 - DNA, 19 bp, Homo sapiens
ccaggcaccgcctgccccc

SEQ ID NO: 6044066 - DNA, 13 bp, Homo sapiens
ccaggcacctccc

SEQ ID NO: 6044067 - DNA, 13 bp, Homo sapiens
ccaggcacctggc

SEQ ID NO: 6044068 - DNA, 14 bp, Homo sapiens
ccaggcacctggcc

SEQ ID NO: 6044069 - DNA, 20 bp, Homo sapiens
ccaggcacctggcctgctgg

SEQ ID NO: 6044070 - DNA, 21 bp, Homo sapiens
ccaggcactaagtctctagcc

SEQ ID NO: 6044071 - DNA, 18 bp, Homo sapiens
ccaggcactgccttctcc

SEQ ID NO: 6044072 - DNA, 12 bp, Homo sapiens
ccaggcactgtt

SEQ ID NO: 6044073 - DNA, 18 bp, Homo sapiens
ccaggcactgtttggagc

SEQ ID NO: 6044074 - DNA, 20 bp, Homo sapiens
ccaggcagaaaactggcagt

SEQ ID NO: 6044075 - DNA, 22 bp, Homo sapiens
ccaggcagaaatagttgtctgt

SEQ ID NO: 6044076 - DNA, 23 bp, Homo sapiens
ccaggcagaaatagttgtctgtg

SEQ ID NO: 6044077 - DNA, 13 bp, Homo sapiens
ccaggcagaagga

SEQ ID NO: 6044078 - DNA, 17 bp, Homo sapiens
ccaggcagaatggctgc

SEQ ID NO: 6044079 - DNA, 14 bp, Homo sapiens
ccaggcagagctga

SEQ ID NO: 6044080 - DNA, 12 bp, Homo sapiens
ccaggcagaggg

SEQ ID NO: 6044081 - DNA, 22 bp, Homo sapiens
ccaggcagaggttttaatgtct

SEQ ID NO: 6044082 - DNA, 13 bp, Homo sapiens
ccaggcagatcca

SEQ ID NO: 6044083 - DNA, 13 bp, Homo sapiens
ccaggcagatctg

SEQ ID NO: 6044084 - DNA, 13 bp, Homo sapiens
ccaggcagccacc

SEQ ID NO: 6044085 - DNA, 15 bp, Homo sapiens
ccaggcagccaccag

SEQ ID NO: 6044086 - DNA, 16 bp, Homo sapiens
ccaggcagccaccagt

SEQ ID NO: 6044087 - DNA, 16 bp, Homo sapiens
ccaggcagcctctggg

SEQ ID NO: 6044088 - DNA, 22 bp, Homo sapiens
ccaggcagcctctgtcaggcct

SEQ ID NO: 6044089 - DNA, 16 bp, Homo sapiens
ccaggcagctccagct

SEQ ID NO: 6044090 - DNA, 23 bp, Homo sapiens
ccaggcagctccctcctgcacac

SEQ ID NO: 6044091 - DNA, 14 bp, Homo sapiens
ccaggcagctcctg

SEQ ID NO: 6044092 - DNA, 16 bp, Homo sapiens
ccaggcagctcgagca

SEQ ID NO: 6044093 - DNA, 22 bp, Homo sapiens
ccaggcagctgagaccagggtc

SEQ ID NO: 6044094 - DNA, 12 bp, Homo sapiens
ccaggcagctgg

SEQ ID NO: 6044095 - DNA, 14 bp, Homo sapiens
ccaggcagctggca

SEQ ID NO: 6044096 - DNA, 21 bp, Homo sapiens
ccaggcaggacgagactcctc

SEQ ID NO: 6044097 - DNA, 23 bp, Homo sapiens
ccaggcaggacgagactcctcgg

SEQ ID NO: 6044098 - DNA, 12 bp, Homo sapiens
ccaggcaggagg

SEQ ID NO: 6044099 - DNA, 13 bp, Homo sapiens
ccaggcaggagga

SEQ ID NO: 6044100 - DNA, 17 bp, Homo sapiens
ccaggcaggcacctggg

SEQ ID NO: 6044101 - DNA, 13 bp, Homo sapiens
ccaggcaggccag

SEQ ID NO: 6044102 - DNA, 15 bp, Homo sapiens
ccaggcaggcccagc

SEQ ID NO: 6044103 - DNA, 19 bp, Homo sapiens
ccaggcaggcccagcctct

SEQ ID NO: 6044104 - DNA, 22 bp, Homo sapiens
ccaggcaggcccagcctctgcc

SEQ ID NO: 6044105 - DNA, 17 bp, Homo sapiens
ccaggcaggccctgcct

SEQ ID NO: 6044106 - DNA, 12 bp, Homo sapiens
ccaggcaggcga

SEQ ID NO: 6044107 - DNA, 18 bp, Homo sapiens
ccaggcaggctaaggcgt

SEQ ID NO: 6044108 - DNA, 20 bp, Homo sapiens
ccaggcaggctaaggcgtgg

SEQ ID NO: 6044109 - DNA, 17 bp, Homo sapiens
ccaggcagggagtgtct

SEQ ID NO: 6044110 - DNA, 20 bp, Homo sapiens
ccaggcagggagtgtctgca

SEQ ID NO: 6044111 - DNA, 19 bp, Homo sapiens
ccaggcagggccaaccctt

SEQ ID NO: 6044112 - DNA, 12 bp, Homo sapiens
ccaggcaggtct

SEQ ID NO: 6044113 - DNA, 21 bp, Homo sapiens
ccaggcaggtctgcaagggcc

SEQ ID NO: 6044114 - DNA, 19 bp, Homo sapiens
ccaggcaggtgcagggaag

SEQ ID NO: 6044115 - DNA, 22 bp, Homo sapiens
ccaggcaggtgcagggaagtgc

SEQ ID NO: 6044116 - DNA, 17 bp, Homo sapiens
ccaggcaggtgcctgga

SEQ ID NO: 6044117 - DNA, 20 bp, Homo sapiens
ccaggcagtcgggggctggc

SEQ ID NO: 6044118 - DNA, 21 bp, Homo sapiens
ccaggcagtcgggggctggcc

SEQ ID NO: 6044119 - DNA, 22 bp, Homo sapiens
ccaggcagtcgggggctggcct

SEQ ID NO: 6044120 - DNA, 23 bp, Homo sapiens
ccaggcagtcgggggctggccta

SEQ ID NO: 6044121 - DNA, 16 bp, Homo sapiens
ccaggcagttctctcg

SEQ ID NO: 6044122 - DNA, 21 bp, Homo sapiens
ccaggcatcactgattccctc

SEQ ID NO: 6044123 - DNA, 16 bp, Homo sapiens
ccaggcatctccttgg

SEQ ID NO: 6044124 - DNA, 18 bp, Homo sapiens
ccaggcatctccttgggc

SEQ ID NO: 6044125 - DNA, 20 bp, Homo sapiens
ccaggcatctgttagcagag

SEQ ID NO: 6044126 - DNA, 23 bp, Homo sapiens
ccaggcatctgttagcagagtct

SEQ ID NO: 6044127 - DNA, 21 bp, Homo sapiens
ccaggcatgaaattcttccta

SEQ ID NO: 6044128 - DNA, 16 bp, Homo sapiens
ccaggcatgaccctgg

SEQ ID NO: 6044129 - DNA, 21 bp, Homo sapiens
ccaggcatgaccctggagccc

SEQ ID NO: 6044130 - DNA, 12 bp, Homo sapiens
ccaggcatgcag

SEQ ID NO: 6044131 - DNA, 15 bp, Homo sapiens
ccaggcatgcagctg

SEQ ID NO: 6044132 - DNA, 21 bp, Homo sapiens
ccaggcatgcagctgcctggg

SEQ ID NO: 6044133 - DNA, 12 bp, Homo sapiens
ccaggcatgctg

SEQ ID NO: 6044134 - DNA, 13 bp, Homo sapiens
ccaggcatgctgg

SEQ ID NO: 6044135 - DNA, 22 bp, Homo sapiens
ccaggcatggaaagatggggag

SEQ ID NO: 6044136 - DNA, 23 bp, Homo sapiens
ccaggcatggaaagatggggagc

SEQ ID NO: 6044137 - DNA, 20 bp, Homo sapiens
ccaggcatggcccagcctgg

SEQ ID NO: 6044138 - DNA, 21 bp, Homo sapiens
ccaggcatggcccagcctgga

SEQ ID NO: 6044139 - DNA, 15 bp, Homo sapiens
ccaggcatggcgagg

SEQ ID NO: 6044140 - DNA, 14 bp, Homo sapiens
ccaggcatgtccta

SEQ ID NO: 6044141 - DNA, 21 bp, Homo sapiens
ccaggcattccccaggaggcc

SEQ ID NO: 6044142 - DNA, 22 bp, Homo sapiens
ccaggcattccccaggaggcca

SEQ ID NO: 6044143 - DNA, 23 bp, Homo sapiens
ccaggcattccccaggaggccag

SEQ ID NO: 6044144 - DNA, 24 bp, Homo sapiens
ccaggcattccccaggaggccagc

SEQ ID NO: 6044145 - DNA, 15 bp, Homo sapiens
ccaggcattggctca

SEQ ID NO: 6044146 - DNA, 13 bp, Homo sapiens
ccaggccaaagcc

SEQ ID NO: 6044147 - DNA, 18 bp, Homo sapiens
ccaggccaaagccccatg

SEQ ID NO: 6044148 - DNA, 22 bp, Homo sapiens
ccaggccaaagccccatgtgcc

SEQ ID NO: 6044149 - DNA, 21 bp, Homo sapiens
ccaggccacaagacccttgtg

SEQ ID NO: 6044150 - DNA, 11 bp, Homo sapiens
ccaggccacag

SEQ ID NO: 6044151 - DNA, 18 bp, Homo sapiens
ccaggccacagccgcctt

SEQ ID NO: 6044152 - DNA, 18 bp, Homo sapiens
ccaggccacccactgtgg

SEQ ID NO: 6044153 - DNA, 16 bp, Homo sapiens
ccaggccacctccaga

SEQ ID NO: 6044154 - DNA, 17 bp, Homo sapiens
ccaggccacctccccag

SEQ ID NO: 6044155 - DNA, 19 bp, Homo sapiens
ccaggccacgggaccttct

SEQ ID NO: 6044156 - DNA, 12 bp, Homo sapiens
ccaggccactgt

SEQ ID NO: 6044157 - DNA, 17 bp, Homo sapiens
ccaggccactgtggcca

SEQ ID NO: 6044158 - DNA, 19 bp, Homo sapiens
ccaggccactgtggccaga

SEQ ID NO: 6044159 - DNA, 21 bp, Homo sapiens
ccaggccactgtggccagagc

SEQ ID NO: 6044160 - DNA, 23 bp, Homo sapiens
ccaggccactgtggccagagctg

SEQ ID NO: 6044161 - DNA, 21 bp, Homo sapiens
ccaggccagagggagtgacag

SEQ ID NO: 6044162 - DNA, 11 bp, Homo sapiens
ccaggccagca

SEQ ID NO: 6044163 - DNA, 18 bp, Homo sapiens
ccaggccagcaggcgggc

SEQ ID NO: 6044164 - DNA, 19 bp, Homo sapiens
ccaggccagcaggcgggct

SEQ ID NO: 6044165 - DNA, 14 bp, Homo sapiens
ccaggccagcctcc

SEQ ID NO: 6044166 - DNA, 12 bp, Homo sapiens
ccaggccagctc

SEQ ID NO: 6044167 - DNA, 22 bp, Homo sapiens
ccaggccagctccttttctgtg

SEQ ID NO: 6044168 - DNA, 16 bp, Homo sapiens
ccaggccagctgcggc

SEQ ID NO: 6044169 - DNA, 21 bp, Homo sapiens
ccaggccagctgcggccaggc

SEQ ID NO: 6044170 - DNA, 21 bp, Homo sapiens
ccaggccagcttcccctcact

SEQ ID NO: 6044171 - DNA, 21 bp, Homo sapiens
ccaggccaggaccaagggcag

SEQ ID NO: 6044172 - DNA, 21 bp, Homo sapiens
ccaggccaggaccacacagtc

SEQ ID NO: 6044173 - DNA, 18 bp, Homo sapiens
ccaggccaggactctgca

SEQ ID NO: 6044174 - DNA, 21 bp, Homo sapiens
ccaggccaggactctgcagcc

SEQ ID NO: 6044175 - DNA, 12 bp, Homo sapiens
ccaggccaggcc

SEQ ID NO: 6044176 - DNA, 18 bp, Homo sapiens
ccaggccaggccaccagg

SEQ ID NO: 6044177 - DNA, 16 bp, Homo sapiens
ccaggccaggcctcat

SEQ ID NO: 6044178 - DNA, 13 bp, Homo sapiens
ccaggccagggct

SEQ ID NO: 6044179 - DNA, 21 bp, Homo sapiens
ccaggccagggctcctgtggc

SEQ ID NO: 6044180 - DNA, 14 bp, Homo sapiens
ccaggccagggctg

SEQ ID NO: 6044181 - DNA, 18 bp, Homo sapiens
ccaggccagggctgggtc

SEQ ID NO: 6044182 - DNA, 19 bp, Homo sapiens
ccaggccagggggccagtc

SEQ ID NO: 6044183 - DNA, 11 bp, Homo sapiens
ccaggccaggt

SEQ ID NO: 6044184 - DNA, 18 bp, Homo sapiens
ccaggccaggtgcccagg

SEQ ID NO: 6044185 - DNA, 15 bp, Homo sapiens
ccaggccagtcagac

SEQ ID NO: 6044186 - DNA, 22 bp, Homo sapiens
ccaggccatccggcccccagag

SEQ ID NO: 6044187 - DNA, 16 bp, Homo sapiens
ccaggccatcttccag

SEQ ID NO: 6044188 - DNA, 24 bp, Homo sapiens
ccaggccatgtggcctgcccagcc

SEQ ID NO: 6044189 - DNA, 17 bp, Homo sapiens
ccaggccattctgccgc

SEQ ID NO: 6044190 - DNA, 16 bp, Homo sapiens
ccaggcccaaggaggg

SEQ ID NO: 6044191 - DNA, 19 bp, Homo sapiens
ccaggcccacgaggagcag

SEQ ID NO: 6044192 - DNA, 11 bp, Homo sapiens
ccaggcccagc

SEQ ID NO: 6044193 - DNA, 12 bp, Homo sapiens
ccaggcccagcc

SEQ ID NO: 6044194 - DNA, 14 bp, Homo sapiens
ccaggcccagccag

SEQ ID NO: 6044195 - DNA, 18 bp, Homo sapiens
ccaggcccagccagttgg

SEQ ID NO: 6044196 - DNA, 14 bp, Homo sapiens
ccaggcccagccct

SEQ ID NO: 6044197 - DNA, 17 bp, Homo sapiens
ccaggcccagcctggcc

SEQ ID NO: 6044198 - DNA, 13 bp, Homo sapiens
ccaggcccaggcc

SEQ ID NO: 6044199 - DNA, 14 bp, Homo sapiens
ccaggcccaggcca

SEQ ID NO: 6044200 - DNA, 15 bp, Homo sapiens
ccaggcccaggccag

SEQ ID NO: 6044201 - DNA, 15 bp, Homo sapiens
ccaggcccaggcctc

SEQ ID NO: 6044202 - DNA, 19 bp, Homo sapiens
ccaggcccaggcctcacca

SEQ ID NO: 6044203 - DNA, 13 bp, Homo sapiens
ccaggcccatctc

SEQ ID NO: 6044204 - DNA, 23 bp, Homo sapiens
ccaggcccatctcaggtgccact

SEQ ID NO: 6044205 - DNA, 14 bp, Homo sapiens
ccaggcccatgcca

SEQ ID NO: 6044206 - DNA, 20 bp, Homo sapiens
ccaggccccaaaaccacagc

SEQ ID NO: 6044207 - DNA, 23 bp, Homo sapiens
ccaggccccaccggccaggccgc

SEQ ID NO: 6044208 - DNA, 16 bp, Homo sapiens
ccaggccccagcctcc

SEQ ID NO: 6044209 - DNA, 18 bp, Homo sapiens
ccaggccccagcctccag

SEQ ID NO: 6044210 - DNA, 20 bp, Homo sapiens
ccaggccccagcctccaggc

SEQ ID NO: 6044211 - DNA, 13 bp, Homo sapiens
ccaggccccaggc

SEQ ID NO: 6044212 - DNA, 14 bp, Homo sapiens
ccaggccccaggct

SEQ ID NO: 6044213 - DNA, 18 bp, Homo sapiens
ccaggccccaggctggat

SEQ ID NO: 6044214 - DNA, 14 bp, Homo sapiens
ccaggccccagggg

SEQ ID NO: 6044215 - DNA, 15 bp, Homo sapiens
ccaggccccatgacc

SEQ ID NO: 6044216 - DNA, 16 bp, Homo sapiens
ccaggccccatgacct

SEQ ID NO: 6044217 - DNA, 17 bp, Homo sapiens
ccaggccccatgacctc

SEQ ID NO: 6044218 - DNA, 21 bp, Homo sapiens
ccaggccccatgacctccagc

SEQ ID NO: 6044219 - DNA, 23 bp, Homo sapiens
ccaggccccatgacctccagctt

SEQ ID NO: 6044220 - DNA, 14 bp, Homo sapiens
ccaggccccatgga

SEQ ID NO: 6044221 - DNA, 16 bp, Homo sapiens
ccaggccccatggagg

SEQ ID NO: 6044222 - DNA, 19 bp, Homo sapiens
ccaggccccatggagggta

SEQ ID NO: 6044223 - DNA, 19 bp, Homo sapiens
ccaggcccccaagcctgca

SEQ ID NO: 6044224 - DNA, 13 bp, Homo sapiens
ccaggcccccagc

SEQ ID NO: 6044225 - DNA, 14 bp, Homo sapiens
ccaggcccccagcc

SEQ ID NO: 6044226 - DNA, 20 bp, Homo sapiens
ccaggcccccgttgaagccg

SEQ ID NO: 6044227 - DNA, 18 bp, Homo sapiens
ccaggcccctccctctcc

SEQ ID NO: 6044228 - DNA, 14 bp, Homo sapiens
ccaggcccctgagg

SEQ ID NO: 6044229 - DNA, 22 bp, Homo sapiens
ccaggcccctgaggactggaga

SEQ ID NO: 6044230 - DNA, 15 bp, Homo sapiens
ccaggcccctgccac

SEQ ID NO: 6044231 - DNA, 16 bp, Homo sapiens
ccaggcccctgccacc

SEQ ID NO: 6044232 - DNA, 15 bp, Homo sapiens
ccaggcccctggagg

SEQ ID NO: 6044233 - DNA, 21 bp, Homo sapiens
ccaggcccgcaccccggcctc

SEQ ID NO: 6044234 - DNA, 14 bp, Homo sapiens
ccaggcccgcactg

SEQ ID NO: 6044235 - DNA, 17 bp, Homo sapiens
ccaggcccgccctgccc

SEQ ID NO: 6044236 - DNA, 19 bp, Homo sapiens
ccaggcccggatgcagagg

SEQ ID NO: 6044237 - DNA, 20 bp, Homo sapiens
ccaggcccggatgcagaggc

SEQ ID NO: 6044238 - DNA, 22 bp, Homo sapiens
ccaggcccggatgcagaggcct

SEQ ID NO: 6044239 - DNA, 17 bp, Homo sapiens
ccaggcccggcatgagg

SEQ ID NO: 6044240 - DNA, 18 bp, Homo sapiens
ccaggcccggcatgaggc

SEQ ID NO: 6044241 - DNA, 15 bp, Homo sapiens
ccaggcccggggctg

SEQ ID NO: 6044242 - DNA, 16 bp, Homo sapiens
ccaggcccggggctgg

SEQ ID NO: 6044243 - DNA, 18 bp, Homo sapiens
ccaggccctagaccctcc

SEQ ID NO: 6044244 - DNA, 19 bp, Homo sapiens
ccaggccctagaccctccc

SEQ ID NO: 6044245 - DNA, 13 bp, Homo sapiens
ccaggccctccag

SEQ ID NO: 6044246 - DNA, 15 bp, Homo sapiens
ccaggccctccatgg

SEQ ID NO: 6044247 - DNA, 16 bp, Homo sapiens
ccaggccctccatggg

SEQ ID NO: 6044248 - DNA, 17 bp, Homo sapiens
ccaggccctccatgggc

SEQ ID NO: 6044249 - DNA, 18 bp, Homo sapiens
ccaggccctccatgggct

SEQ ID NO: 6044250 - DNA, 14 bp, Homo sapiens
ccaggccctcccac

SEQ ID NO: 6044251 - DNA, 16 bp, Homo sapiens
ccaggccctcccacca

SEQ ID NO: 6044252 - DNA, 14 bp, Homo sapiens
ccaggccctccctg

SEQ ID NO: 6044253 - DNA, 17 bp, Homo sapiens
ccaggccctcctgctgg

SEQ ID NO: 6044254 - DNA, 19 bp, Homo sapiens
ccaggccctcctgctggct

SEQ ID NO: 6044255 - DNA, 19 bp, Homo sapiens
ccaggccctctctgcagtc

SEQ ID NO: 6044256 - DNA, 20 bp, Homo sapiens
ccaggccctctctgcagtcc

SEQ ID NO: 6044257 - DNA, 14 bp, Homo sapiens
ccaggccctctgcc

SEQ ID NO: 6044258 - DNA, 15 bp, Homo sapiens
ccaggccctctgccc

SEQ ID NO: 6044259 - DNA, 16 bp, Homo sapiens
ccaggccctctgccca

SEQ ID NO: 6044260 - DNA, 18 bp, Homo sapiens
ccaggccctctgcccact

SEQ ID NO: 6044261 - DNA, 14 bp, Homo sapiens
ccaggccctgagat

SEQ ID NO: 6044262 - DNA, 15 bp, Homo sapiens
ccaggccctgccaga

SEQ ID NO: 6044263 - DNA, 20 bp, Homo sapiens
ccaggccctgccattggcct

SEQ ID NO: 6044264 - DNA, 17 bp, Homo sapiens
ccaggccctgtggcagg

SEQ ID NO: 6044265 - DNA, 18 bp, Homo sapiens
ccaggcccttggctgcag

SEQ ID NO: 6044266 - DNA, 13 bp, Homo sapiens
ccaggccctttgg

SEQ ID NO: 6044267 - DNA, 15 bp, Homo sapiens
ccaggccgacaggag

SEQ ID NO: 6044268 - DNA, 18 bp, Homo sapiens
ccaggccgacaggaggcc

SEQ ID NO: 6044269 - DNA, 14 bp, Homo sapiens
ccaggccgcagctc

SEQ ID NO: 6044270 - DNA, 17 bp, Homo sapiens
ccaggccgcagctcttg

SEQ ID NO: 6044271 - DNA, 15 bp, Homo sapiens
ccaggccgcatggcc

SEQ ID NO: 6044272 - DNA, 15 bp, Homo sapiens
ccaggccgccccagc

SEQ ID NO: 6044273 - DNA, 19 bp, Homo sapiens
ccaggccgcgcccagcaga

SEQ ID NO: 6044274 - DNA, 15 bp, Homo sapiens
ccaggccggagccca

SEQ ID NO: 6044275 - DNA, 15 bp, Homo sapiens
ccaggccggccagcc

SEQ ID NO: 6044276 - DNA, 15 bp, Homo sapiens
ccaggccggcccaga

SEQ ID NO: 6044277 - DNA, 16 bp, Homo sapiens
ccaggccggcccagat

SEQ ID NO: 6044278 - DNA, 21 bp, Homo sapiens
ccaggccgggaaaaagcccac

SEQ ID NO: 6044279 - DNA, 19 bp, Homo sapiens
ccaggccgggaagagccac

SEQ ID NO: 6044280 - DNA, 23 bp, Homo sapiens
ccaggccgggaagagccacctgg

SEQ ID NO: 6044281 - DNA, 20 bp, Homo sapiens
ccaggccgggcacagtggct

SEQ ID NO: 6044282 - DNA, 20 bp, Homo sapiens
ccaggccggggctggaggga

SEQ ID NO: 6044283 - DNA, 16 bp, Homo sapiens
ccaggccgtggctgcc

SEQ ID NO: 6044284 - DNA, 20 bp, Homo sapiens
ccaggccgttccccttggct

SEQ ID NO: 6044285 - DNA, 17 bp, Homo sapiens
ccaggcctactcctgtc

SEQ ID NO: 6044286 - DNA, 17 bp, Homo sapiens
ccaggcctcaccacctg

SEQ ID NO: 6044287 - DNA, 15 bp, Homo sapiens
ccaggcctcactggc

SEQ ID NO: 6044288 - DNA, 17 bp, Homo sapiens
ccaggcctcactggctc

SEQ ID NO: 6044289 - DNA, 21 bp, Homo sapiens
ccaggcctcactggctcatgc

SEQ ID NO: 6044290 - DNA, 22 bp, Homo sapiens
ccaggcctcactggctcatgcc

SEQ ID NO: 6044291 - DNA, 14 bp, Homo sapiens
catggggtcagccc

SEQ ID NO: 6044292 - DNA, 17 bp, Homo sapiens
catggggtcagccccaa

SEQ ID NO: 6044293 - DNA, 19 bp, Homo sapiens
catggggtcggctcctgat

SEQ ID NO: 6044294 - DNA, 19 bp, Homo sapiens
catggggtctctcacagac

SEQ ID NO: 6044295 - DNA, 23 bp, Homo sapiens
catggggtctctgcatcttcagt

SEQ ID NO: 6044296 - DNA, 22 bp, Homo sapiens
catggggtggaataaaggctga

SEQ ID NO: 6044297 - DNA, 16 bp, Homo sapiens
catggggtgggcctct

SEQ ID NO: 6044298 - DNA, 18 bp, Homo sapiens
catggggtgggcctctgg

SEQ ID NO: 6044299 - DNA, 19 bp, Homo sapiens
catggggtgggcctctggt

SEQ ID NO: 6044300 - DNA, 20 bp, Homo sapiens
catggggttggctgggccca

SEQ ID NO: 6044301 - DNA, 22 bp, Homo sapiens
catggggttggctgggcccaga

SEQ ID NO: 6044302 - DNA, 23 bp, Homo sapiens
catggggtttttgccctggagcc

SEQ ID NO: 6044303 - DNA, 22 bp, Homo sapiens
catgggtacccagactctaaat

SEQ ID NO: 6044304 - DNA, 15 bp, Homo sapiens
catgggtagcttctg

SEQ ID NO: 6044305 - DNA, 16 bp, Homo sapiens
catgggtagcttctga

SEQ ID NO: 6044306 - DNA, 15 bp, Homo sapiens
catgggtcagggtgt

SEQ ID NO: 6044307 - DNA, 14 bp, Homo sapiens
catgggtccaagag

SEQ ID NO: 6044308 - DNA, 14 bp, Homo sapiens
catgggtccagggc

SEQ ID NO: 6044309 - DNA, 16 bp, Homo sapiens
catgggtccagggcct

SEQ ID NO: 6044310 - DNA, 16 bp, Homo sapiens
catgggtcccttcccc

SEQ ID NO: 6044311 - DNA, 19 bp, Homo sapiens
catgggtcccttgaaggaa

SEQ ID NO: 6044312 - DNA, 15 bp, Homo sapiens
catgggtcctcggcc

SEQ ID NO: 6044313 - DNA, 15 bp, Homo sapiens
catgggtcgggagag

SEQ ID NO: 6044314 - DNA, 18 bp, Homo sapiens
catgggtcgggagagggg

SEQ ID NO: 6044315 - DNA, 20 bp, Homo sapiens
catgggtcgggagaggggac

SEQ ID NO: 6044316 - DNA, 13 bp, Homo sapiens
catgggtctggcc

SEQ ID NO: 6044317 - DNA, 13 bp, Homo sapiens
catgggtctggct

SEQ ID NO: 6044318 - DNA, 22 bp, Homo sapiens
catgggtctggctagagggccc

SEQ ID NO: 6044319 - DNA, 12 bp, Homo sapiens
catgggtggagg

SEQ ID NO: 6044320 - DNA, 15 bp, Homo sapiens
catgggtggctgtga

SEQ ID NO: 6044321 - DNA, 20 bp, Homo sapiens
catgggtgttttgatctctg

SEQ ID NO: 6044322 - DNA, 12 bp, Homo sapiens
catgggttcctc

SEQ ID NO: 6044323 - DNA, 19 bp, Homo sapiens
catggtaagagtcacaatt

SEQ ID NO: 6044324 - DNA, 17 bp, Homo sapiens
catggtaccagccctgg

SEQ ID NO: 6044325 - DNA, 13 bp, Homo sapiens
catggtacttcct

SEQ ID NO: 6044326 - DNA, 17 bp, Homo sapiens
catggtacttcctctgt

SEQ ID NO: 6044327 - DNA, 24 bp, Homo sapiens
catggtacttcctctgtgaactgt

SEQ ID NO: 6044328 - DNA, 15 bp, Homo sapiens
catggtagactgtga

SEQ ID NO: 6044329 - DNA, 17 bp, Homo sapiens
catggtagactgtgaca

SEQ ID NO: 6044330 - DNA, 20 bp, Homo sapiens
catggtagagaatctctccc

SEQ ID NO: 6044331 - DNA, 20 bp, Homo sapiens
catggtatcttgagtcttgg

SEQ ID NO: 6044332 - DNA, 15 bp, Homo sapiens
catggtattgggact

SEQ ID NO: 6044333 - DNA, 16 bp, Homo sapiens
catggtcacacactga

SEQ ID NO: 6044334 - DNA, 13 bp, Homo sapiens
catggtcacagta

SEQ ID NO: 6044335 - DNA, 16 bp, Homo sapiens
catggtcacagtccta

SEQ ID NO: 6044336 - DNA, 18 bp, Homo sapiens
catggtccatcccctgag

SEQ ID NO: 6044337 - DNA, 14 bp, Homo sapiens
catggtccatttca

SEQ ID NO: 6044338 - DNA, 21 bp, Homo sapiens
catggtccatttcatgtgatc

SEQ ID NO: 6044339 - DNA, 21 bp, Homo sapiens
catggtcccacatccctgggc

SEQ ID NO: 6044340 - DNA, 17 bp, Homo sapiens
catggtcccacttcccc

SEQ ID NO: 6044341 - DNA, 18 bp, Homo sapiens
catggtcccacttcccca

SEQ ID NO: 6044342 - DNA, 21 bp, Homo sapiens
catggtcccacttccccatct

SEQ ID NO: 6044343 - DNA, 18 bp, Homo sapiens
catggtccccatggcatg

SEQ ID NO: 6044344 - DNA, 21 bp, Homo sapiens
catggtcccgaagtgtagggc

SEQ ID NO: 6044345 - DNA, 14 bp, Homo sapiens
catggtccctagca

SEQ ID NO: 6044346 - DNA, 21 bp, Homo sapiens
catggtcccttgtcaccaggc

SEQ ID NO: 6044347 - DNA, 17 bp, Homo sapiens
catggtcctgaatgtag

SEQ ID NO: 6044348 - DNA, 16 bp, Homo sapiens
catggtcctggctgga

SEQ ID NO: 6044349 - DNA, 12 bp, Homo sapiens
catggtcctgtc

SEQ ID NO: 6044350 - DNA, 18 bp, Homo sapiens
catggtcctgtctgtcct

SEQ ID NO: 6044351 - DNA, 22 bp, Homo sapiens
catggtcctgtctgtccttctg

SEQ ID NO: 6044352 - DNA, 14 bp, Homo sapiens
catggtcctttctg

SEQ ID NO: 6044353 - DNA, 19 bp, Homo sapiens
catggtcggaaaacatgct

SEQ ID NO: 6044354 - DNA, 23 bp, Homo sapiens
catggtcggaaaacatgctacac

SEQ ID NO: 6044355 - DNA, 21 bp, Homo sapiens
catggtctgagtggggcttcc

SEQ ID NO: 6044356 - DNA, 23 bp, Homo sapiens
catggtctgagtggggcttcctg

SEQ ID NO: 6044357 - DNA, 17 bp, Homo sapiens
catggtgaaaagctcca

SEQ ID NO: 6044358 - DNA, 18 bp, Homo sapiens
catggtgaaaagctccat

SEQ ID NO: 6044359 - DNA, 20 bp, Homo sapiens
catggtgaaacccccatctc

SEQ ID NO: 6044360 - DNA, 15 bp, Homo sapiens
catggtgaaattata

SEQ ID NO: 6044361 - DNA, 15 bp, Homo sapiens
catggtgaactgaag

SEQ ID NO: 6044362 - DNA, 23 bp, Homo sapiens
catggtgaactgaagcagagtca

SEQ ID NO: 6044363 - DNA, 21 bp, Homo sapiens
catggtgaaggtttttgtttc

SEQ ID NO: 6044364 - DNA, 23 bp, Homo sapiens
catggtgaagtgcttggaacata

SEQ ID NO: 6044365 - DNA, 16 bp, Homo sapiens
catggtgacacacagc

SEQ ID NO: 6044366 - DNA, 22 bp, Homo sapiens
catggtgaccaccccctgttcc

SEQ ID NO: 6044367 - DNA, 21 bp, Homo sapiens
catggtgaggcttaacaatgt

SEQ ID NO: 6044368 - DNA, 20 bp, Homo sapiens
catggtgagtctatttttaa

SEQ ID NO: 6044369 - DNA, 15 bp, Homo sapiens
catggtgatgcaagt

SEQ ID NO: 6044370 - DNA, 19 bp, Homo sapiens
catggtgattcctgggaag

SEQ ID NO: 6044371 - DNA, 15 bp, Homo sapiens
catggtgccccagga

SEQ ID NO: 6044372 - DNA, 12 bp, Homo sapiens
catggtgcctat

SEQ ID NO: 6044373 - DNA, 16 bp, Homo sapiens
catggtgcctgagagg

SEQ ID NO: 6044374 - DNA, 17 bp, Homo sapiens
catggtgcctgagaggc

SEQ ID NO: 6044375 - DNA, 13 bp, Homo sapiens
catggtgctagga

SEQ ID NO: 6044376 - DNA, 17 bp, Homo sapiens
catggtgctaggaagag

SEQ ID NO: 6044377 - DNA, 14 bp, Homo sapiens
catggtgctgcatt

SEQ ID NO: 6044378 - DNA, 22 bp, Homo sapiens
catggtgctgtgtgtgagcgag

SEQ ID NO: 6044379 - DNA, 19 bp, Homo sapiens
catggtgcttgttaatgct

SEQ ID NO: 6044380 - DNA, 20 bp, Homo sapiens
catggtgctttcaggtctgg

SEQ ID NO: 6044381 - DNA, 13 bp, Homo sapiens
catggtggaaggg

SEQ ID NO: 6044382 - DNA, 13 bp, Homo sapiens
catggtggagggc

SEQ ID NO: 6044383 - DNA, 13 bp, Homo sapiens
catggtggccaga

SEQ ID NO: 6044384 - DNA, 22 bp, Homo sapiens
catggtggcggcgaagaagaga

SEQ ID NO: 6044385 - DNA, 18 bp, Homo sapiens
catggtggctcccgcctg

SEQ ID NO: 6044386 - DNA, 23 bp, Homo sapiens
catggtgggcttgtggtggctgc

SEQ ID NO: 6044387 - DNA, 21 bp, Homo sapiens
catggtggggtctcctcagga

SEQ ID NO: 6044388 - DNA, 22 bp, Homo sapiens
catggtgggtccatgggcagag

SEQ ID NO: 6044389 - DNA, 19 bp, Homo sapiens
catggtggtgcgtgcctgt

SEQ ID NO: 6044390 - DNA, 13 bp, Homo sapiens
catggtgtaataa

SEQ ID NO: 6044391 - DNA, 18 bp, Homo sapiens
catggtgtaataagacat

SEQ ID NO: 6044392 - DNA, 19 bp, Homo sapiens
catggtgtaataagacata

SEQ ID NO: 6044393 - DNA, 21 bp, Homo sapiens
catggtgtaataagacataac

SEQ ID NO: 6044394 - DNA, 22 bp, Homo sapiens
catggtgtaataagacataacg

SEQ ID NO: 6044395 - DNA, 12 bp, Homo sapiens
catggtgtatgt

SEQ ID NO: 6044396 - DNA, 19 bp, Homo sapiens
catggtgtatgtggttttt

SEQ ID NO: 6044397 - DNA, 23 bp, Homo sapiens
catggtgtgaaagtcagatgccc

SEQ ID NO: 6044398 - DNA, 19 bp, Homo sapiens
catggtgtgaactaagtta

SEQ ID NO: 6044399 - DNA, 18 bp, Homo sapiens
catggtgtgatcgtctga

SEQ ID NO: 6044400 - DNA, 23 bp, Homo sapiens
catggtgtgtggtgctacaggga

SEQ ID NO: 6044401 - DNA, 18 bp, Homo sapiens
catggtgtgtgtctctga

SEQ ID NO: 6044402 - DNA, 14 bp, Homo sapiens
catggtgttctcct

SEQ ID NO: 6044403 - DNA, 15 bp, Homo sapiens
catggtgttctcctg

SEQ ID NO: 6044404 - DNA, 17 bp, Homo sapiens
catggtgttctcctgct

SEQ ID NO: 6044405 - DNA, 19 bp, Homo sapiens
catggtgttggaggggcag

SEQ ID NO: 6044406 - DNA, 17 bp, Homo sapiens
catggttaacgaggaag

SEQ ID NO: 6044407 - DNA, 16 bp, Homo sapiens
catggttaagagtcca

SEQ ID NO: 6044408 - DNA, 17 bp, Homo sapiens
catggttaccatgtctt

SEQ ID NO: 6044409 - DNA, 14 bp, Homo sapiens
catggttcaagtat

SEQ ID NO: 6044410 - DNA, 19 bp, Homo sapiens
catggttcaggtacacata

SEQ ID NO: 6044411 - DNA, 20 bp, Homo sapiens
catggttcaggtacacatat

SEQ ID NO: 6044412 - DNA, 20 bp, Homo sapiens
catggttcattttctgatgc

SEQ ID NO: 6044413 - DNA, 16 bp, Homo sapiens
catggttccttccctg

SEQ ID NO: 6044414 - DNA, 22 bp, Homo sapiens
catggttctcaatttatttggg

SEQ ID NO: 6044415 - DNA, 15 bp, Homo sapiens
catggttctgcctcc

SEQ ID NO: 6044416 - DNA, 23 bp, Homo sapiens
catggttctgcctcctggccaag

SEQ ID NO: 6044417 - DNA, 14 bp, Homo sapiens
catggttgagaaat

SEQ ID NO: 6044418 - DNA, 16 bp, Homo sapiens
catggttgagaaatga

SEQ ID NO: 6044419 - DNA, 13 bp, Homo sapiens
catggttggggga

SEQ ID NO: 6044420 - DNA, 18 bp, Homo sapiens
catggttgggggaatgca

SEQ ID NO: 6044421 - DNA, 14 bp, Homo sapiens
catggttgtcatca

SEQ ID NO: 6044422 - DNA, 20 bp, Homo sapiens
catggttgtgcacatgcttc

SEQ ID NO: 6044423 - DNA, 18 bp, Homo sapiens
catggtttaaaagaaaaa

SEQ ID NO: 6044424 - DNA, 20 bp, Homo sapiens
catggtttaaaagaaaaaat

SEQ ID NO: 6044425 - DNA, 22 bp, Homo sapiens
catggtttaaaagaaaaaatga

SEQ ID NO: 6044426 - DNA, 20 bp, Homo sapiens
catggtttaaatatgaatga

SEQ ID NO: 6044427 - DNA, 20 bp, Homo sapiens
catggtttagataaaggaaa

SEQ ID NO: 6044428 - DNA, 13 bp, Homo sapiens
catggtttcagca

SEQ ID NO: 6044429 - DNA, 15 bp, Homo sapiens
catggtttcagcact

SEQ ID NO: 6044430 - DNA, 18 bp, Homo sapiens
catggtttggagctgatc

SEQ ID NO: 6044431 - DNA, 17 bp, Homo sapiens
catggttttaaagctaa

SEQ ID NO: 6044432 - DNA, 18 bp, Homo sapiens
catggttttaaagctaaa

SEQ ID NO: 6044433 - DNA, 16 bp, Homo sapiens
catggttttacagtga

SEQ ID NO: 6044434 - DNA, 24 bp, Homo sapiens
catggttttgtgccatctgtagct

SEQ ID NO: 6044435 - DNA, 15 bp, Homo sapiens
catggtttttataat

SEQ ID NO: 6044436 - DNA, 17 bp, Homo sapiens
catgtaaaaagtgcagt

SEQ ID NO: 6044437 - DNA, 21 bp, Homo sapiens
catgtaaaaagtgcagtaaat

SEQ ID NO: 6044438 - DNA, 16 bp, Homo sapiens
catgtaaaacaaaaaa

SEQ ID NO: 6044439 - DNA, 17 bp, Homo sapiens
catgtaaaacagaaaaa

SEQ ID NO: 6044440 - DNA, 16 bp, Homo sapiens
catgtaaaagagtcat

SEQ ID NO: 6044441 - DNA, 13 bp, Homo sapiens
catgtaaaatatg

SEQ ID NO: 6044442 - DNA, 18 bp, Homo sapiens
catgtaaaatcttcagct

SEQ ID NO: 6044443 - DNA, 22 bp, Homo sapiens
catgtaaaatcttcagctggtg

SEQ ID NO: 6044444 - DNA, 17 bp, Homo sapiens
catgtaaaatgcagtcc

SEQ ID NO: 6044445 - DNA, 20 bp, Homo sapiens
catgtaaaatgcagtccaga

SEQ ID NO: 6044446 - DNA, 18 bp, Homo sapiens
catgtaaacaaaatttag

SEQ ID NO: 6044447 - DNA, 16 bp, Homo sapiens
catgtaaactgtgcac

SEQ ID NO: 6044448 - DNA, 13 bp, Homo sapiens
catgtaaagaaaa

SEQ ID NO: 6044449 - DNA, 17 bp, Homo sapiens
catgtaaagaaatgtct

SEQ ID NO: 6044450 - DNA, 21 bp, Homo sapiens
catgtaaagaaatgtcttaat

SEQ ID NO: 6044451 - DNA, 17 bp, Homo sapiens
catgtaaagagctggga

SEQ ID NO: 6044452 - DNA, 14 bp, Homo sapiens
catgtaaaggcctt

SEQ ID NO: 6044453 - DNA, 18 bp, Homo sapiens
catgtaaagtgtcagaag

SEQ ID NO: 6044454 - DNA, 18 bp, Homo sapiens
catgtaaataccagactg

SEQ ID NO: 6044455 - DNA, 15 bp, Homo sapiens
catgtaaatgtaaac

SEQ ID NO: 6044456 - DNA, 16 bp, Homo sapiens
catgtaaattaccagt

SEQ ID NO: 6044457 - DNA, 15 bp, Homo sapiens
catgtaacaaccaga

SEQ ID NO: 6044458 - DNA, 21 bp, Homo sapiens
catgtaacacataaacaattc

SEQ ID NO: 6044459 - DNA, 21 bp, Homo sapiens
catgtaacagttgtgtcataa

SEQ ID NO: 6044460 - DNA, 12 bp, Homo sapiens
catgtaacattg

SEQ ID NO: 6044461 - DNA, 18 bp, Homo sapiens
catgtaaccaagagtatt

SEQ ID NO: 6044462 - DNA, 15 bp, Homo sapiens
catgtaaccactgca

SEQ ID NO: 6044463 - DNA, 22 bp, Homo sapiens
catgtaaccggcatgtttccag

SEQ ID NO: 6044464 - DNA, 19 bp, Homo sapiens
catgtaacgaaacacttca

SEQ ID NO: 6044465 - DNA, 20 bp, Homo sapiens
catgtaacgcaagttcccag

SEQ ID NO: 6044466 - DNA, 21 bp, Homo sapiens
catgtaactatttcttcagag

SEQ ID NO: 6044467 - DNA, 13 bp, Homo sapiens
catgtaactctcc

SEQ ID NO: 6044468 - DNA, 16 bp, Homo sapiens
ccaggcctccagaacc

SEQ ID NO: 6044469 - DNA, 14 bp, Homo sapiens
ccaggcctccagcc

SEQ ID NO: 6044470 - DNA, 15 bp, Homo sapiens
ccaggcctccagcct

SEQ ID NO: 6044471 - DNA, 18 bp, Homo sapiens
ccaggcctccagcctctc

SEQ ID NO: 6044472 - DNA, 16 bp, Homo sapiens
ccaggcctccagctca

SEQ ID NO: 6044473 - DNA, 19 bp, Homo sapiens
ccaggcctccagctcagca

SEQ ID NO: 6044474 - DNA, 13 bp, Homo sapiens
ccaggcctcccgc

SEQ ID NO: 6044475 - DNA, 16 bp, Homo sapiens
ccaggcctccctcggg

SEQ ID NO: 6044476 - DNA, 20 bp, Homo sapiens
ccaggcctcctaggggaagg

SEQ ID NO: 6044477 - DNA, 17 bp, Homo sapiens
ccaggcctcgcctgccc

SEQ ID NO: 6044478 - DNA, 18 bp, Homo sapiens
ccaggcctcgcctgccct

SEQ ID NO: 6044479 - DNA, 21 bp, Homo sapiens
ccaggcctcgcctgccctcct

SEQ ID NO: 6044480 - DNA, 15 bp, Homo sapiens
ccaggcctctctctg

SEQ ID NO: 6044481 - DNA, 21 bp, Homo sapiens
ccaggcctctgccccaagagc

SEQ ID NO: 6044482 - DNA, 13 bp, Homo sapiens
ccaggcctctgct

SEQ ID NO: 6044483 - DNA, 15 bp, Homo sapiens
ccaggcctctgctgc

SEQ ID NO: 6044484 - DNA, 17 bp, Homo sapiens
ccaggcctctgctggct

SEQ ID NO: 6044485 - DNA, 20 bp, Homo sapiens
ccaggcctctgctggctcag

SEQ ID NO: 6044486 - DNA, 22 bp, Homo sapiens
ccaggcctctgctggctcagga

SEQ ID NO: 6044487 - DNA, 13 bp, Homo sapiens
ccaggcctctgtg

SEQ ID NO: 6044488 - DNA, 15 bp, Homo sapiens
ccaggcctctgtgtc

SEQ ID NO: 6044489 - DNA, 16 bp, Homo sapiens
ccaggcctcttggcag

SEQ ID NO: 6044490 - DNA, 19 bp, Homo sapiens
ccaggcctcttggcagtca

SEQ ID NO: 6044491 - DNA, 15 bp, Homo sapiens
ccaggcctgaccagg

SEQ ID NO: 6044492 - DNA, 13 bp, Homo sapiens
ccaggcctgagct

SEQ ID NO: 6044493 - DNA, 17 bp, Homo sapiens
ccaggcctgagctgctt

SEQ ID NO: 6044494 - DNA, 16 bp, Homo sapiens
ccaggcctgaggctgc

SEQ ID NO: 6044495 - DNA, 18 bp, Homo sapiens
ccaggcctgaggctgctg

SEQ ID NO: 6044496 - DNA, 23 bp, Homo sapiens
ccaggcctgattcactggcctgg

SEQ ID NO: 6044497 - DNA, 13 bp, Homo sapiens
ccaggcctgcagc

SEQ ID NO: 6044498 - DNA, 12 bp, Homo sapiens
ccaggcctgccc

SEQ ID NO: 6044499 - DNA, 13 bp, Homo sapiens
ccaggcctgcctc

SEQ ID NO: 6044500 - DNA, 13 bp, Homo sapiens
ccaggcctgcggg

SEQ ID NO: 6044501 - DNA, 22 bp, Homo sapiens
ccaggcctgcgggcccctggtg

SEQ ID NO: 6044502 - DNA, 15 bp, Homo sapiens
ccaggcctgctggca

SEQ ID NO: 6044503 - DNA, 19 bp, Homo sapiens
ccaggcctgctggcatcag

SEQ ID NO: 6044504 - DNA, 13 bp, Homo sapiens
ccaggcctggacg

SEQ ID NO: 6044505 - DNA, 17 bp, Homo sapiens
ccaggcctggacgggcc

SEQ ID NO: 6044506 - DNA, 19 bp, Homo sapiens
ccaggcctggacgggccct

SEQ ID NO: 6044507 - DNA, 13 bp, Homo sapiens
ccaggcctggagg

SEQ ID NO: 6044508 - DNA, 17 bp, Homo sapiens
ccaggcctggagggcac

SEQ ID NO: 6044509 - DNA, 13 bp, Homo sapiens
ccaggcctggcct

SEQ ID NO: 6044510 - DNA, 14 bp, Homo sapiens
ccaggcctggcctc

SEQ ID NO: 6044511 - DNA, 15 bp, Homo sapiens
ccaggcctggcctcg

SEQ ID NO: 6044512 - DNA, 19 bp, Homo sapiens
ccaggcctggcctcggggc

SEQ ID NO: 6044513 - DNA, 15 bp, Homo sapiens
ccaggcctggctccc

SEQ ID NO: 6044514 - DNA, 13 bp, Homo sapiens
ccaggcctggctg

SEQ ID NO: 6044515 - DNA, 12 bp, Homo sapiens
ccaggcctgggt

SEQ ID NO: 6044516 - DNA, 13 bp, Homo sapiens
ccaggcctgggtc

SEQ ID NO: 6044517 - DNA, 17 bp, Homo sapiens
ccaggcctgggtctgtg

SEQ ID NO: 6044518 - DNA, 18 bp, Homo sapiens
ccaggcctgggtctgtgt

SEQ ID NO: 6044519 - DNA, 19 bp, Homo sapiens
ccaggcctgggtctgtgtc

SEQ ID NO: 6044520 - DNA, 20 bp, Homo sapiens
ccaggcctgggtctgtgtct

SEQ ID NO: 6044521 - DNA, 15 bp, Homo sapiens
ccaggcctggtggag

SEQ ID NO: 6044522 - DNA, 19 bp, Homo sapiens
ccaggcctgtccaccctgc

SEQ ID NO: 6044523 - DNA, 18 bp, Homo sapiens
ccaggcctgtggctccct

SEQ ID NO: 6044524 - DNA, 13 bp, Homo sapiens
ccaggccttgtcc

SEQ ID NO: 6044525 - DNA, 13 bp, Homo sapiens
ccaggcctttgga

SEQ ID NO: 6044526 - DNA, 18 bp, Homo sapiens
ccaggcgagcctgactct

SEQ ID NO: 6044527 - DNA, 19 bp, Homo sapiens
ccaggcgagcctgactctg

SEQ ID NO: 6044528 - DNA, 18 bp, Homo sapiens
ccaggcgatgtgcaagtg

SEQ ID NO: 6044529 - DNA, 14 bp, Homo sapiens
ccaggcgcatgtct

SEQ ID NO: 6044530 - DNA, 16 bp, Homo sapiens
ccaggcgcatgtctgc

SEQ ID NO: 6044531 - DNA, 20 bp, Homo sapiens
ccaggcgcatgtctgcacct

SEQ ID NO: 6044532 - DNA, 21 bp, Homo sapiens
ccaggcgcatgtctgcacctc

SEQ ID NO: 6044533 - DNA, 23 bp, Homo sapiens
ccaggcgcatgtctgcacctccg

SEQ ID NO: 6044534 - DNA, 23 bp, Homo sapiens
ccaggcgctagcacagctccctt

SEQ ID NO: 6044535 - DNA, 16 bp, Homo sapiens
ccaggcgctgcagggc

SEQ ID NO: 6044536 - DNA, 21 bp, Homo sapiens
ccaggcgctgggggctggacc

SEQ ID NO: 6044537 - DNA, 23 bp, Homo sapiens
ccaggcggaggggcttggagcag

SEQ ID NO: 6044538 - DNA, 24 bp, Homo sapiens
ccaggcggaggggcttggagcaga

SEQ ID NO: 6044539 - DNA, 19 bp, Homo sapiens
ccaggcggccctggggagg

SEQ ID NO: 6044540 - DNA, 22 bp, Homo sapiens
ccaggcgggagcggtggccctg

SEQ ID NO: 6044541 - DNA, 14 bp, Homo sapiens
ccaggcgggctcaa

SEQ ID NO: 6044542 - DNA, 21 bp, Homo sapiens
ccaggcggggcgccccaagag

SEQ ID NO: 6044543 - DNA, 19 bp, Homo sapiens
ccaggcgtagggccagggc

SEQ ID NO: 6044544 - DNA, 20 bp, Homo sapiens
ccaggcgtagggccagggct

SEQ ID NO: 6044545 - DNA, 21 bp, Homo sapiens
ccaggcgtagggccagggctc

SEQ ID NO: 6044546 - DNA, 14 bp, Homo sapiens
ccaggcgtgggacg

SEQ ID NO: 6044547 - DNA, 19 bp, Homo sapiens
ccaggcgttggtgccactt

SEQ ID NO: 6044548 - DNA, 19 bp, Homo sapiens
ccaggctagagtgcaatgg

SEQ ID NO: 6044549 - DNA, 17 bp, Homo sapiens
ccaggctagagtgcagt

SEQ ID NO: 6044550 - DNA, 19 bp, Homo sapiens
ccaggctagtccggaccca

SEQ ID NO: 6044551 - DNA, 20 bp, Homo sapiens
ccaggctagtccggacccac

SEQ ID NO: 6044552 - DNA, 19 bp, Homo sapiens
ccaggctatggttgccacc

SEQ ID NO: 6044553 - DNA, 22 bp, Homo sapiens
ccaggctatggttgccacccca

SEQ ID NO: 6044554 - DNA, 20 bp, Homo sapiens
ccaggctatgtataaaatac

SEQ ID NO: 6044555 - DNA, 22 bp, Homo sapiens
ccaggctatgtataaaatacat

SEQ ID NO: 6044556 - DNA, 17 bp, Homo sapiens
ccaggctcactcacaga

SEQ ID NO: 6044557 - DNA, 18 bp, Homo sapiens
ccaggctcactcacagag

SEQ ID NO: 6044558 - DNA, 20 bp, Homo sapiens
ccaggctcaggagaagccag

SEQ ID NO: 6044559 - DNA, 21 bp, Homo sapiens
ccaggctcaggagaagccagt

SEQ ID NO: 6044560 - DNA, 18 bp, Homo sapiens
ccaggctcaggctgccca

SEQ ID NO: 6044561 - DNA, 20 bp, Homo sapiens
ccaggctcaggctgcccagc

SEQ ID NO: 6044562 - DNA, 15 bp, Homo sapiens
ccaggctccagcaca

SEQ ID NO: 6044563 - DNA, 16 bp, Homo sapiens
ccaggctccagcacat

SEQ ID NO: 6044564 - DNA, 22 bp, Homo sapiens
ccaggctccagcacatccccct

SEQ ID NO: 6044565 - DNA, 15 bp, Homo sapiens
ccaggctccaggctg

SEQ ID NO: 6044566 - DNA, 15 bp, Homo sapiens
ccaggctccatgggg

SEQ ID NO: 6044567 - DNA, 18 bp, Homo sapiens
ccaggctccatggggaag

SEQ ID NO: 6044568 - DNA, 18 bp, Homo sapiens
ccaggctcccactgcccc

SEQ ID NO: 6044569 - DNA, 19 bp, Homo sapiens
ccaggctcccagcctaagg

SEQ ID NO: 6044570 - DNA, 17 bp, Homo sapiens
ccaggctccctgaccac

SEQ ID NO: 6044571 - DNA, 21 bp, Homo sapiens
ccaggctccctttctcttctt

SEQ ID NO: 6044572 - DNA, 23 bp, Homo sapiens
ccaggctccgcccttagtccccc

SEQ ID NO: 6044573 - DNA, 22 bp, Homo sapiens
ccaggctcctacctgtctgctg

SEQ ID NO: 6044574 - DNA, 23 bp, Homo sapiens
ccaggctcctacctgtctgctgc

SEQ ID NO: 6044575 - DNA, 14 bp, Homo sapiens
ccaggctcctccct

SEQ ID NO: 6044576 - DNA, 16 bp, Homo sapiens
ccaggctcctccctcc

SEQ ID NO: 6044577 - DNA, 22 bp, Homo sapiens
ccaggctcctgaccccgccatg

SEQ ID NO: 6044578 - DNA, 20 bp, Homo sapiens
ccaggctcggaggaccctgg

SEQ ID NO: 6044579 - DNA, 16 bp, Homo sapiens
ccaggctcggcctgcc

SEQ ID NO: 6044580 - DNA, 19 bp, Homo sapiens
ccaggctctccctctctgc

SEQ ID NO: 6044581 - DNA, 23 bp, Homo sapiens
ccaggctctcgcacacctctgca

SEQ ID NO: 6044582 - DNA, 14 bp, Homo sapiens
ccaggctctgctga

SEQ ID NO: 6044583 - DNA, 19 bp, Homo sapiens
ccaggctctggagccagag

SEQ ID NO: 6044584 - DNA, 20 bp, Homo sapiens
ccaggctctggagccagaga

SEQ ID NO: 6044585 - DNA, 13 bp, Homo sapiens
ccaggctctgggc

SEQ ID NO: 6044586 - DNA, 14 bp, Homo sapiens
ccaggctctgggca

SEQ ID NO: 6044587 - DNA, 15 bp, Homo sapiens
ccaggctctgtgctg

SEQ ID NO: 6044588 - DNA, 20 bp, Homo sapiens
ccaggctctgtgctgaccct

SEQ ID NO: 6044589 - DNA, 23 bp, Homo sapiens
ccaggctcttcctggacctgagt

SEQ ID NO: 6044590 - DNA, 16 bp, Homo sapiens
ccaggctgaattacag

SEQ ID NO: 6044591 - DNA, 21 bp, Homo sapiens
ccaggctgaccacagcacagc

SEQ ID NO: 6044592 - DNA, 23 bp, Homo sapiens
ccaggctgactgggggcctctgc

SEQ ID NO: 6044593 - DNA, 13 bp, Homo sapiens
ccaggctgagagc

SEQ ID NO: 6044594 - DNA, 15 bp, Homo sapiens
ccaggctgagccatg

SEQ ID NO: 6044595 - DNA, 18 bp, Homo sapiens
ccaggctgagccatgagg

SEQ ID NO: 6044596 - DNA, 19 bp, Homo sapiens
ccaggctgagccatgagga

SEQ ID NO: 6044597 - DNA, 13 bp, Homo sapiens
ccaggctgagccg

SEQ ID NO: 6044598 - DNA, 22 bp, Homo sapiens
ccaggctgagccgatctggtct

SEQ ID NO: 6044599 - DNA, 15 bp, Homo sapiens
ccaggctgaggtcct

SEQ ID NO: 6044600 - DNA, 16 bp, Homo sapiens
ccaggctgcacagcat

SEQ ID NO: 6044601 - DNA, 12 bp, Homo sapiens
ccaggctgcact

SEQ ID NO: 6044602 - DNA, 16 bp, Homo sapiens
ccaggctgcactgcag

SEQ ID NO: 6044603 - DNA, 23 bp, Homo sapiens
ccaggctgcagcctccacttccc

SEQ ID NO: 6044604 - DNA, 20 bp, Homo sapiens
ccaggctgcccagagctgct

SEQ ID NO: 6044605 - DNA, 12 bp, Homo sapiens
ccaggctgcccc

SEQ ID NO: 6044606 - DNA, 21 bp, Homo sapiens
ccaggctgccgtcccctagag

SEQ ID NO: 6044607 - DNA, 14 bp, Homo sapiens
ccaggctgccgtgg

SEQ ID NO: 6044608 - DNA, 23 bp, Homo sapiens
ccaggctgcctcccttgtggcag

SEQ ID NO: 6044609 - DNA, 21 bp, Homo sapiens
ccaggctgcctcggactccat

SEQ ID NO: 6044610 - DNA, 13 bp, Homo sapiens
ccaggctgcgcct

SEQ ID NO: 6044611 - DNA, 16 bp, Homo sapiens
ccaggctgcgcctgcc

SEQ ID NO: 6044612 - DNA, 18 bp, Homo sapiens
ccaggctgcgcctgcccg

SEQ ID NO: 6044613 - DNA, 20 bp, Homo sapiens
ccaggctgcgcctgcccgcc

SEQ ID NO: 6044614 - DNA, 19 bp, Homo sapiens
ccaggctgctcagggctgg

SEQ ID NO: 6044615 - DNA, 12 bp, Homo sapiens
ccaggctgctgc

SEQ ID NO: 6044616 - DNA, 15 bp, Homo sapiens
ccaggctgctggagt

SEQ ID NO: 6044617 - DNA, 15 bp, Homo sapiens
ccaggctggacaccc

SEQ ID NO: 6044618 - DNA, 19 bp, Homo sapiens
ccaggctggacaccctctg

SEQ ID NO: 6044619 - DNA, 20 bp, Homo sapiens
ccaggctggacaccctctgc

SEQ ID NO: 6044620 - DNA, 18 bp, Homo sapiens
ccaggctggacatgctga

SEQ ID NO: 6044621 - DNA, 21 bp, Homo sapiens
ccaggctggacatgctgactg

SEQ ID NO: 6044622 - DNA, 12 bp, Homo sapiens
ccaggctggagc

SEQ ID NO: 6044623 - DNA, 16 bp, Homo sapiens
ccaggctggagtacag

SEQ ID NO: 6044624 - DNA, 15 bp, Homo sapiens
ccaggctggagtgca

SEQ ID NO: 6044625 - DNA, 17 bp, Homo sapiens
ccaggctggagtgcaat

SEQ ID NO: 6044626 - DNA, 17 bp, Homo sapiens
ccaggctggagtgcagt

SEQ ID NO: 6044627 - DNA, 19 bp, Homo sapiens
ccaggctggagtgcagtgg

SEQ ID NO: 6044628 - DNA, 21 bp, Homo sapiens
ccaggctggagtgcagtggca

SEQ ID NO: 6044629 - DNA, 15 bp, Homo sapiens
ccaggctggatgctg

SEQ ID NO: 6044630 - DNA, 18 bp, Homo sapiens
ccaggctggccagcccca

SEQ ID NO: 6044631 - DNA, 22 bp, Homo sapiens
ccaggctggccagtgctgccca

SEQ ID NO: 6044632 - DNA, 23 bp, Homo sapiens
ccaggctggcccccacccacctt

SEQ ID NO: 6044633 - DNA, 13 bp, Homo sapiens
ccaggctggcgca

SEQ ID NO: 6044634 - DNA, 15 bp, Homo sapiens
ccaggctggcgcagc

SEQ ID NO: 6044635 - DNA, 16 bp, Homo sapiens
ccaggctggcgcagcc

SEQ ID NO: 6044636 - DNA, 12 bp, Homo sapiens
ccaggctggcgt

SEQ ID NO: 6044637 - DNA, 18 bp, Homo sapiens
ccaggctggcgtgcagtg

SEQ ID NO: 6044638 - DNA, 18 bp, Homo sapiens
ccaggctgggagagcctt

SEQ ID NO: 6044639 - DNA, 23 bp, Homo sapiens
ccaggctgggagagccttccagg

SEQ ID NO: 6044640 - DNA, 12 bp, Homo sapiens
ccaggctgggca

SEQ ID NO: 6044641 - DNA, 20 bp, Homo sapiens
ccaggctgggcaaggaggcc

SEQ ID NO: 6044642 - DNA, 13 bp, Homo sapiens
ccaggctgggcat

SEQ ID NO: 6044643 - DNA, 13 bp, Homo sapiens
ccaggctgggccg

SEQ ID NO: 6044644 - DNA, 20 bp, Homo sapiens
ccaggctgggccgcaagggc

SEQ ID NO: 6044645 - DNA, 13 bp, Homo sapiens
ccaggctgggctc

SEQ ID NO: 6044646 - DNA, 15 bp, Homo sapiens
ccaggctgggctgag

SEQ ID NO: 6044647 - DNA, 18 bp, Homo sapiens
ccaggctgggctgagcca

SEQ ID NO: 6044648 - DNA, 22 bp, Homo sapiens
ccaggctgggctgagccaaagc

SEQ ID NO: 6044649 - DNA, 23 bp, Homo sapiens
ccaggctgggctgagccaaagcc

SEQ ID NO: 6044650 - DNA, 13 bp, Homo sapiens
ccaggctggggcc

SEQ ID NO: 6044651 - DNA, 16 bp, Homo sapiens
ccaggctggggccagg

SEQ ID NO: 6044652 - DNA, 14 bp, Homo sapiens
ccaggctggggcct

SEQ ID NO: 6044653 - DNA, 15 bp, Homo sapiens
ccaggctggggcctg

SEQ ID NO: 6044654 - DNA, 23 bp, Homo sapiens
ccaggctggggcctggcctattt

SEQ ID NO: 6044655 - DNA, 21 bp, Homo sapiens
ccaggctgggtcgccctggac

SEQ ID NO: 6044656 - DNA, 23 bp, Homo sapiens
ccaggctggtccgagctgaggac

SEQ ID NO: 6044657 - DNA, 15 bp, Homo sapiens
ccaggctggtctcaa

SEQ ID NO: 6044658 - DNA, 20 bp, Homo sapiens
ccaggctggtctcaaactcc

SEQ ID NO: 6044659 - DNA, 13 bp, Homo sapiens
ccaggctggtctt

SEQ ID NO: 6044660 - DNA, 21 bp, Homo sapiens
ccaggctggtcttgaactcct

SEQ ID NO: 6044661 - DNA, 22 bp, Homo sapiens
ccaggctggtcttgaagtcctg

SEQ ID NO: 6044662 - DNA, 18 bp, Homo sapiens
ccaggctggttcttgggc

SEQ ID NO: 6044663 - DNA, 21 bp, Homo sapiens
ccaggctggttcttgggctag

SEQ ID NO: 6044664 - DNA, 21 bp, Homo sapiens
ccaggctggtttcgaactcct

SEQ ID NO: 6044665 - DNA, 18 bp, Homo sapiens
ccaggctgtcagcgcctc

SEQ ID NO: 6044666 - DNA, 17 bp, Homo sapiens
ccaggctgttctccagg

SEQ ID NO: 6044667 - DNA, 18 bp, Homo sapiens
ccaggctgttctccaggc

SEQ ID NO: 6044668 - DNA, 20 bp, Homo sapiens
ccaggctgttctccaggctt

SEQ ID NO: 6044669 - DNA, 23 bp, Homo sapiens
ccaggctgttcttcaactcctgg

SEQ ID NO: 6044670 - DNA, 21 bp, Homo sapiens
ccaggcttagtcactgagaca

SEQ ID NO: 6044671 - DNA, 23 bp, Homo sapiens
ccaggcttagtcactgagacagc

SEQ ID NO: 6044672 - DNA, 16 bp, Homo sapiens
ccaggcttcacagtct

SEQ ID NO: 6044673 - DNA, 16 bp, Homo sapiens
ccaggcttcaccctga

SEQ ID NO: 6044674 - DNA, 15 bp, Homo sapiens
ccaggcttccgcgcc

SEQ ID NO: 6044675 - DNA, 15 bp, Homo sapiens
ccaggcttcctgccc

SEQ ID NO: 6044676 - DNA, 16 bp, Homo sapiens
ccaggcttcctgccct

SEQ ID NO: 6044677 - DNA, 20 bp, Homo sapiens
ccaggcttcctgccctagca

SEQ ID NO: 6044678 - DNA, 17 bp, Homo sapiens
ccaggcttcctgggtcc

SEQ ID NO: 6044679 - DNA, 21 bp, Homo sapiens
ccaggcttcctgggtcctgcc

SEQ ID NO: 6044680 - DNA, 13 bp, Homo sapiens
ccaggcttctgct

SEQ ID NO: 6044681 - DNA, 18 bp, Homo sapiens
ccaggcttctgctggggc

SEQ ID NO: 6044682 - DNA, 14 bp, Homo sapiens
ccaggcttcttcct

SEQ ID NO: 6044683 - DNA, 17 bp, Homo sapiens
ccaggcttcttcctaca

SEQ ID NO: 6044684 - DNA, 17 bp, Homo sapiens
ccaggcttgcctgggac

SEQ ID NO: 6044685 - DNA, 15 bp, Homo sapiens
ccaggcttttctcag

SEQ ID NO: 6044686 - DNA, 15 bp, Homo sapiens
ccagggaaacagcct

SEQ ID NO: 6044687 - DNA, 16 bp, Homo sapiens
ccagggaaacagcctc

SEQ ID NO: 6044688 - DNA, 18 bp, Homo sapiens
ccagggaactggcctgct

SEQ ID NO: 6044689 - DNA, 14 bp, Homo sapiens
ccagggaagacaga

SEQ ID NO: 6044690 - DNA, 18 bp, Homo sapiens
ccagggaagcagcagcct

SEQ ID NO: 6044691 - DNA, 18 bp, Homo sapiens
ccagggaagctggccgag

SEQ ID NO: 6044692 - DNA, 22 bp, Homo sapiens
ccagggaagtgtgtgtgtgtcc

SEQ ID NO: 6044693 - DNA, 21 bp, Homo sapiens
ccagggaagtttttaaaaatg

SEQ ID NO: 6044694 - DNA, 15 bp, Homo sapiens
ccagggaatcaggga

SEQ ID NO: 6044695 - DNA, 21 bp, Homo sapiens
ccagggaatcagggaccagct

SEQ ID NO: 6044696 - DNA, 15 bp, Homo sapiens
ccagggaatccaagc

SEQ ID NO: 6044697 - DNA, 12 bp, Homo sapiens
ccagggaattct

SEQ ID NO: 6044698 - DNA, 16 bp, Homo sapiens
ccagggacacacagcc

SEQ ID NO: 6044699 - DNA, 21 bp, Homo sapiens
ccagggacaccagccaggctc

SEQ ID NO: 6044700 - DNA, 14 bp, Homo sapiens
ccagggacactcca

SEQ ID NO: 6044701 - DNA, 11 bp, Homo sapiens
ccagggacaga

SEQ ID NO: 6044702 - DNA, 15 bp, Homo sapiens
ccagggacagacgct

SEQ ID NO: 6044703 - DNA, 14 bp, Homo sapiens
ccagggacagaggc

SEQ ID NO: 6044704 - DNA, 17 bp, Homo sapiens
ccagggacagaggccaa

SEQ ID NO: 6044705 - DNA, 18 bp, Homo sapiens
ccagggacagaggcccca

SEQ ID NO: 6044706 - DNA, 15 bp, Homo sapiens
ccagggacagagggg

SEQ ID NO: 6044707 - DNA, 23 bp, Homo sapiens
ccagggacagagggggtggcctc

SEQ ID NO: 6044708 - DNA, 20 bp, Homo sapiens
ccagggacattgcagagtgg

SEQ ID NO: 6044709 - DNA, 22 bp, Homo sapiens
ccagggaccactgggtgagaga

SEQ ID NO: 6044710 - DNA, 16 bp, Homo sapiens
ccagggaccagcacct

SEQ ID NO: 6044711 - DNA, 21 bp, Homo sapiens
ccagggaccagcccagcctgc

SEQ ID NO: 6044712 - DNA, 22 bp, Homo sapiens
ccagggaccagcccagcctgca

SEQ ID NO: 6044713 - DNA, 22 bp, Homo sapiens
ccagggacccaaagcaggatga

SEQ ID NO: 6044714 - DNA, 12 bp, Homo sapiens
ccagggacccag

SEQ ID NO: 6044715 - DNA, 20 bp, Homo sapiens
ccagggacccaggtgtgcct

SEQ ID NO: 6044716 - DNA, 15 bp, Homo sapiens
ccagggacccccaga

SEQ ID NO: 6044717 - DNA, 13 bp, Homo sapiens
ccagggacccccg

SEQ ID NO: 6044718 - DNA, 20 bp, Homo sapiens
ccagggacccttgcctgcct

SEQ ID NO: 6044719 - DNA, 23 bp, Homo sapiens
ccagggacccttgcctgcctcct

SEQ ID NO: 6044720 - DNA, 14 bp, Homo sapiens
ccagggaccggcgg

SEQ ID NO: 6044721 - DNA, 21 bp, Homo sapiens
ccagggacgaagaagagccac

SEQ ID NO: 6044722 - DNA, 17 bp, Homo sapiens
ccagggactatctttgc

SEQ ID NO: 6044723 - DNA, 14 bp, Homo sapiens
ccagggactgacac

SEQ ID NO: 6044724 - DNA, 22 bp, Homo sapiens
ccagggactgcagctgcaccag

SEQ ID NO: 6044725 - DNA, 13 bp, Homo sapiens
ccagggagaagct

SEQ ID NO: 6044726 - DNA, 15 bp, Homo sapiens
ccagggagaatctga

SEQ ID NO: 6044727 - DNA, 16 bp, Homo sapiens
ccagggagacctggac

SEQ ID NO: 6044728 - DNA, 18 bp, Homo sapiens
ccagggagacctggacac

SEQ ID NO: 6044729 - DNA, 21 bp, Homo sapiens
ccagggagacctggacacagg

SEQ ID NO: 6044730 - DNA, 18 bp, Homo sapiens
ccagggagactccgctgt

SEQ ID NO: 6044731 - DNA, 22 bp, Homo sapiens
ccagggagactccgctgtggga

SEQ ID NO: 6044732 - DNA, 18 bp, Homo sapiens
ccagggagagcccaggag

SEQ ID NO: 6044733 - DNA, 19 bp, Homo sapiens
ccagggagagcccaggagc

SEQ ID NO: 6044734 - DNA, 20 bp, Homo sapiens
ccagggagagcccaggagct

SEQ ID NO: 6044735 - DNA, 14 bp, Homo sapiens
ccagggagaggcca

SEQ ID NO: 6044736 - DNA, 14 bp, Homo sapiens
ccagggagaggcct

SEQ ID NO: 6044737 - DNA, 15 bp, Homo sapiens
ccagggagaggcctc

SEQ ID NO: 6044738 - DNA, 15 bp, Homo sapiens
ccagggagaggctgt

SEQ ID NO: 6044739 - DNA, 18 bp, Homo sapiens
ccagggagagggggctgg

SEQ ID NO: 6044740 - DNA, 15 bp, Homo sapiens
ccagggagattttga

SEQ ID NO: 6044741 - DNA, 18 bp, Homo sapiens
ccagggagcaagacagag

SEQ ID NO: 6044742 - DNA, 23 bp, Homo sapiens
ccagggagcatgagaggaggcag

SEQ ID NO: 6044743 - DNA, 19 bp, Homo sapiens
ccagggagcattttcctcc

SEQ ID NO: 6044744 - DNA, 20 bp, Homo sapiens
ccagggagcattttcctcca

SEQ ID NO: 6044745 - DNA, 14 bp, Homo sapiens
ccagggagcctaga

SEQ ID NO: 6044746 - DNA, 23 bp, Homo sapiens
ccagggagcggaaagcagctcaa

SEQ ID NO: 6044747 - DNA, 16 bp, Homo sapiens
ccagggagctctgggg

SEQ ID NO: 6044748 - DNA, 23 bp, Homo sapiens
ccagggagctctggggacagctt

SEQ ID NO: 6044749 - DNA, 23 bp, Homo sapiens
ccagggagctgatgccccttctc

SEQ ID NO: 6044750 - DNA, 13 bp, Homo sapiens
ccagggagctgca

SEQ ID NO: 6044751 - DNA, 15 bp, Homo sapiens
ccagggagctgcagg

SEQ ID NO: 6044752 - DNA, 19 bp, Homo sapiens
ccagggagctgcaggggca

SEQ ID NO: 6044753 - DNA, 18 bp, Homo sapiens
ccagggagcttcctggct

SEQ ID NO: 6044754 - DNA, 23 bp, Homo sapiens
ccagggagcttcctggctctggg

SEQ ID NO: 6044755 - DNA, 17 bp, Homo sapiens
ccagggaggaaggaggc

SEQ ID NO: 6044756 - DNA, 10 bp, Homo sapiens
ccagggaggc

SEQ ID NO: 6044757 - DNA, 13 bp, Homo sapiens
ccagggaggcagc

SEQ ID NO: 6044758 - DNA, 23 bp, Homo sapiens
ccagggaggcagcctagcctatg

SEQ ID NO: 6044759 - DNA, 21 bp, Homo sapiens
ccagggaggcagcgtgggctc

SEQ ID NO: 6044760 - DNA, 12 bp, Homo sapiens
ccagggaggcgc

SEQ ID NO: 6044761 - DNA, 14 bp, Homo sapiens
ccagggaggcgcag

SEQ ID NO: 6044762 - DNA, 18 bp, Homo sapiens
ccagggaggcgcagggac

SEQ ID NO: 6044763 - DNA, 17 bp, Homo sapiens
ccagggaggctggtcct

SEQ ID NO: 6044764 - DNA, 19 bp, Homo sapiens
ccagggagggaagtgtgag

SEQ ID NO: 6044765 - DNA, 20 bp, Homo sapiens
ccagggagggaagtgtgagc

SEQ ID NO: 6044766 - DNA, 13 bp, Homo sapiens
ccagggaggggtc

SEQ ID NO: 6044767 - DNA, 14 bp, Homo sapiens
ccagggaggggtcc

SEQ ID NO: 6044768 - DNA, 19 bp, Homo sapiens
ccagggagggtatttattg

SEQ ID NO: 6044769 - DNA, 12 bp, Homo sapiens
ccagggagggtg

SEQ ID NO: 6044770 - DNA, 22 bp, Homo sapiens
ccagggagggtgagctggtgcc

SEQ ID NO: 6044771 - DNA, 14 bp, Homo sapiens
ccagggagtccagg

SEQ ID NO: 6044772 - DNA, 17 bp, Homo sapiens
ccagggagtccagggtt

SEQ ID NO: 6044773 - DNA, 23 bp, Homo sapiens
ccagggagtccagggtttctctg

SEQ ID NO: 6044774 - DNA, 17 bp, Homo sapiens
ccagggagtcccctccc

SEQ ID NO: 6044775 - DNA, 12 bp, Homo sapiens
ccagggagtgag

SEQ ID NO: 6044776 - DNA, 18 bp, Homo sapiens
ccagggagtgagcagcta

SEQ ID NO: 6044777 - DNA, 18 bp, Homo sapiens
ccagggagtggggaggag

SEQ ID NO: 6044778 - DNA, 20 bp, Homo sapiens
ccagggatgattcaagccat

SEQ ID NO: 6044779 - DNA, 23 bp, Homo sapiens
ccagggatgccatctgtgggcac

SEQ ID NO: 6044780 - DNA, 15 bp, Homo sapiens
ccagggatgctgggc

SEQ ID NO: 6044781 - DNA, 17 bp, Homo sapiens
ccagggatgctgggctg

SEQ ID NO: 6044782 - DNA, 20 bp, Homo sapiens
ccagggatgctgggctgggc

SEQ ID NO: 6044783 - DNA, 17 bp, Homo sapiens
ccagggatggcagtggc

SEQ ID NO: 6044784 - DNA, 18 bp, Homo sapiens
ccagggatggcagtggct

SEQ ID NO: 6044785 - DNA, 17 bp, Homo sapiens
ccagggatggggccaca

SEQ ID NO: 6044786 - DNA, 20 bp, Homo sapiens
ccagggatgtctgttgaaat

SEQ ID NO: 6044787 - DNA, 13 bp, Homo sapiens
ccagggcaaatgt

SEQ ID NO: 6044788 - DNA, 23 bp, Homo sapiens
ccagggcaaatgtttacattttg

SEQ ID NO: 6044789 - DNA, 20 bp, Homo sapiens
ccagggcaagctccgcagga

SEQ ID NO: 6044790 - DNA, 19 bp, Homo sapiens
ccagggcaaggccccttcc

SEQ ID NO: 6044791 - DNA, 13 bp, Homo sapiens
ccagggcaatgcc

SEQ ID NO: 6044792 - DNA, 16 bp, Homo sapiens
ccagggcaatgccatc

SEQ ID NO: 6044793 - DNA, 13 bp, Homo sapiens
ccagggcacagct

SEQ ID NO: 6044794 - DNA, 15 bp, Homo sapiens
ccagggcacaggagc

SEQ ID NO: 6044795 - DNA, 22 bp, Homo sapiens
ccagggcacaggagctacctgt

SEQ ID NO: 6044796 - DNA, 16 bp, Homo sapiens
ccagggcaccatccag

SEQ ID NO: 6044797 - DNA, 13 bp, Homo sapiens
ccagggcacccag

SEQ ID NO: 6044798 - DNA, 11 bp, Homo sapiens
ccagggcactg

SEQ ID NO: 6044799 - DNA, 15 bp, Homo sapiens
ccagggcactgccag

SEQ ID NO: 6044800 - DNA, 19 bp, Homo sapiens
ccagggcacttcacagagt

SEQ ID NO: 6044801 - DNA, 15 bp, Homo sapiens
ccagggcagcagccg

SEQ ID NO: 6044802 - DNA, 14 bp, Homo sapiens
ccagggcagccagg

SEQ ID NO: 6044803 - DNA, 20 bp, Homo sapiens
ccagggcagccagggagagc

SEQ ID NO: 6044804 - DNA, 11 bp, Homo sapiens
ccagggcaggg

SEQ ID NO: 6044805 - DNA, 13 bp, Homo sapiens
ccagggcagggcc

SEQ ID NO: 6044806 - DNA, 16 bp, Homo sapiens
ccagggcagggccacc

SEQ ID NO: 6044807 - DNA, 20 bp, Homo sapiens
ccagggcagggcgagctgca

SEQ ID NO: 6044808 - DNA, 20 bp, Homo sapiens
ccagggcagggtctgggctg

SEQ ID NO: 6044809 - DNA, 21 bp, Homo sapiens
ccagggcagggtgggcagcct

SEQ ID NO: 6044810 - DNA, 23 bp, Homo sapiens
ccagggcagggtgggcagcctat

SEQ ID NO: 6044811 - DNA, 12 bp, Homo sapiens
ccagggcagtgc

SEQ ID NO: 6044812 - DNA, 14 bp, Homo sapiens
ccagggcagtgcta

SEQ ID NO: 6044813 - DNA, 22 bp, Homo sapiens
ccagggcagtgtggtgggaggg

SEQ ID NO: 6044814 - DNA, 17 bp, Homo sapiens
ccagggcatctctgggc

SEQ ID NO: 6044815 - DNA, 19 bp, Homo sapiens
ccagggcatctctgggctg

SEQ ID NO: 6044816 - DNA, 15 bp, Homo sapiens
ccagggcatctggga

SEQ ID NO: 6044817 - DNA, 16 bp, Homo sapiens
ccagggcatgtgtatg

SEQ ID NO: 6044818 - DNA, 19 bp, Homo sapiens
ccagggcattcgggccaca

SEQ ID NO: 6044819 - DNA, 15 bp, Homo sapiens
ccagggcattgctca

SEQ ID NO: 6044820 - DNA, 16 bp, Homo sapiens
ccagggcattgctcag

SEQ ID NO: 6044821 - DNA, 17 bp, Homo sapiens
ccagggcattgctcagc

SEQ ID NO: 6044822 - DNA, 20 bp, Homo sapiens
ccagggcattgctcagcccg

SEQ ID NO: 6044823 - DNA, 22 bp, Homo sapiens
ccagggcattgctcagcccgct

SEQ ID NO: 6044824 - DNA, 14 bp, Homo sapiens
catgtaactgccta

SEQ ID NO: 6044825 - DNA, 20 bp, Homo sapiens
catgtaactgcctagaaaca

SEQ ID NO: 6044826 - DNA, 21 bp, Homo sapiens
catgtaactgcctagaaacaa

SEQ ID NO: 6044827 - DNA, 20 bp, Homo sapiens
catgtaacttttttatttta

SEQ ID NO: 6044828 - DNA, 16 bp, Homo sapiens
catgtaagaaaatgtt

SEQ ID NO: 6044829 - DNA, 18 bp, Homo sapiens
catgtaagaaaatgttac

SEQ ID NO: 6044830 - DNA, 14 bp, Homo sapiens
catgtaagaaataa

SEQ ID NO: 6044831 - DNA, 17 bp, Homo sapiens
catgtaagctgaaaata

SEQ ID NO: 6044832 - DNA, 23 bp, Homo sapiens
catgtaagtagcaaacagggctt

SEQ ID NO: 6044833 - DNA, 12 bp, Homo sapiens
catgtaataaaa

SEQ ID NO: 6044834 - DNA, 12 bp, Homo sapiens
catgtaataaat

SEQ ID NO: 6044835 - DNA, 16 bp, Homo sapiens
catgtaataaatctga

SEQ ID NO: 6044836 - DNA, 17 bp, Homo sapiens
catgtaataaattcaaa

SEQ ID NO: 6044837 - DNA, 22 bp, Homo sapiens
catgtaataaattcaaaacctg

SEQ ID NO: 6044838 - DNA, 21 bp, Homo sapiens
catgtaataagcacttgcctg

SEQ ID NO: 6044839 - DNA, 14 bp, Homo sapiens
catgtaatatattt

SEQ ID NO: 6044840 - DNA, 15 bp, Homo sapiens
catgtaatatatttc

SEQ ID NO: 6044841 - DNA, 15 bp, Homo sapiens
catgtaatattaaat

SEQ ID NO: 6044842 - DNA, 19 bp, Homo sapiens
catgtaatattaaattcct

SEQ ID NO: 6044843 - DNA, 14 bp, Homo sapiens
catgtaatcctcaa

SEQ ID NO: 6044844 - DNA, 13 bp, Homo sapiens
catgtaatgatct

SEQ ID NO: 6044845 - DNA, 15 bp, Homo sapiens
catgtaatggactat

SEQ ID NO: 6044846 - DNA, 20 bp, Homo sapiens
catgtaattatctagtagtt

SEQ ID NO: 6044847 - DNA, 21 bp, Homo sapiens
catgtacaaaaattatgcaat

SEQ ID NO: 6044848 - DNA, 23 bp, Homo sapiens
catgtacaaaatcgattggcttt

SEQ ID NO: 6044849 - DNA, 19 bp, Homo sapiens
catgtacaatgatgtaaat

SEQ ID NO: 6044850 - DNA, 16 bp, Homo sapiens
catgtacagacagaga

SEQ ID NO: 6044851 - DNA, 21 bp, Homo sapiens
catgtacatagtaaagtattt

SEQ ID NO: 6044852 - DNA, 18 bp, Homo sapiens
catgtacatttgaaaata

SEQ ID NO: 6044853 - DNA, 13 bp, Homo sapiens
catgtacatttgg

SEQ ID NO: 6044854 - DNA, 17 bp, Homo sapiens
catgtacatttggaact

SEQ ID NO: 6044855 - DNA, 16 bp, Homo sapiens
catgtaccagtgtact

SEQ ID NO: 6044856 - DNA, 23 bp, Homo sapiens
catgtaccagtgtactgctttca

SEQ ID NO: 6044857 - DNA, 15 bp, Homo sapiens
catgtaccatcaata

SEQ ID NO: 6044858 - DNA, 16 bp, Homo sapiens
catgtacctcccctgc

SEQ ID NO: 6044859 - DNA, 17 bp, Homo sapiens
catgtacctcccctgcc

SEQ ID NO: 6044860 - DNA, 18 bp, Homo sapiens
catgtacctcccctgcct

SEQ ID NO: 6044861 - DNA, 19 bp, Homo sapiens
catgtacctcccctgcctt

SEQ ID NO: 6044862 - DNA, 20 bp, Homo sapiens
catgtacctcccctgccttg

SEQ ID NO: 6044863 - DNA, 23 bp, Homo sapiens
catgtactacacttctgaaactt

SEQ ID NO: 6044864 - DNA, 17 bp, Homo sapiens
catgtactacagctata

SEQ ID NO: 6044865 - DNA, 22 bp, Homo sapiens
catgtactagttttagttttct

SEQ ID NO: 6044866 - DNA, 20 bp, Homo sapiens
catgtactccagagggacag

SEQ ID NO: 6044867 - DNA, 16 bp, Homo sapiens
catgtactgagacaaa

SEQ ID NO: 6044868 - DNA, 19 bp, Homo sapiens
catgtactgagccttgtaa

SEQ ID NO: 6044869 - DNA, 22 bp, Homo sapiens
catgtactgcattatttgagaa

SEQ ID NO: 6044870 - DNA, 23 bp, Homo sapiens
catgtactgcattatttgagaag

SEQ ID NO: 6044871 - DNA, 19 bp, Homo sapiens
catgtactgctagtacctg

SEQ ID NO: 6044872 - DNA, 20 bp, Homo sapiens
catgtactgctagtacctgt

SEQ ID NO: 6044873 - DNA, 21 bp, Homo sapiens
catgtactgctagtacctgta

SEQ ID NO: 6044874 - DNA, 19 bp, Homo sapiens
catgtactgtacttcccaa

SEQ ID NO: 6044875 - DNA, 20 bp, Homo sapiens
catgtactgttactgtgtca

SEQ ID NO: 6044876 - DNA, 21 bp, Homo sapiens
catgtactgttactgtgtcag

SEQ ID NO: 6044877 - DNA, 19 bp, Homo sapiens
catgtacttccctcttgaa

SEQ ID NO: 6044878 - DNA, 16 bp, Homo sapiens
catgtacttcctgtgt

SEQ ID NO: 6044879 - DNA, 15 bp, Homo sapiens
catgtacttgaagga

SEQ ID NO: 6044880 - DNA, 13 bp, Homo sapiens
catgtacttgttt

SEQ ID NO: 6044881 - DNA, 22 bp, Homo sapiens
catgtactttttagtaatttct

SEQ ID NO: 6044882 - DNA, 14 bp, Homo sapiens
catgtagaaaacaa

SEQ ID NO: 6044883 - DNA, 15 bp, Homo sapiens
catgtagaacttgaa

SEQ ID NO: 6044884 - DNA, 22 bp, Homo sapiens
catgtagaacttgaactaacat

SEQ ID NO: 6044885 - DNA, 23 bp, Homo sapiens
catgtagaacttgaactaacata

SEQ ID NO: 6044886 - DNA, 21 bp, Homo sapiens
catgtagaagagggagaagga

SEQ ID NO: 6044887 - DNA, 15 bp, Homo sapiens
catgtagaagctgca

SEQ ID NO: 6044888 - DNA, 16 bp, Homo sapiens
catgtagactgtgcca

SEQ ID NO: 6044889 - DNA, 12 bp, Homo sapiens
catgtagagaaa

SEQ ID NO: 6044890 - DNA, 19 bp, Homo sapiens
catgtagagaaaagcacac

SEQ ID NO: 6044891 - DNA, 14 bp, Homo sapiens
catgtagcagacaa

SEQ ID NO: 6044892 - DNA, 19 bp, Homo sapiens
catgtagcagtgagtcata

SEQ ID NO: 6044893 - DNA, 10 bp, Homo sapiens
catgtagcat

SEQ ID NO: 6044894 - DNA, 17 bp, Homo sapiens
catgtagcatataaatg

SEQ ID NO: 6044895 - DNA, 21 bp, Homo sapiens
catgtagcatataaatgttta

SEQ ID NO: 6044896 - DNA, 17 bp, Homo sapiens
catgtagccacccaact

SEQ ID NO: 6044897 - DNA, 22 bp, Homo sapiens
catgtagccccctggcctctgt

SEQ ID NO: 6044898 - DNA, 14 bp, Homo sapiens
catgtagctgagtt

SEQ ID NO: 6044899 - DNA, 18 bp, Homo sapiens
catgtaggaagtaggaag

SEQ ID NO: 6044900 - DNA, 18 bp, Homo sapiens
catgtagggcaagaggat

SEQ ID NO: 6044901 - DNA, 20 bp, Homo sapiens
catgtagggtgatgagcact

SEQ ID NO: 6044902 - DNA, 16 bp, Homo sapiens
catgtaggtgagcctg

SEQ ID NO: 6044903 - DNA, 17 bp, Homo sapiens
catgtaggtgagcctgg

SEQ ID NO: 6044904 - DNA, 19 bp, Homo sapiens
catgtaggtgagcctgggc

SEQ ID NO: 6044905 - DNA, 22 bp, Homo sapiens
catgtaggtgagcctgggcagc

SEQ ID NO: 6044906 - DNA, 21 bp, Homo sapiens
catgtagtaacactaatatat

SEQ ID NO: 6044907 - DNA, 23 bp, Homo sapiens
catgtagtgtgggaggctcctgt

SEQ ID NO: 6044908 - DNA, 22 bp, Homo sapiens
catgtagttgaatttcagtcct

SEQ ID NO: 6044909 - DNA, 13 bp, Homo sapiens
catgtataaatga

SEQ ID NO: 6044910 - DNA, 17 bp, Homo sapiens
catgtataaatgtgata

SEQ ID NO: 6044911 - DNA, 15 bp, Homo sapiens
catgtataatatttt

SEQ ID NO: 6044912 - DNA, 18 bp, Homo sapiens
catgtataatatttttaa

SEQ ID NO: 6044913 - DNA, 19 bp, Homo sapiens
catgtataatttttttctt

SEQ ID NO: 6044914 - DNA, 17 bp, Homo sapiens
catgtatactccataga

SEQ ID NO: 6044915 - DNA, 12 bp, Homo sapiens
catgtatactta

SEQ ID NO: 6044916 - DNA, 15 bp, Homo sapiens
catgtatagctagct

SEQ ID NO: 6044917 - DNA, 22 bp, Homo sapiens
catgtataggtatgatctgtgt

SEQ ID NO: 6044918 - DNA, 13 bp, Homo sapiens
catgtatagtgag

SEQ ID NO: 6044919 - DNA, 20 bp, Homo sapiens
catgtatagttgcttttgaa

SEQ ID NO: 6044920 - DNA, 19 bp, Homo sapiens
catgtatagttttccctat

SEQ ID NO: 6044921 - DNA, 15 bp, Homo sapiens
catgtatcataatta

SEQ ID NO: 6044922 - DNA, 22 bp, Homo sapiens
catgtatctctaatgaaattgt

SEQ ID NO: 6044923 - DNA, 14 bp, Homo sapiens
catgtatctgtcta

SEQ ID NO: 6044924 - DNA, 23 bp, Homo sapiens
catgtatctgtctactttctctt

SEQ ID NO: 6044925 - DNA, 23 bp, Homo sapiens
catgtatgaaattggttttccag

SEQ ID NO: 6044926 - DNA, 22 bp, Homo sapiens
catgtatgcaagttttgtgact

SEQ ID NO: 6044927 - DNA, 13 bp, Homo sapiens
catgtatgccatg

SEQ ID NO: 6044928 - DNA, 14 bp, Homo sapiens
catgtatggccagg

SEQ ID NO: 6044929 - DNA, 22 bp, Homo sapiens
catgtatgtatgagacagaaac

SEQ ID NO: 6044930 - DNA, 13 bp, Homo sapiens
catgtatgtccat

SEQ ID NO: 6044931 - DNA, 21 bp, Homo sapiens
catgtatgtggtatgtatatt

SEQ ID NO: 6044932 - DNA, 12 bp, Homo sapiens
catgtatgtgtg

SEQ ID NO: 6044933 - DNA, 13 bp, Homo sapiens
catgtatgtgtgt

SEQ ID NO: 6044934 - DNA, 15 bp, Homo sapiens
catgtatgttgcatg

SEQ ID NO: 6044935 - DNA, 17 bp, Homo sapiens
catgtatgttgcatgaa

SEQ ID NO: 6044936 - DNA, 21 bp, Homo sapiens
catgtatgttttggtatctgt

SEQ ID NO: 6044937 - DNA, 20 bp, Homo sapiens
catgtattagccagtcattg

SEQ ID NO: 6044938 - DNA, 15 bp, Homo sapiens
catgtattagctcac

SEQ ID NO: 6044939 - DNA, 17 bp, Homo sapiens
catgtattatcacatca

SEQ ID NO: 6044940 - DNA, 14 bp, Homo sapiens
catgtattatgaaa

SEQ ID NO: 6044941 - DNA, 18 bp, Homo sapiens
catgtattatgaaaaaga

SEQ ID NO: 6044942 - DNA, 22 bp, Homo sapiens
catgtattatgaaaaagattat

SEQ ID NO: 6044943 - DNA, 21 bp, Homo sapiens
catgtattcacacacccctca

SEQ ID NO: 6044944 - DNA, 13 bp, Homo sapiens
catgtattcatcc

SEQ ID NO: 6044945 - DNA, 17 bp, Homo sapiens
catgtattcatccagag

SEQ ID NO: 6044946 - DNA, 17 bp, Homo sapiens
catgtattgcacattgt

SEQ ID NO: 6044947 - DNA, 16 bp, Homo sapiens
catgtattggcctgga

SEQ ID NO: 6044948 - DNA, 17 bp, Homo sapiens
catgtattgtaaacaga

SEQ ID NO: 6044949 - DNA, 22 bp, Homo sapiens
catgtattgtaaacagaaggag

SEQ ID NO: 6044950 - DNA, 19 bp, Homo sapiens
catgtatttaaagaacact

SEQ ID NO: 6044951 - DNA, 23 bp, Homo sapiens
catgtatttatctctatttaata

SEQ ID NO: 6044952 - DNA, 21 bp, Homo sapiens
catgtatttcagggacctcag

SEQ ID NO: 6044953 - DNA, 15 bp, Homo sapiens
catgtatttctttag

SEQ ID NO: 6044954 - DNA, 17 bp, Homo sapiens
catgtatttctttagaa

SEQ ID NO: 6044955 - DNA, 15 bp, Homo sapiens
catgtatttggtgat

SEQ ID NO: 6044956 - DNA, 16 bp, Homo sapiens
catgtatttgttatat

SEQ ID NO: 6044957 - DNA, 13 bp, Homo sapiens
catgtattttaca

SEQ ID NO: 6044958 - DNA, 16 bp, Homo sapiens
catgtattttacacaa

SEQ ID NO: 6044959 - DNA, 14 bp, Homo sapiens
catgtcaaacaaat

SEQ ID NO: 6044960 - DNA, 21 bp, Homo sapiens
catgtcaaagtgaaagacatt

SEQ ID NO: 6044961 - DNA, 23 bp, Homo sapiens
catgtcaaagtgaaagacatttc

SEQ ID NO: 6044962 - DNA, 22 bp, Homo sapiens
catgtcaacaatccacatcaga

SEQ ID NO: 6044963 - DNA, 18 bp, Homo sapiens
catgtcaacttctggctc

SEQ ID NO: 6044964 - DNA, 19 bp, Homo sapiens
catgtcaagagtcgctgtg

SEQ ID NO: 6044965 - DNA, 19 bp, Homo sapiens
catgtcaagattcagctag

SEQ ID NO: 6044966 - DNA, 12 bp, Homo sapiens
catgtcaatcaa

SEQ ID NO: 6044967 - DNA, 14 bp, Homo sapiens
catgtcacatgaca

SEQ ID NO: 6044968 - DNA, 20 bp, Homo sapiens
catgtcaccggatcctgggt

SEQ ID NO: 6044969 - DNA, 20 bp, Homo sapiens
catgtcaccggtcagtgcct

SEQ ID NO: 6044970 - DNA, 20 bp, Homo sapiens
catgtcaccgtggaccttcc

SEQ ID NO: 6044971 - DNA, 12 bp, Homo sapiens
catgtcacctca

SEQ ID NO: 6044972 - DNA, 15 bp, Homo sapiens
catgtcacctcagct

SEQ ID NO: 6044973 - DNA, 17 bp, Homo sapiens
catgtcacctcagctga

SEQ ID NO: 6044974 - DNA, 16 bp, Homo sapiens
catgtcacctggctgc

SEQ ID NO: 6044975 - DNA, 20 bp, Homo sapiens
catgtcactaaacaagaaat

SEQ ID NO: 6044976 - DNA, 13 bp, Homo sapiens
catgtcagacaca

SEQ ID NO: 6044977 - DNA, 13 bp, Homo sapiens
catgtcagagcac

SEQ ID NO: 6044978 - DNA, 17 bp, Homo sapiens
catgtcagagccaggct

SEQ ID NO: 6044979 - DNA, 16 bp, Homo sapiens
catgtcagaggacccc

SEQ ID NO: 6044980 - DNA, 21 bp, Homo sapiens
catgtcagaggaccccagggt

SEQ ID NO: 6044981 - DNA, 21 bp, Homo sapiens
catgtcagataagtgtaaata

SEQ ID NO: 6044982 - DNA, 23 bp, Homo sapiens
catgtcagcaaaaagcaaaatca

SEQ ID NO: 6044983 - DNA, 18 bp, Homo sapiens
catgtcagccactgtgat

SEQ ID NO: 6044984 - DNA, 22 bp, Homo sapiens
catgtcagcctcatgccccagg

SEQ ID NO: 6044985 - DNA, 16 bp, Homo sapiens
catgtcaggcctgtgt

SEQ ID NO: 6044986 - DNA, 19 bp, Homo sapiens
catgtcatcaaaatctgca

SEQ ID NO: 6044987 - DNA, 18 bp, Homo sapiens
catgtcattgcccacttc

SEQ ID NO: 6044988 - DNA, 20 bp, Homo sapiens
catgtcatttgactgtctca

SEQ ID NO: 6044989 - DNA, 23 bp, Homo sapiens
catgtcatttgactgtctcactt

SEQ ID NO: 6044990 - DNA, 17 bp, Homo sapiens
catgtcatttgcacaca

SEQ ID NO: 6044991 - DNA, 12 bp, Homo sapiens
catgtccaaaga

SEQ ID NO: 6044992 - DNA, 13 bp, Homo sapiens
catgtccaaagag

SEQ ID NO: 6044993 - DNA, 14 bp, Homo sapiens
catgtccaaagagg

SEQ ID NO: 6044994 - DNA, 15 bp, Homo sapiens
catgtccaaagaggc

SEQ ID NO: 6044995 - DNA, 15 bp, Homo sapiens
catgtccaagaagcc

SEQ ID NO: 6044996 - DNA, 19 bp, Homo sapiens
catgtccaagtccaacctg

SEQ ID NO: 6044997 - DNA, 23 bp, Homo sapiens
catgtccaagttcttcacctcta

SEQ ID NO: 6044998 - DNA, 19 bp, Homo sapiens
catgtccagagggactgga

SEQ ID NO: 6044999 - DNA, 20 bp, Homo sapiens
catgtccagcaccttgtgcc

SEQ ID NO: 6045000 - DNA, 22 bp, Homo sapiens
catgtccagcaccttgtgcctg

SEQ ID NO: 6045001 - DNA, 13 bp, Homo sapiens
ccagggccaaaag

SEQ ID NO: 6045002 - DNA, 14 bp, Homo sapiens
ccagggccacgctc

SEQ ID NO: 6045003 - DNA, 19 bp, Homo sapiens
ccagggccacgctccagct

SEQ ID NO: 6045004 - DNA, 17 bp, Homo sapiens
ccagggccacgtgccag

SEQ ID NO: 6045005 - DNA, 21 bp, Homo sapiens
ccagggccacgtgccaggccc

SEQ ID NO: 6045006 - DNA, 22 bp, Homo sapiens
ccagggccacgtgccaggcccg

SEQ ID NO: 6045007 - DNA, 21 bp, Homo sapiens
ccagggccactctgcctctgc

SEQ ID NO: 6045008 - DNA, 13 bp, Homo sapiens
ccagggccagagc

SEQ ID NO: 6045009 - DNA, 15 bp, Homo sapiens
ccagggccagagcag

SEQ ID NO: 6045010 - DNA, 17 bp, Homo sapiens
ccagggccagagcagct

SEQ ID NO: 6045011 - DNA, 17 bp, Homo sapiens
ccagggccagctaattt

SEQ ID NO: 6045012 - DNA, 23 bp, Homo sapiens
ccagggccagctaatttttgtat

SEQ ID NO: 6045013 - DNA, 16 bp, Homo sapiens
ccagggccaggattca

SEQ ID NO: 6045014 - DNA, 17 bp, Homo sapiens
ccagggccagggccctg

SEQ ID NO: 6045015 - DNA, 19 bp, Homo sapiens
ccagggccagtagagagtg

SEQ ID NO: 6045016 - DNA, 18 bp, Homo sapiens
ccagggccagtgggaccc

SEQ ID NO: 6045017 - DNA, 18 bp, Homo sapiens
ccagggcccaaagcccag

SEQ ID NO: 6045018 - DNA, 12 bp, Homo sapiens
ccagggcccacc

SEQ ID NO: 6045019 - DNA, 15 bp, Homo sapiens
ccagggcccacccca

SEQ ID NO: 6045020 - DNA, 17 bp, Homo sapiens
ccagggcccaccccagc

SEQ ID NO: 6045021 - DNA, 22 bp, Homo sapiens
ccagggcccacccccaggaagg

SEQ ID NO: 6045022 - DNA, 17 bp, Homo sapiens
ccagggcccagagccca

SEQ ID NO: 6045023 - DNA, 19 bp, Homo sapiens
ccagggcccagagcccagc

SEQ ID NO: 6045024 - DNA, 21 bp, Homo sapiens
ccagggcccagagcccagctc

SEQ ID NO: 6045025 - DNA, 23 bp, Homo sapiens
ccagggcccagagcccagctcca

SEQ ID NO: 6045026 - DNA, 13 bp, Homo sapiens
ccagggcccaggc

SEQ ID NO: 6045027 - DNA, 14 bp, Homo sapiens
ccagggcccaggcc

SEQ ID NO: 6045028 - DNA, 19 bp, Homo sapiens
ccagggccccagaacacag

SEQ ID NO: 6045029 - DNA, 15 bp, Homo sapiens
ccagggcccccacag

SEQ ID NO: 6045030 - DNA, 17 bp, Homo sapiens
ccagggcccccacaggc

SEQ ID NO: 6045031 - DNA, 18 bp, Homo sapiens
ccagggcccccacaggcc

SEQ ID NO: 6045032 - DNA, 14 bp, Homo sapiens
ccagggcccccacc

SEQ ID NO: 6045033 - DNA, 13 bp, Homo sapiens
ccagggcccccca

SEQ ID NO: 6045034 - DNA, 15 bp, Homo sapiens
ccagggcccctctcc

SEQ ID NO: 6045035 - DNA, 16 bp, Homo sapiens
ccagggcccctgttcc

SEQ ID NO: 6045036 - DNA, 13 bp, Homo sapiens
ccagggcccggca

SEQ ID NO: 6045037 - DNA, 14 bp, Homo sapiens
ccagggccctaacg

SEQ ID NO: 6045038 - DNA, 18 bp, Homo sapiens
ccagggccctaggcccct

SEQ ID NO: 6045039 - DNA, 15 bp, Homo sapiens
ccagggccctcccag

SEQ ID NO: 6045040 - DNA, 17 bp, Homo sapiens
ccagggccctcccagcc

SEQ ID NO: 6045041 - DNA, 15 bp, Homo sapiens
ccagggccctgagct

SEQ ID NO: 6045042 - DNA, 18 bp, Homo sapiens
ccagggccctgagctcgg

SEQ ID NO: 6045043 - DNA, 15 bp, Homo sapiens
ccagggccctgcaga

SEQ ID NO: 6045044 - DNA, 16 bp, Homo sapiens
ccagggccctgctcag

SEQ ID NO: 6045045 - DNA, 17 bp, Homo sapiens
ccagggccctgctcagg

SEQ ID NO: 6045046 - DNA, 14 bp, Homo sapiens
ccagggccctggat

SEQ ID NO: 6045047 - DNA, 16 bp, Homo sapiens
ccagggccctgggcag

SEQ ID NO: 6045048 - DNA, 17 bp, Homo sapiens
ccagggccctgggcagg

SEQ ID NO: 6045049 - DNA, 17 bp, Homo sapiens
ccagggcccttgtacaa

SEQ ID NO: 6045050 - DNA, 18 bp, Homo sapiens
ccagggccgcttctcctg

SEQ ID NO: 6045051 - DNA, 14 bp, Homo sapiens
ccagggccgggctt

SEQ ID NO: 6045052 - DNA, 17 bp, Homo sapiens
ccagggcctactgccac

SEQ ID NO: 6045053 - DNA, 12 bp, Homo sapiens
ccagggcctcca

SEQ ID NO: 6045054 - DNA, 14 bp, Homo sapiens
ccagggcctccagg

SEQ ID NO: 6045055 - DNA, 17 bp, Homo sapiens
ccagggcctccagggcc

SEQ ID NO: 6045056 - DNA, 12 bp, Homo sapiens
ccagggcctctc

SEQ ID NO: 6045057 - DNA, 14 bp, Homo sapiens
ccagggcctctcca

SEQ ID NO: 6045058 - DNA, 18 bp, Homo sapiens
ccagggcctctccttgga

SEQ ID NO: 6045059 - DNA, 18 bp, Homo sapiens
ccagggcctctggcttcc

SEQ ID NO: 6045060 - DNA, 23 bp, Homo sapiens
ccagggcctctggcttccctgcc

SEQ ID NO: 6045061 - DNA, 14 bp, Homo sapiens
ccagggcctctgtg

SEQ ID NO: 6045062 - DNA, 14 bp, Homo sapiens
ccagggcctgacac

SEQ ID NO: 6045063 - DNA, 19 bp, Homo sapiens
ccagggcctgagcctggcc

SEQ ID NO: 6045064 - DNA, 16 bp, Homo sapiens
ccagggcctgcatggg

SEQ ID NO: 6045065 - DNA, 17 bp, Homo sapiens
ccagggcctggaagaca

SEQ ID NO: 6045066 - DNA, 14 bp, Homo sapiens
ccagggcctgtctc

SEQ ID NO: 6045067 - DNA, 15 bp, Homo sapiens
ccagggcctgtctca

SEQ ID NO: 6045068 - DNA, 12 bp, Homo sapiens
ccagggcctttt

SEQ ID NO: 6045069 - DNA, 21 bp, Homo sapiens
ccagggccttttctggcaccg

SEQ ID NO: 6045070 - DNA, 18 bp, Homo sapiens
ccagggcgcaggggaggg

SEQ ID NO: 6045071 - DNA, 18 bp, Homo sapiens
ccagggcgctgggaaggg

SEQ ID NO: 6045072 - DNA, 13 bp, Homo sapiens
ccagggctacaca

SEQ ID NO: 6045073 - DNA, 14 bp, Homo sapiens
ccagggctacacag

SEQ ID NO: 6045074 - DNA, 17 bp, Homo sapiens
ccagggctacacagacc

SEQ ID NO: 6045075 - DNA, 18 bp, Homo sapiens
ccagggctacacagaccc

SEQ ID NO: 6045076 - DNA, 16 bp, Homo sapiens
ccagggctagtgactt

SEQ ID NO: 6045077 - DNA, 19 bp, Homo sapiens
ccagggctatagcagaaag

SEQ ID NO: 6045078 - DNA, 18 bp, Homo sapiens
ccagggctcaaaaagttt

SEQ ID NO: 6045079 - DNA, 19 bp, Homo sapiens
ccagggctcaccagctggg

SEQ ID NO: 6045080 - DNA, 16 bp, Homo sapiens
ccagggctcagctcct

SEQ ID NO: 6045081 - DNA, 13 bp, Homo sapiens
ccagggctccaaa

SEQ ID NO: 6045082 - DNA, 14 bp, Homo sapiens
ccagggctccaaat

SEQ ID NO: 6045083 - DNA, 12 bp, Homo sapiens
ccagggctccag

SEQ ID NO: 6045084 - DNA, 21 bp, Homo sapiens
ccagggctccaggagcctcat

SEQ ID NO: 6045085 - DNA, 21 bp, Homo sapiens
ccagggctccctcctggagca

SEQ ID NO: 6045086 - DNA, 12 bp, Homo sapiens
ccagggctcctg

SEQ ID NO: 6045087 - DNA, 21 bp, Homo sapiens
ccagggctcctgtggcagctg

SEQ ID NO: 6045088 - DNA, 23 bp, Homo sapiens
ccagggctcgggcgctgtggctc

SEQ ID NO: 6045089 - DNA, 12 bp, Homo sapiens
ccagggctctgc

SEQ ID NO: 6045090 - DNA, 17 bp, Homo sapiens
ccagggctctgcaggcc

SEQ ID NO: 6045091 - DNA, 14 bp, Homo sapiens
ccagggctctggca

SEQ ID NO: 6045092 - DNA, 17 bp, Homo sapiens
ccagggctctgggggca

SEQ ID NO: 6045093 - DNA, 17 bp, Homo sapiens
ccagggctcttccagat

SEQ ID NO: 6045094 - DNA, 15 bp, Homo sapiens
ccagggctcttctca

SEQ ID NO: 6045095 - DNA, 14 bp, Homo sapiens
ccagggctgcccct

SEQ ID NO: 6045096 - DNA, 16 bp, Homo sapiens
ccagggctgcccctgt

SEQ ID NO: 6045097 - DNA, 16 bp, Homo sapiens
ccagggctgccctgag

SEQ ID NO: 6045098 - DNA, 17 bp, Homo sapiens
ccagggctgccctgaga

SEQ ID NO: 6045099 - DNA, 18 bp, Homo sapiens
ccagggctgctctttcca

SEQ ID NO: 6045100 - DNA, 11 bp, Homo sapiens
ccagggctgga

SEQ ID NO: 6045101 - DNA, 21 bp, Homo sapiens
ccagggctggaatgatttcag

SEQ ID NO: 6045102 - DNA, 16 bp, Homo sapiens
ccagggctggactgag

SEQ ID NO: 6045103 - DNA, 13 bp, Homo sapiens
ccagggctggaga

SEQ ID NO: 6045104 - DNA, 19 bp, Homo sapiens
ccagggctggagacttcct

SEQ ID NO: 6045105 - DNA, 23 bp, Homo sapiens
ccagggctggagacttcctctgg

SEQ ID NO: 6045106 - DNA, 16 bp, Homo sapiens
ccagggctggatggac

SEQ ID NO: 6045107 - DNA, 18 bp, Homo sapiens
ccagggctggatggacag

SEQ ID NO: 6045108 - DNA, 23 bp, Homo sapiens
ccagggctggatggacagacacc

SEQ ID NO: 6045109 - DNA, 13 bp, Homo sapiens
ccagggctggccc

SEQ ID NO: 6045110 - DNA, 19 bp, Homo sapiens
ccagggctggccctaggca

SEQ ID NO: 6045111 - DNA, 12 bp, Homo sapiens
ccagggctggct

SEQ ID NO: 6045112 - DNA, 15 bp, Homo sapiens
ccagggctgggagga

SEQ ID NO: 6045113 - DNA, 19 bp, Homo sapiens
ccagggctggggacagagg

SEQ ID NO: 6045114 - DNA, 22 bp, Homo sapiens
ccagggctggggcagcctctgg

SEQ ID NO: 6045115 - DNA, 13 bp, Homo sapiens
ccagggctggggt

SEQ ID NO: 6045116 - DNA, 22 bp, Homo sapiens
ccagggctggggtgagcctgac

SEQ ID NO: 6045117 - DNA, 20 bp, Homo sapiens
ccagggctggggttgccaga

SEQ ID NO: 6045118 - DNA, 13 bp, Homo sapiens
ccagggctgtcct

SEQ ID NO: 6045119 - DNA, 14 bp, Homo sapiens
ccagggctgtcctt

SEQ ID NO: 6045120 - DNA, 23 bp, Homo sapiens
ccagggctgttggaggaccccga

SEQ ID NO: 6045121 - DNA, 22 bp, Homo sapiens
ccagggcttacctgtacactga

SEQ ID NO: 6045122 - DNA, 21 bp, Homo sapiens
ccagggcttacggccctggcc

SEQ ID NO: 6045123 - DNA, 22 bp, Homo sapiens
ccagggcttacggccctggcct

SEQ ID NO: 6045124 - DNA, 14 bp, Homo sapiens
ccagggcttcccca

SEQ ID NO: 6045125 - DNA, 21 bp, Homo sapiens
ccagggcttccccatcagctc

SEQ ID NO: 6045126 - DNA, 23 bp, Homo sapiens
ccagggcttccccatcagctccc

SEQ ID NO: 6045127 - DNA, 18 bp, Homo sapiens
ccagggcttttcccagga

SEQ ID NO: 6045128 - DNA, 19 bp, Homo sapiens
ccagggcttttcccaggaa

SEQ ID NO: 6045129 - DNA, 19 bp, Homo sapiens
ccaggggaaaatcagcctg

SEQ ID NO: 6045130 - DNA, 19 bp, Homo sapiens
ccaggggaaagatgagctt

SEQ ID NO: 6045131 - DNA, 19 bp, Homo sapiens
ccaggggaactggcagcgc

SEQ ID NO: 6045132 - DNA, 14 bp, Homo sapiens
ccaggggaaggccc

SEQ ID NO: 6045133 - DNA, 16 bp, Homo sapiens
ccaggggaaggccctg

SEQ ID NO: 6045134 - DNA, 17 bp, Homo sapiens
ccaggggacctcctggg

SEQ ID NO: 6045135 - DNA, 16 bp, Homo sapiens
ccaggggaccttcctg

SEQ ID NO: 6045136 - DNA, 20 bp, Homo sapiens
ccaggggagaatgcagccca

SEQ ID NO: 6045137 - DNA, 22 bp, Homo sapiens
ccaggggagaatgcagcccacc

SEQ ID NO: 6045138 - DNA, 15 bp, Homo sapiens
ccaggggagcagagg

SEQ ID NO: 6045139 - DNA, 20 bp, Homo sapiens
ccaggggagcagaggggcag

SEQ ID NO: 6045140 - DNA, 12 bp, Homo sapiens
ccaggggagcca

SEQ ID NO: 6045141 - DNA, 15 bp, Homo sapiens
ccaggggagccagct

SEQ ID NO: 6045142 - DNA, 16 bp, Homo sapiens
ccaggggagccagctg

SEQ ID NO: 6045143 - DNA, 14 bp, Homo sapiens
ccaggggagccctc

SEQ ID NO: 6045144 - DNA, 14 bp, Homo sapiens
ccaggggaggcaca

SEQ ID NO: 6045145 - DNA, 23 bp, Homo sapiens
ccaggggaggcacaaagggcagg

SEQ ID NO: 6045146 - DNA, 16 bp, Homo sapiens
ccaggggaggccaagt

SEQ ID NO: 6045147 - DNA, 21 bp, Homo sapiens
ccaggggaggcctgaggcttc

SEQ ID NO: 6045148 - DNA, 14 bp, Homo sapiens
ccaggggcagccac

SEQ ID NO: 6045149 - DNA, 15 bp, Homo sapiens
ccaggggcagccaca

SEQ ID NO: 6045150 - DNA, 16 bp, Homo sapiens
ccaggggcagccacac

SEQ ID NO: 6045151 - DNA, 21 bp, Homo sapiens
ccaggggcagccacaccactg

SEQ ID NO: 6045152 - DNA, 23 bp, Homo sapiens
ccaggggcagccccaggccaaag

SEQ ID NO: 6045153 - DNA, 14 bp, Homo sapiens
ccaggggcaggact

SEQ ID NO: 6045154 - DNA, 12 bp, Homo sapiens
ccaggggcaggc

SEQ ID NO: 6045155 - DNA, 15 bp, Homo sapiens
ccaggggcaggcagg

SEQ ID NO: 6045156 - DNA, 22 bp, Homo sapiens
ccaggggcatgtattggcctgg

SEQ ID NO: 6045157 - DNA, 23 bp, Homo sapiens
ccaggggcatgtattggcctgga

SEQ ID NO: 6045158 - DNA, 21 bp, Homo sapiens
ccaggggccaggagtggggag

SEQ ID NO: 6045159 - DNA, 22 bp, Homo sapiens
ccaggggcccaaggcggcccct

SEQ ID NO: 6045160 - DNA, 23 bp, Homo sapiens
ccaggggcccaccctctgcccag

SEQ ID NO: 6045161 - DNA, 16 bp, Homo sapiens
ccaggggcccaggctc

SEQ ID NO: 6045162 - DNA, 23 bp, Homo sapiens
ccaggggcccaggctcccctgcc

SEQ ID NO: 6045163 - DNA, 17 bp, Homo sapiens
ccaggggcccctccagc

SEQ ID NO: 6045164 - DNA, 22 bp, Homo sapiens
ccaggggcccctccagcttgtg

SEQ ID NO: 6045165 - DNA, 15 bp, Homo sapiens
ccaggggccctacct

SEQ ID NO: 6045166 - DNA, 12 bp, Homo sapiens
ccaggggcctgc

SEQ ID NO: 6045167 - DNA, 13 bp, Homo sapiens
ccaggggcctgca

SEQ ID NO: 6045168 - DNA, 20 bp, Homo sapiens
ccaggggcctgcagaaggaa

SEQ ID NO: 6045169 - DNA, 15 bp, Homo sapiens
ccaggggctccacct

SEQ ID NO: 6045170 - DNA, 16 bp, Homo sapiens
ccaggggctccctccg

SEQ ID NO: 6045171 - DNA, 13 bp, Homo sapiens
ccaggggctcctg

SEQ ID NO: 6045172 - DNA, 17 bp, Homo sapiens
ccaggggctcctgggtt

SEQ ID NO: 6045173 - DNA, 21 bp, Homo sapiens
ccaggggctcctgggttggag

SEQ ID NO: 6045174 - DNA, 14 bp, Homo sapiens
ccaggggctctgtg

SEQ ID NO: 6045175 - DNA, 16 bp, Homo sapiens
ccaggggctgcagccc

SEQ ID NO: 6045176 - DNA, 23 bp, Homo sapiens
ccaggggctgcttcctcctggaa

SEQ ID NO: 6045177 - DNA, 19 bp, Homo sapiens
ccaggggctggcttcagga

SEQ ID NO: 6045178 - DNA, 18 bp, Homo sapiens
ccaggggctgggctccct

SEQ ID NO: 6045179 - DNA, 21 bp, Homo sapiens
ccaggggctgggctccctgat

SEQ ID NO: 6045180 - DNA, 21 bp, Homo sapiens
ccaggggcttctccccctcag

SEQ ID NO: 6045181 - DNA, 23 bp, Homo sapiens
catgtccatacactttgttgcaa

SEQ ID NO: 6045182 - DNA, 13 bp, Homo sapiens
catgtccatacta

SEQ ID NO: 6045183 - DNA, 14 bp, Homo sapiens
catgtccatatgca

SEQ ID NO: 6045184 - DNA, 14 bp, Homo sapiens
catgtccatccctt

SEQ ID NO: 6045185 - DNA, 20 bp, Homo sapiens
catgtccatcccttttcctg

SEQ ID NO: 6045186 - DNA, 18 bp, Homo sapiens
catgtcccacccacccgc

SEQ ID NO: 6045187 - DNA, 15 bp, Homo sapiens
catgtcccagcctgg

SEQ ID NO: 6045188 - DNA, 21 bp, Homo sapiens
catgtccccaaacctgcaagg

SEQ ID NO: 6045189 - DNA, 16 bp, Homo sapiens
catgtccccagtgtgg

SEQ ID NO: 6045190 - DNA, 14 bp, Homo sapiens
catgtccccttccc

SEQ ID NO: 6045191 - DNA, 14 bp, Homo sapiens
catgtccccttcct

SEQ ID NO: 6045192 - DNA, 22 bp, Homo sapiens
catgtccctaccgagtctcttc

SEQ ID NO: 6045193 - DNA, 23 bp, Homo sapiens
catgtccctaccgagtctcttct

SEQ ID NO: 6045194 - DNA, 18 bp, Homo sapiens
catgtccctgtccccagg

SEQ ID NO: 6045195 - DNA, 20 bp, Homo sapiens
catgtccctgtccccaggcc

SEQ ID NO: 6045196 - DNA, 21 bp, Homo sapiens
catgtccctgtccccaggccc

SEQ ID NO: 6045197 - DNA, 16 bp, Homo sapiens
catgtcctatgcctca

SEQ ID NO: 6045198 - DNA, 17 bp, Homo sapiens
catgtcctatgcctcac

SEQ ID NO: 6045199 - DNA, 14 bp, Homo sapiens
catgtcctatgtgt

SEQ ID NO: 6045200 - DNA, 15 bp, Homo sapiens
catgtcctatgtgtg

SEQ ID NO: 6045201 - DNA, 19 bp, Homo sapiens
catgtcctgctggcttcca

SEQ ID NO: 6045202 - DNA, 15 bp, Homo sapiens
catgtcctgtaaagg

SEQ ID NO: 6045203 - DNA, 14 bp, Homo sapiens
catgtcctgtcctg

SEQ ID NO: 6045204 - DNA, 19 bp, Homo sapiens
catgtccttgtgtgttttg

SEQ ID NO: 6045205 - DNA, 19 bp, Homo sapiens
catgtcctttgcgcctgtg

SEQ ID NO: 6045206 - DNA, 21 bp, Homo sapiens
catgtcctttgcgcctgtgac

SEQ ID NO: 6045207 - DNA, 20 bp, Homo sapiens
catgtcgcctctgcattcag

SEQ ID NO: 6045208 - DNA, 17 bp, Homo sapiens
catgtcgcgctcagcat

SEQ ID NO: 6045209 - DNA, 16 bp, Homo sapiens
catgtcggagtagaaa

SEQ ID NO: 6045210 - DNA, 15 bp, Homo sapiens
catgtcggggcccct

SEQ ID NO: 6045211 - DNA, 14 bp, Homo sapiens
catgtcgtgaccaa

SEQ ID NO: 6045212 - DNA, 16 bp, Homo sapiens
catgtctaacctgatt

SEQ ID NO: 6045213 - DNA, 21 bp, Homo sapiens
catgtctaacctgatttacct

SEQ ID NO: 6045214 - DNA, 21 bp, Homo sapiens
catgtctaattcatttactca

SEQ ID NO: 6045215 - DNA, 14 bp, Homo sapiens
catgtctacttttt

SEQ ID NO: 6045216 - DNA, 22 bp, Homo sapiens
catgtctataatcccagcactt

SEQ ID NO: 6045217 - DNA, 13 bp, Homo sapiens
catgtctattgtc

SEQ ID NO: 6045218 - DNA, 16 bp, Homo sapiens
catgtctcctatcctg

SEQ ID NO: 6045219 - DNA, 20 bp, Homo sapiens
catgtctctacccactatgc

SEQ ID NO: 6045220 - DNA, 16 bp, Homo sapiens
catgtctctttgccaa

SEQ ID NO: 6045221 - DNA, 21 bp, Homo sapiens
catgtctctttgccaagggag

SEQ ID NO: 6045222 - DNA, 13 bp, Homo sapiens
catgtctctttgg

SEQ ID NO: 6045223 - DNA, 21 bp, Homo sapiens
catgtctgaaaaatgcctgct

SEQ ID NO: 6045224 - DNA, 16 bp, Homo sapiens
catgtctgaaacagag

SEQ ID NO: 6045225 - DNA, 19 bp, Homo sapiens
catgtctgaaacagagaac

SEQ ID NO: 6045226 - DNA, 21 bp, Homo sapiens
catgtctgagcggcgcagagc

SEQ ID NO: 6045227 - DNA, 11 bp, Homo sapiens
catgtctgcac

SEQ ID NO: 6045228 - DNA, 12 bp, Homo sapiens
catgtctgcacc

SEQ ID NO: 6045229 - DNA, 13 bp, Homo sapiens
catgtctgcacct

SEQ ID NO: 6045230 - DNA, 20 bp, Homo sapiens
catgtctgcagtgtgccccc

SEQ ID NO: 6045231 - DNA, 14 bp, Homo sapiens
catgtctgcatggc

SEQ ID NO: 6045232 - DNA, 17 bp, Homo sapiens
catgtctgcatggcaga

SEQ ID NO: 6045233 - DNA, 21 bp, Homo sapiens
catgtctgcatggcagaagcg

SEQ ID NO: 6045234 - DNA, 20 bp, Homo sapiens
catgtctgccaaaatgcaac

SEQ ID NO: 6045235 - DNA, 19 bp, Homo sapiens
catgtctgcctatgcactg

SEQ ID NO: 6045236 - DNA, 20 bp, Homo sapiens
catgtctgcctatgcactga

SEQ ID NO: 6045237 - DNA, 20 bp, Homo sapiens
catgtctgcctggagtgctg

SEQ ID NO: 6045238 - DNA, 22 bp, Homo sapiens
catgtctgcttgtcaaaagaaa

SEQ ID NO: 6045239 - DNA, 22 bp, Homo sapiens
catgtctggagtcccctcctcc

SEQ ID NO: 6045240 - DNA, 12 bp, Homo sapiens
catgtctggcta

SEQ ID NO: 6045241 - DNA, 21 bp, Homo sapiens
catgtctgtaatcccagcaat

SEQ ID NO: 6045242 - DNA, 12 bp, Homo sapiens
catgtctgtagt

SEQ ID NO: 6045243 - DNA, 19 bp, Homo sapiens
catgtctgtatactcctgt

SEQ ID NO: 6045244 - DNA, 21 bp, Homo sapiens
catgtctgtatactcctgtca

SEQ ID NO: 6045245 - DNA, 13 bp, Homo sapiens
catgtctgtatcc

SEQ ID NO: 6045246 - DNA, 17 bp, Homo sapiens
catgtctgtatccccag

SEQ ID NO: 6045247 - DNA, 18 bp, Homo sapiens
catgtctgtatccccagt

SEQ ID NO: 6045248 - DNA, 19 bp, Homo sapiens
catgtctgtatccccagtg

SEQ ID NO: 6045249 - DNA, 16 bp, Homo sapiens
catgtctgtcctcaga

SEQ ID NO: 6045250 - DNA, 18 bp, Homo sapiens
catgtctgtcctcagagc

SEQ ID NO: 6045251 - DNA, 19 bp, Homo sapiens
catgtctgtcctcagagca

SEQ ID NO: 6045252 - DNA, 20 bp, Homo sapiens
catgtctgtgaacttgatgt

SEQ ID NO: 6045253 - DNA, 14 bp, Homo sapiens
catgtctgttcttc

SEQ ID NO: 6045254 - DNA, 14 bp, Homo sapiens
catgtcttaaatgc

SEQ ID NO: 6045255 - DNA, 15 bp, Homo sapiens
catgtcttaaatgct

SEQ ID NO: 6045256 - DNA, 13 bp, Homo sapiens
catgtcttaatga

SEQ ID NO: 6045257 - DNA, 17 bp, Homo sapiens
catgtcttaatgaagtt

SEQ ID NO: 6045258 - DNA, 14 bp, Homo sapiens
catgtcttctccct

SEQ ID NO: 6045259 - DNA, 15 bp, Homo sapiens
catgtcttctgctgt

SEQ ID NO: 6045260 - DNA, 17 bp, Homo sapiens
catgtcttgtacatgtg

SEQ ID NO: 6045261 - DNA, 13 bp, Homo sapiens
catgtcttgtcat

SEQ ID NO: 6045262 - DNA, 14 bp, Homo sapiens
catgtcttgtcata

SEQ ID NO: 6045263 - DNA, 21 bp, Homo sapiens
catgtctttattagtaacatc

SEQ ID NO: 6045264 - DNA, 21 bp, Homo sapiens
catgtctttctccaaagttat

SEQ ID NO: 6045265 - DNA, 17 bp, Homo sapiens
catgtctttctccaggg

SEQ ID NO: 6045266 - DNA, 18 bp, Homo sapiens
catgtctttctccaggga

SEQ ID NO: 6045267 - DNA, 21 bp, Homo sapiens
catgtctttggcttcagaatt

SEQ ID NO: 6045268 - DNA, 15 bp, Homo sapiens
catgtcttttaaaat

SEQ ID NO: 6045269 - DNA, 19 bp, Homo sapiens
catgtcttttcttgcatga

SEQ ID NO: 6045270 - DNA, 17 bp, Homo sapiens
catgtgaaaagtaaaac

SEQ ID NO: 6045271 - DNA, 18 bp, Homo sapiens
catgtgaaaagtaaaaca

SEQ ID NO: 6045272 - DNA, 12 bp, Homo sapiens
catgtgaaacct

SEQ ID NO: 6045273 - DNA, 14 bp, Homo sapiens
catgtgaaaccttt

SEQ ID NO: 6045274 - DNA, 22 bp, Homo sapiens
catgtgaaaccttttttaagat

SEQ ID NO: 6045275 - DNA, 20 bp, Homo sapiens
catgtgaaactcatctcatt

SEQ ID NO: 6045276 - DNA, 13 bp, Homo sapiens
catgtgaaagata

SEQ ID NO: 6045277 - DNA, 21 bp, Homo sapiens
catgtgaagcatgctttgctg

SEQ ID NO: 6045278 - DNA, 22 bp, Homo sapiens
catgtgaagtgtatatgattct

SEQ ID NO: 6045279 - DNA, 21 bp, Homo sapiens
catgtgaagtgttgtggagaa

SEQ ID NO: 6045280 - DNA, 22 bp, Homo sapiens
catgtgaagtgttgtggagaaa

SEQ ID NO: 6045281 - DNA, 19 bp, Homo sapiens
catgtgaattctgtgaaga

SEQ ID NO: 6045282 - DNA, 12 bp, Homo sapiens
catgtgacacat

SEQ ID NO: 6045283 - DNA, 16 bp, Homo sapiens
catgtgacacatatgc

SEQ ID NO: 6045284 - DNA, 12 bp, Homo sapiens
catgtgacattt

SEQ ID NO: 6045285 - DNA, 16 bp, Homo sapiens
catgtgaccattctgc

SEQ ID NO: 6045286 - DNA, 20 bp, Homo sapiens
catgtgactagcgcctggcc

SEQ ID NO: 6045287 - DNA, 21 bp, Homo sapiens
catgtgactagcgcctggcct

SEQ ID NO: 6045288 - DNA, 21 bp, Homo sapiens
catgtgactcctatgatctca

SEQ ID NO: 6045289 - DNA, 22 bp, Homo sapiens
catgtgagccaccgctgccagc

SEQ ID NO: 6045290 - DNA, 18 bp, Homo sapiens
catgtgagctcttcctat

SEQ ID NO: 6045291 - DNA, 20 bp, Homo sapiens
catgtgagctgctgccatga

SEQ ID NO: 6045292 - DNA, 19 bp, Homo sapiens
catgtgaggaggaaaagga

SEQ ID NO: 6045293 - DNA, 16 bp, Homo sapiens
catgtgagtccctgtg

SEQ ID NO: 6045294 - DNA, 15 bp, Homo sapiens
catgtgagtctggga

SEQ ID NO: 6045295 - DNA, 23 bp, Homo sapiens
catgtgataactgattattactt

SEQ ID NO: 6045296 - DNA, 17 bp, Homo sapiens
catgtgataattgtaaa

SEQ ID NO: 6045297 - DNA, 18 bp, Homo sapiens
catgtgataattgtaaag

SEQ ID NO: 6045298 - DNA, 16 bp, Homo sapiens
catgtgatcacgcctg

SEQ ID NO: 6045299 - DNA, 22 bp, Homo sapiens
catgtgatccttttatgttatt

SEQ ID NO: 6045300 - DNA, 15 bp, Homo sapiens
catgtgatgagagga

SEQ ID NO: 6045301 - DNA, 17 bp, Homo sapiens
catgtgatggacactcc

SEQ ID NO: 6045302 - DNA, 15 bp, Homo sapiens
catgtgatgtcatga

SEQ ID NO: 6045303 - DNA, 23 bp, Homo sapiens
catgtgatgtgttgctctccatt

SEQ ID NO: 6045304 - DNA, 20 bp, Homo sapiens
catgtgattaccctctgggt

SEQ ID NO: 6045305 - DNA, 19 bp, Homo sapiens
catgtgcaactcttgtatt

SEQ ID NO: 6045306 - DNA, 21 bp, Homo sapiens
catgtgcaattgtgagggaca

SEQ ID NO: 6045307 - DNA, 21 bp, Homo sapiens
catgtgcagacactcaagagc

SEQ ID NO: 6045308 - DNA, 23 bp, Homo sapiens
catgtgcagattgcagttctgat

SEQ ID NO: 6045309 - DNA, 16 bp, Homo sapiens
catgtgcataacaaat

SEQ ID NO: 6045310 - DNA, 23 bp, Homo sapiens
catgtgcataacaaattctgaat

SEQ ID NO: 6045311 - DNA, 16 bp, Homo sapiens
catgtgcatagtttct

SEQ ID NO: 6045312 - DNA, 17 bp, Homo sapiens
catgtgcatagtttctt

SEQ ID NO: 6045313 - DNA, 17 bp, Homo sapiens
catgtgcatctggtgta

SEQ ID NO: 6045314 - DNA, 15 bp, Homo sapiens
catgtgcatgcatac

SEQ ID NO: 6045315 - DNA, 18 bp, Homo sapiens
catgtgcatgcataccac

SEQ ID NO: 6045316 - DNA, 21 bp, Homo sapiens
catgtgcatggaaatgtcctc

SEQ ID NO: 6045317 - DNA, 18 bp, Homo sapiens
catgtgcattattttcca

SEQ ID NO: 6045318 - DNA, 24 bp, Homo sapiens
catgtgccagggcaatgatgaatg

SEQ ID NO: 6045319 - DNA, 21 bp, Homo sapiens
catgtgccaggtttttggtct

SEQ ID NO: 6045320 - DNA, 22 bp, Homo sapiens
catgtgccaggtttttggtctg

SEQ ID NO: 6045321 - DNA, 17 bp, Homo sapiens
catgtgccatctgtaca

SEQ ID NO: 6045322 - DNA, 15 bp, Homo sapiens
catgtgcccactgtc

SEQ ID NO: 6045323 - DNA, 20 bp, Homo sapiens
catgtgcccctgccaaggcc

SEQ ID NO: 6045324 - DNA, 14 bp, Homo sapiens
catgtgccctcctg

SEQ ID NO: 6045325 - DNA, 16 bp, Homo sapiens
catgtgccctgccttg

SEQ ID NO: 6045326 - DNA, 17 bp, Homo sapiens
catgtgccctgccttga

SEQ ID NO: 6045327 - DNA, 16 bp, Homo sapiens
catgtgccgaatgtgc

SEQ ID NO: 6045328 - DNA, 16 bp, Homo sapiens
catgtgcctataatcc

SEQ ID NO: 6045329 - DNA, 22 bp, Homo sapiens
catgtgcctatagtcccagcta

SEQ ID NO: 6045330 - DNA, 18 bp, Homo sapiens
catgtgcctctgtcctta

SEQ ID NO: 6045331 - DNA, 14 bp, Homo sapiens
catgtgcctgatcc

SEQ ID NO: 6045332 - DNA, 19 bp, Homo sapiens
catgtgcctgatccagcct

SEQ ID NO: 6045333 - DNA, 15 bp, Homo sapiens
catgtgcctgcacca

SEQ ID NO: 6045334 - DNA, 23 bp, Homo sapiens
catgtgcctgcaccaggagacag

SEQ ID NO: 6045335 - DNA, 14 bp, Homo sapiens
catgtgcctggaaa

SEQ ID NO: 6045336 - DNA, 12 bp, Homo sapiens
catgtgcctgta

SEQ ID NO: 6045337 - DNA, 14 bp, Homo sapiens
catgtgcctgtcac

SEQ ID NO: 6045338 - DNA, 11 bp, Homo sapiens
catgtgccttt

SEQ ID NO: 6045339 - DNA, 16 bp, Homo sapiens
catgtgccttttctga

SEQ ID NO: 6045340 - DNA, 14 bp, Homo sapiens
catgtgcgaacaca

SEQ ID NO: 6045341 - DNA, 17 bp, Homo sapiens
catgtgcgaacacagtg

SEQ ID NO: 6045342 - DNA, 18 bp, Homo sapiens
catgtgcggagcagcctt

SEQ ID NO: 6045343 - DNA, 20 bp, Homo sapiens
catgtgctagtaattggaaa

SEQ ID NO: 6045344 - DNA, 20 bp, Homo sapiens
catgtgctagtcactggcag

SEQ ID NO: 6045345 - DNA, 23 bp, Homo sapiens
catgtgctctgttttgacataat

SEQ ID NO: 6045346 - DNA, 11 bp, Homo sapiens
catgtgctgca

SEQ ID NO: 6045347 - DNA, 19 bp, Homo sapiens
catgtgctgtgaccattta

SEQ ID NO: 6045348 - DNA, 16 bp, Homo sapiens
catgtgctgtgcaccc

SEQ ID NO: 6045349 - DNA, 17 bp, Homo sapiens
catgtgctgtgcacccg

SEQ ID NO: 6045350 - DNA, 23 bp, Homo sapiens
catgtgctgtgcacccgtgccac

SEQ ID NO: 6045351 - DNA, 21 bp, Homo sapiens
catgtgctgtgtgagtgagca

SEQ ID NO: 6045352 - DNA, 14 bp, Homo sapiens
catgtgcttcatct

SEQ ID NO: 6045353 - DNA, 21 bp, Homo sapiens
catgtgcttccctaggctgag

SEQ ID NO: 6045354 - DNA, 13 bp, Homo sapiens
catgtgctttgta

SEQ ID NO: 6045355 - DNA, 17 bp, Homo sapiens
catgtgctttgtagctt

SEQ ID NO: 6045356 - DNA, 17 bp, Homo sapiens
catgtggaaagtgaatt

SEQ ID NO: 6045357 - DNA, 22 bp, Homo sapiens
catgtggaaagtgaatttgaat

SEQ ID NO: 6045358 - DNA, 20 bp, Homo sapiens
catgtggaaatgacccaaac

SEQ ID NO: 6045359 - DNA, 23 bp, Homo sapiens
ccaggggctttggtggcccctcc

SEQ ID NO: 6045360 - DNA, 19 bp, Homo sapiens
ccagggggaagatgccaag

SEQ ID NO: 6045361 - DNA, 23 bp, Homo sapiens
ccagggggaagcaccagcctcag

SEQ ID NO: 6045362 - DNA, 18 bp, Homo sapiens
ccagggggaaggccaagg

SEQ ID NO: 6045363 - DNA, 17 bp, Homo sapiens
ccagggggactagcccc

SEQ ID NO: 6045364 - DNA, 20 bp, Homo sapiens
ccagggggactagcccctgt

SEQ ID NO: 6045365 - DNA, 19 bp, Homo sapiens
ccagggggagaaggaagat

SEQ ID NO: 6045366 - DNA, 22 bp, Homo sapiens
ccagggggccagtccctgaggc

SEQ ID NO: 6045367 - DNA, 13 bp, Homo sapiens
ccagggggcccga

SEQ ID NO: 6045368 - DNA, 18 bp, Homo sapiens
ccagggggcctgcaggcc

SEQ ID NO: 6045369 - DNA, 15 bp, Homo sapiens
ccagggggcctggag

SEQ ID NO: 6045370 - DNA, 13 bp, Homo sapiens
ccagggggcttcc

SEQ ID NO: 6045371 - DNA, 23 bp, Homo sapiens
ccagggggcttcctgaggggaga

SEQ ID NO: 6045372 - DNA, 18 bp, Homo sapiens
ccagggggtctcacccat

SEQ ID NO: 6045373 - DNA, 17 bp, Homo sapiens
ccaggggtaacctggcc

SEQ ID NO: 6045374 - DNA, 17 bp, Homo sapiens
ccaggggtaccaggcac

SEQ ID NO: 6045375 - DNA, 20 bp, Homo sapiens
ccaggggtaccaggcacatg

SEQ ID NO: 6045376 - DNA, 23 bp, Homo sapiens
ccaggggtatatttagaccctgt

SEQ ID NO: 6045377 - DNA, 18 bp, Homo sapiens
ccaggggtcaccttgaga

SEQ ID NO: 6045378 - DNA, 18 bp, Homo sapiens
ccaggggtcccagccacc

SEQ ID NO: 6045379 - DNA, 15 bp, Homo sapiens
ccaggggtctccctg

SEQ ID NO: 6045380 - DNA, 17 bp, Homo sapiens
ccaggggtctccctgag

SEQ ID NO: 6045381 - DNA, 21 bp, Homo sapiens
ccaggggtctccctgagcctg

SEQ ID NO: 6045382 - DNA, 17 bp, Homo sapiens
ccaggggtctccctggc

SEQ ID NO: 6045383 - DNA, 15 bp, Homo sapiens
ccaggggtctgtctg

SEQ ID NO: 6045384 - DNA, 16 bp, Homo sapiens
ccaggggtctgtctgc

SEQ ID NO: 6045385 - DNA, 16 bp, Homo sapiens
ccaggggtgcacaata

SEQ ID NO: 6045386 - DNA, 15 bp, Homo sapiens
ccaggggtgccccct

SEQ ID NO: 6045387 - DNA, 18 bp, Homo sapiens
ccaggggtgccccctcct

SEQ ID NO: 6045388 - DNA, 20 bp, Homo sapiens
ccaggggtgctatgacatgc

SEQ ID NO: 6045389 - DNA, 13 bp, Homo sapiens
ccaggggtgggac

SEQ ID NO: 6045390 - DNA, 23 bp, Homo sapiens
ccaggggtgggacaccctgtgat

SEQ ID NO: 6045391 - DNA, 22 bp, Homo sapiens
ccaggggtggggcccatggggt

SEQ ID NO: 6045392 - DNA, 13 bp, Homo sapiens
ccaggggtggtga

SEQ ID NO: 6045393 - DNA, 18 bp, Homo sapiens
ccaggggtgtcccagtcc

SEQ ID NO: 6045394 - DNA, 17 bp, Homo sapiens
ccaggggttccccagga

SEQ ID NO: 6045395 - DNA, 15 bp, Homo sapiens
ccaggggttctgaga

SEQ ID NO: 6045396 - DNA, 22 bp, Homo sapiens
ccaggggttctgagaagcgctg

SEQ ID NO: 6045397 - DNA, 18 bp, Homo sapiens
ccagggtacactcttctc

SEQ ID NO: 6045398 - DNA, 23 bp, Homo sapiens
ccagggtacccgcctgagctcct

SEQ ID NO: 6045399 - DNA, 10 bp, Homo sapiens
ccagggtaga

SEQ ID NO: 6045400 - DNA, 20 bp, Homo sapiens
ccagggtagacttggagctg

SEQ ID NO: 6045401 - DNA, 19 bp, Homo sapiens
ccagggtagcccgcctgcc

SEQ ID NO: 6045402 - DNA, 21 bp, Homo sapiens
ccagggtaggcaaggctgccg

SEQ ID NO: 6045403 - DNA, 14 bp, Homo sapiens
ccagggtatgacct

SEQ ID NO: 6045404 - DNA, 17 bp, Homo sapiens
ccagggtcactgaaggc

SEQ ID NO: 6045405 - DNA, 14 bp, Homo sapiens
ccagggtccagccc

SEQ ID NO: 6045406 - DNA, 16 bp, Homo sapiens
ccagggtcccaggaag

SEQ ID NO: 6045407 - DNA, 14 bp, Homo sapiens
ccagggtcccctcc

SEQ ID NO: 6045408 - DNA, 15 bp, Homo sapiens
ccagggtcccctccc

SEQ ID NO: 6045409 - DNA, 16 bp, Homo sapiens
ccagggtcccctgcca

SEQ ID NO: 6045410 - DNA, 19 bp, Homo sapiens
ccagggtcccctgccaccg

SEQ ID NO: 6045411 - DNA, 16 bp, Homo sapiens
ccagggtccctctgtg

SEQ ID NO: 6045412 - DNA, 17 bp, Homo sapiens
ccagggtccgcaccagc

SEQ ID NO: 6045413 - DNA, 23 bp, Homo sapiens
ccagggtccgcaccagctgctct

SEQ ID NO: 6045414 - DNA, 18 bp, Homo sapiens
ccagggtcctctcttcca

SEQ ID NO: 6045415 - DNA, 23 bp, Homo sapiens
ccagggtcctctcttccacagtg

SEQ ID NO: 6045416 - DNA, 20 bp, Homo sapiens
ccagggtcctgggggctgct

SEQ ID NO: 6045417 - DNA, 14 bp, Homo sapiens
ccagggtcctgtgc

SEQ ID NO: 6045418 - DNA, 22 bp, Homo sapiens
ccagggtctaaagagaacaaga

SEQ ID NO: 6045419 - DNA, 21 bp, Homo sapiens
ccagggtctagccgctgccct

SEQ ID NO: 6045420 - DNA, 14 bp, Homo sapiens
ccagggtctctcag

SEQ ID NO: 6045421 - DNA, 13 bp, Homo sapiens
ccagggtctgaaa

SEQ ID NO: 6045422 - DNA, 15 bp, Homo sapiens
ccagggtctggcaga

SEQ ID NO: 6045423 - DNA, 20 bp, Homo sapiens
ccagggtctgtgtgaatgtg

SEQ ID NO: 6045424 - DNA, 14 bp, Homo sapiens
ccagggtcttccct

SEQ ID NO: 6045425 - DNA, 23 bp, Homo sapiens
ccagggtcttccctacctcaggc

SEQ ID NO: 6045426 - DNA, 20 bp, Homo sapiens
ccagggtcttgggctactgg

SEQ ID NO: 6045427 - DNA, 22 bp, Homo sapiens
ccagggtcttgggctactggca

SEQ ID NO: 6045428 - DNA, 20 bp, Homo sapiens
ccagggtgacaaggcctgct

SEQ ID NO: 6045429 - DNA, 21 bp, Homo sapiens
ccagggtgacatacagaaggg

SEQ ID NO: 6045430 - DNA, 15 bp, Homo sapiens
ccagggtgagcaggg

SEQ ID NO: 6045431 - DNA, 17 bp, Homo sapiens
ccagggtgagcagggcc

SEQ ID NO: 6045432 - DNA, 15 bp, Homo sapiens
ccagggtgcaggcgc

SEQ ID NO: 6045433 - DNA, 17 bp, Homo sapiens
ccagggtgcaggcgcgc

SEQ ID NO: 6045434 - DNA, 16 bp, Homo sapiens
ccagggtgcagtgtga

SEQ ID NO: 6045435 - DNA, 22 bp, Homo sapiens
ccagggtgcccagaacttccct

SEQ ID NO: 6045436 - DNA, 18 bp, Homo sapiens
ccagggtgctgggatggc

SEQ ID NO: 6045437 - DNA, 14 bp, Homo sapiens
ccagggtggaccag

SEQ ID NO: 6045438 - DNA, 22 bp, Homo sapiens
ccagggtggaccaggcctggag

SEQ ID NO: 6045439 - DNA, 23 bp, Homo sapiens
ccagggtggccacacaggcaggg

SEQ ID NO: 6045440 - DNA, 18 bp, Homo sapiens
ccagggtgggaagagaag

SEQ ID NO: 6045441 - DNA, 15 bp, Homo sapiens
ccagggtgggctggg

SEQ ID NO: 6045442 - DNA, 16 bp, Homo sapiens
ccagggtgggctgggg

SEQ ID NO: 6045443 - DNA, 19 bp, Homo sapiens
ccagggtgggctggggact

SEQ ID NO: 6045444 - DNA, 23 bp, Homo sapiens
ccagggtgggctggggactctgg

SEQ ID NO: 6045445 - DNA, 19 bp, Homo sapiens
ccagggtgggtgtccatgt

SEQ ID NO: 6045446 - DNA, 21 bp, Homo sapiens
ccagggtggtcttcaagcctg

SEQ ID NO: 6045447 - DNA, 22 bp, Homo sapiens
ccagggtggtggtgcacacctg

SEQ ID NO: 6045448 - DNA, 18 bp, Homo sapiens
ccagggtgtgagggatgg

SEQ ID NO: 6045449 - DNA, 19 bp, Homo sapiens
ccagggtgtggccctgcca

SEQ ID NO: 6045450 - DNA, 22 bp, Homo sapiens
ccagggtgttacaaggcacttg

SEQ ID NO: 6045451 - DNA, 17 bp, Homo sapiens
ccagggttccagacagg

SEQ ID NO: 6045452 - DNA, 21 bp, Homo sapiens
ccagggttcccccagccctgt

SEQ ID NO: 6045453 - DNA, 22 bp, Homo sapiens
ccagggttcccccagccctgtg

SEQ ID NO: 6045454 - DNA, 22 bp, Homo sapiens
ccagggttgatcacactctggg

SEQ ID NO: 6045455 - DNA, 14 bp, Homo sapiens
ccagggtttctctg

SEQ ID NO: 6045456 - DNA, 15 bp, Homo sapiens
ccagggtttctctgc

SEQ ID NO: 6045457 - DNA, 14 bp, Homo sapiens
ccaggtaactttgc

SEQ ID NO: 6045458 - DNA, 23 bp, Homo sapiens
ccaggtaagcaggaggaggtgcc

SEQ ID NO: 6045459 - DNA, 16 bp, Homo sapiens
ccaggtaatgagggac

SEQ ID NO: 6045460 - DNA, 23 bp, Homo sapiens
ccaggtaatgagggactggaacc

SEQ ID NO: 6045461 - DNA, 23 bp, Homo sapiens
ccaggtaatggcatgagatagct

SEQ ID NO: 6045462 - DNA, 20 bp, Homo sapiens
ccaggtacaaccggatgcca

SEQ ID NO: 6045463 - DNA, 17 bp, Homo sapiens
ccaggtacacctccccc

SEQ ID NO: 6045464 - DNA, 18 bp, Homo sapiens
ccaggtacaggagaggca

SEQ ID NO: 6045465 - DNA, 16 bp, Homo sapiens
ccaggtaccacccttc

SEQ ID NO: 6045466 - DNA, 18 bp, Homo sapiens
ccaggtaccagctgcgct

SEQ ID NO: 6045467 - DNA, 14 bp, Homo sapiens
ccaggtactgagtg

SEQ ID NO: 6045468 - DNA, 21 bp, Homo sapiens
ccaggtactgatcctgtttct

SEQ ID NO: 6045469 - DNA, 20 bp, Homo sapiens
ccaggtactgcattctctcc

SEQ ID NO: 6045470 - DNA, 16 bp, Homo sapiens
ccaggtacttgagaaa

SEQ ID NO: 6045471 - DNA, 13 bp, Homo sapiens
ccaggtagaaact

SEQ ID NO: 6045472 - DNA, 14 bp, Homo sapiens
ccaggtagaaactt

SEQ ID NO: 6045473 - DNA, 14 bp, Homo sapiens
ccaggtagaacaca

SEQ ID NO: 6045474 - DNA, 20 bp, Homo sapiens
ccaggtagagggtgtgtaag

SEQ ID NO: 6045475 - DNA, 19 bp, Homo sapiens
ccaggtatccaaaaatgtg

SEQ ID NO: 6045476 - DNA, 21 bp, Homo sapiens
ccaggtatcctgggggaagag

SEQ ID NO: 6045477 - DNA, 15 bp, Homo sapiens
ccaggtatctccagg

SEQ ID NO: 6045478 - DNA, 17 bp, Homo sapiens
ccaggtatctccaggat

SEQ ID NO: 6045479 - DNA, 14 bp, Homo sapiens
ccaggtatggctct

SEQ ID NO: 6045480 - DNA, 14 bp, Homo sapiens
ccaggtattgtctt

SEQ ID NO: 6045481 - DNA, 14 bp, Homo sapiens
ccaggtcaacagaa

SEQ ID NO: 6045482 - DNA, 14 bp, Homo sapiens
ccaggtcacacgac

SEQ ID NO: 6045483 - DNA, 12 bp, Homo sapiens
ccaggtcaccag

SEQ ID NO: 6045484 - DNA, 17 bp, Homo sapiens
ccaggtcaccatcctca

SEQ ID NO: 6045485 - DNA, 23 bp, Homo sapiens
ccaggtcaccatcctcagaggct

SEQ ID NO: 6045486 - DNA, 16 bp, Homo sapiens
ccaggtcagccctgtg

SEQ ID NO: 6045487 - DNA, 22 bp, Homo sapiens
ccaggtcagccctgtgtctgtc

SEQ ID NO: 6045488 - DNA, 15 bp, Homo sapiens
ccaggtcagcctgga

SEQ ID NO: 6045489 - DNA, 11 bp, Homo sapiens
ccaggtcagga

SEQ ID NO: 6045490 - DNA, 20 bp, Homo sapiens
ccaggtccaaacccttcaac

SEQ ID NO: 6045491 - DNA, 18 bp, Homo sapiens
ccaggtccaatgagcttt

SEQ ID NO: 6045492 - DNA, 18 bp, Homo sapiens
ccaggtccagctctggag

SEQ ID NO: 6045493 - DNA, 22 bp, Homo sapiens
ccaggtcccagcccctcctccc

SEQ ID NO: 6045494 - DNA, 13 bp, Homo sapiens
ccaggtcccagtg

SEQ ID NO: 6045495 - DNA, 19 bp, Homo sapiens
ccaggtcccccgactgcct

SEQ ID NO: 6045496 - DNA, 18 bp, Homo sapiens
ccaggtccccctgcagct

SEQ ID NO: 6045497 - DNA, 12 bp, Homo sapiens
ccaggtcccctc

SEQ ID NO: 6045498 - DNA, 15 bp, Homo sapiens
ccaggtccctctcat

SEQ ID NO: 6045499 - DNA, 16 bp, Homo sapiens
ccaggtccctggacca

SEQ ID NO: 6045500 - DNA, 20 bp, Homo sapiens
ccaggtccgtagctcccctg

SEQ ID NO: 6045501 - DNA, 23 bp, Homo sapiens
ccaggtccgtagctcccctggct

SEQ ID NO: 6045502 - DNA, 14 bp, Homo sapiens
ccaggtcctcacag

SEQ ID NO: 6045503 - DNA, 20 bp, Homo sapiens
ccaggtcctcacagcagtca

SEQ ID NO: 6045504 - DNA, 23 bp, Homo sapiens
ccaggtcctcacagcagtcacag

SEQ ID NO: 6045505 - DNA, 14 bp, Homo sapiens
ccaggtcctctgat

SEQ ID NO: 6045506 - DNA, 22 bp, Homo sapiens
ccaggtcctctgatacccagag

SEQ ID NO: 6045507 - DNA, 13 bp, Homo sapiens
ccaggtcctgctc

SEQ ID NO: 6045508 - DNA, 12 bp, Homo sapiens
ccaggtcctggt

SEQ ID NO: 6045509 - DNA, 14 bp, Homo sapiens
ccaggtcctggtgg

SEQ ID NO: 6045510 - DNA, 15 bp, Homo sapiens
ccaggtcctgtctct

SEQ ID NO: 6045511 - DNA, 23 bp, Homo sapiens
ccaggtcctttccttctcgtctt

SEQ ID NO: 6045512 - DNA, 17 bp, Homo sapiens
ccaggtcgcccacctgt

SEQ ID NO: 6045513 - DNA, 22 bp, Homo sapiens
ccaggtcggagtgcctggagtc

SEQ ID NO: 6045514 - DNA, 23 bp, Homo sapiens
ccaggtcggagtgcctggagtca

SEQ ID NO: 6045515 - DNA, 23 bp, Homo sapiens
ccaggtctacccctcccggccct

SEQ ID NO: 6045516 - DNA, 17 bp, Homo sapiens
ccaggtctagaaggcca

SEQ ID NO: 6045517 - DNA, 20 bp, Homo sapiens
ccaggtctagaaggccaggc

SEQ ID NO: 6045518 - DNA, 18 bp, Homo sapiens
ccaggtctcactgctttg

SEQ ID NO: 6045519 - DNA, 18 bp, Homo sapiens
ccaggtctccccaggccc

SEQ ID NO: 6045520 - DNA, 13 bp, Homo sapiens
ccaggtctccctg

SEQ ID NO: 6045521 - DNA, 15 bp, Homo sapiens
ccaggtctcctccac

SEQ ID NO: 6045522 - DNA, 16 bp, Homo sapiens
ccaggtctcctccacc

SEQ ID NO: 6045523 - DNA, 19 bp, Homo sapiens
ccaggtctcctccaccgcc

SEQ ID NO: 6045524 - DNA, 21 bp, Homo sapiens
ccaggtctcctccaccgccat

SEQ ID NO: 6045525 - DNA, 13 bp, Homo sapiens
ccaggtctcctgg

SEQ ID NO: 6045526 - DNA, 16 bp, Homo sapiens
ccaggtctcctgggaa

SEQ ID NO: 6045527 - DNA, 18 bp, Homo sapiens
ccaggtctgactccaaag

SEQ ID NO: 6045528 - DNA, 19 bp, Homo sapiens
ccaggtctgactccaaagc

SEQ ID NO: 6045529 - DNA, 16 bp, Homo sapiens
ccaggtctgatctggg

SEQ ID NO: 6045530 - DNA, 14 bp, Homo sapiens
ccaggtctgatgcc

SEQ ID NO: 6045531 - DNA, 15 bp, Homo sapiens
ccaggtctgatgcca

SEQ ID NO: 6045532 - DNA, 14 bp, Homo sapiens
ccaggtctggcgcc

SEQ ID NO: 6045533 - DNA, 19 bp, Homo sapiens
ccaggtctggcgccagggg

SEQ ID NO: 6045534 - DNA, 23 bp, Homo sapiens
ccaggtctgggaagctgagggca

SEQ ID NO: 6045535 - DNA, 13 bp, Homo sapiens
ccaggtcttccag

SEQ ID NO: 6045536 - DNA, 23 bp, Homo sapiens
catgtggaaatgacccaaacata

SEQ ID NO: 6045537 - DNA, 17 bp, Homo sapiens
catgtggaatataaaga

SEQ ID NO: 6045538 - DNA, 15 bp, Homo sapiens
catgtggagaaggtg

SEQ ID NO: 6045539 - DNA, 15 bp, Homo sapiens
catgtggagtgtatt

SEQ ID NO: 6045540 - DNA, 21 bp, Homo sapiens
catgtggcaaaatatggtttg

SEQ ID NO: 6045541 - DNA, 19 bp, Homo sapiens
catgtggcacgtaaggtct

SEQ ID NO: 6045542 - DNA, 18 bp, Homo sapiens
catgtggcagcaggcatg

SEQ ID NO: 6045543 - DNA, 14 bp, Homo sapiens
catgtggcagccca

SEQ ID NO: 6045544 - DNA, 15 bp, Homo sapiens
catgtggcagcccat

SEQ ID NO: 6045545 - DNA, 20 bp, Homo sapiens
catgtggcattctctctgct

SEQ ID NO: 6045546 - DNA, 22 bp, Homo sapiens
catgtggccacaactgctgtgg

SEQ ID NO: 6045547 - DNA, 23 bp, Homo sapiens
catgtggccacaactgctgtggc

SEQ ID NO: 6045548 - DNA, 18 bp, Homo sapiens
catgtggccatggcctct

SEQ ID NO: 6045549 - DNA, 19 bp, Homo sapiens
catgtggccatggcctctg

SEQ ID NO: 6045550 - DNA, 15 bp, Homo sapiens
catgtggccccaccc

SEQ ID NO: 6045551 - DNA, 17 bp, Homo sapiens
catgtggccccaggtgc

SEQ ID NO: 6045552 - DNA, 21 bp, Homo sapiens
catgtggcctgcccagcctca

SEQ ID NO: 6045553 - DNA, 17 bp, Homo sapiens
catgtggcctttatctc

SEQ ID NO: 6045554 - DNA, 23 bp, Homo sapiens
catgtggcctttatctcaacgga

SEQ ID NO: 6045555 - DNA, 24 bp, Homo sapiens
catgtggcctttatctcaacggaa

SEQ ID NO: 6045556 - DNA, 12 bp, Homo sapiens
catgtggctgga

SEQ ID NO: 6045557 - DNA, 13 bp, Homo sapiens
catgtggctggaa

SEQ ID NO: 6045558 - DNA, 15 bp, Homo sapiens
catgtggctggaaga

SEQ ID NO: 6045559 - DNA, 18 bp, Homo sapiens
catgtggcttctctgtct

SEQ ID NO: 6045560 - DNA, 20 bp, Homo sapiens
catgtggcttctctgtctct

SEQ ID NO: 6045561 - DNA, 20 bp, Homo sapiens
catgtggcttttttaaaaaa

SEQ ID NO: 6045562 - DNA, 21 bp, Homo sapiens
catgtggcttttttaaaaaag

SEQ ID NO: 6045563 - DNA, 22 bp, Homo sapiens
catgtgggaaaaaaatgaatga

SEQ ID NO: 6045564 - DNA, 21 bp, Homo sapiens
catgtgggcgcccaccctggg

SEQ ID NO: 6045565 - DNA, 17 bp, Homo sapiens
catgtggggaagcaaga

SEQ ID NO: 6045566 - DNA, 23 bp, Homo sapiens
catgtggggccaggtcacccttt

SEQ ID NO: 6045567 - DNA, 21 bp, Homo sapiens
catgtgggggaggagggagag

SEQ ID NO: 6045568 - DNA, 19 bp, Homo sapiens
catgtgggtcttccagggg

SEQ ID NO: 6045569 - DNA, 17 bp, Homo sapiens
catgtgggtgagccagt

SEQ ID NO: 6045570 - DNA, 22 bp, Homo sapiens
catgtgggtggagaagggaggg

SEQ ID NO: 6045571 - DNA, 21 bp, Homo sapiens
catgtgggtgtcagtgtcatt

SEQ ID NO: 6045572 - DNA, 17 bp, Homo sapiens
catgtgggttgtgatat

SEQ ID NO: 6045573 - DNA, 14 bp, Homo sapiens
catgtggtgatgat

SEQ ID NO: 6045574 - DNA, 23 bp, Homo sapiens
catgtggtgatgatgtgtatata

SEQ ID NO: 6045575 - DNA, 23 bp, Homo sapiens
catgtggtggcacaggccccctt

SEQ ID NO: 6045576 - DNA, 12 bp, Homo sapiens
catgtggtggga

SEQ ID NO: 6045577 - DNA, 17 bp, Homo sapiens
catgtggttaatgccat

SEQ ID NO: 6045578 - DNA, 22 bp, Homo sapiens
catgtggttaatgccatggaca

SEQ ID NO: 6045579 - DNA, 23 bp, Homo sapiens
catgtggttacacagtgtgaata

SEQ ID NO: 6045580 - DNA, 21 bp, Homo sapiens
catgtggtttggttcctctct

SEQ ID NO: 6045581 - DNA, 22 bp, Homo sapiens
catgtggtttggttcctctctg

SEQ ID NO: 6045582 - DNA, 16 bp, Homo sapiens
catgtgtaatcaataa

SEQ ID NO: 6045583 - DNA, 14 bp, Homo sapiens
catgtgtacagaaa

SEQ ID NO: 6045584 - DNA, 23 bp, Homo sapiens
catgtgtacagaaacaactgcca

SEQ ID NO: 6045585 - DNA, 11 bp, Homo sapiens
catgtgtacat

SEQ ID NO: 6045586 - DNA, 15 bp, Homo sapiens
catgtgtacatatat

SEQ ID NO: 6045587 - DNA, 19 bp, Homo sapiens
catgtgtacatatatgtat

SEQ ID NO: 6045588 - DNA, 20 bp, Homo sapiens
catgtgtacatatatgtata

SEQ ID NO: 6045589 - DNA, 15 bp, Homo sapiens
catgtgtacattctg

SEQ ID NO: 6045590 - DNA, 18 bp, Homo sapiens
catgtgtagattgcgtgg

SEQ ID NO: 6045591 - DNA, 14 bp, Homo sapiens
catgtgtagcctgt

SEQ ID NO: 6045592 - DNA, 12 bp, Homo sapiens
catgtgtatata

SEQ ID NO: 6045593 - DNA, 13 bp, Homo sapiens
catgtgtatggaa

SEQ ID NO: 6045594 - DNA, 18 bp, Homo sapiens
catgtgtatgggcaaaaa

SEQ ID NO: 6045595 - DNA, 16 bp, Homo sapiens
catgtgtatgtgtctg

SEQ ID NO: 6045596 - DNA, 12 bp, Homo sapiens
catgtgtatgtt

SEQ ID NO: 6045597 - DNA, 23 bp, Homo sapiens
catgtgtcaacacccctgtgtgg

SEQ ID NO: 6045598 - DNA, 14 bp, Homo sapiens
catgtgtcagagtg

SEQ ID NO: 6045599 - DNA, 21 bp, Homo sapiens
catgtgtcagctgtagaaagg

SEQ ID NO: 6045600 - DNA, 15 bp, Homo sapiens
catgtgtcatgcatg

SEQ ID NO: 6045601 - DNA, 18 bp, Homo sapiens
catgtgtccatcccagcg

SEQ ID NO: 6045602 - DNA, 17 bp, Homo sapiens
catgtgtcccccctgtg

SEQ ID NO: 6045603 - DNA, 17 bp, Homo sapiens
catgtgtcccctcactc

SEQ ID NO: 6045604 - DNA, 21 bp, Homo sapiens
catgtgtcctggttcccgttt

SEQ ID NO: 6045605 - DNA, 14 bp, Homo sapiens
catgtgtcgcctct

SEQ ID NO: 6045606 - DNA, 22 bp, Homo sapiens
catgtgtcgcctctcactctgg

SEQ ID NO: 6045607 - DNA, 15 bp, Homo sapiens
catgtgtctggccct

SEQ ID NO: 6045608 - DNA, 16 bp, Homo sapiens
catgtgtctgtattca

SEQ ID NO: 6045609 - DNA, 21 bp, Homo sapiens
catgtgtgagataacttcctt

SEQ ID NO: 6045610 - DNA, 22 bp, Homo sapiens
catgtgtgagataacttccttc

SEQ ID NO: 6045611 - DNA, 15 bp, Homo sapiens
catgtgtgatgctga

SEQ ID NO: 6045612 - DNA, 13 bp, Homo sapiens
catgtgtgcagag

SEQ ID NO: 6045613 - DNA, 20 bp, Homo sapiens
catgtgtgcagagcagacag

SEQ ID NO: 6045614 - DNA, 12 bp, Homo sapiens
catgtgtgcatg

SEQ ID NO: 6045615 - DNA, 16 bp, Homo sapiens
catgtgtgcctgtggc

SEQ ID NO: 6045616 - DNA, 13 bp, Homo sapiens
catgtgtgcgtgt

SEQ ID NO: 6045617 - DNA, 18 bp, Homo sapiens
catgtgtgctcacaatgt

SEQ ID NO: 6045618 - DNA, 17 bp, Homo sapiens
catgtgtgctcttcttc

SEQ ID NO: 6045619 - DNA, 17 bp, Homo sapiens
catgtgtggatgtgtaa

SEQ ID NO: 6045620 - DNA, 14 bp, Homo sapiens
catgtgtgggtgct

SEQ ID NO: 6045621 - DNA, 21 bp, Homo sapiens
catgtgtggtacatggtgttt

SEQ ID NO: 6045622 - DNA, 14 bp, Homo sapiens
catgtgtgtatata

SEQ ID NO: 6045623 - DNA, 18 bp, Homo sapiens
catgtgtgtcagcccatg

SEQ ID NO: 6045624 - DNA, 21 bp, Homo sapiens
catgtgtgtcagcccatgtca

SEQ ID NO: 6045625 - DNA, 23 bp, Homo sapiens
catgtgtgtccacgactgtctcc

SEQ ID NO: 6045626 - DNA, 15 bp, Homo sapiens
catgtgtgtgagttt

SEQ ID NO: 6045627 - DNA, 15 bp, Homo sapiens
catgtgtgtgcaagt

SEQ ID NO: 6045628 - DNA, 13 bp, Homo sapiens
catgtgtgtgtct

SEQ ID NO: 6045629 - DNA, 15 bp, Homo sapiens
catgtgtgtgtctgt

SEQ ID NO: 6045630 - DNA, 16 bp, Homo sapiens
catgtgtgtgtctgtc

SEQ ID NO: 6045631 - DNA, 19 bp, Homo sapiens
catgtgtgtgtctgtcttt

SEQ ID NO: 6045632 - DNA, 20 bp, Homo sapiens
catgtgtgtgtctgtctttg

SEQ ID NO: 6045633 - DNA, 13 bp, Homo sapiens
catgtgtgtgtgt

SEQ ID NO: 6045634 - DNA, 22 bp, Homo sapiens
catgtgtgttaacccagtgctt

SEQ ID NO: 6045635 - DNA, 23 bp, Homo sapiens
catgtgtgttaacccagtgcttt

SEQ ID NO: 6045636 - DNA, 14 bp, Homo sapiens
catgtgttaaaata

SEQ ID NO: 6045637 - DNA, 19 bp, Homo sapiens
catgtgttagtgtatgtga

SEQ ID NO: 6045638 - DNA, 18 bp, Homo sapiens
catgtgttggcagcctct

SEQ ID NO: 6045639 - DNA, 21 bp, Homo sapiens
catgtgttggggagacatcaa

SEQ ID NO: 6045640 - DNA, 22 bp, Homo sapiens
catgtgttgttgtttttgataa

SEQ ID NO: 6045641 - DNA, 22 bp, Homo sapiens
catgtgtttattcatccagcag

SEQ ID NO: 6045642 - DNA, 22 bp, Homo sapiens
catgtgttttcatcatttcagc

SEQ ID NO: 6045643 - DNA, 13 bp, Homo sapiens
catgtgttttgct

SEQ ID NO: 6045644 - DNA, 13 bp, Homo sapiens
catgttaaaataa

SEQ ID NO: 6045645 - DNA, 18 bp, Homo sapiens
catgttaaaatgtacttt

SEQ ID NO: 6045646 - DNA, 15 bp, Homo sapiens
catgttaaattagaa

SEQ ID NO: 6045647 - DNA, 16 bp, Homo sapiens
catgttaaattagaat

SEQ ID NO: 6045648 - DNA, 15 bp, Homo sapiens
catgttaactttatt

SEQ ID NO: 6045649 - DNA, 17 bp, Homo sapiens
catgttaatatttgaat

SEQ ID NO: 6045650 - DNA, 17 bp, Homo sapiens
catgttaatcctagctg

SEQ ID NO: 6045651 - DNA, 22 bp, Homo sapiens
catgttaatcctagctgtgtgc

SEQ ID NO: 6045652 - DNA, 17 bp, Homo sapiens
catgttaatgaacagtg

SEQ ID NO: 6045653 - DNA, 17 bp, Homo sapiens
catgttaattaaactga

SEQ ID NO: 6045654 - DNA, 16 bp, Homo sapiens
catgttacataagata

SEQ ID NO: 6045655 - DNA, 17 bp, Homo sapiens
catgttacataagataa

SEQ ID NO: 6045656 - DNA, 18 bp, Homo sapiens
catgttaccaaagcaata

SEQ ID NO: 6045657 - DNA, 17 bp, Homo sapiens
catgttacgtgtgcaac

SEQ ID NO: 6045658 - DNA, 19 bp, Homo sapiens
catgttacgtgtgcaacag

SEQ ID NO: 6045659 - DNA, 22 bp, Homo sapiens
catgttactaaatggtgttaca

SEQ ID NO: 6045660 - DNA, 15 bp, Homo sapiens
catgttactcagtgt

SEQ ID NO: 6045661 - DNA, 17 bp, Homo sapiens
catgttactgaccagca

SEQ ID NO: 6045662 - DNA, 16 bp, Homo sapiens
catgttactgccaaaa

SEQ ID NO: 6045663 - DNA, 22 bp, Homo sapiens
catgttactgcttcattttgga

SEQ ID NO: 6045664 - DNA, 17 bp, Homo sapiens
catgttactggataaat

SEQ ID NO: 6045665 - DNA, 21 bp, Homo sapiens
catgttactggataaattgtt

SEQ ID NO: 6045666 - DNA, 13 bp, Homo sapiens
catgttagccagg

SEQ ID NO: 6045667 - DNA, 16 bp, Homo sapiens
catgttagcccttcct

SEQ ID NO: 6045668 - DNA, 18 bp, Homo sapiens
catgttaggaattagaca

SEQ ID NO: 6045669 - DNA, 14 bp, Homo sapiens
catgttagtaatac

SEQ ID NO: 6045670 - DNA, 18 bp, Homo sapiens
catgttagtaatacctct

SEQ ID NO: 6045671 - DNA, 20 bp, Homo sapiens
catgttagtaatacctctaa

SEQ ID NO: 6045672 - DNA, 24 bp, Homo sapiens
catgttagttaccttatagttact

SEQ ID NO: 6045673 - DNA, 22 bp, Homo sapiens
catgttatatattttttgtagg

SEQ ID NO: 6045674 - DNA, 20 bp, Homo sapiens
catgttatatttaatgcatt

SEQ ID NO: 6045675 - DNA, 23 bp, Homo sapiens
catgttatgataaaaaattttgt

SEQ ID NO: 6045676 - DNA, 19 bp, Homo sapiens
catgttatgatttgtaaca

SEQ ID NO: 6045677 - DNA, 13 bp, Homo sapiens
catgttatgcagt

SEQ ID NO: 6045678 - DNA, 14 bp, Homo sapiens
catgttatgcagtg

SEQ ID NO: 6045679 - DNA, 21 bp, Homo sapiens
catgttatgcagtgaactatt

SEQ ID NO: 6045680 - DNA, 13 bp, Homo sapiens
catgttatgcctg

SEQ ID NO: 6045681 - DNA, 12 bp, Homo sapiens
catgttatgctg

SEQ ID NO: 6045682 - DNA, 16 bp, Homo sapiens
catgttattgttttca

SEQ ID NO: 6045683 - DNA, 20 bp, Homo sapiens
catgttcaattatttccccc

SEQ ID NO: 6045684 - DNA, 14 bp, Homo sapiens
catgttcagggatg

SEQ ID NO: 6045685 - DNA, 18 bp, Homo sapiens
catgttcatatgtacttg

SEQ ID NO: 6045686 - DNA, 22 bp, Homo sapiens
catgttcattataatctcaaag

SEQ ID NO: 6045687 - DNA, 14 bp, Homo sapiens
catgttccaataaa

SEQ ID NO: 6045688 - DNA, 16 bp, Homo sapiens
catgttccactaaccc

SEQ ID NO: 6045689 - DNA, 16 bp, Homo sapiens
catgttcccaaaacaa

SEQ ID NO: 6045690 - DNA, 18 bp, Homo sapiens
catgttcccaaaacaatg

SEQ ID NO: 6045691 - DNA, 21 bp, Homo sapiens
catgttcccacttcaaaacaa

SEQ ID NO: 6045692 - DNA, 15 bp, Homo sapiens
catgttcccagaaag

SEQ ID NO: 6045693 - DNA, 17 bp, Homo sapiens
catgttccctttaaaat

SEQ ID NO: 6045694 - DNA, 13 bp, Homo sapiens
catgttcctcaaa

SEQ ID NO: 6045695 - DNA, 14 bp, Homo sapiens
catgttccttcaag

SEQ ID NO: 6045696 - DNA, 16 bp, Homo sapiens
catgttccttcaagat

SEQ ID NO: 6045697 - DNA, 16 bp, Homo sapiens
catgttccttttgaaa

SEQ ID NO: 6045698 - DNA, 24 bp, Homo sapiens
catgttctaccgtggatttgtact

SEQ ID NO: 6045699 - DNA, 18 bp, Homo sapiens
catgttctatattcttta

SEQ ID NO: 6045700 - DNA, 20 bp, Homo sapiens
catgttctatttttgactgt

SEQ ID NO: 6045701 - DNA, 22 bp, Homo sapiens
catgttctcatgcatgtctaac

SEQ ID NO: 6045702 - DNA, 13 bp, Homo sapiens
catgttctcccaa

SEQ ID NO: 6045703 - DNA, 19 bp, Homo sapiens
catgttctgcccccagccc

SEQ ID NO: 6045704 - DNA, 19 bp, Homo sapiens
catgttctggtggtttgat

SEQ ID NO: 6045705 - DNA, 23 bp, Homo sapiens
catgttctgtgtcacgtgaccct

SEQ ID NO: 6045706 - DNA, 23 bp, Homo sapiens
catgttctgtgtgccctgaaaat

SEQ ID NO: 6045707 - DNA, 18 bp, Homo sapiens
catgttcttaattcttag

SEQ ID NO: 6045708 - DNA, 22 bp, Homo sapiens
catgttcttgtcataaaatgca

SEQ ID NO: 6045709 - DNA, 18 bp, Homo sapiens
catgttgaagtaattctt

SEQ ID NO: 6045710 - DNA, 17 bp, Homo sapiens
catgttgactgtcttga

SEQ ID NO: 6045711 - DNA, 18 bp, Homo sapiens
catgttgagacctcagct

SEQ ID NO: 6045712 - DNA, 20 bp, Homo sapiens
catgttgatcatgtactttt

SEQ ID NO: 6045713 - DNA, 16 bp, Homo sapiens
ccaggtcttccagacc

SEQ ID NO: 6045714 - DNA, 18 bp, Homo sapiens
ccaggtcttccagacctg

SEQ ID NO: 6045715 - DNA, 20 bp, Homo sapiens
ccaggtcttccagacctgct

SEQ ID NO: 6045716 - DNA, 18 bp, Homo sapiens
ccaggtcttcctgctttc

SEQ ID NO: 6045717 - DNA, 15 bp, Homo sapiens
ccaggtcttgactca

SEQ ID NO: 6045718 - DNA, 20 bp, Homo sapiens
ccaggtcttggagctgagcc

SEQ ID NO: 6045719 - DNA, 21 bp, Homo sapiens
ccaggtgaaggaggctccagg

SEQ ID NO: 6045720 - DNA, 14 bp, Homo sapiens
ccaggtgagaattc

SEQ ID NO: 6045721 - DNA, 13 bp, Homo sapiens
ccaggtgagacag

SEQ ID NO: 6045722 - DNA, 17 bp, Homo sapiens
ccaggtgagctctgacc

SEQ ID NO: 6045723 - DNA, 20 bp, Homo sapiens
ccaggtgagctctgaccctt

SEQ ID NO: 6045724 - DNA, 12 bp, Homo sapiens
ccaggtgagctg

SEQ ID NO: 6045725 - DNA, 20 bp, Homo sapiens
ccaggtgaggcccaagagcc

SEQ ID NO: 6045726 - DNA, 21 bp, Homo sapiens
ccaggtgagggaaggagacag

SEQ ID NO: 6045727 - DNA, 22 bp, Homo sapiens
ccaggtgaggtccaccggcccc

SEQ ID NO: 6045728 - DNA, 21 bp, Homo sapiens
ccaggtgagtcctagagctac

SEQ ID NO: 6045729 - DNA, 19 bp, Homo sapiens
ccaggtgagtgtgagggca

SEQ ID NO: 6045730 - DNA, 22 bp, Homo sapiens
ccaggtgagtgtgagggcagca

SEQ ID NO: 6045731 - DNA, 19 bp, Homo sapiens
ccaggtgatctcctgtggc

SEQ ID NO: 6045732 - DNA, 22 bp, Homo sapiens
ccaggtgatctcctgtggctca

SEQ ID NO: 6045733 - DNA, 24 bp, Homo sapiens
ccaggtgcacaagctccaagctcc

SEQ ID NO: 6045734 - DNA, 18 bp, Homo sapiens
ccaggtgcagaccttggg

SEQ ID NO: 6045735 - DNA, 14 bp, Homo sapiens
ccaggtgcagaggt

SEQ ID NO: 6045736 - DNA, 16 bp, Homo sapiens
ccaggtgcagccagag

SEQ ID NO: 6045737 - DNA, 16 bp, Homo sapiens
ccaggtgcagccccag

SEQ ID NO: 6045738 - DNA, 22 bp, Homo sapiens
ccaggtgcagtggctcacgcct

SEQ ID NO: 6045739 - DNA, 13 bp, Homo sapiens
ccaggtgcatttc

SEQ ID NO: 6045740 - DNA, 14 bp, Homo sapiens
ccaggtgcatttct

SEQ ID NO: 6045741 - DNA, 15 bp, Homo sapiens
ccaggtgcatttctt

SEQ ID NO: 6045742 - DNA, 19 bp, Homo sapiens
ccaggtgccaccaataaaa

SEQ ID NO: 6045743 - DNA, 17 bp, Homo sapiens
ccaggtgccagttatgg

SEQ ID NO: 6045744 - DNA, 13 bp, Homo sapiens
ccaggtgcccagc

SEQ ID NO: 6045745 - DNA, 20 bp, Homo sapiens
ccaggtgccccgactgtggg

SEQ ID NO: 6045746 - DNA, 20 bp, Homo sapiens
ccaggtgcccgcgccaggcc

SEQ ID NO: 6045747 - DNA, 15 bp, Homo sapiens
ccaggtgccctgtgg

SEQ ID NO: 6045748 - DNA, 16 bp, Homo sapiens
ccaggtgcctggccct

SEQ ID NO: 6045749 - DNA, 12 bp, Homo sapiens
ccaggtgccttg

SEQ ID NO: 6045750 - DNA, 13 bp, Homo sapiens
ccaggtgccttgg

SEQ ID NO: 6045751 - DNA, 19 bp, Homo sapiens
ccaggtgctaggaacactc

SEQ ID NO: 6045752 - DNA, 15 bp, Homo sapiens
ccaggtgctcagccc

SEQ ID NO: 6045753 - DNA, 19 bp, Homo sapiens
ccaggtgctggaggcagac

SEQ ID NO: 6045754 - DNA, 20 bp, Homo sapiens
ccaggtgctggaggcagact

SEQ ID NO: 6045755 - DNA, 19 bp, Homo sapiens
ccaggtggaaggcagacag

SEQ ID NO: 6045756 - DNA, 20 bp, Homo sapiens
ccaggtggaaggcagacagc

SEQ ID NO: 6045757 - DNA, 19 bp, Homo sapiens
ccaggtggagggcacagcc

SEQ ID NO: 6045758 - DNA, 20 bp, Homo sapiens
ccaggtggaggtggcatccc

SEQ ID NO: 6045759 - DNA, 13 bp, Homo sapiens
ccaggtggcacct

SEQ ID NO: 6045760 - DNA, 17 bp, Homo sapiens
ccaggtggcacctgcag

SEQ ID NO: 6045761 - DNA, 22 bp, Homo sapiens
ccaggtggcacctgcagcggct

SEQ ID NO: 6045762 - DNA, 16 bp, Homo sapiens
ccaggtggctgaccca

SEQ ID NO: 6045763 - DNA, 14 bp, Homo sapiens
ccaggtgggactta

SEQ ID NO: 6045764 - DNA, 16 bp, Homo sapiens
ccaggtgggagagaca

SEQ ID NO: 6045765 - DNA, 19 bp, Homo sapiens
ccaggtggggccggggact

SEQ ID NO: 6045766 - DNA, 22 bp, Homo sapiens
ccaggtggtgggcattctctct

SEQ ID NO: 6045767 - DNA, 16 bp, Homo sapiens
ccaggtgtcctgactg

SEQ ID NO: 6045768 - DNA, 15 bp, Homo sapiens
ccaggtgtctagagg

SEQ ID NO: 6045769 - DNA, 22 bp, Homo sapiens
ccaggtgtgcccctccaagtca

SEQ ID NO: 6045770 - DNA, 14 bp, Homo sapiens
ccaggtgtgcctgt

SEQ ID NO: 6045771 - DNA, 15 bp, Homo sapiens
ccaggtgtgcctgtg

SEQ ID NO: 6045772 - DNA, 20 bp, Homo sapiens
ccaggtgtgcctgtgctcct

SEQ ID NO: 6045773 - DNA, 22 bp, Homo sapiens
ccaggtgtggaccggccgcagc

SEQ ID NO: 6045774 - DNA, 23 bp, Homo sapiens
ccaggtgtggaccggccgcagcc

SEQ ID NO: 6045775 - DNA, 22 bp, Homo sapiens
ccaggtgtggttgctcacagct

SEQ ID NO: 6045776 - DNA, 22 bp, Homo sapiens
ccaggtgtgtccacctgggcat

SEQ ID NO: 6045777 - DNA, 23 bp, Homo sapiens
ccaggtgttaaaaaccattataa

SEQ ID NO: 6045778 - DNA, 21 bp, Homo sapiens
ccaggtgttactgtaattcct

SEQ ID NO: 6045779 - DNA, 21 bp, Homo sapiens
ccaggttagcctttgccctgt

SEQ ID NO: 6045780 - DNA, 23 bp, Homo sapiens
ccaggttaggaaggcagcattcc

SEQ ID NO: 6045781 - DNA, 15 bp, Homo sapiens
ccaggttatgcctca

SEQ ID NO: 6045782 - DNA, 15 bp, Homo sapiens
ccaggttcaacccac

SEQ ID NO: 6045783 - DNA, 18 bp, Homo sapiens
ccaggttccacagaggac

SEQ ID NO: 6045784 - DNA, 15 bp, Homo sapiens
ccaggttccatccac

SEQ ID NO: 6045785 - DNA, 23 bp, Homo sapiens
ccaggttccatccaccaccttgc

SEQ ID NO: 6045786 - DNA, 15 bp, Homo sapiens
ccaggttcccccagc

SEQ ID NO: 6045787 - DNA, 11 bp, Homo sapiens
ccaggttcctc

SEQ ID NO: 6045788 - DNA, 16 bp, Homo sapiens
ccaggttctatttgga

SEQ ID NO: 6045789 - DNA, 22 bp, Homo sapiens
ccaggttctatttggaatttat

SEQ ID NO: 6045790 - DNA, 21 bp, Homo sapiens
ccaggttctccgttagctcct

SEQ ID NO: 6045791 - DNA, 24 bp, Homo sapiens
ccaggttctccgttagctcctgtg

SEQ ID NO: 6045792 - DNA, 23 bp, Homo sapiens
ccaggttctggttagctcagccc

SEQ ID NO: 6045793 - DNA, 16 bp, Homo sapiens
ccaggttgaaagacct

SEQ ID NO: 6045794 - DNA, 15 bp, Homo sapiens
ccaggttgcagctgc

SEQ ID NO: 6045795 - DNA, 21 bp, Homo sapiens
ccaggttgcagctgctcttgc

SEQ ID NO: 6045796 - DNA, 23 bp, Homo sapiens
ccaggttgcagctgctcttgcat

SEQ ID NO: 6045797 - DNA, 20 bp, Homo sapiens
ccaggttggctctgccagtc

SEQ ID NO: 6045798 - DNA, 22 bp, Homo sapiens
ccaggtttaagtagatttcatg

SEQ ID NO: 6045799 - DNA, 22 bp, Homo sapiens
ccaggtttagtgaaaaactgct

SEQ ID NO: 6045800 - DNA, 14 bp, Homo sapiens
ccaggtttcttctc

SEQ ID NO: 6045801 - DNA, 18 bp, Homo sapiens
ccaggtttcttctctgga

SEQ ID NO: 6045802 - DNA, 12 bp, Homo sapiens
ccaggtttttca

SEQ ID NO: 6045803 - DNA, 17 bp, Homo sapiens
ccaggtttttcaattaa

SEQ ID NO: 6045804 - DNA, 19 bp, Homo sapiens
ccaggtttttcaattaaac

SEQ ID NO: 6045805 - DNA, 22 bp, Homo sapiens
ccaggtttttcaattaaacgga

SEQ ID NO: 6045806 - DNA, 19 bp, Homo sapiens
ccaggtttttcatctgaaa

SEQ ID NO: 6045807 - DNA, 16 bp, Homo sapiens
ccaggtttttgcccat

SEQ ID NO: 6045808 - DNA, 15 bp, Homo sapiens
ccagtaaaattgcca

SEQ ID NO: 6045809 - DNA, 19 bp, Homo sapiens
ccagtaaaattgccatatt

SEQ ID NO: 6045810 - DNA, 24 bp, Homo sapiens
ccagtaaagtgtaacatatgcaaa

SEQ ID NO: 6045811 - DNA, 12 bp, Homo sapiens
ccagtaacacag

SEQ ID NO: 6045812 - DNA, 20 bp, Homo sapiens
ccagtaacgcgtcttcctga

SEQ ID NO: 6045813 - DNA, 17 bp, Homo sapiens
ccagtaagatcactgtt

SEQ ID NO: 6045814 - DNA, 15 bp, Homo sapiens
ccagtaagatgataa

SEQ ID NO: 6045815 - DNA, 15 bp, Homo sapiens
ccagtaaggaaatat

SEQ ID NO: 6045816 - DNA, 20 bp, Homo sapiens
ccagtaaggcagctctgtcg

SEQ ID NO: 6045817 - DNA, 21 bp, Homo sapiens
ccagtaagtttcccctctggc

SEQ ID NO: 6045818 - DNA, 14 bp, Homo sapiens
ccagtaatcctgta

SEQ ID NO: 6045819 - DNA, 17 bp, Homo sapiens
ccagtacaataaataaa

SEQ ID NO: 6045820 - DNA, 19 bp, Homo sapiens
ccagtacattctcagtttt

SEQ ID NO: 6045821 - DNA, 22 bp, Homo sapiens
ccagtacattctcagtttttct

SEQ ID NO: 6045822 - DNA, 17 bp, Homo sapiens
ccagtaccataatctta

SEQ ID NO: 6045823 - DNA, 18 bp, Homo sapiens
ccagtacctcctgtctct

SEQ ID NO: 6045824 - DNA, 22 bp, Homo sapiens
ccagtacctcctgtctctggcc

SEQ ID NO: 6045825 - DNA, 17 bp, Homo sapiens
ccagtaccttctgccag

SEQ ID NO: 6045826 - DNA, 20 bp, Homo sapiens
ccagtacgtcccgctgctgt

SEQ ID NO: 6045827 - DNA, 16 bp, Homo sapiens
ccagtacgtgctaaca

SEQ ID NO: 6045828 - DNA, 16 bp, Homo sapiens
ccagtactgaggtggt

SEQ ID NO: 6045829 - DNA, 13 bp, Homo sapiens
ccagtacttgtca

SEQ ID NO: 6045830 - DNA, 14 bp, Homo sapiens
ccagtacttgtcat

SEQ ID NO: 6045831 - DNA, 18 bp, Homo sapiens
ccagtagccaaggcccgg

SEQ ID NO: 6045832 - DNA, 19 bp, Homo sapiens
ccagtagccattttgtaac

SEQ ID NO: 6045833 - DNA, 20 bp, Homo sapiens
ccagtagccattttgtaact

SEQ ID NO: 6045834 - DNA, 22 bp, Homo sapiens
ccagtagccccaatatggtggc

SEQ ID NO: 6045835 - DNA, 22 bp, Homo sapiens
ccagtaggaaattgattttgaa

SEQ ID NO: 6045836 - DNA, 18 bp, Homo sapiens
ccagtaggaggaggatga

SEQ ID NO: 6045837 - DNA, 22 bp, Homo sapiens
ccagtagggtttgacatttcat

SEQ ID NO: 6045838 - DNA, 17 bp, Homo sapiens
ccagtagtaccttgttt

SEQ ID NO: 6045839 - DNA, 12 bp, Homo sapiens
ccagtagtgacc

SEQ ID NO: 6045840 - DNA, 17 bp, Homo sapiens
ccagtagtgaccaatcg

SEQ ID NO: 6045841 - DNA, 17 bp, Homo sapiens
ccagtagtgtttggaat

SEQ ID NO: 6045842 - DNA, 17 bp, Homo sapiens
ccagtagttataaagtc

SEQ ID NO: 6045843 - DNA, 22 bp, Homo sapiens
ccagtataaaacacctaaataa

SEQ ID NO: 6045844 - DNA, 18 bp, Homo sapiens
ccagtataaaattacagt

SEQ ID NO: 6045845 - DNA, 21 bp, Homo sapiens
ccagtataaattacatgcatg

SEQ ID NO: 6045846 - DNA, 17 bp, Homo sapiens
ccagtatacctcatttt

SEQ ID NO: 6045847 - DNA, 21 bp, Homo sapiens
ccagtatacctcatttttcat

SEQ ID NO: 6045848 - DNA, 21 bp, Homo sapiens
ccagtatataagctgtttagt

SEQ ID NO: 6045849 - DNA, 17 bp, Homo sapiens
ccagtatcctgaaacag

SEQ ID NO: 6045850 - DNA, 23 bp, Homo sapiens
ccagtatcctgctggttcactct

SEQ ID NO: 6045851 - DNA, 22 bp, Homo sapiens
ccagtatctccatccttaactg

SEQ ID NO: 6045852 - DNA, 15 bp, Homo sapiens
ccagtatctcttcag

SEQ ID NO: 6045853 - DNA, 22 bp, Homo sapiens
ccagtatcttgaagacttttct

SEQ ID NO: 6045854 - DNA, 17 bp, Homo sapiens
ccagtatgacagaggag

SEQ ID NO: 6045855 - DNA, 16 bp, Homo sapiens
ccagtatgttttaaca

SEQ ID NO: 6045856 - DNA, 22 bp, Homo sapiens
ccagtattactgctgctgtgct

SEQ ID NO: 6045857 - DNA, 22 bp, Homo sapiens
ccagtattatattatcatatct

SEQ ID NO: 6045858 - DNA, 14 bp, Homo sapiens
ccagtattcttgtc

SEQ ID NO: 6045859 - DNA, 15 bp, Homo sapiens
ccagtattgccccct

SEQ ID NO: 6045860 - DNA, 16 bp, Homo sapiens
ccagtattgccccctc

SEQ ID NO: 6045861 - DNA, 22 bp, Homo sapiens
ccagtattgtacaaagtattaa

SEQ ID NO: 6045862 - DNA, 9 bp, Homo sapiens
ccagtattt

SEQ ID NO: 6045863 - DNA, 16 bp, Homo sapiens
ccagtatttaagcttt

SEQ ID NO: 6045864 - DNA, 17 bp, Homo sapiens
ccagtcaaatctgggct

SEQ ID NO: 6045865 - DNA, 21 bp, Homo sapiens
ccagtcaacatcgtggatgta

SEQ ID NO: 6045866 - DNA, 21 bp, Homo sapiens
ccagtcaacggggggctcctg

SEQ ID NO: 6045867 - DNA, 15 bp, Homo sapiens
ccagtcaagctccta

SEQ ID NO: 6045868 - DNA, 21 bp, Homo sapiens
ccagtcaagttccctcctgca

SEQ ID NO: 6045869 - DNA, 13 bp, Homo sapiens
ccagtcacatgac

SEQ ID NO: 6045870 - DNA, 21 bp, Homo sapiens
ccagtcacatgacctgatcac

SEQ ID NO: 6045871 - DNA, 12 bp, Homo sapiens
ccagtcacattg

SEQ ID NO: 6045872 - DNA, 12 bp, Homo sapiens
ccagtcaccccg

SEQ ID NO: 6045873 - DNA, 19 bp, Homo sapiens
ccagtcaccccggccacct

SEQ ID NO: 6045874 - DNA, 20 bp, Homo sapiens
ccagtcaccccggccacctg

SEQ ID NO: 6045875 - DNA, 15 bp, Homo sapiens
ccagtcacctcccca

SEQ ID NO: 6045876 - DNA, 18 bp, Homo sapiens
ccagtcacctccccacat

SEQ ID NO: 6045877 - DNA, 20 bp, Homo sapiens
ccagtcacctcgtctccctg

SEQ ID NO: 6045878 - DNA, 17 bp, Homo sapiens
ccagtcaccttctgggc

SEQ ID NO: 6045879 - DNA, 22 bp, Homo sapiens
ccagtcactccctctgccttca

SEQ ID NO: 6045880 - DNA, 16 bp, Homo sapiens
ccagtcactcctctct

SEQ ID NO: 6045881 - DNA, 21 bp, Homo sapiens
ccagtcactgtgagctcccag

SEQ ID NO: 6045882 - DNA, 13 bp, Homo sapiens
ccagtcagaaata

SEQ ID NO: 6045883 - DNA, 17 bp, Homo sapiens
ccagtcagaagttctgg

SEQ ID NO: 6045884 - DNA, 16 bp, Homo sapiens
ccagtcagcagtcatg

SEQ ID NO: 6045885 - DNA, 12 bp, Homo sapiens
ccagtcagcctc

SEQ ID NO: 6045886 - DNA, 17 bp, Homo sapiens
ccagtcagcctctctcc

SEQ ID NO: 6045887 - DNA, 18 bp, Homo sapiens
ccagtcagcctctctccc

SEQ ID NO: 6045888 - DNA, 14 bp, Homo sapiens
ccagtcagcctggc

SEQ ID NO: 6045889 - DNA, 21 bp, Homo sapiens
catgttgatcatgtacttttt

SEQ ID NO: 6045890 - DNA, 18 bp, Homo sapiens
catgttgctgaatttgta

SEQ ID NO: 6045891 - DNA, 13 bp, Homo sapiens
catgttgctgcca

SEQ ID NO: 6045892 - DNA, 22 bp, Homo sapiens
catgttgcttcactctatccaa

SEQ ID NO: 6045893 - DNA, 18 bp, Homo sapiens
catgttggaaatgtgttt

SEQ ID NO: 6045894 - DNA, 12 bp, Homo sapiens
catgttggccaa

SEQ ID NO: 6045895 - DNA, 13 bp, Homo sapiens
catgttggccagg

SEQ ID NO: 6045896 - DNA, 14 bp, Homo sapiens
catgttggccaggc

SEQ ID NO: 6045897 - DNA, 15 bp, Homo sapiens
catgttggccaggct

SEQ ID NO: 6045898 - DNA, 22 bp, Homo sapiens
catgttggccaggctgctctca

SEQ ID NO: 6045899 - DNA, 23 bp, Homo sapiens
catgttggccaggctgctctcaa

SEQ ID NO: 6045900 - DNA, 18 bp, Homo sapiens
catgttggccaggctggt

SEQ ID NO: 6045901 - DNA, 21 bp, Homo sapiens
catgttggccaggctggtttc

SEQ ID NO: 6045902 - DNA, 13 bp, Homo sapiens
catgttggcctct

SEQ ID NO: 6045903 - DNA, 14 bp, Homo sapiens
catgttggcctctt

SEQ ID NO: 6045904 - DNA, 13 bp, Homo sapiens
catgttgggaaaa

SEQ ID NO: 6045905 - DNA, 20 bp, Homo sapiens
catgttgggtttgagacaga

SEQ ID NO: 6045906 - DNA, 21 bp, Homo sapiens
catgttgggtttgagacagac

SEQ ID NO: 6045907 - DNA, 22 bp, Homo sapiens
catgttgggtttgagacagaca

SEQ ID NO: 6045908 - DNA, 20 bp, Homo sapiens
catgttggtatttatctatt

SEQ ID NO: 6045909 - DNA, 16 bp, Homo sapiens
catgttggttgcactt

SEQ ID NO: 6045910 - DNA, 21 bp, Homo sapiens
catgttggttgcactttgtag

SEQ ID NO: 6045911 - DNA, 12 bp, Homo sapiens
catgttgtaatg

SEQ ID NO: 6045912 - DNA, 20 bp, Homo sapiens
catgttgtaatgctgcactt

SEQ ID NO: 6045913 - DNA, 17 bp, Homo sapiens
catgttgtattagtaaa

SEQ ID NO: 6045914 - DNA, 21 bp, Homo sapiens
catgttgtcctttttatctga

SEQ ID NO: 6045915 - DNA, 13 bp, Homo sapiens
catgttgtgcctc

SEQ ID NO: 6045916 - DNA, 14 bp, Homo sapiens
catgtttaaacctg

SEQ ID NO: 6045917 - DNA, 20 bp, Homo sapiens
catgtttaaactttgtgcct

SEQ ID NO: 6045918 - DNA, 20 bp, Homo sapiens
catgtttaaatagcctaaat

SEQ ID NO: 6045919 - DNA, 19 bp, Homo sapiens
catgtttaaattgtaaatt

SEQ ID NO: 6045920 - DNA, 19 bp, Homo sapiens
catgtttaagatttaattt

SEQ ID NO: 6045921 - DNA, 13 bp, Homo sapiens
catgtttaataat

SEQ ID NO: 6045922 - DNA, 14 bp, Homo sapiens
catgtttaataata

SEQ ID NO: 6045923 - DNA, 23 bp, Homo sapiens
catgtttaataatatgtacaaat

SEQ ID NO: 6045924 - DNA, 20 bp, Homo sapiens
catgtttaatgggtatgctc

SEQ ID NO: 6045925 - DNA, 13 bp, Homo sapiens
catgtttaatgtg

SEQ ID NO: 6045926 - DNA, 18 bp, Homo sapiens
catgtttaatgtgaactc

SEQ ID NO: 6045927 - DNA, 19 bp, Homo sapiens
catgtttaatgtgaactct

SEQ ID NO: 6045928 - DNA, 23 bp, Homo sapiens
catgtttaatgtgaactctcccc

SEQ ID NO: 6045929 - DNA, 14 bp, Homo sapiens
catgtttaattgtg

SEQ ID NO: 6045930 - DNA, 19 bp, Homo sapiens
catgtttacttttcagggc

SEQ ID NO: 6045931 - DNA, 21 bp, Homo sapiens
catgtttagtgaatgactttt

SEQ ID NO: 6045932 - DNA, 12 bp, Homo sapiens
catgtttattac

SEQ ID NO: 6045933 - DNA, 20 bp, Homo sapiens
catgtttattacagtataat

SEQ ID NO: 6045934 - DNA, 22 bp, Homo sapiens
catgtttattacagtataatta

SEQ ID NO: 6045935 - DNA, 18 bp, Homo sapiens
catgtttatttttcttgt

SEQ ID NO: 6045936 - DNA, 14 bp, Homo sapiens
catgtttcactcct

SEQ ID NO: 6045937 - DNA, 17 bp, Homo sapiens
catgtttcactcctgct

SEQ ID NO: 6045938 - DNA, 12 bp, Homo sapiens
catgtttccagc

SEQ ID NO: 6045939 - DNA, 22 bp, Homo sapiens
catgtttccagcattcccaggt

SEQ ID NO: 6045940 - DNA, 21 bp, Homo sapiens
catgtttctcacattgctgta

SEQ ID NO: 6045941 - DNA, 21 bp, Homo sapiens
catgtttctctggccccaagg

SEQ ID NO: 6045942 - DNA, 16 bp, Homo sapiens
catgtttctgagacca

SEQ ID NO: 6045943 - DNA, 13 bp, Homo sapiens
catgtttcttcat

SEQ ID NO: 6045944 - DNA, 20 bp, Homo sapiens
catgtttctttgatcatgaa

SEQ ID NO: 6045945 - DNA, 22 bp, Homo sapiens
catgtttctttgatcatgaata

SEQ ID NO: 6045946 - DNA, 16 bp, Homo sapiens
catgtttgagctcaga

SEQ ID NO: 6045947 - DNA, 23 bp, Homo sapiens
catgtttgatgtatctgagcagg

SEQ ID NO: 6045948 - DNA, 22 bp, Homo sapiens
catgtttgcacctttctagttg

SEQ ID NO: 6045949 - DNA, 14 bp, Homo sapiens
catgtttggaagac

SEQ ID NO: 6045950 - DNA, 17 bp, Homo sapiens
catgtttggtgcataga

SEQ ID NO: 6045951 - DNA, 22 bp, Homo sapiens
catgtttggtgtttgtctgtgt

SEQ ID NO: 6045952 - DNA, 20 bp, Homo sapiens
catgtttgtctgtgtgctgt

SEQ ID NO: 6045953 - DNA, 12 bp, Homo sapiens
catgtttgtgat

SEQ ID NO: 6045954 - DNA, 14 bp, Homo sapiens
catgtttgtgattg

SEQ ID NO: 6045955 - DNA, 15 bp, Homo sapiens
catgtttgtgattga

SEQ ID NO: 6045956 - DNA, 16 bp, Homo sapiens
catgttttaaaatcta

SEQ ID NO: 6045957 - DNA, 12 bp, Homo sapiens
catgttttaaca

SEQ ID NO: 6045958 - DNA, 18 bp, Homo sapiens
catgttttaacttattgt

SEQ ID NO: 6045959 - DNA, 14 bp, Homo sapiens
catgttttaatgta

SEQ ID NO: 6045960 - DNA, 17 bp, Homo sapiens
catgttttaatgtagaa

SEQ ID NO: 6045961 - DNA, 19 bp, Homo sapiens
catgttttacaaagaaaca

SEQ ID NO: 6045962 - DNA, 21 bp, Homo sapiens
catgttttacaaagaaacaaa

SEQ ID NO: 6045963 - DNA, 18 bp, Homo sapiens
catgttttagcatttgta

SEQ ID NO: 6045964 - DNA, 18 bp, Homo sapiens
catgttttataatttgaa

SEQ ID NO: 6045965 - DNA, 18 bp, Homo sapiens
catgttttatactgctct

SEQ ID NO: 6045966 - DNA, 10 bp, Homo sapiens
catgttttcc

SEQ ID NO: 6045967 - DNA, 10 bp, Homo sapiens
catgttttct

SEQ ID NO: 6045968 - DNA, 15 bp, Homo sapiens
catgttttctgcttt

SEQ ID NO: 6045969 - DNA, 18 bp, Homo sapiens
catgttttgataaagtag

SEQ ID NO: 6045970 - DNA, 20 bp, Homo sapiens
catgttttgatgagaaaaaa

SEQ ID NO: 6045971 - DNA, 15 bp, Homo sapiens
catgttttgcatgta

SEQ ID NO: 6045972 - DNA, 15 bp, Homo sapiens
catgttttgctaatg

SEQ ID NO: 6045973 - DNA, 19 bp, Homo sapiens
catgttttgtatacaaata

SEQ ID NO: 6045974 - DNA, 18 bp, Homo sapiens
catgttttgtcattgttt

SEQ ID NO: 6045975 - DNA, 21 bp, Homo sapiens
catgttttgtgcatttgtaaa

SEQ ID NO: 6045976 - DNA, 15 bp, Homo sapiens
catgttttgttttct

SEQ ID NO: 6045977 - DNA, 20 bp, Homo sapiens
catgtttttcttctccctca

SEQ ID NO: 6045978 - DNA, 14 bp, Homo sapiens
catgtttttgaaaa

SEQ ID NO: 6045979 - DNA, 17 bp, Homo sapiens
catgtttttgttttctt

SEQ ID NO: 6045980 - DNA, 23 bp, Homo sapiens
catgtttttgttttctttgaatg

SEQ ID NO: 6045981 - DNA, 23 bp, Homo sapiens
catgttttttcttcaaatgttta

SEQ ID NO: 6045982 - DNA, 17 bp, Homo sapiens
cattaaaaaaaacagaa

SEQ ID NO: 6045983 - DNA, 21 bp, Homo sapiens
cattaaaaaatcagttgtaca

SEQ ID NO: 6045984 - DNA, 22 bp, Homo sapiens
cattaaaaaatgaaatattttt

SEQ ID NO: 6045985 - DNA, 13 bp, Homo sapiens
cattaaaaacata

SEQ ID NO: 6045986 - DNA, 17 bp, Homo sapiens
cattaaaaacatagaaa

SEQ ID NO: 6045987 - DNA, 14 bp, Homo sapiens
cattaaaaacattt

SEQ ID NO: 6045988 - DNA, 14 bp, Homo sapiens
cattaaaaagcctt

SEQ ID NO: 6045989 - DNA, 13 bp, Homo sapiens
cattaaaacaaga

SEQ ID NO: 6045990 - DNA, 15 bp, Homo sapiens
cattaaaacaagaga

SEQ ID NO: 6045991 - DNA, 19 bp, Homo sapiens
cattaaaacagaagcaaat

SEQ ID NO: 6045992 - DNA, 19 bp, Homo sapiens
cattaaaactgaagtctga

SEQ ID NO: 6045993 - DNA, 21 bp, Homo sapiens
cattaaaactgaagtctgaaa

SEQ ID NO: 6045994 - DNA, 16 bp, Homo sapiens
cattaaaactgctttt

SEQ ID NO: 6045995 - DNA, 17 bp, Homo sapiens
cattaaaagaaaataaa

SEQ ID NO: 6045996 - DNA, 20 bp, Homo sapiens
cattaaaagctttagattga

SEQ ID NO: 6045997 - DNA, 22 bp, Homo sapiens
cattaaaaggaaaaaagaaaaa

SEQ ID NO: 6045998 - DNA, 21 bp, Homo sapiens
cattaaaagttttatgtactt

SEQ ID NO: 6045999 - DNA, 11 bp, Homo sapiens
cattaaaataa

SEQ ID NO: 6046000 - DNA, 13 bp, Homo sapiens
cattaaaataaaa

SEQ ID NO: 6046001 - DNA, 14 bp, Homo sapiens
cattaaaataaaac

SEQ ID NO: 6046002 - DNA, 20 bp, Homo sapiens
cattaaaataaaacaagcct

SEQ ID NO: 6046003 - DNA, 13 bp, Homo sapiens
cattaaaataaac

SEQ ID NO: 6046004 - DNA, 14 bp, Homo sapiens
cattaaaataaacc

SEQ ID NO: 6046005 - DNA, 15 bp, Homo sapiens
cattaaaataactat

SEQ ID NO: 6046006 - DNA, 22 bp, Homo sapiens
cattaaaataactatcaggcag

SEQ ID NO: 6046007 - DNA, 20 bp, Homo sapiens
cattaaaatagcacatgatt

SEQ ID NO: 6046008 - DNA, 19 bp, Homo sapiens
cattaaaatatagagacag

SEQ ID NO: 6046009 - DNA, 18 bp, Homo sapiens
cattaaaatatgcactaa

SEQ ID NO: 6046010 - DNA, 18 bp, Homo sapiens
cattaaaatgacaaacat

SEQ ID NO: 6046011 - DNA, 22 bp, Homo sapiens
cattaaaatgacaaacatgata

SEQ ID NO: 6046012 - DNA, 16 bp, Homo sapiens
cattaaacaaataaaa

SEQ ID NO: 6046013 - DNA, 12 bp, Homo sapiens
cattaaacatga

SEQ ID NO: 6046014 - DNA, 14 bp, Homo sapiens
cattaaacatgaat

SEQ ID NO: 6046015 - DNA, 19 bp, Homo sapiens
cattaaacatgaatttaat

SEQ ID NO: 6046016 - DNA, 23 bp, Homo sapiens
cattaaaccatctccctggtgct

SEQ ID NO: 6046017 - DNA, 13 bp, Homo sapiens
cattaaacctgga

SEQ ID NO: 6046018 - DNA, 12 bp, Homo sapiens
cattaaacctgt

SEQ ID NO: 6046019 - DNA, 22 bp, Homo sapiens
cattaaacctgtctccactgtg

SEQ ID NO: 6046020 - DNA, 13 bp, Homo sapiens
cattaaactaatt

SEQ ID NO: 6046021 - DNA, 21 bp, Homo sapiens
cattaaagcaatctgttgaaa

SEQ ID NO: 6046022 - DNA, 12 bp, Homo sapiens
cattaaagccat

SEQ ID NO: 6046023 - DNA, 19 bp, Homo sapiens
cattaaagccctgtgttaa

SEQ ID NO: 6046024 - DNA, 21 bp, Homo sapiens
cattaaagccctgtgttaagt

SEQ ID NO: 6046025 - DNA, 22 bp, Homo sapiens
cattaaagccctgtgttaagtg

SEQ ID NO: 6046026 - DNA, 19 bp, Homo sapiens
cattaaaggaaacgtggca

SEQ ID NO: 6046027 - DNA, 22 bp, Homo sapiens
cattaaaggaaacgtggcagga

SEQ ID NO: 6046028 - DNA, 17 bp, Homo sapiens
cattaaagtctgaatca

SEQ ID NO: 6046029 - DNA, 12 bp, Homo sapiens
cattaaagttct

SEQ ID NO: 6046030 - DNA, 18 bp, Homo sapiens
cattaaataccagccagc

SEQ ID NO: 6046031 - DNA, 15 bp, Homo sapiens
cattaaatataaaat

SEQ ID NO: 6046032 - DNA, 18 bp, Homo sapiens
cattaaatataaaataca

SEQ ID NO: 6046033 - DNA, 17 bp, Homo sapiens
cattaaatcaatcagga

SEQ ID NO: 6046034 - DNA, 13 bp, Homo sapiens
cattaaatccgca

SEQ ID NO: 6046035 - DNA, 11 bp, Homo sapiens
cattaaatgaa

SEQ ID NO: 6046036 - DNA, 22 bp, Homo sapiens
cattaaatgaatattttgataa

SEQ ID NO: 6046037 - DNA, 18 bp, Homo sapiens
cattaaatgcaataattt

SEQ ID NO: 6046038 - DNA, 13 bp, Homo sapiens
cattaaatgtttg

SEQ ID NO: 6046039 - DNA, 14 bp, Homo sapiens
cattaaattacaga

SEQ ID NO: 6046040 - DNA, 13 bp, Homo sapiens
cattaaattacct

SEQ ID NO: 6046041 - DNA, 17 bp, Homo sapiens
cattaaattagctattt

SEQ ID NO: 6046042 - DNA, 17 bp, Homo sapiens
cattaaattcacaaact

SEQ ID NO: 6046043 - DNA, 18 bp, Homo sapiens
cattaaattcacaaactt

SEQ ID NO: 6046044 - DNA, 13 bp, Homo sapiens
cattaaattttct

SEQ ID NO: 6046045 - DNA, 13 bp, Homo sapiens
cattaacaaataa

SEQ ID NO: 6046046 - DNA, 16 bp, Homo sapiens
cattaacaaataaaaa

SEQ ID NO: 6046047 - DNA, 17 bp, Homo sapiens
cattaacaataaagcat

SEQ ID NO: 6046048 - DNA, 13 bp, Homo sapiens
cattaacacaaag

SEQ ID NO: 6046049 - DNA, 12 bp, Homo sapiens
cattaacacatt

SEQ ID NO: 6046050 - DNA, 15 bp, Homo sapiens
cattaacacattgtt

SEQ ID NO: 6046051 - DNA, 23 bp, Homo sapiens
cattaacacattgttatttctgt

SEQ ID NO: 6046052 - DNA, 15 bp, Homo sapiens
cattaacacttttta

SEQ ID NO: 6046053 - DNA, 17 bp, Homo sapiens
cattaacaggtctttga

SEQ ID NO: 6046054 - DNA, 13 bp, Homo sapiens
cattaacagtttt

SEQ ID NO: 6046055 - DNA, 17 bp, Homo sapiens
cattaacagttttccat

SEQ ID NO: 6046056 - DNA, 20 bp, Homo sapiens
cattaacagttttccatgaa

SEQ ID NO: 6046057 - DNA, 21 bp, Homo sapiens
cattaacagttttccatgaaa

SEQ ID NO: 6046058 - DNA, 16 bp, Homo sapiens
cattaaccgatgcttt

SEQ ID NO: 6046059 - DNA, 17 bp, Homo sapiens
cattaaccgatgcttta

SEQ ID NO: 6046060 - DNA, 18 bp, Homo sapiens
cattaaccgatgctttac

SEQ ID NO: 6046061 - DNA, 16 bp, Homo sapiens
cattaacggtgctaaa

SEQ ID NO: 6046062 - DNA, 17 bp, Homo sapiens
cattaacggtgctaaaa

SEQ ID NO: 6046063 - DNA, 15 bp, Homo sapiens
cattaactaaatgct

SEQ ID NO: 6046064 - DNA, 17 bp, Homo sapiens
cattaactaaatgctca

SEQ ID NO: 6046065 - DNA, 20 bp, Homo sapiens
cattaactatttttttcaaa

SEQ ID NO: 6046066 - DNA, 15 bp, Homo sapiens
cattaactcaggcat

SEQ ID NO: 6046067 - DNA, 15 bp, Homo sapiens
cattaactcattaga

SEQ ID NO: 6046068 - DNA, 18 bp, Homo sapiens
cattaactcattagactg

SEQ ID NO: 6046069 - DNA, 17 bp, Homo sapiens
ccagtcagcctggctgg

SEQ ID NO: 6046070 - DNA, 14 bp, Homo sapiens
ccagtcaggctctc

SEQ ID NO: 6046071 - DNA, 17 bp, Homo sapiens
ccagtcaggctgcagag

SEQ ID NO: 6046072 - DNA, 13 bp, Homo sapiens
ccagtcagggaca

SEQ ID NO: 6046073 - DNA, 20 bp, Homo sapiens
ccagtcagggacagcagcct

SEQ ID NO: 6046074 - DNA, 17 bp, Homo sapiens
ccagtcataccaacttt

SEQ ID NO: 6046075 - DNA, 21 bp, Homo sapiens
ccagtcatcagctattcagtt

SEQ ID NO: 6046076 - DNA, 16 bp, Homo sapiens
ccagtcatcatctctt

SEQ ID NO: 6046077 - DNA, 22 bp, Homo sapiens
ccagtcatcatctcttgataaa

SEQ ID NO: 6046078 - DNA, 18 bp, Homo sapiens
ccagtcatcctgccctgc

SEQ ID NO: 6046079 - DNA, 21 bp, Homo sapiens
ccagtcatctgtaagagcttg

SEQ ID NO: 6046080 - DNA, 19 bp, Homo sapiens
ccagtcatggaatcttgct

SEQ ID NO: 6046081 - DNA, 17 bp, Homo sapiens
ccagtcatggctgtccc

SEQ ID NO: 6046082 - DNA, 19 bp, Homo sapiens
ccagtcatggtactacccc

SEQ ID NO: 6046083 - DNA, 16 bp, Homo sapiens
ccagtcatggtggcac

SEQ ID NO: 6046084 - DNA, 17 bp, Homo sapiens
ccagtcattttattttg

SEQ ID NO: 6046085 - DNA, 21 bp, Homo sapiens
ccagtccaaatgtcctccaga

SEQ ID NO: 6046086 - DNA, 17 bp, Homo sapiens
ccagtccaccctgcctg

SEQ ID NO: 6046087 - DNA, 13 bp, Homo sapiens
ccagtccaggctg

SEQ ID NO: 6046088 - DNA, 19 bp, Homo sapiens
ccagtccaggctgccgtgg

SEQ ID NO: 6046089 - DNA, 18 bp, Homo sapiens
ccagtccatgctccaggg

SEQ ID NO: 6046090 - DNA, 14 bp, Homo sapiens
ccagtccatttcca

SEQ ID NO: 6046091 - DNA, 14 bp, Homo sapiens
ccagtcccacactg

SEQ ID NO: 6046092 - DNA, 19 bp, Homo sapiens
ccagtcccacactgtggcc

SEQ ID NO: 6046093 - DNA, 22 bp, Homo sapiens
ccagtcccacactgtggccagg

SEQ ID NO: 6046094 - DNA, 16 bp, Homo sapiens
ccagtcccaccctgct

SEQ ID NO: 6046095 - DNA, 17 bp, Homo sapiens
ccagtcccaccctgctg

SEQ ID NO: 6046096 - DNA, 21 bp, Homo sapiens
ccagtcccaccctgctgctgc

SEQ ID NO: 6046097 - DNA, 14 bp, Homo sapiens
ccagtcccacggct

SEQ ID NO: 6046098 - DNA, 17 bp, Homo sapiens
ccagtcccacggctctg

SEQ ID NO: 6046099 - DNA, 23 bp, Homo sapiens
ccagtcccacggctctgtgcccg

SEQ ID NO: 6046100 - DNA, 22 bp, Homo sapiens
ccagtcccagaaccacactgtt

SEQ ID NO: 6046101 - DNA, 13 bp, Homo sapiens
ccagtcccagagc

SEQ ID NO: 6046102 - DNA, 18 bp, Homo sapiens
ccagtcccagcagccagc

SEQ ID NO: 6046103 - DNA, 20 bp, Homo sapiens
ccagtcccagcagccagcca

SEQ ID NO: 6046104 - DNA, 14 bp, Homo sapiens
ccagtcccaggggc

SEQ ID NO: 6046105 - DNA, 15 bp, Homo sapiens
ccagtccccacccct

SEQ ID NO: 6046106 - DNA, 16 bp, Homo sapiens
ccagtccccacccctg

SEQ ID NO: 6046107 - DNA, 17 bp, Homo sapiens
ccagtccccacccctgc

SEQ ID NO: 6046108 - DNA, 22 bp, Homo sapiens
ccagtccccacccctgccccca

SEQ ID NO: 6046109 - DNA, 16 bp, Homo sapiens
ccagtccccagaactc

SEQ ID NO: 6046110 - DNA, 21 bp, Homo sapiens
ccagtccccagaactctgcct

SEQ ID NO: 6046111 - DNA, 14 bp, Homo sapiens
ccagtccccagccc

SEQ ID NO: 6046112 - DNA, 17 bp, Homo sapiens
ccagtccccagccctgg

SEQ ID NO: 6046113 - DNA, 18 bp, Homo sapiens
ccagtccccagccctggg

SEQ ID NO: 6046114 - DNA, 19 bp, Homo sapiens
ccagtccccagccctgggc

SEQ ID NO: 6046115 - DNA, 21 bp, Homo sapiens
ccagtccccatttctgcctcg

SEQ ID NO: 6046116 - DNA, 15 bp, Homo sapiens
ccagtccccccaccc

SEQ ID NO: 6046117 - DNA, 14 bp, Homo sapiens
ccagtccccgctag

SEQ ID NO: 6046118 - DNA, 15 bp, Homo sapiens
ccagtccccgtgccc

SEQ ID NO: 6046119 - DNA, 14 bp, Homo sapiens
ccagtcccctttct

SEQ ID NO: 6046120 - DNA, 15 bp, Homo sapiens
ccagtcccctttctc

SEQ ID NO: 6046121 - DNA, 15 bp, Homo sapiens
ccagtccctgggagc

SEQ ID NO: 6046122 - DNA, 23 bp, Homo sapiens
ccagtccctgggagcaagttgca

SEQ ID NO: 6046123 - DNA, 13 bp, Homo sapiens
ccagtccctgtcc

SEQ ID NO: 6046124 - DNA, 20 bp, Homo sapiens
ccagtccgccaaacactcca

SEQ ID NO: 6046125 - DNA, 22 bp, Homo sapiens
ccagtccgccccgtgctcctct

SEQ ID NO: 6046126 - DNA, 19 bp, Homo sapiens
ccagtccggtgccttccac

SEQ ID NO: 6046127 - DNA, 15 bp, Homo sapiens
ccagtcctaacaaat

SEQ ID NO: 6046128 - DNA, 15 bp, Homo sapiens
ccagtcctagagctc

SEQ ID NO: 6046129 - DNA, 19 bp, Homo sapiens
ccagtcctagagctcctgt

SEQ ID NO: 6046130 - DNA, 20 bp, Homo sapiens
ccagtcctagagctcctgtc

SEQ ID NO: 6046131 - DNA, 22 bp, Homo sapiens
ccagtcctagagctcctgtccc

SEQ ID NO: 6046132 - DNA, 24 bp, Homo sapiens
ccagtcctagagctcctgtcccta

SEQ ID NO: 6046133 - DNA, 18 bp, Homo sapiens
ccagtcctagctgcacag

SEQ ID NO: 6046134 - DNA, 18 bp, Homo sapiens
ccagtcctcacatgcccg

SEQ ID NO: 6046135 - DNA, 19 bp, Homo sapiens
ccagtcctcacatgcccgc

SEQ ID NO: 6046136 - DNA, 21 bp, Homo sapiens
ccagtcctcacatgcccgctg

SEQ ID NO: 6046137 - DNA, 13 bp, Homo sapiens
ccagtcctccact

SEQ ID NO: 6046138 - DNA, 21 bp, Homo sapiens
ccagtcctcctcaggagaagg

SEQ ID NO: 6046139 - DNA, 16 bp, Homo sapiens
ccagtcctcctgggag

SEQ ID NO: 6046140 - DNA, 14 bp, Homo sapiens
ccagtcctctgcct

SEQ ID NO: 6046141 - DNA, 12 bp, Homo sapiens
ccagtcctgcaa

SEQ ID NO: 6046142 - DNA, 15 bp, Homo sapiens
ccagtcctgccacca

SEQ ID NO: 6046143 - DNA, 14 bp, Homo sapiens
ccagtcctgcctga

SEQ ID NO: 6046144 - DNA, 18 bp, Homo sapiens
ccagtcctgcctggccag

SEQ ID NO: 6046145 - DNA, 21 bp, Homo sapiens
ccagtcctgcctggccaggca

SEQ ID NO: 6046146 - DNA, 21 bp, Homo sapiens
ccagtcctgctacctcccttg

SEQ ID NO: 6046147 - DNA, 12 bp, Homo sapiens
ccagtcctgctc

SEQ ID NO: 6046148 - DNA, 14 bp, Homo sapiens
ccagtcctgctctc

SEQ ID NO: 6046149 - DNA, 13 bp, Homo sapiens
ccagtcctgctgc

SEQ ID NO: 6046150 - DNA, 23 bp, Homo sapiens
ccagtcctgctgcctggagtcag

SEQ ID NO: 6046151 - DNA, 18 bp, Homo sapiens
ccagtcctgctggcctgc

SEQ ID NO: 6046152 - DNA, 19 bp, Homo sapiens
ccagtcctgctggcctgct

SEQ ID NO: 6046153 - DNA, 20 bp, Homo sapiens
ccagtcctgctggcctgctc

SEQ ID NO: 6046154 - DNA, 12 bp, Homo sapiens
ccagtcctggcc

SEQ ID NO: 6046155 - DNA, 15 bp, Homo sapiens
ccagtcctggcctgg

SEQ ID NO: 6046156 - DNA, 14 bp, Homo sapiens
ccagtcctggtcct

SEQ ID NO: 6046157 - DNA, 19 bp, Homo sapiens
ccagtcctggtcctggctg

SEQ ID NO: 6046158 - DNA, 20 bp, Homo sapiens
ccagtcctggtcctggctgc

SEQ ID NO: 6046159 - DNA, 14 bp, Homo sapiens
ccagtcctggttca

SEQ ID NO: 6046160 - DNA, 19 bp, Homo sapiens
ccagtcctggttgtctgaa

SEQ ID NO: 6046161 - DNA, 23 bp, Homo sapiens
ccagtccttaatgtcaccatgct

SEQ ID NO: 6046162 - DNA, 17 bp, Homo sapiens
ccagtccttccacctcg

SEQ ID NO: 6046163 - DNA, 19 bp, Homo sapiens
ccagtcctttgttgctgtt

SEQ ID NO: 6046164 - DNA, 20 bp, Homo sapiens
ccagtcctttgttgctgttg

SEQ ID NO: 6046165 - DNA, 21 bp, Homo sapiens
ccagtcctttgttgctgttgc

SEQ ID NO: 6046166 - DNA, 23 bp, Homo sapiens
ccagtcctttgttgctgttgctg

SEQ ID NO: 6046167 - DNA, 19 bp, Homo sapiens
ccagtcgaccccaaaggaa

SEQ ID NO: 6046168 - DNA, 16 bp, Homo sapiens
ccagtcgagccctgca

SEQ ID NO: 6046169 - DNA, 18 bp, Homo sapiens
ccagtcgccctctgtgcc

SEQ ID NO: 6046170 - DNA, 16 bp, Homo sapiens
ccagtcgcgctgcctg

SEQ ID NO: 6046171 - DNA, 18 bp, Homo sapiens
ccagtcggccccatctct

SEQ ID NO: 6046172 - DNA, 14 bp, Homo sapiens
ccagtcgggaggag

SEQ ID NO: 6046173 - DNA, 20 bp, Homo sapiens
ccagtcgtcatcagatgctt

SEQ ID NO: 6046174 - DNA, 18 bp, Homo sapiens
ccagtcgttagaatatag

SEQ ID NO: 6046175 - DNA, 19 bp, Homo sapiens
ccagtcgttatttctgttt

SEQ ID NO: 6046176 - DNA, 16 bp, Homo sapiens
ccagtctacccagaga

SEQ ID NO: 6046177 - DNA, 24 bp, Homo sapiens
ccagtctagtccgtcctggcacag

SEQ ID NO: 6046178 - DNA, 14 bp, Homo sapiens
ccagtctcacccac

SEQ ID NO: 6046179 - DNA, 20 bp, Homo sapiens
ccagtctcagagaccagcac

SEQ ID NO: 6046180 - DNA, 21 bp, Homo sapiens
ccagtctcagagaccagcact

SEQ ID NO: 6046181 - DNA, 18 bp, Homo sapiens
ccagtctccaccaggaac

SEQ ID NO: 6046182 - DNA, 20 bp, Homo sapiens
ccagtctccaccaggaacct

SEQ ID NO: 6046183 - DNA, 23 bp, Homo sapiens
ccagtctccaccaggaacctctt

SEQ ID NO: 6046184 - DNA, 14 bp, Homo sapiens
ccagtctccaggga

SEQ ID NO: 6046185 - DNA, 12 bp, Homo sapiens
ccagtctcccag

SEQ ID NO: 6046186 - DNA, 21 bp, Homo sapiens
ccagtctcccaggccccctgc

SEQ ID NO: 6046187 - DNA, 12 bp, Homo sapiens
ccagtctcccca

SEQ ID NO: 6046188 - DNA, 18 bp, Homo sapiens
ccagtctcctatacccag

SEQ ID NO: 6046189 - DNA, 12 bp, Homo sapiens
ccagtctcctca

SEQ ID NO: 6046190 - DNA, 13 bp, Homo sapiens
ccagtctcctccc

SEQ ID NO: 6046191 - DNA, 15 bp, Homo sapiens
ccagtctcctctcca

SEQ ID NO: 6046192 - DNA, 16 bp, Homo sapiens
ccagtctctcttaaag

SEQ ID NO: 6046193 - DNA, 14 bp, Homo sapiens
ccagtctctgtcgt

SEQ ID NO: 6046194 - DNA, 14 bp, Homo sapiens
ccagtctgaagttt

SEQ ID NO: 6046195 - DNA, 20 bp, Homo sapiens
ccagtctgaagtttcattta

SEQ ID NO: 6046196 - DNA, 12 bp, Homo sapiens
ccagtctgaccc

SEQ ID NO: 6046197 - DNA, 20 bp, Homo sapiens
ccagtctgctctcagcttgt

SEQ ID NO: 6046198 - DNA, 21 bp, Homo sapiens
ccagtctgctctcagcttgtg

SEQ ID NO: 6046199 - DNA, 20 bp, Homo sapiens
ccagtctggaagaagaggag

SEQ ID NO: 6046200 - DNA, 18 bp, Homo sapiens
ccagtctggaatgcagtg

SEQ ID NO: 6046201 - DNA, 19 bp, Homo sapiens
ccagtctggaatgcagtgg

SEQ ID NO: 6046202 - DNA, 20 bp, Homo sapiens
ccagtctggaatgcagtggt

SEQ ID NO: 6046203 - DNA, 16 bp, Homo sapiens
ccagtctgggctgccg

SEQ ID NO: 6046204 - DNA, 18 bp, Homo sapiens
ccagtctgggctgccggg

SEQ ID NO: 6046205 - DNA, 17 bp, Homo sapiens
ccagtctgtctactgtg

SEQ ID NO: 6046206 - DNA, 18 bp, Homo sapiens
ccagtctgtctactgtgg

SEQ ID NO: 6046207 - DNA, 18 bp, Homo sapiens
ccagtctgtgtttacaga

SEQ ID NO: 6046208 - DNA, 14 bp, Homo sapiens
ccagtctgttctca

SEQ ID NO: 6046209 - DNA, 19 bp, Homo sapiens
ccagtcttatttttctagt

SEQ ID NO: 6046210 - DNA, 17 bp, Homo sapiens
ccagtcttccagaaagc

SEQ ID NO: 6046211 - DNA, 22 bp, Homo sapiens
ccagtcttcctcttagcctctg

SEQ ID NO: 6046212 - DNA, 17 bp, Homo sapiens
ccagtcttcctgacact

SEQ ID NO: 6046213 - DNA, 18 bp, Homo sapiens
ccagtcttccttgtctct

SEQ ID NO: 6046214 - DNA, 17 bp, Homo sapiens
ccagtcttctccctgtc

SEQ ID NO: 6046215 - DNA, 13 bp, Homo sapiens
ccagtcttgccta

SEQ ID NO: 6046216 - DNA, 18 bp, Homo sapiens
ccagtctttaaaggccca

SEQ ID NO: 6046217 - DNA, 21 bp, Homo sapiens
ccagtctttaaaggcccagcc

SEQ ID NO: 6046218 - DNA, 21 bp, Homo sapiens
ccagtctttcttcactctggc

SEQ ID NO: 6046219 - DNA, 22 bp, Homo sapiens
ccagtctttcttcactctggct

SEQ ID NO: 6046220 - DNA, 16 bp, Homo sapiens
ccagtcttttgaaaga

SEQ ID NO: 6046221 - DNA, 15 bp, Homo sapiens
ccagtcttttgtcct

SEQ ID NO: 6046222 - DNA, 14 bp, Homo sapiens
ccagtctttttaaa

SEQ ID NO: 6046223 - DNA, 17 bp, Homo sapiens
ccagtgaaatgtgaagg

SEQ ID NO: 6046224 - DNA, 16 bp, Homo sapiens
ccagtgaaccaaagag

SEQ ID NO: 6046225 - DNA, 15 bp, Homo sapiens
ccagtgaactcctgc

SEQ ID NO: 6046226 - DNA, 18 bp, Homo sapiens
ccagtgaactcctgccag

SEQ ID NO: 6046227 - DNA, 20 bp, Homo sapiens
ccagtgaacttacacttgga

SEQ ID NO: 6046228 - DNA, 22 bp, Homo sapiens
ccagtgaacttacacttggagc

SEQ ID NO: 6046229 - DNA, 23 bp, Homo sapiens
ccagtgaacttacacttggagcc

SEQ ID NO: 6046230 - DNA, 22 bp, Homo sapiens
ccagtgaagagccactgccatt

SEQ ID NO: 6046231 - DNA, 15 bp, Homo sapiens
ccagtgaagatattt

SEQ ID NO: 6046232 - DNA, 19 bp, Homo sapiens
ccagtgaagggttttgtgt

SEQ ID NO: 6046233 - DNA, 17 bp, Homo sapiens
ccagtgaagtccttcag

SEQ ID NO: 6046234 - DNA, 16 bp, Homo sapiens
ccagtgaattcttgaa

SEQ ID NO: 6046235 - DNA, 18 bp, Homo sapiens
ccagtgaatttttgcaat

SEQ ID NO: 6046236 - DNA, 19 bp, Homo sapiens
ccagtgaatttttgcaata

SEQ ID NO: 6046237 - DNA, 16 bp, Homo sapiens
ccagtgacacttcaga

SEQ ID NO: 6046238 - DNA, 19 bp, Homo sapiens
ccagtgacacttcagagag

SEQ ID NO: 6046239 - DNA, 23 bp, Homo sapiens
ccagtgacacttcagagagctgg

SEQ ID NO: 6046240 - DNA, 24 bp, Homo sapiens
ccagtgacacttcagagagctggt

SEQ ID NO: 6046241 - DNA, 17 bp, Homo sapiens
ccagtgacagacaggct

SEQ ID NO: 6046242 - DNA, 19 bp, Homo sapiens
ccagtgacagacaggctct

SEQ ID NO: 6046243 - DNA, 12 bp, Homo sapiens
ccagtgacagct

SEQ ID NO: 6046244 - DNA, 16 bp, Homo sapiens
ccagtgaccaaccttt

SEQ ID NO: 6046245 - DNA, 13 bp, Homo sapiens
ccagtgaccctgg

SEQ ID NO: 6046246 - DNA, 18 bp, Homo sapiens
ccagtgaccctggagcta

SEQ ID NO: 6046247 - DNA, 13 bp, Homo sapiens
cattaactccctc

SEQ ID NO: 6046248 - DNA, 15 bp, Homo sapiens
cattaactccctcca

SEQ ID NO: 6046249 - DNA, 19 bp, Homo sapiens
cattaactccctccaccag

SEQ ID NO: 6046250 - DNA, 20 bp, Homo sapiens
cattaactccctccaccagc

SEQ ID NO: 6046251 - DNA, 11 bp, Homo sapiens
cattaactgtt

SEQ ID NO: 6046252 - DNA, 23 bp, Homo sapiens
cattaactgttgcacttttgaat

SEQ ID NO: 6046253 - DNA, 18 bp, Homo sapiens
cattaagaaaaacaataa

SEQ ID NO: 6046254 - DNA, 13 bp, Homo sapiens
cattaagaaaatc

SEQ ID NO: 6046255 - DNA, 17 bp, Homo sapiens
cattaagaaaatcatat

SEQ ID NO: 6046256 - DNA, 20 bp, Homo sapiens
cattaagaagagcagagctg

SEQ ID NO: 6046257 - DNA, 22 bp, Homo sapiens
cattaagaatgttggtttactt

SEQ ID NO: 6046258 - DNA, 14 bp, Homo sapiens
cattaagagtgaat

SEQ ID NO: 6046259 - DNA, 24 bp, Homo sapiens
cattaagcacacacatctggccct

SEQ ID NO: 6046260 - DNA, 13 bp, Homo sapiens
cattaagcatcac

SEQ ID NO: 6046261 - DNA, 21 bp, Homo sapiens
cattaagcgggatcccagcat

SEQ ID NO: 6046262 - DNA, 14 bp, Homo sapiens
cattaagctttttt

SEQ ID NO: 6046263 - DNA, 18 bp, Homo sapiens
cattaagggcctgctgga

SEQ ID NO: 6046264 - DNA, 18 bp, Homo sapiens
cattaaggggaagaatga

SEQ ID NO: 6046265 - DNA, 21 bp, Homo sapiens
cattaaggggaagaatgaaag

SEQ ID NO: 6046266 - DNA, 23 bp, Homo sapiens
cattaagtattccttggcccagc

SEQ ID NO: 6046267 - DNA, 16 bp, Homo sapiens
cattaagtcagtggct

SEQ ID NO: 6046268 - DNA, 12 bp, Homo sapiens
cattaataaaac

SEQ ID NO: 6046269 - DNA, 14 bp, Homo sapiens
cattaataaaactg

SEQ ID NO: 6046270 - DNA, 15 bp, Homo sapiens
cattaataaaactgt

SEQ ID NO: 6046271 - DNA, 17 bp, Homo sapiens
cattaataaaactgtgc

SEQ ID NO: 6046272 - DNA, 22 bp, Homo sapiens
cattaataatagctaataataa

SEQ ID NO: 6046273 - DNA, 23 bp, Homo sapiens
cattaataatagctaataataaa

SEQ ID NO: 6046274 - DNA, 21 bp, Homo sapiens
cattaataatccttccaggcc

SEQ ID NO: 6046275 - DNA, 12 bp, Homo sapiens
cattaatactgt

SEQ ID NO: 6046276 - DNA, 15 bp, Homo sapiens
cattaatactgtgtt

SEQ ID NO: 6046277 - DNA, 21 bp, Homo sapiens
cattaatacttccttataaaa

SEQ ID NO: 6046278 - DNA, 15 bp, Homo sapiens
cattaatagcagcct

SEQ ID NO: 6046279 - DNA, 23 bp, Homo sapiens
cattaataggaaagatttaatgt

SEQ ID NO: 6046280 - DNA, 18 bp, Homo sapiens
cattaatatttaccaaag

SEQ ID NO: 6046281 - DNA, 22 bp, Homo sapiens
cattaatcaatcatctgtgtga

SEQ ID NO: 6046282 - DNA, 23 bp, Homo sapiens
cattaatcaatcatctgtgtgaa

SEQ ID NO: 6046283 - DNA, 20 bp, Homo sapiens
cattaatcagttcattagaa

SEQ ID NO: 6046284 - DNA, 16 bp, Homo sapiens
cattaatcatttcccc

SEQ ID NO: 6046285 - DNA, 17 bp, Homo sapiens
cattaatccacatgttt

SEQ ID NO: 6046286 - DNA, 19 bp, Homo sapiens
cattaatccacatgtttca

SEQ ID NO: 6046287 - DNA, 16 bp, Homo sapiens
cattaatgaaatacca

SEQ ID NO: 6046288 - DNA, 12 bp, Homo sapiens
cattaatgagaa

SEQ ID NO: 6046289 - DNA, 19 bp, Homo sapiens
cattaatgatgatcttcag

SEQ ID NO: 6046290 - DNA, 17 bp, Homo sapiens
cattaatgcctgctttt

SEQ ID NO: 6046291 - DNA, 21 bp, Homo sapiens
cattaatgtagataaagcact

SEQ ID NO: 6046292 - DNA, 13 bp, Homo sapiens
cattaatgttaat

SEQ ID NO: 6046293 - DNA, 21 bp, Homo sapiens
cattaatgttaattcagcact

SEQ ID NO: 6046294 - DNA, 23 bp, Homo sapiens
cattaatgttaattcagcactga

SEQ ID NO: 6046295 - DNA, 22 bp, Homo sapiens
cattaatgttgaaaaagaaaac

SEQ ID NO: 6046296 - DNA, 13 bp, Homo sapiens
cattaatgttgat

SEQ ID NO: 6046297 - DNA, 14 bp, Homo sapiens
cattaatgttgatt

SEQ ID NO: 6046298 - DNA, 20 bp, Homo sapiens
cattaattacatacagattt

SEQ ID NO: 6046299 - DNA, 18 bp, Homo sapiens
cattaattatatgtatat

SEQ ID NO: 6046300 - DNA, 13 bp, Homo sapiens
cattaattattaa

SEQ ID NO: 6046301 - DNA, 16 bp, Homo sapiens
cattaattattaatac

SEQ ID NO: 6046302 - DNA, 16 bp, Homo sapiens
cattaattcaatgaaa

SEQ ID NO: 6046303 - DNA, 15 bp, Homo sapiens
cattaattcaattaa

SEQ ID NO: 6046304 - DNA, 16 bp, Homo sapiens
cattaattcaattaaa

SEQ ID NO: 6046305 - DNA, 17 bp, Homo sapiens
cattaattcaattaaaa

SEQ ID NO: 6046306 - DNA, 21 bp, Homo sapiens
cattaattcaattaaaaccat

SEQ ID NO: 6046307 - DNA, 21 bp, Homo sapiens
cattaattcaggcatatttta

SEQ ID NO: 6046308 - DNA, 18 bp, Homo sapiens
cattaattctactaaata

SEQ ID NO: 6046309 - DNA, 20 bp, Homo sapiens
cattaattctactaaatatt

SEQ ID NO: 6046310 - DNA, 19 bp, Homo sapiens
cattaattgctaacaattg

SEQ ID NO: 6046311 - DNA, 12 bp, Homo sapiens
cattaatttaaa

SEQ ID NO: 6046312 - DNA, 14 bp, Homo sapiens
cattaatttaaatg

SEQ ID NO: 6046313 - DNA, 12 bp, Homo sapiens
cattaatttaat

SEQ ID NO: 6046314 - DNA, 21 bp, Homo sapiens
cattaatttatgcagagacag

SEQ ID NO: 6046315 - DNA, 13 bp, Homo sapiens
cattaatttcaat

SEQ ID NO: 6046316 - DNA, 23 bp, Homo sapiens
cattaatttcaatcaaccaaagt

SEQ ID NO: 6046317 - DNA, 16 bp, Homo sapiens
cattaattttatgaac

SEQ ID NO: 6046318 - DNA, 14 bp, Homo sapiens
cattaattttgtgc

SEQ ID NO: 6046319 - DNA, 17 bp, Homo sapiens
cattaattttgtgcatt

SEQ ID NO: 6046320 - DNA, 18 bp, Homo sapiens
cattaattttgtgcattc

SEQ ID NO: 6046321 - DNA, 19 bp, Homo sapiens
cattaattttgtgcattct

SEQ ID NO: 6046322 - DNA, 17 bp, Homo sapiens
cattaatttttaattga

SEQ ID NO: 6046323 - DNA, 19 bp, Homo sapiens
cattaatttttaattgaaa

SEQ ID NO: 6046324 - DNA, 23 bp, Homo sapiens
cattaatttttaattgaaactag

SEQ ID NO: 6046325 - DNA, 17 bp, Homo sapiens
cattacaaaatccaact

SEQ ID NO: 6046326 - DNA, 19 bp, Homo sapiens
cattacaaaatccaactct

SEQ ID NO: 6046327 - DNA, 22 bp, Homo sapiens
cattacaactgaccaagtttct

SEQ ID NO: 6046328 - DNA, 20 bp, Homo sapiens
cattacaatacagtatttct

SEQ ID NO: 6046329 - DNA, 13 bp, Homo sapiens
cattacaatggaa

SEQ ID NO: 6046330 - DNA, 16 bp, Homo sapiens
cattacaattttctgt

SEQ ID NO: 6046331 - DNA, 18 bp, Homo sapiens
cattacaattttctgtaa

SEQ ID NO: 6046332 - DNA, 19 bp, Homo sapiens
cattacactccagcctggg

SEQ ID NO: 6046333 - DNA, 18 bp, Homo sapiens
cattacagagaggagaaa

SEQ ID NO: 6046334 - DNA, 20 bp, Homo sapiens
cattacagagaggagaaaca

SEQ ID NO: 6046335 - DNA, 22 bp, Homo sapiens
cattacagagaggagaaacaca

SEQ ID NO: 6046336 - DNA, 14 bp, Homo sapiens
cattacagccaggt

SEQ ID NO: 6046337 - DNA, 24 bp, Homo sapiens
cattacagggaatgcctgagtgcc

SEQ ID NO: 6046338 - DNA, 22 bp, Homo sapiens
cattacagggcacaggccatgg

SEQ ID NO: 6046339 - DNA, 18 bp, Homo sapiens
cattacagtgtaaaaatt

SEQ ID NO: 6046340 - DNA, 22 bp, Homo sapiens
cattacagtgtaaaaattcaga

SEQ ID NO: 6046341 - DNA, 15 bp, Homo sapiens
cattacagttcataa

SEQ ID NO: 6046342 - DNA, 16 bp, Homo sapiens
cattacagttctttcc

SEQ ID NO: 6046343 - DNA, 17 bp, Homo sapiens
cattacagttctttcct

SEQ ID NO: 6046344 - DNA, 19 bp, Homo sapiens
cattacagtttggaagtgt

SEQ ID NO: 6046345 - DNA, 15 bp, Homo sapiens
cattacatggctgtg

SEQ ID NO: 6046346 - DNA, 16 bp, Homo sapiens
cattacatgtaaatta

SEQ ID NO: 6046347 - DNA, 11 bp, Homo sapiens
cattacatgtt

SEQ ID NO: 6046348 - DNA, 20 bp, Homo sapiens
cattacatgtttaaattgta

SEQ ID NO: 6046349 - DNA, 22 bp, Homo sapiens
cattacatgtttaaattgtaaa

SEQ ID NO: 6046350 - DNA, 18 bp, Homo sapiens
cattacatttctgaattg

SEQ ID NO: 6046351 - DNA, 13 bp, Homo sapiens
cattaccactcag

SEQ ID NO: 6046352 - DNA, 18 bp, Homo sapiens
cattaccagacggttcac

SEQ ID NO: 6046353 - DNA, 14 bp, Homo sapiens
cattacccaaaagc

SEQ ID NO: 6046354 - DNA, 19 bp, Homo sapiens
cattacccacccgacctgg

SEQ ID NO: 6046355 - DNA, 15 bp, Homo sapiens
cattaccctacagac

SEQ ID NO: 6046356 - DNA, 16 bp, Homo sapiens
cattacctccatccat

SEQ ID NO: 6046357 - DNA, 17 bp, Homo sapiens
cattacctccatccatc

SEQ ID NO: 6046358 - DNA, 15 bp, Homo sapiens
cattacctctttgga

SEQ ID NO: 6046359 - DNA, 12 bp, Homo sapiens
cattacctgtac

SEQ ID NO: 6046360 - DNA, 15 bp, Homo sapiens
cattaccttaaaatt

SEQ ID NO: 6046361 - DNA, 17 bp, Homo sapiens
cattaccttactgtgga

SEQ ID NO: 6046362 - DNA, 15 bp, Homo sapiens
cattacggctcctct

SEQ ID NO: 6046363 - DNA, 16 bp, Homo sapiens
cattacggctcctctc

SEQ ID NO: 6046364 - DNA, 16 bp, Homo sapiens
cattacgtgagccagg

SEQ ID NO: 6046365 - DNA, 17 bp, Homo sapiens
cattacgtgagccaggt

SEQ ID NO: 6046366 - DNA, 15 bp, Homo sapiens
cattacgtgcattta

SEQ ID NO: 6046367 - DNA, 17 bp, Homo sapiens
cattacgtgcatttaaa

SEQ ID NO: 6046368 - DNA, 18 bp, Homo sapiens
cattacgtgcatttaaac

SEQ ID NO: 6046369 - DNA, 19 bp, Homo sapiens
cattactcaaaatgcagga

SEQ ID NO: 6046370 - DNA, 21 bp, Homo sapiens
cattactcaaaatgcaggaca

SEQ ID NO: 6046371 - DNA, 14 bp, Homo sapiens
cattactccttcag

SEQ ID NO: 6046372 - DNA, 14 bp, Homo sapiens
cattactcttgtaa

SEQ ID NO: 6046373 - DNA, 19 bp, Homo sapiens
cattactcttgtaagattt

SEQ ID NO: 6046374 - DNA, 22 bp, Homo sapiens
cattactgaggggattctctac

SEQ ID NO: 6046375 - DNA, 13 bp, Homo sapiens
cattactgccttc

SEQ ID NO: 6046376 - DNA, 17 bp, Homo sapiens
cattactgcctttggaa

SEQ ID NO: 6046377 - DNA, 20 bp, Homo sapiens
cattactgtatgtataaatt

SEQ ID NO: 6046378 - DNA, 15 bp, Homo sapiens
cattactgtcccctt

SEQ ID NO: 6046379 - DNA, 12 bp, Homo sapiens
cattactgtgat

SEQ ID NO: 6046380 - DNA, 19 bp, Homo sapiens
cattacttactgttaaaac

SEQ ID NO: 6046381 - DNA, 19 bp, Homo sapiens
cattacttctgagccccag

SEQ ID NO: 6046382 - DNA, 14 bp, Homo sapiens
cattacttgcacaa

SEQ ID NO: 6046383 - DNA, 22 bp, Homo sapiens
cattacttgcacaagcttgtat

SEQ ID NO: 6046384 - DNA, 23 bp, Homo sapiens
cattacttgcacaagcttgtata

SEQ ID NO: 6046385 - DNA, 19 bp, Homo sapiens
cattacttgggaaattttt

SEQ ID NO: 6046386 - DNA, 18 bp, Homo sapiens
cattacttgttgcctata

SEQ ID NO: 6046387 - DNA, 18 bp, Homo sapiens
cattagaaaaaaatgaaa

SEQ ID NO: 6046388 - DNA, 18 bp, Homo sapiens
cattagaaaattttgtaa

SEQ ID NO: 6046389 - DNA, 14 bp, Homo sapiens
cattagaaaggcta

SEQ ID NO: 6046390 - DNA, 18 bp, Homo sapiens
cattagaaatattttaaa

SEQ ID NO: 6046391 - DNA, 12 bp, Homo sapiens
cattagaacttc

SEQ ID NO: 6046392 - DNA, 14 bp, Homo sapiens
cattagaagaaaac

SEQ ID NO: 6046393 - DNA, 18 bp, Homo sapiens
cattagaagaaaacatat

SEQ ID NO: 6046394 - DNA, 22 bp, Homo sapiens
cattagaagaaaacatatattt

SEQ ID NO: 6046395 - DNA, 12 bp, Homo sapiens
cattagaatgtg

SEQ ID NO: 6046396 - DNA, 18 bp, Homo sapiens
cattagaattaccatttg

SEQ ID NO: 6046397 - DNA, 19 bp, Homo sapiens
cattagaattatttaaaca

SEQ ID NO: 6046398 - DNA, 15 bp, Homo sapiens
cattagacacacata

SEQ ID NO: 6046399 - DNA, 18 bp, Homo sapiens
cattagaccaagcttgtc

SEQ ID NO: 6046400 - DNA, 20 bp, Homo sapiens
cattagactgaatttaacta

SEQ ID NO: 6046401 - DNA, 16 bp, Homo sapiens
cattagactggaactt

SEQ ID NO: 6046402 - DNA, 13 bp, Homo sapiens
cattagagaaaac

SEQ ID NO: 6046403 - DNA, 20 bp, Homo sapiens
cattagagaaaaccttaaaa

SEQ ID NO: 6046404 - DNA, 23 bp, Homo sapiens
cattagagaaatgaattataact

SEQ ID NO: 6046405 - DNA, 17 bp, Homo sapiens
cattagagaagtattta

SEQ ID NO: 6046406 - DNA, 20 bp, Homo sapiens
cattagagagatttttcatt

SEQ ID NO: 6046407 - DNA, 18 bp, Homo sapiens
cattagagagtggcaata

SEQ ID NO: 6046408 - DNA, 18 bp, Homo sapiens
cattagagcacagcttct

SEQ ID NO: 6046409 - DNA, 11 bp, Homo sapiens
cattagagcag

SEQ ID NO: 6046410 - DNA, 12 bp, Homo sapiens
cattagagctta

SEQ ID NO: 6046411 - DNA, 22 bp, Homo sapiens
cattagagcttaaattgtcaga

SEQ ID NO: 6046412 - DNA, 18 bp, Homo sapiens
cattagataaacacaggc

SEQ ID NO: 6046413 - DNA, 20 bp, Homo sapiens
cattagataaacacaggcag

SEQ ID NO: 6046414 - DNA, 22 bp, Homo sapiens
cattagatattaggggggaaag

SEQ ID NO: 6046415 - DNA, 15 bp, Homo sapiens
cattagatgtcatga

SEQ ID NO: 6046416 - DNA, 23 bp, Homo sapiens
cattagattcctttcctgtgtga

SEQ ID NO: 6046417 - DNA, 19 bp, Homo sapiens
cattagattttattttact

SEQ ID NO: 6046418 - DNA, 17 bp, Homo sapiens
cattagcaacgcctgcc

SEQ ID NO: 6046419 - DNA, 21 bp, Homo sapiens
cattagcaaggcagagccttt

SEQ ID NO: 6046420 - DNA, 19 bp, Homo sapiens
cattagcacatatttcaca

SEQ ID NO: 6046421 - DNA, 14 bp, Homo sapiens
cattagcagttgct

SEQ ID NO: 6046422 - DNA, 15 bp, Homo sapiens
cattagcataatttt

SEQ ID NO: 6046423 - DNA, 16 bp, Homo sapiens
cattagcataattttg

SEQ ID NO: 6046424 - DNA, 12 bp, Homo sapiens
cattagccaagg

SEQ ID NO: 6046425 - DNA, 13 bp, Homo sapiens
ccagtgacctctc

SEQ ID NO: 6046426 - DNA, 19 bp, Homo sapiens
ccagtgacctctctctctg

SEQ ID NO: 6046427 - DNA, 19 bp, Homo sapiens
ccagtgacctgaggaagcg

SEQ ID NO: 6046428 - DNA, 20 bp, Homo sapiens
ccagtgacctggaaggccca

SEQ ID NO: 6046429 - DNA, 15 bp, Homo sapiens
ccagtgactccagga

SEQ ID NO: 6046430 - DNA, 16 bp, Homo sapiens
ccagtgactccaggag

SEQ ID NO: 6046431 - DNA, 14 bp, Homo sapiens
ccagtgactgctgc

SEQ ID NO: 6046432 - DNA, 18 bp, Homo sapiens
ccagtgacttgttctgag

SEQ ID NO: 6046433 - DNA, 12 bp, Homo sapiens
ccagtgactttt

SEQ ID NO: 6046434 - DNA, 17 bp, Homo sapiens
ccagtgactttttctaa

SEQ ID NO: 6046435 - DNA, 18 bp, Homo sapiens
ccagtgagaagctgaggc

SEQ ID NO: 6046436 - DNA, 19 bp, Homo sapiens
ccagtgagagtgaggcccc

SEQ ID NO: 6046437 - DNA, 16 bp, Homo sapiens
ccagtgagcactccca

SEQ ID NO: 6046438 - DNA, 18 bp, Homo sapiens
ccagtgagcactcccaag

SEQ ID NO: 6046439 - DNA, 20 bp, Homo sapiens
ccagtgagcactcccaagtc

SEQ ID NO: 6046440 - DNA, 13 bp, Homo sapiens
ccagtgagcctct

SEQ ID NO: 6046441 - DNA, 16 bp, Homo sapiens
ccagtgagcctctgcg

SEQ ID NO: 6046442 - DNA, 20 bp, Homo sapiens
ccagtgagcctctgcgcctc

SEQ ID NO: 6046443 - DNA, 20 bp, Homo sapiens
ccagtgagcgcttgggcgcc

SEQ ID NO: 6046444 - DNA, 12 bp, Homo sapiens
ccagtgaggaac

SEQ ID NO: 6046445 - DNA, 16 bp, Homo sapiens
ccagtgaggatgacag

SEQ ID NO: 6046446 - DNA, 21 bp, Homo sapiens
ccagtgaggatgctgcagtga

SEQ ID NO: 6046447 - DNA, 14 bp, Homo sapiens
ccagtgaggctctg

SEQ ID NO: 6046448 - DNA, 20 bp, Homo sapiens
ccagtgaggctctgcccttg

SEQ ID NO: 6046449 - DNA, 18 bp, Homo sapiens
ccagtgagggacgtcaga

SEQ ID NO: 6046450 - DNA, 22 bp, Homo sapiens
ccagtgagggacgtcagacttg

SEQ ID NO: 6046451 - DNA, 15 bp, Homo sapiens
ccagtgagtggcccc

SEQ ID NO: 6046452 - DNA, 17 bp, Homo sapiens
ccagtgagtggccccac

SEQ ID NO: 6046453 - DNA, 12 bp, Homo sapiens
ccagtgagtgta

SEQ ID NO: 6046454 - DNA, 13 bp, Homo sapiens
ccagtgagtgtaa

SEQ ID NO: 6046455 - DNA, 20 bp, Homo sapiens
ccagtgatctcgactccccc

SEQ ID NO: 6046456 - DNA, 12 bp, Homo sapiens
ccagtgatgatg

SEQ ID NO: 6046457 - DNA, 15 bp, Homo sapiens
ccagtgatgatgttt

SEQ ID NO: 6046458 - DNA, 20 bp, Homo sapiens
ccagtgatgatgttttgata

SEQ ID NO: 6046459 - DNA, 21 bp, Homo sapiens
ccagtgatgctaaaggttgta

SEQ ID NO: 6046460 - DNA, 15 bp, Homo sapiens
ccagtgatgtgctgg

SEQ ID NO: 6046461 - DNA, 14 bp, Homo sapiens
ccagtgcaacactg

SEQ ID NO: 6046462 - DNA, 18 bp, Homo sapiens
ccagtgcaacagcactgg

SEQ ID NO: 6046463 - DNA, 17 bp, Homo sapiens
ccagtgcaatctgtcca

SEQ ID NO: 6046464 - DNA, 21 bp, Homo sapiens
ccagtgcaatctgtccagaca

SEQ ID NO: 6046465 - DNA, 21 bp, Homo sapiens
ccagtgcacctccctccccag

SEQ ID NO: 6046466 - DNA, 17 bp, Homo sapiens
ccagtgcagaaatgaaa

SEQ ID NO: 6046467 - DNA, 16 bp, Homo sapiens
ccagtgcagaatgtaa

SEQ ID NO: 6046468 - DNA, 15 bp, Homo sapiens
ccagtgcagccactg

SEQ ID NO: 6046469 - DNA, 16 bp, Homo sapiens
ccagtgcagccactgg

SEQ ID NO: 6046470 - DNA, 16 bp, Homo sapiens
ccagtgcaggctggcc

SEQ ID NO: 6046471 - DNA, 19 bp, Homo sapiens
ccagtgcaggctggccagc

SEQ ID NO: 6046472 - DNA, 21 bp, Homo sapiens
ccagtgcaggctggccagccg

SEQ ID NO: 6046473 - DNA, 20 bp, Homo sapiens
ccagtgcagtttctaagcat

SEQ ID NO: 6046474 - DNA, 15 bp, Homo sapiens
ccagtgcatactgta

SEQ ID NO: 6046475 - DNA, 13 bp, Homo sapiens
ccagtgcatcaca

SEQ ID NO: 6046476 - DNA, 17 bp, Homo sapiens
ccagtgcatcacatctg

SEQ ID NO: 6046477 - DNA, 20 bp, Homo sapiens
ccagtgcatgttgccatgag

SEQ ID NO: 6046478 - DNA, 18 bp, Homo sapiens
ccagtgcattttgtttct

SEQ ID NO: 6046479 - DNA, 16 bp, Homo sapiens
ccagtgccaaacttgg

SEQ ID NO: 6046480 - DNA, 12 bp, Homo sapiens
ccagtgccaagg

SEQ ID NO: 6046481 - DNA, 16 bp, Homo sapiens
ccagtgccaaggacct

SEQ ID NO: 6046482 - DNA, 18 bp, Homo sapiens
ccagtgccacagagaaga

SEQ ID NO: 6046483 - DNA, 11 bp, Homo sapiens
ccagtgccacg

SEQ ID NO: 6046484 - DNA, 15 bp, Homo sapiens
ccagtgccacgtcat

SEQ ID NO: 6046485 - DNA, 15 bp, Homo sapiens
ccagtgccagctcca

SEQ ID NO: 6046486 - DNA, 19 bp, Homo sapiens
ccagtgccaggacagctgg

SEQ ID NO: 6046487 - DNA, 21 bp, Homo sapiens
ccagtgccattccactccact

SEQ ID NO: 6046488 - DNA, 24 bp, Homo sapiens
ccagtgccattccactccactcag

SEQ ID NO: 6046489 - DNA, 23 bp, Homo sapiens
ccagtgcccacaggatcagtctg

SEQ ID NO: 6046490 - DNA, 16 bp, Homo sapiens
ccagtgccctgatccc

SEQ ID NO: 6046491 - DNA, 17 bp, Homo sapiens
ccagtgccctgatccca

SEQ ID NO: 6046492 - DNA, 20 bp, Homo sapiens
ccagtgccgagaaggaagcc

SEQ ID NO: 6046493 - DNA, 15 bp, Homo sapiens
ccagtgccgaggaca

SEQ ID NO: 6046494 - DNA, 18 bp, Homo sapiens
ccagtgccgcctgtgccc

SEQ ID NO: 6046495 - DNA, 20 bp, Homo sapiens
ccagtgccgcctgtgcccac

SEQ ID NO: 6046496 - DNA, 16 bp, Homo sapiens
ccagtgccgctcctgc

SEQ ID NO: 6046497 - DNA, 19 bp, Homo sapiens
ccagtgccgctcctgcttc

SEQ ID NO: 6046498 - DNA, 15 bp, Homo sapiens
ccagtgcctcctagc

SEQ ID NO: 6046499 - DNA, 21 bp, Homo sapiens
ccagtgcctctccctgctgct

SEQ ID NO: 6046500 - DNA, 15 bp, Homo sapiens
ccagtgcctgcacat

SEQ ID NO: 6046501 - DNA, 18 bp, Homo sapiens
ccagtgcctgccactctc

SEQ ID NO: 6046502 - DNA, 14 bp, Homo sapiens
ccagtgcctgggtg

SEQ ID NO: 6046503 - DNA, 20 bp, Homo sapiens
ccagtgcctgtctggagctc

SEQ ID NO: 6046504 - DNA, 14 bp, Homo sapiens
ccagtgccttctgg

SEQ ID NO: 6046505 - DNA, 19 bp, Homo sapiens
ccagtgctaagctgccctg

SEQ ID NO: 6046506 - DNA, 13 bp, Homo sapiens
ccagtgctcacac

SEQ ID NO: 6046507 - DNA, 23 bp, Homo sapiens
ccagtgctcacacaatcagacca

SEQ ID NO: 6046508 - DNA, 18 bp, Homo sapiens
ccagtgctcagctgtggc

SEQ ID NO: 6046509 - DNA, 19 bp, Homo sapiens
ccagtgctcagctgtggct

SEQ ID NO: 6046510 - DNA, 21 bp, Homo sapiens
ccagtgctcagctgtggctgg

SEQ ID NO: 6046511 - DNA, 16 bp, Homo sapiens
ccagtgctcctggccc

SEQ ID NO: 6046512 - DNA, 13 bp, Homo sapiens
ccagtgctctgcc

SEQ ID NO: 6046513 - DNA, 15 bp, Homo sapiens
ccagtgctctgcctc

SEQ ID NO: 6046514 - DNA, 12 bp, Homo sapiens
ccagtgctgaat

SEQ ID NO: 6046515 - DNA, 22 bp, Homo sapiens
ccagtgctgaatttccctctct

SEQ ID NO: 6046516 - DNA, 12 bp, Homo sapiens
ccagtgctgcca

SEQ ID NO: 6046517 - DNA, 19 bp, Homo sapiens
ccagtgctgccatgccact

SEQ ID NO: 6046518 - DNA, 20 bp, Homo sapiens
ccagtgctgccatgccactg

SEQ ID NO: 6046519 - DNA, 21 bp, Homo sapiens
ccagtgctgccatgccactgc

SEQ ID NO: 6046520 - DNA, 13 bp, Homo sapiens
ccagtgctgctgt

SEQ ID NO: 6046521 - DNA, 18 bp, Homo sapiens
ccagtgctgctgtaaata

SEQ ID NO: 6046522 - DNA, 13 bp, Homo sapiens
ccagtgctgcttc

SEQ ID NO: 6046523 - DNA, 14 bp, Homo sapiens
ccagtgctgcttct

SEQ ID NO: 6046524 - DNA, 13 bp, Homo sapiens
ccagtgctggaag

SEQ ID NO: 6046525 - DNA, 13 bp, Homo sapiens
ccagtgctggcca

SEQ ID NO: 6046526 - DNA, 13 bp, Homo sapiens
ccagtgctggctg

SEQ ID NO: 6046527 - DNA, 21 bp, Homo sapiens
ccagtgctggctgctggccca

SEQ ID NO: 6046528 - DNA, 14 bp, Homo sapiens
ccagtgctgtctgg

SEQ ID NO: 6046529 - DNA, 19 bp, Homo sapiens
ccagtgcttagcaaaaaat

SEQ ID NO: 6046530 - DNA, 20 bp, Homo sapiens
ccagtgcttggctgccccac

SEQ ID NO: 6046531 - DNA, 21 bp, Homo sapiens
ccagtgcttggctgccccaca

SEQ ID NO: 6046532 - DNA, 17 bp, Homo sapiens
ccagtgctttatgttgt

SEQ ID NO: 6046533 - DNA, 15 bp, Homo sapiens
ccagtggaaaacaaa

SEQ ID NO: 6046534 - DNA, 21 bp, Homo sapiens
ccagtggaaggagaatttaat

SEQ ID NO: 6046535 - DNA, 18 bp, Homo sapiens
ccagtggacagagggaga

SEQ ID NO: 6046536 - DNA, 20 bp, Homo sapiens
ccagtggacagagggagaag

SEQ ID NO: 6046537 - DNA, 23 bp, Homo sapiens
ccagtggacccgcccgcggccct

SEQ ID NO: 6046538 - DNA, 20 bp, Homo sapiens
ccagtggagacggaatctgc

SEQ ID NO: 6046539 - DNA, 18 bp, Homo sapiens
ccagtggatcccctgcgg

SEQ ID NO: 6046540 - DNA, 22 bp, Homo sapiens
ccagtggatcccctgcggtcag

SEQ ID NO: 6046541 - DNA, 19 bp, Homo sapiens
ccagtggatgccacagccc

SEQ ID NO: 6046542 - DNA, 19 bp, Homo sapiens
ccagtggatggattcatca

SEQ ID NO: 6046543 - DNA, 22 bp, Homo sapiens
ccagtggattcttgttttgctt

SEQ ID NO: 6046544 - DNA, 14 bp, Homo sapiens
ccagtggcacagga

SEQ ID NO: 6046545 - DNA, 15 bp, Homo sapiens
ccagtggcacaggag

SEQ ID NO: 6046546 - DNA, 14 bp, Homo sapiens
ccagtggcagggca

SEQ ID NO: 6046547 - DNA, 20 bp, Homo sapiens
ccagtggcagggcacagggc

SEQ ID NO: 6046548 - DNA, 23 bp, Homo sapiens
ccagtggcagggcacagggcctg

SEQ ID NO: 6046549 - DNA, 17 bp, Homo sapiens
ccagtggccactcagct

SEQ ID NO: 6046550 - DNA, 21 bp, Homo sapiens
ccagtggccactcagcttcct

SEQ ID NO: 6046551 - DNA, 13 bp, Homo sapiens
ccagtggcccccg

SEQ ID NO: 6046552 - DNA, 19 bp, Homo sapiens
ccagtggcccccgggcctg

SEQ ID NO: 6046553 - DNA, 19 bp, Homo sapiens
ccagtggccgaacccccca

SEQ ID NO: 6046554 - DNA, 22 bp, Homo sapiens
ccagtggccgaaccccccactc

SEQ ID NO: 6046555 - DNA, 16 bp, Homo sapiens
ccagtggcctcaaccc

SEQ ID NO: 6046556 - DNA, 24 bp, Homo sapiens
ccagtggcctcaaccctccctcag

SEQ ID NO: 6046557 - DNA, 14 bp, Homo sapiens
ccagtggcctggct

SEQ ID NO: 6046558 - DNA, 15 bp, Homo sapiens
ccagtggcctggctt

SEQ ID NO: 6046559 - DNA, 19 bp, Homo sapiens
ccagtggccttacccctgc

SEQ ID NO: 6046560 - DNA, 22 bp, Homo sapiens
ccagtggccttacccctgcctt

SEQ ID NO: 6046561 - DNA, 12 bp, Homo sapiens
ccagtggccttt

SEQ ID NO: 6046562 - DNA, 20 bp, Homo sapiens
ccagtggcgttgttgcatgt

SEQ ID NO: 6046563 - DNA, 13 bp, Homo sapiens
ccagtggctgctg

SEQ ID NO: 6046564 - DNA, 17 bp, Homo sapiens
ccagtggctgctgccca

SEQ ID NO: 6046565 - DNA, 21 bp, Homo sapiens
ccagtggctgctgcccaggcc

SEQ ID NO: 6046566 - DNA, 20 bp, Homo sapiens
ccagtggctggaagaaccac

SEQ ID NO: 6046567 - DNA, 15 bp, Homo sapiens
ccagtggctggtctc

SEQ ID NO: 6046568 - DNA, 17 bp, Homo sapiens
ccagtggctgttctgga

SEQ ID NO: 6046569 - DNA, 16 bp, Homo sapiens
ccagtggcttctccca

SEQ ID NO: 6046570 - DNA, 18 bp, Homo sapiens
ccagtgggaactgtgcaa

SEQ ID NO: 6046571 - DNA, 13 bp, Homo sapiens
ccagtgggaagat

SEQ ID NO: 6046572 - DNA, 14 bp, Homo sapiens
ccagtgggaccaca

SEQ ID NO: 6046573 - DNA, 20 bp, Homo sapiens
ccagtgggaggacagagccg

SEQ ID NO: 6046574 - DNA, 12 bp, Homo sapiens
ccagtgggaggg

SEQ ID NO: 6046575 - DNA, 15 bp, Homo sapiens
ccagtgggaggggca

SEQ ID NO: 6046576 - DNA, 17 bp, Homo sapiens
ccagtgggaggggcagg

SEQ ID NO: 6046577 - DNA, 22 bp, Homo sapiens
ccagtgggaggggcaggctgac

SEQ ID NO: 6046578 - DNA, 23 bp, Homo sapiens
ccagtgggaggtgagaccacctc

SEQ ID NO: 6046579 - DNA, 18 bp, Homo sapiens
ccagtgggatgggctcta

SEQ ID NO: 6046580 - DNA, 21 bp, Homo sapiens
ccagtgggatgggctctacct

SEQ ID NO: 6046581 - DNA, 22 bp, Homo sapiens
ccagtgggatgggctctacctc

SEQ ID NO: 6046582 - DNA, 14 bp, Homo sapiens
ccagtgggcagggg

SEQ ID NO: 6046583 - DNA, 14 bp, Homo sapiens
ccagtgggcctggt

SEQ ID NO: 6046584 - DNA, 18 bp, Homo sapiens
ccagtgggcgggccatga

SEQ ID NO: 6046585 - DNA, 10 bp, Homo sapiens
ccagtgggct

SEQ ID NO: 6046586 - DNA, 15 bp, Homo sapiens
ccagtgggctgcacg

SEQ ID NO: 6046587 - DNA, 16 bp, Homo sapiens
ccagtgggctgtgttg

SEQ ID NO: 6046588 - DNA, 13 bp, Homo sapiens
ccagtggggacag

SEQ ID NO: 6046589 - DNA, 14 bp, Homo sapiens
ccagtggggacagg

SEQ ID NO: 6046590 - DNA, 15 bp, Homo sapiens
ccagtggggacaggg

SEQ ID NO: 6046591 - DNA, 18 bp, Homo sapiens
ccagtggggacagggagg

SEQ ID NO: 6046592 - DNA, 21 bp, Homo sapiens
ccagtggggacagggaggggg

SEQ ID NO: 6046593 - DNA, 13 bp, Homo sapiens
ccagtggggcctg

SEQ ID NO: 6046594 - DNA, 14 bp, Homo sapiens
ccagtggggcctgt

SEQ ID NO: 6046595 - DNA, 13 bp, Homo sapiens
ccagtggggtccc

SEQ ID NO: 6046596 - DNA, 14 bp, Homo sapiens
ccagtggggtcccc

SEQ ID NO: 6046597 - DNA, 23 bp, Homo sapiens
ccagtggggtcccccctgagtgg

SEQ ID NO: 6046598 - DNA, 21 bp, Homo sapiens
ccagtgggtgatgcttttgct

SEQ ID NO: 6046599 - DNA, 19 bp, Homo sapiens
ccagtggtcagcaggtgtc

SEQ ID NO: 6046600 - DNA, 17 bp, Homo sapiens
ccagtggtcatgctcag

SEQ ID NO: 6046601 - DNA, 14 bp, Homo sapiens
ccagtggtgccttg

SEQ ID NO: 6046602 - DNA, 22 bp, Homo sapiens
ccagtggtgcgggccaggtctg

SEQ ID NO: 6046603 - DNA, 23 bp, Homo sapiens
ccagtggtgcgggccaggtctgg

SEQ ID NO: 6046604 - DNA, 18 bp, Homo sapiens
cattagccagatttgtct

SEQ ID NO: 6046605 - DNA, 9 bp, Homo sapiens
cattagcct

SEQ ID NO: 6046606 - DNA, 14 bp, Homo sapiens
cattagcctgagta

SEQ ID NO: 6046607 - DNA, 18 bp, Homo sapiens
cattagcttgtctattat

SEQ ID NO: 6046608 - DNA, 23 bp, Homo sapiens
cattaggaacagagtatatatgt

SEQ ID NO: 6046609 - DNA, 21 bp, Homo sapiens
cattaggcaaagtacaaaatt

SEQ ID NO: 6046610 - DNA, 12 bp, Homo sapiens
cattaggcccca

SEQ ID NO: 6046611 - DNA, 20 bp, Homo sapiens
cattaggccccagcaacacg

SEQ ID NO: 6046612 - DNA, 20 bp, Homo sapiens
cattaggctgtggtgcagta

SEQ ID NO: 6046613 - DNA, 20 bp, Homo sapiens
cattaggggaaccattgttg

SEQ ID NO: 6046614 - DNA, 18 bp, Homo sapiens
cattaggggattcttctt

SEQ ID NO: 6046615 - DNA, 21 bp, Homo sapiens
cattagggtgggcgtgctgcg

SEQ ID NO: 6046616 - DNA, 22 bp, Homo sapiens
cattaggtagatgagaaaacag

SEQ ID NO: 6046617 - DNA, 22 bp, Homo sapiens
cattaggtccctcactccacag

SEQ ID NO: 6046618 - DNA, 22 bp, Homo sapiens
cattagtaaatgtctttgtaag

SEQ ID NO: 6046619 - DNA, 15 bp, Homo sapiens
cattagtactttata

SEQ ID NO: 6046620 - DNA, 11 bp, Homo sapiens
cattagtatcc

SEQ ID NO: 6046621 - DNA, 23 bp, Homo sapiens
cattagtattcctcattctgcat

SEQ ID NO: 6046622 - DNA, 22 bp, Homo sapiens
cattagtcatgtttatctgctt

SEQ ID NO: 6046623 - DNA, 15 bp, Homo sapiens
cattagtcctttgtc

SEQ ID NO: 6046624 - DNA, 22 bp, Homo sapiens
cattagtctcagtgaagactat

SEQ ID NO: 6046625 - DNA, 13 bp, Homo sapiens
cattagtgggaaa

SEQ ID NO: 6046626 - DNA, 20 bp, Homo sapiens
cattagtgtccccccttgaa

SEQ ID NO: 6046627 - DNA, 23 bp, Homo sapiens
cattagtgtgttgtctctttcct

SEQ ID NO: 6046628 - DNA, 18 bp, Homo sapiens
cattagtgttctttatat

SEQ ID NO: 6046629 - DNA, 19 bp, Homo sapiens
cattagtgttctttatata

SEQ ID NO: 6046630 - DNA, 22 bp, Homo sapiens
cattagttactttattgaaggt

SEQ ID NO: 6046631 - DNA, 14 bp, Homo sapiens
cattagttgcacta

SEQ ID NO: 6046632 - DNA, 20 bp, Homo sapiens
cattagttgcactaactgct

SEQ ID NO: 6046633 - DNA, 16 bp, Homo sapiens
cattagtttcaggcaa

SEQ ID NO: 6046634 - DNA, 16 bp, Homo sapiens
cattagttttagaggc

SEQ ID NO: 6046635 - DNA, 16 bp, Homo sapiens
cattagttttgaagat

SEQ ID NO: 6046636 - DNA, 13 bp, Homo sapiens
cattataaaaaga

SEQ ID NO: 6046637 - DNA, 18 bp, Homo sapiens
cattataaaatctttcca

SEQ ID NO: 6046638 - DNA, 17 bp, Homo sapiens
cattataaaccttcaga

SEQ ID NO: 6046639 - DNA, 14 bp, Homo sapiens
cattataataaaat

SEQ ID NO: 6046640 - DNA, 16 bp, Homo sapiens
cattataataaaattt

SEQ ID NO: 6046641 - DNA, 17 bp, Homo sapiens
cattataataaaatttc

SEQ ID NO: 6046642 - DNA, 18 bp, Homo sapiens
cattataatcaccagggc

SEQ ID NO: 6046643 - DNA, 14 bp, Homo sapiens
cattataatctcaa

SEQ ID NO: 6046644 - DNA, 14 bp, Homo sapiens
cattataatgaatt

SEQ ID NO: 6046645 - DNA, 22 bp, Homo sapiens
cattataattttgaccataaat

SEQ ID NO: 6046646 - DNA, 14 bp, Homo sapiens
cattataccgcaga

SEQ ID NO: 6046647 - DNA, 22 bp, Homo sapiens
cattataccgcagagtatttga

SEQ ID NO: 6046648 - DNA, 23 bp, Homo sapiens
cattataccgcagagtatttgaa

SEQ ID NO: 6046649 - DNA, 14 bp, Homo sapiens
cattatactttata

SEQ ID NO: 6046650 - DNA, 16 bp, Homo sapiens
cattatactttatatc

SEQ ID NO: 6046651 - DNA, 13 bp, Homo sapiens
cattatagcatgt

SEQ ID NO: 6046652 - DNA, 22 bp, Homo sapiens
cattatagcatgtaatattaaa

SEQ ID NO: 6046653 - DNA, 13 bp, Homo sapiens
cattatagcgcct

SEQ ID NO: 6046654 - DNA, 14 bp, Homo sapiens
cattatagcgcctg

SEQ ID NO: 6046655 - DNA, 17 bp, Homo sapiens
cattatagcgcctgtat

SEQ ID NO: 6046656 - DNA, 22 bp, Homo sapiens
cattatagcgcctgtataagta

SEQ ID NO: 6046657 - DNA, 14 bp, Homo sapiens
cattatagtaaatc

SEQ ID NO: 6046658 - DNA, 16 bp, Homo sapiens
cattatataacaaaaa

SEQ ID NO: 6046659 - DNA, 17 bp, Homo sapiens
cattatataacaaaaaa

SEQ ID NO: 6046660 - DNA, 20 bp, Homo sapiens
cattatatagcagtaaaaaa

SEQ ID NO: 6046661 - DNA, 15 bp, Homo sapiens
cattatattctaatt

SEQ ID NO: 6046662 - DNA, 18 bp, Homo sapiens
cattatattctaattaaa

SEQ ID NO: 6046663 - DNA, 19 bp, Homo sapiens
cattatattctaattaaaa

SEQ ID NO: 6046664 - DNA, 13 bp, Homo sapiens
cattatatttatt

SEQ ID NO: 6046665 - DNA, 19 bp, Homo sapiens
cattatatttattactgta

SEQ ID NO: 6046666 - DNA, 18 bp, Homo sapiens
cattatatttgagtttct

SEQ ID NO: 6046667 - DNA, 15 bp, Homo sapiens
cattatatttgcatt

SEQ ID NO: 6046668 - DNA, 19 bp, Homo sapiens
cattatcactttaaagccc

SEQ ID NO: 6046669 - DNA, 16 bp, Homo sapiens
cattatcatgtgtaat

SEQ ID NO: 6046670 - DNA, 17 bp, Homo sapiens
cattatccattcccaag

SEQ ID NO: 6046671 - DNA, 14 bp, Homo sapiens
cattatccctgaat

SEQ ID NO: 6046672 - DNA, 13 bp, Homo sapiens
cattatcctaggg

SEQ ID NO: 6046673 - DNA, 15 bp, Homo sapiens
cattatccttttatc

SEQ ID NO: 6046674 - DNA, 21 bp, Homo sapiens
cattatcgagcagcattttat

SEQ ID NO: 6046675 - DNA, 23 bp, Homo sapiens
cattatcgggagcagtgtcttcc

SEQ ID NO: 6046676 - DNA, 18 bp, Homo sapiens
cattatctagatactgta

SEQ ID NO: 6046677 - DNA, 12 bp, Homo sapiens
cattatctcaaa

SEQ ID NO: 6046678 - DNA, 13 bp, Homo sapiens
cattatctcaaaa

SEQ ID NO: 6046679 - DNA, 20 bp, Homo sapiens
cattatctgtactgaaagca

SEQ ID NO: 6046680 - DNA, 14 bp, Homo sapiens
cattatcttatcat

SEQ ID NO: 6046681 - DNA, 14 bp, Homo sapiens
cattatcttatgaa

SEQ ID NO: 6046682 - DNA, 15 bp, Homo sapiens
cattatcttcatatg

SEQ ID NO: 6046683 - DNA, 15 bp, Homo sapiens
cattatcttcatgtt

SEQ ID NO: 6046684 - DNA, 12 bp, Homo sapiens
cattatgaaaaa

SEQ ID NO: 6046685 - DNA, 21 bp, Homo sapiens
cattatgaagatgtttttaga

SEQ ID NO: 6046686 - DNA, 22 bp, Homo sapiens
cattatgacatttcttaaaact

SEQ ID NO: 6046687 - DNA, 20 bp, Homo sapiens
cattatgactgttgttctta

SEQ ID NO: 6046688 - DNA, 22 bp, Homo sapiens
cattatgagaggcaatgattgt

SEQ ID NO: 6046689 - DNA, 14 bp, Homo sapiens
cattatgagtaaaa

SEQ ID NO: 6046690 - DNA, 20 bp, Homo sapiens
cattatgatcaaaaactgcc

SEQ ID NO: 6046691 - DNA, 19 bp, Homo sapiens
cattatgatcccttccccc

SEQ ID NO: 6046692 - DNA, 14 bp, Homo sapiens
cattatgatttcat

SEQ ID NO: 6046693 - DNA, 18 bp, Homo sapiens
cattatgcaaatggagat

SEQ ID NO: 6046694 - DNA, 21 bp, Homo sapiens
cattatgcaaatggagataaa

SEQ ID NO: 6046695 - DNA, 16 bp, Homo sapiens
cattatgccacttcct

SEQ ID NO: 6046696 - DNA, 21 bp, Homo sapiens
cattatgcccttgagtctaga

SEQ ID NO: 6046697 - DNA, 14 bp, Homo sapiens
cattatgcctggct

SEQ ID NO: 6046698 - DNA, 15 bp, Homo sapiens
cattatgctttgaac

SEQ ID NO: 6046699 - DNA, 18 bp, Homo sapiens
cattatggataaagatga

SEQ ID NO: 6046700 - DNA, 20 bp, Homo sapiens
cattatggctttgtgcttgt

SEQ ID NO: 6046701 - DNA, 15 bp, Homo sapiens
cattatgtagaaata

SEQ ID NO: 6046702 - DNA, 15 bp, Homo sapiens
cattatgtatcttag

SEQ ID NO: 6046703 - DNA, 17 bp, Homo sapiens
cattatgtccactgtgt

SEQ ID NO: 6046704 - DNA, 20 bp, Homo sapiens
cattatgtccactgtgtata

SEQ ID NO: 6046705 - DNA, 17 bp, Homo sapiens
cattatgtgagtttcct

SEQ ID NO: 6046706 - DNA, 21 bp, Homo sapiens
cattatgtggttttagatttt

SEQ ID NO: 6046707 - DNA, 16 bp, Homo sapiens
cattatgttagagagg

SEQ ID NO: 6046708 - DNA, 21 bp, Homo sapiens
cattatgttattggaattttc

SEQ ID NO: 6046709 - DNA, 22 bp, Homo sapiens
cattatgttattggaattttct

SEQ ID NO: 6046710 - DNA, 16 bp, Homo sapiens
cattatgttttattta

SEQ ID NO: 6046711 - DNA, 14 bp, Homo sapiens
cattattaaagttt

SEQ ID NO: 6046712 - DNA, 13 bp, Homo sapiens
cattattaaattg

SEQ ID NO: 6046713 - DNA, 21 bp, Homo sapiens
cattattaagtaacttattta

SEQ ID NO: 6046714 - DNA, 20 bp, Homo sapiens
cattattaatcattccattt

SEQ ID NO: 6046715 - DNA, 19 bp, Homo sapiens
cattattagtactgctctt

SEQ ID NO: 6046716 - DNA, 18 bp, Homo sapiens
cattattagtttgttatg

SEQ ID NO: 6046717 - DNA, 15 bp, Homo sapiens
cattattatcattga

SEQ ID NO: 6046718 - DNA, 19 bp, Homo sapiens
cattattatcattgaaagt

SEQ ID NO: 6046719 - DNA, 12 bp, Homo sapiens
cattattatgca

SEQ ID NO: 6046720 - DNA, 15 bp, Homo sapiens
cattattatttctgt

SEQ ID NO: 6046721 - DNA, 17 bp, Homo sapiens
cattattatttctgttc

SEQ ID NO: 6046722 - DNA, 15 bp, Homo sapiens
cattattcaaagttg

SEQ ID NO: 6046723 - DNA, 18 bp, Homo sapiens
cattattcaaagttgcct

SEQ ID NO: 6046724 - DNA, 13 bp, Homo sapiens
cattattcattta

SEQ ID NO: 6046725 - DNA, 14 bp, Homo sapiens
cattattcatttag

SEQ ID NO: 6046726 - DNA, 14 bp, Homo sapiens
cattattcctcaga

SEQ ID NO: 6046727 - DNA, 13 bp, Homo sapiens
cattattcctggt

SEQ ID NO: 6046728 - DNA, 22 bp, Homo sapiens
cattattcgtagatattggaca

SEQ ID NO: 6046729 - DNA, 13 bp, Homo sapiens
cattattctatgt

SEQ ID NO: 6046730 - DNA, 15 bp, Homo sapiens
cattattctatgtag

SEQ ID NO: 6046731 - DNA, 22 bp, Homo sapiens
cattattctctgctatatataa

SEQ ID NO: 6046732 - DNA, 12 bp, Homo sapiens
cattattgccaa

SEQ ID NO: 6046733 - DNA, 14 bp, Homo sapiens
cattattgcttatt

SEQ ID NO: 6046734 - DNA, 12 bp, Homo sapiens
cattattggaat

SEQ ID NO: 6046735 - DNA, 17 bp, Homo sapiens
cattattggaattaacc

SEQ ID NO: 6046736 - DNA, 19 bp, Homo sapiens
cattattggacttccattt

SEQ ID NO: 6046737 - DNA, 14 bp, Homo sapiens
cattattgtagttt

SEQ ID NO: 6046738 - DNA, 22 bp, Homo sapiens
cattatttagcaccgtttgtga

SEQ ID NO: 6046739 - DNA, 23 bp, Homo sapiens
cattatttatatggggaatatat

SEQ ID NO: 6046740 - DNA, 15 bp, Homo sapiens
cattatttatgtatt

SEQ ID NO: 6046741 - DNA, 16 bp, Homo sapiens
cattatttatgtattg

SEQ ID NO: 6046742 - DNA, 13 bp, Homo sapiens
cattatttattgt

SEQ ID NO: 6046743 - DNA, 17 bp, Homo sapiens
cattatttattgttaaa

SEQ ID NO: 6046744 - DNA, 18 bp, Homo sapiens
cattatttattgttaaat

SEQ ID NO: 6046745 - DNA, 21 bp, Homo sapiens
cattatttattgttaaattac

SEQ ID NO: 6046746 - DNA, 12 bp, Homo sapiens
cattatttcaaa

SEQ ID NO: 6046747 - DNA, 17 bp, Homo sapiens
cattatttcaaaatgat

SEQ ID NO: 6046748 - DNA, 13 bp, Homo sapiens
cattatttctagt

SEQ ID NO: 6046749 - DNA, 14 bp, Homo sapiens
cattatttctgtat

SEQ ID NO: 6046750 - DNA, 16 bp, Homo sapiens
cattatttctgtatat

SEQ ID NO: 6046751 - DNA, 18 bp, Homo sapiens
cattatttctgtatatag

SEQ ID NO: 6046752 - DNA, 19 bp, Homo sapiens
cattatttcttcccagaat

SEQ ID NO: 6046753 - DNA, 21 bp, Homo sapiens
cattatttgaaaacactgctg

SEQ ID NO: 6046754 - DNA, 12 bp, Homo sapiens
cattatttgaga

SEQ ID NO: 6046755 - DNA, 14 bp, Homo sapiens
cattatttgagaag

SEQ ID NO: 6046756 - DNA, 14 bp, Homo sapiens
cattatttgagttt

SEQ ID NO: 6046757 - DNA, 17 bp, Homo sapiens
cattatttgataacatt

SEQ ID NO: 6046758 - DNA, 13 bp, Homo sapiens
cattatttgcatg

SEQ ID NO: 6046759 - DNA, 13 bp, Homo sapiens
cattatttggaaa

SEQ ID NO: 6046760 - DNA, 14 bp, Homo sapiens
cattatttgtcaaa

SEQ ID NO: 6046761 - DNA, 17 bp, Homo sapiens
cattattttctgtcaga

SEQ ID NO: 6046762 - DNA, 14 bp, Homo sapiens
cattattttgtatg

SEQ ID NO: 6046763 - DNA, 17 bp, Homo sapiens
cattattttgtcataaa

SEQ ID NO: 6046764 - DNA, 18 bp, Homo sapiens
cattattttgtcataaaa

SEQ ID NO: 6046765 - DNA, 19 bp, Homo sapiens
cattattttgtcataaaat

SEQ ID NO: 6046766 - DNA, 20 bp, Homo sapiens
cattattttgtcataaaatg

SEQ ID NO: 6046767 - DNA, 13 bp, Homo sapiens
cattattttgtgg

SEQ ID NO: 6046768 - DNA, 14 bp, Homo sapiens
cattattttgtggt

SEQ ID NO: 6046769 - DNA, 22 bp, Homo sapiens
cattattttgtggttctatttt

SEQ ID NO: 6046770 - DNA, 13 bp, Homo sapiens
cattatttttaga

SEQ ID NO: 6046771 - DNA, 21 bp, Homo sapiens
cattatttttgttagcaaaga

SEQ ID NO: 6046772 - DNA, 17 bp, Homo sapiens
cattattttttatttct

SEQ ID NO: 6046773 - DNA, 19 bp, Homo sapiens
cattattttttatttctga

SEQ ID NO: 6046774 - DNA, 22 bp, Homo sapiens
cattattttttatttctgattt

SEQ ID NO: 6046775 - DNA, 22 bp, Homo sapiens
cattcaaaaagacagcagacaa

SEQ ID NO: 6046776 - DNA, 23 bp, Homo sapiens
cattcaaaaagacagcagacaaa

SEQ ID NO: 6046777 - DNA, 19 bp, Homo sapiens
cattcaaaaagccaaaata

SEQ ID NO: 6046778 - DNA, 20 bp, Homo sapiens
cattcaaaacgtgatgtttt

SEQ ID NO: 6046779 - DNA, 16 bp, Homo sapiens
cattcaaaagcacaaa

SEQ ID NO: 6046780 - DNA, 17 bp, Homo sapiens
cattcaaaagcacaaac

SEQ ID NO: 6046781 - DNA, 22 bp, Homo sapiens
cattcaaaagcacaaaccctgg

SEQ ID NO: 6046782 - DNA, 17 bp, Homo sapiens
cattcaaaagttgaaat

SEQ ID NO: 6046783 - DNA, 23 bp, Homo sapiens
cattcaaaatagggtatattttc

SEQ ID NO: 6046784 - DNA, 18 bp, Homo sapiens
ccagtggtggaggtgggt

SEQ ID NO: 6046785 - DNA, 15 bp, Homo sapiens
ccagtggtgggtaat

SEQ ID NO: 6046786 - DNA, 17 bp, Homo sapiens
ccagtggtgggtaattg

SEQ ID NO: 6046787 - DNA, 22 bp, Homo sapiens
ccagtggttcctaatcctctag

SEQ ID NO: 6046788 - DNA, 19 bp, Homo sapiens
ccagtggtttccagtcatg

SEQ ID NO: 6046789 - DNA, 19 bp, Homo sapiens
ccagtgtaaagaataaatg

SEQ ID NO: 6046790 - DNA, 20 bp, Homo sapiens
ccagtgtaactggctgctcc

SEQ ID NO: 6046791 - DNA, 16 bp, Homo sapiens
ccagtgtaaggcatag

SEQ ID NO: 6046792 - DNA, 17 bp, Homo sapiens
ccagtgtaaggcatagg

SEQ ID NO: 6046793 - DNA, 20 bp, Homo sapiens
ccagtgtaatcccccaggag

SEQ ID NO: 6046794 - DNA, 17 bp, Homo sapiens
ccagtgtacaggtcacc

SEQ ID NO: 6046795 - DNA, 21 bp, Homo sapiens
ccagtgtactaggtcaatcag

SEQ ID NO: 6046796 - DNA, 14 bp, Homo sapiens
ccagtgtactgctt

SEQ ID NO: 6046797 - DNA, 16 bp, Homo sapiens
ccagtgtactgctttc

SEQ ID NO: 6046798 - DNA, 21 bp, Homo sapiens
ccagtgtactgctttcaactt

SEQ ID NO: 6046799 - DNA, 24 bp, Homo sapiens
ccagtgtagcatcttcctctgcag

SEQ ID NO: 6046800 - DNA, 18 bp, Homo sapiens
ccagtgtatcaggtcagg

SEQ ID NO: 6046801 - DNA, 19 bp, Homo sapiens
ccagtgtattttctgtgtt

SEQ ID NO: 6046802 - DNA, 17 bp, Homo sapiens
ccagtgtattttgtcca

SEQ ID NO: 6046803 - DNA, 21 bp, Homo sapiens
ccagtgtcacctctctcagag

SEQ ID NO: 6046804 - DNA, 23 bp, Homo sapiens
ccagtgtcacctctctcagagca

SEQ ID NO: 6046805 - DNA, 15 bp, Homo sapiens
ccagtgtccatgttg

SEQ ID NO: 6046806 - DNA, 18 bp, Homo sapiens
ccagtgtccccaggggca

SEQ ID NO: 6046807 - DNA, 12 bp, Homo sapiens
ccagtgtcctcc

SEQ ID NO: 6046808 - DNA, 19 bp, Homo sapiens
ccagtgtcctccaagtgcc

SEQ ID NO: 6046809 - DNA, 22 bp, Homo sapiens
ccagtgtcctgagccccaggga

SEQ ID NO: 6046810 - DNA, 16 bp, Homo sapiens
ccagtgtccttagaac

SEQ ID NO: 6046811 - DNA, 21 bp, Homo sapiens
ccagtgtcgtgtctgctgttg

SEQ ID NO: 6046812 - DNA, 23 bp, Homo sapiens
ccagtgtcgtgtctgctgttgtg

SEQ ID NO: 6046813 - DNA, 21 bp, Homo sapiens
ccagtgtctataaaagaaaca

SEQ ID NO: 6046814 - DNA, 13 bp, Homo sapiens
ccagtgtctggcc

SEQ ID NO: 6046815 - DNA, 14 bp, Homo sapiens
ccagtgtctggccc

SEQ ID NO: 6046816 - DNA, 22 bp, Homo sapiens
ccagtgtctgggtttttcttgt

SEQ ID NO: 6046817 - DNA, 13 bp, Homo sapiens
ccagtgtcttcct

SEQ ID NO: 6046818 - DNA, 16 bp, Homo sapiens
ccagtgtcttcctgtg

SEQ ID NO: 6046819 - DNA, 12 bp, Homo sapiens
ccagtgtctttc

SEQ ID NO: 6046820 - DNA, 11 bp, Homo sapiens
ccagtgtgaac

SEQ ID NO: 6046821 - DNA, 15 bp, Homo sapiens
ccagtgtgaaccccc

SEQ ID NO: 6046822 - DNA, 14 bp, Homo sapiens
ccagtgtgacaagg

SEQ ID NO: 6046823 - DNA, 18 bp, Homo sapiens
ccagtgtgagaccccaaa

SEQ ID NO: 6046824 - DNA, 22 bp, Homo sapiens
ccagtgtgagatactgtgtata

SEQ ID NO: 6046825 - DNA, 18 bp, Homo sapiens
ccagtgtggactctggac

SEQ ID NO: 6046826 - DNA, 21 bp, Homo sapiens
ccagtgtggactctggactgg

SEQ ID NO: 6046827 - DNA, 23 bp, Homo sapiens
ccagtgtggactctggactggga

SEQ ID NO: 6046828 - DNA, 20 bp, Homo sapiens
ccagtgtggccccagcccga

SEQ ID NO: 6046829 - DNA, 14 bp, Homo sapiens
ccagtgtggctccc

SEQ ID NO: 6046830 - DNA, 13 bp, Homo sapiens
ccagtgtgggctt

SEQ ID NO: 6046831 - DNA, 16 bp, Homo sapiens
ccagtgtgtgctcagc

SEQ ID NO: 6046832 - DNA, 18 bp, Homo sapiens
ccagtgtgtgctcagcag

SEQ ID NO: 6046833 - DNA, 19 bp, Homo sapiens
ccagtgtgtgctcagcagc

SEQ ID NO: 6046834 - DNA, 22 bp, Homo sapiens
ccagtgtgtgctcagcagcccc

SEQ ID NO: 6046835 - DNA, 16 bp, Homo sapiens
ccagtgtgtggctttc

SEQ ID NO: 6046836 - DNA, 22 bp, Homo sapiens
ccagtgtgtggctttcagagcc

SEQ ID NO: 6046837 - DNA, 16 bp, Homo sapiens
ccagtgttaataaatg

SEQ ID NO: 6046838 - DNA, 23 bp, Homo sapiens
ccagtgttacaatcagtgtgaat

SEQ ID NO: 6046839 - DNA, 18 bp, Homo sapiens
ccagtgttagtgggaaga

SEQ ID NO: 6046840 - DNA, 24 bp, Homo sapiens
ccagtgttagtgggaagagctggg

SEQ ID NO: 6046841 - DNA, 22 bp, Homo sapiens
ccagtgttatttattccccagt

SEQ ID NO: 6046842 - DNA, 17 bp, Homo sapiens
ccagtgttccccccata

SEQ ID NO: 6046843 - DNA, 18 bp, Homo sapiens
ccagtgttcctgaagctg

SEQ ID NO: 6046844 - DNA, 22 bp, Homo sapiens
ccagtgttcctgaagctgctgt

SEQ ID NO: 6046845 - DNA, 23 bp, Homo sapiens
ccagtgttcctgaagctgctgtg

SEQ ID NO: 6046846 - DNA, 19 bp, Homo sapiens
ccagtgttctatttgcttt

SEQ ID NO: 6046847 - DNA, 17 bp, Homo sapiens
ccagtgttgcctcctcc

SEQ ID NO: 6046848 - DNA, 23 bp, Homo sapiens
ccagtgttggctgtgtgacagaa

SEQ ID NO: 6046849 - DNA, 22 bp, Homo sapiens
ccagtgttgtggatttaacaga

SEQ ID NO: 6046850 - DNA, 23 bp, Homo sapiens
ccagtgttgtttgtaaataagag

SEQ ID NO: 6046851 - DNA, 17 bp, Homo sapiens
ccagtgtttctgaatgt

SEQ ID NO: 6046852 - DNA, 15 bp, Homo sapiens
ccagtgttttcttgt

SEQ ID NO: 6046853 - DNA, 22 bp, Homo sapiens
ccagtgtttttcttcatgtgca

SEQ ID NO: 6046854 - DNA, 19 bp, Homo sapiens
ccagttaaaatgtgtttct

SEQ ID NO: 6046855 - DNA, 13 bp, Homo sapiens
ccagttaaagatt

SEQ ID NO: 6046856 - DNA, 16 bp, Homo sapiens
ccagttaagaatggaa

SEQ ID NO: 6046857 - DNA, 15 bp, Homo sapiens
ccagttaaggaaaga

SEQ ID NO: 6046858 - DNA, 22 bp, Homo sapiens
ccagttaatactccagagacag

SEQ ID NO: 6046859 - DNA, 13 bp, Homo sapiens
ccagttaattttt

SEQ ID NO: 6046860 - DNA, 23 bp, Homo sapiens
ccagttactcaggaggctgaggc

SEQ ID NO: 6046861 - DNA, 23 bp, Homo sapiens
ccagttagcccggccaaggacac

SEQ ID NO: 6046862 - DNA, 17 bp, Homo sapiens
ccagttagcctctgcag

SEQ ID NO: 6046863 - DNA, 22 bp, Homo sapiens
ccagttagcctctgcaggatgt

SEQ ID NO: 6046864 - DNA, 20 bp, Homo sapiens
ccagttataaagaggtcaca

SEQ ID NO: 6046865 - DNA, 14 bp, Homo sapiens
ccagttatggctat

SEQ ID NO: 6046866 - DNA, 14 bp, Homo sapiens
ccagttatgtttga

SEQ ID NO: 6046867 - DNA, 19 bp, Homo sapiens
ccagttatttatttccaaa

SEQ ID NO: 6046868 - DNA, 16 bp, Homo sapiens
ccagttatttttatta

SEQ ID NO: 6046869 - DNA, 12 bp, Homo sapiens
ccagttcaaagt

SEQ ID NO: 6046870 - DNA, 19 bp, Homo sapiens
ccagttcaatctcccgctg

SEQ ID NO: 6046871 - DNA, 13 bp, Homo sapiens
ccagttcaccctg

SEQ ID NO: 6046872 - DNA, 14 bp, Homo sapiens
ccagttcagacact

SEQ ID NO: 6046873 - DNA, 21 bp, Homo sapiens
ccagttcagacactaccccat

SEQ ID NO: 6046874 - DNA, 15 bp, Homo sapiens
ccagttcagcttggg

SEQ ID NO: 6046875 - DNA, 14 bp, Homo sapiens
ccagttcaggagtc

SEQ ID NO: 6046876 - DNA, 21 bp, Homo sapiens
ccagttcatctatggcagtcc

SEQ ID NO: 6046877 - DNA, 18 bp, Homo sapiens
ccagttcattgcactttg

SEQ ID NO: 6046878 - DNA, 21 bp, Homo sapiens
ccagttcccatggtgtatgtg

SEQ ID NO: 6046879 - DNA, 22 bp, Homo sapiens
ccagttcccatggtgtatgtgg

SEQ ID NO: 6046880 - DNA, 23 bp, Homo sapiens
ccagttccctcagccctcattaa

SEQ ID NO: 6046881 - DNA, 15 bp, Homo sapiens
ccagttccctccctc

SEQ ID NO: 6046882 - DNA, 13 bp, Homo sapiens
ccagttcctatga

SEQ ID NO: 6046883 - DNA, 18 bp, Homo sapiens
ccagttcctatgacacag

SEQ ID NO: 6046884 - DNA, 12 bp, Homo sapiens
ccagttcctgct

SEQ ID NO: 6046885 - DNA, 14 bp, Homo sapiens
ccagttcctgctct

SEQ ID NO: 6046886 - DNA, 19 bp, Homo sapiens
ccagttcctgctctctgct

SEQ ID NO: 6046887 - DNA, 12 bp, Homo sapiens
ccagttcctgta

SEQ ID NO: 6046888 - DNA, 19 bp, Homo sapiens
ccagttctccttccctgca

SEQ ID NO: 6046889 - DNA, 22 bp, Homo sapiens
ccagttctcgttttgggccaga

SEQ ID NO: 6046890 - DNA, 14 bp, Homo sapiens
ccagttctgctcct

SEQ ID NO: 6046891 - DNA, 21 bp, Homo sapiens
ccagttctgctcctctccagg

SEQ ID NO: 6046892 - DNA, 15 bp, Homo sapiens
ccagttctggccagg

SEQ ID NO: 6046893 - DNA, 12 bp, Homo sapiens
ccagttctgggg

SEQ ID NO: 6046894 - DNA, 15 bp, Homo sapiens
ccagttcttgcaata

SEQ ID NO: 6046895 - DNA, 22 bp, Homo sapiens
ccagttgaactgcaggaagaga

SEQ ID NO: 6046896 - DNA, 18 bp, Homo sapiens
ccagttgcactcaggtga

SEQ ID NO: 6046897 - DNA, 20 bp, Homo sapiens
ccagttgcacttggcctctg

SEQ ID NO: 6046898 - DNA, 15 bp, Homo sapiens
ccagttgccatctgc

SEQ ID NO: 6046899 - DNA, 14 bp, Homo sapiens
ccagttgcccagag

SEQ ID NO: 6046900 - DNA, 15 bp, Homo sapiens
ccagttgcccagagc

SEQ ID NO: 6046901 - DNA, 16 bp, Homo sapiens
ccagttgcccagagca

SEQ ID NO: 6046902 - DNA, 18 bp, Homo sapiens
ccagttgcccagagcact

SEQ ID NO: 6046903 - DNA, 17 bp, Homo sapiens
ccagttgcctccagggc

SEQ ID NO: 6046904 - DNA, 19 bp, Homo sapiens
ccagttggagctccagcct

SEQ ID NO: 6046905 - DNA, 19 bp, Homo sapiens
ccagttggaggagactggg

SEQ ID NO: 6046906 - DNA, 19 bp, Homo sapiens
ccagttgggctcgcactgc

SEQ ID NO: 6046907 - DNA, 21 bp, Homo sapiens
ccagttggggaagccaggtga

SEQ ID NO: 6046908 - DNA, 23 bp, Homo sapiens
ccagttggggaagccaggtgagc

SEQ ID NO: 6046909 - DNA, 23 bp, Homo sapiens
ccagttgggtggatgcctggtgg

SEQ ID NO: 6046910 - DNA, 13 bp, Homo sapiens
ccagttggtcccc

SEQ ID NO: 6046911 - DNA, 17 bp, Homo sapiens
ccagttggtggggccag

SEQ ID NO: 6046912 - DNA, 23 bp, Homo sapiens
ccagttggtggggccaggccagg

SEQ ID NO: 6046913 - DNA, 15 bp, Homo sapiens
ccagttgtatttgaa

SEQ ID NO: 6046914 - DNA, 16 bp, Homo sapiens
ccagttgtatttgaag

SEQ ID NO: 6046915 - DNA, 15 bp, Homo sapiens
ccagttgtcctcctt

SEQ ID NO: 6046916 - DNA, 23 bp, Homo sapiens
ccagtttaagacaccaaatataa

SEQ ID NO: 6046917 - DNA, 20 bp, Homo sapiens
ccagtttaatgaactaccat

SEQ ID NO: 6046918 - DNA, 21 bp, Homo sapiens
ccagtttatggatatgctgct

SEQ ID NO: 6046919 - DNA, 16 bp, Homo sapiens
ccagtttattctgtgg

SEQ ID NO: 6046920 - DNA, 21 bp, Homo sapiens
ccagtttcaggtgtttagttg

SEQ ID NO: 6046921 - DNA, 12 bp, Homo sapiens
ccagtttcccac

SEQ ID NO: 6046922 - DNA, 13 bp, Homo sapiens
ccagtttcccacc

SEQ ID NO: 6046923 - DNA, 20 bp, Homo sapiens
ccagtttccccatggggctg

SEQ ID NO: 6046924 - DNA, 13 bp, Homo sapiens
ccagtttcccttc

SEQ ID NO: 6046925 - DNA, 17 bp, Homo sapiens
ccagtttctaaactgga

SEQ ID NO: 6046926 - DNA, 20 bp, Homo sapiens
ccagtttctaaactggagac

SEQ ID NO: 6046927 - DNA, 15 bp, Homo sapiens
ccagtttctcagaag

SEQ ID NO: 6046928 - DNA, 15 bp, Homo sapiens
ccagtttctgcctct

SEQ ID NO: 6046929 - DNA, 10 bp, Homo sapiens
ccagtttctt

SEQ ID NO: 6046930 - DNA, 11 bp, Homo sapiens
ccagtttcttt

SEQ ID NO: 6046931 - DNA, 17 bp, Homo sapiens
ccagtttgaagcctgtg

SEQ ID NO: 6046932 - DNA, 14 bp, Homo sapiens
ccagtttgactgtg

SEQ ID NO: 6046933 - DNA, 14 bp, Homo sapiens
ccagtttgcagaaa

SEQ ID NO: 6046934 - DNA, 22 bp, Homo sapiens
ccagtttgcatgattcttctct

SEQ ID NO: 6046935 - DNA, 14 bp, Homo sapiens
ccagtttgcatttg

SEQ ID NO: 6046936 - DNA, 13 bp, Homo sapiens
ccagtttgctttg

SEQ ID NO: 6046937 - DNA, 14 bp, Homo sapiens
ccagtttgggaact

SEQ ID NO: 6046938 - DNA, 17 bp, Homo sapiens
ccagttttattttctaa

SEQ ID NO: 6046939 - DNA, 23 bp, Homo sapiens
ccagttttattttctaaattctt

SEQ ID NO: 6046940 - DNA, 14 bp, Homo sapiens
ccagttttcatttt

SEQ ID NO: 6046941 - DNA, 12 bp, Homo sapiens
ccagttttccct

SEQ ID NO: 6046942 - DNA, 16 bp, Homo sapiens
ccagttttccctggaa

SEQ ID NO: 6046943 - DNA, 13 bp, Homo sapiens
ccagttttccgaa

SEQ ID NO: 6046944 - DNA, 13 bp, Homo sapiens
ccagttttctggt

SEQ ID NO: 6046945 - DNA, 20 bp, Homo sapiens
ccagttttctgttcagcttt

SEQ ID NO: 6046946 - DNA, 17 bp, Homo sapiens
ccagttttgagtgtact

SEQ ID NO: 6046947 - DNA, 17 bp, Homo sapiens
ccagttttggaggctga

SEQ ID NO: 6046948 - DNA, 12 bp, Homo sapiens
ccagttttgtat

SEQ ID NO: 6046949 - DNA, 23 bp, Homo sapiens
ccagttttgtggattaaaccttt

SEQ ID NO: 6046950 - DNA, 23 bp, Homo sapiens
ccagtttttgtttttgcatgaaa

SEQ ID NO: 6046951 - DNA, 13 bp, Homo sapiens
ccataaaaagctg

SEQ ID NO: 6046952 - DNA, 19 bp, Homo sapiens
ccataaaacattaagaaaa

SEQ ID NO: 6046953 - DNA, 15 bp, Homo sapiens
ccataaaaccctata

SEQ ID NO: 6046954 - DNA, 14 bp, Homo sapiens
ccataaaataaata

SEQ ID NO: 6046955 - DNA, 23 bp, Homo sapiens
ccataaaatctcacgctgccatt

SEQ ID NO: 6046956 - DNA, 17 bp, Homo sapiens
ccataaaatgatcctgc

SEQ ID NO: 6046957 - DNA, 22 bp, Homo sapiens
ccataaacacccatgaatcaaa

SEQ ID NO: 6046958 - DNA, 20 bp, Homo sapiens
ccataaacagcacacctgtg

SEQ ID NO: 6046959 - DNA, 22 bp, Homo sapiens
ccataaacagcacacctgtgtc

SEQ ID NO: 6046960 - DNA, 23 bp, Homo sapiens
ccataaacagcacacctgtgtcc

SEQ ID NO: 6046961 - DNA, 18 bp, Homo sapiens
ccataaacagtaatgact

SEQ ID NO: 6046962 - DNA, 16 bp, Homo sapiens
ccataaacggttcctg

SEQ ID NO: 6046963 - DNA, 16 bp, Homo sapiens
ccataaactaagagaa

SEQ ID NO: 6046964 - DNA, 15 bp, Homo sapiens
ccataaactgtacaa

SEQ ID NO: 6046965 - DNA, 21 bp, Homo sapiens
ccataaagacaatcactgcca

SEQ ID NO: 6046966 - DNA, 14 bp, Homo sapiens
ccataaagataatg

SEQ ID NO: 6046967 - DNA, 15 bp, Homo sapiens
ccataaagcaagctc

SEQ ID NO: 6046968 - DNA, 13 bp, Homo sapiens
ccataaagccttt

SEQ ID NO: 6046969 - DNA, 17 bp, Homo sapiens
ccataaagcctttaaaa

SEQ ID NO: 6046970 - DNA, 21 bp, Homo sapiens
ccataaagggtgtaggggcca

SEQ ID NO: 6046971 - DNA, 19 bp, Homo sapiens
ccataaatcaattcattgt

SEQ ID NO: 6046972 - DNA, 17 bp, Homo sapiens
ccataaatccagttcta

SEQ ID NO: 6046973 - DNA, 21 bp, Homo sapiens
ccataacaccgtcccagggct

SEQ ID NO: 6046974 - DNA, 13 bp, Homo sapiens
ccataactgaaca

SEQ ID NO: 6046975 - DNA, 13 bp, Homo sapiens
ccataacttgaaa

SEQ ID NO: 6046976 - DNA, 20 bp, Homo sapiens
ccataagacaaacactgcca

SEQ ID NO: 6046977 - DNA, 23 bp, Homo sapiens
ccataagacaaacactgccatat

SEQ ID NO: 6046978 - DNA, 15 bp, Homo sapiens
ccataagagaaacct

SEQ ID NO: 6046979 - DNA, 21 bp, Homo sapiens
ccataagagaaacctgccaag

SEQ ID NO: 6046980 - DNA, 16 bp, Homo sapiens
ccataagagaaatggt

SEQ ID NO: 6046981 - DNA, 21 bp, Homo sapiens
ccataagcctccatttagttc

SEQ ID NO: 6046982 - DNA, 18 bp, Homo sapiens
ccataagctactgccatc

SEQ ID NO: 6046983 - DNA, 15 bp, Homo sapiens
ccataaggaatgtag

SEQ ID NO: 6046984 - DNA, 15 bp, Homo sapiens
ccataagggactgtg

SEQ ID NO: 6046985 - DNA, 17 bp, Homo sapiens
ccataagggggtgggaa

SEQ ID NO: 6046986 - DNA, 22 bp, Homo sapiens
ccataaggtgcagtaggagcaa

SEQ ID NO: 6046987 - DNA, 17 bp, Homo sapiens
ccataagtgacaccaat

SEQ ID NO: 6046988 - DNA, 18 bp, Homo sapiens
ccataagtgacaccaata

SEQ ID NO: 6046989 - DNA, 19 bp, Homo sapiens
ccataataaaaggctttga

SEQ ID NO: 6046990 - DNA, 21 bp, Homo sapiens
ccataataaaggttgtgaatg

SEQ ID NO: 6046991 - DNA, 12 bp, Homo sapiens
ccataatacaaa

SEQ ID NO: 6046992 - DNA, 20 bp, Homo sapiens
ccataatagttagccctcag

SEQ ID NO: 6046993 - DNA, 15 bp, Homo sapiens
ccataatatgatgca

SEQ ID NO: 6046994 - DNA, 14 bp, Homo sapiens
ccataatccctgtc

SEQ ID NO: 6046995 - DNA, 16 bp, Homo sapiens
ccataatcctagcccc

SEQ ID NO: 6046996 - DNA, 21 bp, Homo sapiens
ccataatctggactcctctgt

SEQ ID NO: 6046997 - DNA, 13 bp, Homo sapiens
ccataatcttaga

SEQ ID NO: 6046998 - DNA, 14 bp, Homo sapiens
ccataatgccactg

SEQ ID NO: 6046999 - DNA, 13 bp, Homo sapiens
ccataatgcttct

SEQ ID NO: 6047000 - DNA, 13 bp, Homo sapiens
ccataatttggtc

SEQ ID NO: 6047001 - DNA, 20 bp, Homo sapiens
ccataattttttttttcctt

SEQ ID NO: 6047002 - DNA, 12 bp, Homo sapiens
ccatacaatgta

SEQ ID NO: 6047003 - DNA, 15 bp, Homo sapiens
ccatacaatgtatgt

SEQ ID NO: 6047004 - DNA, 11 bp, Homo sapiens
ccatacacaca

SEQ ID NO: 6047005 - DNA, 14 bp, Homo sapiens
ccatacacacgctg

SEQ ID NO: 6047006 - DNA, 16 bp, Homo sapiens
ccatacacatccccag

SEQ ID NO: 6047007 - DNA, 17 bp, Homo sapiens
ccatacacatccccagc

SEQ ID NO: 6047008 - DNA, 17 bp, Homo sapiens
ccatacactttgttgca

SEQ ID NO: 6047009 - DNA, 21 bp, Homo sapiens
ccatacagggtctcttccttc

SEQ ID NO: 6047010 - DNA, 13 bp, Homo sapiens
ccataccatcact

SEQ ID NO: 6047011 - DNA, 17 bp, Homo sapiens
ccataccatcactgagt

SEQ ID NO: 6047012 - DNA, 12 bp, Homo sapiens
ccataccattcc

SEQ ID NO: 6047013 - DNA, 19 bp, Homo sapiens
ccatacccacaatctgagc

SEQ ID NO: 6047014 - DNA, 20 bp, Homo sapiens
ccatacccacaatctgagca

SEQ ID NO: 6047015 - DNA, 16 bp, Homo sapiens
ccataccccctgcccc

SEQ ID NO: 6047016 - DNA, 21 bp, Homo sapiens
ccataccccctgccccagaga

SEQ ID NO: 6047017 - DNA, 16 bp, Homo sapiens
ccatacccctgcctgg

SEQ ID NO: 6047018 - DNA, 21 bp, Homo sapiens
ccataccccttattgctgcca

SEQ ID NO: 6047019 - DNA, 22 bp, Homo sapiens
ccataccccttattgctgccaa

SEQ ID NO: 6047020 - DNA, 16 bp, Homo sapiens
ccatacctgcccctgc

SEQ ID NO: 6047021 - DNA, 16 bp, Homo sapiens
ccatacctttccaggg

SEQ ID NO: 6047022 - DNA, 15 bp, Homo sapiens
ccatacgcggaggag

SEQ ID NO: 6047023 - DNA, 16 bp, Homo sapiens
ccatacgcggaggagt

SEQ ID NO: 6047024 - DNA, 16 bp, Homo sapiens
ccatactaataaatat

SEQ ID NO: 6047025 - DNA, 12 bp, Homo sapiens
ccatactaatta

SEQ ID NO: 6047026 - DNA, 13 bp, Homo sapiens
ccatactaattat

SEQ ID NO: 6047027 - DNA, 23 bp, Homo sapiens
ccatactaattataccccctgca

SEQ ID NO: 6047028 - DNA, 21 bp, Homo sapiens
ccatactcagcctgctgccca

SEQ ID NO: 6047029 - DNA, 21 bp, Homo sapiens
ccatactccttgcttcctgat

SEQ ID NO: 6047030 - DNA, 20 bp, Homo sapiens
ccatactctgtccccccagc

SEQ ID NO: 6047031 - DNA, 14 bp, Homo sapiens
ccatactgagcctg

SEQ ID NO: 6047032 - DNA, 15 bp, Homo sapiens
ccatactgagcctgc

SEQ ID NO: 6047033 - DNA, 16 bp, Homo sapiens
ccatactgcgtccacc

SEQ ID NO: 6047034 - DNA, 20 bp, Homo sapiens
ccatactgcgtccaccctga

SEQ ID NO: 6047035 - DNA, 20 bp, Homo sapiens
ccatactggcctcgcctggc

SEQ ID NO: 6047036 - DNA, 17 bp, Homo sapiens
ccatactgtagacactc

SEQ ID NO: 6047037 - DNA, 18 bp, Homo sapiens
ccatactgtagacactct

SEQ ID NO: 6047038 - DNA, 19 bp, Homo sapiens
ccatactgtagacactctg

SEQ ID NO: 6047039 - DNA, 23 bp, Homo sapiens
ccatactgtttgcccattttcat

SEQ ID NO: 6047040 - DNA, 11 bp, Homo sapiens
ccatactttgg

SEQ ID NO: 6047041 - DNA, 18 bp, Homo sapiens
ccatacttttgagagggg

SEQ ID NO: 6047042 - DNA, 16 bp, Homo sapiens
ccatacttttggctcc

SEQ ID NO: 6047043 - DNA, 14 bp, Homo sapiens
ccatagaaaaatgt

SEQ ID NO: 6047044 - DNA, 18 bp, Homo sapiens
ccatagaaacatgacact

SEQ ID NO: 6047045 - DNA, 21 bp, Homo sapiens
ccatagaaacatgacactgac

SEQ ID NO: 6047046 - DNA, 22 bp, Homo sapiens
ccatagaaacatgacactgacc

SEQ ID NO: 6047047 - DNA, 13 bp, Homo sapiens
ccatagacacagt

SEQ ID NO: 6047048 - DNA, 20 bp, Homo sapiens
ccatagacagccctggggga

SEQ ID NO: 6047049 - DNA, 16 bp, Homo sapiens
ccatagacatgaaagg

SEQ ID NO: 6047050 - DNA, 16 bp, Homo sapiens
ccatagaccctgaggc

SEQ ID NO: 6047051 - DNA, 18 bp, Homo sapiens
ccatagacctacagacct

SEQ ID NO: 6047052 - DNA, 23 bp, Homo sapiens
ccatagagagcaagacgctgtgc

SEQ ID NO: 6047053 - DNA, 15 bp, Homo sapiens
ccatagaggcccagg

SEQ ID NO: 6047054 - DNA, 17 bp, Homo sapiens
ccatagaggcccaggca

SEQ ID NO: 6047055 - DNA, 18 bp, Homo sapiens
ccatagaggcccaggcac

SEQ ID NO: 6047056 - DNA, 17 bp, Homo sapiens
ccatagagtaatgatgt

SEQ ID NO: 6047057 - DNA, 19 bp, Homo sapiens
ccatagagtacactgcctg

SEQ ID NO: 6047058 - DNA, 22 bp, Homo sapiens
ccatagagtacactgcctgcct

SEQ ID NO: 6047059 - DNA, 13 bp, Homo sapiens
ccatagagtttaa

SEQ ID NO: 6047060 - DNA, 16 bp, Homo sapiens
ccatagatgctggctg

SEQ ID NO: 6047061 - DNA, 15 bp, Homo sapiens
ccatagatttgaaga

SEQ ID NO: 6047062 - DNA, 22 bp, Homo sapiens
ccatagatttgaagatctgatt

SEQ ID NO: 6047063 - DNA, 23 bp, Homo sapiens
ccatagcaccctgccctcatggg

SEQ ID NO: 6047064 - DNA, 18 bp, Homo sapiens
ccatagccaccccagaaa

SEQ ID NO: 6047065 - DNA, 14 bp, Homo sapiens
ccatagcgctggct

SEQ ID NO: 6047066 - DNA, 20 bp, Homo sapiens
ccatagcgctggctcaggaa

SEQ ID NO: 6047067 - DNA, 21 bp, Homo sapiens
ccatagctcctctccctcaca

SEQ ID NO: 6047068 - DNA, 16 bp, Homo sapiens
ccatagctcctgctcc

SEQ ID NO: 6047069 - DNA, 19 bp, Homo sapiens
ccatagctcttcacttcct

SEQ ID NO: 6047070 - DNA, 18 bp, Homo sapiens
ccatagctgctgccctag

SEQ ID NO: 6047071 - DNA, 14 bp, Homo sapiens
ccatagctgggact

SEQ ID NO: 6047072 - DNA, 20 bp, Homo sapiens
ccatagctggtttttcccac

SEQ ID NO: 6047073 - DNA, 22 bp, Homo sapiens
ccataggactaccgcaggcccg

SEQ ID NO: 6047074 - DNA, 18 bp, Homo sapiens
ccataggagcagccttag

SEQ ID NO: 6047075 - DNA, 14 bp, Homo sapiens
ccataggcccacac

SEQ ID NO: 6047076 - DNA, 17 bp, Homo sapiens
ccataggcccacacaca

SEQ ID NO: 6047077 - DNA, 20 bp, Homo sapiens
ccataggcccacacacaggt

SEQ ID NO: 6047078 - DNA, 16 bp, Homo sapiens
ccataggctgtgttta

SEQ ID NO: 6047079 - DNA, 22 bp, Homo sapiens
ccatagggctggggactgggga

SEQ ID NO: 6047080 - DNA, 15 bp, Homo sapiens
ccatagggggctgca

SEQ ID NO: 6047081 - DNA, 20 bp, Homo sapiens
ccatagggtcggaggtgctg

SEQ ID NO: 6047082 - DNA, 21 bp, Homo sapiens
ccatagggtcggaggtgctgt

SEQ ID NO: 6047083 - DNA, 22 bp, Homo sapiens
ccatagggtcggaggtgctgtc

SEQ ID NO: 6047084 - DNA, 12 bp, Homo sapiens
ccataggtcacc

SEQ ID NO: 6047085 - DNA, 19 bp, Homo sapiens
ccataggtttctctccctc

SEQ ID NO: 6047086 - DNA, 13 bp, Homo sapiens
ccatagtaactga

SEQ ID NO: 6047087 - DNA, 15 bp, Homo sapiens
ccatagtaactgaca

SEQ ID NO: 6047088 - DNA, 22 bp, Homo sapiens
ccatagtatattaaaaatggta

SEQ ID NO: 6047089 - DNA, 19 bp, Homo sapiens
ccatagtcagcagcagctc

SEQ ID NO: 6047090 - DNA, 21 bp, Homo sapiens
ccatagtcagcagcagctctg

SEQ ID NO: 6047091 - DNA, 18 bp, Homo sapiens
ccatagtcattctgcctg

SEQ ID NO: 6047092 - DNA, 21 bp, Homo sapiens
ccatagtggaccacttggaaa

SEQ ID NO: 6047093 - DNA, 15 bp, Homo sapiens
ccatagtggggcctg

SEQ ID NO: 6047094 - DNA, 19 bp, Homo sapiens
ccatagtggggcctgggag

SEQ ID NO: 6047095 - DNA, 17 bp, Homo sapiens
ccatagttactgtaaaa

SEQ ID NO: 6047096 - DNA, 18 bp, Homo sapiens
ccatagttactgtaaaat

SEQ ID NO: 6047097 - DNA, 19 bp, Homo sapiens
ccatagtttgggtattttt

SEQ ID NO: 6047098 - DNA, 16 bp, Homo sapiens
ccatagttttgtttaa

SEQ ID NO: 6047099 - DNA, 17 bp, Homo sapiens
ccatagttttgtttaat

SEQ ID NO: 6047100 - DNA, 16 bp, Homo sapiens
ccatataagtttgaag

SEQ ID NO: 6047101 - DNA, 13 bp, Homo sapiens
ccatatagtctat

SEQ ID NO: 6047102 - DNA, 18 bp, Homo sapiens
ccatatagtttgttttct

SEQ ID NO: 6047103 - DNA, 22 bp, Homo sapiens
ccatatagtttgttttcttttt

SEQ ID NO: 6047104 - DNA, 13 bp, Homo sapiens
ccatatataaatt

SEQ ID NO: 6047105 - DNA, 16 bp, Homo sapiens
ccatatataaattatt

SEQ ID NO: 6047106 - DNA, 18 bp, Homo sapiens
ccatatataaattattac

SEQ ID NO: 6047107 - DNA, 18 bp, Homo sapiens
ccatatatgaccagaagc

SEQ ID NO: 6047108 - DNA, 21 bp, Homo sapiens
ccatatatgctgtatttcttt

SEQ ID NO: 6047109 - DNA, 21 bp, Homo sapiens
ccatatattaccccttcatgt

SEQ ID NO: 6047110 - DNA, 21 bp, Homo sapiens
ccatatattggcactgctaaa

SEQ ID NO: 6047111 - DNA, 18 bp, Homo sapiens
ccatatcaaaagacacag

SEQ ID NO: 6047112 - DNA, 17 bp, Homo sapiens
ccatatcaagagacatg

SEQ ID NO: 6047113 - DNA, 17 bp, Homo sapiens
ccatatcagacctctga

SEQ ID NO: 6047114 - DNA, 18 bp, Homo sapiens
ccatatcagacctctgat

SEQ ID NO: 6047115 - DNA, 18 bp, Homo sapiens
ccatatcagctctctgca

SEQ ID NO: 6047116 - DNA, 20 bp, Homo sapiens
ccatatcagctctctgcaga

SEQ ID NO: 6047117 - DNA, 14 bp, Homo sapiens
ccatatcagctctg

SEQ ID NO: 6047118 - DNA, 21 bp, Homo sapiens
ccatatccatgttgctgactt

SEQ ID NO: 6047119 - DNA, 18 bp, Homo sapiens
ccatatcccctctccccc

SEQ ID NO: 6047120 - DNA, 14 bp, Homo sapiens
ccatatcccgggag

SEQ ID NO: 6047121 - DNA, 15 bp, Homo sapiens
ccatatccctggttg

SEQ ID NO: 6047122 - DNA, 15 bp, Homo sapiens
ccatatccgggtgct

SEQ ID NO: 6047123 - DNA, 18 bp, Homo sapiens
ccatatccgggtgctcaa

SEQ ID NO: 6047124 - DNA, 13 bp, Homo sapiens
ccatatcctgcct

SEQ ID NO: 6047125 - DNA, 15 bp, Homo sapiens
ccatatcctggtgcc

SEQ ID NO: 6047126 - DNA, 17 bp, Homo sapiens
ccatatccttctggctg

SEQ ID NO: 6047127 - DNA, 16 bp, Homo sapiens
ccatatctaaccagtg

SEQ ID NO: 6047128 - DNA, 23 bp, Homo sapiens
ccatatctagtcaataactctga

SEQ ID NO: 6047129 - DNA, 19 bp, Homo sapiens
ccatatctccatggccctg

SEQ ID NO: 6047130 - DNA, 15 bp, Homo sapiens
ccatatctgtgtgcc

SEQ ID NO: 6047131 - DNA, 16 bp, Homo sapiens
ccatatcttaaagaaa

SEQ ID NO: 6047132 - DNA, 15 bp, Homo sapiens
ccatatcttgccttc

SEQ ID NO: 6047133 - DNA, 16 bp, Homo sapiens
ccatatcttgccttca

SEQ ID NO: 6047134 - DNA, 14 bp, Homo sapiens
ccatatgaattgta

SEQ ID NO: 6047135 - DNA, 19 bp, Homo sapiens
ccatatgacaatttcaaaa

SEQ ID NO: 6047136 - DNA, 14 bp, Homo sapiens
ccatatgcagaaat

SEQ ID NO: 6047137 - DNA, 16 bp, Homo sapiens
ccatatgcagaaatag

SEQ ID NO: 6047138 - DNA, 20 bp, Homo sapiens
ccatatgcatctacttggca

SEQ ID NO: 6047139 - DNA, 13 bp, Homo sapiens
ccatatgcctggg

SEQ ID NO: 6047140 - DNA, 19 bp, Homo sapiens
cattcaaactgcactttta

SEQ ID NO: 6047141 - DNA, 20 bp, Homo sapiens
cattcaaactgcacttttag

SEQ ID NO: 6047142 - DNA, 18 bp, Homo sapiens
cattcaaatgacgcctga

SEQ ID NO: 6047143 - DNA, 20 bp, Homo sapiens
cattcaaatgtattacagtg

SEQ ID NO: 6047144 - DNA, 15 bp, Homo sapiens
cattcaaatttgtct

SEQ ID NO: 6047145 - DNA, 12 bp, Homo sapiens
cattcaacaaga

SEQ ID NO: 6047146 - DNA, 18 bp, Homo sapiens
cattcaacagagactgaa

SEQ ID NO: 6047147 - DNA, 20 bp, Homo sapiens
cattcaaccacgcaggaagc

SEQ ID NO: 6047148 - DNA, 17 bp, Homo sapiens
cattcaaccctggagag

SEQ ID NO: 6047149 - DNA, 19 bp, Homo sapiens
cattcaaccttaccaaaaa

SEQ ID NO: 6047150 - DNA, 18 bp, Homo sapiens
cattcaagcctgtgaata

SEQ ID NO: 6047151 - DNA, 12 bp, Homo sapiens
cattcaagctat

SEQ ID NO: 6047152 - DNA, 22 bp, Homo sapiens
cattcaagtgtaaaatattttg

SEQ ID NO: 6047153 - DNA, 16 bp, Homo sapiens
cattcaatacaagtgt

SEQ ID NO: 6047154 - DNA, 15 bp, Homo sapiens
cattcaatctccaga

SEQ ID NO: 6047155 - DNA, 20 bp, Homo sapiens
cattcacaaagtagcaccaa

SEQ ID NO: 6047156 - DNA, 21 bp, Homo sapiens
cattcacaaagtataacaatt

SEQ ID NO: 6047157 - DNA, 13 bp, Homo sapiens
cattcacaagcct

SEQ ID NO: 6047158 - DNA, 16 bp, Homo sapiens
cattcacaagcctcct

SEQ ID NO: 6047159 - DNA, 14 bp, Homo sapiens
cattcacacacagc

SEQ ID NO: 6047160 - DNA, 16 bp, Homo sapiens
cattcacacacagcct

SEQ ID NO: 6047161 - DNA, 18 bp, Homo sapiens
cattcacacacagcctgg

SEQ ID NO: 6047162 - DNA, 23 bp, Homo sapiens
cattcacacacagcctggcctcc

SEQ ID NO: 6047163 - DNA, 17 bp, Homo sapiens
cattcacacagggctct

SEQ ID NO: 6047164 - DNA, 22 bp, Homo sapiens
cattcacactttttatttaatt

SEQ ID NO: 6047165 - DNA, 11 bp, Homo sapiens
cattcacagcc

SEQ ID NO: 6047166 - DNA, 12 bp, Homo sapiens
cattcacagccc

SEQ ID NO: 6047167 - DNA, 14 bp, Homo sapiens
cattcacagcccag

SEQ ID NO: 6047168 - DNA, 15 bp, Homo sapiens
cattcacagcccaga

SEQ ID NO: 6047169 - DNA, 17 bp, Homo sapiens
cattcacagcgcctcct

SEQ ID NO: 6047170 - DNA, 23 bp, Homo sapiens
cattcacagttctttgggccaga

SEQ ID NO: 6047171 - DNA, 16 bp, Homo sapiens
cattcacatatctgct

SEQ ID NO: 6047172 - DNA, 12 bp, Homo sapiens
cattcacatttc

SEQ ID NO: 6047173 - DNA, 17 bp, Homo sapiens
cattcacatttgatgta

SEQ ID NO: 6047174 - DNA, 21 bp, Homo sapiens
cattcacggcctggcatgcag

SEQ ID NO: 6047175 - DNA, 15 bp, Homo sapiens
cattcactagaaaat

SEQ ID NO: 6047176 - DNA, 20 bp, Homo sapiens
cattcactcttccagaatcc

SEQ ID NO: 6047177 - DNA, 16 bp, Homo sapiens
cattcactggcaaatg

SEQ ID NO: 6047178 - DNA, 18 bp, Homo sapiens
cattcacttcactgtgct

SEQ ID NO: 6047179 - DNA, 20 bp, Homo sapiens
cattcacttcactgtgctgt

SEQ ID NO: 6047180 - DNA, 18 bp, Homo sapiens
cattcacttgcatttctt

SEQ ID NO: 6047181 - DNA, 12 bp, Homo sapiens
cattcactttca

SEQ ID NO: 6047182 - DNA, 15 bp, Homo sapiens
cattcacttttgtta

SEQ ID NO: 6047183 - DNA, 13 bp, Homo sapiens
cattcagaaaaaa

SEQ ID NO: 6047184 - DNA, 12 bp, Homo sapiens
cattcagaaatg

SEQ ID NO: 6047185 - DNA, 23 bp, Homo sapiens
cattcagaaatgttgagtctgta

SEQ ID NO: 6047186 - DNA, 18 bp, Homo sapiens
cattcagaagaaaaagaa

SEQ ID NO: 6047187 - DNA, 22 bp, Homo sapiens
cattcagacgttttttctgcac

SEQ ID NO: 6047188 - DNA, 16 bp, Homo sapiens
cattcagactaaaaat

SEQ ID NO: 6047189 - DNA, 23 bp, Homo sapiens
cattcagatataagatttgtaca

SEQ ID NO: 6047190 - DNA, 21 bp, Homo sapiens
cattcagatatgattcaaatg

SEQ ID NO: 6047191 - DNA, 17 bp, Homo sapiens
cattcagcaaatgcctt

SEQ ID NO: 6047192 - DNA, 18 bp, Homo sapiens
cattcagcaaatgccttt

SEQ ID NO: 6047193 - DNA, 12 bp, Homo sapiens
cattcagcacac

SEQ ID NO: 6047194 - DNA, 16 bp, Homo sapiens
cattcagcacacccca

SEQ ID NO: 6047195 - DNA, 20 bp, Homo sapiens
cattcagcagcaaattttca

SEQ ID NO: 6047196 - DNA, 15 bp, Homo sapiens
cattcagcagtcagt

SEQ ID NO: 6047197 - DNA, 12 bp, Homo sapiens
cattcagcctcg

SEQ ID NO: 6047198 - DNA, 15 bp, Homo sapiens
cattcagccttcaat

SEQ ID NO: 6047199 - DNA, 14 bp, Homo sapiens
cattcagctctgga

SEQ ID NO: 6047200 - DNA, 15 bp, Homo sapiens
cattcagctctggag

SEQ ID NO: 6047201 - DNA, 12 bp, Homo sapiens
cattcaggaacc

SEQ ID NO: 6047202 - DNA, 20 bp, Homo sapiens
cattcaggaccccaacccct

SEQ ID NO: 6047203 - DNA, 21 bp, Homo sapiens
cattcaggtgacctcctgcag

SEQ ID NO: 6047204 - DNA, 20 bp, Homo sapiens
cattcagtaagttctgtggt

SEQ ID NO: 6047205 - DNA, 21 bp, Homo sapiens
cattcagtaagttctgtggtt

SEQ ID NO: 6047206 - DNA, 19 bp, Homo sapiens
cattcagtctatgctgtgt

SEQ ID NO: 6047207 - DNA, 21 bp, Homo sapiens
cattcagtgattactgtcaag

SEQ ID NO: 6047208 - DNA, 15 bp, Homo sapiens
cattcagtgtaaatt

SEQ ID NO: 6047209 - DNA, 12 bp, Homo sapiens
cattcagttcta

SEQ ID NO: 6047210 - DNA, 19 bp, Homo sapiens
cattcataaaagtttgcat

SEQ ID NO: 6047211 - DNA, 16 bp, Homo sapiens
cattcataattaaaat

SEQ ID NO: 6047212 - DNA, 17 bp, Homo sapiens
cattcatacacaacgta

SEQ ID NO: 6047213 - DNA, 20 bp, Homo sapiens
cattcatactaaataaaaca

SEQ ID NO: 6047214 - DNA, 21 bp, Homo sapiens
cattcatactaaataaaacaa

SEQ ID NO: 6047215 - DNA, 15 bp, Homo sapiens
cattcatactcaaag

SEQ ID NO: 6047216 - DNA, 22 bp, Homo sapiens
cattcatacttaaaaatttatt

SEQ ID NO: 6047217 - DNA, 14 bp, Homo sapiens
cattcatattaaga

SEQ ID NO: 6047218 - DNA, 21 bp, Homo sapiens
cattcatattaagacagtgta

SEQ ID NO: 6047219 - DNA, 22 bp, Homo sapiens
cattcatattaagacagtgtac

SEQ ID NO: 6047220 - DNA, 18 bp, Homo sapiens
cattcatattacaatatt

SEQ ID NO: 6047221 - DNA, 20 bp, Homo sapiens
cattcatatttgtctttgaa

SEQ ID NO: 6047222 - DNA, 23 bp, Homo sapiens
cattcatcaatatccctcttgta

SEQ ID NO: 6047223 - DNA, 19 bp, Homo sapiens
cattcatccaggactgaga

SEQ ID NO: 6047224 - DNA, 14 bp, Homo sapiens
cattcatcctcaca

SEQ ID NO: 6047225 - DNA, 14 bp, Homo sapiens
cattcatcctctta

SEQ ID NO: 6047226 - DNA, 15 bp, Homo sapiens
cattcatcctcttat

SEQ ID NO: 6047227 - DNA, 12 bp, Homo sapiens
cattcatcctga

SEQ ID NO: 6047228 - DNA, 18 bp, Homo sapiens
cattcatctctcaaactt

SEQ ID NO: 6047229 - DNA, 19 bp, Homo sapiens
cattcatctctcaaactta

SEQ ID NO: 6047230 - DNA, 14 bp, Homo sapiens
cattcatctggagg

SEQ ID NO: 6047231 - DNA, 16 bp, Homo sapiens
cattcatctggaggct

SEQ ID NO: 6047232 - DNA, 21 bp, Homo sapiens
cattcatctgggctggcagag

SEQ ID NO: 6047233 - DNA, 14 bp, Homo sapiens
cattcatcttgcaa

SEQ ID NO: 6047234 - DNA, 15 bp, Homo sapiens
cattcatgaatattt

SEQ ID NO: 6047235 - DNA, 22 bp, Homo sapiens
cattcatgccaaagcaaaagaa

SEQ ID NO: 6047236 - DNA, 14 bp, Homo sapiens
cattcatgcctggc

SEQ ID NO: 6047237 - DNA, 17 bp, Homo sapiens
cattcatggaccactgt

SEQ ID NO: 6047238 - DNA, 19 bp, Homo sapiens
cattcatggaccactgttt

SEQ ID NO: 6047239 - DNA, 22 bp, Homo sapiens
cattcatggaccactgtttctt

SEQ ID NO: 6047240 - DNA, 15 bp, Homo sapiens
cattcatgtaactct

SEQ ID NO: 6047241 - DNA, 19 bp, Homo sapiens
cattcatgtaactctccag

SEQ ID NO: 6047242 - DNA, 21 bp, Homo sapiens
cattcatgtaactctccagcc

SEQ ID NO: 6047243 - DNA, 13 bp, Homo sapiens
cattcatgtacaa

SEQ ID NO: 6047244 - DNA, 22 bp, Homo sapiens
cattcatgtactaccctcagtc

SEQ ID NO: 6047245 - DNA, 17 bp, Homo sapiens
cattcattcaacagctg

SEQ ID NO: 6047246 - DNA, 17 bp, Homo sapiens
cattcattcaatagata

SEQ ID NO: 6047247 - DNA, 17 bp, Homo sapiens
cattcattcatcctctt

SEQ ID NO: 6047248 - DNA, 15 bp, Homo sapiens
cattcattccattct

SEQ ID NO: 6047249 - DNA, 15 bp, Homo sapiens
cattcattctgagcc

SEQ ID NO: 6047250 - DNA, 14 bp, Homo sapiens
cattcatttacaac

SEQ ID NO: 6047251 - DNA, 15 bp, Homo sapiens
cattcattttatatt

SEQ ID NO: 6047252 - DNA, 23 bp, Homo sapiens
cattcattttatattgaaaaaaa

SEQ ID NO: 6047253 - DNA, 13 bp, Homo sapiens
cattcattttgaa

SEQ ID NO: 6047254 - DNA, 15 bp, Homo sapiens
cattcattttgtgta

SEQ ID NO: 6047255 - DNA, 13 bp, Homo sapiens
cattcatttttat

SEQ ID NO: 6047256 - DNA, 15 bp, Homo sapiens
cattccaaaacgaag

SEQ ID NO: 6047257 - DNA, 19 bp, Homo sapiens
cattccaaaattcatttca

SEQ ID NO: 6047258 - DNA, 14 bp, Homo sapiens
cattccaaagaaac

SEQ ID NO: 6047259 - DNA, 23 bp, Homo sapiens
cattccaaaggggacccctatga

SEQ ID NO: 6047260 - DNA, 17 bp, Homo sapiens
cattccaaatgctttca

SEQ ID NO: 6047261 - DNA, 15 bp, Homo sapiens
cattccaacacctgc

SEQ ID NO: 6047262 - DNA, 23 bp, Homo sapiens
cattccaacagctcaagtcttcc

SEQ ID NO: 6047263 - DNA, 21 bp, Homo sapiens
cattccaagaactataaactt

SEQ ID NO: 6047264 - DNA, 14 bp, Homo sapiens
cattccaagacagt

SEQ ID NO: 6047265 - DNA, 15 bp, Homo sapiens
cattccaagacagta

SEQ ID NO: 6047266 - DNA, 17 bp, Homo sapiens
cattccaagactctaga

SEQ ID NO: 6047267 - DNA, 14 bp, Homo sapiens
cattccaagcctga

SEQ ID NO: 6047268 - DNA, 20 bp, Homo sapiens
cattccaagtgtatatttgt

SEQ ID NO: 6047269 - DNA, 22 bp, Homo sapiens
cattccacactgcagggaggag

SEQ ID NO: 6047270 - DNA, 15 bp, Homo sapiens
cattccacactgttg

SEQ ID NO: 6047271 - DNA, 10 bp, Homo sapiens
cattccacag

SEQ ID NO: 6047272 - DNA, 22 bp, Homo sapiens
cattccacaggacgaatgcata

SEQ ID NO: 6047273 - DNA, 22 bp, Homo sapiens
cattccacatccccaccttcca

SEQ ID NO: 6047274 - DNA, 17 bp, Homo sapiens
cattccaccttcccatg

SEQ ID NO: 6047275 - DNA, 18 bp, Homo sapiens
cattccacgtgccccttg

SEQ ID NO: 6047276 - DNA, 21 bp, Homo sapiens
cattccactatacaattcagt

SEQ ID NO: 6047277 - DNA, 14 bp, Homo sapiens
cattccactccact

SEQ ID NO: 6047278 - DNA, 13 bp, Homo sapiens
cattccagaatct

SEQ ID NO: 6047279 - DNA, 15 bp, Homo sapiens
cattccagacttcaa

SEQ ID NO: 6047280 - DNA, 13 bp, Homo sapiens
cattccagaggaa

SEQ ID NO: 6047281 - DNA, 14 bp, Homo sapiens
cattccagaggaag

SEQ ID NO: 6047282 - DNA, 19 bp, Homo sapiens
cattccagagttaaaatgt

SEQ ID NO: 6047283 - DNA, 14 bp, Homo sapiens
cattccagcagctg

SEQ ID NO: 6047284 - DNA, 15 bp, Homo sapiens
cattccagccaggcc

SEQ ID NO: 6047285 - DNA, 15 bp, Homo sapiens
cattccagcccctct

SEQ ID NO: 6047286 - DNA, 17 bp, Homo sapiens
cattccagctctcccat

SEQ ID NO: 6047287 - DNA, 20 bp, Homo sapiens
cattccagctctcccatgga

SEQ ID NO: 6047288 - DNA, 13 bp, Homo sapiens
cattccagctctg

SEQ ID NO: 6047289 - DNA, 16 bp, Homo sapiens
cattccaggagtggga

SEQ ID NO: 6047290 - DNA, 21 bp, Homo sapiens
cattccaggcagcctctgtca

SEQ ID NO: 6047291 - DNA, 12 bp, Homo sapiens
cattccagggct

SEQ ID NO: 6047292 - DNA, 13 bp, Homo sapiens
cattccagggctg

SEQ ID NO: 6047293 - DNA, 20 bp, Homo sapiens
cattccaggggctgcagccc

SEQ ID NO: 6047294 - DNA, 22 bp, Homo sapiens
cattccaggggctgcagccccc

SEQ ID NO: 6047295 - DNA, 14 bp, Homo sapiens
cattccagggttgg

SEQ ID NO: 6047296 - DNA, 15 bp, Homo sapiens
cattccagtaacttt

SEQ ID NO: 6047297 - DNA, 16 bp, Homo sapiens
cattccagtaactttt

SEQ ID NO: 6047298 - DNA, 17 bp, Homo sapiens
cattccagtaacttttt

SEQ ID NO: 6047299 - DNA, 20 bp, Homo sapiens
cattccagtaacttttttgt

SEQ ID NO: 6047300 - DNA, 23 bp, Homo sapiens
cattccagtcaaatctgggctca

SEQ ID NO: 6047301 - DNA, 21 bp, Homo sapiens
cattccagtccaattttccta

SEQ ID NO: 6047302 - DNA, 13 bp, Homo sapiens
cattccagtctga

SEQ ID NO: 6047303 - DNA, 13 bp, Homo sapiens
cattccagtgcta

SEQ ID NO: 6047304 - DNA, 17 bp, Homo sapiens
cattccatcacagccag

SEQ ID NO: 6047305 - DNA, 17 bp, Homo sapiens
cattccatcccttcctg

SEQ ID NO: 6047306 - DNA, 14 bp, Homo sapiens
cattccatcttaca

SEQ ID NO: 6047307 - DNA, 15 bp, Homo sapiens
cattccatgactctg

SEQ ID NO: 6047308 - DNA, 19 bp, Homo sapiens
cattccatgactctgccta

SEQ ID NO: 6047309 - DNA, 16 bp, Homo sapiens
cattccatgattttac

SEQ ID NO: 6047310 - DNA, 16 bp, Homo sapiens
cattccatgtgcccag

SEQ ID NO: 6047311 - DNA, 15 bp, Homo sapiens
cattccattctggaa

SEQ ID NO: 6047312 - DNA, 16 bp, Homo sapiens
cattccattgttttag

SEQ ID NO: 6047313 - DNA, 22 bp, Homo sapiens
cattccatttatcctagaaaat

SEQ ID NO: 6047314 - DNA, 19 bp, Homo sapiens
cattcccaagatgcctgat

SEQ ID NO: 6047315 - DNA, 20 bp, Homo sapiens
cattcccaagatgcctgatc

SEQ ID NO: 6047316 - DNA, 16 bp, Homo sapiens
cattcccaagccatgg

SEQ ID NO: 6047317 - DNA, 16 bp, Homo sapiens
cattcccactgcactt

SEQ ID NO: 6047318 - DNA, 17 bp, Homo sapiens
cattcccagctctaccc

SEQ ID NO: 6047319 - DNA, 18 bp, Homo sapiens
cattcccagctctaccct

SEQ ID NO: 6047320 - DNA, 15 bp, Homo sapiens
ccatatgcctgggca

SEQ ID NO: 6047321 - DNA, 18 bp, Homo sapiens
ccatatgctaccaccagc

SEQ ID NO: 6047322 - DNA, 15 bp, Homo sapiens
ccatatgctccagga

SEQ ID NO: 6047323 - DNA, 12 bp, Homo sapiens
ccatatgctctt

SEQ ID NO: 6047324 - DNA, 16 bp, Homo sapiens
ccatatggacactgtg

SEQ ID NO: 6047325 - DNA, 18 bp, Homo sapiens
ccatatggacactgtgac

SEQ ID NO: 6047326 - DNA, 22 bp, Homo sapiens
ccatatggattttctattgtta

SEQ ID NO: 6047327 - DNA, 15 bp, Homo sapiens
ccatatgtctgcttc

SEQ ID NO: 6047328 - DNA, 19 bp, Homo sapiens
ccatatgtctgcttctgtc

SEQ ID NO: 6047329 - DNA, 22 bp, Homo sapiens
ccatattaaattttttgttgac

SEQ ID NO: 6047330 - DNA, 14 bp, Homo sapiens
ccatattaacaaat

SEQ ID NO: 6047331 - DNA, 20 bp, Homo sapiens
ccatattaacaaattgcatt

SEQ ID NO: 6047332 - DNA, 16 bp, Homo sapiens
ccatattaattgcctg

SEQ ID NO: 6047333 - DNA, 20 bp, Homo sapiens
ccatattaattgcctgttaa

SEQ ID NO: 6047334 - DNA, 19 bp, Homo sapiens
ccatattagaaaactttgt

SEQ ID NO: 6047335 - DNA, 16 bp, Homo sapiens
ccatattcacacctca

SEQ ID NO: 6047336 - DNA, 18 bp, Homo sapiens
ccatattctaaattcact

SEQ ID NO: 6047337 - DNA, 23 bp, Homo sapiens
ccatattctaagttagactcttc

SEQ ID NO: 6047338 - DNA, 18 bp, Homo sapiens
ccatattctggttcttga

SEQ ID NO: 6047339 - DNA, 19 bp, Homo sapiens
ccatattctgttggccagt

SEQ ID NO: 6047340 - DNA, 13 bp, Homo sapiens
ccatattgctctt

SEQ ID NO: 6047341 - DNA, 14 bp, Homo sapiens
ccatattgctctta

SEQ ID NO: 6047342 - DNA, 22 bp, Homo sapiens
ccatattggcatggatttctgt

SEQ ID NO: 6047343 - DNA, 14 bp, Homo sapiens
ccatattggccagt

SEQ ID NO: 6047344 - DNA, 19 bp, Homo sapiens
ccatatttaataatgcttt

SEQ ID NO: 6047345 - DNA, 22 bp, Homo sapiens
ccatatttacattctagttcag

SEQ ID NO: 6047346 - DNA, 17 bp, Homo sapiens
ccatatttacctcagcc

SEQ ID NO: 6047347 - DNA, 16 bp, Homo sapiens
ccatatttgaattggc

SEQ ID NO: 6047348 - DNA, 16 bp, Homo sapiens
ccatatttgatttcta

SEQ ID NO: 6047349 - DNA, 12 bp, Homo sapiens
ccatatttgtaa

SEQ ID NO: 6047350 - DNA, 14 bp, Homo sapiens
ccatatttgtaaaa

SEQ ID NO: 6047351 - DNA, 17 bp, Homo sapiens
ccatatttgtaaaatga

SEQ ID NO: 6047352 - DNA, 23 bp, Homo sapiens
ccatatttgtcataatttttcct

SEQ ID NO: 6047353 - DNA, 14 bp, Homo sapiens
ccatatttgtgttc

SEQ ID NO: 6047354 - DNA, 17 bp, Homo sapiens
ccatattttaaaaaatc

SEQ ID NO: 6047355 - DNA, 20 bp, Homo sapiens
ccatattttaaaaaatcaaa

SEQ ID NO: 6047356 - DNA, 21 bp, Homo sapiens
ccatattttattgtattttga

SEQ ID NO: 6047357 - DNA, 15 bp, Homo sapiens
ccatatttttttcct

SEQ ID NO: 6047358 - DNA, 16 bp, Homo sapiens
ccatatttttttcctt

SEQ ID NO: 6047359 - DNA, 16 bp, Homo sapiens
ccatcaaaatgctttt

SEQ ID NO: 6047360 - DNA, 21 bp, Homo sapiens
ccatcaaacctcacatttgtg

SEQ ID NO: 6047361 - DNA, 13 bp, Homo sapiens
ccatcaaagagaa

SEQ ID NO: 6047362 - DNA, 17 bp, Homo sapiens
ccatcaaaggaatataa

SEQ ID NO: 6047363 - DNA, 12 bp, Homo sapiens
ccatcaaatgct

SEQ ID NO: 6047364 - DNA, 18 bp, Homo sapiens
ccatcaacaaaaattgtc

SEQ ID NO: 6047365 - DNA, 13 bp, Homo sapiens
ccatcaacctctg

SEQ ID NO: 6047366 - DNA, 20 bp, Homo sapiens
ccatcaactaaaacattata

SEQ ID NO: 6047367 - DNA, 23 bp, Homo sapiens
ccatcaactcccaacttcttcct

SEQ ID NO: 6047368 - DNA, 20 bp, Homo sapiens
ccatcaagaacctacagact

SEQ ID NO: 6047369 - DNA, 22 bp, Homo sapiens
ccatcaagaacctacagactcc

SEQ ID NO: 6047370 - DNA, 12 bp, Homo sapiens
ccatcaagcact

SEQ ID NO: 6047371 - DNA, 14 bp, Homo sapiens
ccatcaagcacttc

SEQ ID NO: 6047372 - DNA, 17 bp, Homo sapiens
ccatcaagcacttccca

SEQ ID NO: 6047373 - DNA, 12 bp, Homo sapiens
ccatcaagccac

SEQ ID NO: 6047374 - DNA, 16 bp, Homo sapiens
ccatcaagccaccaac

SEQ ID NO: 6047375 - DNA, 18 bp, Homo sapiens
ccatcaagggtacactgc

SEQ ID NO: 6047376 - DNA, 15 bp, Homo sapiens
ccatcaaggtccagt

SEQ ID NO: 6047377 - DNA, 18 bp, Homo sapiens
ccatcaaggtccagtgga

SEQ ID NO: 6047378 - DNA, 19 bp, Homo sapiens
ccatcaaggtccagtggaa

SEQ ID NO: 6047379 - DNA, 17 bp, Homo sapiens
ccatcaatggaaacagg

SEQ ID NO: 6047380 - DNA, 16 bp, Homo sapiens
ccatcacaatacagat

SEQ ID NO: 6047381 - DNA, 14 bp, Homo sapiens
ccatcacagccagc

SEQ ID NO: 6047382 - DNA, 20 bp, Homo sapiens
ccatcacaggatgccagccc

SEQ ID NO: 6047383 - DNA, 13 bp, Homo sapiens
ccatcacagggtt

SEQ ID NO: 6047384 - DNA, 20 bp, Homo sapiens
ccatcacagggttgggccca

SEQ ID NO: 6047385 - DNA, 17 bp, Homo sapiens
ccatcaccaccgcctct

SEQ ID NO: 6047386 - DNA, 20 bp, Homo sapiens
ccatcaccaccgcctctggc

SEQ ID NO: 6047387 - DNA, 17 bp, Homo sapiens
ccatcaccacgcagaga

SEQ ID NO: 6047388 - DNA, 13 bp, Homo sapiens
ccatcacccaagc

SEQ ID NO: 6047389 - DNA, 17 bp, Homo sapiens
ccatcacccctggtggc

SEQ ID NO: 6047390 - DNA, 23 bp, Homo sapiens
ccatcaccccttccccatttcct

SEQ ID NO: 6047391 - DNA, 16 bp, Homo sapiens
ccatcaccctcaccca

SEQ ID NO: 6047392 - DNA, 18 bp, Homo sapiens
ccatcaccctcacccact

SEQ ID NO: 6047393 - DNA, 18 bp, Homo sapiens
ccatcaccctcttcctgt

SEQ ID NO: 6047394 - DNA, 15 bp, Homo sapiens
ccatcaccctttccg

SEQ ID NO: 6047395 - DNA, 15 bp, Homo sapiens
ccatcaccgctgggt

SEQ ID NO: 6047396 - DNA, 21 bp, Homo sapiens
ccatcacctactcacacaggc

SEQ ID NO: 6047397 - DNA, 14 bp, Homo sapiens
ccatcacctctact

SEQ ID NO: 6047398 - DNA, 11 bp, Homo sapiens
ccatcacctga

SEQ ID NO: 6047399 - DNA, 21 bp, Homo sapiens
ccatcacctgaaacactggac

SEQ ID NO: 6047400 - DNA, 20 bp, Homo sapiens
ccatcactagagtgctctga

SEQ ID NO: 6047401 - DNA, 16 bp, Homo sapiens
ccatcactattcaagg

SEQ ID NO: 6047402 - DNA, 15 bp, Homo sapiens
ccatcactcactcac

SEQ ID NO: 6047403 - DNA, 22 bp, Homo sapiens
ccatcactcactcactccccac

SEQ ID NO: 6047404 - DNA, 14 bp, Homo sapiens
ccatcactcagccc

SEQ ID NO: 6047405 - DNA, 15 bp, Homo sapiens
ccatcactcagcccc

SEQ ID NO: 6047406 - DNA, 20 bp, Homo sapiens
ccatcactcagcccctaccc

SEQ ID NO: 6047407 - DNA, 21 bp, Homo sapiens
ccatcactcgcaggaccaagg

SEQ ID NO: 6047408 - DNA, 15 bp, Homo sapiens
ccatcactgagtggc

SEQ ID NO: 6047409 - DNA, 22 bp, Homo sapiens
ccatcactgctgtccctcctga

SEQ ID NO: 6047410 - DNA, 20 bp, Homo sapiens
ccatcacttctccccgcagc

SEQ ID NO: 6047411 - DNA, 20 bp, Homo sapiens
ccatcagaaacaccctcaca

SEQ ID NO: 6047412 - DNA, 19 bp, Homo sapiens
ccatcagaaattttctaca

SEQ ID NO: 6047413 - DNA, 17 bp, Homo sapiens
ccatcagaacctgagct

SEQ ID NO: 6047414 - DNA, 21 bp, Homo sapiens
ccatcagagatgggaaaacca

SEQ ID NO: 6047415 - DNA, 15 bp, Homo sapiens
ccatcagaggctggg

SEQ ID NO: 6047416 - DNA, 18 bp, Homo sapiens
ccatcagatgtgttcctc

SEQ ID NO: 6047417 - DNA, 14 bp, Homo sapiens
ccatcagcagtgat

SEQ ID NO: 6047418 - DNA, 17 bp, Homo sapiens
ccatcagcccctgctgc

SEQ ID NO: 6047419 - DNA, 19 bp, Homo sapiens
ccatcagcccctgctgctc

SEQ ID NO: 6047420 - DNA, 12 bp, Homo sapiens
ccatcagccctg

SEQ ID NO: 6047421 - DNA, 14 bp, Homo sapiens
ccatcagccctgct

SEQ ID NO: 6047422 - DNA, 15 bp, Homo sapiens
ccatcagccctgcta

SEQ ID NO: 6047423 - DNA, 13 bp, Homo sapiens
ccatcagcctcca

SEQ ID NO: 6047424 - DNA, 20 bp, Homo sapiens
ccatcagcctgttccagaag

SEQ ID NO: 6047425 - DNA, 23 bp, Homo sapiens
ccatcagctacccctgcagctgg

SEQ ID NO: 6047426 - DNA, 16 bp, Homo sapiens
ccatcagctctgcctt

SEQ ID NO: 6047427 - DNA, 13 bp, Homo sapiens
ccatcagctgcca

SEQ ID NO: 6047428 - DNA, 21 bp, Homo sapiens
ccatcagcttaggggctgctg

SEQ ID NO: 6047429 - DNA, 20 bp, Homo sapiens
ccatcaggaccactcagtta

SEQ ID NO: 6047430 - DNA, 15 bp, Homo sapiens
ccatcaggactttcc

SEQ ID NO: 6047431 - DNA, 19 bp, Homo sapiens
ccatcaggactttccctga

SEQ ID NO: 6047432 - DNA, 16 bp, Homo sapiens
ccatcaggggcaggaa

SEQ ID NO: 6047433 - DNA, 13 bp, Homo sapiens
ccatcagggtggg

SEQ ID NO: 6047434 - DNA, 19 bp, Homo sapiens
ccatcagggttctcttagc

SEQ ID NO: 6047435 - DNA, 12 bp, Homo sapiens
ccatcagtctag

SEQ ID NO: 6047436 - DNA, 15 bp, Homo sapiens
ccatcagtgctctgt

SEQ ID NO: 6047437 - DNA, 16 bp, Homo sapiens
ccatcagtgctctgta

SEQ ID NO: 6047438 - DNA, 18 bp, Homo sapiens
ccatcagtggagtccaga

SEQ ID NO: 6047439 - DNA, 14 bp, Homo sapiens
ccatcagttactgg

SEQ ID NO: 6047440 - DNA, 16 bp, Homo sapiens
ccatcagttagagctg

SEQ ID NO: 6047441 - DNA, 16 bp, Homo sapiens
ccatcagttcccccag

SEQ ID NO: 6047442 - DNA, 20 bp, Homo sapiens
ccatcagttcccccagtacc

SEQ ID NO: 6047443 - DNA, 21 bp, Homo sapiens
ccatcatatcctttgccccaa

SEQ ID NO: 6047444 - DNA, 21 bp, Homo sapiens
ccatcatcaccgattcttcct

SEQ ID NO: 6047445 - DNA, 15 bp, Homo sapiens
ccatcatcactgtaa

SEQ ID NO: 6047446 - DNA, 18 bp, Homo sapiens
ccatcatcactgtaaaga

SEQ ID NO: 6047447 - DNA, 16 bp, Homo sapiens
ccatcatcccagctgc

SEQ ID NO: 6047448 - DNA, 16 bp, Homo sapiens
ccatcatcctctggct

SEQ ID NO: 6047449 - DNA, 17 bp, Homo sapiens
ccatcatcctttgttct

SEQ ID NO: 6047450 - DNA, 23 bp, Homo sapiens
ccatcatcctttgttctgagcat

SEQ ID NO: 6047451 - DNA, 17 bp, Homo sapiens
ccatcatctctgccttt

SEQ ID NO: 6047452 - DNA, 22 bp, Homo sapiens
ccatcatctcttttcccactcc

SEQ ID NO: 6047453 - DNA, 13 bp, Homo sapiens
ccatcatctgctg

SEQ ID NO: 6047454 - DNA, 20 bp, Homo sapiens
ccatcatctgctgcacatag

SEQ ID NO: 6047455 - DNA, 13 bp, Homo sapiens
ccatcatgccctc

SEQ ID NO: 6047456 - DNA, 16 bp, Homo sapiens
ccatcatgccctctct

SEQ ID NO: 6047457 - DNA, 20 bp, Homo sapiens
ccatcatgccttgataaata

SEQ ID NO: 6047458 - DNA, 19 bp, Homo sapiens
ccatcatggggggagcacc

SEQ ID NO: 6047459 - DNA, 14 bp, Homo sapiens
ccatcatgtcccca

SEQ ID NO: 6047460 - DNA, 14 bp, Homo sapiens
ccatcatgtctggc

SEQ ID NO: 6047461 - DNA, 20 bp, Homo sapiens
ccatcatgtgcctggaaatt

SEQ ID NO: 6047462 - DNA, 22 bp, Homo sapiens
ccatcattgaaatctttttgct

SEQ ID NO: 6047463 - DNA, 18 bp, Homo sapiens
ccatcattgcacctgcag

SEQ ID NO: 6047464 - DNA, 18 bp, Homo sapiens
ccatcattgctgtctgca

SEQ ID NO: 6047465 - DNA, 12 bp, Homo sapiens
ccatcatttcat

SEQ ID NO: 6047466 - DNA, 16 bp, Homo sapiens
ccatcattttacagtg

SEQ ID NO: 6047467 - DNA, 15 bp, Homo sapiens
ccatccaaacactga

SEQ ID NO: 6047468 - DNA, 20 bp, Homo sapiens
ccatccaaataagaaaccta

SEQ ID NO: 6047469 - DNA, 18 bp, Homo sapiens
ccatccaaccactgtaca

SEQ ID NO: 6047470 - DNA, 13 bp, Homo sapiens
ccatccaataaaa

SEQ ID NO: 6047471 - DNA, 19 bp, Homo sapiens
ccatccacaccctctcctt

SEQ ID NO: 6047472 - DNA, 18 bp, Homo sapiens
ccatccacagttgtcagt

SEQ ID NO: 6047473 - DNA, 16 bp, Homo sapiens
ccatccacatgggtac

SEQ ID NO: 6047474 - DNA, 13 bp, Homo sapiens
ccatccaccctga

SEQ ID NO: 6047475 - DNA, 15 bp, Homo sapiens
ccatccaccctgagg

SEQ ID NO: 6047476 - DNA, 16 bp, Homo sapiens
ccatccaccctgagga

SEQ ID NO: 6047477 - DNA, 17 bp, Homo sapiens
ccatccaccctgaggag

SEQ ID NO: 6047478 - DNA, 22 bp, Homo sapiens
ccatccactctaccctcccacc

SEQ ID NO: 6047479 - DNA, 23 bp, Homo sapiens
ccatccactgggtgtaaacacat

SEQ ID NO: 6047480 - DNA, 16 bp, Homo sapiens
ccatccagacctggct

SEQ ID NO: 6047481 - DNA, 18 bp, Homo sapiens
ccatccagacctggctcc

SEQ ID NO: 6047482 - DNA, 22 bp, Homo sapiens
ccatccagaggaataaaaaggt

SEQ ID NO: 6047483 - DNA, 22 bp, Homo sapiens
ccatccagcatgtgtgtgtctc

SEQ ID NO: 6047484 - DNA, 13 bp, Homo sapiens
ccatccagccacg

SEQ ID NO: 6047485 - DNA, 19 bp, Homo sapiens
ccatccagccacggaggga

SEQ ID NO: 6047486 - DNA, 14 bp, Homo sapiens
ccatccagccagac

SEQ ID NO: 6047487 - DNA, 13 bp, Homo sapiens
ccatccagccagg

SEQ ID NO: 6047488 - DNA, 13 bp, Homo sapiens
ccatccagcctcc

SEQ ID NO: 6047489 - DNA, 14 bp, Homo sapiens
ccatccagcctcca

SEQ ID NO: 6047490 - DNA, 16 bp, Homo sapiens
ccatccagcctccagg

SEQ ID NO: 6047491 - DNA, 17 bp, Homo sapiens
ccatccagcctccaggg

SEQ ID NO: 6047492 - DNA, 18 bp, Homo sapiens
ccatccagcctccagggc

SEQ ID NO: 6047493 - DNA, 14 bp, Homo sapiens
ccatccagctcccc

SEQ ID NO: 6047494 - DNA, 13 bp, Homo sapiens
ccatccagcttgc

SEQ ID NO: 6047495 - DNA, 12 bp, Homo sapiens
ccatccaggcag

SEQ ID NO: 6047496 - DNA, 11 bp, Homo sapiens
ccatccagggt

SEQ ID NO: 6047497 - DNA, 14 bp, Homo sapiens
ccatccagggtctg

SEQ ID NO: 6047498 - DNA, 19 bp, Homo sapiens
ccatccagggtctggcaga

SEQ ID NO: 6047499 - DNA, 21 bp, Homo sapiens
ccatccagggtctggcagagc

SEQ ID NO: 6047500 - DNA, 20 bp, Homo sapiens
cattcccagggaccttggaa

SEQ ID NO: 6047501 - DNA, 18 bp, Homo sapiens
cattcccatcactgctgt

SEQ ID NO: 6047502 - DNA, 22 bp, Homo sapiens
cattcccatgaatatcaagaat

SEQ ID NO: 6047503 - DNA, 19 bp, Homo sapiens
cattcccatggtggcctca

SEQ ID NO: 6047504 - DNA, 18 bp, Homo sapiens
cattcccatgtggaacag

SEQ ID NO: 6047505 - DNA, 21 bp, Homo sapiens
cattccccaacggggtgggga

SEQ ID NO: 6047506 - DNA, 22 bp, Homo sapiens
cattccccaattatcttattta

SEQ ID NO: 6047507 - DNA, 13 bp, Homo sapiens
cattccccaggag

SEQ ID NO: 6047508 - DNA, 17 bp, Homo sapiens
cattccccaggaggcca

SEQ ID NO: 6047509 - DNA, 13 bp, Homo sapiens
cattccccaggtg

SEQ ID NO: 6047510 - DNA, 17 bp, Homo sapiens
cattccccaggtggctg

SEQ ID NO: 6047511 - DNA, 19 bp, Homo sapiens
cattccccattctgtgtcc

SEQ ID NO: 6047512 - DNA, 19 bp, Homo sapiens
cattcccccaccagctgca

SEQ ID NO: 6047513 - DNA, 19 bp, Homo sapiens
cattcccccatgtggctga

SEQ ID NO: 6047514 - DNA, 21 bp, Homo sapiens
cattcccccatgtggctgaag

SEQ ID NO: 6047515 - DNA, 17 bp, Homo sapiens
cattcccccggtgcctc

SEQ ID NO: 6047516 - DNA, 18 bp, Homo sapiens
cattcccccttcaacaaa

SEQ ID NO: 6047517 - DNA, 16 bp, Homo sapiens
cattcccccttcctag

SEQ ID NO: 6047518 - DNA, 17 bp, Homo sapiens
cattccccgacactgcc

SEQ ID NO: 6047519 - DNA, 23 bp, Homo sapiens
cattcccctcccacctctccttt

SEQ ID NO: 6047520 - DNA, 16 bp, Homo sapiens
cattcccctttgcact

SEQ ID NO: 6047521 - DNA, 18 bp, Homo sapiens
cattccctacaattcaca

SEQ ID NO: 6047522 - DNA, 16 bp, Homo sapiens
cattccctacagccta

SEQ ID NO: 6047523 - DNA, 20 bp, Homo sapiens
cattccctacagcctagggc

SEQ ID NO: 6047524 - DNA, 24 bp, Homo sapiens
cattccctatcaaaacatatcaat

SEQ ID NO: 6047525 - DNA, 14 bp, Homo sapiens
cattccctccaccc

SEQ ID NO: 6047526 - DNA, 22 bp, Homo sapiens
cattccctccacccacttgcct

SEQ ID NO: 6047527 - DNA, 22 bp, Homo sapiens
cattccctcgggaccctcccag

SEQ ID NO: 6047528 - DNA, 15 bp, Homo sapiens
cattccctctcctgc

SEQ ID NO: 6047529 - DNA, 20 bp, Homo sapiens
cattccctctcctgcccaga

SEQ ID NO: 6047530 - DNA, 18 bp, Homo sapiens
cattccctgagtcaccag

SEQ ID NO: 6047531 - DNA, 15 bp, Homo sapiens
cattccctgcatcca

SEQ ID NO: 6047532 - DNA, 10 bp, Homo sapiens
cattccctgg

SEQ ID NO: 6047533 - DNA, 15 bp, Homo sapiens
cattccctggaattg

SEQ ID NO: 6047534 - DNA, 14 bp, Homo sapiens
cattccctggcctg

SEQ ID NO: 6047535 - DNA, 18 bp, Homo sapiens
cattccctggcctggctc

SEQ ID NO: 6047536 - DNA, 14 bp, Homo sapiens
cattccctgtagga

SEQ ID NO: 6047537 - DNA, 18 bp, Homo sapiens
cattcccttctctcagcc

SEQ ID NO: 6047538 - DNA, 20 bp, Homo sapiens
cattcccttggatgtagtct

SEQ ID NO: 6047539 - DNA, 16 bp, Homo sapiens
cattccggactggcag

SEQ ID NO: 6047540 - DNA, 19 bp, Homo sapiens
cattccggactggcagaag

SEQ ID NO: 6047541 - DNA, 21 bp, Homo sapiens
cattccggactggcagaagca

SEQ ID NO: 6047542 - DNA, 23 bp, Homo sapiens
cattccgttaggaataacactgc

SEQ ID NO: 6047543 - DNA, 19 bp, Homo sapiens
cattcctaaaacacccttc

SEQ ID NO: 6047544 - DNA, 20 bp, Homo sapiens
cattcctaacacagcatgtg

SEQ ID NO: 6047545 - DNA, 21 bp, Homo sapiens
cattcctaacacagcatgtgt

SEQ ID NO: 6047546 - DNA, 23 bp, Homo sapiens
cattcctaacacagcatgtgtat

SEQ ID NO: 6047547 - DNA, 22 bp, Homo sapiens
cattcctaatcaaattctgtct

SEQ ID NO: 6047548 - DNA, 22 bp, Homo sapiens
cattcctagagagcagaaataa

SEQ ID NO: 6047549 - DNA, 19 bp, Homo sapiens
cattcctatagtactttat

SEQ ID NO: 6047550 - DNA, 14 bp, Homo sapiens
cattcctcagctgc

SEQ ID NO: 6047551 - DNA, 16 bp, Homo sapiens
cattcctcagctgcca

SEQ ID NO: 6047552 - DNA, 14 bp, Homo sapiens
cattcctccagcct

SEQ ID NO: 6047553 - DNA, 16 bp, Homo sapiens
cattcctccagcctcc

SEQ ID NO: 6047554 - DNA, 13 bp, Homo sapiens
cattcctccaggt

SEQ ID NO: 6047555 - DNA, 18 bp, Homo sapiens
cattcctcccattcaaga

SEQ ID NO: 6047556 - DNA, 14 bp, Homo sapiens
cattcctctgccct

SEQ ID NO: 6047557 - DNA, 13 bp, Homo sapiens
cattcctgaagaa

SEQ ID NO: 6047558 - DNA, 17 bp, Homo sapiens
cattcctgaccctcact

SEQ ID NO: 6047559 - DNA, 16 bp, Homo sapiens
cattcctgagattctg

SEQ ID NO: 6047560 - DNA, 19 bp, Homo sapiens
cattcctgagattctggga

SEQ ID NO: 6047561 - DNA, 14 bp, Homo sapiens
cattcctgatgctt

SEQ ID NO: 6047562 - DNA, 16 bp, Homo sapiens
cattcctgatgcttct

SEQ ID NO: 6047563 - DNA, 21 bp, Homo sapiens
cattcctgatggaattgttat

SEQ ID NO: 6047564 - DNA, 12 bp, Homo sapiens
cattcctgcctg

SEQ ID NO: 6047565 - DNA, 14 bp, Homo sapiens
cattcctgcctgtc

SEQ ID NO: 6047566 - DNA, 19 bp, Homo sapiens
cattcctgcctttaagcca

SEQ ID NO: 6047567 - DNA, 15 bp, Homo sapiens
cattcctggagcccg

SEQ ID NO: 6047568 - DNA, 12 bp, Homo sapiens
cattcctggccc

SEQ ID NO: 6047569 - DNA, 14 bp, Homo sapiens
cattcctgggcaca

SEQ ID NO: 6047570 - DNA, 15 bp, Homo sapiens
cattcctggtaccca

SEQ ID NO: 6047571 - DNA, 18 bp, Homo sapiens
cattcctggtacccagcc

SEQ ID NO: 6047572 - DNA, 20 bp, Homo sapiens
cattcctggtacccagccat

SEQ ID NO: 6047573 - DNA, 15 bp, Homo sapiens
cattcctgtcaacaa

SEQ ID NO: 6047574 - DNA, 20 bp, Homo sapiens
cattcctgtcagagctttca

SEQ ID NO: 6047575 - DNA, 18 bp, Homo sapiens
cattcctgttctctttgc

SEQ ID NO: 6047576 - DNA, 23 bp, Homo sapiens
cattcctgttctctttgccttga

SEQ ID NO: 6047577 - DNA, 15 bp, Homo sapiens
cattccttacttgca

SEQ ID NO: 6047578 - DNA, 18 bp, Homo sapiens
cattccttacttgcactg

SEQ ID NO: 6047579 - DNA, 19 bp, Homo sapiens
cattccttagcagctcagg

SEQ ID NO: 6047580 - DNA, 20 bp, Homo sapiens
cattccttagcagctcaggc

SEQ ID NO: 6047581 - DNA, 15 bp, Homo sapiens
cattccttcaaataa

SEQ ID NO: 6047582 - DNA, 18 bp, Homo sapiens
cattccttcaaataaaga

SEQ ID NO: 6047583 - DNA, 21 bp, Homo sapiens
cattccttctggcctctgctg

SEQ ID NO: 6047584 - DNA, 16 bp, Homo sapiens
cattccttctttgata

SEQ ID NO: 6047585 - DNA, 23 bp, Homo sapiens
cattccttctttgataatgttaa

SEQ ID NO: 6047586 - DNA, 13 bp, Homo sapiens
cattccttctttt

SEQ ID NO: 6047587 - DNA, 15 bp, Homo sapiens
cattccttgataatg

SEQ ID NO: 6047588 - DNA, 15 bp, Homo sapiens
cattccttgtcacca

SEQ ID NO: 6047589 - DNA, 16 bp, Homo sapiens
cattccttgtcaccag

SEQ ID NO: 6047590 - DNA, 12 bp, Homo sapiens
cattcctttggg

SEQ ID NO: 6047591 - DNA, 22 bp, Homo sapiens
cattcgaatctctgcccctcac

SEQ ID NO: 6047592 - DNA, 17 bp, Homo sapiens
cattcgacataccccac

SEQ ID NO: 6047593 - DNA, 19 bp, Homo sapiens
cattcgacataccccactg

SEQ ID NO: 6047594 - DNA, 18 bp, Homo sapiens
cattcgaggtgtcaccct

SEQ ID NO: 6047595 - DNA, 23 bp, Homo sapiens
cattcgaggtgtcaccctgcaga

SEQ ID NO: 6047596 - DNA, 13 bp, Homo sapiens
cattcgcagcagc

SEQ ID NO: 6047597 - DNA, 16 bp, Homo sapiens
cattcgcctttgtctt

SEQ ID NO: 6047598 - DNA, 21 bp, Homo sapiens
cattcgctgtaccctttaaga

SEQ ID NO: 6047599 - DNA, 13 bp, Homo sapiens
cattcggctccct

SEQ ID NO: 6047600 - DNA, 18 bp, Homo sapiens
cattcggctccctggagc

SEQ ID NO: 6047601 - DNA, 16 bp, Homo sapiens
cattcgggaccaatat

SEQ ID NO: 6047602 - DNA, 15 bp, Homo sapiens
cattcgggccacagg

SEQ ID NO: 6047603 - DNA, 22 bp, Homo sapiens
cattcggggtgatcctgttctg

SEQ ID NO: 6047604 - DNA, 13 bp, Homo sapiens
cattcgtgaaaac

SEQ ID NO: 6047605 - DNA, 20 bp, Homo sapiens
cattcgtgggcctgctgctc

SEQ ID NO: 6047606 - DNA, 21 bp, Homo sapiens
cattcgtgggcctgctgctct

SEQ ID NO: 6047607 - DNA, 18 bp, Homo sapiens
cattcgtggttgatttca

SEQ ID NO: 6047608 - DNA, 14 bp, Homo sapiens
cattcgttctgtgg

SEQ ID NO: 6047609 - DNA, 21 bp, Homo sapiens
cattcgttgtgttttttaaga

SEQ ID NO: 6047610 - DNA, 14 bp, Homo sapiens
cattctaaaacaca

SEQ ID NO: 6047611 - DNA, 16 bp, Homo sapiens
cattctaaatgaactc

SEQ ID NO: 6047612 - DNA, 13 bp, Homo sapiens
cattctacagttg

SEQ ID NO: 6047613 - DNA, 14 bp, Homo sapiens
cattctacttcagc

SEQ ID NO: 6047614 - DNA, 11 bp, Homo sapiens
cattctacttg

SEQ ID NO: 6047615 - DNA, 13 bp, Homo sapiens
cattctagatcct

SEQ ID NO: 6047616 - DNA, 17 bp, Homo sapiens
cattctaggctcactgc

SEQ ID NO: 6047617 - DNA, 23 bp, Homo sapiens
cattctaggtaggggcccacttc

SEQ ID NO: 6047618 - DNA, 14 bp, Homo sapiens
cattctagttcaga

SEQ ID NO: 6047619 - DNA, 17 bp, Homo sapiens
cattctatcaagcccag

SEQ ID NO: 6047620 - DNA, 22 bp, Homo sapiens
cattctatccccaatcagctcc

SEQ ID NO: 6047621 - DNA, 23 bp, Homo sapiens
cattctatccccaatcagctcct

SEQ ID NO: 6047622 - DNA, 22 bp, Homo sapiens
cattctatcgttattataaatg

SEQ ID NO: 6047623 - DNA, 23 bp, Homo sapiens
cattctatcgttattataaatgt

SEQ ID NO: 6047624 - DNA, 18 bp, Homo sapiens
cattctatctactgattt

SEQ ID NO: 6047625 - DNA, 15 bp, Homo sapiens
cattctattctccag

SEQ ID NO: 6047626 - DNA, 18 bp, Homo sapiens
cattctattgccttcttt

SEQ ID NO: 6047627 - DNA, 20 bp, Homo sapiens
cattctattgccttctttga

SEQ ID NO: 6047628 - DNA, 21 bp, Homo sapiens
cattctattgccttctttgaa

SEQ ID NO: 6047629 - DNA, 14 bp, Homo sapiens
cattctattgttaa

SEQ ID NO: 6047630 - DNA, 21 bp, Homo sapiens
cattctcaagggacgtcctcc

SEQ ID NO: 6047631 - DNA, 22 bp, Homo sapiens
cattctcaagggacgtcctcca

SEQ ID NO: 6047632 - DNA, 16 bp, Homo sapiens
cattctcacaattgta

SEQ ID NO: 6047633 - DNA, 20 bp, Homo sapiens
cattctcacaggtcccaaat

SEQ ID NO: 6047634 - DNA, 21 bp, Homo sapiens
cattctcacctaaaccctctg

SEQ ID NO: 6047635 - DNA, 23 bp, Homo sapiens
cattctcacctaaaccctctgtg

SEQ ID NO: 6047636 - DNA, 13 bp, Homo sapiens
cattctcagtttt

SEQ ID NO: 6047637 - DNA, 16 bp, Homo sapiens
cattctcataattcct

SEQ ID NO: 6047638 - DNA, 18 bp, Homo sapiens
cattctcataattcctac

SEQ ID NO: 6047639 - DNA, 19 bp, Homo sapiens
cattctcataattcctaca

SEQ ID NO: 6047640 - DNA, 20 bp, Homo sapiens
cattctcatatgtagccctc

SEQ ID NO: 6047641 - DNA, 14 bp, Homo sapiens
cattctcatccaaa

SEQ ID NO: 6047642 - DNA, 14 bp, Homo sapiens
cattctcatctgca

SEQ ID NO: 6047643 - DNA, 17 bp, Homo sapiens
cattctcatctgcaccc

SEQ ID NO: 6047644 - DNA, 19 bp, Homo sapiens
cattctcatggagaagtta

SEQ ID NO: 6047645 - DNA, 13 bp, Homo sapiens
cattctcattgca

SEQ ID NO: 6047646 - DNA, 19 bp, Homo sapiens
cattctcattgcagaataa

SEQ ID NO: 6047647 - DNA, 17 bp, Homo sapiens
cattctccacagcaacc

SEQ ID NO: 6047648 - DNA, 18 bp, Homo sapiens
cattctccacagcaaccc

SEQ ID NO: 6047649 - DNA, 14 bp, Homo sapiens
cattctccacctgc

SEQ ID NO: 6047650 - DNA, 16 bp, Homo sapiens
cattctccacctgcca

SEQ ID NO: 6047651 - DNA, 21 bp, Homo sapiens
cattctccacctgccagggac

SEQ ID NO: 6047652 - DNA, 12 bp, Homo sapiens
cattctcccagc

SEQ ID NO: 6047653 - DNA, 13 bp, Homo sapiens
cattctcccagct

SEQ ID NO: 6047654 - DNA, 14 bp, Homo sapiens
cattctcccagctc

SEQ ID NO: 6047655 - DNA, 15 bp, Homo sapiens
cattctcccagctct

SEQ ID NO: 6047656 - DNA, 12 bp, Homo sapiens
cattctcccagt

SEQ ID NO: 6047657 - DNA, 15 bp, Homo sapiens
cattctcccagtctc

SEQ ID NO: 6047658 - DNA, 12 bp, Homo sapiens
cattctccccag

SEQ ID NO: 6047659 - DNA, 16 bp, Homo sapiens
cattctccctccatgg

SEQ ID NO: 6047660 - DNA, 23 bp, Homo sapiens
cattctccctccatggcaggaag

SEQ ID NO: 6047661 - DNA, 21 bp, Homo sapiens
cattctcctatcacctgtctt

SEQ ID NO: 6047662 - DNA, 22 bp, Homo sapiens
cattctcctgcctcagcctcct

SEQ ID NO: 6047663 - DNA, 23 bp, Homo sapiens
cattctcctgcctcagcctcctg

SEQ ID NO: 6047664 - DNA, 23 bp, Homo sapiens
cattctcctgcctgtagcagtga

SEQ ID NO: 6047665 - DNA, 15 bp, Homo sapiens
cattctcctgtgccc

SEQ ID NO: 6047666 - DNA, 16 bp, Homo sapiens
cattctccttgtgtta

SEQ ID NO: 6047667 - DNA, 16 bp, Homo sapiens
cattctcgcttccctg

SEQ ID NO: 6047668 - DNA, 18 bp, Homo sapiens
cattctcggtacttctgt

SEQ ID NO: 6047669 - DNA, 19 bp, Homo sapiens
cattctcgtgagtcattta

SEQ ID NO: 6047670 - DNA, 23 bp, Homo sapiens
cattctcgtgagtcatttaaatg

SEQ ID NO: 6047671 - DNA, 19 bp, Homo sapiens
cattctctaagcctggctt

SEQ ID NO: 6047672 - DNA, 20 bp, Homo sapiens
cattctctaatatccacttg

SEQ ID NO: 6047673 - DNA, 18 bp, Homo sapiens
cattctctatgtactatg

SEQ ID NO: 6047674 - DNA, 17 bp, Homo sapiens
cattctctattgtaatt

SEQ ID NO: 6047675 - DNA, 17 bp, Homo sapiens
cattctctcccatcctg

SEQ ID NO: 6047676 - DNA, 13 bp, Homo sapiens
cattctctctgcc

SEQ ID NO: 6047677 - DNA, 19 bp, Homo sapiens
cattctctcttcctgcagt

SEQ ID NO: 6047678 - DNA, 22 bp, Homo sapiens
ccatccagggtctggcagagcc

SEQ ID NO: 6047679 - DNA, 14 bp, Homo sapiens
ccatccagtagaga

SEQ ID NO: 6047680 - DNA, 17 bp, Homo sapiens
ccatccatcagctccct

SEQ ID NO: 6047681 - DNA, 11 bp, Homo sapiens
ccatccatccc

SEQ ID NO: 6047682 - DNA, 13 bp, Homo sapiens
ccatccatcccta

SEQ ID NO: 6047683 - DNA, 14 bp, Homo sapiens
ccatccatctccag

SEQ ID NO: 6047684 - DNA, 14 bp, Homo sapiens
ccatccatctctct

SEQ ID NO: 6047685 - DNA, 16 bp, Homo sapiens
ccatccatctctctct

SEQ ID NO: 6047686 - DNA, 19 bp, Homo sapiens
ccatccatggagcacgagg

SEQ ID NO: 6047687 - DNA, 14 bp, Homo sapiens
ccatccatggccag

SEQ ID NO: 6047688 - DNA, 15 bp, Homo sapiens
ccatccatggccagc

SEQ ID NO: 6047689 - DNA, 16 bp, Homo sapiens
ccatccatggccagca

SEQ ID NO: 6047690 - DNA, 17 bp, Homo sapiens
ccatccatggccagcag

SEQ ID NO: 6047691 - DNA, 13 bp, Homo sapiens
ccatccattctcc

SEQ ID NO: 6047692 - DNA, 15 bp, Homo sapiens
ccatccattctcctc

SEQ ID NO: 6047693 - DNA, 16 bp, Homo sapiens
ccatcccaaccagtgc

SEQ ID NO: 6047694 - DNA, 21 bp, Homo sapiens
ccatcccaaccagtgccaagg

SEQ ID NO: 6047695 - DNA, 23 bp, Homo sapiens
ccatcccaaccagtgccaaggac

SEQ ID NO: 6047696 - DNA, 12 bp, Homo sapiens
ccatcccacacc

SEQ ID NO: 6047697 - DNA, 16 bp, Homo sapiens
ccatcccaccagcccc

SEQ ID NO: 6047698 - DNA, 14 bp, Homo sapiens
ccatcccaccccat

SEQ ID NO: 6047699 - DNA, 22 bp, Homo sapiens
ccatcccacccccgaccctgcc

SEQ ID NO: 6047700 - DNA, 13 bp, Homo sapiens
ccatcccactgat

SEQ ID NO: 6047701 - DNA, 17 bp, Homo sapiens
ccatcccactgctcccc

SEQ ID NO: 6047702 - DNA, 20 bp, Homo sapiens
ccatcccactgctcccccaa

SEQ ID NO: 6047703 - DNA, 21 bp, Homo sapiens
ccatcccagagggtgggcttc

SEQ ID NO: 6047704 - DNA, 23 bp, Homo sapiens
ccatcccagccttggcatctaga

SEQ ID NO: 6047705 - DNA, 16 bp, Homo sapiens
ccatcccaggatgggt

SEQ ID NO: 6047706 - DNA, 15 bp, Homo sapiens
ccatcccagtgtcct

SEQ ID NO: 6047707 - DNA, 19 bp, Homo sapiens
ccatcccatatgcctgggc

SEQ ID NO: 6047708 - DNA, 18 bp, Homo sapiens
ccatcccattttcatcct

SEQ ID NO: 6047709 - DNA, 20 bp, Homo sapiens
ccatcccattttcatcctga

SEQ ID NO: 6047710 - DNA, 16 bp, Homo sapiens
ccatccccaactccat

SEQ ID NO: 6047711 - DNA, 14 bp, Homo sapiens
ccatccccaccact

SEQ ID NO: 6047712 - DNA, 11 bp, Homo sapiens
ccatccccagg

SEQ ID NO: 6047713 - DNA, 13 bp, Homo sapiens
ccatccccaggtc

SEQ ID NO: 6047714 - DNA, 18 bp, Homo sapiens
ccatccccatcctccagc

SEQ ID NO: 6047715 - DNA, 22 bp, Homo sapiens
ccatccccatcctccagcttct

SEQ ID NO: 6047716 - DNA, 22 bp, Homo sapiens
ccatccccatcggccctgtccc

SEQ ID NO: 6047717 - DNA, 14 bp, Homo sapiens
ccatcccccactgc

SEQ ID NO: 6047718 - DNA, 19 bp, Homo sapiens
ccatcccccctcaccaggg

SEQ ID NO: 6047719 - DNA, 20 bp, Homo sapiens
ccatcccccctcaccagggg

SEQ ID NO: 6047720 - DNA, 21 bp, Homo sapiens
ccatcccccctcaccaggggc

SEQ ID NO: 6047721 - DNA, 20 bp, Homo sapiens
ccatccccctctcacgccac

SEQ ID NO: 6047722 - DNA, 14 bp, Homo sapiens
ccatccccgcagtg

SEQ ID NO: 6047723 - DNA, 16 bp, Homo sapiens
ccatcccctagaaatc

SEQ ID NO: 6047724 - DNA, 21 bp, Homo sapiens
ccatcccctcaacaccctgct

SEQ ID NO: 6047725 - DNA, 15 bp, Homo sapiens
ccatcccctccctgc

SEQ ID NO: 6047726 - DNA, 15 bp, Homo sapiens
ccatcccctgcctct

SEQ ID NO: 6047727 - DNA, 13 bp, Homo sapiens
ccatcccctggac

SEQ ID NO: 6047728 - DNA, 22 bp, Homo sapiens
ccatccccttcccccatcccta

SEQ ID NO: 6047729 - DNA, 13 bp, Homo sapiens
ccatcccctttcc

SEQ ID NO: 6047730 - DNA, 14 bp, Homo sapiens
ccatcccctttcct

SEQ ID NO: 6047731 - DNA, 15 bp, Homo sapiens
ccatcccctttcctc

SEQ ID NO: 6047732 - DNA, 18 bp, Homo sapiens
ccatcccctttcctcccc

SEQ ID NO: 6047733 - DNA, 20 bp, Homo sapiens
ccatcccctttcctccccac

SEQ ID NO: 6047734 - DNA, 21 bp, Homo sapiens
ccatcccctttcctccccacc

SEQ ID NO: 6047735 - DNA, 20 bp, Homo sapiens
ccatcccgaagccatcactt

SEQ ID NO: 6047736 - DNA, 22 bp, Homo sapiens
ccatcccgaagccatcacttct

SEQ ID NO: 6047737 - DNA, 20 bp, Homo sapiens
ccatcccgatgaacctgcat

SEQ ID NO: 6047738 - DNA, 20 bp, Homo sapiens
ccatcccgcttagcctgcct

SEQ ID NO: 6047739 - DNA, 21 bp, Homo sapiens
ccatcccgcttagcctgcctc

SEQ ID NO: 6047740 - DNA, 18 bp, Homo sapiens
ccatcccgtaagaccacc

SEQ ID NO: 6047741 - DNA, 17 bp, Homo sapiens
ccatcccgtttccctcc

SEQ ID NO: 6047742 - DNA, 22 bp, Homo sapiens
ccatccctaagaattcccagat

SEQ ID NO: 6047743 - DNA, 23 bp, Homo sapiens
ccatccctaagaattcccagata

SEQ ID NO: 6047744 - DNA, 13 bp, Homo sapiens
ccatccctgaaga

SEQ ID NO: 6047745 - DNA, 14 bp, Homo sapiens
ccatccctgaaggc

SEQ ID NO: 6047746 - DNA, 20 bp, Homo sapiens
ccatccctgaaggccccgcc

SEQ ID NO: 6047747 - DNA, 14 bp, Homo sapiens
ccatccctgatggc

SEQ ID NO: 6047748 - DNA, 13 bp, Homo sapiens
ccatccctgccac

SEQ ID NO: 6047749 - DNA, 13 bp, Homo sapiens
ccatccctgctct

SEQ ID NO: 6047750 - DNA, 15 bp, Homo sapiens
ccatccctgctctgg

SEQ ID NO: 6047751 - DNA, 12 bp, Homo sapiens
ccatccctgctt

SEQ ID NO: 6047752 - DNA, 13 bp, Homo sapiens
ccatccctgggcc

SEQ ID NO: 6047753 - DNA, 19 bp, Homo sapiens
ccatccctgggcccctcca

SEQ ID NO: 6047754 - DNA, 22 bp, Homo sapiens
ccatccctggtgaaagagtaaa

SEQ ID NO: 6047755 - DNA, 14 bp, Homo sapiens
ccatccctgtcctc

SEQ ID NO: 6047756 - DNA, 13 bp, Homo sapiens
ccatccctgtgag

SEQ ID NO: 6047757 - DNA, 13 bp, Homo sapiens
ccatccctgtggt

SEQ ID NO: 6047758 - DNA, 13 bp, Homo sapiens
ccatcccttcccc

SEQ ID NO: 6047759 - DNA, 18 bp, Homo sapiens
ccatcccttcctccccag

SEQ ID NO: 6047760 - DNA, 22 bp, Homo sapiens
ccatcccttcctccccagtcta

SEQ ID NO: 6047761 - DNA, 12 bp, Homo sapiens
ccatcccttggg

SEQ ID NO: 6047762 - DNA, 23 bp, Homo sapiens
ccatccctttccctcgctcgatt

SEQ ID NO: 6047763 - DNA, 15 bp, Homo sapiens
ccatcccttttcctg

SEQ ID NO: 6047764 - DNA, 18 bp, Homo sapiens
ccatcccttttcctgtca

SEQ ID NO: 6047765 - DNA, 18 bp, Homo sapiens
ccatcccttttcctttct

SEQ ID NO: 6047766 - DNA, 19 bp, Homo sapiens
ccatccctttttgaagtgt

SEQ ID NO: 6047767 - DNA, 16 bp, Homo sapiens
ccatccgactgcccct

SEQ ID NO: 6047768 - DNA, 21 bp, Homo sapiens
ccatccgactgcccctgctgt

SEQ ID NO: 6047769 - DNA, 22 bp, Homo sapiens
ccatccgactgcccctgctgtg

SEQ ID NO: 6047770 - DNA, 16 bp, Homo sapiens
ccatccgggacgcttc

SEQ ID NO: 6047771 - DNA, 19 bp, Homo sapiens
ccatccgggacgcttccag

SEQ ID NO: 6047772 - DNA, 22 bp, Homo sapiens
ccatccgggacgcttccagacc

SEQ ID NO: 6047773 - DNA, 14 bp, Homo sapiens
ccatccgtcaccag

SEQ ID NO: 6047774 - DNA, 21 bp, Homo sapiens
ccatcctaatcatccaatgct

SEQ ID NO: 6047775 - DNA, 22 bp, Homo sapiens
ccatcctaatcatccaatgctc

SEQ ID NO: 6047776 - DNA, 15 bp, Homo sapiens
ccatcctaccaatgc

SEQ ID NO: 6047777 - DNA, 19 bp, Homo sapiens
ccatcctaccaatgcatgc

SEQ ID NO: 6047778 - DNA, 12 bp, Homo sapiens
ccatcctaccca

SEQ ID NO: 6047779 - DNA, 16 bp, Homo sapiens
ccatcctacccagcgt

SEQ ID NO: 6047780 - DNA, 16 bp, Homo sapiens
ccatcctaggaaccag

SEQ ID NO: 6047781 - DNA, 21 bp, Homo sapiens
ccatcctaggaaccagccaac

SEQ ID NO: 6047782 - DNA, 16 bp, Homo sapiens
ccatcctaggctgaca

SEQ ID NO: 6047783 - DNA, 19 bp, Homo sapiens
ccatcctatccactgggca

SEQ ID NO: 6047784 - DNA, 18 bp, Homo sapiens
ccatcctcaaacgacaga

SEQ ID NO: 6047785 - DNA, 19 bp, Homo sapiens
ccatcctcacccagatcag

SEQ ID NO: 6047786 - DNA, 18 bp, Homo sapiens
ccatcctcagaggctgag

SEQ ID NO: 6047787 - DNA, 21 bp, Homo sapiens
ccatcctcagaggctgagccc

SEQ ID NO: 6047788 - DNA, 12 bp, Homo sapiens
ccatcctccaga

SEQ ID NO: 6047789 - DNA, 13 bp, Homo sapiens
ccatcctccagag

SEQ ID NO: 6047790 - DNA, 16 bp, Homo sapiens
ccatcctccagcaggg

SEQ ID NO: 6047791 - DNA, 17 bp, Homo sapiens
ccatcctccagcaggga

SEQ ID NO: 6047792 - DNA, 16 bp, Homo sapiens
ccatcctccagccctg

SEQ ID NO: 6047793 - DNA, 23 bp, Homo sapiens
ccatcctccagccctgcccaccc

SEQ ID NO: 6047794 - DNA, 15 bp, Homo sapiens
ccatcctccagcttc

SEQ ID NO: 6047795 - DNA, 15 bp, Homo sapiens
ccatcctcccaatct

SEQ ID NO: 6047796 - DNA, 18 bp, Homo sapiens
ccatcctccccttccctg

SEQ ID NO: 6047797 - DNA, 22 bp, Homo sapiens
ccatcctccctgttccccacag

SEQ ID NO: 6047798 - DNA, 13 bp, Homo sapiens
ccatcctcctctc

SEQ ID NO: 6047799 - DNA, 16 bp, Homo sapiens
ccatcctcctctccat

SEQ ID NO: 6047800 - DNA, 22 bp, Homo sapiens
ccatcctcctctccatgcaagt

SEQ ID NO: 6047801 - DNA, 14 bp, Homo sapiens
ccatcctcctggga

SEQ ID NO: 6047802 - DNA, 13 bp, Homo sapiens
ccatcctgactga

SEQ ID NO: 6047803 - DNA, 14 bp, Homo sapiens
ccatcctgagccag

SEQ ID NO: 6047804 - DNA, 15 bp, Homo sapiens
ccatcctgaggctcc

SEQ ID NO: 6047805 - DNA, 22 bp, Homo sapiens
ccatcctgaggtgcctcccagt

SEQ ID NO: 6047806 - DNA, 13 bp, Homo sapiens
ccatcctgatccc

SEQ ID NO: 6047807 - DNA, 17 bp, Homo sapiens
ccatcctgatcccagac

SEQ ID NO: 6047808 - DNA, 11 bp, Homo sapiens
ccatcctgatg

SEQ ID NO: 6047809 - DNA, 11 bp, Homo sapiens
ccatcctgcaa

SEQ ID NO: 6047810 - DNA, 13 bp, Homo sapiens
ccatcctgcagat

SEQ ID NO: 6047811 - DNA, 21 bp, Homo sapiens
ccatcctgcagatactttgaa

SEQ ID NO: 6047812 - DNA, 16 bp, Homo sapiens
ccatcctgcagcctcc

SEQ ID NO: 6047813 - DNA, 18 bp, Homo sapiens
ccatcctgcagcctcctc

SEQ ID NO: 6047814 - DNA, 15 bp, Homo sapiens
ccatcctgccacagg

SEQ ID NO: 6047815 - DNA, 21 bp, Homo sapiens
ccatcctgccaggagcagcct

SEQ ID NO: 6047816 - DNA, 12 bp, Homo sapiens
ccatcctgctag

SEQ ID NO: 6047817 - DNA, 15 bp, Homo sapiens
ccatcctgctagcac

SEQ ID NO: 6047818 - DNA, 16 bp, Homo sapiens
ccatcctgctcttcca

SEQ ID NO: 6047819 - DNA, 17 bp, Homo sapiens
ccatcctggcccagggc

SEQ ID NO: 6047820 - DNA, 18 bp, Homo sapiens
ccatcctggcccagggca

SEQ ID NO: 6047821 - DNA, 19 bp, Homo sapiens
ccatcctggcccagggcat

SEQ ID NO: 6047822 - DNA, 14 bp, Homo sapiens
ccatcctggcccct

SEQ ID NO: 6047823 - DNA, 13 bp, Homo sapiens
ccatcctggctaa

SEQ ID NO: 6047824 - DNA, 21 bp, Homo sapiens
ccatcctgggccttacctccc

SEQ ID NO: 6047825 - DNA, 15 bp, Homo sapiens
ccatcctggggcagc

SEQ ID NO: 6047826 - DNA, 16 bp, Homo sapiens
ccatcctggggcagca

SEQ ID NO: 6047827 - DNA, 22 bp, Homo sapiens
ccatcctgtacaagtgctcagt

SEQ ID NO: 6047828 - DNA, 14 bp, Homo sapiens
ccatcctgtcccac

SEQ ID NO: 6047829 - DNA, 16 bp, Homo sapiens
ccatcctgtcccacca

SEQ ID NO: 6047830 - DNA, 17 bp, Homo sapiens
ccatcctgtcccaccat

SEQ ID NO: 6047831 - DNA, 13 bp, Homo sapiens
ccatcctgtgtcc

SEQ ID NO: 6047832 - DNA, 22 bp, Homo sapiens
ccatcctgtgtgttaagctctg

SEQ ID NO: 6047833 - DNA, 19 bp, Homo sapiens
ccatccttccatcctgagg

SEQ ID NO: 6047834 - DNA, 21 bp, Homo sapiens
ccatccttccatcctgaggac

SEQ ID NO: 6047835 - DNA, 21 bp, Homo sapiens
ccatccttcccgcagcaccag

SEQ ID NO: 6047836 - DNA, 20 bp, Homo sapiens
ccatccttccctgtctgcca

SEQ ID NO: 6047837 - DNA, 22 bp, Homo sapiens
ccatccttccgccaatctggcc

SEQ ID NO: 6047838 - DNA, 17 bp, Homo sapiens
ccatccttctccccaag

SEQ ID NO: 6047839 - DNA, 16 bp, Homo sapiens
ccatcctttctgcctc

SEQ ID NO: 6047840 - DNA, 20 bp, Homo sapiens
ccatcctttctgcctctcaa

SEQ ID NO: 6047841 - DNA, 18 bp, Homo sapiens
ccatcctttgcatttctc

SEQ ID NO: 6047842 - DNA, 16 bp, Homo sapiens
ccatccttttgcttca

SEQ ID NO: 6047843 - DNA, 17 bp, Homo sapiens
ccatcgccatcttcttc

SEQ ID NO: 6047844 - DNA, 18 bp, Homo sapiens
ccatcgcccaggcctggg

SEQ ID NO: 6047845 - DNA, 13 bp, Homo sapiens
ccatcgccccacc

SEQ ID NO: 6047846 - DNA, 13 bp, Homo sapiens
ccatcgcctctgt

SEQ ID NO: 6047847 - DNA, 15 bp, Homo sapiens
ccatcggaagagagg

SEQ ID NO: 6047848 - DNA, 17 bp, Homo sapiens
ccatcggaagagagggc

SEQ ID NO: 6047849 - DNA, 17 bp, Homo sapiens
ccatcggacaggaggat

SEQ ID NO: 6047850 - DNA, 20 bp, Homo sapiens
ccatcggccctgtcccctgg

SEQ ID NO: 6047851 - DNA, 22 bp, Homo sapiens
ccatcggccctgtcccctggag

SEQ ID NO: 6047852 - DNA, 16 bp, Homo sapiens
ccatcggtcctgtctc

SEQ ID NO: 6047853 - DNA, 13 bp, Homo sapiens
ccatcgtccagcc

SEQ ID NO: 6047854 - DNA, 14 bp, Homo sapiens
ccatcgtccagccc

SEQ ID NO: 6047855 - DNA, 16 bp, Homo sapiens
ccatcgtccagccctc

SEQ ID NO: 6047856 - DNA, 18 bp, Homo sapiens
ccatcgtccagccctcct

SEQ ID NO: 6047857 - DNA, 17 bp, Homo sapiens
ccatcgtcctgggactc

SEQ ID NO: 6047858 - DNA, 19 bp, Homo sapiens
cattctctgtctcatccat

SEQ ID NO: 6047859 - DNA, 22 bp, Homo sapiens
cattctcttactttttgtaaat

SEQ ID NO: 6047860 - DNA, 14 bp, Homo sapiens
cattctcttcccag

SEQ ID NO: 6047861 - DNA, 20 bp, Homo sapiens
cattctctttgataacaaaa

SEQ ID NO: 6047862 - DNA, 21 bp, Homo sapiens
cattctctttgataacaaaaa

SEQ ID NO: 6047863 - DNA, 22 bp, Homo sapiens
cattctctttgataacaaaaaa

SEQ ID NO: 6047864 - DNA, 18 bp, Homo sapiens
cattctgaaccctccaaa

SEQ ID NO: 6047865 - DNA, 15 bp, Homo sapiens
cattctgaatgcttc

SEQ ID NO: 6047866 - DNA, 12 bp, Homo sapiens
cattctgaatta

SEQ ID NO: 6047867 - DNA, 15 bp, Homo sapiens
cattctgaattaatt

SEQ ID NO: 6047868 - DNA, 21 bp, Homo sapiens
cattctgaattaattaatttg

SEQ ID NO: 6047869 - DNA, 15 bp, Homo sapiens
cattctgacacatat

SEQ ID NO: 6047870 - DNA, 15 bp, Homo sapiens
cattctgactcatat

SEQ ID NO: 6047871 - DNA, 15 bp, Homo sapiens
cattctgagaccaaa

SEQ ID NO: 6047872 - DNA, 15 bp, Homo sapiens
cattctgagcagggg

SEQ ID NO: 6047873 - DNA, 19 bp, Homo sapiens
cattctgagctccccatca

SEQ ID NO: 6047874 - DNA, 17 bp, Homo sapiens
cattctgataggagggg

SEQ ID NO: 6047875 - DNA, 18 bp, Homo sapiens
cattctgataggaggggg

SEQ ID NO: 6047876 - DNA, 19 bp, Homo sapiens
cattctgataggagggggc

SEQ ID NO: 6047877 - DNA, 22 bp, Homo sapiens
cattctgattcgaatgacactg

SEQ ID NO: 6047878 - DNA, 22 bp, Homo sapiens
cattctgattggacctggccca

SEQ ID NO: 6047879 - DNA, 11 bp, Homo sapiens
cattctgcaag

SEQ ID NO: 6047880 - DNA, 19 bp, Homo sapiens
cattctgcactcagaaaat

SEQ ID NO: 6047881 - DNA, 23 bp, Homo sapiens
cattctgcactcagaaaatggca

SEQ ID NO: 6047882 - DNA, 22 bp, Homo sapiens
cattctgcatcctggcttgaaa

SEQ ID NO: 6047883 - DNA, 16 bp, Homo sapiens
cattctgcattgagaa

SEQ ID NO: 6047884 - DNA, 20 bp, Homo sapiens
cattctgcattgagaaggaa

SEQ ID NO: 6047885 - DNA, 18 bp, Homo sapiens
cattctgcattgctagat

SEQ ID NO: 6047886 - DNA, 20 bp, Homo sapiens
cattctgcattgctagataa

SEQ ID NO: 6047887 - DNA, 12 bp, Homo sapiens
cattctgcattt

SEQ ID NO: 6047888 - DNA, 13 bp, Homo sapiens
cattctgccaaag

SEQ ID NO: 6047889 - DNA, 18 bp, Homo sapiens
cattctgccctgtgggac

SEQ ID NO: 6047890 - DNA, 21 bp, Homo sapiens
cattctgccgccccctcctga

SEQ ID NO: 6047891 - DNA, 22 bp, Homo sapiens
cattctgccgccccctcctgaa

SEQ ID NO: 6047892 - DNA, 23 bp, Homo sapiens
cattctgccgccccctcctgaac

SEQ ID NO: 6047893 - DNA, 18 bp, Homo sapiens
cattctgcctaacagaaa

SEQ ID NO: 6047894 - DNA, 17 bp, Homo sapiens
cattctgcctctctagg

SEQ ID NO: 6047895 - DNA, 15 bp, Homo sapiens
cattctgcctgccca

SEQ ID NO: 6047896 - DNA, 14 bp, Homo sapiens
cattctgcctgctc

SEQ ID NO: 6047897 - DNA, 16 bp, Homo sapiens
cattctgcctgctcca

SEQ ID NO: 6047898 - DNA, 12 bp, Homo sapiens
cattctgccttg

SEQ ID NO: 6047899 - DNA, 13 bp, Homo sapiens
cattctgccttgg

SEQ ID NO: 6047900 - DNA, 14 bp, Homo sapiens
cattctgctctgcc

SEQ ID NO: 6047901 - DNA, 17 bp, Homo sapiens
cattctgctgcccccag

SEQ ID NO: 6047902 - DNA, 18 bp, Homo sapiens
cattctgctttcttgcca

SEQ ID NO: 6047903 - DNA, 14 bp, Homo sapiens
cattctggaaactt

SEQ ID NO: 6047904 - DNA, 17 bp, Homo sapiens
cattctggacctctggg

SEQ ID NO: 6047905 - DNA, 12 bp, Homo sapiens
cattctggaggg

SEQ ID NO: 6047906 - DNA, 23 bp, Homo sapiens
cattctggatctgaccctcccag

SEQ ID NO: 6047907 - DNA, 19 bp, Homo sapiens
cattctggcactttaatga

SEQ ID NO: 6047908 - DNA, 12 bp, Homo sapiens
cattctggctta

SEQ ID NO: 6047909 - DNA, 16 bp, Homo sapiens
cattctggggtggggc

SEQ ID NO: 6047910 - DNA, 20 bp, Homo sapiens
cattctggggtggggcttgg

SEQ ID NO: 6047911 - DNA, 21 bp, Homo sapiens
cattctgggtgtgttcttact

SEQ ID NO: 6047912 - DNA, 21 bp, Homo sapiens
cattctggtcaagggctgtca

SEQ ID NO: 6047913 - DNA, 23 bp, Homo sapiens
cattctggtcaagggctgtcatt

SEQ ID NO: 6047914 - DNA, 18 bp, Homo sapiens
cattctggtctctctatt

SEQ ID NO: 6047915 - DNA, 19 bp, Homo sapiens
cattctggtgaccagactt

SEQ ID NO: 6047916 - DNA, 19 bp, Homo sapiens
cattctgtctctgcttggc

SEQ ID NO: 6047917 - DNA, 21 bp, Homo sapiens
cattctgtctgtttttctttt

SEQ ID NO: 6047918 - DNA, 15 bp, Homo sapiens
cattctgtcttgaag

SEQ ID NO: 6047919 - DNA, 11 bp, Homo sapiens
cattctgtgac

SEQ ID NO: 6047920 - DNA, 22 bp, Homo sapiens
cattctgtgtcccatgtcccgt

SEQ ID NO: 6047921 - DNA, 17 bp, Homo sapiens
cattctgtgtctctgca

SEQ ID NO: 6047922 - DNA, 17 bp, Homo sapiens
cattctgtgtgtatcta

SEQ ID NO: 6047923 - DNA, 17 bp, Homo sapiens
cattctgttaatcatta

SEQ ID NO: 6047924 - DNA, 14 bp, Homo sapiens
cattctgttgttca

SEQ ID NO: 6047925 - DNA, 14 bp, Homo sapiens
cattctgtttcctc

SEQ ID NO: 6047926 - DNA, 16 bp, Homo sapiens
cattctgtttcctctt

SEQ ID NO: 6047927 - DNA, 17 bp, Homo sapiens
cattctgtttcctcttg

SEQ ID NO: 6047928 - DNA, 13 bp, Homo sapiens
cattctgttttcc

SEQ ID NO: 6047929 - DNA, 17 bp, Homo sapiens
cattctgttttccccca

SEQ ID NO: 6047930 - DNA, 18 bp, Homo sapiens
cattctgttttcccccag

SEQ ID NO: 6047931 - DNA, 22 bp, Homo sapiens
cattctgttttcccccagcaac

SEQ ID NO: 6047932 - DNA, 18 bp, Homo sapiens
cattctgttttttctgta

SEQ ID NO: 6047933 - DNA, 13 bp, Homo sapiens
cattcttaaaaaa

SEQ ID NO: 6047934 - DNA, 23 bp, Homo sapiens
cattcttaaaggaaaagtcaaca

SEQ ID NO: 6047935 - DNA, 17 bp, Homo sapiens
cattcttaatttatgta

SEQ ID NO: 6047936 - DNA, 23 bp, Homo sapiens
cattcttaccgagaaaaggagaa

SEQ ID NO: 6047937 - DNA, 19 bp, Homo sapiens
cattcttactaaaaagtat

SEQ ID NO: 6047938 - DNA, 22 bp, Homo sapiens
cattcttactaaaaagtataaa

SEQ ID NO: 6047939 - DNA, 21 bp, Homo sapiens
cattcttacttactaaaatat

SEQ ID NO: 6047940 - DNA, 22 bp, Homo sapiens
cattcttacttactaaaatata

SEQ ID NO: 6047941 - DNA, 23 bp, Homo sapiens
cattcttacttactaaaatatat

SEQ ID NO: 6047942 - DNA, 15 bp, Homo sapiens
cattcttagcctgtg

SEQ ID NO: 6047943 - DNA, 21 bp, Homo sapiens
cattcttagcctgtggcagta

SEQ ID NO: 6047944 - DNA, 14 bp, Homo sapiens
cattcttagctctt

SEQ ID NO: 6047945 - DNA, 15 bp, Homo sapiens
cattcttataaatat

SEQ ID NO: 6047946 - DNA, 17 bp, Homo sapiens
cattcttataaatatga

SEQ ID NO: 6047947 - DNA, 22 bp, Homo sapiens
cattcttataacattgtatgtt

SEQ ID NO: 6047948 - DNA, 18 bp, Homo sapiens
cattcttatattttatca

SEQ ID NO: 6047949 - DNA, 20 bp, Homo sapiens
cattcttatattttatcaag

SEQ ID NO: 6047950 - DNA, 21 bp, Homo sapiens
cattcttatttcatgaaaatt

SEQ ID NO: 6047951 - DNA, 13 bp, Homo sapiens
cattcttatttta

SEQ ID NO: 6047952 - DNA, 15 bp, Homo sapiens
cattcttattttaga

SEQ ID NO: 6047953 - DNA, 22 bp, Homo sapiens
cattcttcaaaccagtgttttg

SEQ ID NO: 6047954 - DNA, 14 bp, Homo sapiens
cattcttcactgtc

SEQ ID NO: 6047955 - DNA, 21 bp, Homo sapiens
cattcttcaggtcgtagcatt

SEQ ID NO: 6047956 - DNA, 17 bp, Homo sapiens
cattcttcagtgtctct

SEQ ID NO: 6047957 - DNA, 18 bp, Homo sapiens
cattcttcagtgtctctg

SEQ ID NO: 6047958 - DNA, 15 bp, Homo sapiens
cattcttccatcatc

SEQ ID NO: 6047959 - DNA, 17 bp, Homo sapiens
cattcttccgcaccctc

SEQ ID NO: 6047960 - DNA, 19 bp, Homo sapiens
cattcttctctagctggtg

SEQ ID NO: 6047961 - DNA, 15 bp, Homo sapiens
cattcttctctccca

SEQ ID NO: 6047962 - DNA, 16 bp, Homo sapiens
cattcttctctgttgt

SEQ ID NO: 6047963 - DNA, 21 bp, Homo sapiens
cattcttctcttttctatgaa

SEQ ID NO: 6047964 - DNA, 14 bp, Homo sapiens
cattcttctgggtg

SEQ ID NO: 6047965 - DNA, 18 bp, Homo sapiens
cattcttctggtgctact

SEQ ID NO: 6047966 - DNA, 21 bp, Homo sapiens
cattcttcttttttgtaaaaa

SEQ ID NO: 6047967 - DNA, 18 bp, Homo sapiens
cattcttgagttttgata

SEQ ID NO: 6047968 - DNA, 19 bp, Homo sapiens
cattcttggcttaatcatt

SEQ ID NO: 6047969 - DNA, 20 bp, Homo sapiens
cattcttggcttaatcattt

SEQ ID NO: 6047970 - DNA, 19 bp, Homo sapiens
cattcttggttgttaattt

SEQ ID NO: 6047971 - DNA, 19 bp, Homo sapiens
cattcttgtaaggctttga

SEQ ID NO: 6047972 - DNA, 17 bp, Homo sapiens
cattcttgtgtctgttt

SEQ ID NO: 6047973 - DNA, 21 bp, Homo sapiens
cattcttgttggtagcatgta

SEQ ID NO: 6047974 - DNA, 15 bp, Homo sapiens
cattctttactgcac

SEQ ID NO: 6047975 - DNA, 20 bp, Homo sapiens
cattctttactgcactcaga

SEQ ID NO: 6047976 - DNA, 17 bp, Homo sapiens
cattctttagtctacat

SEQ ID NO: 6047977 - DNA, 21 bp, Homo sapiens
cattctttatagtgaagtgtt

SEQ ID NO: 6047978 - DNA, 13 bp, Homo sapiens
cattctttcccag

SEQ ID NO: 6047979 - DNA, 22 bp, Homo sapiens
cattctttcccctcagagctct

SEQ ID NO: 6047980 - DNA, 14 bp, Homo sapiens
cattctttcctaaa

SEQ ID NO: 6047981 - DNA, 18 bp, Homo sapiens
cattctttctctttgaaa

SEQ ID NO: 6047982 - DNA, 22 bp, Homo sapiens
cattctttctctttgaaaaaaa

SEQ ID NO: 6047983 - DNA, 13 bp, Homo sapiens
cattctttcttcc

SEQ ID NO: 6047984 - DNA, 22 bp, Homo sapiens
cattctttcttcctccagtctg

SEQ ID NO: 6047985 - DNA, 15 bp, Homo sapiens
cattctttgcttgaa

SEQ ID NO: 6047986 - DNA, 20 bp, Homo sapiens
cattctttgcttgaacacag

SEQ ID NO: 6047987 - DNA, 17 bp, Homo sapiens
cattctttggtaatttt

SEQ ID NO: 6047988 - DNA, 19 bp, Homo sapiens
cattctttgtatcttaaat

SEQ ID NO: 6047989 - DNA, 17 bp, Homo sapiens
cattcttttaaatgggt

SEQ ID NO: 6047990 - DNA, 22 bp, Homo sapiens
cattcttttcagcttgtttcta

SEQ ID NO: 6047991 - DNA, 15 bp, Homo sapiens
cattcttttgccaca

SEQ ID NO: 6047992 - DNA, 19 bp, Homo sapiens
cattcttttgccacatccc

SEQ ID NO: 6047993 - DNA, 20 bp, Homo sapiens
cattcttttgccacatccct

SEQ ID NO: 6047994 - DNA, 14 bp, Homo sapiens
cattcttttgtaat

SEQ ID NO: 6047995 - DNA, 21 bp, Homo sapiens
cattgaaaaaaatatatgatt

SEQ ID NO: 6047996 - DNA, 15 bp, Homo sapiens
cattgaaaaaggaaa

SEQ ID NO: 6047997 - DNA, 18 bp, Homo sapiens
cattgaaaaaggaaaaat

SEQ ID NO: 6047998 - DNA, 18 bp, Homo sapiens
cattgaaaaatttctaac

SEQ ID NO: 6047999 - DNA, 16 bp, Homo sapiens
cattgaaaatgtaagt

SEQ ID NO: 6048000 - DNA, 18 bp, Homo sapiens
cattgaaacatttataaa

SEQ ID NO: 6048001 - DNA, 15 bp, Homo sapiens
cattgaaactgtatt

SEQ ID NO: 6048002 - DNA, 16 bp, Homo sapiens
cattgaaacttgagtt

SEQ ID NO: 6048003 - DNA, 12 bp, Homo sapiens
cattgaaagaag

SEQ ID NO: 6048004 - DNA, 14 bp, Homo sapiens
cattgaaagaatta

SEQ ID NO: 6048005 - DNA, 19 bp, Homo sapiens
cattgaaagagaaccagtt

SEQ ID NO: 6048006 - DNA, 12 bp, Homo sapiens
cattgaaagctc

SEQ ID NO: 6048007 - DNA, 12 bp, Homo sapiens
cattgaaataat

SEQ ID NO: 6048008 - DNA, 13 bp, Homo sapiens
cattgaaataata

SEQ ID NO: 6048009 - DNA, 16 bp, Homo sapiens
cattgaaataataata

SEQ ID NO: 6048010 - DNA, 16 bp, Homo sapiens
cattgaaatacttttt

SEQ ID NO: 6048011 - DNA, 12 bp, Homo sapiens
cattgaaatatt

SEQ ID NO: 6048012 - DNA, 13 bp, Homo sapiens
cattgaaatatta

SEQ ID NO: 6048013 - DNA, 19 bp, Homo sapiens
cattgaaatctttttgctt

SEQ ID NO: 6048014 - DNA, 10 bp, Homo sapiens
cattgaaatg

SEQ ID NO: 6048015 - DNA, 16 bp, Homo sapiens
cattgaaatgagcacc

SEQ ID NO: 6048016 - DNA, 19 bp, Homo sapiens
cattgaaatgagcacctcc

SEQ ID NO: 6048017 - DNA, 20 bp, Homo sapiens
cattgaaatgagcacctcca

SEQ ID NO: 6048018 - DNA, 21 bp, Homo sapiens
cattgaaatgagcacctccat

SEQ ID NO: 6048019 - DNA, 19 bp, Homo sapiens
cattgaacactgcaccctc

SEQ ID NO: 6048020 - DNA, 21 bp, Homo sapiens
cattgaacactgcaccctcca

SEQ ID NO: 6048021 - DNA, 14 bp, Homo sapiens
cattgaacagctgt

SEQ ID NO: 6048022 - DNA, 23 bp, Homo sapiens
cattgaacagctgtgagccatgc

SEQ ID NO: 6048023 - DNA, 20 bp, Homo sapiens
cattgaacatttcttatgat

SEQ ID NO: 6048024 - DNA, 20 bp, Homo sapiens
cattgaagaagaaccagccc

SEQ ID NO: 6048025 - DNA, 22 bp, Homo sapiens
cattgaagaatgttagagtaat

SEQ ID NO: 6048026 - DNA, 17 bp, Homo sapiens
cattgaagagttgagga

SEQ ID NO: 6048027 - DNA, 18 bp, Homo sapiens
cattgaagcagatttctg

SEQ ID NO: 6048028 - DNA, 19 bp, Homo sapiens
cattgaagcagatttctgc

SEQ ID NO: 6048029 - DNA, 20 bp, Homo sapiens
cattgaagccgactctggcc

SEQ ID NO: 6048030 - DNA, 21 bp, Homo sapiens
cattgaagccgactctggccc

SEQ ID NO: 6048031 - DNA, 20 bp, Homo sapiens
cattgaaggcgaggctgccc

SEQ ID NO: 6048032 - DNA, 20 bp, Homo sapiens
cattgaagggggatgcaggc

SEQ ID NO: 6048033 - DNA, 18 bp, Homo sapiens
cattgaagtaatgaattt

SEQ ID NO: 6048034 - DNA, 19 bp, Homo sapiens
cattgaagtaatgaatttt

SEQ ID NO: 6048035 - DNA, 19 bp, Homo sapiens
ccatcgtctcatcctcctt

SEQ ID NO: 6048036 - DNA, 17 bp, Homo sapiens
ccatctaagctgcagct

SEQ ID NO: 6048037 - DNA, 14 bp, Homo sapiens
ccatctacccctgg

SEQ ID NO: 6048038 - DNA, 13 bp, Homo sapiens
ccatctaccttcc

SEQ ID NO: 6048039 - DNA, 18 bp, Homo sapiens
ccatctactcttttgaag

SEQ ID NO: 6048040 - DNA, 12 bp, Homo sapiens
ccatctagagat

SEQ ID NO: 6048041 - DNA, 17 bp, Homo sapiens
ccatctagcagctggcc

SEQ ID NO: 6048042 - DNA, 20 bp, Homo sapiens
ccatctagggaatgggactg

SEQ ID NO: 6048043 - DNA, 17 bp, Homo sapiens
ccatctaggtcctggct

SEQ ID NO: 6048044 - DNA, 18 bp, Homo sapiens
ccatctagtttttggaaa

SEQ ID NO: 6048045 - DNA, 16 bp, Homo sapiens
ccatctatcactgcat

SEQ ID NO: 6048046 - DNA, 15 bp, Homo sapiens
ccatctcaaaacaaa

SEQ ID NO: 6048047 - DNA, 16 bp, Homo sapiens
ccatctcaaaacaaaa

SEQ ID NO: 6048048 - DNA, 21 bp, Homo sapiens
ccatctcaacctacctcgagt

SEQ ID NO: 6048049 - DNA, 23 bp, Homo sapiens
ccatctcaagcaagtttaatcaa

SEQ ID NO: 6048050 - DNA, 15 bp, Homo sapiens
ccatctcacacatga

SEQ ID NO: 6048051 - DNA, 21 bp, Homo sapiens
ccatctcacctcctgctgggc

SEQ ID NO: 6048052 - DNA, 14 bp, Homo sapiens
ccatctcagcctcc

SEQ ID NO: 6048053 - DNA, 12 bp, Homo sapiens
ccatctcaggag

SEQ ID NO: 6048054 - DNA, 17 bp, Homo sapiens
ccatctcaggagatgga

SEQ ID NO: 6048055 - DNA, 11 bp, Homo sapiens
ccatctcaggc

SEQ ID NO: 6048056 - DNA, 18 bp, Homo sapiens
ccatctcaggccacctgc

SEQ ID NO: 6048057 - DNA, 23 bp, Homo sapiens
ccatctcaggccacctgccccct

SEQ ID NO: 6048058 - DNA, 13 bp, Homo sapiens
ccatctcaggtgc

SEQ ID NO: 6048059 - DNA, 14 bp, Homo sapiens
ccatctcaggttgg

SEQ ID NO: 6048060 - DNA, 17 bp, Homo sapiens
ccatctcatcctggcac

SEQ ID NO: 6048061 - DNA, 20 bp, Homo sapiens
ccatctcatgtatcatctgg

SEQ ID NO: 6048062 - DNA, 22 bp, Homo sapiens
ccatctccaagaatgctgaaac

SEQ ID NO: 6048063 - DNA, 21 bp, Homo sapiens
ccatctccaagataagcctga

SEQ ID NO: 6048064 - DNA, 12 bp, Homo sapiens
ccatctccaggg

SEQ ID NO: 6048065 - DNA, 21 bp, Homo sapiens
ccatctccagggagcaagaca

SEQ ID NO: 6048066 - DNA, 19 bp, Homo sapiens
ccatctccatttcacacag

SEQ ID NO: 6048067 - DNA, 17 bp, Homo sapiens
ccatctcccaccctgta

SEQ ID NO: 6048068 - DNA, 14 bp, Homo sapiens
ccatctccccaggc

SEQ ID NO: 6048069 - DNA, 17 bp, Homo sapiens
ccatctccccaggcctc

SEQ ID NO: 6048070 - DNA, 20 bp, Homo sapiens
ccatctccccaggcctccag

SEQ ID NO: 6048071 - DNA, 20 bp, Homo sapiens
ccatctcccccatcccccac

SEQ ID NO: 6048072 - DNA, 14 bp, Homo sapiens
ccatctcccctcag

SEQ ID NO: 6048073 - DNA, 17 bp, Homo sapiens
ccatctcccctcagctc

SEQ ID NO: 6048074 - DNA, 18 bp, Homo sapiens
ccatctcccctcagctcg

SEQ ID NO: 6048075 - DNA, 16 bp, Homo sapiens
ccatctccctgcctgg

SEQ ID NO: 6048076 - DNA, 17 bp, Homo sapiens
ccatctccctgcctggc

SEQ ID NO: 6048077 - DNA, 13 bp, Homo sapiens
ccatctccctgct

SEQ ID NO: 6048078 - DNA, 16 bp, Homo sapiens
ccatctccctggtgct

SEQ ID NO: 6048079 - DNA, 20 bp, Homo sapiens
ccatctcctataatctgtca

SEQ ID NO: 6048080 - DNA, 18 bp, Homo sapiens
ccatctcctgatttctct

SEQ ID NO: 6048081 - DNA, 17 bp, Homo sapiens
ccatctcctgctcacca

SEQ ID NO: 6048082 - DNA, 20 bp, Homo sapiens
ccatctcctgctcaccacct

SEQ ID NO: 6048083 - DNA, 14 bp, Homo sapiens
ccatctccttcccc

SEQ ID NO: 6048084 - DNA, 19 bp, Homo sapiens
ccatctccttcccccagcc

SEQ ID NO: 6048085 - DNA, 16 bp, Homo sapiens
ccatctccttgtcttt

SEQ ID NO: 6048086 - DNA, 18 bp, Homo sapiens
ccatctcgctccctccca

SEQ ID NO: 6048087 - DNA, 22 bp, Homo sapiens
ccatctcgctccctcccaggac

SEQ ID NO: 6048088 - DNA, 22 bp, Homo sapiens
ccatctcggagcatcccggagg

SEQ ID NO: 6048089 - DNA, 23 bp, Homo sapiens
ccatctcggagcatcccggagga

SEQ ID NO: 6048090 - DNA, 16 bp, Homo sapiens
ccatctcggggctgct

SEQ ID NO: 6048091 - DNA, 14 bp, Homo sapiens
ccatctctactaaa

SEQ ID NO: 6048092 - DNA, 15 bp, Homo sapiens
ccatctctactaaaa

SEQ ID NO: 6048093 - DNA, 22 bp, Homo sapiens
ccatctctaggatgtcgtcttt

SEQ ID NO: 6048094 - DNA, 16 bp, Homo sapiens
ccatctctatcagaaa

SEQ ID NO: 6048095 - DNA, 18 bp, Homo sapiens
ccatctctcatcctccag

SEQ ID NO: 6048096 - DNA, 20 bp, Homo sapiens
ccatctctcccacttcctcc

SEQ ID NO: 6048097 - DNA, 14 bp, Homo sapiens
ccatctctccctcc

SEQ ID NO: 6048098 - DNA, 23 bp, Homo sapiens
ccatctctccctcccctgccatt

SEQ ID NO: 6048099 - DNA, 20 bp, Homo sapiens
ccatctctcccttacccatc

SEQ ID NO: 6048100 - DNA, 20 bp, Homo sapiens
ccatctctctactcctacct

SEQ ID NO: 6048101 - DNA, 14 bp, Homo sapiens
ccatctctctccct

SEQ ID NO: 6048102 - DNA, 16 bp, Homo sapiens
ccatctctctggccct

SEQ ID NO: 6048103 - DNA, 11 bp, Homo sapiens
ccatctctctt

SEQ ID NO: 6048104 - DNA, 16 bp, Homo sapiens
ccatctctgagtggag

SEQ ID NO: 6048105 - DNA, 16 bp, Homo sapiens
ccatctctgcctgtca

SEQ ID NO: 6048106 - DNA, 14 bp, Homo sapiens
ccatctctgctcca

SEQ ID NO: 6048107 - DNA, 13 bp, Homo sapiens
ccatctctggttg

SEQ ID NO: 6048108 - DNA, 12 bp, Homo sapiens
ccatctctgtct

SEQ ID NO: 6048109 - DNA, 18 bp, Homo sapiens
ccatctcttgtaccagcc

SEQ ID NO: 6048110 - DNA, 21 bp, Homo sapiens
ccatctgaagccacctctctg

SEQ ID NO: 6048111 - DNA, 22 bp, Homo sapiens
ccatctgacaaaatggggcaga

SEQ ID NO: 6048112 - DNA, 21 bp, Homo sapiens
ccatctgactgccaagccaga

SEQ ID NO: 6048113 - DNA, 14 bp, Homo sapiens
ccatctgagctggg

SEQ ID NO: 6048114 - DNA, 20 bp, Homo sapiens
ccatctgatccccatgccta

SEQ ID NO: 6048115 - DNA, 21 bp, Homo sapiens
ccatctgcacacacctccgag

SEQ ID NO: 6048116 - DNA, 12 bp, Homo sapiens
ccatctgcaccc

SEQ ID NO: 6048117 - DNA, 20 bp, Homo sapiens
ccatctgcaccccttctctc

SEQ ID NO: 6048118 - DNA, 22 bp, Homo sapiens
ccatctgcaccccttctctcct

SEQ ID NO: 6048119 - DNA, 12 bp, Homo sapiens
ccatctgcatgg

SEQ ID NO: 6048120 - DNA, 17 bp, Homo sapiens
ccatctgcattcccagc

SEQ ID NO: 6048121 - DNA, 19 bp, Homo sapiens
ccatctgccaatgccatga

SEQ ID NO: 6048122 - DNA, 15 bp, Homo sapiens
ccatctgcccaggac

SEQ ID NO: 6048123 - DNA, 16 bp, Homo sapiens
ccatctgccccacagt

SEQ ID NO: 6048124 - DNA, 17 bp, Homo sapiens
ccatctgccccacagtc

SEQ ID NO: 6048125 - DNA, 19 bp, Homo sapiens
ccatctgccccacagtctc

SEQ ID NO: 6048126 - DNA, 20 bp, Homo sapiens
ccatctgcccgcctgcccac

SEQ ID NO: 6048127 - DNA, 17 bp, Homo sapiens
ccatctgccctccctgt

SEQ ID NO: 6048128 - DNA, 16 bp, Homo sapiens
ccatctgccgcctggg

SEQ ID NO: 6048129 - DNA, 19 bp, Homo sapiens
ccatctgcctgaccccttc

SEQ ID NO: 6048130 - DNA, 18 bp, Homo sapiens
ccatctgcctgttctgag

SEQ ID NO: 6048131 - DNA, 20 bp, Homo sapiens
ccatctgcctgttctgagga

SEQ ID NO: 6048132 - DNA, 22 bp, Homo sapiens
ccatctgcgacaccaccaacag

SEQ ID NO: 6048133 - DNA, 14 bp, Homo sapiens
ccatctgcgcaggg

SEQ ID NO: 6048134 - DNA, 20 bp, Homo sapiens
ccatctgcgggggcagtgct

SEQ ID NO: 6048135 - DNA, 12 bp, Homo sapiens
ccatctgctcct

SEQ ID NO: 6048136 - DNA, 15 bp, Homo sapiens
ccatctgctgagctc

SEQ ID NO: 6048137 - DNA, 18 bp, Homo sapiens
ccatctgctgagctctga

SEQ ID NO: 6048138 - DNA, 11 bp, Homo sapiens
ccatctgctgc

SEQ ID NO: 6048139 - DNA, 15 bp, Homo sapiens
ccatctgctgcagtt

SEQ ID NO: 6048140 - DNA, 22 bp, Homo sapiens
ccatctgctgccccgcttcccc

SEQ ID NO: 6048141 - DNA, 12 bp, Homo sapiens
ccatctgcttgt

SEQ ID NO: 6048142 - DNA, 12 bp, Homo sapiens
ccatctggagag

SEQ ID NO: 6048143 - DNA, 14 bp, Homo sapiens
ccatctggcccagg

SEQ ID NO: 6048144 - DNA, 21 bp, Homo sapiens
ccatctggcccaggctggccc

SEQ ID NO: 6048145 - DNA, 14 bp, Homo sapiens
ccatctggcctggc

SEQ ID NO: 6048146 - DNA, 21 bp, Homo sapiens
ccatctggctgtgacagcctc

SEQ ID NO: 6048147 - DNA, 22 bp, Homo sapiens
ccatctggctgtgacagcctct

SEQ ID NO: 6048148 - DNA, 13 bp, Homo sapiens
ccatctggctttt

SEQ ID NO: 6048149 - DNA, 15 bp, Homo sapiens
ccatctggctttttc

SEQ ID NO: 6048150 - DNA, 16 bp, Homo sapiens
ccatctggctttttct

SEQ ID NO: 6048151 - DNA, 17 bp, Homo sapiens
ccatctgggagtcccct

SEQ ID NO: 6048152 - DNA, 22 bp, Homo sapiens
ccatctgggagtccccttttct

SEQ ID NO: 6048153 - DNA, 22 bp, Homo sapiens
ccatctgggctcctaaccttcc

SEQ ID NO: 6048154 - DNA, 17 bp, Homo sapiens
ccatctgggtccttgca

SEQ ID NO: 6048155 - DNA, 22 bp, Homo sapiens
ccatctggttaggatggcagga

SEQ ID NO: 6048156 - DNA, 13 bp, Homo sapiens
ccatctgtaatat

SEQ ID NO: 6048157 - DNA, 16 bp, Homo sapiens
ccatctgtaccctgct

SEQ ID NO: 6048158 - DNA, 19 bp, Homo sapiens
ccatctgtaccctgcttcc

SEQ ID NO: 6048159 - DNA, 16 bp, Homo sapiens
ccatctgtacttggtc

SEQ ID NO: 6048160 - DNA, 20 bp, Homo sapiens
ccatctgtacttggtccaac

SEQ ID NO: 6048161 - DNA, 21 bp, Homo sapiens
ccatctgtagtaatttattgt

SEQ ID NO: 6048162 - DNA, 22 bp, Homo sapiens
ccatctgtatgctggtagctag

SEQ ID NO: 6048163 - DNA, 23 bp, Homo sapiens
ccatctgtccacatccccagagc

SEQ ID NO: 6048164 - DNA, 15 bp, Homo sapiens
ccatctgtccatcct

SEQ ID NO: 6048165 - DNA, 16 bp, Homo sapiens
ccatctgtccatcctc

SEQ ID NO: 6048166 - DNA, 19 bp, Homo sapiens
ccatctgtccatcctcctc

SEQ ID NO: 6048167 - DNA, 14 bp, Homo sapiens
ccatctgtccctgc

SEQ ID NO: 6048168 - DNA, 23 bp, Homo sapiens
ccatctgtccgtccagagccggc

SEQ ID NO: 6048169 - DNA, 14 bp, Homo sapiens
ccatctgtcttcag

SEQ ID NO: 6048170 - DNA, 19 bp, Homo sapiens
ccatctgtcttgccagcca

SEQ ID NO: 6048171 - DNA, 15 bp, Homo sapiens
ccatctgtgaataag

SEQ ID NO: 6048172 - DNA, 19 bp, Homo sapiens
ccatctgtgatatgccata

SEQ ID NO: 6048173 - DNA, 16 bp, Homo sapiens
ccatctgtgcacgcag

SEQ ID NO: 6048174 - DNA, 12 bp, Homo sapiens
ccatctgtgcat

SEQ ID NO: 6048175 - DNA, 22 bp, Homo sapiens
ccatctgtgccatacttgttct

SEQ ID NO: 6048176 - DNA, 11 bp, Homo sapiens
ccatctgtggg

SEQ ID NO: 6048177 - DNA, 15 bp, Homo sapiens
ccatctgtgtcctgg

SEQ ID NO: 6048178 - DNA, 11 bp, Homo sapiens
ccatctgtgtg

SEQ ID NO: 6048179 - DNA, 19 bp, Homo sapiens
ccatctgtttggtgggggt

SEQ ID NO: 6048180 - DNA, 13 bp, Homo sapiens
ccatcttaatctt

SEQ ID NO: 6048181 - DNA, 21 bp, Homo sapiens
ccatcttaatctttattttat

SEQ ID NO: 6048182 - DNA, 17 bp, Homo sapiens
ccatcttacttggcttt

SEQ ID NO: 6048183 - DNA, 21 bp, Homo sapiens
ccatcttagatagatggtact

SEQ ID NO: 6048184 - DNA, 14 bp, Homo sapiens
ccatcttcacccag

SEQ ID NO: 6048185 - DNA, 21 bp, Homo sapiens
ccatcttcacccaggcctatg

SEQ ID NO: 6048186 - DNA, 16 bp, Homo sapiens
ccatcttcactggctt

SEQ ID NO: 6048187 - DNA, 15 bp, Homo sapiens
ccatcttcataattt

SEQ ID NO: 6048188 - DNA, 22 bp, Homo sapiens
ccatcttccacctcacctcttt

SEQ ID NO: 6048189 - DNA, 15 bp, Homo sapiens
ccatcttccacctgt

SEQ ID NO: 6048190 - DNA, 14 bp, Homo sapiens
ccatcttccagcca

SEQ ID NO: 6048191 - DNA, 15 bp, Homo sapiens
ccatcttccatatcc

SEQ ID NO: 6048192 - DNA, 18 bp, Homo sapiens
ccatcttccatatccggg

SEQ ID NO: 6048193 - DNA, 13 bp, Homo sapiens
ccatcttccattg

SEQ ID NO: 6048194 - DNA, 20 bp, Homo sapiens
ccatcttcccgcctcagcct

SEQ ID NO: 6048195 - DNA, 20 bp, Homo sapiens
ccatcttccctacccttcct

SEQ ID NO: 6048196 - DNA, 22 bp, Homo sapiens
ccatcttccctggcgtcctctc

SEQ ID NO: 6048197 - DNA, 16 bp, Homo sapiens
ccatcttcctgctgct

SEQ ID NO: 6048198 - DNA, 18 bp, Homo sapiens
ccatcttcctgctgctgt

SEQ ID NO: 6048199 - DNA, 20 bp, Homo sapiens
ccatcttcgggaccaggatt

SEQ ID NO: 6048200 - DNA, 14 bp, Homo sapiens
ccatcttctatctt

SEQ ID NO: 6048201 - DNA, 19 bp, Homo sapiens
ccatcttctccccacagcc

SEQ ID NO: 6048202 - DNA, 20 bp, Homo sapiens
ccatcttctccccacagcct

SEQ ID NO: 6048203 - DNA, 23 bp, Homo sapiens
ccatcttctccccacagcctctg

SEQ ID NO: 6048204 - DNA, 13 bp, Homo sapiens
ccatcttcttccc

SEQ ID NO: 6048205 - DNA, 23 bp, Homo sapiens
ccatcttcttcccttaactccaa

SEQ ID NO: 6048206 - DNA, 18 bp, Homo sapiens
ccatcttgaagtcattgt

SEQ ID NO: 6048207 - DNA, 14 bp, Homo sapiens
ccatcttgctaata

SEQ ID NO: 6048208 - DNA, 21 bp, Homo sapiens
ccatcttgctaataaacactg

SEQ ID NO: 6048209 - DNA, 20 bp, Homo sapiens
ccatcttggccaggctggtc

SEQ ID NO: 6048210 - DNA, 17 bp, Homo sapiens
ccatcttggcctcccag

SEQ ID NO: 6048211 - DNA, 17 bp, Homo sapiens
ccatcttggtaaatttc

SEQ ID NO: 6048212 - DNA, 17 bp, Homo sapiens
ccatcttggtagttctg

SEQ ID NO: 6048213 - DNA, 22 bp, Homo sapiens
ccatcttggtcctgtcaccctg

SEQ ID NO: 6048214 - DNA, 23 bp, Homo sapiens
ccatcttggtcctgtcaccctgg

SEQ ID NO: 6048215 - DNA, 17 bp, Homo sapiens
ccatcttgtggggccag

SEQ ID NO: 6048216 - DNA, 10 bp, Homo sapiens
ccatcttgtt

SEQ ID NO: 6048217 - DNA, 17 bp, Homo sapiens
ccatctttactcccaag

SEQ ID NO: 6048218 - DNA, 23 bp, Homo sapiens
ccatctttatagaaggaatttgt

SEQ ID NO: 6048219 - DNA, 18 bp, Homo sapiens
ccatctttctcacacgga

SEQ ID NO: 6048220 - DNA, 14 bp, Homo sapiens
ccatctttctttgg

SEQ ID NO: 6048221 - DNA, 17 bp, Homo sapiens
ccatctttgtatattta

SEQ ID NO: 6048222 - DNA, 20 bp, Homo sapiens
ccatcttttaatatgctgtg

SEQ ID NO: 6048223 - DNA, 12 bp, Homo sapiens
ccatctttttct

SEQ ID NO: 6048224 - DNA, 17 bp, Homo sapiens
ccatgaaaaacagcaga

SEQ ID NO: 6048225 - DNA, 19 bp, Homo sapiens
ccatgaaaacgttttattg

SEQ ID NO: 6048226 - DNA, 20 bp, Homo sapiens
ccatgaaaacgttttattgt

SEQ ID NO: 6048227 - DNA, 11 bp, Homo sapiens
ccatgaaaata

SEQ ID NO: 6048228 - DNA, 17 bp, Homo sapiens
ccatgaaatcaactcag

SEQ ID NO: 6048229 - DNA, 18 bp, Homo sapiens
ccatgaacaaattcttta

SEQ ID NO: 6048230 - DNA, 22 bp, Homo sapiens
ccatgaacacactgtgtcctgg

SEQ ID NO: 6048231 - DNA, 14 bp, Homo sapiens
ccatgaaccctgcc

SEQ ID NO: 6048232 - DNA, 15 bp, Homo sapiens
ccatgaaccctgccc

SEQ ID NO: 6048233 - DNA, 14 bp, Homo sapiens
ccatgaactttgtc

SEQ ID NO: 6048234 - DNA, 15 bp, Homo sapiens
ccatgaactttgtcc

SEQ ID NO: 6048235 - DNA, 12 bp, Homo sapiens
ccatgaagacag

SEQ ID NO: 6048236 - DNA, 13 bp, Homo sapiens
ccatgaagacagg

SEQ ID NO: 6048237 - DNA, 15 bp, Homo sapiens
ccatgaagacaggat

SEQ ID NO: 6048238 - DNA, 21 bp, Homo sapiens
ccatgaagaggatgctgtgaa

SEQ ID NO: 6048239 - DNA, 18 bp, Homo sapiens
ccatgaagccacagccca

SEQ ID NO: 6048240 - DNA, 16 bp, Homo sapiens
ccatgaagccttttga

SEQ ID NO: 6048241 - DNA, 16 bp, Homo sapiens
ccatgaagctggccct

SEQ ID NO: 6048242 - DNA, 22 bp, Homo sapiens
ccatgaagctggccctcagctc

SEQ ID NO: 6048243 - DNA, 20 bp, Homo sapiens
ccatgaaggaaattgggact

SEQ ID NO: 6048244 - DNA, 13 bp, Homo sapiens
ccatgaatattta

SEQ ID NO: 6048245 - DNA, 16 bp, Homo sapiens
ccatgaatcaaagaca

SEQ ID NO: 6048246 - DNA, 17 bp, Homo sapiens
ccatgaatcgcttctct

SEQ ID NO: 6048247 - DNA, 19 bp, Homo sapiens
ccatgaatcgcttctcttt

SEQ ID NO: 6048248 - DNA, 21 bp, Homo sapiens
ccatgaatgaacccctggctc

SEQ ID NO: 6048249 - DNA, 23 bp, Homo sapiens
ccatgaatgaacccctggctcct

SEQ ID NO: 6048250 - DNA, 18 bp, Homo sapiens
ccatgaatgtatcaggaa

SEQ ID NO: 6048251 - DNA, 16 bp, Homo sapiens
ccatgacaagaacaaa

SEQ ID NO: 6048252 - DNA, 20 bp, Homo sapiens
ccatgacagaggctgcaccc

SEQ ID NO: 6048253 - DNA, 21 bp, Homo sapiens
ccatgacaggcctgaagatat

SEQ ID NO: 6048254 - DNA, 17 bp, Homo sapiens
ccatgacatttcatctg

SEQ ID NO: 6048255 - DNA, 16 bp, Homo sapiens
ccatgacatttttcct

SEQ ID NO: 6048256 - DNA, 16 bp, Homo sapiens
ccatgaccaggccacc

SEQ ID NO: 6048257 - DNA, 22 bp, Homo sapiens
ccatgaccagttctggccagga

SEQ ID NO: 6048258 - DNA, 14 bp, Homo sapiens
ccatgaccatactg

SEQ ID NO: 6048259 - DNA, 15 bp, Homo sapiens
ccatgacccacccct

SEQ ID NO: 6048260 - DNA, 22 bp, Homo sapiens
ccatgacctccagctttcctgt

SEQ ID NO: 6048261 - DNA, 13 bp, Homo sapiens
ccatgaccttgac

SEQ ID NO: 6048262 - DNA, 21 bp, Homo sapiens
ccatgacgcaaagagagattt

SEQ ID NO: 6048263 - DNA, 13 bp, Homo sapiens
ccatgactcttgg

SEQ ID NO: 6048264 - DNA, 16 bp, Homo sapiens
ccatgactcttggagc

SEQ ID NO: 6048265 - DNA, 14 bp, Homo sapiens
ccatgactgcaccc

SEQ ID NO: 6048266 - DNA, 17 bp, Homo sapiens
ccatgactgcacccagc

SEQ ID NO: 6048267 - DNA, 15 bp, Homo sapiens
ccatgactgcatttt

SEQ ID NO: 6048268 - DNA, 17 bp, Homo sapiens
ccatgactgcattttac

SEQ ID NO: 6048269 - DNA, 13 bp, Homo sapiens
ccatgactgcccc

SEQ ID NO: 6048270 - DNA, 21 bp, Homo sapiens
ccatgactgccccttgcttct

SEQ ID NO: 6048271 - DNA, 22 bp, Homo sapiens
ccatgactgccccttgcttctc

SEQ ID NO: 6048272 - DNA, 23 bp, Homo sapiens
ccatgactgccccttgcttctca

SEQ ID NO: 6048273 - DNA, 14 bp, Homo sapiens
ccatgactggctgt

SEQ ID NO: 6048274 - DNA, 18 bp, Homo sapiens
ccatgactgtgaccacct

SEQ ID NO: 6048275 - DNA, 18 bp, Homo sapiens
ccatgacttgagaaacaa

SEQ ID NO: 6048276 - DNA, 14 bp, Homo sapiens
ccatgacttgggct

SEQ ID NO: 6048277 - DNA, 22 bp, Homo sapiens
ccatgagaataagagaaagaaa

SEQ ID NO: 6048278 - DNA, 23 bp, Homo sapiens
ccatgagaatgttttagcacagc

SEQ ID NO: 6048279 - DNA, 20 bp, Homo sapiens
ccatgagactgatccctggc

SEQ ID NO: 6048280 - DNA, 18 bp, Homo sapiens
ccatgagactgccctgcc

SEQ ID NO: 6048281 - DNA, 21 bp, Homo sapiens
ccatgagactgccctgcccag

SEQ ID NO: 6048282 - DNA, 23 bp, Homo sapiens
ccatgagatgatacatccaaagc

SEQ ID NO: 6048283 - DNA, 12 bp, Homo sapiens
ccatgagcaagc

SEQ ID NO: 6048284 - DNA, 19 bp, Homo sapiens
ccatgagcacctccagctg

SEQ ID NO: 6048285 - DNA, 13 bp, Homo sapiens
ccatgagcctgcc

SEQ ID NO: 6048286 - DNA, 13 bp, Homo sapiens
ccatgagctccag

SEQ ID NO: 6048287 - DNA, 15 bp, Homo sapiens
ccatgagctccagac

SEQ ID NO: 6048288 - DNA, 16 bp, Homo sapiens
ccatgagctccagacc

SEQ ID NO: 6048289 - DNA, 23 bp, Homo sapiens
ccatgagctccagacccccagca

SEQ ID NO: 6048290 - DNA, 21 bp, Homo sapiens
ccatgagctccttaaggctct

SEQ ID NO: 6048291 - DNA, 17 bp, Homo sapiens
ccatgagctcggggtcc

SEQ ID NO: 6048292 - DNA, 19 bp, Homo sapiens
ccatgagctcggggtccac

SEQ ID NO: 6048293 - DNA, 22 bp, Homo sapiens
ccatgaggagaaaaaaagcatg

SEQ ID NO: 6048294 - DNA, 15 bp, Homo sapiens
ccatgaggaggcaga

SEQ ID NO: 6048295 - DNA, 20 bp, Homo sapiens
ccatgaggagttgctgtttg

SEQ ID NO: 6048296 - DNA, 12 bp, Homo sapiens
ccatgaggctca

SEQ ID NO: 6048297 - DNA, 17 bp, Homo sapiens
ccatgagggacagggtc

SEQ ID NO: 6048298 - DNA, 16 bp, Homo sapiens
ccatgagggtgttttt

SEQ ID NO: 6048299 - DNA, 22 bp, Homo sapiens
ccatgaggtaaaagagccaagt

SEQ ID NO: 6048300 - DNA, 14 bp, Homo sapiens
ccatgaggtactgg

SEQ ID NO: 6048301 - DNA, 22 bp, Homo sapiens
ccatgaggtactggtcccttcc

SEQ ID NO: 6048302 - DNA, 15 bp, Homo sapiens
ccatgaggtcttccc

SEQ ID NO: 6048303 - DNA, 21 bp, Homo sapiens
ccatgagtattagcttaccca

SEQ ID NO: 6048304 - DNA, 16 bp, Homo sapiens
ccatgagtccatgtcc

SEQ ID NO: 6048305 - DNA, 14 bp, Homo sapiens
ccatgagtcccctg

SEQ ID NO: 6048306 - DNA, 18 bp, Homo sapiens
ccatgagtcccctgtttg

SEQ ID NO: 6048307 - DNA, 19 bp, Homo sapiens
ccatgagtgctaagagcct

SEQ ID NO: 6048308 - DNA, 19 bp, Homo sapiens
ccatgagttccagaaagta

SEQ ID NO: 6048309 - DNA, 23 bp, Homo sapiens
ccatgagttggggtctggcagcc

SEQ ID NO: 6048310 - DNA, 13 bp, Homo sapiens
ccatgataaaata

SEQ ID NO: 6048311 - DNA, 15 bp, Homo sapiens
ccatgataactgcat

SEQ ID NO: 6048312 - DNA, 16 bp, Homo sapiens
ccatgataagaacaga

SEQ ID NO: 6048313 - DNA, 21 bp, Homo sapiens
ccatgataataggtcatatgt

SEQ ID NO: 6048314 - DNA, 22 bp, Homo sapiens
ccatgatacctattaaaggaaa

SEQ ID NO: 6048315 - DNA, 20 bp, Homo sapiens
ccatgatactccactcccag

SEQ ID NO: 6048316 - DNA, 23 bp, Homo sapiens
ccatgatactccactcccagcag

SEQ ID NO: 6048317 - DNA, 13 bp, Homo sapiens
ccatgatacttta

SEQ ID NO: 6048318 - DNA, 17 bp, Homo sapiens
ccatgatagatataaag

SEQ ID NO: 6048319 - DNA, 17 bp, Homo sapiens
ccatgatcacacagcta

SEQ ID NO: 6048320 - DNA, 23 bp, Homo sapiens
ccatgatcagacatacagctgcc

SEQ ID NO: 6048321 - DNA, 24 bp, Homo sapiens
ccatgatcagacatacagctgcct

SEQ ID NO: 6048322 - DNA, 22 bp, Homo sapiens
ccatgatccctgtgttgtctct

SEQ ID NO: 6048323 - DNA, 14 bp, Homo sapiens
ccatgatctgcagg

SEQ ID NO: 6048324 - DNA, 15 bp, Homo sapiens
ccatgatctgtattt

SEQ ID NO: 6048325 - DNA, 21 bp, Homo sapiens
ccatgatgacttagtacaaag

SEQ ID NO: 6048326 - DNA, 19 bp, Homo sapiens
ccatgatgcaagccagctt

SEQ ID NO: 6048327 - DNA, 19 bp, Homo sapiens
ccatgatgccgctcttctg

SEQ ID NO: 6048328 - DNA, 22 bp, Homo sapiens
ccatgatgccgctcttctgtca

SEQ ID NO: 6048329 - DNA, 20 bp, Homo sapiens
ccatgatgcctctgtcttct

SEQ ID NO: 6048330 - DNA, 12 bp, Homo sapiens
ccatgatgctgg

SEQ ID NO: 6048331 - DNA, 23 bp, Homo sapiens
ccatgatggaataaggagctggg

SEQ ID NO: 6048332 - DNA, 21 bp, Homo sapiens
ccatgatggcaacagaaacca

SEQ ID NO: 6048333 - DNA, 19 bp, Homo sapiens
ccatgatggcaacagatct

SEQ ID NO: 6048334 - DNA, 21 bp, Homo sapiens
ccatgatggcaacagatctgg

SEQ ID NO: 6048335 - DNA, 14 bp, Homo sapiens
ccatgatgtatatc

SEQ ID NO: 6048336 - DNA, 22 bp, Homo sapiens
ccatgatgtggagtggggcagt

SEQ ID NO: 6048337 - DNA, 16 bp, Homo sapiens
ccatgatgtttagaaa

SEQ ID NO: 6048338 - DNA, 16 bp, Homo sapiens
ccatgattctctgagt

SEQ ID NO: 6048339 - DNA, 17 bp, Homo sapiens
ccatgatttagcaagca

SEQ ID NO: 6048340 - DNA, 19 bp, Homo sapiens
ccatgatttagcaagcaac

SEQ ID NO: 6048341 - DNA, 17 bp, Homo sapiens
ccatgatttcccactgc

SEQ ID NO: 6048342 - DNA, 20 bp, Homo sapiens
ccatgatttcccactgcact

SEQ ID NO: 6048343 - DNA, 15 bp, Homo sapiens
ccatgatttggggtg

SEQ ID NO: 6048344 - DNA, 19 bp, Homo sapiens
ccatgatttgtcccagcct

SEQ ID NO: 6048345 - DNA, 20 bp, Homo sapiens
ccatgatttgtcccagcctg

SEQ ID NO: 6048346 - DNA, 22 bp, Homo sapiens
ccatgatttgtcccagcctggg

SEQ ID NO: 6048347 - DNA, 18 bp, Homo sapiens
ccatgcaaattgtgaaat

SEQ ID NO: 6048348 - DNA, 17 bp, Homo sapiens
ccatgcaactccatgcc

SEQ ID NO: 6048349 - DNA, 18 bp, Homo sapiens
ccatgcaactccatgcct

SEQ ID NO: 6048350 - DNA, 16 bp, Homo sapiens
ccatgcaagcagagga

SEQ ID NO: 6048351 - DNA, 23 bp, Homo sapiens
ccatgcaagcagaggaccagggc

SEQ ID NO: 6048352 - DNA, 13 bp, Homo sapiens
ccatgcaaggtgc

SEQ ID NO: 6048353 - DNA, 20 bp, Homo sapiens
ccatgcaaggtgcccacatg

SEQ ID NO: 6048354 - DNA, 15 bp, Homo sapiens
ccatgcaagtgctgt

SEQ ID NO: 6048355 - DNA, 18 bp, Homo sapiens
ccatgcaagtgctgtttg

SEQ ID NO: 6048356 - DNA, 19 bp, Homo sapiens
ccatgcaatatttcctcat

SEQ ID NO: 6048357 - DNA, 22 bp, Homo sapiens
ccatgcaattttattaaatgca

SEQ ID NO: 6048358 - DNA, 23 bp, Homo sapiens
ccatgcacaagatgccccaggga

SEQ ID NO: 6048359 - DNA, 16 bp, Homo sapiens
ccatgcacagaacaag

SEQ ID NO: 6048360 - DNA, 14 bp, Homo sapiens
ccatgcacagtaca

SEQ ID NO: 6048361 - DNA, 21 bp, Homo sapiens
ccatgcaccaggactggctgt

SEQ ID NO: 6048362 - DNA, 17 bp, Homo sapiens
ccatgcacccctgatgt

SEQ ID NO: 6048363 - DNA, 18 bp, Homo sapiens
ccatgcacctcagggcca

SEQ ID NO: 6048364 - DNA, 22 bp, Homo sapiens
ccatgcacgcaccccgcccctg

SEQ ID NO: 6048365 - DNA, 17 bp, Homo sapiens
ccatgcactcaataaag

SEQ ID NO: 6048366 - DNA, 13 bp, Homo sapiens
ccatgcactgtga

SEQ ID NO: 6048367 - DNA, 15 bp, Homo sapiens
ccatgcactgtgaag

SEQ ID NO: 6048368 - DNA, 16 bp, Homo sapiens
ccatgcactgtgaagg

SEQ ID NO: 6048369 - DNA, 14 bp, Homo sapiens
ccatgcagaacacc

SEQ ID NO: 6048370 - DNA, 17 bp, Homo sapiens
ccatgcagatctagcca

SEQ ID NO: 6048371 - DNA, 21 bp, Homo sapiens
ccatgcagatctagccaggcc

SEQ ID NO: 6048372 - DNA, 17 bp, Homo sapiens
ccatgcagcccctgggc

SEQ ID NO: 6048373 - DNA, 19 bp, Homo sapiens
ccatgcagcccctgggccc

SEQ ID NO: 6048374 - DNA, 20 bp, Homo sapiens
ccatgcagcccctgggccct

SEQ ID NO: 6048375 - DNA, 11 bp, Homo sapiens
ccatgcagcct

SEQ ID NO: 6048376 - DNA, 13 bp, Homo sapiens
ccatgcagccttg

SEQ ID NO: 6048377 - DNA, 15 bp, Homo sapiens
ccatgcagctgctcc

SEQ ID NO: 6048378 - DNA, 14 bp, Homo sapiens
ccatgcagcttcat

SEQ ID NO: 6048379 - DNA, 16 bp, Homo sapiens
ccatgcaggaggtgga

SEQ ID NO: 6048380 - DNA, 20 bp, Homo sapiens
ccatgcaggcagcctgcaga

SEQ ID NO: 6048381 - DNA, 13 bp, Homo sapiens
ccatgcaggtggt

SEQ ID NO: 6048382 - DNA, 23 bp, Homo sapiens
ccatgcaggtggtgtcgggccct

SEQ ID NO: 6048383 - DNA, 16 bp, Homo sapiens
ccatgcatcttccact

SEQ ID NO: 6048384 - DNA, 16 bp, Homo sapiens
ccatgcatggcctccc

SEQ ID NO: 6048385 - DNA, 23 bp, Homo sapiens
ccatgcatggcctcccagccacc

SEQ ID NO: 6048386 - DNA, 11 bp, Homo sapiens
ccatgcatttc

SEQ ID NO: 6048387 - DNA, 13 bp, Homo sapiens
ccatgccaatgtc

SEQ ID NO: 6048388 - DNA, 14 bp, Homo sapiens
ccatgccaccaccc

SEQ ID NO: 6048389 - DNA, 17 bp, Homo sapiens
ccatgccaccacccacc

SEQ ID NO: 6048390 - DNA, 13 bp, Homo sapiens
ccatgccacgttc

SEQ ID NO: 6048391 - DNA, 17 bp, Homo sapiens
ccatgccactgccaggc

SEQ ID NO: 6048392 - DNA, 19 bp, Homo sapiens
cattgaagtatggtgtgtt

SEQ ID NO: 6048393 - DNA, 16 bp, Homo sapiens
cattgaagtcagatgt

SEQ ID NO: 6048394 - DNA, 14 bp, Homo sapiens
cattgaatatcagt

SEQ ID NO: 6048395 - DNA, 13 bp, Homo sapiens
cattgaatcctca

SEQ ID NO: 6048396 - DNA, 17 bp, Homo sapiens
cattgaattataaaagc

SEQ ID NO: 6048397 - DNA, 18 bp, Homo sapiens
cattgacaaatctgtgta

SEQ ID NO: 6048398 - DNA, 22 bp, Homo sapiens
cattgacaccaaatattttcaa

SEQ ID NO: 6048399 - DNA, 14 bp, Homo sapiens
cattgacagcaatt

SEQ ID NO: 6048400 - DNA, 22 bp, Homo sapiens
cattgacagtggtgggcgggga

SEQ ID NO: 6048401 - DNA, 22 bp, Homo sapiens
cattgacataggtcataaagca

SEQ ID NO: 6048402 - DNA, 14 bp, Homo sapiens
cattgacatgatat

SEQ ID NO: 6048403 - DNA, 15 bp, Homo sapiens
cattgacatgtacag

SEQ ID NO: 6048404 - DNA, 21 bp, Homo sapiens
cattgacatgtacagagaact

SEQ ID NO: 6048405 - DNA, 22 bp, Homo sapiens
cattgacatgtacagagaacta

SEQ ID NO: 6048406 - DNA, 16 bp, Homo sapiens
cattgaccaagaactg

SEQ ID NO: 6048407 - DNA, 18 bp, Homo sapiens
cattgaccaagaactgca

SEQ ID NO: 6048408 - DNA, 21 bp, Homo sapiens
cattgaccaagaactgcatgg

SEQ ID NO: 6048409 - DNA, 15 bp, Homo sapiens
cattgaccagctctc

SEQ ID NO: 6048410 - DNA, 22 bp, Homo sapiens
cattgaccgcgactaatttcaa

SEQ ID NO: 6048411 - DNA, 21 bp, Homo sapiens
cattgaccgtgctggccccag

SEQ ID NO: 6048412 - DNA, 16 bp, Homo sapiens
cattgacctaattgtt

SEQ ID NO: 6048413 - DNA, 17 bp, Homo sapiens
cattgacctaattgtta

SEQ ID NO: 6048414 - DNA, 17 bp, Homo sapiens
cattgacctctcagggc

SEQ ID NO: 6048415 - DNA, 21 bp, Homo sapiens
cattgacctctcagggcctgg

SEQ ID NO: 6048416 - DNA, 15 bp, Homo sapiens
cattgacctgaggcc

SEQ ID NO: 6048417 - DNA, 17 bp, Homo sapiens
cattgacctgaggccct

SEQ ID NO: 6048418 - DNA, 16 bp, Homo sapiens
cattgacctggagggg

SEQ ID NO: 6048419 - DNA, 20 bp, Homo sapiens
cattgacctggaggggagag

SEQ ID NO: 6048420 - DNA, 23 bp, Homo sapiens
cattgacctggaggggagaggtc

SEQ ID NO: 6048421 - DNA, 17 bp, Homo sapiens
cattgaccttaatttct

SEQ ID NO: 6048422 - DNA, 23 bp, Homo sapiens
cattgacgattccttctctgaac

SEQ ID NO: 6048423 - DNA, 22 bp, Homo sapiens
cattgactatttttgtttttat

SEQ ID NO: 6048424 - DNA, 18 bp, Homo sapiens
cattgactcctttccaat

SEQ ID NO: 6048425 - DNA, 19 bp, Homo sapiens
cattgacttcaagatgcct

SEQ ID NO: 6048426 - DNA, 17 bp, Homo sapiens
cattgacttcattttat

SEQ ID NO: 6048427 - DNA, 22 bp, Homo sapiens
cattgacttcattttatattta

SEQ ID NO: 6048428 - DNA, 22 bp, Homo sapiens
cattgacttcttggtgctgttg

SEQ ID NO: 6048429 - DNA, 18 bp, Homo sapiens
cattgagaactgcatatg

SEQ ID NO: 6048430 - DNA, 19 bp, Homo sapiens
cattgagaactgcatatgt

SEQ ID NO: 6048431 - DNA, 20 bp, Homo sapiens
cattgagacttacggcaaga

SEQ ID NO: 6048432 - DNA, 15 bp, Homo sapiens
cattgagagtaagca

SEQ ID NO: 6048433 - DNA, 18 bp, Homo sapiens
cattgagagttttgtctt

SEQ ID NO: 6048434 - DNA, 14 bp, Homo sapiens
cattgagatctcca

SEQ ID NO: 6048435 - DNA, 17 bp, Homo sapiens
cattgagcatttgaaag

SEQ ID NO: 6048436 - DNA, 19 bp, Homo sapiens
cattgagctgatataaatt

SEQ ID NO: 6048437 - DNA, 14 bp, Homo sapiens
cattgagctgcctc

SEQ ID NO: 6048438 - DNA, 15 bp, Homo sapiens
cattgagctgtgcaa

SEQ ID NO: 6048439 - DNA, 19 bp, Homo sapiens
cattgagcttgcatgcttg

SEQ ID NO: 6048440 - DNA, 18 bp, Homo sapiens
cattgaggataaattgcc

SEQ ID NO: 6048441 - DNA, 22 bp, Homo sapiens
cattgagggaaaacataatatc

SEQ ID NO: 6048442 - DNA, 13 bp, Homo sapiens
cattgagggctct

SEQ ID NO: 6048443 - DNA, 21 bp, Homo sapiens
cattgagtagacacatttaag

SEQ ID NO: 6048444 - DNA, 14 bp, Homo sapiens
cattgagtattgtt

SEQ ID NO: 6048445 - DNA, 16 bp, Homo sapiens
cattgagtattgttta

SEQ ID NO: 6048446 - DNA, 18 bp, Homo sapiens
cattgagtattgtttaaa

SEQ ID NO: 6048447 - DNA, 14 bp, Homo sapiens
cattgagtccagct

SEQ ID NO: 6048448 - DNA, 18 bp, Homo sapiens
cattgagtgctgggggag

SEQ ID NO: 6048449 - DNA, 20 bp, Homo sapiens
cattgagtttaagtctctga

SEQ ID NO: 6048450 - DNA, 23 bp, Homo sapiens
cattgagtttaagtctctgactc

SEQ ID NO: 6048451 - DNA, 21 bp, Homo sapiens
cattgataattcgagcaaaca

SEQ ID NO: 6048452 - DNA, 22 bp, Homo sapiens
cattgataattcgagcaaacaa

SEQ ID NO: 6048453 - DNA, 16 bp, Homo sapiens
cattgatacaaagtac

SEQ ID NO: 6048454 - DNA, 22 bp, Homo sapiens
cattgatatgaaaaatatgata

SEQ ID NO: 6048455 - DNA, 20 bp, Homo sapiens
cattgatattgtgaacattt

SEQ ID NO: 6048456 - DNA, 16 bp, Homo sapiens
cattgatatttgtgca

SEQ ID NO: 6048457 - DNA, 19 bp, Homo sapiens
cattgatatttgtgcattt

SEQ ID NO: 6048458 - DNA, 23 bp, Homo sapiens
cattgatatttgtgcattttcta

SEQ ID NO: 6048459 - DNA, 17 bp, Homo sapiens
cattgatccaggagata

SEQ ID NO: 6048460 - DNA, 20 bp, Homo sapiens
cattgatcctagtgtcttta

SEQ ID NO: 6048461 - DNA, 21 bp, Homo sapiens
cattgatctgttttacaggaa

SEQ ID NO: 6048462 - DNA, 15 bp, Homo sapiens
cattgatcttaaact

SEQ ID NO: 6048463 - DNA, 15 bp, Homo sapiens
cattgatgccaagct

SEQ ID NO: 6048464 - DNA, 20 bp, Homo sapiens
cattgatgccaagctttttt

SEQ ID NO: 6048465 - DNA, 19 bp, Homo sapiens
cattgatggagcctgaacc

SEQ ID NO: 6048466 - DNA, 18 bp, Homo sapiens
cattgatgggatttttgt

SEQ ID NO: 6048467 - DNA, 15 bp, Homo sapiens
cattgattcagcctg

SEQ ID NO: 6048468 - DNA, 23 bp, Homo sapiens
cattgattgctgtgtccaactcc

SEQ ID NO: 6048469 - DNA, 18 bp, Homo sapiens
cattgattggataaatgc

SEQ ID NO: 6048470 - DNA, 16 bp, Homo sapiens
cattgattgtcagcta

SEQ ID NO: 6048471 - DNA, 17 bp, Homo sapiens
cattgattgtcagctac

SEQ ID NO: 6048472 - DNA, 18 bp, Homo sapiens
cattgattgtcagctact

SEQ ID NO: 6048473 - DNA, 13 bp, Homo sapiens
cattgatttgatt

SEQ ID NO: 6048474 - DNA, 19 bp, Homo sapiens
cattgattttataattggt

SEQ ID NO: 6048475 - DNA, 22 bp, Homo sapiens
cattgatttttaacctcaaaat

SEQ ID NO: 6048476 - DNA, 22 bp, Homo sapiens
cattgcaaaaggttaagccata

SEQ ID NO: 6048477 - DNA, 21 bp, Homo sapiens
cattgcaaaatagaagaagag

SEQ ID NO: 6048478 - DNA, 19 bp, Homo sapiens
cattgcaaacaactgaaat

SEQ ID NO: 6048479 - DNA, 17 bp, Homo sapiens
cattgcaaagtgcgctc

SEQ ID NO: 6048480 - DNA, 15 bp, Homo sapiens
cattgcaacaaaata

SEQ ID NO: 6048481 - DNA, 14 bp, Homo sapiens
cattgcaatagaaa

SEQ ID NO: 6048482 - DNA, 12 bp, Homo sapiens
cattgcacccag

SEQ ID NO: 6048483 - DNA, 16 bp, Homo sapiens
cattgcacccagccca

SEQ ID NO: 6048484 - DNA, 17 bp, Homo sapiens
cattgcactaaaagtga

SEQ ID NO: 6048485 - DNA, 19 bp, Homo sapiens
cattgcactaaaagtgatg

SEQ ID NO: 6048486 - DNA, 21 bp, Homo sapiens
cattgcactaaaagtgatgtg

SEQ ID NO: 6048487 - DNA, 14 bp, Homo sapiens
cattgcactccagc

SEQ ID NO: 6048488 - DNA, 16 bp, Homo sapiens
cattgcactccagcct

SEQ ID NO: 6048489 - DNA, 18 bp, Homo sapiens
cattgcactccagcctgg

SEQ ID NO: 6048490 - DNA, 18 bp, Homo sapiens
cattgcactcccgcctgg

SEQ ID NO: 6048491 - DNA, 18 bp, Homo sapiens
cattgcactttcctttca

SEQ ID NO: 6048492 - DNA, 19 bp, Homo sapiens
cattgcactttcctttcaa

SEQ ID NO: 6048493 - DNA, 20 bp, Homo sapiens
cattgcactttcctttcaat

SEQ ID NO: 6048494 - DNA, 21 bp, Homo sapiens
cattgcactttcctttcaata

SEQ ID NO: 6048495 - DNA, 23 bp, Homo sapiens
cattgcactttcctttcaataaa

SEQ ID NO: 6048496 - DNA, 18 bp, Homo sapiens
cattgcagaacatgagtg

SEQ ID NO: 6048497 - DNA, 22 bp, Homo sapiens
cattgcagaacatgagtgctga

SEQ ID NO: 6048498 - DNA, 17 bp, Homo sapiens
cattgcagatcccagcc

SEQ ID NO: 6048499 - DNA, 11 bp, Homo sapiens
cattgcagcct

SEQ ID NO: 6048500 - DNA, 19 bp, Homo sapiens
cattgcagcctaagaagaa

SEQ ID NO: 6048501 - DNA, 14 bp, Homo sapiens
cattgcagccttgc

SEQ ID NO: 6048502 - DNA, 19 bp, Homo sapiens
cattgcagtatcagagggt

SEQ ID NO: 6048503 - DNA, 23 bp, Homo sapiens
cattgcagtatcagagggtggag

SEQ ID NO: 6048504 - DNA, 16 bp, Homo sapiens
cattgcagtctgcttc

SEQ ID NO: 6048505 - DNA, 12 bp, Homo sapiens
cattgcagttta

SEQ ID NO: 6048506 - DNA, 20 bp, Homo sapiens
cattgcagtttaagagcaga

SEQ ID NO: 6048507 - DNA, 23 bp, Homo sapiens
cattgcataagtggacccagctg

SEQ ID NO: 6048508 - DNA, 16 bp, Homo sapiens
cattgcatataactta

SEQ ID NO: 6048509 - DNA, 18 bp, Homo sapiens
cattgcatcatgaaactc

SEQ ID NO: 6048510 - DNA, 19 bp, Homo sapiens
cattgcatcatgaaactct

SEQ ID NO: 6048511 - DNA, 12 bp, Homo sapiens
cattgcattcta

SEQ ID NO: 6048512 - DNA, 18 bp, Homo sapiens
cattgcattctattgcct

SEQ ID NO: 6048513 - DNA, 19 bp, Homo sapiens
cattgcattctattgcctt

SEQ ID NO: 6048514 - DNA, 11 bp, Homo sapiens
cattgcattta

SEQ ID NO: 6048515 - DNA, 16 bp, Homo sapiens
cattgcatttattgca

SEQ ID NO: 6048516 - DNA, 15 bp, Homo sapiens
cattgccaaaaagga

SEQ ID NO: 6048517 - DNA, 18 bp, Homo sapiens
cattgccaggagatggcc

SEQ ID NO: 6048518 - DNA, 21 bp, Homo sapiens
cattgccaggagatggcccca

SEQ ID NO: 6048519 - DNA, 17 bp, Homo sapiens
cattgccagtgtctttc

SEQ ID NO: 6048520 - DNA, 21 bp, Homo sapiens
cattgccagtgtctttctttg

SEQ ID NO: 6048521 - DNA, 15 bp, Homo sapiens
cattgccatcagtga

SEQ ID NO: 6048522 - DNA, 20 bp, Homo sapiens
cattgccatgtaactatgta

SEQ ID NO: 6048523 - DNA, 20 bp, Homo sapiens
cattgccattccctgcctgg

SEQ ID NO: 6048524 - DNA, 14 bp, Homo sapiens
cattgcccacacct

SEQ ID NO: 6048525 - DNA, 20 bp, Homo sapiens
cattgcccacacctgcctct

SEQ ID NO: 6048526 - DNA, 18 bp, Homo sapiens
cattgcccagtctttcat

SEQ ID NO: 6048527 - DNA, 15 bp, Homo sapiens
cattgcccagtgagc

SEQ ID NO: 6048528 - DNA, 20 bp, Homo sapiens
cattgcccagtgagccctgc

SEQ ID NO: 6048529 - DNA, 21 bp, Homo sapiens
cattgcccagtgagccctgct

SEQ ID NO: 6048530 - DNA, 23 bp, Homo sapiens
cattgcccagtgagccctgctct

SEQ ID NO: 6048531 - DNA, 19 bp, Homo sapiens
cattgcccatggctgggaa

SEQ ID NO: 6048532 - DNA, 23 bp, Homo sapiens
cattgccccaaatggattcctgt

SEQ ID NO: 6048533 - DNA, 15 bp, Homo sapiens
cattgccccatgaga

SEQ ID NO: 6048534 - DNA, 17 bp, Homo sapiens
cattgcccccacctctg

SEQ ID NO: 6048535 - DNA, 20 bp, Homo sapiens
cattgcccccacctctggtc

SEQ ID NO: 6048536 - DNA, 17 bp, Homo sapiens
cattgccctgaggggcc

SEQ ID NO: 6048537 - DNA, 22 bp, Homo sapiens
cattgccctgaggggcctgcca

SEQ ID NO: 6048538 - DNA, 14 bp, Homo sapiens
cattgccggcgagt

SEQ ID NO: 6048539 - DNA, 13 bp, Homo sapiens
cattgcctatttc

SEQ ID NO: 6048540 - DNA, 23 bp, Homo sapiens
cattgcctcatttcttcctctgc

SEQ ID NO: 6048541 - DNA, 18 bp, Homo sapiens
cattgcctcggctggctc

SEQ ID NO: 6048542 - DNA, 19 bp, Homo sapiens
cattgcctcttctacttgt

SEQ ID NO: 6048543 - DNA, 13 bp, Homo sapiens
cattgcctctttt

SEQ ID NO: 6048544 - DNA, 12 bp, Homo sapiens
cattgcctggac

SEQ ID NO: 6048545 - DNA, 15 bp, Homo sapiens
cattgcctggactga

SEQ ID NO: 6048546 - DNA, 16 bp, Homo sapiens
cattgcctgtaacaat

SEQ ID NO: 6048547 - DNA, 17 bp, Homo sapiens
cattgcctgtaacaatg

SEQ ID NO: 6048548 - DNA, 12 bp, Homo sapiens
cattgccttcct

SEQ ID NO: 6048549 - DNA, 19 bp, Homo sapiens
cattgccttcctaccctct

SEQ ID NO: 6048550 - DNA, 17 bp, Homo sapiens
cattgccttcgctccat

SEQ ID NO: 6048551 - DNA, 21 bp, Homo sapiens
cattgccttctctgcccacag

SEQ ID NO: 6048552 - DNA, 13 bp, Homo sapiens
cattgccttctgg

SEQ ID NO: 6048553 - DNA, 15 bp, Homo sapiens
cattgccttctgggg

SEQ ID NO: 6048554 - DNA, 15 bp, Homo sapiens
cattgcctttccagg

SEQ ID NO: 6048555 - DNA, 14 bp, Homo sapiens
cattgcctttgaat

SEQ ID NO: 6048556 - DNA, 22 bp, Homo sapiens
cattgcctttgaatgttaattt

SEQ ID NO: 6048557 - DNA, 17 bp, Homo sapiens
cattgcggacagccacg

SEQ ID NO: 6048558 - DNA, 18 bp, Homo sapiens
cattgcgttattttcttt

SEQ ID NO: 6048559 - DNA, 15 bp, Homo sapiens
cattgctaagatgct

SEQ ID NO: 6048560 - DNA, 13 bp, Homo sapiens
cattgctacactt

SEQ ID NO: 6048561 - DNA, 12 bp, Homo sapiens
cattgctaccac

SEQ ID NO: 6048562 - DNA, 17 bp, Homo sapiens
cattgctaccacagact

SEQ ID NO: 6048563 - DNA, 21 bp, Homo sapiens
cattgctaccacagacttgca

SEQ ID NO: 6048564 - DNA, 18 bp, Homo sapiens
cattgctacctcagtgct

SEQ ID NO: 6048565 - DNA, 15 bp, Homo sapiens
cattgctcagcccgc

SEQ ID NO: 6048566 - DNA, 16 bp, Homo sapiens
cattgctcagcccgct

SEQ ID NO: 6048567 - DNA, 17 bp, Homo sapiens
cattgctccaagatgtt

SEQ ID NO: 6048568 - DNA, 15 bp, Homo sapiens
cattgctcccctgat

SEQ ID NO: 6048569 - DNA, 23 bp, Homo sapiens
ccatgccactgccaggcacctgg

SEQ ID NO: 6048570 - DNA, 14 bp, Homo sapiens
ccatgccagaccca

SEQ ID NO: 6048571 - DNA, 20 bp, Homo sapiens
ccatgccagattctgcctct

SEQ ID NO: 6048572 - DNA, 22 bp, Homo sapiens
ccatgccagattctgcctctct

SEQ ID NO: 6048573 - DNA, 14 bp, Homo sapiens
ccatgccagcgcag

SEQ ID NO: 6048574 - DNA, 15 bp, Homo sapiens
ccatgccagctggcc

SEQ ID NO: 6048575 - DNA, 15 bp, Homo sapiens
ccatgccaggaacct

SEQ ID NO: 6048576 - DNA, 16 bp, Homo sapiens
ccatgcccacctgccc

SEQ ID NO: 6048577 - DNA, 22 bp, Homo sapiens
ccatgcccacgcccctccccag

SEQ ID NO: 6048578 - DNA, 14 bp, Homo sapiens
ccatgcccactgct

SEQ ID NO: 6048579 - DNA, 19 bp, Homo sapiens
ccatgcccactgctggtgc

SEQ ID NO: 6048580 - DNA, 20 bp, Homo sapiens
ccatgcccactgctggtgcc

SEQ ID NO: 6048581 - DNA, 13 bp, Homo sapiens
ccatgcccagaga

SEQ ID NO: 6048582 - DNA, 18 bp, Homo sapiens
ccatgcccagctcagagg

SEQ ID NO: 6048583 - DNA, 13 bp, Homo sapiens
ccatgcccaggac

SEQ ID NO: 6048584 - DNA, 17 bp, Homo sapiens
ccatgccccacccccct

SEQ ID NO: 6048585 - DNA, 14 bp, Homo sapiens
ccatgccccaggat

SEQ ID NO: 6048586 - DNA, 16 bp, Homo sapiens
ccatgccccaggatca

SEQ ID NO: 6048587 - DNA, 13 bp, Homo sapiens
ccatgccccagtc

SEQ ID NO: 6048588 - DNA, 22 bp, Homo sapiens
ccatgcccccgccacctcccca

SEQ ID NO: 6048589 - DNA, 13 bp, Homo sapiens
ccatgcccccttc

SEQ ID NO: 6048590 - DNA, 13 bp, Homo sapiens
ccatgcccctgac

SEQ ID NO: 6048591 - DNA, 14 bp, Homo sapiens
ccatgccctagacc

SEQ ID NO: 6048592 - DNA, 15 bp, Homo sapiens
ccatgccctagaccc

SEQ ID NO: 6048593 - DNA, 16 bp, Homo sapiens
ccatgccctcatcccg

SEQ ID NO: 6048594 - DNA, 15 bp, Homo sapiens
ccatgccctcccagg

SEQ ID NO: 6048595 - DNA, 12 bp, Homo sapiens
ccatgccctccg

SEQ ID NO: 6048596 - DNA, 12 bp, Homo sapiens
ccatgccctgcc

SEQ ID NO: 6048597 - DNA, 23 bp, Homo sapiens
ccatgccctgccaagcctggagc

SEQ ID NO: 6048598 - DNA, 18 bp, Homo sapiens
ccatgccggtacacagcc

SEQ ID NO: 6048599 - DNA, 14 bp, Homo sapiens
ccatgcctcagccc

SEQ ID NO: 6048600 - DNA, 15 bp, Homo sapiens
ccatgcctcagccct

SEQ ID NO: 6048601 - DNA, 21 bp, Homo sapiens
ccatgcctcagccctgaccct

SEQ ID NO: 6048602 - DNA, 14 bp, Homo sapiens
ccatgcctccctgg

SEQ ID NO: 6048603 - DNA, 22 bp, Homo sapiens
ccatgcctccctgggccacctc

SEQ ID NO: 6048604 - DNA, 23 bp, Homo sapiens
ccatgcctccctgggccacctcc

SEQ ID NO: 6048605 - DNA, 22 bp, Homo sapiens
ccatgcctctggaggcctctgg

SEQ ID NO: 6048606 - DNA, 13 bp, Homo sapiens
ccatgcctgaggg

SEQ ID NO: 6048607 - DNA, 15 bp, Homo sapiens
ccatgcctgagggtg

SEQ ID NO: 6048608 - DNA, 18 bp, Homo sapiens
ccatgcctgctccctgtc

SEQ ID NO: 6048609 - DNA, 19 bp, Homo sapiens
ccatgcctgctccctgtct

SEQ ID NO: 6048610 - DNA, 15 bp, Homo sapiens
ccatgcctggccctt

SEQ ID NO: 6048611 - DNA, 16 bp, Homo sapiens
ccatgccttaaaccta

SEQ ID NO: 6048612 - DNA, 22 bp, Homo sapiens
ccatgcgacactgggaggccag

SEQ ID NO: 6048613 - DNA, 23 bp, Homo sapiens
ccatgcgaggggccagcagaggg

SEQ ID NO: 6048614 - DNA, 19 bp, Homo sapiens
ccatgcgcgcgctctctct

SEQ ID NO: 6048615 - DNA, 20 bp, Homo sapiens
ccatgcgcgcgctctctctc

SEQ ID NO: 6048616 - DNA, 14 bp, Homo sapiens
ccatgcgctgctca

SEQ ID NO: 6048617 - DNA, 19 bp, Homo sapiens
ccatgcgctgctcaacctc

SEQ ID NO: 6048618 - DNA, 20 bp, Homo sapiens
ccatgcgtgctgagaggcga

SEQ ID NO: 6048619 - DNA, 14 bp, Homo sapiens
ccatgctacagtta

SEQ ID NO: 6048620 - DNA, 16 bp, Homo sapiens
ccatgctcagaaatgt

SEQ ID NO: 6048621 - DNA, 16 bp, Homo sapiens
ccatgctcatctgctg

SEQ ID NO: 6048622 - DNA, 20 bp, Homo sapiens
ccatgctcatctgctggtcc

SEQ ID NO: 6048623 - DNA, 16 bp, Homo sapiens
ccatgctccagggtca

SEQ ID NO: 6048624 - DNA, 15 bp, Homo sapiens
ccatgctcctcacct

SEQ ID NO: 6048625 - DNA, 21 bp, Homo sapiens
ccatgctcctcactgcccgca

SEQ ID NO: 6048626 - DNA, 22 bp, Homo sapiens
ccatgctcctcactgcccgcac

SEQ ID NO: 6048627 - DNA, 18 bp, Homo sapiens
ccatgctcctcttcccca

SEQ ID NO: 6048628 - DNA, 20 bp, Homo sapiens
ccatgctccttgagaggaga

SEQ ID NO: 6048629 - DNA, 15 bp, Homo sapiens
ccatgctctctcacc

SEQ ID NO: 6048630 - DNA, 23 bp, Homo sapiens
ccatgctctctcacctgctccca

SEQ ID NO: 6048631 - DNA, 14 bp, Homo sapiens
ccatgctctgcccc

SEQ ID NO: 6048632 - DNA, 15 bp, Homo sapiens
ccatgctctgcccca

SEQ ID NO: 6048633 - DNA, 23 bp, Homo sapiens
ccatgctctttcaccctgccacc

SEQ ID NO: 6048634 - DNA, 20 bp, Homo sapiens
ccatgctgaaggctcccatt

SEQ ID NO: 6048635 - DNA, 14 bp, Homo sapiens
ccatgctgaattat

SEQ ID NO: 6048636 - DNA, 20 bp, Homo sapiens
ccatgctgagacatccctca

SEQ ID NO: 6048637 - DNA, 23 bp, Homo sapiens
ccatgctgagacatccctcatct

SEQ ID NO: 6048638 - DNA, 14 bp, Homo sapiens
ccatgctgccctgt

SEQ ID NO: 6048639 - DNA, 18 bp, Homo sapiens
ccatgctgccttcaggga

SEQ ID NO: 6048640 - DNA, 14 bp, Homo sapiens
ccatgctgctgggg

SEQ ID NO: 6048641 - DNA, 21 bp, Homo sapiens
ccatgctgctggggaagacag

SEQ ID NO: 6048642 - DNA, 21 bp, Homo sapiens
ccatgctgctttttggcacag

SEQ ID NO: 6048643 - DNA, 22 bp, Homo sapiens
ccatgctgctttttggcacagt

SEQ ID NO: 6048644 - DNA, 14 bp, Homo sapiens
ccatgctggagcct

SEQ ID NO: 6048645 - DNA, 15 bp, Homo sapiens
ccatgctggagcctg

SEQ ID NO: 6048646 - DNA, 24 bp, Homo sapiens
ccatgctggagcctgtgtaacagc

SEQ ID NO: 6048647 - DNA, 18 bp, Homo sapiens
ccatgctggatactggac

SEQ ID NO: 6048648 - DNA, 19 bp, Homo sapiens
ccatgctggatactggaca

SEQ ID NO: 6048649 - DNA, 19 bp, Homo sapiens
ccatgctggcggcgcagag

SEQ ID NO: 6048650 - DNA, 15 bp, Homo sapiens
ccatgctggctgggg

SEQ ID NO: 6048651 - DNA, 20 bp, Homo sapiens
ccatgctggctggggccggg

SEQ ID NO: 6048652 - DNA, 13 bp, Homo sapiens
ccatgctgggccg

SEQ ID NO: 6048653 - DNA, 22 bp, Homo sapiens
ccatgctgggctcactacatgg

SEQ ID NO: 6048654 - DNA, 16 bp, Homo sapiens
ccatgctgggtctgag

SEQ ID NO: 6048655 - DNA, 21 bp, Homo sapiens
ccatgctgggtctgaggcccc

SEQ ID NO: 6048656 - DNA, 23 bp, Homo sapiens
ccatgctgggtctgaggcccctg

SEQ ID NO: 6048657 - DNA, 20 bp, Homo sapiens
ccatgctggtggaaagatag

SEQ ID NO: 6048658 - DNA, 17 bp, Homo sapiens
ccatgctgtccctgcac

SEQ ID NO: 6048659 - DNA, 22 bp, Homo sapiens
ccatgctgtccctgcactgtgc

SEQ ID NO: 6048660 - DNA, 19 bp, Homo sapiens
ccatgctgtccctgtgggc

SEQ ID NO: 6048661 - DNA, 22 bp, Homo sapiens
ccatgctgtccctgtgggctca

SEQ ID NO: 6048662 - DNA, 16 bp, Homo sapiens
ccatgctgtccggcct

SEQ ID NO: 6048663 - DNA, 19 bp, Homo sapiens
ccatgctgtgcgcccaggg

SEQ ID NO: 6048664 - DNA, 22 bp, Homo sapiens
ccatgcttagtcactgcctgca

SEQ ID NO: 6048665 - DNA, 18 bp, Homo sapiens
ccatgcttcttgcccctt

SEQ ID NO: 6048666 - DNA, 18 bp, Homo sapiens
ccatgcttgcctgaagct

SEQ ID NO: 6048667 - DNA, 19 bp, Homo sapiens
ccatgcttgcctgaagctt

SEQ ID NO: 6048668 - DNA, 15 bp, Homo sapiens
ccatgcttgggtgta

SEQ ID NO: 6048669 - DNA, 19 bp, Homo sapiens
ccatgctttatgtgggtta

SEQ ID NO: 6048670 - DNA, 19 bp, Homo sapiens
ccatgctttgagtccacgc

SEQ ID NO: 6048671 - DNA, 19 bp, Homo sapiens
ccatgctttgctctcaagg

SEQ ID NO: 6048672 - DNA, 21 bp, Homo sapiens
ccatggaaataaaaagtatgt

SEQ ID NO: 6048673 - DNA, 12 bp, Homo sapiens
ccatggaacagc

SEQ ID NO: 6048674 - DNA, 15 bp, Homo sapiens
ccatggaacagccct

SEQ ID NO: 6048675 - DNA, 16 bp, Homo sapiens
ccatggaacagccctg

SEQ ID NO: 6048676 - DNA, 20 bp, Homo sapiens
ccatggaaccatggaggagg

SEQ ID NO: 6048677 - DNA, 12 bp, Homo sapiens
ccatggaacctg

SEQ ID NO: 6048678 - DNA, 23 bp, Homo sapiens
ccatggaagaggctacagggcca

SEQ ID NO: 6048679 - DNA, 18 bp, Homo sapiens
ccatggaagctggcagga

SEQ ID NO: 6048680 - DNA, 14 bp, Homo sapiens
ccatggaaggtgcc

SEQ ID NO: 6048681 - DNA, 20 bp, Homo sapiens
ccatggaatgactgaagaca

SEQ ID NO: 6048682 - DNA, 14 bp, Homo sapiens
ccatggaatgcttg

SEQ ID NO: 6048683 - DNA, 15 bp, Homo sapiens
ccatggaatgcttga

SEQ ID NO: 6048684 - DNA, 18 bp, Homo sapiens
ccatggaatgcttgaaaa

SEQ ID NO: 6048685 - DNA, 19 bp, Homo sapiens
ccatggaattccctcctga

SEQ ID NO: 6048686 - DNA, 22 bp, Homo sapiens
ccatggacactacacccagcaa

SEQ ID NO: 6048687 - DNA, 23 bp, Homo sapiens
ccatggacactacacccagcaat

SEQ ID NO: 6048688 - DNA, 17 bp, Homo sapiens
ccatggaccagcccatt

SEQ ID NO: 6048689 - DNA, 19 bp, Homo sapiens
ccatggacctgcacttggc

SEQ ID NO: 6048690 - DNA, 19 bp, Homo sapiens
ccatggacgaatatgaatg

SEQ ID NO: 6048691 - DNA, 16 bp, Homo sapiens
ccatggactctgtcct

SEQ ID NO: 6048692 - DNA, 18 bp, Homo sapiens
ccatggagaaagctgact

SEQ ID NO: 6048693 - DNA, 20 bp, Homo sapiens
ccatggagaaagctgacttg

SEQ ID NO: 6048694 - DNA, 18 bp, Homo sapiens
ccatggagagctggagcc

SEQ ID NO: 6048695 - DNA, 20 bp, Homo sapiens
ccatggagatgaaatgcctt

SEQ ID NO: 6048696 - DNA, 14 bp, Homo sapiens
ccatggagcacgag

SEQ ID NO: 6048697 - DNA, 14 bp, Homo sapiens
ccatggagcaggga

SEQ ID NO: 6048698 - DNA, 13 bp, Homo sapiens
ccatggagcccca

SEQ ID NO: 6048699 - DNA, 13 bp, Homo sapiens
ccatggagcccct

SEQ ID NO: 6048700 - DNA, 16 bp, Homo sapiens
ccatggagcctacctc

SEQ ID NO: 6048701 - DNA, 23 bp, Homo sapiens
ccatggaggaaggctctgttcca

SEQ ID NO: 6048702 - DNA, 22 bp, Homo sapiens
ccatggaggagacaggaagcct

SEQ ID NO: 6048703 - DNA, 13 bp, Homo sapiens
ccatggaggcaga

SEQ ID NO: 6048704 - DNA, 17 bp, Homo sapiens
ccatggaggcagatgcc

SEQ ID NO: 6048705 - DNA, 21 bp, Homo sapiens
ccatggaggcagatgcccttg

SEQ ID NO: 6048706 - DNA, 19 bp, Homo sapiens
ccatggaggcgccttcctg

SEQ ID NO: 6048707 - DNA, 19 bp, Homo sapiens
ccatggagggagggagtgg

SEQ ID NO: 6048708 - DNA, 19 bp, Homo sapiens
ccatggagtgagacccagg

SEQ ID NO: 6048709 - DNA, 15 bp, Homo sapiens
ccatggagtggcagc

SEQ ID NO: 6048710 - DNA, 21 bp, Homo sapiens
ccatggagtggcagcccagcc

SEQ ID NO: 6048711 - DNA, 14 bp, Homo sapiens
ccatggatatgttg

SEQ ID NO: 6048712 - DNA, 23 bp, Homo sapiens
ccatggatgagtaaactgtttct

SEQ ID NO: 6048713 - DNA, 17 bp, Homo sapiens
ccatggatgcagaaatg

SEQ ID NO: 6048714 - DNA, 15 bp, Homo sapiens
ccatggatgcatgcc

SEQ ID NO: 6048715 - DNA, 16 bp, Homo sapiens
ccatggattcccctgg

SEQ ID NO: 6048716 - DNA, 21 bp, Homo sapiens
ccatggattgtacatattttt

SEQ ID NO: 6048717 - DNA, 18 bp, Homo sapiens
ccatggatttccactgct

SEQ ID NO: 6048718 - DNA, 20 bp, Homo sapiens
ccatggatttttacaagatc

SEQ ID NO: 6048719 - DNA, 23 bp, Homo sapiens
ccatggcaattttgtaaattgac

SEQ ID NO: 6048720 - DNA, 23 bp, Homo sapiens
ccatggcaccttcagactttgct

SEQ ID NO: 6048721 - DNA, 22 bp, Homo sapiens
ccatggcactaaaccacttctc

SEQ ID NO: 6048722 - DNA, 23 bp, Homo sapiens
ccatggcactaaaccacttctct

SEQ ID NO: 6048723 - DNA, 14 bp, Homo sapiens
ccatggcagcagcc

SEQ ID NO: 6048724 - DNA, 17 bp, Homo sapiens
ccatggcagcagccagg

SEQ ID NO: 6048725 - DNA, 20 bp, Homo sapiens
ccatggcagcagccagggac

SEQ ID NO: 6048726 - DNA, 22 bp, Homo sapiens
ccatggcagcagccagggaccc

SEQ ID NO: 6048727 - DNA, 15 bp, Homo sapiens
ccatggcagctcctg

SEQ ID NO: 6048728 - DNA, 17 bp, Homo sapiens
ccatggcaggaaggcgg

SEQ ID NO: 6048729 - DNA, 13 bp, Homo sapiens
ccatggccacccc

SEQ ID NO: 6048730 - DNA, 14 bp, Homo sapiens
ccatggccaccccg

SEQ ID NO: 6048731 - DNA, 13 bp, Homo sapiens
ccatggccagcag

SEQ ID NO: 6048732 - DNA, 21 bp, Homo sapiens
ccatggccagcagcacctgcc

SEQ ID NO: 6048733 - DNA, 19 bp, Homo sapiens
ccatggccatttctgtgga

SEQ ID NO: 6048734 - DNA, 20 bp, Homo sapiens
ccatggccatttctgtggag

SEQ ID NO: 6048735 - DNA, 18 bp, Homo sapiens
ccatggcccagcagcttg

SEQ ID NO: 6048736 - DNA, 19 bp, Homo sapiens
ccatggcccagcagcttgg

SEQ ID NO: 6048737 - DNA, 13 bp, Homo sapiens
ccatggccccagc

SEQ ID NO: 6048738 - DNA, 20 bp, Homo sapiens
ccatggcccccaataaaggc

SEQ ID NO: 6048739 - DNA, 17 bp, Homo sapiens
ccatggccccccactcc

SEQ ID NO: 6048740 - DNA, 15 bp, Homo sapiens
ccatggccctcatta

SEQ ID NO: 6048741 - DNA, 16 bp, Homo sapiens
ccatggccctgtccca

SEQ ID NO: 6048742 - DNA, 18 bp, Homo sapiens
ccatggccctgtcccagg

SEQ ID NO: 6048743 - DNA, 21 bp, Homo sapiens
ccatggccggctttcaggagc

SEQ ID NO: 6048744 - DNA, 14 bp, Homo sapiens
ccatggcctcagat

SEQ ID NO: 6048745 - DNA, 17 bp, Homo sapiens
ccatggcctctggccag

SEQ ID NO: 6048746 - DNA, 21 bp, Homo sapiens
ccatggcctgcaaactgggaa

SEQ ID NO: 6048747 - DNA, 22 bp, Homo sapiens
ccatggcctgcaaactgggaac

SEQ ID NO: 6048748 - DNA, 18 bp, Homo sapiens
ccatggcctgctgggctt

SEQ ID NO: 6048749 - DNA, 15 bp, Homo sapiens
ccatggccttccctc

SEQ ID NO: 6048750 - DNA, 21 bp, Homo sapiens
ccatggccttccctccccaca

SEQ ID NO: 6048751 - DNA, 17 bp, Homo sapiens
ccatggcctttctaata

SEQ ID NO: 6048752 - DNA, 19 bp, Homo sapiens
ccatggcgtgtccctctcg

SEQ ID NO: 6048753 - DNA, 13 bp, Homo sapiens
ccatggctcaggc

SEQ ID NO: 6048754 - DNA, 14 bp, Homo sapiens
ccatggctcaggca

SEQ ID NO: 6048755 - DNA, 20 bp, Homo sapiens
ccatggctctatttcttctt

SEQ ID NO: 6048756 - DNA, 11 bp, Homo sapiens
ccatggctctg

SEQ ID NO: 6048757 - DNA, 18 bp, Homo sapiens
ccatggctgaagctggag

SEQ ID NO: 6048758 - DNA, 21 bp, Homo sapiens
ccatggctgaagctggagcag

SEQ ID NO: 6048759 - DNA, 23 bp, Homo sapiens
ccatggctgaagctggagcagcg

SEQ ID NO: 6048760 - DNA, 15 bp, Homo sapiens
ccatggctggatgtg

SEQ ID NO: 6048761 - DNA, 21 bp, Homo sapiens
ccatggctggatgtgcatctg

SEQ ID NO: 6048762 - DNA, 11 bp, Homo sapiens
ccatggctggg

SEQ ID NO: 6048763 - DNA, 21 bp, Homo sapiens
ccatggctgggcgtgctagag

SEQ ID NO: 6048764 - DNA, 23 bp, Homo sapiens
ccatggctggggggtctcagcat

SEQ ID NO: 6048765 - DNA, 21 bp, Homo sapiens
ccatggctttcatcctgtgtc

SEQ ID NO: 6048766 - DNA, 19 bp, Homo sapiens
ccatggctttgtgctgctg

SEQ ID NO: 6048767 - DNA, 21 bp, Homo sapiens
ccatgggaaatgtcaacaagt

SEQ ID NO: 6048768 - DNA, 17 bp, Homo sapiens
ccatgggaacctcatat

SEQ ID NO: 6048769 - DNA, 15 bp, Homo sapiens
ccatgggaccacaac

SEQ ID NO: 6048770 - DNA, 19 bp, Homo sapiens
ccatgggagccagctgctt

SEQ ID NO: 6048771 - DNA, 21 bp, Homo sapiens
ccatgggagccagctgctttt

SEQ ID NO: 6048772 - DNA, 22 bp, Homo sapiens
ccatgggagctggttagaaatg

SEQ ID NO: 6048773 - DNA, 11 bp, Homo sapiens
ccatgggaggg

SEQ ID NO: 6048774 - DNA, 16 bp, Homo sapiens
ccatgggatacaacct

SEQ ID NO: 6048775 - DNA, 16 bp, Homo sapiens
ccatgggcacagtggt

SEQ ID NO: 6048776 - DNA, 17 bp, Homo sapiens
ccatgggcactgctggg

SEQ ID NO: 6048777 - DNA, 14 bp, Homo sapiens
ccatgggcagagcc

SEQ ID NO: 6048778 - DNA, 13 bp, Homo sapiens
ccatgggcaggag

SEQ ID NO: 6048779 - DNA, 13 bp, Homo sapiens
ccatgggccagcc

SEQ ID NO: 6048780 - DNA, 17 bp, Homo sapiens
ccatgggccagcctagc

SEQ ID NO: 6048781 - DNA, 18 bp, Homo sapiens
ccatgggccagcctagcc

SEQ ID NO: 6048782 - DNA, 20 bp, Homo sapiens
ccatgggccccaccatttat

SEQ ID NO: 6048783 - DNA, 18 bp, Homo sapiens
ccatgggcccgctgcctc

SEQ ID NO: 6048784 - DNA, 19 bp, Homo sapiens
ccatgggcccgctgcctct

SEQ ID NO: 6048785 - DNA, 20 bp, Homo sapiens
ccatgggcccgctgcctctt

SEQ ID NO: 6048786 - DNA, 13 bp, Homo sapiens
ccatgggcctcct

SEQ ID NO: 6048787 - DNA, 15 bp, Homo sapiens
ccatgggcctcctgt

SEQ ID NO: 6048788 - DNA, 11 bp, Homo sapiens
ccatgggcctg

SEQ ID NO: 6048789 - DNA, 20 bp, Homo sapiens
ccatgggcctgctgcgtcag

SEQ ID NO: 6048790 - DNA, 21 bp, Homo sapiens
ccatgggcctgctgcgtcaga

SEQ ID NO: 6048791 - DNA, 13 bp, Homo sapiens
ccatgggcctggg

SEQ ID NO: 6048792 - DNA, 16 bp, Homo sapiens
ccatgggcctgggcct

SEQ ID NO: 6048793 - DNA, 19 bp, Homo sapiens
ccatgggctacagtgtctg

SEQ ID NO: 6048794 - DNA, 20 bp, Homo sapiens
ccatgggctcagggccaggt

SEQ ID NO: 6048795 - DNA, 22 bp, Homo sapiens
ccatgggctcagggccaggtcc

SEQ ID NO: 6048796 - DNA, 14 bp, Homo sapiens
ccatgggctctggc

SEQ ID NO: 6048797 - DNA, 22 bp, Homo sapiens
ccatgggctgagtggggagcag

SEQ ID NO: 6048798 - DNA, 21 bp, Homo sapiens
ccatgggcttcactgtataaa

SEQ ID NO: 6048799 - DNA, 11 bp, Homo sapiens
ccatgggcttg

SEQ ID NO: 6048800 - DNA, 17 bp, Homo sapiens
ccatggggaagtgctcc

SEQ ID NO: 6048801 - DNA, 19 bp, Homo sapiens
ccatggggaagtgctcccc

SEQ ID NO: 6048802 - DNA, 23 bp, Homo sapiens
ccatggggacgccctcagtctag

SEQ ID NO: 6048803 - DNA, 12 bp, Homo sapiens
ccatggggaggg

SEQ ID NO: 6048804 - DNA, 20 bp, Homo sapiens
ccatggggagggattctggt

SEQ ID NO: 6048805 - DNA, 15 bp, Homo sapiens
ccatggggaggtggc

SEQ ID NO: 6048806 - DNA, 16 bp, Homo sapiens
ccatggggaggtggca

SEQ ID NO: 6048807 - DNA, 16 bp, Homo sapiens
ccatggggcagcctcc

SEQ ID NO: 6048808 - DNA, 17 bp, Homo sapiens
ccatggggcagcctcca

SEQ ID NO: 6048809 - DNA, 15 bp, Homo sapiens
ccatggggccctccc

SEQ ID NO: 6048810 - DNA, 16 bp, Homo sapiens
ccatgggggcacttga

SEQ ID NO: 6048811 - DNA, 13 bp, Homo sapiens
ccatgggggcagg

SEQ ID NO: 6048812 - DNA, 14 bp, Homo sapiens
ccatgggggcaggg

SEQ ID NO: 6048813 - DNA, 19 bp, Homo sapiens
ccatgggggtgctgcagcc

SEQ ID NO: 6048814 - DNA, 20 bp, Homo sapiens
ccatggggtcggctcctgat

SEQ ID NO: 6048815 - DNA, 16 bp, Homo sapiens
ccatggggtctctgca

SEQ ID NO: 6048816 - DNA, 23 bp, Homo sapiens
ccatggggtctctgcatcttcag

SEQ ID NO: 6048817 - DNA, 21 bp, Homo sapiens
ccatgggtcctcggcccatct

SEQ ID NO: 6048818 - DNA, 14 bp, Homo sapiens
ccatggtaaaaact

SEQ ID NO: 6048819 - DNA, 19 bp, Homo sapiens
ccatggtaaccagccacag

SEQ ID NO: 6048820 - DNA, 20 bp, Homo sapiens
ccatggtaatgtaacttaat

SEQ ID NO: 6048821 - DNA, 20 bp, Homo sapiens
ccatggtacccccttctggg

SEQ ID NO: 6048822 - DNA, 19 bp, Homo sapiens
ccatggtactgtagcaggg

SEQ ID NO: 6048823 - DNA, 22 bp, Homo sapiens
ccatggtactgtagcaggggaa

SEQ ID NO: 6048824 - DNA, 16 bp, Homo sapiens
ccatggtagaaaatgc

SEQ ID NO: 6048825 - DNA, 15 bp, Homo sapiens
ccatggtagactgtg

SEQ ID NO: 6048826 - DNA, 18 bp, Homo sapiens
ccatggtagactgtgaca

SEQ ID NO: 6048827 - DNA, 21 bp, Homo sapiens
ccatggtagcccatctctcct

SEQ ID NO: 6048828 - DNA, 19 bp, Homo sapiens
ccatggtagtttaaaacat

SEQ ID NO: 6048829 - DNA, 19 bp, Homo sapiens
ccatggtcacagacccctg

SEQ ID NO: 6048830 - DNA, 23 bp, Homo sapiens
ccatggtgaaagggtttgatatg

SEQ ID NO: 6048831 - DNA, 16 bp, Homo sapiens
ccatggtgaactgaag

SEQ ID NO: 6048832 - DNA, 22 bp, Homo sapiens
ccatggtgaactgaagcagagt

SEQ ID NO: 6048833 - DNA, 20 bp, Homo sapiens
ccatggtgaattaatcactt

SEQ ID NO: 6048834 - DNA, 22 bp, Homo sapiens
ccatggtgaattaatcactttt

SEQ ID NO: 6048835 - DNA, 17 bp, Homo sapiens
ccatggtgactgccaca

SEQ ID NO: 6048836 - DNA, 20 bp, Homo sapiens
ccatggtgatggtgtagccc

SEQ ID NO: 6048837 - DNA, 13 bp, Homo sapiens
ccatggtgcagtg

SEQ ID NO: 6048838 - DNA, 21 bp, Homo sapiens
ccatggtgcccgtgcctctgt

SEQ ID NO: 6048839 - DNA, 17 bp, Homo sapiens
ccatggtgctaggaaga

SEQ ID NO: 6048840 - DNA, 15 bp, Homo sapiens
ccatggtgctgcatt

SEQ ID NO: 6048841 - DNA, 14 bp, Homo sapiens
ccatggtgcttgtt

SEQ ID NO: 6048842 - DNA, 14 bp, Homo sapiens
ccatggtggaaggg

SEQ ID NO: 6048843 - DNA, 13 bp, Homo sapiens
ccatggtggaggg

SEQ ID NO: 6048844 - DNA, 16 bp, Homo sapiens
ccatggtggagggcac

SEQ ID NO: 6048845 - DNA, 22 bp, Homo sapiens
ccatggtggagggcacttcagg

SEQ ID NO: 6048846 - DNA, 21 bp, Homo sapiens
ccatggtggtttcagaaaggg

SEQ ID NO: 6048847 - DNA, 17 bp, Homo sapiens
ccatggtgtatgtggtt

SEQ ID NO: 6048848 - DNA, 15 bp, Homo sapiens
ccatggtgtcccggt

SEQ ID NO: 6048849 - DNA, 22 bp, Homo sapiens
ccatggttaccatgggtgtgga

SEQ ID NO: 6048850 - DNA, 21 bp, Homo sapiens
ccatggttctcaatttatttg

SEQ ID NO: 6048851 - DNA, 14 bp, Homo sapiens
ccatggttgagaaa

SEQ ID NO: 6048852 - DNA, 14 bp, Homo sapiens
ccatggttttggct

SEQ ID NO: 6048853 - DNA, 15 bp, Homo sapiens
ccatggttttggctc

SEQ ID NO: 6048854 - DNA, 17 bp, Homo sapiens
ccatgtaaaacaaaaaa

SEQ ID NO: 6048855 - DNA, 11 bp, Homo sapiens
ccatgtaaata

SEQ ID NO: 6048856 - DNA, 18 bp, Homo sapiens
ccatgtaaataagatgat

SEQ ID NO: 6048857 - DNA, 15 bp, Homo sapiens
ccatgtaacaaccag

SEQ ID NO: 6048858 - DNA, 19 bp, Homo sapiens
ccatgtaacaaccagagat

SEQ ID NO: 6048859 - DNA, 23 bp, Homo sapiens
ccatgtaacaaccagagatgact

SEQ ID NO: 6048860 - DNA, 16 bp, Homo sapiens
ccatgtaacagaaagg

SEQ ID NO: 6048861 - DNA, 19 bp, Homo sapiens
ccatgtaataagcacttgc

SEQ ID NO: 6048862 - DNA, 23 bp, Homo sapiens
ccatgtaatggcagttatatttt

SEQ ID NO: 6048863 - DNA, 19 bp, Homo sapiens
ccatgtaccagtgtactgc

SEQ ID NO: 6048864 - DNA, 23 bp, Homo sapiens
ccatgtaccagtgtactgctttc

SEQ ID NO: 6048865 - DNA, 14 bp, Homo sapiens
ccatgtacctcccc

SEQ ID NO: 6048866 - DNA, 15 bp, Homo sapiens
ccatgtactgtagtt

SEQ ID NO: 6048867 - DNA, 15 bp, Homo sapiens
ccatgtagaaaattt

SEQ ID NO: 6048868 - DNA, 16 bp, Homo sapiens
ccatgtagaaaatttg

SEQ ID NO: 6048869 - DNA, 20 bp, Homo sapiens
ccatgtagaataaatgaaga

SEQ ID NO: 6048870 - DNA, 14 bp, Homo sapiens
ccatgtagacccct

SEQ ID NO: 6048871 - DNA, 16 bp, Homo sapiens
ccatgtagcaggactg

SEQ ID NO: 6048872 - DNA, 20 bp, Homo sapiens
ccatgtagccccctggcctc

SEQ ID NO: 6048873 - DNA, 14 bp, Homo sapiens
ccatgtagctggca

SEQ ID NO: 6048874 - DNA, 22 bp, Homo sapiens
ccatgtagctggcaagctgcaa

SEQ ID NO: 6048875 - DNA, 14 bp, Homo sapiens
ccatgtatggccag

SEQ ID NO: 6048876 - DNA, 19 bp, Homo sapiens
ccatgtattatgaaaaaga

SEQ ID NO: 6048877 - DNA, 20 bp, Homo sapiens
ccatgtatttcagggacctc

SEQ ID NO: 6048878 - DNA, 13 bp, Homo sapiens
ccatgtcaatcaa

SEQ ID NO: 6048879 - DNA, 21 bp, Homo sapiens
ccatgtcaccggtcagtgcct

SEQ ID NO: 6048880 - DNA, 16 bp, Homo sapiens
ccatgtcacctcagct

SEQ ID NO: 6048881 - DNA, 13 bp, Homo sapiens
ccatgtcacctgg

SEQ ID NO: 6048882 - DNA, 13 bp, Homo sapiens
ccatgtcagacac

SEQ ID NO: 6048883 - DNA, 21 bp, Homo sapiens
ccatgtcagacacagattggc

SEQ ID NO: 6048884 - DNA, 22 bp, Homo sapiens
ccatgtcagataagtgtaaata

SEQ ID NO: 6048885 - DNA, 19 bp, Homo sapiens
ccatgtcaggccagcctgt

SEQ ID NO: 6048886 - DNA, 22 bp, Homo sapiens
ccatgtcatccgagcaaggtgg

SEQ ID NO: 6048887 - DNA, 13 bp, Homo sapiens
ccatgtcatgtga

SEQ ID NO: 6048888 - DNA, 17 bp, Homo sapiens
ccatgtccaaagaggct

SEQ ID NO: 6048889 - DNA, 19 bp, Homo sapiens
ccatgtccaagtccaacct

SEQ ID NO: 6048890 - DNA, 23 bp, Homo sapiens
ccatgtccaagtccaacctgcct

SEQ ID NO: 6048891 - DNA, 23 bp, Homo sapiens
ccatgtccaagttcttcacctct

SEQ ID NO: 6048892 - DNA, 19 bp, Homo sapiens
ccatgtccagagggactgg

SEQ ID NO: 6048893 - DNA, 21 bp, Homo sapiens
ccatgtcccagcctggcctgt

SEQ ID NO: 6048894 - DNA, 15 bp, Homo sapiens
ccatgtcccctccca

SEQ ID NO: 6048895 - DNA, 22 bp, Homo sapiens
ccatgtcctaggggccgaggga

SEQ ID NO: 6048896 - DNA, 16 bp, Homo sapiens
ccatgtcctatgcctc

SEQ ID NO: 6048897 - DNA, 15 bp, Homo sapiens
ccatgtcctcagcat

SEQ ID NO: 6048898 - DNA, 15 bp, Homo sapiens
ccatgtccttagcac

SEQ ID NO: 6048899 - DNA, 17 bp, Homo sapiens
ccatgtcgcctctgcat

SEQ ID NO: 6048900 - DNA, 17 bp, Homo sapiens
ccatgtcgcctgccccc

SEQ ID NO: 6048901 - DNA, 23 bp, Homo sapiens
ccatgtcgcctgcccccagcact

SEQ ID NO: 6048902 - DNA, 18 bp, Homo sapiens
ccatgtcgcgctcagcat

SEQ ID NO: 6048903 - DNA, 15 bp, Homo sapiens
ccatgtcggcctcta

SEQ ID NO: 6048904 - DNA, 17 bp, Homo sapiens
ccatgtctgccccatca

SEQ ID NO: 6048905 - DNA, 14 bp, Homo sapiens
ccatgtctgtgctg

SEQ ID NO: 6048906 - DNA, 15 bp, Homo sapiens
ccatgtcttctccct

SEQ ID NO: 6048907 - DNA, 16 bp, Homo sapiens
ccatgtcttctccctg

SEQ ID NO: 6048908 - DNA, 15 bp, Homo sapiens
ccatgtctttctcca

SEQ ID NO: 6048909 - DNA, 21 bp, Homo sapiens
ccatgtgaaaaggcaaaaagc

SEQ ID NO: 6048910 - DNA, 18 bp, Homo sapiens
ccatgtgaaactctaccc

SEQ ID NO: 6048911 - DNA, 16 bp, Homo sapiens
ccatgtgaacagcata

SEQ ID NO: 6048912 - DNA, 19 bp, Homo sapiens
ccatgtgagctgctgccat

SEQ ID NO: 6048913 - DNA, 22 bp, Homo sapiens
ccatgtgatggacactccaggg

SEQ ID NO: 6048914 - DNA, 14 bp, Homo sapiens
ccatgtgcacccgg

SEQ ID NO: 6048915 - DNA, 19 bp, Homo sapiens
ccatgtgcatagtttcttt

SEQ ID NO: 6048916 - DNA, 19 bp, Homo sapiens
ccatgtgccatctgtacat

SEQ ID NO: 6048917 - DNA, 15 bp, Homo sapiens
ccatgtgcctctttg

SEQ ID NO: 6048918 - DNA, 18 bp, Homo sapiens
ccatgtgcctgcaccagg

SEQ ID NO: 6048919 - DNA, 19 bp, Homo sapiens
ccatgtgcctgcaccagga

SEQ ID NO: 6048920 - DNA, 19 bp, Homo sapiens
ccatgtgccttgtccagga

SEQ ID NO: 6048921 - DNA, 16 bp, Homo sapiens
ccatgtgcctttcttt

SEQ ID NO: 6048922 - DNA, 17 bp, Homo sapiens
ccatgtgcctttctttg

SEQ ID NO: 6048923 - DNA, 19 bp, Homo sapiens
ccatgtgcctttctttgcc

SEQ ID NO: 6048924 - DNA, 16 bp, Homo sapiens
cattgctctctgggct

SEQ ID NO: 6048925 - DNA, 16 bp, Homo sapiens
cattgctgaaaatggt

SEQ ID NO: 6048926 - DNA, 22 bp, Homo sapiens
cattgctgaaaatggtattttc

SEQ ID NO: 6048927 - DNA, 17 bp, Homo sapiens
cattgctgacagagccc

SEQ ID NO: 6048928 - DNA, 15 bp, Homo sapiens
cattgctgagcctct

SEQ ID NO: 6048929 - DNA, 18 bp, Homo sapiens
cattgctgctccttagct

SEQ ID NO: 6048930 - DNA, 17 bp, Homo sapiens
cattgctgctgctacca

SEQ ID NO: 6048931 - DNA, 21 bp, Homo sapiens
cattgctgctgctaccagcgc

SEQ ID NO: 6048932 - DNA, 22 bp, Homo sapiens
cattgctgctgctaccagcgcc

SEQ ID NO: 6048933 - DNA, 16 bp, Homo sapiens
cattgctggactctga

SEQ ID NO: 6048934 - DNA, 18 bp, Homo sapiens
cattgctggactgatggt

SEQ ID NO: 6048935 - DNA, 14 bp, Homo sapiens
cattgctggctgcc

SEQ ID NO: 6048936 - DNA, 20 bp, Homo sapiens
cattgctgtaccacatctgc

SEQ ID NO: 6048937 - DNA, 13 bp, Homo sapiens
cattgctgtagga

SEQ ID NO: 6048938 - DNA, 14 bp, Homo sapiens
cattgctgtaggat

SEQ ID NO: 6048939 - DNA, 16 bp, Homo sapiens
cattgctgtccttggg

SEQ ID NO: 6048940 - DNA, 21 bp, Homo sapiens
cattgctgtctgcagccttga

SEQ ID NO: 6048941 - DNA, 15 bp, Homo sapiens
cattgctgtcttgcc

SEQ ID NO: 6048942 - DNA, 22 bp, Homo sapiens
cattgctgtgaattagctcact

SEQ ID NO: 6048943 - DNA, 20 bp, Homo sapiens
cattgctgttatgtctgttt

SEQ ID NO: 6048944 - DNA, 22 bp, Homo sapiens
cattgctgttatgtctgtttaa

SEQ ID NO: 6048945 - DNA, 21 bp, Homo sapiens
cattgctgttgtccaactatt

SEQ ID NO: 6048946 - DNA, 16 bp, Homo sapiens
cattgctgttttaatt

SEQ ID NO: 6048947 - DNA, 19 bp, Homo sapiens
cattgcttaaaagaaagtt

SEQ ID NO: 6048948 - DNA, 15 bp, Homo sapiens
cattgcttaaaatat

SEQ ID NO: 6048949 - DNA, 17 bp, Homo sapiens
cattgcttacacggatg

SEQ ID NO: 6048950 - DNA, 20 bp, Homo sapiens
cattgcttcacaacccatct

SEQ ID NO: 6048951 - DNA, 21 bp, Homo sapiens
cattgcttcattaaaacaaga

SEQ ID NO: 6048952 - DNA, 11 bp, Homo sapiens
cattgctttac

SEQ ID NO: 6048953 - DNA, 19 bp, Homo sapiens
cattgctttcgtgtaaatt

SEQ ID NO: 6048954 - DNA, 13 bp, Homo sapiens
cattgctttctaa

SEQ ID NO: 6048955 - DNA, 22 bp, Homo sapiens
cattgctttgaagcagttgtgt

SEQ ID NO: 6048956 - DNA, 20 bp, Homo sapiens
cattgctttgccctggagca

SEQ ID NO: 6048957 - DNA, 15 bp, Homo sapiens
cattgcttttatttt

SEQ ID NO: 6048958 - DNA, 17 bp, Homo sapiens
cattgcttttattttga

SEQ ID NO: 6048959 - DNA, 18 bp, Homo sapiens
cattgcttttattttgaa

SEQ ID NO: 6048960 - DNA, 19 bp, Homo sapiens
cattgcttttattttgaaa

SEQ ID NO: 6048961 - DNA, 18 bp, Homo sapiens
cattggaagaccccaccc

SEQ ID NO: 6048962 - DNA, 21 bp, Homo sapiens
cattggaagcaggttaaatgt

SEQ ID NO: 6048963 - DNA, 23 bp, Homo sapiens
cattggaagcaggttaaatgttt

SEQ ID NO: 6048964 - DNA, 14 bp, Homo sapiens
cattggaagcctga

SEQ ID NO: 6048965 - DNA, 17 bp, Homo sapiens
cattggaataaggcatg

SEQ ID NO: 6048966 - DNA, 20 bp, Homo sapiens
cattggaattctactggaaa

SEQ ID NO: 6048967 - DNA, 21 bp, Homo sapiens
cattggacagaaaatgcaatg

SEQ ID NO: 6048968 - DNA, 19 bp, Homo sapiens
cattggacagtctccctga

SEQ ID NO: 6048969 - DNA, 17 bp, Homo sapiens
cattggacccttccatg

SEQ ID NO: 6048970 - DNA, 16 bp, Homo sapiens
cattggacttccttgg

SEQ ID NO: 6048971 - DNA, 18 bp, Homo sapiens
cattggagcacctgggcc

SEQ ID NO: 6048972 - DNA, 16 bp, Homo sapiens
cattggattatcctga

SEQ ID NO: 6048973 - DNA, 15 bp, Homo sapiens
cattggattctgaga

SEQ ID NO: 6048974 - DNA, 21 bp, Homo sapiens
cattggcaaagtgacaaagca

SEQ ID NO: 6048975 - DNA, 23 bp, Homo sapiens
cattggcaagatgaaataatttt

SEQ ID NO: 6048976 - DNA, 20 bp, Homo sapiens
cattggcacctaatccaggc

SEQ ID NO: 6048977 - DNA, 16 bp, Homo sapiens
cattggcagtgtgtca

SEQ ID NO: 6048978 - DNA, 22 bp, Homo sapiens
cattggcagtgtgtcacactga

SEQ ID NO: 6048979 - DNA, 20 bp, Homo sapiens
cattggccagctcataaaat

SEQ ID NO: 6048980 - DNA, 16 bp, Homo sapiens
cattggcccctgagcc

SEQ ID NO: 6048981 - DNA, 19 bp, Homo sapiens
cattggccgagctcctggg

SEQ ID NO: 6048982 - DNA, 15 bp, Homo sapiens
cattggcctctgtct

SEQ ID NO: 6048983 - DNA, 20 bp, Homo sapiens
cattggcctctgtgtacaaa

SEQ ID NO: 6048984 - DNA, 22 bp, Homo sapiens
cattggcctcttgtcccttggc

SEQ ID NO: 6048985 - DNA, 13 bp, Homo sapiens
cattggcctggcc

SEQ ID NO: 6048986 - DNA, 14 bp, Homo sapiens
cattggcctggcct

SEQ ID NO: 6048987 - DNA, 18 bp, Homo sapiens
cattggcctggcctccag

SEQ ID NO: 6048988 - DNA, 18 bp, Homo sapiens
cattggccttaactggcc

SEQ ID NO: 6048989 - DNA, 18 bp, Homo sapiens
cattggctatttaaaact

SEQ ID NO: 6048990 - DNA, 15 bp, Homo sapiens
cattggctgagagac

SEQ ID NO: 6048991 - DNA, 22 bp, Homo sapiens
cattggctttttaaattttcca

SEQ ID NO: 6048992 - DNA, 16 bp, Homo sapiens
cattgggaccctccag

SEQ ID NO: 6048993 - DNA, 16 bp, Homo sapiens
cattgggcacagtcca

SEQ ID NO: 6048994 - DNA, 18 bp, Homo sapiens
cattgggcacagtccaga

SEQ ID NO: 6048995 - DNA, 17 bp, Homo sapiens
cattgggctcacttcta

SEQ ID NO: 6048996 - DNA, 15 bp, Homo sapiens
cattgggctgacacc

SEQ ID NO: 6048997 - DNA, 19 bp, Homo sapiens
cattggggctcccagccag

SEQ ID NO: 6048998 - DNA, 22 bp, Homo sapiens
cattggggctcccagccaggcc

SEQ ID NO: 6048999 - DNA, 16 bp, Homo sapiens
cattggggtggggctt

SEQ ID NO: 6049000 - DNA, 22 bp, Homo sapiens
cattggggttcctctgtacagc

SEQ ID NO: 6049001 - DNA, 20 bp, Homo sapiens
cattggggttgcaacaataa

SEQ ID NO: 6049002 - DNA, 21 bp, Homo sapiens
cattgggtcctgggtctttca

SEQ ID NO: 6049003 - DNA, 20 bp, Homo sapiens
cattgggtctattccagctc

SEQ ID NO: 6049004 - DNA, 22 bp, Homo sapiens
cattgggtctattccagctcat

SEQ ID NO: 6049005 - DNA, 23 bp, Homo sapiens
cattgggtttggggccatggtgg

SEQ ID NO: 6049006 - DNA, 16 bp, Homo sapiens
cattgggttttatcag

SEQ ID NO: 6049007 - DNA, 19 bp, Homo sapiens
cattgggttttatcagtgc

SEQ ID NO: 6049008 - DNA, 14 bp, Homo sapiens
cattggtccaagat

SEQ ID NO: 6049009 - DNA, 15 bp, Homo sapiens
cattggtccaccctt

SEQ ID NO: 6049010 - DNA, 14 bp, Homo sapiens
cattggtctgctga

SEQ ID NO: 6049011 - DNA, 14 bp, Homo sapiens
cattggtcttcttt

SEQ ID NO: 6049012 - DNA, 18 bp, Homo sapiens
cattggtctttctacata

SEQ ID NO: 6049013 - DNA, 20 bp, Homo sapiens
cattggtggcatcacagacc

SEQ ID NO: 6049014 - DNA, 22 bp, Homo sapiens
cattggtggcatcacagacccc

SEQ ID NO: 6049015 - DNA, 19 bp, Homo sapiens
cattggttcttcctttccc

SEQ ID NO: 6049016 - DNA, 22 bp, Homo sapiens
cattggttcttcctttccctgg

SEQ ID NO: 6049017 - DNA, 14 bp, Homo sapiens
cattggttttgaaa

SEQ ID NO: 6049018 - DNA, 15 bp, Homo sapiens
cattggttttgaaat

SEQ ID NO: 6049019 - DNA, 20 bp, Homo sapiens
cattgtaaaagcattttgta

SEQ ID NO: 6049020 - DNA, 14 bp, Homo sapiens
cattgtaaaataaa

SEQ ID NO: 6049021 - DNA, 14 bp, Homo sapiens
cattgtaaaataat

SEQ ID NO: 6049022 - DNA, 21 bp, Homo sapiens
cattgtaaaccacaaggctgt

SEQ ID NO: 6049023 - DNA, 13 bp, Homo sapiens
cattgtaaagtat

SEQ ID NO: 6049024 - DNA, 14 bp, Homo sapiens
cattgtaaagtatg

SEQ ID NO: 6049025 - DNA, 14 bp, Homo sapiens
cattgtaaatcact

SEQ ID NO: 6049026 - DNA, 16 bp, Homo sapiens
cattgtaaatctgaag

SEQ ID NO: 6049027 - DNA, 21 bp, Homo sapiens
cattgtaaatctgaagaaagt

SEQ ID NO: 6049028 - DNA, 21 bp, Homo sapiens
cattgtaaatgaacataatga

SEQ ID NO: 6049029 - DNA, 15 bp, Homo sapiens
cattgtaacttggat

SEQ ID NO: 6049030 - DNA, 22 bp, Homo sapiens
cattgtaatctgctttgttaat

SEQ ID NO: 6049031 - DNA, 18 bp, Homo sapiens
cattgtaatgttactgat

SEQ ID NO: 6049032 - DNA, 14 bp, Homo sapiens
cattgtaatgttgt

SEQ ID NO: 6049033 - DNA, 19 bp, Homo sapiens
cattgtaatgttgtgaata

SEQ ID NO: 6049034 - DNA, 14 bp, Homo sapiens
cattgtaattatgt

SEQ ID NO: 6049035 - DNA, 14 bp, Homo sapiens
cattgtacaagtat

SEQ ID NO: 6049036 - DNA, 13 bp, Homo sapiens
cattgtacagttt

SEQ ID NO: 6049037 - DNA, 21 bp, Homo sapiens
cattgtacagtttgtttacac

SEQ ID NO: 6049038 - DNA, 19 bp, Homo sapiens
cattgtacgaagagtattt

SEQ ID NO: 6049039 - DNA, 20 bp, Homo sapiens
cattgtacgaagagtatttt

SEQ ID NO: 6049040 - DNA, 14 bp, Homo sapiens
cattgtactccagc

SEQ ID NO: 6049041 - DNA, 16 bp, Homo sapiens
cattgtactccagcct

SEQ ID NO: 6049042 - DNA, 18 bp, Homo sapiens
cattgtactccagcctgg

SEQ ID NO: 6049043 - DNA, 20 bp, Homo sapiens
cattgtactccagcctgggc

SEQ ID NO: 6049044 - DNA, 20 bp, Homo sapiens
cattgtactccagcctgggt

SEQ ID NO: 6049045 - DNA, 22 bp, Homo sapiens
cattgtactgttgctttaatat

SEQ ID NO: 6049046 - DNA, 16 bp, Homo sapiens
cattgtagagcttctg

SEQ ID NO: 6049047 - DNA, 21 bp, Homo sapiens
cattgtagagcttctggcact

SEQ ID NO: 6049048 - DNA, 19 bp, Homo sapiens
cattgtagagcttggtggc

SEQ ID NO: 6049049 - DNA, 18 bp, Homo sapiens
cattgtagattttgttat

SEQ ID NO: 6049050 - DNA, 19 bp, Homo sapiens
cattgtagcctaatattca

SEQ ID NO: 6049051 - DNA, 16 bp, Homo sapiens
cattgtataaaaatag

SEQ ID NO: 6049052 - DNA, 24 bp, Homo sapiens
cattgtatagatataatgaacaaa

SEQ ID NO: 6049053 - DNA, 15 bp, Homo sapiens
cattgtataggccat

SEQ ID NO: 6049054 - DNA, 17 bp, Homo sapiens
cattgtataggccatct

SEQ ID NO: 6049055 - DNA, 22 bp, Homo sapiens
cattgtataggccatctgtaaa

SEQ ID NO: 6049056 - DNA, 20 bp, Homo sapiens
cattgtatatatgtgtgttt

SEQ ID NO: 6049057 - DNA, 22 bp, Homo sapiens
cattgtatatatgtgtgtttaa

SEQ ID NO: 6049058 - DNA, 17 bp, Homo sapiens
cattgtatcgatgttat

SEQ ID NO: 6049059 - DNA, 22 bp, Homo sapiens
cattgtatgatgtgttgtgata

SEQ ID NO: 6049060 - DNA, 22 bp, Homo sapiens
cattgtatggatagtaaaattc

SEQ ID NO: 6049061 - DNA, 23 bp, Homo sapiens
cattgtattgtctgacacatgct

SEQ ID NO: 6049062 - DNA, 14 bp, Homo sapiens
cattgtatttaaaa

SEQ ID NO: 6049063 - DNA, 16 bp, Homo sapiens
cattgtatttaaaaca

SEQ ID NO: 6049064 - DNA, 20 bp, Homo sapiens
cattgtatttaaaacatttc

SEQ ID NO: 6049065 - DNA, 21 bp, Homo sapiens
cattgtatttaaaacatttca

SEQ ID NO: 6049066 - DNA, 18 bp, Homo sapiens
cattgtcaaaattaatat

SEQ ID NO: 6049067 - DNA, 14 bp, Homo sapiens
cattgtcaagtgga

SEQ ID NO: 6049068 - DNA, 18 bp, Homo sapiens
cattgtcaataaggagca

SEQ ID NO: 6049069 - DNA, 13 bp, Homo sapiens
cattgtcagaatg

SEQ ID NO: 6049070 - DNA, 14 bp, Homo sapiens
cattgtcagaatgt

SEQ ID NO: 6049071 - DNA, 15 bp, Homo sapiens
cattgtcagaatgtt

SEQ ID NO: 6049072 - DNA, 16 bp, Homo sapiens
cattgtcagagatgtt

SEQ ID NO: 6049073 - DNA, 21 bp, Homo sapiens
cattgtcagagatgttttcaa

SEQ ID NO: 6049074 - DNA, 13 bp, Homo sapiens
cattgtcagcctt

SEQ ID NO: 6049075 - DNA, 14 bp, Homo sapiens
cattgtcagccttg

SEQ ID NO: 6049076 - DNA, 18 bp, Homo sapiens
cattgtccagagctgctt

SEQ ID NO: 6049077 - DNA, 22 bp, Homo sapiens
cattgtccagagctgcttcccc

SEQ ID NO: 6049078 - DNA, 14 bp, Homo sapiens
cattgtccagctgg

SEQ ID NO: 6049079 - DNA, 20 bp, Homo sapiens
cattgtccatgcctacagat

SEQ ID NO: 6049080 - DNA, 19 bp, Homo sapiens
cattgtccccaatgaatat

SEQ ID NO: 6049081 - DNA, 13 bp, Homo sapiens
cattgtccctctg

SEQ ID NO: 6049082 - DNA, 17 bp, Homo sapiens
cattgtccctcttcact

SEQ ID NO: 6049083 - DNA, 20 bp, Homo sapiens
cattgtccctcttcactccc

SEQ ID NO: 6049084 - DNA, 19 bp, Homo sapiens
cattgtccctgaagagaag

SEQ ID NO: 6049085 - DNA, 20 bp, Homo sapiens
cattgtcctccttttcactt

SEQ ID NO: 6049086 - DNA, 16 bp, Homo sapiens
cattgtcctgtagctt

SEQ ID NO: 6049087 - DNA, 18 bp, Homo sapiens
cattgtccttttcttttc

SEQ ID NO: 6049088 - DNA, 17 bp, Homo sapiens
cattgtctcattgccag

SEQ ID NO: 6049089 - DNA, 21 bp, Homo sapiens
cattgtctcattgccagtggt

SEQ ID NO: 6049090 - DNA, 13 bp, Homo sapiens
cattgtctgcaat

SEQ ID NO: 6049091 - DNA, 15 bp, Homo sapiens
cattgtctgtctgca

SEQ ID NO: 6049092 - DNA, 18 bp, Homo sapiens
cattgtcttccaacccca

SEQ ID NO: 6049093 - DNA, 21 bp, Homo sapiens
cattgtcttccaaccccagct

SEQ ID NO: 6049094 - DNA, 23 bp, Homo sapiens
cattgtcttcggaaaccttggtg

SEQ ID NO: 6049095 - DNA, 14 bp, Homo sapiens
cattgtcttgttat

SEQ ID NO: 6049096 - DNA, 20 bp, Homo sapiens
cattgtcttgttctgtccct

SEQ ID NO: 6049097 - DNA, 19 bp, Homo sapiens
cattgtctttcctcccttc

SEQ ID NO: 6049098 - DNA, 19 bp, Homo sapiens
cattgtctttgctgtactc

SEQ ID NO: 6049099 - DNA, 16 bp, Homo sapiens
cattgtgaagcaccta

SEQ ID NO: 6049100 - DNA, 23 bp, Homo sapiens
ccatgtgcggaattcaagttacc

SEQ ID NO: 6049101 - DNA, 16 bp, Homo sapiens
ccatgtgcggagcagc

SEQ ID NO: 6049102 - DNA, 23 bp, Homo sapiens
ccatgtgctacaggggccagaag

SEQ ID NO: 6049103 - DNA, 21 bp, Homo sapiens
ccatgtgctgcggtcactcag

SEQ ID NO: 6049104 - DNA, 13 bp, Homo sapiens
ccatgtgctgtgc

SEQ ID NO: 6049105 - DNA, 15 bp, Homo sapiens
ccatgtgctgtgcac

SEQ ID NO: 6049106 - DNA, 17 bp, Homo sapiens
ccatgtgctgtgcaccc

SEQ ID NO: 6049107 - DNA, 20 bp, Homo sapiens
ccatgtggaaggcaagccag

SEQ ID NO: 6049108 - DNA, 17 bp, Homo sapiens
ccatgtggagacttcat

SEQ ID NO: 6049109 - DNA, 13 bp, Homo sapiens
ccatgtggagtgg

SEQ ID NO: 6049110 - DNA, 13 bp, Homo sapiens
ccatgtggcagcc

SEQ ID NO: 6049111 - DNA, 15 bp, Homo sapiens
ccatgtggcagccca

SEQ ID NO: 6049112 - DNA, 15 bp, Homo sapiens
ccatgtggccccagg

SEQ ID NO: 6049113 - DNA, 16 bp, Homo sapiens
ccatgtggccccaggt

SEQ ID NO: 6049114 - DNA, 20 bp, Homo sapiens
ccatgtggccccaggtgcca

SEQ ID NO: 6049115 - DNA, 14 bp, Homo sapiens
ccatgtggcctgcc

SEQ ID NO: 6049116 - DNA, 16 bp, Homo sapiens
ccatgtgggcacggag

SEQ ID NO: 6049117 - DNA, 19 bp, Homo sapiens
ccatgtgggcgcccaccct

SEQ ID NO: 6049118 - DNA, 21 bp, Homo sapiens
ccatgtggggttgctgaagat

SEQ ID NO: 6049119 - DNA, 17 bp, Homo sapiens
ccatgtggtgatgatgt

SEQ ID NO: 6049120 - DNA, 23 bp, Homo sapiens
ccatgtggtttgctgttaccaaa

SEQ ID NO: 6049121 - DNA, 13 bp, Homo sapiens
ccatgtgtacatt

SEQ ID NO: 6049122 - DNA, 11 bp, Homo sapiens
ccatgtgtatg

SEQ ID NO: 6049123 - DNA, 12 bp, Homo sapiens
ccatgtgtcact

SEQ ID NO: 6049124 - DNA, 19 bp, Homo sapiens
ccatgtgtcacttgtgctt

SEQ ID NO: 6049125 - DNA, 20 bp, Homo sapiens
ccatgtgtcacttgtgcttt

SEQ ID NO: 6049126 - DNA, 14 bp, Homo sapiens
ccatgtgtcatgta

SEQ ID NO: 6049127 - DNA, 21 bp, Homo sapiens
ccatgtgtcatgtaatactga

SEQ ID NO: 6049128 - DNA, 12 bp, Homo sapiens
ccatgtgtcccc

SEQ ID NO: 6049129 - DNA, 18 bp, Homo sapiens
ccatgtgtcccccctgtg

SEQ ID NO: 6049130 - DNA, 20 bp, Homo sapiens
ccatgtgtcccccctgtggt

SEQ ID NO: 6049131 - DNA, 21 bp, Homo sapiens
ccatgtgtcccccctgtggtc

SEQ ID NO: 6049132 - DNA, 13 bp, Homo sapiens
ccatgtgtcccct

SEQ ID NO: 6049133 - DNA, 15 bp, Homo sapiens
ccatgtgtcccctca

SEQ ID NO: 6049134 - DNA, 17 bp, Homo sapiens
ccatgtgtcccctcact

SEQ ID NO: 6049135 - DNA, 17 bp, Homo sapiens
ccatgtgtcgcctctca

SEQ ID NO: 6049136 - DNA, 11 bp, Homo sapiens
ccatgtgtgag

SEQ ID NO: 6049137 - DNA, 17 bp, Homo sapiens
ccatgtgtgagtgtgtg

SEQ ID NO: 6049138 - DNA, 21 bp, Homo sapiens
ccatgtgtgatgctgacacca

SEQ ID NO: 6049139 - DNA, 22 bp, Homo sapiens
ccatgtgtgatgctgacaccag

SEQ ID NO: 6049140 - DNA, 12 bp, Homo sapiens
ccatgtgtgctg

SEQ ID NO: 6049141 - DNA, 14 bp, Homo sapiens
ccatgtgtggagtg

SEQ ID NO: 6049142 - DNA, 22 bp, Homo sapiens
ccatgtgtggtggtgttttttg

SEQ ID NO: 6049143 - DNA, 19 bp, Homo sapiens
ccatgtgtgtgcaagtgtg

SEQ ID NO: 6049144 - DNA, 22 bp, Homo sapiens
ccatgtgttaaaatactcagtg

SEQ ID NO: 6049145 - DNA, 13 bp, Homo sapiens
ccatgttaaatga

SEQ ID NO: 6049146 - DNA, 20 bp, Homo sapiens
ccatgttaatcacattccta

SEQ ID NO: 6049147 - DNA, 17 bp, Homo sapiens
ccatgttaattaaactg

SEQ ID NO: 6049148 - DNA, 16 bp, Homo sapiens
ccatgttacttctctg

SEQ ID NO: 6049149 - DNA, 17 bp, Homo sapiens
ccatgttacttctctga

SEQ ID NO: 6049150 - DNA, 19 bp, Homo sapiens
ccatgttacttctctgagt

SEQ ID NO: 6049151 - DNA, 20 bp, Homo sapiens
ccatgttagggttatgtttt

SEQ ID NO: 6049152 - DNA, 16 bp, Homo sapiens
ccatgttatgctggtg

SEQ ID NO: 6049153 - DNA, 17 bp, Homo sapiens
ccatgttattctctcac

SEQ ID NO: 6049154 - DNA, 15 bp, Homo sapiens
ccatgttcattataa

SEQ ID NO: 6049155 - DNA, 12 bp, Homo sapiens
ccatgttcccag

SEQ ID NO: 6049156 - DNA, 15 bp, Homo sapiens
ccatgttcccagctc

SEQ ID NO: 6049157 - DNA, 18 bp, Homo sapiens
ccatgttccccagttcag

SEQ ID NO: 6049158 - DNA, 13 bp, Homo sapiens
ccatgttctccca

SEQ ID NO: 6049159 - DNA, 16 bp, Homo sapiens
ccatgttctgccccca

SEQ ID NO: 6049160 - DNA, 19 bp, Homo sapiens
ccatgttctgcccccagcc

SEQ ID NO: 6049161 - DNA, 22 bp, Homo sapiens
ccatgttctgtcccttgccccc

SEQ ID NO: 6049162 - DNA, 12 bp, Homo sapiens
ccatgttgaagt

SEQ ID NO: 6049163 - DNA, 13 bp, Homo sapiens
ccatgttgaagta

SEQ ID NO: 6049164 - DNA, 21 bp, Homo sapiens
ccatgttgaagtaattcttct

SEQ ID NO: 6049165 - DNA, 13 bp, Homo sapiens
ccatgttggccag

SEQ ID NO: 6049166 - DNA, 18 bp, Homo sapiens
ccatgttggccaggctgg

SEQ ID NO: 6049167 - DNA, 19 bp, Homo sapiens
ccatgttggccaggctggt

SEQ ID NO: 6049168 - DNA, 21 bp, Homo sapiens
ccatgttggccaggctggtct

SEQ ID NO: 6049169 - DNA, 23 bp, Homo sapiens
ccatgttggccaggctggtctca

SEQ ID NO: 6049170 - DNA, 15 bp, Homo sapiens
ccatgttggcctctt

SEQ ID NO: 6049171 - DNA, 18 bp, Homo sapiens
ccatgttggcctcttcag

SEQ ID NO: 6049172 - DNA, 19 bp, Homo sapiens
ccatgttgggaaaaactgg

SEQ ID NO: 6049173 - DNA, 17 bp, Homo sapiens
ccatgttggtcaggctg

SEQ ID NO: 6049174 - DNA, 20 bp, Homo sapiens
ccatgttgtaatgctgcact

SEQ ID NO: 6049175 - DNA, 22 bp, Homo sapiens
ccatgttgtaatgctgcacttc

SEQ ID NO: 6049176 - DNA, 22 bp, Homo sapiens
ccatgtttattgttttttaaag

SEQ ID NO: 6049177 - DNA, 18 bp, Homo sapiens
ccatgtttccaccaaatg

SEQ ID NO: 6049178 - DNA, 16 bp, Homo sapiens
ccatgtttctctggcc

SEQ ID NO: 6049179 - DNA, 21 bp, Homo sapiens
ccatgtttctctggccccaag

SEQ ID NO: 6049180 - DNA, 21 bp, Homo sapiens
ccatgtttgagctcagacccc

SEQ ID NO: 6049181 - DNA, 23 bp, Homo sapiens
ccatgtttggtgtttgtctgtgt

SEQ ID NO: 6049182 - DNA, 13 bp, Homo sapiens
ccatgtttgtaaa

SEQ ID NO: 6049183 - DNA, 15 bp, Homo sapiens
ccatgtttgtaaaac

SEQ ID NO: 6049184 - DNA, 16 bp, Homo sapiens
ccatgtttttgccaaa

SEQ ID NO: 6049185 - DNA, 21 bp, Homo sapiens
ccatgttttttcttcaaatgt

SEQ ID NO: 6049186 - DNA, 21 bp, Homo sapiens
ccattaaaactgaagtctgaa

SEQ ID NO: 6049187 - DNA, 22 bp, Homo sapiens
ccattaaaactgaagtctgaaa

SEQ ID NO: 6049188 - DNA, 21 bp, Homo sapiens
ccattaaaataaaacaagcct

SEQ ID NO: 6049189 - DNA, 23 bp, Homo sapiens
ccattaaacgatttttaaaatgt

SEQ ID NO: 6049190 - DNA, 19 bp, Homo sapiens
ccattaaacttctactgag

SEQ ID NO: 6049191 - DNA, 21 bp, Homo sapiens
ccattaaacttctactgagca

SEQ ID NO: 6049192 - DNA, 22 bp, Homo sapiens
ccattaaacttctactgagcaa

SEQ ID NO: 6049193 - DNA, 14 bp, Homo sapiens
ccattaaagaatat

SEQ ID NO: 6049194 - DNA, 16 bp, Homo sapiens
ccattaaagaatatga

SEQ ID NO: 6049195 - DNA, 18 bp, Homo sapiens
ccattaaagaatatgaaa

SEQ ID NO: 6049196 - DNA, 14 bp, Homo sapiens
ccattaaagtcaga

SEQ ID NO: 6049197 - DNA, 19 bp, Homo sapiens
ccattaaagtcagaagttt

SEQ ID NO: 6049198 - DNA, 22 bp, Homo sapiens
ccattaaagtcgagcttttcta

SEQ ID NO: 6049199 - DNA, 11 bp, Homo sapiens
ccattaaatag

SEQ ID NO: 6049200 - DNA, 24 bp, Homo sapiens
ccattaaatataaagcaagataat

SEQ ID NO: 6049201 - DNA, 15 bp, Homo sapiens
ccattaaatgaatat

SEQ ID NO: 6049202 - DNA, 14 bp, Homo sapiens
ccattaacattttt

SEQ ID NO: 6049203 - DNA, 22 bp, Homo sapiens
ccattaaccagatctagtcaat

SEQ ID NO: 6049204 - DNA, 22 bp, Homo sapiens
ccattaactatttttttcaaag

SEQ ID NO: 6049205 - DNA, 14 bp, Homo sapiens
ccattaactgcttc

SEQ ID NO: 6049206 - DNA, 23 bp, Homo sapiens
ccattaagtcatgtgtgaacaca

SEQ ID NO: 6049207 - DNA, 21 bp, Homo sapiens
ccattaataactgaataaaaa

SEQ ID NO: 6049208 - DNA, 17 bp, Homo sapiens
ccattaatcagttcatt

SEQ ID NO: 6049209 - DNA, 15 bp, Homo sapiens
ccattaatcttgatc

SEQ ID NO: 6049210 - DNA, 20 bp, Homo sapiens
ccattaatcttgatcattcc

SEQ ID NO: 6049211 - DNA, 13 bp, Homo sapiens
ccattaattacat

SEQ ID NO: 6049212 - DNA, 13 bp, Homo sapiens
ccattaatttcaa

SEQ ID NO: 6049213 - DNA, 13 bp, Homo sapiens
ccattacactcca

SEQ ID NO: 6049214 - DNA, 14 bp, Homo sapiens
ccattacactccag

SEQ ID NO: 6049215 - DNA, 18 bp, Homo sapiens
ccattacactccagcctg

SEQ ID NO: 6049216 - DNA, 22 bp, Homo sapiens
ccattacagaggtattaaaact

SEQ ID NO: 6049217 - DNA, 15 bp, Homo sapiens
ccattaccccatacc

SEQ ID NO: 6049218 - DNA, 12 bp, Homo sapiens
ccattaccctca

SEQ ID NO: 6049219 - DNA, 16 bp, Homo sapiens
ccattacctgtacctg

SEQ ID NO: 6049220 - DNA, 15 bp, Homo sapiens
ccattacgtgcattt

SEQ ID NO: 6049221 - DNA, 13 bp, Homo sapiens
ccattactactgt

SEQ ID NO: 6049222 - DNA, 15 bp, Homo sapiens
ccattactactgtac

SEQ ID NO: 6049223 - DNA, 16 bp, Homo sapiens
ccattactactgtaca

SEQ ID NO: 6049224 - DNA, 14 bp, Homo sapiens
ccattactgtgatt

SEQ ID NO: 6049225 - DNA, 19 bp, Homo sapiens
ccattacttgtataaatac

SEQ ID NO: 6049226 - DNA, 17 bp, Homo sapiens
ccattagagcacagctt

SEQ ID NO: 6049227 - DNA, 22 bp, Homo sapiens
ccattagagcacagcttcttct

SEQ ID NO: 6049228 - DNA, 19 bp, Homo sapiens
ccattagcaacgcctgcct

SEQ ID NO: 6049229 - DNA, 19 bp, Homo sapiens
ccattagctttcaattccg

SEQ ID NO: 6049230 - DNA, 16 bp, Homo sapiens
ccattataaaatcttt

SEQ ID NO: 6049231 - DNA, 20 bp, Homo sapiens
ccattataaccttaatttat

SEQ ID NO: 6049232 - DNA, 18 bp, Homo sapiens
ccattatactttatatct

SEQ ID NO: 6049233 - DNA, 15 bp, Homo sapiens
ccattatatttattg

SEQ ID NO: 6049234 - DNA, 16 bp, Homo sapiens
ccattatatttgcatt

SEQ ID NO: 6049235 - DNA, 13 bp, Homo sapiens
ccattatcatgtg

SEQ ID NO: 6049236 - DNA, 14 bp, Homo sapiens
ccattatctgctgt

SEQ ID NO: 6049237 - DNA, 17 bp, Homo sapiens
ccattatgaagaagaga

SEQ ID NO: 6049238 - DNA, 23 bp, Homo sapiens
ccattatgactgttgttcttata

SEQ ID NO: 6049239 - DNA, 13 bp, Homo sapiens
ccattatgcaaat

SEQ ID NO: 6049240 - DNA, 14 bp, Homo sapiens
ccattattcaaagt

SEQ ID NO: 6049241 - DNA, 22 bp, Homo sapiens
ccattattctagggtcttactc

SEQ ID NO: 6049242 - DNA, 17 bp, Homo sapiens
ccattattgagttcctc

SEQ ID NO: 6049243 - DNA, 19 bp, Homo sapiens
ccattattgagttcctcct

SEQ ID NO: 6049244 - DNA, 18 bp, Homo sapiens
ccattatttaatttgtat

SEQ ID NO: 6049245 - DNA, 13 bp, Homo sapiens
ccattattttatt

SEQ ID NO: 6049246 - DNA, 18 bp, Homo sapiens
ccattattttattttata

SEQ ID NO: 6049247 - DNA, 13 bp, Homo sapiens
ccattattttctg

SEQ ID NO: 6049248 - DNA, 12 bp, Homo sapiens
ccattattttgt

SEQ ID NO: 6049249 - DNA, 14 bp, Homo sapiens
ccattcaactggaa

SEQ ID NO: 6049250 - DNA, 20 bp, Homo sapiens
ccattcacaataaaagctta

SEQ ID NO: 6049251 - DNA, 13 bp, Homo sapiens
ccattcacaccag

SEQ ID NO: 6049252 - DNA, 18 bp, Homo sapiens
ccattcacatttgatgta

SEQ ID NO: 6049253 - DNA, 19 bp, Homo sapiens
ccattcacattttaacata

SEQ ID NO: 6049254 - DNA, 13 bp, Homo sapiens
ccattcaccttcc

SEQ ID NO: 6049255 - DNA, 16 bp, Homo sapiens
ccattcacggcctggc

SEQ ID NO: 6049256 - DNA, 18 bp, Homo sapiens
ccattcacggcctggcat

SEQ ID NO: 6049257 - DNA, 21 bp, Homo sapiens
ccattcacttctgcattcctg

SEQ ID NO: 6049258 - DNA, 17 bp, Homo sapiens
ccattcagaactctcag

SEQ ID NO: 6049259 - DNA, 14 bp, Homo sapiens
ccattcagaatatc

SEQ ID NO: 6049260 - DNA, 19 bp, Homo sapiens
ccattcagaatatcatctt

SEQ ID NO: 6049261 - DNA, 15 bp, Homo sapiens
ccattcagcctcgtc

SEQ ID NO: 6049262 - DNA, 18 bp, Homo sapiens
ccattcagcctcgtctct

SEQ ID NO: 6049263 - DNA, 12 bp, Homo sapiens
ccattcaggaac

SEQ ID NO: 6049264 - DNA, 17 bp, Homo sapiens
ccattcaggaacctgga

SEQ ID NO: 6049265 - DNA, 18 bp, Homo sapiens
ccattcatacacaacgta

SEQ ID NO: 6049266 - DNA, 13 bp, Homo sapiens
ccattcatccttc

SEQ ID NO: 6049267 - DNA, 15 bp, Homo sapiens
ccattcatccttcca

SEQ ID NO: 6049268 - DNA, 23 bp, Homo sapiens
ccattcatctctaacatatgata

SEQ ID NO: 6049269 - DNA, 19 bp, Homo sapiens
ccattcatctgggctggca

SEQ ID NO: 6049270 - DNA, 21 bp, Homo sapiens
ccattcatctgggctggcaga

SEQ ID NO: 6049271 - DNA, 15 bp, Homo sapiens
ccattcatctttcct

SEQ ID NO: 6049272 - DNA, 18 bp, Homo sapiens
ccattcatgccaaagcaa

SEQ ID NO: 6049273 - DNA, 14 bp, Homo sapiens
ccattcattccatt

SEQ ID NO: 6049274 - DNA, 18 bp, Homo sapiens
ccattcattccattctgg

SEQ ID NO: 6049275 - DNA, 14 bp, Homo sapiens
ccattccaaagctt

SEQ ID NO: 6049276 - DNA, 21 bp, Homo sapiens
ccattccaagtcaacactctt

SEQ ID NO: 6049277 - DNA, 13 bp, Homo sapiens
ccattccacatcc

SEQ ID NO: 6049278 - DNA, 13 bp, Homo sapiens
ccattccactcca

SEQ ID NO: 6049279 - DNA, 13 bp, Homo sapiens
ccattccagctct

SEQ ID NO: 6049280 - DNA, 11 bp, Homo sapiens
cattgtgaatg

SEQ ID NO: 6049281 - DNA, 19 bp, Homo sapiens
cattgtgaatgctgtggga

SEQ ID NO: 6049282 - DNA, 15 bp, Homo sapiens
cattgtgaatgttgt

SEQ ID NO: 6049283 - DNA, 20 bp, Homo sapiens
cattgtgaatgttgtcctgt

SEQ ID NO: 6049284 - DNA, 22 bp, Homo sapiens
cattgtgaatgttgtcctgtgt

SEQ ID NO: 6049285 - DNA, 15 bp, Homo sapiens
cattgtgacttggag

SEQ ID NO: 6049286 - DNA, 13 bp, Homo sapiens
cattgtgagctct

SEQ ID NO: 6049287 - DNA, 21 bp, Homo sapiens
cattgtgaggtttaacattaa

SEQ ID NO: 6049288 - DNA, 19 bp, Homo sapiens
cattgtgagtaaatcagat

SEQ ID NO: 6049289 - DNA, 22 bp, Homo sapiens
cattgtgcagaaaagctcagag

SEQ ID NO: 6049290 - DNA, 14 bp, Homo sapiens
cattgtgccaagcc

SEQ ID NO: 6049291 - DNA, 19 bp, Homo sapiens
cattgtgcccacttaccct

SEQ ID NO: 6049292 - DNA, 15 bp, Homo sapiens
cattgtgcttaataa

SEQ ID NO: 6049293 - DNA, 18 bp, Homo sapiens
cattgtgcttaataatac

SEQ ID NO: 6049294 - DNA, 13 bp, Homo sapiens
cattgtgcttctt

SEQ ID NO: 6049295 - DNA, 14 bp, Homo sapiens
cattgtggctgtca

SEQ ID NO: 6049296 - DNA, 21 bp, Homo sapiens
cattgtggctgtcagcaggaa

SEQ ID NO: 6049297 - DNA, 13 bp, Homo sapiens
cattgtgggaagg

SEQ ID NO: 6049298 - DNA, 15 bp, Homo sapiens
cattgtgggaagggg

SEQ ID NO: 6049299 - DNA, 20 bp, Homo sapiens
cattgtggttatttttatac

SEQ ID NO: 6049300 - DNA, 21 bp, Homo sapiens
cattgtggttatttttataca

SEQ ID NO: 6049301 - DNA, 13 bp, Homo sapiens
cattgtgtcctgc

SEQ ID NO: 6049302 - DNA, 17 bp, Homo sapiens
cattgtgtgagcttcta

SEQ ID NO: 6049303 - DNA, 20 bp, Homo sapiens
cattgtgtgatccagccctg

SEQ ID NO: 6049304 - DNA, 22 bp, Homo sapiens
cattgtgtgatccagccctggt

SEQ ID NO: 6049305 - DNA, 13 bp, Homo sapiens
cattgtgtggaat

SEQ ID NO: 6049306 - DNA, 14 bp, Homo sapiens
cattgtgtggcctg

SEQ ID NO: 6049307 - DNA, 15 bp, Homo sapiens
cattgtgtggcctgg

SEQ ID NO: 6049308 - DNA, 16 bp, Homo sapiens
cattgtgtggcctggt

SEQ ID NO: 6049309 - DNA, 15 bp, Homo sapiens
cattgtgtgtggaat

SEQ ID NO: 6049310 - DNA, 14 bp, Homo sapiens
cattgtgtttgtgt

SEQ ID NO: 6049311 - DNA, 18 bp, Homo sapiens
cattgttaaatacacatt

SEQ ID NO: 6049312 - DNA, 15 bp, Homo sapiens
cattgttaaatgttc

SEQ ID NO: 6049313 - DNA, 14 bp, Homo sapiens
cattgttaatataa

SEQ ID NO: 6049314 - DNA, 14 bp, Homo sapiens
cattgttacctcta

SEQ ID NO: 6049315 - DNA, 21 bp, Homo sapiens
cattgttatataatcattatt

SEQ ID NO: 6049316 - DNA, 20 bp, Homo sapiens
cattgttatttaatagctgt

SEQ ID NO: 6049317 - DNA, 16 bp, Homo sapiens
cattgttcaattagaa

SEQ ID NO: 6049318 - DNA, 17 bp, Homo sapiens
cattgttcacctttgta

SEQ ID NO: 6049319 - DNA, 18 bp, Homo sapiens
cattgttcacctttgtag

SEQ ID NO: 6049320 - DNA, 19 bp, Homo sapiens
cattgttcacctttgtagc

SEQ ID NO: 6049321 - DNA, 20 bp, Homo sapiens
cattgttcagaaaagcacct

SEQ ID NO: 6049322 - DNA, 21 bp, Homo sapiens
cattgttcagaaaagcacctc

SEQ ID NO: 6049323 - DNA, 13 bp, Homo sapiens
cattgttcagaag

SEQ ID NO: 6049324 - DNA, 11 bp, Homo sapiens
cattgttccac

SEQ ID NO: 6049325 - DNA, 12 bp, Homo sapiens
cattgttccaca

SEQ ID NO: 6049326 - DNA, 16 bp, Homo sapiens
cattgttcccttcctc

SEQ ID NO: 6049327 - DNA, 18 bp, Homo sapiens
cattgttccttaccttta

SEQ ID NO: 6049328 - DNA, 13 bp, Homo sapiens
cattgttctcctc

SEQ ID NO: 6049329 - DNA, 22 bp, Homo sapiens
cattgttctcctcgtccatcag

SEQ ID NO: 6049330 - DNA, 22 bp, Homo sapiens
cattgttctgaacactttaggt

SEQ ID NO: 6049331 - DNA, 19 bp, Homo sapiens
cattgttcttattctggca

SEQ ID NO: 6049332 - DNA, 20 bp, Homo sapiens
cattgttcttattctggcat

SEQ ID NO: 6049333 - DNA, 23 bp, Homo sapiens
cattgttgatgctcacatatgat

SEQ ID NO: 6049334 - DNA, 17 bp, Homo sapiens
cattgttgctccctgtg

SEQ ID NO: 6049335 - DNA, 16 bp, Homo sapiens
cattgttgcttgttgg

SEQ ID NO: 6049336 - DNA, 17 bp, Homo sapiens
cattgttggcgctgagg

SEQ ID NO: 6049337 - DNA, 17 bp, Homo sapiens
cattgttggtgttaatt

SEQ ID NO: 6049338 - DNA, 20 bp, Homo sapiens
cattgttggtgttaattgaa

SEQ ID NO: 6049339 - DNA, 12 bp, Homo sapiens
cattgttgtaaa

SEQ ID NO: 6049340 - DNA, 13 bp, Homo sapiens
cattgttgtaaag

SEQ ID NO: 6049341 - DNA, 14 bp, Homo sapiens
cattgttgtaaagt

SEQ ID NO: 6049342 - DNA, 15 bp, Homo sapiens
cattgttgtgtataa

SEQ ID NO: 6049343 - DNA, 17 bp, Homo sapiens
cattgtttaaaaataca

SEQ ID NO: 6049344 - DNA, 20 bp, Homo sapiens
cattgtttaaaaatacacat

SEQ ID NO: 6049345 - DNA, 17 bp, Homo sapiens
cattgtttagatgaggc

SEQ ID NO: 6049346 - DNA, 18 bp, Homo sapiens
cattgtttagatgaggct

SEQ ID NO: 6049347 - DNA, 22 bp, Homo sapiens
cattgtttagatgaggctcaga

SEQ ID NO: 6049348 - DNA, 21 bp, Homo sapiens
cattgtttctgtgggcgggcc

SEQ ID NO: 6049349 - DNA, 21 bp, Homo sapiens
cattgtttgaaacaaagaagg

SEQ ID NO: 6049350 - DNA, 16 bp, Homo sapiens
cattgtttgctgctat

SEQ ID NO: 6049351 - DNA, 20 bp, Homo sapiens
cattgtttgcttattgttcc

SEQ ID NO: 6049352 - DNA, 17 bp, Homo sapiens
cattgtttggagacatt

SEQ ID NO: 6049353 - DNA, 22 bp, Homo sapiens
cattgtttgtctgtcttcatag

SEQ ID NO: 6049354 - DNA, 15 bp, Homo sapiens
cattgtttgtttgta

SEQ ID NO: 6049355 - DNA, 23 bp, Homo sapiens
cattgttttaaaaagaaacaaga

SEQ ID NO: 6049356 - DNA, 13 bp, Homo sapiens
cattgttttaaag

SEQ ID NO: 6049357 - DNA, 18 bp, Homo sapiens
cattgttttcttttacag

SEQ ID NO: 6049358 - DNA, 23 bp, Homo sapiens
cattgttttcttttacagactag

SEQ ID NO: 6049359 - DNA, 14 bp, Homo sapiens
cattgttttgccaa

SEQ ID NO: 6049360 - DNA, 21 bp, Homo sapiens
cattgtttttaagaaaaacat

SEQ ID NO: 6049361 - DNA, 23 bp, Homo sapiens
cattgtttttaagaaaaacatgt

SEQ ID NO: 6049362 - DNA, 15 bp, Homo sapiens
catttaaaaaaatca

SEQ ID NO: 6049363 - DNA, 23 bp, Homo sapiens
catttaaaaagctcactgctgat

SEQ ID NO: 6049364 - DNA, 13 bp, Homo sapiens
catttaaaacaag

SEQ ID NO: 6049365 - DNA, 18 bp, Homo sapiens
catttaaaacagacactg

SEQ ID NO: 6049366 - DNA, 13 bp, Homo sapiens
catttaaaacatt

SEQ ID NO: 6049367 - DNA, 21 bp, Homo sapiens
catttaaaacattaaaatata

SEQ ID NO: 6049368 - DNA, 15 bp, Homo sapiens
catttaaaagataca

SEQ ID NO: 6049369 - DNA, 12 bp, Homo sapiens
catttaaaagca

SEQ ID NO: 6049370 - DNA, 22 bp, Homo sapiens
catttaaaataccactgtaatt

SEQ ID NO: 6049371 - DNA, 24 bp, Homo sapiens
catttaaaataccactgtaattga

SEQ ID NO: 6049372 - DNA, 19 bp, Homo sapiens
catttaaaatagttttcta

SEQ ID NO: 6049373 - DNA, 18 bp, Homo sapiens
catttaaaatgattagaa

SEQ ID NO: 6049374 - DNA, 20 bp, Homo sapiens
catttaaaattaaataaatt

SEQ ID NO: 6049375 - DNA, 19 bp, Homo sapiens
catttaaaattgctatgtt

SEQ ID NO: 6049376 - DNA, 15 bp, Homo sapiens
catttaaacaagtat

SEQ ID NO: 6049377 - DNA, 19 bp, Homo sapiens
catttaaacaagtatttta

SEQ ID NO: 6049378 - DNA, 13 bp, Homo sapiens
catttaaacagat

SEQ ID NO: 6049379 - DNA, 19 bp, Homo sapiens
catttaaacagatgtccat

SEQ ID NO: 6049380 - DNA, 17 bp, Homo sapiens
catttaaacatgcagaa

SEQ ID NO: 6049381 - DNA, 15 bp, Homo sapiens
catttaaacccggct

SEQ ID NO: 6049382 - DNA, 20 bp, Homo sapiens
catttaaactaaccttttat

SEQ ID NO: 6049383 - DNA, 12 bp, Homo sapiens
catttaaactct

SEQ ID NO: 6049384 - DNA, 19 bp, Homo sapiens
catttaaactctgccagaa

SEQ ID NO: 6049385 - DNA, 22 bp, Homo sapiens
catttaaactctgccagaaaaa

SEQ ID NO: 6049386 - DNA, 18 bp, Homo sapiens
catttaaagaccaataaa

SEQ ID NO: 6049387 - DNA, 17 bp, Homo sapiens
catttaaagagatttcc

SEQ ID NO: 6049388 - DNA, 17 bp, Homo sapiens
catttaaagataccaaa

SEQ ID NO: 6049389 - DNA, 23 bp, Homo sapiens
catttaaagttgtataaaaacat

SEQ ID NO: 6049390 - DNA, 23 bp, Homo sapiens
catttaaataaaactttccaaat

SEQ ID NO: 6049391 - DNA, 15 bp, Homo sapiens
catttaaatattaat

SEQ ID NO: 6049392 - DNA, 11 bp, Homo sapiens
catttaaatcc

SEQ ID NO: 6049393 - DNA, 18 bp, Homo sapiens
catttaaatgtaacttat

SEQ ID NO: 6049394 - DNA, 22 bp, Homo sapiens
catttaaatgtaacttattatt

SEQ ID NO: 6049395 - DNA, 14 bp, Homo sapiens
catttaacagataa

SEQ ID NO: 6049396 - DNA, 18 bp, Homo sapiens
catttaacattgtttttg

SEQ ID NO: 6049397 - DNA, 20 bp, Homo sapiens
catttaacattgtttttgta

SEQ ID NO: 6049398 - DNA, 20 bp, Homo sapiens
catttaactgaactgtgaac

SEQ ID NO: 6049399 - DNA, 15 bp, Homo sapiens
catttaacttacatt

SEQ ID NO: 6049400 - DNA, 14 bp, Homo sapiens
catttaagaaaaat

SEQ ID NO: 6049401 - DNA, 17 bp, Homo sapiens
catttaagaatttacca

SEQ ID NO: 6049402 - DNA, 19 bp, Homo sapiens
catttaagagacagtcacc

SEQ ID NO: 6049403 - DNA, 19 bp, Homo sapiens
catttaagagactctttat

SEQ ID NO: 6049404 - DNA, 17 bp, Homo sapiens
catttaaggaaactaga

SEQ ID NO: 6049405 - DNA, 12 bp, Homo sapiens
catttaaggaga

SEQ ID NO: 6049406 - DNA, 17 bp, Homo sapiens
catttaagggaaaaata

SEQ ID NO: 6049407 - DNA, 17 bp, Homo sapiens
catttaagttgtaaacg

SEQ ID NO: 6049408 - DNA, 15 bp, Homo sapiens
catttaataaaactg

SEQ ID NO: 6049409 - DNA, 12 bp, Homo sapiens
catttaataaag

SEQ ID NO: 6049410 - DNA, 12 bp, Homo sapiens
catttaataata

SEQ ID NO: 6049411 - DNA, 13 bp, Homo sapiens
catttaataatat

SEQ ID NO: 6049412 - DNA, 16 bp, Homo sapiens
catttaataattatat

SEQ ID NO: 6049413 - DNA, 17 bp, Homo sapiens
catttaataattatatg

SEQ ID NO: 6049414 - DNA, 19 bp, Homo sapiens
catttaataattatatgct

SEQ ID NO: 6049415 - DNA, 13 bp, Homo sapiens
catttaatgccat

SEQ ID NO: 6049416 - DNA, 24 bp, Homo sapiens
catttaatgtagccatgggaccaa

SEQ ID NO: 6049417 - DNA, 16 bp, Homo sapiens
catttaattcataatt

SEQ ID NO: 6049418 - DNA, 20 bp, Homo sapiens
catttaattcataattagaa

SEQ ID NO: 6049419 - DNA, 24 bp, Homo sapiens
catttaattcataattagaacaat

SEQ ID NO: 6049420 - DNA, 14 bp, Homo sapiens
catttaattgagaa

SEQ ID NO: 6049421 - DNA, 16 bp, Homo sapiens
catttaatttagatat

SEQ ID NO: 6049422 - DNA, 22 bp, Homo sapiens
catttaatttagatattttcca

SEQ ID NO: 6049423 - DNA, 19 bp, Homo sapiens
catttaatttagtgatctt

SEQ ID NO: 6049424 - DNA, 14 bp, Homo sapiens
catttaatttcatg

SEQ ID NO: 6049425 - DNA, 15 bp, Homo sapiens
catttaatttcatgt

SEQ ID NO: 6049426 - DNA, 16 bp, Homo sapiens
catttaatttcatgta

SEQ ID NO: 6049427 - DNA, 18 bp, Homo sapiens
catttaatttcatgtata

SEQ ID NO: 6049428 - DNA, 19 bp, Homo sapiens
catttaatttcatgtatat

SEQ ID NO: 6049429 - DNA, 15 bp, Homo sapiens
catttaatttctaat

SEQ ID NO: 6049430 - DNA, 20 bp, Homo sapiens
catttaatttctaatttcaa

SEQ ID NO: 6049431 - DNA, 20 bp, Homo sapiens
catttaatttttaaatgttt

SEQ ID NO: 6049432 - DNA, 13 bp, Homo sapiens
catttacaacaat

SEQ ID NO: 6049433 - DNA, 14 bp, Homo sapiens
catttacaacccgg

SEQ ID NO: 6049434 - DNA, 19 bp, Homo sapiens
catttacaataaatattct

SEQ ID NO: 6049435 - DNA, 20 bp, Homo sapiens
catttacaatttcaaaagaa

SEQ ID NO: 6049436 - DNA, 14 bp, Homo sapiens
catttacacattct

SEQ ID NO: 6049437 - DNA, 21 bp, Homo sapiens
catttacacattctcacaatt

SEQ ID NO: 6049438 - DNA, 17 bp, Homo sapiens
catttacaccacacttt

SEQ ID NO: 6049439 - DNA, 13 bp, Homo sapiens
catttacaggagg

SEQ ID NO: 6049440 - DNA, 22 bp, Homo sapiens
catttacaggagggcccggaga

SEQ ID NO: 6049441 - DNA, 20 bp, Homo sapiens
catttacagtctctttcttc

SEQ ID NO: 6049442 - DNA, 12 bp, Homo sapiens
catttacatgta

SEQ ID NO: 6049443 - DNA, 24 bp, Homo sapiens
catttacattaggtattacaagta

SEQ ID NO: 6049444 - DNA, 17 bp, Homo sapiens
catttaccaaattgctt

SEQ ID NO: 6049445 - DNA, 20 bp, Homo sapiens
catttaccaaattgcttgag

SEQ ID NO: 6049446 - DNA, 13 bp, Homo sapiens
catttaccaacat

SEQ ID NO: 6049447 - DNA, 14 bp, Homo sapiens
catttaccaacatg

SEQ ID NO: 6049448 - DNA, 20 bp, Homo sapiens
catttaccaacatgtatctg

SEQ ID NO: 6049449 - DNA, 16 bp, Homo sapiens
catttaccctggtgga

SEQ ID NO: 6049450 - DNA, 17 bp, Homo sapiens
catttacctctaaattt

SEQ ID NO: 6049451 - DNA, 19 bp, Homo sapiens
catttacgcctgtaaatgt

SEQ ID NO: 6049452 - DNA, 21 bp, Homo sapiens
catttacgcctgtaaatgtat

SEQ ID NO: 6049453 - DNA, 19 bp, Homo sapiens
catttactatgcacaacag

SEQ ID NO: 6049454 - DNA, 18 bp, Homo sapiens
catttactcaccatattt

SEQ ID NO: 6049455 - DNA, 13 bp, Homo sapiens
catttactcttga

SEQ ID NO: 6049456 - DNA, 12 bp, Homo sapiens
catttactgaaa

SEQ ID NO: 6049457 - DNA, 19 bp, Homo sapiens
catttactgatcatctgct

SEQ ID NO: 6049458 - DNA, 15 bp, Homo sapiens
catttacttaagact

SEQ ID NO: 6049459 - DNA, 20 bp, Homo sapiens
ccattccaggcagcctctgt

SEQ ID NO: 6049460 - DNA, 21 bp, Homo sapiens
ccattccaggcagcctctgtc

SEQ ID NO: 6049461 - DNA, 12 bp, Homo sapiens
ccattccaggta

SEQ ID NO: 6049462 - DNA, 22 bp, Homo sapiens
ccattccatctagtttttggaa

SEQ ID NO: 6049463 - DNA, 17 bp, Homo sapiens
ccattccatttatcttt

SEQ ID NO: 6049464 - DNA, 16 bp, Homo sapiens
ccattcccaagatgcc

SEQ ID NO: 6049465 - DNA, 17 bp, Homo sapiens
ccattcccaagatgcct

SEQ ID NO: 6049466 - DNA, 21 bp, Homo sapiens
ccattcccaagatgcctgatc

SEQ ID NO: 6049467 - DNA, 23 bp, Homo sapiens
ccattcccaagatgcctgatcag

SEQ ID NO: 6049468 - DNA, 19 bp, Homo sapiens
ccattcccaagggagactg

SEQ ID NO: 6049469 - DNA, 22 bp, Homo sapiens
ccattccccaacggggtgggga

SEQ ID NO: 6049470 - DNA, 19 bp, Homo sapiens
ccattcccccatgtggctg

SEQ ID NO: 6049471 - DNA, 14 bp, Homo sapiens
ccattccctagcag

SEQ ID NO: 6049472 - DNA, 17 bp, Homo sapiens
ccattccctccacccac

SEQ ID NO: 6049473 - DNA, 15 bp, Homo sapiens
ccattccctccattt

SEQ ID NO: 6049474 - DNA, 18 bp, Homo sapiens
ccattccctccatttttc

SEQ ID NO: 6049475 - DNA, 12 bp, Homo sapiens
ccattccctggg

SEQ ID NO: 6049476 - DNA, 19 bp, Homo sapiens
ccattccctgggatctggt

SEQ ID NO: 6049477 - DNA, 11 bp, Homo sapiens
ccattccctgt

SEQ ID NO: 6049478 - DNA, 15 bp, Homo sapiens
ccattcccttcggcc

SEQ ID NO: 6049479 - DNA, 18 bp, Homo sapiens
ccattcccttcggccaaa

SEQ ID NO: 6049480 - DNA, 16 bp, Homo sapiens
ccattcctcagggaca

SEQ ID NO: 6049481 - DNA, 20 bp, Homo sapiens
ccattcctccactctgtatc

SEQ ID NO: 6049482 - DNA, 13 bp, Homo sapiens
ccattcctccctc

SEQ ID NO: 6049483 - DNA, 15 bp, Homo sapiens
ccattcctgcctggt

SEQ ID NO: 6049484 - DNA, 24 bp, Homo sapiens
ccattcctggagcccgaggcacca

SEQ ID NO: 6049485 - DNA, 17 bp, Homo sapiens
ccattcctggtacccag

SEQ ID NO: 6049486 - DNA, 24 bp, Homo sapiens
ccattcctggtacccagccatctg

SEQ ID NO: 6049487 - DNA, 18 bp, Homo sapiens
ccattcctgtccctttgt

SEQ ID NO: 6049488 - DNA, 15 bp, Homo sapiens
ccattcctgttctct

SEQ ID NO: 6049489 - DNA, 17 bp, Homo sapiens
ccattccttcaaataaa

SEQ ID NO: 6049490 - DNA, 18 bp, Homo sapiens
ccattccttgcgcctcag

SEQ ID NO: 6049491 - DNA, 20 bp, Homo sapiens
ccattcctttaaattctcca

SEQ ID NO: 6049492 - DNA, 16 bp, Homo sapiens
ccattcgtctgtccca

SEQ ID NO: 6049493 - DNA, 14 bp, Homo sapiens
ccattctacacaga

SEQ ID NO: 6049494 - DNA, 12 bp, Homo sapiens
ccattctacttg

SEQ ID NO: 6049495 - DNA, 13 bp, Homo sapiens
ccattctacttgc

SEQ ID NO: 6049496 - DNA, 22 bp, Homo sapiens
ccattctacttgctctggacct

SEQ ID NO: 6049497 - DNA, 18 bp, Homo sapiens
ccattctagatcctgcac

SEQ ID NO: 6049498 - DNA, 22 bp, Homo sapiens
ccattctatgactcttgtctcc

SEQ ID NO: 6049499 - DNA, 17 bp, Homo sapiens
ccattctcaagccctgc

SEQ ID NO: 6049500 - DNA, 19 bp, Homo sapiens
ccattctcacctatccaca

SEQ ID NO: 6049501 - DNA, 20 bp, Homo sapiens
ccattctcatatgtagccct

SEQ ID NO: 6049502 - DNA, 15 bp, Homo sapiens
ccattctcatctgca

SEQ ID NO: 6049503 - DNA, 18 bp, Homo sapiens
ccattctcatctgcaccc

SEQ ID NO: 6049504 - DNA, 13 bp, Homo sapiens
ccattctccacag

SEQ ID NO: 6049505 - DNA, 18 bp, Homo sapiens
ccattctccacagcaacc

SEQ ID NO: 6049506 - DNA, 23 bp, Homo sapiens
ccattctcccaggtaccagctgc

SEQ ID NO: 6049507 - DNA, 16 bp, Homo sapiens
ccattctcctgcctca

SEQ ID NO: 6049508 - DNA, 19 bp, Homo sapiens
ccattctcctgcctcagcc

SEQ ID NO: 6049509 - DNA, 20 bp, Homo sapiens
ccattctctttcaattctgt

SEQ ID NO: 6049510 - DNA, 22 bp, Homo sapiens
ccattctgaaaatagcaggaca

SEQ ID NO: 6049511 - DNA, 22 bp, Homo sapiens
ccattctgacatccacatgctc

SEQ ID NO: 6049512 - DNA, 17 bp, Homo sapiens
ccattctgaccatttca

SEQ ID NO: 6049513 - DNA, 13 bp, Homo sapiens
ccattctgactcg

SEQ ID NO: 6049514 - DNA, 20 bp, Homo sapiens
ccattctgactcggtttctc

SEQ ID NO: 6049515 - DNA, 18 bp, Homo sapiens
ccattctgcatgagctga

SEQ ID NO: 6049516 - DNA, 13 bp, Homo sapiens
ccattctgcattt

SEQ ID NO: 6049517 - DNA, 18 bp, Homo sapiens
ccattctgcatttagctg

SEQ ID NO: 6049518 - DNA, 20 bp, Homo sapiens
ccattctgcctcagcctccc

SEQ ID NO: 6049519 - DNA, 13 bp, Homo sapiens
ccattctgctcct

SEQ ID NO: 6049520 - DNA, 19 bp, Homo sapiens
ccattctgctccttcccca

SEQ ID NO: 6049521 - DNA, 12 bp, Homo sapiens
ccattctggaag

SEQ ID NO: 6049522 - DNA, 19 bp, Homo sapiens
ccattctggaagtgacttt

SEQ ID NO: 6049523 - DNA, 22 bp, Homo sapiens
ccattctggattttgtcaagca

SEQ ID NO: 6049524 - DNA, 19 bp, Homo sapiens
ccattctgtcctaccttta

SEQ ID NO: 6049525 - DNA, 10 bp, Homo sapiens
ccattctgtg

SEQ ID NO: 6049526 - DNA, 13 bp, Homo sapiens
ccattctgtgcag

SEQ ID NO: 6049527 - DNA, 17 bp, Homo sapiens
ccattctgtgtcccatg

SEQ ID NO: 6049528 - DNA, 12 bp, Homo sapiens
ccattctgtgtg

SEQ ID NO: 6049529 - DNA, 20 bp, Homo sapiens
ccattcttcagtgtctctgt

SEQ ID NO: 6049530 - DNA, 14 bp, Homo sapiens
ccattcttctgggt

SEQ ID NO: 6049531 - DNA, 15 bp, Homo sapiens
ccattcttgtcctgg

SEQ ID NO: 6049532 - DNA, 20 bp, Homo sapiens
ccattctttcccaacacctc

SEQ ID NO: 6049533 - DNA, 15 bp, Homo sapiens
ccattctttcttcct

SEQ ID NO: 6049534 - DNA, 17 bp, Homo sapiens
ccattcttttaaatatt

SEQ ID NO: 6049535 - DNA, 15 bp, Homo sapiens
ccattcttttcactt

SEQ ID NO: 6049536 - DNA, 16 bp, Homo sapiens
ccattcttttgtaatt

SEQ ID NO: 6049537 - DNA, 18 bp, Homo sapiens
ccattcttttgtaattta

SEQ ID NO: 6049538 - DNA, 23 bp, Homo sapiens
ccattgaaaaaggaaaaatgtag

SEQ ID NO: 6049539 - DNA, 10 bp, Homo sapiens
ccattgaaat

SEQ ID NO: 6049540 - DNA, 16 bp, Homo sapiens
ccattgaaatcagcat

SEQ ID NO: 6049541 - DNA, 22 bp, Homo sapiens
ccattgaagaagaaccagccca

SEQ ID NO: 6049542 - DNA, 19 bp, Homo sapiens
ccattgaagccgactctgg

SEQ ID NO: 6049543 - DNA, 20 bp, Homo sapiens
ccattgaagccgactctggc

SEQ ID NO: 6049544 - DNA, 12 bp, Homo sapiens
ccattgaaggct

SEQ ID NO: 6049545 - DNA, 21 bp, Homo sapiens
ccattgaaggcttaaacccat

SEQ ID NO: 6049546 - DNA, 21 bp, Homo sapiens
ccattgaaggcttaattgact

SEQ ID NO: 6049547 - DNA, 22 bp, Homo sapiens
ccattgaattcttggttgagga

SEQ ID NO: 6049548 - DNA, 19 bp, Homo sapiens
ccattgacaaggtgtttct

SEQ ID NO: 6049549 - DNA, 14 bp, Homo sapiens
ccattgacatttga

SEQ ID NO: 6049550 - DNA, 21 bp, Homo sapiens
ccattgacatttgaatttgga

SEQ ID NO: 6049551 - DNA, 15 bp, Homo sapiens
ccattgaccagctct

SEQ ID NO: 6049552 - DNA, 16 bp, Homo sapiens
ccattgaccagctctc

SEQ ID NO: 6049553 - DNA, 15 bp, Homo sapiens
ccattgacctcagct

SEQ ID NO: 6049554 - DNA, 21 bp, Homo sapiens
ccattgacctcagctgcacat

SEQ ID NO: 6049555 - DNA, 21 bp, Homo sapiens
ccattgacttgcacatctctg

SEQ ID NO: 6049556 - DNA, 17 bp, Homo sapiens
ccattgagatcttcctg

SEQ ID NO: 6049557 - DNA, 16 bp, Homo sapiens
ccattgagctgtttcc

SEQ ID NO: 6049558 - DNA, 24 bp, Homo sapiens
ccattgaggcttggttccttccca

SEQ ID NO: 6049559 - DNA, 14 bp, Homo sapiens
ccattgagtccctg

SEQ ID NO: 6049560 - DNA, 18 bp, Homo sapiens
ccattgatcataaactga

SEQ ID NO: 6049561 - DNA, 22 bp, Homo sapiens
ccattgatgagcactcctgatt

SEQ ID NO: 6049562 - DNA, 19 bp, Homo sapiens
ccattgattttttttttct

SEQ ID NO: 6049563 - DNA, 14 bp, Homo sapiens
ccattgcaaacatt

SEQ ID NO: 6049564 - DNA, 16 bp, Homo sapiens
ccattgcacccagccc

SEQ ID NO: 6049565 - DNA, 21 bp, Homo sapiens
ccattgcactccagcctgggc

SEQ ID NO: 6049566 - DNA, 15 bp, Homo sapiens
ccattgccaccagga

SEQ ID NO: 6049567 - DNA, 17 bp, Homo sapiens
ccattgccaccaggaga

SEQ ID NO: 6049568 - DNA, 21 bp, Homo sapiens
ccattgccaccaggagaacca

SEQ ID NO: 6049569 - DNA, 23 bp, Homo sapiens
ccattgccacggccatgagggct

SEQ ID NO: 6049570 - DNA, 17 bp, Homo sapiens
ccattgccatcagtgat

SEQ ID NO: 6049571 - DNA, 16 bp, Homo sapiens
ccattgcccagtgagc

SEQ ID NO: 6049572 - DNA, 17 bp, Homo sapiens
ccattgcccagtgagcc

SEQ ID NO: 6049573 - DNA, 22 bp, Homo sapiens
ccattgcccagtgagccctgct

SEQ ID NO: 6049574 - DNA, 16 bp, Homo sapiens
ccattgccccagacct

SEQ ID NO: 6049575 - DNA, 23 bp, Homo sapiens
ccattgcctcttttcacattttt

SEQ ID NO: 6049576 - DNA, 16 bp, Homo sapiens
ccattgcggccccagg

SEQ ID NO: 6049577 - DNA, 20 bp, Homo sapiens
ccattgcggccccaggaggg

SEQ ID NO: 6049578 - DNA, 21 bp, Homo sapiens
ccattgcggccccaggagggg

SEQ ID NO: 6049579 - DNA, 17 bp, Homo sapiens
ccattgctaatttaaag

SEQ ID NO: 6049580 - DNA, 17 bp, Homo sapiens
ccattgctcacactact

SEQ ID NO: 6049581 - DNA, 21 bp, Homo sapiens
ccattgctcacactacttgag

SEQ ID NO: 6049582 - DNA, 16 bp, Homo sapiens
ccattgctcccagtgc

SEQ ID NO: 6049583 - DNA, 18 bp, Homo sapiens
ccattgctcccagtgcca

SEQ ID NO: 6049584 - DNA, 21 bp, Homo sapiens
ccattgctcttagtcccaagc

SEQ ID NO: 6049585 - DNA, 22 bp, Homo sapiens
ccattgctcttagtcccaagct

SEQ ID NO: 6049586 - DNA, 23 bp, Homo sapiens
ccattgctggcaatgagtgtgcc

SEQ ID NO: 6049587 - DNA, 19 bp, Homo sapiens
ccattgctgttctactttt

SEQ ID NO: 6049588 - DNA, 17 bp, Homo sapiens
ccattgcttattatgta

SEQ ID NO: 6049589 - DNA, 18 bp, Homo sapiens
ccattgcttattatgtag

SEQ ID NO: 6049590 - DNA, 16 bp, Homo sapiens
ccattggcctcttgtc

SEQ ID NO: 6049591 - DNA, 19 bp, Homo sapiens
ccattggccttaactggcc

SEQ ID NO: 6049592 - DNA, 22 bp, Homo sapiens
ccattggctgcgctaaccccca

SEQ ID NO: 6049593 - DNA, 12 bp, Homo sapiens
ccattggcttcc

SEQ ID NO: 6049594 - DNA, 11 bp, Homo sapiens
ccattgggacc

SEQ ID NO: 6049595 - DNA, 20 bp, Homo sapiens
ccattgggaccctccagtgc

SEQ ID NO: 6049596 - DNA, 15 bp, Homo sapiens
ccattggggctccca

SEQ ID NO: 6049597 - DNA, 19 bp, Homo sapiens
ccattggggctcccagcca

SEQ ID NO: 6049598 - DNA, 23 bp, Homo sapiens
ccattgggtttggggccatggtg

SEQ ID NO: 6049599 - DNA, 16 bp, Homo sapiens
ccattggttggaagct

SEQ ID NO: 6049600 - DNA, 19 bp, Homo sapiens
ccattgtaaatctgaagaa

SEQ ID NO: 6049601 - DNA, 20 bp, Homo sapiens
ccattgtaaatctgaagaaa

SEQ ID NO: 6049602 - DNA, 22 bp, Homo sapiens
ccattgtactccagcctgggca

SEQ ID NO: 6049603 - DNA, 19 bp, Homo sapiens
ccattgtagcgtctttctt

SEQ ID NO: 6049604 - DNA, 20 bp, Homo sapiens
ccattgtagcgtctttcttt

SEQ ID NO: 6049605 - DNA, 20 bp, Homo sapiens
ccattgtatttaaaacattt

SEQ ID NO: 6049606 - DNA, 14 bp, Homo sapiens
ccattgtctcattg

SEQ ID NO: 6049607 - DNA, 13 bp, Homo sapiens
ccattgtcttcca

SEQ ID NO: 6049608 - DNA, 14 bp, Homo sapiens
ccattgtcttccaa

SEQ ID NO: 6049609 - DNA, 21 bp, Homo sapiens
ccattgtcttccaaccccagc

SEQ ID NO: 6049610 - DNA, 22 bp, Homo sapiens
ccattgtcttccaaccccagct

SEQ ID NO: 6049611 - DNA, 16 bp, Homo sapiens
ccattgtcttgttctg

SEQ ID NO: 6049612 - DNA, 12 bp, Homo sapiens
ccattgtcttta

SEQ ID NO: 6049613 - DNA, 19 bp, Homo sapiens
ccattgtgaaccaatgcaa

SEQ ID NO: 6049614 - DNA, 21 bp, Homo sapiens
ccattgtgaatgttgtcctgt

SEQ ID NO: 6049615 - DNA, 17 bp, Homo sapiens
ccattgtgacagcgatg

SEQ ID NO: 6049616 - DNA, 12 bp, Homo sapiens
ccattgtgcatt

SEQ ID NO: 6049617 - DNA, 18 bp, Homo sapiens
ccattgtggaaactggat

SEQ ID NO: 6049618 - DNA, 20 bp, Homo sapiens
ccattgtggctcctatctgt

SEQ ID NO: 6049619 - DNA, 12 bp, Homo sapiens
ccattgtgtgag

SEQ ID NO: 6049620 - DNA, 19 bp, Homo sapiens
ccattgtgtgatccagccc

SEQ ID NO: 6049621 - DNA, 20 bp, Homo sapiens
ccattgtgtgatccagccct

SEQ ID NO: 6049622 - DNA, 15 bp, Homo sapiens
ccattgttcccttcc

SEQ ID NO: 6049623 - DNA, 17 bp, Homo sapiens
ccattgttgtcaaatgc

SEQ ID NO: 6049624 - DNA, 15 bp, Homo sapiens
ccattgtttaaaaat

SEQ ID NO: 6049625 - DNA, 20 bp, Homo sapiens
ccattgtttaaaaatacaca

SEQ ID NO: 6049626 - DNA, 22 bp, Homo sapiens
ccattgtttaaaaatacacatg

SEQ ID NO: 6049627 - DNA, 22 bp, Homo sapiens
ccattgtttgaaacaaagaagg

SEQ ID NO: 6049628 - DNA, 23 bp, Homo sapiens
ccattgtttttcaaaggcctcac

SEQ ID NO: 6049629 - DNA, 14 bp, Homo sapiens
ccatttaaaaagtt

SEQ ID NO: 6049630 - DNA, 17 bp, Homo sapiens
ccatttaaaacaagctg

SEQ ID NO: 6049631 - DNA, 19 bp, Homo sapiens
ccatttaactagcacttta

SEQ ID NO: 6049632 - DNA, 20 bp, Homo sapiens
ccatttaagtatcttgtgct

SEQ ID NO: 6049633 - DNA, 22 bp, Homo sapiens
ccatttaatcatttccagcaaa

SEQ ID NO: 6049634 - DNA, 20 bp, Homo sapiens
ccatttaatggggaggacaa

SEQ ID NO: 6049635 - DNA, 15 bp, Homo sapiens
ccatttaatttctat

SEQ ID NO: 6049636 - DNA, 15 bp, Homo sapiens
catttacttaggact

SEQ ID NO: 6049637 - DNA, 15 bp, Homo sapiens
catttactttggtca

SEQ ID NO: 6049638 - DNA, 12 bp, Homo sapiens
catttagaaaag

SEQ ID NO: 6049639 - DNA, 15 bp, Homo sapiens
catttagaaatcaag

SEQ ID NO: 6049640 - DNA, 13 bp, Homo sapiens
catttagaagaaa

SEQ ID NO: 6049641 - DNA, 20 bp, Homo sapiens
catttagaagaaagatgttt

SEQ ID NO: 6049642 - DNA, 21 bp, Homo sapiens
catttagaagcctgacaactc

SEQ ID NO: 6049643 - DNA, 18 bp, Homo sapiens
catttagaatctagaaat

SEQ ID NO: 6049644 - DNA, 21 bp, Homo sapiens
catttagaatttgaaaggaaa

SEQ ID NO: 6049645 - DNA, 19 bp, Homo sapiens
catttagagggtgaaggag

SEQ ID NO: 6049646 - DNA, 18 bp, Homo sapiens
catttagagtttcacaga

SEQ ID NO: 6049647 - DNA, 18 bp, Homo sapiens
catttagataatttgaaa

SEQ ID NO: 6049648 - DNA, 19 bp, Homo sapiens
catttagataatttgaaaa

SEQ ID NO: 6049649 - DNA, 14 bp, Homo sapiens
catttagcaataaa

SEQ ID NO: 6049650 - DNA, 18 bp, Homo sapiens
catttagcaataaataac

SEQ ID NO: 6049651 - DNA, 16 bp, Homo sapiens
catttagcacagtatt

SEQ ID NO: 6049652 - DNA, 18 bp, Homo sapiens
catttagcacagtattta

SEQ ID NO: 6049653 - DNA, 19 bp, Homo sapiens
catttagcatgagttctgc

SEQ ID NO: 6049654 - DNA, 18 bp, Homo sapiens
catttagccaccatcttt

SEQ ID NO: 6049655 - DNA, 18 bp, Homo sapiens
catttagcccctctctta

SEQ ID NO: 6049656 - DNA, 17 bp, Homo sapiens
catttagcctgtcctgt

SEQ ID NO: 6049657 - DNA, 22 bp, Homo sapiens
catttagctaaacggattccaa

SEQ ID NO: 6049658 - DNA, 17 bp, Homo sapiens
catttagcttctttccc

SEQ ID NO: 6049659 - DNA, 19 bp, Homo sapiens
catttaggatactcttaat

SEQ ID NO: 6049660 - DNA, 20 bp, Homo sapiens
catttagggagtattctaat

SEQ ID NO: 6049661 - DNA, 16 bp, Homo sapiens
catttaggggcaagca

SEQ ID NO: 6049662 - DNA, 16 bp, Homo sapiens
catttaggtgaggaag

SEQ ID NO: 6049663 - DNA, 15 bp, Homo sapiens
catttaggtttctga

SEQ ID NO: 6049664 - DNA, 21 bp, Homo sapiens
catttagtaaatgctgaaata

SEQ ID NO: 6049665 - DNA, 14 bp, Homo sapiens
catttagtaagaat

SEQ ID NO: 6049666 - DNA, 15 bp, Homo sapiens
catttagtaagaata

SEQ ID NO: 6049667 - DNA, 15 bp, Homo sapiens
catttagtaccctgc

SEQ ID NO: 6049668 - DNA, 12 bp, Homo sapiens
catttagtagaa

SEQ ID NO: 6049669 - DNA, 19 bp, Homo sapiens
catttagtccaatgaagat

SEQ ID NO: 6049670 - DNA, 17 bp, Homo sapiens
catttagtcctcacctt

SEQ ID NO: 6049671 - DNA, 17 bp, Homo sapiens
catttagtctctttatt

SEQ ID NO: 6049672 - DNA, 23 bp, Homo sapiens
catttagtctctttattcctagt

SEQ ID NO: 6049673 - DNA, 17 bp, Homo sapiens
catttagtgtgaatatt

SEQ ID NO: 6049674 - DNA, 20 bp, Homo sapiens
catttagttctttgttattt

SEQ ID NO: 6049675 - DNA, 22 bp, Homo sapiens
catttagttgggtctgaaagga

SEQ ID NO: 6049676 - DNA, 23 bp, Homo sapiens
catttagtttgattattcagtgt

SEQ ID NO: 6049677 - DNA, 21 bp, Homo sapiens
catttataaagctaaaataac

SEQ ID NO: 6049678 - DNA, 17 bp, Homo sapiens
catttataattgcatct

SEQ ID NO: 6049679 - DNA, 19 bp, Homo sapiens
catttatacaaattagaaa

SEQ ID NO: 6049680 - DNA, 22 bp, Homo sapiens
catttatacatcacctttttga

SEQ ID NO: 6049681 - DNA, 16 bp, Homo sapiens
catttatacctttgaa

SEQ ID NO: 6049682 - DNA, 14 bp, Homo sapiens
catttatagaagaa

SEQ ID NO: 6049683 - DNA, 15 bp, Homo sapiens
catttatagaagaaa

SEQ ID NO: 6049684 - DNA, 12 bp, Homo sapiens
catttatagatc

SEQ ID NO: 6049685 - DNA, 14 bp, Homo sapiens
catttatagatcat

SEQ ID NO: 6049686 - DNA, 20 bp, Homo sapiens
catttatagatcatttctag

SEQ ID NO: 6049687 - DNA, 14 bp, Homo sapiens
catttatatatata

SEQ ID NO: 6049688 - DNA, 17 bp, Homo sapiens
catttatatatatatgt

SEQ ID NO: 6049689 - DNA, 20 bp, Homo sapiens
catttatatatatatgtata

SEQ ID NO: 6049690 - DNA, 13 bp, Homo sapiens
catttatatattg

SEQ ID NO: 6049691 - DNA, 15 bp, Homo sapiens
catttatatattgaa

SEQ ID NO: 6049692 - DNA, 18 bp, Homo sapiens
catttatatattgtctgt

SEQ ID NO: 6049693 - DNA, 21 bp, Homo sapiens
catttatatattgtctgtaaa

SEQ ID NO: 6049694 - DNA, 14 bp, Homo sapiens
catttatatctgct

SEQ ID NO: 6049695 - DNA, 20 bp, Homo sapiens
catttatatgggtttatttt

SEQ ID NO: 6049696 - DNA, 17 bp, Homo sapiens
catttatattaaataac

SEQ ID NO: 6049697 - DNA, 21 bp, Homo sapiens
catttatattgataagatctt

SEQ ID NO: 6049698 - DNA, 21 bp, Homo sapiens
catttatattgcagattgaat

SEQ ID NO: 6049699 - DNA, 14 bp, Homo sapiens
catttatattttta

SEQ ID NO: 6049700 - DNA, 15 bp, Homo sapiens
catttatatttttat

SEQ ID NO: 6049701 - DNA, 18 bp, Homo sapiens
catttatcaagcagagac

SEQ ID NO: 6049702 - DNA, 23 bp, Homo sapiens
catttatcatggtcctgaatgta

SEQ ID NO: 6049703 - DNA, 18 bp, Homo sapiens
catttatccacaggaaag

SEQ ID NO: 6049704 - DNA, 19 bp, Homo sapiens
catttatccaggaattgat

SEQ ID NO: 6049705 - DNA, 23 bp, Homo sapiens
catttatcccaaatcctgtctga

SEQ ID NO: 6049706 - DNA, 16 bp, Homo sapiens
catttatctataattt

SEQ ID NO: 6049707 - DNA, 21 bp, Homo sapiens
catttatctataatttaccta

SEQ ID NO: 6049708 - DNA, 15 bp, Homo sapiens
catttatctattaaa

SEQ ID NO: 6049709 - DNA, 21 bp, Homo sapiens
catttatctattaaaattgcc

SEQ ID NO: 6049710 - DNA, 15 bp, Homo sapiens
catttatcttatcta

SEQ ID NO: 6049711 - DNA, 15 bp, Homo sapiens
catttatcttctgtt

SEQ ID NO: 6049712 - DNA, 23 bp, Homo sapiens
catttatcttgaaggaaaaattc

SEQ ID NO: 6049713 - DNA, 14 bp, Homo sapiens
catttatctttgta

SEQ ID NO: 6049714 - DNA, 19 bp, Homo sapiens
catttatctttgtattctt

SEQ ID NO: 6049715 - DNA, 21 bp, Homo sapiens
catttatgacaagctgtatca

SEQ ID NO: 6049716 - DNA, 22 bp, Homo sapiens
catttatgacctaagtcaggta

SEQ ID NO: 6049717 - DNA, 17 bp, Homo sapiens
catttatgagctcttca

SEQ ID NO: 6049718 - DNA, 19 bp, Homo sapiens
catttatgagtaactatta

SEQ ID NO: 6049719 - DNA, 20 bp, Homo sapiens
catttatgatttaataaaat

SEQ ID NO: 6049720 - DNA, 23 bp, Homo sapiens
catttatgatttaataaaataat

SEQ ID NO: 6049721 - DNA, 23 bp, Homo sapiens
catttatgatttctccagaaatt

SEQ ID NO: 6049722 - DNA, 21 bp, Homo sapiens
catttatgcaatttacttgga

SEQ ID NO: 6049723 - DNA, 14 bp, Homo sapiens
catttatgcacatt

SEQ ID NO: 6049724 - DNA, 22 bp, Homo sapiens
catttatgcatgagaactaaat

SEQ ID NO: 6049725 - DNA, 23 bp, Homo sapiens
catttatgcatgagaactaaata

SEQ ID NO: 6049726 - DNA, 22 bp, Homo sapiens
catttatggaacttccctcccc

SEQ ID NO: 6049727 - DNA, 16 bp, Homo sapiens
catttatggtaatcat

SEQ ID NO: 6049728 - DNA, 19 bp, Homo sapiens
catttatggtaatcatatt

SEQ ID NO: 6049729 - DNA, 20 bp, Homo sapiens
catttatggtcaacacttaa

SEQ ID NO: 6049730 - DNA, 22 bp, Homo sapiens
catttatgtagacattgtaaat

SEQ ID NO: 6049731 - DNA, 16 bp, Homo sapiens
catttatgtctcatgt

SEQ ID NO: 6049732 - DNA, 12 bp, Homo sapiens
catttatgtgtt

SEQ ID NO: 6049733 - DNA, 21 bp, Homo sapiens
catttatgttcctttatttag

SEQ ID NO: 6049734 - DNA, 14 bp, Homo sapiens
catttatgtttatt

SEQ ID NO: 6049735 - DNA, 15 bp, Homo sapiens
catttattaagcagt

SEQ ID NO: 6049736 - DNA, 18 bp, Homo sapiens
catttattagtattctaa

SEQ ID NO: 6049737 - DNA, 21 bp, Homo sapiens
catttattattttaatattta

SEQ ID NO: 6049738 - DNA, 14 bp, Homo sapiens
catttattccttcc

SEQ ID NO: 6049739 - DNA, 13 bp, Homo sapiens
catttattctgct

SEQ ID NO: 6049740 - DNA, 14 bp, Homo sapiens
catttattctgctc

SEQ ID NO: 6049741 - DNA, 16 bp, Homo sapiens
catttattctgctcac

SEQ ID NO: 6049742 - DNA, 15 bp, Homo sapiens
catttattgtttgaa

SEQ ID NO: 6049743 - DNA, 17 bp, Homo sapiens
catttatttatccagaa

SEQ ID NO: 6049744 - DNA, 22 bp, Homo sapiens
catttatttatgaaaaaatatg

SEQ ID NO: 6049745 - DNA, 20 bp, Homo sapiens
catttatttattactgtccc

SEQ ID NO: 6049746 - DNA, 22 bp, Homo sapiens
catttatttattactgtcccta

SEQ ID NO: 6049747 - DNA, 23 bp, Homo sapiens
catttattttatgagaaatgtaa

SEQ ID NO: 6049748 - DNA, 19 bp, Homo sapiens
catttatttttagttaaaa

SEQ ID NO: 6049749 - DNA, 19 bp, Homo sapiens
catttattttttacattat

SEQ ID NO: 6049750 - DNA, 19 bp, Homo sapiens
catttattttttttaaaga

SEQ ID NO: 6049751 - DNA, 20 bp, Homo sapiens
catttattttttttaaagaa

SEQ ID NO: 6049752 - DNA, 21 bp, Homo sapiens
catttattttttttaaagaaa

SEQ ID NO: 6049753 - DNA, 23 bp, Homo sapiens
catttcaaaacaagatgtgtcat

SEQ ID NO: 6049754 - DNA, 14 bp, Homo sapiens
catttcaaaatgat

SEQ ID NO: 6049755 - DNA, 14 bp, Homo sapiens
catttcaaaatgct

SEQ ID NO: 6049756 - DNA, 17 bp, Homo sapiens
catttcaaagccctgcc

SEQ ID NO: 6049757 - DNA, 14 bp, Homo sapiens
catttcaaatctgt

SEQ ID NO: 6049758 - DNA, 19 bp, Homo sapiens
catttcaaatctgtagcat

SEQ ID NO: 6049759 - DNA, 18 bp, Homo sapiens
catttcaactttgttcct

SEQ ID NO: 6049760 - DNA, 19 bp, Homo sapiens
catttcaaggtaaaatgta

SEQ ID NO: 6049761 - DNA, 11 bp, Homo sapiens
catttcaatcc

SEQ ID NO: 6049762 - DNA, 19 bp, Homo sapiens
catttcaatccatttttta

SEQ ID NO: 6049763 - DNA, 16 bp, Homo sapiens
catttcaattctcaaa

SEQ ID NO: 6049764 - DNA, 15 bp, Homo sapiens
catttcacacaactg

SEQ ID NO: 6049765 - DNA, 16 bp, Homo sapiens
catttcacacaactgt

SEQ ID NO: 6049766 - DNA, 14 bp, Homo sapiens
catttcacacaggt

SEQ ID NO: 6049767 - DNA, 14 bp, Homo sapiens
catttcacaccctt

SEQ ID NO: 6049768 - DNA, 15 bp, Homo sapiens
catttcacagtattt

SEQ ID NO: 6049769 - DNA, 14 bp, Homo sapiens
catttcacatgcct

SEQ ID NO: 6049770 - DNA, 18 bp, Homo sapiens
catttcacatgccttgca

SEQ ID NO: 6049771 - DNA, 13 bp, Homo sapiens
catttcacattaa

SEQ ID NO: 6049772 - DNA, 16 bp, Homo sapiens
catttcacattattct

SEQ ID NO: 6049773 - DNA, 16 bp, Homo sapiens
catttcacattcctga

SEQ ID NO: 6049774 - DNA, 17 bp, Homo sapiens
catttcacattcctgac

SEQ ID NO: 6049775 - DNA, 18 bp, Homo sapiens
catttcacattcctgacc

SEQ ID NO: 6049776 - DNA, 17 bp, Homo sapiens
catttcacattgaatca

SEQ ID NO: 6049777 - DNA, 19 bp, Homo sapiens
catttcacatttttgtaat

SEQ ID NO: 6049778 - DNA, 19 bp, Homo sapiens
catttcacccctccctttc

SEQ ID NO: 6049779 - DNA, 13 bp, Homo sapiens
catttcactttaa

SEQ ID NO: 6049780 - DNA, 16 bp, Homo sapiens
catttcacttttctgt

SEQ ID NO: 6049781 - DNA, 13 bp, Homo sapiens
catttcagaagtt

SEQ ID NO: 6049782 - DNA, 23 bp, Homo sapiens
catttcagaagttagtttgtata

SEQ ID NO: 6049783 - DNA, 15 bp, Homo sapiens
catttcagagggtaa

SEQ ID NO: 6049784 - DNA, 22 bp, Homo sapiens
catttcagagttctttttgaag

SEQ ID NO: 6049785 - DNA, 14 bp, Homo sapiens
catttcagatttta

SEQ ID NO: 6049786 - DNA, 12 bp, Homo sapiens
catttcagccaa

SEQ ID NO: 6049787 - DNA, 20 bp, Homo sapiens
catttcagccaaactgtaga

SEQ ID NO: 6049788 - DNA, 14 bp, Homo sapiens
catttcagccaaag

SEQ ID NO: 6049789 - DNA, 17 bp, Homo sapiens
catttcagccaaagtcc

SEQ ID NO: 6049790 - DNA, 14 bp, Homo sapiens
catttcaggaattt

SEQ ID NO: 6049791 - DNA, 20 bp, Homo sapiens
catttcaggactctctccag

SEQ ID NO: 6049792 - DNA, 22 bp, Homo sapiens
catttcagggagaaactccaaa

SEQ ID NO: 6049793 - DNA, 22 bp, Homo sapiens
catttcaggttgtgcattttgt

SEQ ID NO: 6049794 - DNA, 20 bp, Homo sapiens
catttcataaggcctgccct

SEQ ID NO: 6049795 - DNA, 21 bp, Homo sapiens
catttcataaggcctgccctc

SEQ ID NO: 6049796 - DNA, 19 bp, Homo sapiens
catttcatatatctatatg

SEQ ID NO: 6049797 - DNA, 18 bp, Homo sapiens
catttcatcaagattaat

SEQ ID NO: 6049798 - DNA, 16 bp, Homo sapiens
catttcatcattgttt

SEQ ID NO: 6049799 - DNA, 21 bp, Homo sapiens
catttcatcattgtttctgca

SEQ ID NO: 6049800 - DNA, 18 bp, Homo sapiens
catttcatccatatttct

SEQ ID NO: 6049801 - DNA, 20 bp, Homo sapiens
catttcatctatttctgaga

SEQ ID NO: 6049802 - DNA, 14 bp, Homo sapiens
catttcatctcatt

SEQ ID NO: 6049803 - DNA, 16 bp, Homo sapiens
catttcatctcattta

SEQ ID NO: 6049804 - DNA, 11 bp, Homo sapiens
catttcatctg

SEQ ID NO: 6049805 - DNA, 15 bp, Homo sapiens
catttcatctgggtg

SEQ ID NO: 6049806 - DNA, 14 bp, Homo sapiens
catttcatgaaaaa

SEQ ID NO: 6049807 - DNA, 23 bp, Homo sapiens
catttcatgaaaaagctgcttct

SEQ ID NO: 6049808 - DNA, 10 bp, Homo sapiens
catttcatgc

SEQ ID NO: 6049809 - DNA, 14 bp, Homo sapiens
catttcatgctctg

SEQ ID NO: 6049810 - DNA, 15 bp, Homo sapiens
catttcatgtagtaa

SEQ ID NO: 6049811 - DNA, 21 bp, Homo sapiens
catttcatgtatttctttaga

SEQ ID NO: 6049812 - DNA, 14 bp, Homo sapiens
catttcatgtgatc

SEQ ID NO: 6049813 - DNA, 23 bp, Homo sapiens
catttcatgtgatctattactct

SEQ ID NO: 6049814 - DNA, 17 bp, Homo sapiens
ccatttacaaataagag

SEQ ID NO: 6049815 - DNA, 23 bp, Homo sapiens
ccatttacagtctctttcttcct

SEQ ID NO: 6049816 - DNA, 17 bp, Homo sapiens
ccatttacatgttttaa

SEQ ID NO: 6049817 - DNA, 20 bp, Homo sapiens
ccatttacatgttttaaaga

SEQ ID NO: 6049818 - DNA, 23 bp, Homo sapiens
ccatttactgacacttcctgtcc

SEQ ID NO: 6049819 - DNA, 23 bp, Homo sapiens
ccatttactgcattcttctgatc

SEQ ID NO: 6049820 - DNA, 14 bp, Homo sapiens
ccatttagaatcta

SEQ ID NO: 6049821 - DNA, 17 bp, Homo sapiens
ccatttagaatctagaa

SEQ ID NO: 6049822 - DNA, 18 bp, Homo sapiens
ccatttagaatctagaaa

SEQ ID NO: 6049823 - DNA, 21 bp, Homo sapiens
ccatttaggtttctgagttcc

SEQ ID NO: 6049824 - DNA, 18 bp, Homo sapiens
ccatttagtgtgaatatt

SEQ ID NO: 6049825 - DNA, 21 bp, Homo sapiens
ccatttataaccccagcctga

SEQ ID NO: 6049826 - DNA, 20 bp, Homo sapiens
ccatttatggaacttccctc

SEQ ID NO: 6049827 - DNA, 22 bp, Homo sapiens
ccatttattattttaatattta

SEQ ID NO: 6049828 - DNA, 20 bp, Homo sapiens
ccatttattgtttgaaatgt

SEQ ID NO: 6049829 - DNA, 12 bp, Homo sapiens
ccatttcaaatg

SEQ ID NO: 6049830 - DNA, 17 bp, Homo sapiens
ccatttcaatagcccca

SEQ ID NO: 6049831 - DNA, 17 bp, Homo sapiens
ccatttcaattctcaaa

SEQ ID NO: 6049832 - DNA, 17 bp, Homo sapiens
ccatttcaattgctttg

SEQ ID NO: 6049833 - DNA, 12 bp, Homo sapiens
ccatttcacaga

SEQ ID NO: 6049834 - DNA, 16 bp, Homo sapiens
ccatttcacattcctg

SEQ ID NO: 6049835 - DNA, 18 bp, Homo sapiens
ccatttcacattcctgac

SEQ ID NO: 6049836 - DNA, 21 bp, Homo sapiens
ccatttcaggactctctccag

SEQ ID NO: 6049837 - DNA, 23 bp, Homo sapiens
ccatttcaggactctctccagga

SEQ ID NO: 6049838 - DNA, 16 bp, Homo sapiens
ccatttcagtggcttc

SEQ ID NO: 6049839 - DNA, 22 bp, Homo sapiens
ccatttcatttgtgccagaatg

SEQ ID NO: 6049840 - DNA, 16 bp, Homo sapiens
ccatttcccacatctt

SEQ ID NO: 6049841 - DNA, 17 bp, Homo sapiens
ccatttcccacatcttt

SEQ ID NO: 6049842 - DNA, 16 bp, Homo sapiens
ccatttcccatctgca

SEQ ID NO: 6049843 - DNA, 14 bp, Homo sapiens
ccatttccccctcc

SEQ ID NO: 6049844 - DNA, 16 bp, Homo sapiens
ccatttccccctcctc

SEQ ID NO: 6049845 - DNA, 17 bp, Homo sapiens
ccatttccccctcctca

SEQ ID NO: 6049846 - DNA, 14 bp, Homo sapiens
ccatttcccctgtg

SEQ ID NO: 6049847 - DNA, 18 bp, Homo sapiens
ccatttcccgcacatggt

SEQ ID NO: 6049848 - DNA, 13 bp, Homo sapiens
ccatttccctgaa

SEQ ID NO: 6049849 - DNA, 17 bp, Homo sapiens
ccatttccctgaacaga

SEQ ID NO: 6049850 - DNA, 22 bp, Homo sapiens
ccatttcccttctggacactga

SEQ ID NO: 6049851 - DNA, 17 bp, Homo sapiens
ccatttcctcttccttc

SEQ ID NO: 6049852 - DNA, 13 bp, Homo sapiens
ccatttcctgtac

SEQ ID NO: 6049853 - DNA, 17 bp, Homo sapiens
ccatttccttatgctgt

SEQ ID NO: 6049854 - DNA, 23 bp, Homo sapiens
ccatttctaaagctgaatgtcaa

SEQ ID NO: 6049855 - DNA, 17 bp, Homo sapiens
ccatttctaaataagga

SEQ ID NO: 6049856 - DNA, 11 bp, Homo sapiens
ccatttctaat

SEQ ID NO: 6049857 - DNA, 14 bp, Homo sapiens
ccatttctaattat

SEQ ID NO: 6049858 - DNA, 21 bp, Homo sapiens
ccatttctaattatgtagctc

SEQ ID NO: 6049859 - DNA, 22 bp, Homo sapiens
ccatttctactcttaagtttct

SEQ ID NO: 6049860 - DNA, 13 bp, Homo sapiens
ccatttctattta

SEQ ID NO: 6049861 - DNA, 19 bp, Homo sapiens
ccatttctcaatcagtgca

SEQ ID NO: 6049862 - DNA, 15 bp, Homo sapiens
ccatttctcagggaa

SEQ ID NO: 6049863 - DNA, 17 bp, Homo sapiens
ccatttctccatgggcc

SEQ ID NO: 6049864 - DNA, 15 bp, Homo sapiens
ccatttctctacact

SEQ ID NO: 6049865 - DNA, 13 bp, Homo sapiens
ccatttctctgct

SEQ ID NO: 6049866 - DNA, 12 bp, Homo sapiens
ccatttctgatg

SEQ ID NO: 6049867 - DNA, 13 bp, Homo sapiens
ccatttctgcctt

SEQ ID NO: 6049868 - DNA, 16 bp, Homo sapiens
ccatttctgttgctgg

SEQ ID NO: 6049869 - DNA, 13 bp, Homo sapiens
ccatttcttcttc

SEQ ID NO: 6049870 - DNA, 22 bp, Homo sapiens
ccatttcttggcattggaattc

SEQ ID NO: 6049871 - DNA, 13 bp, Homo sapiens
ccatttctttata

SEQ ID NO: 6049872 - DNA, 18 bp, Homo sapiens
ccatttctttatatggaa

SEQ ID NO: 6049873 - DNA, 13 bp, Homo sapiens
ccatttctttctg

SEQ ID NO: 6049874 - DNA, 13 bp, Homo sapiens
ccatttgaagtgt

SEQ ID NO: 6049875 - DNA, 22 bp, Homo sapiens
ccatttgaattttttagtgact

SEQ ID NO: 6049876 - DNA, 19 bp, Homo sapiens
ccatttgatacccctgggg

SEQ ID NO: 6049877 - DNA, 17 bp, Homo sapiens
ccatttgattgttttat

SEQ ID NO: 6049878 - DNA, 17 bp, Homo sapiens
ccatttgatttttctaa

SEQ ID NO: 6049879 - DNA, 21 bp, Homo sapiens
ccatttgcacaggttttcagc

SEQ ID NO: 6049880 - DNA, 22 bp, Homo sapiens
ccatttgcatttgtttatgtaa

SEQ ID NO: 6049881 - DNA, 22 bp, Homo sapiens
ccatttgccaattttcctactc

SEQ ID NO: 6049882 - DNA, 14 bp, Homo sapiens
ccatttgcctttct

SEQ ID NO: 6049883 - DNA, 18 bp, Homo sapiens
ccatttgctactgtacat

SEQ ID NO: 6049884 - DNA, 20 bp, Homo sapiens
ccatttgctactgtacataa

SEQ ID NO: 6049885 - DNA, 21 bp, Homo sapiens
ccatttgctagttctgctgcc

SEQ ID NO: 6049886 - DNA, 13 bp, Homo sapiens
ccatttgctcctt

SEQ ID NO: 6049887 - DNA, 19 bp, Homo sapiens
ccatttgctcttcagatgc

SEQ ID NO: 6049888 - DNA, 22 bp, Homo sapiens
ccatttgctcttcagatgccac

SEQ ID NO: 6049889 - DNA, 12 bp, Homo sapiens
ccatttgctgat

SEQ ID NO: 6049890 - DNA, 14 bp, Homo sapiens
ccatttgctgccct

SEQ ID NO: 6049891 - DNA, 19 bp, Homo sapiens
ccatttgctgtctttttgt

SEQ ID NO: 6049892 - DNA, 16 bp, Homo sapiens
ccatttgctttttcac

SEQ ID NO: 6049893 - DNA, 15 bp, Homo sapiens
ccatttgggcacatt

SEQ ID NO: 6049894 - DNA, 16 bp, Homo sapiens
ccatttggtattacac

SEQ ID NO: 6049895 - DNA, 19 bp, Homo sapiens
ccatttgtaaaacattcca

SEQ ID NO: 6049896 - DNA, 21 bp, Homo sapiens
ccatttgtaaaacattccaaa

SEQ ID NO: 6049897 - DNA, 20 bp, Homo sapiens
ccatttgtaaaactccggat

SEQ ID NO: 6049898 - DNA, 20 bp, Homo sapiens
ccatttgtaataaagtatat

SEQ ID NO: 6049899 - DNA, 12 bp, Homo sapiens
ccatttgtaatg

SEQ ID NO: 6049900 - DNA, 17 bp, Homo sapiens
ccatttgtaatgtatct

SEQ ID NO: 6049901 - DNA, 16 bp, Homo sapiens
ccatttgtaattaaat

SEQ ID NO: 6049902 - DNA, 21 bp, Homo sapiens
ccatttgtaccgaaacacccc

SEQ ID NO: 6049903 - DNA, 22 bp, Homo sapiens
ccatttgtaccgaaacaccccg

SEQ ID NO: 6049904 - DNA, 12 bp, Homo sapiens
ccatttgtagtg

SEQ ID NO: 6049905 - DNA, 16 bp, Homo sapiens
ccatttgtattaccat

SEQ ID NO: 6049906 - DNA, 21 bp, Homo sapiens
ccatttgtattgtacataaaa

SEQ ID NO: 6049907 - DNA, 18 bp, Homo sapiens
ccatttgtctctactttt

SEQ ID NO: 6049908 - DNA, 22 bp, Homo sapiens
ccatttgtggtcctgaaggaaa

SEQ ID NO: 6049909 - DNA, 21 bp, Homo sapiens
ccatttgtgtctctttattat

SEQ ID NO: 6049910 - DNA, 14 bp, Homo sapiens
ccatttgtgtgtgt

SEQ ID NO: 6049911 - DNA, 15 bp, Homo sapiens
ccatttgttcatatt

SEQ ID NO: 6049912 - DNA, 16 bp, Homo sapiens
ccatttgttcatatta

SEQ ID NO: 6049913 - DNA, 20 bp, Homo sapiens
ccatttgttcatattaagaa

SEQ ID NO: 6049914 - DNA, 13 bp, Homo sapiens
ccatttgttcctg

SEQ ID NO: 6049915 - DNA, 12 bp, Homo sapiens
ccatttgtttat

SEQ ID NO: 6049916 - DNA, 13 bp, Homo sapiens
ccatttgttttcg

SEQ ID NO: 6049917 - DNA, 22 bp, Homo sapiens
ccattttaaagttagtatcttt

SEQ ID NO: 6049918 - DNA, 14 bp, Homo sapiens
ccattttaaattga

SEQ ID NO: 6049919 - DNA, 16 bp, Homo sapiens
ccattttaagtccctg

SEQ ID NO: 6049920 - DNA, 20 bp, Homo sapiens
ccattttaagtccctgtcac

SEQ ID NO: 6049921 - DNA, 21 bp, Homo sapiens
ccattttaattttaaagtgca

SEQ ID NO: 6049922 - DNA, 14 bp, Homo sapiens
ccattttacacagc

SEQ ID NO: 6049923 - DNA, 16 bp, Homo sapiens
ccattttacatttcta

SEQ ID NO: 6049924 - DNA, 18 bp, Homo sapiens
ccattttagtcacttttt

SEQ ID NO: 6049925 - DNA, 22 bp, Homo sapiens
ccattttataaagtgcttgtgt

SEQ ID NO: 6049926 - DNA, 23 bp, Homo sapiens
ccattttatcttatcttgctttg

SEQ ID NO: 6049927 - DNA, 19 bp, Homo sapiens
ccattttattaaacatttt

SEQ ID NO: 6049928 - DNA, 12 bp, Homo sapiens
ccattttccagt

SEQ ID NO: 6049929 - DNA, 12 bp, Homo sapiens
ccattttcgctt

SEQ ID NO: 6049930 - DNA, 14 bp, Homo sapiens
ccattttctggttc

SEQ ID NO: 6049931 - DNA, 15 bp, Homo sapiens
ccattttctgtaaag

SEQ ID NO: 6049932 - DNA, 12 bp, Homo sapiens
ccattttctgtg

SEQ ID NO: 6049933 - DNA, 14 bp, Homo sapiens
ccattttgaaatat

SEQ ID NO: 6049934 - DNA, 20 bp, Homo sapiens
ccattttgctgtcccttttc

SEQ ID NO: 6049935 - DNA, 20 bp, Homo sapiens
ccattttggggtacccactg

SEQ ID NO: 6049936 - DNA, 15 bp, Homo sapiens
ccattttggtgctta

SEQ ID NO: 6049937 - DNA, 18 bp, Homo sapiens
ccattttggtgtctttct

SEQ ID NO: 6049938 - DNA, 17 bp, Homo sapiens
ccattttggtgtgcatc

SEQ ID NO: 6049939 - DNA, 20 bp, Homo sapiens
ccattttgtaaatgaaactt

SEQ ID NO: 6049940 - DNA, 22 bp, Homo sapiens
ccattttgtaactgcctaccag

SEQ ID NO: 6049941 - DNA, 21 bp, Homo sapiens
ccattttgtattttactaata

SEQ ID NO: 6049942 - DNA, 14 bp, Homo sapiens
ccattttgtgaagc

SEQ ID NO: 6049943 - DNA, 18 bp, Homo sapiens
ccattttgttaaaatcta

SEQ ID NO: 6049944 - DNA, 23 bp, Homo sapiens
ccattttgttattgactaacagg

SEQ ID NO: 6049945 - DNA, 14 bp, Homo sapiens
ccatttttacaagt

SEQ ID NO: 6049946 - DNA, 15 bp, Homo sapiens
ccatttttactgtta

SEQ ID NO: 6049947 - DNA, 16 bp, Homo sapiens
ccatttttcaaagcaa

SEQ ID NO: 6049948 - DNA, 23 bp, Homo sapiens
ccatttttcccaggcaaataaaa

SEQ ID NO: 6049949 - DNA, 15 bp, Homo sapiens
ccatttttcctctgt

SEQ ID NO: 6049950 - DNA, 22 bp, Homo sapiens
ccatttttctcccaagaaacct

SEQ ID NO: 6049951 - DNA, 17 bp, Homo sapiens
ccatttttgagtaaaac

SEQ ID NO: 6049952 - DNA, 16 bp, Homo sapiens
ccattttttatatttc

SEQ ID NO: 6049953 - DNA, 23 bp, Homo sapiens
ccattttttcttcccttttccct

SEQ ID NO: 6049954 - DNA, 19 bp, Homo sapiens
ccattttttgagtctcctt

SEQ ID NO: 6049955 - DNA, 21 bp, Homo sapiens
ccatttttttcactcagaatt

SEQ ID NO: 6049956 - DNA, 23 bp, Homo sapiens
ccattttttttttctttttgggg

SEQ ID NO: 6049957 - DNA, 21 bp, Homo sapiens
cccaaaaatatctcctccaat

SEQ ID NO: 6049958 - DNA, 17 bp, Homo sapiens
cccaaaacaaagtcttt

SEQ ID NO: 6049959 - DNA, 18 bp, Homo sapiens
cccaaaacagctttgtct

SEQ ID NO: 6049960 - DNA, 22 bp, Homo sapiens
cccaaaacagttatacagatga

SEQ ID NO: 6049961 - DNA, 21 bp, Homo sapiens
cccaaaaccacagccctgtca

SEQ ID NO: 6049962 - DNA, 18 bp, Homo sapiens
cccaaaaccctgaagcca

SEQ ID NO: 6049963 - DNA, 23 bp, Homo sapiens
cccaaaacctcatgacagccaga

SEQ ID NO: 6049964 - DNA, 15 bp, Homo sapiens
cccaaaactctgtag

SEQ ID NO: 6049965 - DNA, 22 bp, Homo sapiens
cccaaaagccatgtatttcagg

SEQ ID NO: 6049966 - DNA, 23 bp, Homo sapiens
cccaaaagtcaaaaggtgcctgt

SEQ ID NO: 6049967 - DNA, 23 bp, Homo sapiens
cccaaaatacttgcatccaaggt

SEQ ID NO: 6049968 - DNA, 21 bp, Homo sapiens
cccaaaattagggagctcttg

SEQ ID NO: 6049969 - DNA, 20 bp, Homo sapiens
cccaaacaaaaatgactcta

SEQ ID NO: 6049970 - DNA, 18 bp, Homo sapiens
cccaaacaaatggaagag

SEQ ID NO: 6049971 - DNA, 19 bp, Homo sapiens
cccaaacacataatttctg

SEQ ID NO: 6049972 - DNA, 21 bp, Homo sapiens
cccaaacaccagtcacctcgt

SEQ ID NO: 6049973 - DNA, 19 bp, Homo sapiens
cccaaacaccttccagctc

SEQ ID NO: 6049974 - DNA, 17 bp, Homo sapiens
cccaaacacttctgctt

SEQ ID NO: 6049975 - DNA, 14 bp, Homo sapiens
cccaaacatagccc

SEQ ID NO: 6049976 - DNA, 22 bp, Homo sapiens
cccaaacattaatcaccaaagt

SEQ ID NO: 6049977 - DNA, 15 bp, Homo sapiens
cccaaaccagggtgc

SEQ ID NO: 6049978 - DNA, 20 bp, Homo sapiens
cccaaaccattactgagggg

SEQ ID NO: 6049979 - DNA, 19 bp, Homo sapiens
cccaaacccaagtgccttc

SEQ ID NO: 6049980 - DNA, 15 bp, Homo sapiens
cccaaacccatcaga

SEQ ID NO: 6049981 - DNA, 17 bp, Homo sapiens
cccaaacccatcagaca

SEQ ID NO: 6049982 - DNA, 13 bp, Homo sapiens
cccaaaccccagc

SEQ ID NO: 6049983 - DNA, 15 bp, Homo sapiens
cccaaaccccagccc

SEQ ID NO: 6049984 - DNA, 17 bp, Homo sapiens
cccaaaccccctgcagc

SEQ ID NO: 6049985 - DNA, 18 bp, Homo sapiens
cccaaaccccctgcagcc

SEQ ID NO: 6049986 - DNA, 13 bp, Homo sapiens
cccaaacctggga

SEQ ID NO: 6049987 - DNA, 20 bp, Homo sapiens
cccaaacctgggaaggccag

SEQ ID NO: 6049988 - DNA, 14 bp, Homo sapiens
cccaaaccttgggc

SEQ ID NO: 6049989 - DNA, 22 bp, Homo sapiens
cccaaactgttcaagaaataat

SEQ ID NO: 6049990 - DNA, 23 bp, Homo sapiens
cccaaactgttgattattagcca

SEQ ID NO: 6049991 - DNA, 17 bp, Homo sapiens
cccaaacttatggacac

SEQ ID NO: 6049992 - DNA, 23 bp, Homo sapiens
cccaaacttatggacactgcctt

SEQ ID NO: 6049993 - DNA, 20 bp, Homo sapiens
cccaaactttaaaatgcgaa

SEQ ID NO: 6049994 - DNA, 12 bp, Homo sapiens
cccaaagaagga

SEQ ID NO: 6049995 - DNA, 19 bp, Homo sapiens
cccaaagagcctggagaag

SEQ ID NO: 6049996 - DNA, 15 bp, Homo sapiens
cccaaagagctgcct

SEQ ID NO: 6049997 - DNA, 21 bp, Homo sapiens
cccaaagatagacaggtcctg

SEQ ID NO: 6049998 - DNA, 13 bp, Homo sapiens
cccaaagcaagca

SEQ ID NO: 6049999 - DNA, 21 bp, Homo sapiens
cccaaagcacatgcttagctt

SEQ ID NO: 6050000 - DNA, 22 bp, Homo sapiens
cccaaagcagcaggcctctggt

SEQ ID NO: 6050001 - DNA, 23 bp, Homo sapiens
cccaaagcagcaggcctctggtt

SEQ ID NO: 6050002 - DNA, 19 bp, Homo sapiens
cccaaagcagcccttcccc

SEQ ID NO: 6050003 - DNA, 16 bp, Homo sapiens
cccaaagcagtgcatg

SEQ ID NO: 6050004 - DNA, 13 bp, Homo sapiens
cccaaagccactg

SEQ ID NO: 6050005 - DNA, 13 bp, Homo sapiens
cccaaagcccagc

SEQ ID NO: 6050006 - DNA, 17 bp, Homo sapiens
cccaaagcccagctctt

SEQ ID NO: 6050007 - DNA, 21 bp, Homo sapiens
cccaaagcccagctctttgtt

SEQ ID NO: 6050008 - DNA, 18 bp, Homo sapiens
cccaaagctgagcctgca

SEQ ID NO: 6050009 - DNA, 19 bp, Homo sapiens
cccaaagcttgtaaatatg

SEQ ID NO: 6050010 - DNA, 18 bp, Homo sapiens
cccaaaggaacactgaca

SEQ ID NO: 6050011 - DNA, 19 bp, Homo sapiens
cccaaaggacgcactgagc

SEQ ID NO: 6050012 - DNA, 20 bp, Homo sapiens
cccaaaggacgcctgcagga

SEQ ID NO: 6050013 - DNA, 14 bp, Homo sapiens
cccaaaggactcca

SEQ ID NO: 6050014 - DNA, 21 bp, Homo sapiens
cccaaaggatgagaatgtgac

SEQ ID NO: 6050015 - DNA, 16 bp, Homo sapiens
cccaaaggcatcccag

SEQ ID NO: 6050016 - DNA, 18 bp, Homo sapiens
cccaaaggcatcccagcc

SEQ ID NO: 6050017 - DNA, 19 bp, Homo sapiens
cccaaaggcatcccagcct

SEQ ID NO: 6050018 - DNA, 20 bp, Homo sapiens
cccaaaggcatcccagcctg

SEQ ID NO: 6050019 - DNA, 18 bp, Homo sapiens
cccaaaggccaacagcat

SEQ ID NO: 6050020 - DNA, 14 bp, Homo sapiens
cccaaaggcccagg

SEQ ID NO: 6050021 - DNA, 16 bp, Homo sapiens
cccaaaggcccaggga

SEQ ID NO: 6050022 - DNA, 21 bp, Homo sapiens
cccaaagggagggtggcagag

SEQ ID NO: 6050023 - DNA, 14 bp, Homo sapiens
cccaaagggcacac

SEQ ID NO: 6050024 - DNA, 23 bp, Homo sapiens
cccaaaggtctatctactaaact

SEQ ID NO: 6050025 - DNA, 15 bp, Homo sapiens
cccaaagtcctctgc

SEQ ID NO: 6050026 - DNA, 20 bp, Homo sapiens
cccaaagtgctaagattaca

SEQ ID NO: 6050027 - DNA, 15 bp, Homo sapiens
cccaaagtgctgaga

SEQ ID NO: 6050028 - DNA, 21 bp, Homo sapiens
cccaaagtgcttccaaggcag

SEQ ID NO: 6050029 - DNA, 20 bp, Homo sapiens
cccaaagtggtatagaaatg

SEQ ID NO: 6050030 - DNA, 22 bp, Homo sapiens
cccaaagttgctcaccgactca

SEQ ID NO: 6050031 - DNA, 18 bp, Homo sapiens
cccaaataaatttataac

SEQ ID NO: 6050032 - DNA, 12 bp, Homo sapiens
cccaaataacag

SEQ ID NO: 6050033 - DNA, 21 bp, Homo sapiens
cccaaataacttcagtcctgc

SEQ ID NO: 6050034 - DNA, 23 bp, Homo sapiens
cccaaatatgcccctccccagta

SEQ ID NO: 6050035 - DNA, 14 bp, Homo sapiens
cccaaatcaataca

SEQ ID NO: 6050036 - DNA, 17 bp, Homo sapiens
cccaaatcttcctctgg

SEQ ID NO: 6050037 - DNA, 18 bp, Homo sapiens
cccaaatcttcctctgga

SEQ ID NO: 6050038 - DNA, 18 bp, Homo sapiens
cccaaatgctctctcttc

SEQ ID NO: 6050039 - DNA, 14 bp, Homo sapiens
cccaaatggctgct

SEQ ID NO: 6050040 - DNA, 13 bp, Homo sapiens
cccaaatgtggaa

SEQ ID NO: 6050041 - DNA, 16 bp, Homo sapiens
cccaaatgtgtaatat

SEQ ID NO: 6050042 - DNA, 15 bp, Homo sapiens
cccaaatgtgtacac

SEQ ID NO: 6050043 - DNA, 21 bp, Homo sapiens
cccaaattaaacgtaaatgtt

SEQ ID NO: 6050044 - DNA, 21 bp, Homo sapiens
cccaaattataagggccctgc

SEQ ID NO: 6050045 - DNA, 20 bp, Homo sapiens
cccaaattatcaagctaata

SEQ ID NO: 6050046 - DNA, 14 bp, Homo sapiens
cccaaattcaaaag

SEQ ID NO: 6050047 - DNA, 18 bp, Homo sapiens
cccaaattccctggacct

SEQ ID NO: 6050048 - DNA, 13 bp, Homo sapiens
cccaaatttaatt

SEQ ID NO: 6050049 - DNA, 20 bp, Homo sapiens
cccaacaatactttgtgtct

SEQ ID NO: 6050050 - DNA, 10 bp, Homo sapiens
cccaacaatg

SEQ ID NO: 6050051 - DNA, 13 bp, Homo sapiens
cccaacacaaaga

SEQ ID NO: 6050052 - DNA, 15 bp, Homo sapiens
cccaacacaatcttt

SEQ ID NO: 6050053 - DNA, 16 bp, Homo sapiens
cccaacaccagcccct

SEQ ID NO: 6050054 - DNA, 13 bp, Homo sapiens
cccaacacctctt

SEQ ID NO: 6050055 - DNA, 21 bp, Homo sapiens
cccaacacctgcctctgaccc

SEQ ID NO: 6050056 - DNA, 14 bp, Homo sapiens
cccaacactccagg

SEQ ID NO: 6050057 - DNA, 18 bp, Homo sapiens
cccaacactccaggccct

SEQ ID NO: 6050058 - DNA, 22 bp, Homo sapiens
cccaacactccaggccctgccc

SEQ ID NO: 6050059 - DNA, 16 bp, Homo sapiens
cccaacactgtgccct

SEQ ID NO: 6050060 - DNA, 19 bp, Homo sapiens
cccaacactgtgccctggt

SEQ ID NO: 6050061 - DNA, 15 bp, Homo sapiens
cccaacagaggcctc

SEQ ID NO: 6050062 - DNA, 13 bp, Homo sapiens
cccaacagcactt

SEQ ID NO: 6050063 - DNA, 14 bp, Homo sapiens
cccaacagcacttt

SEQ ID NO: 6050064 - DNA, 16 bp, Homo sapiens
cccaacagcctctgtg

SEQ ID NO: 6050065 - DNA, 19 bp, Homo sapiens
cccaacagccttagctgcc

SEQ ID NO: 6050066 - DNA, 23 bp, Homo sapiens
cccaacagctggaccctgaccag

SEQ ID NO: 6050067 - DNA, 23 bp, Homo sapiens
cccaacagggcaaccaataaaag

SEQ ID NO: 6050068 - DNA, 12 bp, Homo sapiens
cccaacagtgtg

SEQ ID NO: 6050069 - DNA, 13 bp, Homo sapiens
cccaacagtgtga

SEQ ID NO: 6050070 - DNA, 14 bp, Homo sapiens
cccaacagtgtgaa

SEQ ID NO: 6050071 - DNA, 15 bp, Homo sapiens
cccaacagtgtgaag

SEQ ID NO: 6050072 - DNA, 17 bp, Homo sapiens
cccaacagtttattttt

SEQ ID NO: 6050073 - DNA, 13 bp, Homo sapiens
cccaaccaacttt

SEQ ID NO: 6050074 - DNA, 19 bp, Homo sapiens
cccaaccaactttcccccc

SEQ ID NO: 6050075 - DNA, 19 bp, Homo sapiens
cccaaccacagaggatgct

SEQ ID NO: 6050076 - DNA, 18 bp, Homo sapiens
cccaaccatttcctcaga

SEQ ID NO: 6050077 - DNA, 15 bp, Homo sapiens
cccaacccaataaaa

SEQ ID NO: 6050078 - DNA, 14 bp, Homo sapiens
cccaacccacctct

SEQ ID NO: 6050079 - DNA, 18 bp, Homo sapiens
cccaaccccaagccagcc

SEQ ID NO: 6050080 - DNA, 13 bp, Homo sapiens
cccaacccccacc

SEQ ID NO: 6050081 - DNA, 14 bp, Homo sapiens
cccaacccccaccc

SEQ ID NO: 6050082 - DNA, 13 bp, Homo sapiens
cccaacccccagc

SEQ ID NO: 6050083 - DNA, 15 bp, Homo sapiens
cccaacccccagcac

SEQ ID NO: 6050084 - DNA, 20 bp, Homo sapiens
cccaacccccagcccccacc

SEQ ID NO: 6050085 - DNA, 14 bp, Homo sapiens
cccaacccccctcc

SEQ ID NO: 6050086 - DNA, 16 bp, Homo sapiens
cccaacccccctcctg

SEQ ID NO: 6050087 - DNA, 17 bp, Homo sapiens
cccaacccccctcctgc

SEQ ID NO: 6050088 - DNA, 14 bp, Homo sapiens
cccaaccccctgca

SEQ ID NO: 6050089 - DNA, 20 bp, Homo sapiens
cccaaccccgcggtgctctg

SEQ ID NO: 6050090 - DNA, 22 bp, Homo sapiens
cccaacccctcctccctcagac

SEQ ID NO: 6050091 - DNA, 22 bp, Homo sapiens
cccaacccctccttccccagac

SEQ ID NO: 6050092 - DNA, 19 bp, Homo sapiens
cccaacccctctccaggcc

SEQ ID NO: 6050093 - DNA, 13 bp, Homo sapiens
cccaacccctgag

SEQ ID NO: 6050094 - DNA, 18 bp, Homo sapiens
cccaacccgtggaggctg

SEQ ID NO: 6050095 - DNA, 19 bp, Homo sapiens
cccaacccgtggaggctgc

SEQ ID NO: 6050096 - DNA, 20 bp, Homo sapiens
cccaacccgtggaggctgct

SEQ ID NO: 6050097 - DNA, 14 bp, Homo sapiens
cccaaccctcggag

SEQ ID NO: 6050098 - DNA, 16 bp, Homo sapiens
cccaaccctgcccagc

SEQ ID NO: 6050099 - DNA, 14 bp, Homo sapiens
cccaaccctgcccc

SEQ ID NO: 6050100 - DNA, 20 bp, Homo sapiens
cccaaccctggcttggggtc

SEQ ID NO: 6050101 - DNA, 13 bp, Homo sapiens
cccaaccctgggc

SEQ ID NO: 6050102 - DNA, 19 bp, Homo sapiens
cccaaccctgggctgggga

SEQ ID NO: 6050103 - DNA, 15 bp, Homo sapiens
cccaacccttcccca

SEQ ID NO: 6050104 - DNA, 17 bp, Homo sapiens
cccaacctacattccac

SEQ ID NO: 6050105 - DNA, 15 bp, Homo sapiens
cccaacctcagggct

SEQ ID NO: 6050106 - DNA, 19 bp, Homo sapiens
cccaacctcagggctccca

SEQ ID NO: 6050107 - DNA, 20 bp, Homo sapiens
cccaacctcagggctcccag

SEQ ID NO: 6050108 - DNA, 22 bp, Homo sapiens
cccaacctcagggctcccaggg

SEQ ID NO: 6050109 - DNA, 20 bp, Homo sapiens
cccaacctcccctggtcctg

SEQ ID NO: 6050110 - DNA, 11 bp, Homo sapiens
cccaacctcct

SEQ ID NO: 6050111 - DNA, 14 bp, Homo sapiens
cccaacctgctctc

SEQ ID NO: 6050112 - DNA, 23 bp, Homo sapiens
cccaacctgctctcctcttgcca

SEQ ID NO: 6050113 - DNA, 14 bp, Homo sapiens
cccaacctgctgaa

SEQ ID NO: 6050114 - DNA, 21 bp, Homo sapiens
cccaacctggcataggactct

SEQ ID NO: 6050115 - DNA, 21 bp, Homo sapiens
cccaacctggctccctcccac

SEQ ID NO: 6050116 - DNA, 23 bp, Homo sapiens
cccaacctgtccttactcagagc

SEQ ID NO: 6050117 - DNA, 15 bp, Homo sapiens
cccaacgaaaagcac

SEQ ID NO: 6050118 - DNA, 19 bp, Homo sapiens
cccaacgaaaagcacatcc

SEQ ID NO: 6050119 - DNA, 15 bp, Homo sapiens
cccaacgctgaagcg

SEQ ID NO: 6050120 - DNA, 14 bp, Homo sapiens
cccaacgggaagca

SEQ ID NO: 6050121 - DNA, 14 bp, Homo sapiens
cccaacggggtggg

SEQ ID NO: 6050122 - DNA, 16 bp, Homo sapiens
cccaacggggtgggga

SEQ ID NO: 6050123 - DNA, 19 bp, Homo sapiens
cccaacgtcccctccgccg

SEQ ID NO: 6050124 - DNA, 15 bp, Homo sapiens
cccaacgtgatgcta

SEQ ID NO: 6050125 - DNA, 23 bp, Homo sapiens
cccaacgtgcaaagccaaggcag

SEQ ID NO: 6050126 - DNA, 20 bp, Homo sapiens
cccaactactatctcagaga

SEQ ID NO: 6050127 - DNA, 22 bp, Homo sapiens
cccaactataaaactaggtgct

SEQ ID NO: 6050128 - DNA, 19 bp, Homo sapiens
cccaactattaaagtgcca

SEQ ID NO: 6050129 - DNA, 22 bp, Homo sapiens
cccaactcaagtgtcacctcct

SEQ ID NO: 6050130 - DNA, 15 bp, Homo sapiens
cccaactcactgtgc

SEQ ID NO: 6050131 - DNA, 20 bp, Homo sapiens
cccaactccaccagatagca

SEQ ID NO: 6050132 - DNA, 18 bp, Homo sapiens
cccaactccaggaaagag

SEQ ID NO: 6050133 - DNA, 18 bp, Homo sapiens
cccaactccaggggcacc

SEQ ID NO: 6050134 - DNA, 15 bp, Homo sapiens
cccaactcccggagg

SEQ ID NO: 6050135 - DNA, 16 bp, Homo sapiens
cccaactccctgccat

SEQ ID NO: 6050136 - DNA, 17 bp, Homo sapiens
cccaactcccttctgct

SEQ ID NO: 6050137 - DNA, 18 bp, Homo sapiens
cccaactccgcccagcct

SEQ ID NO: 6050138 - DNA, 12 bp, Homo sapiens
cccaactcctgg

SEQ ID NO: 6050139 - DNA, 15 bp, Homo sapiens
cccaactccttcctc

SEQ ID NO: 6050140 - DNA, 20 bp, Homo sapiens
cccaactccttcctctttgc

SEQ ID NO: 6050141 - DNA, 15 bp, Homo sapiens
cccaactctcccctg

SEQ ID NO: 6050142 - DNA, 14 bp, Homo sapiens
cccaactctgagcc

SEQ ID NO: 6050143 - DNA, 16 bp, Homo sapiens
cccaactctgagccca

SEQ ID NO: 6050144 - DNA, 19 bp, Homo sapiens
cccaactctgagcccatgt

SEQ ID NO: 6050145 - DNA, 23 bp, Homo sapiens
cccaactcttgcacagtcactgc

SEQ ID NO: 6050146 - DNA, 14 bp, Homo sapiens
cccaactctttatc

SEQ ID NO: 6050147 - DNA, 16 bp, Homo sapiens
cccaactgacttctgc

SEQ ID NO: 6050148 - DNA, 16 bp, Homo sapiens
cccaactgatcctgct

SEQ ID NO: 6050149 - DNA, 22 bp, Homo sapiens
cccaactgatcctgctccagca

SEQ ID NO: 6050150 - DNA, 12 bp, Homo sapiens
cccaactgctcc

SEQ ID NO: 6050151 - DNA, 15 bp, Homo sapiens
cccaactgctccagc

SEQ ID NO: 6050152 - DNA, 22 bp, Homo sapiens
cccaactgctccagcctctgcc

SEQ ID NO: 6050153 - DNA, 11 bp, Homo sapiens
cccaactgtct

SEQ ID NO: 6050154 - DNA, 17 bp, Homo sapiens
cccaactgtgagcaagg

SEQ ID NO: 6050155 - DNA, 17 bp, Homo sapiens
cccaacttccctgttct

SEQ ID NO: 6050156 - DNA, 13 bp, Homo sapiens
cccaacttcttcc

SEQ ID NO: 6050157 - DNA, 20 bp, Homo sapiens
cccaactttgtggatgtctt

SEQ ID NO: 6050158 - DNA, 22 bp, Homo sapiens
cccaagaaaccaaagtctgccg

SEQ ID NO: 6050159 - DNA, 12 bp, Homo sapiens
cccaagaactgc

SEQ ID NO: 6050160 - DNA, 15 bp, Homo sapiens
cccaagaaggctggg

SEQ ID NO: 6050161 - DNA, 15 bp, Homo sapiens
cccaagaatgggagg

SEQ ID NO: 6050162 - DNA, 18 bp, Homo sapiens
cccaagacacttcccctt

SEQ ID NO: 6050163 - DNA, 19 bp, Homo sapiens
cccaagacagatgccccag

SEQ ID NO: 6050164 - DNA, 16 bp, Homo sapiens
cccaagaccatccctg

SEQ ID NO: 6050165 - DNA, 21 bp, Homo sapiens
cccaagacctcatctgcctgc

SEQ ID NO: 6050166 - DNA, 22 bp, Homo sapiens
cccaagacctcatctgcctgca

SEQ ID NO: 6050167 - DNA, 20 bp, Homo sapiens
cccaagactctgctctcctc

SEQ ID NO: 6050168 - DNA, 22 bp, Homo sapiens
cccaagactgtcattgcccctc

SEQ ID NO: 6050169 - DNA, 20 bp, Homo sapiens
cccaagacttcattgtccct

SEQ ID NO: 6050170 - DNA, 17 bp, Homo sapiens
catttcattagccatgc

SEQ ID NO: 6050171 - DNA, 21 bp, Homo sapiens
catttcattagccatgcaaca

SEQ ID NO: 6050172 - DNA, 23 bp, Homo sapiens
catttcattatttctgcttcctg

SEQ ID NO: 6050173 - DNA, 19 bp, Homo sapiens
catttcattatttttcaat

SEQ ID NO: 6050174 - DNA, 21 bp, Homo sapiens
catttcattcaaatcagtgat

SEQ ID NO: 6050175 - DNA, 13 bp, Homo sapiens
catttcattccat

SEQ ID NO: 6050176 - DNA, 15 bp, Homo sapiens
catttcattccattg

SEQ ID NO: 6050177 - DNA, 18 bp, Homo sapiens
catttcattccattgcct

SEQ ID NO: 6050178 - DNA, 21 bp, Homo sapiens
catttcattccattgcctagc

SEQ ID NO: 6050179 - DNA, 14 bp, Homo sapiens
catttcattgtaca

SEQ ID NO: 6050180 - DNA, 15 bp, Homo sapiens
catttcattgtacaa

SEQ ID NO: 6050181 - DNA, 20 bp, Homo sapiens
catttcattgtacaagtatt

SEQ ID NO: 6050182 - DNA, 18 bp, Homo sapiens
catttcattgtatgatgt

SEQ ID NO: 6050183 - DNA, 11 bp, Homo sapiens
catttccaaac

SEQ ID NO: 6050184 - DNA, 11 bp, Homo sapiens
catttccaaat

SEQ ID NO: 6050185 - DNA, 19 bp, Homo sapiens
catttccacaccaagcagc

SEQ ID NO: 6050186 - DNA, 21 bp, Homo sapiens
catttccacactgtcagagct

SEQ ID NO: 6050187 - DNA, 22 bp, Homo sapiens
catttccaccaagggtatctgc

SEQ ID NO: 6050188 - DNA, 15 bp, Homo sapiens
catttccagcaaaat

SEQ ID NO: 6050189 - DNA, 19 bp, Homo sapiens
catttccagcaaaatatat

SEQ ID NO: 6050190 - DNA, 21 bp, Homo sapiens
catttccagcaaaatatatgt

SEQ ID NO: 6050191 - DNA, 13 bp, Homo sapiens
catttccagctgt

SEQ ID NO: 6050192 - DNA, 17 bp, Homo sapiens
catttccagctgtgcag

SEQ ID NO: 6050193 - DNA, 21 bp, Homo sapiens
catttccagcttctcagtttc

SEQ ID NO: 6050194 - DNA, 14 bp, Homo sapiens
catttccatgtatg

SEQ ID NO: 6050195 - DNA, 16 bp, Homo sapiens
catttccatttattgt

SEQ ID NO: 6050196 - DNA, 14 bp, Homo sapiens
catttcccacatct

SEQ ID NO: 6050197 - DNA, 16 bp, Homo sapiens
catttccccagacctg

SEQ ID NO: 6050198 - DNA, 22 bp, Homo sapiens
catttcccccaaaggcatccca

SEQ ID NO: 6050199 - DNA, 21 bp, Homo sapiens
catttcccccgagctcttggc

SEQ ID NO: 6050200 - DNA, 14 bp, Homo sapiens
catttccccctcct

SEQ ID NO: 6050201 - DNA, 15 bp, Homo sapiens
catttccccctcctc

SEQ ID NO: 6050202 - DNA, 12 bp, Homo sapiens
catttcccctcc

SEQ ID NO: 6050203 - DNA, 15 bp, Homo sapiens
catttcccctcccgc

SEQ ID NO: 6050204 - DNA, 20 bp, Homo sapiens
catttcccctcccgcttcct

SEQ ID NO: 6050205 - DNA, 18 bp, Homo sapiens
catttccctatcttctcc

SEQ ID NO: 6050206 - DNA, 16 bp, Homo sapiens
catttccctgaacaga

SEQ ID NO: 6050207 - DNA, 12 bp, Homo sapiens
catttccctgct

SEQ ID NO: 6050208 - DNA, 13 bp, Homo sapiens
catttccctgctg

SEQ ID NO: 6050209 - DNA, 17 bp, Homo sapiens
catttccgaataaagta

SEQ ID NO: 6050210 - DNA, 16 bp, Homo sapiens
catttccgtaattctt

SEQ ID NO: 6050211 - DNA, 22 bp, Homo sapiens
catttccgtaattcttattcca

SEQ ID NO: 6050212 - DNA, 22 bp, Homo sapiens
catttccgtccccccccaggcc

SEQ ID NO: 6050213 - DNA, 13 bp, Homo sapiens
catttccgtgaag

SEQ ID NO: 6050214 - DNA, 23 bp, Homo sapiens
catttccgtgagagtcatctcaa

SEQ ID NO: 6050215 - DNA, 13 bp, Homo sapiens
catttcctatgca

SEQ ID NO: 6050216 - DNA, 14 bp, Homo sapiens
catttcctcacgtg

SEQ ID NO: 6050217 - DNA, 19 bp, Homo sapiens
catttcctctctatctttt

SEQ ID NO: 6050218 - DNA, 21 bp, Homo sapiens
catttcctctctatctttttt

SEQ ID NO: 6050219 - DNA, 20 bp, Homo sapiens
catttcctctgagctgttat

SEQ ID NO: 6050220 - DNA, 12 bp, Homo sapiens
catttcctgatc

SEQ ID NO: 6050221 - DNA, 15 bp, Homo sapiens
catttcctgatctag

SEQ ID NO: 6050222 - DNA, 21 bp, Homo sapiens
catttcctgcccttcctcagt

SEQ ID NO: 6050223 - DNA, 23 bp, Homo sapiens
catttcctgcccttcctcagttt

SEQ ID NO: 6050224 - DNA, 11 bp, Homo sapiens
catttcctgct

SEQ ID NO: 6050225 - DNA, 14 bp, Homo sapiens
catttccttccagc

SEQ ID NO: 6050226 - DNA, 11 bp, Homo sapiens
catttccttgg

SEQ ID NO: 6050227 - DNA, 18 bp, Homo sapiens
catttccttgtctaaaga

SEQ ID NO: 6050228 - DNA, 12 bp, Homo sapiens
catttccttttt

SEQ ID NO: 6050229 - DNA, 22 bp, Homo sapiens
catttcggaagtggtggggact

SEQ ID NO: 6050230 - DNA, 21 bp, Homo sapiens
catttcggtgcttccctttca

SEQ ID NO: 6050231 - DNA, 16 bp, Homo sapiens
catttcgttttttaca

SEQ ID NO: 6050232 - DNA, 15 bp, Homo sapiens
catttctaaaatgtt

SEQ ID NO: 6050233 - DNA, 23 bp, Homo sapiens
catttctaaaggcctcttccttg

SEQ ID NO: 6050234 - DNA, 16 bp, Homo sapiens
catttctaaatttata

SEQ ID NO: 6050235 - DNA, 15 bp, Homo sapiens
catttctaacataag

SEQ ID NO: 6050236 - DNA, 18 bp, Homo sapiens
catttctaacatatgtat

SEQ ID NO: 6050237 - DNA, 19 bp, Homo sapiens
catttctaactctattaat

SEQ ID NO: 6050238 - DNA, 15 bp, Homo sapiens
catttctaagccttt

SEQ ID NO: 6050239 - DNA, 23 bp, Homo sapiens
catttctaattaaccttactaat

SEQ ID NO: 6050240 - DNA, 22 bp, Homo sapiens
catttctactgtataaacaaat

SEQ ID NO: 6050241 - DNA, 23 bp, Homo sapiens
catttctagaacatccctgccag

SEQ ID NO: 6050242 - DNA, 12 bp, Homo sapiens
catttctagact

SEQ ID NO: 6050243 - DNA, 20 bp, Homo sapiens
catttctagcgcatggcctg

SEQ ID NO: 6050244 - DNA, 20 bp, Homo sapiens
catttctaggcaaaattgtg

SEQ ID NO: 6050245 - DNA, 17 bp, Homo sapiens
catttctagtcccttct

SEQ ID NO: 6050246 - DNA, 14 bp, Homo sapiens
catttctatacttt

SEQ ID NO: 6050247 - DNA, 23 bp, Homo sapiens
catttctatagccaaaaatagct

SEQ ID NO: 6050248 - DNA, 21 bp, Homo sapiens
catttctatagccaaagctgt

SEQ ID NO: 6050249 - DNA, 18 bp, Homo sapiens
catttctatattcctcca

SEQ ID NO: 6050250 - DNA, 22 bp, Homo sapiens
catttctatattcctccagctg

SEQ ID NO: 6050251 - DNA, 12 bp, Homo sapiens
catttctattaa

SEQ ID NO: 6050252 - DNA, 23 bp, Homo sapiens
catttctatttatttactgagct

SEQ ID NO: 6050253 - DNA, 22 bp, Homo sapiens
catttctatttcataatgaaaa

SEQ ID NO: 6050254 - DNA, 16 bp, Homo sapiens
catttctcaaagtttt

SEQ ID NO: 6050255 - DNA, 17 bp, Homo sapiens
catttctcaatcagtgc

SEQ ID NO: 6050256 - DNA, 19 bp, Homo sapiens
catttctcactagtgtcag

SEQ ID NO: 6050257 - DNA, 14 bp, Homo sapiens
catttctcatgtgc

SEQ ID NO: 6050258 - DNA, 17 bp, Homo sapiens
catttctcatgttgaaa

SEQ ID NO: 6050259 - DNA, 18 bp, Homo sapiens
catttctccagattatct

SEQ ID NO: 6050260 - DNA, 22 bp, Homo sapiens
catttctccatgggccaccgcc

SEQ ID NO: 6050261 - DNA, 20 bp, Homo sapiens
catttctcctttgataaaat

SEQ ID NO: 6050262 - DNA, 10 bp, Homo sapiens
catttctctc

SEQ ID NO: 6050263 - DNA, 15 bp, Homo sapiens
catttctctcctcac

SEQ ID NO: 6050264 - DNA, 11 bp, Homo sapiens
catttctctct

SEQ ID NO: 6050265 - DNA, 17 bp, Homo sapiens
catttctctctccagtc

SEQ ID NO: 6050266 - DNA, 16 bp, Homo sapiens
catttctctggggtat

SEQ ID NO: 6050267 - DNA, 21 bp, Homo sapiens
catttctcttccccttagaaa

SEQ ID NO: 6050268 - DNA, 17 bp, Homo sapiens
catttctcttcctaaat

SEQ ID NO: 6050269 - DNA, 13 bp, Homo sapiens
catttctgaggtg

SEQ ID NO: 6050270 - DNA, 18 bp, Homo sapiens
catttctgaggtgcactg

SEQ ID NO: 6050271 - DNA, 21 bp, Homo sapiens
catttctgaggtgcactggga

SEQ ID NO: 6050272 - DNA, 18 bp, Homo sapiens
catttctgatcagaggtg

SEQ ID NO: 6050273 - DNA, 11 bp, Homo sapiens
catttctgatt

SEQ ID NO: 6050274 - DNA, 14 bp, Homo sapiens
catttctgattctg

SEQ ID NO: 6050275 - DNA, 12 bp, Homo sapiens
catttctgattt

SEQ ID NO: 6050276 - DNA, 23 bp, Homo sapiens
catttctgcatcagctgctgaaa

SEQ ID NO: 6050277 - DNA, 18 bp, Homo sapiens
catttctgccttttgttc

SEQ ID NO: 6050278 - DNA, 20 bp, Homo sapiens
catttctggggggagaaaaa

SEQ ID NO: 6050279 - DNA, 21 bp, Homo sapiens
catttctggggggagaaaaaa

SEQ ID NO: 6050280 - DNA, 18 bp, Homo sapiens
catttctgtatactgtaa

SEQ ID NO: 6050281 - DNA, 20 bp, Homo sapiens
catttctgtatactgtaaaa

SEQ ID NO: 6050282 - DNA, 17 bp, Homo sapiens
catttctgtattttttg

SEQ ID NO: 6050283 - DNA, 23 bp, Homo sapiens
catttctgtggatacagtgccca

SEQ ID NO: 6050284 - DNA, 16 bp, Homo sapiens
catttctgttctcatt

SEQ ID NO: 6050285 - DNA, 17 bp, Homo sapiens
catttctgttgctggag

SEQ ID NO: 6050286 - DNA, 12 bp, Homo sapiens
catttcttagac

SEQ ID NO: 6050287 - DNA, 13 bp, Homo sapiens
catttcttatcac

SEQ ID NO: 6050288 - DNA, 15 bp, Homo sapiens
catttcttatgattt

SEQ ID NO: 6050289 - DNA, 22 bp, Homo sapiens
catttcttatggaaaggtcctg

SEQ ID NO: 6050290 - DNA, 15 bp, Homo sapiens
catttcttcacttca

SEQ ID NO: 6050291 - DNA, 14 bp, Homo sapiens
catttcttcccaag

SEQ ID NO: 6050292 - DNA, 17 bp, Homo sapiens
catttcttccccagtgt

SEQ ID NO: 6050293 - DNA, 14 bp, Homo sapiens
catttcttcctcac

SEQ ID NO: 6050294 - DNA, 14 bp, Homo sapiens
catttcttcctcag

SEQ ID NO: 6050295 - DNA, 19 bp, Homo sapiens
catttcttcctcagctggt

SEQ ID NO: 6050296 - DNA, 16 bp, Homo sapiens
catttcttcctctgca

SEQ ID NO: 6050297 - DNA, 14 bp, Homo sapiens
catttcttgggccc

SEQ ID NO: 6050298 - DNA, 15 bp, Homo sapiens
catttcttgggccct

SEQ ID NO: 6050299 - DNA, 17 bp, Homo sapiens
catttcttggtatgatc

SEQ ID NO: 6050300 - DNA, 15 bp, Homo sapiens
catttcttgtgttct

SEQ ID NO: 6050301 - DNA, 13 bp, Homo sapiens
catttctttatga

SEQ ID NO: 6050302 - DNA, 12 bp, Homo sapiens
catttctttctt

SEQ ID NO: 6050303 - DNA, 19 bp, Homo sapiens
catttctttcttccattcc

SEQ ID NO: 6050304 - DNA, 24 bp, Homo sapiens
catttctttcttccattccttcat

SEQ ID NO: 6050305 - DNA, 18 bp, Homo sapiens
catttctttcttgctggc

SEQ ID NO: 6050306 - DNA, 21 bp, Homo sapiens
catttctttcttgctggctct

SEQ ID NO: 6050307 - DNA, 15 bp, Homo sapiens
catttctttgtcttt

SEQ ID NO: 6050308 - DNA, 13 bp, Homo sapiens
catttcttttaaa

SEQ ID NO: 6050309 - DNA, 19 bp, Homo sapiens
catttcttttccaaaatta

SEQ ID NO: 6050310 - DNA, 19 bp, Homo sapiens
catttcttttctttttaca

SEQ ID NO: 6050311 - DNA, 15 bp, Homo sapiens
catttctttttggga

SEQ ID NO: 6050312 - DNA, 20 bp, Homo sapiens
catttgaaaattttgatgtt

SEQ ID NO: 6050313 - DNA, 22 bp, Homo sapiens
catttgaaaattttgatgtttt

SEQ ID NO: 6050314 - DNA, 21 bp, Homo sapiens
catttgaaacccctgtaggcc

SEQ ID NO: 6050315 - DNA, 18 bp, Homo sapiens
catttgaaacctttttct

SEQ ID NO: 6050316 - DNA, 19 bp, Homo sapiens
catttgaaagaaaggactc

SEQ ID NO: 6050317 - DNA, 12 bp, Homo sapiens
catttgaaatgt

SEQ ID NO: 6050318 - DNA, 16 bp, Homo sapiens
catttgaacacattat

SEQ ID NO: 6050319 - DNA, 23 bp, Homo sapiens
catttgaacctggatccagcact

SEQ ID NO: 6050320 - DNA, 13 bp, Homo sapiens
catttgaatgaga

SEQ ID NO: 6050321 - DNA, 12 bp, Homo sapiens
catttgaatgca

SEQ ID NO: 6050322 - DNA, 13 bp, Homo sapiens
catttgaatgcat

SEQ ID NO: 6050323 - DNA, 14 bp, Homo sapiens
catttgaatgcatt

SEQ ID NO: 6050324 - DNA, 23 bp, Homo sapiens
catttgaatgcattttgtttggt

SEQ ID NO: 6050325 - DNA, 13 bp, Homo sapiens
catttgaatgctt

SEQ ID NO: 6050326 - DNA, 20 bp, Homo sapiens
catttgaattcatttgctga

SEQ ID NO: 6050327 - DNA, 15 bp, Homo sapiens
catttgaattcttga

SEQ ID NO: 6050328 - DNA, 16 bp, Homo sapiens
catttgaattcttgat

SEQ ID NO: 6050329 - DNA, 18 bp, Homo sapiens
catttgaattcttgatct

SEQ ID NO: 6050330 - DNA, 19 bp, Homo sapiens
catttgaattcttgatctc

SEQ ID NO: 6050331 - DNA, 16 bp, Homo sapiens
catttgacaaaactaa

SEQ ID NO: 6050332 - DNA, 20 bp, Homo sapiens
catttgactgttcaatgatt

SEQ ID NO: 6050333 - DNA, 23 bp, Homo sapiens
catttgactgttcaatgattatt

SEQ ID NO: 6050334 - DNA, 23 bp, Homo sapiens
catttgacttctagaaaacattt

SEQ ID NO: 6050335 - DNA, 15 bp, Homo sapiens
catttgacttgaacc

SEQ ID NO: 6050336 - DNA, 18 bp, Homo sapiens
catttgagaaatgcatat

SEQ ID NO: 6050337 - DNA, 16 bp, Homo sapiens
catttgagagaagcca

SEQ ID NO: 6050338 - DNA, 23 bp, Homo sapiens
catttgagagaagccacgctgtc

SEQ ID NO: 6050339 - DNA, 21 bp, Homo sapiens
catttgagatttttggttttt

SEQ ID NO: 6050340 - DNA, 13 bp, Homo sapiens
catttgagcagct

SEQ ID NO: 6050341 - DNA, 14 bp, Homo sapiens
catttgagcagggc

SEQ ID NO: 6050342 - DNA, 18 bp, Homo sapiens
catttgagcagggctcag

SEQ ID NO: 6050343 - DNA, 23 bp, Homo sapiens
catttgaggatttagaagtgtca

SEQ ID NO: 6050344 - DNA, 21 bp, Homo sapiens
catttgagggcccagccagga

SEQ ID NO: 6050345 - DNA, 17 bp, Homo sapiens
catttgaggtctgttct

SEQ ID NO: 6050346 - DNA, 13 bp, Homo sapiens
catttgagtgtct

SEQ ID NO: 6050347 - DNA, 19 bp, Homo sapiens
catttgataaactaaaagc

SEQ ID NO: 6050348 - DNA, 14 bp, Homo sapiens
catttgataatgat

SEQ ID NO: 6050349 - DNA, 22 bp, Homo sapiens
cccaagacttggtgtcctttcc

SEQ ID NO: 6050350 - DNA, 14 bp, Homo sapiens
cccaagagaactcg

SEQ ID NO: 6050351 - DNA, 24 bp, Homo sapiens
cccaagagaactcgcgctcagtaa

SEQ ID NO: 6050352 - DNA, 17 bp, Homo sapiens
cccaagagagacagcac

SEQ ID NO: 6050353 - DNA, 18 bp, Homo sapiens
cccaagagaggaaggacc

SEQ ID NO: 6050354 - DNA, 17 bp, Homo sapiens
cccaagagatgaagagt

SEQ ID NO: 6050355 - DNA, 16 bp, Homo sapiens
cccaagagcagagtct

SEQ ID NO: 6050356 - DNA, 21 bp, Homo sapiens
cccaagagcagagtctgggcc

SEQ ID NO: 6050357 - DNA, 22 bp, Homo sapiens
cccaagagcatcatgcctctga

SEQ ID NO: 6050358 - DNA, 17 bp, Homo sapiens
cccaagagccctgtggc

SEQ ID NO: 6050359 - DNA, 21 bp, Homo sapiens
cccaagagccctgtggccgcc

SEQ ID NO: 6050360 - DNA, 14 bp, Homo sapiens
cccaagaggactga

SEQ ID NO: 6050361 - DNA, 14 bp, Homo sapiens
cccaagaggctagc

SEQ ID NO: 6050362 - DNA, 15 bp, Homo sapiens
cccaagaggctagcc

SEQ ID NO: 6050363 - DNA, 20 bp, Homo sapiens
cccaagaggctagccccagg

SEQ ID NO: 6050364 - DNA, 12 bp, Homo sapiens
cccaagagggct

SEQ ID NO: 6050365 - DNA, 20 bp, Homo sapiens
cccaagaggggcgggctcag

SEQ ID NO: 6050366 - DNA, 21 bp, Homo sapiens
cccaagaggggcgggctcaga

SEQ ID NO: 6050367 - DNA, 17 bp, Homo sapiens
cccaagaggtctgagcc

SEQ ID NO: 6050368 - DNA, 19 bp, Homo sapiens
cccaagagtggtggcagct

SEQ ID NO: 6050369 - DNA, 13 bp, Homo sapiens
cccaagatgcctg

SEQ ID NO: 6050370 - DNA, 14 bp, Homo sapiens
cccaagcagagaag

SEQ ID NO: 6050371 - DNA, 19 bp, Homo sapiens
cccaagcagccgcagcgca

SEQ ID NO: 6050372 - DNA, 14 bp, Homo sapiens
cccaagcagctgaa

SEQ ID NO: 6050373 - DNA, 22 bp, Homo sapiens
cccaagcatgggggaccccttc

SEQ ID NO: 6050374 - DNA, 12 bp, Homo sapiens
cccaagccacag

SEQ ID NO: 6050375 - DNA, 14 bp, Homo sapiens
cccaagccagaggc

SEQ ID NO: 6050376 - DNA, 17 bp, Homo sapiens
cccaagcccaccaggtg

SEQ ID NO: 6050377 - DNA, 16 bp, Homo sapiens
cccaagcccaggccac

SEQ ID NO: 6050378 - DNA, 14 bp, Homo sapiens
cccaagccccatct

SEQ ID NO: 6050379 - DNA, 15 bp, Homo sapiens
cccaagcccctgacc

SEQ ID NO: 6050380 - DNA, 19 bp, Homo sapiens
cccaagccctgaggcctga

SEQ ID NO: 6050381 - DNA, 21 bp, Homo sapiens
cccaagccctgaggcctgagg

SEQ ID NO: 6050382 - DNA, 23 bp, Homo sapiens
cccaagccctgaggcctgaggcc

SEQ ID NO: 6050383 - DNA, 12 bp, Homo sapiens
cccaagcctgat

SEQ ID NO: 6050384 - DNA, 16 bp, Homo sapiens
cccaagcctggcaagg

SEQ ID NO: 6050385 - DNA, 12 bp, Homo sapiens
cccaagcctggg

SEQ ID NO: 6050386 - DNA, 22 bp, Homo sapiens
cccaagccttcgggcgtctgtg

SEQ ID NO: 6050387 - DNA, 20 bp, Homo sapiens
cccaagcgccctggccccca

SEQ ID NO: 6050388 - DNA, 21 bp, Homo sapiens
cccaagcgcctggctgctgct

SEQ ID NO: 6050389 - DNA, 18 bp, Homo sapiens
cccaagcgttcctggcct

SEQ ID NO: 6050390 - DNA, 20 bp, Homo sapiens
cccaagcgttcctggccttc

SEQ ID NO: 6050391 - DNA, 22 bp, Homo sapiens
cccaagcgttcctggccttctg

SEQ ID NO: 6050392 - DNA, 18 bp, Homo sapiens
cccaagctagactgtgtc

SEQ ID NO: 6050393 - DNA, 12 bp, Homo sapiens
cccaagctcaga

SEQ ID NO: 6050394 - DNA, 12 bp, Homo sapiens
cccaagctccct

SEQ ID NO: 6050395 - DNA, 13 bp, Homo sapiens
cccaagctcctcc

SEQ ID NO: 6050396 - DNA, 12 bp, Homo sapiens
cccaagctctgc

SEQ ID NO: 6050397 - DNA, 13 bp, Homo sapiens
cccaagctctgct

SEQ ID NO: 6050398 - DNA, 16 bp, Homo sapiens
cccaagctgattttat

SEQ ID NO: 6050399 - DNA, 16 bp, Homo sapiens
cccaagctgcctctgg

SEQ ID NO: 6050400 - DNA, 16 bp, Homo sapiens
cccaagctgctgccgc

SEQ ID NO: 6050401 - DNA, 11 bp, Homo sapiens
cccaagctgga

SEQ ID NO: 6050402 - DNA, 12 bp, Homo sapiens
cccaagctgggc

SEQ ID NO: 6050403 - DNA, 12 bp, Homo sapiens
cccaagcttccc

SEQ ID NO: 6050404 - DNA, 18 bp, Homo sapiens
cccaagcttcccaacaga

SEQ ID NO: 6050405 - DNA, 14 bp, Homo sapiens
cccaagcttggcag

SEQ ID NO: 6050406 - DNA, 20 bp, Homo sapiens
cccaagcttggcagccgagc

SEQ ID NO: 6050407 - DNA, 22 bp, Homo sapiens
cccaaggaaagccccagcacta

SEQ ID NO: 6050408 - DNA, 21 bp, Homo sapiens
cccaaggaagaacaaatatga

SEQ ID NO: 6050409 - DNA, 21 bp, Homo sapiens
cccaaggaagctccttcctgt

SEQ ID NO: 6050410 - DNA, 22 bp, Homo sapiens
cccaaggaagctccttcctgtt

SEQ ID NO: 6050411 - DNA, 12 bp, Homo sapiens
cccaaggaccca

SEQ ID NO: 6050412 - DNA, 16 bp, Homo sapiens
cccaaggacccagccc

SEQ ID NO: 6050413 - DNA, 21 bp, Homo sapiens
cccaaggacggcaccatccag

SEQ ID NO: 6050414 - DNA, 18 bp, Homo sapiens
cccaaggactctggcctc

SEQ ID NO: 6050415 - DNA, 18 bp, Homo sapiens
cccaaggagcacaggtcc

SEQ ID NO: 6050416 - DNA, 22 bp, Homo sapiens
cccaaggagctgatttccaggc

SEQ ID NO: 6050417 - DNA, 22 bp, Homo sapiens
cccaaggagcttacccaagctg

SEQ ID NO: 6050418 - DNA, 14 bp, Homo sapiens
cccaaggaggaaaa

SEQ ID NO: 6050419 - DNA, 14 bp, Homo sapiens
cccaaggaggcagc

SEQ ID NO: 6050420 - DNA, 16 bp, Homo sapiens
cccaaggaggcagcct

SEQ ID NO: 6050421 - DNA, 19 bp, Homo sapiens
cccaaggagggggcctcat

SEQ ID NO: 6050422 - DNA, 22 bp, Homo sapiens
cccaaggagggggcctcattgt

SEQ ID NO: 6050423 - DNA, 16 bp, Homo sapiens
cccaaggatgaccaca

SEQ ID NO: 6050424 - DNA, 14 bp, Homo sapiens
cccaaggatgcctt

SEQ ID NO: 6050425 - DNA, 23 bp, Homo sapiens
cccaaggcaaggggtgcctggga

SEQ ID NO: 6050426 - DNA, 21 bp, Homo sapiens
cccaaggcattctcccagctc

SEQ ID NO: 6050427 - DNA, 24 bp, Homo sapiens
cccaaggccactgcgctcttggga

SEQ ID NO: 6050428 - DNA, 11 bp, Homo sapiens
cccaaggccag

SEQ ID NO: 6050429 - DNA, 17 bp, Homo sapiens
cccaaggccccagggac

SEQ ID NO: 6050430 - DNA, 14 bp, Homo sapiens
cccaaggcccccac

SEQ ID NO: 6050431 - DNA, 19 bp, Homo sapiens
cccaaggccccctgcctgc

SEQ ID NO: 6050432 - DNA, 13 bp, Homo sapiens
cccaaggctgcca

SEQ ID NO: 6050433 - DNA, 16 bp, Homo sapiens
cccaaggctgccagac

SEQ ID NO: 6050434 - DNA, 21 bp, Homo sapiens
cccaaggctgcgtctggaggg

SEQ ID NO: 6050435 - DNA, 16 bp, Homo sapiens
cccaaggctggcaggt

SEQ ID NO: 6050436 - DNA, 19 bp, Homo sapiens
cccaagggcaaaattccca

SEQ ID NO: 6050437 - DNA, 21 bp, Homo sapiens
cccaagggcaaaattcccagg

SEQ ID NO: 6050438 - DNA, 22 bp, Homo sapiens
cccaagggcaaaattcccaggg

SEQ ID NO: 6050439 - DNA, 14 bp, Homo sapiens
cccaagggcccaga

SEQ ID NO: 6050440 - DNA, 14 bp, Homo sapiens
cccaagggcctggc

SEQ ID NO: 6050441 - DNA, 17 bp, Homo sapiens
cccaagggcctggcctg

SEQ ID NO: 6050442 - DNA, 12 bp, Homo sapiens
cccaaggggcag

SEQ ID NO: 6050443 - DNA, 15 bp, Homo sapiens
cccaaggggcagtct

SEQ ID NO: 6050444 - DNA, 18 bp, Homo sapiens
cccaaggggcctgagcag

SEQ ID NO: 6050445 - DNA, 22 bp, Homo sapiens
cccaaggggtctgtatatacat

SEQ ID NO: 6050446 - DNA, 16 bp, Homo sapiens
cccaaggtacagctgt

SEQ ID NO: 6050447 - DNA, 14 bp, Homo sapiens
cccaaggtcctctc

SEQ ID NO: 6050448 - DNA, 17 bp, Homo sapiens
cccaaggtcctctcagt

SEQ ID NO: 6050449 - DNA, 22 bp, Homo sapiens
cccaaggtgaggtgaactccag

SEQ ID NO: 6050450 - DNA, 18 bp, Homo sapiens
cccaaggtggtcttggag

SEQ ID NO: 6050451 - DNA, 22 bp, Homo sapiens
cccaaggttacttaattcaact

SEQ ID NO: 6050452 - DNA, 11 bp, Homo sapiens
cccaaggttcc

SEQ ID NO: 6050453 - DNA, 20 bp, Homo sapiens
cccaaggttccagaggccct

SEQ ID NO: 6050454 - DNA, 21 bp, Homo sapiens
cccaaggttctgggtgcagga

SEQ ID NO: 6050455 - DNA, 18 bp, Homo sapiens
cccaaggttgcacagcaa

SEQ ID NO: 6050456 - DNA, 16 bp, Homo sapiens
cccaaggtttgagtcc

SEQ ID NO: 6050457 - DNA, 20 bp, Homo sapiens
cccaagtagctgggattaca

SEQ ID NO: 6050458 - DNA, 21 bp, Homo sapiens
cccaagtcaaacagtgtggct

SEQ ID NO: 6050459 - DNA, 21 bp, Homo sapiens
cccaagtcaaagatgccccat

SEQ ID NO: 6050460 - DNA, 17 bp, Homo sapiens
cccaagtcacacccact

SEQ ID NO: 6050461 - DNA, 19 bp, Homo sapiens
cccaagtcagcagtcctag

SEQ ID NO: 6050462 - DNA, 11 bp, Homo sapiens
cccaagtccac

SEQ ID NO: 6050463 - DNA, 14 bp, Homo sapiens
cccaagtcccaccc

SEQ ID NO: 6050464 - DNA, 19 bp, Homo sapiens
cccaagtcccagagcacct

SEQ ID NO: 6050465 - DNA, 14 bp, Homo sapiens
cccaagtcctccgg

SEQ ID NO: 6050466 - DNA, 14 bp, Homo sapiens
cccaagtcctcgcc

SEQ ID NO: 6050467 - DNA, 15 bp, Homo sapiens
cccaagtcctcgccc

SEQ ID NO: 6050468 - DNA, 13 bp, Homo sapiens
cccaagtcctgaa

SEQ ID NO: 6050469 - DNA, 15 bp, Homo sapiens
cccaagtgaggcagc

SEQ ID NO: 6050470 - DNA, 13 bp, Homo sapiens
cccaagtgagtct

SEQ ID NO: 6050471 - DNA, 23 bp, Homo sapiens
cccaagtgatccttccacctcag

SEQ ID NO: 6050472 - DNA, 19 bp, Homo sapiens
cccaagtgcactttctaat

SEQ ID NO: 6050473 - DNA, 12 bp, Homo sapiens
cccaagtgccat

SEQ ID NO: 6050474 - DNA, 14 bp, Homo sapiens
cccaagtgcctcac

SEQ ID NO: 6050475 - DNA, 16 bp, Homo sapiens
cccaagtggcagagct

SEQ ID NO: 6050476 - DNA, 16 bp, Homo sapiens
cccaagtgggcagtca

SEQ ID NO: 6050477 - DNA, 21 bp, Homo sapiens
cccaagtgggcagtcaccacc

SEQ ID NO: 6050478 - DNA, 24 bp, Homo sapiens
cccaagtgggcagtcaccacccag

SEQ ID NO: 6050479 - DNA, 19 bp, Homo sapiens
cccaagttcatgcagctgt

SEQ ID NO: 6050480 - DNA, 13 bp, Homo sapiens
cccaagttgcagt

SEQ ID NO: 6050481 - DNA, 16 bp, Homo sapiens
cccaagttggaaggga

SEQ ID NO: 6050482 - DNA, 15 bp, Homo sapiens
cccaagttgggggtc

SEQ ID NO: 6050483 - DNA, 22 bp, Homo sapiens
cccaagttttaggacaaacagc

SEQ ID NO: 6050484 - DNA, 23 bp, Homo sapiens
cccaagttttaggacaaacagct

SEQ ID NO: 6050485 - DNA, 17 bp, Homo sapiens
cccaagttttgtgaaat

SEQ ID NO: 6050486 - DNA, 12 bp, Homo sapiens
cccaataaacca

SEQ ID NO: 6050487 - DNA, 16 bp, Homo sapiens
cccaataaaccagtgt

SEQ ID NO: 6050488 - DNA, 12 bp, Homo sapiens
cccaataaagaa

SEQ ID NO: 6050489 - DNA, 12 bp, Homo sapiens
cccaataaaggc

SEQ ID NO: 6050490 - DNA, 19 bp, Homo sapiens
cccaataaaggcagctgcc

SEQ ID NO: 6050491 - DNA, 20 bp, Homo sapiens
cccaataaaggcagctgcct

SEQ ID NO: 6050492 - DNA, 23 bp, Homo sapiens
cccaataaaggtcccttagcccc

SEQ ID NO: 6050493 - DNA, 17 bp, Homo sapiens
cccaataaagtcctctt

SEQ ID NO: 6050494 - DNA, 12 bp, Homo sapiens
cccaatagctgc

SEQ ID NO: 6050495 - DNA, 14 bp, Homo sapiens
cccaatatatgtat

SEQ ID NO: 6050496 - DNA, 17 bp, Homo sapiens
cccaatatggtggccct

SEQ ID NO: 6050497 - DNA, 19 bp, Homo sapiens
cccaatatggtggccctgg

SEQ ID NO: 6050498 - DNA, 21 bp, Homo sapiens
cccaatatggtggccctgggg

SEQ ID NO: 6050499 - DNA, 11 bp, Homo sapiens
cccaatcactg

SEQ ID NO: 6050500 - DNA, 22 bp, Homo sapiens
cccaatcagcttttgttctaga

SEQ ID NO: 6050501 - DNA, 18 bp, Homo sapiens
cccaatccaacccatgca

SEQ ID NO: 6050502 - DNA, 22 bp, Homo sapiens
cccaatccaggtacgcacagac

SEQ ID NO: 6050503 - DNA, 15 bp, Homo sapiens
cccaatccatcgtat

SEQ ID NO: 6050504 - DNA, 17 bp, Homo sapiens
cccaatccatgcttcac

SEQ ID NO: 6050505 - DNA, 23 bp, Homo sapiens
cccaatccatttggcagaactgc

SEQ ID NO: 6050506 - DNA, 19 bp, Homo sapiens
cccaatcccagctacctca

SEQ ID NO: 6050507 - DNA, 19 bp, Homo sapiens
cccaatccctcaaaccttg

SEQ ID NO: 6050508 - DNA, 19 bp, Homo sapiens
cccaatccctgccactggg

SEQ ID NO: 6050509 - DNA, 21 bp, Homo sapiens
cccaatccctttattaccccc

SEQ ID NO: 6050510 - DNA, 16 bp, Homo sapiens
cccaatcctccctgga

SEQ ID NO: 6050511 - DNA, 18 bp, Homo sapiens
cccaatcctccctggaga

SEQ ID NO: 6050512 - DNA, 19 bp, Homo sapiens
cccaatcctctctcccctc

SEQ ID NO: 6050513 - DNA, 18 bp, Homo sapiens
cccaatcggactgccaaa

SEQ ID NO: 6050514 - DNA, 16 bp, Homo sapiens
cccaatcgggtccaga

SEQ ID NO: 6050515 - DNA, 17 bp, Homo sapiens
cccaatcgggtccagag

SEQ ID NO: 6050516 - DNA, 20 bp, Homo sapiens
cccaatctcaatacagcctg

SEQ ID NO: 6050517 - DNA, 21 bp, Homo sapiens
cccaatctctacccctttctt

SEQ ID NO: 6050518 - DNA, 13 bp, Homo sapiens
cccaatctttcta

SEQ ID NO: 6050519 - DNA, 14 bp, Homo sapiens
cccaatctttctat

SEQ ID NO: 6050520 - DNA, 22 bp, Homo sapiens
cccaatgagactctagggtcca

SEQ ID NO: 6050521 - DNA, 23 bp, Homo sapiens
cccaatgcacagggctgcaacac

SEQ ID NO: 6050522 - DNA, 20 bp, Homo sapiens
cccaatgcacatccattccc

SEQ ID NO: 6050523 - DNA, 16 bp, Homo sapiens
cccaatgcactttgtt

SEQ ID NO: 6050524 - DNA, 23 bp, Homo sapiens
cccaatgcatagagccctggcca

SEQ ID NO: 6050525 - DNA, 14 bp, Homo sapiens
cccaatgcctgtga

SEQ ID NO: 6050526 - DNA, 16 bp, Homo sapiens
cccaatgctcctggag

SEQ ID NO: 6050527 - DNA, 16 bp, Homo sapiens
cccaatgctgctccac

SEQ ID NO: 6050528 - DNA, 17 bp, Homo sapiens
catttgataattttgaa

SEQ ID NO: 6050529 - DNA, 23 bp, Homo sapiens
catttgataattttgaaatgatt

SEQ ID NO: 6050530 - DNA, 13 bp, Homo sapiens
catttgatattgt

SEQ ID NO: 6050531 - DNA, 14 bp, Homo sapiens
catttgatattgtg

SEQ ID NO: 6050532 - DNA, 15 bp, Homo sapiens
catttgatatttttc

SEQ ID NO: 6050533 - DNA, 19 bp, Homo sapiens
catttgatgcatgtctttt

SEQ ID NO: 6050534 - DNA, 20 bp, Homo sapiens
catttgatgcatgtctttta

SEQ ID NO: 6050535 - DNA, 15 bp, Homo sapiens
catttgatgtacatg

SEQ ID NO: 6050536 - DNA, 18 bp, Homo sapiens
catttgatgtacatgtgt

SEQ ID NO: 6050537 - DNA, 14 bp, Homo sapiens
catttgattaacat

SEQ ID NO: 6050538 - DNA, 17 bp, Homo sapiens
catttgattaataaaat

SEQ ID NO: 6050539 - DNA, 18 bp, Homo sapiens
catttgattaataaaata

SEQ ID NO: 6050540 - DNA, 15 bp, Homo sapiens
catttgatttccatg

SEQ ID NO: 6050541 - DNA, 14 bp, Homo sapiens
catttgatttgttc

SEQ ID NO: 6050542 - DNA, 16 bp, Homo sapiens
catttgatttgtttag

SEQ ID NO: 6050543 - DNA, 18 bp, Homo sapiens
catttgcaaaatggaaat

SEQ ID NO: 6050544 - DNA, 16 bp, Homo sapiens
catttgcaataacagc

SEQ ID NO: 6050545 - DNA, 20 bp, Homo sapiens
catttgcaataacagctgca

SEQ ID NO: 6050546 - DNA, 19 bp, Homo sapiens
catttgcaatatggatttc

SEQ ID NO: 6050547 - DNA, 22 bp, Homo sapiens
catttgcacaaacttgtgagca

SEQ ID NO: 6050548 - DNA, 19 bp, Homo sapiens
catttgcacaggttttcag

SEQ ID NO: 6050549 - DNA, 15 bp, Homo sapiens
catttgcaccctccg

SEQ ID NO: 6050550 - DNA, 18 bp, Homo sapiens
catttgcagagtcctgca

SEQ ID NO: 6050551 - DNA, 19 bp, Homo sapiens
catttgcagatgttcaaat

SEQ ID NO: 6050552 - DNA, 17 bp, Homo sapiens
catttgcagctgctggt

SEQ ID NO: 6050553 - DNA, 22 bp, Homo sapiens
catttgcaggatctgtctgtgc

SEQ ID NO: 6050554 - DNA, 14 bp, Homo sapiens
catttgcagggtcc

SEQ ID NO: 6050555 - DNA, 23 bp, Homo sapiens
catttgcatatcacccttccctg

SEQ ID NO: 6050556 - DNA, 14 bp, Homo sapiens
catttgcatttgtt

SEQ ID NO: 6050557 - DNA, 19 bp, Homo sapiens
catttgccaactaatttta

SEQ ID NO: 6050558 - DNA, 12 bp, Homo sapiens
catttgccctgt

SEQ ID NO: 6050559 - DNA, 19 bp, Homo sapiens
catttgcctaattcctggc

SEQ ID NO: 6050560 - DNA, 14 bp, Homo sapiens
catttgcctattcc

SEQ ID NO: 6050561 - DNA, 16 bp, Homo sapiens
catttgccttgcagaa

SEQ ID NO: 6050562 - DNA, 19 bp, Homo sapiens
catttgccttgcagaactg

SEQ ID NO: 6050563 - DNA, 21 bp, Homo sapiens
catttgcgaatggttccattc

SEQ ID NO: 6050564 - DNA, 21 bp, Homo sapiens
catttgcgttccatgatgctg

SEQ ID NO: 6050565 - DNA, 15 bp, Homo sapiens
catttgctaaggcag

SEQ ID NO: 6050566 - DNA, 21 bp, Homo sapiens
catttgctaagtgtatgatgt

SEQ ID NO: 6050567 - DNA, 11 bp, Homo sapiens
catttgctaat

SEQ ID NO: 6050568 - DNA, 22 bp, Homo sapiens
catttgctactgttgtaagaat

SEQ ID NO: 6050569 - DNA, 13 bp, Homo sapiens
catttgctcatgg

SEQ ID NO: 6050570 - DNA, 16 bp, Homo sapiens
catttgctcatggaat

SEQ ID NO: 6050571 - DNA, 19 bp, Homo sapiens
catttgctcttcagatgcc

SEQ ID NO: 6050572 - DNA, 20 bp, Homo sapiens
catttgctgaataacaacaa

SEQ ID NO: 6050573 - DNA, 23 bp, Homo sapiens
catttgctgattgtctgaaattt

SEQ ID NO: 6050574 - DNA, 19 bp, Homo sapiens
catttgctgatttctagtg

SEQ ID NO: 6050575 - DNA, 15 bp, Homo sapiens
catttgctgccctgg

SEQ ID NO: 6050576 - DNA, 17 bp, Homo sapiens
catttgctgccctgggg

SEQ ID NO: 6050577 - DNA, 18 bp, Homo sapiens
catttgctgccctggggc

SEQ ID NO: 6050578 - DNA, 22 bp, Homo sapiens
catttgctggcctggcaggggg

SEQ ID NO: 6050579 - DNA, 15 bp, Homo sapiens
catttgctgttttaa

SEQ ID NO: 6050580 - DNA, 14 bp, Homo sapiens
catttgctttcctc

SEQ ID NO: 6050581 - DNA, 14 bp, Homo sapiens
catttgctttggaa

SEQ ID NO: 6050582 - DNA, 15 bp, Homo sapiens
catttgctttggaag

SEQ ID NO: 6050583 - DNA, 15 bp, Homo sapiens
catttgctttttgct

SEQ ID NO: 6050584 - DNA, 18 bp, Homo sapiens
catttgctttttgcttgt

SEQ ID NO: 6050585 - DNA, 19 bp, Homo sapiens
catttggaaaagacagaaa

SEQ ID NO: 6050586 - DNA, 20 bp, Homo sapiens
catttggaaaccatgcacta

SEQ ID NO: 6050587 - DNA, 11 bp, Homo sapiens
catttggaaat

SEQ ID NO: 6050588 - DNA, 17 bp, Homo sapiens
catttggaaatctttaa

SEQ ID NO: 6050589 - DNA, 15 bp, Homo sapiens
catttggaatgaata

SEQ ID NO: 6050590 - DNA, 18 bp, Homo sapiens
catttggaatgcacacag

SEQ ID NO: 6050591 - DNA, 20 bp, Homo sapiens
catttggaattagtggattt

SEQ ID NO: 6050592 - DNA, 18 bp, Homo sapiens
catttggagggcctgggc

SEQ ID NO: 6050593 - DNA, 16 bp, Homo sapiens
catttggatataaatc

SEQ ID NO: 6050594 - DNA, 18 bp, Homo sapiens
catttggattagaaattt

SEQ ID NO: 6050595 - DNA, 15 bp, Homo sapiens
catttggattggatg

SEQ ID NO: 6050596 - DNA, 14 bp, Homo sapiens
catttggattttaa

SEQ ID NO: 6050597 - DNA, 23 bp, Homo sapiens
catttggattttaaacaaaattt

SEQ ID NO: 6050598 - DNA, 15 bp, Homo sapiens
catttggcactatgg

SEQ ID NO: 6050599 - DNA, 20 bp, Homo sapiens
catttggcagaactgctggg

SEQ ID NO: 6050600 - DNA, 23 bp, Homo sapiens
catttggcagaactgctggggct

SEQ ID NO: 6050601 - DNA, 21 bp, Homo sapiens
catttggcaggggtggctgcc

SEQ ID NO: 6050602 - DNA, 18 bp, Homo sapiens
catttggcatccctgggc

SEQ ID NO: 6050603 - DNA, 18 bp, Homo sapiens
catttggcatttatttgt

SEQ ID NO: 6050604 - DNA, 18 bp, Homo sapiens
catttggccgagtcagca

SEQ ID NO: 6050605 - DNA, 16 bp, Homo sapiens
catttggcctcttgta

SEQ ID NO: 6050606 - DNA, 20 bp, Homo sapiens
catttggctccactgtaaat

SEQ ID NO: 6050607 - DNA, 12 bp, Homo sapiens
catttggcttcc

SEQ ID NO: 6050608 - DNA, 18 bp, Homo sapiens
catttggcttcctctgct

SEQ ID NO: 6050609 - DNA, 15 bp, Homo sapiens
catttggcttgctgt

SEQ ID NO: 6050610 - DNA, 22 bp, Homo sapiens
catttgggaaattcagcttttg

SEQ ID NO: 6050611 - DNA, 18 bp, Homo sapiens
catttgggagactgagct

SEQ ID NO: 6050612 - DNA, 22 bp, Homo sapiens
catttgggctcagggttggcca

SEQ ID NO: 6050613 - DNA, 14 bp, Homo sapiens
catttgggctctgg

SEQ ID NO: 6050614 - DNA, 12 bp, Homo sapiens
catttggggaga

SEQ ID NO: 6050615 - DNA, 12 bp, Homo sapiens
catttgggggcg

SEQ ID NO: 6050616 - DNA, 14 bp, Homo sapiens
catttggggtgggg

SEQ ID NO: 6050617 - DNA, 18 bp, Homo sapiens
catttgggtattttgtca

SEQ ID NO: 6050618 - DNA, 14 bp, Homo sapiens
catttgggtccagg

SEQ ID NO: 6050619 - DNA, 17 bp, Homo sapiens
catttgggtccaggagg

SEQ ID NO: 6050620 - DNA, 18 bp, Homo sapiens
catttgggtccaggagga

SEQ ID NO: 6050621 - DNA, 17 bp, Homo sapiens
catttgggtggtaagag

SEQ ID NO: 6050622 - DNA, 23 bp, Homo sapiens
catttgggtggtaagagaatgtt

SEQ ID NO: 6050623 - DNA, 23 bp, Homo sapiens
catttggtatattacctcaaatt

SEQ ID NO: 6050624 - DNA, 14 bp, Homo sapiens
catttggtcctttc

SEQ ID NO: 6050625 - DNA, 14 bp, Homo sapiens
catttggtctcagg

SEQ ID NO: 6050626 - DNA, 16 bp, Homo sapiens
catttggtctgccaga

SEQ ID NO: 6050627 - DNA, 22 bp, Homo sapiens
catttggtgagagtcaaagctg

SEQ ID NO: 6050628 - DNA, 20 bp, Homo sapiens
catttggtgcacttttctgt

SEQ ID NO: 6050629 - DNA, 21 bp, Homo sapiens
catttggtggtttcagaaatg

SEQ ID NO: 6050630 - DNA, 23 bp, Homo sapiens
catttggtggtttcagaaatgtg

SEQ ID NO: 6050631 - DNA, 17 bp, Homo sapiens
catttggttaaatcatt

SEQ ID NO: 6050632 - DNA, 19 bp, Homo sapiens
catttggttttacacagga

SEQ ID NO: 6050633 - DNA, 20 bp, Homo sapiens
catttggttttacacaggaa

SEQ ID NO: 6050634 - DNA, 14 bp, Homo sapiens
catttgtaaaaatg

SEQ ID NO: 6050635 - DNA, 21 bp, Homo sapiens
catttgtaaaaatgagtcatt

SEQ ID NO: 6050636 - DNA, 13 bp, Homo sapiens
catttgtaaaact

SEQ ID NO: 6050637 - DNA, 18 bp, Homo sapiens
catttgtaataaagtata

SEQ ID NO: 6050638 - DNA, 19 bp, Homo sapiens
catttgtaattaaattatg

SEQ ID NO: 6050639 - DNA, 12 bp, Homo sapiens
catttgtacatt

SEQ ID NO: 6050640 - DNA, 23 bp, Homo sapiens
catttgtactttatttttgtata

SEQ ID NO: 6050641 - DNA, 17 bp, Homo sapiens
catttgtagatatatat

SEQ ID NO: 6050642 - DNA, 14 bp, Homo sapiens
catttgtagtgagc

SEQ ID NO: 6050643 - DNA, 17 bp, Homo sapiens
catttgtataaaataat

SEQ ID NO: 6050644 - DNA, 14 bp, Homo sapiens
catttgtatattgt

SEQ ID NO: 6050645 - DNA, 19 bp, Homo sapiens
catttgtattgcttatttt

SEQ ID NO: 6050646 - DNA, 20 bp, Homo sapiens
catttgtattgcttatttta

SEQ ID NO: 6050647 - DNA, 14 bp, Homo sapiens
catttgtattttgt

SEQ ID NO: 6050648 - DNA, 19 bp, Homo sapiens
catttgtattttgtgatga

SEQ ID NO: 6050649 - DNA, 14 bp, Homo sapiens
catttgtcattttc

SEQ ID NO: 6050650 - DNA, 20 bp, Homo sapiens
catttgtcattttcattagc

SEQ ID NO: 6050651 - DNA, 21 bp, Homo sapiens
catttgtcccagactaaagga

SEQ ID NO: 6050652 - DNA, 15 bp, Homo sapiens
catttgtcctgcaga

SEQ ID NO: 6050653 - DNA, 21 bp, Homo sapiens
catttgtcctgcagagctggg

SEQ ID NO: 6050654 - DNA, 16 bp, Homo sapiens
catttgtctctacttt

SEQ ID NO: 6050655 - DNA, 17 bp, Homo sapiens
catttgtcttagagaga

SEQ ID NO: 6050656 - DNA, 19 bp, Homo sapiens
catttgtcttagagagaga

SEQ ID NO: 6050657 - DNA, 15 bp, Homo sapiens
catttgtctttttat

SEQ ID NO: 6050658 - DNA, 13 bp, Homo sapiens
catttgtgaagaa

SEQ ID NO: 6050659 - DNA, 11 bp, Homo sapiens
catttgtgagg

SEQ ID NO: 6050660 - DNA, 12 bp, Homo sapiens
catttgtgatat

SEQ ID NO: 6050661 - DNA, 23 bp, Homo sapiens
catttgtgatcagcattgtgact

SEQ ID NO: 6050662 - DNA, 16 bp, Homo sapiens
catttgtgcataaatt

SEQ ID NO: 6050663 - DNA, 16 bp, Homo sapiens
catttgtgccacacgc

SEQ ID NO: 6050664 - DNA, 15 bp, Homo sapiens
catttgtgccagagg

SEQ ID NO: 6050665 - DNA, 20 bp, Homo sapiens
catttgtgctagaaattttc

SEQ ID NO: 6050666 - DNA, 23 bp, Homo sapiens
catttgtggcagtcccttataat

SEQ ID NO: 6050667 - DNA, 17 bp, Homo sapiens
catttgtgggcaagcag

SEQ ID NO: 6050668 - DNA, 21 bp, Homo sapiens
catttgtgggcaagcagatga

SEQ ID NO: 6050669 - DNA, 19 bp, Homo sapiens
catttgtggtaatctacac

SEQ ID NO: 6050670 - DNA, 21 bp, Homo sapiens
catttgtggtaatctacacca

SEQ ID NO: 6050671 - DNA, 22 bp, Homo sapiens
catttgtggttagaatcttgtt

SEQ ID NO: 6050672 - DNA, 15 bp, Homo sapiens
catttgtgtctgcct

SEQ ID NO: 6050673 - DNA, 20 bp, Homo sapiens
catttgtgtctgcctgcctc

SEQ ID NO: 6050674 - DNA, 16 bp, Homo sapiens
catttgttaatatttc

SEQ ID NO: 6050675 - DNA, 19 bp, Homo sapiens
catttgttaatatttcttc

SEQ ID NO: 6050676 - DNA, 22 bp, Homo sapiens
catttgttacagtttcttcatg

SEQ ID NO: 6050677 - DNA, 15 bp, Homo sapiens
catttgttattctta

SEQ ID NO: 6050678 - DNA, 14 bp, Homo sapiens
catttgttcagctc

SEQ ID NO: 6050679 - DNA, 20 bp, Homo sapiens
catttgttcagctcccccag

SEQ ID NO: 6050680 - DNA, 14 bp, Homo sapiens
catttgttcatatt

SEQ ID NO: 6050681 - DNA, 12 bp, Homo sapiens
catttgttcctg

SEQ ID NO: 6050682 - DNA, 17 bp, Homo sapiens
catttgttcctgcttcc

SEQ ID NO: 6050683 - DNA, 15 bp, Homo sapiens
catttgttctttgcc

SEQ ID NO: 6050684 - DNA, 19 bp, Homo sapiens
catttgttgccagatttca

SEQ ID NO: 6050685 - DNA, 16 bp, Homo sapiens
catttgttgctgctgc

SEQ ID NO: 6050686 - DNA, 17 bp, Homo sapiens
catttgttgctgctgct

SEQ ID NO: 6050687 - DNA, 16 bp, Homo sapiens
catttgttggaatgaa

SEQ ID NO: 6050688 - DNA, 20 bp, Homo sapiens
catttgtttacatttgatgc

SEQ ID NO: 6050689 - DNA, 18 bp, Homo sapiens
catttgtttatgtaattt

SEQ ID NO: 6050690 - DNA, 19 bp, Homo sapiens
catttgtttatgtaatttc

SEQ ID NO: 6050691 - DNA, 16 bp, Homo sapiens
catttgtttgtattca

SEQ ID NO: 6050692 - DNA, 19 bp, Homo sapiens
catttgtttgtattcatgt

SEQ ID NO: 6050693 - DNA, 17 bp, Homo sapiens
catttgttttagcatta

SEQ ID NO: 6050694 - DNA, 21 bp, Homo sapiens
catttgttttcggcagcctta

SEQ ID NO: 6050695 - DNA, 15 bp, Homo sapiens
catttgttttgcttt

SEQ ID NO: 6050696 - DNA, 18 bp, Homo sapiens
catttgttttgcttttgt

SEQ ID NO: 6050697 - DNA, 17 bp, Homo sapiens
catttgttttgtttaca

SEQ ID NO: 6050698 - DNA, 15 bp, Homo sapiens
catttgttttttcaa

SEQ ID NO: 6050699 - DNA, 16 bp, Homo sapiens
cattttaaaaacttta

SEQ ID NO: 6050700 - DNA, 20 bp, Homo sapiens
cattttaaaaactttattgg

SEQ ID NO: 6050701 - DNA, 13 bp, Homo sapiens
cattttaaaaagt

SEQ ID NO: 6050702 - DNA, 23 bp, Homo sapiens
cattttaaaaataaatgaaaaac

SEQ ID NO: 6050703 - DNA, 23 bp, Homo sapiens
cattttaaaagcaattatattgt

SEQ ID NO: 6050704 - DNA, 15 bp, Homo sapiens
cattttaaaatgtct

SEQ ID NO: 6050705 - DNA, 18 bp, Homo sapiens
cattttaaaatgtcttgg

SEQ ID NO: 6050706 - DNA, 14 bp, Homo sapiens
cccaatgctttggg

SEQ ID NO: 6050707 - DNA, 24 bp, Homo sapiens
cccaatgctttgggaggccaaggc

SEQ ID NO: 6050708 - DNA, 12 bp, Homo sapiens
cccaatggagaa

SEQ ID NO: 6050709 - DNA, 22 bp, Homo sapiens
cccaatggagaaatgaagcaga

SEQ ID NO: 6050710 - DNA, 20 bp, Homo sapiens
cccaatggataaatcagtgc

SEQ ID NO: 6050711 - DNA, 21 bp, Homo sapiens
cccaatgggaccgtgccccac

SEQ ID NO: 6050712 - DNA, 23 bp, Homo sapiens
cccaatgggaccgtgccccacct

SEQ ID NO: 6050713 - DNA, 21 bp, Homo sapiens
cccaattacagggtgactcac

SEQ ID NO: 6050714 - DNA, 19 bp, Homo sapiens
cccaattatcctccttcac

SEQ ID NO: 6050715 - DNA, 16 bp, Homo sapiens
cccaattcaggactgg

SEQ ID NO: 6050716 - DNA, 13 bp, Homo sapiens
cccaattcatttc

SEQ ID NO: 6050717 - DNA, 17 bp, Homo sapiens
cccaattcggggcctgc

SEQ ID NO: 6050718 - DNA, 21 bp, Homo sapiens
cccaattcggggcctgctgga

SEQ ID NO: 6050719 - DNA, 18 bp, Homo sapiens
cccaattctgcctgcctc

SEQ ID NO: 6050720 - DNA, 17 bp, Homo sapiens
cccaatttcacagagta

SEQ ID NO: 6050721 - DNA, 15 bp, Homo sapiens
cccaatttcagactc

SEQ ID NO: 6050722 - DNA, 19 bp, Homo sapiens
cccacaaaagacagaccca

SEQ ID NO: 6050723 - DNA, 22 bp, Homo sapiens
cccacaaaagacagacccagtg

SEQ ID NO: 6050724 - DNA, 14 bp, Homo sapiens
cccacaaactccag

SEQ ID NO: 6050725 - DNA, 18 bp, Homo sapiens
cccacaaactccaggctg

SEQ ID NO: 6050726 - DNA, 20 bp, Homo sapiens
cccacaaactccaggctgga

SEQ ID NO: 6050727 - DNA, 13 bp, Homo sapiens
cccacaaactgat

SEQ ID NO: 6050728 - DNA, 19 bp, Homo sapiens
cccacaaagagagtgcgcc

SEQ ID NO: 6050729 - DNA, 21 bp, Homo sapiens
cccacaaaggagagctagcag

SEQ ID NO: 6050730 - DNA, 21 bp, Homo sapiens
cccacaaccttcggctccggg

SEQ ID NO: 6050731 - DNA, 21 bp, Homo sapiens
cccacaacgtcccctcaagcc

SEQ ID NO: 6050732 - DNA, 20 bp, Homo sapiens
cccacaagaaatgaaagcag

SEQ ID NO: 6050733 - DNA, 22 bp, Homo sapiens
cccacaagcaccactctgggca

SEQ ID NO: 6050734 - DNA, 16 bp, Homo sapiens
cccacaagcctgcctc

SEQ ID NO: 6050735 - DNA, 20 bp, Homo sapiens
cccacaagccttactcacct

SEQ ID NO: 6050736 - DNA, 22 bp, Homo sapiens
cccacaagccttactcacctct

SEQ ID NO: 6050737 - DNA, 14 bp, Homo sapiens
cccacaagctgtcc

SEQ ID NO: 6050738 - DNA, 18 bp, Homo sapiens
cccacaagctgtccctgc

SEQ ID NO: 6050739 - DNA, 18 bp, Homo sapiens
cccacaaggaaccctcag

SEQ ID NO: 6050740 - DNA, 14 bp, Homo sapiens
cccacaaggcctgg

SEQ ID NO: 6050741 - DNA, 15 bp, Homo sapiens
cccacaaggcctggt

SEQ ID NO: 6050742 - DNA, 17 bp, Homo sapiens
cccacaagtggcagaca

SEQ ID NO: 6050743 - DNA, 16 bp, Homo sapiens
cccacaagtggtggta

SEQ ID NO: 6050744 - DNA, 20 bp, Homo sapiens
cccacaagtggtggtaaccc

SEQ ID NO: 6050745 - DNA, 23 bp, Homo sapiens
cccacaagtggtggtaaccctgg

SEQ ID NO: 6050746 - DNA, 23 bp, Homo sapiens
cccacaataagagttcttgccct

SEQ ID NO: 6050747 - DNA, 22 bp, Homo sapiens
cccacaatcccacctagcccag

SEQ ID NO: 6050748 - DNA, 23 bp, Homo sapiens
cccacaatcccacctagcccagg

SEQ ID NO: 6050749 - DNA, 14 bp, Homo sapiens
cccacaatgatgat

SEQ ID NO: 6050750 - DNA, 18 bp, Homo sapiens
cccacaatggctgggagg

SEQ ID NO: 6050751 - DNA, 15 bp, Homo sapiens
cccacaatttcttta

SEQ ID NO: 6050752 - DNA, 18 bp, Homo sapiens
cccacaatttctttaaaa

SEQ ID NO: 6050753 - DNA, 13 bp, Homo sapiens
cccacacacacac

SEQ ID NO: 6050754 - DNA, 14 bp, Homo sapiens
cccacacacacaca

SEQ ID NO: 6050755 - DNA, 20 bp, Homo sapiens
cccacacacacacacatgca

SEQ ID NO: 6050756 - DNA, 13 bp, Homo sapiens
cccacacacactc

SEQ ID NO: 6050757 - DNA, 19 bp, Homo sapiens
cccacacacactccttccc

SEQ ID NO: 6050758 - DNA, 21 bp, Homo sapiens
cccacacacactccttcccct

SEQ ID NO: 6050759 - DNA, 12 bp, Homo sapiens
cccacacacagg

SEQ ID NO: 6050760 - DNA, 15 bp, Homo sapiens
cccacacacaggcct

SEQ ID NO: 6050761 - DNA, 18 bp, Homo sapiens
cccacacacaggccttct

SEQ ID NO: 6050762 - DNA, 21 bp, Homo sapiens
cccacacacaggccttctgtg

SEQ ID NO: 6050763 - DNA, 14 bp, Homo sapiens
cccacacacaggtg

SEQ ID NO: 6050764 - DNA, 13 bp, Homo sapiens
cccacacacccca

SEQ ID NO: 6050765 - DNA, 16 bp, Homo sapiens
cccacacagaggacct

SEQ ID NO: 6050766 - DNA, 21 bp, Homo sapiens
cccacacagctgccctagctg

SEQ ID NO: 6050767 - DNA, 20 bp, Homo sapiens
cccacacaggcctggcccag

SEQ ID NO: 6050768 - DNA, 13 bp, Homo sapiens
cccacacagggca

SEQ ID NO: 6050769 - DNA, 14 bp, Homo sapiens
cccacacagggcac

SEQ ID NO: 6050770 - DNA, 11 bp, Homo sapiens
cccacacatgt

SEQ ID NO: 6050771 - DNA, 16 bp, Homo sapiens
cccacacattccaggg

SEQ ID NO: 6050772 - DNA, 23 bp, Homo sapiens
cccacacattccagggctggggt

SEQ ID NO: 6050773 - DNA, 16 bp, Homo sapiens
cccacaccagccttgg

SEQ ID NO: 6050774 - DNA, 20 bp, Homo sapiens
cccacaccaggccgtcctcc

SEQ ID NO: 6050775 - DNA, 14 bp, Homo sapiens
cccacaccatctgg

SEQ ID NO: 6050776 - DNA, 16 bp, Homo sapiens
cccacacccaaagctg

SEQ ID NO: 6050777 - DNA, 23 bp, Homo sapiens
cccacacccactccacaccagta

SEQ ID NO: 6050778 - DNA, 13 bp, Homo sapiens
cccacaccccagc

SEQ ID NO: 6050779 - DNA, 18 bp, Homo sapiens
cccacaccccgtctgccc

SEQ ID NO: 6050780 - DNA, 20 bp, Homo sapiens
cccacaccccgtctgcccct

SEQ ID NO: 6050781 - DNA, 17 bp, Homo sapiens
cccacacccctccaaag

SEQ ID NO: 6050782 - DNA, 17 bp, Homo sapiens
cccacaccctacagcag

SEQ ID NO: 6050783 - DNA, 22 bp, Homo sapiens
cccacaccctacagcagatcca

SEQ ID NO: 6050784 - DNA, 17 bp, Homo sapiens
cccacaccctggagtgg

SEQ ID NO: 6050785 - DNA, 16 bp, Homo sapiens
cccacaccgctggtcc

SEQ ID NO: 6050786 - DNA, 22 bp, Homo sapiens
cccacaccgtcaggtactcctg

SEQ ID NO: 6050787 - DNA, 17 bp, Homo sapiens
cccacaccgtcttcctt

SEQ ID NO: 6050788 - DNA, 18 bp, Homo sapiens
cccacaccgtcttccttc

SEQ ID NO: 6050789 - DNA, 15 bp, Homo sapiens
cccacaccgtgtaaa

SEQ ID NO: 6050790 - DNA, 22 bp, Homo sapiens
cccacacctcagttcccttggc

SEQ ID NO: 6050791 - DNA, 16 bp, Homo sapiens
cccacacctccctact

SEQ ID NO: 6050792 - DNA, 16 bp, Homo sapiens
cccacacctcctgggg

SEQ ID NO: 6050793 - DNA, 16 bp, Homo sapiens
cccacacctgcctctg

SEQ ID NO: 6050794 - DNA, 16 bp, Homo sapiens
cccacacctggccctg

SEQ ID NO: 6050795 - DNA, 18 bp, Homo sapiens
cccacaccttccagggcc

SEQ ID NO: 6050796 - DNA, 21 bp, Homo sapiens
cccacacgccggggctggccc

SEQ ID NO: 6050797 - DNA, 17 bp, Homo sapiens
cccacacggcagccccc

SEQ ID NO: 6050798 - DNA, 21 bp, Homo sapiens
cccacacgtgctcgcagcctg

SEQ ID NO: 6050799 - DNA, 22 bp, Homo sapiens
cccacactatgcacagagccca

SEQ ID NO: 6050800 - DNA, 21 bp, Homo sapiens
cccacactcagatcctcctca

SEQ ID NO: 6050801 - DNA, 22 bp, Homo sapiens
cccacactcagatcctcctcat

SEQ ID NO: 6050802 - DNA, 13 bp, Homo sapiens
cccacactccact

SEQ ID NO: 6050803 - DNA, 23 bp, Homo sapiens
cccacactcccaaggttggagcc

SEQ ID NO: 6050804 - DNA, 13 bp, Homo sapiens
cccacactcgcca

SEQ ID NO: 6050805 - DNA, 19 bp, Homo sapiens
cccacactgaaaccaaaac

SEQ ID NO: 6050806 - DNA, 16 bp, Homo sapiens
cccacactgccagaag

SEQ ID NO: 6050807 - DNA, 19 bp, Homo sapiens
cccacactgtggccaggcc

SEQ ID NO: 6050808 - DNA, 19 bp, Homo sapiens
cccacacttgttccagctc

SEQ ID NO: 6050809 - DNA, 18 bp, Homo sapiens
cccacactttgaagcaaa

SEQ ID NO: 6050810 - DNA, 23 bp, Homo sapiens
cccacagaaagactgagctcaag

SEQ ID NO: 6050811 - DNA, 19 bp, Homo sapiens
cccacagaaagccaggagc

SEQ ID NO: 6050812 - DNA, 11 bp, Homo sapiens
cccacagaact

SEQ ID NO: 6050813 - DNA, 12 bp, Homo sapiens
cccacagacctg

SEQ ID NO: 6050814 - DNA, 20 bp, Homo sapiens
cccacagactgccccagcca

SEQ ID NO: 6050815 - DNA, 12 bp, Homo sapiens
cccacagagcct

SEQ ID NO: 6050816 - DNA, 17 bp, Homo sapiens
cccacagagcctggctt

SEQ ID NO: 6050817 - DNA, 18 bp, Homo sapiens
cccacagaggacagtgct

SEQ ID NO: 6050818 - DNA, 18 bp, Homo sapiens
cccacagagtgctggact

SEQ ID NO: 6050819 - DNA, 22 bp, Homo sapiens
cccacagatgtctctggggcag

SEQ ID NO: 6050820 - DNA, 15 bp, Homo sapiens
cccacagcacccagg

SEQ ID NO: 6050821 - DNA, 16 bp, Homo sapiens
cccacagcacccaggc

SEQ ID NO: 6050822 - DNA, 17 bp, Homo sapiens
cccacagcacccaggct

SEQ ID NO: 6050823 - DNA, 13 bp, Homo sapiens
cccacagcagggg

SEQ ID NO: 6050824 - DNA, 15 bp, Homo sapiens
cccacagcccccacc

SEQ ID NO: 6050825 - DNA, 16 bp, Homo sapiens
cccacagccctgaaac

SEQ ID NO: 6050826 - DNA, 13 bp, Homo sapiens
cccacagccctgg

SEQ ID NO: 6050827 - DNA, 15 bp, Homo sapiens
cccacagccctggaa

SEQ ID NO: 6050828 - DNA, 19 bp, Homo sapiens
cccacagcgctggccggga

SEQ ID NO: 6050829 - DNA, 18 bp, Homo sapiens
cccacagctacctgagac

SEQ ID NO: 6050830 - DNA, 12 bp, Homo sapiens
cccacagctctg

SEQ ID NO: 6050831 - DNA, 14 bp, Homo sapiens
cccacagctctgct

SEQ ID NO: 6050832 - DNA, 14 bp, Homo sapiens
cccacagctctggg

SEQ ID NO: 6050833 - DNA, 16 bp, Homo sapiens
cccacagctggggccg

SEQ ID NO: 6050834 - DNA, 20 bp, Homo sapiens
cccacaggaagcctgcagtc

SEQ ID NO: 6050835 - DNA, 17 bp, Homo sapiens
cccacaggaagctcagc

SEQ ID NO: 6050836 - DNA, 19 bp, Homo sapiens
cccacaggaagctcagcct

SEQ ID NO: 6050837 - DNA, 19 bp, Homo sapiens
cccacaggagcatgtccta

SEQ ID NO: 6050838 - DNA, 22 bp, Homo sapiens
cccacaggaggcaagcaagctc

SEQ ID NO: 6050839 - DNA, 21 bp, Homo sapiens
cccacaggagggccagcgctg

SEQ ID NO: 6050840 - DNA, 17 bp, Homo sapiens
cccacaggatcagtctg

SEQ ID NO: 6050841 - DNA, 16 bp, Homo sapiens
cccacaggatgaacta

SEQ ID NO: 6050842 - DNA, 22 bp, Homo sapiens
cccacaggatgaactagccatg

SEQ ID NO: 6050843 - DNA, 12 bp, Homo sapiens
cccacaggcagc

SEQ ID NO: 6050844 - DNA, 20 bp, Homo sapiens
cccacaggccacacgctgcc

SEQ ID NO: 6050845 - DNA, 23 bp, Homo sapiens
cccacaggccacacgctgcccag

SEQ ID NO: 6050846 - DNA, 18 bp, Homo sapiens
cccacaggcccttcctct

SEQ ID NO: 6050847 - DNA, 14 bp, Homo sapiens
cccacagggccaga

SEQ ID NO: 6050848 - DNA, 16 bp, Homo sapiens
cccacagggcctgact

SEQ ID NO: 6050849 - DNA, 18 bp, Homo sapiens
cccacaggggggaggcac

SEQ ID NO: 6050850 - DNA, 12 bp, Homo sapiens
cccacaggtgcg

SEQ ID NO: 6050851 - DNA, 22 bp, Homo sapiens
cccacaggtgcgggaccatctg

SEQ ID NO: 6050852 - DNA, 16 bp, Homo sapiens
cccacagtagagcact

SEQ ID NO: 6050853 - DNA, 23 bp, Homo sapiens
cccacagtatattttatttcaat

SEQ ID NO: 6050854 - DNA, 21 bp, Homo sapiens
cccacagtctccggcctctcc

SEQ ID NO: 6050855 - DNA, 23 bp, Homo sapiens
cccacagtgctcagttgtacttt

SEQ ID NO: 6050856 - DNA, 15 bp, Homo sapiens
cccacagtgctgtct

SEQ ID NO: 6050857 - DNA, 11 bp, Homo sapiens
cccacagtttt

SEQ ID NO: 6050858 - DNA, 12 bp, Homo sapiens
cccacagtttta

SEQ ID NO: 6050859 - DNA, 18 bp, Homo sapiens
cccacataaaagccccag

SEQ ID NO: 6050860 - DNA, 17 bp, Homo sapiens
cccacataaacacttct

SEQ ID NO: 6050861 - DNA, 16 bp, Homo sapiens
cccacataagcactag

SEQ ID NO: 6050862 - DNA, 16 bp, Homo sapiens
cccacatatcttacag

SEQ ID NO: 6050863 - DNA, 20 bp, Homo sapiens
cccacatatcttacagccag

SEQ ID NO: 6050864 - DNA, 14 bp, Homo sapiens
cccacatcccactg

SEQ ID NO: 6050865 - DNA, 13 bp, Homo sapiens
cccacatccctgg

SEQ ID NO: 6050866 - DNA, 18 bp, Homo sapiens
cccacatccctgggcctg

SEQ ID NO: 6050867 - DNA, 20 bp, Homo sapiens
cccacatccttctcactgcc

SEQ ID NO: 6050868 - DNA, 20 bp, Homo sapiens
cccacatcgcacactggggc

SEQ ID NO: 6050869 - DNA, 17 bp, Homo sapiens
cccacatcgggctcacc

SEQ ID NO: 6050870 - DNA, 12 bp, Homo sapiens
cccacatgcatg

SEQ ID NO: 6050871 - DNA, 16 bp, Homo sapiens
cccacatgtgacacat

SEQ ID NO: 6050872 - DNA, 19 bp, Homo sapiens
cccacatgtgacacatatg

SEQ ID NO: 6050873 - DNA, 19 bp, Homo sapiens
cccacatgtggccatggcc

SEQ ID NO: 6050874 - DNA, 22 bp, Homo sapiens
cccacatgtggccatggcctct

SEQ ID NO: 6050875 - DNA, 18 bp, Homo sapiens
cccacatgtgtccatccc

SEQ ID NO: 6050876 - DNA, 14 bp, Homo sapiens
cccacattccgaca

SEQ ID NO: 6050877 - DNA, 19 bp, Homo sapiens
cccacattcggaccctgcc

SEQ ID NO: 6050878 - DNA, 16 bp, Homo sapiens
cccacattctatagcc

SEQ ID NO: 6050879 - DNA, 17 bp, Homo sapiens
cccacattctggctcca

SEQ ID NO: 6050880 - DNA, 19 bp, Homo sapiens
cccacattggacttccttg

SEQ ID NO: 6050881 - DNA, 19 bp, Homo sapiens
cccacatttagtctcttta

SEQ ID NO: 6050882 - DNA, 21 bp, Homo sapiens
cccacatttagtctctttatt

SEQ ID NO: 6050883 - DNA, 20 bp, Homo sapiens
cccacatttgggctcagggt

SEQ ID NO: 6050884 - DNA, 12 bp, Homo sapiens
cattttaaacaa

SEQ ID NO: 6050885 - DNA, 13 bp, Homo sapiens
cattttaaacaaa

SEQ ID NO: 6050886 - DNA, 18 bp, Homo sapiens
cattttaaactcctgaaa

SEQ ID NO: 6050887 - DNA, 18 bp, Homo sapiens
cattttaaataaaagaaa

SEQ ID NO: 6050888 - DNA, 18 bp, Homo sapiens
cattttaaatgtctataa

SEQ ID NO: 6050889 - DNA, 23 bp, Homo sapiens
cattttaaattccactgaaaatt

SEQ ID NO: 6050890 - DNA, 13 bp, Homo sapiens
cattttaacaaga

SEQ ID NO: 6050891 - DNA, 14 bp, Homo sapiens
cattttaacaagaa

SEQ ID NO: 6050892 - DNA, 18 bp, Homo sapiens
cattttaacaagaagatg

SEQ ID NO: 6050893 - DNA, 18 bp, Homo sapiens
cattttaacatgatttca

SEQ ID NO: 6050894 - DNA, 18 bp, Homo sapiens
cattttaaccctatttta

SEQ ID NO: 6050895 - DNA, 16 bp, Homo sapiens
cattttaactggcatg

SEQ ID NO: 6050896 - DNA, 20 bp, Homo sapiens
cattttaactggcatgtcat

SEQ ID NO: 6050897 - DNA, 16 bp, Homo sapiens
cattttaactttatca

SEQ ID NO: 6050898 - DNA, 15 bp, Homo sapiens
cattttaagaaaacc

SEQ ID NO: 6050899 - DNA, 17 bp, Homo sapiens
cattttaagcataatta

SEQ ID NO: 6050900 - DNA, 18 bp, Homo sapiens
cattttaagcataattaa

SEQ ID NO: 6050901 - DNA, 14 bp, Homo sapiens
cattttaagtgctt

SEQ ID NO: 6050902 - DNA, 20 bp, Homo sapiens
cattttaagtgcttcacatt

SEQ ID NO: 6050903 - DNA, 12 bp, Homo sapiens
cattttaataaa

SEQ ID NO: 6050904 - DNA, 13 bp, Homo sapiens
cattttaatacag

SEQ ID NO: 6050905 - DNA, 23 bp, Homo sapiens
cattttaatacagattgaaagga

SEQ ID NO: 6050906 - DNA, 13 bp, Homo sapiens
cattttaatatat

SEQ ID NO: 6050907 - DNA, 23 bp, Homo sapiens
cattttaatatataatttaatgt

SEQ ID NO: 6050908 - DNA, 17 bp, Homo sapiens
cattttaattattattc

SEQ ID NO: 6050909 - DNA, 16 bp, Homo sapiens
cattttaattctctcc

SEQ ID NO: 6050910 - DNA, 23 bp, Homo sapiens
cattttaatttattaattgcttt

SEQ ID NO: 6050911 - DNA, 16 bp, Homo sapiens
cattttacacagcacc

SEQ ID NO: 6050912 - DNA, 12 bp, Homo sapiens
cattttacacat

SEQ ID NO: 6050913 - DNA, 18 bp, Homo sapiens
cattttacacattgacaa

SEQ ID NO: 6050914 - DNA, 18 bp, Homo sapiens
cattttacacttgcttta

SEQ ID NO: 6050915 - DNA, 20 bp, Homo sapiens
cattttacagtatcttcaaa

SEQ ID NO: 6050916 - DNA, 13 bp, Homo sapiens
cattttacagtga

SEQ ID NO: 6050917 - DNA, 20 bp, Homo sapiens
cattttacagtgaccttttc

SEQ ID NO: 6050918 - DNA, 15 bp, Homo sapiens
cattttacattctgt

SEQ ID NO: 6050919 - DNA, 23 bp, Homo sapiens
cattttacccttgcagttttact

SEQ ID NO: 6050920 - DNA, 14 bp, Homo sapiens
cattttacgctaga

SEQ ID NO: 6050921 - DNA, 18 bp, Homo sapiens
cattttacgctagattaa

SEQ ID NO: 6050922 - DNA, 21 bp, Homo sapiens
cattttactactgagggaaat

SEQ ID NO: 6050923 - DNA, 16 bp, Homo sapiens
cattttactacttgtt

SEQ ID NO: 6050924 - DNA, 15 bp, Homo sapiens
cattttactatttgc

SEQ ID NO: 6050925 - DNA, 20 bp, Homo sapiens
cattttactcagaatagctg

SEQ ID NO: 6050926 - DNA, 16 bp, Homo sapiens
cattttactgtacaga

SEQ ID NO: 6050927 - DNA, 16 bp, Homo sapiens
cattttactgtatatt

SEQ ID NO: 6050928 - DNA, 17 bp, Homo sapiens
cattttactgtctgtaa

SEQ ID NO: 6050929 - DNA, 16 bp, Homo sapiens
cattttactgttgtac

SEQ ID NO: 6050930 - DNA, 23 bp, Homo sapiens
cattttactgttgtacaatcatg

SEQ ID NO: 6050931 - DNA, 20 bp, Homo sapiens
cattttactttttcctggct

SEQ ID NO: 6050932 - DNA, 17 bp, Homo sapiens
cattttagaaactacaa

SEQ ID NO: 6050933 - DNA, 23 bp, Homo sapiens
cattttagaaactacaaatatag

SEQ ID NO: 6050934 - DNA, 16 bp, Homo sapiens
cattttagacactggg

SEQ ID NO: 6050935 - DNA, 15 bp, Homo sapiens
cattttagacagtaa

SEQ ID NO: 6050936 - DNA, 19 bp, Homo sapiens
cattttagattaagctttt

SEQ ID NO: 6050937 - DNA, 16 bp, Homo sapiens
cattttagctaattta

SEQ ID NO: 6050938 - DNA, 16 bp, Homo sapiens
cattttaggaataata

SEQ ID NO: 6050939 - DNA, 18 bp, Homo sapiens
cattttaggaataataaa

SEQ ID NO: 6050940 - DNA, 23 bp, Homo sapiens
cattttaggatctcgcctggaaa

SEQ ID NO: 6050941 - DNA, 14 bp, Homo sapiens
cattttaggcctcc

SEQ ID NO: 6050942 - DNA, 21 bp, Homo sapiens
cattttaggggtgttgacaca

SEQ ID NO: 6050943 - DNA, 17 bp, Homo sapiens
cattttagtcacttttt

SEQ ID NO: 6050944 - DNA, 14 bp, Homo sapiens
cattttagtgactg

SEQ ID NO: 6050945 - DNA, 16 bp, Homo sapiens
cattttagtgactgta

SEQ ID NO: 6050946 - DNA, 22 bp, Homo sapiens
cattttataaagtgcttgtgta

SEQ ID NO: 6050947 - DNA, 23 bp, Homo sapiens
cattttataaagtgcttgtgtaa

SEQ ID NO: 6050948 - DNA, 21 bp, Homo sapiens
cattttataaatcgcttttga

SEQ ID NO: 6050949 - DNA, 23 bp, Homo sapiens
cattttataaatcgcttttgata

SEQ ID NO: 6050950 - DNA, 22 bp, Homo sapiens
cattttataatgatgaacttat

SEQ ID NO: 6050951 - DNA, 12 bp, Homo sapiens
cattttatacaa

SEQ ID NO: 6050952 - DNA, 19 bp, Homo sapiens
cattttatacaagaaggga

SEQ ID NO: 6050953 - DNA, 14 bp, Homo sapiens
cattttatactgta

SEQ ID NO: 6050954 - DNA, 15 bp, Homo sapiens
cattttatagaatgt

SEQ ID NO: 6050955 - DNA, 20 bp, Homo sapiens
cattttatataaagaaaatc

SEQ ID NO: 6050956 - DNA, 16 bp, Homo sapiens
cattttatatgtcaaa

SEQ ID NO: 6050957 - DNA, 16 bp, Homo sapiens
cattttatattgaaaa

SEQ ID NO: 6050958 - DNA, 18 bp, Homo sapiens
cattttatattgaaaaaa

SEQ ID NO: 6050959 - DNA, 22 bp, Homo sapiens
cattttatattgaaaaaaataa

SEQ ID NO: 6050960 - DNA, 19 bp, Homo sapiens
cattttatatttttgtaca

SEQ ID NO: 6050961 - DNA, 22 bp, Homo sapiens
cattttatatttttgtacatat

SEQ ID NO: 6050962 - DNA, 15 bp, Homo sapiens
cattttatcagacaa

SEQ ID NO: 6050963 - DNA, 15 bp, Homo sapiens
cattttatcattaat

SEQ ID NO: 6050964 - DNA, 20 bp, Homo sapiens
cattttatgaatatcattga

SEQ ID NO: 6050965 - DNA, 12 bp, Homo sapiens
cattttatggtg

SEQ ID NO: 6050966 - DNA, 13 bp, Homo sapiens
cattttatgtctt

SEQ ID NO: 6050967 - DNA, 14 bp, Homo sapiens
cattttattaaaca

SEQ ID NO: 6050968 - DNA, 16 bp, Homo sapiens
cattttattaaactta

SEQ ID NO: 6050969 - DNA, 21 bp, Homo sapiens
cattttattaagctttttgga

SEQ ID NO: 6050970 - DNA, 22 bp, Homo sapiens
cattttattaataatatttatg

SEQ ID NO: 6050971 - DNA, 11 bp, Homo sapiens
cattttattac

SEQ ID NO: 6050972 - DNA, 18 bp, Homo sapiens
cattttattactgtaata

SEQ ID NO: 6050973 - DNA, 14 bp, Homo sapiens
cattttattgactg

SEQ ID NO: 6050974 - DNA, 14 bp, Homo sapiens
cattttattgcttg

SEQ ID NO: 6050975 - DNA, 21 bp, Homo sapiens
cattttatttacagctgtgct

SEQ ID NO: 6050976 - DNA, 22 bp, Homo sapiens
cattttatttacagctgtgctc

SEQ ID NO: 6050977 - DNA, 21 bp, Homo sapiens
cattttatttattagctgtaa

SEQ ID NO: 6050978 - DNA, 22 bp, Homo sapiens
cattttattttattatgcatga

SEQ ID NO: 6050979 - DNA, 15 bp, Homo sapiens
cattttattttcatg

SEQ ID NO: 6050980 - DNA, 15 bp, Homo sapiens
cattttattttgtaa

SEQ ID NO: 6050981 - DNA, 17 bp, Homo sapiens
cattttattttgtaata

SEQ ID NO: 6050982 - DNA, 19 bp, Homo sapiens
cattttattttttcttgca

SEQ ID NO: 6050983 - DNA, 19 bp, Homo sapiens
cattttattttttgggcca

SEQ ID NO: 6050984 - DNA, 22 bp, Homo sapiens
cattttcaacattgatttttga

SEQ ID NO: 6050985 - DNA, 15 bp, Homo sapiens
cattttcaactgctt

SEQ ID NO: 6050986 - DNA, 17 bp, Homo sapiens
cattttcaactgctttg

SEQ ID NO: 6050987 - DNA, 13 bp, Homo sapiens
cattttcaataat

SEQ ID NO: 6050988 - DNA, 12 bp, Homo sapiens
cattttcacctc

SEQ ID NO: 6050989 - DNA, 19 bp, Homo sapiens
cattttcagactgctttaa

SEQ ID NO: 6050990 - DNA, 13 bp, Homo sapiens
cattttcagagtg

SEQ ID NO: 6050991 - DNA, 18 bp, Homo sapiens
cattttcagatccttcca

SEQ ID NO: 6050992 - DNA, 20 bp, Homo sapiens
cattttcagcatcaaacatg

SEQ ID NO: 6050993 - DNA, 22 bp, Homo sapiens
cattttcagcatcaaacatgaa

SEQ ID NO: 6050994 - DNA, 17 bp, Homo sapiens
cattttcagtaccaaag

SEQ ID NO: 6050995 - DNA, 18 bp, Homo sapiens
cattttcagtaccaaaga

SEQ ID NO: 6050996 - DNA, 20 bp, Homo sapiens
cattttcagtcgttgtgctt

SEQ ID NO: 6050997 - DNA, 13 bp, Homo sapiens
cattttcatcctg

SEQ ID NO: 6050998 - DNA, 15 bp, Homo sapiens
cattttcattagcaa

SEQ ID NO: 6050999 - DNA, 17 bp, Homo sapiens
cattttcattagcaaaa

SEQ ID NO: 6051000 - DNA, 13 bp, Homo sapiens
cattttccaatta

SEQ ID NO: 6051001 - DNA, 19 bp, Homo sapiens
cattttccatatcctggtg

SEQ ID NO: 6051002 - DNA, 18 bp, Homo sapiens
cattttccatatttggat

SEQ ID NO: 6051003 - DNA, 16 bp, Homo sapiens
cattttcccatcatcc

SEQ ID NO: 6051004 - DNA, 19 bp, Homo sapiens
cattttcccatcatccttt

SEQ ID NO: 6051005 - DNA, 20 bp, Homo sapiens
cattttccccccactctccc

SEQ ID NO: 6051006 - DNA, 16 bp, Homo sapiens
cattttccccttcctc

SEQ ID NO: 6051007 - DNA, 15 bp, Homo sapiens
cattttcctcctctg

SEQ ID NO: 6051008 - DNA, 19 bp, Homo sapiens
cattttcctcctctgccta

SEQ ID NO: 6051009 - DNA, 17 bp, Homo sapiens
cattttcctctgctttg

SEQ ID NO: 6051010 - DNA, 22 bp, Homo sapiens
cattttcctcttgtcctggccc

SEQ ID NO: 6051011 - DNA, 16 bp, Homo sapiens
cattttcctgtttact

SEQ ID NO: 6051012 - DNA, 17 bp, Homo sapiens
cattttctaaactgttt

SEQ ID NO: 6051013 - DNA, 13 bp, Homo sapiens
cattttctaaata

SEQ ID NO: 6051014 - DNA, 23 bp, Homo sapiens
cattttctaagaaacatttatat

SEQ ID NO: 6051015 - DNA, 19 bp, Homo sapiens
cattttctacgtcatgtat

SEQ ID NO: 6051016 - DNA, 13 bp, Homo sapiens
cattttctagata

SEQ ID NO: 6051017 - DNA, 18 bp, Homo sapiens
cattttctataacagata

SEQ ID NO: 6051018 - DNA, 15 bp, Homo sapiens
cattttctcagtgtg

SEQ ID NO: 6051019 - DNA, 12 bp, Homo sapiens
cattttctccct

SEQ ID NO: 6051020 - DNA, 17 bp, Homo sapiens
cattttctccctggatt

SEQ ID NO: 6051021 - DNA, 14 bp, Homo sapiens
cattttctctagct

SEQ ID NO: 6051022 - DNA, 15 bp, Homo sapiens
cattttctctgtatg

SEQ ID NO: 6051023 - DNA, 15 bp, Homo sapiens
cattttctgaaacta

SEQ ID NO: 6051024 - DNA, 20 bp, Homo sapiens
cattttctgaaactaatgaa

SEQ ID NO: 6051025 - DNA, 17 bp, Homo sapiens
cattttctgacatgcat

SEQ ID NO: 6051026 - DNA, 19 bp, Homo sapiens
cattttctgatgcccaccg

SEQ ID NO: 6051027 - DNA, 12 bp, Homo sapiens
cattttctgcaa

SEQ ID NO: 6051028 - DNA, 14 bp, Homo sapiens
cattttctgcaagc

SEQ ID NO: 6051029 - DNA, 16 bp, Homo sapiens
cattttctgcatctcc

SEQ ID NO: 6051030 - DNA, 23 bp, Homo sapiens
cattttctggccagtgtttaaaa

SEQ ID NO: 6051031 - DNA, 19 bp, Homo sapiens
cattttctgtaattgctgc

SEQ ID NO: 6051032 - DNA, 12 bp, Homo sapiens
cattttctgtgg

SEQ ID NO: 6051033 - DNA, 20 bp, Homo sapiens
cattttcttattgcgctgct

SEQ ID NO: 6051034 - DNA, 15 bp, Homo sapiens
cattttcttcagaat

SEQ ID NO: 6051035 - DNA, 22 bp, Homo sapiens
cattttcttcagaattatccat

SEQ ID NO: 6051036 - DNA, 18 bp, Homo sapiens
cattttcttctctgtgaa

SEQ ID NO: 6051037 - DNA, 20 bp, Homo sapiens
cattttcttgtatgatagtg

SEQ ID NO: 6051038 - DNA, 13 bp, Homo sapiens
cattttctttaca

SEQ ID NO: 6051039 - DNA, 22 bp, Homo sapiens
cattttctttaggacataaaga

SEQ ID NO: 6051040 - DNA, 13 bp, Homo sapiens
cattttctttcat

SEQ ID NO: 6051041 - DNA, 14 bp, Homo sapiens
cattttctttcata

SEQ ID NO: 6051042 - DNA, 16 bp, Homo sapiens
cattttcttttattat

SEQ ID NO: 6051043 - DNA, 17 bp, Homo sapiens
cattttcttttttaacc

SEQ ID NO: 6051044 - DNA, 21 bp, Homo sapiens
cattttctttttttaactggt

SEQ ID NO: 6051045 - DNA, 11 bp, Homo sapiens
cattttgaaaa

SEQ ID NO: 6051046 - DNA, 18 bp, Homo sapiens
cattttgaaaacccctgg

SEQ ID NO: 6051047 - DNA, 21 bp, Homo sapiens
cattttgaaaacccctggctg

SEQ ID NO: 6051048 - DNA, 16 bp, Homo sapiens
cattttgaaaagtatt

SEQ ID NO: 6051049 - DNA, 22 bp, Homo sapiens
cattttgaaaatatgtactgta

SEQ ID NO: 6051050 - DNA, 15 bp, Homo sapiens
cattttgaaatattc

SEQ ID NO: 6051051 - DNA, 17 bp, Homo sapiens
cattttgaagctaatta

SEQ ID NO: 6051052 - DNA, 12 bp, Homo sapiens
cattttgaagtg

SEQ ID NO: 6051053 - DNA, 12 bp, Homo sapiens
cattttgaatgt

SEQ ID NO: 6051054 - DNA, 14 bp, Homo sapiens
cattttgaatgtga

SEQ ID NO: 6051055 - DNA, 20 bp, Homo sapiens
cattttgaatgtgatcatct

SEQ ID NO: 6051056 - DNA, 21 bp, Homo sapiens
cattttgacaactgaaagaaa

SEQ ID NO: 6051057 - DNA, 14 bp, Homo sapiens
cattttgacctact

SEQ ID NO: 6051058 - DNA, 16 bp, Homo sapiens
cattttgactggcttg

SEQ ID NO: 6051059 - DNA, 15 bp, Homo sapiens
cattttgagaacatt

SEQ ID NO: 6051060 - DNA, 22 bp, Homo sapiens
cattttgagctgaaatgctgca

SEQ ID NO: 6051061 - DNA, 17 bp, Homo sapiens
cattttgagtgactcga

SEQ ID NO: 6051062 - DNA, 14 bp, Homo sapiens
cattttgcaaaatt

SEQ ID NO: 6051063 - DNA, 17 bp, Homo sapiens
cattttgcaaaatttcc

SEQ ID NO: 6051064 - DNA, 22 bp, Homo sapiens
cccacattttagaataccccac

SEQ ID NO: 6051065 - DNA, 18 bp, Homo sapiens
cccaccaaatcatcctga

SEQ ID NO: 6051066 - DNA, 17 bp, Homo sapiens
cccaccaaatgcctctg

SEQ ID NO: 6051067 - DNA, 16 bp, Homo sapiens
cccaccaaccctcagg

SEQ ID NO: 6051068 - DNA, 17 bp, Homo sapiens
cccaccaaccctcaggg

SEQ ID NO: 6051069 - DNA, 16 bp, Homo sapiens
cccaccaacctccagt

SEQ ID NO: 6051070 - DNA, 17 bp, Homo sapiens
cccaccaactctctctg

SEQ ID NO: 6051071 - DNA, 19 bp, Homo sapiens
cccaccaactctctctgcc

SEQ ID NO: 6051072 - DNA, 20 bp, Homo sapiens
cccaccaactctctctgccc

SEQ ID NO: 6051073 - DNA, 14 bp, Homo sapiens
cccaccaactctgc

SEQ ID NO: 6051074 - DNA, 15 bp, Homo sapiens
cccaccaactctgca

SEQ ID NO: 6051075 - DNA, 18 bp, Homo sapiens
cccaccaactctgcactc

SEQ ID NO: 6051076 - DNA, 22 bp, Homo sapiens
cccaccaaggtctcacactcct

SEQ ID NO: 6051077 - DNA, 16 bp, Homo sapiens
cccaccaatctgccct

SEQ ID NO: 6051078 - DNA, 21 bp, Homo sapiens
cccaccacaactaacaatgcc

SEQ ID NO: 6051079 - DNA, 19 bp, Homo sapiens
cccaccacacacacccttc

SEQ ID NO: 6051080 - DNA, 16 bp, Homo sapiens
cccaccacacatccca

SEQ ID NO: 6051081 - DNA, 18 bp, Homo sapiens
cccaccacacatcccagc

SEQ ID NO: 6051082 - DNA, 22 bp, Homo sapiens
cccaccacacatcccagcccaa

SEQ ID NO: 6051083 - DNA, 16 bp, Homo sapiens
cccaccaccacgcctg

SEQ ID NO: 6051084 - DNA, 13 bp, Homo sapiens
cccaccaccctcc

SEQ ID NO: 6051085 - DNA, 23 bp, Homo sapiens
cccaccaccctcccaccatgcgc

SEQ ID NO: 6051086 - DNA, 12 bp, Homo sapiens
cccaccaccctg

SEQ ID NO: 6051087 - DNA, 21 bp, Homo sapiens
cccaccaccctttgctgactc

SEQ ID NO: 6051088 - DNA, 13 bp, Homo sapiens
cccaccacctagg

SEQ ID NO: 6051089 - DNA, 16 bp, Homo sapiens
cccaccacctaggcca

SEQ ID NO: 6051090 - DNA, 21 bp, Homo sapiens
cccaccacctaggccactcct

SEQ ID NO: 6051091 - DNA, 20 bp, Homo sapiens
cccaccaccttggactcctc

SEQ ID NO: 6051092 - DNA, 23 bp, Homo sapiens
cccaccaccttggactcctccca

SEQ ID NO: 6051093 - DNA, 20 bp, Homo sapiens
cccaccacgcatgctcagtg

SEQ ID NO: 6051094 - DNA, 23 bp, Homo sapiens
cccaccacgtctggctccctgcc

SEQ ID NO: 6051095 - DNA, 13 bp, Homo sapiens
cccaccactcccc

SEQ ID NO: 6051096 - DNA, 17 bp, Homo sapiens
cccaccactctcaggac

SEQ ID NO: 6051097 - DNA, 16 bp, Homo sapiens
cccaccactgatatca

SEQ ID NO: 6051098 - DNA, 15 bp, Homo sapiens
cccaccactggaagc

SEQ ID NO: 6051099 - DNA, 22 bp, Homo sapiens
cccaccagaacgcaccccactg

SEQ ID NO: 6051100 - DNA, 17 bp, Homo sapiens
cccaccagacatcaccc

SEQ ID NO: 6051101 - DNA, 15 bp, Homo sapiens
cccaccagagccggg

SEQ ID NO: 6051102 - DNA, 18 bp, Homo sapiens
cccaccagagcctccctc

SEQ ID NO: 6051103 - DNA, 13 bp, Homo sapiens
cccaccagagctg

SEQ ID NO: 6051104 - DNA, 18 bp, Homo sapiens
cccaccagagctgcctcc

SEQ ID NO: 6051105 - DNA, 21 bp, Homo sapiens
cccaccagcatgtcactccca

SEQ ID NO: 6051106 - DNA, 23 bp, Homo sapiens
cccaccagcatgtcactcccaga

SEQ ID NO: 6051107 - DNA, 15 bp, Homo sapiens
cccaccagccacctc

SEQ ID NO: 6051108 - DNA, 14 bp, Homo sapiens
cccaccagccagcc

SEQ ID NO: 6051109 - DNA, 21 bp, Homo sapiens
cccaccagccagccctggccc

SEQ ID NO: 6051110 - DNA, 14 bp, Homo sapiens
cccaccagcccaca

SEQ ID NO: 6051111 - DNA, 13 bp, Homo sapiens
cccaccagccccg

SEQ ID NO: 6051112 - DNA, 14 bp, Homo sapiens
cccaccagcggcct

SEQ ID NO: 6051113 - DNA, 16 bp, Homo sapiens
cccaccagctccacac

SEQ ID NO: 6051114 - DNA, 13 bp, Homo sapiens
cccaccagctgca

SEQ ID NO: 6051115 - DNA, 12 bp, Homo sapiens
cccaccagctgg

SEQ ID NO: 6051116 - DNA, 14 bp, Homo sapiens
cccaccagctggct

SEQ ID NO: 6051117 - DNA, 22 bp, Homo sapiens
cccaccagctggctctgcagca

SEQ ID NO: 6051118 - DNA, 16 bp, Homo sapiens
cccaccagctttattt

SEQ ID NO: 6051119 - DNA, 23 bp, Homo sapiens
cccaccaggaatgccgtttcctt

SEQ ID NO: 6051120 - DNA, 13 bp, Homo sapiens
cccaccaggagca

SEQ ID NO: 6051121 - DNA, 22 bp, Homo sapiens
cccaccaggagcacctggaccc

SEQ ID NO: 6051122 - DNA, 16 bp, Homo sapiens
cccaccaggctgctca

SEQ ID NO: 6051123 - DNA, 14 bp, Homo sapiens
cccaccagggctca

SEQ ID NO: 6051124 - DNA, 13 bp, Homo sapiens
cccaccaggtgtc

SEQ ID NO: 6051125 - DNA, 19 bp, Homo sapiens
cccaccagtctcacccact

SEQ ID NO: 6051126 - DNA, 14 bp, Homo sapiens
cccaccagtgcctc

SEQ ID NO: 6051127 - DNA, 16 bp, Homo sapiens
cccaccagtgcctctc

SEQ ID NO: 6051128 - DNA, 18 bp, Homo sapiens
cccaccatcatgtctggc

SEQ ID NO: 6051129 - DNA, 14 bp, Homo sapiens
cccaccatccttcc

SEQ ID NO: 6051130 - DNA, 16 bp, Homo sapiens
cccaccatccttccat

SEQ ID NO: 6051131 - DNA, 19 bp, Homo sapiens
cccaccatgcgctgctcaa

SEQ ID NO: 6051132 - DNA, 12 bp, Homo sapiens
cccaccattcca

SEQ ID NO: 6051133 - DNA, 14 bp, Homo sapiens
cccaccattccaca

SEQ ID NO: 6051134 - DNA, 13 bp, Homo sapiens
cccaccatttatg

SEQ ID NO: 6051135 - DNA, 22 bp, Homo sapiens
cccaccatttctgggggccgca

SEQ ID NO: 6051136 - DNA, 20 bp, Homo sapiens
cccaccatttggcatccctg

SEQ ID NO: 6051137 - DNA, 21 bp, Homo sapiens
cccacccaaaagtcacccagg

SEQ ID NO: 6051138 - DNA, 17 bp, Homo sapiens
cccacccaagcccaaac

SEQ ID NO: 6051139 - DNA, 18 bp, Homo sapiens
cccacccaagcttggcag

SEQ ID NO: 6051140 - DNA, 12 bp, Homo sapiens
cccacccaagga

SEQ ID NO: 6051141 - DNA, 22 bp, Homo sapiens
cccacccacaatcctattctcg

SEQ ID NO: 6051142 - DNA, 18 bp, Homo sapiens
cccacccacacagctgcc

SEQ ID NO: 6051143 - DNA, 13 bp, Homo sapiens
cccacccacccca

SEQ ID NO: 6051144 - DNA, 15 bp, Homo sapiens
cccacccacccccag

SEQ ID NO: 6051145 - DNA, 14 bp, Homo sapiens
cccacccacctcca

SEQ ID NO: 6051146 - DNA, 14 bp, Homo sapiens
cccacccacctttg

SEQ ID NO: 6051147 - DNA, 20 bp, Homo sapiens
cccacccacgcatacacaca

SEQ ID NO: 6051148 - DNA, 23 bp, Homo sapiens
cccacccagatgcccctttctgg

SEQ ID NO: 6051149 - DNA, 12 bp, Homo sapiens
cccacccagcag

SEQ ID NO: 6051150 - DNA, 21 bp, Homo sapiens
cccacccagcagcgcccgagg

SEQ ID NO: 6051151 - DNA, 18 bp, Homo sapiens
cccacccagctccaggcc

SEQ ID NO: 6051152 - DNA, 13 bp, Homo sapiens
cccacccagctgg

SEQ ID NO: 6051153 - DNA, 13 bp, Homo sapiens
cccacccaggagg

SEQ ID NO: 6051154 - DNA, 13 bp, Homo sapiens
cccacccaggcca

SEQ ID NO: 6051155 - DNA, 12 bp, Homo sapiens
cccacccagtcc

SEQ ID NO: 6051156 - DNA, 23 bp, Homo sapiens
cccacccagtccatgctccaggg

SEQ ID NO: 6051157 - DNA, 16 bp, Homo sapiens
cccacccagtctctgc

SEQ ID NO: 6051158 - DNA, 20 bp, Homo sapiens
cccacccatcttcctgctgc

SEQ ID NO: 6051159 - DNA, 22 bp, Homo sapiens
cccacccatcttcctgctgctg

SEQ ID NO: 6051160 - DNA, 23 bp, Homo sapiens
cccacccatgcacgcaccccgcc

SEQ ID NO: 6051161 - DNA, 18 bp, Homo sapiens
cccacccatgccagcgca

SEQ ID NO: 6051162 - DNA, 13 bp, Homo sapiens
cccacccatgcgc

SEQ ID NO: 6051163 - DNA, 19 bp, Homo sapiens
cccaccccaacctgctctc

SEQ ID NO: 6051164 - DNA, 13 bp, Homo sapiens
cccaccccaactc

SEQ ID NO: 6051165 - DNA, 17 bp, Homo sapiens
cccaccccaactctccc

SEQ ID NO: 6051166 - DNA, 23 bp, Homo sapiens
cccaccccaactctccccagtgc

SEQ ID NO: 6051167 - DNA, 13 bp, Homo sapiens
cccaccccacact

SEQ ID NO: 6051168 - DNA, 17 bp, Homo sapiens
cccaccccacctcttgt

SEQ ID NO: 6051169 - DNA, 15 bp, Homo sapiens
cccaccccacctgca

SEQ ID NO: 6051170 - DNA, 16 bp, Homo sapiens
cccaccccacctgcag

SEQ ID NO: 6051171 - DNA, 23 bp, Homo sapiens
cccaccccactcaggggacccca

SEQ ID NO: 6051172 - DNA, 13 bp, Homo sapiens
cccaccccactcc

SEQ ID NO: 6051173 - DNA, 19 bp, Homo sapiens
cccaccccactccagccct

SEQ ID NO: 6051174 - DNA, 23 bp, Homo sapiens
cccaccccagaaatcactgtgaa

SEQ ID NO: 6051175 - DNA, 15 bp, Homo sapiens
cccaccccagagttg

SEQ ID NO: 6051176 - DNA, 12 bp, Homo sapiens
cccaccccagca

SEQ ID NO: 6051177 - DNA, 22 bp, Homo sapiens
cccaccccagcacagccacctc

SEQ ID NO: 6051178 - DNA, 19 bp, Homo sapiens
cccaccccagcacagctcc

SEQ ID NO: 6051179 - DNA, 14 bp, Homo sapiens
cccaccccagccta

SEQ ID NO: 6051180 - DNA, 14 bp, Homo sapiens
cccaccccagcctc

SEQ ID NO: 6051181 - DNA, 13 bp, Homo sapiens
cccaccccaggct

SEQ ID NO: 6051182 - DNA, 15 bp, Homo sapiens
cccaccccaggctgg

SEQ ID NO: 6051183 - DNA, 19 bp, Homo sapiens
cccaccccaggctgggctg

SEQ ID NO: 6051184 - DNA, 22 bp, Homo sapiens
cccaccccataagccctgagac

SEQ ID NO: 6051185 - DNA, 18 bp, Homo sapiens
cccaccccatccagccag

SEQ ID NO: 6051186 - DNA, 13 bp, Homo sapiens
cccaccccatgga

SEQ ID NO: 6051187 - DNA, 14 bp, Homo sapiens
cccaccccatgggc

SEQ ID NO: 6051188 - DNA, 17 bp, Homo sapiens
cccaccccattcccgca

SEQ ID NO: 6051189 - DNA, 20 bp, Homo sapiens
cccacccccaaagacctgcc

SEQ ID NO: 6051190 - DNA, 24 bp, Homo sapiens
cccacccccaaagacctgcctgtg

SEQ ID NO: 6051191 - DNA, 13 bp, Homo sapiens
cccacccccaagg

SEQ ID NO: 6051192 - DNA, 13 bp, Homo sapiens
cccacccccaccc

SEQ ID NO: 6051193 - DNA, 13 bp, Homo sapiens
cccacccccagtg

SEQ ID NO: 6051194 - DNA, 15 bp, Homo sapiens
cccaccccccagcct

SEQ ID NO: 6051195 - DNA, 14 bp, Homo sapiens
cccacccccctcat

SEQ ID NO: 6051196 - DNA, 14 bp, Homo sapiens
cccacccccctcct

SEQ ID NO: 6051197 - DNA, 18 bp, Homo sapiens
cccacccccctcctcccc

SEQ ID NO: 6051198 - DNA, 21 bp, Homo sapiens
cccacccccgggatcctgccc

SEQ ID NO: 6051199 - DNA, 14 bp, Homo sapiens
cccacccccgggtg

SEQ ID NO: 6051200 - DNA, 18 bp, Homo sapiens
cccacccccgggtgcctg

SEQ ID NO: 6051201 - DNA, 14 bp, Homo sapiens
cccacccccgtcac

SEQ ID NO: 6051202 - DNA, 17 bp, Homo sapiens
cccaccccctccccagg

SEQ ID NO: 6051203 - DNA, 15 bp, Homo sapiens
cccaccccctctgga

SEQ ID NO: 6051204 - DNA, 13 bp, Homo sapiens
cccaccccctgcc

SEQ ID NO: 6051205 - DNA, 17 bp, Homo sapiens
cccaccccctgccctgc

SEQ ID NO: 6051206 - DNA, 19 bp, Homo sapiens
cccaccccctgccctgcac

SEQ ID NO: 6051207 - DNA, 16 bp, Homo sapiens
cccaccccctgctggt

SEQ ID NO: 6051208 - DNA, 16 bp, Homo sapiens
cccacccccttctctg

SEQ ID NO: 6051209 - DNA, 19 bp, Homo sapiens
cccacccccttctctgctc

SEQ ID NO: 6051210 - DNA, 18 bp, Homo sapiens
cccaccccgcctctgggc

SEQ ID NO: 6051211 - DNA, 16 bp, Homo sapiens
cccaccccgctctgca

SEQ ID NO: 6051212 - DNA, 16 bp, Homo sapiens
cccaccccgctgcctg

SEQ ID NO: 6051213 - DNA, 17 bp, Homo sapiens
cccaccccggggaccct

SEQ ID NO: 6051214 - DNA, 20 bp, Homo sapiens
cccaccccggggaccctgtg

SEQ ID NO: 6051215 - DNA, 16 bp, Homo sapiens
cccacccctaagtgcc

SEQ ID NO: 6051216 - DNA, 17 bp, Homo sapiens
cccacccctaagtgccc

SEQ ID NO: 6051217 - DNA, 19 bp, Homo sapiens
cccacccctacagcctgca

SEQ ID NO: 6051218 - DNA, 14 bp, Homo sapiens
cccacccctcactc

SEQ ID NO: 6051219 - DNA, 15 bp, Homo sapiens
cccacccctcactcc

SEQ ID NO: 6051220 - DNA, 16 bp, Homo sapiens
cccacccctcactccc

SEQ ID NO: 6051221 - DNA, 13 bp, Homo sapiens
cccacccctccat

SEQ ID NO: 6051222 - DNA, 15 bp, Homo sapiens
cccacccctccccac

SEQ ID NO: 6051223 - DNA, 22 bp, Homo sapiens
cccacccctcttcccccttccc

SEQ ID NO: 6051224 - DNA, 14 bp, Homo sapiens
cccacccctgccca

SEQ ID NO: 6051225 - DNA, 11 bp, Homo sapiens
cccacccctgg

SEQ ID NO: 6051226 - DNA, 15 bp, Homo sapiens
cccacccctggaaga

SEQ ID NO: 6051227 - DNA, 12 bp, Homo sapiens
cccacccctggg

SEQ ID NO: 6051228 - DNA, 20 bp, Homo sapiens
cccaccccttggaggagaga

SEQ ID NO: 6051229 - DNA, 23 bp, Homo sapiens
cccaccccttggaggagagagac

SEQ ID NO: 6051230 - DNA, 14 bp, Homo sapiens
cccacccgacttct

SEQ ID NO: 6051231 - DNA, 16 bp, Homo sapiens
cccacccgagtacctc

SEQ ID NO: 6051232 - DNA, 15 bp, Homo sapiens
cccacccgccccaga

SEQ ID NO: 6051233 - DNA, 17 bp, Homo sapiens
cccacccgccccagaga

SEQ ID NO: 6051234 - DNA, 23 bp, Homo sapiens
cccacccgccccagagactgccc

SEQ ID NO: 6051235 - DNA, 15 bp, Homo sapiens
cccacccgcccgagg

SEQ ID NO: 6051236 - DNA, 15 bp, Homo sapiens
cccacccggacaggt

SEQ ID NO: 6051237 - DNA, 17 bp, Homo sapiens
cccacccggccacagct

SEQ ID NO: 6051238 - DNA, 20 bp, Homo sapiens
cccacccggccacagctgct

SEQ ID NO: 6051239 - DNA, 15 bp, Homo sapiens
cccacccggcccggc

SEQ ID NO: 6051240 - DNA, 22 bp, Homo sapiens
cccacccggtggttcttcctgt

SEQ ID NO: 6051241 - DNA, 20 bp, Homo sapiens
cccacccgtgttctcctcca

SEQ ID NO: 6051242 - DNA, 17 bp, Homo sapiens
cccacccgttaatttaa

SEQ ID NO: 6051243 - DNA, 22 bp, Homo sapiens
cccaccctaatttgcccttcag

SEQ ID NO: 6051244 - DNA, 18 bp, Homo sapiens
cccaccctaccagctcct

SEQ ID NO: 6051245 - DNA, 17 bp, Homo sapiens
cattttgcacctgcagc

SEQ ID NO: 6051246 - DNA, 12 bp, Homo sapiens
cattttgcactg

SEQ ID NO: 6051247 - DNA, 17 bp, Homo sapiens
cattttgcactgtaaat

SEQ ID NO: 6051248 - DNA, 23 bp, Homo sapiens
cattttgcagaaggaaatgatgg

SEQ ID NO: 6051249 - DNA, 15 bp, Homo sapiens
cattttgcagcagtg

SEQ ID NO: 6051250 - DNA, 16 bp, Homo sapiens
cattttgcagcagtga

SEQ ID NO: 6051251 - DNA, 19 bp, Homo sapiens
cattttgcattagacagat

SEQ ID NO: 6051252 - DNA, 15 bp, Homo sapiens
cattttgccaaaatt

SEQ ID NO: 6051253 - DNA, 23 bp, Homo sapiens
cattttgccacctttcctgttca

SEQ ID NO: 6051254 - DNA, 13 bp, Homo sapiens
cattttgcctttc

SEQ ID NO: 6051255 - DNA, 21 bp, Homo sapiens
cattttgctaaatgtgaatga

SEQ ID NO: 6051256 - DNA, 24 bp, Homo sapiens
cattttgctaaatgtgaatgatga

SEQ ID NO: 6051257 - DNA, 22 bp, Homo sapiens
cattttgctagacagttaaact

SEQ ID NO: 6051258 - DNA, 15 bp, Homo sapiens
cattttgcttcatag

SEQ ID NO: 6051259 - DNA, 17 bp, Homo sapiens
cattttgcttcccatct

SEQ ID NO: 6051260 - DNA, 22 bp, Homo sapiens
cattttggagagtttcctgaaa

SEQ ID NO: 6051261 - DNA, 14 bp, Homo sapiens
cattttggatttct

SEQ ID NO: 6051262 - DNA, 15 bp, Homo sapiens
cattttggatttctt

SEQ ID NO: 6051263 - DNA, 20 bp, Homo sapiens
cattttggcatctgcaaagg

SEQ ID NO: 6051264 - DNA, 16 bp, Homo sapiens
cattttggctcagagt

SEQ ID NO: 6051265 - DNA, 23 bp, Homo sapiens
cattttggctcagagtccaatgt

SEQ ID NO: 6051266 - DNA, 19 bp, Homo sapiens
cattttgggatccttcagc

SEQ ID NO: 6051267 - DNA, 22 bp, Homo sapiens
cattttggggctatatttacat

SEQ ID NO: 6051268 - DNA, 20 bp, Homo sapiens
cattttggggtacccactgc

SEQ ID NO: 6051269 - DNA, 18 bp, Homo sapiens
cattttggtttatttttg

SEQ ID NO: 6051270 - DNA, 23 bp, Homo sapiens
cattttggtttatttttgtaatg

SEQ ID NO: 6051271 - DNA, 17 bp, Homo sapiens
cattttggtttttcctc

SEQ ID NO: 6051272 - DNA, 18 bp, Homo sapiens
cattttggtttttcctca

SEQ ID NO: 6051273 - DNA, 15 bp, Homo sapiens
cattttgtaaaatat

SEQ ID NO: 6051274 - DNA, 12 bp, Homo sapiens
cattttgtaaat

SEQ ID NO: 6051275 - DNA, 19 bp, Homo sapiens
cattttgtaacaaatgaac

SEQ ID NO: 6051276 - DNA, 12 bp, Homo sapiens
cattttgtaact

SEQ ID NO: 6051277 - DNA, 21 bp, Homo sapiens
cattttgtaagttatgtttta

SEQ ID NO: 6051278 - DNA, 22 bp, Homo sapiens
cattttgtaatatttgaatttt

SEQ ID NO: 6051279 - DNA, 12 bp, Homo sapiens
cattttgtacca

SEQ ID NO: 6051280 - DNA, 16 bp, Homo sapiens
cattttgtatattaac

SEQ ID NO: 6051281 - DNA, 13 bp, Homo sapiens
cattttgtatcaa

SEQ ID NO: 6051282 - DNA, 19 bp, Homo sapiens
cattttgtatggagttaaa

SEQ ID NO: 6051283 - DNA, 15 bp, Homo sapiens
cattttgtatgtatg

SEQ ID NO: 6051284 - DNA, 18 bp, Homo sapiens
cattttgtatgtatgtgt

SEQ ID NO: 6051285 - DNA, 19 bp, Homo sapiens
cattttgtatgtatgtgta

SEQ ID NO: 6051286 - DNA, 20 bp, Homo sapiens
cattttgtcaggtgggagat

SEQ ID NO: 6051287 - DNA, 15 bp, Homo sapiens
cattttgtctggctg

SEQ ID NO: 6051288 - DNA, 12 bp, Homo sapiens
cattttgtgaag

SEQ ID NO: 6051289 - DNA, 15 bp, Homo sapiens
cattttgtgaagccc

SEQ ID NO: 6051290 - DNA, 17 bp, Homo sapiens
cattttgtgaagccctg

SEQ ID NO: 6051291 - DNA, 18 bp, Homo sapiens
cattttgtgaagccctgt

SEQ ID NO: 6051292 - DNA, 13 bp, Homo sapiens
cattttgtgaatg

SEQ ID NO: 6051293 - DNA, 18 bp, Homo sapiens
cattttgtgaatttgggt

SEQ ID NO: 6051294 - DNA, 13 bp, Homo sapiens
cattttgtgcagt

SEQ ID NO: 6051295 - DNA, 19 bp, Homo sapiens
cattttgtggaattttgag

SEQ ID NO: 6051296 - DNA, 22 bp, Homo sapiens
cattttgtggtcattaagcatt

SEQ ID NO: 6051297 - DNA, 15 bp, Homo sapiens
cattttgtgtaatat

SEQ ID NO: 6051298 - DNA, 15 bp, Homo sapiens
cattttgtgtacagt

SEQ ID NO: 6051299 - DNA, 13 bp, Homo sapiens
cattttgtgtctt

SEQ ID NO: 6051300 - DNA, 11 bp, Homo sapiens
cattttgtgtg

SEQ ID NO: 6051301 - DNA, 20 bp, Homo sapiens
cattttgtgtgatgcatgta

SEQ ID NO: 6051302 - DNA, 21 bp, Homo sapiens
cattttgtgttgaagagcagc

SEQ ID NO: 6051303 - DNA, 17 bp, Homo sapiens
cattttgttatagaata

SEQ ID NO: 6051304 - DNA, 19 bp, Homo sapiens
cattttgttgtaaaaagaa

SEQ ID NO: 6051305 - DNA, 17 bp, Homo sapiens
cattttgtttctgtata

SEQ ID NO: 6051306 - DNA, 22 bp, Homo sapiens
cattttgtttggtattgtattt

SEQ ID NO: 6051307 - DNA, 23 bp, Homo sapiens
cattttgtttggtattgtattta

SEQ ID NO: 6051308 - DNA, 9 bp, Homo sapiens
catttttaa

SEQ ID NO: 6051309 - DNA, 17 bp, Homo sapiens
catttttaaacttgaaa

SEQ ID NO: 6051310 - DNA, 18 bp, Homo sapiens
catttttaaacttgaaat

SEQ ID NO: 6051311 - DNA, 20 bp, Homo sapiens
catttttaaacttgaaatat

SEQ ID NO: 6051312 - DNA, 12 bp, Homo sapiens
catttttaaagg

SEQ ID NO: 6051313 - DNA, 23 bp, Homo sapiens
catttttaaagtagaagagggtt

SEQ ID NO: 6051314 - DNA, 16 bp, Homo sapiens
catttttaaattgtta

SEQ ID NO: 6051315 - DNA, 19 bp, Homo sapiens
catttttaactactgtatt

SEQ ID NO: 6051316 - DNA, 23 bp, Homo sapiens
catttttaagatagaacacaaaa

SEQ ID NO: 6051317 - DNA, 15 bp, Homo sapiens
catttttaagatgca

SEQ ID NO: 6051318 - DNA, 17 bp, Homo sapiens
catttttaatacattgg

SEQ ID NO: 6051319 - DNA, 18 bp, Homo sapiens
catttttaatattactgt

SEQ ID NO: 6051320 - DNA, 21 bp, Homo sapiens
catttttaatattactgtctt

SEQ ID NO: 6051321 - DNA, 15 bp, Homo sapiens
catttttaatcatga

SEQ ID NO: 6051322 - DNA, 19 bp, Homo sapiens
catttttaatcatgaaatt

SEQ ID NO: 6051323 - DNA, 13 bp, Homo sapiens
catttttaatgag

SEQ ID NO: 6051324 - DNA, 19 bp, Homo sapiens
catttttaatgatctcgga

SEQ ID NO: 6051325 - DNA, 16 bp, Homo sapiens
catttttaatttaaca

SEQ ID NO: 6051326 - DNA, 15 bp, Homo sapiens
catttttaattttca

SEQ ID NO: 6051327 - DNA, 19 bp, Homo sapiens
catttttacaatgtaatta

SEQ ID NO: 6051328 - DNA, 20 bp, Homo sapiens
catttttacactattgtgaa

SEQ ID NO: 6051329 - DNA, 21 bp, Homo sapiens
catttttactaaagcagtgtt

SEQ ID NO: 6051330 - DNA, 20 bp, Homo sapiens
catttttactactattctgt

SEQ ID NO: 6051331 - DNA, 16 bp, Homo sapiens
catttttagaaatcac

SEQ ID NO: 6051332 - DNA, 17 bp, Homo sapiens
catttttagtagagaca

SEQ ID NO: 6051333 - DNA, 19 bp, Homo sapiens
catttttagtagagacagg

SEQ ID NO: 6051334 - DNA, 20 bp, Homo sapiens
catttttagtttaaaatctt

SEQ ID NO: 6051335 - DNA, 12 bp, Homo sapiens
catttttatagc

SEQ ID NO: 6051336 - DNA, 23 bp, Homo sapiens
catttttattaaagcatttccta

SEQ ID NO: 6051337 - DNA, 16 bp, Homo sapiens
catttttatttatgaa

SEQ ID NO: 6051338 - DNA, 10 bp, Homo sapiens
catttttcaa

SEQ ID NO: 6051339 - DNA, 17 bp, Homo sapiens
catttttcaactttgaa

SEQ ID NO: 6051340 - DNA, 14 bp, Homo sapiens
catttttcaatata

SEQ ID NO: 6051341 - DNA, 21 bp, Homo sapiens
catttttcaatatattgaact

SEQ ID NO: 6051342 - DNA, 15 bp, Homo sapiens
catttttcacttttg

SEQ ID NO: 6051343 - DNA, 12 bp, Homo sapiens
catttttcagag

SEQ ID NO: 6051344 - DNA, 20 bp, Homo sapiens
catttttcagagttttctaa

SEQ ID NO: 6051345 - DNA, 18 bp, Homo sapiens
catttttcagatataaaa

SEQ ID NO: 6051346 - DNA, 12 bp, Homo sapiens
catttttcagca

SEQ ID NO: 6051347 - DNA, 15 bp, Homo sapiens
catttttcagcagca

SEQ ID NO: 6051348 - DNA, 12 bp, Homo sapiens
catttttcattc

SEQ ID NO: 6051349 - DNA, 17 bp, Homo sapiens
catttttccaacacaca

SEQ ID NO: 6051350 - DNA, 18 bp, Homo sapiens
catttttccagagctgca

SEQ ID NO: 6051351 - DNA, 16 bp, Homo sapiens
catttttccaggactc

SEQ ID NO: 6051352 - DNA, 20 bp, Homo sapiens
catttttccaggactctttg

SEQ ID NO: 6051353 - DNA, 17 bp, Homo sapiens
catttttcctctctgca

SEQ ID NO: 6051354 - DNA, 18 bp, Homo sapiens
catttttccttcccttct

SEQ ID NO: 6051355 - DNA, 21 bp, Homo sapiens
catttttccttcccttctcca

SEQ ID NO: 6051356 - DNA, 16 bp, Homo sapiens
catttttctcccaaga

SEQ ID NO: 6051357 - DNA, 20 bp, Homo sapiens
catttttctcccaagaaacc

SEQ ID NO: 6051358 - DNA, 13 bp, Homo sapiens
catttttctgatg

SEQ ID NO: 6051359 - DNA, 14 bp, Homo sapiens
catttttcttccag

SEQ ID NO: 6051360 - DNA, 17 bp, Homo sapiens
catttttcttccaggat

SEQ ID NO: 6051361 - DNA, 21 bp, Homo sapiens
catttttcttggatctttttg

SEQ ID NO: 6051362 - DNA, 16 bp, Homo sapiens
catttttctttagtca

SEQ ID NO: 6051363 - DNA, 18 bp, Homo sapiens
catttttgaatacaggca

SEQ ID NO: 6051364 - DNA, 12 bp, Homo sapiens
catttttgagta

SEQ ID NO: 6051365 - DNA, 19 bp, Homo sapiens
catttttgctaattatcaa

SEQ ID NO: 6051366 - DNA, 15 bp, Homo sapiens
catttttgcttccta

SEQ ID NO: 6051367 - DNA, 20 bp, Homo sapiens
catttttggatttctgtgaa

SEQ ID NO: 6051368 - DNA, 13 bp, Homo sapiens
catttttgggggg

SEQ ID NO: 6051369 - DNA, 17 bp, Homo sapiens
catttttggggggagag

SEQ ID NO: 6051370 - DNA, 11 bp, Homo sapiens
catttttgtaa

SEQ ID NO: 6051371 - DNA, 13 bp, Homo sapiens
catttttgtaaat

SEQ ID NO: 6051372 - DNA, 22 bp, Homo sapiens
catttttgtaataacatttaat

SEQ ID NO: 6051373 - DNA, 22 bp, Homo sapiens
catttttgtaatataagacaag

SEQ ID NO: 6051374 - DNA, 22 bp, Homo sapiens
catttttgtacagtttgctgta

SEQ ID NO: 6051375 - DNA, 18 bp, Homo sapiens
catttttgtacattatgt

SEQ ID NO: 6051376 - DNA, 23 bp, Homo sapiens
catttttgtacattatgttattg

SEQ ID NO: 6051377 - DNA, 20 bp, Homo sapiens
catttttgtactaactagca

SEQ ID NO: 6051378 - DNA, 13 bp, Homo sapiens
catttttgtataa

SEQ ID NO: 6051379 - DNA, 16 bp, Homo sapiens
catttttgtattttgt

SEQ ID NO: 6051380 - DNA, 17 bp, Homo sapiens
catttttgtctgtccta

SEQ ID NO: 6051381 - DNA, 15 bp, Homo sapiens
catttttgtgagcct

SEQ ID NO: 6051382 - DNA, 22 bp, Homo sapiens
catttttgtgagcctctttgta

SEQ ID NO: 6051383 - DNA, 12 bp, Homo sapiens
catttttgtgca

SEQ ID NO: 6051384 - DNA, 13 bp, Homo sapiens
catttttgtgcca

SEQ ID NO: 6051385 - DNA, 16 bp, Homo sapiens
catttttgtgccatta

SEQ ID NO: 6051386 - DNA, 21 bp, Homo sapiens
catttttgtgggggctagaaa

SEQ ID NO: 6051387 - DNA, 15 bp, Homo sapiens
catttttgttttgaa

SEQ ID NO: 6051388 - DNA, 19 bp, Homo sapiens
catttttgttttgaaagtt

SEQ ID NO: 6051389 - DNA, 17 bp, Homo sapiens
cattttttaaaacaaga

SEQ ID NO: 6051390 - DNA, 16 bp, Homo sapiens
cattttttaaaactga

SEQ ID NO: 6051391 - DNA, 21 bp, Homo sapiens
cattttttaaaagccttccag

SEQ ID NO: 6051392 - DNA, 22 bp, Homo sapiens
cattttttaaaagccttccagt

SEQ ID NO: 6051393 - DNA, 17 bp, Homo sapiens
cattttttaaggaaaca

SEQ ID NO: 6051394 - DNA, 18 bp, Homo sapiens
cattttttaaggaaacaa

SEQ ID NO: 6051395 - DNA, 19 bp, Homo sapiens
cattttttaaggactcagc

SEQ ID NO: 6051396 - DNA, 20 bp, Homo sapiens
cattttttaatgtgctctgt

SEQ ID NO: 6051397 - DNA, 12 bp, Homo sapiens
cattttttactt

SEQ ID NO: 6051398 - DNA, 14 bp, Homo sapiens
cattttttaggaaa

SEQ ID NO: 6051399 - DNA, 14 bp, Homo sapiens
cattttttaggaca

SEQ ID NO: 6051400 - DNA, 22 bp, Homo sapiens
cattttttaggacatcttaaat

SEQ ID NO: 6051401 - DNA, 17 bp, Homo sapiens
cattttttaggtgcttt

SEQ ID NO: 6051402 - DNA, 17 bp, Homo sapiens
cattttttataattttc

SEQ ID NO: 6051403 - DNA, 17 bp, Homo sapiens
cattttttcttctgaag

SEQ ID NO: 6051404 - DNA, 19 bp, Homo sapiens
cattttttgctataatcat

SEQ ID NO: 6051405 - DNA, 22 bp, Homo sapiens
cattttttgggcagcaatttaa

SEQ ID NO: 6051406 - DNA, 17 bp, Homo sapiens
cattttttgtctatttt

SEQ ID NO: 6051407 - DNA, 14 bp, Homo sapiens
cattttttgtctgt

SEQ ID NO: 6051408 - DNA, 17 bp, Homo sapiens
catttttttattcagca

SEQ ID NO: 6051409 - DNA, 15 bp, Homo sapiens
catttttttccaggc

SEQ ID NO: 6051410 - DNA, 17 bp, Homo sapiens
catttttttccaggctg

SEQ ID NO: 6051411 - DNA, 18 bp, Homo sapiens
catttttttccttgcaaa

SEQ ID NO: 6051412 - DNA, 16 bp, Homo sapiens
catttttttctctctg

SEQ ID NO: 6051413 - DNA, 17 bp, Homo sapiens
catttttttctctctgg

SEQ ID NO: 6051414 - DNA, 23 bp, Homo sapiens
catttttttctctctggagcccc

SEQ ID NO: 6051415 - DNA, 21 bp, Homo sapiens
catttttttctgatttgtcct

SEQ ID NO: 6051416 - DNA, 14 bp, Homo sapiens
catttttttcttta

SEQ ID NO: 6051417 - DNA, 17 bp, Homo sapiens
cattttttttctttgaa

SEQ ID NO: 6051418 - DNA, 21 bp, Homo sapiens
cattttttttctttgaataaa

SEQ ID NO: 6051419 - DNA, 17 bp, Homo sapiens
cattttttttttaaatc

SEQ ID NO: 6051420 - DNA, 22 bp, Homo sapiens
cattttttttttcattggtgta

SEQ ID NO: 6051421 - DNA, 22 bp, Homo sapiens
cattttttttttctttttgggg

SEQ ID NO: 6051422 - DNA, 20 bp, Homo sapiens
catttttttttttaattttg

SEQ ID NO: 6051423 - DNA, 13 bp, Homo sapiens
ccaaaaaaaaaag

SEQ ID NO: 6051424 - DNA, 19 bp, Homo sapiens
cccaccctaccagctcctc

SEQ ID NO: 6051425 - DNA, 18 bp, Homo sapiens
cccaccctcaaggtgcgg

SEQ ID NO: 6051426 - DNA, 16 bp, Homo sapiens
cccaccctcagcaccc

SEQ ID NO: 6051427 - DNA, 18 bp, Homo sapiens
cccaccctcagcacccct

SEQ ID NO: 6051428 - DNA, 13 bp, Homo sapiens
cccaccctccact

SEQ ID NO: 6051429 - DNA, 14 bp, Homo sapiens
cccaccctccactc

SEQ ID NO: 6051430 - DNA, 15 bp, Homo sapiens
cccaccctccatgct

SEQ ID NO: 6051431 - DNA, 18 bp, Homo sapiens
cccaccctccatgctcct

SEQ ID NO: 6051432 - DNA, 15 bp, Homo sapiens
cccaccctccctgga

SEQ ID NO: 6051433 - DNA, 16 bp, Homo sapiens
cccaccctccctggag

SEQ ID NO: 6051434 - DNA, 14 bp, Homo sapiens
cccaccctccggcg

SEQ ID NO: 6051435 - DNA, 13 bp, Homo sapiens
cccaccctcctgc

SEQ ID NO: 6051436 - DNA, 18 bp, Homo sapiens
cccaccctccttgagact

SEQ ID NO: 6051437 - DNA, 20 bp, Homo sapiens
cccaccctcgtggacacctg

SEQ ID NO: 6051438 - DNA, 13 bp, Homo sapiens
cccaccctctcca

SEQ ID NO: 6051439 - DNA, 17 bp, Homo sapiens
cccaccctctccacacc

SEQ ID NO: 6051440 - DNA, 20 bp, Homo sapiens
cccaccctctccacacccag

SEQ ID NO: 6051441 - DNA, 13 bp, Homo sapiens
cccaccctctgtg

SEQ ID NO: 6051442 - DNA, 13 bp, Homo sapiens
cccaccctcttcc

SEQ ID NO: 6051443 - DNA, 18 bp, Homo sapiens
cccaccctgaaagccctg

SEQ ID NO: 6051444 - DNA, 11 bp, Homo sapiens
cccaccctgcc

SEQ ID NO: 6051445 - DNA, 14 bp, Homo sapiens
cccaccctgctgcc

SEQ ID NO: 6051446 - DNA, 15 bp, Homo sapiens
cccaccctgctgctg

SEQ ID NO: 6051447 - DNA, 18 bp, Homo sapiens
cccaccctgcttctgctg

SEQ ID NO: 6051448 - DNA, 20 bp, Homo sapiens
cccaccctggcctagaccag

SEQ ID NO: 6051449 - DNA, 12 bp, Homo sapiens
cccaccctggga

SEQ ID NO: 6051450 - DNA, 19 bp, Homo sapiens
cccaccctgggatgggcca

SEQ ID NO: 6051451 - DNA, 12 bp, Homo sapiens
cccaccctgggc

SEQ ID NO: 6051452 - DNA, 13 bp, Homo sapiens
cccaccctgggcc

SEQ ID NO: 6051453 - DNA, 18 bp, Homo sapiens
cccaccctgggcctcccg

SEQ ID NO: 6051454 - DNA, 18 bp, Homo sapiens
cccaccctggtgggccaa

SEQ ID NO: 6051455 - DNA, 15 bp, Homo sapiens
cccaccctgtcccag

SEQ ID NO: 6051456 - DNA, 18 bp, Homo sapiens
cccaccctgtctgcaggc

SEQ ID NO: 6051457 - DNA, 13 bp, Homo sapiens
cccaccctgtgcc

SEQ ID NO: 6051458 - DNA, 17 bp, Homo sapiens
cccaccctgtgccatca

SEQ ID NO: 6051459 - DNA, 15 bp, Homo sapiens
cccaccctgttcctg

SEQ ID NO: 6051460 - DNA, 17 bp, Homo sapiens
cccaccctgtttggatt

SEQ ID NO: 6051461 - DNA, 23 bp, Homo sapiens
cccacccttacttcctggcctct

SEQ ID NO: 6051462 - DNA, 23 bp, Homo sapiens
cccaccctttctgccagggatgg

SEQ ID NO: 6051463 - DNA, 15 bp, Homo sapiens
cccaccgaagagccc

SEQ ID NO: 6051464 - DNA, 16 bp, Homo sapiens
cccaccgaagagccct

SEQ ID NO: 6051465 - DNA, 17 bp, Homo sapiens
cccaccgaagagccctg

SEQ ID NO: 6051466 - DNA, 15 bp, Homo sapiens
cccaccgagctggag

SEQ ID NO: 6051467 - DNA, 20 bp, Homo sapiens
cccaccgaggagccccagcc

SEQ ID NO: 6051468 - DNA, 20 bp, Homo sapiens
cccaccgatggagcccccag

SEQ ID NO: 6051469 - DNA, 21 bp, Homo sapiens
cccaccgatggagcccccaga

SEQ ID NO: 6051470 - DNA, 15 bp, Homo sapiens
cccaccgcagacagg

SEQ ID NO: 6051471 - DNA, 19 bp, Homo sapiens
cccaccgcagcgtcccccg

SEQ ID NO: 6051472 - DNA, 15 bp, Homo sapiens
cccaccgcagtcacc

SEQ ID NO: 6051473 - DNA, 14 bp, Homo sapiens
cccaccgcccactc

SEQ ID NO: 6051474 - DNA, 22 bp, Homo sapiens
cccaccgccggggtcctgggag

SEQ ID NO: 6051475 - DNA, 14 bp, Homo sapiens
cccaccgctcagtg

SEQ ID NO: 6051476 - DNA, 19 bp, Homo sapiens
cccaccgctgagaggctgc

SEQ ID NO: 6051477 - DNA, 15 bp, Homo sapiens
cccaccgctgcctcg

SEQ ID NO: 6051478 - DNA, 19 bp, Homo sapiens
cccaccgggccactccttc

SEQ ID NO: 6051479 - DNA, 22 bp, Homo sapiens
cccaccgggtgaaagtgtcgtc

SEQ ID NO: 6051480 - DNA, 22 bp, Homo sapiens
cccaccggtgccaaacccagcc

SEQ ID NO: 6051481 - DNA, 18 bp, Homo sapiens
cccaccggttgcttctgg

SEQ ID NO: 6051482 - DNA, 20 bp, Homo sapiens
cccaccggttgcttctggga

SEQ ID NO: 6051483 - DNA, 15 bp, Homo sapiens
cccaccgtccgccct

SEQ ID NO: 6051484 - DNA, 17 bp, Homo sapiens
cccaccgtccgccctgc

SEQ ID NO: 6051485 - DNA, 23 bp, Homo sapiens
cccaccgtccgccctgctcctcc

SEQ ID NO: 6051486 - DNA, 20 bp, Homo sapiens
cccaccgtggaggaggaagg

SEQ ID NO: 6051487 - DNA, 20 bp, Homo sapiens
cccaccgttgtctcatgcca

SEQ ID NO: 6051488 - DNA, 21 bp, Homo sapiens
cccacctaaagggaagccctg

SEQ ID NO: 6051489 - DNA, 23 bp, Homo sapiens
cccacctaagggctaaggcctct

SEQ ID NO: 6051490 - DNA, 14 bp, Homo sapiens
cccacctagcccag

SEQ ID NO: 6051491 - DNA, 14 bp, Homo sapiens
cccacctagtgccc

SEQ ID NO: 6051492 - DNA, 20 bp, Homo sapiens
cccacctagtgccccagact

SEQ ID NO: 6051493 - DNA, 12 bp, Homo sapiens
cccacctcagcc

SEQ ID NO: 6051494 - DNA, 18 bp, Homo sapiens
cccacctcagcctcccaa

SEQ ID NO: 6051495 - DNA, 21 bp, Homo sapiens
cccacctcagcctcccaaagt

SEQ ID NO: 6051496 - DNA, 16 bp, Homo sapiens
cccacctcatgcctgg

SEQ ID NO: 6051497 - DNA, 18 bp, Homo sapiens
cccacctcatgcctggcc

SEQ ID NO: 6051498 - DNA, 23 bp, Homo sapiens
cccacctcatgcctggcccccct

SEQ ID NO: 6051499 - DNA, 14 bp, Homo sapiens
cccacctccacccc

SEQ ID NO: 6051500 - DNA, 13 bp, Homo sapiens
cccacctccacct

SEQ ID NO: 6051501 - DNA, 15 bp, Homo sapiens
cccacctccacctgt

SEQ ID NO: 6051502 - DNA, 12 bp, Homo sapiens
cccacctccact

SEQ ID NO: 6051503 - DNA, 16 bp, Homo sapiens
cccacctccagcccac

SEQ ID NO: 6051504 - DNA, 18 bp, Homo sapiens
cccacctccagcccacag

SEQ ID NO: 6051505 - DNA, 15 bp, Homo sapiens
cccacctccccacac

SEQ ID NO: 6051506 - DNA, 21 bp, Homo sapiens
cccacctccccacacacaggc

SEQ ID NO: 6051507 - DNA, 14 bp, Homo sapiens
cccacctccccacg

SEQ ID NO: 6051508 - DNA, 15 bp, Homo sapiens
cccacctccccacgc

SEQ ID NO: 6051509 - DNA, 16 bp, Homo sapiens
cccacctccccacgcc

SEQ ID NO: 6051510 - DNA, 14 bp, Homo sapiens
cccacctccccctc

SEQ ID NO: 6051511 - DNA, 15 bp, Homo sapiens
cccacctccccctcc

SEQ ID NO: 6051512 - DNA, 16 bp, Homo sapiens
cccacctccccttggg

SEQ ID NO: 6051513 - DNA, 13 bp, Homo sapiens
cccacctccctgc

SEQ ID NO: 6051514 - DNA, 17 bp, Homo sapiens
cccacctccctgcagct

SEQ ID NO: 6051515 - DNA, 17 bp, Homo sapiens
cccacctccctgcccag

SEQ ID NO: 6051516 - DNA, 14 bp, Homo sapiens
cccacctcccttcc

SEQ ID NO: 6051517 - DNA, 15 bp, Homo sapiens
cccacctcccttccc

SEQ ID NO: 6051518 - DNA, 23 bp, Homo sapiens
cccacctcgcggcgcagcccctg

SEQ ID NO: 6051519 - DNA, 20 bp, Homo sapiens
cccacctcgctcccctctgg

SEQ ID NO: 6051520 - DNA, 22 bp, Homo sapiens
cccacctcgctcccctctggaa

SEQ ID NO: 6051521 - DNA, 13 bp, Homo sapiens
cccacctcggccc

SEQ ID NO: 6051522 - DNA, 19 bp, Homo sapiens
cccacctcggccctccctg

SEQ ID NO: 6051523 - DNA, 22 bp, Homo sapiens
cccacctctccccaccttaccc

SEQ ID NO: 6051524 - DNA, 17 bp, Homo sapiens
cccacctctctcactcc

SEQ ID NO: 6051525 - DNA, 22 bp, Homo sapiens
cccacctctcttttcctctctg

SEQ ID NO: 6051526 - DNA, 13 bp, Homo sapiens
cccacctctgagg

SEQ ID NO: 6051527 - DNA, 13 bp, Homo sapiens
cccacctctgcca

SEQ ID NO: 6051528 - DNA, 22 bp, Homo sapiens
cccacctctgctgcccacggcc

SEQ ID NO: 6051529 - DNA, 16 bp, Homo sapiens
cccacctctggccctg

SEQ ID NO: 6051530 - DNA, 17 bp, Homo sapiens
cccacctctggccctgt

SEQ ID NO: 6051531 - DNA, 20 bp, Homo sapiens
cccacctctgtgacctcagg

SEQ ID NO: 6051532 - DNA, 17 bp, Homo sapiens
cccacctcttccttccg

SEQ ID NO: 6051533 - DNA, 12 bp, Homo sapiens
cccacctcttct

SEQ ID NO: 6051534 - DNA, 12 bp, Homo sapiens
cccacctcttgt

SEQ ID NO: 6051535 - DNA, 23 bp, Homo sapiens
cccacctctttcttcaattaatg

SEQ ID NO: 6051536 - DNA, 13 bp, Homo sapiens
cccacctcttttc

SEQ ID NO: 6051537 - DNA, 16 bp, Homo sapiens
cccacctgaaagcctg

SEQ ID NO: 6051538 - DNA, 20 bp, Homo sapiens
cccacctgaggccccaggtg

SEQ ID NO: 6051539 - DNA, 21 bp, Homo sapiens
cccacctgaggctcagcccta

SEQ ID NO: 6051540 - DNA, 12 bp, Homo sapiens
cccacctgcagc

SEQ ID NO: 6051541 - DNA, 14 bp, Homo sapiens
cccacctgcagggc

SEQ ID NO: 6051542 - DNA, 20 bp, Homo sapiens
cccacctgcagggctgccct

SEQ ID NO: 6051543 - DNA, 21 bp, Homo sapiens
cccacctgcatcagcctctgg

SEQ ID NO: 6051544 - DNA, 19 bp, Homo sapiens
cccacctgcatctggggcc

SEQ ID NO: 6051545 - DNA, 23 bp, Homo sapiens
cccacctgccactaggctgggtg

SEQ ID NO: 6051546 - DNA, 22 bp, Homo sapiens
cccacctgccagcggtttcctg

SEQ ID NO: 6051547 - DNA, 22 bp, Homo sapiens
cccacctgccaggctgcaggga

SEQ ID NO: 6051548 - DNA, 13 bp, Homo sapiens
cccacctgcccag

SEQ ID NO: 6051549 - DNA, 13 bp, Homo sapiens
cccacctgccggc

SEQ ID NO: 6051550 - DNA, 13 bp, Homo sapiens
cccacctgcctgg

SEQ ID NO: 6051551 - DNA, 16 bp, Homo sapiens
cccacctgcctggtgc

SEQ ID NO: 6051552 - DNA, 14 bp, Homo sapiens
cccacctgctccca

SEQ ID NO: 6051553 - DNA, 19 bp, Homo sapiens
cccacctgctgagagaccc

SEQ ID NO: 6051554 - DNA, 12 bp, Homo sapiens
cccacctgctgc

SEQ ID NO: 6051555 - DNA, 13 bp, Homo sapiens
cccacctgctgcc

SEQ ID NO: 6051556 - DNA, 13 bp, Homo sapiens
cccacctggacac

SEQ ID NO: 6051557 - DNA, 13 bp, Homo sapiens
cccacctggagcc

SEQ ID NO: 6051558 - DNA, 14 bp, Homo sapiens
cccacctggagccc

SEQ ID NO: 6051559 - DNA, 18 bp, Homo sapiens
cccacctggagcccgctt

SEQ ID NO: 6051560 - DNA, 12 bp, Homo sapiens
cccacctggcca

SEQ ID NO: 6051561 - DNA, 16 bp, Homo sapiens
cccacctggccacctg

SEQ ID NO: 6051562 - DNA, 12 bp, Homo sapiens
cccacctggccc

SEQ ID NO: 6051563 - DNA, 22 bp, Homo sapiens
cccacctggccccctcagctct

SEQ ID NO: 6051564 - DNA, 23 bp, Homo sapiens
cccacctggccccctcagctctg

SEQ ID NO: 6051565 - DNA, 18 bp, Homo sapiens
cccacctggccctctctg

SEQ ID NO: 6051566 - DNA, 15 bp, Homo sapiens
cccacctggcctctg

SEQ ID NO: 6051567 - DNA, 16 bp, Homo sapiens
cccacctggcctctgc

SEQ ID NO: 6051568 - DNA, 14 bp, Homo sapiens
cccacctggctctg

SEQ ID NO: 6051569 - DNA, 14 bp, Homo sapiens
cccacctggctgcc

SEQ ID NO: 6051570 - DNA, 13 bp, Homo sapiens
cccacctgggacc

SEQ ID NO: 6051571 - DNA, 21 bp, Homo sapiens
cccacctgggccctaggcata

SEQ ID NO: 6051572 - DNA, 16 bp, Homo sapiens
cccacctgggctgggc

SEQ ID NO: 6051573 - DNA, 14 bp, Homo sapiens
cccacctggggtct

SEQ ID NO: 6051574 - DNA, 19 bp, Homo sapiens
cccacctggggtctctctc

SEQ ID NO: 6051575 - DNA, 13 bp, Homo sapiens
cccacctgtagct

SEQ ID NO: 6051576 - DNA, 14 bp, Homo sapiens
cccacctgtagctg

SEQ ID NO: 6051577 - DNA, 23 bp, Homo sapiens
cccacctgtcaaacaaagccaga

SEQ ID NO: 6051578 - DNA, 18 bp, Homo sapiens
cccacctgtggggcctgg

SEQ ID NO: 6051579 - DNA, 16 bp, Homo sapiens
cccacctgttgtcctg

SEQ ID NO: 6051580 - DNA, 19 bp, Homo sapiens
cccacctgtttctggaaga

SEQ ID NO: 6051581 - DNA, 16 bp, Homo sapiens
cccacctgttttctga

SEQ ID NO: 6051582 - DNA, 23 bp, Homo sapiens
cccacctgttttctgaaacacac

SEQ ID NO: 6051583 - DNA, 22 bp, Homo sapiens
cccaccttcaattcctgggccc

SEQ ID NO: 6051584 - DNA, 12 bp, Homo sapiens
cccaccttccca

SEQ ID NO: 6051585 - DNA, 13 bp, Homo sapiens
cccaccttcccca

SEQ ID NO: 6051586 - DNA, 14 bp, Homo sapiens
cccaccttccccag

SEQ ID NO: 6051587 - DNA, 14 bp, Homo sapiens
cccaccttcttggg

SEQ ID NO: 6051588 - DNA, 22 bp, Homo sapiens
cccaccttcttgggactgctgt

SEQ ID NO: 6051589 - DNA, 13 bp, Homo sapiens
cccaccttgacca

SEQ ID NO: 6051590 - DNA, 16 bp, Homo sapiens
cccaccttggcctccc

SEQ ID NO: 6051591 - DNA, 12 bp, Homo sapiens
cccaccttggct

SEQ ID NO: 6051592 - DNA, 15 bp, Homo sapiens
cccaccttggctcaa

SEQ ID NO: 6051593 - DNA, 20 bp, Homo sapiens
cccaccttgttggagcctgc

SEQ ID NO: 6051594 - DNA, 20 bp, Homo sapiens
cccacctttaagtcctctct

SEQ ID NO: 6051595 - DNA, 13 bp, Homo sapiens
cccacgacaaaaa

SEQ ID NO: 6051596 - DNA, 23 bp, Homo sapiens
cccacgacaaaaacaagactgcc

SEQ ID NO: 6051597 - DNA, 21 bp, Homo sapiens
cccacgacccctgcctcgagg

SEQ ID NO: 6051598 - DNA, 15 bp, Homo sapiens
cccacgaggagcagc

SEQ ID NO: 6051599 - DNA, 16 bp, Homo sapiens
cccacgaggagcagca

SEQ ID NO: 6051600 - DNA, 17 bp, Homo sapiens
cccacgaggaggaacca

SEQ ID NO: 6051601 - DNA, 20 bp, Homo sapiens
cccacgaggatggcctggaa

SEQ ID NO: 6051602 - DNA, 14 bp, Homo sapiens
cccacgagggctgg

SEQ ID NO: 6051603 - DNA, 15 bp, Homo sapiens
cccacgagggctggc

SEQ ID NO: 6051604 - DNA, 22 bp, Homo sapiens
cccacgagggtctcccctcctg

SEQ ID NO: 6051605 - DNA, 13 bp, Homo sapiens
ccaaaaaaataag

SEQ ID NO: 6051606 - DNA, 17 bp, Homo sapiens
ccaaaaaaccccagcta

SEQ ID NO: 6051607 - DNA, 20 bp, Homo sapiens
ccaaaaaaccccagctattt

SEQ ID NO: 6051608 - DNA, 17 bp, Homo sapiens
ccaaaaaacctcactgg

SEQ ID NO: 6051609 - DNA, 13 bp, Homo sapiens
ccaaaaaagaaag

SEQ ID NO: 6051610 - DNA, 13 bp, Homo sapiens
ccaaaaaagcgaa

SEQ ID NO: 6051611 - DNA, 22 bp, Homo sapiens
ccaaaaaagctgtattttgaaa

SEQ ID NO: 6051612 - DNA, 23 bp, Homo sapiens
ccaaaaaagctgtattttgaaaa

SEQ ID NO: 6051613 - DNA, 16 bp, Homo sapiens
ccaaaaaagtattttt

SEQ ID NO: 6051614 - DNA, 19 bp, Homo sapiens
ccaaaaaatgtgagctata

SEQ ID NO: 6051615 - DNA, 20 bp, Homo sapiens
ccaaaaaattctacaacaca

SEQ ID NO: 6051616 - DNA, 11 bp, Homo sapiens
ccaaaaacaaa

SEQ ID NO: 6051617 - DNA, 20 bp, Homo sapiens
ccaaaaacaaagtgcaaagc

SEQ ID NO: 6051618 - DNA, 23 bp, Homo sapiens
ccaaaaacaaagtgcaaagctgc

SEQ ID NO: 6051619 - DNA, 14 bp, Homo sapiens
ccaaaaaccatgtt

SEQ ID NO: 6051620 - DNA, 17 bp, Homo sapiens
ccaaaaagacaagtgct

SEQ ID NO: 6051621 - DNA, 19 bp, Homo sapiens
ccaaaaagattttcagaaa

SEQ ID NO: 6051622 - DNA, 13 bp, Homo sapiens
ccaaaaagcacat

SEQ ID NO: 6051623 - DNA, 18 bp, Homo sapiens
ccaaaaaggcaaataatg

SEQ ID NO: 6051624 - DNA, 22 bp, Homo sapiens
ccaaaaaggttgctgtttcaca

SEQ ID NO: 6051625 - DNA, 23 bp, Homo sapiens
ccaaaaaggttgctgtttcacaa

SEQ ID NO: 6051626 - DNA, 16 bp, Homo sapiens
ccaaaaatagaaatta

SEQ ID NO: 6051627 - DNA, 12 bp, Homo sapiens
ccaaaaatagct

SEQ ID NO: 6051628 - DNA, 19 bp, Homo sapiens
ccaaaaatagtcaaaaatt

SEQ ID NO: 6051629 - DNA, 19 bp, Homo sapiens
ccaaaaatgtgtaagaaca

SEQ ID NO: 6051630 - DNA, 16 bp, Homo sapiens
ccaaaaattgccaagt

SEQ ID NO: 6051631 - DNA, 22 bp, Homo sapiens
ccaaaaattgccaagtgcctat

SEQ ID NO: 6051632 - DNA, 21 bp, Homo sapiens
ccaaaacacattttccatatt

SEQ ID NO: 6051633 - DNA, 18 bp, Homo sapiens
ccaaaacaccccaacttg

SEQ ID NO: 6051634 - DNA, 22 bp, Homo sapiens
ccaaaacacttaggaagaaatc

SEQ ID NO: 6051635 - DNA, 14 bp, Homo sapiens
ccaaaacagctttg

SEQ ID NO: 6051636 - DNA, 21 bp, Homo sapiens
ccaaaacatccacttaagttc

SEQ ID NO: 6051637 - DNA, 18 bp, Homo sapiens
ccaaaacatttctaagac

SEQ ID NO: 6051638 - DNA, 21 bp, Homo sapiens
ccaaaacatttctaagactac

SEQ ID NO: 6051639 - DNA, 11 bp, Homo sapiens
ccaaaaccaaa

SEQ ID NO: 6051640 - DNA, 14 bp, Homo sapiens
ccaaaaccaaattg

SEQ ID NO: 6051641 - DNA, 14 bp, Homo sapiens
ccaaaaccaatgct

SEQ ID NO: 6051642 - DNA, 13 bp, Homo sapiens
ccaaaaccacatg

SEQ ID NO: 6051643 - DNA, 16 bp, Homo sapiens
ccaaaaccacatgggc

SEQ ID NO: 6051644 - DNA, 17 bp, Homo sapiens
ccaaaaccagagggcag

SEQ ID NO: 6051645 - DNA, 15 bp, Homo sapiens
ccaaaaccaggcctc

SEQ ID NO: 6051646 - DNA, 14 bp, Homo sapiens
ccaaaacccatcgt

SEQ ID NO: 6051647 - DNA, 15 bp, Homo sapiens
ccaaaacccatgtgg

SEQ ID NO: 6051648 - DNA, 16 bp, Homo sapiens
ccaaaaccgccagctc

SEQ ID NO: 6051649 - DNA, 21 bp, Homo sapiens
ccaaaaccgccagctctgttc

SEQ ID NO: 6051650 - DNA, 19 bp, Homo sapiens
ccaaaacctgcttccttca

SEQ ID NO: 6051651 - DNA, 23 bp, Homo sapiens
ccaaaacctttccccagacacat

SEQ ID NO: 6051652 - DNA, 23 bp, Homo sapiens
ccaaaactctacaccctctgccc

SEQ ID NO: 6051653 - DNA, 20 bp, Homo sapiens
ccaaaactctcctctgctgc

SEQ ID NO: 6051654 - DNA, 17 bp, Homo sapiens
ccaaaactgagcataag

SEQ ID NO: 6051655 - DNA, 13 bp, Homo sapiens
ccaaaactgccta

SEQ ID NO: 6051656 - DNA, 11 bp, Homo sapiens
ccaaaactgtg

SEQ ID NO: 6051657 - DNA, 16 bp, Homo sapiens
ccaaaactgtgcagag

SEQ ID NO: 6051658 - DNA, 10 bp, Homo sapiens
ccaaaagaac

SEQ ID NO: 6051659 - DNA, 21 bp, Homo sapiens
ccaaaagaagtttaaagcatc

SEQ ID NO: 6051660 - DNA, 14 bp, Homo sapiens
ccaaaagacaaaaa

SEQ ID NO: 6051661 - DNA, 16 bp, Homo sapiens
ccaaaagatctgggga

SEQ ID NO: 6051662 - DNA, 23 bp, Homo sapiens
ccaaaagattgctgaaattttat

SEQ ID NO: 6051663 - DNA, 13 bp, Homo sapiens
ccaaaagccttac

SEQ ID NO: 6051664 - DNA, 17 bp, Homo sapiens
ccaaaagctcagggccc

SEQ ID NO: 6051665 - DNA, 14 bp, Homo sapiens
ccaaaagctgctca

SEQ ID NO: 6051666 - DNA, 16 bp, Homo sapiens
ccaaaagctgctttcc

SEQ ID NO: 6051667 - DNA, 15 bp, Homo sapiens
ccaaaagctttttat

SEQ ID NO: 6051668 - DNA, 12 bp, Homo sapiens
ccaaaaggaaaa

SEQ ID NO: 6051669 - DNA, 17 bp, Homo sapiens
ccaaaaggaaaaagctc

SEQ ID NO: 6051670 - DNA, 23 bp, Homo sapiens
ccaaaaggagagattattaaatc

SEQ ID NO: 6051671 - DNA, 21 bp, Homo sapiens
ccaaaaggattcctctttgtt

SEQ ID NO: 6051672 - DNA, 13 bp, Homo sapiens
ccaaaaggcccct

SEQ ID NO: 6051673 - DNA, 14 bp, Homo sapiens
ccaaaaggcccctt

SEQ ID NO: 6051674 - DNA, 15 bp, Homo sapiens
ccaaaagggaaaaaa

SEQ ID NO: 6051675 - DNA, 21 bp, Homo sapiens
ccaaaagggcacccaccagaa

SEQ ID NO: 6051676 - DNA, 13 bp, Homo sapiens
ccaaaagggcagc

SEQ ID NO: 6051677 - DNA, 16 bp, Homo sapiens
ccaaaagggggcctgg

SEQ ID NO: 6051678 - DNA, 18 bp, Homo sapiens
ccaaaagtatcgggggct

SEQ ID NO: 6051679 - DNA, 18 bp, Homo sapiens
ccaaaagtgaccagcata

SEQ ID NO: 6051680 - DNA, 23 bp, Homo sapiens
ccaaaagtgtcaaggggccctag

SEQ ID NO: 6051681 - DNA, 21 bp, Homo sapiens
ccaaaagtgttgactgtgtca

SEQ ID NO: 6051682 - DNA, 17 bp, Homo sapiens
ccaaaagttacatgttt

SEQ ID NO: 6051683 - DNA, 20 bp, Homo sapiens
ccaaaagttacatgtttgca

SEQ ID NO: 6051684 - DNA, 14 bp, Homo sapiens
ccaaaagttattaa

SEQ ID NO: 6051685 - DNA, 18 bp, Homo sapiens
ccaaaataaaaattgaaa

SEQ ID NO: 6051686 - DNA, 21 bp, Homo sapiens
ccaaaataaaaattgaaaaat

SEQ ID NO: 6051687 - DNA, 19 bp, Homo sapiens
ccaaaataaaacctcagct

SEQ ID NO: 6051688 - DNA, 13 bp, Homo sapiens
ccaaaataaaagg

SEQ ID NO: 6051689 - DNA, 15 bp, Homo sapiens
ccaaaataaagtctg

SEQ ID NO: 6051690 - DNA, 14 bp, Homo sapiens
ccaaaataagaaaa

SEQ ID NO: 6051691 - DNA, 18 bp, Homo sapiens
ccaaaataagaaaagatg

SEQ ID NO: 6051692 - DNA, 17 bp, Homo sapiens
ccaaaataccagagcct

SEQ ID NO: 6051693 - DNA, 20 bp, Homo sapiens
ccaaaatactacacatccaa

SEQ ID NO: 6051694 - DNA, 17 bp, Homo sapiens
ccaaaatactccaaaga

SEQ ID NO: 6051695 - DNA, 21 bp, Homo sapiens
ccaaaatattatattttttct

SEQ ID NO: 6051696 - DNA, 18 bp, Homo sapiens
ccaaaatccaaaacttct

SEQ ID NO: 6051697 - DNA, 16 bp, Homo sapiens
ccaaaatctcaagaaa

SEQ ID NO: 6051698 - DNA, 15 bp, Homo sapiens
ccaaaatgacatctt

SEQ ID NO: 6051699 - DNA, 22 bp, Homo sapiens
ccaaaatgctctagtgccttct

SEQ ID NO: 6051700 - DNA, 17 bp, Homo sapiens
ccaaaatgttggctgcg

SEQ ID NO: 6051701 - DNA, 11 bp, Homo sapiens
ccaaaattatt

SEQ ID NO: 6051702 - DNA, 11 bp, Homo sapiens
ccaaaattcca

SEQ ID NO: 6051703 - DNA, 16 bp, Homo sapiens
ccaaacaaaaatgact

SEQ ID NO: 6051704 - DNA, 12 bp, Homo sapiens
ccaaacaagcct

SEQ ID NO: 6051705 - DNA, 14 bp, Homo sapiens
ccaaacaagcctta

SEQ ID NO: 6051706 - DNA, 21 bp, Homo sapiens
ccaaacaaggaagccaaagtt

SEQ ID NO: 6051707 - DNA, 17 bp, Homo sapiens
ccaaacaattctgatga

SEQ ID NO: 6051708 - DNA, 13 bp, Homo sapiens
ccaaacacaggca

SEQ ID NO: 6051709 - DNA, 13 bp, Homo sapiens
ccaaacacccaga

SEQ ID NO: 6051710 - DNA, 19 bp, Homo sapiens
ccaaacaccctcctggcac

SEQ ID NO: 6051711 - DNA, 22 bp, Homo sapiens
ccaaacaccttccagctcctgt

SEQ ID NO: 6051712 - DNA, 15 bp, Homo sapiens
ccaaacactcagtcc

SEQ ID NO: 6051713 - DNA, 22 bp, Homo sapiens
ccaaacactgggctctgaggag

SEQ ID NO: 6051714 - DNA, 16 bp, Homo sapiens
ccaaacacttctgctt

SEQ ID NO: 6051715 - DNA, 23 bp, Homo sapiens
ccaaacagacaggtggaaaaact

SEQ ID NO: 6051716 - DNA, 14 bp, Homo sapiens
ccaaacaggacagc

SEQ ID NO: 6051717 - DNA, 18 bp, Homo sapiens
ccaaacaggtgctggccc

SEQ ID NO: 6051718 - DNA, 13 bp, Homo sapiens
ccaaacatcagac

SEQ ID NO: 6051719 - DNA, 15 bp, Homo sapiens
ccaaacatcagacct

SEQ ID NO: 6051720 - DNA, 17 bp, Homo sapiens
ccaaacatgtatttatg

SEQ ID NO: 6051721 - DNA, 22 bp, Homo sapiens
ccaaacattaatgttgatttct

SEQ ID NO: 6051722 - DNA, 16 bp, Homo sapiens
ccaaacattcttattt

SEQ ID NO: 6051723 - DNA, 16 bp, Homo sapiens
ccaaaccacaagactc

SEQ ID NO: 6051724 - DNA, 14 bp, Homo sapiens
ccaaaccaccttcc

SEQ ID NO: 6051725 - DNA, 16 bp, Homo sapiens
ccaaaccaccttccct

SEQ ID NO: 6051726 - DNA, 22 bp, Homo sapiens
ccaaaccactttttgcagcttt

SEQ ID NO: 6051727 - DNA, 13 bp, Homo sapiens
ccaaaccagcctt

SEQ ID NO: 6051728 - DNA, 17 bp, Homo sapiens
ccaaaccaggacactac

SEQ ID NO: 6051729 - DNA, 18 bp, Homo sapiens
ccaaaccagggggaagca

SEQ ID NO: 6051730 - DNA, 14 bp, Homo sapiens
ccaaaccagtttat

SEQ ID NO: 6051731 - DNA, 21 bp, Homo sapiens
ccaaaccagtttattctgtgg

SEQ ID NO: 6051732 - DNA, 15 bp, Homo sapiens
ccaaaccatgagaat

SEQ ID NO: 6051733 - DNA, 16 bp, Homo sapiens
ccaaacccaccctttc

SEQ ID NO: 6051734 - DNA, 13 bp, Homo sapiens
ccaaacccactca

SEQ ID NO: 6051735 - DNA, 15 bp, Homo sapiens
ccaaacccagaaaga

SEQ ID NO: 6051736 - DNA, 16 bp, Homo sapiens
ccaaacccagcccctg

SEQ ID NO: 6051737 - DNA, 17 bp, Homo sapiens
ccaaacccagcccctgc

SEQ ID NO: 6051738 - DNA, 23 bp, Homo sapiens
ccaaacccaggttcatgaatatg

SEQ ID NO: 6051739 - DNA, 17 bp, Homo sapiens
ccaaacccagtctcctc

SEQ ID NO: 6051740 - DNA, 22 bp, Homo sapiens
ccaaacccatggctctatttct

SEQ ID NO: 6051741 - DNA, 13 bp, Homo sapiens
ccaaaccccagcc

SEQ ID NO: 6051742 - DNA, 15 bp, Homo sapiens
ccaaaccccttccca

SEQ ID NO: 6051743 - DNA, 15 bp, Homo sapiens
ccaaaccctgtcctc

SEQ ID NO: 6051744 - DNA, 12 bp, Homo sapiens
ccaaacccttca

SEQ ID NO: 6051745 - DNA, 17 bp, Homo sapiens
ccaaacccttgctttcc

SEQ ID NO: 6051746 - DNA, 23 bp, Homo sapiens
ccaaacccttgctttcctgggcc

SEQ ID NO: 6051747 - DNA, 19 bp, Homo sapiens
ccaaaccgcaaacgtgaaa

SEQ ID NO: 6051748 - DNA, 14 bp, Homo sapiens
ccaaacctagcccc

SEQ ID NO: 6051749 - DNA, 14 bp, Homo sapiens
ccaaacctccagcc

SEQ ID NO: 6051750 - DNA, 17 bp, Homo sapiens
ccaaacctccagcctcc

SEQ ID NO: 6051751 - DNA, 13 bp, Homo sapiens
ccaaacctctgtt

SEQ ID NO: 6051752 - DNA, 22 bp, Homo sapiens
ccaaacctgcaagggctcccca

SEQ ID NO: 6051753 - DNA, 14 bp, Homo sapiens
ccaaacctggagat

SEQ ID NO: 6051754 - DNA, 18 bp, Homo sapiens
ccaaacctgggaaggcca

SEQ ID NO: 6051755 - DNA, 14 bp, Homo sapiens
ccaaacctgggacc

SEQ ID NO: 6051756 - DNA, 20 bp, Homo sapiens
ccaaaccttactctgagctc

SEQ ID NO: 6051757 - DNA, 22 bp, Homo sapiens
ccaaaccttactctgagctcat

SEQ ID NO: 6051758 - DNA, 21 bp, Homo sapiens
ccaaacgccctttcctcctca

SEQ ID NO: 6051759 - DNA, 13 bp, Homo sapiens
ccaaacgcctccc

SEQ ID NO: 6051760 - DNA, 15 bp, Homo sapiens
ccaaactcaggccca

SEQ ID NO: 6051761 - DNA, 14 bp, Homo sapiens
ccaaactcatcttg

SEQ ID NO: 6051762 - DNA, 12 bp, Homo sapiens
ccaaactcccct

SEQ ID NO: 6051763 - DNA, 14 bp, Homo sapiens
ccaaactccccttc

SEQ ID NO: 6051764 - DNA, 18 bp, Homo sapiens
ccaaactccccttccctg

SEQ ID NO: 6051765 - DNA, 20 bp, Homo sapiens
ccaaactccccttccctggg

SEQ ID NO: 6051766 - DNA, 12 bp, Homo sapiens
ccaaactcctgc

SEQ ID NO: 6051767 - DNA, 13 bp, Homo sapiens
ccaaactcctgcc

SEQ ID NO: 6051768 - DNA, 13 bp, Homo sapiens
ccaaactccttta

SEQ ID NO: 6051769 - DNA, 23 bp, Homo sapiens
ccaaactcctttactgcagcctg

SEQ ID NO: 6051770 - DNA, 19 bp, Homo sapiens
ccaaactcctttcttatct

SEQ ID NO: 6051771 - DNA, 21 bp, Homo sapiens
ccaaactgactcaacagtcat

SEQ ID NO: 6051772 - DNA, 17 bp, Homo sapiens
ccaaactgatccagtat

SEQ ID NO: 6051773 - DNA, 19 bp, Homo sapiens
ccaaactgcacacacagct

SEQ ID NO: 6051774 - DNA, 24 bp, Homo sapiens
ccaaactgctggacgtctttcttt

SEQ ID NO: 6051775 - DNA, 15 bp, Homo sapiens
ccaaactgctgtctc

SEQ ID NO: 6051776 - DNA, 14 bp, Homo sapiens
ccaaactggagctt

SEQ ID NO: 6051777 - DNA, 19 bp, Homo sapiens
ccaaactgggtcttcagct

SEQ ID NO: 6051778 - DNA, 22 bp, Homo sapiens
ccaaactgggtcttcagcttta

SEQ ID NO: 6051779 - DNA, 14 bp, Homo sapiens
ccaaactgtagtaa

SEQ ID NO: 6051780 - DNA, 22 bp, Homo sapiens
ccaaactgtccctcccttgctg

SEQ ID NO: 6051781 - DNA, 20 bp, Homo sapiens
ccaaactgtctttgtcacca

SEQ ID NO: 6051782 - DNA, 22 bp, Homo sapiens
ccaaacttctgaactttggaag

SEQ ID NO: 6051783 - DNA, 12 bp, Homo sapiens
ccaaactttaaa

SEQ ID NO: 6051784 - DNA, 16 bp, Homo sapiens
ccaaactttaaaatgc

SEQ ID NO: 6051785 - DNA, 23 bp, Homo sapiens
cccacgagggtctcccctcctgc

SEQ ID NO: 6051786 - DNA, 14 bp, Homo sapiens
cccacgagtcacct

SEQ ID NO: 6051787 - DNA, 20 bp, Homo sapiens
cccacgagtcacctgcaagc

SEQ ID NO: 6051788 - DNA, 13 bp, Homo sapiens
cccacgatcccct

SEQ ID NO: 6051789 - DNA, 19 bp, Homo sapiens
cccacgatggaatgtaaaa

SEQ ID NO: 6051790 - DNA, 22 bp, Homo sapiens
cccacgattggtatgatgctgc

SEQ ID NO: 6051791 - DNA, 18 bp, Homo sapiens
cccacgattttctccagc

SEQ ID NO: 6051792 - DNA, 22 bp, Homo sapiens
cccacgcacgacgtcagcctct

SEQ ID NO: 6051793 - DNA, 12 bp, Homo sapiens
cccacgcagagc

SEQ ID NO: 6051794 - DNA, 15 bp, Homo sapiens
cccacgcagagcccc

SEQ ID NO: 6051795 - DNA, 16 bp, Homo sapiens
cccacgcagagccccg

SEQ ID NO: 6051796 - DNA, 23 bp, Homo sapiens
cccacgcagagccccggagcacc

SEQ ID NO: 6051797 - DNA, 13 bp, Homo sapiens
cccacgccacagc

SEQ ID NO: 6051798 - DNA, 17 bp, Homo sapiens
cccacgccacagccctt

SEQ ID NO: 6051799 - DNA, 13 bp, Homo sapiens
cccacgccagctg

SEQ ID NO: 6051800 - DNA, 16 bp, Homo sapiens
cccacgccaggccagc

SEQ ID NO: 6051801 - DNA, 13 bp, Homo sapiens
cccacgcccccac

SEQ ID NO: 6051802 - DNA, 15 bp, Homo sapiens
cccacgcccccactg

SEQ ID NO: 6051803 - DNA, 19 bp, Homo sapiens
cccacgcccccactggtga

SEQ ID NO: 6051804 - DNA, 16 bp, Homo sapiens
cccacgcccccatgca

SEQ ID NO: 6051805 - DNA, 17 bp, Homo sapiens
cccacgcccccatgcag

SEQ ID NO: 6051806 - DNA, 17 bp, Homo sapiens
cccacgcccctccccag

SEQ ID NO: 6051807 - DNA, 18 bp, Homo sapiens
cccacgcccctccccagc

SEQ ID NO: 6051808 - DNA, 17 bp, Homo sapiens
cccacgcccgcaccccc

SEQ ID NO: 6051809 - DNA, 18 bp, Homo sapiens
cccacgcccgcacccccg

SEQ ID NO: 6051810 - DNA, 13 bp, Homo sapiens
cccacgccctgtt

SEQ ID NO: 6051811 - DNA, 16 bp, Homo sapiens
cccacgccctgttcac

SEQ ID NO: 6051812 - DNA, 18 bp, Homo sapiens
cccacgcccttggagcct

SEQ ID NO: 6051813 - DNA, 16 bp, Homo sapiens
cccacgccggcctctg

SEQ ID NO: 6051814 - DNA, 13 bp, Homo sapiens
cccacgcctccat

SEQ ID NO: 6051815 - DNA, 15 bp, Homo sapiens
cccacgctcaccccc

SEQ ID NO: 6051816 - DNA, 16 bp, Homo sapiens
cccacgctcctgccct

SEQ ID NO: 6051817 - DNA, 20 bp, Homo sapiens
cccacgctgactacagggcc

SEQ ID NO: 6051818 - DNA, 20 bp, Homo sapiens
cccacgctggagtgcagtga

SEQ ID NO: 6051819 - DNA, 15 bp, Homo sapiens
cccacgctgggtatt

SEQ ID NO: 6051820 - DNA, 13 bp, Homo sapiens
cccacgcttctct

SEQ ID NO: 6051821 - DNA, 15 bp, Homo sapiens
cccacgcttctggag

SEQ ID NO: 6051822 - DNA, 16 bp, Homo sapiens
cccacgcttctggagg

SEQ ID NO: 6051823 - DNA, 19 bp, Homo sapiens
cccacgcttctggaggtgg

SEQ ID NO: 6051824 - DNA, 22 bp, Homo sapiens
cccacggaaaatgccaatctct

SEQ ID NO: 6051825 - DNA, 18 bp, Homo sapiens
cccacggaaggcgggctg

SEQ ID NO: 6051826 - DNA, 18 bp, Homo sapiens
cccacggagacagaggaa

SEQ ID NO: 6051827 - DNA, 17 bp, Homo sapiens
cccacggagccctccct

SEQ ID NO: 6051828 - DNA, 22 bp, Homo sapiens
cccacggagccctccctatgtc

SEQ ID NO: 6051829 - DNA, 14 bp, Homo sapiens
cccacggaggagtt

SEQ ID NO: 6051830 - DNA, 22 bp, Homo sapiens
cccacggatgttgtcaggaatc

SEQ ID NO: 6051831 - DNA, 23 bp, Homo sapiens
cccacggcacctcggggacacca

SEQ ID NO: 6051832 - DNA, 14 bp, Homo sapiens
cccacggccaccca

SEQ ID NO: 6051833 - DNA, 17 bp, Homo sapiens
cccacggccacccaccc

SEQ ID NO: 6051834 - DNA, 13 bp, Homo sapiens
cccacggccactg

SEQ ID NO: 6051835 - DNA, 15 bp, Homo sapiens
cccacggccactgca

SEQ ID NO: 6051836 - DNA, 22 bp, Homo sapiens
cccacggccctgtcagagccgc

SEQ ID NO: 6051837 - DNA, 14 bp, Homo sapiens
cccacggccgctcc

SEQ ID NO: 6051838 - DNA, 17 bp, Homo sapiens
cccacggccgctccagg

SEQ ID NO: 6051839 - DNA, 15 bp, Homo sapiens
cccacggcctttcta

SEQ ID NO: 6051840 - DNA, 17 bp, Homo sapiens
cccacgggccggccagc

SEQ ID NO: 6051841 - DNA, 20 bp, Homo sapiens
cccacggggaccactgggcc

SEQ ID NO: 6051842 - DNA, 16 bp, Homo sapiens
cccacggggatcacag

SEQ ID NO: 6051843 - DNA, 21 bp, Homo sapiens
cccacggggcaaagctgctgg

SEQ ID NO: 6051844 - DNA, 22 bp, Homo sapiens
cccacggggcaaagctgctggg

SEQ ID NO: 6051845 - DNA, 22 bp, Homo sapiens
cccacggggcagttagagcagc

SEQ ID NO: 6051846 - DNA, 17 bp, Homo sapiens
cccacggtctgagctag

SEQ ID NO: 6051847 - DNA, 24 bp, Homo sapiens
cccacggtctgagctagctagcgc

SEQ ID NO: 6051848 - DNA, 15 bp, Homo sapiens
cccacgtcaggcctg

SEQ ID NO: 6051849 - DNA, 21 bp, Homo sapiens
cccacgtcaggcctggcctca

SEQ ID NO: 6051850 - DNA, 15 bp, Homo sapiens
cccacgtcccgggca

SEQ ID NO: 6051851 - DNA, 18 bp, Homo sapiens
cccacgtcccgggcactg

SEQ ID NO: 6051852 - DNA, 19 bp, Homo sapiens
cccacgtccctgcggaagc

SEQ ID NO: 6051853 - DNA, 13 bp, Homo sapiens
cccacgtcctgtc

SEQ ID NO: 6051854 - DNA, 19 bp, Homo sapiens
cccacgtcctgtcagtgcc

SEQ ID NO: 6051855 - DNA, 22 bp, Homo sapiens
cccacgtctctctgcctgctgg

SEQ ID NO: 6051856 - DNA, 23 bp, Homo sapiens
cccacgtctctctgcctgctggg

SEQ ID NO: 6051857 - DNA, 15 bp, Homo sapiens
cccacgtctgtcctc

SEQ ID NO: 6051858 - DNA, 19 bp, Homo sapiens
cccacgtggactctgtgct

SEQ ID NO: 6051859 - DNA, 20 bp, Homo sapiens
cccacgtggcacctcctcac

SEQ ID NO: 6051860 - DNA, 12 bp, Homo sapiens
cccacgtgggag

SEQ ID NO: 6051861 - DNA, 16 bp, Homo sapiens
cccacgttctcacacc

SEQ ID NO: 6051862 - DNA, 22 bp, Homo sapiens
cccacgttgacaccaagaaacc

SEQ ID NO: 6051863 - DNA, 11 bp, Homo sapiens
cccactaaaga

SEQ ID NO: 6051864 - DNA, 12 bp, Homo sapiens
cccactaaagag

SEQ ID NO: 6051865 - DNA, 14 bp, Homo sapiens
cccactaactgagg

SEQ ID NO: 6051866 - DNA, 23 bp, Homo sapiens
cccactaagtagaataaagaaaa

SEQ ID NO: 6051867 - DNA, 15 bp, Homo sapiens
cccactacgggcacc

SEQ ID NO: 6051868 - DNA, 22 bp, Homo sapiens
cccactactcaatactacctct

SEQ ID NO: 6051869 - DNA, 14 bp, Homo sapiens
cccactagagggcc

SEQ ID NO: 6051870 - DNA, 18 bp, Homo sapiens
cccactagagggcccatc

SEQ ID NO: 6051871 - DNA, 14 bp, Homo sapiens
cccactagccctct

SEQ ID NO: 6051872 - DNA, 18 bp, Homo sapiens
cccactatccttcgtgaa

SEQ ID NO: 6051873 - DNA, 16 bp, Homo sapiens
cccactcaagccaagc

SEQ ID NO: 6051874 - DNA, 20 bp, Homo sapiens
cccactcaagccaagcagcc

SEQ ID NO: 6051875 - DNA, 16 bp, Homo sapiens
cccactcaccagccct

SEQ ID NO: 6051876 - DNA, 17 bp, Homo sapiens
cccactcaccagcccta

SEQ ID NO: 6051877 - DNA, 13 bp, Homo sapiens
cccactcaccccc

SEQ ID NO: 6051878 - DNA, 19 bp, Homo sapiens
cccactcacctttctccac

SEQ ID NO: 6051879 - DNA, 18 bp, Homo sapiens
cccactcagaactctcca

SEQ ID NO: 6051880 - DNA, 14 bp, Homo sapiens
cccactcagccttt

SEQ ID NO: 6051881 - DNA, 16 bp, Homo sapiens
cccactcaggattggg

SEQ ID NO: 6051882 - DNA, 15 bp, Homo sapiens
cccactcagtgcctc

SEQ ID NO: 6051883 - DNA, 18 bp, Homo sapiens
cccactccaagccagcaa

SEQ ID NO: 6051884 - DNA, 11 bp, Homo sapiens
cccactccagc

SEQ ID NO: 6051885 - DNA, 16 bp, Homo sapiens
cccactccagcccgca

SEQ ID NO: 6051886 - DNA, 17 bp, Homo sapiens
cccactccagccctgtc

SEQ ID NO: 6051887 - DNA, 14 bp, Homo sapiens
cccactccagctga

SEQ ID NO: 6051888 - DNA, 15 bp, Homo sapiens
cccactccagtccac

SEQ ID NO: 6051889 - DNA, 14 bp, Homo sapiens
cccactccatctgg

SEQ ID NO: 6051890 - DNA, 19 bp, Homo sapiens
cccactccatctggtagaa

SEQ ID NO: 6051891 - DNA, 12 bp, Homo sapiens
cccactcccaca

SEQ ID NO: 6051892 - DNA, 16 bp, Homo sapiens
cccactcccaggacca

SEQ ID NO: 6051893 - DNA, 22 bp, Homo sapiens
cccactcccatggctctgggcg

SEQ ID NO: 6051894 - DNA, 13 bp, Homo sapiens
cccactccccagc

SEQ ID NO: 6051895 - DNA, 20 bp, Homo sapiens
cccactcccccaggagcagc

SEQ ID NO: 6051896 - DNA, 24 bp, Homo sapiens
cccactcccccgtttctccttttc

SEQ ID NO: 6051897 - DNA, 14 bp, Homo sapiens
cccactcccctcac

SEQ ID NO: 6051898 - DNA, 13 bp, Homo sapiens
cccactcccgaaa

SEQ ID NO: 6051899 - DNA, 16 bp, Homo sapiens
cccactcccgcctcag

SEQ ID NO: 6051900 - DNA, 15 bp, Homo sapiens
cccactccctgccac

SEQ ID NO: 6051901 - DNA, 19 bp, Homo sapiens
cccactccctgccaccgtc

SEQ ID NO: 6051902 - DNA, 22 bp, Homo sapiens
cccactccctgccaccgtcaca

SEQ ID NO: 6051903 - DNA, 15 bp, Homo sapiens
cccactccctgccta

SEQ ID NO: 6051904 - DNA, 15 bp, Homo sapiens
cccactccctgctct

SEQ ID NO: 6051905 - DNA, 13 bp, Homo sapiens
cccactccctggc

SEQ ID NO: 6051906 - DNA, 20 bp, Homo sapiens
cccactccctggctctcaga

SEQ ID NO: 6051907 - DNA, 22 bp, Homo sapiens
cccactccctggctctcagaag

SEQ ID NO: 6051908 - DNA, 13 bp, Homo sapiens
cccactccctgtc

SEQ ID NO: 6051909 - DNA, 12 bp, Homo sapiens
cccactcccttg

SEQ ID NO: 6051910 - DNA, 17 bp, Homo sapiens
cccactccgccagccac

SEQ ID NO: 6051911 - DNA, 18 bp, Homo sapiens
cccactccgccagccaca

SEQ ID NO: 6051912 - DNA, 19 bp, Homo sapiens
cccactcctaggacatgtt

SEQ ID NO: 6051913 - DNA, 15 bp, Homo sapiens
cccactcctcctcct

SEQ ID NO: 6051914 - DNA, 13 bp, Homo sapiens
cccactcctctcc

SEQ ID NO: 6051915 - DNA, 18 bp, Homo sapiens
cccactcctgctctgctc

SEQ ID NO: 6051916 - DNA, 13 bp, Homo sapiens
cccactcctgctg

SEQ ID NO: 6051917 - DNA, 12 bp, Homo sapiens
cccactcctgtc

SEQ ID NO: 6051918 - DNA, 13 bp, Homo sapiens
cccactcctgtca

SEQ ID NO: 6051919 - DNA, 22 bp, Homo sapiens
cccactctactgccccagctcc

SEQ ID NO: 6051920 - DNA, 11 bp, Homo sapiens
cccactctcag

SEQ ID NO: 6051921 - DNA, 13 bp, Homo sapiens
cccactctcagag

SEQ ID NO: 6051922 - DNA, 21 bp, Homo sapiens
cccactctcattccccaggtg

SEQ ID NO: 6051923 - DNA, 16 bp, Homo sapiens
cccactctccacctca

SEQ ID NO: 6051924 - DNA, 23 bp, Homo sapiens
cccactctccacctcactagctc

SEQ ID NO: 6051925 - DNA, 11 bp, Homo sapiens
cccactctccc

SEQ ID NO: 6051926 - DNA, 14 bp, Homo sapiens
cccactctccccac

SEQ ID NO: 6051927 - DNA, 12 bp, Homo sapiens
cccactctccta

SEQ ID NO: 6051928 - DNA, 15 bp, Homo sapiens
cccactctcctaggc

SEQ ID NO: 6051929 - DNA, 17 bp, Homo sapiens
cccactctctcacccac

SEQ ID NO: 6051930 - DNA, 21 bp, Homo sapiens
cccactctctcacccaccagc

SEQ ID NO: 6051931 - DNA, 16 bp, Homo sapiens
cccactctgcctgcct

SEQ ID NO: 6051932 - DNA, 17 bp, Homo sapiens
cccactctgcctgcctg

SEQ ID NO: 6051933 - DNA, 18 bp, Homo sapiens
cccactctgctctgatgc

SEQ ID NO: 6051934 - DNA, 13 bp, Homo sapiens
cccactctgctga

SEQ ID NO: 6051935 - DNA, 15 bp, Homo sapiens
cccactctgctgagg

SEQ ID NO: 6051936 - DNA, 22 bp, Homo sapiens
cccactctgggcaaagcccctc

SEQ ID NO: 6051937 - DNA, 13 bp, Homo sapiens
cccactctggtgg

SEQ ID NO: 6051938 - DNA, 21 bp, Homo sapiens
cccactctggtggccacttca

SEQ ID NO: 6051939 - DNA, 15 bp, Homo sapiens
cccactcttgaagag

SEQ ID NO: 6051940 - DNA, 22 bp, Homo sapiens
cccactctttgctacaataaat

SEQ ID NO: 6051941 - DNA, 22 bp, Homo sapiens
cccactgaaggattaatgaaaa

SEQ ID NO: 6051942 - DNA, 14 bp, Homo sapiens
cccactgacaccca

SEQ ID NO: 6051943 - DNA, 15 bp, Homo sapiens
cccactgacctgccc

SEQ ID NO: 6051944 - DNA, 16 bp, Homo sapiens
cccactgacctgccca

SEQ ID NO: 6051945 - DNA, 20 bp, Homo sapiens
cccactgacctgcccatgtc

SEQ ID NO: 6051946 - DNA, 14 bp, Homo sapiens
cccactgagagctg

SEQ ID NO: 6051947 - DNA, 17 bp, Homo sapiens
cccactgagagctgctc

SEQ ID NO: 6051948 - DNA, 22 bp, Homo sapiens
cccactgagagctgctcctttg

SEQ ID NO: 6051949 - DNA, 20 bp, Homo sapiens
cccactgaggggccagggag

SEQ ID NO: 6051950 - DNA, 20 bp, Homo sapiens
cccactgatatcacgggccc

SEQ ID NO: 6051951 - DNA, 21 bp, Homo sapiens
cccactgatatcacgggcccg

SEQ ID NO: 6051952 - DNA, 15 bp, Homo sapiens
cccactgcaacttgt

SEQ ID NO: 6051953 - DNA, 20 bp, Homo sapiens
cccactgcacccccctgtgc

SEQ ID NO: 6051954 - DNA, 22 bp, Homo sapiens
cccactgcacccccctgtgcct

SEQ ID NO: 6051955 - DNA, 15 bp, Homo sapiens
cccactgcaccccct

SEQ ID NO: 6051956 - DNA, 21 bp, Homo sapiens
cccactgcaccccctcctgct

SEQ ID NO: 6051957 - DNA, 22 bp, Homo sapiens
cccactgcaccccctcctgctg

SEQ ID NO: 6051958 - DNA, 18 bp, Homo sapiens
cccactgcaccgcctcag

SEQ ID NO: 6051959 - DNA, 21 bp, Homo sapiens
cccactgcacttggtgctgct

SEQ ID NO: 6051960 - DNA, 23 bp, Homo sapiens
cccactgcatcctactcctacct

SEQ ID NO: 6051961 - DNA, 18 bp, Homo sapiens
cccactgcatgcagaaac

SEQ ID NO: 6051962 - DNA, 13 bp, Homo sapiens
cccactgccagca

SEQ ID NO: 6051963 - DNA, 14 bp, Homo sapiens
cccactgccagcag

SEQ ID NO: 6051964 - DNA, 21 bp, Homo sapiens
cccactgccagcagcagcagg

SEQ ID NO: 6051965 - DNA, 19 bp, Homo sapiens
ccaaactttaaaatgcgaa

SEQ ID NO: 6051966 - DNA, 11 bp, Homo sapiens
ccaaagaaaat

SEQ ID NO: 6051967 - DNA, 14 bp, Homo sapiens
ccaaagaaacaagc

SEQ ID NO: 6051968 - DNA, 17 bp, Homo sapiens
ccaaagaaacaagctgt

SEQ ID NO: 6051969 - DNA, 22 bp, Homo sapiens
ccaaagaaacactaagctctct

SEQ ID NO: 6051970 - DNA, 11 bp, Homo sapiens
ccaaagaaact

SEQ ID NO: 6051971 - DNA, 19 bp, Homo sapiens
ccaaagaaactcagaagag

SEQ ID NO: 6051972 - DNA, 11 bp, Homo sapiens
ccaaagaaagt

SEQ ID NO: 6051973 - DNA, 12 bp, Homo sapiens
ccaaagaaagtt

SEQ ID NO: 6051974 - DNA, 20 bp, Homo sapiens
ccaaagaaatagggcatggc

SEQ ID NO: 6051975 - DNA, 16 bp, Homo sapiens
ccaaagaaatgaacat

SEQ ID NO: 6051976 - DNA, 19 bp, Homo sapiens
ccaaagaaatgggcctgcc

SEQ ID NO: 6051977 - DNA, 23 bp, Homo sapiens
ccaaagaaatgggcctgcctgcc

SEQ ID NO: 6051978 - DNA, 17 bp, Homo sapiens
ccaaagaaatgtaaggg

SEQ ID NO: 6051979 - DNA, 14 bp, Homo sapiens
ccaaagaacagcct

SEQ ID NO: 6051980 - DNA, 16 bp, Homo sapiens
ccaaagaacttgattt

SEQ ID NO: 6051981 - DNA, 21 bp, Homo sapiens
ccaaagaagatagctctctga

SEQ ID NO: 6051982 - DNA, 15 bp, Homo sapiens
ccaaagaaggcaggg

SEQ ID NO: 6051983 - DNA, 16 bp, Homo sapiens
ccaaagaaggcaggga

SEQ ID NO: 6051984 - DNA, 19 bp, Homo sapiens
ccaaagaatgttagagcac

SEQ ID NO: 6051985 - DNA, 16 bp, Homo sapiens
ccaaagaattggaatc

SEQ ID NO: 6051986 - DNA, 14 bp, Homo sapiens
ccaaagacaaatag

SEQ ID NO: 6051987 - DNA, 14 bp, Homo sapiens
ccaaagacctgcct

SEQ ID NO: 6051988 - DNA, 16 bp, Homo sapiens
ccaaagacctgcctgt

SEQ ID NO: 6051989 - DNA, 21 bp, Homo sapiens
ccaaagacgatacagcttggc

SEQ ID NO: 6051990 - DNA, 18 bp, Homo sapiens
ccaaagactctggaggtc

SEQ ID NO: 6051991 - DNA, 14 bp, Homo sapiens
ccaaagactgtact

SEQ ID NO: 6051992 - DNA, 16 bp, Homo sapiens
ccaaagagaaaagatt

SEQ ID NO: 6051993 - DNA, 12 bp, Homo sapiens
ccaaagagaaag

SEQ ID NO: 6051994 - DNA, 17 bp, Homo sapiens
ccaaagagaaggcctgg

SEQ ID NO: 6051995 - DNA, 20 bp, Homo sapiens
ccaaagagactggagcatct

SEQ ID NO: 6051996 - DNA, 14 bp, Homo sapiens
ccaaagagcacaaa

SEQ ID NO: 6051997 - DNA, 12 bp, Homo sapiens
ccaaagagcctg

SEQ ID NO: 6051998 - DNA, 14 bp, Homo sapiens
ccaaagagcctgga

SEQ ID NO: 6051999 - DNA, 17 bp, Homo sapiens
ccaaagagcctggagaa

SEQ ID NO: 6052000 - DNA, 18 bp, Homo sapiens
ccaaagagcctggagaag

SEQ ID NO: 6052001 - DNA, 17 bp, Homo sapiens
ccaaagagctctttttt

SEQ ID NO: 6052002 - DNA, 12 bp, Homo sapiens
ccaaagagctgc

SEQ ID NO: 6052003 - DNA, 15 bp, Homo sapiens
ccaaagagctgtggc

SEQ ID NO: 6052004 - DNA, 16 bp, Homo sapiens
ccaaagagctgtggct

SEQ ID NO: 6052005 - DNA, 19 bp, Homo sapiens
ccaaagagctgtggctggg

SEQ ID NO: 6052006 - DNA, 14 bp, Homo sapiens
ccaaagaggctgcc

SEQ ID NO: 6052007 - DNA, 19 bp, Homo sapiens
ccaaagaggggtcaccagg

SEQ ID NO: 6052008 - DNA, 22 bp, Homo sapiens
ccaaagagtagaattgcattga

SEQ ID NO: 6052009 - DNA, 16 bp, Homo sapiens
ccaaagagtcatcatg

SEQ ID NO: 6052010 - DNA, 17 bp, Homo sapiens
ccaaagagtctctggct

SEQ ID NO: 6052011 - DNA, 22 bp, Homo sapiens
ccaaagagtctctggctcagct

SEQ ID NO: 6052012 - DNA, 15 bp, Homo sapiens
ccaaagagtgatagt

SEQ ID NO: 6052013 - DNA, 15 bp, Homo sapiens
ccaaagataaggact

SEQ ID NO: 6052014 - DNA, 14 bp, Homo sapiens
ccaaagataatgtt

SEQ ID NO: 6052015 - DNA, 16 bp, Homo sapiens
ccaaagatctgctcct

SEQ ID NO: 6052016 - DNA, 14 bp, Homo sapiens
ccaaagatgcagcc

SEQ ID NO: 6052017 - DNA, 18 bp, Homo sapiens
ccaaagatgcagccgcct

SEQ ID NO: 6052018 - DNA, 19 bp, Homo sapiens
ccaaagatgcagccgcctt

SEQ ID NO: 6052019 - DNA, 23 bp, Homo sapiens
ccaaagatgcagccgccttcctt

SEQ ID NO: 6052020 - DNA, 17 bp, Homo sapiens
ccaaagatgtcctgact

SEQ ID NO: 6052021 - DNA, 11 bp, Homo sapiens
ccaaagcaaaa

SEQ ID NO: 6052022 - DNA, 22 bp, Homo sapiens
ccaaagcaaaacatcacattcc

SEQ ID NO: 6052023 - DNA, 17 bp, Homo sapiens
ccaaagcaaagaaaata

SEQ ID NO: 6052024 - DNA, 17 bp, Homo sapiens
ccaaagcaagcacctgg

SEQ ID NO: 6052025 - DNA, 20 bp, Homo sapiens
ccaaagcaagcacctgggtg

SEQ ID NO: 6052026 - DNA, 15 bp, Homo sapiens
ccaaagcaatatttc

SEQ ID NO: 6052027 - DNA, 13 bp, Homo sapiens
ccaaagcacagct

SEQ ID NO: 6052028 - DNA, 14 bp, Homo sapiens
ccaaagcagacagc

SEQ ID NO: 6052029 - DNA, 18 bp, Homo sapiens
ccaaagcagattttccta

SEQ ID NO: 6052030 - DNA, 15 bp, Homo sapiens
ccaaagcagggtctg

SEQ ID NO: 6052031 - DNA, 19 bp, Homo sapiens
ccaaagcagtgcatgctgt

SEQ ID NO: 6052032 - DNA, 21 bp, Homo sapiens
ccaaagcagttgggagtacat

SEQ ID NO: 6052033 - DNA, 13 bp, Homo sapiens
ccaaagcatggac

SEQ ID NO: 6052034 - DNA, 20 bp, Homo sapiens
ccaaagccaataacacacag

SEQ ID NO: 6052035 - DNA, 21 bp, Homo sapiens
ccaaagccaataacacacagc

SEQ ID NO: 6052036 - DNA, 14 bp, Homo sapiens
ccaaagccaatgtg

SEQ ID NO: 6052037 - DNA, 16 bp, Homo sapiens
ccaaagccacctgctg

SEQ ID NO: 6052038 - DNA, 18 bp, Homo sapiens
ccaaagccacctgctgcg

SEQ ID NO: 6052039 - DNA, 19 bp, Homo sapiens
ccaaagccccatgtgcctt

SEQ ID NO: 6052040 - DNA, 23 bp, Homo sapiens
ccaaagcctagacaacctttctg

SEQ ID NO: 6052041 - DNA, 22 bp, Homo sapiens
ccaaagcctgaggacagaaaga

SEQ ID NO: 6052042 - DNA, 16 bp, Homo sapiens
ccaaagcctgtcccag

SEQ ID NO: 6052043 - DNA, 17 bp, Homo sapiens
ccaaagcgaattttaaa

SEQ ID NO: 6052044 - DNA, 18 bp, Homo sapiens
ccaaagctagggtggccc

SEQ ID NO: 6052045 - DNA, 15 bp, Homo sapiens
ccaaagctgaagatc

SEQ ID NO: 6052046 - DNA, 13 bp, Homo sapiens
ccaaagctgccca

SEQ ID NO: 6052047 - DNA, 12 bp, Homo sapiens
ccaaagctgcct

SEQ ID NO: 6052048 - DNA, 20 bp, Homo sapiens
ccaaagctgcctgtgccatg

SEQ ID NO: 6052049 - DNA, 17 bp, Homo sapiens
ccaaagctgctttcttc

SEQ ID NO: 6052050 - DNA, 22 bp, Homo sapiens
ccaaagctgctttcttctctgc

SEQ ID NO: 6052051 - DNA, 17 bp, Homo sapiens
ccaaagctggaactgaa

SEQ ID NO: 6052052 - DNA, 15 bp, Homo sapiens
ccaaagctggcccag

SEQ ID NO: 6052053 - DNA, 16 bp, Homo sapiens
ccaaagctggcccagt

SEQ ID NO: 6052054 - DNA, 13 bp, Homo sapiens
ccaaagctggtct

SEQ ID NO: 6052055 - DNA, 14 bp, Homo sapiens
ccaaagctgttcca

SEQ ID NO: 6052056 - DNA, 17 bp, Homo sapiens
ccaaagctgttccatta

SEQ ID NO: 6052057 - DNA, 18 bp, Homo sapiens
ccaaagctttactactgt

SEQ ID NO: 6052058 - DNA, 14 bp, Homo sapiens
ccaaagctttcctg

SEQ ID NO: 6052059 - DNA, 17 bp, Homo sapiens
ccaaaggaaaaagcaca

SEQ ID NO: 6052060 - DNA, 14 bp, Homo sapiens
ccaaaggaacactg

SEQ ID NO: 6052061 - DNA, 16 bp, Homo sapiens
ccaaaggaacactgac

SEQ ID NO: 6052062 - DNA, 16 bp, Homo sapiens
ccaaaggaactctaga

SEQ ID NO: 6052063 - DNA, 20 bp, Homo sapiens
ccaaaggacattatgtgtgc

SEQ ID NO: 6052064 - DNA, 18 bp, Homo sapiens
ccaaaggacgcactgagc

SEQ ID NO: 6052065 - DNA, 19 bp, Homo sapiens
ccaaaggacgcactgagca

SEQ ID NO: 6052066 - DNA, 17 bp, Homo sapiens
ccaaaggactccaccca

SEQ ID NO: 6052067 - DNA, 18 bp, Homo sapiens
ccaaaggagctatggaga

SEQ ID NO: 6052068 - DNA, 15 bp, Homo sapiens
ccaaaggaggctggc

SEQ ID NO: 6052069 - DNA, 19 bp, Homo sapiens
ccaaaggagtgcatggcca

SEQ ID NO: 6052070 - DNA, 23 bp, Homo sapiens
ccaaaggagtgcatggccacagc

SEQ ID NO: 6052071 - DNA, 21 bp, Homo sapiens
ccaaaggatgagaatgtgacc

SEQ ID NO: 6052072 - DNA, 19 bp, Homo sapiens
ccaaaggatgtgatatata

SEQ ID NO: 6052073 - DNA, 16 bp, Homo sapiens
ccaaaggcactgaccc

SEQ ID NO: 6052074 - DNA, 13 bp, Homo sapiens
ccaaaggcagcta

SEQ ID NO: 6052075 - DNA, 17 bp, Homo sapiens
ccaaaggcagctaagat

SEQ ID NO: 6052076 - DNA, 22 bp, Homo sapiens
ccaaaggcagctaagatagaaa

SEQ ID NO: 6052077 - DNA, 16 bp, Homo sapiens
ccaaaggcatcccagc

SEQ ID NO: 6052078 - DNA, 18 bp, Homo sapiens
ccaaaggcatcccagcct

SEQ ID NO: 6052079 - DNA, 13 bp, Homo sapiens
ccaaaggccagcg

SEQ ID NO: 6052080 - DNA, 19 bp, Homo sapiens
ccaaaggccatggagagct

SEQ ID NO: 6052081 - DNA, 21 bp, Homo sapiens
ccaaaggccatggagagctgg

SEQ ID NO: 6052082 - DNA, 22 bp, Homo sapiens
ccaaaggccctaccagagggaa

SEQ ID NO: 6052083 - DNA, 18 bp, Homo sapiens
ccaaaggcggggtggcgg

SEQ ID NO: 6052084 - DNA, 14 bp, Homo sapiens
ccaaaggctccctg

SEQ ID NO: 6052085 - DNA, 22 bp, Homo sapiens
ccaaaggctcctgagacacatg

SEQ ID NO: 6052086 - DNA, 21 bp, Homo sapiens
ccaaaggctggtggcaagtgc

SEQ ID NO: 6052087 - DNA, 21 bp, Homo sapiens
ccaaagggaaaactcttcatt

SEQ ID NO: 6052088 - DNA, 21 bp, Homo sapiens
ccaaagggaagtgaggcccaa

SEQ ID NO: 6052089 - DNA, 24 bp, Homo sapiens
ccaaagggaagtgaggcccaagga

SEQ ID NO: 6052090 - DNA, 20 bp, Homo sapiens
ccaaagggagggtggcagag

SEQ ID NO: 6052091 - DNA, 21 bp, Homo sapiens
ccaaagggagggtggcagaga

SEQ ID NO: 6052092 - DNA, 23 bp, Homo sapiens
ccaaagggcacacccctggggct

SEQ ID NO: 6052093 - DNA, 12 bp, Homo sapiens
ccaaagggcagt

SEQ ID NO: 6052094 - DNA, 19 bp, Homo sapiens
ccaaaggggacctggaagg

SEQ ID NO: 6052095 - DNA, 16 bp, Homo sapiens
ccaaaggggagccaga

SEQ ID NO: 6052096 - DNA, 20 bp, Homo sapiens
ccaaaggggcctctcctttt

SEQ ID NO: 6052097 - DNA, 14 bp, Homo sapiens
ccaaaggggctgct

SEQ ID NO: 6052098 - DNA, 20 bp, Homo sapiens
ccaaaggggctgctggggca

SEQ ID NO: 6052099 - DNA, 23 bp, Homo sapiens
ccaaagggtgaagctatttatct

SEQ ID NO: 6052100 - DNA, 14 bp, Homo sapiens
ccaaagggtgctag

SEQ ID NO: 6052101 - DNA, 22 bp, Homo sapiens
ccaaaggtaagttgctattttc

SEQ ID NO: 6052102 - DNA, 14 bp, Homo sapiens
ccaaaggtcaatgt

SEQ ID NO: 6052103 - DNA, 21 bp, Homo sapiens
ccaaaggtccgcaccctgtcc

SEQ ID NO: 6052104 - DNA, 11 bp, Homo sapiens
ccaaaggtgct

SEQ ID NO: 6052105 - DNA, 14 bp, Homo sapiens
ccaaaggtggcagc

SEQ ID NO: 6052106 - DNA, 15 bp, Homo sapiens
ccaaaggtggcagct

SEQ ID NO: 6052107 - DNA, 14 bp, Homo sapiens
ccaaaggtggcctg

SEQ ID NO: 6052108 - DNA, 11 bp, Homo sapiens
ccaaaggttcc

SEQ ID NO: 6052109 - DNA, 22 bp, Homo sapiens
ccaaagtacactgtttcaaact

SEQ ID NO: 6052110 - DNA, 12 bp, Homo sapiens
ccaaagtacctt

SEQ ID NO: 6052111 - DNA, 20 bp, Homo sapiens
ccaaagtattaatgtacaga

SEQ ID NO: 6052112 - DNA, 14 bp, Homo sapiens
ccaaagtcacagga

SEQ ID NO: 6052113 - DNA, 15 bp, Homo sapiens
ccaaagtccaggcta

SEQ ID NO: 6052114 - DNA, 14 bp, Homo sapiens
ccaaagtcccttcc

SEQ ID NO: 6052115 - DNA, 21 bp, Homo sapiens
ccaaagtcccttcctgcttcc

SEQ ID NO: 6052116 - DNA, 16 bp, Homo sapiens
ccaaagtctcccttct

SEQ ID NO: 6052117 - DNA, 15 bp, Homo sapiens
ccaaagtctgccgcc

SEQ ID NO: 6052118 - DNA, 17 bp, Homo sapiens
ccaaagtctgccgccca

SEQ ID NO: 6052119 - DNA, 16 bp, Homo sapiens
ccaaagtcttaaaata

SEQ ID NO: 6052120 - DNA, 17 bp, Homo sapiens
ccaaagtgacctaccca

SEQ ID NO: 6052121 - DNA, 15 bp, Homo sapiens
ccaaagtgcagccct

SEQ ID NO: 6052122 - DNA, 19 bp, Homo sapiens
ccaaagtgcagcccttcct

SEQ ID NO: 6052123 - DNA, 21 bp, Homo sapiens
ccaaagtgcagcccttcctcc

SEQ ID NO: 6052124 - DNA, 17 bp, Homo sapiens
ccaaagtgcctgggaag

SEQ ID NO: 6052125 - DNA, 18 bp, Homo sapiens
ccaaagtgcgtgtgtgta

SEQ ID NO: 6052126 - DNA, 14 bp, Homo sapiens
ccaaagtgctggga

SEQ ID NO: 6052127 - DNA, 15 bp, Homo sapiens
ccaaagtgctgggat

SEQ ID NO: 6052128 - DNA, 23 bp, Homo sapiens
ccaaagtgctgggattacaggtg

SEQ ID NO: 6052129 - DNA, 16 bp, Homo sapiens
ccaaagtggggaggga

SEQ ID NO: 6052130 - DNA, 16 bp, Homo sapiens
ccaaagtggtttcagc

SEQ ID NO: 6052131 - DNA, 19 bp, Homo sapiens
ccaaagtgttaggattaca

SEQ ID NO: 6052132 - DNA, 16 bp, Homo sapiens
ccaaagtgttgggatt

SEQ ID NO: 6052133 - DNA, 19 bp, Homo sapiens
ccaaagttagttcagtagc

SEQ ID NO: 6052134 - DNA, 12 bp, Homo sapiens
ccaaagttctaa

SEQ ID NO: 6052135 - DNA, 14 bp, Homo sapiens
ccaaagttctaata

SEQ ID NO: 6052136 - DNA, 20 bp, Homo sapiens
ccaaagttctaataatttct

SEQ ID NO: 6052137 - DNA, 14 bp, Homo sapiens
ccaaagttcttatc

SEQ ID NO: 6052138 - DNA, 15 bp, Homo sapiens
ccaaagttgttgtaa

SEQ ID NO: 6052139 - DNA, 16 bp, Homo sapiens
ccaaataaaaactaaa

SEQ ID NO: 6052140 - DNA, 14 bp, Homo sapiens
ccaaataaaaatta

SEQ ID NO: 6052141 - DNA, 21 bp, Homo sapiens
ccaaataaaatgtttacattt

SEQ ID NO: 6052142 - DNA, 22 bp, Homo sapiens
ccaaataaaatgtttacatttt

SEQ ID NO: 6052143 - DNA, 12 bp, Homo sapiens
ccaaataaacag

SEQ ID NO: 6052144 - DNA, 14 bp, Homo sapiens
ccaaataaacagct

SEQ ID NO: 6052145 - DNA, 22 bp, Homo sapiens
cccactgccaggattttgtatt

SEQ ID NO: 6052146 - DNA, 16 bp, Homo sapiens
cccactgcccaccccc

SEQ ID NO: 6052147 - DNA, 19 bp, Homo sapiens
cccactgcccatggcatgt

SEQ ID NO: 6052148 - DNA, 16 bp, Homo sapiens
cccactgcccctgcac

SEQ ID NO: 6052149 - DNA, 14 bp, Homo sapiens
cccactgccctcca

SEQ ID NO: 6052150 - DNA, 17 bp, Homo sapiens
cccactgccctccaggg

SEQ ID NO: 6052151 - DNA, 20 bp, Homo sapiens
cccactgccctccagggcca

SEQ ID NO: 6052152 - DNA, 21 bp, Homo sapiens
cccactgccctccagggccag

SEQ ID NO: 6052153 - DNA, 23 bp, Homo sapiens
cccactgccctccagggccagga

SEQ ID NO: 6052154 - DNA, 18 bp, Homo sapiens
cccactgcctcctccctg

SEQ ID NO: 6052155 - DNA, 23 bp, Homo sapiens
cccactgcctcctccctggctgc

SEQ ID NO: 6052156 - DNA, 24 bp, Homo sapiens
cccactgcctcctccctggctgca

SEQ ID NO: 6052157 - DNA, 22 bp, Homo sapiens
cccactgcctcctgcctggggt

SEQ ID NO: 6052158 - DNA, 13 bp, Homo sapiens
cccactgcctgcc

SEQ ID NO: 6052159 - DNA, 20 bp, Homo sapiens
cccactgctaaggctgctgg

SEQ ID NO: 6052160 - DNA, 12 bp, Homo sapiens
cccactgctctg

SEQ ID NO: 6052161 - DNA, 14 bp, Homo sapiens
cccactgctggctg

SEQ ID NO: 6052162 - DNA, 15 bp, Homo sapiens
cccactgctggctgc

SEQ ID NO: 6052163 - DNA, 17 bp, Homo sapiens
cccactgctggtgccag

SEQ ID NO: 6052164 - DNA, 19 bp, Homo sapiens
cccactgctggtgccaggg

SEQ ID NO: 6052165 - DNA, 12 bp, Homo sapiens
cccactggacaa

SEQ ID NO: 6052166 - DNA, 16 bp, Homo sapiens
cccactggactcacct

SEQ ID NO: 6052167 - DNA, 22 bp, Homo sapiens
cccactggagcagaaggggaga

SEQ ID NO: 6052168 - DNA, 17 bp, Homo sapiens
cccactggatctggctt

SEQ ID NO: 6052169 - DNA, 12 bp, Homo sapiens
cccactggccag

SEQ ID NO: 6052170 - DNA, 15 bp, Homo sapiens
cccactggccagctc

SEQ ID NO: 6052171 - DNA, 21 bp, Homo sapiens
cccactggccagtcctagagc

SEQ ID NO: 6052172 - DNA, 22 bp, Homo sapiens
cccactggccagtcctagagct

SEQ ID NO: 6052173 - DNA, 13 bp, Homo sapiens
cccactggccgct

SEQ ID NO: 6052174 - DNA, 12 bp, Homo sapiens
cccactggctcc

SEQ ID NO: 6052175 - DNA, 18 bp, Homo sapiens
cccactggctcctcccag

SEQ ID NO: 6052176 - DNA, 23 bp, Homo sapiens
cccactggctgtgggctcccttc

SEQ ID NO: 6052177 - DNA, 20 bp, Homo sapiens
cccactgggactcccagcag

SEQ ID NO: 6052178 - DNA, 21 bp, Homo sapiens
cccactgggactcccagcaga

SEQ ID NO: 6052179 - DNA, 23 bp, Homo sapiens
cccactgggagagtccttagcct

SEQ ID NO: 6052180 - DNA, 10 bp, Homo sapiens
cccactgggc

SEQ ID NO: 6052181 - DNA, 13 bp, Homo sapiens
cccactgggccag

SEQ ID NO: 6052182 - DNA, 16 bp, Homo sapiens
cccactgggccctggg

SEQ ID NO: 6052183 - DNA, 21 bp, Homo sapiens
cccactggggaaataacagct

SEQ ID NO: 6052184 - DNA, 21 bp, Homo sapiens
cccactggggccggcggggcc

SEQ ID NO: 6052185 - DNA, 22 bp, Homo sapiens
cccactggggccggcggggccc

SEQ ID NO: 6052186 - DNA, 14 bp, Homo sapiens
cccactggtgagac

SEQ ID NO: 6052187 - DNA, 23 bp, Homo sapiens
cccactgtacttgctcttgatgc

SEQ ID NO: 6052188 - DNA, 22 bp, Homo sapiens
cccactgtcaggcctctgagcc

SEQ ID NO: 6052189 - DNA, 22 bp, Homo sapiens
cccactgtccccctacccaccg

SEQ ID NO: 6052190 - DNA, 14 bp, Homo sapiens
cccactgtcctacc

SEQ ID NO: 6052191 - DNA, 14 bp, Homo sapiens
cccactgtcctggg

SEQ ID NO: 6052192 - DNA, 16 bp, Homo sapiens
cccactgtcctgggcc

SEQ ID NO: 6052193 - DNA, 14 bp, Homo sapiens
cccactgtcctttc

SEQ ID NO: 6052194 - DNA, 16 bp, Homo sapiens
cccactgtcctttctc

SEQ ID NO: 6052195 - DNA, 23 bp, Homo sapiens
cccactgtcctttctccaggccc

SEQ ID NO: 6052196 - DNA, 20 bp, Homo sapiens
cccacttagcagggacagga

SEQ ID NO: 6052197 - DNA, 21 bp, Homo sapiens
cccacttagccgcaccctgca

SEQ ID NO: 6052198 - DNA, 15 bp, Homo sapiens
cccacttagtgctgg

SEQ ID NO: 6052199 - DNA, 18 bp, Homo sapiens
cccacttatgctgctgtg

SEQ ID NO: 6052200 - DNA, 19 bp, Homo sapiens
cccacttatgctgctgtga

SEQ ID NO: 6052201 - DNA, 17 bp, Homo sapiens
cccacttcacagctgga

SEQ ID NO: 6052202 - DNA, 12 bp, Homo sapiens
cccacttcactt

SEQ ID NO: 6052203 - DNA, 19 bp, Homo sapiens
cccacttcactttcttcaa

SEQ ID NO: 6052204 - DNA, 16 bp, Homo sapiens
cccacttcagcccagc

SEQ ID NO: 6052205 - DNA, 15 bp, Homo sapiens
cccacttcagcctcc

SEQ ID NO: 6052206 - DNA, 15 bp, Homo sapiens
cccacttcatgccca

SEQ ID NO: 6052207 - DNA, 19 bp, Homo sapiens
cccacttcatgcccactgc

SEQ ID NO: 6052208 - DNA, 15 bp, Homo sapiens
cccacttcccctcct

SEQ ID NO: 6052209 - DNA, 17 bp, Homo sapiens
cccacttcccctcctac

SEQ ID NO: 6052210 - DNA, 12 bp, Homo sapiens
cccacttccctg

SEQ ID NO: 6052211 - DNA, 17 bp, Homo sapiens
cccacttccctgacact

SEQ ID NO: 6052212 - DNA, 24 bp, Homo sapiens
cccacttccctgacactgcggggc

SEQ ID NO: 6052213 - DNA, 17 bp, Homo sapiens
cccacttccctgcaagg

SEQ ID NO: 6052214 - DNA, 22 bp, Homo sapiens
cccacttcctactgtaatagat

SEQ ID NO: 6052215 - DNA, 17 bp, Homo sapiens
cccacttcctcctacct

SEQ ID NO: 6052216 - DNA, 12 bp, Homo sapiens
cccacttcctgt

SEQ ID NO: 6052217 - DNA, 18 bp, Homo sapiens
cccacttctcatcacaca

SEQ ID NO: 6052218 - DNA, 14 bp, Homo sapiens
cccacttctggcat

SEQ ID NO: 6052219 - DNA, 17 bp, Homo sapiens
cccacttctggccacat

SEQ ID NO: 6052220 - DNA, 19 bp, Homo sapiens
cccacttctggcctccagc

SEQ ID NO: 6052221 - DNA, 18 bp, Homo sapiens
cccacttctgtgtagaca

SEQ ID NO: 6052222 - DNA, 13 bp, Homo sapiens
cccacttggggcc

SEQ ID NO: 6052223 - DNA, 14 bp, Homo sapiens
cccacttggggcct

SEQ ID NO: 6052224 - DNA, 17 bp, Homo sapiens
cccacttggttagatga

SEQ ID NO: 6052225 - DNA, 15 bp, Homo sapiens
cccacttgtcatcca

SEQ ID NO: 6052226 - DNA, 18 bp, Homo sapiens
cccacttgtccttagcct

SEQ ID NO: 6052227 - DNA, 21 bp, Homo sapiens
cccactttcatctaccttttc

SEQ ID NO: 6052228 - DNA, 13 bp, Homo sapiens
cccactttcctga

SEQ ID NO: 6052229 - DNA, 15 bp, Homo sapiens
cccactttcctgagc

SEQ ID NO: 6052230 - DNA, 16 bp, Homo sapiens
cccactttcctgagct

SEQ ID NO: 6052231 - DNA, 16 bp, Homo sapiens
cccactttcgcctcct

SEQ ID NO: 6052232 - DNA, 17 bp, Homo sapiens
cccactttcgcctcctc

SEQ ID NO: 6052233 - DNA, 19 bp, Homo sapiens
cccactttcgcctcctcca

SEQ ID NO: 6052234 - DNA, 20 bp, Homo sapiens
cccactttcgcctcctccag

SEQ ID NO: 6052235 - DNA, 22 bp, Homo sapiens
cccactttgctgttccttactt

SEQ ID NO: 6052236 - DNA, 18 bp, Homo sapiens
cccactttgtctgtacat

SEQ ID NO: 6052237 - DNA, 19 bp, Homo sapiens
cccactttgtctgtacata

SEQ ID NO: 6052238 - DNA, 23 bp, Homo sapiens
cccactttgtctgtacatactgg

SEQ ID NO: 6052239 - DNA, 21 bp, Homo sapiens
cccactttttttttttctgcc

SEQ ID NO: 6052240 - DNA, 23 bp, Homo sapiens
cccactttttttttttctgcctg

SEQ ID NO: 6052241 - DNA, 12 bp, Homo sapiens
cccagaaaaaag

SEQ ID NO: 6052242 - DNA, 16 bp, Homo sapiens
cccagaaaaaaggact

SEQ ID NO: 6052243 - DNA, 17 bp, Homo sapiens
cccagaaaaactggctc

SEQ ID NO: 6052244 - DNA, 16 bp, Homo sapiens
cccagaaaacctccag

SEQ ID NO: 6052245 - DNA, 18 bp, Homo sapiens
cccagaaaacctccagta

SEQ ID NO: 6052246 - DNA, 13 bp, Homo sapiens
cccagaaaagaaa

SEQ ID NO: 6052247 - DNA, 13 bp, Homo sapiens
cccagaaactgaa

SEQ ID NO: 6052248 - DNA, 17 bp, Homo sapiens
cccagaaagcctcagag

SEQ ID NO: 6052249 - DNA, 22 bp, Homo sapiens
cccagaaagcctcagagtcctg

SEQ ID NO: 6052250 - DNA, 19 bp, Homo sapiens
cccagaaagcctctctctc

SEQ ID NO: 6052251 - DNA, 15 bp, Homo sapiens
cccagaaagctgcca

SEQ ID NO: 6052252 - DNA, 14 bp, Homo sapiens
cccagaaaggagac

SEQ ID NO: 6052253 - DNA, 14 bp, Homo sapiens
cccagaaagtgggg

SEQ ID NO: 6052254 - DNA, 15 bp, Homo sapiens
cccagaaagtggggg

SEQ ID NO: 6052255 - DNA, 17 bp, Homo sapiens
cccagaaagtgggggtg

SEQ ID NO: 6052256 - DNA, 22 bp, Homo sapiens
cccagaaagtgggggtggagga

SEQ ID NO: 6052257 - DNA, 23 bp, Homo sapiens
cccagaaagtgggggtggaggac

SEQ ID NO: 6052258 - DNA, 17 bp, Homo sapiens
cccagaaatcactgtga

SEQ ID NO: 6052259 - DNA, 20 bp, Homo sapiens
cccagaaatcactgtgaaat

SEQ ID NO: 6052260 - DNA, 21 bp, Homo sapiens
cccagaaatcactgtgaaatt

SEQ ID NO: 6052261 - DNA, 17 bp, Homo sapiens
cccagaaatgccgctgt

SEQ ID NO: 6052262 - DNA, 19 bp, Homo sapiens
cccagaaattccttcccac

SEQ ID NO: 6052263 - DNA, 23 bp, Homo sapiens
cccagaacaaaaagaaatcttgt

SEQ ID NO: 6052264 - DNA, 22 bp, Homo sapiens
cccagaacccttcctgagacct

SEQ ID NO: 6052265 - DNA, 19 bp, Homo sapiens
cccagaacctctaagtgct

SEQ ID NO: 6052266 - DNA, 23 bp, Homo sapiens
cccagaacctctaagtgctgctg

SEQ ID NO: 6052267 - DNA, 15 bp, Homo sapiens
cccagaacctgtcct

SEQ ID NO: 6052268 - DNA, 17 bp, Homo sapiens
cccagaacctgtccttg

SEQ ID NO: 6052269 - DNA, 19 bp, Homo sapiens
cccagaacctgtccttgca

SEQ ID NO: 6052270 - DNA, 21 bp, Homo sapiens
cccagaaccttgatggggtga

SEQ ID NO: 6052271 - DNA, 17 bp, Homo sapiens
cccagaacctttttata

SEQ ID NO: 6052272 - DNA, 15 bp, Homo sapiens
cccagaacgcatgca

SEQ ID NO: 6052273 - DNA, 14 bp, Homo sapiens
cccagaacgggcct

SEQ ID NO: 6052274 - DNA, 15 bp, Homo sapiens
cccagaacgggcctc

SEQ ID NO: 6052275 - DNA, 18 bp, Homo sapiens
cccagaacgggcctcccc

SEQ ID NO: 6052276 - DNA, 11 bp, Homo sapiens
cccagaactag

SEQ ID NO: 6052277 - DNA, 14 bp, Homo sapiens
cccagaactctgcc

SEQ ID NO: 6052278 - DNA, 13 bp, Homo sapiens
cccagctgactgt

SEQ ID NO: 6052279 - DNA, 17 bp, Homo sapiens
cccagctgactgtggcc

SEQ ID NO: 6052280 - DNA, 21 bp, Homo sapiens
cccagctgatctaaggacccc

SEQ ID NO: 6052281 - DNA, 18 bp, Homo sapiens
cccagctgcaccccttcc

SEQ ID NO: 6052282 - DNA, 13 bp, Homo sapiens
cccagctgcacct

SEQ ID NO: 6052283 - DNA, 14 bp, Homo sapiens
cccagctgccaggc

SEQ ID NO: 6052284 - DNA, 17 bp, Homo sapiens
cccagctgccaggcggc

SEQ ID NO: 6052285 - DNA, 21 bp, Homo sapiens
cccagctgccaggcggccctg

SEQ ID NO: 6052286 - DNA, 15 bp, Homo sapiens
cccagctgccaggga

SEQ ID NO: 6052287 - DNA, 14 bp, Homo sapiens
cccagctgcccctc

SEQ ID NO: 6052288 - DNA, 13 bp, Homo sapiens
cccagctgccgcc

SEQ ID NO: 6052289 - DNA, 13 bp, Homo sapiens
cccagctgctccc

SEQ ID NO: 6052290 - DNA, 15 bp, Homo sapiens
cccagctgctcccct

SEQ ID NO: 6052291 - DNA, 17 bp, Homo sapiens
cccagctgctcccctgg

SEQ ID NO: 6052292 - DNA, 18 bp, Homo sapiens
cccagctgctcccctgga

SEQ ID NO: 6052293 - DNA, 13 bp, Homo sapiens
cccagctgctctg

SEQ ID NO: 6052294 - DNA, 19 bp, Homo sapiens
cccagctgctctgcccaga

SEQ ID NO: 6052295 - DNA, 20 bp, Homo sapiens
cccagctgctctgcccagag

SEQ ID NO: 6052296 - DNA, 23 bp, Homo sapiens
cccagctgctctgcccagagctg

SEQ ID NO: 6052297 - DNA, 13 bp, Homo sapiens
cccagctggcagc

SEQ ID NO: 6052298 - DNA, 11 bp, Homo sapiens
cccagctggcc

SEQ ID NO: 6052299 - DNA, 16 bp, Homo sapiens
cccagctggcctctag

SEQ ID NO: 6052300 - DNA, 12 bp, Homo sapiens
cccagctggctg

SEQ ID NO: 6052301 - DNA, 19 bp, Homo sapiens
cccagctggctgggtcgcc

SEQ ID NO: 6052302 - DNA, 12 bp, Homo sapiens
cccagctgggag

SEQ ID NO: 6052303 - DNA, 14 bp, Homo sapiens
cccagctgggaggc

SEQ ID NO: 6052304 - DNA, 15 bp, Homo sapiens
cccagctgggaggca

SEQ ID NO: 6052305 - DNA, 21 bp, Homo sapiens
cccagctgggaggcaagaggg

SEQ ID NO: 6052306 - DNA, 22 bp, Homo sapiens
cccagctgggaggcaagagggg

SEQ ID NO: 6052307 - DNA, 13 bp, Homo sapiens
cccagctgggctc

SEQ ID NO: 6052308 - DNA, 17 bp, Homo sapiens
cccagctgggctctgcc

SEQ ID NO: 6052309 - DNA, 19 bp, Homo sapiens
cccagctgggctctgccac

SEQ ID NO: 6052310 - DNA, 24 bp, Homo sapiens
cccagctgggctctgccaccctac

SEQ ID NO: 6052311 - DNA, 22 bp, Homo sapiens
cccagctgggctgttggctggg

SEQ ID NO: 6052312 - DNA, 23 bp, Homo sapiens
cccagctgggctgttggctgggg

SEQ ID NO: 6052313 - DNA, 22 bp, Homo sapiens
cccagctggggccaggctgggt

SEQ ID NO: 6052314 - DNA, 22 bp, Homo sapiens
cccagctggggcccctcggcta

SEQ ID NO: 6052315 - DNA, 13 bp, Homo sapiens
cccagctggtcct

SEQ ID NO: 6052316 - DNA, 13 bp, Homo sapiens
cccagctggtggc

SEQ ID NO: 6052317 - DNA, 23 bp, Homo sapiens
cccagctggtggccctgtgcctg

SEQ ID NO: 6052318 - DNA, 23 bp, Homo sapiens
cccagctggtgtcactctgcctc

SEQ ID NO: 6052319 - DNA, 20 bp, Homo sapiens
cccagctgtaccggccactg

SEQ ID NO: 6052320 - DNA, 12 bp, Homo sapiens
cccagctgtgac

SEQ ID NO: 6052321 - DNA, 15 bp, Homo sapiens
cccagctgtgactga

SEQ ID NO: 6052322 - DNA, 21 bp, Homo sapiens
cccagctgtgcccctccccca

SEQ ID NO: 6052323 - DNA, 21 bp, Homo sapiens
cccagctgtgctctggacagg

SEQ ID NO: 6052324 - DNA, 11 bp, Homo sapiens
cccagctgttt

SEQ ID NO: 6052325 - DNA, 23 bp, Homo sapiens
cccagcttaaatcctagcaggag

SEQ ID NO: 6052326 - DNA, 19 bp, Homo sapiens
cccagcttatctcctcctc

SEQ ID NO: 6052327 - DNA, 14 bp, Homo sapiens
cccagcttcacctc

SEQ ID NO: 6052328 - DNA, 19 bp, Homo sapiens
cccagcttcacctctggga

SEQ ID NO: 6052329 - DNA, 23 bp, Homo sapiens
cccagcttcacctctgggacccc

SEQ ID NO: 6052330 - DNA, 17 bp, Homo sapiens
cccagcttcacttctga

SEQ ID NO: 6052331 - DNA, 15 bp, Homo sapiens
ccaagccctggggca

SEQ ID NO: 6052332 - DNA, 16 bp, Homo sapiens
ccaagccctggggcag

SEQ ID NO: 6052333 - DNA, 17 bp, Homo sapiens
ccaagccctggggcagg

SEQ ID NO: 6052334 - DNA, 16 bp, Homo sapiens
ccaagccctggtgacc

SEQ ID NO: 6052335 - DNA, 19 bp, Homo sapiens
ccaagccgtaggacccagt

SEQ ID NO: 6052336 - DNA, 23 bp, Homo sapiens
ccaagccgtggcttcccgctcag

SEQ ID NO: 6052337 - DNA, 19 bp, Homo sapiens
ccaagcctccacagcgagg

SEQ ID NO: 6052338 - DNA, 11 bp, Homo sapiens
ccaagcctctg

SEQ ID NO: 6052339 - DNA, 20 bp, Homo sapiens
ccaagcctctgccccaaggg

SEQ ID NO: 6052340 - DNA, 12 bp, Homo sapiens
ccaagcctctgg

SEQ ID NO: 6052341 - DNA, 15 bp, Homo sapiens
ccaagcctctgtctt

SEQ ID NO: 6052342 - DNA, 20 bp, Homo sapiens
ccaagcctctgtcttttctg

SEQ ID NO: 6052343 - DNA, 13 bp, Homo sapiens
ccaagcctgacca

SEQ ID NO: 6052344 - DNA, 15 bp, Homo sapiens
ccaagcctgactttg

SEQ ID NO: 6052345 - DNA, 21 bp, Homo sapiens
ccaagcctgactttggggaca

SEQ ID NO: 6052346 - DNA, 17 bp, Homo sapiens
ccaagcctgcagctttc

SEQ ID NO: 6052347 - DNA, 13 bp, Homo sapiens
ccaagcctgcctc

SEQ ID NO: 6052348 - DNA, 16 bp, Homo sapiens
ccaagcctgctggctg

SEQ ID NO: 6052349 - DNA, 17 bp, Homo sapiens
ccaagcctgctggctgc

SEQ ID NO: 6052350 - DNA, 13 bp, Homo sapiens
ccaagcctgctgt

SEQ ID NO: 6052351 - DNA, 20 bp, Homo sapiens
ccaagcctgctgtgtccttc

SEQ ID NO: 6052352 - DNA, 20 bp, Homo sapiens
ccaagcctggagtaggcctg

SEQ ID NO: 6052353 - DNA, 21 bp, Homo sapiens
ccaagcctggagtaggcctgg

SEQ ID NO: 6052354 - DNA, 12 bp, Homo sapiens
ccaagcctggca

SEQ ID NO: 6052355 - DNA, 15 bp, Homo sapiens
ccaagcctggcaccc

SEQ ID NO: 6052356 - DNA, 16 bp, Homo sapiens
ccaagcctggcaccca

SEQ ID NO: 6052357 - DNA, 14 bp, Homo sapiens
ccaagcctggcagg

SEQ ID NO: 6052358 - DNA, 15 bp, Homo sapiens
ccaagcctggcaggg

SEQ ID NO: 6052359 - DNA, 16 bp, Homo sapiens
ccaagcctggcagggg

SEQ ID NO: 6052360 - DNA, 11 bp, Homo sapiens
ccaagcctggg

SEQ ID NO: 6052361 - DNA, 13 bp, Homo sapiens
ccaagcctggtct

SEQ ID NO: 6052362 - DNA, 23 bp, Homo sapiens
ccaagccttaaactgtacagaat

SEQ ID NO: 6052363 - DNA, 15 bp, Homo sapiens
ccaagccttctgtga

SEQ ID NO: 6052364 - DNA, 12 bp, Homo sapiens
ccaagccttggc

SEQ ID NO: 6052365 - DNA, 22 bp, Homo sapiens
ccaagccttggggattcttcca

SEQ ID NO: 6052366 - DNA, 24 bp, Homo sapiens
ccaagcgacctaaacagctgcttt

SEQ ID NO: 6052367 - DNA, 20 bp, Homo sapiens
ccaagcgaggtcaacagaga

SEQ ID NO: 6052368 - DNA, 13 bp, Homo sapiens
ccaagcgccctgg

SEQ ID NO: 6052369 - DNA, 22 bp, Homo sapiens
ccaagcggccttttccaaatgc

SEQ ID NO: 6052370 - DNA, 22 bp, Homo sapiens
ccaagcgggggcgtggctggcc

SEQ ID NO: 6052371 - DNA, 15 bp, Homo sapiens
ccaagcgtcccgtcc

SEQ ID NO: 6052372 - DNA, 13 bp, Homo sapiens
ccaagcgttcctg

SEQ ID NO: 6052373 - DNA, 17 bp, Homo sapiens
ccaagctaagcactgcc

SEQ ID NO: 6052374 - DNA, 17 bp, Homo sapiens
ccaagctaagctgcagg

SEQ ID NO: 6052375 - DNA, 18 bp, Homo sapiens
ccaagctaagctgcaggc

SEQ ID NO: 6052376 - DNA, 18 bp, Homo sapiens
ccaagctaatgtggtagt

SEQ ID NO: 6052377 - DNA, 18 bp, Homo sapiens
ccaagctattcctttccc

SEQ ID NO: 6052378 - DNA, 19 bp, Homo sapiens
ccaagctattcctttccct

SEQ ID NO: 6052379 - DNA, 17 bp, Homo sapiens
ccaagctcaaagcgtgg

SEQ ID NO: 6052380 - DNA, 17 bp, Homo sapiens
ccaagctcacagttcct

SEQ ID NO: 6052381 - DNA, 22 bp, Homo sapiens
ccaagctcacagttcctcgccc

SEQ ID NO: 6052382 - DNA, 13 bp, Homo sapiens
ccaagctcaccct

SEQ ID NO: 6052383 - DNA, 12 bp, Homo sapiens
ccaagctcagaa

SEQ ID NO: 6052384 - DNA, 19 bp, Homo sapiens
ccaagctcaggaccaggca

SEQ ID NO: 6052385 - DNA, 14 bp, Homo sapiens
ccaagctccatctc

SEQ ID NO: 6052386 - DNA, 13 bp, Homo sapiens
ccaagctcccagg

SEQ ID NO: 6052387 - DNA, 17 bp, Homo sapiens
ccaagctccctgcccca

SEQ ID NO: 6052388 - DNA, 17 bp, Homo sapiens
ccaagctccctggagcc

SEQ ID NO: 6052389 - DNA, 20 bp, Homo sapiens
ccaagctccctggagccctg

SEQ ID NO: 6052390 - DNA, 13 bp, Homo sapiens
ccaagctcccttc

SEQ ID NO: 6052391 - DNA, 19 bp, Homo sapiens
ccaagctcggatcacatga

SEQ ID NO: 6052392 - DNA, 18 bp, Homo sapiens
ccaagctctagtgggaag

SEQ ID NO: 6052393 - DNA, 17 bp, Homo sapiens
ccaagctctgctcctct

SEQ ID NO: 6052394 - DNA, 19 bp, Homo sapiens
ccaagctgaagtgaaggag

SEQ ID NO: 6052395 - DNA, 19 bp, Homo sapiens
ccaagctgaggaggtgctg

SEQ ID NO: 6052396 - DNA, 21 bp, Homo sapiens
ccaagctgaggtgcccaggag

SEQ ID NO: 6052397 - DNA, 23 bp, Homo sapiens
ccaagctgaggtgcccaggagaa

SEQ ID NO: 6052398 - DNA, 16 bp, Homo sapiens
ccaagctgagtttcct

SEQ ID NO: 6052399 - DNA, 18 bp, Homo sapiens
ccaagctgagtttcctat

SEQ ID NO: 6052400 - DNA, 12 bp, Homo sapiens
ccaagctgcaca

SEQ ID NO: 6052401 - DNA, 16 bp, Homo sapiens
ccaagctgcacaattt

SEQ ID NO: 6052402 - DNA, 19 bp, Homo sapiens
ccaagctgcctctgggcca

SEQ ID NO: 6052403 - DNA, 15 bp, Homo sapiens
ccaagctgctgccgc

SEQ ID NO: 6052404 - DNA, 22 bp, Homo sapiens
ccaagctggagtgcagtggtgc

SEQ ID NO: 6052405 - DNA, 12 bp, Homo sapiens
ccaagctgggcc

SEQ ID NO: 6052406 - DNA, 13 bp, Homo sapiens
ccaagctgggccc

SEQ ID NO: 6052407 - DNA, 17 bp, Homo sapiens
ccaagctgggccccagc

SEQ ID NO: 6052408 - DNA, 12 bp, Homo sapiens
ccaagctgggct

SEQ ID NO: 6052409 - DNA, 13 bp, Homo sapiens
ccaagctgggctc

SEQ ID NO: 6052410 - DNA, 21 bp, Homo sapiens
ccaagctggggcaaggggcag

SEQ ID NO: 6052411 - DNA, 16 bp, Homo sapiens
ccaagctgtatgtact

SEQ ID NO: 6052412 - DNA, 18 bp, Homo sapiens
ccaagctgtatgtacttc

SEQ ID NO: 6052413 - DNA, 14 bp, Homo sapiens
ccaagctgtgccac

SEQ ID NO: 6052414 - DNA, 18 bp, Homo sapiens
ccaagctgtgccaccctg

SEQ ID NO: 6052415 - DNA, 21 bp, Homo sapiens
ccaagctgtgccaccctgggc

SEQ ID NO: 6052416 - DNA, 22 bp, Homo sapiens
ccaagctgtgccaccctgggct

SEQ ID NO: 6052417 - DNA, 13 bp, Homo sapiens
ccaagctgtgctg

SEQ ID NO: 6052418 - DNA, 20 bp, Homo sapiens
ccaagctgtgctgggaagcc

SEQ ID NO: 6052419 - DNA, 12 bp, Homo sapiens
ccaagctgtggc

SEQ ID NO: 6052420 - DNA, 17 bp, Homo sapiens
ccaagctgtggcagccg

SEQ ID NO: 6052421 - DNA, 21 bp, Homo sapiens
ccaagctgtggcagccgtccc

SEQ ID NO: 6052422 - DNA, 14 bp, Homo sapiens
ccaagctgttaaag

SEQ ID NO: 6052423 - DNA, 22 bp, Homo sapiens
ccaagctgttaaagatattttt

SEQ ID NO: 6052424 - DNA, 17 bp, Homo sapiens
ccaagctgttttcttct

SEQ ID NO: 6052425 - DNA, 16 bp, Homo sapiens
ccaagcttaaggagag

SEQ ID NO: 6052426 - DNA, 19 bp, Homo sapiens
ccaagcttaaggagaggag

SEQ ID NO: 6052427 - DNA, 18 bp, Homo sapiens
ccaagcttaatagccctc

SEQ ID NO: 6052428 - DNA, 19 bp, Homo sapiens
ccaagcttaatagccctcc

SEQ ID NO: 6052429 - DNA, 20 bp, Homo sapiens
ccaagcttaatagccctccc

SEQ ID NO: 6052430 - DNA, 22 bp, Homo sapiens
ccaagcttagggtatttttcct

SEQ ID NO: 6052431 - DNA, 17 bp, Homo sapiens
ccaagcttagtcctggg

SEQ ID NO: 6052432 - DNA, 15 bp, Homo sapiens
ccaagcttcaagtga

SEQ ID NO: 6052433 - DNA, 13 bp, Homo sapiens
ccaagcttcagag

SEQ ID NO: 6052434 - DNA, 19 bp, Homo sapiens
ccaagcttcagagcctagc

SEQ ID NO: 6052435 - DNA, 21 bp, Homo sapiens
ccaagcttcagagcctagcca

SEQ ID NO: 6052436 - DNA, 16 bp, Homo sapiens
ccaagcttcccaacag

SEQ ID NO: 6052437 - DNA, 17 bp, Homo sapiens
ccaagcttcctgtgccc

SEQ ID NO: 6052438 - DNA, 16 bp, Homo sapiens
ccaagcttggcagccg

SEQ ID NO: 6052439 - DNA, 23 bp, Homo sapiens
ccaagcttgtgagagctggttgc

SEQ ID NO: 6052440 - DNA, 20 bp, Homo sapiens
ccaagcttgtttccctgctg

SEQ ID NO: 6052441 - DNA, 15 bp, Homo sapiens
ccaagctttaaatta

SEQ ID NO: 6052442 - DNA, 15 bp, Homo sapiens
ccaagctttcttcta

SEQ ID NO: 6052443 - DNA, 22 bp, Homo sapiens
ccaagctttgaatacccccaga

SEQ ID NO: 6052444 - DNA, 23 bp, Homo sapiens
ccaagctttgaatacccccagag

SEQ ID NO: 6052445 - DNA, 21 bp, Homo sapiens
ccaagctttgaggctctgtca

SEQ ID NO: 6052446 - DNA, 16 bp, Homo sapiens
ccaaggaaaactgcat

SEQ ID NO: 6052447 - DNA, 19 bp, Homo sapiens
ccaaggaaaccacagctgc

SEQ ID NO: 6052448 - DNA, 17 bp, Homo sapiens
ccaaggaaacgctacct

SEQ ID NO: 6052449 - DNA, 15 bp, Homo sapiens
ccaaggaaatatatt

SEQ ID NO: 6052450 - DNA, 14 bp, Homo sapiens
ccaaggaacctaat

SEQ ID NO: 6052451 - DNA, 19 bp, Homo sapiens
ccaaggaacctaattgaaa

SEQ ID NO: 6052452 - DNA, 18 bp, Homo sapiens
ccaaggaagaacaaatat

SEQ ID NO: 6052453 - DNA, 19 bp, Homo sapiens
ccaaggaagctccttcctg

SEQ ID NO: 6052454 - DNA, 12 bp, Homo sapiens
ccaaggaaggag

SEQ ID NO: 6052455 - DNA, 14 bp, Homo sapiens
ccaaggaaggagcc

SEQ ID NO: 6052456 - DNA, 17 bp, Homo sapiens
ccaaggaaggagcccct

SEQ ID NO: 6052457 - DNA, 17 bp, Homo sapiens
ccaaggaagtctgtgtc

SEQ ID NO: 6052458 - DNA, 16 bp, Homo sapiens
ccaaggaatcagcagg

SEQ ID NO: 6052459 - DNA, 17 bp, Homo sapiens
ccaaggaatcagcagga

SEQ ID NO: 6052460 - DNA, 18 bp, Homo sapiens
ccaaggaatttaaaactg

SEQ ID NO: 6052461 - DNA, 19 bp, Homo sapiens
ccaaggaatttaaaactgt

SEQ ID NO: 6052462 - DNA, 15 bp, Homo sapiens
ccaaggacaccctcc

SEQ ID NO: 6052463 - DNA, 22 bp, Homo sapiens
ccaaggacagaaggctcctgcc

SEQ ID NO: 6052464 - DNA, 16 bp, Homo sapiens
ccaaggacagggctgg

SEQ ID NO: 6052465 - DNA, 20 bp, Homo sapiens
ccaaggacagggctggctcc

SEQ ID NO: 6052466 - DNA, 13 bp, Homo sapiens
ccaaggacagttc

SEQ ID NO: 6052467 - DNA, 14 bp, Homo sapiens
ccaaggaccaggtt

SEQ ID NO: 6052468 - DNA, 19 bp, Homo sapiens
ccaaggacccagccctcgc

SEQ ID NO: 6052469 - DNA, 17 bp, Homo sapiens
ccaaggacccaggcgct

SEQ ID NO: 6052470 - DNA, 18 bp, Homo sapiens
ccaaggacccctcacctt

SEQ ID NO: 6052471 - DNA, 20 bp, Homo sapiens
ccaaggacctcctcttcccc

SEQ ID NO: 6052472 - DNA, 14 bp, Homo sapiens
ccaaggacctgaga

SEQ ID NO: 6052473 - DNA, 21 bp, Homo sapiens
ccaaggaccttacaggccctc

SEQ ID NO: 6052474 - DNA, 20 bp, Homo sapiens
ccaaggacggtccccacccc

SEQ ID NO: 6052475 - DNA, 15 bp, Homo sapiens
ccaaggactgactga

SEQ ID NO: 6052476 - DNA, 16 bp, Homo sapiens
ccaaggactgactgag

SEQ ID NO: 6052477 - DNA, 23 bp, Homo sapiens
ccaaggactgactgagacacgat

SEQ ID NO: 6052478 - DNA, 14 bp, Homo sapiens
ccaaggactgaggg

SEQ ID NO: 6052479 - DNA, 15 bp, Homo sapiens
ccaaggactgagggc

SEQ ID NO: 6052480 - DNA, 17 bp, Homo sapiens
ccaaggactgagggcag

SEQ ID NO: 6052481 - DNA, 22 bp, Homo sapiens
ccaaggacttccacatttttgc

SEQ ID NO: 6052482 - DNA, 13 bp, Homo sapiens
ccaaggactttcc

SEQ ID NO: 6052483 - DNA, 20 bp, Homo sapiens
ccaaggactttccagtgagg

SEQ ID NO: 6052484 - DNA, 15 bp, Homo sapiens
ccaaggagaaacaga

SEQ ID NO: 6052485 - DNA, 19 bp, Homo sapiens
ccaaggagaaacagagaca

SEQ ID NO: 6052486 - DNA, 11 bp, Homo sapiens
ccaaggagaac

SEQ ID NO: 6052487 - DNA, 22 bp, Homo sapiens
ccaaggagaccaagtcctggct

SEQ ID NO: 6052488 - DNA, 13 bp, Homo sapiens
ccaaggagcacag

SEQ ID NO: 6052489 - DNA, 18 bp, Homo sapiens
ccaaggagcacaggtccc

SEQ ID NO: 6052490 - DNA, 16 bp, Homo sapiens
ccaaggagcagagagg

SEQ ID NO: 6052491 - DNA, 21 bp, Homo sapiens
ccaaggagctgatttccaggc

SEQ ID NO: 6052492 - DNA, 22 bp, Homo sapiens
ccaaggagctgatttccaggcc

SEQ ID NO: 6052493 - DNA, 16 bp, Homo sapiens
ccaaggagctgctata

SEQ ID NO: 6052494 - DNA, 15 bp, Homo sapiens
ccaaggagggaagag

SEQ ID NO: 6052495 - DNA, 18 bp, Homo sapiens
ccaaggagggggcctcat

SEQ ID NO: 6052496 - DNA, 19 bp, Homo sapiens
ccaaggagggggcctcatt

SEQ ID NO: 6052497 - DNA, 20 bp, Homo sapiens
ccaaggagggggcctcattg

SEQ ID NO: 6052498 - DNA, 16 bp, Homo sapiens
ccaaggagggtccagg

SEQ ID NO: 6052499 - DNA, 17 bp, Homo sapiens
ccaaggaggtcccagga

SEQ ID NO: 6052500 - DNA, 13 bp, Homo sapiens
ccaaggaggtggc

SEQ ID NO: 6052501 - DNA, 21 bp, Homo sapiens
ccaaggaggtgggccacaccc

SEQ ID NO: 6052502 - DNA, 21 bp, Homo sapiens
ccaaggatcctctccactcca

SEQ ID NO: 6052503 - DNA, 23 bp, Homo sapiens
ccaaggatcggactctgcccctg

SEQ ID NO: 6052504 - DNA, 10 bp, Homo sapiens
ccaaggcaaa

SEQ ID NO: 6052505 - DNA, 15 bp, Homo sapiens
ccaaggcaaaaaact

SEQ ID NO: 6052506 - DNA, 16 bp, Homo sapiens
ccaaggcaaatgtcca

SEQ ID NO: 6052507 - DNA, 17 bp, Homo sapiens
ccaaggcaaatgtccaa

SEQ ID NO: 6052508 - DNA, 13 bp, Homo sapiens
ccaaggcaaggca

SEQ ID NO: 6052509 - DNA, 21 bp, Homo sapiens
ccaaggcagaagcagcagggg

SEQ ID NO: 6052510 - DNA, 14 bp, Homo sapiens
ccaaggcagcctcc

SEQ ID NO: 6052511 - DNA, 13 bp, Homo sapiens
cccagcttccagc

SEQ ID NO: 6052512 - DNA, 14 bp, Homo sapiens
cccagcttcctccc

SEQ ID NO: 6052513 - DNA, 13 bp, Homo sapiens
cccagcttcctgt

SEQ ID NO: 6052514 - DNA, 17 bp, Homo sapiens
cccagcttcgtcagctc

SEQ ID NO: 6052515 - DNA, 19 bp, Homo sapiens
cccagcttcgtcagctcca

SEQ ID NO: 6052516 - DNA, 20 bp, Homo sapiens
cccagcttcgtcagctccag

SEQ ID NO: 6052517 - DNA, 16 bp, Homo sapiens
cccagcttctcagctc

SEQ ID NO: 6052518 - DNA, 22 bp, Homo sapiens
cccagcttctctctccctgtca

SEQ ID NO: 6052519 - DNA, 17 bp, Homo sapiens
cccagcttggagtgcca

SEQ ID NO: 6052520 - DNA, 14 bp, Homo sapiens
cccagcttggctca

SEQ ID NO: 6052521 - DNA, 22 bp, Homo sapiens
cccagcttgggcccagctgggc

SEQ ID NO: 6052522 - DNA, 17 bp, Homo sapiens
cccagcttgtaggagct

SEQ ID NO: 6052523 - DNA, 18 bp, Homo sapiens
cccagctttaaaaagaaa

SEQ ID NO: 6052524 - DNA, 21 bp, Homo sapiens
cccagctttaaaaagaaaaaa

SEQ ID NO: 6052525 - DNA, 17 bp, Homo sapiens
cccagctttcagggaca

SEQ ID NO: 6052526 - DNA, 16 bp, Homo sapiens
cccagctttctgtgtg

SEQ ID NO: 6052527 - DNA, 20 bp, Homo sapiens
cccagctttctgtgtgcaca

SEQ ID NO: 6052528 - DNA, 20 bp, Homo sapiens
cccagctttgaggaaaatgg

SEQ ID NO: 6052529 - DNA, 23 bp, Homo sapiens
cccagcttttcttgccagctcag

SEQ ID NO: 6052530 - DNA, 19 bp, Homo sapiens
cccaggaaaaacctgtggg

SEQ ID NO: 6052531 - DNA, 20 bp, Homo sapiens
cccaggaaaggaggaccagt

SEQ ID NO: 6052532 - DNA, 16 bp, Homo sapiens
cccaggaaaggcccag

SEQ ID NO: 6052533 - DNA, 16 bp, Homo sapiens
cccaggaaaggctcca

SEQ ID NO: 6052534 - DNA, 18 bp, Homo sapiens
cccaggaaaggctccagg

SEQ ID NO: 6052535 - DNA, 17 bp, Homo sapiens
cccaggaacgctctcct

SEQ ID NO: 6052536 - DNA, 18 bp, Homo sapiens
cccaggaacgctctcctc

SEQ ID NO: 6052537 - DNA, 15 bp, Homo sapiens
cccaggaactgggcc

SEQ ID NO: 6052538 - DNA, 16 bp, Homo sapiens
cccaggaagcccacac

SEQ ID NO: 6052539 - DNA, 19 bp, Homo sapiens
cccaggaagcccactgcct

SEQ ID NO: 6052540 - DNA, 20 bp, Homo sapiens
cccaggaagcccactgcctc

SEQ ID NO: 6052541 - DNA, 12 bp, Homo sapiens
cccaggaagccg

SEQ ID NO: 6052542 - DNA, 23 bp, Homo sapiens
cccaggaagccggtgcctgggtg

SEQ ID NO: 6052543 - DNA, 18 bp, Homo sapiens
cccaggaaggcggcaggc

SEQ ID NO: 6052544 - DNA, 18 bp, Homo sapiens
cccaggaagggagggagc

SEQ ID NO: 6052545 - DNA, 20 bp, Homo sapiens
cccaggaagggagggagctg

SEQ ID NO: 6052546 - DNA, 23 bp, Homo sapiens
cccaggaagggagggagctgagg

SEQ ID NO: 6052547 - DNA, 21 bp, Homo sapiens
cccaggaagtccagaacgtag

SEQ ID NO: 6052548 - DNA, 19 bp, Homo sapiens
cccaggaagtccagctcct

SEQ ID NO: 6052549 - DNA, 22 bp, Homo sapiens
cccaggaagtctcatctgggga

SEQ ID NO: 6052550 - DNA, 20 bp, Homo sapiens
cccaggaatagtggacatgg

SEQ ID NO: 6052551 - DNA, 23 bp, Homo sapiens
cccaggaatcagtttaaaagcac

SEQ ID NO: 6052552 - DNA, 23 bp, Homo sapiens
cccaggaatttgggaccctgctt

SEQ ID NO: 6052553 - DNA, 16 bp, Homo sapiens
cccaggacaagcacga

SEQ ID NO: 6052554 - DNA, 18 bp, Homo sapiens
cccaggacaagcacgagg

SEQ ID NO: 6052555 - DNA, 16 bp, Homo sapiens
cccaggacaagcatgg

SEQ ID NO: 6052556 - DNA, 21 bp, Homo sapiens
cccaggacaagcatggtccca

SEQ ID NO: 6052557 - DNA, 22 bp, Homo sapiens
cccaggacaccacacccagcct

SEQ ID NO: 6052558 - DNA, 16 bp, Homo sapiens
cccaggacatctcctg

SEQ ID NO: 6052559 - DNA, 15 bp, Homo sapiens
cccaggaccaagcca

SEQ ID NO: 6052560 - DNA, 23 bp, Homo sapiens
cccaggaccaagcttaaggagag

SEQ ID NO: 6052561 - DNA, 12 bp, Homo sapiens
cccaggaccagc

SEQ ID NO: 6052562 - DNA, 13 bp, Homo sapiens
cccaggaccagct

SEQ ID NO: 6052563 - DNA, 14 bp, Homo sapiens
cccaggaccagctc

SEQ ID NO: 6052564 - DNA, 17 bp, Homo sapiens
cccaggaccagctcagg

SEQ ID NO: 6052565 - DNA, 21 bp, Homo sapiens
cccaggaccagctcaggacag

SEQ ID NO: 6052566 - DNA, 19 bp, Homo sapiens
cccaggaccagctggggcg

SEQ ID NO: 6052567 - DNA, 14 bp, Homo sapiens
cccaggaccatcct

SEQ ID NO: 6052568 - DNA, 20 bp, Homo sapiens
cccaggaccatcttcccgag

SEQ ID NO: 6052569 - DNA, 12 bp, Homo sapiens
cccaggacccca

SEQ ID NO: 6052570 - DNA, 18 bp, Homo sapiens
cccaggacccccccagtc

SEQ ID NO: 6052571 - DNA, 16 bp, Homo sapiens
cccaggaccctccact

SEQ ID NO: 6052572 - DNA, 13 bp, Homo sapiens
cccaggaccctga

SEQ ID NO: 6052573 - DNA, 15 bp, Homo sapiens
cccaggaccctgagg

SEQ ID NO: 6052574 - DNA, 21 bp, Homo sapiens
cccaggacctcggatgaccat

SEQ ID NO: 6052575 - DNA, 21 bp, Homo sapiens
cccaggacctcttcagctgct

SEQ ID NO: 6052576 - DNA, 17 bp, Homo sapiens
cccaggacctgagcctg

SEQ ID NO: 6052577 - DNA, 18 bp, Homo sapiens
cccaggacctggctgcca

SEQ ID NO: 6052578 - DNA, 15 bp, Homo sapiens
cccaggacgcaggga

SEQ ID NO: 6052579 - DNA, 18 bp, Homo sapiens
cccaggacgcagggagac

SEQ ID NO: 6052580 - DNA, 21 bp, Homo sapiens
cccaggacgcagggagaccct

SEQ ID NO: 6052581 - DNA, 23 bp, Homo sapiens
cccaggacgcagggagaccctgg

SEQ ID NO: 6052582 - DNA, 15 bp, Homo sapiens
cccaggacgcatgca

SEQ ID NO: 6052583 - DNA, 17 bp, Homo sapiens
cccaggactcaccctca

SEQ ID NO: 6052584 - DNA, 19 bp, Homo sapiens
cccaggactctggcacttc

SEQ ID NO: 6052585 - DNA, 15 bp, Homo sapiens
cccaggactgggcca

SEQ ID NO: 6052586 - DNA, 20 bp, Homo sapiens
cccaggagacaaacagccct

SEQ ID NO: 6052587 - DNA, 22 bp, Homo sapiens
cccaggagacaaacagcccttc

SEQ ID NO: 6052588 - DNA, 23 bp, Homo sapiens
cccaggagacaaacagcccttcc

SEQ ID NO: 6052589 - DNA, 17 bp, Homo sapiens
cccaggagacctccagc

SEQ ID NO: 6052590 - DNA, 18 bp, Homo sapiens
cccaggagacctccagct

SEQ ID NO: 6052591 - DNA, 20 bp, Homo sapiens
cccaggagagaccttctctt

SEQ ID NO: 6052592 - DNA, 13 bp, Homo sapiens
cccaggagagaga

SEQ ID NO: 6052593 - DNA, 21 bp, Homo sapiens
cccaggagagccagccctccc

SEQ ID NO: 6052594 - DNA, 19 bp, Homo sapiens
cccaggagatgggtccagg

SEQ ID NO: 6052595 - DNA, 17 bp, Homo sapiens
cccaggagcaaatgctg

SEQ ID NO: 6052596 - DNA, 18 bp, Homo sapiens
cccaggagcaacagccta

SEQ ID NO: 6052597 - DNA, 14 bp, Homo sapiens
cccaggagcagctg

SEQ ID NO: 6052598 - DNA, 22 bp, Homo sapiens
cccaggagcatccacctccttc

SEQ ID NO: 6052599 - DNA, 22 bp, Homo sapiens
cccaggagcccatttggagggc

SEQ ID NO: 6052600 - DNA, 20 bp, Homo sapiens
cccaggagcccgtcaggcca

SEQ ID NO: 6052601 - DNA, 14 bp, Homo sapiens
cccaggagcgcagc

SEQ ID NO: 6052602 - DNA, 20 bp, Homo sapiens
cccaggagctcccctcccca

SEQ ID NO: 6052603 - DNA, 15 bp, Homo sapiens
cccaggagctctctg

SEQ ID NO: 6052604 - DNA, 16 bp, Homo sapiens
cccaggagctctgcgc

SEQ ID NO: 6052605 - DNA, 19 bp, Homo sapiens
cccaggagctctgcgccag

SEQ ID NO: 6052606 - DNA, 19 bp, Homo sapiens
cccaggagctgagtcacct

SEQ ID NO: 6052607 - DNA, 21 bp, Homo sapiens
cccaggagctgagtcacctcc

SEQ ID NO: 6052608 - DNA, 23 bp, Homo sapiens
cccaggagctgagtcacctcctc

SEQ ID NO: 6052609 - DNA, 17 bp, Homo sapiens
cccaggagctgcccaga

SEQ ID NO: 6052610 - DNA, 14 bp, Homo sapiens
cccaggaggcagct

SEQ ID NO: 6052611 - DNA, 18 bp, Homo sapiens
cccaggaggcagctcagg

SEQ ID NO: 6052612 - DNA, 15 bp, Homo sapiens
cccaggaggcaggga

SEQ ID NO: 6052613 - DNA, 14 bp, Homo sapiens
cccaggaggccagc

SEQ ID NO: 6052614 - DNA, 15 bp, Homo sapiens
cccaggaggccagcc

SEQ ID NO: 6052615 - DNA, 16 bp, Homo sapiens
cccaggaggccagcct

SEQ ID NO: 6052616 - DNA, 13 bp, Homo sapiens
cccaggaggctga

SEQ ID NO: 6052617 - DNA, 14 bp, Homo sapiens
cccaggagggaggg

SEQ ID NO: 6052618 - DNA, 13 bp, Homo sapiens
cccaggaggggaa

SEQ ID NO: 6052619 - DNA, 15 bp, Homo sapiens
cccaggaggtgcagt

SEQ ID NO: 6052620 - DNA, 16 bp, Homo sapiens
cccaggaggtgcagtg

SEQ ID NO: 6052621 - DNA, 14 bp, Homo sapiens
cccaggaggtggag

SEQ ID NO: 6052622 - DNA, 13 bp, Homo sapiens
cccaggagtccag

SEQ ID NO: 6052623 - DNA, 23 bp, Homo sapiens
cccaggagtccaggcccccagcc

SEQ ID NO: 6052624 - DNA, 22 bp, Homo sapiens
cccaggagtggaggaggcctgg

SEQ ID NO: 6052625 - DNA, 14 bp, Homo sapiens
cccaggagttctgc

SEQ ID NO: 6052626 - DNA, 18 bp, Homo sapiens
cccaggagttctgctcat

SEQ ID NO: 6052627 - DNA, 21 bp, Homo sapiens
cccaggagttctgctcattct

SEQ ID NO: 6052628 - DNA, 23 bp, Homo sapiens
cccaggagtttgagacaagccct

SEQ ID NO: 6052629 - DNA, 18 bp, Homo sapiens
cccaggagtttgaggctg

SEQ ID NO: 6052630 - DNA, 15 bp, Homo sapiens
cccaggagtttggcc

SEQ ID NO: 6052631 - DNA, 16 bp, Homo sapiens
cccaggagtttggcca

SEQ ID NO: 6052632 - DNA, 18 bp, Homo sapiens
cccaggagtttgtgtgtc

SEQ ID NO: 6052633 - DNA, 19 bp, Homo sapiens
cccaggatatctgaaaata

SEQ ID NO: 6052634 - DNA, 18 bp, Homo sapiens
cccaggatatttctgaga

SEQ ID NO: 6052635 - DNA, 18 bp, Homo sapiens
cccaggatcactctctgc

SEQ ID NO: 6052636 - DNA, 19 bp, Homo sapiens
cccaggatcactctctgct

SEQ ID NO: 6052637 - DNA, 15 bp, Homo sapiens
cccaggatcccctgc

SEQ ID NO: 6052638 - DNA, 17 bp, Homo sapiens
cccaggatcccctgcta

SEQ ID NO: 6052639 - DNA, 22 bp, Homo sapiens
cccaggatctcctgccagccca

SEQ ID NO: 6052640 - DNA, 23 bp, Homo sapiens
cccaggatgaaggggccagacca

SEQ ID NO: 6052641 - DNA, 20 bp, Homo sapiens
cccaggatgcatgcagggcc

SEQ ID NO: 6052642 - DNA, 20 bp, Homo sapiens
cccaggatgccacgcctgga

SEQ ID NO: 6052643 - DNA, 17 bp, Homo sapiens
cccaggattcccagaga

SEQ ID NO: 6052644 - DNA, 15 bp, Homo sapiens
cccaggattccccca

SEQ ID NO: 6052645 - DNA, 17 bp, Homo sapiens
cccaggattcccccagc

SEQ ID NO: 6052646 - DNA, 22 bp, Homo sapiens
cccaggatttgactcgggcctt

SEQ ID NO: 6052647 - DNA, 15 bp, Homo sapiens
cccaggcaaataaaa

SEQ ID NO: 6052648 - DNA, 16 bp, Homo sapiens
cccaggcaaataaaat

SEQ ID NO: 6052649 - DNA, 22 bp, Homo sapiens
cccaggcaaataaaattcccta

SEQ ID NO: 6052650 - DNA, 21 bp, Homo sapiens
cccaggcacaacttcagcagg

SEQ ID NO: 6052651 - DNA, 23 bp, Homo sapiens
cccaggcacaacttcagcagggg

SEQ ID NO: 6052652 - DNA, 14 bp, Homo sapiens
cccaggcaccacca

SEQ ID NO: 6052653 - DNA, 15 bp, Homo sapiens
cccaggcaccgccag

SEQ ID NO: 6052654 - DNA, 12 bp, Homo sapiens
cccaggcactgc

SEQ ID NO: 6052655 - DNA, 13 bp, Homo sapiens
cccaggcactgtt

SEQ ID NO: 6052656 - DNA, 18 bp, Homo sapiens
cccaggcagacaaccttg

SEQ ID NO: 6052657 - DNA, 14 bp, Homo sapiens
cccaggcagagctg

SEQ ID NO: 6052658 - DNA, 12 bp, Homo sapiens
cccaggcagcca

SEQ ID NO: 6052659 - DNA, 19 bp, Homo sapiens
cccaggcagccaccagtgg

SEQ ID NO: 6052660 - DNA, 12 bp, Homo sapiens
cccaggcagcta

SEQ ID NO: 6052661 - DNA, 14 bp, Homo sapiens
cccaggcagctcct

SEQ ID NO: 6052662 - DNA, 17 bp, Homo sapiens
cccaggcagctcctgtt

SEQ ID NO: 6052663 - DNA, 13 bp, Homo sapiens
cccaggcagctgg

SEQ ID NO: 6052664 - DNA, 18 bp, Homo sapiens
cccaggcagctggcagga

SEQ ID NO: 6052665 - DNA, 16 bp, Homo sapiens
cccaggcaggcccagc

SEQ ID NO: 6052666 - DNA, 19 bp, Homo sapiens
cccaggcaggcccagcctc

SEQ ID NO: 6052667 - DNA, 13 bp, Homo sapiens
cccaggcaggtct

SEQ ID NO: 6052668 - DNA, 19 bp, Homo sapiens
cccaggcatcccatccctt

SEQ ID NO: 6052669 - DNA, 21 bp, Homo sapiens
cccaggcatctccttgggctg

SEQ ID NO: 6052670 - DNA, 14 bp, Homo sapiens
cccaggcatgcagc

SEQ ID NO: 6052671 - DNA, 20 bp, Homo sapiens
cccaggcatgcagctgcctg

SEQ ID NO: 6052672 - DNA, 21 bp, Homo sapiens
cccaggcatgcagctgcctgg

SEQ ID NO: 6052673 - DNA, 15 bp, Homo sapiens
cccaggcattcccca

SEQ ID NO: 6052674 - DNA, 17 bp, Homo sapiens
cccaggcattccccagg

SEQ ID NO: 6052675 - DNA, 20 bp, Homo sapiens
cccaggcattccccaggagg

SEQ ID NO: 6052676 - DNA, 23 bp, Homo sapiens
cccaggcattccccaggaggcca

SEQ ID NO: 6052677 - DNA, 15 bp, Homo sapiens
cccaggccacagccg

SEQ ID NO: 6052678 - DNA, 12 bp, Homo sapiens
cccaggccaccc

SEQ ID NO: 6052679 - DNA, 23 bp, Homo sapiens
cccaggccacctcagtctcacct

SEQ ID NO: 6052680 - DNA, 14 bp, Homo sapiens
cccaggccacctgt

SEQ ID NO: 6052681 - DNA, 19 bp, Homo sapiens
cccaggccagagtgcagtg

SEQ ID NO: 6052682 - DNA, 16 bp, Homo sapiens
cccaggccagcccccc

SEQ ID NO: 6052683 - DNA, 14 bp, Homo sapiens
cccaggccagctgc

SEQ ID NO: 6052684 - DNA, 15 bp, Homo sapiens
cccaggccaggactc

SEQ ID NO: 6052685 - DNA, 20 bp, Homo sapiens
cccaggccaggactctgcag

SEQ ID NO: 6052686 - DNA, 23 bp, Homo sapiens
cccaggccaggactctgcagcct

SEQ ID NO: 6052687 - DNA, 13 bp, Homo sapiens
cccaggccaggcc

SEQ ID NO: 6052688 - DNA, 17 bp, Homo sapiens
cccaggccaggccacca

SEQ ID NO: 6052689 - DNA, 15 bp, Homo sapiens
ccaaggcagcctcca

SEQ ID NO: 6052690 - DNA, 16 bp, Homo sapiens
ccaaggcagcctccag

SEQ ID NO: 6052691 - DNA, 17 bp, Homo sapiens
ccaaggcagcctccaga

SEQ ID NO: 6052692 - DNA, 19 bp, Homo sapiens
ccaaggcagcctccagagc

SEQ ID NO: 6052693 - DNA, 21 bp, Homo sapiens
ccaaggcagcctccagagcca

SEQ ID NO: 6052694 - DNA, 15 bp, Homo sapiens
ccaaggcagcgaccc

SEQ ID NO: 6052695 - DNA, 19 bp, Homo sapiens
ccaaggcagcgaccccagg

SEQ ID NO: 6052696 - DNA, 15 bp, Homo sapiens
ccaaggcagggccca

SEQ ID NO: 6052697 - DNA, 18 bp, Homo sapiens
ccaaggcagggcccagca

SEQ ID NO: 6052698 - DNA, 16 bp, Homo sapiens
ccaaggcagtgcatgc

SEQ ID NO: 6052699 - DNA, 19 bp, Homo sapiens
ccaaggcagtgttcctcac

SEQ ID NO: 6052700 - DNA, 17 bp, Homo sapiens
ccaaggcagttctgtgt

SEQ ID NO: 6052701 - DNA, 22 bp, Homo sapiens
ccaaggcatccccagtgccagc

SEQ ID NO: 6052702 - DNA, 15 bp, Homo sapiens
ccaaggccaaaggaa

SEQ ID NO: 6052703 - DNA, 18 bp, Homo sapiens
ccaaggccaaaggaagca

SEQ ID NO: 6052704 - DNA, 17 bp, Homo sapiens
ccaaggccagaaggagg

SEQ ID NO: 6052705 - DNA, 19 bp, Homo sapiens
ccaaggccagagtggcctg

SEQ ID NO: 6052706 - DNA, 13 bp, Homo sapiens
ccaaggccaggtt

SEQ ID NO: 6052707 - DNA, 23 bp, Homo sapiens
ccaaggcccaactaacagtcaag

SEQ ID NO: 6052708 - DNA, 14 bp, Homo sapiens
ccaaggccccaggg

SEQ ID NO: 6052709 - DNA, 17 bp, Homo sapiens
ccaaggccccagggaca

SEQ ID NO: 6052710 - DNA, 18 bp, Homo sapiens
ccaaggccccagggacag

SEQ ID NO: 6052711 - DNA, 19 bp, Homo sapiens
ccaaggccccagggacaga

SEQ ID NO: 6052712 - DNA, 19 bp, Homo sapiens
ccaaggccccctgcctgcc

SEQ ID NO: 6052713 - DNA, 18 bp, Homo sapiens
ccaaggccgaagctctgg

SEQ ID NO: 6052714 - DNA, 15 bp, Homo sapiens
ccaaggccgcccacc

SEQ ID NO: 6052715 - DNA, 16 bp, Homo sapiens
ccaaggccggagaccc

SEQ ID NO: 6052716 - DNA, 21 bp, Homo sapiens
ccaaggccggagacccacagc

SEQ ID NO: 6052717 - DNA, 22 bp, Homo sapiens
ccaaggccggagacccacagcc

SEQ ID NO: 6052718 - DNA, 10 bp, Homo sapiens
ccaaggccta

SEQ ID NO: 6052719 - DNA, 23 bp, Homo sapiens
ccaaggcctaccccagttcctag

SEQ ID NO: 6052720 - DNA, 12 bp, Homo sapiens
ccaaggcctcag

SEQ ID NO: 6052721 - DNA, 18 bp, Homo sapiens
ccaaggcctcaggagagc

SEQ ID NO: 6052722 - DNA, 22 bp, Homo sapiens
ccaaggcctctcaccccacttc

SEQ ID NO: 6052723 - DNA, 14 bp, Homo sapiens
ccaaggcctctctc

SEQ ID NO: 6052724 - DNA, 17 bp, Homo sapiens
ccaaggcctctctctgc

SEQ ID NO: 6052725 - DNA, 20 bp, Homo sapiens
ccaaggccttctcaggctgg

SEQ ID NO: 6052726 - DNA, 14 bp, Homo sapiens
ccaaggccttctcc

SEQ ID NO: 6052727 - DNA, 16 bp, Homo sapiens
ccaaggccttctcctc

SEQ ID NO: 6052728 - DNA, 19 bp, Homo sapiens
ccaaggcctttttcataaa

SEQ ID NO: 6052729 - DNA, 21 bp, Homo sapiens
ccaaggcggcccctcccgccc

SEQ ID NO: 6052730 - DNA, 20 bp, Homo sapiens
ccaaggcgggcggatcactt

SEQ ID NO: 6052731 - DNA, 23 bp, Homo sapiens
ccaaggcgtccgcgcgccagcac

SEQ ID NO: 6052732 - DNA, 19 bp, Homo sapiens
ccaaggctcactgcagcgc

SEQ ID NO: 6052733 - DNA, 16 bp, Homo sapiens
ccaaggctcccgttcc

SEQ ID NO: 6052734 - DNA, 22 bp, Homo sapiens
ccaaggctcccgttccgtggga

SEQ ID NO: 6052735 - DNA, 16 bp, Homo sapiens
ccaaggctcctgacct

SEQ ID NO: 6052736 - DNA, 19 bp, Homo sapiens
ccaaggctctcccctctcg

SEQ ID NO: 6052737 - DNA, 16 bp, Homo sapiens
ccaaggctctgagcaa

SEQ ID NO: 6052738 - DNA, 22 bp, Homo sapiens
ccaaggctcttctccttggagg

SEQ ID NO: 6052739 - DNA, 11 bp, Homo sapiens
ccaaggctgcc

SEQ ID NO: 6052740 - DNA, 17 bp, Homo sapiens
ccaaggctgccagacat

SEQ ID NO: 6052741 - DNA, 13 bp, Homo sapiens
ccaaggctgcctg

SEQ ID NO: 6052742 - DNA, 14 bp, Homo sapiens
ccaaggctgcctgc

SEQ ID NO: 6052743 - DNA, 17 bp, Homo sapiens
ccaaggctgtgtttaga

SEQ ID NO: 6052744 - DNA, 22 bp, Homo sapiens
ccaaggcttctccaattctgcc

SEQ ID NO: 6052745 - DNA, 21 bp, Homo sapiens
ccaagggaaagaaaaggaagg

SEQ ID NO: 6052746 - DNA, 22 bp, Homo sapiens
ccaagggaaaggggtgctttta

SEQ ID NO: 6052747 - DNA, 16 bp, Homo sapiens
ccaagggacaacccca

SEQ ID NO: 6052748 - DNA, 16 bp, Homo sapiens
ccaagggacacaggag

SEQ ID NO: 6052749 - DNA, 22 bp, Homo sapiens
ccaagggacacaggagaccacc

SEQ ID NO: 6052750 - DNA, 18 bp, Homo sapiens
ccaagggacagcccacgg

SEQ ID NO: 6052751 - DNA, 20 bp, Homo sapiens
ccaagggacaggagaagaga

SEQ ID NO: 6052752 - DNA, 18 bp, Homo sapiens
ccaagggacaggtgggcc

SEQ ID NO: 6052753 - DNA, 22 bp, Homo sapiens
ccaagggacaggtgggcctggc

SEQ ID NO: 6052754 - DNA, 19 bp, Homo sapiens
ccaagggacagtggtctaa

SEQ ID NO: 6052755 - DNA, 18 bp, Homo sapiens
ccaagggactccaatctg

SEQ ID NO: 6052756 - DNA, 19 bp, Homo sapiens
ccaagggaggcccatgtga

SEQ ID NO: 6052757 - DNA, 22 bp, Homo sapiens
ccaagggaggctgctgctgctc

SEQ ID NO: 6052758 - DNA, 16 bp, Homo sapiens
ccaagggagggaaggg

SEQ ID NO: 6052759 - DNA, 13 bp, Homo sapiens
ccaagggatctgg

SEQ ID NO: 6052760 - DNA, 16 bp, Homo sapiens
ccaagggatggcacca

SEQ ID NO: 6052761 - DNA, 22 bp, Homo sapiens
ccaagggcaaaattcccaggga

SEQ ID NO: 6052762 - DNA, 24 bp, Homo sapiens
ccaagggcaaaattcccagggaag

SEQ ID NO: 6052763 - DNA, 20 bp, Homo sapiens
ccaagggccaaacccacttc

SEQ ID NO: 6052764 - DNA, 13 bp, Homo sapiens
ccaagggccagac

SEQ ID NO: 6052765 - DNA, 17 bp, Homo sapiens
ccaagggccagacagac

SEQ ID NO: 6052766 - DNA, 17 bp, Homo sapiens
ccaagggcccagaccct

SEQ ID NO: 6052767 - DNA, 18 bp, Homo sapiens
ccaagggccccaggggca

SEQ ID NO: 6052768 - DNA, 21 bp, Homo sapiens
ccaagggccccaggggcagca

SEQ ID NO: 6052769 - DNA, 13 bp, Homo sapiens
ccaagggccctgg

SEQ ID NO: 6052770 - DNA, 18 bp, Homo sapiens
ccaagggccgactaagag

SEQ ID NO: 6052771 - DNA, 13 bp, Homo sapiens
ccaagggctaggc

SEQ ID NO: 6052772 - DNA, 16 bp, Homo sapiens
ccaagggctaggctct

SEQ ID NO: 6052773 - DNA, 21 bp, Homo sapiens
ccaagggctgacttctccagg

SEQ ID NO: 6052774 - DNA, 22 bp, Homo sapiens
ccaagggcttctgcaccctcca

SEQ ID NO: 6052775 - DNA, 23 bp, Homo sapiens
ccaagggcttctgcaccctccac

SEQ ID NO: 6052776 - DNA, 22 bp, Homo sapiens
ccaaggggagtcaccttccctt

SEQ ID NO: 6052777 - DNA, 15 bp, Homo sapiens
ccaaggggccagctg

SEQ ID NO: 6052778 - DNA, 15 bp, Homo sapiens
ccaaggggcctgagc

SEQ ID NO: 6052779 - DNA, 17 bp, Homo sapiens
ccaaggggcctgagcag

SEQ ID NO: 6052780 - DNA, 15 bp, Homo sapiens
ccaaggggctgcgct

SEQ ID NO: 6052781 - DNA, 21 bp, Homo sapiens
ccaaggggctgcgctagcagc

SEQ ID NO: 6052782 - DNA, 19 bp, Homo sapiens
ccaaggggctttgtcctgg

SEQ ID NO: 6052783 - DNA, 22 bp, Homo sapiens
ccaagggggcggggactgctgg

SEQ ID NO: 6052784 - DNA, 24 bp, Homo sapiens
ccaagggggcggggactgctggct

SEQ ID NO: 6052785 - DNA, 19 bp, Homo sapiens
ccaaggggtcccctccagg

SEQ ID NO: 6052786 - DNA, 20 bp, Homo sapiens
ccaaggggtctgctcctgtg

SEQ ID NO: 6052787 - DNA, 13 bp, Homo sapiens
ccaaggggtggcc

SEQ ID NO: 6052788 - DNA, 22 bp, Homo sapiens
ccaaggggtggccgggcacagt

SEQ ID NO: 6052789 - DNA, 21 bp, Homo sapiens
ccaagggtacagatccccagc

SEQ ID NO: 6052790 - DNA, 20 bp, Homo sapiens
ccaagggtcgcctattttta

SEQ ID NO: 6052791 - DNA, 15 bp, Homo sapiens
ccaagggttgagagc

SEQ ID NO: 6052792 - DNA, 19 bp, Homo sapiens
ccaagggttgagagccagt

SEQ ID NO: 6052793 - DNA, 21 bp, Homo sapiens
ccaagggtttcgactggtcca

SEQ ID NO: 6052794 - DNA, 22 bp, Homo sapiens
ccaaggtcccattttccccctg

SEQ ID NO: 6052795 - DNA, 23 bp, Homo sapiens
ccaaggtcccattttccccctgt

SEQ ID NO: 6052796 - DNA, 16 bp, Homo sapiens
ccaaggtcctctcagt

SEQ ID NO: 6052797 - DNA, 15 bp, Homo sapiens
ccaaggtcctgctca

SEQ ID NO: 6052798 - DNA, 15 bp, Homo sapiens
ccaaggtctcacact

SEQ ID NO: 6052799 - DNA, 22 bp, Homo sapiens
ccaaggtctcacactcctcctg

SEQ ID NO: 6052800 - DNA, 19 bp, Homo sapiens
ccaaggtctgaacccttcc

SEQ ID NO: 6052801 - DNA, 15 bp, Homo sapiens
ccaaggtctgagcca

SEQ ID NO: 6052802 - DNA, 18 bp, Homo sapiens
ccaaggtgaaatgaagca

SEQ ID NO: 6052803 - DNA, 19 bp, Homo sapiens
ccaaggtgaatagcacagg

SEQ ID NO: 6052804 - DNA, 24 bp, Homo sapiens
ccaaggtgaggtgaactccaggca

SEQ ID NO: 6052805 - DNA, 13 bp, Homo sapiens
ccaaggtgcacat

SEQ ID NO: 6052806 - DNA, 20 bp, Homo sapiens
ccaaggtgcatatagaaaac

SEQ ID NO: 6052807 - DNA, 18 bp, Homo sapiens
ccaaggtgctaaaaggaa

SEQ ID NO: 6052808 - DNA, 21 bp, Homo sapiens
ccaaggtgctgatgtcaaagt

SEQ ID NO: 6052809 - DNA, 15 bp, Homo sapiens
ccaaggtgctggact

SEQ ID NO: 6052810 - DNA, 16 bp, Homo sapiens
ccaaggtggagggaag

SEQ ID NO: 6052811 - DNA, 18 bp, Homo sapiens
ccaaggtggagggaagga

SEQ ID NO: 6052812 - DNA, 19 bp, Homo sapiens
ccaaggtggagggaaggat

SEQ ID NO: 6052813 - DNA, 18 bp, Homo sapiens
ccaaggtgggctgagccc

SEQ ID NO: 6052814 - DNA, 21 bp, Homo sapiens
ccaaggtggtcttggagagga

SEQ ID NO: 6052815 - DNA, 22 bp, Homo sapiens
ccaaggtggtcttggagaggag

SEQ ID NO: 6052816 - DNA, 21 bp, Homo sapiens
ccaaggtgtcatttatgtgtc

SEQ ID NO: 6052817 - DNA, 17 bp, Homo sapiens
ccaaggtgtcctacaga

SEQ ID NO: 6052818 - DNA, 18 bp, Homo sapiens
ccaaggtgtcctacagaa

SEQ ID NO: 6052819 - DNA, 19 bp, Homo sapiens
ccaaggtgtcctacagaaa

SEQ ID NO: 6052820 - DNA, 16 bp, Homo sapiens
ccaaggttccagaggc

SEQ ID NO: 6052821 - DNA, 16 bp, Homo sapiens
ccaaggttctccaaca

SEQ ID NO: 6052822 - DNA, 17 bp, Homo sapiens
ccaaggttgcacagcaa

SEQ ID NO: 6052823 - DNA, 20 bp, Homo sapiens
ccaaggttgcacagcaagaa

SEQ ID NO: 6052824 - DNA, 22 bp, Homo sapiens
ccaaggttggagcccagggcat

SEQ ID NO: 6052825 - DNA, 22 bp, Homo sapiens
ccaaggtttaaagagtctagat

SEQ ID NO: 6052826 - DNA, 15 bp, Homo sapiens
ccaaggtttcccagt

SEQ ID NO: 6052827 - DNA, 23 bp, Homo sapiens
ccaaggtttggggaagaacgaag

SEQ ID NO: 6052828 - DNA, 19 bp, Homo sapiens
ccaaggttttataaggctg

SEQ ID NO: 6052829 - DNA, 13 bp, Homo sapiens
ccaagtaaaatgt

SEQ ID NO: 6052830 - DNA, 24 bp, Homo sapiens
ccaagtaaccaggccccagcctcc

SEQ ID NO: 6052831 - DNA, 14 bp, Homo sapiens
ccaagtacactgag

SEQ ID NO: 6052832 - DNA, 18 bp, Homo sapiens
ccaagtaccaatgctgtt

SEQ ID NO: 6052833 - DNA, 19 bp, Homo sapiens
ccaagtactaaagcacctt

SEQ ID NO: 6052834 - DNA, 20 bp, Homo sapiens
ccaagtacttaactatctgt

SEQ ID NO: 6052835 - DNA, 15 bp, Homo sapiens
ccaagtactttccaa

SEQ ID NO: 6052836 - DNA, 22 bp, Homo sapiens
ccaagtagaatctcagttgatt

SEQ ID NO: 6052837 - DNA, 20 bp, Homo sapiens
ccaagtagctgagattacag

SEQ ID NO: 6052838 - DNA, 20 bp, Homo sapiens
ccaagtagctgggactacag

SEQ ID NO: 6052839 - DNA, 15 bp, Homo sapiens
ccaagtagtccacct

SEQ ID NO: 6052840 - DNA, 15 bp, Homo sapiens
ccaagtatgccttaa

SEQ ID NO: 6052841 - DNA, 21 bp, Homo sapiens
ccaagtatgccttaagcagaa

SEQ ID NO: 6052842 - DNA, 20 bp, Homo sapiens
ccaagtattttatctgtgtt

SEQ ID NO: 6052843 - DNA, 23 bp, Homo sapiens
ccaagtcaacactcttcttgagc

SEQ ID NO: 6052844 - DNA, 16 bp, Homo sapiens
ccaagtcactcttttt

SEQ ID NO: 6052845 - DNA, 17 bp, Homo sapiens
ccaagtcagacaccaag

SEQ ID NO: 6052846 - DNA, 20 bp, Homo sapiens
ccaagtcagctttgccttcc

SEQ ID NO: 6052847 - DNA, 13 bp, Homo sapiens
ccaagtcaggcca

SEQ ID NO: 6052848 - DNA, 18 bp, Homo sapiens
ccaagtcaggccaggtgg

SEQ ID NO: 6052849 - DNA, 17 bp, Homo sapiens
ccaagtcatgggagaag

SEQ ID NO: 6052850 - DNA, 16 bp, Homo sapiens
ccaagtcatttttgtt

SEQ ID NO: 6052851 - DNA, 19 bp, Homo sapiens
ccaagtccaacctgcctgt

SEQ ID NO: 6052852 - DNA, 15 bp, Homo sapiens
ccaagtccactgtcc

SEQ ID NO: 6052853 - DNA, 16 bp, Homo sapiens
ccaagtccactgtcct

SEQ ID NO: 6052854 - DNA, 17 bp, Homo sapiens
ccaagtccactgtcctc

SEQ ID NO: 6052855 - DNA, 13 bp, Homo sapiens
ccaagtccagatt

SEQ ID NO: 6052856 - DNA, 17 bp, Homo sapiens
ccaagtccaggtcctgg

SEQ ID NO: 6052857 - DNA, 18 bp, Homo sapiens
ccaagtccaggtcctggt

SEQ ID NO: 6052858 - DNA, 19 bp, Homo sapiens
ccaagtccaggtcctggtg

SEQ ID NO: 6052859 - DNA, 22 bp, Homo sapiens
ccaagtccaggtcgggctcagc

SEQ ID NO: 6052860 - DNA, 13 bp, Homo sapiens
ccaagtcccaccc

SEQ ID NO: 6052861 - DNA, 15 bp, Homo sapiens
ccaagtccctgtttt

SEQ ID NO: 6052862 - DNA, 18 bp, Homo sapiens
ccaagtcctccctctcta

SEQ ID NO: 6052863 - DNA, 19 bp, Homo sapiens
ccaagtcctgaagaggcgg

SEQ ID NO: 6052864 - DNA, 21 bp, Homo sapiens
cccaggccaggctccttcctg

SEQ ID NO: 6052865 - DNA, 14 bp, Homo sapiens
cccaggccagggct

SEQ ID NO: 6052866 - DNA, 23 bp, Homo sapiens
cccaggccagggctgggtcacag

SEQ ID NO: 6052867 - DNA, 13 bp, Homo sapiens
cccaggccaggtg

SEQ ID NO: 6052868 - DNA, 15 bp, Homo sapiens
cccaggccaggtgcc

SEQ ID NO: 6052869 - DNA, 17 bp, Homo sapiens
cccaggccaggtgccca

SEQ ID NO: 6052870 - DNA, 14 bp, Homo sapiens
cccaggccagtaag

SEQ ID NO: 6052871 - DNA, 20 bp, Homo sapiens
cccaggccataccaggtgct

SEQ ID NO: 6052872 - DNA, 18 bp, Homo sapiens
cccaggccatcttccagg

SEQ ID NO: 6052873 - DNA, 22 bp, Homo sapiens
cccaggccatcttccaggtggg

SEQ ID NO: 6052874 - DNA, 17 bp, Homo sapiens
cccaggccatgtggcct

SEQ ID NO: 6052875 - DNA, 21 bp, Homo sapiens
cccaggccatgtggcctgccc

SEQ ID NO: 6052876 - DNA, 13 bp, Homo sapiens
cccaggcccacca

SEQ ID NO: 6052877 - DNA, 20 bp, Homo sapiens
cccaggcccaccatcaccac

SEQ ID NO: 6052878 - DNA, 11 bp, Homo sapiens
cccaggcccag

SEQ ID NO: 6052879 - DNA, 10 bp, Homo sapiens
cccaggcccc

SEQ ID NO: 6052880 - DNA, 14 bp, Homo sapiens
cccaggccccaggg

SEQ ID NO: 6052881 - DNA, 15 bp, Homo sapiens
cccaggccccagggg

SEQ ID NO: 6052882 - DNA, 16 bp, Homo sapiens
cccaggccccatgacc

SEQ ID NO: 6052883 - DNA, 22 bp, Homo sapiens
cccaggccccatgacctccagc

SEQ ID NO: 6052884 - DNA, 21 bp, Homo sapiens
cccaggcccccggctttcctc

SEQ ID NO: 6052885 - DNA, 12 bp, Homo sapiens
cccaggcccctg

SEQ ID NO: 6052886 - DNA, 16 bp, Homo sapiens
cccaggcccctggagg

SEQ ID NO: 6052887 - DNA, 18 bp, Homo sapiens
cccaggcccctggaggct

SEQ ID NO: 6052888 - DNA, 13 bp, Homo sapiens
cccaggcccgagc

SEQ ID NO: 6052889 - DNA, 17 bp, Homo sapiens
cccaggccctactaccc

SEQ ID NO: 6052890 - DNA, 12 bp, Homo sapiens
cccaggccctcc

SEQ ID NO: 6052891 - DNA, 16 bp, Homo sapiens
cccaggccctccatgg

SEQ ID NO: 6052892 - DNA, 19 bp, Homo sapiens
cccaggccctccatgggct

SEQ ID NO: 6052893 - DNA, 20 bp, Homo sapiens
cccaggccctccatgggcta

SEQ ID NO: 6052894 - DNA, 17 bp, Homo sapiens
cccaggccctccctgac

SEQ ID NO: 6052895 - DNA, 15 bp, Homo sapiens
cccaggcccttggct

SEQ ID NO: 6052896 - DNA, 17 bp, Homo sapiens
cccaggcccttggctgc

SEQ ID NO: 6052897 - DNA, 18 bp, Homo sapiens
cccaggcccttggctgca

SEQ ID NO: 6052898 - DNA, 20 bp, Homo sapiens
cccaggcccttggctgcagg

SEQ ID NO: 6052899 - DNA, 22 bp, Homo sapiens
cccaggccgaggaagggccccc

SEQ ID NO: 6052900 - DNA, 14 bp, Homo sapiens
cccaggccgcagct

SEQ ID NO: 6052901 - DNA, 16 bp, Homo sapiens
cccaggccgcagctct

SEQ ID NO: 6052902 - DNA, 17 bp, Homo sapiens
cccaggccgcagctctt

SEQ ID NO: 6052903 - DNA, 12 bp, Homo sapiens
cccaggccgcct

SEQ ID NO: 6052904 - DNA, 15 bp, Homo sapiens
cccaggccgcctgcc

SEQ ID NO: 6052905 - DNA, 17 bp, Homo sapiens
cccaggccgcctgccat

SEQ ID NO: 6052906 - DNA, 19 bp, Homo sapiens
cccaggccgcctgccatac

SEQ ID NO: 6052907 - DNA, 16 bp, Homo sapiens
cccaggccggagccca

SEQ ID NO: 6052908 - DNA, 18 bp, Homo sapiens
cccaggccggagcccaga

SEQ ID NO: 6052909 - DNA, 19 bp, Homo sapiens
cccaggccggagcccagat

SEQ ID NO: 6052910 - DNA, 20 bp, Homo sapiens
cccaggccggagcccagata

SEQ ID NO: 6052911 - DNA, 12 bp, Homo sapiens
cccaggccggcc

SEQ ID NO: 6052912 - DNA, 23 bp, Homo sapiens
cccaggccggccagcctcaccct

SEQ ID NO: 6052913 - DNA, 16 bp, Homo sapiens
cccaggccggcccaga

SEQ ID NO: 6052914 - DNA, 23 bp, Homo sapiens
cccaggccgggaagagccacctg

SEQ ID NO: 6052915 - DNA, 12 bp, Homo sapiens
cccaggcctacc

SEQ ID NO: 6052916 - DNA, 10 bp, Homo sapiens
cccaggcctc

SEQ ID NO: 6052917 - DNA, 15 bp, Homo sapiens
cccaggcctcaccac

SEQ ID NO: 6052918 - DNA, 17 bp, Homo sapiens
cccaggcctccctgcag

SEQ ID NO: 6052919 - DNA, 15 bp, Homo sapiens
cccaggcctcctagg

SEQ ID NO: 6052920 - DNA, 16 bp, Homo sapiens
cccaggcctcctaggg

SEQ ID NO: 6052921 - DNA, 15 bp, Homo sapiens
cccaggcctctgccc

SEQ ID NO: 6052922 - DNA, 19 bp, Homo sapiens
cccaggcctgagctgcttc

SEQ ID NO: 6052923 - DNA, 20 bp, Homo sapiens
cccaggcctgagctgcttca

SEQ ID NO: 6052924 - DNA, 13 bp, Homo sapiens
cccaggcctgccc

SEQ ID NO: 6052925 - DNA, 15 bp, Homo sapiens
cccaggcctgccctg

SEQ ID NO: 6052926 - DNA, 19 bp, Homo sapiens
cccaggcctgctggcatca

SEQ ID NO: 6052927 - DNA, 16 bp, Homo sapiens
cccaggcctggcctcg

SEQ ID NO: 6052928 - DNA, 23 bp, Homo sapiens
cccaggcctggcctcgcctgcct

SEQ ID NO: 6052929 - DNA, 19 bp, Homo sapiens
cccaggcctggcctcgggg

SEQ ID NO: 6052930 - DNA, 22 bp, Homo sapiens
cccaggcctggctccccgaggg

SEQ ID NO: 6052931 - DNA, 18 bp, Homo sapiens
cccaggcctgggatgcag

SEQ ID NO: 6052932 - DNA, 20 bp, Homo sapiens
cccaggcctgggatgcagtg

SEQ ID NO: 6052933 - DNA, 23 bp, Homo sapiens
cccaggcctgggatgcagtgatg

SEQ ID NO: 6052934 - DNA, 12 bp, Homo sapiens
cccaggcctggt

SEQ ID NO: 6052935 - DNA, 13 bp, Homo sapiens
cccaggcctgtcc

SEQ ID NO: 6052936 - DNA, 13 bp, Homo sapiens
cccaggcctgtgg

SEQ ID NO: 6052937 - DNA, 20 bp, Homo sapiens
cccaggcctgtggccccacc

SEQ ID NO: 6052938 - DNA, 14 bp, Homo sapiens
cccaggccttgctg

SEQ ID NO: 6052939 - DNA, 18 bp, Homo sapiens
cccaggccttgctgactc

SEQ ID NO: 6052940 - DNA, 19 bp, Homo sapiens
cccaggccttgctgactct

SEQ ID NO: 6052941 - DNA, 22 bp, Homo sapiens
cccaggccttgctgactctctg

SEQ ID NO: 6052942 - DNA, 12 bp, Homo sapiens
cccaggcctttg

SEQ ID NO: 6052943 - DNA, 18 bp, Homo sapiens
cccaggcgccccttcccc

SEQ ID NO: 6052944 - DNA, 18 bp, Homo sapiens
cccaggcggaggggcttg

SEQ ID NO: 6052945 - DNA, 13 bp, Homo sapiens
cccaggcgggagc

SEQ ID NO: 6052946 - DNA, 18 bp, Homo sapiens
cccaggctagagtgcagt

SEQ ID NO: 6052947 - DNA, 21 bp, Homo sapiens
cccaggctcaggctgcccagc

SEQ ID NO: 6052948 - DNA, 12 bp, Homo sapiens
cccaggctccca

SEQ ID NO: 6052949 - DNA, 19 bp, Homo sapiens
cccaggctcccagcctaag

SEQ ID NO: 6052950 - DNA, 18 bp, Homo sapiens
cccaggctcccctgcccg

SEQ ID NO: 6052951 - DNA, 18 bp, Homo sapiens
cccaggctccgcccttag

SEQ ID NO: 6052952 - DNA, 21 bp, Homo sapiens
cccaggctccgcccttagtcc

SEQ ID NO: 6052953 - DNA, 23 bp, Homo sapiens
cccaggctccgcccttagtcccc

SEQ ID NO: 6052954 - DNA, 17 bp, Homo sapiens
cccaggctcgtggactg

SEQ ID NO: 6052955 - DNA, 16 bp, Homo sapiens
cccaggctctgctgac

SEQ ID NO: 6052956 - DNA, 16 bp, Homo sapiens
cccaggctctgggaag

SEQ ID NO: 6052957 - DNA, 14 bp, Homo sapiens
cccaggctgaagag

SEQ ID NO: 6052958 - DNA, 15 bp, Homo sapiens
cccaggctgagcctc

SEQ ID NO: 6052959 - DNA, 18 bp, Homo sapiens
cccaggctgagcctcagt

SEQ ID NO: 6052960 - DNA, 13 bp, Homo sapiens
cccaggctgcact

SEQ ID NO: 6052961 - DNA, 15 bp, Homo sapiens
cccaggctgcactgc

SEQ ID NO: 6052962 - DNA, 18 bp, Homo sapiens
cccaggctgcactgcagt

SEQ ID NO: 6052963 - DNA, 19 bp, Homo sapiens
cccaggctgcactgcagtg

SEQ ID NO: 6052964 - DNA, 14 bp, Homo sapiens
cccaggctgcagtg

SEQ ID NO: 6052965 - DNA, 11 bp, Homo sapiens
cccaggctgcc

SEQ ID NO: 6052966 - DNA, 22 bp, Homo sapiens
cccaggctgcccactctgggga

SEQ ID NO: 6052967 - DNA, 17 bp, Homo sapiens
cccaggctgcccagagc

SEQ ID NO: 6052968 - DNA, 18 bp, Homo sapiens
cccaggctgcccagagct

SEQ ID NO: 6052969 - DNA, 19 bp, Homo sapiens
cccaggctgcccagagctg

SEQ ID NO: 6052970 - DNA, 21 bp, Homo sapiens
cccaggctgcccagagctgct

SEQ ID NO: 6052971 - DNA, 12 bp, Homo sapiens
cccaggctgccg

SEQ ID NO: 6052972 - DNA, 20 bp, Homo sapiens
cccaggctgccggctcccct

SEQ ID NO: 6052973 - DNA, 15 bp, Homo sapiens
cccaggctgccgtcc

SEQ ID NO: 6052974 - DNA, 14 bp, Homo sapiens
cccaggctgcgcct

SEQ ID NO: 6052975 - DNA, 21 bp, Homo sapiens
cccaggctgcgcctgcccgcc

SEQ ID NO: 6052976 - DNA, 19 bp, Homo sapiens
cccaggctggacatgctga

SEQ ID NO: 6052977 - DNA, 14 bp, Homo sapiens
cccaggctggactg

SEQ ID NO: 6052978 - DNA, 12 bp, Homo sapiens
cccaggctggag

SEQ ID NO: 6052979 - DNA, 17 bp, Homo sapiens
cccaggctggagacccc

SEQ ID NO: 6052980 - DNA, 18 bp, Homo sapiens
cccaggctggagtgcaat

SEQ ID NO: 6052981 - DNA, 15 bp, Homo sapiens
cccaggctggccagc

SEQ ID NO: 6052982 - DNA, 23 bp, Homo sapiens
cccaggctggccagccccacagc

SEQ ID NO: 6052983 - DNA, 17 bp, Homo sapiens
cccaggctggcccccac

SEQ ID NO: 6052984 - DNA, 13 bp, Homo sapiens
cccaggctggcgt

SEQ ID NO: 6052985 - DNA, 17 bp, Homo sapiens
cccaggctggcgtgcag

SEQ ID NO: 6052986 - DNA, 20 bp, Homo sapiens
cccaggctggcgtgcagtgg

SEQ ID NO: 6052987 - DNA, 21 bp, Homo sapiens
cccaggctggcgtgcagtggt

SEQ ID NO: 6052988 - DNA, 13 bp, Homo sapiens
cccaggctgggca

SEQ ID NO: 6052989 - DNA, 16 bp, Homo sapiens
cccaggctggtctcaa

SEQ ID NO: 6052990 - DNA, 12 bp, Homo sapiens
cccaggctgtca

SEQ ID NO: 6052991 - DNA, 16 bp, Homo sapiens
cccaggctgttctcca

SEQ ID NO: 6052992 - DNA, 22 bp, Homo sapiens
cccaggctgttctccaggcttc

SEQ ID NO: 6052993 - DNA, 16 bp, Homo sapiens
cccaggcttccgcgcc

SEQ ID NO: 6052994 - DNA, 13 bp, Homo sapiens
cccaggcttcctg

SEQ ID NO: 6052995 - DNA, 19 bp, Homo sapiens
cccaggcttcctgggtcct

SEQ ID NO: 6052996 - DNA, 15 bp, Homo sapiens
cccaggcttctcacc

SEQ ID NO: 6052997 - DNA, 15 bp, Homo sapiens
cccaggctttagcat

SEQ ID NO: 6052998 - DNA, 17 bp, Homo sapiens
cccaggctttagcatta

SEQ ID NO: 6052999 - DNA, 14 bp, Homo sapiens
cccaggcttttgct

SEQ ID NO: 6053000 - DNA, 18 bp, Homo sapiens
cccagggaagccctcggc

SEQ ID NO: 6053001 - DNA, 22 bp, Homo sapiens
cccagggaagccctcggcctcc

SEQ ID NO: 6053002 - DNA, 20 bp, Homo sapiens
cccagggaagcctgggtgtc

SEQ ID NO: 6053003 - DNA, 21 bp, Homo sapiens
cccagggaaggtggggccctg

SEQ ID NO: 6053004 - DNA, 23 bp, Homo sapiens
cccagggaaggtggggccctgcc

SEQ ID NO: 6053005 - DNA, 21 bp, Homo sapiens
cccagggaagtttctgggtgc

SEQ ID NO: 6053006 - DNA, 16 bp, Homo sapiens
cccagggaatcaggga

SEQ ID NO: 6053007 - DNA, 18 bp, Homo sapiens
cccagggaatcagggagc

SEQ ID NO: 6053008 - DNA, 20 bp, Homo sapiens
cccagggacaagggaaggaa

SEQ ID NO: 6053009 - DNA, 15 bp, Homo sapiens
cccagggacaccagc

SEQ ID NO: 6053010 - DNA, 17 bp, Homo sapiens
cccagggacaccagcca

SEQ ID NO: 6053011 - DNA, 16 bp, Homo sapiens
cccagggacagaggcc

SEQ ID NO: 6053012 - DNA, 17 bp, Homo sapiens
cccagggacagaggcca

SEQ ID NO: 6053013 - DNA, 18 bp, Homo sapiens
cccagggacagaggccaa

SEQ ID NO: 6053014 - DNA, 14 bp, Homo sapiens
cccagggacagggc

SEQ ID NO: 6053015 - DNA, 20 bp, Homo sapiens
cccagggacattgcagagtg

SEQ ID NO: 6053016 - DNA, 11 bp, Homo sapiens
cccagggacct

SEQ ID NO: 6053017 - DNA, 16 bp, Homo sapiens
cccagggagaggctgt

SEQ ID NO: 6053018 - DNA, 17 bp, Homo sapiens
cccagggagaggctgtg

SEQ ID NO: 6053019 - DNA, 19 bp, Homo sapiens
cccagggagaggctgtgtc

SEQ ID NO: 6053020 - DNA, 22 bp, Homo sapiens
cccagggagcggaaagcagctc

SEQ ID NO: 6053021 - DNA, 16 bp, Homo sapiens
cccagggagctctggg

SEQ ID NO: 6053022 - DNA, 14 bp, Homo sapiens
cccagggaggcagc

SEQ ID NO: 6053023 - DNA, 15 bp, Homo sapiens
cccagggaggcagcg

SEQ ID NO: 6053024 - DNA, 14 bp, Homo sapiens
cccagggagggaag

SEQ ID NO: 6053025 - DNA, 15 bp, Homo sapiens
cccagggagggggtc

SEQ ID NO: 6053026 - DNA, 18 bp, Homo sapiens
cccagggagggtgagctg

SEQ ID NO: 6053027 - DNA, 22 bp, Homo sapiens
cccagggagggtgagctggtgc

SEQ ID NO: 6053028 - DNA, 23 bp, Homo sapiens
cccagggagggtgagctggtgcc

SEQ ID NO: 6053029 - DNA, 11 bp, Homo sapiens
cccagggaggt

SEQ ID NO: 6053030 - DNA, 13 bp, Homo sapiens
cccagggagtcca

SEQ ID NO: 6053031 - DNA, 16 bp, Homo sapiens
cccagggagtccaggg

SEQ ID NO: 6053032 - DNA, 22 bp, Homo sapiens
cccagggagtccttgcgtccca

SEQ ID NO: 6053033 - DNA, 13 bp, Homo sapiens
cccagggagtgag

SEQ ID NO: 6053034 - DNA, 16 bp, Homo sapiens
cccagggagtgagcag

SEQ ID NO: 6053035 - DNA, 22 bp, Homo sapiens
cccagggatcgatcggtacagt

SEQ ID NO: 6053036 - DNA, 15 bp, Homo sapiens
cccagggcaagctcc

SEQ ID NO: 6053037 - DNA, 23 bp, Homo sapiens
cccagggcaagggttaaggcctg

SEQ ID NO: 6053038 - DNA, 11 bp, Homo sapiens
cccagggcaca

SEQ ID NO: 6053039 - DNA, 13 bp, Homo sapiens
cccagggcacagg

SEQ ID NO: 6053040 - DNA, 14 bp, Homo sapiens
cccagggcacagga

SEQ ID NO: 6053041 - DNA, 14 bp, Homo sapiens
cccagggcacccag

SEQ ID NO: 6053042 - DNA, 13 bp, Homo sapiens
cccagggcacgtg

SEQ ID NO: 6053043 - DNA, 14 bp, Homo sapiens
cccagggcactgcc

SEQ ID NO: 6053044 - DNA, 15 bp, Homo sapiens
cccagggcactgcca

SEQ ID NO: 6053045 - DNA, 14 bp, Homo sapiens
ccaagtcctgcctt

SEQ ID NO: 6053046 - DNA, 18 bp, Homo sapiens
ccaagtcctgcctttggg

SEQ ID NO: 6053047 - DNA, 16 bp, Homo sapiens
ccaagtctaatgaaga

SEQ ID NO: 6053048 - DNA, 17 bp, Homo sapiens
ccaagtctaatgaagag

SEQ ID NO: 6053049 - DNA, 14 bp, Homo sapiens
ccaagtctacagag

SEQ ID NO: 6053050 - DNA, 17 bp, Homo sapiens
ccaagtctacagagtga

SEQ ID NO: 6053051 - DNA, 16 bp, Homo sapiens
ccaagtctcagaagag

SEQ ID NO: 6053052 - DNA, 18 bp, Homo sapiens
ccaagtctcaggaggagg

SEQ ID NO: 6053053 - DNA, 19 bp, Homo sapiens
ccaagtctctctgtgaata

SEQ ID NO: 6053054 - DNA, 18 bp, Homo sapiens
ccaagtctctgggcccca

SEQ ID NO: 6053055 - DNA, 16 bp, Homo sapiens
ccaagtctgacagcca

SEQ ID NO: 6053056 - DNA, 13 bp, Homo sapiens
ccaagtctggcac

SEQ ID NO: 6053057 - DNA, 17 bp, Homo sapiens
ccaagtctggcaccatg

SEQ ID NO: 6053058 - DNA, 22 bp, Homo sapiens
ccaagtctggcaccatgttggc

SEQ ID NO: 6053059 - DNA, 18 bp, Homo sapiens
ccaagtctgtacctcaaa

SEQ ID NO: 6053060 - DNA, 13 bp, Homo sapiens
ccaagtcttcctg

SEQ ID NO: 6053061 - DNA, 13 bp, Homo sapiens
ccaagtcttctcc

SEQ ID NO: 6053062 - DNA, 19 bp, Homo sapiens
ccaagtctttcttcttttt

SEQ ID NO: 6053063 - DNA, 23 bp, Homo sapiens
ccaagtgaaggttcccaaggaca

SEQ ID NO: 6053064 - DNA, 23 bp, Homo sapiens
ccaagtgaccagggaagtgtgtg

SEQ ID NO: 6053065 - DNA, 14 bp, Homo sapiens
ccaagtgaggcagc

SEQ ID NO: 6053066 - DNA, 18 bp, Homo sapiens
ccaagtgaggcagccgag

SEQ ID NO: 6053067 - DNA, 23 bp, Homo sapiens
ccaagtgatccttccacctcagt

SEQ ID NO: 6053068 - DNA, 12 bp, Homo sapiens
ccaagtgcaata

SEQ ID NO: 6053069 - DNA, 20 bp, Homo sapiens
ccaagtgcatttttatctgt

SEQ ID NO: 6053070 - DNA, 16 bp, Homo sapiens
ccaagtgccagaggtg

SEQ ID NO: 6053071 - DNA, 17 bp, Homo sapiens
ccaagtgccagaggtgg

SEQ ID NO: 6053072 - DNA, 23 bp, Homo sapiens
ccaagtgccagaggtgggcaggt

SEQ ID NO: 6053073 - DNA, 16 bp, Homo sapiens
ccaagtgccatcccac

SEQ ID NO: 6053074 - DNA, 19 bp, Homo sapiens
ccaagtgccccaccactcc

SEQ ID NO: 6053075 - DNA, 20 bp, Homo sapiens
ccaagtgccccaccactccc

SEQ ID NO: 6053076 - DNA, 20 bp, Homo sapiens
ccaagtgccccctcacctct

SEQ ID NO: 6053077 - DNA, 22 bp, Homo sapiens
ccaagtgccccctcacctctcc

SEQ ID NO: 6053078 - DNA, 20 bp, Homo sapiens
ccaagtgcctgcttttgatg

SEQ ID NO: 6053079 - DNA, 14 bp, Homo sapiens
ccaagtgccttgag

SEQ ID NO: 6053080 - DNA, 14 bp, Homo sapiens
ccaagtgctggccc

SEQ ID NO: 6053081 - DNA, 20 bp, Homo sapiens
ccaagtgctggcccacccag

SEQ ID NO: 6053082 - DNA, 23 bp, Homo sapiens
ccaagtgctggcccacccagtcc

SEQ ID NO: 6053083 - DNA, 16 bp, Homo sapiens
ccaagtggacagtctg

SEQ ID NO: 6053084 - DNA, 21 bp, Homo sapiens
ccaagtggacagtctggccac

SEQ ID NO: 6053085 - DNA, 22 bp, Homo sapiens
ccaagtggacgttaggccaggc

SEQ ID NO: 6053086 - DNA, 18 bp, Homo sapiens
ccaagtggagcctgacag

SEQ ID NO: 6053087 - DNA, 17 bp, Homo sapiens
ccaagtggatattttct

SEQ ID NO: 6053088 - DNA, 17 bp, Homo sapiens
ccaagtggcagagcttg

SEQ ID NO: 6053089 - DNA, 14 bp, Homo sapiens
ccaagtggccctca

SEQ ID NO: 6053090 - DNA, 15 bp, Homo sapiens
ccaagtggctcttgg

SEQ ID NO: 6053091 - DNA, 23 bp, Homo sapiens
ccaagtggctgggtgccctctca

SEQ ID NO: 6053092 - DNA, 14 bp, Homo sapiens
ccaagtgggctggt

SEQ ID NO: 6053093 - DNA, 18 bp, Homo sapiens
ccaagtggtcaggagttg

SEQ ID NO: 6053094 - DNA, 16 bp, Homo sapiens
ccaagtggtccagcgt

SEQ ID NO: 6053095 - DNA, 19 bp, Homo sapiens
ccaagtgtagatgtagcat

SEQ ID NO: 6053096 - DNA, 15 bp, Homo sapiens
ccaagtgtattttaa

SEQ ID NO: 6053097 - DNA, 13 bp, Homo sapiens
ccaagtgtcctgc

SEQ ID NO: 6053098 - DNA, 10 bp, Homo sapiens
ccaagtgtgc

SEQ ID NO: 6053099 - DNA, 12 bp, Homo sapiens
ccaagtgtgcta

SEQ ID NO: 6053100 - DNA, 18 bp, Homo sapiens
ccaagtgtggaattggag

SEQ ID NO: 6053101 - DNA, 13 bp, Homo sapiens
ccaagtgtgtgtg

SEQ ID NO: 6053102 - DNA, 13 bp, Homo sapiens
ccaagtgtttctt

SEQ ID NO: 6053103 - DNA, 17 bp, Homo sapiens
ccaagtgttttgtattt

SEQ ID NO: 6053104 - DNA, 15 bp, Homo sapiens
ccaagttataaatca

SEQ ID NO: 6053105 - DNA, 20 bp, Homo sapiens
ccaagttataaatcaatgtc

SEQ ID NO: 6053106 - DNA, 22 bp, Homo sapiens
ccaagttatataaagagaaaat

SEQ ID NO: 6053107 - DNA, 16 bp, Homo sapiens
ccaagttatctttccc

SEQ ID NO: 6053108 - DNA, 17 bp, Homo sapiens
ccaagttatgcatcccc

SEQ ID NO: 6053109 - DNA, 22 bp, Homo sapiens
ccaagttatttgatctggtgcg

SEQ ID NO: 6053110 - DNA, 10 bp, Homo sapiens
ccaagttcaa

SEQ ID NO: 6053111 - DNA, 20 bp, Homo sapiens
ccaagttcctgcactccaga

SEQ ID NO: 6053112 - DNA, 15 bp, Homo sapiens
ccaagttctcacctc

SEQ ID NO: 6053113 - DNA, 17 bp, Homo sapiens
ccaagttcttcacctct

SEQ ID NO: 6053114 - DNA, 18 bp, Homo sapiens
ccaagttcttcacctcta

SEQ ID NO: 6053115 - DNA, 22 bp, Homo sapiens
ccaagttgatttagtgttttta

SEQ ID NO: 6053116 - DNA, 19 bp, Homo sapiens
ccaagttgcagtgagcagg

SEQ ID NO: 6053117 - DNA, 16 bp, Homo sapiens
ccaagttgctgtcact

SEQ ID NO: 6053118 - DNA, 18 bp, Homo sapiens
ccaagttgctgtcactgt

SEQ ID NO: 6053119 - DNA, 22 bp, Homo sapiens
ccaagttggtcttactttgtta

SEQ ID NO: 6053120 - DNA, 23 bp, Homo sapiens
ccaagttggtcttactttgttaa

SEQ ID NO: 6053121 - DNA, 14 bp, Homo sapiens
ccaagtttatatac

SEQ ID NO: 6053122 - DNA, 19 bp, Homo sapiens
ccaagtttattcagtaaac

SEQ ID NO: 6053123 - DNA, 20 bp, Homo sapiens
ccaagtttccggaggagccg

SEQ ID NO: 6053124 - DNA, 19 bp, Homo sapiens
ccaagtttctaagggaggc

SEQ ID NO: 6053125 - DNA, 15 bp, Homo sapiens
ccaagtttttcagaa

SEQ ID NO: 6053126 - DNA, 18 bp, Homo sapiens
ccaataaaaaaaaaccta

SEQ ID NO: 6053127 - DNA, 16 bp, Homo sapiens
ccaataaaaaaataag

SEQ ID NO: 6053128 - DNA, 14 bp, Homo sapiens
ccaataaaaagttc

SEQ ID NO: 6053129 - DNA, 21 bp, Homo sapiens
ccaataaaaagttcagagttc

SEQ ID NO: 6053130 - DNA, 21 bp, Homo sapiens
ccaataaaaatcaggagcctg

SEQ ID NO: 6053131 - DNA, 22 bp, Homo sapiens
ccaataaaagctcttctttttt

SEQ ID NO: 6053132 - DNA, 11 bp, Homo sapiens
ccaataaaagt

SEQ ID NO: 6053133 - DNA, 13 bp, Homo sapiens
ccaataaacagga

SEQ ID NO: 6053134 - DNA, 13 bp, Homo sapiens
ccaataaaccagt

SEQ ID NO: 6053135 - DNA, 15 bp, Homo sapiens
ccaataaaccagtgt

SEQ ID NO: 6053136 - DNA, 20 bp, Homo sapiens
ccaataaaccagtgtgaacc

SEQ ID NO: 6053137 - DNA, 19 bp, Homo sapiens
ccaataaactgagcgaccc

SEQ ID NO: 6053138 - DNA, 10 bp, Homo sapiens
ccaataaagc

SEQ ID NO: 6053139 - DNA, 15 bp, Homo sapiens
ccaataaagcagagt

SEQ ID NO: 6053140 - DNA, 13 bp, Homo sapiens
ccaataaagcctt

SEQ ID NO: 6053141 - DNA, 15 bp, Homo sapiens
ccaataaagcctttt

SEQ ID NO: 6053142 - DNA, 16 bp, Homo sapiens
ccaataaagctcacac

SEQ ID NO: 6053143 - DNA, 12 bp, Homo sapiens
ccaataaagctt

SEQ ID NO: 6053144 - DNA, 19 bp, Homo sapiens
ccaataaaggaggaatcag

SEQ ID NO: 6053145 - DNA, 14 bp, Homo sapiens
ccaataaaggcagc

SEQ ID NO: 6053146 - DNA, 15 bp, Homo sapiens
ccaataaaggcagct

SEQ ID NO: 6053147 - DNA, 20 bp, Homo sapiens
ccaataaaggcagctgcctc

SEQ ID NO: 6053148 - DNA, 16 bp, Homo sapiens
ccaataaagtgccttc

SEQ ID NO: 6053149 - DNA, 19 bp, Homo sapiens
ccaataaagtgccttctgg

SEQ ID NO: 6053150 - DNA, 22 bp, Homo sapiens
ccaataaatgtttgttatttac

SEQ ID NO: 6053151 - DNA, 21 bp, Homo sapiens
ccaataacaaggagctcaccc

SEQ ID NO: 6053152 - DNA, 23 bp, Homo sapiens
ccaataacaaggagctcaccctg

SEQ ID NO: 6053153 - DNA, 14 bp, Homo sapiens
ccaataacattctt

SEQ ID NO: 6053154 - DNA, 22 bp, Homo sapiens
ccaataataaaaaacaagaaac

SEQ ID NO: 6053155 - DNA, 14 bp, Homo sapiens
ccaataattttcct

SEQ ID NO: 6053156 - DNA, 17 bp, Homo sapiens
ccaatacaaaatgtatt

SEQ ID NO: 6053157 - DNA, 16 bp, Homo sapiens
ccaatacatttgtatt

SEQ ID NO: 6053158 - DNA, 17 bp, Homo sapiens
ccaataccccatggacc

SEQ ID NO: 6053159 - DNA, 22 bp, Homo sapiens
ccaataccctagaagaaaaccc

SEQ ID NO: 6053160 - DNA, 15 bp, Homo sapiens
ccaatactactgtaa

SEQ ID NO: 6053161 - DNA, 14 bp, Homo sapiens
ccaatactctccta

SEQ ID NO: 6053162 - DNA, 19 bp, Homo sapiens
ccaatagcactttcattgc

SEQ ID NO: 6053163 - DNA, 15 bp, Homo sapiens
ccaatagctctactg

SEQ ID NO: 6053164 - DNA, 16 bp, Homo sapiens
ccaataggaatgctaa

SEQ ID NO: 6053165 - DNA, 22 bp, Homo sapiens
ccaatagttgttgattggcagg

SEQ ID NO: 6053166 - DNA, 23 bp, Homo sapiens
ccaatatatagtgggtacatcaa

SEQ ID NO: 6053167 - DNA, 13 bp, Homo sapiens
ccaatatatgtat

SEQ ID NO: 6053168 - DNA, 21 bp, Homo sapiens
ccaatatcatgtcttgtgcat

SEQ ID NO: 6053169 - DNA, 15 bp, Homo sapiens
ccaatatcatgtgat

SEQ ID NO: 6053170 - DNA, 14 bp, Homo sapiens
ccaatatcctaata

SEQ ID NO: 6053171 - DNA, 17 bp, Homo sapiens
ccaatatcctaataaaa

SEQ ID NO: 6053172 - DNA, 19 bp, Homo sapiens
ccaatatcctaataaaaag

SEQ ID NO: 6053173 - DNA, 13 bp, Homo sapiens
ccaatatgacaca

SEQ ID NO: 6053174 - DNA, 16 bp, Homo sapiens
ccaatatggtggccct

SEQ ID NO: 6053175 - DNA, 16 bp, Homo sapiens
ccaatatgtattgtaa

SEQ ID NO: 6053176 - DNA, 22 bp, Homo sapiens
ccaatattaacacgctgcctgg

SEQ ID NO: 6053177 - DNA, 12 bp, Homo sapiens
ccaatattataa

SEQ ID NO: 6053178 - DNA, 20 bp, Homo sapiens
ccaatattcatagcagctta

SEQ ID NO: 6053179 - DNA, 12 bp, Homo sapiens
ccaatattgtaa

SEQ ID NO: 6053180 - DNA, 14 bp, Homo sapiens
ccaatattgtacag

SEQ ID NO: 6053181 - DNA, 18 bp, Homo sapiens
ccaatattgtacagtttt

SEQ ID NO: 6053182 - DNA, 12 bp, Homo sapiens
ccaatatttaaa

SEQ ID NO: 6053183 - DNA, 19 bp, Homo sapiens
ccaatatttataattaaag

SEQ ID NO: 6053184 - DNA, 23 bp, Homo sapiens
ccaatatttataattaaagaaaa

SEQ ID NO: 6053185 - DNA, 12 bp, Homo sapiens
ccaatatttctg

SEQ ID NO: 6053186 - DNA, 18 bp, Homo sapiens
ccaatatttctgctttct

SEQ ID NO: 6053187 - DNA, 12 bp, Homo sapiens
ccaatattttaa

SEQ ID NO: 6053188 - DNA, 14 bp, Homo sapiens
ccaatattttgcct

SEQ ID NO: 6053189 - DNA, 23 bp, Homo sapiens
ccaatcaaaatcacctcccacca

SEQ ID NO: 6053190 - DNA, 13 bp, Homo sapiens
ccaatcaaatata

SEQ ID NO: 6053191 - DNA, 16 bp, Homo sapiens
ccaatcaatcttgcat

SEQ ID NO: 6053192 - DNA, 21 bp, Homo sapiens
ccaatcaatttaaatgtttac

SEQ ID NO: 6053193 - DNA, 19 bp, Homo sapiens
ccaatcacgagatcttcct

SEQ ID NO: 6053194 - DNA, 22 bp, Homo sapiens
ccaatcacgagatcttccttcc

SEQ ID NO: 6053195 - DNA, 19 bp, Homo sapiens
ccaatcactgagtttgtgg

SEQ ID NO: 6053196 - DNA, 15 bp, Homo sapiens
ccaatcagagaccag

SEQ ID NO: 6053197 - DNA, 18 bp, Homo sapiens
ccaatcagagagcctaga

SEQ ID NO: 6053198 - DNA, 19 bp, Homo sapiens
ccaatcagagagcctagaa

SEQ ID NO: 6053199 - DNA, 12 bp, Homo sapiens
ccaatcagcact

SEQ ID NO: 6053200 - DNA, 14 bp, Homo sapiens
ccaatcagcactct

SEQ ID NO: 6053201 - DNA, 13 bp, Homo sapiens
ccaatcagcactg

SEQ ID NO: 6053202 - DNA, 16 bp, Homo sapiens
ccaatcagcactgaaa

SEQ ID NO: 6053203 - DNA, 13 bp, Homo sapiens
ccaatcagctcct

SEQ ID NO: 6053204 - DNA, 14 bp, Homo sapiens
ccaatcagcttttg

SEQ ID NO: 6053205 - DNA, 12 bp, Homo sapiens
ccaatcatctta

SEQ ID NO: 6053206 - DNA, 12 bp, Homo sapiens
ccaatccagaga

SEQ ID NO: 6053207 - DNA, 20 bp, Homo sapiens
ccaatccagagaagcgctgt

SEQ ID NO: 6053208 - DNA, 13 bp, Homo sapiens
ccaatccagcctt

SEQ ID NO: 6053209 - DNA, 13 bp, Homo sapiens
ccaatccaggtac

SEQ ID NO: 6053210 - DNA, 19 bp, Homo sapiens
ccaatccaggtgggagaga

SEQ ID NO: 6053211 - DNA, 19 bp, Homo sapiens
ccaatccatcgtattaaaa

SEQ ID NO: 6053212 - DNA, 20 bp, Homo sapiens
ccaatccatcgtattaaaaa

SEQ ID NO: 6053213 - DNA, 20 bp, Homo sapiens
ccaatccatttggcagaact

SEQ ID NO: 6053214 - DNA, 19 bp, Homo sapiens
ccaatcccagggctggctc

SEQ ID NO: 6053215 - DNA, 20 bp, Homo sapiens
ccaatcccagggctggctct

SEQ ID NO: 6053216 - DNA, 15 bp, Homo sapiens
ccaatcccagttctt

SEQ ID NO: 6053217 - DNA, 18 bp, Homo sapiens
ccaatcccagttcttcct

SEQ ID NO: 6053218 - DNA, 20 bp, Homo sapiens
ccaatcccagttcttcctgc

SEQ ID NO: 6053219 - DNA, 22 bp, Homo sapiens
ccaatcccagttcttcctgcaa

SEQ ID NO: 6053220 - DNA, 15 bp, Homo sapiens
ccaatccccactcct

SEQ ID NO: 6053221 - DNA, 17 bp, Homo sapiens
ccaatccccactcctcc

SEQ ID NO: 6053222 - DNA, 13 bp, Homo sapiens
ccaatccccagcc

SEQ ID NO: 6053223 - DNA, 15 bp, Homo sapiens
ccaatccccagccta

SEQ ID NO: 6053224 - DNA, 17 bp, Homo sapiens
ccaatcccccagcgctt

SEQ ID NO: 6053225 - DNA, 23 bp, Homo sapiens
cccagggcagggtgggcagccta

SEQ ID NO: 6053226 - DNA, 14 bp, Homo sapiens
cccagggcagtgtg

SEQ ID NO: 6053227 - DNA, 16 bp, Homo sapiens
cccagggcatcccatg

SEQ ID NO: 6053228 - DNA, 18 bp, Homo sapiens
cccagggcatcccatggg

SEQ ID NO: 6053229 - DNA, 19 bp, Homo sapiens
cccagggcatcccatgggg

SEQ ID NO: 6053230 - DNA, 16 bp, Homo sapiens
cccagggcatctggga

SEQ ID NO: 6053231 - DNA, 19 bp, Homo sapiens
cccagggcatcttgctggc

SEQ ID NO: 6053232 - DNA, 13 bp, Homo sapiens
cccagggccagcc

SEQ ID NO: 6053233 - DNA, 17 bp, Homo sapiens
cccagggccagcccacg

SEQ ID NO: 6053234 - DNA, 15 bp, Homo sapiens
cccagggccagggcc

SEQ ID NO: 6053235 - DNA, 20 bp, Homo sapiens
cccagggccagggccctgca

SEQ ID NO: 6053236 - DNA, 14 bp, Homo sapiens
cccagggcccagag

SEQ ID NO: 6053237 - DNA, 20 bp, Homo sapiens
cccagggcccccaaagagca

SEQ ID NO: 6053238 - DNA, 16 bp, Homo sapiens
cccagggcccccacag

SEQ ID NO: 6053239 - DNA, 18 bp, Homo sapiens
cccagggcccccacaggc

SEQ ID NO: 6053240 - DNA, 21 bp, Homo sapiens
cccagggcccccctcccccca

SEQ ID NO: 6053241 - DNA, 20 bp, Homo sapiens
cccagggcccgggcacccac

SEQ ID NO: 6053242 - DNA, 11 bp, Homo sapiens
cccagggccct

SEQ ID NO: 6053243 - DNA, 12 bp, Homo sapiens
cccagggcccta

SEQ ID NO: 6053244 - DNA, 16 bp, Homo sapiens
cccagggccctcccag

SEQ ID NO: 6053245 - DNA, 14 bp, Homo sapiens
cccagggccctgct

SEQ ID NO: 6053246 - DNA, 13 bp, Homo sapiens
cccagggccctgg

SEQ ID NO: 6053247 - DNA, 20 bp, Homo sapiens
cccagggccgcttctcctgc

SEQ ID NO: 6053248 - DNA, 14 bp, Homo sapiens
cccagggcctagag

SEQ ID NO: 6053249 - DNA, 17 bp, Homo sapiens
cccagggcctccagggc

SEQ ID NO: 6053250 - DNA, 17 bp, Homo sapiens
cccagggcctcctgggg

SEQ ID NO: 6053251 - DNA, 14 bp, Homo sapiens
cccagggcctctgg

SEQ ID NO: 6053252 - DNA, 13 bp, Homo sapiens
cccagggcctgac

SEQ ID NO: 6053253 - DNA, 19 bp, Homo sapiens
cccagggcctgagcctggc

SEQ ID NO: 6053254 - DNA, 12 bp, Homo sapiens
cccagggcctgg

SEQ ID NO: 6053255 - DNA, 16 bp, Homo sapiens
cccagggcctgggggc

SEQ ID NO: 6053256 - DNA, 18 bp, Homo sapiens
cccagggcctgggggcag

SEQ ID NO: 6053257 - DNA, 24 bp, Homo sapiens
cccagggcctgggggcagtgactg

SEQ ID NO: 6053258 - DNA, 13 bp, Homo sapiens
cccagggcctgtc

SEQ ID NO: 6053259 - DNA, 13 bp, Homo sapiens
cccagggctacac

SEQ ID NO: 6053260 - DNA, 16 bp, Homo sapiens
cccagggctacacaga

SEQ ID NO: 6053261 - DNA, 17 bp, Homo sapiens
cccagggctacacagac

SEQ ID NO: 6053262 - DNA, 22 bp, Homo sapiens
cccagggctagtataaacatga

SEQ ID NO: 6053263 - DNA, 15 bp, Homo sapiens
cccagggctcagcct

SEQ ID NO: 6053264 - DNA, 21 bp, Homo sapiens
cccagggctccctcctggagc

SEQ ID NO: 6053265 - DNA, 14 bp, Homo sapiens
cccagggctccctt

SEQ ID NO: 6053266 - DNA, 17 bp, Homo sapiens
cccagggctcccttatg

SEQ ID NO: 6053267 - DNA, 15 bp, Homo sapiens
cccagggctcctgca

SEQ ID NO: 6053268 - DNA, 12 bp, Homo sapiens
cccagggctctc

SEQ ID NO: 6053269 - DNA, 15 bp, Homo sapiens
cccagggctctgcag

SEQ ID NO: 6053270 - DNA, 16 bp, Homo sapiens
cccagggctctgcagg

SEQ ID NO: 6053271 - DNA, 19 bp, Homo sapiens
cccagggctctgcaggcca

SEQ ID NO: 6053272 - DNA, 19 bp, Homo sapiens
cccagggctctgccccagt

SEQ ID NO: 6053273 - DNA, 11 bp, Homo sapiens
cccagggctgc

SEQ ID NO: 6053274 - DNA, 15 bp, Homo sapiens
cccagggctggccct

SEQ ID NO: 6053275 - DNA, 13 bp, Homo sapiens
cccagggctggct

SEQ ID NO: 6053276 - DNA, 16 bp, Homo sapiens
cccagggctggctctg

SEQ ID NO: 6053277 - DNA, 16 bp, Homo sapiens
cccagggctgggagga

SEQ ID NO: 6053278 - DNA, 21 bp, Homo sapiens
cccagggctgggaggaaggac

SEQ ID NO: 6053279 - DNA, 17 bp, Homo sapiens
cccagggctgtcatctg

SEQ ID NO: 6053280 - DNA, 17 bp, Homo sapiens
cccagggctgtgggtgg

SEQ ID NO: 6053281 - DNA, 18 bp, Homo sapiens
cccagggctgtgggtggg

SEQ ID NO: 6053282 - DNA, 19 bp, Homo sapiens
cccagggctgtgggtgggg

SEQ ID NO: 6053283 - DNA, 22 bp, Homo sapiens
cccagggcttacggccctggcc

SEQ ID NO: 6053284 - DNA, 17 bp, Homo sapiens
cccaggggaaaatgaag

SEQ ID NO: 6053285 - DNA, 13 bp, Homo sapiens
cccaggggagagg

SEQ ID NO: 6053286 - DNA, 15 bp, Homo sapiens
cccaggggagagggt

SEQ ID NO: 6053287 - DNA, 16 bp, Homo sapiens
cccaggggagccagct

SEQ ID NO: 6053288 - DNA, 19 bp, Homo sapiens
cccaggggagccagctgct

SEQ ID NO: 6053289 - DNA, 20 bp, Homo sapiens
cccaggggagccagctgctt

SEQ ID NO: 6053290 - DNA, 23 bp, Homo sapiens
cccaggggaggcggcactccaac

SEQ ID NO: 6053291 - DNA, 20 bp, Homo sapiens
cccaggggcacacttcccct

SEQ ID NO: 6053292 - DNA, 21 bp, Homo sapiens
cccaggggcactgtgttctca

SEQ ID NO: 6053293 - DNA, 13 bp, Homo sapiens
cccaggggcagca

SEQ ID NO: 6053294 - DNA, 15 bp, Homo sapiens
cccaggggcagccac

SEQ ID NO: 6053295 - DNA, 16 bp, Homo sapiens
cccaggggcagccaca

SEQ ID NO: 6053296 - DNA, 16 bp, Homo sapiens
cccaggggcagcccca

SEQ ID NO: 6053297 - DNA, 13 bp, Homo sapiens
cccaggggcagga

SEQ ID NO: 6053298 - DNA, 12 bp, Homo sapiens
cccaggggccgg

SEQ ID NO: 6053299 - DNA, 17 bp, Homo sapiens
cccaggggctccacctg

SEQ ID NO: 6053300 - DNA, 18 bp, Homo sapiens
cccaggggctccacctgt

SEQ ID NO: 6053301 - DNA, 21 bp, Homo sapiens
cccagggggaagatgccaagg

SEQ ID NO: 6053302 - DNA, 14 bp, Homo sapiens
cccagggggcctgg

SEQ ID NO: 6053303 - DNA, 15 bp, Homo sapiens
cccagggggcctgga

SEQ ID NO: 6053304 - DNA, 16 bp, Homo sapiens
cccagggggcctggag

SEQ ID NO: 6053305 - DNA, 13 bp, Homo sapiens
cccaggggggcct

SEQ ID NO: 6053306 - DNA, 15 bp, Homo sapiens
cccaggggggcctcc

SEQ ID NO: 6053307 - DNA, 20 bp, Homo sapiens
cccaggggtccaggccccca

SEQ ID NO: 6053308 - DNA, 15 bp, Homo sapiens
cccaggggtcccagc

SEQ ID NO: 6053309 - DNA, 16 bp, Homo sapiens
cccaggggtctccctg

SEQ ID NO: 6053310 - DNA, 17 bp, Homo sapiens
cccaggggtctccctga

SEQ ID NO: 6053311 - DNA, 18 bp, Homo sapiens
cccaggggtctccctggc

SEQ ID NO: 6053312 - DNA, 19 bp, Homo sapiens
cccaggggtctccctggct

SEQ ID NO: 6053313 - DNA, 20 bp, Homo sapiens
cccaggggtctccctggctc

SEQ ID NO: 6053314 - DNA, 19 bp, Homo sapiens
cccaggggtgagccccgcc

SEQ ID NO: 6053315 - DNA, 21 bp, Homo sapiens
cccaggggtgccccctcctct

SEQ ID NO: 6053316 - DNA, 14 bp, Homo sapiens
cccaggggtgcctg

SEQ ID NO: 6053317 - DNA, 17 bp, Homo sapiens
cccagggtagcccgcct

SEQ ID NO: 6053318 - DNA, 9 bp, Homo sapiens
cccagggtc

SEQ ID NO: 6053319 - DNA, 20 bp, Homo sapiens
cccagggtcataagtgggga

SEQ ID NO: 6053320 - DNA, 21 bp, Homo sapiens
cccagggtcataagtggggag

SEQ ID NO: 6053321 - DNA, 16 bp, Homo sapiens
cccagggtcccagcct

SEQ ID NO: 6053322 - DNA, 15 bp, Homo sapiens
cccagggtcctggga

SEQ ID NO: 6053323 - DNA, 16 bp, Homo sapiens
cccagggtcctgtgcc

SEQ ID NO: 6053324 - DNA, 17 bp, Homo sapiens
cccagggtcgtctttgt

SEQ ID NO: 6053325 - DNA, 20 bp, Homo sapiens
cccagggtcgtctttgtgta

SEQ ID NO: 6053326 - DNA, 19 bp, Homo sapiens
cccagggtctagccgctgc

SEQ ID NO: 6053327 - DNA, 21 bp, Homo sapiens
cccagggtctagccgctgccc

SEQ ID NO: 6053328 - DNA, 12 bp, Homo sapiens
cccagggtctga

SEQ ID NO: 6053329 - DNA, 14 bp, Homo sapiens
cccagggtctgaaa

SEQ ID NO: 6053330 - DNA, 20 bp, Homo sapiens
cccagggtctgaaaggggtg

SEQ ID NO: 6053331 - DNA, 21 bp, Homo sapiens
cccagggtctgaaaggggtgt

SEQ ID NO: 6053332 - DNA, 16 bp, Homo sapiens
cccagggtcttcccta

SEQ ID NO: 6053333 - DNA, 23 bp, Homo sapiens
cccagggtgagaacgtgcccagc

SEQ ID NO: 6053334 - DNA, 19 bp, Homo sapiens
cccagggtgaggtggcatg

SEQ ID NO: 6053335 - DNA, 14 bp, Homo sapiens
cccagggtgcaggc

SEQ ID NO: 6053336 - DNA, 16 bp, Homo sapiens
cccagggtgcaggcgc

SEQ ID NO: 6053337 - DNA, 13 bp, Homo sapiens
cccagggtgctgg

SEQ ID NO: 6053338 - DNA, 15 bp, Homo sapiens
cccagggtgctggga

SEQ ID NO: 6053339 - DNA, 22 bp, Homo sapiens
cccagggtggacttagaaagca

SEQ ID NO: 6053340 - DNA, 19 bp, Homo sapiens
cccagggtggagagggaga

SEQ ID NO: 6053341 - DNA, 15 bp, Homo sapiens
cccagggtggaggaa

SEQ ID NO: 6053342 - DNA, 19 bp, Homo sapiens
cccagggtggaggaaggtg

SEQ ID NO: 6053343 - DNA, 15 bp, Homo sapiens
cccagggtggccaca

SEQ ID NO: 6053344 - DNA, 22 bp, Homo sapiens
cccagggtggtcttcaagcctg

SEQ ID NO: 6053345 - DNA, 21 bp, Homo sapiens
cccaggtaccacccttcagac

SEQ ID NO: 6053346 - DNA, 15 bp, Homo sapiens
cccaggtaccagctg

SEQ ID NO: 6053347 - DNA, 17 bp, Homo sapiens
cccaggtaccagctgcg

SEQ ID NO: 6053348 - DNA, 14 bp, Homo sapiens
cccaggtattgtct

SEQ ID NO: 6053349 - DNA, 15 bp, Homo sapiens
cccaggtattgtctt

SEQ ID NO: 6053350 - DNA, 16 bp, Homo sapiens
cccaggtcagccctgt

SEQ ID NO: 6053351 - DNA, 19 bp, Homo sapiens
cccaggtcagccctgtgtc

SEQ ID NO: 6053352 - DNA, 15 bp, Homo sapiens
cccaggtcaggggct

SEQ ID NO: 6053353 - DNA, 18 bp, Homo sapiens
cccaggtcaggggctccc

SEQ ID NO: 6053354 - DNA, 19 bp, Homo sapiens
cccaggtcaggggctccct

SEQ ID NO: 6053355 - DNA, 22 bp, Homo sapiens
cccaggtcaggggctccctaca

SEQ ID NO: 6053356 - DNA, 14 bp, Homo sapiens
cccaggtccagctc

SEQ ID NO: 6053357 - DNA, 17 bp, Homo sapiens
cccaggtccagctctgg

SEQ ID NO: 6053358 - DNA, 22 bp, Homo sapiens
cccaggtcccccgactgcctgt

SEQ ID NO: 6053359 - DNA, 13 bp, Homo sapiens
cccaggtcctcac

SEQ ID NO: 6053360 - DNA, 15 bp, Homo sapiens
cccaggtcctctgat

SEQ ID NO: 6053361 - DNA, 20 bp, Homo sapiens
cccaggtcctctgataccca

SEQ ID NO: 6053362 - DNA, 11 bp, Homo sapiens
cccaggtcctg

SEQ ID NO: 6053363 - DNA, 15 bp, Homo sapiens
cccaggtcctgtctc

SEQ ID NO: 6053364 - DNA, 23 bp, Homo sapiens
cccaggtcctgtctctgcacaga

SEQ ID NO: 6053365 - DNA, 17 bp, Homo sapiens
cccaggtcgcccacctg

SEQ ID NO: 6053366 - DNA, 17 bp, Homo sapiens
cccaggtcgggcagtgg

SEQ ID NO: 6053367 - DNA, 12 bp, Homo sapiens
cccaggtctcct

SEQ ID NO: 6053368 - DNA, 15 bp, Homo sapiens
cccaggtctctccac

SEQ ID NO: 6053369 - DNA, 18 bp, Homo sapiens
cccaggtctctccactgc

SEQ ID NO: 6053370 - DNA, 13 bp, Homo sapiens
cccaggtctgatg

SEQ ID NO: 6053371 - DNA, 22 bp, Homo sapiens
cccaggtctgggtggggcccag

SEQ ID NO: 6053372 - DNA, 21 bp, Homo sapiens
cccaggtcttccagacctgct

SEQ ID NO: 6053373 - DNA, 17 bp, Homo sapiens
cccaggtcttcctgctt

SEQ ID NO: 6053374 - DNA, 22 bp, Homo sapiens
cccaggtcttcctgctttccat

SEQ ID NO: 6053375 - DNA, 21 bp, Homo sapiens
cccaggtgacacgcttctgag

SEQ ID NO: 6053376 - DNA, 14 bp, Homo sapiens
cccaggtgagacag

SEQ ID NO: 6053377 - DNA, 19 bp, Homo sapiens
cccaggtgagctgaagaca

SEQ ID NO: 6053378 - DNA, 15 bp, Homo sapiens
cccaggtgaggaatt

SEQ ID NO: 6053379 - DNA, 21 bp, Homo sapiens
cccaggtgaggaatttgaagc

SEQ ID NO: 6053380 - DNA, 18 bp, Homo sapiens
cccaggtgagggaaggag

SEQ ID NO: 6053381 - DNA, 20 bp, Homo sapiens
cccaggtgagggaaggagac

SEQ ID NO: 6053382 - DNA, 21 bp, Homo sapiens
cccaggtgcagccagaggcac

SEQ ID NO: 6053383 - DNA, 20 bp, Homo sapiens
cccaggtgcatttcttggtt

SEQ ID NO: 6053384 - DNA, 17 bp, Homo sapiens
cccaggtgccaccaata

SEQ ID NO: 6053385 - DNA, 20 bp, Homo sapiens
cccaggtgcgtgtgtctctg

SEQ ID NO: 6053386 - DNA, 22 bp, Homo sapiens
cccaggtgctaggaacactcct

SEQ ID NO: 6053387 - DNA, 22 bp, Homo sapiens
cccaggtgctggaggcagactc

SEQ ID NO: 6053388 - DNA, 21 bp, Homo sapiens
cccaggtggaaggcagacagc

SEQ ID NO: 6053389 - DNA, 16 bp, Homo sapiens
cccaggtggagggcac

SEQ ID NO: 6053390 - DNA, 19 bp, Homo sapiens
cccaggtggcctcctggcc

SEQ ID NO: 6053391 - DNA, 16 bp, Homo sapiens
cccaggtggctatttt

SEQ ID NO: 6053392 - DNA, 18 bp, Homo sapiens
cccaggtggctgacccag

SEQ ID NO: 6053393 - DNA, 19 bp, Homo sapiens
cccaggtggctgacccagt

SEQ ID NO: 6053394 - DNA, 16 bp, Homo sapiens
cccaggtgtgcctgtg

SEQ ID NO: 6053395 - DNA, 21 bp, Homo sapiens
cccaggtgtgcctgtgctcct

SEQ ID NO: 6053396 - DNA, 23 bp, Homo sapiens
cccaggtgtgcctgtgctcctgc

SEQ ID NO: 6053397 - DNA, 14 bp, Homo sapiens
cccaggtgttgtcc

SEQ ID NO: 6053398 - DNA, 16 bp, Homo sapiens
cccaggtgttgtccgt

SEQ ID NO: 6053399 - DNA, 20 bp, Homo sapiens
cccaggtgtttgtggggctg

SEQ ID NO: 6053400 - DNA, 18 bp, Homo sapiens
cccaggttcccccagcaa

SEQ ID NO: 6053401 - DNA, 20 bp, Homo sapiens
cccaggttcccccagcaagc

SEQ ID NO: 6053402 - DNA, 19 bp, Homo sapiens
cccaggttgacaccattct

SEQ ID NO: 6053403 - DNA, 23 bp, Homo sapiens
cccaggttgaggtgcgctcacct

SEQ ID NO: 6053404 - DNA, 17 bp, Homo sapiens
ccaatcccctccttggg

SEQ ID NO: 6053405 - DNA, 16 bp, Homo sapiens
ccaatccctctccact

SEQ ID NO: 6053406 - DNA, 22 bp, Homo sapiens
ccaatccctctccactcttctc

SEQ ID NO: 6053407 - DNA, 15 bp, Homo sapiens
ccaatccctgatccc

SEQ ID NO: 6053408 - DNA, 18 bp, Homo sapiens
ccaatccctgccactggg

SEQ ID NO: 6053409 - DNA, 16 bp, Homo sapiens
ccaatccctgtgtgtc

SEQ ID NO: 6053410 - DNA, 21 bp, Homo sapiens
ccaatccctgtgtgtcgttcc

SEQ ID NO: 6053411 - DNA, 13 bp, Homo sapiens
ccaatcccttctc

SEQ ID NO: 6053412 - DNA, 21 bp, Homo sapiens
ccaatcccttctccacttact

SEQ ID NO: 6053413 - DNA, 18 bp, Homo sapiens
ccaatcctcactgggtgg

SEQ ID NO: 6053414 - DNA, 16 bp, Homo sapiens
ccaatcctcccagaaa

SEQ ID NO: 6053415 - DNA, 12 bp, Homo sapiens
ccaatcctcccc

SEQ ID NO: 6053416 - DNA, 16 bp, Homo sapiens
ccaatcctccccgctc

SEQ ID NO: 6053417 - DNA, 17 bp, Homo sapiens
ccaatcctccctggaga

SEQ ID NO: 6053418 - DNA, 12 bp, Homo sapiens
ccaatcctctct

SEQ ID NO: 6053419 - DNA, 17 bp, Homo sapiens
ccaatcggactgccaaa

SEQ ID NO: 6053420 - DNA, 19 bp, Homo sapiens
ccaatcggactgccaaatt

SEQ ID NO: 6053421 - DNA, 16 bp, Homo sapiens
ccaatcggctacccct

SEQ ID NO: 6053422 - DNA, 21 bp, Homo sapiens
ccaatcgggagtagcaaggaa

SEQ ID NO: 6053423 - DNA, 15 bp, Homo sapiens
ccaatcgggtccaga

SEQ ID NO: 6053424 - DNA, 19 bp, Homo sapiens
ccaatctcaatacagcctg

SEQ ID NO: 6053425 - DNA, 23 bp, Homo sapiens
ccaatctctacccctttcttctc

SEQ ID NO: 6053426 - DNA, 11 bp, Homo sapiens
ccaatctctgt

SEQ ID NO: 6053427 - DNA, 23 bp, Homo sapiens
ccaatctctgttctgtttggcac

SEQ ID NO: 6053428 - DNA, 23 bp, Homo sapiens
ccaatctgagcaaacaccagtga

SEQ ID NO: 6053429 - DNA, 19 bp, Homo sapiens
ccaatctgcaatttctact

SEQ ID NO: 6053430 - DNA, 18 bp, Homo sapiens
ccaatctggcccttacac

SEQ ID NO: 6053431 - DNA, 19 bp, Homo sapiens
ccaatctggcccttacaca

SEQ ID NO: 6053432 - DNA, 18 bp, Homo sapiens
ccaatctgtaatttcact

SEQ ID NO: 6053433 - DNA, 19 bp, Homo sapiens
ccaatcttaccagatgcta

SEQ ID NO: 6053434 - DNA, 20 bp, Homo sapiens
ccaatcttactttgtaaatt

SEQ ID NO: 6053435 - DNA, 21 bp, Homo sapiens
ccaatcttactttgtaaattc

SEQ ID NO: 6053436 - DNA, 13 bp, Homo sapiens
ccaatcttctttt

SEQ ID NO: 6053437 - DNA, 20 bp, Homo sapiens
ccaatcttctttttcaggct

SEQ ID NO: 6053438 - DNA, 24 bp, Homo sapiens
ccaatcttgctttgtgtatctcat

SEQ ID NO: 6053439 - DNA, 19 bp, Homo sapiens
ccaatcttgtttatagcaa

SEQ ID NO: 6053440 - DNA, 15 bp, Homo sapiens
ccaatgaaaaaatgt

SEQ ID NO: 6053441 - DNA, 18 bp, Homo sapiens
ccaatgaaaaaattaaaa

SEQ ID NO: 6053442 - DNA, 20 bp, Homo sapiens
ccaatgaaaacatgtactac

SEQ ID NO: 6053443 - DNA, 23 bp, Homo sapiens
ccaatgaaatacacaagtaaaca

SEQ ID NO: 6053444 - DNA, 12 bp, Homo sapiens
ccaatgaaatga

SEQ ID NO: 6053445 - DNA, 17 bp, Homo sapiens
ccaatgaactctttccc

SEQ ID NO: 6053446 - DNA, 19 bp, Homo sapiens
ccaatgaactctttcccca

SEQ ID NO: 6053447 - DNA, 14 bp, Homo sapiens
ccaatgaagaagac

SEQ ID NO: 6053448 - DNA, 15 bp, Homo sapiens
ccaatgaagaagaca

SEQ ID NO: 6053449 - DNA, 16 bp, Homo sapiens
ccaatgaagaagacaa

SEQ ID NO: 6053450 - DNA, 18 bp, Homo sapiens
ccaatgaagataaatgct

SEQ ID NO: 6053451 - DNA, 19 bp, Homo sapiens
ccaatgaagataaatgctt

SEQ ID NO: 6053452 - DNA, 18 bp, Homo sapiens
ccaatgaattattatata

SEQ ID NO: 6053453 - DNA, 23 bp, Homo sapiens
ccaatgacacccatgccagagag

SEQ ID NO: 6053454 - DNA, 15 bp, Homo sapiens
ccaatgacaggacat

SEQ ID NO: 6053455 - DNA, 16 bp, Homo sapiens
ccaatgagacttgcct

SEQ ID NO: 6053456 - DNA, 21 bp, Homo sapiens
ccaatgagacttgccttccta

SEQ ID NO: 6053457 - DNA, 14 bp, Homo sapiens
ccaatgagctttct

SEQ ID NO: 6053458 - DNA, 22 bp, Homo sapiens
ccaatgaggtggctcatgcctg

SEQ ID NO: 6053459 - DNA, 15 bp, Homo sapiens
ccaatgagtctgtaa

SEQ ID NO: 6053460 - DNA, 17 bp, Homo sapiens
ccaatgagtctgtaatt

SEQ ID NO: 6053461 - DNA, 20 bp, Homo sapiens
ccaatgattcataacaatgt

SEQ ID NO: 6053462 - DNA, 18 bp, Homo sapiens
ccaatgcacctaaagaaa

SEQ ID NO: 6053463 - DNA, 22 bp, Homo sapiens
ccaatgcactttgttctggctc

SEQ ID NO: 6053464 - DNA, 14 bp, Homo sapiens
ccaatgcagaactc

SEQ ID NO: 6053465 - DNA, 18 bp, Homo sapiens
ccaatgcatagagccctg

SEQ ID NO: 6053466 - DNA, 24 bp, Homo sapiens
ccaatgcatagagccctggccagc

SEQ ID NO: 6053467 - DNA, 19 bp, Homo sapiens
ccaatgcatagtttgttca

SEQ ID NO: 6053468 - DNA, 13 bp, Homo sapiens
ccaatgccacaga

SEQ ID NO: 6053469 - DNA, 13 bp, Homo sapiens
ccaatgccacagc

SEQ ID NO: 6053470 - DNA, 21 bp, Homo sapiens
ccaatgccacatacttgcagc

SEQ ID NO: 6053471 - DNA, 16 bp, Homo sapiens
ccaatgcccagcaggg

SEQ ID NO: 6053472 - DNA, 18 bp, Homo sapiens
ccaatgccccactggcag

SEQ ID NO: 6053473 - DNA, 16 bp, Homo sapiens
ccaatgcctttttaga

SEQ ID NO: 6053474 - DNA, 18 bp, Homo sapiens
ccaatgcgacaagtagtt

SEQ ID NO: 6053475 - DNA, 18 bp, Homo sapiens
ccaatgcggcccactttc

SEQ ID NO: 6053476 - DNA, 12 bp, Homo sapiens
ccaatgctctgg

SEQ ID NO: 6053477 - DNA, 14 bp, Homo sapiens
ccaatgctgatgtc

SEQ ID NO: 6053478 - DNA, 16 bp, Homo sapiens
ccaatgctgcctggga

SEQ ID NO: 6053479 - DNA, 18 bp, Homo sapiens
ccaatgctgcctgggagc

SEQ ID NO: 6053480 - DNA, 15 bp, Homo sapiens
ccaatgctgctccac

SEQ ID NO: 6053481 - DNA, 12 bp, Homo sapiens
ccaatgctgctt

SEQ ID NO: 6053482 - DNA, 18 bp, Homo sapiens
ccaatgctgtacctggct

SEQ ID NO: 6053483 - DNA, 24 bp, Homo sapiens
ccaatgctttgggaggccaaggca

SEQ ID NO: 6053484 - DNA, 19 bp, Homo sapiens
ccaatggaaagcttttcag

SEQ ID NO: 6053485 - DNA, 22 bp, Homo sapiens
ccaatggaaagcttttcagtgt

SEQ ID NO: 6053486 - DNA, 17 bp, Homo sapiens
ccaatggagaaaatgaa

SEQ ID NO: 6053487 - DNA, 20 bp, Homo sapiens
ccaatggagtagacccctgg

SEQ ID NO: 6053488 - DNA, 23 bp, Homo sapiens
ccaatggagtagacccctggctg

SEQ ID NO: 6053489 - DNA, 16 bp, Homo sapiens
ccaatggattcatgga

SEQ ID NO: 6053490 - DNA, 18 bp, Homo sapiens
ccaatggattcatggagt

SEQ ID NO: 6053491 - DNA, 22 bp, Homo sapiens
ccaatggcccggcccctcctga

SEQ ID NO: 6053492 - DNA, 18 bp, Homo sapiens
ccaatgggaccgtgcccc

SEQ ID NO: 6053493 - DNA, 14 bp, Homo sapiens
ccaatgggagctca

SEQ ID NO: 6053494 - DNA, 17 bp, Homo sapiens
ccaatgggagctcatgg

SEQ ID NO: 6053495 - DNA, 18 bp, Homo sapiens
ccaatggggccagcactg

SEQ ID NO: 6053496 - DNA, 12 bp, Homo sapiens
ccaatggggcgg

SEQ ID NO: 6053497 - DNA, 16 bp, Homo sapiens
ccaatggggcggggct

SEQ ID NO: 6053498 - DNA, 21 bp, Homo sapiens
ccaatggggcggggcttctct

SEQ ID NO: 6053499 - DNA, 21 bp, Homo sapiens
ccaatggtgagggctgagagg

SEQ ID NO: 6053500 - DNA, 19 bp, Homo sapiens
ccaatggtgatcctctatt

SEQ ID NO: 6053501 - DNA, 21 bp, Homo sapiens
ccaatggtgatcctctatttt

SEQ ID NO: 6053502 - DNA, 16 bp, Homo sapiens
ccaatggtgtttttct

SEQ ID NO: 6053503 - DNA, 17 bp, Homo sapiens
ccaatgtaccgtttcct

SEQ ID NO: 6053504 - DNA, 12 bp, Homo sapiens
ccaatgtctccc

SEQ ID NO: 6053505 - DNA, 22 bp, Homo sapiens
ccaatgtctcccacacccaccc

SEQ ID NO: 6053506 - DNA, 14 bp, Homo sapiens
ccaatgtctggaga

SEQ ID NO: 6053507 - DNA, 15 bp, Homo sapiens
ccaatgtctggagac

SEQ ID NO: 6053508 - DNA, 12 bp, Homo sapiens
ccaatgtgaaga

SEQ ID NO: 6053509 - DNA, 14 bp, Homo sapiens
ccaatgtgcccagt

SEQ ID NO: 6053510 - DNA, 14 bp, Homo sapiens
ccaatgtggcaaga

SEQ ID NO: 6053511 - DNA, 18 bp, Homo sapiens
ccaatgttcctgctaata

SEQ ID NO: 6053512 - DNA, 14 bp, Homo sapiens
ccaatgtttaaaaa

SEQ ID NO: 6053513 - DNA, 22 bp, Homo sapiens
ccaatgtttattgggcaataaa

SEQ ID NO: 6053514 - DNA, 18 bp, Homo sapiens
ccaattaaaaacgaaaac

SEQ ID NO: 6053515 - DNA, 22 bp, Homo sapiens
ccaattaaaatactatgcagta

SEQ ID NO: 6053516 - DNA, 18 bp, Homo sapiens
ccaattaaaatatatata

SEQ ID NO: 6053517 - DNA, 15 bp, Homo sapiens
ccaattaaaattaag

SEQ ID NO: 6053518 - DNA, 21 bp, Homo sapiens
ccaattaaaattaaggtctgg

SEQ ID NO: 6053519 - DNA, 18 bp, Homo sapiens
ccaattaaggattttatg

SEQ ID NO: 6053520 - DNA, 22 bp, Homo sapiens
ccaattaaggattttatgcttt

SEQ ID NO: 6053521 - DNA, 20 bp, Homo sapiens
ccaattacagggtgactcac

SEQ ID NO: 6053522 - DNA, 17 bp, Homo sapiens
ccaattactattccctt

SEQ ID NO: 6053523 - DNA, 17 bp, Homo sapiens
ccaattacttgaagtat

SEQ ID NO: 6053524 - DNA, 23 bp, Homo sapiens
ccaattaggaagtgtaacagctg

SEQ ID NO: 6053525 - DNA, 14 bp, Homo sapiens
ccaattagtttcct

SEQ ID NO: 6053526 - DNA, 16 bp, Homo sapiens
ccaattatcatctttt

SEQ ID NO: 6053527 - DNA, 16 bp, Homo sapiens
ccaattatgcactggc

SEQ ID NO: 6053528 - DNA, 13 bp, Homo sapiens
ccaattatgtgac

SEQ ID NO: 6053529 - DNA, 15 bp, Homo sapiens
ccaattatgtgacaa

SEQ ID NO: 6053530 - DNA, 22 bp, Homo sapiens
ccaattcaaaaataaattagaa

SEQ ID NO: 6053531 - DNA, 20 bp, Homo sapiens
ccaattcacccactcccttg

SEQ ID NO: 6053532 - DNA, 16 bp, Homo sapiens
ccaattcacctcgtta

SEQ ID NO: 6053533 - DNA, 17 bp, Homo sapiens
ccaattcactttagagt

SEQ ID NO: 6053534 - DNA, 16 bp, Homo sapiens
ccaattcagacaggca

SEQ ID NO: 6053535 - DNA, 17 bp, Homo sapiens
ccaattcatctcagcaa

SEQ ID NO: 6053536 - DNA, 17 bp, Homo sapiens
ccaattccaaaattcca

SEQ ID NO: 6053537 - DNA, 15 bp, Homo sapiens
ccaattccagagctg

SEQ ID NO: 6053538 - DNA, 18 bp, Homo sapiens
ccaattcccccttaaact

SEQ ID NO: 6053539 - DNA, 24 bp, Homo sapiens
ccaattcctcatcctcagatgctc

SEQ ID NO: 6053540 - DNA, 19 bp, Homo sapiens
ccaattcggggcctgctgg

SEQ ID NO: 6053541 - DNA, 22 bp, Homo sapiens
ccaattctatcttttgtttcct

SEQ ID NO: 6053542 - DNA, 14 bp, Homo sapiens
ccaattctcccctc

SEQ ID NO: 6053543 - DNA, 17 bp, Homo sapiens
ccaattctcgagcttgg

SEQ ID NO: 6053544 - DNA, 23 bp, Homo sapiens
ccaattctgcctgcctcctccct

SEQ ID NO: 6053545 - DNA, 14 bp, Homo sapiens
ccaattctgtccca

SEQ ID NO: 6053546 - DNA, 18 bp, Homo sapiens
ccaattcttacaaacatg

SEQ ID NO: 6053547 - DNA, 16 bp, Homo sapiens
ccaattgaaaagtgtt

SEQ ID NO: 6053548 - DNA, 22 bp, Homo sapiens
ccaattgactctcacactgaat

SEQ ID NO: 6053549 - DNA, 22 bp, Homo sapiens
ccaattgcctcttgcaggctga

SEQ ID NO: 6053550 - DNA, 16 bp, Homo sapiens
ccaattggtgcttcag

SEQ ID NO: 6053551 - DNA, 13 bp, Homo sapiens
ccaattgtaaaaa

SEQ ID NO: 6053552 - DNA, 21 bp, Homo sapiens
ccaattgttgacagttctgaa

SEQ ID NO: 6053553 - DNA, 16 bp, Homo sapiens
ccaatttactggccac

SEQ ID NO: 6053554 - DNA, 12 bp, Homo sapiens
ccaatttagaat

SEQ ID NO: 6053555 - DNA, 13 bp, Homo sapiens
ccaatttcaaaat

SEQ ID NO: 6053556 - DNA, 19 bp, Homo sapiens
ccaatttcaagttccaagt

SEQ ID NO: 6053557 - DNA, 13 bp, Homo sapiens
ccaatttcacaga

SEQ ID NO: 6053558 - DNA, 20 bp, Homo sapiens
ccaatttcaccccattttct

SEQ ID NO: 6053559 - DNA, 22 bp, Homo sapiens
ccaatttcaccccattttctgt

SEQ ID NO: 6053560 - DNA, 16 bp, Homo sapiens
ccaatttcagactccc

SEQ ID NO: 6053561 - DNA, 22 bp, Homo sapiens
ccaatttcccacccccacccac

SEQ ID NO: 6053562 - DNA, 21 bp, Homo sapiens
ccaatttcctctccactgctg

SEQ ID NO: 6053563 - DNA, 23 bp, Homo sapiens
ccaatttcctctccactgctgga

SEQ ID NO: 6053564 - DNA, 21 bp, Homo sapiens
ccaatttcggattttttccaa

SEQ ID NO: 6053565 - DNA, 20 bp, Homo sapiens
ccaatttctattaaaggttc

SEQ ID NO: 6053566 - DNA, 10 bp, Homo sapiens
ccaatttctc

SEQ ID NO: 6053567 - DNA, 14 bp, Homo sapiens
ccaatttcttcctt

SEQ ID NO: 6053568 - DNA, 20 bp, Homo sapiens
ccaatttgcacattaaatga

SEQ ID NO: 6053569 - DNA, 20 bp, Homo sapiens
ccaatttggtaaaaatgctg

SEQ ID NO: 6053570 - DNA, 20 bp, Homo sapiens
ccaatttgtaaaaacagcat

SEQ ID NO: 6053571 - DNA, 23 bp, Homo sapiens
ccaatttgtctcctactctgtgt

SEQ ID NO: 6053572 - DNA, 14 bp, Homo sapiens
ccaatttgttctgt

SEQ ID NO: 6053573 - DNA, 18 bp, Homo sapiens
ccaatttgttctgtgcaa

SEQ ID NO: 6053574 - DNA, 17 bp, Homo sapiens
ccaattttaaaatgaaa

SEQ ID NO: 6053575 - DNA, 15 bp, Homo sapiens
ccaattttggatgag

SEQ ID NO: 6053576 - DNA, 23 bp, Homo sapiens
ccaattttttgttcttcagagat

SEQ ID NO: 6053577 - DNA, 17 bp, Homo sapiens
ccaatttttttttcctt

SEQ ID NO: 6053578 - DNA, 13 bp, Homo sapiens
ccacaaaaagaga

SEQ ID NO: 6053579 - DNA, 21 bp, Homo sapiens
ccacaaaacttcagtgtggta

SEQ ID NO: 6053580 - DNA, 16 bp, Homo sapiens
ccacaaaagacagacc

SEQ ID NO: 6053581 - DNA, 15 bp, Homo sapiens
cccaggttggaggcc

SEQ ID NO: 6053582 - DNA, 14 bp, Homo sapiens
cccaggttggctct

SEQ ID NO: 6053583 - DNA, 15 bp, Homo sapiens
cccaggttggctctg

SEQ ID NO: 6053584 - DNA, 21 bp, Homo sapiens
cccaggttggctctgccagtc

SEQ ID NO: 6053585 - DNA, 22 bp, Homo sapiens
cccaggtttagtgaaaaactgc

SEQ ID NO: 6053586 - DNA, 16 bp, Homo sapiens
cccaggtttcttctct

SEQ ID NO: 6053587 - DNA, 20 bp, Homo sapiens
cccaggtttcttctctggag

SEQ ID NO: 6053588 - DNA, 18 bp, Homo sapiens
cccaggtttttgcccatc

SEQ ID NO: 6053589 - DNA, 12 bp, Homo sapiens
cccagtaaaatt

SEQ ID NO: 6053590 - DNA, 15 bp, Homo sapiens
cccagtaactcatct

SEQ ID NO: 6053591 - DNA, 22 bp, Homo sapiens
cccagtaattattttcttcctt

SEQ ID NO: 6053592 - DNA, 22 bp, Homo sapiens
cccagtacacaggggcttgact

SEQ ID NO: 6053593 - DNA, 14 bp, Homo sapiens
cccagtagccccaa

SEQ ID NO: 6053594 - DNA, 19 bp, Homo sapiens
cccagtagctgggattaca

SEQ ID NO: 6053595 - DNA, 13 bp, Homo sapiens
cccagtagtcaga

SEQ ID NO: 6053596 - DNA, 19 bp, Homo sapiens
cccagtatacctcattttt

SEQ ID NO: 6053597 - DNA, 15 bp, Homo sapiens
cccagtatctcttca

SEQ ID NO: 6053598 - DNA, 16 bp, Homo sapiens
cccagtatctcttcag

SEQ ID NO: 6053599 - DNA, 22 bp, Homo sapiens
cccagtattactgctgctgtgc

SEQ ID NO: 6053600 - DNA, 21 bp, Homo sapiens
cccagtcaattacatgtttgg

SEQ ID NO: 6053601 - DNA, 13 bp, Homo sapiens
cccagtcactcct

SEQ ID NO: 6053602 - DNA, 13 bp, Homo sapiens
cccagtcagcctc

SEQ ID NO: 6053603 - DNA, 15 bp, Homo sapiens
cccagtcagcctctc

SEQ ID NO: 6053604 - DNA, 18 bp, Homo sapiens
cccagtcagcctctctcc

SEQ ID NO: 6053605 - DNA, 21 bp, Homo sapiens
cccagtcagcctctctcccag

SEQ ID NO: 6053606 - DNA, 22 bp, Homo sapiens
cccagtccactggggagtgctg

SEQ ID NO: 6053607 - DNA, 23 bp, Homo sapiens
cccagtccatgctccagggtcag

SEQ ID NO: 6053608 - DNA, 21 bp, Homo sapiens
cccagtcccacactgtggcca

SEQ ID NO: 6053609 - DNA, 14 bp, Homo sapiens
cccagtcccagcag

SEQ ID NO: 6053610 - DNA, 15 bp, Homo sapiens
cccagtcccagcagc

SEQ ID NO: 6053611 - DNA, 15 bp, Homo sapiens
cccagtcccagggaa

SEQ ID NO: 6053612 - DNA, 21 bp, Homo sapiens
cccagtcccagggaaggtggg

SEQ ID NO: 6053613 - DNA, 21 bp, Homo sapiens
cccagtccccaacctgcactc

SEQ ID NO: 6053614 - DNA, 13 bp, Homo sapiens
cccagtccccacc

SEQ ID NO: 6053615 - DNA, 21 bp, Homo sapiens
cccagtccccacccctgcccc

SEQ ID NO: 6053616 - DNA, 14 bp, Homo sapiens
cccagtccccagcc

SEQ ID NO: 6053617 - DNA, 22 bp, Homo sapiens
cccagtcccccaaccccagccg

SEQ ID NO: 6053618 - DNA, 14 bp, Homo sapiens
cccagtccccggga

SEQ ID NO: 6053619 - DNA, 23 bp, Homo sapiens
cccagtccccgtgccccgcctcc

SEQ ID NO: 6053620 - DNA, 13 bp, Homo sapiens
cccagtccctggg

SEQ ID NO: 6053621 - DNA, 14 bp, Homo sapiens
cccagtccctgggg

SEQ ID NO: 6053622 - DNA, 21 bp, Homo sapiens
cccagtccgccaaacactcca

SEQ ID NO: 6053623 - DNA, 19 bp, Homo sapiens
cccagtccggtgccttcca

SEQ ID NO: 6053624 - DNA, 17 bp, Homo sapiens
cccagtcctctgcctcc

SEQ ID NO: 6053625 - DNA, 12 bp, Homo sapiens
cccagtcctgcc

SEQ ID NO: 6053626 - DNA, 13 bp, Homo sapiens
cccagtcctggcc

SEQ ID NO: 6053627 - DNA, 16 bp, Homo sapiens
cccagtcctggcctgg

SEQ ID NO: 6053628 - DNA, 20 bp, Homo sapiens
cccagtcctggcctggcttc

SEQ ID NO: 6053629 - DNA, 14 bp, Homo sapiens
cccagtccttggct

SEQ ID NO: 6053630 - DNA, 18 bp, Homo sapiens
cccagtcgaactgggggc

SEQ ID NO: 6053631 - DNA, 15 bp, Homo sapiens
cccagtcgaccccaa

SEQ ID NO: 6053632 - DNA, 14 bp, Homo sapiens
cccagtcgagacct

SEQ ID NO: 6053633 - DNA, 13 bp, Homo sapiens
cccagtcgagccc

SEQ ID NO: 6053634 - DNA, 19 bp, Homo sapiens
cccagtcgagccctgcagc

SEQ ID NO: 6053635 - DNA, 21 bp, Homo sapiens
cccagtcgagccctgcagcca

SEQ ID NO: 6053636 - DNA, 13 bp, Homo sapiens
cccagtcgccctt

SEQ ID NO: 6053637 - DNA, 20 bp, Homo sapiens
cccagtcgtccgctcagcca

SEQ ID NO: 6053638 - DNA, 21 bp, Homo sapiens
cccagtctacgttctccagcc

SEQ ID NO: 6053639 - DNA, 13 bp, Homo sapiens
cccagtctcagac

SEQ ID NO: 6053640 - DNA, 14 bp, Homo sapiens
cccagtctcagaca

SEQ ID NO: 6053641 - DNA, 17 bp, Homo sapiens
cccagtctcatctcctg

SEQ ID NO: 6053642 - DNA, 18 bp, Homo sapiens
cccagtctcatctcctga

SEQ ID NO: 6053643 - DNA, 20 bp, Homo sapiens
cccagtctcctctccatttt

SEQ ID NO: 6053644 - DNA, 22 bp, Homo sapiens
cccagtctgatattcacctaag

SEQ ID NO: 6053645 - DNA, 14 bp, Homo sapiens
cccagtctggaaga

SEQ ID NO: 6053646 - DNA, 20 bp, Homo sapiens
cccagtctggaagaagagga

SEQ ID NO: 6053647 - DNA, 22 bp, Homo sapiens
cccagtctggaagaagaggagg

SEQ ID NO: 6053648 - DNA, 23 bp, Homo sapiens
cccagtctggaagaagaggagga

SEQ ID NO: 6053649 - DNA, 17 bp, Homo sapiens
cccagtctgttccccat

SEQ ID NO: 6053650 - DNA, 20 bp, Homo sapiens
cccagtctgttgctgctcca

SEQ ID NO: 6053651 - DNA, 12 bp, Homo sapiens
cccagtcttcct

SEQ ID NO: 6053652 - DNA, 14 bp, Homo sapiens
cccagtcttccttg

SEQ ID NO: 6053653 - DNA, 16 bp, Homo sapiens
cccagtcttgagtggg

SEQ ID NO: 6053654 - DNA, 13 bp, Homo sapiens
cccagtctttctt

SEQ ID NO: 6053655 - DNA, 22 bp, Homo sapiens
cccagtctttcttcactctggc

SEQ ID NO: 6053656 - DNA, 14 bp, Homo sapiens
cccagtgaagcctc

SEQ ID NO: 6053657 - DNA, 18 bp, Homo sapiens
cccagtgaagcctctgag

SEQ ID NO: 6053658 - DNA, 13 bp, Homo sapiens
cccagtgacactt

SEQ ID NO: 6053659 - DNA, 15 bp, Homo sapiens
cccagtgacctgacc

SEQ ID NO: 6053660 - DNA, 15 bp, Homo sapiens
cccagtgaccttact

SEQ ID NO: 6053661 - DNA, 15 bp, Homo sapiens
cccagtgactccagg

SEQ ID NO: 6053662 - DNA, 22 bp, Homo sapiens
cccagtgacttaggaggctgag

SEQ ID NO: 6053663 - DNA, 17 bp, Homo sapiens
cccagtgagactgcccc

SEQ ID NO: 6053664 - DNA, 18 bp, Homo sapiens
cccagtgagactgcccca

SEQ ID NO: 6053665 - DNA, 22 bp, Homo sapiens
cccagtgagagtgaggcccccg

SEQ ID NO: 6053666 - DNA, 21 bp, Homo sapiens
cccagtgagcagcctggagcc

SEQ ID NO: 6053667 - DNA, 14 bp, Homo sapiens
cccagtgagccctg

SEQ ID NO: 6053668 - DNA, 14 bp, Homo sapiens
cccagtgagcctct

SEQ ID NO: 6053669 - DNA, 15 bp, Homo sapiens
cccagtgagcctctg

SEQ ID NO: 6053670 - DNA, 18 bp, Homo sapiens
cccagtgaggatgctgca

SEQ ID NO: 6053671 - DNA, 20 bp, Homo sapiens
cccagtgatctcgactcccc

SEQ ID NO: 6053672 - DNA, 22 bp, Homo sapiens
cccagtgatctcgactcccccc

SEQ ID NO: 6053673 - DNA, 12 bp, Homo sapiens
cccagtgcaaac

SEQ ID NO: 6053674 - DNA, 15 bp, Homo sapiens
cccagtgcacccact

SEQ ID NO: 6053675 - DNA, 12 bp, Homo sapiens
cccagtgcagaa

SEQ ID NO: 6053676 - DNA, 21 bp, Homo sapiens
cccagtgcagggctggtcttg

SEQ ID NO: 6053677 - DNA, 18 bp, Homo sapiens
cccagtgcatggtggcca

SEQ ID NO: 6053678 - DNA, 20 bp, Homo sapiens
cccagtgcatggtggccaga

SEQ ID NO: 6053679 - DNA, 14 bp, Homo sapiens
cccagtgccacaga

SEQ ID NO: 6053680 - DNA, 12 bp, Homo sapiens
cccagtgccact

SEQ ID NO: 6053681 - DNA, 14 bp, Homo sapiens
cccagtgccactgc

SEQ ID NO: 6053682 - DNA, 16 bp, Homo sapiens
cccagtgccagctcca

SEQ ID NO: 6053683 - DNA, 15 bp, Homo sapiens
cccagtgccagctgg

SEQ ID NO: 6053684 - DNA, 19 bp, Homo sapiens
cccagtgccattggcttca

SEQ ID NO: 6053685 - DNA, 15 bp, Homo sapiens
cccagtgccccctgg

SEQ ID NO: 6053686 - DNA, 18 bp, Homo sapiens
cccagtgccctctcccct

SEQ ID NO: 6053687 - DNA, 15 bp, Homo sapiens
cccagtgccctgggg

SEQ ID NO: 6053688 - DNA, 11 bp, Homo sapiens
cccagtgccta

SEQ ID NO: 6053689 - DNA, 16 bp, Homo sapiens
cccagtgcctcacctt

SEQ ID NO: 6053690 - DNA, 20 bp, Homo sapiens
cccagtgcctcctagcccct

SEQ ID NO: 6053691 - DNA, 14 bp, Homo sapiens
cccagtgcctgcca

SEQ ID NO: 6053692 - DNA, 15 bp, Homo sapiens
cccagtgccttctgg

SEQ ID NO: 6053693 - DNA, 18 bp, Homo sapiens
cccagtgctcacacaatc

SEQ ID NO: 6053694 - DNA, 17 bp, Homo sapiens
cccagtgctcaccagcc

SEQ ID NO: 6053695 - DNA, 18 bp, Homo sapiens
cccagtgctcaccagccc

SEQ ID NO: 6053696 - DNA, 22 bp, Homo sapiens
cccagtgctcctggcccttcta

SEQ ID NO: 6053697 - DNA, 13 bp, Homo sapiens
cccagtgctgcca

SEQ ID NO: 6053698 - DNA, 15 bp, Homo sapiens
cccagtgctgccatg

SEQ ID NO: 6053699 - DNA, 18 bp, Homo sapiens
cccagtgctgccatgcca

SEQ ID NO: 6053700 - DNA, 19 bp, Homo sapiens
cccagtgctgccatgccac

SEQ ID NO: 6053701 - DNA, 21 bp, Homo sapiens
cccagtgctgccatgccactg

SEQ ID NO: 6053702 - DNA, 14 bp, Homo sapiens
cccagtgcttctcc

SEQ ID NO: 6053703 - DNA, 22 bp, Homo sapiens
cccagtggaacagtcacccttc

SEQ ID NO: 6053704 - DNA, 22 bp, Homo sapiens
cccagtggaattccaacttgaa

SEQ ID NO: 6053705 - DNA, 16 bp, Homo sapiens
cccagtggagcctgcc

SEQ ID NO: 6053706 - DNA, 13 bp, Homo sapiens
cccagtggcaggg

SEQ ID NO: 6053707 - DNA, 14 bp, Homo sapiens
cccagtggcagggc

SEQ ID NO: 6053708 - DNA, 22 bp, Homo sapiens
cccagtggcagggcacagggcc

SEQ ID NO: 6053709 - DNA, 16 bp, Homo sapiens
cccagtggcctggctt

SEQ ID NO: 6053710 - DNA, 15 bp, Homo sapiens
cccagtggctgctgc

SEQ ID NO: 6053711 - DNA, 18 bp, Homo sapiens
cccagtggctgctgccca

SEQ ID NO: 6053712 - DNA, 18 bp, Homo sapiens
cccagtggctgttctgga

SEQ ID NO: 6053713 - DNA, 16 bp, Homo sapiens
cccagtgggacagagg

SEQ ID NO: 6053714 - DNA, 18 bp, Homo sapiens
cccagtgggacagaggag

SEQ ID NO: 6053715 - DNA, 20 bp, Homo sapiens
cccagtgggaccacatgcca

SEQ ID NO: 6053716 - DNA, 19 bp, Homo sapiens
cccagtgggacccacagtc

SEQ ID NO: 6053717 - DNA, 18 bp, Homo sapiens
cccagtgggagcttcccg

SEQ ID NO: 6053718 - DNA, 17 bp, Homo sapiens
cccagtgggatgggaca

SEQ ID NO: 6053719 - DNA, 22 bp, Homo sapiens
cccagtggggacagggaggggg

SEQ ID NO: 6053720 - DNA, 16 bp, Homo sapiens
cccagtgggtgatgct

SEQ ID NO: 6053721 - DNA, 19 bp, Homo sapiens
cccagtgggtgatgctttt

SEQ ID NO: 6053722 - DNA, 16 bp, Homo sapiens
cccagtggtcagcagg

SEQ ID NO: 6053723 - DNA, 13 bp, Homo sapiens
cccagtggtgagg

SEQ ID NO: 6053724 - DNA, 20 bp, Homo sapiens
cccagtggttcctaatcctc

SEQ ID NO: 6053725 - DNA, 22 bp, Homo sapiens
cccagtgtaaagaataaatgaa

SEQ ID NO: 6053726 - DNA, 19 bp, Homo sapiens
cccagtgtatgtcttgtat

SEQ ID NO: 6053727 - DNA, 21 bp, Homo sapiens
cccagtgtcaagttgtgcttg

SEQ ID NO: 6053728 - DNA, 22 bp, Homo sapiens
cccagtgtcaagttgtgcttgt

SEQ ID NO: 6053729 - DNA, 23 bp, Homo sapiens
cccagtgtccttccatcttcaca

SEQ ID NO: 6053730 - DNA, 14 bp, Homo sapiens
cccagtgtctggcc

SEQ ID NO: 6053731 - DNA, 17 bp, Homo sapiens
cccagtgtctggcccag

SEQ ID NO: 6053732 - DNA, 15 bp, Homo sapiens
cccagtgtcttcctg

SEQ ID NO: 6053733 - DNA, 17 bp, Homo sapiens
cccagtgtgagacccca

SEQ ID NO: 6053734 - DNA, 18 bp, Homo sapiens
cccagtgttatttattcc

SEQ ID NO: 6053735 - DNA, 14 bp, Homo sapiens
cccagttaatcttg

SEQ ID NO: 6053736 - DNA, 12 bp, Homo sapiens
cccagttacttt

SEQ ID NO: 6053737 - DNA, 14 bp, Homo sapiens
cccagttagctctc

SEQ ID NO: 6053738 - DNA, 14 bp, Homo sapiens
cccagttcaccctg

SEQ ID NO: 6053739 - DNA, 14 bp, Homo sapiens
cccagttcatccca

SEQ ID NO: 6053740 - DNA, 17 bp, Homo sapiens
cccagttcatctctgct

SEQ ID NO: 6053741 - DNA, 19 bp, Homo sapiens
cccagttcatctctgctga

SEQ ID NO: 6053742 - DNA, 23 bp, Homo sapiens
cccagttcatctctgctgaacat

SEQ ID NO: 6053743 - DNA, 22 bp, Homo sapiens
cccagttcccgggccctcctgg

SEQ ID NO: 6053744 - DNA, 22 bp, Homo sapiens
cccagttcccgtgacgaggctc

SEQ ID NO: 6053745 - DNA, 12 bp, Homo sapiens
cccagttccctg

SEQ ID NO: 6053746 - DNA, 16 bp, Homo sapiens
cccagttcctagcact

SEQ ID NO: 6053747 - DNA, 20 bp, Homo sapiens
cccagttcgcctggagccct

SEQ ID NO: 6053748 - DNA, 16 bp, Homo sapiens
cccagttctctaggga

SEQ ID NO: 6053749 - DNA, 13 bp, Homo sapiens
cccagttctgctc

SEQ ID NO: 6053750 - DNA, 21 bp, Homo sapiens
cccagttctgctcctctccag

SEQ ID NO: 6053751 - DNA, 15 bp, Homo sapiens
cccagttcttcattt

SEQ ID NO: 6053752 - DNA, 22 bp, Homo sapiens
cccagttcttcatttggaggaa

SEQ ID NO: 6053753 - DNA, 15 bp, Homo sapiens
cccagttgccatctg

SEQ ID NO: 6053754 - DNA, 16 bp, Homo sapiens
cccagttgctgtcaca

SEQ ID NO: 6053755 - DNA, 15 bp, Homo sapiens
cccagttggagctcc

SEQ ID NO: 6053756 - DNA, 19 bp, Homo sapiens
cccagttggaggagactgg

SEQ ID NO: 6053757 - DNA, 19 bp, Homo sapiens
cccagttggcccttctgcc

SEQ ID NO: 6053758 - DNA, 13 bp, Homo sapiens
cccagttggggct

SEQ ID NO: 6053759 - DNA, 18 bp, Homo sapiens
cccagttggtcaaacttg

SEQ ID NO: 6053760 - DNA, 13 bp, Homo sapiens
cccagttgtattt

SEQ ID NO: 6053761 - DNA, 19 bp, Homo sapiens
ccacaaaagacagacccag

SEQ ID NO: 6053762 - DNA, 22 bp, Homo sapiens
ccacaaaagacagacccagtga

SEQ ID NO: 6053763 - DNA, 21 bp, Homo sapiens
ccacaaaagcaaaatttttaa

SEQ ID NO: 6053764 - DNA, 23 bp, Homo sapiens
ccacaaaataaccaatcctggac

SEQ ID NO: 6053765 - DNA, 16 bp, Homo sapiens
ccacaaacacattata

SEQ ID NO: 6053766 - DNA, 14 bp, Homo sapiens
ccacaaacctgccc

SEQ ID NO: 6053767 - DNA, 15 bp, Homo sapiens
ccacaaacggagccc

SEQ ID NO: 6053768 - DNA, 16 bp, Homo sapiens
ccacaaacggagcccc

SEQ ID NO: 6053769 - DNA, 23 bp, Homo sapiens
ccacaaactgcctgttaagtctg

SEQ ID NO: 6053770 - DNA, 14 bp, Homo sapiens
ccacaaactgtaat

SEQ ID NO: 6053771 - DNA, 14 bp, Homo sapiens
ccacaaagagacca

SEQ ID NO: 6053772 - DNA, 16 bp, Homo sapiens
ccacaaagagaccagg

SEQ ID NO: 6053773 - DNA, 18 bp, Homo sapiens
ccacaaagagaccagggg

SEQ ID NO: 6053774 - DNA, 21 bp, Homo sapiens
ccacaaagccccccagctccc

SEQ ID NO: 6053775 - DNA, 16 bp, Homo sapiens
ccacaaaggcaaaggg

SEQ ID NO: 6053776 - DNA, 20 bp, Homo sapiens
ccacaaaggcaaagggtcca

SEQ ID NO: 6053777 - DNA, 21 bp, Homo sapiens
ccacaaagggacacacagtga

SEQ ID NO: 6053778 - DNA, 16 bp, Homo sapiens
ccacaaaggggagaag

SEQ ID NO: 6053779 - DNA, 16 bp, Homo sapiens
ccacaaataatgaaca

SEQ ID NO: 6053780 - DNA, 20 bp, Homo sapiens
ccacaaatcaaagcaagggc

SEQ ID NO: 6053781 - DNA, 20 bp, Homo sapiens
ccacaaatctatattaaagt

SEQ ID NO: 6053782 - DNA, 23 bp, Homo sapiens
ccacaaatctatattaaagtgtt

SEQ ID NO: 6053783 - DNA, 16 bp, Homo sapiens
ccacaaatgcaggtgt

SEQ ID NO: 6053784 - DNA, 18 bp, Homo sapiens
ccacaaatgtcctcagag

SEQ ID NO: 6053785 - DNA, 21 bp, Homo sapiens
ccacaacaaagtgcttccttt

SEQ ID NO: 6053786 - DNA, 13 bp, Homo sapiens
ccacaacacacag

SEQ ID NO: 6053787 - DNA, 18 bp, Homo sapiens
ccacaacagaataaagca

SEQ ID NO: 6053788 - DNA, 16 bp, Homo sapiens
ccacaacagcctgggg

SEQ ID NO: 6053789 - DNA, 17 bp, Homo sapiens
ccacaacatgaggccac

SEQ ID NO: 6053790 - DNA, 23 bp, Homo sapiens
ccacaaccaaaaaaaaataaaaa

SEQ ID NO: 6053791 - DNA, 14 bp, Homo sapiens
ccacaaccaggaag

SEQ ID NO: 6053792 - DNA, 16 bp, Homo sapiens
ccacaaccctctggaa

SEQ ID NO: 6053793 - DNA, 17 bp, Homo sapiens
ccacaaccctctggaag

SEQ ID NO: 6053794 - DNA, 14 bp, Homo sapiens
ccacaaccctgttg

SEQ ID NO: 6053795 - DNA, 21 bp, Homo sapiens
ccacaaccctgttgctacatc

SEQ ID NO: 6053796 - DNA, 16 bp, Homo sapiens
ccacaacgtcccctca

SEQ ID NO: 6053797 - DNA, 17 bp, Homo sapiens
ccacaactattttcaga

SEQ ID NO: 6053798 - DNA, 19 bp, Homo sapiens
ccacaactcctacatgatg

SEQ ID NO: 6053799 - DNA, 14 bp, Homo sapiens
ccacaactgacaca

SEQ ID NO: 6053800 - DNA, 15 bp, Homo sapiens
ccacaactgacacag

SEQ ID NO: 6053801 - DNA, 22 bp, Homo sapiens
ccacaactgctgtggccccctg

SEQ ID NO: 6053802 - DNA, 15 bp, Homo sapiens
ccacaactgtcttag

SEQ ID NO: 6053803 - DNA, 20 bp, Homo sapiens
ccacaacttgtcacccaaag

SEQ ID NO: 6053804 - DNA, 16 bp, Homo sapiens
ccacaagacccttgtg

SEQ ID NO: 6053805 - DNA, 20 bp, Homo sapiens
ccacaagactggtattctct

SEQ ID NO: 6053806 - DNA, 18 bp, Homo sapiens
ccacaagagcccaggcct

SEQ ID NO: 6053807 - DNA, 18 bp, Homo sapiens
ccacaagattcccagaga

SEQ ID NO: 6053808 - DNA, 19 bp, Homo sapiens
ccacaagattcccagagac

SEQ ID NO: 6053809 - DNA, 23 bp, Homo sapiens
ccacaagcaccactctgggcaca

SEQ ID NO: 6053810 - DNA, 20 bp, Homo sapiens
ccacaagcaggctcaacata

SEQ ID NO: 6053811 - DNA, 12 bp, Homo sapiens
ccacaagcctct

SEQ ID NO: 6053812 - DNA, 15 bp, Homo sapiens
ccacaagcctgcctc

SEQ ID NO: 6053813 - DNA, 20 bp, Homo sapiens
ccacaagccttactcacctc

SEQ ID NO: 6053814 - DNA, 22 bp, Homo sapiens
ccacaagccttactcacctctc

SEQ ID NO: 6053815 - DNA, 13 bp, Homo sapiens
ccacaagctgagc

SEQ ID NO: 6053816 - DNA, 11 bp, Homo sapiens
ccacaagctgc

SEQ ID NO: 6053817 - DNA, 18 bp, Homo sapiens
ccacaagctgcactgtga

SEQ ID NO: 6053818 - DNA, 19 bp, Homo sapiens
ccacaagctgcactgtgaa

SEQ ID NO: 6053819 - DNA, 16 bp, Homo sapiens
ccacaagctgtccctg

SEQ ID NO: 6053820 - DNA, 19 bp, Homo sapiens
ccacaagctgtccctgcag

SEQ ID NO: 6053821 - DNA, 16 bp, Homo sapiens
ccacaagcttctgtcc

SEQ ID NO: 6053822 - DNA, 20 bp, Homo sapiens
ccacaaggaaaaggaggagg

SEQ ID NO: 6053823 - DNA, 20 bp, Homo sapiens
ccacaaggcccagccctggg

SEQ ID NO: 6053824 - DNA, 22 bp, Homo sapiens
ccacaaggcccagccctgggca

SEQ ID NO: 6053825 - DNA, 12 bp, Homo sapiens
ccacaaggcctg

SEQ ID NO: 6053826 - DNA, 13 bp, Homo sapiens
ccacaaggcctgg

SEQ ID NO: 6053827 - DNA, 20 bp, Homo sapiens
ccacaaggcctggtctggga

SEQ ID NO: 6053828 - DNA, 23 bp, Homo sapiens
ccacaaggctgaaaagtgctttg

SEQ ID NO: 6053829 - DNA, 12 bp, Homo sapiens
ccacaaggctgg

SEQ ID NO: 6053830 - DNA, 22 bp, Homo sapiens
ccacaaggtccactccctgctc

SEQ ID NO: 6053831 - DNA, 19 bp, Homo sapiens
ccacaagtatctaaatttg

SEQ ID NO: 6053832 - DNA, 22 bp, Homo sapiens
ccacaagtcttccagaggatgc

SEQ ID NO: 6053833 - DNA, 20 bp, Homo sapiens
ccacaagtgccgcaaattgt

SEQ ID NO: 6053834 - DNA, 21 bp, Homo sapiens
ccacaagtgccgcaaattgta

SEQ ID NO: 6053835 - DNA, 15 bp, Homo sapiens
ccacaagtggtggta

SEQ ID NO: 6053836 - DNA, 22 bp, Homo sapiens
ccacaagtggtggtaaccctgg

SEQ ID NO: 6053837 - DNA, 15 bp, Homo sapiens
ccacaagttaaataa

SEQ ID NO: 6053838 - DNA, 20 bp, Homo sapiens
ccacaagttaaataaatcat

SEQ ID NO: 6053839 - DNA, 23 bp, Homo sapiens
ccacaatcactaaatatctagtg

SEQ ID NO: 6053840 - DNA, 23 bp, Homo sapiens
ccacaatcctattctcgggctga

SEQ ID NO: 6053841 - DNA, 20 bp, Homo sapiens
ccacaatgacagaaatgaca

SEQ ID NO: 6053842 - DNA, 21 bp, Homo sapiens
ccacaatgatgattaaacacc

SEQ ID NO: 6053843 - DNA, 14 bp, Homo sapiens
ccacaatgcctctc

SEQ ID NO: 6053844 - DNA, 23 bp, Homo sapiens
ccacaatggctgggagggggccc

SEQ ID NO: 6053845 - DNA, 19 bp, Homo sapiens
ccacaattattggcaaagt

SEQ ID NO: 6053846 - DNA, 13 bp, Homo sapiens
ccacaattccatt

SEQ ID NO: 6053847 - DNA, 23 bp, Homo sapiens
ccacaattcttctgtcaagctta

SEQ ID NO: 6053848 - DNA, 20 bp, Homo sapiens
ccacaatttctttaaaaaag

SEQ ID NO: 6053849 - DNA, 13 bp, Homo sapiens
ccacacaaaatgt

SEQ ID NO: 6053850 - DNA, 20 bp, Homo sapiens
ccacacaaagattttctaag

SEQ ID NO: 6053851 - DNA, 20 bp, Homo sapiens
ccacacaaggatagatgctg

SEQ ID NO: 6053852 - DNA, 13 bp, Homo sapiens
ccacacacaacag

SEQ ID NO: 6053853 - DNA, 14 bp, Homo sapiens
ccacacacaacagc

SEQ ID NO: 6053854 - DNA, 12 bp, Homo sapiens
ccacacacacaa

SEQ ID NO: 6053855 - DNA, 21 bp, Homo sapiens
ccacacacacacacatgcata

SEQ ID NO: 6053856 - DNA, 18 bp, Homo sapiens
ccacacacacagaaaata

SEQ ID NO: 6053857 - DNA, 22 bp, Homo sapiens
ccacacacacagaaaatatact

SEQ ID NO: 6053858 - DNA, 23 bp, Homo sapiens
ccacacacacagaaaatatactg

SEQ ID NO: 6053859 - DNA, 15 bp, Homo sapiens
ccacacacacccttc

SEQ ID NO: 6053860 - DNA, 17 bp, Homo sapiens
ccacacacacccttccc

SEQ ID NO: 6053861 - DNA, 16 bp, Homo sapiens
ccacacacactccttc

SEQ ID NO: 6053862 - DNA, 17 bp, Homo sapiens
ccacacacactccttcc

SEQ ID NO: 6053863 - DNA, 18 bp, Homo sapiens
ccacacacactccttccc

SEQ ID NO: 6053864 - DNA, 16 bp, Homo sapiens
ccacacacagaggaag

SEQ ID NO: 6053865 - DNA, 17 bp, Homo sapiens
ccacacacagaggaaga

SEQ ID NO: 6053866 - DNA, 12 bp, Homo sapiens
ccacacacagca

SEQ ID NO: 6053867 - DNA, 18 bp, Homo sapiens
ccacacacagcagctcca

SEQ ID NO: 6053868 - DNA, 11 bp, Homo sapiens
ccacacacagg

SEQ ID NO: 6053869 - DNA, 14 bp, Homo sapiens
ccacacacaggcct

SEQ ID NO: 6053870 - DNA, 18 bp, Homo sapiens
ccacacacaggccttctg

SEQ ID NO: 6053871 - DNA, 19 bp, Homo sapiens
ccacacacaggccttctgt

SEQ ID NO: 6053872 - DNA, 20 bp, Homo sapiens
ccacacacaggccttctgtg

SEQ ID NO: 6053873 - DNA, 16 bp, Homo sapiens
ccacacaccacagaag

SEQ ID NO: 6053874 - DNA, 24 bp, Homo sapiens
ccacacactgttttttggcttgct

SEQ ID NO: 6053875 - DNA, 15 bp, Homo sapiens
ccacacactttccat

SEQ ID NO: 6053876 - DNA, 18 bp, Homo sapiens
ccacacactttccatctc

SEQ ID NO: 6053877 - DNA, 20 bp, Homo sapiens
ccacacactttccatctctg

SEQ ID NO: 6053878 - DNA, 14 bp, Homo sapiens
ccacacagagcctg

SEQ ID NO: 6053879 - DNA, 20 bp, Homo sapiens
ccacacagagcctgcctcag

SEQ ID NO: 6053880 - DNA, 13 bp, Homo sapiens
ccacacagagtgg

SEQ ID NO: 6053881 - DNA, 15 bp, Homo sapiens
ccacacagcccagaa

SEQ ID NO: 6053882 - DNA, 15 bp, Homo sapiens
ccacacagcctgtct

SEQ ID NO: 6053883 - DNA, 12 bp, Homo sapiens
ccacacagctgc

SEQ ID NO: 6053884 - DNA, 13 bp, Homo sapiens
ccacacagctgcc

SEQ ID NO: 6053885 - DNA, 16 bp, Homo sapiens
ccacacagctgccggt

SEQ ID NO: 6053886 - DNA, 19 bp, Homo sapiens
ccacacaggcagggcctgg

SEQ ID NO: 6053887 - DNA, 23 bp, Homo sapiens
ccacacaggcagggcctggctcc

SEQ ID NO: 6053888 - DNA, 13 bp, Homo sapiens
ccacacaggcctg

SEQ ID NO: 6053889 - DNA, 15 bp, Homo sapiens
ccacacaggcctggc

SEQ ID NO: 6053890 - DNA, 16 bp, Homo sapiens
ccacacagggcactga

SEQ ID NO: 6053891 - DNA, 18 bp, Homo sapiens
ccacacagggcactgact

SEQ ID NO: 6053892 - DNA, 17 bp, Homo sapiens
ccacacaggtggccatc

SEQ ID NO: 6053893 - DNA, 20 bp, Homo sapiens
ccacacaggtgttccgtggg

SEQ ID NO: 6053894 - DNA, 22 bp, Homo sapiens
ccacacagtcacccctccctcc

SEQ ID NO: 6053895 - DNA, 13 bp, Homo sapiens
ccacacagtcccc

SEQ ID NO: 6053896 - DNA, 17 bp, Homo sapiens
ccacacagtccccagac

SEQ ID NO: 6053897 - DNA, 20 bp, Homo sapiens
ccacacagtggccggggctg

SEQ ID NO: 6053898 - DNA, 23 bp, Homo sapiens
ccacacagtggccggggctgaag

SEQ ID NO: 6053899 - DNA, 12 bp, Homo sapiens
ccacacatccca

SEQ ID NO: 6053900 - DNA, 17 bp, Homo sapiens
ccacacatcccagccca

SEQ ID NO: 6053901 - DNA, 18 bp, Homo sapiens
ccacacatcccagcccaa

SEQ ID NO: 6053902 - DNA, 15 bp, Homo sapiens
ccacacatctgtgga

SEQ ID NO: 6053903 - DNA, 23 bp, Homo sapiens
ccacacattccagccaggcccag

SEQ ID NO: 6053904 - DNA, 20 bp, Homo sapiens
ccacacattccagggctggg

SEQ ID NO: 6053905 - DNA, 15 bp, Homo sapiens
ccacaccaaccaggc

SEQ ID NO: 6053906 - DNA, 14 bp, Homo sapiens
ccacaccaagcagc

SEQ ID NO: 6053907 - DNA, 12 bp, Homo sapiens
ccacaccaagct

SEQ ID NO: 6053908 - DNA, 13 bp, Homo sapiens
ccacaccaagctg

SEQ ID NO: 6053909 - DNA, 18 bp, Homo sapiens
ccacaccaagctgtgcca

SEQ ID NO: 6053910 - DNA, 23 bp, Homo sapiens
ccacaccaagctgtgccaccctg

SEQ ID NO: 6053911 - DNA, 14 bp, Homo sapiens
ccacaccaaggagg

SEQ ID NO: 6053912 - DNA, 22 bp, Homo sapiens
ccacaccacaggatctgaactt

SEQ ID NO: 6053913 - DNA, 23 bp, Homo sapiens
ccacaccacccctaaagtgccag

SEQ ID NO: 6053914 - DNA, 14 bp, Homo sapiens
ccacaccactgcca

SEQ ID NO: 6053915 - DNA, 14 bp, Homo sapiens
ccacaccagcccca

SEQ ID NO: 6053916 - DNA, 13 bp, Homo sapiens
ccacaccagcctc

SEQ ID NO: 6053917 - DNA, 20 bp, Homo sapiens
ccacaccagggccagcctct

SEQ ID NO: 6053918 - DNA, 20 bp, Homo sapiens
ccacaccataagctactgcc

SEQ ID NO: 6053919 - DNA, 22 bp, Homo sapiens
ccacaccataagctactgccat

SEQ ID NO: 6053920 - DNA, 15 bp, Homo sapiens
ccacacccacctctg

SEQ ID NO: 6053921 - DNA, 17 bp, Homo sapiens
ccacacccagccagctc

SEQ ID NO: 6053922 - DNA, 15 bp, Homo sapiens
ccacacccagcccac

SEQ ID NO: 6053923 - DNA, 20 bp, Homo sapiens
ccacacccagcccacttctg

SEQ ID NO: 6053924 - DNA, 22 bp, Homo sapiens
ccacacccagcccacttctgcc

SEQ ID NO: 6053925 - DNA, 16 bp, Homo sapiens
ccacacccagcctcag

SEQ ID NO: 6053926 - DNA, 16 bp, Homo sapiens
ccacacccagcctctg

SEQ ID NO: 6053927 - DNA, 15 bp, Homo sapiens
ccacacccaggaagg

SEQ ID NO: 6053928 - DNA, 14 bp, Homo sapiens
ccacacccagggga

SEQ ID NO: 6053929 - DNA, 19 bp, Homo sapiens
ccacacccatgactgcccc

SEQ ID NO: 6053930 - DNA, 21 bp, Homo sapiens
ccacaccccagactccaggcc

SEQ ID NO: 6053931 - DNA, 22 bp, Homo sapiens
ccacaccccagcgcctgtgctg

SEQ ID NO: 6053932 - DNA, 16 bp, Homo sapiens
ccacacccctccaaag

SEQ ID NO: 6053933 - DNA, 17 bp, Homo sapiens
ccacacccctctgctgc

SEQ ID NO: 6053934 - DNA, 18 bp, Homo sapiens
ccacacccggctccccct

SEQ ID NO: 6053935 - DNA, 20 bp, Homo sapiens
ccacacccggctccccctgc

SEQ ID NO: 6053936 - DNA, 13 bp, Homo sapiens
ccacaccctacag

SEQ ID NO: 6053937 - DNA, 18 bp, Homo sapiens
ccacaccctacagcagat

SEQ ID NO: 6053938 - DNA, 13 bp, Homo sapiens
ccacaccctcggg

SEQ ID NO: 6053939 - DNA, 15 bp, Homo sapiens
cccagtttcccactc

SEQ ID NO: 6053940 - DNA, 15 bp, Homo sapiens
cccagtttcccttct

SEQ ID NO: 6053941 - DNA, 16 bp, Homo sapiens
cccagtttcccttcta

SEQ ID NO: 6053942 - DNA, 21 bp, Homo sapiens
cccagtttctaaactggagac

SEQ ID NO: 6053943 - DNA, 20 bp, Homo sapiens
cccagtttctgcctctgagg

SEQ ID NO: 6053944 - DNA, 22 bp, Homo sapiens
cccagtttggctggttaattcc

SEQ ID NO: 6053945 - DNA, 21 bp, Homo sapiens
cccagttttttgaacatggaa

SEQ ID NO: 6053946 - DNA, 17 bp, Homo sapiens
cccataaaatgatcctg

SEQ ID NO: 6053947 - DNA, 21 bp, Homo sapiens
cccataaacagcacacctgtg

SEQ ID NO: 6053948 - DNA, 18 bp, Homo sapiens
cccataaagtctgagaaa

SEQ ID NO: 6053949 - DNA, 21 bp, Homo sapiens
cccataagcacagatttttct

SEQ ID NO: 6053950 - DNA, 15 bp, Homo sapiens
cccataagccctgag

SEQ ID NO: 6053951 - DNA, 22 bp, Homo sapiens
cccataagccctgagactcccg

SEQ ID NO: 6053952 - DNA, 15 bp, Homo sapiens
cccataataaagcaa

SEQ ID NO: 6053953 - DNA, 22 bp, Homo sapiens
cccataataaaggttgtgaatg

SEQ ID NO: 6053954 - DNA, 19 bp, Homo sapiens
cccataataaccctgccag

SEQ ID NO: 6053955 - DNA, 21 bp, Homo sapiens
cccataataaccctgccagtg

SEQ ID NO: 6053956 - DNA, 20 bp, Homo sapiens
cccataatagttagccctca

SEQ ID NO: 6053957 - DNA, 19 bp, Homo sapiens
cccataatcatgtaaatgc

SEQ ID NO: 6053958 - DNA, 23 bp, Homo sapiens
cccatacaatgtatgtacaatac

SEQ ID NO: 6053959 - DNA, 19 bp, Homo sapiens
cccatacacacacaaacca

SEQ ID NO: 6053960 - DNA, 20 bp, Homo sapiens
cccataccccttattgctgc

SEQ ID NO: 6053961 - DNA, 21 bp, Homo sapiens
cccataccccttattgctgcc

SEQ ID NO: 6053962 - DNA, 14 bp, Homo sapiens
cccatactgagcct

SEQ ID NO: 6053963 - DNA, 14 bp, Homo sapiens
cccatacttcctgg

SEQ ID NO: 6053964 - DNA, 23 bp, Homo sapiens
cccatagataggcccctggggct

SEQ ID NO: 6053965 - DNA, 21 bp, Homo sapiens
cccatagcaaagggtctgtgg

SEQ ID NO: 6053966 - DNA, 24 bp, Homo sapiens
cccatagcaccctgccctcatggg

SEQ ID NO: 6053967 - DNA, 20 bp, Homo sapiens
cccatagcagccagttcaaa

SEQ ID NO: 6053968 - DNA, 13 bp, Homo sapiens
cccatagcgctgg

SEQ ID NO: 6053969 - DNA, 17 bp, Homo sapiens
cccatagcgctggctca

SEQ ID NO: 6053970 - DNA, 21 bp, Homo sapiens
cccatagcgctggctcaggaa

SEQ ID NO: 6053971 - DNA, 19 bp, Homo sapiens
cccatagctattttccttg

SEQ ID NO: 6053972 - DNA, 21 bp, Homo sapiens
cccatagctattttccttgct

SEQ ID NO: 6053973 - DNA, 14 bp, Homo sapiens
cccatagctgggac

SEQ ID NO: 6053974 - DNA, 18 bp, Homo sapiens
cccataggccacccccta

SEQ ID NO: 6053975 - DNA, 15 bp, Homo sapiens
cccataggcccacac

SEQ ID NO: 6053976 - DNA, 21 bp, Homo sapiens
cccatagggtcggaggtgctg

SEQ ID NO: 6053977 - DNA, 15 bp, Homo sapiens
cccatagtccctgcc

SEQ ID NO: 6053978 - DNA, 15 bp, Homo sapiens
cccatagtggggcct

SEQ ID NO: 6053979 - DNA, 19 bp, Homo sapiens
cccatagtggggcctggga

SEQ ID NO: 6053980 - DNA, 14 bp, Homo sapiens
cccatatctccttt

SEQ ID NO: 6053981 - DNA, 14 bp, Homo sapiens
cccatatctgtgtg

SEQ ID NO: 6053982 - DNA, 18 bp, Homo sapiens
cccatattaacaaattgc

SEQ ID NO: 6053983 - DNA, 21 bp, Homo sapiens
cccatattaacaaattgcatt

SEQ ID NO: 6053984 - DNA, 15 bp, Homo sapiens
cccatattgtaaaac

SEQ ID NO: 6053985 - DNA, 18 bp, Homo sapiens
cccatattgtaaaacagg

SEQ ID NO: 6053986 - DNA, 19 bp, Homo sapiens
cccatattgtaaaacaggt

SEQ ID NO: 6053987 - DNA, 21 bp, Homo sapiens
cccatcacagggttgggccca

SEQ ID NO: 6053988 - DNA, 18 bp, Homo sapiens
cccatcaccatgggaggt

SEQ ID NO: 6053989 - DNA, 15 bp, Homo sapiens
cccatcacccaagcc

SEQ ID NO: 6053990 - DNA, 20 bp, Homo sapiens
cccatcacctactcacacag

SEQ ID NO: 6053991 - DNA, 21 bp, Homo sapiens
cccatcacctactcacacagg

SEQ ID NO: 6053992 - DNA, 22 bp, Homo sapiens
cccatcacctactcacacaggc

SEQ ID NO: 6053993 - DNA, 13 bp, Homo sapiens
cccatcacctcta

SEQ ID NO: 6053994 - DNA, 16 bp, Homo sapiens
cccatcacgcctgtgc

SEQ ID NO: 6053995 - DNA, 20 bp, Homo sapiens
cccatcactggagcaccagg

SEQ ID NO: 6053996 - DNA, 12 bp, Homo sapiens
cccatcactgtg

SEQ ID NO: 6053997 - DNA, 19 bp, Homo sapiens
cccatcactgtgtctcatg

SEQ ID NO: 6053998 - DNA, 16 bp, Homo sapiens
cccatcagaggctggg

SEQ ID NO: 6053999 - DNA, 12 bp, Homo sapiens
cccatcagcacc

SEQ ID NO: 6054000 - DNA, 14 bp, Homo sapiens
cccatcagcactct

SEQ ID NO: 6054001 - DNA, 18 bp, Homo sapiens
cccatcagcactctgtaa

SEQ ID NO: 6054002 - DNA, 16 bp, Homo sapiens
cccatcagcatcccac

SEQ ID NO: 6054003 - DNA, 14 bp, Homo sapiens
cccatcagccctgc

SEQ ID NO: 6054004 - DNA, 16 bp, Homo sapiens
cccatcagctacccct

SEQ ID NO: 6054005 - DNA, 12 bp, Homo sapiens
cccatcagctcc

SEQ ID NO: 6054006 - DNA, 14 bp, Homo sapiens
cccatcagctccca

SEQ ID NO: 6054007 - DNA, 15 bp, Homo sapiens
cccatcagctcccaa

SEQ ID NO: 6054008 - DNA, 11 bp, Homo sapiens
cccatcaggac

SEQ ID NO: 6054009 - DNA, 17 bp, Homo sapiens
cccatcaggactcttgt

SEQ ID NO: 6054010 - DNA, 20 bp, Homo sapiens
cccatcagtgccagcccctg

SEQ ID NO: 6054011 - DNA, 22 bp, Homo sapiens
cccatcagtgctccctcacatg

SEQ ID NO: 6054012 - DNA, 16 bp, Homo sapiens
cccatcagtgctctgt

SEQ ID NO: 6054013 - DNA, 18 bp, Homo sapiens
cccatcagtgctctgtaa

SEQ ID NO: 6054014 - DNA, 13 bp, Homo sapiens
cccatcagtgtac

SEQ ID NO: 6054015 - DNA, 23 bp, Homo sapiens
cccatcagtgtacccccgcccag

SEQ ID NO: 6054016 - DNA, 20 bp, Homo sapiens
cccatcatatgacatgccac

SEQ ID NO: 6054017 - DNA, 16 bp, Homo sapiens
cccatcatcctctggc

SEQ ID NO: 6054018 - DNA, 12 bp, Homo sapiens
cccatcatctct

SEQ ID NO: 6054019 - DNA, 14 bp, Homo sapiens
cccatccaaccact

SEQ ID NO: 6054020 - DNA, 22 bp, Homo sapiens
cccatccaccgtcccctcccag

SEQ ID NO: 6054021 - DNA, 16 bp, Homo sapiens
cccatccacctatcca

SEQ ID NO: 6054022 - DNA, 13 bp, Homo sapiens
cccatccagcatg

SEQ ID NO: 6054023 - DNA, 17 bp, Homo sapiens
cccatccagccacggag

SEQ ID NO: 6054024 - DNA, 14 bp, Homo sapiens
cccatccagccagg

SEQ ID NO: 6054025 - DNA, 14 bp, Homo sapiens
cccatccagcctcc

SEQ ID NO: 6054026 - DNA, 15 bp, Homo sapiens
cccatccagctacca

SEQ ID NO: 6054027 - DNA, 13 bp, Homo sapiens
cccatccaggcag

SEQ ID NO: 6054028 - DNA, 18 bp, Homo sapiens
cccatccagtggactctg

SEQ ID NO: 6054029 - DNA, 14 bp, Homo sapiens
cccatccagttcat

SEQ ID NO: 6054030 - DNA, 17 bp, Homo sapiens
cccatccatcagctccc

SEQ ID NO: 6054031 - DNA, 18 bp, Homo sapiens
cccatccatcagctccct

SEQ ID NO: 6054032 - DNA, 13 bp, Homo sapiens
cccatcccacacc

SEQ ID NO: 6054033 - DNA, 12 bp, Homo sapiens
cccatcccaccc

SEQ ID NO: 6054034 - DNA, 14 bp, Homo sapiens
cccatcccacccct

SEQ ID NO: 6054035 - DNA, 12 bp, Homo sapiens
cccatcccaggg

SEQ ID NO: 6054036 - DNA, 20 bp, Homo sapiens
cccatcccagtgtcctagga

SEQ ID NO: 6054037 - DNA, 20 bp, Homo sapiens
cccatcccattttcatcctg

SEQ ID NO: 6054038 - DNA, 12 bp, Homo sapiens
cccatccccacc

SEQ ID NO: 6054039 - DNA, 14 bp, Homo sapiens
cccatccccaccag

SEQ ID NO: 6054040 - DNA, 13 bp, Homo sapiens
cccatccccagcg

SEQ ID NO: 6054041 - DNA, 14 bp, Homo sapiens
cccatccccagcga

SEQ ID NO: 6054042 - DNA, 17 bp, Homo sapiens
cccatccccatgccctc

SEQ ID NO: 6054043 - DNA, 12 bp, Homo sapiens
cccatcccccct

SEQ ID NO: 6054044 - DNA, 14 bp, Homo sapiens
cccatcccccctca

SEQ ID NO: 6054045 - DNA, 15 bp, Homo sapiens
cccatcccccctcac

SEQ ID NO: 6054046 - DNA, 14 bp, Homo sapiens
cccatccccctgcc

SEQ ID NO: 6054047 - DNA, 14 bp, Homo sapiens
cccatcccctcaac

SEQ ID NO: 6054048 - DNA, 20 bp, Homo sapiens
cccatcccctcaacaccctg

SEQ ID NO: 6054049 - DNA, 17 bp, Homo sapiens
cccatccccttcctaaa

SEQ ID NO: 6054050 - DNA, 16 bp, Homo sapiens
cccatcccctttcctc

SEQ ID NO: 6054051 - DNA, 23 bp, Homo sapiens
cccatcccctttcctccccacct

SEQ ID NO: 6054052 - DNA, 21 bp, Homo sapiens
cccatcccgatgaacctgcat

SEQ ID NO: 6054053 - DNA, 16 bp, Homo sapiens
cccatcccgccttctc

SEQ ID NO: 6054054 - DNA, 22 bp, Homo sapiens
cccatcccgtaagaccaccttc

SEQ ID NO: 6054055 - DNA, 17 bp, Homo sapiens
cccatcccgtttccctc

SEQ ID NO: 6054056 - DNA, 19 bp, Homo sapiens
cccatcccgtttccctcca

SEQ ID NO: 6054057 - DNA, 12 bp, Homo sapiens
cccatccctacc

SEQ ID NO: 6054058 - DNA, 16 bp, Homo sapiens
cccatccctccccagt

SEQ ID NO: 6054059 - DNA, 22 bp, Homo sapiens
cccatccctcgggaagcagcca

SEQ ID NO: 6054060 - DNA, 23 bp, Homo sapiens
cccatccctcgggaagcagccag

SEQ ID NO: 6054061 - DNA, 12 bp, Homo sapiens
cccatccctgcc

SEQ ID NO: 6054062 - DNA, 17 bp, Homo sapiens
cccatccctgcctggag

SEQ ID NO: 6054063 - DNA, 17 bp, Homo sapiens
cccatccctgcctggtc

SEQ ID NO: 6054064 - DNA, 13 bp, Homo sapiens
cccatccctgctt

SEQ ID NO: 6054065 - DNA, 13 bp, Homo sapiens
cccatccctggct

SEQ ID NO: 6054066 - DNA, 15 bp, Homo sapiens
cccatccctggctga

SEQ ID NO: 6054067 - DNA, 15 bp, Homo sapiens
cccatcccttcaacc

SEQ ID NO: 6054068 - DNA, 21 bp, Homo sapiens
cccatcctaggaaccagccaa

SEQ ID NO: 6054069 - DNA, 13 bp, Homo sapiens
cccatcctccaga

SEQ ID NO: 6054070 - DNA, 14 bp, Homo sapiens
cccatcctccagag

SEQ ID NO: 6054071 - DNA, 14 bp, Homo sapiens
cccatcctccagct

SEQ ID NO: 6054072 - DNA, 15 bp, Homo sapiens
cccatcctccagctt

SEQ ID NO: 6054073 - DNA, 16 bp, Homo sapiens
cccatcctccagcttc

SEQ ID NO: 6054074 - DNA, 12 bp, Homo sapiens
cccatcctcccc

SEQ ID NO: 6054075 - DNA, 13 bp, Homo sapiens
cccatcctcccct

SEQ ID NO: 6054076 - DNA, 14 bp, Homo sapiens
cccatcctcccctt

SEQ ID NO: 6054077 - DNA, 19 bp, Homo sapiens
cccatcctctaaagcagag

SEQ ID NO: 6054078 - DNA, 14 bp, Homo sapiens
cccatcctctgtac

SEQ ID NO: 6054079 - DNA, 15 bp, Homo sapiens
cccatcctctgtaca

SEQ ID NO: 6054080 - DNA, 19 bp, Homo sapiens
cccatcctctgtacagagc

SEQ ID NO: 6054081 - DNA, 21 bp, Homo sapiens
cccatcctctgtacagagccc

SEQ ID NO: 6054082 - DNA, 22 bp, Homo sapiens
cccatcctctgtacagagccca

SEQ ID NO: 6054083 - DNA, 19 bp, Homo sapiens
cccatcctcttcttttagc

SEQ ID NO: 6054084 - DNA, 16 bp, Homo sapiens
cccatcctggcccatc

SEQ ID NO: 6054085 - DNA, 20 bp, Homo sapiens
cccatcctgggccttacctc

SEQ ID NO: 6054086 - DNA, 21 bp, Homo sapiens
cccatcctggggcagcactcc

SEQ ID NO: 6054087 - DNA, 18 bp, Homo sapiens
cccatcctgtggtcactg

SEQ ID NO: 6054088 - DNA, 18 bp, Homo sapiens
cccatccttcccgcagca

SEQ ID NO: 6054089 - DNA, 21 bp, Homo sapiens
cccatcgccagctgatgactc

SEQ ID NO: 6054090 - DNA, 23 bp, Homo sapiens
cccatcgccagctgatgactcaa

SEQ ID NO: 6054091 - DNA, 23 bp, Homo sapiens
cccatcgccccaccgcagctact

SEQ ID NO: 6054092 - DNA, 13 bp, Homo sapiens
cccatcgcctggg

SEQ ID NO: 6054093 - DNA, 13 bp, Homo sapiens
cccatcgctctga

SEQ ID NO: 6054094 - DNA, 13 bp, Homo sapiens
cccatcggaagtt

SEQ ID NO: 6054095 - DNA, 12 bp, Homo sapiens
cccatcggccct

SEQ ID NO: 6054096 - DNA, 18 bp, Homo sapiens
cccatctaagctgcagct

SEQ ID NO: 6054097 - DNA, 17 bp, Homo sapiens
cccatctcacctctagg

SEQ ID NO: 6054098 - DNA, 20 bp, Homo sapiens
cccatctcagcctcctgagc

SEQ ID NO: 6054099 - DNA, 11 bp, Homo sapiens
cccatctcagg

SEQ ID NO: 6054100 - DNA, 19 bp, Homo sapiens
cccatctcaggtgccactc

SEQ ID NO: 6054101 - DNA, 18 bp, Homo sapiens
cccatctcatcctggcac

SEQ ID NO: 6054102 - DNA, 14 bp, Homo sapiens
cccatctcatgccc

SEQ ID NO: 6054103 - DNA, 22 bp, Homo sapiens
cccatctcatgcccctggctgg

SEQ ID NO: 6054104 - DNA, 15 bp, Homo sapiens
cccatctccagggaa

SEQ ID NO: 6054105 - DNA, 15 bp, Homo sapiens
cccatctccccaggc

SEQ ID NO: 6054106 - DNA, 13 bp, Homo sapiens
cccatctccccct

SEQ ID NO: 6054107 - DNA, 18 bp, Homo sapiens
cccatctccctgcctggc

SEQ ID NO: 6054108 - DNA, 20 bp, Homo sapiens
cccatctcctcccatggcct

SEQ ID NO: 6054109 - DNA, 19 bp, Homo sapiens
cccatctccttacctctgg

SEQ ID NO: 6054110 - DNA, 20 bp, Homo sapiens
cccatctccttacctctgga

SEQ ID NO: 6054111 - DNA, 23 bp, Homo sapiens
cccatctcgctccctcccaggac

SEQ ID NO: 6054112 - DNA, 13 bp, Homo sapiens
cccatctcggagc

SEQ ID NO: 6054113 - DNA, 18 bp, Homo sapiens
cccatctcggagcatccc

SEQ ID NO: 6054114 - DNA, 14 bp, Homo sapiens
cccatctctcttcc

SEQ ID NO: 6054115 - DNA, 13 bp, Homo sapiens
cccatctctgtct

SEQ ID NO: 6054116 - DNA, 16 bp, Homo sapiens
cccatctctgtctggg

SEQ ID NO: 6054117 - DNA, 18 bp, Homo sapiens
cccatctctgtctggggc

SEQ ID NO: 6054118 - DNA, 19 bp, Homo sapiens
cccatctctgtctggggct

SEQ ID NO: 6054119 - DNA, 13 bp, Homo sapiens
ccacaccctgcct

SEQ ID NO: 6054120 - DNA, 18 bp, Homo sapiens
ccacaccctgcctgctgt

SEQ ID NO: 6054121 - DNA, 23 bp, Homo sapiens
ccacaccctgcctgctgtggagc

SEQ ID NO: 6054122 - DNA, 14 bp, Homo sapiens
ccacaccctggagt

SEQ ID NO: 6054123 - DNA, 17 bp, Homo sapiens
ccacaccgcgtcccagc

SEQ ID NO: 6054124 - DNA, 15 bp, Homo sapiens
ccacaccgctggctc

SEQ ID NO: 6054125 - DNA, 20 bp, Homo sapiens
ccacaccggtaccctcctcc

SEQ ID NO: 6054126 - DNA, 17 bp, Homo sapiens
ccacaccgtcttccttc

SEQ ID NO: 6054127 - DNA, 21 bp, Homo sapiens
ccacaccgtggcagcttgctg

SEQ ID NO: 6054128 - DNA, 16 bp, Homo sapiens
ccacaccgtgtaaacc

SEQ ID NO: 6054129 - DNA, 18 bp, Homo sapiens
ccacaccgtgtaaaccaa

SEQ ID NO: 6054130 - DNA, 13 bp, Homo sapiens
ccacacctccaca

SEQ ID NO: 6054131 - DNA, 14 bp, Homo sapiens
ccacacctccaccg

SEQ ID NO: 6054132 - DNA, 11 bp, Homo sapiens
ccacacctcct

SEQ ID NO: 6054133 - DNA, 13 bp, Homo sapiens
ccacacctgcagt

SEQ ID NO: 6054134 - DNA, 16 bp, Homo sapiens
ccacacctgcagtgcc

SEQ ID NO: 6054135 - DNA, 14 bp, Homo sapiens
ccacacctggcact

SEQ ID NO: 6054136 - DNA, 17 bp, Homo sapiens
ccacacctggcactgct

SEQ ID NO: 6054137 - DNA, 19 bp, Homo sapiens
ccacacctggcactgctgt

SEQ ID NO: 6054138 - DNA, 18 bp, Homo sapiens
ccacacctggccctgggg

SEQ ID NO: 6054139 - DNA, 16 bp, Homo sapiens
ccacacctggccttaa

SEQ ID NO: 6054140 - DNA, 14 bp, Homo sapiens
ccacacctggcttt

SEQ ID NO: 6054141 - DNA, 15 bp, Homo sapiens
ccacaccttccaggg

SEQ ID NO: 6054142 - DNA, 16 bp, Homo sapiens
ccacaccttccagggc

SEQ ID NO: 6054143 - DNA, 16 bp, Homo sapiens
ccacaccttggccttc

SEQ ID NO: 6054144 - DNA, 16 bp, Homo sapiens
ccacacgattagcttt

SEQ ID NO: 6054145 - DNA, 18 bp, Homo sapiens
ccacacgattagctttat

SEQ ID NO: 6054146 - DNA, 15 bp, Homo sapiens
ccacacgcactggtg

SEQ ID NO: 6054147 - DNA, 16 bp, Homo sapiens
ccacacgcactggtgc

SEQ ID NO: 6054148 - DNA, 17 bp, Homo sapiens
ccacacgcactggtgcc

SEQ ID NO: 6054149 - DNA, 14 bp, Homo sapiens
ccacacgccggggc

SEQ ID NO: 6054150 - DNA, 15 bp, Homo sapiens
ccacacgccggggct

SEQ ID NO: 6054151 - DNA, 21 bp, Homo sapiens
ccacacgccggggctggccct

SEQ ID NO: 6054152 - DNA, 23 bp, Homo sapiens
ccacacgccggggctggccctgc

SEQ ID NO: 6054153 - DNA, 23 bp, Homo sapiens
ccacacgcctctgtgtacatgtg

SEQ ID NO: 6054154 - DNA, 12 bp, Homo sapiens
ccacacgctcac

SEQ ID NO: 6054155 - DNA, 17 bp, Homo sapiens
ccacacgctgcccaggc

SEQ ID NO: 6054156 - DNA, 17 bp, Homo sapiens
ccacacggactcccggg

SEQ ID NO: 6054157 - DNA, 15 bp, Homo sapiens
ccacacggagctcct

SEQ ID NO: 6054158 - DNA, 21 bp, Homo sapiens
ccacacggagctcctggcagc

SEQ ID NO: 6054159 - DNA, 23 bp, Homo sapiens
ccacacggcaatcagaagaaagg

SEQ ID NO: 6054160 - DNA, 15 bp, Homo sapiens
ccacacggcagcccc

SEQ ID NO: 6054161 - DNA, 14 bp, Homo sapiens
ccacacggcccctt

SEQ ID NO: 6054162 - DNA, 18 bp, Homo sapiens
ccacacgtgcatagaggt

SEQ ID NO: 6054163 - DNA, 20 bp, Homo sapiens
ccacacgtgctcgcagcctg

SEQ ID NO: 6054164 - DNA, 22 bp, Homo sapiens
ccacacgtgctcgcagcctggc

SEQ ID NO: 6054165 - DNA, 16 bp, Homo sapiens
ccacactaacctgggt

SEQ ID NO: 6054166 - DNA, 16 bp, Homo sapiens
ccacactacacagcac

SEQ ID NO: 6054167 - DNA, 17 bp, Homo sapiens
ccacactatgcacagag

SEQ ID NO: 6054168 - DNA, 18 bp, Homo sapiens
ccacactatgcacagagc

SEQ ID NO: 6054169 - DNA, 20 bp, Homo sapiens
ccacactatgcacagagccc

SEQ ID NO: 6054170 - DNA, 14 bp, Homo sapiens
ccacactatgtgtg

SEQ ID NO: 6054171 - DNA, 15 bp, Homo sapiens
ccacactatgtgtgt

SEQ ID NO: 6054172 - DNA, 17 bp, Homo sapiens
ccacactattaccatga

SEQ ID NO: 6054173 - DNA, 20 bp, Homo sapiens
ccacactattaccatgagaa

SEQ ID NO: 6054174 - DNA, 21 bp, Homo sapiens
ccacactcaccccagcctcat

SEQ ID NO: 6054175 - DNA, 11 bp, Homo sapiens
ccacactcaga

SEQ ID NO: 6054176 - DNA, 23 bp, Homo sapiens
ccacactcagaaaattccctggg

SEQ ID NO: 6054177 - DNA, 19 bp, Homo sapiens
ccacactcagatcctcctc

SEQ ID NO: 6054178 - DNA, 21 bp, Homo sapiens
ccacactcagatcctcctcat

SEQ ID NO: 6054179 - DNA, 14 bp, Homo sapiens
ccacactccagctg

SEQ ID NO: 6054180 - DNA, 16 bp, Homo sapiens
ccacactccttgtcaa

SEQ ID NO: 6054181 - DNA, 13 bp, Homo sapiens
ccacactctccat

SEQ ID NO: 6054182 - DNA, 12 bp, Homo sapiens
ccacactgacca

SEQ ID NO: 6054183 - DNA, 14 bp, Homo sapiens
ccacactgaccaag

SEQ ID NO: 6054184 - DNA, 14 bp, Homo sapiens
ccacactgaccaca

SEQ ID NO: 6054185 - DNA, 20 bp, Homo sapiens
ccacactgagttctatcagt

SEQ ID NO: 6054186 - DNA, 19 bp, Homo sapiens
ccacactgatccagccctg

SEQ ID NO: 6054187 - DNA, 14 bp, Homo sapiens
ccacactgcaacag

SEQ ID NO: 6054188 - DNA, 12 bp, Homo sapiens
ccacactgcaca

SEQ ID NO: 6054189 - DNA, 14 bp, Homo sapiens
ccacactgcacaat

SEQ ID NO: 6054190 - DNA, 18 bp, Homo sapiens
ccacactgccagaagaga

SEQ ID NO: 6054191 - DNA, 14 bp, Homo sapiens
ccacactgctacac

SEQ ID NO: 6054192 - DNA, 23 bp, Homo sapiens
ccacactgctaggtgggccagcc

SEQ ID NO: 6054193 - DNA, 11 bp, Homo sapiens
ccacactgggc

SEQ ID NO: 6054194 - DNA, 15 bp, Homo sapiens
ccacactgggcctgg

SEQ ID NO: 6054195 - DNA, 17 bp, Homo sapiens
ccacactgggcctggag

SEQ ID NO: 6054196 - DNA, 18 bp, Homo sapiens
ccacactgggcctggagc

SEQ ID NO: 6054197 - DNA, 15 bp, Homo sapiens
ccacactggggctga

SEQ ID NO: 6054198 - DNA, 23 bp, Homo sapiens
ccacactggggctgacacccagg

SEQ ID NO: 6054199 - DNA, 13 bp, Homo sapiens
ccacactggtgac

SEQ ID NO: 6054200 - DNA, 18 bp, Homo sapiens
ccacactgtgcagaccca

SEQ ID NO: 6054201 - DNA, 18 bp, Homo sapiens
ccacactgtggccaggcc

SEQ ID NO: 6054202 - DNA, 22 bp, Homo sapiens
ccacacttcaggctcttctcct

SEQ ID NO: 6054203 - DNA, 23 bp, Homo sapiens
ccacacttccacccccagctcct

SEQ ID NO: 6054204 - DNA, 13 bp, Homo sapiens
ccacacttccctg

SEQ ID NO: 6054205 - DNA, 14 bp, Homo sapiens
ccacacttccctgg

SEQ ID NO: 6054206 - DNA, 21 bp, Homo sapiens
ccacacttcctgtccagagag

SEQ ID NO: 6054207 - DNA, 18 bp, Homo sapiens
ccacacttcgctcttgag

SEQ ID NO: 6054208 - DNA, 14 bp, Homo sapiens
ccacacttctcagg

SEQ ID NO: 6054209 - DNA, 15 bp, Homo sapiens
ccacacttctcagga

SEQ ID NO: 6054210 - DNA, 18 bp, Homo sapiens
ccacacttctcaggacac

SEQ ID NO: 6054211 - DNA, 12 bp, Homo sapiens
ccacacttcttg

SEQ ID NO: 6054212 - DNA, 13 bp, Homo sapiens
ccacacttcttga

SEQ ID NO: 6054213 - DNA, 17 bp, Homo sapiens
ccacacttgaaaccttt

SEQ ID NO: 6054214 - DNA, 23 bp, Homo sapiens
ccacacttgaagcctaaatttgt

SEQ ID NO: 6054215 - DNA, 13 bp, Homo sapiens
ccacacttgctgg

SEQ ID NO: 6054216 - DNA, 16 bp, Homo sapiens
ccacacttgctggggc

SEQ ID NO: 6054217 - DNA, 17 bp, Homo sapiens
ccacacttgctggggct

SEQ ID NO: 6054218 - DNA, 18 bp, Homo sapiens
ccacacttgtgccagccc

SEQ ID NO: 6054219 - DNA, 20 bp, Homo sapiens
ccacacttgtgccagcccgg

SEQ ID NO: 6054220 - DNA, 20 bp, Homo sapiens
ccacacttgttccagctctt

SEQ ID NO: 6054221 - DNA, 21 bp, Homo sapiens
ccacacttgttccagctcttt

SEQ ID NO: 6054222 - DNA, 21 bp, Homo sapiens
ccacactttgaagcaaataca

SEQ ID NO: 6054223 - DNA, 22 bp, Homo sapiens
ccacactttgagaacctgtgct

SEQ ID NO: 6054224 - DNA, 23 bp, Homo sapiens
ccacagaaaagaaagttcatgct

SEQ ID NO: 6054225 - DNA, 18 bp, Homo sapiens
ccacagaaaccctgtttt

SEQ ID NO: 6054226 - DNA, 12 bp, Homo sapiens
ccacagaaagag

SEQ ID NO: 6054227 - DNA, 18 bp, Homo sapiens
ccacagaacctttgtcaa

SEQ ID NO: 6054228 - DNA, 18 bp, Homo sapiens
ccacagaactgcttacta

SEQ ID NO: 6054229 - DNA, 11 bp, Homo sapiens
ccacagaactt

SEQ ID NO: 6054230 - DNA, 21 bp, Homo sapiens
ccacagaagccaggagcaaat

SEQ ID NO: 6054231 - DNA, 15 bp, Homo sapiens
ccacagaagggggaa

SEQ ID NO: 6054232 - DNA, 18 bp, Homo sapiens
ccacagaaggtgaacttt

SEQ ID NO: 6054233 - DNA, 19 bp, Homo sapiens
ccacagaaggtgaactttg

SEQ ID NO: 6054234 - DNA, 17 bp, Homo sapiens
ccacagacaactcacat

SEQ ID NO: 6054235 - DNA, 15 bp, Homo sapiens
ccacagacaaggtag

SEQ ID NO: 6054236 - DNA, 11 bp, Homo sapiens
ccacagacaca

SEQ ID NO: 6054237 - DNA, 20 bp, Homo sapiens
ccacagacacacacacgcac

SEQ ID NO: 6054238 - DNA, 17 bp, Homo sapiens
ccacagacactcctggg

SEQ ID NO: 6054239 - DNA, 16 bp, Homo sapiens
ccacagacagatccca

SEQ ID NO: 6054240 - DNA, 20 bp, Homo sapiens
ccacagacagatcccatcca

SEQ ID NO: 6054241 - DNA, 20 bp, Homo sapiens
ccacagaccacctgcttctg

SEQ ID NO: 6054242 - DNA, 18 bp, Homo sapiens
ccacagacccctgggagc

SEQ ID NO: 6054243 - DNA, 15 bp, Homo sapiens
ccacagacctgctct

SEQ ID NO: 6054244 - DNA, 21 bp, Homo sapiens
ccacagacctgctctggacac

SEQ ID NO: 6054245 - DNA, 13 bp, Homo sapiens
ccacagacgccac

SEQ ID NO: 6054246 - DNA, 18 bp, Homo sapiens
ccacagacgccacctggc

SEQ ID NO: 6054247 - DNA, 23 bp, Homo sapiens
ccacagacgggcacacagactgg

SEQ ID NO: 6054248 - DNA, 20 bp, Homo sapiens
ccacagactcaatgtgctct

SEQ ID NO: 6054249 - DNA, 11 bp, Homo sapiens
ccacagactga

SEQ ID NO: 6054250 - DNA, 19 bp, Homo sapiens
ccacagactgccccagcca

SEQ ID NO: 6054251 - DNA, 16 bp, Homo sapiens
ccacagactggttttg

SEQ ID NO: 6054252 - DNA, 20 bp, Homo sapiens
ccacagacttgcactgaagc

SEQ ID NO: 6054253 - DNA, 15 bp, Homo sapiens
ccacagagcaggaag

SEQ ID NO: 6054254 - DNA, 15 bp, Homo sapiens
ccacagagcctggct

SEQ ID NO: 6054255 - DNA, 14 bp, Homo sapiens
ccacagagcgggga

SEQ ID NO: 6054256 - DNA, 13 bp, Homo sapiens
ccacagaggacag

SEQ ID NO: 6054257 - DNA, 11 bp, Homo sapiens
ccacagaggcc

SEQ ID NO: 6054258 - DNA, 19 bp, Homo sapiens
ccacagaggccaggcatgg

SEQ ID NO: 6054259 - DNA, 11 bp, Homo sapiens
ccacagaggct

SEQ ID NO: 6054260 - DNA, 12 bp, Homo sapiens
ccacagaggctg

SEQ ID NO: 6054261 - DNA, 13 bp, Homo sapiens
ccacagaggctgt

SEQ ID NO: 6054262 - DNA, 15 bp, Homo sapiens
ccacagaggctgtgg

SEQ ID NO: 6054263 - DNA, 22 bp, Homo sapiens
ccacagagggcaggggatggtt

SEQ ID NO: 6054264 - DNA, 19 bp, Homo sapiens
ccacagagtgagccagtga

SEQ ID NO: 6054265 - DNA, 20 bp, Homo sapiens
ccacagagtgccatccctga

SEQ ID NO: 6054266 - DNA, 23 bp, Homo sapiens
ccacagagtgccatccctgagag

SEQ ID NO: 6054267 - DNA, 23 bp, Homo sapiens
ccacagagtgtagccaggtcccc

SEQ ID NO: 6054268 - DNA, 18 bp, Homo sapiens
ccacagagtgtggtccct

SEQ ID NO: 6054269 - DNA, 18 bp, Homo sapiens
ccacagagttactgccac

SEQ ID NO: 6054270 - DNA, 22 bp, Homo sapiens
ccacagagtttgtagtaaatat

SEQ ID NO: 6054271 - DNA, 23 bp, Homo sapiens
ccacagataagcctgaaacagcc

SEQ ID NO: 6054272 - DNA, 19 bp, Homo sapiens
ccacagatcagttttccta

SEQ ID NO: 6054273 - DNA, 22 bp, Homo sapiens
ccacagatggctttcagggcag

SEQ ID NO: 6054274 - DNA, 15 bp, Homo sapiens
ccacagatgtctctg

SEQ ID NO: 6054275 - DNA, 13 bp, Homo sapiens
ccacagatgtgtc

SEQ ID NO: 6054276 - DNA, 19 bp, Homo sapiens
ccacagatgtgtctgggag

SEQ ID NO: 6054277 - DNA, 22 bp, Homo sapiens
ccacagatgtgtctgggagagc

SEQ ID NO: 6054278 - DNA, 16 bp, Homo sapiens
ccacagatttgtgccc

SEQ ID NO: 6054279 - DNA, 19 bp, Homo sapiens
ccacagatttttttgtaag

SEQ ID NO: 6054280 - DNA, 22 bp, Homo sapiens
ccacagcaacgatcacaaatga

SEQ ID NO: 6054281 - DNA, 22 bp, Homo sapiens
ccacagcaaggaaatgtcctgc

SEQ ID NO: 6054282 - DNA, 23 bp, Homo sapiens
ccacagcaaggaaatgtcctgca

SEQ ID NO: 6054283 - DNA, 17 bp, Homo sapiens
ccacagcacaaacacac

SEQ ID NO: 6054284 - DNA, 16 bp, Homo sapiens
ccacagcacccaggct

SEQ ID NO: 6054285 - DNA, 19 bp, Homo sapiens
ccacagcacccaggctcca

SEQ ID NO: 6054286 - DNA, 11 bp, Homo sapiens
ccacagcagac

SEQ ID NO: 6054287 - DNA, 12 bp, Homo sapiens
ccacagcagaca

SEQ ID NO: 6054288 - DNA, 18 bp, Homo sapiens
ccacagcagcagaacaag

SEQ ID NO: 6054289 - DNA, 15 bp, Homo sapiens
ccacagcagcatttt

SEQ ID NO: 6054290 - DNA, 18 bp, Homo sapiens
ccacagcagcatttttat

SEQ ID NO: 6054291 - DNA, 19 bp, Homo sapiens
ccacagcagcctctgaagt

SEQ ID NO: 6054292 - DNA, 14 bp, Homo sapiens
ccacagcaggatcg

SEQ ID NO: 6054293 - DNA, 12 bp, Homo sapiens
ccacagcaggcc

SEQ ID NO: 6054294 - DNA, 13 bp, Homo sapiens
ccacagcaggtgc

SEQ ID NO: 6054295 - DNA, 18 bp, Homo sapiens
ccacagcagttgaaaaga

SEQ ID NO: 6054296 - DNA, 15 bp, Homo sapiens
ccacagcatcgggag

SEQ ID NO: 6054297 - DNA, 16 bp, Homo sapiens
ccacagcatgaacctt

SEQ ID NO: 6054298 - DNA, 18 bp, Homo sapiens
ccacagcattcctccatc

SEQ ID NO: 6054299 - DNA, 19 bp, Homo sapiens
cccatctgaaccactttgc

SEQ ID NO: 6054300 - DNA, 13 bp, Homo sapiens
cccatctgattta

SEQ ID NO: 6054301 - DNA, 22 bp, Homo sapiens
cccatctgcacccccctgggct

SEQ ID NO: 6054302 - DNA, 21 bp, Homo sapiens
cccatctgcagagcaatgact

SEQ ID NO: 6054303 - DNA, 18 bp, Homo sapiens
cccatctgcattcccagc

SEQ ID NO: 6054304 - DNA, 14 bp, Homo sapiens
cccatctgcccagg

SEQ ID NO: 6054305 - DNA, 15 bp, Homo sapiens
cccatctgcccagga

SEQ ID NO: 6054306 - DNA, 16 bp, Homo sapiens
cccatctgcccaggac

SEQ ID NO: 6054307 - DNA, 14 bp, Homo sapiens
cccatctgccctcc

SEQ ID NO: 6054308 - DNA, 21 bp, Homo sapiens
cccatctgcgggggcagtgct

SEQ ID NO: 6054309 - DNA, 23 bp, Homo sapiens
cccatctgctcctcccattcccc

SEQ ID NO: 6054310 - DNA, 13 bp, Homo sapiens
cccatctgctgag

SEQ ID NO: 6054311 - DNA, 12 bp, Homo sapiens
cccatctggctt

SEQ ID NO: 6054312 - DNA, 13 bp, Homo sapiens
cccatctggcttt

SEQ ID NO: 6054313 - DNA, 19 bp, Homo sapiens
cccatctgtagtaatttat

SEQ ID NO: 6054314 - DNA, 15 bp, Homo sapiens
cccatctgtccatcc

SEQ ID NO: 6054315 - DNA, 16 bp, Homo sapiens
cccatctgtccatcct

SEQ ID NO: 6054316 - DNA, 19 bp, Homo sapiens
cccatctgtccatcctcct

SEQ ID NO: 6054317 - DNA, 16 bp, Homo sapiens
cccatctgtcggccta

SEQ ID NO: 6054318 - DNA, 14 bp, Homo sapiens
cccatctgtctaaa

SEQ ID NO: 6054319 - DNA, 16 bp, Homo sapiens
cccatctgtgaataag

SEQ ID NO: 6054320 - DNA, 16 bp, Homo sapiens
cccatctgtgcattct

SEQ ID NO: 6054321 - DNA, 15 bp, Homo sapiens
cccatctgtggtttt

SEQ ID NO: 6054322 - DNA, 12 bp, Homo sapiens
cccatctgtgtt

SEQ ID NO: 6054323 - DNA, 13 bp, Homo sapiens
cccatcttcaccc

SEQ ID NO: 6054324 - DNA, 13 bp, Homo sapiens
cccatcttccacc

SEQ ID NO: 6054325 - DNA, 16 bp, Homo sapiens
cccatcttccacctgt

SEQ ID NO: 6054326 - DNA, 22 bp, Homo sapiens
cccatcttccacctgtgccctc

SEQ ID NO: 6054327 - DNA, 19 bp, Homo sapiens
cccatcttgatctttgagc

SEQ ID NO: 6054328 - DNA, 24 bp, Homo sapiens
cccatcttgcctccatggtgcctc

SEQ ID NO: 6054329 - DNA, 21 bp, Homo sapiens
cccatcttgcttccaagacca

SEQ ID NO: 6054330 - DNA, 18 bp, Homo sapiens
cccatcttggcctcccag

SEQ ID NO: 6054331 - DNA, 22 bp, Homo sapiens
cccatcttgggggtcacccatg

SEQ ID NO: 6054332 - DNA, 15 bp, Homo sapiens
cccatcttggtcctg

SEQ ID NO: 6054333 - DNA, 19 bp, Homo sapiens
cccatctttgatccttctg

SEQ ID NO: 6054334 - DNA, 17 bp, Homo sapiens
cccatgaaacagcagct

SEQ ID NO: 6054335 - DNA, 16 bp, Homo sapiens
cccatgaaccctgccc

SEQ ID NO: 6054336 - DNA, 17 bp, Homo sapiens
cccatgaagaaagcccc

SEQ ID NO: 6054337 - DNA, 18 bp, Homo sapiens
cccatgaagacaggacag

SEQ ID NO: 6054338 - DNA, 12 bp, Homo sapiens
cccatgaagcca

SEQ ID NO: 6054339 - DNA, 16 bp, Homo sapiens
cccatgaagccacagc

SEQ ID NO: 6054340 - DNA, 14 bp, Homo sapiens
cccatgaagctggc

SEQ ID NO: 6054341 - DNA, 18 bp, Homo sapiens
cccatgaagctggccctc

SEQ ID NO: 6054342 - DNA, 23 bp, Homo sapiens
cccatgaagctggccctcagctc

SEQ ID NO: 6054343 - DNA, 19 bp, Homo sapiens
cccatgaccatactgaggg

SEQ ID NO: 6054344 - DNA, 14 bp, Homo sapiens
cccatgacccaccc

SEQ ID NO: 6054345 - DNA, 15 bp, Homo sapiens
cccatgacccacccc

SEQ ID NO: 6054346 - DNA, 16 bp, Homo sapiens
cccatgacccacccct

SEQ ID NO: 6054347 - DNA, 17 bp, Homo sapiens
cccatgacccacccctg

SEQ ID NO: 6054348 - DNA, 22 bp, Homo sapiens
cccatgacccacccctgtgctc

SEQ ID NO: 6054349 - DNA, 18 bp, Homo sapiens
cccatgaccccaaagcca

SEQ ID NO: 6054350 - DNA, 13 bp, Homo sapiens
cccatgaccgttc

SEQ ID NO: 6054351 - DNA, 14 bp, Homo sapiens
cccatgacctccag

SEQ ID NO: 6054352 - DNA, 15 bp, Homo sapiens
cccatgacctccagc

SEQ ID NO: 6054353 - DNA, 16 bp, Homo sapiens
cccatgacctccagct

SEQ ID NO: 6054354 - DNA, 20 bp, Homo sapiens
cccatgaccttatccttcct

SEQ ID NO: 6054355 - DNA, 16 bp, Homo sapiens
cccatgaccttgacgt

SEQ ID NO: 6054356 - DNA, 16 bp, Homo sapiens
cccatgactcttggag

SEQ ID NO: 6054357 - DNA, 13 bp, Homo sapiens
cccatgactgcac

SEQ ID NO: 6054358 - DNA, 14 bp, Homo sapiens
cccatgactgcccc

SEQ ID NO: 6054359 - DNA, 24 bp, Homo sapiens
cccatgactgccccttgcttctca

SEQ ID NO: 6054360 - DNA, 20 bp, Homo sapiens
cccatgagactgccctgccc

SEQ ID NO: 6054361 - DNA, 19 bp, Homo sapiens
cccatgagagcgcagcccg

SEQ ID NO: 6054362 - DNA, 16 bp, Homo sapiens
cccatgagcctcagca

SEQ ID NO: 6054363 - DNA, 20 bp, Homo sapiens
cccatgagcctcagcatcct

SEQ ID NO: 6054364 - DNA, 16 bp, Homo sapiens
cccatgagcgtccagg

SEQ ID NO: 6054365 - DNA, 13 bp, Homo sapiens
cccatgagctcct

SEQ ID NO: 6054366 - DNA, 22 bp, Homo sapiens
cccatgagctccttaaggctct

SEQ ID NO: 6054367 - DNA, 22 bp, Homo sapiens
cccatgagctcggggtccacca

SEQ ID NO: 6054368 - DNA, 14 bp, Homo sapiens
cccatgaggactag

SEQ ID NO: 6054369 - DNA, 21 bp, Homo sapiens
cccatgaggcttgtggccaca

SEQ ID NO: 6054370 - DNA, 13 bp, Homo sapiens
cccatgaggtctt

SEQ ID NO: 6054371 - DNA, 21 bp, Homo sapiens
cccatgatactccactcccag

SEQ ID NO: 6054372 - DNA, 14 bp, Homo sapiens
cccatgatccagaa

SEQ ID NO: 6054373 - DNA, 13 bp, Homo sapiens
cccatgattccct

SEQ ID NO: 6054374 - DNA, 17 bp, Homo sapiens
cccatgatttcatgtac

SEQ ID NO: 6054375 - DNA, 19 bp, Homo sapiens
cccatgatttcatgtactg

SEQ ID NO: 6054376 - DNA, 14 bp, Homo sapiens
cccatgatttgggg

SEQ ID NO: 6054377 - DNA, 20 bp, Homo sapiens
cccatgcacaactctccaaa

SEQ ID NO: 6054378 - DNA, 20 bp, Homo sapiens
cccatgcacagtacaataat

SEQ ID NO: 6054379 - DNA, 21 bp, Homo sapiens
cccatgcaccttccagcccgg

SEQ ID NO: 6054380 - DNA, 14 bp, Homo sapiens
cccatgcactgtga

SEQ ID NO: 6054381 - DNA, 18 bp, Homo sapiens
cccatgcactgtgaagga

SEQ ID NO: 6054382 - DNA, 19 bp, Homo sapiens
cccatgcactgtgaaggac

SEQ ID NO: 6054383 - DNA, 20 bp, Homo sapiens
cccatgcactgtgaaggacc

SEQ ID NO: 6054384 - DNA, 22 bp, Homo sapiens
cccatgcactgtgaaggaccct

SEQ ID NO: 6054385 - DNA, 18 bp, Homo sapiens
cccatgcaggcagcctgc

SEQ ID NO: 6054386 - DNA, 14 bp, Homo sapiens
cccatgcatggcct

SEQ ID NO: 6054387 - DNA, 15 bp, Homo sapiens
cccatgcatggcctc

SEQ ID NO: 6054388 - DNA, 21 bp, Homo sapiens
cccatgcatggcctcccagcc

SEQ ID NO: 6054389 - DNA, 16 bp, Homo sapiens
cccatgccaaggcctc

SEQ ID NO: 6054390 - DNA, 14 bp, Homo sapiens
cccatgccaatgtc

SEQ ID NO: 6054391 - DNA, 17 bp, Homo sapiens
cccatgccaccacccac

SEQ ID NO: 6054392 - DNA, 20 bp, Homo sapiens
cccatgccaccacccacccc

SEQ ID NO: 6054393 - DNA, 17 bp, Homo sapiens
cccatgccacgttccac

SEQ ID NO: 6054394 - DNA, 15 bp, Homo sapiens
cccatgccagagagg

SEQ ID NO: 6054395 - DNA, 13 bp, Homo sapiens
cccatgccccctt

SEQ ID NO: 6054396 - DNA, 19 bp, Homo sapiens
cccatgcccccttcgctcc

SEQ ID NO: 6054397 - DNA, 13 bp, Homo sapiens
cccatgcccctcc

SEQ ID NO: 6054398 - DNA, 20 bp, Homo sapiens
cccatgccctccctgctgcc

SEQ ID NO: 6054399 - DNA, 12 bp, Homo sapiens
cccatgccctgc

SEQ ID NO: 6054400 - DNA, 20 bp, Homo sapiens
cccatgccctgccaagcctg

SEQ ID NO: 6054401 - DNA, 22 bp, Homo sapiens
cccatgccctgccaagcctgga

SEQ ID NO: 6054402 - DNA, 14 bp, Homo sapiens
cccatgcctccagc

SEQ ID NO: 6054403 - DNA, 23 bp, Homo sapiens
cccatgcctggtcccaagacagt

SEQ ID NO: 6054404 - DNA, 23 bp, Homo sapiens
cccatgcgccttcgtgcctgaga

SEQ ID NO: 6054405 - DNA, 22 bp, Homo sapiens
cccatgcgtgccgcctgctcct

SEQ ID NO: 6054406 - DNA, 19 bp, Homo sapiens
cccatgctcaaccactgtg

SEQ ID NO: 6054407 - DNA, 19 bp, Homo sapiens
cccatgctctgatgcagtg

SEQ ID NO: 6054408 - DNA, 16 bp, Homo sapiens
cccatgctctgcccca

SEQ ID NO: 6054409 - DNA, 14 bp, Homo sapiens
cccatgctgaatta

SEQ ID NO: 6054410 - DNA, 17 bp, Homo sapiens
cccatgctgaattattt

SEQ ID NO: 6054411 - DNA, 12 bp, Homo sapiens
cccatgctgcct

SEQ ID NO: 6054412 - DNA, 16 bp, Homo sapiens
cccatgctgccttcag

SEQ ID NO: 6054413 - DNA, 14 bp, Homo sapiens
cccatgctggagcc

SEQ ID NO: 6054414 - DNA, 20 bp, Homo sapiens
cccatgctggagcctgtgta

SEQ ID NO: 6054415 - DNA, 13 bp, Homo sapiens
cccatgctggctg

SEQ ID NO: 6054416 - DNA, 14 bp, Homo sapiens
cccatgctggctgg

SEQ ID NO: 6054417 - DNA, 16 bp, Homo sapiens
cccatgctggctgggg

SEQ ID NO: 6054418 - DNA, 18 bp, Homo sapiens
cccatgctgtccatccat

SEQ ID NO: 6054419 - DNA, 19 bp, Homo sapiens
cccatgctgttgattgcta

SEQ ID NO: 6054420 - DNA, 12 bp, Homo sapiens
cccatgctttcc

SEQ ID NO: 6054421 - DNA, 17 bp, Homo sapiens
cccatggaaaaatgcca

SEQ ID NO: 6054422 - DNA, 16 bp, Homo sapiens
cccatggaacagccct

SEQ ID NO: 6054423 - DNA, 19 bp, Homo sapiens
cccatggaacagccctgca

SEQ ID NO: 6054424 - DNA, 22 bp, Homo sapiens
cccatggaacagccctgcacgc

SEQ ID NO: 6054425 - DNA, 15 bp, Homo sapiens
cccatggacaggctg

SEQ ID NO: 6054426 - DNA, 14 bp, Homo sapiens
cccatggaccatgc

SEQ ID NO: 6054427 - DNA, 20 bp, Homo sapiens
cccatggagattgacctgga

SEQ ID NO: 6054428 - DNA, 13 bp, Homo sapiens
cccatggagccag

SEQ ID NO: 6054429 - DNA, 14 bp, Homo sapiens
cccatggagcccca

SEQ ID NO: 6054430 - DNA, 14 bp, Homo sapiens
cccatggagcccct

SEQ ID NO: 6054431 - DNA, 22 bp, Homo sapiens
cccatggaggcagatgcccttg

SEQ ID NO: 6054432 - DNA, 15 bp, Homo sapiens
cccatggcagctcct

SEQ ID NO: 6054433 - DNA, 15 bp, Homo sapiens
cccatggcattttat

SEQ ID NO: 6054434 - DNA, 13 bp, Homo sapiens
cccatggcccagc

SEQ ID NO: 6054435 - DNA, 17 bp, Homo sapiens
cccatggccccagctgg

SEQ ID NO: 6054436 - DNA, 19 bp, Homo sapiens
cccatggccccagctggct

SEQ ID NO: 6054437 - DNA, 17 bp, Homo sapiens
cccatggccccaggccc

SEQ ID NO: 6054438 - DNA, 17 bp, Homo sapiens
cccatggcccccaataa

SEQ ID NO: 6054439 - DNA, 17 bp, Homo sapiens
cccatggccctcccagt

SEQ ID NO: 6054440 - DNA, 22 bp, Homo sapiens
cccatggccctgtgctaatccc

SEQ ID NO: 6054441 - DNA, 23 bp, Homo sapiens
cccatggccggctttcaggagct

SEQ ID NO: 6054442 - DNA, 13 bp, Homo sapiens
cccatggcctcag

SEQ ID NO: 6054443 - DNA, 14 bp, Homo sapiens
cccatggcctcagc

SEQ ID NO: 6054444 - DNA, 18 bp, Homo sapiens
cccatggcctcagccctg

SEQ ID NO: 6054445 - DNA, 20 bp, Homo sapiens
cccatggcctcagccctgct

SEQ ID NO: 6054446 - DNA, 15 bp, Homo sapiens
cccatggcctgctgg

SEQ ID NO: 6054447 - DNA, 16 bp, Homo sapiens
cccatggcctgctggg

SEQ ID NO: 6054448 - DNA, 15 bp, Homo sapiens
cccatggctgaagct

SEQ ID NO: 6054449 - DNA, 22 bp, Homo sapiens
cccatggctgaagctggagcag

SEQ ID NO: 6054450 - DNA, 20 bp, Homo sapiens
cccatggcttgttctctgga

SEQ ID NO: 6054451 - DNA, 21 bp, Homo sapiens
cccatgggaagacgaggccct

SEQ ID NO: 6054452 - DNA, 16 bp, Homo sapiens
cccatgggagccaggc

SEQ ID NO: 6054453 - DNA, 23 bp, Homo sapiens
cccatgggagggagctgagaaga

SEQ ID NO: 6054454 - DNA, 17 bp, Homo sapiens
cccatgggcactgctgg

SEQ ID NO: 6054455 - DNA, 17 bp, Homo sapiens
cccatgggcagaagata

SEQ ID NO: 6054456 - DNA, 16 bp, Homo sapiens
cccatgggcaggagac

SEQ ID NO: 6054457 - DNA, 14 bp, Homo sapiens
cccatgggctctgg

SEQ ID NO: 6054458 - DNA, 16 bp, Homo sapiens
cccatgggctctggcc

SEQ ID NO: 6054459 - DNA, 23 bp, Homo sapiens
cccatgggctgagtggggagcag

SEQ ID NO: 6054460 - DNA, 14 bp, Homo sapiens
cccatggggaggag

SEQ ID NO: 6054461 - DNA, 19 bp, Homo sapiens
cccatggggagggattctg

SEQ ID NO: 6054462 - DNA, 19 bp, Homo sapiens
cccatgggggtgagaccct

SEQ ID NO: 6054463 - DNA, 20 bp, Homo sapiens
cccatgggggtgagaccctc

SEQ ID NO: 6054464 - DNA, 14 bp, Homo sapiens
cccatggggtcctt

SEQ ID NO: 6054465 - DNA, 23 bp, Homo sapiens
cccatgggttgtgtgtttatttc

SEQ ID NO: 6054466 - DNA, 17 bp, Homo sapiens
cccatggtagactgtga

SEQ ID NO: 6054467 - DNA, 15 bp, Homo sapiens
cccatggtcacagac

SEQ ID NO: 6054468 - DNA, 17 bp, Homo sapiens
cccatggtccatcccct

SEQ ID NO: 6054469 - DNA, 14 bp, Homo sapiens
cccatggtccctag

SEQ ID NO: 6054470 - DNA, 17 bp, Homo sapiens
cccatggtggcctcaag

SEQ ID NO: 6054471 - DNA, 19 bp, Homo sapiens
cccatggtgtatgtggttt

SEQ ID NO: 6054472 - DNA, 18 bp, Homo sapiens
cccatgtagctggcaagc

SEQ ID NO: 6054473 - DNA, 14 bp, Homo sapiens
cccatgtcaatcaa

SEQ ID NO: 6054474 - DNA, 12 bp, Homo sapiens
cccatgtcacct

SEQ ID NO: 6054475 - DNA, 15 bp, Homo sapiens
cccatgtcacctcag

SEQ ID NO: 6054476 - DNA, 18 bp, Homo sapiens
cccatgtcgcgctcagca

SEQ ID NO: 6054477 - DNA, 12 bp, Homo sapiens
cccatgtcttct

SEQ ID NO: 6054478 - DNA, 22 bp, Homo sapiens
cccatgtcttctgctgttcttc

SEQ ID NO: 6054479 - DNA, 13 bp, Homo sapiens
ccacagccaagcc

SEQ ID NO: 6054480 - DNA, 14 bp, Homo sapiens
ccacagccaagccc

SEQ ID NO: 6054481 - DNA, 17 bp, Homo sapiens
ccacagccaagcccacc

SEQ ID NO: 6054482 - DNA, 15 bp, Homo sapiens
ccacagccacctcca

SEQ ID NO: 6054483 - DNA, 22 bp, Homo sapiens
ccacagccacctccacccccaa

SEQ ID NO: 6054484 - DNA, 13 bp, Homo sapiens
ccacagccagagg

SEQ ID NO: 6054485 - DNA, 15 bp, Homo sapiens
ccacagccagaggag

SEQ ID NO: 6054486 - DNA, 22 bp, Homo sapiens
ccacagccagcacctggcatcg

SEQ ID NO: 6054487 - DNA, 18 bp, Homo sapiens
ccacagcccagccacgga

SEQ ID NO: 6054488 - DNA, 20 bp, Homo sapiens
ccacagcccagccacggacg

SEQ ID NO: 6054489 - DNA, 21 bp, Homo sapiens
ccacagcccaggcctccagct

SEQ ID NO: 6054490 - DNA, 16 bp, Homo sapiens
ccacagccccacagca

SEQ ID NO: 6054491 - DNA, 18 bp, Homo sapiens
ccacagccccacagcacc

SEQ ID NO: 6054492 - DNA, 23 bp, Homo sapiens
ccacagcccccgggacaccgtgg

SEQ ID NO: 6054493 - DNA, 13 bp, Homo sapiens
ccacagcccctgg

SEQ ID NO: 6054494 - DNA, 19 bp, Homo sapiens
ccacagccctagtatgaaa

SEQ ID NO: 6054495 - DNA, 11 bp, Homo sapiens
ccacagccctg

SEQ ID NO: 6054496 - DNA, 12 bp, Homo sapiens
ccacagccctga

SEQ ID NO: 6054497 - DNA, 15 bp, Homo sapiens
ccacagccctgaaac

SEQ ID NO: 6054498 - DNA, 13 bp, Homo sapiens
ccacagccctgga

SEQ ID NO: 6054499 - DNA, 14 bp, Homo sapiens
ccacagccctggaa

SEQ ID NO: 6054500 - DNA, 14 bp, Homo sapiens
ccacagccctgtca

SEQ ID NO: 6054501 - DNA, 16 bp, Homo sapiens
ccacagccctgtcagc

SEQ ID NO: 6054502 - DNA, 19 bp, Homo sapiens
ccacagccctgtcagcatg

SEQ ID NO: 6054503 - DNA, 20 bp, Homo sapiens
ccacagcccttttgtctctg

SEQ ID NO: 6054504 - DNA, 12 bp, Homo sapiens
ccacagccgcag

SEQ ID NO: 6054505 - DNA, 18 bp, Homo sapiens
ccacagccgcctttgggt

SEQ ID NO: 6054506 - DNA, 15 bp, Homo sapiens
ccacagccgggtgtg

SEQ ID NO: 6054507 - DNA, 18 bp, Homo sapiens
ccacagccggtcagagga

SEQ ID NO: 6054508 - DNA, 13 bp, Homo sapiens
ccacagcctcccc

SEQ ID NO: 6054509 - DNA, 19 bp, Homo sapiens
ccacagcctccccacccag

SEQ ID NO: 6054510 - DNA, 19 bp, Homo sapiens
ccacagcctccccttccca

SEQ ID NO: 6054511 - DNA, 21 bp, Homo sapiens
ccacagcctccccttcccaga

SEQ ID NO: 6054512 - DNA, 19 bp, Homo sapiens
ccacagcctctggctccac

SEQ ID NO: 6054513 - DNA, 20 bp, Homo sapiens
ccacagcctctggctccaca

SEQ ID NO: 6054514 - DNA, 16 bp, Homo sapiens
ccacagcctgctggca

SEQ ID NO: 6054515 - DNA, 16 bp, Homo sapiens
ccacagcctgggaagg

SEQ ID NO: 6054516 - DNA, 14 bp, Homo sapiens
ccacagcctgggtg

SEQ ID NO: 6054517 - DNA, 19 bp, Homo sapiens
ccacagccttccctctgca

SEQ ID NO: 6054518 - DNA, 20 bp, Homo sapiens
ccacagccttccctctgcat

SEQ ID NO: 6054519 - DNA, 18 bp, Homo sapiens
ccacagccttgcagcggc

SEQ ID NO: 6054520 - DNA, 21 bp, Homo sapiens
ccacagccttgcagcggctcc

SEQ ID NO: 6054521 - DNA, 17 bp, Homo sapiens
ccacagcgagggcagct

SEQ ID NO: 6054522 - DNA, 19 bp, Homo sapiens
ccacagcgagggcagctgc

SEQ ID NO: 6054523 - DNA, 21 bp, Homo sapiens
ccacagcgagggcagctgcta

SEQ ID NO: 6054524 - DNA, 13 bp, Homo sapiens
ccacagcgccagc

SEQ ID NO: 6054525 - DNA, 20 bp, Homo sapiens
ccacagcggaggagaccagc

SEQ ID NO: 6054526 - DNA, 22 bp, Homo sapiens
ccacagcggaggagaccagctc

SEQ ID NO: 6054527 - DNA, 19 bp, Homo sapiens
ccacagcggaggagctccg

SEQ ID NO: 6054528 - DNA, 15 bp, Homo sapiens
ccacagctccaggac

SEQ ID NO: 6054529 - DNA, 16 bp, Homo sapiens
ccacagctccaggaca

SEQ ID NO: 6054530 - DNA, 15 bp, Homo sapiens
ccacagctcccaccc

SEQ ID NO: 6054531 - DNA, 15 bp, Homo sapiens
ccacagctccttgca

SEQ ID NO: 6054532 - DNA, 19 bp, Homo sapiens
ccacagctctgctggaaga

SEQ ID NO: 6054533 - DNA, 12 bp, Homo sapiens
ccacagctctgg

SEQ ID NO: 6054534 - DNA, 13 bp, Homo sapiens
ccacagctctggg

SEQ ID NO: 6054535 - DNA, 16 bp, Homo sapiens
ccacagctctgggcct

SEQ ID NO: 6054536 - DNA, 18 bp, Homo sapiens
ccacagctctgggcctct

SEQ ID NO: 6054537 - DNA, 20 bp, Homo sapiens
ccacagctgcagctgatcca

SEQ ID NO: 6054538 - DNA, 19 bp, Homo sapiens
ccacagctgcctccgggcc

SEQ ID NO: 6054539 - DNA, 11 bp, Homo sapiens
ccacagctgct

SEQ ID NO: 6054540 - DNA, 13 bp, Homo sapiens
ccacagctgctgg

SEQ ID NO: 6054541 - DNA, 14 bp, Homo sapiens
ccacagctgctggc

SEQ ID NO: 6054542 - DNA, 15 bp, Homo sapiens
ccacagctgctgttc

SEQ ID NO: 6054543 - DNA, 17 bp, Homo sapiens
ccacagctgctgttctc

SEQ ID NO: 6054544 - DNA, 23 bp, Homo sapiens
ccacagctgctgttctcaggaca

SEQ ID NO: 6054545 - DNA, 23 bp, Homo sapiens
ccacagctggaaagttgggcccc

SEQ ID NO: 6054546 - DNA, 15 bp, Homo sapiens
ccacagctggcctgg

SEQ ID NO: 6054547 - DNA, 13 bp, Homo sapiens
ccacagctggggc

SEQ ID NO: 6054548 - DNA, 19 bp, Homo sapiens
ccacagcttatggcatctc

SEQ ID NO: 6054549 - DNA, 19 bp, Homo sapiens
ccacaggaacaacagcatc

SEQ ID NO: 6054550 - DNA, 16 bp, Homo sapiens
ccacaggaacggccct

SEQ ID NO: 6054551 - DNA, 21 bp, Homo sapiens
ccacaggaagatgggaggtgg

SEQ ID NO: 6054552 - DNA, 16 bp, Homo sapiens
ccacaggaagctcagc

SEQ ID NO: 6054553 - DNA, 21 bp, Homo sapiens
ccacaggaagctcagccttct

SEQ ID NO: 6054554 - DNA, 22 bp, Homo sapiens
ccacaggaataatagttcagga

SEQ ID NO: 6054555 - DNA, 22 bp, Homo sapiens
ccacaggactgagccctctcac

SEQ ID NO: 6054556 - DNA, 15 bp, Homo sapiens
ccacaggactttgat

SEQ ID NO: 6054557 - DNA, 20 bp, Homo sapiens
ccacaggagcatgtcctatc

SEQ ID NO: 6054558 - DNA, 16 bp, Homo sapiens
ccacaggagccgcaga

SEQ ID NO: 6054559 - DNA, 23 bp, Homo sapiens
ccacaggagccgcagaggcccga

SEQ ID NO: 6054560 - DNA, 15 bp, Homo sapiens
ccacaggagcgtgta

SEQ ID NO: 6054561 - DNA, 17 bp, Homo sapiens
ccacaggagcgtgtact

SEQ ID NO: 6054562 - DNA, 23 bp, Homo sapiens
ccacaggagcgtgtcctatcccc

SEQ ID NO: 6054563 - DNA, 19 bp, Homo sapiens
ccacaggaggcaagcaagc

SEQ ID NO: 6054564 - DNA, 23 bp, Homo sapiens
ccacaggaggtgtgatagagcct

SEQ ID NO: 6054565 - DNA, 20 bp, Homo sapiens
ccacaggagtgggaaaacac

SEQ ID NO: 6054566 - DNA, 16 bp, Homo sapiens
ccacaggatcagtctg

SEQ ID NO: 6054567 - DNA, 16 bp, Homo sapiens
ccacaggatctgaact

SEQ ID NO: 6054568 - DNA, 18 bp, Homo sapiens
ccacaggattccagttgc

SEQ ID NO: 6054569 - DNA, 19 bp, Homo sapiens
ccacaggcacacaggtctc

SEQ ID NO: 6054570 - DNA, 18 bp, Homo sapiens
ccacaggcacattaactg

SEQ ID NO: 6054571 - DNA, 20 bp, Homo sapiens
ccacaggcacattaactgtt

SEQ ID NO: 6054572 - DNA, 14 bp, Homo sapiens
ccacaggcagcttt

SEQ ID NO: 6054573 - DNA, 16 bp, Homo sapiens
ccacaggcatgtccca

SEQ ID NO: 6054574 - DNA, 18 bp, Homo sapiens
ccacaggcatgtcccatg

SEQ ID NO: 6054575 - DNA, 23 bp, Homo sapiens
ccacaggccccccgcagcaccct

SEQ ID NO: 6054576 - DNA, 15 bp, Homo sapiens
ccacaggcccttcct

SEQ ID NO: 6054577 - DNA, 19 bp, Homo sapiens
ccacaggcccttcctctcc

SEQ ID NO: 6054578 - DNA, 23 bp, Homo sapiens
ccacaggcccttcctctccactg

SEQ ID NO: 6054579 - DNA, 22 bp, Homo sapiens
ccacaggccctttcctcaggca

SEQ ID NO: 6054580 - DNA, 23 bp, Homo sapiens
ccacaggccctttcctcaggcaa

SEQ ID NO: 6054581 - DNA, 15 bp, Homo sapiens
ccacaggcctccctg

SEQ ID NO: 6054582 - DNA, 12 bp, Homo sapiens
ccacaggcctgg

SEQ ID NO: 6054583 - DNA, 17 bp, Homo sapiens
ccacaggctagatcccc

SEQ ID NO: 6054584 - DNA, 17 bp, Homo sapiens
ccacaggctcaggcagg

SEQ ID NO: 6054585 - DNA, 21 bp, Homo sapiens
ccacaggctcaggcaggggcc

SEQ ID NO: 6054586 - DNA, 15 bp, Homo sapiens
ccacaggcttaggga

SEQ ID NO: 6054587 - DNA, 18 bp, Homo sapiens
ccacaggcttagggacag

SEQ ID NO: 6054588 - DNA, 16 bp, Homo sapiens
ccacagggaaccctgc

SEQ ID NO: 6054589 - DNA, 19 bp, Homo sapiens
ccacagggaagcatgtact

SEQ ID NO: 6054590 - DNA, 23 bp, Homo sapiens
ccacagggaagctcacacatcct

SEQ ID NO: 6054591 - DNA, 18 bp, Homo sapiens
ccacagggaccacatcca

SEQ ID NO: 6054592 - DNA, 23 bp, Homo sapiens
ccacagggaccagggccaccgca

SEQ ID NO: 6054593 - DNA, 14 bp, Homo sapiens
ccacagggagccac

SEQ ID NO: 6054594 - DNA, 17 bp, Homo sapiens
ccacagggagctccgtc

SEQ ID NO: 6054595 - DNA, 11 bp, Homo sapiens
ccacagggcac

SEQ ID NO: 6054596 - DNA, 17 bp, Homo sapiens
ccacagggccagatgtg

SEQ ID NO: 6054597 - DNA, 11 bp, Homo sapiens
ccacagggcct

SEQ ID NO: 6054598 - DNA, 17 bp, Homo sapiens
ccacagggcctcccagc

SEQ ID NO: 6054599 - DNA, 14 bp, Homo sapiens
ccacagggctaaga

SEQ ID NO: 6054600 - DNA, 17 bp, Homo sapiens
ccacagggctaagagct

SEQ ID NO: 6054601 - DNA, 18 bp, Homo sapiens
ccacagggcttgttttcc

SEQ ID NO: 6054602 - DNA, 19 bp, Homo sapiens
ccacaggggcaggcctggg

SEQ ID NO: 6054603 - DNA, 20 bp, Homo sapiens
ccacagggtcccacagccac

SEQ ID NO: 6054604 - DNA, 21 bp, Homo sapiens
ccacagggtcccacagccacg

SEQ ID NO: 6054605 - DNA, 17 bp, Homo sapiens
ccacagggtctgcctcc

SEQ ID NO: 6054606 - DNA, 20 bp, Homo sapiens
ccacagggtgagcactctgg

SEQ ID NO: 6054607 - DNA, 17 bp, Homo sapiens
ccacagggtgggatgag

SEQ ID NO: 6054608 - DNA, 22 bp, Homo sapiens
ccacagggttcaaaatgtctgt

SEQ ID NO: 6054609 - DNA, 16 bp, Homo sapiens
ccacaggtccaaggac

SEQ ID NO: 6054610 - DNA, 15 bp, Homo sapiens
ccacaggtctagact

SEQ ID NO: 6054611 - DNA, 22 bp, Homo sapiens
ccacaggtgcgggaccatctga

SEQ ID NO: 6054612 - DNA, 17 bp, Homo sapiens
ccacaggtgggaggagt

SEQ ID NO: 6054613 - DNA, 19 bp, Homo sapiens
ccacaggttttagcattgt

SEQ ID NO: 6054614 - DNA, 20 bp, Homo sapiens
ccacagtagaactgtctgtg

SEQ ID NO: 6054615 - DNA, 11 bp, Homo sapiens
ccacagtattg

SEQ ID NO: 6054616 - DNA, 14 bp, Homo sapiens
ccacagtcactgga

SEQ ID NO: 6054617 - DNA, 15 bp, Homo sapiens
ccacagtcagtggag

SEQ ID NO: 6054618 - DNA, 21 bp, Homo sapiens
ccacagtcagtggagcctggg

SEQ ID NO: 6054619 - DNA, 19 bp, Homo sapiens
ccacagtcccatctgcttc

SEQ ID NO: 6054620 - DNA, 14 bp, Homo sapiens
ccacagtcccccac

SEQ ID NO: 6054621 - DNA, 19 bp, Homo sapiens
ccacagtcccccacccacc

SEQ ID NO: 6054622 - DNA, 16 bp, Homo sapiens
ccacagtccctcacct

SEQ ID NO: 6054623 - DNA, 17 bp, Homo sapiens
ccacagtccctcacctc

SEQ ID NO: 6054624 - DNA, 14 bp, Homo sapiens
ccacagtctcccat

SEQ ID NO: 6054625 - DNA, 14 bp, Homo sapiens
ccacagtgacagtc

SEQ ID NO: 6054626 - DNA, 22 bp, Homo sapiens
ccacagtgactcgggctcctgt

SEQ ID NO: 6054627 - DNA, 23 bp, Homo sapiens
ccacagtgactcgggctcctgtg

SEQ ID NO: 6054628 - DNA, 18 bp, Homo sapiens
ccacagtgactgggccct

SEQ ID NO: 6054629 - DNA, 19 bp, Homo sapiens
ccacagtgagaggggaggg

SEQ ID NO: 6054630 - DNA, 21 bp, Homo sapiens
ccacagtgagaggggagggct

SEQ ID NO: 6054631 - DNA, 19 bp, Homo sapiens
ccacagtgccaccaagctc

SEQ ID NO: 6054632 - DNA, 19 bp, Homo sapiens
ccacagtgcccagctaatt

SEQ ID NO: 6054633 - DNA, 21 bp, Homo sapiens
ccacagtgctcagttgtactt

SEQ ID NO: 6054634 - DNA, 22 bp, Homo sapiens
ccacagtgctcagttgtacttt

SEQ ID NO: 6054635 - DNA, 14 bp, Homo sapiens
ccacagtgctgctt

SEQ ID NO: 6054636 - DNA, 12 bp, Homo sapiens
ccacagtgctgt

SEQ ID NO: 6054637 - DNA, 14 bp, Homo sapiens
ccacagtggagagg

SEQ ID NO: 6054638 - DNA, 20 bp, Homo sapiens
ccacagtggcgggcccactc

SEQ ID NO: 6054639 - DNA, 19 bp, Homo sapiens
ccacagtggggctgcaggc

SEQ ID NO: 6054640 - DNA, 20 bp, Homo sapiens
ccacagtggggctgcaggca

SEQ ID NO: 6054641 - DNA, 14 bp, Homo sapiens
ccacagtgggtggc

SEQ ID NO: 6054642 - DNA, 19 bp, Homo sapiens
ccacagtgtcactggtcag

SEQ ID NO: 6054643 - DNA, 13 bp, Homo sapiens
ccacagtgtcagg

SEQ ID NO: 6054644 - DNA, 21 bp, Homo sapiens
ccacagtgtgaagacactgtg

SEQ ID NO: 6054645 - DNA, 23 bp, Homo sapiens
ccacagtgttgtgccccttcact

SEQ ID NO: 6054646 - DNA, 19 bp, Homo sapiens
ccacagttattaattaaag

SEQ ID NO: 6054647 - DNA, 20 bp, Homo sapiens
ccacagtttcctcatctgtc

SEQ ID NO: 6054648 - DNA, 22 bp, Homo sapiens
ccacagtttgagaccagcctgg

SEQ ID NO: 6054649 - DNA, 13 bp, Homo sapiens
ccacagttttaat

SEQ ID NO: 6054650 - DNA, 24 bp, Homo sapiens
ccacagttttagttggtgctgatg

SEQ ID NO: 6054651 - DNA, 16 bp, Homo sapiens
ccacataaaagcccca

SEQ ID NO: 6054652 - DNA, 17 bp, Homo sapiens
ccacataaaagccccag

SEQ ID NO: 6054653 - DNA, 19 bp, Homo sapiens
ccacataaaagccccagct

SEQ ID NO: 6054654 - DNA, 11 bp, Homo sapiens
ccacataaagg

SEQ ID NO: 6054655 - DNA, 16 bp, Homo sapiens
ccacataaattttaat

SEQ ID NO: 6054656 - DNA, 20 bp, Homo sapiens
ccacataaattttaattcaa

SEQ ID NO: 6054657 - DNA, 14 bp, Homo sapiens
cccatgtgagctgc

SEQ ID NO: 6054658 - DNA, 22 bp, Homo sapiens
cccatgtgagctgctgccatga

SEQ ID NO: 6054659 - DNA, 12 bp, Homo sapiens
cccatgtgcctg

SEQ ID NO: 6054660 - DNA, 13 bp, Homo sapiens
cccatgtgcctgt

SEQ ID NO: 6054661 - DNA, 16 bp, Homo sapiens
cccatgtgcctgtcac

SEQ ID NO: 6054662 - DNA, 23 bp, Homo sapiens
cccatgtgctgggaaatgcagaa

SEQ ID NO: 6054663 - DNA, 16 bp, Homo sapiens
cccatgtggcagccca

SEQ ID NO: 6054664 - DNA, 17 bp, Homo sapiens
cccatgtggctgaagac

SEQ ID NO: 6054665 - DNA, 22 bp, Homo sapiens
cccatgtgggcgcccaccctgg

SEQ ID NO: 6054666 - DNA, 23 bp, Homo sapiens
cccatgtggtgatgatgtgtata

SEQ ID NO: 6054667 - DNA, 17 bp, Homo sapiens
cccatgtgtacattctg

SEQ ID NO: 6054668 - DNA, 21 bp, Homo sapiens
cccatgtgtacattctgccta

SEQ ID NO: 6054669 - DNA, 17 bp, Homo sapiens
cccatgtgtcccctcac

SEQ ID NO: 6054670 - DNA, 20 bp, Homo sapiens
cccatgtgtcccctcactct

SEQ ID NO: 6054671 - DNA, 23 bp, Homo sapiens
cccatgtgtcgcctctcactctg

SEQ ID NO: 6054672 - DNA, 20 bp, Homo sapiens
cccatgtgtgactccagcct

SEQ ID NO: 6054673 - DNA, 16 bp, Homo sapiens
cccatgtgtgatgctg

SEQ ID NO: 6054674 - DNA, 19 bp, Homo sapiens
cccatgtgtgatgctgaca

SEQ ID NO: 6054675 - DNA, 23 bp, Homo sapiens
cccatgttagctacacagtgcag

SEQ ID NO: 6054676 - DNA, 21 bp, Homo sapiens
cccatgttctgcccccagccc

SEQ ID NO: 6054677 - DNA, 17 bp, Homo sapiens
cccatgttgagacctca

SEQ ID NO: 6054678 - DNA, 18 bp, Homo sapiens
cccatgttgggaaaaact

SEQ ID NO: 6054679 - DNA, 16 bp, Homo sapiens
cccattaatcttgatc

SEQ ID NO: 6054680 - DNA, 21 bp, Homo sapiens
cccattaatcttgatcattcc

SEQ ID NO: 6054681 - DNA, 22 bp, Homo sapiens
cccattagttgagaaagtcaca

SEQ ID NO: 6054682 - DNA, 21 bp, Homo sapiens
cccattatattgttttctcct

SEQ ID NO: 6054683 - DNA, 12 bp, Homo sapiens
cccattattcaa

SEQ ID NO: 6054684 - DNA, 15 bp, Homo sapiens
cccattcaagattcc

SEQ ID NO: 6054685 - DNA, 18 bp, Homo sapiens
cccattcacagagccttt

SEQ ID NO: 6054686 - DNA, 15 bp, Homo sapiens
cccattcacatgccc

SEQ ID NO: 6054687 - DNA, 22 bp, Homo sapiens
cccattcacttctgcattcctg

SEQ ID NO: 6054688 - DNA, 17 bp, Homo sapiens
cccattcagacacttca

SEQ ID NO: 6054689 - DNA, 12 bp, Homo sapiens
cccattcagtga

SEQ ID NO: 6054690 - DNA, 15 bp, Homo sapiens
cccattcatactaaa

SEQ ID NO: 6054691 - DNA, 22 bp, Homo sapiens
cccattcattccattctggaag

SEQ ID NO: 6054692 - DNA, 18 bp, Homo sapiens
cccattccaaagctttat

SEQ ID NO: 6054693 - DNA, 13 bp, Homo sapiens
cccattccagctc

SEQ ID NO: 6054694 - DNA, 20 bp, Homo sapiens
cccattccaggcagcctctg

SEQ ID NO: 6054695 - DNA, 12 bp, Homo sapiens
cccattcccagc

SEQ ID NO: 6054696 - DNA, 14 bp, Homo sapiens
cccattccccagcc

SEQ ID NO: 6054697 - DNA, 21 bp, Homo sapiens
cccattcccccatgtggctga

SEQ ID NO: 6054698 - DNA, 18 bp, Homo sapiens
cccattcccgcagtggga

SEQ ID NO: 6054699 - DNA, 13 bp, Homo sapiens
cccattcctaaga

SEQ ID NO: 6054700 - DNA, 14 bp, Homo sapiens
cccattcctcacct

SEQ ID NO: 6054701 - DNA, 19 bp, Homo sapiens
cccattcctccactctgta

SEQ ID NO: 6054702 - DNA, 13 bp, Homo sapiens
cccattcctccct

SEQ ID NO: 6054703 - DNA, 14 bp, Homo sapiens
cccattcctccctc

SEQ ID NO: 6054704 - DNA, 13 bp, Homo sapiens
cccattcctgaag

SEQ ID NO: 6054705 - DNA, 12 bp, Homo sapiens
cccattcctgcc

SEQ ID NO: 6054706 - DNA, 16 bp, Homo sapiens
cccattcctgcctggt

SEQ ID NO: 6054707 - DNA, 17 bp, Homo sapiens
cccattcgcgctctgct

SEQ ID NO: 6054708 - DNA, 16 bp, Homo sapiens
cccattcggactgctg

SEQ ID NO: 6054709 - DNA, 21 bp, Homo sapiens
cccattcggtgtggtgcagtg

SEQ ID NO: 6054710 - DNA, 18 bp, Homo sapiens
cccattctacacagagca

SEQ ID NO: 6054711 - DNA, 17 bp, Homo sapiens
cccattctacttgctct

SEQ ID NO: 6054712 - DNA, 22 bp, Homo sapiens
cccattctacttgctctggacc

SEQ ID NO: 6054713 - DNA, 21 bp, Homo sapiens
cccattctagatcctgcaccc

SEQ ID NO: 6054714 - DNA, 19 bp, Homo sapiens
cccattctataaattcaac

SEQ ID NO: 6054715 - DNA, 22 bp, Homo sapiens
cccattctcatatgtagccctc

SEQ ID NO: 6054716 - DNA, 23 bp, Homo sapiens
cccattctcatatgtagccctca

SEQ ID NO: 6054717 - DNA, 16 bp, Homo sapiens
cccattctcatctgca

SEQ ID NO: 6054718 - DNA, 13 bp, Homo sapiens
cccattctcatgt

SEQ ID NO: 6054719 - DNA, 14 bp, Homo sapiens
cccattctcccagt

SEQ ID NO: 6054720 - DNA, 17 bp, Homo sapiens
cccattctctctcctgt

SEQ ID NO: 6054721 - DNA, 18 bp, Homo sapiens
cccattctgcatgccctc

SEQ ID NO: 6054722 - DNA, 21 bp, Homo sapiens
cccattctgcctccattctga

SEQ ID NO: 6054723 - DNA, 14 bp, Homo sapiens
cccattctgcctgc

SEQ ID NO: 6054724 - DNA, 19 bp, Homo sapiens
cccattctgcctgcccagg

SEQ ID NO: 6054725 - DNA, 21 bp, Homo sapiens
cccattctgcctgcccaggcc

SEQ ID NO: 6054726 - DNA, 23 bp, Homo sapiens
cccattctgcctgcccaggcccc

SEQ ID NO: 6054727 - DNA, 12 bp, Homo sapiens
cccattctgtcc

SEQ ID NO: 6054728 - DNA, 12 bp, Homo sapiens
cccattcttcct

SEQ ID NO: 6054729 - DNA, 14 bp, Homo sapiens
cccattcttctggg

SEQ ID NO: 6054730 - DNA, 18 bp, Homo sapiens
cccattcttttcacttcc

SEQ ID NO: 6054731 - DNA, 14 bp, Homo sapiens
cccattcttttgta

SEQ ID NO: 6054732 - DNA, 21 bp, Homo sapiens
cccattcttttgtaatttaaa

SEQ ID NO: 6054733 - DNA, 21 bp, Homo sapiens
cccattgacttgcacatctct

SEQ ID NO: 6054734 - DNA, 22 bp, Homo sapiens
cccattgagatcttcctgctga

SEQ ID NO: 6054735 - DNA, 15 bp, Homo sapiens
cccattgcccagtga

SEQ ID NO: 6054736 - DNA, 18 bp, Homo sapiens
cccattgcccagtgagcc

SEQ ID NO: 6054737 - DNA, 14 bp, Homo sapiens
cccattgccctggt

SEQ ID NO: 6054738 - DNA, 14 bp, Homo sapiens
cccattgcctcctc

SEQ ID NO: 6054739 - DNA, 17 bp, Homo sapiens
cccattgcctcctcctt

SEQ ID NO: 6054740 - DNA, 13 bp, Homo sapiens
cccattgctgcca

SEQ ID NO: 6054741 - DNA, 12 bp, Homo sapiens
cccattgctgtt

SEQ ID NO: 6054742 - DNA, 14 bp, Homo sapiens
cccattggccgagc

SEQ ID NO: 6054743 - DNA, 17 bp, Homo sapiens
cccattggccgagctcc

SEQ ID NO: 6054744 - DNA, 12 bp, Homo sapiens
cccattggcttt

SEQ ID NO: 6054745 - DNA, 21 bp, Homo sapiens
cccattggtgttgtcattgta

SEQ ID NO: 6054746 - DNA, 21 bp, Homo sapiens
cccattgtatttaaaacattt

SEQ ID NO: 6054747 - DNA, 16 bp, Homo sapiens
cccattgtctcattgc

SEQ ID NO: 6054748 - DNA, 18 bp, Homo sapiens
cccattgtgaatgttgtc

SEQ ID NO: 6054749 - DNA, 22 bp, Homo sapiens
cccattgtggtcacaggaagta

SEQ ID NO: 6054750 - DNA, 17 bp, Homo sapiens
cccattgttcccttcct

SEQ ID NO: 6054751 - DNA, 20 bp, Homo sapiens
cccatttaaatttttttcct

SEQ ID NO: 6054752 - DNA, 12 bp, Homo sapiens
cccatttagaat

SEQ ID NO: 6054753 - DNA, 20 bp, Homo sapiens
cccatttagaggatgtggct

SEQ ID NO: 6054754 - DNA, 19 bp, Homo sapiens
cccatttatccacctccat

SEQ ID NO: 6054755 - DNA, 17 bp, Homo sapiens
cccatttattattttaa

SEQ ID NO: 6054756 - DNA, 23 bp, Homo sapiens
cccatttattattttaatattta

SEQ ID NO: 6054757 - DNA, 16 bp, Homo sapiens
cccatttcacacaact

SEQ ID NO: 6054758 - DNA, 13 bp, Homo sapiens
cccatttcaggaa

SEQ ID NO: 6054759 - DNA, 15 bp, Homo sapiens
cccatttcaggaggt

SEQ ID NO: 6054760 - DNA, 14 bp, Homo sapiens
cccatttcccatct

SEQ ID NO: 6054761 - DNA, 18 bp, Homo sapiens
cccatttcctcacactaa

SEQ ID NO: 6054762 - DNA, 14 bp, Homo sapiens
cccatttcctcttc

SEQ ID NO: 6054763 - DNA, 16 bp, Homo sapiens
cccatttcctcttcct

SEQ ID NO: 6054764 - DNA, 17 bp, Homo sapiens
cccatttcctcttcctt

SEQ ID NO: 6054765 - DNA, 21 bp, Homo sapiens
cccatttcctcttccttctct

SEQ ID NO: 6054766 - DNA, 12 bp, Homo sapiens
cccatttcctga

SEQ ID NO: 6054767 - DNA, 11 bp, Homo sapiens
cccatttcctt

SEQ ID NO: 6054768 - DNA, 20 bp, Homo sapiens
cccatttcgtgagccccatc

SEQ ID NO: 6054769 - DNA, 18 bp, Homo sapiens
cccatttctaaaggcctc

SEQ ID NO: 6054770 - DNA, 16 bp, Homo sapiens
cccatttctatttatt

SEQ ID NO: 6054771 - DNA, 20 bp, Homo sapiens
cccatttctatttatttact

SEQ ID NO: 6054772 - DNA, 17 bp, Homo sapiens
cccatttctccagaacc

SEQ ID NO: 6054773 - DNA, 18 bp, Homo sapiens
cccatttctccagaaccc

SEQ ID NO: 6054774 - DNA, 13 bp, Homo sapiens
cccatttctgagg

SEQ ID NO: 6054775 - DNA, 17 bp, Homo sapiens
cccatttctgcctcgct

SEQ ID NO: 6054776 - DNA, 19 bp, Homo sapiens
cccatttggagggcctggg

SEQ ID NO: 6054777 - DNA, 20 bp, Homo sapiens
cccatttgggcagagaggct

SEQ ID NO: 6054778 - DNA, 13 bp, Homo sapiens
cccatttgtccca

SEQ ID NO: 6054779 - DNA, 15 bp, Homo sapiens
cccatttgtcccaga

SEQ ID NO: 6054780 - DNA, 16 bp, Homo sapiens
cccatttgtgccagag

SEQ ID NO: 6054781 - DNA, 20 bp, Homo sapiens
cccatttgttgctgctgctg

SEQ ID NO: 6054782 - DNA, 12 bp, Homo sapiens
cccattttaact

SEQ ID NO: 6054783 - DNA, 20 bp, Homo sapiens
cccattttagtcactttttt

SEQ ID NO: 6054784 - DNA, 16 bp, Homo sapiens
cccattttataccaaa

SEQ ID NO: 6054785 - DNA, 19 bp, Homo sapiens
cccattttcaactgctttg

SEQ ID NO: 6054786 - DNA, 14 bp, Homo sapiens
cccattttcccctt

SEQ ID NO: 6054787 - DNA, 17 bp, Homo sapiens
cccattttgagtgactc

SEQ ID NO: 6054788 - DNA, 18 bp, Homo sapiens
cccattttgagtgactcg

SEQ ID NO: 6054789 - DNA, 13 bp, Homo sapiens
cccatttttactt

SEQ ID NO: 6054790 - DNA, 12 bp, Homo sapiens
cccatttttcct

SEQ ID NO: 6054791 - DNA, 16 bp, Homo sapiens
cccatttttgagccaa

SEQ ID NO: 6054792 - DNA, 18 bp, Homo sapiens
ccccaaaacaaagtcttt

SEQ ID NO: 6054793 - DNA, 16 bp, Homo sapiens
ccccaaaaccacagcc

SEQ ID NO: 6054794 - DNA, 20 bp, Homo sapiens
ccccaaaaccacagccctgt

SEQ ID NO: 6054795 - DNA, 23 bp, Homo sapiens
ccccaaaaccacagccctgtcag

SEQ ID NO: 6054796 - DNA, 14 bp, Homo sapiens
ccccaaaacccggg

SEQ ID NO: 6054797 - DNA, 20 bp, Homo sapiens
ccccaaaactctcctctgct

SEQ ID NO: 6054798 - DNA, 23 bp, Homo sapiens
ccccaaaactctcctctgctgct

SEQ ID NO: 6054799 - DNA, 19 bp, Homo sapiens
ccccaaaagcgtgagctta

SEQ ID NO: 6054800 - DNA, 13 bp, Homo sapiens
ccccaaaatccaa

SEQ ID NO: 6054801 - DNA, 21 bp, Homo sapiens
ccccaaaatccaaaacttctc

SEQ ID NO: 6054802 - DNA, 17 bp, Homo sapiens
ccccaaacaactcagct

SEQ ID NO: 6054803 - DNA, 23 bp, Homo sapiens
ccccaaacacaaaacattcatgt

SEQ ID NO: 6054804 - DNA, 18 bp, Homo sapiens
ccccaaacaccttccagc

SEQ ID NO: 6054805 - DNA, 19 bp, Homo sapiens
ccccaaacagcatgtgctc

SEQ ID NO: 6054806 - DNA, 20 bp, Homo sapiens
ccccaaacagcatgtgctca

SEQ ID NO: 6054807 - DNA, 17 bp, Homo sapiens
ccccaaacaggacagca

SEQ ID NO: 6054808 - DNA, 16 bp, Homo sapiens
ccccaaaccagggtgc

SEQ ID NO: 6054809 - DNA, 16 bp, Homo sapiens
ccccaaacccagaaag

SEQ ID NO: 6054810 - DNA, 12 bp, Homo sapiens
ccccaaaccctg

SEQ ID NO: 6054811 - DNA, 15 bp, Homo sapiens
ccccaaacttcttgt

SEQ ID NO: 6054812 - DNA, 19 bp, Homo sapiens
ccccaaagactctggaggt

SEQ ID NO: 6054813 - DNA, 13 bp, Homo sapiens
ccccaaagagagc

SEQ ID NO: 6054814 - DNA, 19 bp, Homo sapiens
ccccaaagagcctggagaa

SEQ ID NO: 6054815 - DNA, 22 bp, Homo sapiens
ccccaaagagcctggagaagct

SEQ ID NO: 6054816 - DNA, 17 bp, Homo sapiens
ccccaaagagctgtggc

SEQ ID NO: 6054817 - DNA, 22 bp, Homo sapiens
ccccaaagatagacaggtcctg

SEQ ID NO: 6054818 - DNA, 17 bp, Homo sapiens
ccccaaagcagcccttc

SEQ ID NO: 6054819 - DNA, 19 bp, Homo sapiens
ccccaaagccactggaagg

SEQ ID NO: 6054820 - DNA, 17 bp, Homo sapiens
ccccaaagcccagcccg

SEQ ID NO: 6054821 - DNA, 18 bp, Homo sapiens
ccccaaagctttcctgcc

SEQ ID NO: 6054822 - DNA, 19 bp, Homo sapiens
ccccaaaggaaaaagcaca

SEQ ID NO: 6054823 - DNA, 17 bp, Homo sapiens
ccccaaaggaacactga

SEQ ID NO: 6054824 - DNA, 23 bp, Homo sapiens
ccccaaaggaagctttctctgct

SEQ ID NO: 6054825 - DNA, 20 bp, Homo sapiens
ccccaaaggacgcctgcagg

SEQ ID NO: 6054826 - DNA, 22 bp, Homo sapiens
ccccaaaggacgcctgcaggag

SEQ ID NO: 6054827 - DNA, 23 bp, Homo sapiens
ccccaaaggacgcctgcaggaga

SEQ ID NO: 6054828 - DNA, 18 bp, Homo sapiens
ccccaaataagaagggat

SEQ ID NO: 6054829 - DNA, 14 bp, Homo sapiens
ccccaaatcccaca

SEQ ID NO: 6054830 - DNA, 21 bp, Homo sapiens
ccccaaatctactgagccacg

SEQ ID NO: 6054831 - DNA, 23 bp, Homo sapiens
ccccaaatctactgagccacgga

SEQ ID NO: 6054832 - DNA, 17 bp, Homo sapiens
ccccaaattgccttcag

SEQ ID NO: 6054833 - DNA, 18 bp, Homo sapiens
ccccaaattgccttcagc

SEQ ID NO: 6054834 - DNA, 19 bp, Homo sapiens
ccccaacacctgctgcgct

SEQ ID NO: 6054835 - DNA, 16 bp, Homo sapiens
ccacataaccctgtca

SEQ ID NO: 6054836 - DNA, 20 bp, Homo sapiens
ccacataagaaggcaatttt

SEQ ID NO: 6054837 - DNA, 20 bp, Homo sapiens
ccacataatttttgtacatc

SEQ ID NO: 6054838 - DNA, 19 bp, Homo sapiens
ccacatacaacacaaagag

SEQ ID NO: 6054839 - DNA, 22 bp, Homo sapiens
ccacataccaggcaacctccca

SEQ ID NO: 6054840 - DNA, 15 bp, Homo sapiens
ccacataccctgacc

SEQ ID NO: 6054841 - DNA, 18 bp, Homo sapiens
ccacatacgcagggggaa

SEQ ID NO: 6054842 - DNA, 23 bp, Homo sapiens
ccacatagactttatgcaataaa

SEQ ID NO: 6054843 - DNA, 16 bp, Homo sapiens
ccacataggaaaatgc

SEQ ID NO: 6054844 - DNA, 19 bp, Homo sapiens
ccacatagtgatggttccc

SEQ ID NO: 6054845 - DNA, 21 bp, Homo sapiens
ccacatagtgatggttcccct

SEQ ID NO: 6054846 - DNA, 14 bp, Homo sapiens
ccacatcaaagagg

SEQ ID NO: 6054847 - DNA, 16 bp, Homo sapiens
ccacatcaaataagaa

SEQ ID NO: 6054848 - DNA, 19 bp, Homo sapiens
ccacatcactattgggccc

SEQ ID NO: 6054849 - DNA, 14 bp, Homo sapiens
ccacatcagcccca

SEQ ID NO: 6054850 - DNA, 13 bp, Homo sapiens
ccacatcagggcg

SEQ ID NO: 6054851 - DNA, 22 bp, Homo sapiens
ccacatcagggcggcctcccag

SEQ ID NO: 6054852 - DNA, 21 bp, Homo sapiens
ccacatcatctttatctcctg

SEQ ID NO: 6054853 - DNA, 16 bp, Homo sapiens
ccacatcattctgtgt

SEQ ID NO: 6054854 - DNA, 13 bp, Homo sapiens
ccacatccaaaca

SEQ ID NO: 6054855 - DNA, 20 bp, Homo sapiens
ccacatccacacacgcagga

SEQ ID NO: 6054856 - DNA, 23 bp, Homo sapiens
ccacatccattccagagctgcag

SEQ ID NO: 6054857 - DNA, 12 bp, Homo sapiens
ccacatcccagc

SEQ ID NO: 6054858 - DNA, 18 bp, Homo sapiens
ccacatcccagcagccca

SEQ ID NO: 6054859 - DNA, 13 bp, Homo sapiens
ccacatcccaggc

SEQ ID NO: 6054860 - DNA, 18 bp, Homo sapiens
ccacatcccaggcttcac

SEQ ID NO: 6054861 - DNA, 19 bp, Homo sapiens
ccacatcccagtcacagtg

SEQ ID NO: 6054862 - DNA, 17 bp, Homo sapiens
ccacatcccatgttgaa

SEQ ID NO: 6054863 - DNA, 22 bp, Homo sapiens
ccacatccccaataaagccgcg

SEQ ID NO: 6054864 - DNA, 21 bp, Homo sapiens
ccacatccccaccctcccctc

SEQ ID NO: 6054865 - DNA, 22 bp, Homo sapiens
ccacatccccaccctcccctct

SEQ ID NO: 6054866 - DNA, 18 bp, Homo sapiens
ccacatccccaccttcca

SEQ ID NO: 6054867 - DNA, 17 bp, Homo sapiens
ccacatccccagagccc

SEQ ID NO: 6054868 - DNA, 18 bp, Homo sapiens
ccacatccccagagccca

SEQ ID NO: 6054869 - DNA, 20 bp, Homo sapiens
ccacatccccagagcccagc

SEQ ID NO: 6054870 - DNA, 21 bp, Homo sapiens
ccacatccccgctggctgggg

SEQ ID NO: 6054871 - DNA, 20 bp, Homo sapiens
ccacatcccgggacgcagca

SEQ ID NO: 6054872 - DNA, 10 bp, Homo sapiens
ccacatccct

SEQ ID NO: 6054873 - DNA, 21 bp, Homo sapiens
ccacatccctctctgctggac

SEQ ID NO: 6054874 - DNA, 16 bp, Homo sapiens
ccacatccctgggcct

SEQ ID NO: 6054875 - DNA, 21 bp, Homo sapiens
ccacatccctgggcctgctgc

SEQ ID NO: 6054876 - DNA, 17 bp, Homo sapiens
ccacatccctttgaaac

SEQ ID NO: 6054877 - DNA, 16 bp, Homo sapiens
ccacatcctcatggcc

SEQ ID NO: 6054878 - DNA, 20 bp, Homo sapiens
ccacatcctccgtccagccg

SEQ ID NO: 6054879 - DNA, 13 bp, Homo sapiens
ccacatcctgtgg

SEQ ID NO: 6054880 - DNA, 15 bp, Homo sapiens
ccacatcgcacactg

SEQ ID NO: 6054881 - DNA, 15 bp, Homo sapiens
ccacatctaagcctg

SEQ ID NO: 6054882 - DNA, 22 bp, Homo sapiens
ccacatctaagcctgaaggggc

SEQ ID NO: 6054883 - DNA, 23 bp, Homo sapiens
ccacatctaagcctgaaggggcg

SEQ ID NO: 6054884 - DNA, 14 bp, Homo sapiens
ccacatctacgttt

SEQ ID NO: 6054885 - DNA, 14 bp, Homo sapiens
ccacatctgcatca

SEQ ID NO: 6054886 - DNA, 16 bp, Homo sapiens
ccacatctgccagacc

SEQ ID NO: 6054887 - DNA, 12 bp, Homo sapiens
ccacatctgtcc

SEQ ID NO: 6054888 - DNA, 13 bp, Homo sapiens
ccacatctgtcct

SEQ ID NO: 6054889 - DNA, 19 bp, Homo sapiens
ccacatctgtcctcaccct

SEQ ID NO: 6054890 - DNA, 20 bp, Homo sapiens
ccacatctgtcctcaccctg

SEQ ID NO: 6054891 - DNA, 14 bp, Homo sapiens
ccacatctgtgtct

SEQ ID NO: 6054892 - DNA, 17 bp, Homo sapiens
ccacatctgtgtctctg

SEQ ID NO: 6054893 - DNA, 15 bp, Homo sapiens
ccacatcttgaaaat

SEQ ID NO: 6054894 - DNA, 16 bp, Homo sapiens
ccacatcttgaaaatg

SEQ ID NO: 6054895 - DNA, 20 bp, Homo sapiens
ccacatcttgatctgctcag

SEQ ID NO: 6054896 - DNA, 22 bp, Homo sapiens
ccacatcttgctctgctgacag

SEQ ID NO: 6054897 - DNA, 23 bp, Homo sapiens
ccacatcttgctctgctgacaga

SEQ ID NO: 6054898 - DNA, 14 bp, Homo sapiens
ccacatgacctcca

SEQ ID NO: 6054899 - DNA, 20 bp, Homo sapiens
ccacatgaggccatctcagg

SEQ ID NO: 6054900 - DNA, 17 bp, Homo sapiens
ccacatgagtcccagtg

SEQ ID NO: 6054901 - DNA, 19 bp, Homo sapiens
ccacatgccaagcactgtg

SEQ ID NO: 6054902 - DNA, 22 bp, Homo sapiens
ccacatgccactgcctgcacct

SEQ ID NO: 6054903 - DNA, 16 bp, Homo sapiens
ccacatgccaggggcc

SEQ ID NO: 6054904 - DNA, 22 bp, Homo sapiens
ccacatgccatttgtactgacc

SEQ ID NO: 6054905 - DNA, 14 bp, Homo sapiens
ccacatgccccatc

SEQ ID NO: 6054906 - DNA, 21 bp, Homo sapiens
ccacatgcctgcgcctgctgc

SEQ ID NO: 6054907 - DNA, 22 bp, Homo sapiens
ccacatgcctgcgcctgctgcc

SEQ ID NO: 6054908 - DNA, 16 bp, Homo sapiens
ccacatgcgctcctgg

SEQ ID NO: 6054909 - DNA, 18 bp, Homo sapiens
ccacatgcgctcctggct

SEQ ID NO: 6054910 - DNA, 17 bp, Homo sapiens
ccacatgcggagaacaa

SEQ ID NO: 6054911 - DNA, 17 bp, Homo sapiens
ccacatgcggctcgggc

SEQ ID NO: 6054912 - DNA, 16 bp, Homo sapiens
ccacatgctgcctggc

SEQ ID NO: 6054913 - DNA, 17 bp, Homo sapiens
ccacatgctgcctggca

SEQ ID NO: 6054914 - DNA, 18 bp, Homo sapiens
ccacatgctgcctggcac

SEQ ID NO: 6054915 - DNA, 20 bp, Homo sapiens
ccacatggaacttaaaacat

SEQ ID NO: 6054916 - DNA, 17 bp, Homo sapiens
ccacatggccgctgccc

SEQ ID NO: 6054917 - DNA, 18 bp, Homo sapiens
ccacatggcggagagttt

SEQ ID NO: 6054918 - DNA, 21 bp, Homo sapiens
ccacatggcttcctcctgcgc

SEQ ID NO: 6054919 - DNA, 17 bp, Homo sapiens
ccacatgggagcagtcc

SEQ ID NO: 6054920 - DNA, 18 bp, Homo sapiens
ccacatgggagcagtcca

SEQ ID NO: 6054921 - DNA, 19 bp, Homo sapiens
ccacatggggctgggcagc

SEQ ID NO: 6054922 - DNA, 20 bp, Homo sapiens
ccacatggggctgggcagct

SEQ ID NO: 6054923 - DNA, 21 bp, Homo sapiens
ccacatggggctgggcagcta

SEQ ID NO: 6054924 - DNA, 19 bp, Homo sapiens
ccacatgggtactgtctcg

SEQ ID NO: 6054925 - DNA, 17 bp, Homo sapiens
ccacatggtgtctccca

SEQ ID NO: 6054926 - DNA, 18 bp, Homo sapiens
ccacatggtgtctcccaa

SEQ ID NO: 6054927 - DNA, 21 bp, Homo sapiens
ccacatggtgtggccatcact

SEQ ID NO: 6054928 - DNA, 13 bp, Homo sapiens
ccacatgtcccag

SEQ ID NO: 6054929 - DNA, 14 bp, Homo sapiens
ccacatgtcccaga

SEQ ID NO: 6054930 - DNA, 20 bp, Homo sapiens
ccacatgtggggacagggct

SEQ ID NO: 6054931 - DNA, 22 bp, Homo sapiens
ccacatgttactggataaattg

SEQ ID NO: 6054932 - DNA, 14 bp, Homo sapiens
ccacattaaagaag

SEQ ID NO: 6054933 - DNA, 18 bp, Homo sapiens
ccacattaattagatttt

SEQ ID NO: 6054934 - DNA, 23 bp, Homo sapiens
ccacattagtgttctttatatac

SEQ ID NO: 6054935 - DNA, 21 bp, Homo sapiens
ccacattcggaccctgcccat

SEQ ID NO: 6054936 - DNA, 19 bp, Homo sapiens
ccacattctatagccataa

SEQ ID NO: 6054937 - DNA, 16 bp, Homo sapiens
ccacattctggctcca

SEQ ID NO: 6054938 - DNA, 14 bp, Homo sapiens
ccacattcttcagt

SEQ ID NO: 6054939 - DNA, 15 bp, Homo sapiens
ccacattgcctcatt

SEQ ID NO: 6054940 - DNA, 22 bp, Homo sapiens
ccacattgcctcatttcttcct

SEQ ID NO: 6054941 - DNA, 16 bp, Homo sapiens
ccacattgctggctgc

SEQ ID NO: 6054942 - DNA, 18 bp, Homo sapiens
ccacattggacttccttg

SEQ ID NO: 6054943 - DNA, 16 bp, Homo sapiens
ccacattgttttaaaa

SEQ ID NO: 6054944 - DNA, 13 bp, Homo sapiens
ccacatttacata

SEQ ID NO: 6054945 - DNA, 15 bp, Homo sapiens
ccacatttagtatcc

SEQ ID NO: 6054946 - DNA, 16 bp, Homo sapiens
ccacatttccatggtg

SEQ ID NO: 6054947 - DNA, 17 bp, Homo sapiens
ccacatttctaagcctt

SEQ ID NO: 6054948 - DNA, 12 bp, Homo sapiens
ccacatttgatg

SEQ ID NO: 6054949 - DNA, 23 bp, Homo sapiens
ccacatttgctgctacttttcct

SEQ ID NO: 6054950 - DNA, 18 bp, Homo sapiens
ccacatttgggctcaggg

SEQ ID NO: 6054951 - DNA, 16 bp, Homo sapiens
ccacatttgtcacaga

SEQ ID NO: 6054952 - DNA, 14 bp, Homo sapiens
ccacattttaggat

SEQ ID NO: 6054953 - DNA, 17 bp, Homo sapiens
ccacattttcaatccag

SEQ ID NO: 6054954 - DNA, 16 bp, Homo sapiens
ccacattttcagccaa

SEQ ID NO: 6054955 - DNA, 15 bp, Homo sapiens
ccacattttgcttta

SEQ ID NO: 6054956 - DNA, 16 bp, Homo sapiens
ccacattttgctttat

SEQ ID NO: 6054957 - DNA, 15 bp, Homo sapiens
ccaccaaaactgctc

SEQ ID NO: 6054958 - DNA, 16 bp, Homo sapiens
ccaccaaactgcacac

SEQ ID NO: 6054959 - DNA, 22 bp, Homo sapiens
ccaccaaactgcacacacagct

SEQ ID NO: 6054960 - DNA, 17 bp, Homo sapiens
ccaccaaatcatcctga

SEQ ID NO: 6054961 - DNA, 20 bp, Homo sapiens
ccaccaaatgcctctgcctt

SEQ ID NO: 6054962 - DNA, 14 bp, Homo sapiens
ccaccaacaaaatc

SEQ ID NO: 6054963 - DNA, 16 bp, Homo sapiens
ccaccaacacacagga

SEQ ID NO: 6054964 - DNA, 22 bp, Homo sapiens
ccaccaacacacaggaactctg

SEQ ID NO: 6054965 - DNA, 19 bp, Homo sapiens
ccaccaacataaaacaaaa

SEQ ID NO: 6054966 - DNA, 17 bp, Homo sapiens
ccaccaactctctctgc

SEQ ID NO: 6054967 - DNA, 18 bp, Homo sapiens
ccaccaactctctctgcc

SEQ ID NO: 6054968 - DNA, 13 bp, Homo sapiens
ccaccaactctgc

SEQ ID NO: 6054969 - DNA, 14 bp, Homo sapiens
ccaccaactcttgc

SEQ ID NO: 6054970 - DNA, 19 bp, Homo sapiens
ccaccaactggccctcttc

SEQ ID NO: 6054971 - DNA, 19 bp, Homo sapiens
ccaccaactttttccaagt

SEQ ID NO: 6054972 - DNA, 17 bp, Homo sapiens
ccaccaagacttgtttt

SEQ ID NO: 6054973 - DNA, 21 bp, Homo sapiens
ccaccaagagggacgcctggg

SEQ ID NO: 6054974 - DNA, 21 bp, Homo sapiens
ccaccaagcctggtcagccca

SEQ ID NO: 6054975 - DNA, 11 bp, Homo sapiens
ccaccaagggc

SEQ ID NO: 6054976 - DNA, 14 bp, Homo sapiens
ccaccaagggcctc

SEQ ID NO: 6054977 - DNA, 23 bp, Homo sapiens
ccaccaagggtatctgctgcctc

SEQ ID NO: 6054978 - DNA, 18 bp, Homo sapiens
ccaccaaggtctcacact

SEQ ID NO: 6054979 - DNA, 22 bp, Homo sapiens
ccaccaagtctaaaaagacctg

SEQ ID NO: 6054980 - DNA, 12 bp, Homo sapiens
ccaccaataaaa

SEQ ID NO: 6054981 - DNA, 13 bp, Homo sapiens
ccaccaataaaaa

SEQ ID NO: 6054982 - DNA, 21 bp, Homo sapiens
ccaccaatatcatgtgtagat

SEQ ID NO: 6054983 - DNA, 12 bp, Homo sapiens
ccaccacacagt

SEQ ID NO: 6054984 - DNA, 14 bp, Homo sapiens
ccaccacacatccc

SEQ ID NO: 6054985 - DNA, 15 bp, Homo sapiens
ccaccacacatccca

SEQ ID NO: 6054986 - DNA, 14 bp, Homo sapiens
ccaccacacccagc

SEQ ID NO: 6054987 - DNA, 15 bp, Homo sapiens
ccaccacacccctgc

SEQ ID NO: 6054988 - DNA, 18 bp, Homo sapiens
ccaccacacccctgccgg

SEQ ID NO: 6054989 - DNA, 17 bp, Homo sapiens
ccaccacaccgcagaag

SEQ ID NO: 6054990 - DNA, 12 bp, Homo sapiens
ccaccacacctg

SEQ ID NO: 6054991 - DNA, 14 bp, Homo sapiens
ccaccacactcagc

SEQ ID NO: 6054992 - DNA, 15 bp, Homo sapiens
ccaccacagccagca

SEQ ID NO: 6054993 - DNA, 20 bp, Homo sapiens
ccaccacagccagcacctgg

SEQ ID NO: 6054994 - DNA, 14 bp, Homo sapiens
ccaccacagcttat

SEQ ID NO: 6054995 - DNA, 23 bp, Homo sapiens
ccaccacagcttatggcatctca

SEQ ID NO: 6054996 - DNA, 20 bp, Homo sapiens
ccaccacatctgccagacct

SEQ ID NO: 6054997 - DNA, 16 bp, Homo sapiens
ccaccaccacgcctgg

SEQ ID NO: 6054998 - DNA, 15 bp, Homo sapiens
ccaccaccactggcc

SEQ ID NO: 6054999 - DNA, 15 bp, Homo sapiens
ccaccaccagtgaga

SEQ ID NO: 6055000 - DNA, 16 bp, Homo sapiens
ccaccaccattctcct

SEQ ID NO: 6055001 - DNA, 14 bp, Homo sapiens
ccaccacccaacct

SEQ ID NO: 6055002 - DNA, 18 bp, Homo sapiens
ccaccacccccatcatca

SEQ ID NO: 6055003 - DNA, 13 bp, Homo sapiens
ccaccacccctac

SEQ ID NO: 6055004 - DNA, 20 bp, Homo sapiens
ccaccacccctccctctgct

SEQ ID NO: 6055005 - DNA, 21 bp, Homo sapiens
ccaccacccctccctctgctc

SEQ ID NO: 6055006 - DNA, 22 bp, Homo sapiens
ccaccacccctccctctgctct

SEQ ID NO: 6055007 - DNA, 15 bp, Homo sapiens
ccaccaccctcccac

SEQ ID NO: 6055008 - DNA, 14 bp, Homo sapiens
ccaccaccctgccc

SEQ ID NO: 6055009 - DNA, 21 bp, Homo sapiens
ccaccaccctgccccccctaa

SEQ ID NO: 6055010 - DNA, 13 bp, Homo sapiens
ccaccaccctggc

SEQ ID NO: 6055011 - DNA, 17 bp, Homo sapiens
ccaccaccctgtcttcc

SEQ ID NO: 6055012 - DNA, 18 bp, Homo sapiens
ccaccaccctgtcttcct

SEQ ID NO: 6055013 - DNA, 14 bp, Homo sapiens
ccccaacactccag

SEQ ID NO: 6055014 - DNA, 14 bp, Homo sapiens
ccccaacactgagc

SEQ ID NO: 6055015 - DNA, 18 bp, Homo sapiens
ccccaacactgtgccctg

SEQ ID NO: 6055016 - DNA, 21 bp, Homo sapiens
ccccaacactgtgccctggtg

SEQ ID NO: 6055017 - DNA, 20 bp, Homo sapiens
ccccaacagcgacatagccc

SEQ ID NO: 6055018 - DNA, 22 bp, Homo sapiens
ccccaacagcgacatagcccat

SEQ ID NO: 6055019 - DNA, 14 bp, Homo sapiens
ccccaacagcgccc

SEQ ID NO: 6055020 - DNA, 17 bp, Homo sapiens
ccccaacagcgcccaaa

SEQ ID NO: 6055021 - DNA, 13 bp, Homo sapiens
ccccaacagctgg

SEQ ID NO: 6055022 - DNA, 12 bp, Homo sapiens
ccccaacagtgt

SEQ ID NO: 6055023 - DNA, 22 bp, Homo sapiens
ccccaacatctccctcccacat

SEQ ID NO: 6055024 - DNA, 16 bp, Homo sapiens
ccccaacatgcactga

SEQ ID NO: 6055025 - DNA, 17 bp, Homo sapiens
ccccaaccaaggaagga

SEQ ID NO: 6055026 - DNA, 12 bp, Homo sapiens
ccccaaccactc

SEQ ID NO: 6055027 - DNA, 21 bp, Homo sapiens
ccccaaccatcttcactggct

SEQ ID NO: 6055028 - DNA, 18 bp, Homo sapiens
ccccaacccacctctggc

SEQ ID NO: 6055029 - DNA, 15 bp, Homo sapiens
ccccaacccccagag

SEQ ID NO: 6055030 - DNA, 23 bp, Homo sapiens
ccccaacccccagcacccgggct

SEQ ID NO: 6055031 - DNA, 15 bp, Homo sapiens
ccccaacccctcctc

SEQ ID NO: 6055032 - DNA, 16 bp, Homo sapiens
ccccaacccctcctcc

SEQ ID NO: 6055033 - DNA, 21 bp, Homo sapiens
ccccaacccctcctccctcag

SEQ ID NO: 6055034 - DNA, 13 bp, Homo sapiens
ccccaacccctga

SEQ ID NO: 6055035 - DNA, 16 bp, Homo sapiens
ccccaacccggaaaca

SEQ ID NO: 6055036 - DNA, 13 bp, Homo sapiens
ccccaaccctgcc

SEQ ID NO: 6055037 - DNA, 21 bp, Homo sapiens
ccccaacccttcttcatgttc

SEQ ID NO: 6055038 - DNA, 15 bp, Homo sapiens
ccccaacctgcactc

SEQ ID NO: 6055039 - DNA, 19 bp, Homo sapiens
ccccaacctttccctcacc

SEQ ID NO: 6055040 - DNA, 19 bp, Homo sapiens
ccccaacgtcccctccgcc

SEQ ID NO: 6055041 - DNA, 16 bp, Homo sapiens
ccccaactcaggacag

SEQ ID NO: 6055042 - DNA, 19 bp, Homo sapiens
ccccaactccatggggttc

SEQ ID NO: 6055043 - DNA, 11 bp, Homo sapiens
ccccaactccc

SEQ ID NO: 6055044 - DNA, 13 bp, Homo sapiens
ccccaactcctgg

SEQ ID NO: 6055045 - DNA, 20 bp, Homo sapiens
ccccaactctccccagtgcc

SEQ ID NO: 6055046 - DNA, 16 bp, Homo sapiens
ccccaactctgagccc

SEQ ID NO: 6055047 - DNA, 17 bp, Homo sapiens
ccccaactcttcctccc

SEQ ID NO: 6055048 - DNA, 13 bp, Homo sapiens
ccccaactgctcc

SEQ ID NO: 6055049 - DNA, 16 bp, Homo sapiens
ccccaactgctccagc

SEQ ID NO: 6055050 - DNA, 23 bp, Homo sapiens
ccccaactgtggtagctccagcg

SEQ ID NO: 6055051 - DNA, 20 bp, Homo sapiens
ccccaagaaacctccatcct

SEQ ID NO: 6055052 - DNA, 16 bp, Homo sapiens
ccccaagaaggctggg

SEQ ID NO: 6055053 - DNA, 23 bp, Homo sapiens
ccccaagacctctatatttgctc

SEQ ID NO: 6055054 - DNA, 17 bp, Homo sapiens
ccccaagactcccatga

SEQ ID NO: 6055055 - DNA, 16 bp, Homo sapiens
ccccaagaggctagcc

SEQ ID NO: 6055056 - DNA, 17 bp, Homo sapiens
ccccaagaggctagccc

SEQ ID NO: 6055057 - DNA, 17 bp, Homo sapiens
ccccaagaggggcgggc

SEQ ID NO: 6055058 - DNA, 21 bp, Homo sapiens
ccccaagaggggcgggctcag

SEQ ID NO: 6055059 - DNA, 16 bp, Homo sapiens
ccccaagcagccagcc

SEQ ID NO: 6055060 - DNA, 19 bp, Homo sapiens
ccccaagcagccagccagt

SEQ ID NO: 6055061 - DNA, 22 bp, Homo sapiens
ccccaagccatggtgacacaca

SEQ ID NO: 6055062 - DNA, 20 bp, Homo sapiens
ccccaagccctgcccctcct

SEQ ID NO: 6055063 - DNA, 13 bp, Homo sapiens
ccccaagcctggc

SEQ ID NO: 6055064 - DNA, 13 bp, Homo sapiens
ccccaagctgggc

SEQ ID NO: 6055065 - DNA, 14 bp, Homo sapiens
ccccaagctgtttt

SEQ ID NO: 6055066 - DNA, 16 bp, Homo sapiens
ccccaagctgttttct

SEQ ID NO: 6055067 - DNA, 13 bp, Homo sapiens
ccccaagcttccc

SEQ ID NO: 6055068 - DNA, 19 bp, Homo sapiens
ccccaaggacccagccctc

SEQ ID NO: 6055069 - DNA, 18 bp, Homo sapiens
ccccaaggaggcagcctg

SEQ ID NO: 6055070 - DNA, 15 bp, Homo sapiens
ccccaaggagggaga

SEQ ID NO: 6055071 - DNA, 20 bp, Homo sapiens
ccccaaggatggggttcttg

SEQ ID NO: 6055072 - DNA, 18 bp, Homo sapiens
ccccaaggccccagggac

SEQ ID NO: 6055073 - DNA, 19 bp, Homo sapiens
ccccaaggccccagggaca

SEQ ID NO: 6055074 - DNA, 16 bp, Homo sapiens
ccccaaggcctctctc

SEQ ID NO: 6055075 - DNA, 17 bp, Homo sapiens
ccccaaggcctctctct

SEQ ID NO: 6055076 - DNA, 20 bp, Homo sapiens
ccccaaggcctctctctgcc

SEQ ID NO: 6055077 - DNA, 20 bp, Homo sapiens
ccccaaggctgcaaagcaaa

SEQ ID NO: 6055078 - DNA, 20 bp, Homo sapiens
ccccaagggaggctgctgct

SEQ ID NO: 6055079 - DNA, 22 bp, Homo sapiens
ccccaagggcaaaattcccagg

SEQ ID NO: 6055080 - DNA, 17 bp, Homo sapiens
ccccaagggcccagacc

SEQ ID NO: 6055081 - DNA, 18 bp, Homo sapiens
ccccaagggccctggcac

SEQ ID NO: 6055082 - DNA, 14 bp, Homo sapiens
ccccaagggctggg

SEQ ID NO: 6055083 - DNA, 22 bp, Homo sapiens
ccccaagggctggggcggagct

SEQ ID NO: 6055084 - DNA, 18 bp, Homo sapiens
ccccaaggggcagtctgg

SEQ ID NO: 6055085 - DNA, 19 bp, Homo sapiens
ccccaagggggctgctgct

SEQ ID NO: 6055086 - DNA, 20 bp, Homo sapiens
ccccaaggttttggagtcag

SEQ ID NO: 6055087 - DNA, 22 bp, Homo sapiens
ccccaagtccacctgcctatcc

SEQ ID NO: 6055088 - DNA, 21 bp, Homo sapiens
ccccaagttgggggtcagtgc

SEQ ID NO: 6055089 - DNA, 12 bp, Homo sapiens
ccccaataaaag

SEQ ID NO: 6055090 - DNA, 14 bp, Homo sapiens
ccccaataaaccag

SEQ ID NO: 6055091 - DNA, 19 bp, Homo sapiens
ccccaataaaccagtgtga

SEQ ID NO: 6055092 - DNA, 20 bp, Homo sapiens
ccccaataaaccagtgtgaa

SEQ ID NO: 6055093 - DNA, 12 bp, Homo sapiens
ccccaataaagc

SEQ ID NO: 6055094 - DNA, 14 bp, Homo sapiens
ccccaataaagcct

SEQ ID NO: 6055095 - DNA, 14 bp, Homo sapiens
ccccaataaaggca

SEQ ID NO: 6055096 - DNA, 15 bp, Homo sapiens
ccccaataaaggcag

SEQ ID NO: 6055097 - DNA, 16 bp, Homo sapiens
ccccaataaaggcagc

SEQ ID NO: 6055098 - DNA, 18 bp, Homo sapiens
ccccaataaaggcagctg

SEQ ID NO: 6055099 - DNA, 21 bp, Homo sapiens
ccccaataaaggcagctgcct

SEQ ID NO: 6055100 - DNA, 22 bp, Homo sapiens
ccccaataaaggcagctgcctc

SEQ ID NO: 6055101 - DNA, 23 bp, Homo sapiens
ccccaataaaggcagctgcctct

SEQ ID NO: 6055102 - DNA, 16 bp, Homo sapiens
ccccaatatcttgctt

SEQ ID NO: 6055103 - DNA, 21 bp, Homo sapiens
ccccaatatggtggccctggg

SEQ ID NO: 6055104 - DNA, 15 bp, Homo sapiens
ccccaatccatgctt

SEQ ID NO: 6055105 - DNA, 14 bp, Homo sapiens
ccccaatccctcaa

SEQ ID NO: 6055106 - DNA, 16 bp, Homo sapiens
ccccaatccctcaaac

SEQ ID NO: 6055107 - DNA, 17 bp, Homo sapiens
ccccaatccctgccact

SEQ ID NO: 6055108 - DNA, 22 bp, Homo sapiens
ccccaatccctgccactgggct

SEQ ID NO: 6055109 - DNA, 17 bp, Homo sapiens
ccccaatcggactgcca

SEQ ID NO: 6055110 - DNA, 20 bp, Homo sapiens
ccccaatcgggtccagagac

SEQ ID NO: 6055111 - DNA, 19 bp, Homo sapiens
ccccaatcttgcccactgg

SEQ ID NO: 6055112 - DNA, 23 bp, Homo sapiens
ccccaatgacacccatgccagag

SEQ ID NO: 6055113 - DNA, 19 bp, Homo sapiens
ccccaatgagacttgcctt

SEQ ID NO: 6055114 - DNA, 20 bp, Homo sapiens
ccccaatgctgtacctggct

SEQ ID NO: 6055115 - DNA, 13 bp, Homo sapiens
ccccaatgtctgt

SEQ ID NO: 6055116 - DNA, 16 bp, Homo sapiens
ccccaatgtgacctgg

SEQ ID NO: 6055117 - DNA, 21 bp, Homo sapiens
ccccaattacagggtgactca

SEQ ID NO: 6055118 - DNA, 18 bp, Homo sapiens
ccccaattactattccct

SEQ ID NO: 6055119 - DNA, 22 bp, Homo sapiens
ccccaattactattccctttga

SEQ ID NO: 6055120 - DNA, 22 bp, Homo sapiens
ccccaattatatctcccccact

SEQ ID NO: 6055121 - DNA, 13 bp, Homo sapiens
ccccaattcctct

SEQ ID NO: 6055122 - DNA, 13 bp, Homo sapiens
ccccaattctccc

SEQ ID NO: 6055123 - DNA, 16 bp, Homo sapiens
ccccaatttcccagac

SEQ ID NO: 6055124 - DNA, 19 bp, Homo sapiens
ccccaatttcccagactag

SEQ ID NO: 6055125 - DNA, 12 bp, Homo sapiens
ccccacaacttt

SEQ ID NO: 6055126 - DNA, 15 bp, Homo sapiens
ccccacaagagcccc

SEQ ID NO: 6055127 - DNA, 13 bp, Homo sapiens
ccccacaagcacc

SEQ ID NO: 6055128 - DNA, 20 bp, Homo sapiens
ccccacaagcaccactctgg

SEQ ID NO: 6055129 - DNA, 22 bp, Homo sapiens
ccccacaagcaccactctgggc

SEQ ID NO: 6055130 - DNA, 18 bp, Homo sapiens
ccccacaagctgtccctg

SEQ ID NO: 6055131 - DNA, 22 bp, Homo sapiens
ccccacaagctgtccctgcagg

SEQ ID NO: 6055132 - DNA, 20 bp, Homo sapiens
ccccacaaggaaccctcagg

SEQ ID NO: 6055133 - DNA, 16 bp, Homo sapiens
ccccacaaggcccagc

SEQ ID NO: 6055134 - DNA, 16 bp, Homo sapiens
ccccacaaggcctggt

SEQ ID NO: 6055135 - DNA, 14 bp, Homo sapiens
ccccacacacaggc

SEQ ID NO: 6055136 - DNA, 15 bp, Homo sapiens
ccccacacacaggcc

SEQ ID NO: 6055137 - DNA, 22 bp, Homo sapiens
ccccacacacaggccttctgtg

SEQ ID NO: 6055138 - DNA, 15 bp, Homo sapiens
ccccacacaggcctg

SEQ ID NO: 6055139 - DNA, 17 bp, Homo sapiens
ccccacacaggcctggc

SEQ ID NO: 6055140 - DNA, 20 bp, Homo sapiens
ccccacacaggcctggccca

SEQ ID NO: 6055141 - DNA, 21 bp, Homo sapiens
ccccacacaggcctggcccag

SEQ ID NO: 6055142 - DNA, 20 bp, Homo sapiens
ccccacaccagggccagcct

SEQ ID NO: 6055143 - DNA, 23 bp, Homo sapiens
ccccacaccccagcccaccctgc

SEQ ID NO: 6055144 - DNA, 14 bp, Homo sapiens
ccccacacctggcc

SEQ ID NO: 6055145 - DNA, 14 bp, Homo sapiens
ccccacacgccggg

SEQ ID NO: 6055146 - DNA, 20 bp, Homo sapiens
ccccacacgccggggctggc

SEQ ID NO: 6055147 - DNA, 13 bp, Homo sapiens
ccccacacggact

SEQ ID NO: 6055148 - DNA, 20 bp, Homo sapiens
ccccacacggactcccgggc

SEQ ID NO: 6055149 - DNA, 20 bp, Homo sapiens
ccccacacgtgctcgcagcc

SEQ ID NO: 6055150 - DNA, 22 bp, Homo sapiens
ccccacacgtgctcgcagcctg

SEQ ID NO: 6055151 - DNA, 15 bp, Homo sapiens
ccccacactcactcc

SEQ ID NO: 6055152 - DNA, 18 bp, Homo sapiens
ccccacactccactctga

SEQ ID NO: 6055153 - DNA, 12 bp, Homo sapiens
ccccacactcct

SEQ ID NO: 6055154 - DNA, 16 bp, Homo sapiens
ccccacagcacccagg

SEQ ID NO: 6055155 - DNA, 21 bp, Homo sapiens
ccccacagcacccaggctcca

SEQ ID NO: 6055156 - DNA, 22 bp, Homo sapiens
ccccacagcccacgtcctgtca

SEQ ID NO: 6055157 - DNA, 14 bp, Homo sapiens
ccccacagccctgc

SEQ ID NO: 6055158 - DNA, 18 bp, Homo sapiens
ccccacagccctgctcat

SEQ ID NO: 6055159 - DNA, 11 bp, Homo sapiens
ccccacagcct

SEQ ID NO: 6055160 - DNA, 17 bp, Homo sapiens
ccccacagcgtccctgg

SEQ ID NO: 6055161 - DNA, 14 bp, Homo sapiens
ccccacagctacct

SEQ ID NO: 6055162 - DNA, 14 bp, Homo sapiens
ccccacagctggct

SEQ ID NO: 6055163 - DNA, 13 bp, Homo sapiens
ccccacagctggg

SEQ ID NO: 6055164 - DNA, 15 bp, Homo sapiens
ccccacagctggggc

SEQ ID NO: 6055165 - DNA, 14 bp, Homo sapiens
ccccacagctttgc

SEQ ID NO: 6055166 - DNA, 17 bp, Homo sapiens
ccccacagctttgcacc

SEQ ID NO: 6055167 - DNA, 20 bp, Homo sapiens
ccccacaggagcgtgtccta

SEQ ID NO: 6055168 - DNA, 23 bp, Homo sapiens
ccccacaggaggtggtctgggac

SEQ ID NO: 6055169 - DNA, 23 bp, Homo sapiens
ccccacaggagttgtgagccctc

SEQ ID NO: 6055170 - DNA, 11 bp, Homo sapiens
ccccacaggat

SEQ ID NO: 6055171 - DNA, 22 bp, Homo sapiens
ccccacaggcacattaactgtt

SEQ ID NO: 6055172 - DNA, 15 bp, Homo sapiens
ccccacaggccacac

SEQ ID NO: 6055173 - DNA, 12 bp, Homo sapiens
ccccacagtccc

SEQ ID NO: 6055174 - DNA, 13 bp, Homo sapiens
ccccacataccat

SEQ ID NO: 6055175 - DNA, 16 bp, Homo sapiens
ccccacatccttctca

SEQ ID NO: 6055176 - DNA, 20 bp, Homo sapiens
ccccacatccttctcactgc

SEQ ID NO: 6055177 - DNA, 17 bp, Homo sapiens
ccccaccacacacaccc

SEQ ID NO: 6055178 - DNA, 18 bp, Homo sapiens
ccccaccacacacaccct

SEQ ID NO: 6055179 - DNA, 12 bp, Homo sapiens
ccccaccaccta

SEQ ID NO: 6055180 - DNA, 20 bp, Homo sapiens
ccccaccacgcatgctcagt

SEQ ID NO: 6055181 - DNA, 23 bp, Homo sapiens
ccccaccacgtctggctccctgc

SEQ ID NO: 6055182 - DNA, 17 bp, Homo sapiens
ccccaccagagctgcct

SEQ ID NO: 6055183 - DNA, 19 bp, Homo sapiens
ccccaccagccacctcttg

SEQ ID NO: 6055184 - DNA, 18 bp, Homo sapiens
ccccaccagcctcaccag

SEQ ID NO: 6055185 - DNA, 22 bp, Homo sapiens
ccccaccagtgcctctccctgc

SEQ ID NO: 6055186 - DNA, 13 bp, Homo sapiens
ccccaccatctgc

SEQ ID NO: 6055187 - DNA, 14 bp, Homo sapiens
ccccaccatctgct

SEQ ID NO: 6055188 - DNA, 20 bp, Homo sapiens
ccccaccatgcagcccctgg

SEQ ID NO: 6055189 - DNA, 13 bp, Homo sapiens
ccccaccatggtg

SEQ ID NO: 6055190 - DNA, 14 bp, Homo sapiens
ccccacccaagccc

SEQ ID NO: 6055191 - DNA, 20 bp, Homo sapiens
ccccacccaagcttggcagc

SEQ ID NO: 6055192 - DNA, 17 bp, Homo sapiens
ccaccacctccctcacc

SEQ ID NO: 6055193 - DNA, 22 bp, Homo sapiens
ccaccaccttggactcctccca

SEQ ID NO: 6055194 - DNA, 20 bp, Homo sapiens
ccaccacgatgtggccctgg

SEQ ID NO: 6055195 - DNA, 15 bp, Homo sapiens
ccaccacgcagccgc

SEQ ID NO: 6055196 - DNA, 16 bp, Homo sapiens
ccaccacgcccagcta

SEQ ID NO: 6055197 - DNA, 16 bp, Homo sapiens
ccaccacggccactgg

SEQ ID NO: 6055198 - DNA, 13 bp, Homo sapiens
ccaccacgtctgc

SEQ ID NO: 6055199 - DNA, 15 bp, Homo sapiens
ccaccacgtctggct

SEQ ID NO: 6055200 - DNA, 22 bp, Homo sapiens
ccaccacgtctggctccctgcc

SEQ ID NO: 6055201 - DNA, 23 bp, Homo sapiens
ccaccacgtctggctccctgccc

SEQ ID NO: 6055202 - DNA, 20 bp, Homo sapiens
ccaccactaagagaatacag

SEQ ID NO: 6055203 - DNA, 15 bp, Homo sapiens
ccaccactagagctg

SEQ ID NO: 6055204 - DNA, 19 bp, Homo sapiens
ccaccactcaggccacagt

SEQ ID NO: 6055205 - DNA, 21 bp, Homo sapiens
ccaccactccccaacccctct

SEQ ID NO: 6055206 - DNA, 13 bp, Homo sapiens
ccaccactcctgc

SEQ ID NO: 6055207 - DNA, 22 bp, Homo sapiens
ccaccactctcactccacccag

SEQ ID NO: 6055208 - DNA, 16 bp, Homo sapiens
ccaccactcttgactc

SEQ ID NO: 6055209 - DNA, 17 bp, Homo sapiens
ccaccactgcctgactg

SEQ ID NO: 6055210 - DNA, 18 bp, Homo sapiens
ccaccactgcctgactgc

SEQ ID NO: 6055211 - DNA, 15 bp, Homo sapiens
ccaccactggccacc

SEQ ID NO: 6055212 - DNA, 19 bp, Homo sapiens
ccaccactggccaccaggc

SEQ ID NO: 6055213 - DNA, 20 bp, Homo sapiens
ccaccactggccaccaggct

SEQ ID NO: 6055214 - DNA, 22 bp, Homo sapiens
ccaccactgtccctaccactga

SEQ ID NO: 6055215 - DNA, 12 bp, Homo sapiens
ccaccactgtgt

SEQ ID NO: 6055216 - DNA, 15 bp, Homo sapiens
ccaccactgtgtccc

SEQ ID NO: 6055217 - DNA, 17 bp, Homo sapiens
ccaccactgtgtcccag

SEQ ID NO: 6055218 - DNA, 20 bp, Homo sapiens
ccaccacttccagagccaga

SEQ ID NO: 6055219 - DNA, 23 bp, Homo sapiens
ccaccagaacgcaccccactggg

SEQ ID NO: 6055220 - DNA, 18 bp, Homo sapiens
ccaccagaagcccagaat

SEQ ID NO: 6055221 - DNA, 18 bp, Homo sapiens
ccaccagacccacctgga

SEQ ID NO: 6055222 - DNA, 22 bp, Homo sapiens
ccaccagacccacctggagccc

SEQ ID NO: 6055223 - DNA, 18 bp, Homo sapiens
ccaccagagcaggggctg

SEQ ID NO: 6055224 - DNA, 22 bp, Homo sapiens
ccaccagagcaggggctgctgg

SEQ ID NO: 6055225 - DNA, 22 bp, Homo sapiens
ccaccagagcctccctcagcca

SEQ ID NO: 6055226 - DNA, 13 bp, Homo sapiens
ccaccagagctgc

SEQ ID NO: 6055227 - DNA, 16 bp, Homo sapiens
ccaccagatgagaagt

SEQ ID NO: 6055228 - DNA, 18 bp, Homo sapiens
ccaccagatgagaagtta

SEQ ID NO: 6055229 - DNA, 12 bp, Homo sapiens
ccaccagatgct

SEQ ID NO: 6055230 - DNA, 15 bp, Homo sapiens
ccaccagatgctgaa

SEQ ID NO: 6055231 - DNA, 22 bp, Homo sapiens
ccaccagatgctgaatccccta

SEQ ID NO: 6055232 - DNA, 18 bp, Homo sapiens
ccaccagcaatgccctgc

SEQ ID NO: 6055233 - DNA, 14 bp, Homo sapiens
ccaccagcagcaca

SEQ ID NO: 6055234 - DNA, 15 bp, Homo sapiens
ccaccagcagcacaa

SEQ ID NO: 6055235 - DNA, 19 bp, Homo sapiens
ccaccagcatcacctgcct

SEQ ID NO: 6055236 - DNA, 18 bp, Homo sapiens
ccaccagccacagcctcc

SEQ ID NO: 6055237 - DNA, 14 bp, Homo sapiens
ccaccagccacctc

SEQ ID NO: 6055238 - DNA, 13 bp, Homo sapiens
ccaccagccagcc

SEQ ID NO: 6055239 - DNA, 15 bp, Homo sapiens
ccaccagccagccct

SEQ ID NO: 6055240 - DNA, 16 bp, Homo sapiens
ccaccagccagccctg

SEQ ID NO: 6055241 - DNA, 17 bp, Homo sapiens
ccaccagccagccctgg

SEQ ID NO: 6055242 - DNA, 19 bp, Homo sapiens
ccaccagccagcgcaggcc

SEQ ID NO: 6055243 - DNA, 11 bp, Homo sapiens
ccaccagcccc

SEQ ID NO: 6055244 - DNA, 12 bp, Homo sapiens
ccaccagccccg

SEQ ID NO: 6055245 - DNA, 19 bp, Homo sapiens
ccaccagcccgcaactctc

SEQ ID NO: 6055246 - DNA, 13 bp, Homo sapiens
ccaccagccgccc

SEQ ID NO: 6055247 - DNA, 18 bp, Homo sapiens
ccaccagccgccccagcc

SEQ ID NO: 6055248 - DNA, 14 bp, Homo sapiens
ccaccagcctgcac

SEQ ID NO: 6055249 - DNA, 14 bp, Homo sapiens
ccaccagcctgctg

SEQ ID NO: 6055250 - DNA, 13 bp, Homo sapiens
ccaccagccttgc

SEQ ID NO: 6055251 - DNA, 14 bp, Homo sapiens
ccaccagccttgct

SEQ ID NO: 6055252 - DNA, 21 bp, Homo sapiens
ccaccagccttgctctcttca

SEQ ID NO: 6055253 - DNA, 23 bp, Homo sapiens
ccaccagcgaactctcagaaata

SEQ ID NO: 6055254 - DNA, 12 bp, Homo sapiens
ccaccagcgccc

SEQ ID NO: 6055255 - DNA, 23 bp, Homo sapiens
ccaccagcgcccccactcctcct

SEQ ID NO: 6055256 - DNA, 20 bp, Homo sapiens
ccaccagcgttcccttctcc

SEQ ID NO: 6055257 - DNA, 21 bp, Homo sapiens
ccaccagcgttcccttctccc

SEQ ID NO: 6055258 - DNA, 15 bp, Homo sapiens
ccaccagctgctgga

SEQ ID NO: 6055259 - DNA, 22 bp, Homo sapiens
ccaccagctggctctgcagcac

SEQ ID NO: 6055260 - DNA, 22 bp, Homo sapiens
ccaccagcttccctctgcctga

SEQ ID NO: 6055261 - DNA, 18 bp, Homo sapiens
ccaccagctttatttttt

SEQ ID NO: 6055262 - DNA, 19 bp, Homo sapiens
ccaccaggagaaccactac

SEQ ID NO: 6055263 - DNA, 12 bp, Homo sapiens
ccaccaggagca

SEQ ID NO: 6055264 - DNA, 17 bp, Homo sapiens
ccaccaggagcacctgg

SEQ ID NO: 6055265 - DNA, 18 bp, Homo sapiens
ccaccaggagcacctgga

SEQ ID NO: 6055266 - DNA, 20 bp, Homo sapiens
ccaccaggagcacctggacc

SEQ ID NO: 6055267 - DNA, 20 bp, Homo sapiens
ccaccaggagcagcagccag

SEQ ID NO: 6055268 - DNA, 18 bp, Homo sapiens
ccaccaggatcccagggg

SEQ ID NO: 6055269 - DNA, 23 bp, Homo sapiens
ccaccaggattaatctctaaaat

SEQ ID NO: 6055270 - DNA, 19 bp, Homo sapiens
ccaccaggcagctccagct

SEQ ID NO: 6055271 - DNA, 22 bp, Homo sapiens
ccaccaggcatccggcccttac

SEQ ID NO: 6055272 - DNA, 19 bp, Homo sapiens
ccaccaggccacctcccca

SEQ ID NO: 6055273 - DNA, 21 bp, Homo sapiens
ccaccaggccacctccccagc

SEQ ID NO: 6055274 - DNA, 20 bp, Homo sapiens
ccaccaggctgctcagggct

SEQ ID NO: 6055275 - DNA, 18 bp, Homo sapiens
ccaccaggctggcgcagc

SEQ ID NO: 6055276 - DNA, 19 bp, Homo sapiens
ccaccaggctggcgcagcc

SEQ ID NO: 6055277 - DNA, 19 bp, Homo sapiens
ccaccagggaccagcccag

SEQ ID NO: 6055278 - DNA, 13 bp, Homo sapiens
ccaccagggagct

SEQ ID NO: 6055279 - DNA, 22 bp, Homo sapiens
ccaccagggagcttcctggctc

SEQ ID NO: 6055280 - DNA, 13 bp, Homo sapiens
ccaccagggcact

SEQ ID NO: 6055281 - DNA, 16 bp, Homo sapiens
ccaccagggcatctct

SEQ ID NO: 6055282 - DNA, 17 bp, Homo sapiens
ccaccagggccagagca

SEQ ID NO: 6055283 - DNA, 15 bp, Homo sapiens
ccaccagggctccag

SEQ ID NO: 6055284 - DNA, 16 bp, Homo sapiens
ccaccagggctccagg

SEQ ID NO: 6055285 - DNA, 20 bp, Homo sapiens
ccaccagggctccaggagcc

SEQ ID NO: 6055286 - DNA, 15 bp, Homo sapiens
ccaccaggggaagga

SEQ ID NO: 6055287 - DNA, 16 bp, Homo sapiens
ccaccaggggaaggaa

SEQ ID NO: 6055288 - DNA, 19 bp, Homo sapiens
ccaccagggtggaccaggc

SEQ ID NO: 6055289 - DNA, 23 bp, Homo sapiens
ccaccagggtggaccaggcctgg

SEQ ID NO: 6055290 - DNA, 18 bp, Homo sapiens
ccaccaggtctcccggga

SEQ ID NO: 6055291 - DNA, 23 bp, Homo sapiens
ccaccaggtctcccgggaagcca

SEQ ID NO: 6055292 - DNA, 14 bp, Homo sapiens
ccaccagtcactgt

SEQ ID NO: 6055293 - DNA, 19 bp, Homo sapiens
ccaccagtctcacccacta

SEQ ID NO: 6055294 - DNA, 14 bp, Homo sapiens
ccaccagtggacct

SEQ ID NO: 6055295 - DNA, 16 bp, Homo sapiens
ccaccagtggacctag

SEQ ID NO: 6055296 - DNA, 23 bp, Homo sapiens
ccaccagtgtagcatcttcctct

SEQ ID NO: 6055297 - DNA, 19 bp, Homo sapiens
ccaccagtgtgtgggggag

SEQ ID NO: 6055298 - DNA, 12 bp, Homo sapiens
ccaccagttctc

SEQ ID NO: 6055299 - DNA, 13 bp, Homo sapiens
ccaccataatccc

SEQ ID NO: 6055300 - DNA, 15 bp, Homo sapiens
ccaccataccttaga

SEQ ID NO: 6055301 - DNA, 19 bp, Homo sapiens
ccaccataccttagagact

SEQ ID NO: 6055302 - DNA, 22 bp, Homo sapiens
ccaccatattcagtgctgtggc

SEQ ID NO: 6055303 - DNA, 16 bp, Homo sapiens
ccaccatcaagccacc

SEQ ID NO: 6055304 - DNA, 21 bp, Homo sapiens
ccaccatcaccaccgcctctg

SEQ ID NO: 6055305 - DNA, 18 bp, Homo sapiens
ccaccatcaccagacagg

SEQ ID NO: 6055306 - DNA, 15 bp, Homo sapiens
ccaccatcactcact

SEQ ID NO: 6055307 - DNA, 14 bp, Homo sapiens
ccaccatccttcca

SEQ ID NO: 6055308 - DNA, 14 bp, Homo sapiens
ccaccatctgctgt

SEQ ID NO: 6055309 - DNA, 17 bp, Homo sapiens
ccaccatctgtaccctg

SEQ ID NO: 6055310 - DNA, 22 bp, Homo sapiens
ccaccatgaccccttctctctc

SEQ ID NO: 6055311 - DNA, 21 bp, Homo sapiens
ccaccatgcaacttcctttga

SEQ ID NO: 6055312 - DNA, 20 bp, Homo sapiens
ccaccatgcagcccctgggc

SEQ ID NO: 6055313 - DNA, 16 bp, Homo sapiens
ccaccatgccaggcta

SEQ ID NO: 6055314 - DNA, 15 bp, Homo sapiens
ccaccatgcccagct

SEQ ID NO: 6055315 - DNA, 18 bp, Homo sapiens
ccaccatgcgctgctcaa

SEQ ID NO: 6055316 - DNA, 17 bp, Homo sapiens
ccaccatgctctctcac

SEQ ID NO: 6055317 - DNA, 21 bp, Homo sapiens
ccaccatgctctctcacctgc

SEQ ID NO: 6055318 - DNA, 22 bp, Homo sapiens
ccaccatgctctctcacctgct

SEQ ID NO: 6055319 - DNA, 14 bp, Homo sapiens
ccaccatggaccag

SEQ ID NO: 6055320 - DNA, 17 bp, Homo sapiens
ccaccatggaccagccc

SEQ ID NO: 6055321 - DNA, 17 bp, Homo sapiens
ccaccatggccagccaa

SEQ ID NO: 6055322 - DNA, 22 bp, Homo sapiens
ccaccatggctaaggcaccagc

SEQ ID NO: 6055323 - DNA, 23 bp, Homo sapiens
ccaccatggctaaggcaccagcc

SEQ ID NO: 6055324 - DNA, 22 bp, Homo sapiens
ccaccatggtcatcaccaccct

SEQ ID NO: 6055325 - DNA, 17 bp, Homo sapiens
ccaccatgtctgcccca

SEQ ID NO: 6055326 - DNA, 12 bp, Homo sapiens
ccaccattccct

SEQ ID NO: 6055327 - DNA, 16 bp, Homo sapiens
ccaccattcctgcctt

SEQ ID NO: 6055328 - DNA, 14 bp, Homo sapiens
ccaccattcctgga

SEQ ID NO: 6055329 - DNA, 15 bp, Homo sapiens
ccaccattgctggaa

SEQ ID NO: 6055330 - DNA, 20 bp, Homo sapiens
ccaccatttaaaaatgttag

SEQ ID NO: 6055331 - DNA, 21 bp, Homo sapiens
ccaccatttctgggggccgca

SEQ ID NO: 6055332 - DNA, 15 bp, Homo sapiens
ccaccatttcttctg

SEQ ID NO: 6055333 - DNA, 17 bp, Homo sapiens
ccaccatttggcatccc

SEQ ID NO: 6055334 - DNA, 21 bp, Homo sapiens
ccacccaaaccccttcccacg

SEQ ID NO: 6055335 - DNA, 23 bp, Homo sapiens
ccacccaaaccccttcccacgac

SEQ ID NO: 6055336 - DNA, 16 bp, Homo sapiens
ccacccaaagcagtgg

SEQ ID NO: 6055337 - DNA, 13 bp, Homo sapiens
ccacccaacccta

SEQ ID NO: 6055338 - DNA, 15 bp, Homo sapiens
ccacccaagagagga

SEQ ID NO: 6055339 - DNA, 15 bp, Homo sapiens
ccacccaagcaggag

SEQ ID NO: 6055340 - DNA, 19 bp, Homo sapiens
ccacccaagccctcctttg

SEQ ID NO: 6055341 - DNA, 18 bp, Homo sapiens
ccacccaagcctgctggc

SEQ ID NO: 6055342 - DNA, 15 bp, Homo sapiens
ccacccaagcttggc

SEQ ID NO: 6055343 - DNA, 21 bp, Homo sapiens
ccacccaagggcctggcctga

SEQ ID NO: 6055344 - DNA, 15 bp, Homo sapiens
ccacccaatgctgat

SEQ ID NO: 6055345 - DNA, 13 bp, Homo sapiens
ccacccacaaact

SEQ ID NO: 6055346 - DNA, 23 bp, Homo sapiens
ccacccacaaactccaggctgga

SEQ ID NO: 6055347 - DNA, 16 bp, Homo sapiens
ccacccacaaagaaac

SEQ ID NO: 6055348 - DNA, 20 bp, Homo sapiens
ccacccacacagctgcccta

SEQ ID NO: 6055349 - DNA, 21 bp, Homo sapiens
ccacccacacagctgccctag

SEQ ID NO: 6055350 - DNA, 23 bp, Homo sapiens
ccacccacaccccgtctgcccct

SEQ ID NO: 6055351 - DNA, 17 bp, Homo sapiens
ccacccacagccataga

SEQ ID NO: 6055352 - DNA, 14 bp, Homo sapiens
ccacccaccagggc

SEQ ID NO: 6055353 - DNA, 12 bp, Homo sapiens
ccacccaccccc

SEQ ID NO: 6055354 - DNA, 19 bp, Homo sapiens
ccacccacccccaggcctc

SEQ ID NO: 6055355 - DNA, 14 bp, Homo sapiens
ccacccacccctcc

SEQ ID NO: 6055356 - DNA, 16 bp, Homo sapiens
ccacccacccctcctg

SEQ ID NO: 6055357 - DNA, 13 bp, Homo sapiens
ccacccaccctct

SEQ ID NO: 6055358 - DNA, 12 bp, Homo sapiens
ccacccacctcc

SEQ ID NO: 6055359 - DNA, 19 bp, Homo sapiens
ccacccacctccctgcctc

SEQ ID NO: 6055360 - DNA, 14 bp, Homo sapiens
ccacccacctcctg

SEQ ID NO: 6055361 - DNA, 16 bp, Homo sapiens
ccacccacctcctgcg

SEQ ID NO: 6055362 - DNA, 19 bp, Homo sapiens
ccacccacctcctgcggct

SEQ ID NO: 6055363 - DNA, 12 bp, Homo sapiens
ccacccacctga

SEQ ID NO: 6055364 - DNA, 15 bp, Homo sapiens
ccacccacctgacca

SEQ ID NO: 6055365 - DNA, 14 bp, Homo sapiens
ccacccacctttgc

SEQ ID NO: 6055366 - DNA, 15 bp, Homo sapiens
ccacccacctttgca

SEQ ID NO: 6055367 - DNA, 16 bp, Homo sapiens
ccacccacctttgcag

SEQ ID NO: 6055368 - DNA, 18 bp, Homo sapiens
ccacccacgtggagacag

SEQ ID NO: 6055369 - DNA, 13 bp, Homo sapiens
ccacccactcagg

SEQ ID NO: 6055370 - DNA, 18 bp, Homo sapiens
ccacccacttagtccact

SEQ ID NO: 6055371 - DNA, 20 bp, Homo sapiens
ccccacccaagggcctggcc

SEQ ID NO: 6055372 - DNA, 19 bp, Homo sapiens
ccccacccaccccacgccc

SEQ ID NO: 6055373 - DNA, 17 bp, Homo sapiens
ccccacccacccccagg

SEQ ID NO: 6055374 - DNA, 18 bp, Homo sapiens
ccccacccacccctcctg

SEQ ID NO: 6055375 - DNA, 12 bp, Homo sapiens
ccccacccacct

SEQ ID NO: 6055376 - DNA, 14 bp, Homo sapiens
ccccacccacctcc

SEQ ID NO: 6055377 - DNA, 21 bp, Homo sapiens
ccccacccacctccacccagc

SEQ ID NO: 6055378 - DNA, 23 bp, Homo sapiens
ccccacccacctccacccagccc

SEQ ID NO: 6055379 - DNA, 13 bp, Homo sapiens
ccccacccacttc

SEQ ID NO: 6055380 - DNA, 16 bp, Homo sapiens
ccccacccacttctgc

SEQ ID NO: 6055381 - DNA, 15 bp, Homo sapiens
ccccacccagctcca

SEQ ID NO: 6055382 - DNA, 13 bp, Homo sapiens
ccccaccccagag

SEQ ID NO: 6055383 - DNA, 14 bp, Homo sapiens
ccccaccccagcac

SEQ ID NO: 6055384 - DNA, 19 bp, Homo sapiens
ccccaccccagcacagctc

SEQ ID NO: 6055385 - DNA, 16 bp, Homo sapiens
ccccaccccaggccct

SEQ ID NO: 6055386 - DNA, 16 bp, Homo sapiens
ccccaccccaggctgg

SEQ ID NO: 6055387 - DNA, 14 bp, Homo sapiens
ccccaccccagggc

SEQ ID NO: 6055388 - DNA, 17 bp, Homo sapiens
ccccaccccagtgggaa

SEQ ID NO: 6055389 - DNA, 12 bp, Homo sapiens
ccccaccccatc

SEQ ID NO: 6055390 - DNA, 13 bp, Homo sapiens
ccccaccccattt

SEQ ID NO: 6055391 - DNA, 13 bp, Homo sapiens
ccccacccccagc

SEQ ID NO: 6055392 - DNA, 22 bp, Homo sapiens
ccccacccccagttcagtctgt

SEQ ID NO: 6055393 - DNA, 13 bp, Homo sapiens
ccccacccccgtc

SEQ ID NO: 6055394 - DNA, 14 bp, Homo sapiens
ccccacccccgtca

SEQ ID NO: 6055395 - DNA, 17 bp, Homo sapiens
ccccacccccttcagtg

SEQ ID NO: 6055396 - DNA, 20 bp, Homo sapiens
ccccaccccgaaatcagccc

SEQ ID NO: 6055397 - DNA, 20 bp, Homo sapiens
ccccacccctaagtgcccaa

SEQ ID NO: 6055398 - DNA, 21 bp, Homo sapiens
ccccacccctaagtgcccaaa

SEQ ID NO: 6055399 - DNA, 23 bp, Homo sapiens
ccccacccctaagtgcccaaagt

SEQ ID NO: 6055400 - DNA, 19 bp, Homo sapiens
ccccacccctacagcctgc

SEQ ID NO: 6055401 - DNA, 13 bp, Homo sapiens
ccccacccctcca

SEQ ID NO: 6055402 - DNA, 16 bp, Homo sapiens
ccccacccctccccac

SEQ ID NO: 6055403 - DNA, 14 bp, Homo sapiens
ccccacccctgccc

SEQ ID NO: 6055404 - DNA, 23 bp, Homo sapiens
ccccacccctgcccccagccccg

SEQ ID NO: 6055405 - DNA, 23 bp, Homo sapiens
ccccacccctggaagagcccagt

SEQ ID NO: 6055406 - DNA, 13 bp, Homo sapiens
ccccacccctggc

SEQ ID NO: 6055407 - DNA, 15 bp, Homo sapiens
ccccaccccttcccc

SEQ ID NO: 6055408 - DNA, 17 bp, Homo sapiens
ccccaccccttccccac

SEQ ID NO: 6055409 - DNA, 19 bp, Homo sapiens
ccccaccccttcctgtctc

SEQ ID NO: 6055410 - DNA, 13 bp, Homo sapiens
ccccaccccttcg

SEQ ID NO: 6055411 - DNA, 14 bp, Homo sapiens
ccccaccccttcga

SEQ ID NO: 6055412 - DNA, 13 bp, Homo sapiens
ccccaccccttgc

SEQ ID NO: 6055413 - DNA, 15 bp, Homo sapiens
ccccaccccttgctc

SEQ ID NO: 6055414 - DNA, 13 bp, Homo sapiens
ccccacccgcctg

SEQ ID NO: 6055415 - DNA, 17 bp, Homo sapiens
ccccacccgctcccaca

SEQ ID NO: 6055416 - DNA, 18 bp, Homo sapiens
ccccacccggcggcggcc

SEQ ID NO: 6055417 - DNA, 17 bp, Homo sapiens
ccccacccgttaattta

SEQ ID NO: 6055418 - DNA, 17 bp, Homo sapiens
ccccaccctccatgctc

SEQ ID NO: 6055419 - DNA, 16 bp, Homo sapiens
ccccaccctccctgga

SEQ ID NO: 6055420 - DNA, 21 bp, Homo sapiens
ccccaccctcggggatgtgtc

SEQ ID NO: 6055421 - DNA, 23 bp, Homo sapiens
ccccaccctcgtggacacctgcc

SEQ ID NO: 6055422 - DNA, 13 bp, Homo sapiens
ccccaccctgctt

SEQ ID NO: 6055423 - DNA, 14 bp, Homo sapiens
ccccaccctgggcc

SEQ ID NO: 6055424 - DNA, 20 bp, Homo sapiens
ccccaccctgggccctgggc

SEQ ID NO: 6055425 - DNA, 20 bp, Homo sapiens
ccccaccctgggctctggga

SEQ ID NO: 6055426 - DNA, 17 bp, Homo sapiens
ccccaccctgtcccagg

SEQ ID NO: 6055427 - DNA, 21 bp, Homo sapiens
ccccaccctgtcccaggcagc

SEQ ID NO: 6055428 - DNA, 21 bp, Homo sapiens
ccccaccctgtctgcaggcca

SEQ ID NO: 6055429 - DNA, 17 bp, Homo sapiens
ccccaccctgttcctgc

SEQ ID NO: 6055430 - DNA, 18 bp, Homo sapiens
ccccaccctgttcctgct

SEQ ID NO: 6055431 - DNA, 13 bp, Homo sapiens
ccccaccctgttt

SEQ ID NO: 6055432 - DNA, 20 bp, Homo sapiens
ccccaccgaagagccctgag

SEQ ID NO: 6055433 - DNA, 16 bp, Homo sapiens
ccccaccgagctggag

SEQ ID NO: 6055434 - DNA, 20 bp, Homo sapiens
ccccaccgaggttcccaggg

SEQ ID NO: 6055435 - DNA, 15 bp, Homo sapiens
ccccaccgcagacag

SEQ ID NO: 6055436 - DNA, 19 bp, Homo sapiens
ccccaccgcagacaggacc

SEQ ID NO: 6055437 - DNA, 13 bp, Homo sapiens
ccccaccgcccac

SEQ ID NO: 6055438 - DNA, 14 bp, Homo sapiens
ccccaccgcccact

SEQ ID NO: 6055439 - DNA, 13 bp, Homo sapiens
ccccaccgctcag

SEQ ID NO: 6055440 - DNA, 15 bp, Homo sapiens
ccccaccgctcagtg

SEQ ID NO: 6055441 - DNA, 16 bp, Homo sapiens
ccccaccgctcagtgt

SEQ ID NO: 6055442 - DNA, 21 bp, Homo sapiens
ccccaccgctcagtgtcagcg

SEQ ID NO: 6055443 - DNA, 19 bp, Homo sapiens
ccccaccggaactgggctg

SEQ ID NO: 6055444 - DNA, 18 bp, Homo sapiens
ccccacctcatgcctggc

SEQ ID NO: 6055445 - DNA, 22 bp, Homo sapiens
ccccacctccacctgtgagatc

SEQ ID NO: 6055446 - DNA, 13 bp, Homo sapiens
ccccacctccact

SEQ ID NO: 6055447 - DNA, 19 bp, Homo sapiens
ccccacctccctgcagctt

SEQ ID NO: 6055448 - DNA, 12 bp, Homo sapiens
ccccacctctcc

SEQ ID NO: 6055449 - DNA, 18 bp, Homo sapiens
ccccacctctggtccaca

SEQ ID NO: 6055450 - DNA, 13 bp, Homo sapiens
ccccacctcttgt

SEQ ID NO: 6055451 - DNA, 19 bp, Homo sapiens
ccccacctcttgtttctgg

SEQ ID NO: 6055452 - DNA, 13 bp, Homo sapiens
ccccacctgcagc

SEQ ID NO: 6055453 - DNA, 11 bp, Homo sapiens
ccccacctgcc

SEQ ID NO: 6055454 - DNA, 17 bp, Homo sapiens
ccccacctgccactagg

SEQ ID NO: 6055455 - DNA, 12 bp, Homo sapiens
ccccacctgccg

SEQ ID NO: 6055456 - DNA, 15 bp, Homo sapiens
ccccacctgcctggt

SEQ ID NO: 6055457 - DNA, 11 bp, Homo sapiens
ccccacctgcg

SEQ ID NO: 6055458 - DNA, 14 bp, Homo sapiens
ccccacctggacac

SEQ ID NO: 6055459 - DNA, 20 bp, Homo sapiens
ccccacctggccctctctga

SEQ ID NO: 6055460 - DNA, 11 bp, Homo sapiens
ccccacctggg

SEQ ID NO: 6055461 - DNA, 13 bp, Homo sapiens
ccccacctgtgtc

SEQ ID NO: 6055462 - DNA, 12 bp, Homo sapiens
ccccacctgttg

SEQ ID NO: 6055463 - DNA, 22 bp, Homo sapiens
ccccacctgttgtcctgaactg

SEQ ID NO: 6055464 - DNA, 12 bp, Homo sapiens
ccccaccttccc

SEQ ID NO: 6055465 - DNA, 20 bp, Homo sapiens
ccccaccttccctccacctg

SEQ ID NO: 6055466 - DNA, 14 bp, Homo sapiens
ccccaccttgccaa

SEQ ID NO: 6055467 - DNA, 15 bp, Homo sapiens
ccccaccttgccagg

SEQ ID NO: 6055468 - DNA, 21 bp, Homo sapiens
ccccacctttaagtcctctct

SEQ ID NO: 6055469 - DNA, 13 bp, Homo sapiens
ccccacgagggct

SEQ ID NO: 6055470 - DNA, 16 bp, Homo sapiens
ccccacgagggctggc

SEQ ID NO: 6055471 - DNA, 21 bp, Homo sapiens
ccccacgagggctggctggcc

SEQ ID NO: 6055472 - DNA, 17 bp, Homo sapiens
ccccacgagggtcagga

SEQ ID NO: 6055473 - DNA, 19 bp, Homo sapiens
ccccacgagtcacctgcaa

SEQ ID NO: 6055474 - DNA, 20 bp, Homo sapiens
ccccacgagtcacctgcaag

SEQ ID NO: 6055475 - DNA, 21 bp, Homo sapiens
ccccacgagtcacctgcaagc

SEQ ID NO: 6055476 - DNA, 13 bp, Homo sapiens
ccccacgccacag

SEQ ID NO: 6055477 - DNA, 19 bp, Homo sapiens
ccccacgcccacccccagt

SEQ ID NO: 6055478 - DNA, 17 bp, Homo sapiens
ccccacggccctgtcag

SEQ ID NO: 6055479 - DNA, 18 bp, Homo sapiens
ccccacggccgctccagg

SEQ ID NO: 6055480 - DNA, 22 bp, Homo sapiens
ccccacggggcctcgggacctc

SEQ ID NO: 6055481 - DNA, 13 bp, Homo sapiens
ccccacgtccctg

SEQ ID NO: 6055482 - DNA, 17 bp, Homo sapiens
ccccacgtctctctgcc

SEQ ID NO: 6055483 - DNA, 18 bp, Homo sapiens
ccccacgtctctctgcct

SEQ ID NO: 6055484 - DNA, 20 bp, Homo sapiens
ccccacgtctctctgcctgc

SEQ ID NO: 6055485 - DNA, 15 bp, Homo sapiens
ccccacgtctgtcct

SEQ ID NO: 6055486 - DNA, 16 bp, Homo sapiens
ccccacgtctgtcctc

SEQ ID NO: 6055487 - DNA, 19 bp, Homo sapiens
ccccacgtggcacctcctc

SEQ ID NO: 6055488 - DNA, 21 bp, Homo sapiens
ccccacgtggcacctcctcac

SEQ ID NO: 6055489 - DNA, 18 bp, Homo sapiens
ccccactactcaatacta

SEQ ID NO: 6055490 - DNA, 15 bp, Homo sapiens
ccccactcacaggga

SEQ ID NO: 6055491 - DNA, 22 bp, Homo sapiens
ccccactcagtaggtctgaagg

SEQ ID NO: 6055492 - DNA, 15 bp, Homo sapiens
ccccactccaccctg

SEQ ID NO: 6055493 - DNA, 14 bp, Homo sapiens
ccccactccagcag

SEQ ID NO: 6055494 - DNA, 13 bp, Homo sapiens
ccccactccagcc

SEQ ID NO: 6055495 - DNA, 14 bp, Homo sapiens
ccccactccagcct

SEQ ID NO: 6055496 - DNA, 22 bp, Homo sapiens
ccccactccagtccactcctga

SEQ ID NO: 6055497 - DNA, 14 bp, Homo sapiens
ccccactcccacat

SEQ ID NO: 6055498 - DNA, 15 bp, Homo sapiens
ccccactcccagcat

SEQ ID NO: 6055499 - DNA, 14 bp, Homo sapiens
ccccactccccacc

SEQ ID NO: 6055500 - DNA, 17 bp, Homo sapiens
ccccactcccccttccc

SEQ ID NO: 6055501 - DNA, 14 bp, Homo sapiens
ccccactcccctca

SEQ ID NO: 6055502 - DNA, 23 bp, Homo sapiens
ccccactcccgaaagcctttcct

SEQ ID NO: 6055503 - DNA, 14 bp, Homo sapiens
ccccactccctcac

SEQ ID NO: 6055504 - DNA, 15 bp, Homo sapiens
ccccactccctcaca

SEQ ID NO: 6055505 - DNA, 14 bp, Homo sapiens
ccccactccctgcc

SEQ ID NO: 6055506 - DNA, 16 bp, Homo sapiens
ccccactccctgccac

SEQ ID NO: 6055507 - DNA, 18 bp, Homo sapiens
ccccactcctcctccagc

SEQ ID NO: 6055508 - DNA, 18 bp, Homo sapiens
ccccactcctcctccttt

SEQ ID NO: 6055509 - DNA, 21 bp, Homo sapiens
ccccactcctcctcctttctt

SEQ ID NO: 6055510 - DNA, 12 bp, Homo sapiens
ccccactcctct

SEQ ID NO: 6055511 - DNA, 16 bp, Homo sapiens
ccccactcctctgctg

SEQ ID NO: 6055512 - DNA, 12 bp, Homo sapiens
ccccactcctgt

SEQ ID NO: 6055513 - DNA, 21 bp, Homo sapiens
ccccactctaggggtcaggct

SEQ ID NO: 6055514 - DNA, 14 bp, Homo sapiens
ccccactctcagag

SEQ ID NO: 6055515 - DNA, 20 bp, Homo sapiens
ccccactctcagaggcccca

SEQ ID NO: 6055516 - DNA, 15 bp, Homo sapiens
ccccactctcattcc

SEQ ID NO: 6055517 - DNA, 12 bp, Homo sapiens
ccccactctgct

SEQ ID NO: 6055518 - DNA, 15 bp, Homo sapiens
ccccactctgctctg

SEQ ID NO: 6055519 - DNA, 17 bp, Homo sapiens
ccccactctgctctgat

SEQ ID NO: 6055520 - DNA, 23 bp, Homo sapiens
ccccactctgctgaggccagagg

SEQ ID NO: 6055521 - DNA, 13 bp, Homo sapiens
ccccactgaagaa

SEQ ID NO: 6055522 - DNA, 15 bp, Homo sapiens
ccccactgaccagaa

SEQ ID NO: 6055523 - DNA, 13 bp, Homo sapiens
ccccactgagagc

SEQ ID NO: 6055524 - DNA, 14 bp, Homo sapiens
ccccactgagagct

SEQ ID NO: 6055525 - DNA, 18 bp, Homo sapiens
ccccactgagagctgctc

SEQ ID NO: 6055526 - DNA, 19 bp, Homo sapiens
ccccactgatgctgttctc

SEQ ID NO: 6055527 - DNA, 18 bp, Homo sapiens
ccccactgcagcagaaaa

SEQ ID NO: 6055528 - DNA, 15 bp, Homo sapiens
ccccactgccagcag

SEQ ID NO: 6055529 - DNA, 18 bp, Homo sapiens
ccccactgccctccaggg

SEQ ID NO: 6055530 - DNA, 20 bp, Homo sapiens
ccccactgccctccagggcc

SEQ ID NO: 6055531 - DNA, 15 bp, Homo sapiens
ccccactgcctgccc

SEQ ID NO: 6055532 - DNA, 20 bp, Homo sapiens
ccccactgctaaggctgctg

SEQ ID NO: 6055533 - DNA, 16 bp, Homo sapiens
ccccactgctgagctg

SEQ ID NO: 6055534 - DNA, 21 bp, Homo sapiens
ccccactgctgagctggccct

SEQ ID NO: 6055535 - DNA, 11 bp, Homo sapiens
ccccactggaa

SEQ ID NO: 6055536 - DNA, 17 bp, Homo sapiens
ccccactggacaacact

SEQ ID NO: 6055537 - DNA, 12 bp, Homo sapiens
ccccactggact

SEQ ID NO: 6055538 - DNA, 12 bp, Homo sapiens
ccccactggctg

SEQ ID NO: 6055539 - DNA, 17 bp, Homo sapiens
ccccactggctgagaat

SEQ ID NO: 6055540 - DNA, 21 bp, Homo sapiens
ccccactggctgagaatctgg

SEQ ID NO: 6055541 - DNA, 13 bp, Homo sapiens
ccccactgggaga

SEQ ID NO: 6055542 - DNA, 15 bp, Homo sapiens
ccccactgggagagc

SEQ ID NO: 6055543 - DNA, 12 bp, Homo sapiens
ccccactgggca

SEQ ID NO: 6055544 - DNA, 15 bp, Homo sapiens
ccccactgggccagc

SEQ ID NO: 6055545 - DNA, 16 bp, Homo sapiens
ccccacttagtgctgg

SEQ ID NO: 6055546 - DNA, 16 bp, Homo sapiens
ccccacttatgctgct

SEQ ID NO: 6055547 - DNA, 18 bp, Homo sapiens
ccccacttatgctgctgt

SEQ ID NO: 6055548 - DNA, 16 bp, Homo sapiens
ccccacttcagaaggt

SEQ ID NO: 6055549 - DNA, 13 bp, Homo sapiens
ccccacttcccac

SEQ ID NO: 6055550 - DNA, 20 bp, Homo sapiens
ccccacttctctactctgga

SEQ ID NO: 6055551 - DNA, 21 bp, Homo sapiens
ccccacttctctactctggaa

SEQ ID NO: 6055552 - DNA, 16 bp, Homo sapiens
ccccacttctggccac

SEQ ID NO: 6055553 - DNA, 22 bp, Homo sapiens
ccccactttcctacaaaatgga

SEQ ID NO: 6055554 - DNA, 15 bp, Homo sapiens
ccacccacttctgca

SEQ ID NO: 6055555 - DNA, 18 bp, Homo sapiens
ccacccagaggtctccct

SEQ ID NO: 6055556 - DNA, 15 bp, Homo sapiens
ccacccagaggtggc

SEQ ID NO: 6055557 - DNA, 14 bp, Homo sapiens
ccacccagcagcgc

SEQ ID NO: 6055558 - DNA, 12 bp, Homo sapiens
ccacccagccag

SEQ ID NO: 6055559 - DNA, 13 bp, Homo sapiens
ccacccagcccat

SEQ ID NO: 6055560 - DNA, 13 bp, Homo sapiens
ccacccagcccct

SEQ ID NO: 6055561 - DNA, 14 bp, Homo sapiens
ccacccagcccctc

SEQ ID NO: 6055562 - DNA, 20 bp, Homo sapiens
ccacccagcccctctcccct

SEQ ID NO: 6055563 - DNA, 21 bp, Homo sapiens
ccacccagcccctctcccctc

SEQ ID NO: 6055564 - DNA, 17 bp, Homo sapiens
ccacccagctccaggcc

SEQ ID NO: 6055565 - DNA, 22 bp, Homo sapiens
ccacccagctggtcctgtggat

SEQ ID NO: 6055566 - DNA, 15 bp, Homo sapiens
ccacccaggaaagga

SEQ ID NO: 6055567 - DNA, 22 bp, Homo sapiens
ccacccaggaagggagggagct

SEQ ID NO: 6055568 - DNA, 21 bp, Homo sapiens
ccacccaggagccccgaggcc

SEQ ID NO: 6055569 - DNA, 16 bp, Homo sapiens
ccacccaggaggcagg

SEQ ID NO: 6055570 - DNA, 23 bp, Homo sapiens
ccacccaggagggagggggctat

SEQ ID NO: 6055571 - DNA, 13 bp, Homo sapiens
ccacccaggctgc

SEQ ID NO: 6055572 - DNA, 17 bp, Homo sapiens
ccacccaggctgcactg

SEQ ID NO: 6055573 - DNA, 12 bp, Homo sapiens
ccacccagggcc

SEQ ID NO: 6055574 - DNA, 17 bp, Homo sapiens
ccacccagggcccggca

SEQ ID NO: 6055575 - DNA, 20 bp, Homo sapiens
ccacccagggcccggcacag

SEQ ID NO: 6055576 - DNA, 12 bp, Homo sapiens
ccacccagtgct

SEQ ID NO: 6055577 - DNA, 16 bp, Homo sapiens
ccacccagttacaggg

SEQ ID NO: 6055578 - DNA, 15 bp, Homo sapiens
ccacccatcttcctg

SEQ ID NO: 6055579 - DNA, 22 bp, Homo sapiens
ccacccatcttcctgctgctgt

SEQ ID NO: 6055580 - DNA, 23 bp, Homo sapiens
ccacccatgaggcttgtggccac

SEQ ID NO: 6055581 - DNA, 14 bp, Homo sapiens
ccacccatgatact

SEQ ID NO: 6055582 - DNA, 17 bp, Homo sapiens
ccacccatggggaggag

SEQ ID NO: 6055583 - DNA, 16 bp, Homo sapiens
ccaccccaacctgctc

SEQ ID NO: 6055584 - DNA, 15 bp, Homo sapiens
ccaccccaagagaac

SEQ ID NO: 6055585 - DNA, 19 bp, Homo sapiens
ccaccccaattaactgaag

SEQ ID NO: 6055586 - DNA, 15 bp, Homo sapiens
ccaccccacacacgc

SEQ ID NO: 6055587 - DNA, 13 bp, Homo sapiens
ccaccccacactt

SEQ ID NO: 6055588 - DNA, 17 bp, Homo sapiens
ccaccccacagactccg

SEQ ID NO: 6055589 - DNA, 11 bp, Homo sapiens
ccaccccaccc

SEQ ID NO: 6055590 - DNA, 17 bp, Homo sapiens
ccaccccacccccttca

SEQ ID NO: 6055591 - DNA, 14 bp, Homo sapiens
ccaccccacctcac

SEQ ID NO: 6055592 - DNA, 13 bp, Homo sapiens
ccaccccacctct

SEQ ID NO: 6055593 - DNA, 15 bp, Homo sapiens
ccaccccacctcttg

SEQ ID NO: 6055594 - DNA, 12 bp, Homo sapiens
ccaccccacgcc

SEQ ID NO: 6055595 - DNA, 12 bp, Homo sapiens
ccaccccacgga

SEQ ID NO: 6055596 - DNA, 18 bp, Homo sapiens
ccaccccactccagccct

SEQ ID NO: 6055597 - DNA, 13 bp, Homo sapiens
ccaccccagaaat

SEQ ID NO: 6055598 - DNA, 15 bp, Homo sapiens
ccaccccagaaatca

SEQ ID NO: 6055599 - DNA, 16 bp, Homo sapiens
ccaccccagaaatcac

SEQ ID NO: 6055600 - DNA, 18 bp, Homo sapiens
ccaccccagaaatcactg

SEQ ID NO: 6055601 - DNA, 13 bp, Homo sapiens
ccaccccagaaga

SEQ ID NO: 6055602 - DNA, 16 bp, Homo sapiens
ccaccccagcacagct

SEQ ID NO: 6055603 - DNA, 12 bp, Homo sapiens
ccaccccagcct

SEQ ID NO: 6055604 - DNA, 14 bp, Homo sapiens
ccaccccagcctcg

SEQ ID NO: 6055605 - DNA, 16 bp, Homo sapiens
ccaccccagcctcgcc

SEQ ID NO: 6055606 - DNA, 19 bp, Homo sapiens
ccaccccagcctcgcctgt

SEQ ID NO: 6055607 - DNA, 18 bp, Homo sapiens
ccaccccagctgctcccc

SEQ ID NO: 6055608 - DNA, 11 bp, Homo sapiens
ccaccccaggc

SEQ ID NO: 6055609 - DNA, 19 bp, Homo sapiens
ccaccccagggcagccagg

SEQ ID NO: 6055610 - DNA, 12 bp, Homo sapiens
ccaccccagtcc

SEQ ID NO: 6055611 - DNA, 14 bp, Homo sapiens
ccaccccatggaga

SEQ ID NO: 6055612 - DNA, 13 bp, Homo sapiens
ccaccccatggcc

SEQ ID NO: 6055613 - DNA, 13 bp, Homo sapiens
ccaccccatgggc

SEQ ID NO: 6055614 - DNA, 23 bp, Homo sapiens
ccaccccatgtcaccggatcctg

SEQ ID NO: 6055615 - DNA, 17 bp, Homo sapiens
ccaccccatgtgccttt

SEQ ID NO: 6055616 - DNA, 21 bp, Homo sapiens
ccacccccaaagacctgcctg

SEQ ID NO: 6055617 - DNA, 17 bp, Homo sapiens
ccacccccaacccccag

SEQ ID NO: 6055618 - DNA, 13 bp, Homo sapiens
ccacccccacacc

SEQ ID NO: 6055619 - DNA, 14 bp, Homo sapiens
ccacccccacacct

SEQ ID NO: 6055620 - DNA, 12 bp, Homo sapiens
ccacccccacca

SEQ ID NO: 6055621 - DNA, 15 bp, Homo sapiens
ccacccccaccccca

SEQ ID NO: 6055622 - DNA, 15 bp, Homo sapiens
ccacccccaccctcg

SEQ ID NO: 6055623 - DNA, 13 bp, Homo sapiens
ccacccccagccc

SEQ ID NO: 6055624 - DNA, 15 bp, Homo sapiens
ccacccccagccccg

SEQ ID NO: 6055625 - DNA, 19 bp, Homo sapiens
ccacccccaggacccctga

SEQ ID NO: 6055626 - DNA, 14 bp, Homo sapiens
ccacccccaggtct

SEQ ID NO: 6055627 - DNA, 14 bp, Homo sapiens
ccacccccaggtgc

SEQ ID NO: 6055628 - DNA, 15 bp, Homo sapiens
ccacccccaggtgca

SEQ ID NO: 6055629 - DNA, 21 bp, Homo sapiens
ccacccccaggtttttgccca

SEQ ID NO: 6055630 - DNA, 18 bp, Homo sapiens
ccacccccagtctccagg

SEQ ID NO: 6055631 - DNA, 15 bp, Homo sapiens
ccacccccagttcct

SEQ ID NO: 6055632 - DNA, 17 bp, Homo sapiens
ccacccccattgtgaat

SEQ ID NO: 6055633 - DNA, 16 bp, Homo sapiens
ccaccccccactcagt

SEQ ID NO: 6055634 - DNA, 22 bp, Homo sapiens
ccaccccccactcagtgcctcc

SEQ ID NO: 6055635 - DNA, 15 bp, Homo sapiens
ccaccccccaggcct

SEQ ID NO: 6055636 - DNA, 16 bp, Homo sapiens
ccaccccccgccggca

SEQ ID NO: 6055637 - DNA, 21 bp, Homo sapiens
ccaccccccgccggcaggggc

SEQ ID NO: 6055638 - DNA, 13 bp, Homo sapiens
ccacccccctcct

SEQ ID NO: 6055639 - DNA, 17 bp, Homo sapiens
ccacccccctcctcccc

SEQ ID NO: 6055640 - DNA, 21 bp, Homo sapiens
ccacccccctctctttctctg

SEQ ID NO: 6055641 - DNA, 19 bp, Homo sapiens
ccacccccgaccctgccct

SEQ ID NO: 6055642 - DNA, 18 bp, Homo sapiens
ccacccccgagcttgcct

SEQ ID NO: 6055643 - DNA, 22 bp, Homo sapiens
ccacccccgagcttgcctcagg

SEQ ID NO: 6055644 - DNA, 14 bp, Homo sapiens
ccacccccggcagc

SEQ ID NO: 6055645 - DNA, 23 bp, Homo sapiens
ccacccccgggatcctgccccca

SEQ ID NO: 6055646 - DNA, 17 bp, Homo sapiens
ccacccccgggtgcctg

SEQ ID NO: 6055647 - DNA, 12 bp, Homo sapiens
ccaccccctcaa

SEQ ID NO: 6055648 - DNA, 19 bp, Homo sapiens
ccaccccctccccaaagcc

SEQ ID NO: 6055649 - DNA, 16 bp, Homo sapiens
ccaccccctccccagg

SEQ ID NO: 6055650 - DNA, 14 bp, Homo sapiens
ccaccccctctgga

SEQ ID NO: 6055651 - DNA, 15 bp, Homo sapiens
ccaccccctctggag

SEQ ID NO: 6055652 - DNA, 16 bp, Homo sapiens
ccaccccctgccctgc

SEQ ID NO: 6055653 - DNA, 18 bp, Homo sapiens
ccaccccctgccctgcac

SEQ ID NO: 6055654 - DNA, 15 bp, Homo sapiens
ccaccccctgcctgg

SEQ ID NO: 6055655 - DNA, 13 bp, Homo sapiens
ccaccccctgctg

SEQ ID NO: 6055656 - DNA, 22 bp, Homo sapiens
ccaccccctgtcccattctaga

SEQ ID NO: 6055657 - DNA, 15 bp, Homo sapiens
ccaccccctgttccc

SEQ ID NO: 6055658 - DNA, 20 bp, Homo sapiens
ccaccccctttgactctggg

SEQ ID NO: 6055659 - DNA, 21 bp, Homo sapiens
ccaccccctttgactctgggg

SEQ ID NO: 6055660 - DNA, 15 bp, Homo sapiens
ccaccccgctctgca

SEQ ID NO: 6055661 - DNA, 18 bp, Homo sapiens
ccaccccgctgcctggcg

SEQ ID NO: 6055662 - DNA, 15 bp, Homo sapiens
ccaccccggcctcca

SEQ ID NO: 6055663 - DNA, 17 bp, Homo sapiens
ccaccccggctccccct

SEQ ID NO: 6055664 - DNA, 18 bp, Homo sapiens
ccaccccggggaccctgt

SEQ ID NO: 6055665 - DNA, 19 bp, Homo sapiens
ccaccccggggaccctgtg

SEQ ID NO: 6055666 - DNA, 18 bp, Homo sapiens
ccaccccgtccctcctct

SEQ ID NO: 6055667 - DNA, 21 bp, Homo sapiens
ccaccccgtccctcctctccc

SEQ ID NO: 6055668 - DNA, 20 bp, Homo sapiens
ccaccccgttgttgtccctg

SEQ ID NO: 6055669 - DNA, 13 bp, Homo sapiens
ccacccctacaca

SEQ ID NO: 6055670 - DNA, 15 bp, Homo sapiens
ccacccctacacaca

SEQ ID NO: 6055671 - DNA, 22 bp, Homo sapiens
ccacccctacacacacactccc

SEQ ID NO: 6055672 - DNA, 17 bp, Homo sapiens
ccacccctacagcctgc

SEQ ID NO: 6055673 - DNA, 16 bp, Homo sapiens
ccacccctacccctgg

SEQ ID NO: 6055674 - DNA, 18 bp, Homo sapiens
ccacccctcaagccagga

SEQ ID NO: 6055675 - DNA, 15 bp, Homo sapiens
ccacccctcactccc

SEQ ID NO: 6055676 - DNA, 21 bp, Homo sapiens
ccacccctcactccccaggga

SEQ ID NO: 6055677 - DNA, 15 bp, Homo sapiens
ccacccctcatcagg

SEQ ID NO: 6055678 - DNA, 15 bp, Homo sapiens
ccacccctccctctg

SEQ ID NO: 6055679 - DNA, 16 bp, Homo sapiens
ccacccctccctctgc

SEQ ID NO: 6055680 - DNA, 13 bp, Homo sapiens
ccacccctcctgg

SEQ ID NO: 6055681 - DNA, 22 bp, Homo sapiens
ccacccctcctgggcccaggca

SEQ ID NO: 6055682 - DNA, 19 bp, Homo sapiens
ccacccctctcgcctcatt

SEQ ID NO: 6055683 - DNA, 13 bp, Homo sapiens
ccacccctcttct

SEQ ID NO: 6055684 - DNA, 13 bp, Homo sapiens
ccacccctgccca

SEQ ID NO: 6055685 - DNA, 14 bp, Homo sapiens
ccacccctgcccag

SEQ ID NO: 6055686 - DNA, 13 bp, Homo sapiens
ccacccctgcccc

SEQ ID NO: 6055687 - DNA, 17 bp, Homo sapiens
ccacccctgcctttgtt

SEQ ID NO: 6055688 - DNA, 21 bp, Homo sapiens
ccacccctgcgtcgagctggg

SEQ ID NO: 6055689 - DNA, 12 bp, Homo sapiens
ccacccctgctg

SEQ ID NO: 6055690 - DNA, 17 bp, Homo sapiens
ccacccctgggggctct

SEQ ID NO: 6055691 - DNA, 23 bp, Homo sapiens
ccacccctgtaatcaggcaagga

SEQ ID NO: 6055692 - DNA, 15 bp, Homo sapiens
ccacccctgtccaga

SEQ ID NO: 6055693 - DNA, 13 bp, Homo sapiens
ccacccctgtgcg

SEQ ID NO: 6055694 - DNA, 15 bp, Homo sapiens
ccacccctgtgctcc

SEQ ID NO: 6055695 - DNA, 13 bp, Homo sapiens
ccaccccttcccc

SEQ ID NO: 6055696 - DNA, 16 bp, Homo sapiens
ccaccccttccccact

SEQ ID NO: 6055697 - DNA, 18 bp, Homo sapiens
ccaccccttccccaggcc

SEQ ID NO: 6055698 - DNA, 14 bp, Homo sapiens
ccaccccttcctca

SEQ ID NO: 6055699 - DNA, 13 bp, Homo sapiens
ccaccccttcctg

SEQ ID NO: 6055700 - DNA, 15 bp, Homo sapiens
ccaccccttcctgtc

SEQ ID NO: 6055701 - DNA, 13 bp, Homo sapiens
ccaccccttgctc

SEQ ID NO: 6055702 - DNA, 16 bp, Homo sapiens
ccaccccttggaggag

SEQ ID NO: 6055703 - DNA, 13 bp, Homo sapiens
ccaccccttggca

SEQ ID NO: 6055704 - DNA, 18 bp, Homo sapiens
ccacccgacctggctgcc

SEQ ID NO: 6055705 - DNA, 15 bp, Homo sapiens
ccacccgacttcttt

SEQ ID NO: 6055706 - DNA, 17 bp, Homo sapiens
ccacccgatgctgcttt

SEQ ID NO: 6055707 - DNA, 19 bp, Homo sapiens
ccacccgcagatgacacgc

SEQ ID NO: 6055708 - DNA, 22 bp, Homo sapiens
ccacccgccccgcgcaccccac

SEQ ID NO: 6055709 - DNA, 21 bp, Homo sapiens
ccacccgcccgcccccgccct

SEQ ID NO: 6055710 - DNA, 16 bp, Homo sapiens
ccacccgcctgcagag

SEQ ID NO: 6055711 - DNA, 18 bp, Homo sapiens
ccacccgcctgcagagag

SEQ ID NO: 6055712 - DNA, 15 bp, Homo sapiens
ccacccgccttgtga

SEQ ID NO: 6055713 - DNA, 18 bp, Homo sapiens
ccacccgctgcccctccc

SEQ ID NO: 6055714 - DNA, 13 bp, Homo sapiens
ccacccggacagg

SEQ ID NO: 6055715 - DNA, 19 bp, Homo sapiens
ccacccggatctccaggcc

SEQ ID NO: 6055716 - DNA, 22 bp, Homo sapiens
ccacccggccacagctgctgga

SEQ ID NO: 6055717 - DNA, 15 bp, Homo sapiens
ccacccggcccggct

SEQ ID NO: 6055718 - DNA, 21 bp, Homo sapiens
ccacccggcggcggccaggga

SEQ ID NO: 6055719 - DNA, 17 bp, Homo sapiens
ccacccggggcctggac

SEQ ID NO: 6055720 - DNA, 17 bp, Homo sapiens
ccacccggttcagtgtt

SEQ ID NO: 6055721 - DNA, 20 bp, Homo sapiens
ccacccggttcagtgtttct

SEQ ID NO: 6055722 - DNA, 22 bp, Homo sapiens
ccacccgtcctccctcagcctc

SEQ ID NO: 6055723 - DNA, 18 bp, Homo sapiens
ccacccgtggggtgctgc

SEQ ID NO: 6055724 - DNA, 20 bp, Homo sapiens
ccacccgtggggtgctgccc

SEQ ID NO: 6055725 - DNA, 21 bp, Homo sapiens
ccacccgttctgctggcctgg

SEQ ID NO: 6055726 - DNA, 22 bp, Homo sapiens
ccacccgttctgctggcctgga

SEQ ID NO: 6055727 - DNA, 17 bp, Homo sapiens
ccacccgtttccaagcc

SEQ ID NO: 6055728 - DNA, 18 bp, Homo sapiens
ccaccctaaaatgacagc

SEQ ID NO: 6055729 - DNA, 17 bp, Homo sapiens
ccaccctaaagtctcag

SEQ ID NO: 6055730 - DNA, 16 bp, Homo sapiens
ccaccctaactgagct

SEQ ID NO: 6055731 - DNA, 17 bp, Homo sapiens
ccaccctaagggcagcc

SEQ ID NO: 6055732 - DNA, 15 bp, Homo sapiens
ccaccctaccagctc

SEQ ID NO: 6055733 - DNA, 17 bp, Homo sapiens
ccaccctaccagctcct

SEQ ID NO: 6055734 - DNA, 19 bp, Homo sapiens
ccaccctaccagctcctcc

SEQ ID NO: 6055735 - DNA, 22 bp, Homo sapiens
ccaccctaccagctcctccagc

SEQ ID NO: 6055736 - DNA, 19 bp, Homo sapiens
ccccactttcgcctcctcc

SEQ ID NO: 6055737 - DNA, 21 bp, Homo sapiens
ccccactttcgcctcctccag

SEQ ID NO: 6055738 - DNA, 13 bp, Homo sapiens
ccccactttgaag

SEQ ID NO: 6055739 - DNA, 19 bp, Homo sapiens
ccccagaaagctgccagag

SEQ ID NO: 6055740 - DNA, 20 bp, Homo sapiens
ccccagaaagctgccagagc

SEQ ID NO: 6055741 - DNA, 21 bp, Homo sapiens
ccccagaaagctgccagagcc

SEQ ID NO: 6055742 - DNA, 14 bp, Homo sapiens
ccccagaaatcact

SEQ ID NO: 6055743 - DNA, 21 bp, Homo sapiens
ccccagaaattctggcccagc

SEQ ID NO: 6055744 - DNA, 15 bp, Homo sapiens
ccccagaactggctg

SEQ ID NO: 6055745 - DNA, 22 bp, Homo sapiens
ccccagaactggctgggcccct

SEQ ID NO: 6055746 - DNA, 16 bp, Homo sapiens
ccccagaaggcaggga

SEQ ID NO: 6055747 - DNA, 16 bp, Homo sapiens
ccccagaatcccctgg

SEQ ID NO: 6055748 - DNA, 14 bp, Homo sapiens
ccccagacacagcc

SEQ ID NO: 6055749 - DNA, 18 bp, Homo sapiens
ccccagacaccgccacat

SEQ ID NO: 6055750 - DNA, 13 bp, Homo sapiens
ccccagacactgg

SEQ ID NO: 6055751 - DNA, 15 bp, Homo sapiens
ccccagacagctgct

SEQ ID NO: 6055752 - DNA, 19 bp, Homo sapiens
ccccagacagctgctcaga

SEQ ID NO: 6055753 - DNA, 14 bp, Homo sapiens
ccccagacagggct

SEQ ID NO: 6055754 - DNA, 21 bp, Homo sapiens
ccccagacagggctccagcct

SEQ ID NO: 6055755 - DNA, 23 bp, Homo sapiens
ccccagacagggctccagcctgt

SEQ ID NO: 6055756 - DNA, 20 bp, Homo sapiens
ccccagacagttcttttcta

SEQ ID NO: 6055757 - DNA, 17 bp, Homo sapiens
ccccagaccagtagtga

SEQ ID NO: 6055758 - DNA, 21 bp, Homo sapiens
ccccagaccagtagtgaccaa

SEQ ID NO: 6055759 - DNA, 21 bp, Homo sapiens
ccccagacccatgtgctggga

SEQ ID NO: 6055760 - DNA, 17 bp, Homo sapiens
ccccagaccccagggca

SEQ ID NO: 6055761 - DNA, 21 bp, Homo sapiens
ccccagacccttcttgcctgc

SEQ ID NO: 6055762 - DNA, 12 bp, Homo sapiens
ccccagacctgc

SEQ ID NO: 6055763 - DNA, 17 bp, Homo sapiens
ccccagacgcatagact

SEQ ID NO: 6055764 - DNA, 20 bp, Homo sapiens
ccccagactcaaactcaagg

SEQ ID NO: 6055765 - DNA, 19 bp, Homo sapiens
ccccagactcagctccaga

SEQ ID NO: 6055766 - DNA, 19 bp, Homo sapiens
ccccagactcagctggaag

SEQ ID NO: 6055767 - DNA, 21 bp, Homo sapiens
ccccagactccaccaagcctg

SEQ ID NO: 6055768 - DNA, 18 bp, Homo sapiens
ccccagactccaggcccc

SEQ ID NO: 6055769 - DNA, 14 bp, Homo sapiens
ccccagactgagct

SEQ ID NO: 6055770 - DNA, 15 bp, Homo sapiens
ccccagactgagctc

SEQ ID NO: 6055771 - DNA, 23 bp, Homo sapiens
ccccagactgggcccaggcaggt

SEQ ID NO: 6055772 - DNA, 12 bp, Homo sapiens
ccccagactgta

SEQ ID NO: 6055773 - DNA, 18 bp, Homo sapiens
ccccagacttctctttct

SEQ ID NO: 6055774 - DNA, 22 bp, Homo sapiens
ccccagagaaagcgcagatgct

SEQ ID NO: 6055775 - DNA, 21 bp, Homo sapiens
ccccagagaccttttctctcc

SEQ ID NO: 6055776 - DNA, 21 bp, Homo sapiens
ccccagagactcagagggagg

SEQ ID NO: 6055777 - DNA, 10 bp, Homo sapiens
ccccagagag

SEQ ID NO: 6055778 - DNA, 16 bp, Homo sapiens
ccccagagagaccctg

SEQ ID NO: 6055779 - DNA, 22 bp, Homo sapiens
ccccagagatgccagcccttca

SEQ ID NO: 6055780 - DNA, 21 bp, Homo sapiens
ccccagagcacccccaagcct

SEQ ID NO: 6055781 - DNA, 22 bp, Homo sapiens
ccccagagcacccccaagcctg

SEQ ID NO: 6055782 - DNA, 11 bp, Homo sapiens
ccccagagcca

SEQ ID NO: 6055783 - DNA, 14 bp, Homo sapiens
ccccagagccacac

SEQ ID NO: 6055784 - DNA, 17 bp, Homo sapiens
ccccagagccacacatg

SEQ ID NO: 6055785 - DNA, 18 bp, Homo sapiens
ccccagagccacacatgg

SEQ ID NO: 6055786 - DNA, 16 bp, Homo sapiens
ccccagagccacagtt

SEQ ID NO: 6055787 - DNA, 22 bp, Homo sapiens
ccccagagccactacctttgtc

SEQ ID NO: 6055788 - DNA, 12 bp, Homo sapiens
ccccagagccag

SEQ ID NO: 6055789 - DNA, 13 bp, Homo sapiens
ccccagagccagg

SEQ ID NO: 6055790 - DNA, 14 bp, Homo sapiens
ccccagagccaggg

SEQ ID NO: 6055791 - DNA, 15 bp, Homo sapiens
ccccagagccagggc

SEQ ID NO: 6055792 - DNA, 12 bp, Homo sapiens
ccccagagcccc

SEQ ID NO: 6055793 - DNA, 19 bp, Homo sapiens
ccccagagcccctcctcca

SEQ ID NO: 6055794 - DNA, 11 bp, Homo sapiens
ccccagagctc

SEQ ID NO: 6055795 - DNA, 14 bp, Homo sapiens
ccccagagctcccc

SEQ ID NO: 6055796 - DNA, 20 bp, Homo sapiens
ccccagagctggcgctcagc

SEQ ID NO: 6055797 - DNA, 12 bp, Homo sapiens
ccccagagctgt

SEQ ID NO: 6055798 - DNA, 13 bp, Homo sapiens
ccccagaggaagt

SEQ ID NO: 6055799 - DNA, 13 bp, Homo sapiens
ccccagaggcaga

SEQ ID NO: 6055800 - DNA, 14 bp, Homo sapiens
ccccagaggctccc

SEQ ID NO: 6055801 - DNA, 18 bp, Homo sapiens
ccccagagggaccagctg

SEQ ID NO: 6055802 - DNA, 17 bp, Homo sapiens
ccccagaggtcgcagct

SEQ ID NO: 6055803 - DNA, 13 bp, Homo sapiens
ccccagaggtgga

SEQ ID NO: 6055804 - DNA, 21 bp, Homo sapiens
ccccagaggtggatactgggg

SEQ ID NO: 6055805 - DNA, 15 bp, Homo sapiens
ccccagagtgctgtc

SEQ ID NO: 6055806 - DNA, 21 bp, Homo sapiens
ccccagagtgctgtcgggacc

SEQ ID NO: 6055807 - DNA, 15 bp, Homo sapiens
ccccagataccagcc

SEQ ID NO: 6055808 - DNA, 18 bp, Homo sapiens
ccccagataccagcccct

SEQ ID NO: 6055809 - DNA, 15 bp, Homo sapiens
ccccagatacctgtg

SEQ ID NO: 6055810 - DNA, 18 bp, Homo sapiens
ccccagatacctgtgagg

SEQ ID NO: 6055811 - DNA, 20 bp, Homo sapiens
ccccagatacctgtgaggac

SEQ ID NO: 6055812 - DNA, 17 bp, Homo sapiens
ccccagatagagctggg

SEQ ID NO: 6055813 - DNA, 18 bp, Homo sapiens
ccccagatagagctgggt

SEQ ID NO: 6055814 - DNA, 23 bp, Homo sapiens
ccccagatagagctgggtggcct

SEQ ID NO: 6055815 - DNA, 22 bp, Homo sapiens
ccccagatctcccactgcgggg

SEQ ID NO: 6055816 - DNA, 19 bp, Homo sapiens
ccccagatctgcctgggcc

SEQ ID NO: 6055817 - DNA, 16 bp, Homo sapiens
ccccagatctgtcctg

SEQ ID NO: 6055818 - DNA, 17 bp, Homo sapiens
ccccagatctgtcctgg

SEQ ID NO: 6055819 - DNA, 20 bp, Homo sapiens
ccccagatctgtcctggggg

SEQ ID NO: 6055820 - DNA, 22 bp, Homo sapiens
ccccagatgtgagggcaccacc

SEQ ID NO: 6055821 - DNA, 20 bp, Homo sapiens
ccccagattgcaacaggctg

SEQ ID NO: 6055822 - DNA, 21 bp, Homo sapiens
ccccagattgcaacaggctgg

SEQ ID NO: 6055823 - DNA, 22 bp, Homo sapiens
ccccagattgcaacaggctggg

SEQ ID NO: 6055824 - DNA, 22 bp, Homo sapiens
ccccagcaacgcccctccaaac

SEQ ID NO: 6055825 - DNA, 12 bp, Homo sapiens
ccccagcaaggc

SEQ ID NO: 6055826 - DNA, 17 bp, Homo sapiens
ccccagcaagtgagagc

SEQ ID NO: 6055827 - DNA, 21 bp, Homo sapiens
ccccagcaagtgagagctggg

SEQ ID NO: 6055828 - DNA, 22 bp, Homo sapiens
ccccagcaagtgagagctgggt

SEQ ID NO: 6055829 - DNA, 22 bp, Homo sapiens
ccccagcaattatgaaaataat

SEQ ID NO: 6055830 - DNA, 16 bp, Homo sapiens
ccccagcacagccacc

SEQ ID NO: 6055831 - DNA, 18 bp, Homo sapiens
ccccagcacagctcctcc

SEQ ID NO: 6055832 - DNA, 13 bp, Homo sapiens
ccccagcacccgg

SEQ ID NO: 6055833 - DNA, 15 bp, Homo sapiens
ccccagcacccgggc

SEQ ID NO: 6055834 - DNA, 13 bp, Homo sapiens
ccccagcacctag

SEQ ID NO: 6055835 - DNA, 20 bp, Homo sapiens
ccccagcagaaccagcctca

SEQ ID NO: 6055836 - DNA, 22 bp, Homo sapiens
ccccagcagaatggaggcaggg

SEQ ID NO: 6055837 - DNA, 20 bp, Homo sapiens
ccccagcagaggcaggctgg

SEQ ID NO: 6055838 - DNA, 11 bp, Homo sapiens
ccccagcaggt

SEQ ID NO: 6055839 - DNA, 12 bp, Homo sapiens
ccccagcaggtg

SEQ ID NO: 6055840 - DNA, 18 bp, Homo sapiens
ccccagcaggtgctgact

SEQ ID NO: 6055841 - DNA, 15 bp, Homo sapiens
ccccagcagtcctgg

SEQ ID NO: 6055842 - DNA, 18 bp, Homo sapiens
ccccagcagtcctgggcc

SEQ ID NO: 6055843 - DNA, 19 bp, Homo sapiens
ccccagcagtttctgtcct

SEQ ID NO: 6055844 - DNA, 20 bp, Homo sapiens
ccccagcatcgggggcctgc

SEQ ID NO: 6055845 - DNA, 22 bp, Homo sapiens
ccccagcatcgggggcctgcaa

SEQ ID NO: 6055846 - DNA, 20 bp, Homo sapiens
ccccagcattctcaggcacc

SEQ ID NO: 6055847 - DNA, 21 bp, Homo sapiens
ccccagcattctcaggcacca

SEQ ID NO: 6055848 - DNA, 15 bp, Homo sapiens
ccccagccaagcctg

SEQ ID NO: 6055849 - DNA, 19 bp, Homo sapiens
ccccagccaagcctgactt

SEQ ID NO: 6055850 - DNA, 11 bp, Homo sapiens
ccccagccaca

SEQ ID NO: 6055851 - DNA, 13 bp, Homo sapiens
ccccagccactcc

SEQ ID NO: 6055852 - DNA, 11 bp, Homo sapiens
ccccagccaga

SEQ ID NO: 6055853 - DNA, 11 bp, Homo sapiens
ccccagccagc

SEQ ID NO: 6055854 - DNA, 12 bp, Homo sapiens
ccccagccagcc

SEQ ID NO: 6055855 - DNA, 15 bp, Homo sapiens
ccccagccagccctt

SEQ ID NO: 6055856 - DNA, 18 bp, Homo sapiens
ccccagccagcccttccc

SEQ ID NO: 6055857 - DNA, 22 bp, Homo sapiens
ccccagccagcctggctgggac

SEQ ID NO: 6055858 - DNA, 14 bp, Homo sapiens
ccccagccaggcta

SEQ ID NO: 6055859 - DNA, 16 bp, Homo sapiens
ccccagccaggctcct

SEQ ID NO: 6055860 - DNA, 20 bp, Homo sapiens
ccccagccatgccagctggc

SEQ ID NO: 6055861 - DNA, 22 bp, Homo sapiens
ccccagccatgccagctggcct

SEQ ID NO: 6055862 - DNA, 20 bp, Homo sapiens
ccccagccatggtgaggaag

SEQ ID NO: 6055863 - DNA, 12 bp, Homo sapiens
ccccagcccaat

SEQ ID NO: 6055864 - DNA, 14 bp, Homo sapiens
ccccagcccaataa

SEQ ID NO: 6055865 - DNA, 17 bp, Homo sapiens
ccccagcccaataaagg

SEQ ID NO: 6055866 - DNA, 13 bp, Homo sapiens
ccccagcccacag

SEQ ID NO: 6055867 - DNA, 16 bp, Homo sapiens
ccccagcccaccctcc

SEQ ID NO: 6055868 - DNA, 18 bp, Homo sapiens
ccccagcccacctgctcc

SEQ ID NO: 6055869 - DNA, 19 bp, Homo sapiens
ccccagcccacctgctccc

SEQ ID NO: 6055870 - DNA, 15 bp, Homo sapiens
ccccagcccagacag

SEQ ID NO: 6055871 - DNA, 15 bp, Homo sapiens
ccccagcccagggtg

SEQ ID NO: 6055872 - DNA, 24 bp, Homo sapiens
ccccagccccactgccctccaggg

SEQ ID NO: 6055873 - DNA, 12 bp, Homo sapiens
ccccagccccca

SEQ ID NO: 6055874 - DNA, 22 bp, Homo sapiens
ccccagcccccaaagcagccct

SEQ ID NO: 6055875 - DNA, 14 bp, Homo sapiens
ccccagcccccaca

SEQ ID NO: 6055876 - DNA, 18 bp, Homo sapiens
ccccagcccccacagccc

SEQ ID NO: 6055877 - DNA, 15 bp, Homo sapiens
ccccagcccccaggg

SEQ ID NO: 6055878 - DNA, 21 bp, Homo sapiens
ccccagccccctcccaccgct

SEQ ID NO: 6055879 - DNA, 21 bp, Homo sapiens
ccccagccccgtcccagaggc

SEQ ID NO: 6055880 - DNA, 18 bp, Homo sapiens
ccccagcccctcccccat

SEQ ID NO: 6055881 - DNA, 16 bp, Homo sapiens
ccccagcccctcctcc

SEQ ID NO: 6055882 - DNA, 22 bp, Homo sapiens
ccccagcccctcctccctcaga

SEQ ID NO: 6055883 - DNA, 17 bp, Homo sapiens
ccccagccctcaggcca

SEQ ID NO: 6055884 - DNA, 14 bp, Homo sapiens
ccccagccctcagt

SEQ ID NO: 6055885 - DNA, 20 bp, Homo sapiens
ccccagccctccagtacctt

SEQ ID NO: 6055886 - DNA, 20 bp, Homo sapiens
ccccagccctgctggggatc

SEQ ID NO: 6055887 - DNA, 17 bp, Homo sapiens
ccccagccctggcccct

SEQ ID NO: 6055888 - DNA, 21 bp, Homo sapiens
ccccagccctggcccctccaa

SEQ ID NO: 6055889 - DNA, 19 bp, Homo sapiens
ccccagccctggctctgca

SEQ ID NO: 6055890 - DNA, 13 bp, Homo sapiens
ccccagccctggg

SEQ ID NO: 6055891 - DNA, 16 bp, Homo sapiens
ccccagccctgggaac

SEQ ID NO: 6055892 - DNA, 12 bp, Homo sapiens
ccccagccctgt

SEQ ID NO: 6055893 - DNA, 13 bp, Homo sapiens
ccccagccctgtg

SEQ ID NO: 6055894 - DNA, 14 bp, Homo sapiens
ccccagccctgtgg

SEQ ID NO: 6055895 - DNA, 11 bp, Homo sapiens
ccccagccctt

SEQ ID NO: 6055896 - DNA, 18 bp, Homo sapiens
ccccagcccttcctctgc

SEQ ID NO: 6055897 - DNA, 16 bp, Homo sapiens
ccccagcccttctgcc

SEQ ID NO: 6055898 - DNA, 16 bp, Homo sapiens
ccccagcctacctctc

SEQ ID NO: 6055899 - DNA, 16 bp, Homo sapiens
ccccagcctaggacgc

SEQ ID NO: 6055900 - DNA, 23 bp, Homo sapiens
ccccagcctatgagcatcctgag

SEQ ID NO: 6055901 - DNA, 14 bp, Homo sapiens
ccccagcctcactc

SEQ ID NO: 6055902 - DNA, 13 bp, Homo sapiens
ccccagcctcagc

SEQ ID NO: 6055903 - DNA, 14 bp, Homo sapiens
ccccagcctcagcc

SEQ ID NO: 6055904 - DNA, 20 bp, Homo sapiens
ccccagcctcattccccatt

SEQ ID NO: 6055905 - DNA, 23 bp, Homo sapiens
ccccagcctcattgtgccaagcc

SEQ ID NO: 6055906 - DNA, 13 bp, Homo sapiens
ccccagcctccag

SEQ ID NO: 6055907 - DNA, 21 bp, Homo sapiens
ccccagcctccagagaagccc

SEQ ID NO: 6055908 - DNA, 23 bp, Homo sapiens
ccccagcctcccccaggctgcgc

SEQ ID NO: 6055909 - DNA, 13 bp, Homo sapiens
ccccagcctccct

SEQ ID NO: 6055910 - DNA, 13 bp, Homo sapiens
ccccagcctcgcc

SEQ ID NO: 6055911 - DNA, 22 bp, Homo sapiens
ccccagcctcgcctgtcacccc

SEQ ID NO: 6055912 - DNA, 11 bp, Homo sapiens
ccccagcctga

SEQ ID NO: 6055913 - DNA, 11 bp, Homo sapiens
ccccagcctgc

SEQ ID NO: 6055914 - DNA, 23 bp, Homo sapiens
ccccagcctgccccagcctccca

SEQ ID NO: 6055915 - DNA, 18 bp, Homo sapiens
ccccagcctgcgcctgct

SEQ ID NO: 6055916 - DNA, 22 bp, Homo sapiens
ccaccctacctgttcagtgtcc

SEQ ID NO: 6055917 - DNA, 14 bp, Homo sapiens
ccaccctacgctca

SEQ ID NO: 6055918 - DNA, 23 bp, Homo sapiens
ccaccctacttcattttcagagt

SEQ ID NO: 6055919 - DNA, 20 bp, Homo sapiens
ccaccctcaccgcggctgga

SEQ ID NO: 6055920 - DNA, 21 bp, Homo sapiens
ccaccctcactggctctcctg

SEQ ID NO: 6055921 - DNA, 19 bp, Homo sapiens
ccaccctcagcaccccttc

SEQ ID NO: 6055922 - DNA, 15 bp, Homo sapiens
ccaccctcaggtgcc

SEQ ID NO: 6055923 - DNA, 15 bp, Homo sapiens
ccaccctccactctc

SEQ ID NO: 6055924 - DNA, 17 bp, Homo sapiens
ccaccctccatgctcct

SEQ ID NO: 6055925 - DNA, 12 bp, Homo sapiens
ccaccctcccta

SEQ ID NO: 6055926 - DNA, 19 bp, Homo sapiens
ccaccctccctccactcct

SEQ ID NO: 6055927 - DNA, 20 bp, Homo sapiens
ccaccctccctgactggcct

SEQ ID NO: 6055928 - DNA, 13 bp, Homo sapiens
ccaccctccctgg

SEQ ID NO: 6055929 - DNA, 11 bp, Homo sapiens
ccaccctcctc

SEQ ID NO: 6055930 - DNA, 18 bp, Homo sapiens
ccaccctcctcttggaat

SEQ ID NO: 6055931 - DNA, 21 bp, Homo sapiens
ccaccctcctgccccacactc

SEQ ID NO: 6055932 - DNA, 12 bp, Homo sapiens
ccaccctcctgg

SEQ ID NO: 6055933 - DNA, 13 bp, Homo sapiens
ccaccctcctgtc

SEQ ID NO: 6055934 - DNA, 15 bp, Homo sapiens
ccaccctcctgtctt

SEQ ID NO: 6055935 - DNA, 17 bp, Homo sapiens
ccaccctcctgtcttcc

SEQ ID NO: 6055936 - DNA, 19 bp, Homo sapiens
ccaccctcctgtcttccca

SEQ ID NO: 6055937 - DNA, 21 bp, Homo sapiens
ccaccctcctgtcttcccagg

SEQ ID NO: 6055938 - DNA, 22 bp, Homo sapiens
ccaccctcctgtcttcccaggg

SEQ ID NO: 6055939 - DNA, 14 bp, Homo sapiens
ccaccctccttccc

SEQ ID NO: 6055940 - DNA, 14 bp, Homo sapiens
ccaccctcgctgcc

SEQ ID NO: 6055941 - DNA, 15 bp, Homo sapiens
ccaccctcgctgcca

SEQ ID NO: 6055942 - DNA, 22 bp, Homo sapiens
ccaccctcggggatgtgtcctg

SEQ ID NO: 6055943 - DNA, 18 bp, Homo sapiens
ccaccctcgtggacacct

SEQ ID NO: 6055944 - DNA, 22 bp, Homo sapiens
ccaccctcgtggacacctgccc

SEQ ID NO: 6055945 - DNA, 13 bp, Homo sapiens
ccaccctctccac

SEQ ID NO: 6055946 - DNA, 19 bp, Homo sapiens
ccaccctctccacacccag

SEQ ID NO: 6055947 - DNA, 13 bp, Homo sapiens
ccaccctctccat

SEQ ID NO: 6055948 - DNA, 12 bp, Homo sapiens
ccaccctctgca

SEQ ID NO: 6055949 - DNA, 14 bp, Homo sapiens
ccaccctctgcagg

SEQ ID NO: 6055950 - DNA, 20 bp, Homo sapiens
ccaccctctgcagggcagcc

SEQ ID NO: 6055951 - DNA, 21 bp, Homo sapiens
ccaccctctgctgcacagtag

SEQ ID NO: 6055952 - DNA, 13 bp, Homo sapiens
ccaccctctggga

SEQ ID NO: 6055953 - DNA, 14 bp, Homo sapiens
ccaccctctgtgag

SEQ ID NO: 6055954 - DNA, 16 bp, Homo sapiens
ccaccctgaaagccct

SEQ ID NO: 6055955 - DNA, 14 bp, Homo sapiens
ccaccctgagcctg

SEQ ID NO: 6055956 - DNA, 12 bp, Homo sapiens
ccaccctgagct

SEQ ID NO: 6055957 - DNA, 15 bp, Homo sapiens
ccaccctgaggagtc

SEQ ID NO: 6055958 - DNA, 23 bp, Homo sapiens
ccaccctgaggagtctgaggtcc

SEQ ID NO: 6055959 - DNA, 11 bp, Homo sapiens
ccaccctgcat

SEQ ID NO: 6055960 - DNA, 19 bp, Homo sapiens
ccaccctgccaagactcct

SEQ ID NO: 6055961 - DNA, 14 bp, Homo sapiens
ccaccctgccatgg

SEQ ID NO: 6055962 - DNA, 15 bp, Homo sapiens
ccaccctgccatgga

SEQ ID NO: 6055963 - DNA, 13 bp, Homo sapiens
ccaccctgcccct

SEQ ID NO: 6055964 - DNA, 13 bp, Homo sapiens
ccaccctgccctg

SEQ ID NO: 6055965 - DNA, 14 bp, Homo sapiens
ccaccctgccctgc

SEQ ID NO: 6055966 - DNA, 16 bp, Homo sapiens
ccaccctgccctgctg

SEQ ID NO: 6055967 - DNA, 17 bp, Homo sapiens
ccaccctgccctgctga

SEQ ID NO: 6055968 - DNA, 15 bp, Homo sapiens
ccaccctgccctggc

SEQ ID NO: 6055969 - DNA, 18 bp, Homo sapiens
ccaccctgcctgtggagg

SEQ ID NO: 6055970 - DNA, 20 bp, Homo sapiens
ccaccctgcgggccagggtc

SEQ ID NO: 6055971 - DNA, 10 bp, Homo sapiens
ccaccctgct

SEQ ID NO: 6055972 - DNA, 13 bp, Homo sapiens
ccaccctgctcat

SEQ ID NO: 6055973 - DNA, 13 bp, Homo sapiens
ccaccctgctcct

SEQ ID NO: 6055974 - DNA, 17 bp, Homo sapiens
ccaccctgctcctcctg

SEQ ID NO: 6055975 - DNA, 16 bp, Homo sapiens
ccaccctgctgcacta

SEQ ID NO: 6055976 - DNA, 18 bp, Homo sapiens
ccaccctgctgcactagg

SEQ ID NO: 6055977 - DNA, 15 bp, Homo sapiens
ccaccctgctgctgg

SEQ ID NO: 6055978 - DNA, 12 bp, Homo sapiens
ccaccctgcttc

SEQ ID NO: 6055979 - DNA, 17 bp, Homo sapiens
ccaccctgcttctgctg

SEQ ID NO: 6055980 - DNA, 17 bp, Homo sapiens
ccaccctgcttggccca

SEQ ID NO: 6055981 - DNA, 12 bp, Homo sapiens
ccaccctggcag

SEQ ID NO: 6055982 - DNA, 13 bp, Homo sapiens
ccaccctggcccg

SEQ ID NO: 6055983 - DNA, 22 bp, Homo sapiens
ccaccctggccgagtccaagct

SEQ ID NO: 6055984 - DNA, 10 bp, Homo sapiens
ccaccctggg

SEQ ID NO: 6055985 - DNA, 22 bp, Homo sapiens
ccaccctgggcaatgcagtgca

SEQ ID NO: 6055986 - DNA, 13 bp, Homo sapiens
ccaccctgggccc

SEQ ID NO: 6055987 - DNA, 14 bp, Homo sapiens
ccaccctgggcctc

SEQ ID NO: 6055988 - DNA, 15 bp, Homo sapiens
ccaccctgggctctg

SEQ ID NO: 6055989 - DNA, 18 bp, Homo sapiens
ccaccctgggctctgtgg

SEQ ID NO: 6055990 - DNA, 20 bp, Homo sapiens
ccaccctgggctctgtgggc

SEQ ID NO: 6055991 - DNA, 11 bp, Homo sapiens
ccaccctgggg

SEQ ID NO: 6055992 - DNA, 22 bp, Homo sapiens
ccaccctgggtttggcccctgg

SEQ ID NO: 6055993 - DNA, 21 bp, Homo sapiens
ccaccctgtacctcatcccat

SEQ ID NO: 6055994 - DNA, 14 bp, Homo sapiens
ccaccctgtcccag

SEQ ID NO: 6055995 - DNA, 17 bp, Homo sapiens
ccaccctgtcccaggca

SEQ ID NO: 6055996 - DNA, 14 bp, Homo sapiens
ccaccctgtccccc

SEQ ID NO: 6055997 - DNA, 18 bp, Homo sapiens
ccaccctgtcccccagct

SEQ ID NO: 6055998 - DNA, 19 bp, Homo sapiens
ccaccctgtcccccagctc

SEQ ID NO: 6055999 - DNA, 15 bp, Homo sapiens
ccaccctgtctgcag

SEQ ID NO: 6056000 - DNA, 16 bp, Homo sapiens
ccaccctgtcttcctc

SEQ ID NO: 6056001 - DNA, 18 bp, Homo sapiens
ccaccctgtcttcctctg

SEQ ID NO: 6056002 - DNA, 19 bp, Homo sapiens
ccaccctgtcttcctctgc

SEQ ID NO: 6056003 - DNA, 12 bp, Homo sapiens
ccaccctgtggc

SEQ ID NO: 6056004 - DNA, 12 bp, Homo sapiens
ccaccctgtgtt

SEQ ID NO: 6056005 - DNA, 17 bp, Homo sapiens
ccaccctgttcctgctg

SEQ ID NO: 6056006 - DNA, 16 bp, Homo sapiens
ccacccttacttcctg

SEQ ID NO: 6056007 - DNA, 19 bp, Homo sapiens
ccacccttcacgctggctt

SEQ ID NO: 6056008 - DNA, 14 bp, Homo sapiens
ccacccttcagacc

SEQ ID NO: 6056009 - DNA, 13 bp, Homo sapiens
ccacccttccatc

SEQ ID NO: 6056010 - DNA, 14 bp, Homo sapiens
ccacccttccatca

SEQ ID NO: 6056011 - DNA, 16 bp, Homo sapiens
ccacccttccatcagc

SEQ ID NO: 6056012 - DNA, 11 bp, Homo sapiens
ccacccttccc

SEQ ID NO: 6056013 - DNA, 15 bp, Homo sapiens
ccacccttccctgcc

SEQ ID NO: 6056014 - DNA, 16 bp, Homo sapiens
ccacccttccctgcct

SEQ ID NO: 6056015 - DNA, 19 bp, Homo sapiens
ccacccttctcccctgccc

SEQ ID NO: 6056016 - DNA, 13 bp, Homo sapiens
ccacccttgccca

SEQ ID NO: 6056017 - DNA, 13 bp, Homo sapiens
ccacccttgggca

SEQ ID NO: 6056018 - DNA, 14 bp, Homo sapiens
ccacccttggtctc

SEQ ID NO: 6056019 - DNA, 18 bp, Homo sapiens
ccacccttggtctcatgc

SEQ ID NO: 6056020 - DNA, 15 bp, Homo sapiens
ccaccctttctggca

SEQ ID NO: 6056021 - DNA, 15 bp, Homo sapiens
ccaccgaagagccct

SEQ ID NO: 6056022 - DNA, 16 bp, Homo sapiens
ccaccgaagagccctg

SEQ ID NO: 6056023 - DNA, 21 bp, Homo sapiens
ccaccgaagagccctgagctc

SEQ ID NO: 6056024 - DNA, 17 bp, Homo sapiens
ccaccgaatatattact

SEQ ID NO: 6056025 - DNA, 16 bp, Homo sapiens
ccaccgaccaactgcc

SEQ ID NO: 6056026 - DNA, 18 bp, Homo sapiens
ccaccgaccaactgccct

SEQ ID NO: 6056027 - DNA, 13 bp, Homo sapiens
ccaccgactgccc

SEQ ID NO: 6056028 - DNA, 14 bp, Homo sapiens
ccaccgactgccca

SEQ ID NO: 6056029 - DNA, 15 bp, Homo sapiens
ccaccgactgcccag

SEQ ID NO: 6056030 - DNA, 15 bp, Homo sapiens
ccaccgagccacgca

SEQ ID NO: 6056031 - DNA, 22 bp, Homo sapiens
ccaccgagctctgtgggaaaaa

SEQ ID NO: 6056032 - DNA, 14 bp, Homo sapiens
ccaccgaggagccc

SEQ ID NO: 6056033 - DNA, 15 bp, Homo sapiens
ccaccgaggagcccc

SEQ ID NO: 6056034 - DNA, 23 bp, Homo sapiens
ccaccgaggagccccagccccgt

SEQ ID NO: 6056035 - DNA, 16 bp, Homo sapiens
ccaccgaggttcccag

SEQ ID NO: 6056036 - DNA, 22 bp, Homo sapiens
ccaccgaggttcccagggctgg

SEQ ID NO: 6056037 - DNA, 15 bp, Homo sapiens
ccaccgatggagccc

SEQ ID NO: 6056038 - DNA, 18 bp, Homo sapiens
ccaccgatggagccccca

SEQ ID NO: 6056039 - DNA, 21 bp, Homo sapiens
ccaccgatggagcccccagat

SEQ ID NO: 6056040 - DNA, 13 bp, Homo sapiens
ccaccgcagacag

SEQ ID NO: 6056041 - DNA, 17 bp, Homo sapiens
ccaccgcagacaggacc

SEQ ID NO: 6056042 - DNA, 13 bp, Homo sapiens
ccaccgcagctac

SEQ ID NO: 6056043 - DNA, 16 bp, Homo sapiens
ccaccgcagctgctgc

SEQ ID NO: 6056044 - DNA, 17 bp, Homo sapiens
ccaccgcagctgctgcc

SEQ ID NO: 6056045 - DNA, 19 bp, Homo sapiens
ccaccgcagctgctgccac

SEQ ID NO: 6056046 - DNA, 21 bp, Homo sapiens
ccaccgcagctgctgccactc

SEQ ID NO: 6056047 - DNA, 22 bp, Homo sapiens
ccaccgcagctgctgccactct

SEQ ID NO: 6056048 - DNA, 12 bp, Homo sapiens
ccaccgcagggg

SEQ ID NO: 6056049 - DNA, 23 bp, Homo sapiens
ccaccgcatatgcatgccaggct

SEQ ID NO: 6056050 - DNA, 17 bp, Homo sapiens
ccaccgcatcctcactg

SEQ ID NO: 6056051 - DNA, 23 bp, Homo sapiens
ccaccgcatcctcactgggctca

SEQ ID NO: 6056052 - DNA, 15 bp, Homo sapiens
ccaccgccaccccac

SEQ ID NO: 6056053 - DNA, 17 bp, Homo sapiens
ccaccgccatggcttcc

SEQ ID NO: 6056054 - DNA, 23 bp, Homo sapiens
ccaccgcccactctccacctcac

SEQ ID NO: 6056055 - DNA, 17 bp, Homo sapiens
ccaccgcccctggccgc

SEQ ID NO: 6056056 - DNA, 18 bp, Homo sapiens
ccaccgcgcccctctgcg

SEQ ID NO: 6056057 - DNA, 22 bp, Homo sapiens
ccaccgctagtgcttgtggaga

SEQ ID NO: 6056058 - DNA, 13 bp, Homo sapiens
ccaccgctcagtg

SEQ ID NO: 6056059 - DNA, 16 bp, Homo sapiens
ccaccgctcagtgtca

SEQ ID NO: 6056060 - DNA, 14 bp, Homo sapiens
ccaccgctgcctaa

SEQ ID NO: 6056061 - DNA, 22 bp, Homo sapiens
ccaccgctgccttttgctgctg

SEQ ID NO: 6056062 - DNA, 16 bp, Homo sapiens
ccaccggcactcatga

SEQ ID NO: 6056063 - DNA, 17 bp, Homo sapiens
ccaccggcccctggcag

SEQ ID NO: 6056064 - DNA, 14 bp, Homo sapiens
ccaccggcctcggc

SEQ ID NO: 6056065 - DNA, 19 bp, Homo sapiens
ccaccgggacagacctgga

SEQ ID NO: 6056066 - DNA, 17 bp, Homo sapiens
ccaccgggagcctcccc

SEQ ID NO: 6056067 - DNA, 22 bp, Homo sapiens
ccaccgggcatgtctgcctgga

SEQ ID NO: 6056068 - DNA, 22 bp, Homo sapiens
ccaccgggccactccttcctgc

SEQ ID NO: 6056069 - DNA, 18 bp, Homo sapiens
ccaccgggctgcaggtgc

SEQ ID NO: 6056070 - DNA, 21 bp, Homo sapiens
ccaccgggctgcaggtgctgc

SEQ ID NO: 6056071 - DNA, 18 bp, Homo sapiens
ccaccggggaacccagcc

SEQ ID NO: 6056072 - DNA, 22 bp, Homo sapiens
ccaccggggcactggctgctct

SEQ ID NO: 6056073 - DNA, 23 bp, Homo sapiens
ccaccggggcactggctgctctg

SEQ ID NO: 6056074 - DNA, 18 bp, Homo sapiens
ccaccgggggtggctctg

SEQ ID NO: 6056075 - DNA, 19 bp, Homo sapiens
ccaccgggggtggctctgt

SEQ ID NO: 6056076 - DNA, 21 bp, Homo sapiens
ccaccgggttctgcagcggca

SEQ ID NO: 6056077 - DNA, 13 bp, Homo sapiens
ccaccggtgcctc

SEQ ID NO: 6056078 - DNA, 15 bp, Homo sapiens
ccaccggtgggcagt

SEQ ID NO: 6056079 - DNA, 19 bp, Homo sapiens
ccaccgtagggcctgactc

SEQ ID NO: 6056080 - DNA, 16 bp, Homo sapiens
ccaccgtccctctgca

SEQ ID NO: 6056081 - DNA, 13 bp, Homo sapiens
ccaccgtccgccc

SEQ ID NO: 6056082 - DNA, 22 bp, Homo sapiens
ccaccgtcctgtcagctccttg

SEQ ID NO: 6056083 - DNA, 14 bp, Homo sapiens
ccaccgtctcggcc

SEQ ID NO: 6056084 - DNA, 18 bp, Homo sapiens
ccaccgtctcggccctga

SEQ ID NO: 6056085 - DNA, 15 bp, Homo sapiens
ccaccgtgaaccaga

SEQ ID NO: 6056086 - DNA, 19 bp, Homo sapiens
ccaccgtgggcagtgccac

SEQ ID NO: 6056087 - DNA, 14 bp, Homo sapiens
ccaccgtgggggaa

SEQ ID NO: 6056088 - DNA, 19 bp, Homo sapiens
ccaccgttcaagcgccaga

SEQ ID NO: 6056089 - DNA, 20 bp, Homo sapiens
ccacctaaagggaagccctg

SEQ ID NO: 6056090 - DNA, 17 bp, Homo sapiens
ccacctaatcaggctga

SEQ ID NO: 6056091 - DNA, 15 bp, Homo sapiens
ccacctacacaggag

SEQ ID NO: 6056092 - DNA, 14 bp, Homo sapiens
ccacctacacccct

SEQ ID NO: 6056093 - DNA, 14 bp, Homo sapiens
ccacctactgcact

SEQ ID NO: 6056094 - DNA, 19 bp, Homo sapiens
ccacctagaacactaactc

SEQ ID NO: 6056095 - DNA, 22 bp, Homo sapiens
ccacctagaatggaagcctcca

SEQ ID NO: 6056096 - DNA, 16 bp, Homo sapiens
ccacctagactctccc

SEQ ID NO: 6056097 - DNA, 13 bp, Homo sapiens
ccacctagcagca

SEQ ID NO: 6056098 - DNA, 19 bp, Homo sapiens
ccccagcctgcgcctgctg

SEQ ID NO: 6056099 - DNA, 12 bp, Homo sapiens
ccccagcctgct

SEQ ID NO: 6056100 - DNA, 13 bp, Homo sapiens
ccccagcctgcta

SEQ ID NO: 6056101 - DNA, 17 bp, Homo sapiens
ccccagcctggccagac

SEQ ID NO: 6056102 - DNA, 15 bp, Homo sapiens
ccccagcctggccca

SEQ ID NO: 6056103 - DNA, 16 bp, Homo sapiens
ccccagcctggcccag

SEQ ID NO: 6056104 - DNA, 21 bp, Homo sapiens
ccccagcctggcccagctccc

SEQ ID NO: 6056105 - DNA, 13 bp, Homo sapiens
ccccagcctgggc

SEQ ID NO: 6056106 - DNA, 16 bp, Homo sapiens
ccccagcctgggccta

SEQ ID NO: 6056107 - DNA, 19 bp, Homo sapiens
ccccagcctgtagggaact

SEQ ID NO: 6056108 - DNA, 14 bp, Homo sapiens
ccccagccttgccc

SEQ ID NO: 6056109 - DNA, 23 bp, Homo sapiens
ccccagcgcggcttggccgccat

SEQ ID NO: 6056110 - DNA, 16 bp, Homo sapiens
ccccagcgcttagaaa

SEQ ID NO: 6056111 - DNA, 22 bp, Homo sapiens
ccccagcgggctggcgggcctt

SEQ ID NO: 6056112 - DNA, 20 bp, Homo sapiens
ccccagcgtcaggcctacct

SEQ ID NO: 6056113 - DNA, 16 bp, Homo sapiens
ccccagcgtcagtttc

SEQ ID NO: 6056114 - DNA, 15 bp, Homo sapiens
ccccagcgtcttgac

SEQ ID NO: 6056115 - DNA, 22 bp, Homo sapiens
ccccagcgtggggctaacgggc

SEQ ID NO: 6056116 - DNA, 19 bp, Homo sapiens
ccccagctaagaacctgga

SEQ ID NO: 6056117 - DNA, 17 bp, Homo sapiens
ccccagctagggctgga

SEQ ID NO: 6056118 - DNA, 21 bp, Homo sapiens
ccccagctattttctgaccaa

SEQ ID NO: 6056119 - DNA, 17 bp, Homo sapiens
ccccagctcaggggcag

SEQ ID NO: 6056120 - DNA, 11 bp, Homo sapiens
ccccagctcca

SEQ ID NO: 6056121 - DNA, 13 bp, Homo sapiens
ccccagctcccac

SEQ ID NO: 6056122 - DNA, 14 bp, Homo sapiens
ccccagctcccaca

SEQ ID NO: 6056123 - DNA, 18 bp, Homo sapiens
ccccagctcccccaggca

SEQ ID NO: 6056124 - DNA, 15 bp, Homo sapiens
ccccagctccctgca

SEQ ID NO: 6056125 - DNA, 19 bp, Homo sapiens
ccccagctccgacctctct

SEQ ID NO: 6056126 - DNA, 19 bp, Homo sapiens
ccccagctccggagggggt

SEQ ID NO: 6056127 - DNA, 22 bp, Homo sapiens
ccccagctccttggctgcagcc

SEQ ID NO: 6056128 - DNA, 17 bp, Homo sapiens
ccccagctcgctggctt

SEQ ID NO: 6056129 - DNA, 17 bp, Homo sapiens
ccccagctctggcttcc

SEQ ID NO: 6056130 - DNA, 22 bp, Homo sapiens
ccccagctctggtgagtcttgg

SEQ ID NO: 6056131 - DNA, 17 bp, Homo sapiens
ccccagctcttctcttc

SEQ ID NO: 6056132 - DNA, 19 bp, Homo sapiens
ccccagctgccaggcggcc

SEQ ID NO: 6056133 - DNA, 22 bp, Homo sapiens
ccccagctgccaggcggccctg

SEQ ID NO: 6056134 - DNA, 20 bp, Homo sapiens
ccccagctgccggcagtgct

SEQ ID NO: 6056135 - DNA, 21 bp, Homo sapiens
ccccagctgccggcagtgctg

SEQ ID NO: 6056136 - DNA, 16 bp, Homo sapiens
ccccagctgcgttttt

SEQ ID NO: 6056137 - DNA, 19 bp, Homo sapiens
ccccagctgctcctcgcag

SEQ ID NO: 6056138 - DNA, 23 bp, Homo sapiens
ccccagctgctctaagcccagga

SEQ ID NO: 6056139 - DNA, 12 bp, Homo sapiens
ccccagctggga

SEQ ID NO: 6056140 - DNA, 13 bp, Homo sapiens
ccccagctgggag

SEQ ID NO: 6056141 - DNA, 14 bp, Homo sapiens
ccccagctgggagg

SEQ ID NO: 6056142 - DNA, 15 bp, Homo sapiens
ccccagctgggctgt

SEQ ID NO: 6056143 - DNA, 22 bp, Homo sapiens
ccccagctgtgactgagggcct

SEQ ID NO: 6056144 - DNA, 19 bp, Homo sapiens
ccccagctgtgagccttgg

SEQ ID NO: 6056145 - DNA, 17 bp, Homo sapiens
ccccagcttccagcagg

SEQ ID NO: 6056146 - DNA, 21 bp, Homo sapiens
ccccagcttccagcaggaggg

SEQ ID NO: 6056147 - DNA, 21 bp, Homo sapiens
ccccagcttctcagctcgctg

SEQ ID NO: 6056148 - DNA, 17 bp, Homo sapiens
ccccagcttttcttgcc

SEQ ID NO: 6056149 - DNA, 17 bp, Homo sapiens
ccccaggaagcccactg

SEQ ID NO: 6056150 - DNA, 21 bp, Homo sapiens
ccccaggaagcccactgcctc

SEQ ID NO: 6056151 - DNA, 20 bp, Homo sapiens
ccccaggaatttgggaccct

SEQ ID NO: 6056152 - DNA, 11 bp, Homo sapiens
ccccaggacca

SEQ ID NO: 6056153 - DNA, 13 bp, Homo sapiens
ccccaggaccagc

SEQ ID NO: 6056154 - DNA, 12 bp, Homo sapiens
ccccaggacccc

SEQ ID NO: 6056155 - DNA, 19 bp, Homo sapiens
ccccaggacccctgtccag

SEQ ID NO: 6056156 - DNA, 14 bp, Homo sapiens
ccccaggaccctga

SEQ ID NO: 6056157 - DNA, 20 bp, Homo sapiens
ccccaggacctggctgccat

SEQ ID NO: 6056158 - DNA, 16 bp, Homo sapiens
ccccaggactcaccct

SEQ ID NO: 6056159 - DNA, 15 bp, Homo sapiens
ccccaggactctggc

SEQ ID NO: 6056160 - DNA, 16 bp, Homo sapiens
ccccaggactgggcca

SEQ ID NO: 6056161 - DNA, 20 bp, Homo sapiens
ccccaggagcagctggcact

SEQ ID NO: 6056162 - DNA, 18 bp, Homo sapiens
ccccaggagctctctgct

SEQ ID NO: 6056163 - DNA, 10 bp, Homo sapiens
ccccaggagg

SEQ ID NO: 6056164 - DNA, 20 bp, Homo sapiens
ccccaggaggcagctcagga

SEQ ID NO: 6056165 - DNA, 17 bp, Homo sapiens
ccccaggatcccagagc

SEQ ID NO: 6056166 - DNA, 19 bp, Homo sapiens
ccccaggattcccagagag

SEQ ID NO: 6056167 - DNA, 15 bp, Homo sapiens
ccccaggattccccc

SEQ ID NO: 6056168 - DNA, 16 bp, Homo sapiens
ccccaggcaccgccag

SEQ ID NO: 6056169 - DNA, 14 bp, Homo sapiens
ccccaggcactgtt

SEQ ID NO: 6056170 - DNA, 18 bp, Homo sapiens
ccccaggcactgtttgga

SEQ ID NO: 6056171 - DNA, 12 bp, Homo sapiens
ccccaggcagaa

SEQ ID NO: 6056172 - DNA, 14 bp, Homo sapiens
ccccaggcagaggg

SEQ ID NO: 6056173 - DNA, 13 bp, Homo sapiens
ccccaggcagcca

SEQ ID NO: 6056174 - DNA, 21 bp, Homo sapiens
ccccaggcagccaccagtgga

SEQ ID NO: 6056175 - DNA, 18 bp, Homo sapiens
ccccaggcaggctgtgcg

SEQ ID NO: 6056176 - DNA, 15 bp, Homo sapiens
ccccaggcatcccat

SEQ ID NO: 6056177 - DNA, 22 bp, Homo sapiens
ccccaggcatctgttagcagag

SEQ ID NO: 6056178 - DNA, 15 bp, Homo sapiens
ccccaggccaatgca

SEQ ID NO: 6056179 - DNA, 15 bp, Homo sapiens
ccccaggccagctgc

SEQ ID NO: 6056180 - DNA, 15 bp, Homo sapiens
ccccaggccaggcca

SEQ ID NO: 6056181 - DNA, 13 bp, Homo sapiens
ccccaggccaggt

SEQ ID NO: 6056182 - DNA, 14 bp, Homo sapiens
ccccaggccaggta

SEQ ID NO: 6056183 - DNA, 15 bp, Homo sapiens
ccccaggccaggtcc

SEQ ID NO: 6056184 - DNA, 11 bp, Homo sapiens
ccccaggccca

SEQ ID NO: 6056185 - DNA, 14 bp, Homo sapiens
ccccaggcccagcc

SEQ ID NO: 6056186 - DNA, 18 bp, Homo sapiens
ccccaggccccagacagg

SEQ ID NO: 6056187 - DNA, 19 bp, Homo sapiens
ccccaggccccaggaagcc

SEQ ID NO: 6056188 - DNA, 12 bp, Homo sapiens
ccccaggccccg

SEQ ID NO: 6056189 - DNA, 13 bp, Homo sapiens
ccccaggccccga

SEQ ID NO: 6056190 - DNA, 13 bp, Homo sapiens
ccccaggcccttc

SEQ ID NO: 6056191 - DNA, 15 bp, Homo sapiens
ccccaggccggagcc

SEQ ID NO: 6056192 - DNA, 18 bp, Homo sapiens
ccccaggccggagcccag

SEQ ID NO: 6056193 - DNA, 10 bp, Homo sapiens
ccccaggcct

SEQ ID NO: 6056194 - DNA, 14 bp, Homo sapiens
ccccaggcctccag

SEQ ID NO: 6056195 - DNA, 19 bp, Homo sapiens
ccccaggcctccagaacct

SEQ ID NO: 6056196 - DNA, 23 bp, Homo sapiens
ccccaggcctcctaggggaaggg

SEQ ID NO: 6056197 - DNA, 21 bp, Homo sapiens
ccccaggcctgaaagaggctg

SEQ ID NO: 6056198 - DNA, 23 bp, Homo sapiens
ccccaggcctgaaagaggctgag

SEQ ID NO: 6056199 - DNA, 16 bp, Homo sapiens
ccccaggcctgccctg

SEQ ID NO: 6056200 - DNA, 19 bp, Homo sapiens
ccccaggcctgccctgcta

SEQ ID NO: 6056201 - DNA, 18 bp, Homo sapiens
ccccaggcctggacgggc

SEQ ID NO: 6056202 - DNA, 21 bp, Homo sapiens
ccccaggcctggacgggccct

SEQ ID NO: 6056203 - DNA, 23 bp, Homo sapiens
ccccaggcctggcctcgcctgcc

SEQ ID NO: 6056204 - DNA, 16 bp, Homo sapiens
ccccaggcctgtccac

SEQ ID NO: 6056205 - DNA, 21 bp, Homo sapiens
ccccaggcctgtccaccctgc

SEQ ID NO: 6056206 - DNA, 13 bp, Homo sapiens
ccccaggccttgt

SEQ ID NO: 6056207 - DNA, 21 bp, Homo sapiens
ccccaggcggaggggcttgga

SEQ ID NO: 6056208 - DNA, 22 bp, Homo sapiens
ccccaggctcaggctgcccagc

SEQ ID NO: 6056209 - DNA, 15 bp, Homo sapiens
ccccaggctcgtgga

SEQ ID NO: 6056210 - DNA, 19 bp, Homo sapiens
ccccaggctgagagccaga

SEQ ID NO: 6056211 - DNA, 16 bp, Homo sapiens
ccccaggctgcccaga

SEQ ID NO: 6056212 - DNA, 19 bp, Homo sapiens
ccccaggctgcccagagct

SEQ ID NO: 6056213 - DNA, 14 bp, Homo sapiens
ccccaggctgcgcc

SEQ ID NO: 6056214 - DNA, 11 bp, Homo sapiens
ccccaggctgg

SEQ ID NO: 6056215 - DNA, 19 bp, Homo sapiens
ccccaggctggagtgcagt

SEQ ID NO: 6056216 - DNA, 15 bp, Homo sapiens
ccccaggctgggctg

SEQ ID NO: 6056217 - DNA, 11 bp, Homo sapiens
ccccaggctgt

SEQ ID NO: 6056218 - DNA, 18 bp, Homo sapiens
ccccagggaagcagcagc

SEQ ID NO: 6056219 - DNA, 22 bp, Homo sapiens
ccccagggaagcagcagcctcg

SEQ ID NO: 6056220 - DNA, 17 bp, Homo sapiens
ccccagggaaggaaaaa

SEQ ID NO: 6056221 - DNA, 22 bp, Homo sapiens
ccccagggacaaaacactgtgt

SEQ ID NO: 6056222 - DNA, 22 bp, Homo sapiens
ccccagggacagaggccaagga

SEQ ID NO: 6056223 - DNA, 12 bp, Homo sapiens
ccccagggagag

SEQ ID NO: 6056224 - DNA, 17 bp, Homo sapiens
ccccagggagggggtca

SEQ ID NO: 6056225 - DNA, 12 bp, Homo sapiens
ccccagggcacg

SEQ ID NO: 6056226 - DNA, 18 bp, Homo sapiens
ccccagggcactgccagc

SEQ ID NO: 6056227 - DNA, 22 bp, Homo sapiens
ccccagggcagccagggagagc

SEQ ID NO: 6056228 - DNA, 16 bp, Homo sapiens
ccccagggcccccaca

SEQ ID NO: 6056229 - DNA, 13 bp, Homo sapiens
ccccagggcccct

SEQ ID NO: 6056230 - DNA, 11 bp, Homo sapiens
ccccagggcct

SEQ ID NO: 6056231 - DNA, 14 bp, Homo sapiens
ccccagggcctcca

SEQ ID NO: 6056232 - DNA, 14 bp, Homo sapiens
ccccagggcctgag

SEQ ID NO: 6056233 - DNA, 21 bp, Homo sapiens
ccccagggcctgtctcccttc

SEQ ID NO: 6056234 - DNA, 19 bp, Homo sapiens
ccccagggctatagcagaa

SEQ ID NO: 6056235 - DNA, 16 bp, Homo sapiens
ccccagggctgtgggt

SEQ ID NO: 6056236 - DNA, 19 bp, Homo sapiens
ccccaggggaaagatgagc

SEQ ID NO: 6056237 - DNA, 21 bp, Homo sapiens
ccccaggggacgtgggccctg

SEQ ID NO: 6056238 - DNA, 14 bp, Homo sapiens
ccccaggggcacac

SEQ ID NO: 6056239 - DNA, 20 bp, Homo sapiens
ccccaggggcactgtgttct

SEQ ID NO: 6056240 - DNA, 19 bp, Homo sapiens
ccccaggggcagcaaggcc

SEQ ID NO: 6056241 - DNA, 22 bp, Homo sapiens
ccccaggggtcccagccacccc

SEQ ID NO: 6056242 - DNA, 18 bp, Homo sapiens
ccccagggtcccctgcat

SEQ ID NO: 6056243 - DNA, 19 bp, Homo sapiens
ccccagggtcccctgcatg

SEQ ID NO: 6056244 - DNA, 19 bp, Homo sapiens
ccccagggtcctaaaactt

SEQ ID NO: 6056245 - DNA, 16 bp, Homo sapiens
ccccagggtcctggga

SEQ ID NO: 6056246 - DNA, 20 bp, Homo sapiens
ccccagggtcctgggaggag

SEQ ID NO: 6056247 - DNA, 22 bp, Homo sapiens
ccccagggtctgaaaggggtgt

SEQ ID NO: 6056248 - DNA, 13 bp, Homo sapiens
ccccagggtgagc

SEQ ID NO: 6056249 - DNA, 18 bp, Homo sapiens
ccccagggtgagcagggc

SEQ ID NO: 6056250 - DNA, 20 bp, Homo sapiens
ccccagggtgagcagggccc

SEQ ID NO: 6056251 - DNA, 12 bp, Homo sapiens
ccccagggtggt

SEQ ID NO: 6056252 - DNA, 18 bp, Homo sapiens
ccccagggttctgtattg

SEQ ID NO: 6056253 - DNA, 13 bp, Homo sapiens
ccccagggttgaa

SEQ ID NO: 6056254 - DNA, 22 bp, Homo sapiens
ccccagggtttacatgaagcag

SEQ ID NO: 6056255 - DNA, 17 bp, Homo sapiens
ccccaggtacacctccc

SEQ ID NO: 6056256 - DNA, 16 bp, Homo sapiens
ccccaggtcagcatct

SEQ ID NO: 6056257 - DNA, 15 bp, Homo sapiens
ccccaggtcaggggc

SEQ ID NO: 6056258 - DNA, 16 bp, Homo sapiens
ccccaggtcaggggct

SEQ ID NO: 6056259 - DNA, 24 bp, Homo sapiens
ccccaggtcaggggctccctacat

SEQ ID NO: 6056260 - DNA, 21 bp, Homo sapiens
ccccaggtccagctctggagg

SEQ ID NO: 6056261 - DNA, 14 bp, Homo sapiens
ccccaggtccccaa

SEQ ID NO: 6056262 - DNA, 16 bp, Homo sapiens
ccccaggtctctccac

SEQ ID NO: 6056263 - DNA, 17 bp, Homo sapiens
ccccaggtctctccact

SEQ ID NO: 6056264 - DNA, 20 bp, Homo sapiens
ccccaggtctgatctgggtt

SEQ ID NO: 6056265 - DNA, 17 bp, Homo sapiens
ccccaggtcttcctgct

SEQ ID NO: 6056266 - DNA, 20 bp, Homo sapiens
ccccaggtcttcctgctttc

SEQ ID NO: 6056267 - DNA, 22 bp, Homo sapiens
ccccaggtgcagccccagggcc

SEQ ID NO: 6056268 - DNA, 20 bp, Homo sapiens
ccccaggtgccaccaataaa

SEQ ID NO: 6056269 - DNA, 14 bp, Homo sapiens
ccccaggtgccagt

SEQ ID NO: 6056270 - DNA, 14 bp, Homo sapiens
ccccaggtgctgga

SEQ ID NO: 6056271 - DNA, 17 bp, Homo sapiens
ccccaggtggaaggcag

SEQ ID NO: 6056272 - DNA, 21 bp, Homo sapiens
ccccaggtggcctgcgtcttt

SEQ ID NO: 6056273 - DNA, 13 bp, Homo sapiens
ccccaggtggctg

SEQ ID NO: 6056274 - DNA, 21 bp, Homo sapiens
ccccaggtggctgacccagtc

SEQ ID NO: 6056275 - DNA, 22 bp, Homo sapiens
ccccaggtggttatggagaggg

SEQ ID NO: 6056276 - DNA, 15 bp, Homo sapiens
ccccaggtgtgtgct

SEQ ID NO: 6056277 - DNA, 22 bp, Homo sapiens
ccccaggttcagactgagctcc

SEQ ID NO: 6056278 - DNA, 14 bp, Homo sapiens
ccacctagcagcac

SEQ ID NO: 6056279 - DNA, 23 bp, Homo sapiens
ccacctagcagcaccgttctgtg

SEQ ID NO: 6056280 - DNA, 13 bp, Homo sapiens
ccacctagcccag

SEQ ID NO: 6056281 - DNA, 15 bp, Homo sapiens
ccacctagcccagga

SEQ ID NO: 6056282 - DNA, 17 bp, Homo sapiens
ccacctagcccaggaga

SEQ ID NO: 6056283 - DNA, 16 bp, Homo sapiens
ccacctaggccactcc

SEQ ID NO: 6056284 - DNA, 20 bp, Homo sapiens
ccacctaggccactcctcca

SEQ ID NO: 6056285 - DNA, 22 bp, Homo sapiens
ccacctaggccactcctccaaa

SEQ ID NO: 6056286 - DNA, 18 bp, Homo sapiens
ccacctagtggctgtcca

SEQ ID NO: 6056287 - DNA, 21 bp, Homo sapiens
ccacctagtggctgtccagtg

SEQ ID NO: 6056288 - DNA, 22 bp, Homo sapiens
ccacctagtggctgtccagtgc

SEQ ID NO: 6056289 - DNA, 20 bp, Homo sapiens
ccacctatccaccaccccac

SEQ ID NO: 6056290 - DNA, 22 bp, Homo sapiens
ccacctatccctaacaggctgt

SEQ ID NO: 6056291 - DNA, 21 bp, Homo sapiens
ccacctatctcgtgggagagc

SEQ ID NO: 6056292 - DNA, 18 bp, Homo sapiens
ccacctatgccagtgctc

SEQ ID NO: 6056293 - DNA, 18 bp, Homo sapiens
ccacctatgcctgtggtg

SEQ ID NO: 6056294 - DNA, 16 bp, Homo sapiens
ccacctcaagaccccc

SEQ ID NO: 6056295 - DNA, 18 bp, Homo sapiens
ccacctcacaactccttc

SEQ ID NO: 6056296 - DNA, 12 bp, Homo sapiens
ccacctcacagc

SEQ ID NO: 6056297 - DNA, 18 bp, Homo sapiens
ccacctcactcctgttac

SEQ ID NO: 6056298 - DNA, 15 bp, Homo sapiens
ccacctcagcctccc

SEQ ID NO: 6056299 - DNA, 18 bp, Homo sapiens
ccacctcagcctcccaga

SEQ ID NO: 6056300 - DNA, 15 bp, Homo sapiens
ccacctcagcctcct

SEQ ID NO: 6056301 - DNA, 14 bp, Homo sapiens
ccacctcagccttg

SEQ ID NO: 6056302 - DNA, 15 bp, Homo sapiens
ccacctcagccttgg

SEQ ID NO: 6056303 - DNA, 11 bp, Homo sapiens
ccacctcaggg

SEQ ID NO: 6056304 - DNA, 12 bp, Homo sapiens
ccacctcagggc

SEQ ID NO: 6056305 - DNA, 13 bp, Homo sapiens
ccacctcagggga

SEQ ID NO: 6056306 - DNA, 16 bp, Homo sapiens
ccacctcatccccaac

SEQ ID NO: 6056307 - DNA, 23 bp, Homo sapiens
ccacctcatggattgccacagct

SEQ ID NO: 6056308 - DNA, 14 bp, Homo sapiens
ccacctccacaccc

SEQ ID NO: 6056309 - DNA, 19 bp, Homo sapiens
ccacctccacccagcccct

SEQ ID NO: 6056310 - DNA, 22 bp, Homo sapiens
ccacctccacccccgccacggc

SEQ ID NO: 6056311 - DNA, 14 bp, Homo sapiens
ccacctccactccc

SEQ ID NO: 6056312 - DNA, 21 bp, Homo sapiens
ccacctccactcccacctcac

SEQ ID NO: 6056313 - DNA, 13 bp, Homo sapiens
ccacctccagaaa

SEQ ID NO: 6056314 - DNA, 14 bp, Homo sapiens
ccacctccagaaac

SEQ ID NO: 6056315 - DNA, 12 bp, Homo sapiens
ccacctccagcc

SEQ ID NO: 6056316 - DNA, 14 bp, Homo sapiens
ccacctccagccca

SEQ ID NO: 6056317 - DNA, 17 bp, Homo sapiens
ccacctccagcccacag

SEQ ID NO: 6056318 - DNA, 23 bp, Homo sapiens
ccacctccagcccgggagcctag

SEQ ID NO: 6056319 - DNA, 14 bp, Homo sapiens
ccacctccagcctc

SEQ ID NO: 6056320 - DNA, 16 bp, Homo sapiens
ccacctccagcctctg

SEQ ID NO: 6056321 - DNA, 18 bp, Homo sapiens
ccacctcccaaaggctgt

SEQ ID NO: 6056322 - DNA, 16 bp, Homo sapiens
ccacctcccaccccac

SEQ ID NO: 6056323 - DNA, 22 bp, Homo sapiens
ccacctcccaccccactccagc

SEQ ID NO: 6056324 - DNA, 21 bp, Homo sapiens
ccacctcccactcctgctgca

SEQ ID NO: 6056325 - DNA, 22 bp, Homo sapiens
ccacctccccacacacaggcct

SEQ ID NO: 6056326 - DNA, 13 bp, Homo sapiens
ccacctccccacg

SEQ ID NO: 6056327 - DNA, 15 bp, Homo sapiens
ccacctccccagagc

SEQ ID NO: 6056328 - DNA, 17 bp, Homo sapiens
ccacctccccagagccc

SEQ ID NO: 6056329 - DNA, 23 bp, Homo sapiens
ccacctccccaggccgtggctgc

SEQ ID NO: 6056330 - DNA, 15 bp, Homo sapiens
ccacctcccccaaac

SEQ ID NO: 6056331 - DNA, 13 bp, Homo sapiens
ccacctccccctc

SEQ ID NO: 6056332 - DNA, 15 bp, Homo sapiens
ccacctccccttggg

SEQ ID NO: 6056333 - DNA, 14 bp, Homo sapiens
ccacctcccgccct

SEQ ID NO: 6056334 - DNA, 18 bp, Homo sapiens
ccacctccctcaacctca

SEQ ID NO: 6056335 - DNA, 20 bp, Homo sapiens
ccacctccctcaacctcatc

SEQ ID NO: 6056336 - DNA, 13 bp, Homo sapiens
ccacctccctcac

SEQ ID NO: 6056337 - DNA, 14 bp, Homo sapiens
ccacctccctgcag

SEQ ID NO: 6056338 - DNA, 16 bp, Homo sapiens
ccacctccctgcagct

SEQ ID NO: 6056339 - DNA, 16 bp, Homo sapiens
ccacctccctgcctcc

SEQ ID NO: 6056340 - DNA, 21 bp, Homo sapiens
ccacctccctgcgcccttgag

SEQ ID NO: 6056341 - DNA, 22 bp, Homo sapiens
ccacctccctgcgcccttgagg

SEQ ID NO: 6056342 - DNA, 17 bp, Homo sapiens
ccacctccgccagaccc

SEQ ID NO: 6056343 - DNA, 22 bp, Homo sapiens
ccacctccgccagaccccgtgg

SEQ ID NO: 6056344 - DNA, 22 bp, Homo sapiens
ccacctcctaaaaggcccagag

SEQ ID NO: 6056345 - DNA, 13 bp, Homo sapiens
ccacctcctaccc

SEQ ID NO: 6056346 - DNA, 20 bp, Homo sapiens
ccacctcctaccccttcctg

SEQ ID NO: 6056347 - DNA, 18 bp, Homo sapiens
ccacctcctagaggtggg

SEQ ID NO: 6056348 - DNA, 23 bp, Homo sapiens
ccacctcctagaggtgggcagct

SEQ ID NO: 6056349 - DNA, 13 bp, Homo sapiens
ccacctcctccag

SEQ ID NO: 6056350 - DNA, 19 bp, Homo sapiens
ccacctcctctgccagcag

SEQ ID NO: 6056351 - DNA, 22 bp, Homo sapiens
ccacctcctctgccagcaggaa

SEQ ID NO: 6056352 - DNA, 14 bp, Homo sapiens
ccacctcctgacac

SEQ ID NO: 6056353 - DNA, 14 bp, Homo sapiens
ccacctcctgcggc

SEQ ID NO: 6056354 - DNA, 12 bp, Homo sapiens
ccacctccttct

SEQ ID NO: 6056355 - DNA, 13 bp, Homo sapiens
ccacctccttctc

SEQ ID NO: 6056356 - DNA, 17 bp, Homo sapiens
ccacctccttctctgtc

SEQ ID NO: 6056357 - DNA, 14 bp, Homo sapiens
ccacctccttggca

SEQ ID NO: 6056358 - DNA, 21 bp, Homo sapiens
ccacctcgcggcgcagcccct

SEQ ID NO: 6056359 - DNA, 15 bp, Homo sapiens
ccacctcgctcccct

SEQ ID NO: 6056360 - DNA, 14 bp, Homo sapiens
ccacctcggacacc

SEQ ID NO: 6056361 - DNA, 18 bp, Homo sapiens
ccacctcggagcatggtg

SEQ ID NO: 6056362 - DNA, 14 bp, Homo sapiens
ccacctcggccctc

SEQ ID NO: 6056363 - DNA, 18 bp, Homo sapiens
ccacctcggccctccctg

SEQ ID NO: 6056364 - DNA, 16 bp, Homo sapiens
ccacctcggcctccca

SEQ ID NO: 6056365 - DNA, 14 bp, Homo sapiens
ccacctctaacagc

SEQ ID NO: 6056366 - DNA, 18 bp, Homo sapiens
ccacctctaacagcacca

SEQ ID NO: 6056367 - DNA, 20 bp, Homo sapiens
ccacctctaacagcaccaaa

SEQ ID NO: 6056368 - DNA, 14 bp, Homo sapiens
ccacctctcaatat

SEQ ID NO: 6056369 - DNA, 23 bp, Homo sapiens
ccacctctcaatattcaataaag

SEQ ID NO: 6056370 - DNA, 20 bp, Homo sapiens
ccacctctcacgggccctgc

SEQ ID NO: 6056371 - DNA, 16 bp, Homo sapiens
ccacctctccaagtct

SEQ ID NO: 6056372 - DNA, 16 bp, Homo sapiens
ccacctctccatcctg

SEQ ID NO: 6056373 - DNA, 17 bp, Homo sapiens
ccacctctccccacctt

SEQ ID NO: 6056374 - DNA, 16 bp, Homo sapiens
ccacctctccctgacc

SEQ ID NO: 6056375 - DNA, 12 bp, Homo sapiens
ccacctctcctg

SEQ ID NO: 6056376 - DNA, 16 bp, Homo sapiens
ccacctctccttggaa

SEQ ID NO: 6056377 - DNA, 14 bp, Homo sapiens
ccacctctctcact

SEQ ID NO: 6056378 - DNA, 16 bp, Homo sapiens
ccacctctctcactcc

SEQ ID NO: 6056379 - DNA, 20 bp, Homo sapiens
ccacctctctcactccttga

SEQ ID NO: 6056380 - DNA, 23 bp, Homo sapiens
ccacctctctgcctgttcctccc

SEQ ID NO: 6056381 - DNA, 15 bp, Homo sapiens
ccacctctctgtctt

SEQ ID NO: 6056382 - DNA, 15 bp, Homo sapiens
ccacctctctttttc

SEQ ID NO: 6056383 - DNA, 21 bp, Homo sapiens
ccacctctgacgcaccactgc

SEQ ID NO: 6056384 - DNA, 13 bp, Homo sapiens
ccacctctgagga

SEQ ID NO: 6056385 - DNA, 13 bp, Homo sapiens
ccacctctgccac

SEQ ID NO: 6056386 - DNA, 13 bp, Homo sapiens
ccacctctgcctc

SEQ ID NO: 6056387 - DNA, 18 bp, Homo sapiens
ccacctctgcggacccca

SEQ ID NO: 6056388 - DNA, 15 bp, Homo sapiens
ccacctctgctgccc

SEQ ID NO: 6056389 - DNA, 16 bp, Homo sapiens
ccacctctgctgccca

SEQ ID NO: 6056390 - DNA, 21 bp, Homo sapiens
ccacctctgctgcccacggcc

SEQ ID NO: 6056391 - DNA, 15 bp, Homo sapiens
ccacctctggccctg

SEQ ID NO: 6056392 - DNA, 19 bp, Homo sapiens
ccacctctggccctgtgta

SEQ ID NO: 6056393 - DNA, 13 bp, Homo sapiens
ccacctctggtcc

SEQ ID NO: 6056394 - DNA, 14 bp, Homo sapiens
ccacctctggtggc

SEQ ID NO: 6056395 - DNA, 15 bp, Homo sapiens
ccacctctggtggct

SEQ ID NO: 6056396 - DNA, 15 bp, Homo sapiens
ccacctctgtgacct

SEQ ID NO: 6056397 - DNA, 23 bp, Homo sapiens
ccacctctgtgacctcaggcact

SEQ ID NO: 6056398 - DNA, 21 bp, Homo sapiens
ccacctctgtggcattgaaat

SEQ ID NO: 6056399 - DNA, 23 bp, Homo sapiens
ccacctctgtgggcactggtggg

SEQ ID NO: 6056400 - DNA, 12 bp, Homo sapiens
ccacctcttcct

SEQ ID NO: 6056401 - DNA, 13 bp, Homo sapiens
ccacctcttcctt

SEQ ID NO: 6056402 - DNA, 16 bp, Homo sapiens
ccacctcttctcttcc

SEQ ID NO: 6056403 - DNA, 18 bp, Homo sapiens
ccacctcttctcttcctg

SEQ ID NO: 6056404 - DNA, 23 bp, Homo sapiens
ccacctcttctcttcctgtaaca

SEQ ID NO: 6056405 - DNA, 20 bp, Homo sapiens
ccacctcttgggcatgctca

SEQ ID NO: 6056406 - DNA, 23 bp, Homo sapiens
ccacctcttgggcatgctcagcc

SEQ ID NO: 6056407 - DNA, 17 bp, Homo sapiens
ccacctcttgtcagtgc

SEQ ID NO: 6056408 - DNA, 14 bp, Homo sapiens
ccacctcttgtgca

SEQ ID NO: 6056409 - DNA, 22 bp, Homo sapiens
ccacctcttgtgcaaggtggcc

SEQ ID NO: 6056410 - DNA, 19 bp, Homo sapiens
ccacctctttctacagcct

SEQ ID NO: 6056411 - DNA, 20 bp, Homo sapiens
ccacctctttctacagccta

SEQ ID NO: 6056412 - DNA, 18 bp, Homo sapiens
ccacctctttcttcaatt

SEQ ID NO: 6056413 - DNA, 22 bp, Homo sapiens
ccacctctttcttcaattaatg

SEQ ID NO: 6056414 - DNA, 14 bp, Homo sapiens
ccacctcttttcct

SEQ ID NO: 6056415 - DNA, 15 bp, Homo sapiens
ccacctgaaagcctg

SEQ ID NO: 6056416 - DNA, 20 bp, Homo sapiens
ccacctgaagtgatgatgga

SEQ ID NO: 6056417 - DNA, 20 bp, Homo sapiens
ccacctgacaatggcagcta

SEQ ID NO: 6056418 - DNA, 20 bp, Homo sapiens
ccacctgacacaccaggcgc

SEQ ID NO: 6056419 - DNA, 22 bp, Homo sapiens
ccacctgacctcttgctgccag

SEQ ID NO: 6056420 - DNA, 22 bp, Homo sapiens
ccacctgacggctggggaccca

SEQ ID NO: 6056421 - DNA, 20 bp, Homo sapiens
ccacctgaggaactgtctcg

SEQ ID NO: 6056422 - DNA, 17 bp, Homo sapiens
ccacctgaggcaggagg

SEQ ID NO: 6056423 - DNA, 19 bp, Homo sapiens
ccacctgaggctcagccct

SEQ ID NO: 6056424 - DNA, 20 bp, Homo sapiens
ccacctgaggtgggcccagg

SEQ ID NO: 6056425 - DNA, 22 bp, Homo sapiens
ccacctgaggtgggctggggct

SEQ ID NO: 6056426 - DNA, 14 bp, Homo sapiens
ccacctgagttcct

SEQ ID NO: 6056427 - DNA, 15 bp, Homo sapiens
ccacctgagttcctg

SEQ ID NO: 6056428 - DNA, 15 bp, Homo sapiens
ccacctgcaagtgcc

SEQ ID NO: 6056429 - DNA, 16 bp, Homo sapiens
ccacctgcaagtgccc

SEQ ID NO: 6056430 - DNA, 15 bp, Homo sapiens
ccacctgcacaaaca

SEQ ID NO: 6056431 - DNA, 16 bp, Homo sapiens
ccacctgcacaaacat

SEQ ID NO: 6056432 - DNA, 17 bp, Homo sapiens
ccacctgcacaaacata

SEQ ID NO: 6056433 - DNA, 23 bp, Homo sapiens
ccacctgcacaaacatagacaga

SEQ ID NO: 6056434 - DNA, 15 bp, Homo sapiens
ccacctgcagcgtct

SEQ ID NO: 6056435 - DNA, 17 bp, Homo sapiens
ccacctgcagctccctc

SEQ ID NO: 6056436 - DNA, 9 bp, Homo sapiens
ccacctgcc

SEQ ID NO: 6056437 - DNA, 12 bp, Homo sapiens
ccacctgccaca

SEQ ID NO: 6056438 - DNA, 18 bp, Homo sapiens
ccacctgccacccccagg

SEQ ID NO: 6056439 - DNA, 17 bp, Homo sapiens
ccacctgccagccatca

SEQ ID NO: 6056440 - DNA, 14 bp, Homo sapiens
ccacctgccaggcc

SEQ ID NO: 6056441 - DNA, 20 bp, Homo sapiens
ccacctgccaggctgcaggg

SEQ ID NO: 6056442 - DNA, 13 bp, Homo sapiens
ccacctgccaggg

SEQ ID NO: 6056443 - DNA, 23 bp, Homo sapiens
ccacctgcccccttctcccacac

SEQ ID NO: 6056444 - DNA, 22 bp, Homo sapiens
ccacctgcccggcccaggagcg

SEQ ID NO: 6056445 - DNA, 20 bp, Homo sapiens
ccacctgcctatccatcctg

SEQ ID NO: 6056446 - DNA, 21 bp, Homo sapiens
ccacctgcctatccatcctgc

SEQ ID NO: 6056447 - DNA, 22 bp, Homo sapiens
ccacctgcctcggcctcccaaa

SEQ ID NO: 6056448 - DNA, 13 bp, Homo sapiens
ccacctgcctcta

SEQ ID NO: 6056449 - DNA, 16 bp, Homo sapiens
ccacctgcctgcgtct

SEQ ID NO: 6056450 - DNA, 23 bp, Homo sapiens
ccacctgcctgcgtcttccgccc

SEQ ID NO: 6056451 - DNA, 12 bp, Homo sapiens
ccacctgcctgg

SEQ ID NO: 6056452 - DNA, 23 bp, Homo sapiens
ccacctgcctggccggccagcca

SEQ ID NO: 6056453 - DNA, 22 bp, Homo sapiens
ccacctgcctggtgcattgctg

SEQ ID NO: 6056454 - DNA, 17 bp, Homo sapiens
ccacctgcctgttgggc

SEQ ID NO: 6056455 - DNA, 13 bp, Homo sapiens
ccacctgccttct

SEQ ID NO: 6056456 - DNA, 23 bp, Homo sapiens
ccacctgccttggcctcccaaag

SEQ ID NO: 6056457 - DNA, 21 bp, Homo sapiens
ccccaggtttttgcccatcct

SEQ ID NO: 6056458 - DNA, 18 bp, Homo sapiens
ccccagtaagccactgcc

SEQ ID NO: 6056459 - DNA, 18 bp, Homo sapiens
ccccagtatctcttcagt

SEQ ID NO: 6056460 - DNA, 22 bp, Homo sapiens
ccccagtcagaagttctgggtg

SEQ ID NO: 6056461 - DNA, 14 bp, Homo sapiens
ccccagtcagcctc

SEQ ID NO: 6056462 - DNA, 21 bp, Homo sapiens
ccccagtcagcctctctccca

SEQ ID NO: 6056463 - DNA, 18 bp, Homo sapiens
ccccagtccccacccctg

SEQ ID NO: 6056464 - DNA, 15 bp, Homo sapiens
ccccagtccccagcc

SEQ ID NO: 6056465 - DNA, 13 bp, Homo sapiens
ccccagtccccgg

SEQ ID NO: 6056466 - DNA, 14 bp, Homo sapiens
ccccagtccccggg

SEQ ID NO: 6056467 - DNA, 17 bp, Homo sapiens
ccccagtccgccccgtg

SEQ ID NO: 6056468 - DNA, 20 bp, Homo sapiens
ccccagtcctcactgtcctg

SEQ ID NO: 6056469 - DNA, 21 bp, Homo sapiens
ccccagtcctcactgtcctgt

SEQ ID NO: 6056470 - DNA, 18 bp, Homo sapiens
ccccagtcctcaggcagc

SEQ ID NO: 6056471 - DNA, 19 bp, Homo sapiens
ccccagtcctccctagctc

SEQ ID NO: 6056472 - DNA, 15 bp, Homo sapiens
ccccagtcctggttc

SEQ ID NO: 6056473 - DNA, 14 bp, Homo sapiens
ccccagtctcacct

SEQ ID NO: 6056474 - DNA, 15 bp, Homo sapiens
ccccagtctccaggg

SEQ ID NO: 6056475 - DNA, 13 bp, Homo sapiens
ccccagtctcccc

SEQ ID NO: 6056476 - DNA, 14 bp, Homo sapiens
ccccagtctcccca

SEQ ID NO: 6056477 - DNA, 13 bp, Homo sapiens
ccccagtcttcct

SEQ ID NO: 6056478 - DNA, 13 bp, Homo sapiens
ccccagtgactcc

SEQ ID NO: 6056479 - DNA, 15 bp, Homo sapiens
ccccagtgactccag

SEQ ID NO: 6056480 - DNA, 16 bp, Homo sapiens
ccccagtgactccagg

SEQ ID NO: 6056481 - DNA, 17 bp, Homo sapiens
ccccagtgactccaggg

SEQ ID NO: 6056482 - DNA, 16 bp, Homo sapiens
ccccagtgaggacctc

SEQ ID NO: 6056483 - DNA, 19 bp, Homo sapiens
ccccagtgcagggctggtc

SEQ ID NO: 6056484 - DNA, 20 bp, Homo sapiens
ccccagtgccacagagaaga

SEQ ID NO: 6056485 - DNA, 16 bp, Homo sapiens
ccccagtgccagctgg

SEQ ID NO: 6056486 - DNA, 12 bp, Homo sapiens
ccccagtgcccg

SEQ ID NO: 6056487 - DNA, 17 bp, Homo sapiens
ccccagtgcctgccact

SEQ ID NO: 6056488 - DNA, 19 bp, Homo sapiens
ccccagtgcctgccactct

SEQ ID NO: 6056489 - DNA, 20 bp, Homo sapiens
ccccagtgcggacccttccc

SEQ ID NO: 6056490 - DNA, 20 bp, Homo sapiens
ccccagtgctcacacaatca

SEQ ID NO: 6056491 - DNA, 22 bp, Homo sapiens
ccccagtgctcacacaatcaga

SEQ ID NO: 6056492 - DNA, 17 bp, Homo sapiens
ccccagtggtgcgggcc

SEQ ID NO: 6056493 - DNA, 21 bp, Homo sapiens
ccccagtgtattttgtccaag

SEQ ID NO: 6056494 - DNA, 14 bp, Homo sapiens
ccccagtgtggact

SEQ ID NO: 6056495 - DNA, 23 bp, Homo sapiens
ccccagttaatactccagagaca

SEQ ID NO: 6056496 - DNA, 17 bp, Homo sapiens
ccccagttccacagcag

SEQ ID NO: 6056497 - DNA, 15 bp, Homo sapiens
ccccagttcccttgg

SEQ ID NO: 6056498 - DNA, 21 bp, Homo sapiens
ccccagttcccttggtggcaa

SEQ ID NO: 6056499 - DNA, 12 bp, Homo sapiens
ccccagttccta

SEQ ID NO: 6056500 - DNA, 15 bp, Homo sapiens
ccccagttcctagca

SEQ ID NO: 6056501 - DNA, 14 bp, Homo sapiens
ccccagttctgctc

SEQ ID NO: 6056502 - DNA, 15 bp, Homo sapiens
ccccagttctgctcc

SEQ ID NO: 6056503 - DNA, 18 bp, Homo sapiens
ccccagttctgctcctct

SEQ ID NO: 6056504 - DNA, 17 bp, Homo sapiens
ccccagttggcccttct

SEQ ID NO: 6056505 - DNA, 17 bp, Homo sapiens
ccccagttggggctgcg

SEQ ID NO: 6056506 - DNA, 18 bp, Homo sapiens
ccccagttggggctgcga

SEQ ID NO: 6056507 - DNA, 23 bp, Homo sapiens
ccccagtttatggatatgctgct

SEQ ID NO: 6056508 - DNA, 13 bp, Homo sapiens
ccccagtttgggg

SEQ ID NO: 6056509 - DNA, 16 bp, Homo sapiens
ccccagtttggggtgc

SEQ ID NO: 6056510 - DNA, 17 bp, Homo sapiens
ccccataagccctgaga

SEQ ID NO: 6056511 - DNA, 19 bp, Homo sapiens
ccccataataaccctgcca

SEQ ID NO: 6056512 - DNA, 23 bp, Homo sapiens
ccccataatgcttctttcctctt

SEQ ID NO: 6056513 - DNA, 15 bp, Homo sapiens
ccccataccagtcac

SEQ ID NO: 6056514 - DNA, 17 bp, Homo sapiens
ccccataccagtcacct

SEQ ID NO: 6056515 - DNA, 18 bp, Homo sapiens
ccccataccccttattgc

SEQ ID NO: 6056516 - DNA, 22 bp, Homo sapiens
ccccataccccttattgctgcc

SEQ ID NO: 6056517 - DNA, 15 bp, Homo sapiens
ccccatactctgtct

SEQ ID NO: 6056518 - DNA, 18 bp, Homo sapiens
ccccatacttcctgggat

SEQ ID NO: 6056519 - DNA, 19 bp, Homo sapiens
ccccatagagaccaggagg

SEQ ID NO: 6056520 - DNA, 18 bp, Homo sapiens
ccccatagataggcccct

SEQ ID NO: 6056521 - DNA, 21 bp, Homo sapiens
ccccatagataggcccctggg

SEQ ID NO: 6056522 - DNA, 19 bp, Homo sapiens
ccccatagcaaagggtctg

SEQ ID NO: 6056523 - DNA, 14 bp, Homo sapiens
ccccatagccaccc

SEQ ID NO: 6056524 - DNA, 21 bp, Homo sapiens
ccccatagggtcggaggtgct

SEQ ID NO: 6056525 - DNA, 16 bp, Homo sapiens
ccccatatacacctgg

SEQ ID NO: 6056526 - DNA, 20 bp, Homo sapiens
ccccatatacacctggaaca

SEQ ID NO: 6056527 - DNA, 16 bp, Homo sapiens
ccccatatttgtgttc

SEQ ID NO: 6056528 - DNA, 17 bp, Homo sapiens
ccccatatttgtgttca

SEQ ID NO: 6056529 - DNA, 18 bp, Homo sapiens
ccccatcacccaagccac

SEQ ID NO: 6056530 - DNA, 21 bp, Homo sapiens
ccccatcacctctactgtctc

SEQ ID NO: 6056531 - DNA, 17 bp, Homo sapiens
ccccatcactcgcagga

SEQ ID NO: 6056532 - DNA, 19 bp, Homo sapiens
ccccatcagaacctgagct

SEQ ID NO: 6056533 - DNA, 14 bp, Homo sapiens
ccccatcagaggct

SEQ ID NO: 6056534 - DNA, 13 bp, Homo sapiens
ccccatcagctcc

SEQ ID NO: 6056535 - DNA, 16 bp, Homo sapiens
ccccatcagctcccaa

SEQ ID NO: 6056536 - DNA, 15 bp, Homo sapiens
ccccatcagctgcca

SEQ ID NO: 6056537 - DNA, 13 bp, Homo sapiens
ccccatcattcat

SEQ ID NO: 6056538 - DNA, 19 bp, Homo sapiens
ccccatcattgcacctgca

SEQ ID NO: 6056539 - DNA, 20 bp, Homo sapiens
ccccatcattgcacctgcag

SEQ ID NO: 6056540 - DNA, 22 bp, Homo sapiens
ccccatcattgcacctgcaggc

SEQ ID NO: 6056541 - DNA, 19 bp, Homo sapiens
ccccatccagacctggctc

SEQ ID NO: 6056542 - DNA, 14 bp, Homo sapiens
ccccatccagcatg

SEQ ID NO: 6056543 - DNA, 18 bp, Homo sapiens
ccccatccagcatgtgtg

SEQ ID NO: 6056544 - DNA, 12 bp, Homo sapiens
ccccatccagcc

SEQ ID NO: 6056545 - DNA, 17 bp, Homo sapiens
ccccatccagccacgga

SEQ ID NO: 6056546 - DNA, 17 bp, Homo sapiens
ccccatccagccagggg

SEQ ID NO: 6056547 - DNA, 19 bp, Homo sapiens
ccccatccagcctccaggg

SEQ ID NO: 6056548 - DNA, 14 bp, Homo sapiens
ccccatcccagggt

SEQ ID NO: 6056549 - DNA, 12 bp, Homo sapiens
ccccatccccac

SEQ ID NO: 6056550 - DNA, 15 bp, Homo sapiens
ccccatccccaccag

SEQ ID NO: 6056551 - DNA, 12 bp, Homo sapiens
ccccatccccca

SEQ ID NO: 6056552 - DNA, 17 bp, Homo sapiens
ccccatcccctttacta

SEQ ID NO: 6056553 - DNA, 19 bp, Homo sapiens
ccccatcccgtttccctcc

SEQ ID NO: 6056554 - DNA, 12 bp, Homo sapiens
ccccatccctcg

SEQ ID NO: 6056555 - DNA, 12 bp, Homo sapiens
ccccatccctgg

SEQ ID NO: 6056556 - DNA, 16 bp, Homo sapiens
ccccatccctggctga

SEQ ID NO: 6056557 - DNA, 14 bp, Homo sapiens
ccccatcccttcct

SEQ ID NO: 6056558 - DNA, 18 bp, Homo sapiens
ccccatcctcatccctga

SEQ ID NO: 6056559 - DNA, 14 bp, Homo sapiens
ccccatcctccaga

SEQ ID NO: 6056560 - DNA, 14 bp, Homo sapiens
ccccatcctccagc

SEQ ID NO: 6056561 - DNA, 15 bp, Homo sapiens
ccccatcctccagca

SEQ ID NO: 6056562 - DNA, 16 bp, Homo sapiens
ccccatcctccagctt

SEQ ID NO: 6056563 - DNA, 18 bp, Homo sapiens
ccccatcctccagcttct

SEQ ID NO: 6056564 - DNA, 13 bp, Homo sapiens
ccccatcctcccc

SEQ ID NO: 6056565 - DNA, 17 bp, Homo sapiens
ccccatcctccccttcc

SEQ ID NO: 6056566 - DNA, 14 bp, Homo sapiens
ccccatcctctgta

SEQ ID NO: 6056567 - DNA, 13 bp, Homo sapiens
ccccatccttcag

SEQ ID NO: 6056568 - DNA, 14 bp, Homo sapiens
ccccatccttcccg

SEQ ID NO: 6056569 - DNA, 19 bp, Homo sapiens
ccccatcgccagctgatga

SEQ ID NO: 6056570 - DNA, 12 bp, Homo sapiens
ccccatcgcctg

SEQ ID NO: 6056571 - DNA, 19 bp, Homo sapiens
ccccatcgcctgggacgcc

SEQ ID NO: 6056572 - DNA, 20 bp, Homo sapiens
ccccatcgcctgggacgccc

SEQ ID NO: 6056573 - DNA, 21 bp, Homo sapiens
ccccatcgcctgggacgcccc

SEQ ID NO: 6056574 - DNA, 21 bp, Homo sapiens
ccccatcgccttctggctgct

SEQ ID NO: 6056575 - DNA, 22 bp, Homo sapiens
ccccatcggccctgtcccctgg

SEQ ID NO: 6056576 - DNA, 22 bp, Homo sapiens
ccccatcgttgcccccatttct

SEQ ID NO: 6056577 - DNA, 17 bp, Homo sapiens
ccccatctcaggccaga

SEQ ID NO: 6056578 - DNA, 16 bp, Homo sapiens
ccccatctccccaggc

SEQ ID NO: 6056579 - DNA, 19 bp, Homo sapiens
ccccatctcccctcagctc

SEQ ID NO: 6056580 - DNA, 18 bp, Homo sapiens
ccccatctcggggctgct

SEQ ID NO: 6056581 - DNA, 20 bp, Homo sapiens
ccccatctcggggctgctgt

SEQ ID NO: 6056582 - DNA, 19 bp, Homo sapiens
ccccatctctccctcccct

SEQ ID NO: 6056583 - DNA, 21 bp, Homo sapiens
ccccatctctcctgctcaccc

SEQ ID NO: 6056584 - DNA, 12 bp, Homo sapiens
ccccatctctga

SEQ ID NO: 6056585 - DNA, 15 bp, Homo sapiens
ccccatctctgagtg

SEQ ID NO: 6056586 - DNA, 17 bp, Homo sapiens
ccccatctctgctgctt

SEQ ID NO: 6056587 - DNA, 20 bp, Homo sapiens
ccccatctctgctgcttctg

SEQ ID NO: 6056588 - DNA, 22 bp, Homo sapiens
ccccatctctgctgcttctggg

SEQ ID NO: 6056589 - DNA, 13 bp, Homo sapiens
ccccatctctgtc

SEQ ID NO: 6056590 - DNA, 14 bp, Homo sapiens
ccccatctctgtct

SEQ ID NO: 6056591 - DNA, 18 bp, Homo sapiens
ccccatctctgtctgggg

SEQ ID NO: 6056592 - DNA, 14 bp, Homo sapiens
ccccatctgcgggg

SEQ ID NO: 6056593 - DNA, 24 bp, Homo sapiens
ccccatctgcgggggcagtgctca

SEQ ID NO: 6056594 - DNA, 13 bp, Homo sapiens
ccccatctgctga

SEQ ID NO: 6056595 - DNA, 14 bp, Homo sapiens
ccccatctgtccag

SEQ ID NO: 6056596 - DNA, 12 bp, Homo sapiens
ccccatctgtct

SEQ ID NO: 6056597 - DNA, 13 bp, Homo sapiens
ccccatctgtgca

SEQ ID NO: 6056598 - DNA, 12 bp, Homo sapiens
ccccatctgtgt

SEQ ID NO: 6056599 - DNA, 13 bp, Homo sapiens
ccccatctgtgtt

SEQ ID NO: 6056600 - DNA, 21 bp, Homo sapiens
ccccatcttccacctgtgccc

SEQ ID NO: 6056601 - DNA, 18 bp, Homo sapiens
ccccatcttcgggaccag

SEQ ID NO: 6056602 - DNA, 23 bp, Homo sapiens
ccccatcttgatctttgagccca

SEQ ID NO: 6056603 - DNA, 12 bp, Homo sapiens
ccccatcttgct

SEQ ID NO: 6056604 - DNA, 21 bp, Homo sapiens
ccccatctttgatccttctga

SEQ ID NO: 6056605 - DNA, 21 bp, Homo sapiens
ccccatgaaacttgagcattc

SEQ ID NO: 6056606 - DNA, 16 bp, Homo sapiens
ccccatgacctccagc

SEQ ID NO: 6056607 - DNA, 14 bp, Homo sapiens
ccccatgagctcgg

SEQ ID NO: 6056608 - DNA, 20 bp, Homo sapiens
ccccatgagctcggggtcca

SEQ ID NO: 6056609 - DNA, 20 bp, Homo sapiens
ccccatgcacctcagggcca

SEQ ID NO: 6056610 - DNA, 23 bp, Homo sapiens
ccccatgcactgtgaaggaccct

SEQ ID NO: 6056611 - DNA, 13 bp, Homo sapiens
ccccatgccaaag

SEQ ID NO: 6056612 - DNA, 19 bp, Homo sapiens
ccccatgccaatgtccagg

SEQ ID NO: 6056613 - DNA, 20 bp, Homo sapiens
ccccatgccaatgtccaggt

SEQ ID NO: 6056614 - DNA, 14 bp, Homo sapiens
ccccatgccaccac

SEQ ID NO: 6056615 - DNA, 16 bp, Homo sapiens
ccccatgccctccctg

SEQ ID NO: 6056616 - DNA, 17 bp, Homo sapiens
ccccatgcctgtccagc

SEQ ID NO: 6056617 - DNA, 22 bp, Homo sapiens
ccccatgcctgtccagcctggg

SEQ ID NO: 6056618 - DNA, 24 bp, Homo sapiens
ccccatgcctgtccagcctgggca

SEQ ID NO: 6056619 - DNA, 14 bp, Homo sapiens
ccccatgctctgcc

SEQ ID NO: 6056620 - DNA, 21 bp, Homo sapiens
ccccatgctctgccccaagcc

SEQ ID NO: 6056621 - DNA, 19 bp, Homo sapiens
ccccatgctgccttcaggg

SEQ ID NO: 6056622 - DNA, 12 bp, Homo sapiens
ccccatgctgga

SEQ ID NO: 6056623 - DNA, 14 bp, Homo sapiens
ccccatgctggagc

SEQ ID NO: 6056624 - DNA, 20 bp, Homo sapiens
ccccatgctggagcctgtgt

SEQ ID NO: 6056625 - DNA, 23 bp, Homo sapiens
ccccatgctggagcctgtgtaac

SEQ ID NO: 6056626 - DNA, 14 bp, Homo sapiens
ccccatgctggcct

SEQ ID NO: 6056627 - DNA, 15 bp, Homo sapiens
ccccatgcttccttg

SEQ ID NO: 6056628 - DNA, 19 bp, Homo sapiens
ccccatggagctgggctaa

SEQ ID NO: 6056629 - DNA, 14 bp, Homo sapiens
ccccatggcagctc

SEQ ID NO: 6056630 - DNA, 16 bp, Homo sapiens
ccccatggcagctcct

SEQ ID NO: 6056631 - DNA, 20 bp, Homo sapiens
ccccatggcagctcctgacc

SEQ ID NO: 6056632 - DNA, 18 bp, Homo sapiens
ccccatggccccaggccc

SEQ ID NO: 6056633 - DNA, 16 bp, Homo sapiens
ccccatggccctgagc

SEQ ID NO: 6056634 - DNA, 19 bp, Homo sapiens
ccccatggccggctttcag

SEQ ID NO: 6056635 - DNA, 24 bp, Homo sapiens
ccccatggccggctttcaggagct

SEQ ID NO: 6056636 - DNA, 17 bp, Homo sapiens
ccccatggctgcacagt

SEQ ID NO: 6056637 - DNA, 23 bp, Homo sapiens
ccacctgcggccgccccccgccc

SEQ ID NO: 6056638 - DNA, 15 bp, Homo sapiens
ccacctgctcccagg

SEQ ID NO: 6056639 - DNA, 15 bp, Homo sapiens
ccacctgctgagaga

SEQ ID NO: 6056640 - DNA, 22 bp, Homo sapiens
ccacctgctgagagacccaagg

SEQ ID NO: 6056641 - DNA, 22 bp, Homo sapiens
ccacctgctgcgggggagccag

SEQ ID NO: 6056642 - DNA, 12 bp, Homo sapiens
ccacctgctgct

SEQ ID NO: 6056643 - DNA, 15 bp, Homo sapiens
ccacctgctgctgta

SEQ ID NO: 6056644 - DNA, 15 bp, Homo sapiens
ccacctgctttctcc

SEQ ID NO: 6056645 - DNA, 18 bp, Homo sapiens
ccacctggaaagccaggt

SEQ ID NO: 6056646 - DNA, 19 bp, Homo sapiens
ccacctggaaagccaggtt

SEQ ID NO: 6056647 - DNA, 14 bp, Homo sapiens
ccacctggaagccc

SEQ ID NO: 6056648 - DNA, 20 bp, Homo sapiens
ccacctggaagccctctctg

SEQ ID NO: 6056649 - DNA, 21 bp, Homo sapiens
ccacctggaagccgcgcggcc

SEQ ID NO: 6056650 - DNA, 21 bp, Homo sapiens
ccacctggacacacactcacc

SEQ ID NO: 6056651 - DNA, 18 bp, Homo sapiens
ccacctggacccctgcat

SEQ ID NO: 6056652 - DNA, 19 bp, Homo sapiens
ccacctggacccctgcatt

SEQ ID NO: 6056653 - DNA, 21 bp, Homo sapiens
ccacctggacgaagagcaggc

SEQ ID NO: 6056654 - DNA, 22 bp, Homo sapiens
ccacctggacgaagagcaggcc

SEQ ID NO: 6056655 - DNA, 24 bp, Homo sapiens
ccacctggagaaggaagctgcctg

SEQ ID NO: 6056656 - DNA, 12 bp, Homo sapiens
ccacctggagcc

SEQ ID NO: 6056657 - DNA, 15 bp, Homo sapiens
ccacctggagcccgc

SEQ ID NO: 6056658 - DNA, 19 bp, Homo sapiens
ccacctggagcccgcttca

SEQ ID NO: 6056659 - DNA, 22 bp, Homo sapiens
ccacctggatggatctgctcca

SEQ ID NO: 6056660 - DNA, 11 bp, Homo sapiens
ccacctggcaa

SEQ ID NO: 6056661 - DNA, 23 bp, Homo sapiens
ccacctggcaaaggacccttgag

SEQ ID NO: 6056662 - DNA, 12 bp, Homo sapiens
ccacctggcagg

SEQ ID NO: 6056663 - DNA, 20 bp, Homo sapiens
ccacctggcagggctcacac

SEQ ID NO: 6056664 - DNA, 21 bp, Homo sapiens
ccacctggccccatgtctctc

SEQ ID NO: 6056665 - DNA, 17 bp, Homo sapiens
ccacctggccctctctg

SEQ ID NO: 6056666 - DNA, 20 bp, Homo sapiens
ccacctggcctctgcactcc

SEQ ID NO: 6056667 - DNA, 12 bp, Homo sapiens
ccacctggctca

SEQ ID NO: 6056668 - DNA, 12 bp, Homo sapiens
ccacctggctct

SEQ ID NO: 6056669 - DNA, 15 bp, Homo sapiens
ccacctggctctcac

SEQ ID NO: 6056670 - DNA, 14 bp, Homo sapiens
ccacctggctctgt

SEQ ID NO: 6056671 - DNA, 16 bp, Homo sapiens
ccacctggctctgtgg

SEQ ID NO: 6056672 - DNA, 11 bp, Homo sapiens
ccacctggctg

SEQ ID NO: 6056673 - DNA, 13 bp, Homo sapiens
ccacctggctgcc

SEQ ID NO: 6056674 - DNA, 12 bp, Homo sapiens
ccacctgggaga

SEQ ID NO: 6056675 - DNA, 20 bp, Homo sapiens
ccacctgggagatgctggga

SEQ ID NO: 6056676 - DNA, 21 bp, Homo sapiens
ccacctgggagatgctgggac

SEQ ID NO: 6056677 - DNA, 17 bp, Homo sapiens
ccacctgggcctcccat

SEQ ID NO: 6056678 - DNA, 12 bp, Homo sapiens
ccacctgggctg

SEQ ID NO: 6056679 - DNA, 13 bp, Homo sapiens
ccacctgggctgg

SEQ ID NO: 6056680 - DNA, 14 bp, Homo sapiens
ccacctgggctggg

SEQ ID NO: 6056681 - DNA, 16 bp, Homo sapiens
ccacctgggctgggag

SEQ ID NO: 6056682 - DNA, 17 bp, Homo sapiens
ccacctgggctgggcgc

SEQ ID NO: 6056683 - DNA, 16 bp, Homo sapiens
ccacctggggcagtca

SEQ ID NO: 6056684 - DNA, 16 bp, Homo sapiens
ccacctgggttcagcc

SEQ ID NO: 6056685 - DNA, 23 bp, Homo sapiens
ccacctggtactccctctcagga

SEQ ID NO: 6056686 - DNA, 21 bp, Homo sapiens
ccacctggtactgacccagga

SEQ ID NO: 6056687 - DNA, 13 bp, Homo sapiens
ccacctggtggcc

SEQ ID NO: 6056688 - DNA, 17 bp, Homo sapiens
ccacctggtggcctctg

SEQ ID NO: 6056689 - DNA, 12 bp, Homo sapiens
ccacctgtacat

SEQ ID NO: 6056690 - DNA, 20 bp, Homo sapiens
ccacctgtagccatctgcac

SEQ ID NO: 6056691 - DNA, 19 bp, Homo sapiens
ccacctgtcaaacaaagcc

SEQ ID NO: 6056692 - DNA, 12 bp, Homo sapiens
ccacctgtccca

SEQ ID NO: 6056693 - DNA, 14 bp, Homo sapiens
ccacctgtcccacc

SEQ ID NO: 6056694 - DNA, 17 bp, Homo sapiens
ccacctgtcccacctca

SEQ ID NO: 6056695 - DNA, 19 bp, Homo sapiens
ccacctgtccggcccagtg

SEQ ID NO: 6056696 - DNA, 20 bp, Homo sapiens
ccacctgtccggcccagtgc

SEQ ID NO: 6056697 - DNA, 12 bp, Homo sapiens
ccacctgtctca

SEQ ID NO: 6056698 - DNA, 11 bp, Homo sapiens
ccacctgtctg

SEQ ID NO: 6056699 - DNA, 11 bp, Homo sapiens
ccacctgtgag

SEQ ID NO: 6056700 - DNA, 19 bp, Homo sapiens
ccacctgtgagaaaggaaa

SEQ ID NO: 6056701 - DNA, 12 bp, Homo sapiens
ccacctgtgctg

SEQ ID NO: 6056702 - DNA, 14 bp, Homo sapiens
ccacctgtgctgct

SEQ ID NO: 6056703 - DNA, 15 bp, Homo sapiens
ccacctgtgctgctg

SEQ ID NO: 6056704 - DNA, 17 bp, Homo sapiens
ccacctgtgctgctgca

SEQ ID NO: 6056705 - DNA, 19 bp, Homo sapiens
ccacctgtgcttggaacca

SEQ ID NO: 6056706 - DNA, 12 bp, Homo sapiens
ccacctgtgggt

SEQ ID NO: 6056707 - DNA, 18 bp, Homo sapiens
ccacctgtggttttacct

SEQ ID NO: 6056708 - DNA, 20 bp, Homo sapiens
ccacctgtgtgttcttttga

SEQ ID NO: 6056709 - DNA, 19 bp, Homo sapiens
ccacctgttaaaatgtaca

SEQ ID NO: 6056710 - DNA, 17 bp, Homo sapiens
ccacctgttcaggagct

SEQ ID NO: 6056711 - DNA, 23 bp, Homo sapiens
ccacctgtttctggaagactgct

SEQ ID NO: 6056712 - DNA, 20 bp, Homo sapiens
ccaccttatacatcacttcc

SEQ ID NO: 6056713 - DNA, 17 bp, Homo sapiens
ccaccttcaagcaccct

SEQ ID NO: 6056714 - DNA, 18 bp, Homo sapiens
ccaccttcaagcaccctg

SEQ ID NO: 6056715 - DNA, 18 bp, Homo sapiens
ccaccttcaattcctggg

SEQ ID NO: 6056716 - DNA, 15 bp, Homo sapiens
ccaccttcaggcccc

SEQ ID NO: 6056717 - DNA, 16 bp, Homo sapiens
ccaccttcccacccct

SEQ ID NO: 6056718 - DNA, 15 bp, Homo sapiens
ccaccttccccagac

SEQ ID NO: 6056719 - DNA, 18 bp, Homo sapiens
ccaccttccccagactca

SEQ ID NO: 6056720 - DNA, 12 bp, Homo sapiens
ccaccttccctc

SEQ ID NO: 6056721 - DNA, 19 bp, Homo sapiens
ccaccttcccttcctcagc

SEQ ID NO: 6056722 - DNA, 20 bp, Homo sapiens
ccaccttcccttcctcagca

SEQ ID NO: 6056723 - DNA, 15 bp, Homo sapiens
ccaccttccgttccc

SEQ ID NO: 6056724 - DNA, 13 bp, Homo sapiens
ccaccttcctgac

SEQ ID NO: 6056725 - DNA, 14 bp, Homo sapiens
ccaccttcctgact

SEQ ID NO: 6056726 - DNA, 15 bp, Homo sapiens
ccaccttcctgactg

SEQ ID NO: 6056727 - DNA, 18 bp, Homo sapiens
ccaccttcctgactggga

SEQ ID NO: 6056728 - DNA, 15 bp, Homo sapiens
ccaccttcctgccca

SEQ ID NO: 6056729 - DNA, 13 bp, Homo sapiens
ccaccttccttgc

SEQ ID NO: 6056730 - DNA, 19 bp, Homo sapiens
ccaccttgccaagctttct

SEQ ID NO: 6056731 - DNA, 15 bp, Homo sapiens
ccaccttgccagggc

SEQ ID NO: 6056732 - DNA, 13 bp, Homo sapiens
ccaccttgcttga

SEQ ID NO: 6056733 - DNA, 14 bp, Homo sapiens
ccaccttggaccct

SEQ ID NO: 6056734 - DNA, 17 bp, Homo sapiens
ccaccttggaccctggt

SEQ ID NO: 6056735 - DNA, 17 bp, Homo sapiens
ccaccttggactcctcc

SEQ ID NO: 6056736 - DNA, 18 bp, Homo sapiens
ccaccttggactcctccc

SEQ ID NO: 6056737 - DNA, 14 bp, Homo sapiens
ccaccttggaggag

SEQ ID NO: 6056738 - DNA, 15 bp, Homo sapiens
ccaccttggcctccc

SEQ ID NO: 6056739 - DNA, 14 bp, Homo sapiens
ccaccttggctctg

SEQ ID NO: 6056740 - DNA, 17 bp, Homo sapiens
ccaccttggtccctctc

SEQ ID NO: 6056741 - DNA, 23 bp, Homo sapiens
ccaccttggtccctctcagatac

SEQ ID NO: 6056742 - DNA, 23 bp, Homo sapiens
ccaccttgtacagaaccagcact

SEQ ID NO: 6056743 - DNA, 20 bp, Homo sapiens
ccaccttgttggagcctgca

SEQ ID NO: 6056744 - DNA, 14 bp, Homo sapiens
ccacctttactgtg

SEQ ID NO: 6056745 - DNA, 18 bp, Homo sapiens
ccacctttctctgtttta

SEQ ID NO: 6056746 - DNA, 11 bp, Homo sapiens
ccacctttgca

SEQ ID NO: 6056747 - DNA, 22 bp, Homo sapiens
ccacctttggaaagctctgacc

SEQ ID NO: 6056748 - DNA, 24 bp, Homo sapiens
ccacctttggaaagctctgaccac

SEQ ID NO: 6056749 - DNA, 21 bp, Homo sapiens
ccacctttgggatcagcctcc

SEQ ID NO: 6056750 - DNA, 17 bp, Homo sapiens
ccacctttgtgcagctt

SEQ ID NO: 6056751 - DNA, 20 bp, Homo sapiens
ccaccttttccttatactgt

SEQ ID NO: 6056752 - DNA, 23 bp, Homo sapiens
ccaccttttgtttttccagttcc

SEQ ID NO: 6056753 - DNA, 22 bp, Homo sapiens
ccacgaacagcccgccagaggc

SEQ ID NO: 6056754 - DNA, 21 bp, Homo sapiens
ccacgaatttctgtgccctcc

SEQ ID NO: 6056755 - DNA, 22 bp, Homo sapiens
ccacgaatttggtgtggctgta

SEQ ID NO: 6056756 - DNA, 20 bp, Homo sapiens
ccacgacaaaaacaagactg

SEQ ID NO: 6056757 - DNA, 22 bp, Homo sapiens
ccacgacaaaaacaagactgcc

SEQ ID NO: 6056758 - DNA, 14 bp, Homo sapiens
ccacgaccagcccc

SEQ ID NO: 6056759 - DNA, 18 bp, Homo sapiens
ccacgaccagccccttcc

SEQ ID NO: 6056760 - DNA, 16 bp, Homo sapiens
ccacgacccctgcctc

SEQ ID NO: 6056761 - DNA, 16 bp, Homo sapiens
ccacgacctgtcctgt

SEQ ID NO: 6056762 - DNA, 14 bp, Homo sapiens
ccacgactgtctcc

SEQ ID NO: 6056763 - DNA, 19 bp, Homo sapiens
ccacgagcacgagctggaa

SEQ ID NO: 6056764 - DNA, 17 bp, Homo sapiens
ccacgaggagcagcagc

SEQ ID NO: 6056765 - DNA, 16 bp, Homo sapiens
ccacgaggaggaacca

SEQ ID NO: 6056766 - DNA, 16 bp, Homo sapiens
ccacgaggctgccccc

SEQ ID NO: 6056767 - DNA, 14 bp, Homo sapiens
ccacgagggctggc

SEQ ID NO: 6056768 - DNA, 17 bp, Homo sapiens
ccacgaggggacccatg

SEQ ID NO: 6056769 - DNA, 19 bp, Homo sapiens
ccacgaggggacccatggg

SEQ ID NO: 6056770 - DNA, 22 bp, Homo sapiens
ccacgagggtctcccctcctgc

SEQ ID NO: 6056771 - DNA, 21 bp, Homo sapiens
ccacgaggtggtagctctgag

SEQ ID NO: 6056772 - DNA, 23 bp, Homo sapiens
ccacgaggtggtagctctgagcc

SEQ ID NO: 6056773 - DNA, 17 bp, Homo sapiens
ccacgatcccctccccc

SEQ ID NO: 6056774 - DNA, 23 bp, Homo sapiens
ccacgatcctgccaccctgtagc

SEQ ID NO: 6056775 - DNA, 18 bp, Homo sapiens
ccacgatgacgcctctgg

SEQ ID NO: 6056776 - DNA, 21 bp, Homo sapiens
ccacgatgatatctatatatg

SEQ ID NO: 6056777 - DNA, 14 bp, Homo sapiens
ccacgatgcctttg

SEQ ID NO: 6056778 - DNA, 17 bp, Homo sapiens
ccacgatgtggccctgg

SEQ ID NO: 6056779 - DNA, 20 bp, Homo sapiens
ccacgatgtggccctggcct

SEQ ID NO: 6056780 - DNA, 13 bp, Homo sapiens
ccacgattctccc

SEQ ID NO: 6056781 - DNA, 14 bp, Homo sapiens
ccacgattggagaa

SEQ ID NO: 6056782 - DNA, 15 bp, Homo sapiens
ccacgattggagaat

SEQ ID NO: 6056783 - DNA, 22 bp, Homo sapiens
ccacgattggtatgatgctgcc

SEQ ID NO: 6056784 - DNA, 12 bp, Homo sapiens
ccacgattttaa

SEQ ID NO: 6056785 - DNA, 16 bp, Homo sapiens
ccacgattttctccag

SEQ ID NO: 6056786 - DNA, 19 bp, Homo sapiens
ccacgattttctccagctc

SEQ ID NO: 6056787 - DNA, 20 bp, Homo sapiens
ccacgattttctccagctca

SEQ ID NO: 6056788 - DNA, 17 bp, Homo sapiens
ccacgcaaggctgtgct

SEQ ID NO: 6056789 - DNA, 20 bp, Homo sapiens
ccacgcacgacgtcagcctc

SEQ ID NO: 6056790 - DNA, 14 bp, Homo sapiens
ccacgcactgggcc

SEQ ID NO: 6056791 - DNA, 19 bp, Homo sapiens
ccacgcactgggccacgga

SEQ ID NO: 6056792 - DNA, 16 bp, Homo sapiens
ccacgcagagccccgg

SEQ ID NO: 6056793 - DNA, 15 bp, Homo sapiens
ccacgcagaggacgc

SEQ ID NO: 6056794 - DNA, 17 bp, Homo sapiens
ccacgcagccaggacac

SEQ ID NO: 6056795 - DNA, 22 bp, Homo sapiens
ccacgcagccgccgccgcccac

SEQ ID NO: 6056796 - DNA, 19 bp, Homo sapiens
ccacgcaggccacccgggc

SEQ ID NO: 6056797 - DNA, 20 bp, Homo sapiens
ccacgcagggccatccactg

SEQ ID NO: 6056798 - DNA, 19 bp, Homo sapiens
ccacgcaggggctctgagc

SEQ ID NO: 6056799 - DNA, 21 bp, Homo sapiens
ccacgcaggggctctgagccc

SEQ ID NO: 6056800 - DNA, 19 bp, Homo sapiens
ccacgcagtgcctggagtt

SEQ ID NO: 6056801 - DNA, 19 bp, Homo sapiens
ccacgcatgctcagtgcct

SEQ ID NO: 6056802 - DNA, 18 bp, Homo sapiens
ccacgccacagccctttt

SEQ ID NO: 6056803 - DNA, 12 bp, Homo sapiens
ccacgccacagg

SEQ ID NO: 6056804 - DNA, 13 bp, Homo sapiens
ccacgccacaggg

SEQ ID NO: 6056805 - DNA, 14 bp, Homo sapiens
ccacgccacagggt

SEQ ID NO: 6056806 - DNA, 16 bp, Homo sapiens
ccacgcccaccagcct

SEQ ID NO: 6056807 - DNA, 18 bp, Homo sapiens
ccacgcccagcttcctcc

SEQ ID NO: 6056808 - DNA, 17 bp, Homo sapiens
ccacgccccagcccgac

SEQ ID NO: 6056809 - DNA, 17 bp, Homo sapiens
ccacgcccccactggtg

SEQ ID NO: 6056810 - DNA, 15 bp, Homo sapiens
ccacgcccctcccca

SEQ ID NO: 6056811 - DNA, 20 bp, Homo sapiens
ccacgcccctccccagcccc

SEQ ID NO: 6056812 - DNA, 13 bp, Homo sapiens
ccacgcccctgcc

SEQ ID NO: 6056813 - DNA, 19 bp, Homo sapiens
ccacgcccgactagcaggc

SEQ ID NO: 6056814 - DNA, 20 bp, Homo sapiens
ccacgcccgactagcaggca

SEQ ID NO: 6056815 - DNA, 20 bp, Homo sapiens
ccacgcccggctaatgtttg

SEQ ID NO: 6056816 - DNA, 17 bp, Homo sapiens
ccacgcccgtcctgcct

SEQ ID NO: 6056817 - DNA, 21 bp, Homo sapiens
ccccatggcttgttctctgga

SEQ ID NO: 6056818 - DNA, 15 bp, Homo sapiens
ccccatgggccctca

SEQ ID NO: 6056819 - DNA, 13 bp, Homo sapiens
ccccatgggctcc

SEQ ID NO: 6056820 - DNA, 15 bp, Homo sapiens
ccccatgggctccca

SEQ ID NO: 6056821 - DNA, 14 bp, Homo sapiens
ccccatgggctcct

SEQ ID NO: 6056822 - DNA, 16 bp, Homo sapiens
ccccatgggctcctgc

SEQ ID NO: 6056823 - DNA, 12 bp, Homo sapiens
ccccatgggctt

SEQ ID NO: 6056824 - DNA, 17 bp, Homo sapiens
ccccatgggcttggact

SEQ ID NO: 6056825 - DNA, 18 bp, Homo sapiens
ccccatggggctgcggga

SEQ ID NO: 6056826 - DNA, 19 bp, Homo sapiens
ccccatggtccatcccctg

SEQ ID NO: 6056827 - DNA, 21 bp, Homo sapiens
ccccatggtccatcccctgag

SEQ ID NO: 6056828 - DNA, 20 bp, Homo sapiens
ccccatggtgctaggaagag

SEQ ID NO: 6056829 - DNA, 21 bp, Homo sapiens
ccccatggtgctaggaagagg

SEQ ID NO: 6056830 - DNA, 17 bp, Homo sapiens
ccccatgtctctcagaa

SEQ ID NO: 6056831 - DNA, 13 bp, Homo sapiens
ccccatgtgcctg

SEQ ID NO: 6056832 - DNA, 23 bp, Homo sapiens
ccccatgtgccttgtccaggaac

SEQ ID NO: 6056833 - DNA, 15 bp, Homo sapiens
ccccatgtgccttta

SEQ ID NO: 6056834 - DNA, 18 bp, Homo sapiens
ccccatgtggcagcccat

SEQ ID NO: 6056835 - DNA, 21 bp, Homo sapiens
ccccatgtgtgacccttgtca

SEQ ID NO: 6056836 - DNA, 20 bp, Homo sapiens
ccccatgttgtaatgctgca

SEQ ID NO: 6056837 - DNA, 23 bp, Homo sapiens
ccccatgttgtaatgctgcactt

SEQ ID NO: 6056838 - DNA, 21 bp, Homo sapiens
ccccatgtttaaactttgtgc

SEQ ID NO: 6056839 - DNA, 21 bp, Homo sapiens
ccccattaccagcatttacta

SEQ ID NO: 6056840 - DNA, 15 bp, Homo sapiens
ccccattcacagagc

SEQ ID NO: 6056841 - DNA, 15 bp, Homo sapiens
ccccattcacggcct

SEQ ID NO: 6056842 - DNA, 17 bp, Homo sapiens
ccccattcacggcctgg

SEQ ID NO: 6056843 - DNA, 19 bp, Homo sapiens
ccccattcagaactctcag

SEQ ID NO: 6056844 - DNA, 13 bp, Homo sapiens
ccccattcagtga

SEQ ID NO: 6056845 - DNA, 17 bp, Homo sapiens
ccccattcccagcctga

SEQ ID NO: 6056846 - DNA, 13 bp, Homo sapiens
ccccattcccgca

SEQ ID NO: 6056847 - DNA, 12 bp, Homo sapiens
ccccattccctc

SEQ ID NO: 6056848 - DNA, 11 bp, Homo sapiens
ccccattccta

SEQ ID NO: 6056849 - DNA, 17 bp, Homo sapiens
ccccattctcccagtct

SEQ ID NO: 6056850 - DNA, 16 bp, Homo sapiens
ccccattctgagctcc

SEQ ID NO: 6056851 - DNA, 13 bp, Homo sapiens
ccccattctgcct

SEQ ID NO: 6056852 - DNA, 13 bp, Homo sapiens
ccccattctggga

SEQ ID NO: 6056853 - DNA, 17 bp, Homo sapiens
ccccattctgggactgc

SEQ ID NO: 6056854 - DNA, 20 bp, Homo sapiens
ccccattctgtgtcccatgt

SEQ ID NO: 6056855 - DNA, 23 bp, Homo sapiens
ccccattcttcctagttttctcc

SEQ ID NO: 6056856 - DNA, 13 bp, Homo sapiens
ccccattgagatc

SEQ ID NO: 6056857 - DNA, 17 bp, Homo sapiens
ccccattgccttctggg

SEQ ID NO: 6056858 - DNA, 17 bp, Homo sapiens
ccccatttcccatctgc

SEQ ID NO: 6056859 - DNA, 18 bp, Homo sapiens
ccccatttcccatctgca

SEQ ID NO: 6056860 - DNA, 20 bp, Homo sapiens
ccccatttcccatctgcacc

SEQ ID NO: 6056861 - DNA, 18 bp, Homo sapiens
ccccatttcctcttcctt

SEQ ID NO: 6056862 - DNA, 20 bp, Homo sapiens
ccccatttcctcttccttct

SEQ ID NO: 6056863 - DNA, 21 bp, Homo sapiens
ccccatttcctcttccttctc

SEQ ID NO: 6056864 - DNA, 12 bp, Homo sapiens
ccccatttcctg

SEQ ID NO: 6056865 - DNA, 13 bp, Homo sapiens
ccccatttctatt

SEQ ID NO: 6056866 - DNA, 14 bp, Homo sapiens
ccccatttctgagg

SEQ ID NO: 6056867 - DNA, 14 bp, Homo sapiens
ccccatttgtccca

SEQ ID NO: 6056868 - DNA, 16 bp, Homo sapiens
ccccatttgtcccaga

SEQ ID NO: 6056869 - DNA, 15 bp, Homo sapiens
ccccattttctgtgg

SEQ ID NO: 6056870 - DNA, 14 bp, Homo sapiens
ccccattttcttta

SEQ ID NO: 6056871 - DNA, 12 bp, Homo sapiens
cccccaaaaaaa

SEQ ID NO: 6056872 - DNA, 15 bp, Homo sapiens
cccccaaagagctgt

SEQ ID NO: 6056873 - DNA, 24 bp, Homo sapiens
cccccaaagatagacaggtcctga

SEQ ID NO: 6056874 - DNA, 15 bp, Homo sapiens
cccccaaaggcatcc

SEQ ID NO: 6056875 - DNA, 21 bp, Homo sapiens
cccccaaaggcatcccagcct

SEQ ID NO: 6056876 - DNA, 20 bp, Homo sapiens
cccccaaattgccttcagcc

SEQ ID NO: 6056877 - DNA, 22 bp, Homo sapiens
cccccaacaccccgcctgcctc

SEQ ID NO: 6056878 - DNA, 18 bp, Homo sapiens
cccccaacacctgctgcg

SEQ ID NO: 6056879 - DNA, 16 bp, Homo sapiens
cccccaacccccagag

SEQ ID NO: 6056880 - DNA, 19 bp, Homo sapiens
cccccaacccccagaggtg

SEQ ID NO: 6056881 - DNA, 21 bp, Homo sapiens
cccccaacccctcctccctca

SEQ ID NO: 6056882 - DNA, 23 bp, Homo sapiens
cccccaacccctccttccccaga

SEQ ID NO: 6056883 - DNA, 16 bp, Homo sapiens
cccccaactccaggaa

SEQ ID NO: 6056884 - DNA, 14 bp, Homo sapiens
cccccaagccacag

SEQ ID NO: 6056885 - DNA, 14 bp, Homo sapiens
cccccaagcctggg

SEQ ID NO: 6056886 - DNA, 17 bp, Homo sapiens
cccccaagcctgggctt

SEQ ID NO: 6056887 - DNA, 22 bp, Homo sapiens
cccccaagcctgggcttgagct

SEQ ID NO: 6056888 - DNA, 16 bp, Homo sapiens
cccccaaggccactgc

SEQ ID NO: 6056889 - DNA, 23 bp, Homo sapiens
cccccaaggggcagtctggaggg

SEQ ID NO: 6056890 - DNA, 21 bp, Homo sapiens
cccccaataaaccagtgtgaa

SEQ ID NO: 6056891 - DNA, 13 bp, Homo sapiens
cccccaataaagg

SEQ ID NO: 6056892 - DNA, 13 bp, Homo sapiens
cccccaatccatg

SEQ ID NO: 6056893 - DNA, 22 bp, Homo sapiens
cccccacaacacaagcacccca

SEQ ID NO: 6056894 - DNA, 14 bp, Homo sapiens
cccccacaagagcc

SEQ ID NO: 6056895 - DNA, 21 bp, Homo sapiens
cccccacaagctgtccctgca

SEQ ID NO: 6056896 - DNA, 17 bp, Homo sapiens
cccccacacctcagttc

SEQ ID NO: 6056897 - DNA, 18 bp, Homo sapiens
cccccacacctggccctg

SEQ ID NO: 6056898 - DNA, 17 bp, Homo sapiens
cccccacacttccctgg

SEQ ID NO: 6056899 - DNA, 22 bp, Homo sapiens
cccccacaggccccccgcagca

SEQ ID NO: 6056900 - DNA, 18 bp, Homo sapiens
cccccacattctggctcc

SEQ ID NO: 6056901 - DNA, 21 bp, Homo sapiens
cccccacattctggctccacc

SEQ ID NO: 6056902 - DNA, 14 bp, Homo sapiens
cccccaccacacat

SEQ ID NO: 6056903 - DNA, 15 bp, Homo sapiens
cccccaccacactga

SEQ ID NO: 6056904 - DNA, 22 bp, Homo sapiens
cccccacccacccccaggcctc

SEQ ID NO: 6056905 - DNA, 14 bp, Homo sapiens
cccccaccccagca

SEQ ID NO: 6056906 - DNA, 15 bp, Homo sapiens
cccccacccccagct

SEQ ID NO: 6056907 - DNA, 17 bp, Homo sapiens
cccccacccccagctca

SEQ ID NO: 6056908 - DNA, 12 bp, Homo sapiens
cccccaccccct

SEQ ID NO: 6056909 - DNA, 20 bp, Homo sapiens
cccccaccccggggaccctg

SEQ ID NO: 6056910 - DNA, 23 bp, Homo sapiens
cccccacccctaacctggcttat

SEQ ID NO: 6056911 - DNA, 15 bp, Homo sapiens
cccccaccccttccc

SEQ ID NO: 6056912 - DNA, 17 bp, Homo sapiens
cccccaccccttcccca

SEQ ID NO: 6056913 - DNA, 20 bp, Homo sapiens
cccccaccccttccccaggc

SEQ ID NO: 6056914 - DNA, 11 bp, Homo sapiens
cccccaccctg

SEQ ID NO: 6056915 - DNA, 12 bp, Homo sapiens
cccccaccctgc

SEQ ID NO: 6056916 - DNA, 14 bp, Homo sapiens
cccccaccctgttc

SEQ ID NO: 6056917 - DNA, 12 bp, Homo sapiens
cccccacccttt

SEQ ID NO: 6056918 - DNA, 20 bp, Homo sapiens
cccccaccggtccagctggc

SEQ ID NO: 6056919 - DNA, 12 bp, Homo sapiens
cccccacctctg

SEQ ID NO: 6056920 - DNA, 13 bp, Homo sapiens
cccccacctctgg

SEQ ID NO: 6056921 - DNA, 12 bp, Homo sapiens
cccccacctgca

SEQ ID NO: 6056922 - DNA, 14 bp, Homo sapiens
cccccaccttgatc

SEQ ID NO: 6056923 - DNA, 18 bp, Homo sapiens
cccccacctttctcgctg

SEQ ID NO: 6056924 - DNA, 21 bp, Homo sapiens
cccccacgtctctctgcctgc

SEQ ID NO: 6056925 - DNA, 23 bp, Homo sapiens
cccccacgtctctctgcctgctg

SEQ ID NO: 6056926 - DNA, 11 bp, Homo sapiens
cccccactact

SEQ ID NO: 6056927 - DNA, 12 bp, Homo sapiens
cccccactcagt

SEQ ID NO: 6056928 - DNA, 18 bp, Homo sapiens
cccccactcccccttccc

SEQ ID NO: 6056929 - DNA, 12 bp, Homo sapiens
cccccactcctc

SEQ ID NO: 6056930 - DNA, 12 bp, Homo sapiens
cccccactgacc

SEQ ID NO: 6056931 - DNA, 13 bp, Homo sapiens
cccccactggctg

SEQ ID NO: 6056932 - DNA, 14 bp, Homo sapiens
cccccactggctgt

SEQ ID NO: 6056933 - DNA, 15 bp, Homo sapiens
cccccactggtgaca

SEQ ID NO: 6056934 - DNA, 20 bp, Homo sapiens
cccccacttagtgctggtcc

SEQ ID NO: 6056935 - DNA, 20 bp, Homo sapiens
cccccacttcatgcccactg

SEQ ID NO: 6056936 - DNA, 22 bp, Homo sapiens
cccccacttcatgcccactgcc

SEQ ID NO: 6056937 - DNA, 18 bp, Homo sapiens
cccccacttcccacttgc

SEQ ID NO: 6056938 - DNA, 13 bp, Homo sapiens
cccccacttggga

SEQ ID NO: 6056939 - DNA, 19 bp, Homo sapiens
cccccactttcgcctcctc

SEQ ID NO: 6056940 - DNA, 21 bp, Homo sapiens
cccccactttcgcctcctcca

SEQ ID NO: 6056941 - DNA, 16 bp, Homo sapiens
cccccagacagctgct

SEQ ID NO: 6056942 - DNA, 15 bp, Homo sapiens
cccccagactctttt

SEQ ID NO: 6056943 - DNA, 14 bp, Homo sapiens
cccccagagacctt

SEQ ID NO: 6056944 - DNA, 22 bp, Homo sapiens
cccccagagacctttgcccaca

SEQ ID NO: 6056945 - DNA, 16 bp, Homo sapiens
cccccagagccacagt

SEQ ID NO: 6056946 - DNA, 13 bp, Homo sapiens
cccccagagccag

SEQ ID NO: 6056947 - DNA, 16 bp, Homo sapiens
cccccagagccagggc

SEQ ID NO: 6056948 - DNA, 17 bp, Homo sapiens
cccccagagccagggct

SEQ ID NO: 6056949 - DNA, 19 bp, Homo sapiens
cccccagagccagggctgt

SEQ ID NO: 6056950 - DNA, 21 bp, Homo sapiens
cccccagagccagggctgtcc

SEQ ID NO: 6056951 - DNA, 23 bp, Homo sapiens
cccccagagcccaggctcggcct

SEQ ID NO: 6056952 - DNA, 21 bp, Homo sapiens
cccccagatagagctgggtgg

SEQ ID NO: 6056953 - DNA, 20 bp, Homo sapiens
cccccagatgcagggctgca

SEQ ID NO: 6056954 - DNA, 11 bp, Homo sapiens
cccccagcacc

SEQ ID NO: 6056955 - DNA, 17 bp, Homo sapiens
cccccagcactcctctg

SEQ ID NO: 6056956 - DNA, 17 bp, Homo sapiens
cccccagcactgaggaa

SEQ ID NO: 6056957 - DNA, 18 bp, Homo sapiens
cccccagcactgaggaag

SEQ ID NO: 6056958 - DNA, 15 bp, Homo sapiens
cccccagcagaggca

SEQ ID NO: 6056959 - DNA, 15 bp, Homo sapiens
cccccagcagctcac

SEQ ID NO: 6056960 - DNA, 21 bp, Homo sapiens
cccccagcatcgggggcctgc

SEQ ID NO: 6056961 - DNA, 14 bp, Homo sapiens
cccccagcccaata

SEQ ID NO: 6056962 - DNA, 17 bp, Homo sapiens
cccccagcccaataaag

SEQ ID NO: 6056963 - DNA, 12 bp, Homo sapiens
cccccagcccca

SEQ ID NO: 6056964 - DNA, 13 bp, Homo sapiens
cccccagccccgg

SEQ ID NO: 6056965 - DNA, 22 bp, Homo sapiens
cccccagcccctcctccctcaa

SEQ ID NO: 6056966 - DNA, 12 bp, Homo sapiens
cccccagcctgg

SEQ ID NO: 6056967 - DNA, 15 bp, Homo sapiens
cccccagcctgggcc

SEQ ID NO: 6056968 - DNA, 12 bp, Homo sapiens
cccccagcctgt

SEQ ID NO: 6056969 - DNA, 21 bp, Homo sapiens
cccccagctaagaacctggaa

SEQ ID NO: 6056970 - DNA, 18 bp, Homo sapiens
cccccagctaataaacca

SEQ ID NO: 6056971 - DNA, 15 bp, Homo sapiens
cccccagctcccacc

SEQ ID NO: 6056972 - DNA, 18 bp, Homo sapiens
cccccagctccctgcacc

SEQ ID NO: 6056973 - DNA, 14 bp, Homo sapiens
cccccagctctggt

SEQ ID NO: 6056974 - DNA, 12 bp, Homo sapiens
cccccagctgcg

SEQ ID NO: 6056975 - DNA, 12 bp, Homo sapiens
cccccagctggt

SEQ ID NO: 6056976 - DNA, 16 bp, Homo sapiens
cccccagctggtgtcc

SEQ ID NO: 6056977 - DNA, 19 bp, Homo sapiens
cccccagcttcacttctga

SEQ ID NO: 6056978 - DNA, 18 bp, Homo sapiens
cccccagcttccagcagg

SEQ ID NO: 6056979 - DNA, 23 bp, Homo sapiens
cccccagctttgctaccaaagca

SEQ ID NO: 6056980 - DNA, 13 bp, Homo sapiens
cccccaggacccc

SEQ ID NO: 6056981 - DNA, 16 bp, Homo sapiens
cccccaggatctgggt

SEQ ID NO: 6056982 - DNA, 16 bp, Homo sapiens
cccccaggattcccag

SEQ ID NO: 6056983 - DNA, 19 bp, Homo sapiens
cccccaggattcccagaga

SEQ ID NO: 6056984 - DNA, 12 bp, Homo sapiens
cccccaggccct

SEQ ID NO: 6056985 - DNA, 14 bp, Homo sapiens
cccccaggccctac

SEQ ID NO: 6056986 - DNA, 18 bp, Homo sapiens
cccccaggccctcccacc

SEQ ID NO: 6056987 - DNA, 13 bp, Homo sapiens
cccccaggcctcc

SEQ ID NO: 6056988 - DNA, 14 bp, Homo sapiens
cccccaggcctcct

SEQ ID NO: 6056989 - DNA, 15 bp, Homo sapiens
cccccaggcctgagc

SEQ ID NO: 6056990 - DNA, 22 bp, Homo sapiens
cccccaggcctgtccaccctgc

SEQ ID NO: 6056991 - DNA, 15 bp, Homo sapiens
cccccaggctgcgcc

SEQ ID NO: 6056992 - DNA, 16 bp, Homo sapiens
cccccaggctgctgga

SEQ ID NO: 6056993 - DNA, 21 bp, Homo sapiens
cccccagggaatcagggacca

SEQ ID NO: 6056994 - DNA, 18 bp, Homo sapiens
cccccagggcctccaggg

SEQ ID NO: 6056995 - DNA, 20 bp, Homo sapiens
cccccagggcctccagggcc

SEQ ID NO: 6056996 - DNA, 21 bp, Homo sapiens
cccccagggcctccagggccc

SEQ ID NO: 6056997 - DNA, 18 bp, Homo sapiens
cccccagggtcctgggag

SEQ ID NO: 6056998 - DNA, 20 bp, Homo sapiens
ccacgcccgtcctgcctgtg

SEQ ID NO: 6056999 - DNA, 21 bp, Homo sapiens
ccacgcccgtcctgcctgtgg

SEQ ID NO: 6057000 - DNA, 22 bp, Homo sapiens
ccacgcccgtctctttctcacc

SEQ ID NO: 6057001 - DNA, 21 bp, Homo sapiens
ccacgccctcattacggctcc

SEQ ID NO: 6057002 - DNA, 14 bp, Homo sapiens
ccacgccctcccct

SEQ ID NO: 6057003 - DNA, 15 bp, Homo sapiens
ccacgccctcccctc

SEQ ID NO: 6057004 - DNA, 20 bp, Homo sapiens
ccacgccctcccctcccctg

SEQ ID NO: 6057005 - DNA, 16 bp, Homo sapiens
ccacgccctccctgct

SEQ ID NO: 6057006 - DNA, 17 bp, Homo sapiens
ccacgccctcctccctc

SEQ ID NO: 6057007 - DNA, 20 bp, Homo sapiens
ccacgccctctcctccccct

SEQ ID NO: 6057008 - DNA, 18 bp, Homo sapiens
ccacgccctggggagtga

SEQ ID NO: 6057009 - DNA, 18 bp, Homo sapiens
ccacgcccttggagcctt

SEQ ID NO: 6057010 - DNA, 16 bp, Homo sapiens
ccacgccgccctccat

SEQ ID NO: 6057011 - DNA, 18 bp, Homo sapiens
ccacgcctcaccagcccc

SEQ ID NO: 6057012 - DNA, 23 bp, Homo sapiens
ccacgcctccatccacacacagc

SEQ ID NO: 6057013 - DNA, 15 bp, Homo sapiens
ccacgcctcctggcc

SEQ ID NO: 6057014 - DNA, 19 bp, Homo sapiens
ccacgcctcctggccagac

SEQ ID NO: 6057015 - DNA, 18 bp, Homo sapiens
ccacgcctcttgaccagg

SEQ ID NO: 6057016 - DNA, 21 bp, Homo sapiens
ccacgcctcttgaccaggctg

SEQ ID NO: 6057017 - DNA, 17 bp, Homo sapiens
ccacgcctgtaatccca

SEQ ID NO: 6057018 - DNA, 14 bp, Homo sapiens
ccacgcgctctgca

SEQ ID NO: 6057019 - DNA, 15 bp, Homo sapiens
ccacgcgctctgcat

SEQ ID NO: 6057020 - DNA, 16 bp, Homo sapiens
ccacgcgctctgcatg

SEQ ID NO: 6057021 - DNA, 17 bp, Homo sapiens
ccacgcgctctgcatgc

SEQ ID NO: 6057022 - DNA, 22 bp, Homo sapiens
ccacgcgctctgcatgctcctc

SEQ ID NO: 6057023 - DNA, 13 bp, Homo sapiens
ccacgctcagtgc

SEQ ID NO: 6057024 - DNA, 14 bp, Homo sapiens
ccacgctcagtgcc

SEQ ID NO: 6057025 - DNA, 14 bp, Homo sapiens
ccacgctcatcttg

SEQ ID NO: 6057026 - DNA, 13 bp, Homo sapiens
ccacgctccagct

SEQ ID NO: 6057027 - DNA, 12 bp, Homo sapiens
ccacgctcctgc

SEQ ID NO: 6057028 - DNA, 13 bp, Homo sapiens
ccacgctggagct

SEQ ID NO: 6057029 - DNA, 16 bp, Homo sapiens
ccacgctggagctgtg

SEQ ID NO: 6057030 - DNA, 18 bp, Homo sapiens
ccacgctggagtgcagtg

SEQ ID NO: 6057031 - DNA, 13 bp, Homo sapiens
ccacgctgggcct

SEQ ID NO: 6057032 - DNA, 18 bp, Homo sapiens
ccacgctgggcctaggat

SEQ ID NO: 6057033 - DNA, 11 bp, Homo sapiens
ccacgctgtcc

SEQ ID NO: 6057034 - DNA, 14 bp, Homo sapiens
ccacgctgtcctct

SEQ ID NO: 6057035 - DNA, 18 bp, Homo sapiens
ccacgctgtctccagacc

SEQ ID NO: 6057036 - DNA, 19 bp, Homo sapiens
ccacgctgtctccagaccc

SEQ ID NO: 6057037 - DNA, 18 bp, Homo sapiens
ccacgctgtggccctgga

SEQ ID NO: 6057038 - DNA, 13 bp, Homo sapiens
ccacggaaacaga

SEQ ID NO: 6057039 - DNA, 16 bp, Homo sapiens
ccacggaaacagaact

SEQ ID NO: 6057040 - DNA, 21 bp, Homo sapiens
ccacggaaggcgggctgagga

SEQ ID NO: 6057041 - DNA, 17 bp, Homo sapiens
ccacggacgctggctcc

SEQ ID NO: 6057042 - DNA, 18 bp, Homo sapiens
ccacggacgtttccatca

SEQ ID NO: 6057043 - DNA, 17 bp, Homo sapiens
ccacggactccagtctg

SEQ ID NO: 6057044 - DNA, 21 bp, Homo sapiens
ccacggagccctccctatgtc

SEQ ID NO: 6057045 - DNA, 14 bp, Homo sapiens
ccacggagggaggc

SEQ ID NO: 6057046 - DNA, 17 bp, Homo sapiens
ccacggagggaggcacc

SEQ ID NO: 6057047 - DNA, 18 bp, Homo sapiens
ccacggagggaggcacca

SEQ ID NO: 6057048 - DNA, 19 bp, Homo sapiens
ccacggagggaggcaccat

SEQ ID NO: 6057049 - DNA, 21 bp, Homo sapiens
ccacggagggaggcaccatgc

SEQ ID NO: 6057050 - DNA, 17 bp, Homo sapiens
ccacggatgcgtgggca

SEQ ID NO: 6057051 - DNA, 19 bp, Homo sapiens
ccacggatgcgtgggcaga

SEQ ID NO: 6057052 - DNA, 20 bp, Homo sapiens
ccacggcacctgggccctgg

SEQ ID NO: 6057053 - DNA, 20 bp, Homo sapiens
ccacggcactccagcctggg

SEQ ID NO: 6057054 - DNA, 14 bp, Homo sapiens
ccacggcagccacc

SEQ ID NO: 6057055 - DNA, 21 bp, Homo sapiens
ccacggcagccaccctgccat

SEQ ID NO: 6057056 - DNA, 22 bp, Homo sapiens
ccacggcattatgatcccttcc

SEQ ID NO: 6057057 - DNA, 17 bp, Homo sapiens
ccacggccacccaccct

SEQ ID NO: 6057058 - DNA, 14 bp, Homo sapiens
ccacggccactgca

SEQ ID NO: 6057059 - DNA, 13 bp, Homo sapiens
ccacggccactgg

SEQ ID NO: 6057060 - DNA, 12 bp, Homo sapiens
ccacggccaggc

SEQ ID NO: 6057061 - DNA, 13 bp, Homo sapiens
ccacggccaggcc

SEQ ID NO: 6057062 - DNA, 18 bp, Homo sapiens
ccacggccaggccagagg

SEQ ID NO: 6057063 - DNA, 17 bp, Homo sapiens
ccacggccatgagggct

SEQ ID NO: 6057064 - DNA, 18 bp, Homo sapiens
ccacggccgctccagggg

SEQ ID NO: 6057065 - DNA, 15 bp, Homo sapiens
ccacggcctggctgg

SEQ ID NO: 6057066 - DNA, 19 bp, Homo sapiens
ccacggcctggctggtggg

SEQ ID NO: 6057067 - DNA, 16 bp, Homo sapiens
ccacggcctgggaggg

SEQ ID NO: 6057068 - DNA, 12 bp, Homo sapiens
ccacggccttgt

SEQ ID NO: 6057069 - DNA, 20 bp, Homo sapiens
ccacggcgttgtacctgtag

SEQ ID NO: 6057070 - DNA, 13 bp, Homo sapiens
ccacggctaagag

SEQ ID NO: 6057071 - DNA, 18 bp, Homo sapiens
ccacggctgagccttcag

SEQ ID NO: 6057072 - DNA, 20 bp, Homo sapiens
ccacgggacatcacagggtg

SEQ ID NO: 6057073 - DNA, 17 bp, Homo sapiens
ccacgggactctggtgg

SEQ ID NO: 6057074 - DNA, 22 bp, Homo sapiens
ccacgggactctggtggctgcc

SEQ ID NO: 6057075 - DNA, 16 bp, Homo sapiens
ccacgggcctcagttt

SEQ ID NO: 6057076 - DNA, 17 bp, Homo sapiens
ccacgggcctcagtttc

SEQ ID NO: 6057077 - DNA, 23 bp, Homo sapiens
ccacggggaccactgggcccctc

SEQ ID NO: 6057078 - DNA, 15 bp, Homo sapiens
ccacggggagcaaac

SEQ ID NO: 6057079 - DNA, 16 bp, Homo sapiens
ccacggggagggggac

SEQ ID NO: 6057080 - DNA, 16 bp, Homo sapiens
ccacggggatcacagc

SEQ ID NO: 6057081 - DNA, 13 bp, Homo sapiens
ccacgggggaggc

SEQ ID NO: 6057082 - DNA, 23 bp, Homo sapiens
ccacgggggaggccgaggcaggg

SEQ ID NO: 6057083 - DNA, 18 bp, Homo sapiens
ccacgggggcctagtggc

SEQ ID NO: 6057084 - DNA, 19 bp, Homo sapiens
ccacgggggcggcaggctg

SEQ ID NO: 6057085 - DNA, 22 bp, Homo sapiens
ccacggggtcgggggaggagca

SEQ ID NO: 6057086 - DNA, 20 bp, Homo sapiens
ccacggtccaatccagcctt

SEQ ID NO: 6057087 - DNA, 19 bp, Homo sapiens
ccacggtctggaggccgag

SEQ ID NO: 6057088 - DNA, 20 bp, Homo sapiens
ccacggtctggaggccgagg

SEQ ID NO: 6057089 - DNA, 17 bp, Homo sapiens
ccacggtctgttcttga

SEQ ID NO: 6057090 - DNA, 19 bp, Homo sapiens
ccacggtgaaagtgctgct

SEQ ID NO: 6057091 - DNA, 13 bp, Homo sapiens
ccacggtgcgtgg

SEQ ID NO: 6057092 - DNA, 16 bp, Homo sapiens
ccacggtgcgtggctg

SEQ ID NO: 6057093 - DNA, 17 bp, Homo sapiens
ccacggtgcgtggctgt

SEQ ID NO: 6057094 - DNA, 14 bp, Homo sapiens
ccacggtgttctgt

SEQ ID NO: 6057095 - DNA, 15 bp, Homo sapiens
ccacgtagggggcag

SEQ ID NO: 6057096 - DNA, 18 bp, Homo sapiens
ccacgtagggggcagggg

SEQ ID NO: 6057097 - DNA, 17 bp, Homo sapiens
ccacgtagggggctctg

SEQ ID NO: 6057098 - DNA, 15 bp, Homo sapiens
ccacgtattcccctt

SEQ ID NO: 6057099 - DNA, 20 bp, Homo sapiens
ccacgtattccccttcccac

SEQ ID NO: 6057100 - DNA, 22 bp, Homo sapiens
ccacgtcagccaaatgacttca

SEQ ID NO: 6057101 - DNA, 17 bp, Homo sapiens
ccacgtcccaccccacc

SEQ ID NO: 6057102 - DNA, 12 bp, Homo sapiens
ccacgtcccagc

SEQ ID NO: 6057103 - DNA, 13 bp, Homo sapiens
ccacgtcccagca

SEQ ID NO: 6057104 - DNA, 18 bp, Homo sapiens
ccacgtcccagcatccct

SEQ ID NO: 6057105 - DNA, 17 bp, Homo sapiens
ccacgtcccgctgcctc

SEQ ID NO: 6057106 - DNA, 18 bp, Homo sapiens
ccacgtccctgcggaagc

SEQ ID NO: 6057107 - DNA, 22 bp, Homo sapiens
ccacgtcctcgaattctcagac

SEQ ID NO: 6057108 - DNA, 19 bp, Homo sapiens
ccacgtcctggtctttgtt

SEQ ID NO: 6057109 - DNA, 21 bp, Homo sapiens
ccacgtctctctgcctgctgg

SEQ ID NO: 6057110 - DNA, 13 bp, Homo sapiens
ccacgtctgccag

SEQ ID NO: 6057111 - DNA, 16 bp, Homo sapiens
ccacgtctgccaggcc

SEQ ID NO: 6057112 - DNA, 20 bp, Homo sapiens
ccacgtctgctaacttggag

SEQ ID NO: 6057113 - DNA, 13 bp, Homo sapiens
ccacgtctggcca

SEQ ID NO: 6057114 - DNA, 21 bp, Homo sapiens
ccacgtctggccaggcactgc

SEQ ID NO: 6057115 - DNA, 18 bp, Homo sapiens
ccacgtctggctccctgc

SEQ ID NO: 6057116 - DNA, 19 bp, Homo sapiens
ccacgtctggctccctgcc

SEQ ID NO: 6057117 - DNA, 22 bp, Homo sapiens
ccacgtctggctccctgcccct

SEQ ID NO: 6057118 - DNA, 15 bp, Homo sapiens
ccacgtctgtcctcc

SEQ ID NO: 6057119 - DNA, 17 bp, Homo sapiens
ccacgtctgtcttcaca

SEQ ID NO: 6057120 - DNA, 23 bp, Homo sapiens
ccacgtgaaatttgcctctgtcc

SEQ ID NO: 6057121 - DNA, 17 bp, Homo sapiens
ccacgtgacagtgcctg

SEQ ID NO: 6057122 - DNA, 17 bp, Homo sapiens
ccacgtgagagaatctg

SEQ ID NO: 6057123 - DNA, 23 bp, Homo sapiens
ccacgtgatttccagtgagtgta

SEQ ID NO: 6057124 - DNA, 15 bp, Homo sapiens
ccacgtgctaccccc

SEQ ID NO: 6057125 - DNA, 14 bp, Homo sapiens
ccacgtgctggaga

SEQ ID NO: 6057126 - DNA, 17 bp, Homo sapiens
ccacgtgctggagagta

SEQ ID NO: 6057127 - DNA, 15 bp, Homo sapiens
ccacgtggactctgt

SEQ ID NO: 6057128 - DNA, 20 bp, Homo sapiens
ccacgtggtcactgtgcact

SEQ ID NO: 6057129 - DNA, 18 bp, Homo sapiens
ccacgtggtggcccagct

SEQ ID NO: 6057130 - DNA, 20 bp, Homo sapiens
ccacgtggtggcccagctcc

SEQ ID NO: 6057131 - DNA, 16 bp, Homo sapiens
ccacgtggtgtccctg

SEQ ID NO: 6057132 - DNA, 23 bp, Homo sapiens
ccacgtgtatagtatctgtatat

SEQ ID NO: 6057133 - DNA, 19 bp, Homo sapiens
ccacgtgtccgtccaccct

SEQ ID NO: 6057134 - DNA, 20 bp, Homo sapiens
ccacgtgtctggaatcccag

SEQ ID NO: 6057135 - DNA, 15 bp, Homo sapiens
ccacgtgtcttccac

SEQ ID NO: 6057136 - DNA, 17 bp, Homo sapiens
ccacgtgtgcagactgt

SEQ ID NO: 6057137 - DNA, 19 bp, Homo sapiens
ccacgtgtttcgggccagg

SEQ ID NO: 6057138 - DNA, 16 bp, Homo sapiens
ccacgttactcccctg

SEQ ID NO: 6057139 - DNA, 16 bp, Homo sapiens
ccacgttcagggaggg

SEQ ID NO: 6057140 - DNA, 15 bp, Homo sapiens
ccacgttccttactg

SEQ ID NO: 6057141 - DNA, 20 bp, Homo sapiens
ccacgttggagaagcccgtg

SEQ ID NO: 6057142 - DNA, 20 bp, Homo sapiens
ccacgttggccaggatggtc

SEQ ID NO: 6057143 - DNA, 13 bp, Homo sapiens
ccacgttttgaaa

SEQ ID NO: 6057144 - DNA, 13 bp, Homo sapiens
ccactaaaaatat

SEQ ID NO: 6057145 - DNA, 23 bp, Homo sapiens
ccactaaaaatattgtttctgca

SEQ ID NO: 6057146 - DNA, 22 bp, Homo sapiens
ccactaaaacaaaacaaaaaac

SEQ ID NO: 6057147 - DNA, 17 bp, Homo sapiens
ccactaaaatccaccca

SEQ ID NO: 6057148 - DNA, 18 bp, Homo sapiens
ccactaaaatccacccag

SEQ ID NO: 6057149 - DNA, 15 bp, Homo sapiens
ccactaaagcttcag

SEQ ID NO: 6057150 - DNA, 18 bp, Homo sapiens
ccactaaagcttcagact

SEQ ID NO: 6057151 - DNA, 20 bp, Homo sapiens
ccactaaagcttcagactca

SEQ ID NO: 6057152 - DNA, 22 bp, Homo sapiens
ccactaaatctccaagacctgg

SEQ ID NO: 6057153 - DNA, 14 bp, Homo sapiens
ccactaaatgagct

SEQ ID NO: 6057154 - DNA, 20 bp, Homo sapiens
ccactaaatgagctcctgcg

SEQ ID NO: 6057155 - DNA, 21 bp, Homo sapiens
ccactaagaattcaaactggg

SEQ ID NO: 6057156 - DNA, 20 bp, Homo sapiens
ccactaagagattgcacagt

SEQ ID NO: 6057157 - DNA, 13 bp, Homo sapiens
ccactaagcagag

SEQ ID NO: 6057158 - DNA, 15 bp, Homo sapiens
ccactaataaagtgc

SEQ ID NO: 6057159 - DNA, 13 bp, Homo sapiens
ccactaatgcaaa

SEQ ID NO: 6057160 - DNA, 17 bp, Homo sapiens
ccactaatttgtcactg

SEQ ID NO: 6057161 - DNA, 21 bp, Homo sapiens
ccactaatttgtcactggaac

SEQ ID NO: 6057162 - DNA, 19 bp, Homo sapiens
ccactacactccagcctga

SEQ ID NO: 6057163 - DNA, 13 bp, Homo sapiens
ccactacaggccc

SEQ ID NO: 6057164 - DNA, 12 bp, Homo sapiens
ccactacagtaa

SEQ ID NO: 6057165 - DNA, 18 bp, Homo sapiens
ccactacagtaagctggt

SEQ ID NO: 6057166 - DNA, 11 bp, Homo sapiens
ccactacattc

SEQ ID NO: 6057167 - DNA, 16 bp, Homo sapiens
ccactacattctgtta

SEQ ID NO: 6057168 - DNA, 18 bp, Homo sapiens
ccactacattctgttaat

SEQ ID NO: 6057169 - DNA, 18 bp, Homo sapiens
ccactaccaaaagacatt

SEQ ID NO: 6057170 - DNA, 12 bp, Homo sapiens
ccactaccagcc

SEQ ID NO: 6057171 - DNA, 14 bp, Homo sapiens
ccactaccagccag

SEQ ID NO: 6057172 - DNA, 15 bp, Homo sapiens
ccactaccagccagc

SEQ ID NO: 6057173 - DNA, 16 bp, Homo sapiens
ccactaccagccagcc

SEQ ID NO: 6057174 - DNA, 18 bp, Homo sapiens
ccactaccatacagacag

SEQ ID NO: 6057175 - DNA, 20 bp, Homo sapiens
ccactaccccacaccagcct

SEQ ID NO: 6057176 - DNA, 19 bp, Homo sapiens
ccactacccgatttgttta

SEQ ID NO: 6057177 - DNA, 21 bp, Homo sapiens
cccccaggtcttcctgctttc

SEQ ID NO: 6057178 - DNA, 22 bp, Homo sapiens
cccccaggtcttcctgctttcc

SEQ ID NO: 6057179 - DNA, 18 bp, Homo sapiens
cccccaggtgcagcccca

SEQ ID NO: 6057180 - DNA, 15 bp, Homo sapiens
cccccagtacctcca

SEQ ID NO: 6057181 - DNA, 18 bp, Homo sapiens
cccccagtatctcttcag

SEQ ID NO: 6057182 - DNA, 23 bp, Homo sapiens
cccccagtcgagccctgcagcca

SEQ ID NO: 6057183 - DNA, 16 bp, Homo sapiens
cccccagtgccacaga

SEQ ID NO: 6057184 - DNA, 14 bp, Homo sapiens
cccccagtgcgctc

SEQ ID NO: 6057185 - DNA, 14 bp, Homo sapiens
cccccagtggactc

SEQ ID NO: 6057186 - DNA, 15 bp, Homo sapiens
cccccatagcaccct

SEQ ID NO: 6057187 - DNA, 21 bp, Homo sapiens
cccccatagcaccctgccctc

SEQ ID NO: 6057188 - DNA, 16 bp, Homo sapiens
cccccatcacccaagc

SEQ ID NO: 6057189 - DNA, 16 bp, Homo sapiens
cccccatcacctctac

SEQ ID NO: 6057190 - DNA, 16 bp, Homo sapiens
cccccatcatcctctg

SEQ ID NO: 6057191 - DNA, 17 bp, Homo sapiens
cccccatccagccacgg

SEQ ID NO: 6057192 - DNA, 18 bp, Homo sapiens
cccccatccagccacgga

SEQ ID NO: 6057193 - DNA, 19 bp, Homo sapiens
cccccatccagcctccagg

SEQ ID NO: 6057194 - DNA, 11 bp, Homo sapiens
cccccatccca

SEQ ID NO: 6057195 - DNA, 14 bp, Homo sapiens
cccccatcccaggg

SEQ ID NO: 6057196 - DNA, 15 bp, Homo sapiens
cccccatcccagggt

SEQ ID NO: 6057197 - DNA, 22 bp, Homo sapiens
cccccatccccatcctccagct

SEQ ID NO: 6057198 - DNA, 23 bp, Homo sapiens
cccccatccccatcctccagctt

SEQ ID NO: 6057199 - DNA, 18 bp, Homo sapiens
cccccatccctaccactg

SEQ ID NO: 6057200 - DNA, 15 bp, Homo sapiens
cccccatcctggccc

SEQ ID NO: 6057201 - DNA, 17 bp, Homo sapiens
cccccatcctggcccat

SEQ ID NO: 6057202 - DNA, 14 bp, Homo sapiens
cccccatcgctctg

SEQ ID NO: 6057203 - DNA, 12 bp, Homo sapiens
cccccatctccc

SEQ ID NO: 6057204 - DNA, 19 bp, Homo sapiens
cccccatctccccaggcct

SEQ ID NO: 6057205 - DNA, 11 bp, Homo sapiens
cccccatctct

SEQ ID NO: 6057206 - DNA, 13 bp, Homo sapiens
cccccatctctga

SEQ ID NO: 6057207 - DNA, 16 bp, Homo sapiens
cccccatctcttctgg

SEQ ID NO: 6057208 - DNA, 14 bp, Homo sapiens
cccccatgcactgt

SEQ ID NO: 6057209 - DNA, 15 bp, Homo sapiens
cccccatgccaccac

SEQ ID NO: 6057210 - DNA, 19 bp, Homo sapiens
cccccatgggctcctgccc

SEQ ID NO: 6057211 - DNA, 18 bp, Homo sapiens
cccccatgggctgtgtcc

SEQ ID NO: 6057212 - DNA, 20 bp, Homo sapiens
cccccatgtggcagcccatg

SEQ ID NO: 6057213 - DNA, 23 bp, Homo sapiens
cccccatgttgtaatgctgcact

SEQ ID NO: 6057214 - DNA, 13 bp, Homo sapiens
cccccattcccag

SEQ ID NO: 6057215 - DNA, 20 bp, Homo sapiens
cccccattctcatctgcacc

SEQ ID NO: 6057216 - DNA, 18 bp, Homo sapiens
cccccattctcccagtct

SEQ ID NO: 6057217 - DNA, 13 bp, Homo sapiens
ccccccacccacc

SEQ ID NO: 6057218 - DNA, 12 bp, Homo sapiens
ccccccaccgct

SEQ ID NO: 6057219 - DNA, 13 bp, Homo sapiens
ccccccactccca

SEQ ID NO: 6057220 - DNA, 13 bp, Homo sapiens
ccccccactctgt

SEQ ID NO: 6057221 - DNA, 12 bp, Homo sapiens
ccccccagagcc

SEQ ID NO: 6057222 - DNA, 21 bp, Homo sapiens
ccccccagatatcatctacct

SEQ ID NO: 6057223 - DNA, 12 bp, Homo sapiens
ccccccagcact

SEQ ID NO: 6057224 - DNA, 14 bp, Homo sapiens
ccccccagcactga

SEQ ID NO: 6057225 - DNA, 12 bp, Homo sapiens
ccccccagcctc

SEQ ID NO: 6057226 - DNA, 11 bp, Homo sapiens
ccccccagctc

SEQ ID NO: 6057227 - DNA, 12 bp, Homo sapiens
ccccccagcttc

SEQ ID NO: 6057228 - DNA, 14 bp, Homo sapiens
ccccccaggccagc

SEQ ID NO: 6057229 - DNA, 12 bp, Homo sapiens
ccccccagggct

SEQ ID NO: 6057230 - DNA, 14 bp, Homo sapiens
ccccccagggtcct

SEQ ID NO: 6057231 - DNA, 14 bp, Homo sapiens
ccccccaggtgctg

SEQ ID NO: 6057232 - DNA, 17 bp, Homo sapiens
ccccccatcccagggtc

SEQ ID NO: 6057233 - DNA, 12 bp, Homo sapiens
cccccccaggcc

SEQ ID NO: 6057234 - DNA, 13 bp, Homo sapiens
cccccccatgcag

SEQ ID NO: 6057235 - DNA, 11 bp, Homo sapiens
cccccccctcc

SEQ ID NO: 6057236 - DNA, 12 bp, Homo sapiens
cccccccttcca

SEQ ID NO: 6057237 - DNA, 22 bp, Homo sapiens
cccccctcaaggggcagggagg

SEQ ID NO: 6057238 - DNA, 13 bp, Homo sapiens
cccccctccaggc

SEQ ID NO: 6057239 - DNA, 13 bp, Homo sapiens
cccccctcctgct

SEQ ID NO: 6057240 - DNA, 13 bp, Homo sapiens
cccccctctcctc

SEQ ID NO: 6057241 - DNA, 22 bp, Homo sapiens
cccccctctcctcccagctgct

SEQ ID NO: 6057242 - DNA, 19 bp, Homo sapiens
cccccctgctgcccagtgc

SEQ ID NO: 6057243 - DNA, 18 bp, Homo sapiens
cccccctgtgcctgctgg

SEQ ID NO: 6057244 - DNA, 12 bp, Homo sapiens
ccccccttccca

SEQ ID NO: 6057245 - DNA, 12 bp, Homo sapiens
ccccccttgaag

SEQ ID NO: 6057246 - DNA, 11 bp, Homo sapiens
cccccctttgg

SEQ ID NO: 6057247 - DNA, 16 bp, Homo sapiens
cccccgacagcccagc

SEQ ID NO: 6057248 - DNA, 13 bp, Homo sapiens
cccccgaccctgc

SEQ ID NO: 6057249 - DNA, 14 bp, Homo sapiens
cccccgacggctgt

SEQ ID NO: 6057250 - DNA, 15 bp, Homo sapiens
cccccgactgcctgt

SEQ ID NO: 6057251 - DNA, 20 bp, Homo sapiens
cccccgagccctgactcctg

SEQ ID NO: 6057252 - DNA, 18 bp, Homo sapiens
cccccgagctcttggcct

SEQ ID NO: 6057253 - DNA, 15 bp, Homo sapiens
cccccgagctggggg

SEQ ID NO: 6057254 - DNA, 15 bp, Homo sapiens
cccccgagcttgcct

SEQ ID NO: 6057255 - DNA, 16 bp, Homo sapiens
cccccgagcttgcctc

SEQ ID NO: 6057256 - DNA, 23 bp, Homo sapiens
cccccgagcttgcctcagggcca

SEQ ID NO: 6057257 - DNA, 14 bp, Homo sapiens
cccccgaggccccc

SEQ ID NO: 6057258 - DNA, 16 bp, Homo sapiens
cccccgaggcccccct

SEQ ID NO: 6057259 - DNA, 19 bp, Homo sapiens
cccccgaggcccccctctg

SEQ ID NO: 6057260 - DNA, 20 bp, Homo sapiens
cccccgaggcccccctctgc

SEQ ID NO: 6057261 - DNA, 14 bp, Homo sapiens
cccccgcacagcca

SEQ ID NO: 6057262 - DNA, 13 bp, Homo sapiens
cccccgcagaggc

SEQ ID NO: 6057263 - DNA, 24 bp, Homo sapiens
cccccgcagtcgtcagcctccctg

SEQ ID NO: 6057264 - DNA, 15 bp, Homo sapiens
cccccgcatcccctg

SEQ ID NO: 6057265 - DNA, 17 bp, Homo sapiens
cccccgccacggccacc

SEQ ID NO: 6057266 - DNA, 12 bp, Homo sapiens
cccccgccatgc

SEQ ID NO: 6057267 - DNA, 11 bp, Homo sapiens
cccccgcccca

SEQ ID NO: 6057268 - DNA, 14 bp, Homo sapiens
cccccgccccaggc

SEQ ID NO: 6057269 - DNA, 12 bp, Homo sapiens
cccccgccccca

SEQ ID NO: 6057270 - DNA, 13 bp, Homo sapiens
cccccgccccctg

SEQ ID NO: 6057271 - DNA, 14 bp, Homo sapiens
cccccgccctcatg

SEQ ID NO: 6057272 - DNA, 16 bp, Homo sapiens
cccccgccctcgctcc

SEQ ID NO: 6057273 - DNA, 13 bp, Homo sapiens
cccccgcctgcca

SEQ ID NO: 6057274 - DNA, 14 bp, Homo sapiens
cccccgcctgggca

SEQ ID NO: 6057275 - DNA, 15 bp, Homo sapiens
cccccgcctgggcac

SEQ ID NO: 6057276 - DNA, 16 bp, Homo sapiens
cccccgccttccggtg

SEQ ID NO: 6057277 - DNA, 12 bp, Homo sapiens
cccccgcgccct

SEQ ID NO: 6057278 - DNA, 21 bp, Homo sapiens
cccccgcgctcgcccagcagg

SEQ ID NO: 6057279 - DNA, 13 bp, Homo sapiens
cccccgctctgcc

SEQ ID NO: 6057280 - DNA, 19 bp, Homo sapiens
cccccgctctgccatcagc

SEQ ID NO: 6057281 - DNA, 13 bp, Homo sapiens
cccccgctggagg

SEQ ID NO: 6057282 - DNA, 21 bp, Homo sapiens
cccccgctgtcagccattcct

SEQ ID NO: 6057283 - DNA, 17 bp, Homo sapiens
cccccgcttagccccgc

SEQ ID NO: 6057284 - DNA, 17 bp, Homo sapiens
cccccggaggcgcccac

SEQ ID NO: 6057285 - DNA, 19 bp, Homo sapiens
cccccggaggcgcccacct

SEQ ID NO: 6057286 - DNA, 21 bp, Homo sapiens
cccccggaggcgcccacctgc

SEQ ID NO: 6057287 - DNA, 14 bp, Homo sapiens
cccccggccaagga

SEQ ID NO: 6057288 - DNA, 14 bp, Homo sapiens
cccccggcccagtg

SEQ ID NO: 6057289 - DNA, 22 bp, Homo sapiens
cccccggcctggccccctcgcg

SEQ ID NO: 6057290 - DNA, 20 bp, Homo sapiens
cccccggctttcctccggag

SEQ ID NO: 6057291 - DNA, 15 bp, Homo sapiens
cccccgggaggggcc

SEQ ID NO: 6057292 - DNA, 14 bp, Homo sapiens
cccccgggcccttt

SEQ ID NO: 6057293 - DNA, 15 bp, Homo sapiens
cccccgggccctttc

SEQ ID NO: 6057294 - DNA, 16 bp, Homo sapiens
cccccgggcctgcaca

SEQ ID NO: 6057295 - DNA, 17 bp, Homo sapiens
cccccgggcctgcacag

SEQ ID NO: 6057296 - DNA, 22 bp, Homo sapiens
cccccgggcctgcacagatacc

SEQ ID NO: 6057297 - DNA, 24 bp, Homo sapiens
cccccgggtttggcgggccaagga

SEQ ID NO: 6057298 - DNA, 13 bp, Homo sapiens
cccccggtgcctc

SEQ ID NO: 6057299 - DNA, 19 bp, Homo sapiens
cccccgtcagctgcttctg

SEQ ID NO: 6057300 - DNA, 17 bp, Homo sapiens
cccccgtggggcaggga

SEQ ID NO: 6057301 - DNA, 14 bp, Homo sapiens
cccccgtggtcttt

SEQ ID NO: 6057302 - DNA, 20 bp, Homo sapiens
ccccctaccgcatggcagct

SEQ ID NO: 6057303 - DNA, 14 bp, Homo sapiens
ccccctagagactc

SEQ ID NO: 6057304 - DNA, 22 bp, Homo sapiens
ccccctagcaatacagggaggc

SEQ ID NO: 6057305 - DNA, 14 bp, Homo sapiens
ccccctatgctcca

SEQ ID NO: 6057306 - DNA, 21 bp, Homo sapiens
ccccctcaccacctgcccggc

SEQ ID NO: 6057307 - DNA, 24 bp, Homo sapiens
ccccctcacctctccaggtgctca

SEQ ID NO: 6057308 - DNA, 11 bp, Homo sapiens
ccccctcagct

SEQ ID NO: 6057309 - DNA, 20 bp, Homo sapiens
ccccctcaggaccctcgctg

SEQ ID NO: 6057310 - DNA, 14 bp, Homo sapiens
ccccctcatctgca

SEQ ID NO: 6057311 - DNA, 11 bp, Homo sapiens
ccccctcattc

SEQ ID NO: 6057312 - DNA, 12 bp, Homo sapiens
ccccctccacac

SEQ ID NO: 6057313 - DNA, 12 bp, Homo sapiens
ccccctcccacc

SEQ ID NO: 6057314 - DNA, 19 bp, Homo sapiens
ccccctccccctcctgctg

SEQ ID NO: 6057315 - DNA, 18 bp, Homo sapiens
ccccctcccctcccagtc

SEQ ID NO: 6057316 - DNA, 21 bp, Homo sapiens
ccccctcccctgcccctgccc

SEQ ID NO: 6057317 - DNA, 12 bp, Homo sapiens
ccccctccctgc

SEQ ID NO: 6057318 - DNA, 13 bp, Homo sapiens
ccccctccctgcc

SEQ ID NO: 6057319 - DNA, 16 bp, Homo sapiens
ccccctccctggatga

SEQ ID NO: 6057320 - DNA, 17 bp, Homo sapiens
ccccctccgcctccagg

SEQ ID NO: 6057321 - DNA, 10 bp, Homo sapiens
ccccctcctc

SEQ ID NO: 6057322 - DNA, 11 bp, Homo sapiens
ccccctcctga

SEQ ID NO: 6057323 - DNA, 11 bp, Homo sapiens
ccccctcctgc

SEQ ID NO: 6057324 - DNA, 12 bp, Homo sapiens
ccccctcctgca

SEQ ID NO: 6057325 - DNA, 17 bp, Homo sapiens
ccccctcctgctcctcc

SEQ ID NO: 6057326 - DNA, 18 bp, Homo sapiens
ccccctcctgctcctccc

SEQ ID NO: 6057327 - DNA, 15 bp, Homo sapiens
ccccctcctgctgtg

SEQ ID NO: 6057328 - DNA, 12 bp, Homo sapiens
ccccctcctggc

SEQ ID NO: 6057329 - DNA, 18 bp, Homo sapiens
ccccctcctttccaaata

SEQ ID NO: 6057330 - DNA, 17 bp, Homo sapiens
ccccctcgccagcttgg

SEQ ID NO: 6057331 - DNA, 13 bp, Homo sapiens
ccccctcgtgcca

SEQ ID NO: 6057332 - DNA, 19 bp, Homo sapiens
ccccctctcacgccacccc

SEQ ID NO: 6057333 - DNA, 14 bp, Homo sapiens
ccccctctccctgc

SEQ ID NO: 6057334 - DNA, 17 bp, Homo sapiens
ccccctctccctgcatg

SEQ ID NO: 6057335 - DNA, 12 bp, Homo sapiens
ccccctctcctc

SEQ ID NO: 6057336 - DNA, 18 bp, Homo sapiens
ccccctctcctggagggc

SEQ ID NO: 6057337 - DNA, 13 bp, Homo sapiens
ccccctctgccct

SEQ ID NO: 6057338 - DNA, 13 bp, Homo sapiens
ccccctctgcctt

SEQ ID NO: 6057339 - DNA, 17 bp, Homo sapiens
ccccctctgcctttgag

SEQ ID NO: 6057340 - DNA, 18 bp, Homo sapiens
ccccctctgcctttgagc

SEQ ID NO: 6057341 - DNA, 13 bp, Homo sapiens
ccccctctgctgc

SEQ ID NO: 6057342 - DNA, 21 bp, Homo sapiens
ccccctctggagaaggcctgg

SEQ ID NO: 6057343 - DNA, 12 bp, Homo sapiens
ccccctctggct

SEQ ID NO: 6057344 - DNA, 12 bp, Homo sapiens
ccccctctggtt

SEQ ID NO: 6057345 - DNA, 12 bp, Homo sapiens
ccccctctgtcc

SEQ ID NO: 6057346 - DNA, 23 bp, Homo sapiens
ccccctgaaacatgtgcccctgc

SEQ ID NO: 6057347 - DNA, 23 bp, Homo sapiens
ccccctgagtcaactggagcaag

SEQ ID NO: 6057348 - DNA, 16 bp, Homo sapiens
ccccctgcagcccagg

SEQ ID NO: 6057349 - DNA, 14 bp, Homo sapiens
ccccctgccagagg

SEQ ID NO: 6057350 - DNA, 12 bp, Homo sapiens
ccccctgcccca

SEQ ID NO: 6057351 - DNA, 22 bp, Homo sapiens
ccccctgccccccagcctctgg

SEQ ID NO: 6057352 - DNA, 12 bp, Homo sapiens
ccccctgccctc

SEQ ID NO: 6057353 - DNA, 19 bp, Homo sapiens
ccccctgccctcgtggcca

SEQ ID NO: 6057354 - DNA, 14 bp, Homo sapiens
ccccctgccctgca

SEQ ID NO: 6057355 - DNA, 18 bp, Homo sapiens
ccccctgctccaccagca

SEQ ID NO: 6057356 - DNA, 13 bp, Homo sapiens
ccccctgctgccc

SEQ ID NO: 6057357 - DNA, 19 bp, Homo sapiens
ccccctgctgctgcccgga

SEQ ID NO: 6057358 - DNA, 13 bp, Homo sapiens
ccccctgcttcag

SEQ ID NO: 6057359 - DNA, 12 bp, Homo sapiens
ccccctgcttct

SEQ ID NO: 6057360 - DNA, 18 bp, Homo sapiens
ccccctgcttctcagccc

SEQ ID NO: 6057361 - DNA, 20 bp, Homo sapiens
ccccctgcttctcccgccat

SEQ ID NO: 6057362 - DNA, 20 bp, Homo sapiens
ccccctggatgtcccctgtc

SEQ ID NO: 6057363 - DNA, 16 bp, Homo sapiens
ccactacccttctcct

SEQ ID NO: 6057364 - DNA, 22 bp, Homo sapiens
ccactacggaatagttggctag

SEQ ID NO: 6057365 - DNA, 23 bp, Homo sapiens
ccactacggaatagttggctagg

SEQ ID NO: 6057366 - DNA, 16 bp, Homo sapiens
ccactactcaaaaatt

SEQ ID NO: 6057367 - DNA, 22 bp, Homo sapiens
ccactactcaatactacctctg

SEQ ID NO: 6057368 - DNA, 19 bp, Homo sapiens
ccactactctcttcctcca

SEQ ID NO: 6057369 - DNA, 21 bp, Homo sapiens
ccactactgtgtagactcctg

SEQ ID NO: 6057370 - DNA, 15 bp, Homo sapiens
ccactagacccactg

SEQ ID NO: 6057371 - DNA, 16 bp, Homo sapiens
ccactagactcttcac

SEQ ID NO: 6057372 - DNA, 13 bp, Homo sapiens
ccactagccctct

SEQ ID NO: 6057373 - DNA, 22 bp, Homo sapiens
ccactagctaagcaagccagga

SEQ ID NO: 6057374 - DNA, 23 bp, Homo sapiens
ccactaggaatcccagaggtggg

SEQ ID NO: 6057375 - DNA, 19 bp, Homo sapiens
ccactaggactctgaggct

SEQ ID NO: 6057376 - DNA, 16 bp, Homo sapiens
ccactaggataggaac

SEQ ID NO: 6057377 - DNA, 18 bp, Homo sapiens
ccactaggccctggtctg

SEQ ID NO: 6057378 - DNA, 19 bp, Homo sapiens
ccactaggccctggtctgg

SEQ ID NO: 6057379 - DNA, 21 bp, Homo sapiens
ccactaggccctggtctggct

SEQ ID NO: 6057380 - DNA, 20 bp, Homo sapiens
ccactagggtcctggccctc

SEQ ID NO: 6057381 - DNA, 18 bp, Homo sapiens
ccactaggtgcccagtct

SEQ ID NO: 6057382 - DNA, 15 bp, Homo sapiens
ccactaggtgtcccc

SEQ ID NO: 6057383 - DNA, 19 bp, Homo sapiens
ccactaggttcttttccat

SEQ ID NO: 6057384 - DNA, 18 bp, Homo sapiens
ccactagtgacagtttct

SEQ ID NO: 6057385 - DNA, 21 bp, Homo sapiens
ccactatagtttaatactcag

SEQ ID NO: 6057386 - DNA, 20 bp, Homo sapiens
ccactatcccaatcaaagaa

SEQ ID NO: 6057387 - DNA, 20 bp, Homo sapiens
ccactatctccgttccatct

SEQ ID NO: 6057388 - DNA, 18 bp, Homo sapiens
ccactatgacagaggatt

SEQ ID NO: 6057389 - DNA, 21 bp, Homo sapiens
ccactatgagctttcagactc

SEQ ID NO: 6057390 - DNA, 16 bp, Homo sapiens
ccactatgcaaagaac

SEQ ID NO: 6057391 - DNA, 21 bp, Homo sapiens
ccactatggtcatctttttct

SEQ ID NO: 6057392 - DNA, 18 bp, Homo sapiens
ccactcaaaatatgtcaa

SEQ ID NO: 6057393 - DNA, 17 bp, Homo sapiens
ccactcaaagagggtga

SEQ ID NO: 6057394 - DNA, 20 bp, Homo sapiens
ccactcaagaccaaatggaa

SEQ ID NO: 6057395 - DNA, 22 bp, Homo sapiens
ccactcaatgtcttaggtcagg

SEQ ID NO: 6057396 - DNA, 22 bp, Homo sapiens
ccactcacacagccaggtgcct

SEQ ID NO: 6057397 - DNA, 14 bp, Homo sapiens
ccactcacacttgg

SEQ ID NO: 6057398 - DNA, 21 bp, Homo sapiens
ccactcacatgacacccgtga

SEQ ID NO: 6057399 - DNA, 13 bp, Homo sapiens
ccactcaccaggg

SEQ ID NO: 6057400 - DNA, 12 bp, Homo sapiens
ccactcactcca

SEQ ID NO: 6057401 - DNA, 17 bp, Homo sapiens
ccactcagaactctcca

SEQ ID NO: 6057402 - DNA, 18 bp, Homo sapiens
ccactcagaactctccag

SEQ ID NO: 6057403 - DNA, 23 bp, Homo sapiens
ccactcagaactctccagggagg

SEQ ID NO: 6057404 - DNA, 12 bp, Homo sapiens
ccactcagagac

SEQ ID NO: 6057405 - DNA, 15 bp, Homo sapiens
ccactcagagacatg

SEQ ID NO: 6057406 - DNA, 17 bp, Homo sapiens
ccactcagaggccccca

SEQ ID NO: 6057407 - DNA, 22 bp, Homo sapiens
ccactcagaggcccccagtggg

SEQ ID NO: 6057408 - DNA, 12 bp, Homo sapiens
ccactcagccat

SEQ ID NO: 6057409 - DNA, 14 bp, Homo sapiens
ccactcagccattc

SEQ ID NO: 6057410 - DNA, 11 bp, Homo sapiens
ccactcagctc

SEQ ID NO: 6057411 - DNA, 15 bp, Homo sapiens
ccactcagctccgtg

SEQ ID NO: 6057412 - DNA, 16 bp, Homo sapiens
ccactcaggcagcctg

SEQ ID NO: 6057413 - DNA, 18 bp, Homo sapiens
ccactcagggctgccact

SEQ ID NO: 6057414 - DNA, 16 bp, Homo sapiens
ccactcagggctggcc

SEQ ID NO: 6057415 - DNA, 15 bp, Homo sapiens
ccactcagggctggg

SEQ ID NO: 6057416 - DNA, 20 bp, Homo sapiens
ccactcaggtgcacacatca

SEQ ID NO: 6057417 - DNA, 17 bp, Homo sapiens
ccactcagtctcttcca

SEQ ID NO: 6057418 - DNA, 13 bp, Homo sapiens
ccactcattttga

SEQ ID NO: 6057419 - DNA, 14 bp, Homo sapiens
ccactccaagccag

SEQ ID NO: 6057420 - DNA, 16 bp, Homo sapiens
ccactccacatctgca

SEQ ID NO: 6057421 - DNA, 14 bp, Homo sapiens
ccactccaccctgt

SEQ ID NO: 6057422 - DNA, 15 bp, Homo sapiens
ccactccaccctgtt

SEQ ID NO: 6057423 - DNA, 13 bp, Homo sapiens
ccactccagcctg

SEQ ID NO: 6057424 - DNA, 14 bp, Homo sapiens
ccactccagcctgg

SEQ ID NO: 6057425 - DNA, 18 bp, Homo sapiens
ccactccagcgctgagtg

SEQ ID NO: 6057426 - DNA, 14 bp, Homo sapiens
ccactccagctctg

SEQ ID NO: 6057427 - DNA, 20 bp, Homo sapiens
ccactccagtccactcctga

SEQ ID NO: 6057428 - DNA, 15 bp, Homo sapiens
ccactccagtcctgc

SEQ ID NO: 6057429 - DNA, 19 bp, Homo sapiens
ccactccagtcctgccacc

SEQ ID NO: 6057430 - DNA, 18 bp, Homo sapiens
ccactccatctggtagaa

SEQ ID NO: 6057431 - DNA, 11 bp, Homo sapiens
ccactcccact

SEQ ID NO: 6057432 - DNA, 22 bp, Homo sapiens
ccactcccacttccctgacact

SEQ ID NO: 6057433 - DNA, 15 bp, Homo sapiens
ccactcccaggcagc

SEQ ID NO: 6057434 - DNA, 13 bp, Homo sapiens
ccactcccatccc

SEQ ID NO: 6057435 - DNA, 16 bp, Homo sapiens
ccactcccatctcctt

SEQ ID NO: 6057436 - DNA, 22 bp, Homo sapiens
ccactccccaacccctctccag

SEQ ID NO: 6057437 - DNA, 19 bp, Homo sapiens
ccactccccagccagcctg

SEQ ID NO: 6057438 - DNA, 22 bp, Homo sapiens
ccactccccagccccagcccct

SEQ ID NO: 6057439 - DNA, 15 bp, Homo sapiens
ccactcccccaccca

SEQ ID NO: 6057440 - DNA, 21 bp, Homo sapiens
ccactcccccaggagcagctg

SEQ ID NO: 6057441 - DNA, 16 bp, Homo sapiens
ccactcccctcacaca

SEQ ID NO: 6057442 - DNA, 21 bp, Homo sapiens
ccactcccgaaagcctttcct

SEQ ID NO: 6057443 - DNA, 14 bp, Homo sapiens
ccactcccgccaca

SEQ ID NO: 6057444 - DNA, 18 bp, Homo sapiens
ccactcccgccacacgct

SEQ ID NO: 6057445 - DNA, 21 bp, Homo sapiens
ccactcccgccacacgctcac

SEQ ID NO: 6057446 - DNA, 21 bp, Homo sapiens
ccactccctatctccttccca

SEQ ID NO: 6057447 - DNA, 13 bp, Homo sapiens
ccactccctcaca

SEQ ID NO: 6057448 - DNA, 12 bp, Homo sapiens
ccactccctccc

SEQ ID NO: 6057449 - DNA, 16 bp, Homo sapiens
ccactccctcccagaa

SEQ ID NO: 6057450 - DNA, 15 bp, Homo sapiens
ccactccctgagctt

SEQ ID NO: 6057451 - DNA, 12 bp, Homo sapiens
ccactccctgca

SEQ ID NO: 6057452 - DNA, 17 bp, Homo sapiens
ccactccctgcaacctg

SEQ ID NO: 6057453 - DNA, 13 bp, Homo sapiens
ccactccctgcca

SEQ ID NO: 6057454 - DNA, 14 bp, Homo sapiens
ccactccctgccaa

SEQ ID NO: 6057455 - DNA, 18 bp, Homo sapiens
ccactccctgccaactcc

SEQ ID NO: 6057456 - DNA, 14 bp, Homo sapiens
ccactccctgccac

SEQ ID NO: 6057457 - DNA, 16 bp, Homo sapiens
ccactccctgctccac

SEQ ID NO: 6057458 - DNA, 17 bp, Homo sapiens
ccactccctgctccacg

SEQ ID NO: 6057459 - DNA, 14 bp, Homo sapiens
ccactccctgggac

SEQ ID NO: 6057460 - DNA, 15 bp, Homo sapiens
ccactccctgggaca

SEQ ID NO: 6057461 - DNA, 15 bp, Homo sapiens
ccactccctgggggc

SEQ ID NO: 6057462 - DNA, 19 bp, Homo sapiens
ccactccctttccaacctc

SEQ ID NO: 6057463 - DNA, 23 bp, Homo sapiens
ccactccctttccaacctcactt

SEQ ID NO: 6057464 - DNA, 16 bp, Homo sapiens
ccactccctttcccct

SEQ ID NO: 6057465 - DNA, 21 bp, Homo sapiens
ccactccctttgcgtcaggag

SEQ ID NO: 6057466 - DNA, 21 bp, Homo sapiens
ccactccgactccccctcccc

SEQ ID NO: 6057467 - DNA, 16 bp, Homo sapiens
ccactccgagaggtgg

SEQ ID NO: 6057468 - DNA, 22 bp, Homo sapiens
ccactccggattccggccctgg

SEQ ID NO: 6057469 - DNA, 20 bp, Homo sapiens
ccactccggccctccagagc

SEQ ID NO: 6057470 - DNA, 21 bp, Homo sapiens
ccactccggccctccagagcc

SEQ ID NO: 6057471 - DNA, 22 bp, Homo sapiens
ccactccggccctccagagccc

SEQ ID NO: 6057472 - DNA, 22 bp, Homo sapiens
ccactcctaatcaagagtctct

SEQ ID NO: 6057473 - DNA, 13 bp, Homo sapiens
ccactcctcactg

SEQ ID NO: 6057474 - DNA, 16 bp, Homo sapiens
ccactcctccaaagga

SEQ ID NO: 6057475 - DNA, 11 bp, Homo sapiens
ccactcctccc

SEQ ID NO: 6057476 - DNA, 13 bp, Homo sapiens
ccactcctccctc

SEQ ID NO: 6057477 - DNA, 14 bp, Homo sapiens
ccactcctccctcc

SEQ ID NO: 6057478 - DNA, 11 bp, Homo sapiens
ccactcctctc

SEQ ID NO: 6057479 - DNA, 12 bp, Homo sapiens
ccactcctctga

SEQ ID NO: 6057480 - DNA, 13 bp, Homo sapiens
ccactcctctgac

SEQ ID NO: 6057481 - DNA, 11 bp, Homo sapiens
ccactcctctt

SEQ ID NO: 6057482 - DNA, 18 bp, Homo sapiens
ccactcctcttcacccac

SEQ ID NO: 6057483 - DNA, 13 bp, Homo sapiens
ccactcctgccag

SEQ ID NO: 6057484 - DNA, 14 bp, Homo sapiens
ccactcctgccagc

SEQ ID NO: 6057485 - DNA, 16 bp, Homo sapiens
ccactcctgccagccc

SEQ ID NO: 6057486 - DNA, 13 bp, Homo sapiens
ccactcctgctgc

SEQ ID NO: 6057487 - DNA, 16 bp, Homo sapiens
ccactcctgcttctct

SEQ ID NO: 6057488 - DNA, 11 bp, Homo sapiens
ccactcctggg

SEQ ID NO: 6057489 - DNA, 13 bp, Homo sapiens
ccactcctgtccc

SEQ ID NO: 6057490 - DNA, 21 bp, Homo sapiens
ccactcctgtcccgccttcct

SEQ ID NO: 6057491 - DNA, 14 bp, Homo sapiens
ccactcctgtccct

SEQ ID NO: 6057492 - DNA, 19 bp, Homo sapiens
ccactcctgttccttgcta

SEQ ID NO: 6057493 - DNA, 14 bp, Homo sapiens
ccactccttccaga

SEQ ID NO: 6057494 - DNA, 15 bp, Homo sapiens
ccactccttccagaa

SEQ ID NO: 6057495 - DNA, 12 bp, Homo sapiens
ccactccttcct

SEQ ID NO: 6057496 - DNA, 18 bp, Homo sapiens
ccactccttcctgcccca

SEQ ID NO: 6057497 - DNA, 19 bp, Homo sapiens
ccactccttccttcaggac

SEQ ID NO: 6057498 - DNA, 14 bp, Homo sapiens
ccactccttccttt

SEQ ID NO: 6057499 - DNA, 17 bp, Homo sapiens
ccactccttctctcact

SEQ ID NO: 6057500 - DNA, 15 bp, Homo sapiens
ccactcgaggcctgc

SEQ ID NO: 6057501 - DNA, 17 bp, Homo sapiens
ccactcgcagtcgcagg

SEQ ID NO: 6057502 - DNA, 13 bp, Homo sapiens
ccactcgccttct

SEQ ID NO: 6057503 - DNA, 21 bp, Homo sapiens
ccactcgcttcccccatagcc

SEQ ID NO: 6057504 - DNA, 22 bp, Homo sapiens
ccactcggagggtgccctctgc

SEQ ID NO: 6057505 - DNA, 20 bp, Homo sapiens
ccactcgggaggctgagaca

SEQ ID NO: 6057506 - DNA, 17 bp, Homo sapiens
ccactcggggcccccat

SEQ ID NO: 6057507 - DNA, 21 bp, Homo sapiens
ccactcggggcccccatcttg

SEQ ID NO: 6057508 - DNA, 18 bp, Homo sapiens
ccactcgtgcatccctga

SEQ ID NO: 6057509 - DNA, 15 bp, Homo sapiens
ccactctaaagcaaa

SEQ ID NO: 6057510 - DNA, 19 bp, Homo sapiens
ccactctaccagtgcaggc

SEQ ID NO: 6057511 - DNA, 20 bp, Homo sapiens
ccactctaccagtgcaggct

SEQ ID NO: 6057512 - DNA, 16 bp, Homo sapiens
ccactctaccctccca

SEQ ID NO: 6057513 - DNA, 18 bp, Homo sapiens
ccactctaccctcccacc

SEQ ID NO: 6057514 - DNA, 19 bp, Homo sapiens
ccactctaccctcccaccc

SEQ ID NO: 6057515 - DNA, 21 bp, Homo sapiens
ccactctaccctcccaccccc

SEQ ID NO: 6057516 - DNA, 13 bp, Homo sapiens
ccactctacctcc

SEQ ID NO: 6057517 - DNA, 14 bp, Homo sapiens
ccactctacctcct

SEQ ID NO: 6057518 - DNA, 15 bp, Homo sapiens
ccactctactgcccc

SEQ ID NO: 6057519 - DNA, 19 bp, Homo sapiens
ccactctactgccccagct

SEQ ID NO: 6057520 - DNA, 22 bp, Homo sapiens
ccactctaggggtcaggctcca

SEQ ID NO: 6057521 - DNA, 15 bp, Homo sapiens
ccactctagttctag

SEQ ID NO: 6057522 - DNA, 17 bp, Homo sapiens
ccactctagttctagat

SEQ ID NO: 6057523 - DNA, 11 bp, Homo sapiens
ccactctcaga

SEQ ID NO: 6057524 - DNA, 18 bp, Homo sapiens
ccactctcagaggcccca

SEQ ID NO: 6057525 - DNA, 17 bp, Homo sapiens
ccactctcaggaccacc

SEQ ID NO: 6057526 - DNA, 13 bp, Homo sapiens
ccactctcaggag

SEQ ID NO: 6057527 - DNA, 23 bp, Homo sapiens
ccactctcaggaggcgcagcccg

SEQ ID NO: 6057528 - DNA, 19 bp, Homo sapiens
ccactctcattccccaggt

SEQ ID NO: 6057529 - DNA, 15 bp, Homo sapiens
ccactctccccacac

SEQ ID NO: 6057530 - DNA, 13 bp, Homo sapiens
ccactctcccctc

SEQ ID NO: 6057531 - DNA, 15 bp, Homo sapiens
ccactctcccctccc

SEQ ID NO: 6057532 - DNA, 16 bp, Homo sapiens
ccactctcccctccct

SEQ ID NO: 6057533 - DNA, 22 bp, Homo sapiens
ccactctcccctccctcttcct

SEQ ID NO: 6057534 - DNA, 14 bp, Homo sapiens
ccactctcctaggc

SEQ ID NO: 6057535 - DNA, 12 bp, Homo sapiens
ccactctcctcc

SEQ ID NO: 6057536 - DNA, 16 bp, Homo sapiens
ccactctcctgaggag

SEQ ID NO: 6057537 - DNA, 17 bp, Homo sapiens
ccactctcctgaggagc

SEQ ID NO: 6057538 - DNA, 22 bp, Homo sapiens
ccactctcctgaggagcagccc

SEQ ID NO: 6057539 - DNA, 12 bp, Homo sapiens
ccactctccttg

SEQ ID NO: 6057540 - DNA, 21 bp, Homo sapiens
ccactctccttgctacccaga

SEQ ID NO: 6057541 - DNA, 23 bp, Homo sapiens
ccactctccttgctacccagaaa

SEQ ID NO: 6057542 - DNA, 17 bp, Homo sapiens
ccactctctaccagata

SEQ ID NO: 6057543 - DNA, 11 bp, Homo sapiens
ccactctctca

SEQ ID NO: 6057544 - DNA, 22 bp, Homo sapiens
ccccctggatgtcccctgtccc

SEQ ID NO: 6057545 - DNA, 19 bp, Homo sapiens
ccccctggcctctgtgcct

SEQ ID NO: 6057546 - DNA, 10 bp, Homo sapiens
ccccctggct

SEQ ID NO: 6057547 - DNA, 12 bp, Homo sapiens
ccccctggctga

SEQ ID NO: 6057548 - DNA, 20 bp, Homo sapiens
ccccctggggcttctcctga

SEQ ID NO: 6057549 - DNA, 21 bp, Homo sapiens
ccccctggggcttctcctgac

SEQ ID NO: 6057550 - DNA, 22 bp, Homo sapiens
ccccctggggggcacagccaga

SEQ ID NO: 6057551 - DNA, 23 bp, Homo sapiens
ccccctggggggcacagccagaa

SEQ ID NO: 6057552 - DNA, 23 bp, Homo sapiens
ccccctggggtgggatctgagct

SEQ ID NO: 6057553 - DNA, 15 bp, Homo sapiens
ccccctggtcccctc

SEQ ID NO: 6057554 - DNA, 21 bp, Homo sapiens
ccccctgtcccctcagctcca

SEQ ID NO: 6057555 - DNA, 12 bp, Homo sapiens
ccccctgtcctt

SEQ ID NO: 6057556 - DNA, 21 bp, Homo sapiens
ccccctgtccttcccacggcc

SEQ ID NO: 6057557 - DNA, 23 bp, Homo sapiens
ccccctgtctctcagggccaggc

SEQ ID NO: 6057558 - DNA, 12 bp, Homo sapiens
ccccctgtgcag

SEQ ID NO: 6057559 - DNA, 21 bp, Homo sapiens
ccccctgtgcagccgctgagc

SEQ ID NO: 6057560 - DNA, 15 bp, Homo sapiens
ccccctgtgccagct

SEQ ID NO: 6057561 - DNA, 21 bp, Homo sapiens
ccccctgtgccagctcaggtg

SEQ ID NO: 6057562 - DNA, 22 bp, Homo sapiens
ccccctgtgcccacccagggcc

SEQ ID NO: 6057563 - DNA, 13 bp, Homo sapiens
ccccctgtgcctg

SEQ ID NO: 6057564 - DNA, 22 bp, Homo sapiens
ccccctgtgccttgtcacgcca

SEQ ID NO: 6057565 - DNA, 14 bp, Homo sapiens
ccccctgtggcggc

SEQ ID NO: 6057566 - DNA, 13 bp, Homo sapiens
ccccctgtggtct

SEQ ID NO: 6057567 - DNA, 21 bp, Homo sapiens
cccccttaaacttccaaagct

SEQ ID NO: 6057568 - DNA, 15 bp, Homo sapiens
cccccttcagtgccc

SEQ ID NO: 6057569 - DNA, 15 bp, Homo sapiens
cccccttccccagcc

SEQ ID NO: 6057570 - DNA, 13 bp, Homo sapiens
cccccttcctggc

SEQ ID NO: 6057571 - DNA, 14 bp, Homo sapiens
cccccttcctgtcc

SEQ ID NO: 6057572 - DNA, 11 bp, Homo sapiens
cccccttcctt

SEQ ID NO: 6057573 - DNA, 14 bp, Homo sapiens
cccccttcctttgg

SEQ ID NO: 6057574 - DNA, 13 bp, Homo sapiens
cccccttctccca

SEQ ID NO: 6057575 - DNA, 15 bp, Homo sapiens
cccccttctcccaca

SEQ ID NO: 6057576 - DNA, 21 bp, Homo sapiens
cccccttctctgcccattccc

SEQ ID NO: 6057577 - DNA, 15 bp, Homo sapiens
cccccttctctgctc

SEQ ID NO: 6057578 - DNA, 12 bp, Homo sapiens
cccccttctggg

SEQ ID NO: 6057579 - DNA, 20 bp, Homo sapiens
cccccttgaatctgcaggga

SEQ ID NO: 6057580 - DNA, 14 bp, Homo sapiens
cccccttgagtggg

SEQ ID NO: 6057581 - DNA, 15 bp, Homo sapiens
cccccttgccacccc

SEQ ID NO: 6057582 - DNA, 14 bp, Homo sapiens
cccccttgcccagg

SEQ ID NO: 6057583 - DNA, 15 bp, Homo sapiens
cccccttgcccaggc

SEQ ID NO: 6057584 - DNA, 18 bp, Homo sapiens
cccccttgtctgctgctc

SEQ ID NO: 6057585 - DNA, 17 bp, Homo sapiens
ccccctttcacaggcag

SEQ ID NO: 6057586 - DNA, 17 bp, Homo sapiens
ccccctttcagatgtct

SEQ ID NO: 6057587 - DNA, 17 bp, Homo sapiens
ccccctttgggcccagg

SEQ ID NO: 6057588 - DNA, 18 bp, Homo sapiens
ccccctttgggcccaggg

SEQ ID NO: 6057589 - DNA, 19 bp, Homo sapiens
ccccctttgggcccaggga

SEQ ID NO: 6057590 - DNA, 21 bp, Homo sapiens
ccccctttggtttggcctcca

SEQ ID NO: 6057591 - DNA, 14 bp, Homo sapiens
ccccctttgtgctg

SEQ ID NO: 6057592 - DNA, 16 bp, Homo sapiens
ccccctttgtgctgtg

SEQ ID NO: 6057593 - DNA, 21 bp, Homo sapiens
ccccgaaatcagcccccagcc

SEQ ID NO: 6057594 - DNA, 12 bp, Homo sapiens
ccccgacacacg

SEQ ID NO: 6057595 - DNA, 14 bp, Homo sapiens
ccccgacactgctg

SEQ ID NO: 6057596 - DNA, 15 bp, Homo sapiens
ccccgacagtggctc

SEQ ID NO: 6057597 - DNA, 18 bp, Homo sapiens
ccccgacccccgcagagg

SEQ ID NO: 6057598 - DNA, 14 bp, Homo sapiens
ccccgacccgggtc

SEQ ID NO: 6057599 - DNA, 16 bp, Homo sapiens
ccccgaccctgccctg

SEQ ID NO: 6057600 - DNA, 18 bp, Homo sapiens
ccccgacgccacagccca

SEQ ID NO: 6057601 - DNA, 21 bp, Homo sapiens
ccccgacgccacagcccagcc

SEQ ID NO: 6057602 - DNA, 14 bp, Homo sapiens
ccccgacggcctcc

SEQ ID NO: 6057603 - DNA, 20 bp, Homo sapiens
ccccgacggcctccaggagg

SEQ ID NO: 6057604 - DNA, 12 bp, Homo sapiens
ccccgacggctg

SEQ ID NO: 6057605 - DNA, 18 bp, Homo sapiens
ccccgactccagccagcg

SEQ ID NO: 6057606 - DNA, 16 bp, Homo sapiens
ccccgactgtgctgct

SEQ ID NO: 6057607 - DNA, 17 bp, Homo sapiens
ccccgagaaccctgagc

SEQ ID NO: 6057608 - DNA, 18 bp, Homo sapiens
ccccgagacaccatcctg

SEQ ID NO: 6057609 - DNA, 19 bp, Homo sapiens
ccccgagacaccatcctga

SEQ ID NO: 6057610 - DNA, 22 bp, Homo sapiens
ccccgagacaccatcctgagcc

SEQ ID NO: 6057611 - DNA, 23 bp, Homo sapiens
ccccgagacaccatcctgagcca

SEQ ID NO: 6057612 - DNA, 14 bp, Homo sapiens
ccccgagccctact

SEQ ID NO: 6057613 - DNA, 21 bp, Homo sapiens
ccccgagccctgactcctgga

SEQ ID NO: 6057614 - DNA, 19 bp, Homo sapiens
ccccgagccgagctctcct

SEQ ID NO: 6057615 - DNA, 22 bp, Homo sapiens
ccccgagccgagctctcctggg

SEQ ID NO: 6057616 - DNA, 12 bp, Homo sapiens
ccccgagctggg

SEQ ID NO: 6057617 - DNA, 13 bp, Homo sapiens
ccccgagctgggg

SEQ ID NO: 6057618 - DNA, 15 bp, Homo sapiens
ccccgagctgggggg

SEQ ID NO: 6057619 - DNA, 23 bp, Homo sapiens
ccccgagctggggggttggcagc

SEQ ID NO: 6057620 - DNA, 15 bp, Homo sapiens
ccccgagcttgcctc

SEQ ID NO: 6057621 - DNA, 16 bp, Homo sapiens
ccccgaggccctgcat

SEQ ID NO: 6057622 - DNA, 15 bp, Homo sapiens
ccccgaggctgcccc

SEQ ID NO: 6057623 - DNA, 13 bp, Homo sapiens
ccccgagggctga

SEQ ID NO: 6057624 - DNA, 14 bp, Homo sapiens
ccccgagggctgag

SEQ ID NO: 6057625 - DNA, 18 bp, Homo sapiens
ccccgagggctgaggagc

SEQ ID NO: 6057626 - DNA, 19 bp, Homo sapiens
ccccgaggttgtggggagg

SEQ ID NO: 6057627 - DNA, 12 bp, Homo sapiens
ccccgagtcctc

SEQ ID NO: 6057628 - DNA, 21 bp, Homo sapiens
ccccgagtttccccagacacc

SEQ ID NO: 6057629 - DNA, 17 bp, Homo sapiens
ccccgatggactcctga

SEQ ID NO: 6057630 - DNA, 14 bp, Homo sapiens
ccccgatgtcccct

SEQ ID NO: 6057631 - DNA, 17 bp, Homo sapiens
ccccgatgtcccctgcg

SEQ ID NO: 6057632 - DNA, 19 bp, Homo sapiens
ccccgatgtcccctgcggg

SEQ ID NO: 6057633 - DNA, 24 bp, Homo sapiens
ccccgatgtgagccgcctcggagt

SEQ ID NO: 6057634 - DNA, 16 bp, Homo sapiens
ccccgcaacccacagc

SEQ ID NO: 6057635 - DNA, 23 bp, Homo sapiens
ccccgcaacccacagctcagctg

SEQ ID NO: 6057636 - DNA, 14 bp, Homo sapiens
ccccgcacccccgc

SEQ ID NO: 6057637 - DNA, 19 bp, Homo sapiens
ccccgcacccccgccaggc

SEQ ID NO: 6057638 - DNA, 12 bp, Homo sapiens
ccccgcacccct

SEQ ID NO: 6057639 - DNA, 17 bp, Homo sapiens
ccccgcacccctcctcc

SEQ ID NO: 6057640 - DNA, 20 bp, Homo sapiens
ccccgcacccctcctccttg

SEQ ID NO: 6057641 - DNA, 15 bp, Homo sapiens
ccccgcacccggctc

SEQ ID NO: 6057642 - DNA, 20 bp, Homo sapiens
ccccgcacgggctgtctggg

SEQ ID NO: 6057643 - DNA, 14 bp, Homo sapiens
ccccgcactgcaga

SEQ ID NO: 6057644 - DNA, 12 bp, Homo sapiens
ccccgcagacct

SEQ ID NO: 6057645 - DNA, 15 bp, Homo sapiens
ccccgcagagctccc

SEQ ID NO: 6057646 - DNA, 16 bp, Homo sapiens
ccccgcagcacgcctc

SEQ ID NO: 6057647 - DNA, 19 bp, Homo sapiens
ccccgcagcacgcctctcc

SEQ ID NO: 6057648 - DNA, 13 bp, Homo sapiens
ccccgcagcccgc

SEQ ID NO: 6057649 - DNA, 13 bp, Homo sapiens
ccccgcagccctc

SEQ ID NO: 6057650 - DNA, 14 bp, Homo sapiens
ccccgcagccctct

SEQ ID NO: 6057651 - DNA, 23 bp, Homo sapiens
ccccgcagccctctccacccaga

SEQ ID NO: 6057652 - DNA, 20 bp, Homo sapiens
ccccgcaggatccctcctga

SEQ ID NO: 6057653 - DNA, 22 bp, Homo sapiens
ccccgcaggatccctcctgagc

SEQ ID NO: 6057654 - DNA, 16 bp, Homo sapiens
ccccgcagtgccctgc

SEQ ID NO: 6057655 - DNA, 16 bp, Homo sapiens
ccccgcatcccctgcc

SEQ ID NO: 6057656 - DNA, 17 bp, Homo sapiens
ccccgcatcccctgcct

SEQ ID NO: 6057657 - DNA, 14 bp, Homo sapiens
ccccgccacggcca

SEQ ID NO: 6057658 - DNA, 14 bp, Homo sapiens
ccccgccagcctac

SEQ ID NO: 6057659 - DNA, 23 bp, Homo sapiens
ccccgccagcctacactgccagc

SEQ ID NO: 6057660 - DNA, 14 bp, Homo sapiens
ccccgccagggctg

SEQ ID NO: 6057661 - DNA, 16 bp, Homo sapiens
ccccgccagggctggg

SEQ ID NO: 6057662 - DNA, 15 bp, Homo sapiens
ccccgcccacaccct

SEQ ID NO: 6057663 - DNA, 13 bp, Homo sapiens
ccccgcccagccc

SEQ ID NO: 6057664 - DNA, 12 bp, Homo sapiens
ccccgcccaggc

SEQ ID NO: 6057665 - DNA, 15 bp, Homo sapiens
ccccgcccaggctgg

SEQ ID NO: 6057666 - DNA, 16 bp, Homo sapiens
ccccgcccaggctggc

SEQ ID NO: 6057667 - DNA, 15 bp, Homo sapiens
ccccgccccacaggg

SEQ ID NO: 6057668 - DNA, 17 bp, Homo sapiens
ccccgccccacattccg

SEQ ID NO: 6057669 - DNA, 13 bp, Homo sapiens
ccccgccccagcc

SEQ ID NO: 6057670 - DNA, 21 bp, Homo sapiens
ccccgccccagccctcagtca

SEQ ID NO: 6057671 - DNA, 18 bp, Homo sapiens
ccccgccccatcctcctg

SEQ ID NO: 6057672 - DNA, 12 bp, Homo sapiens
ccccgcccccac

SEQ ID NO: 6057673 - DNA, 16 bp, Homo sapiens
ccccgcccccacccct

SEQ ID NO: 6057674 - DNA, 21 bp, Homo sapiens
ccccgcccccacccctacagc

SEQ ID NO: 6057675 - DNA, 18 bp, Homo sapiens
ccccgccccccagagcca

SEQ ID NO: 6057676 - DNA, 20 bp, Homo sapiens
ccccgccccccagagccagg

SEQ ID NO: 6057677 - DNA, 23 bp, Homo sapiens
ccccgccccctccctgctcccag

SEQ ID NO: 6057678 - DNA, 15 bp, Homo sapiens
ccccgccccctgaaa

SEQ ID NO: 6057679 - DNA, 21 bp, Homo sapiens
ccccgccccctgccctcccct

SEQ ID NO: 6057680 - DNA, 15 bp, Homo sapiens
ccccgccccgcgcgc

SEQ ID NO: 6057681 - DNA, 17 bp, Homo sapiens
ccccgcccctgcatgcc

SEQ ID NO: 6057682 - DNA, 17 bp, Homo sapiens
ccccgcccctgggctac

SEQ ID NO: 6057683 - DNA, 17 bp, Homo sapiens
ccccgcccgagcccctg

SEQ ID NO: 6057684 - DNA, 15 bp, Homo sapiens
ccccgccctcgctcc

SEQ ID NO: 6057685 - DNA, 15 bp, Homo sapiens
ccccgccctctctca

SEQ ID NO: 6057686 - DNA, 17 bp, Homo sapiens
ccccgccctcttcctga

SEQ ID NO: 6057687 - DNA, 12 bp, Homo sapiens
ccccgccgcgcc

SEQ ID NO: 6057688 - DNA, 23 bp, Homo sapiens
ccccgccgtgtctgtggccctct

SEQ ID NO: 6057689 - DNA, 15 bp, Homo sapiens
ccccgcctccactct

SEQ ID NO: 6057690 - DNA, 19 bp, Homo sapiens
ccccgcctcctcccactgg

SEQ ID NO: 6057691 - DNA, 16 bp, Homo sapiens
ccccgcctcctccctg

SEQ ID NO: 6057692 - DNA, 21 bp, Homo sapiens
ccccgcctgcagtcttctggg

SEQ ID NO: 6057693 - DNA, 14 bp, Homo sapiens
ccccgcctgccacc

SEQ ID NO: 6057694 - DNA, 13 bp, Homo sapiens
ccccgcctgcctc

SEQ ID NO: 6057695 - DNA, 16 bp, Homo sapiens
ccccgcctggccagga

SEQ ID NO: 6057696 - DNA, 17 bp, Homo sapiens
ccccgcctggccaggag

SEQ ID NO: 6057697 - DNA, 13 bp, Homo sapiens
ccccgcctgggca

SEQ ID NO: 6057698 - DNA, 22 bp, Homo sapiens
ccccgcctgtcctgcctctctg

SEQ ID NO: 6057699 - DNA, 21 bp, Homo sapiens
ccccgccttccgccccttccc

SEQ ID NO: 6057700 - DNA, 20 bp, Homo sapiens
ccccgccttcgtgtgctgct

SEQ ID NO: 6057701 - DNA, 22 bp, Homo sapiens
ccccgccttcgtgtgctgctgc

SEQ ID NO: 6057702 - DNA, 19 bp, Homo sapiens
ccccgcgcgtgcccccagc

SEQ ID NO: 6057703 - DNA, 16 bp, Homo sapiens
ccccgcggagcccccg

SEQ ID NO: 6057704 - DNA, 19 bp, Homo sapiens
ccccgcggagcccccgccc

SEQ ID NO: 6057705 - DNA, 19 bp, Homo sapiens
ccccgcggatcaaccaggc

SEQ ID NO: 6057706 - DNA, 21 bp, Homo sapiens
ccccgcggatcaaccaggcag

SEQ ID NO: 6057707 - DNA, 20 bp, Homo sapiens
ccccgcgggctttgttgctg

SEQ ID NO: 6057708 - DNA, 17 bp, Homo sapiens
ccccgcgggttctagac

SEQ ID NO: 6057709 - DNA, 17 bp, Homo sapiens
ccccgcggtgctctggc

SEQ ID NO: 6057710 - DNA, 21 bp, Homo sapiens
ccccgcgtggaactcgtgtct

SEQ ID NO: 6057711 - DNA, 16 bp, Homo sapiens
ccccgctcatgggccc

SEQ ID NO: 6057712 - DNA, 13 bp, Homo sapiens
ccccgctcccacc

SEQ ID NO: 6057713 - DNA, 16 bp, Homo sapiens
ccccgctccgtctctg

SEQ ID NO: 6057714 - DNA, 21 bp, Homo sapiens
ccccgctccgtctctgtcctc

SEQ ID NO: 6057715 - DNA, 13 bp, Homo sapiens
ccccgctctgcat

SEQ ID NO: 6057716 - DNA, 21 bp, Homo sapiens
ccccgctctgcatgcggccca

SEQ ID NO: 6057717 - DNA, 12 bp, Homo sapiens
ccccgctctgcc

SEQ ID NO: 6057718 - DNA, 17 bp, Homo sapiens
ccccgctgatggagccc

SEQ ID NO: 6057719 - DNA, 12 bp, Homo sapiens
ccccgctgcctg

SEQ ID NO: 6057720 - DNA, 23 bp, Homo sapiens
ccccgctggaggatgtgggcagc

SEQ ID NO: 6057721 - DNA, 15 bp, Homo sapiens
ccccgctgggggtgg

SEQ ID NO: 6057722 - DNA, 22 bp, Homo sapiens
ccccgctgtaagctcctttgtg

SEQ ID NO: 6057723 - DNA, 16 bp, Homo sapiens
ccccgcttccccacag

SEQ ID NO: 6057724 - DNA, 15 bp, Homo sapiens
ccactctctgcccac

SEQ ID NO: 6057725 - DNA, 22 bp, Homo sapiens
ccactctctgggactctcctcc

SEQ ID NO: 6057726 - DNA, 15 bp, Homo sapiens
ccactctcttccctt

SEQ ID NO: 6057727 - DNA, 21 bp, Homo sapiens
ccactctgaataccaagtgtg

SEQ ID NO: 6057728 - DNA, 17 bp, Homo sapiens
ccactctgagtgaatac

SEQ ID NO: 6057729 - DNA, 15 bp, Homo sapiens
ccactctgatagaat

SEQ ID NO: 6057730 - DNA, 13 bp, Homo sapiens
ccactctgcggcc

SEQ ID NO: 6057731 - DNA, 13 bp, Homo sapiens
ccactctgctccc

SEQ ID NO: 6057732 - DNA, 15 bp, Homo sapiens
ccactctgctcccag

SEQ ID NO: 6057733 - DNA, 19 bp, Homo sapiens
ccactctgctcccagcccc

SEQ ID NO: 6057734 - DNA, 13 bp, Homo sapiens
ccactctgctctg

SEQ ID NO: 6057735 - DNA, 14 bp, Homo sapiens
ccactctgctctga

SEQ ID NO: 6057736 - DNA, 13 bp, Homo sapiens
ccactctgctgag

SEQ ID NO: 6057737 - DNA, 22 bp, Homo sapiens
ccactctgctgaggccagagga

SEQ ID NO: 6057738 - DNA, 23 bp, Homo sapiens
ccactctgctgaggccagaggaa

SEQ ID NO: 6057739 - DNA, 16 bp, Homo sapiens
ccactctgctgcctgt

SEQ ID NO: 6057740 - DNA, 11 bp, Homo sapiens
ccactctggaa

SEQ ID NO: 6057741 - DNA, 18 bp, Homo sapiens
ccactctggattcagcct

SEQ ID NO: 6057742 - DNA, 19 bp, Homo sapiens
ccactctggattcagcctt

SEQ ID NO: 6057743 - DNA, 14 bp, Homo sapiens
ccactctggcagcc

SEQ ID NO: 6057744 - DNA, 18 bp, Homo sapiens
ccactctggcagccacac

SEQ ID NO: 6057745 - DNA, 22 bp, Homo sapiens
ccactctgggcaaagcccctca

SEQ ID NO: 6057746 - DNA, 13 bp, Homo sapiens
ccactctgggcag

SEQ ID NO: 6057747 - DNA, 12 bp, Homo sapiens
ccactctgggga

SEQ ID NO: 6057748 - DNA, 13 bp, Homo sapiens
ccactctggtggc

SEQ ID NO: 6057749 - DNA, 20 bp, Homo sapiens
ccactctggtggccacttca

SEQ ID NO: 6057750 - DNA, 22 bp, Homo sapiens
ccactctggtggccacttcatt

SEQ ID NO: 6057751 - DNA, 15 bp, Homo sapiens
ccactctgtggccag

SEQ ID NO: 6057752 - DNA, 21 bp, Homo sapiens
ccactctgtggccagcctggc

SEQ ID NO: 6057753 - DNA, 22 bp, Homo sapiens
ccactcttatcttacaactccc

SEQ ID NO: 6057754 - DNA, 14 bp, Homo sapiens
ccactcttctctcc

SEQ ID NO: 6057755 - DNA, 22 bp, Homo sapiens
ccactcttctctccaaggaaat

SEQ ID NO: 6057756 - DNA, 15 bp, Homo sapiens
ccactcttctctcct

SEQ ID NO: 6057757 - DNA, 23 bp, Homo sapiens
ccactcttctctcctttctccct

SEQ ID NO: 6057758 - DNA, 23 bp, Homo sapiens
ccactcttgaagaggaggccgcc

SEQ ID NO: 6057759 - DNA, 17 bp, Homo sapiens
ccactcttgatctctct

SEQ ID NO: 6057760 - DNA, 18 bp, Homo sapiens
ccactcttgatctctctt

SEQ ID NO: 6057761 - DNA, 23 bp, Homo sapiens
ccactctttgctacaataaatgc

SEQ ID NO: 6057762 - DNA, 17 bp, Homo sapiens
ccactcttttgctgtgc

SEQ ID NO: 6057763 - DNA, 17 bp, Homo sapiens
ccactgaaaagctttcc

SEQ ID NO: 6057764 - DNA, 12 bp, Homo sapiens
ccactgaaaatt

SEQ ID NO: 6057765 - DNA, 17 bp, Homo sapiens
ccactgaacaaaaccta

SEQ ID NO: 6057766 - DNA, 12 bp, Homo sapiens
ccactgaagagg

SEQ ID NO: 6057767 - DNA, 16 bp, Homo sapiens
ccactgaagctgggat

SEQ ID NO: 6057768 - DNA, 23 bp, Homo sapiens
ccactgaagtccccctttctcct

SEQ ID NO: 6057769 - DNA, 17 bp, Homo sapiens
ccactgaattcactcca

SEQ ID NO: 6057770 - DNA, 24 bp, Homo sapiens
ccactgaattcactccagtcaaca

SEQ ID NO: 6057771 - DNA, 20 bp, Homo sapiens
ccactgaattgacatgaccc

SEQ ID NO: 6057772 - DNA, 21 bp, Homo sapiens
ccactgaattgacatgaccct

SEQ ID NO: 6057773 - DNA, 19 bp, Homo sapiens
ccactgacacccagtgtcc

SEQ ID NO: 6057774 - DNA, 21 bp, Homo sapiens
ccactgacacccagtgtcctt

SEQ ID NO: 6057775 - DNA, 13 bp, Homo sapiens
ccactgacagcta

SEQ ID NO: 6057776 - DNA, 15 bp, Homo sapiens
ccactgacccacctg

SEQ ID NO: 6057777 - DNA, 18 bp, Homo sapiens
ccactgacccacctgcgc

SEQ ID NO: 6057778 - DNA, 17 bp, Homo sapiens
ccactgacctcaccggc

SEQ ID NO: 6057779 - DNA, 18 bp, Homo sapiens
ccactgacctgcccatgt

SEQ ID NO: 6057780 - DNA, 20 bp, Homo sapiens
ccactgacctggttgtccag

SEQ ID NO: 6057781 - DNA, 22 bp, Homo sapiens
ccactgacctggttgtccaggt

SEQ ID NO: 6057782 - DNA, 15 bp, Homo sapiens
ccactgagagctgct

SEQ ID NO: 6057783 - DNA, 16 bp, Homo sapiens
ccactgagcaagcaag

SEQ ID NO: 6057784 - DNA, 15 bp, Homo sapiens
ccactgagcccttgc

SEQ ID NO: 6057785 - DNA, 18 bp, Homo sapiens
ccactgagcccttgcaca

SEQ ID NO: 6057786 - DNA, 22 bp, Homo sapiens
ccactgagcccttgcacaggcc

SEQ ID NO: 6057787 - DNA, 12 bp, Homo sapiens
ccactgagctcc

SEQ ID NO: 6057788 - DNA, 16 bp, Homo sapiens
ccactgagctctgcct

SEQ ID NO: 6057789 - DNA, 18 bp, Homo sapiens
ccactgagctctgcctca

SEQ ID NO: 6057790 - DNA, 14 bp, Homo sapiens
ccactgagctggct

SEQ ID NO: 6057791 - DNA, 21 bp, Homo sapiens
ccactgaggagacagaaagcc

SEQ ID NO: 6057792 - DNA, 19 bp, Homo sapiens
ccactgaggggccagggag

SEQ ID NO: 6057793 - DNA, 19 bp, Homo sapiens
ccactgagtaccaggggct

SEQ ID NO: 6057794 - DNA, 23 bp, Homo sapiens
ccactgatatcacgggcccgctc

SEQ ID NO: 6057795 - DNA, 12 bp, Homo sapiens
ccactgcaaaca

SEQ ID NO: 6057796 - DNA, 20 bp, Homo sapiens
ccactgcaaaccctgctgcc

SEQ ID NO: 6057797 - DNA, 19 bp, Homo sapiens
ccactgcaaataaagcctt

SEQ ID NO: 6057798 - DNA, 23 bp, Homo sapiens
ccactgcaacccatgagcgtcca

SEQ ID NO: 6057799 - DNA, 18 bp, Homo sapiens
ccactgcaacttgtgaac

SEQ ID NO: 6057800 - DNA, 18 bp, Homo sapiens
ccactgcaagtccttttg

SEQ ID NO: 6057801 - DNA, 22 bp, Homo sapiens
ccactgcaagtccttttgtaaa

SEQ ID NO: 6057802 - DNA, 18 bp, Homo sapiens
ccactgcacacacctcag

SEQ ID NO: 6057803 - DNA, 23 bp, Homo sapiens
ccactgcacagagctctccagct

SEQ ID NO: 6057804 - DNA, 11 bp, Homo sapiens
ccactgcaccc

SEQ ID NO: 6057805 - DNA, 16 bp, Homo sapiens
ccactgcacccaccca

SEQ ID NO: 6057806 - DNA, 14 bp, Homo sapiens
ccactgcaccccct

SEQ ID NO: 6057807 - DNA, 17 bp, Homo sapiens
ccactgcaccccctcct

SEQ ID NO: 6057808 - DNA, 23 bp, Homo sapiens
ccactgcaccccctcctgctgca

SEQ ID NO: 6057809 - DNA, 19 bp, Homo sapiens
ccactgcactatagcctag

SEQ ID NO: 6057810 - DNA, 11 bp, Homo sapiens
ccactgcactc

SEQ ID NO: 6057811 - DNA, 15 bp, Homo sapiens
ccactgcactccagc

SEQ ID NO: 6057812 - DNA, 19 bp, Homo sapiens
ccactgcactccagcctga

SEQ ID NO: 6057813 - DNA, 20 bp, Homo sapiens
ccactgcactccagcctggg

SEQ ID NO: 6057814 - DNA, 19 bp, Homo sapiens
ccactgcactctagccgga

SEQ ID NO: 6057815 - DNA, 20 bp, Homo sapiens
ccactgcactctagccggag

SEQ ID NO: 6057816 - DNA, 21 bp, Homo sapiens
ccactgcacttggtgctgctt

SEQ ID NO: 6057817 - DNA, 14 bp, Homo sapiens
ccactgcagagatg

SEQ ID NO: 6057818 - DNA, 17 bp, Homo sapiens
ccactgcagagatggtg

SEQ ID NO: 6057819 - DNA, 14 bp, Homo sapiens
ccactgcaggcccc

SEQ ID NO: 6057820 - DNA, 20 bp, Homo sapiens
ccactgcagtcacccctgtc

SEQ ID NO: 6057821 - DNA, 22 bp, Homo sapiens
ccactgcagtcacccctgtctg

SEQ ID NO: 6057822 - DNA, 22 bp, Homo sapiens
ccactgccaagcttcctgtgcc

SEQ ID NO: 6057823 - DNA, 22 bp, Homo sapiens
ccactgccagatgctgcaagcg

SEQ ID NO: 6057824 - DNA, 13 bp, Homo sapiens
ccactgccagcag

SEQ ID NO: 6057825 - DNA, 12 bp, Homo sapiens
ccactgccaggc

SEQ ID NO: 6057826 - DNA, 15 bp, Homo sapiens
ccactgccaggcacc

SEQ ID NO: 6057827 - DNA, 19 bp, Homo sapiens
ccactgccaggcacctggc

SEQ ID NO: 6057828 - DNA, 20 bp, Homo sapiens
ccactgccaggcacctggcc

SEQ ID NO: 6057829 - DNA, 24 bp, Homo sapiens
ccactgccaggcacctggcctgct

SEQ ID NO: 6057830 - DNA, 20 bp, Homo sapiens
ccactgccattacccagtgc

SEQ ID NO: 6057831 - DNA, 15 bp, Homo sapiens
ccactgcccaccccc

SEQ ID NO: 6057832 - DNA, 17 bp, Homo sapiens
ccactgcccactggccg

SEQ ID NO: 6057833 - DNA, 21 bp, Homo sapiens
ccactgccccgtgtgaatgta

SEQ ID NO: 6057834 - DNA, 22 bp, Homo sapiens
ccactgccccgtgtgaatgtag

SEQ ID NO: 6057835 - DNA, 18 bp, Homo sapiens
ccactgcccgagctggtg

SEQ ID NO: 6057836 - DNA, 20 bp, Homo sapiens
ccactgcccgagctggtgca

SEQ ID NO: 6057837 - DNA, 13 bp, Homo sapiens
ccactgccctcca

SEQ ID NO: 6057838 - DNA, 15 bp, Homo sapiens
ccactgccctccagg

SEQ ID NO: 6057839 - DNA, 18 bp, Homo sapiens
ccactgccctccagggcc

SEQ ID NO: 6057840 - DNA, 20 bp, Homo sapiens
ccactgccctccagggccag

SEQ ID NO: 6057841 - DNA, 22 bp, Homo sapiens
ccactgccctccagggccagga

SEQ ID NO: 6057842 - DNA, 12 bp, Homo sapiens
ccactgccctct

SEQ ID NO: 6057843 - DNA, 17 bp, Homo sapiens
ccactgccctctccaca

SEQ ID NO: 6057844 - DNA, 23 bp, Homo sapiens
ccactgccctctccacacccatg

SEQ ID NO: 6057845 - DNA, 13 bp, Homo sapiens
ccactgccctctg

SEQ ID NO: 6057846 - DNA, 14 bp, Homo sapiens
ccactgccctctgt

SEQ ID NO: 6057847 - DNA, 12 bp, Homo sapiens
ccactgccctgc

SEQ ID NO: 6057848 - DNA, 18 bp, Homo sapiens
ccactgccctgcctgccc

SEQ ID NO: 6057849 - DNA, 21 bp, Homo sapiens
ccactgccctgcctgcccact

SEQ ID NO: 6057850 - DNA, 18 bp, Homo sapiens
ccactgccctggcagcag

SEQ ID NO: 6057851 - DNA, 14 bp, Homo sapiens
ccactgcctcaggt

SEQ ID NO: 6057852 - DNA, 18 bp, Homo sapiens
ccactgcctcctgcctgg

SEQ ID NO: 6057853 - DNA, 13 bp, Homo sapiens
ccactgcctctgc

SEQ ID NO: 6057854 - DNA, 15 bp, Homo sapiens
ccactgcctctgcct

SEQ ID NO: 6057855 - DNA, 12 bp, Homo sapiens
ccactgcctgca

SEQ ID NO: 6057856 - DNA, 13 bp, Homo sapiens
ccactgcctgcac

SEQ ID NO: 6057857 - DNA, 15 bp, Homo sapiens
ccactgcctgcacct

SEQ ID NO: 6057858 - DNA, 16 bp, Homo sapiens
ccactgcctgcccacc

SEQ ID NO: 6057859 - DNA, 23 bp, Homo sapiens
ccactgcctgcccacccgtggag

SEQ ID NO: 6057860 - DNA, 21 bp, Homo sapiens
ccactgccttcgatacaccgg

SEQ ID NO: 6057861 - DNA, 15 bp, Homo sapiens
ccactgccttcgctt

SEQ ID NO: 6057862 - DNA, 17 bp, Homo sapiens
ccactgcctttcagaag

SEQ ID NO: 6057863 - DNA, 14 bp, Homo sapiens
ccactgcctttgac

SEQ ID NO: 6057864 - DNA, 19 bp, Homo sapiens
ccactgcgccactgccatc

SEQ ID NO: 6057865 - DNA, 19 bp, Homo sapiens
ccactgcgcccggcccaag

SEQ ID NO: 6057866 - DNA, 19 bp, Homo sapiens
ccactgcgcttactcctct

SEQ ID NO: 6057867 - DNA, 23 bp, Homo sapiens
ccactgcggggagacagaagcct

SEQ ID NO: 6057868 - DNA, 22 bp, Homo sapiens
ccactgctaaggctgctggctt

SEQ ID NO: 6057869 - DNA, 23 bp, Homo sapiens
ccactgctaaggctgctggcttc

SEQ ID NO: 6057870 - DNA, 17 bp, Homo sapiens
ccactgctaataaatga

SEQ ID NO: 6057871 - DNA, 20 bp, Homo sapiens
ccactgctaataaatgacca

SEQ ID NO: 6057872 - DNA, 17 bp, Homo sapiens
ccactgctatgccattt

SEQ ID NO: 6057873 - DNA, 16 bp, Homo sapiens
ccactgctccgtggag

SEQ ID NO: 6057874 - DNA, 17 bp, Homo sapiens
ccactgctcgaaatggc

SEQ ID NO: 6057875 - DNA, 23 bp, Homo sapiens
ccactgctcgaaatggcccctgt

SEQ ID NO: 6057876 - DNA, 19 bp, Homo sapiens
ccactgctctcagcctccc

SEQ ID NO: 6057877 - DNA, 12 bp, Homo sapiens
ccactgctctgg

SEQ ID NO: 6057878 - DNA, 15 bp, Homo sapiens
ccactgctctggtta

SEQ ID NO: 6057879 - DNA, 18 bp, Homo sapiens
ccactgctgaaaaagaaa

SEQ ID NO: 6057880 - DNA, 18 bp, Homo sapiens
ccactgctgaggagtctg

SEQ ID NO: 6057881 - DNA, 23 bp, Homo sapiens
ccactgctgaggagtctgaggac

SEQ ID NO: 6057882 - DNA, 16 bp, Homo sapiens
ccactgctgcttctcc

SEQ ID NO: 6057883 - DNA, 19 bp, Homo sapiens
ccactgctgcttctccatg

SEQ ID NO: 6057884 - DNA, 11 bp, Homo sapiens
ccactgctgga

SEQ ID NO: 6057885 - DNA, 18 bp, Homo sapiens
ccactgctggtgccaggg

SEQ ID NO: 6057886 - DNA, 19 bp, Homo sapiens
ccactgctggtgccagggt

SEQ ID NO: 6057887 - DNA, 21 bp, Homo sapiens
ccactgctggtgccagggtgg

SEQ ID NO: 6057888 - DNA, 19 bp, Homo sapiens
ccactgctggtgtttatgt

SEQ ID NO: 6057889 - DNA, 13 bp, Homo sapiens
ccactgcttccca

SEQ ID NO: 6057890 - DNA, 17 bp, Homo sapiens
ccactgcttcccactgg

SEQ ID NO: 6057891 - DNA, 20 bp, Homo sapiens
ccactgcttcccactggggc

SEQ ID NO: 6057892 - DNA, 14 bp, Homo sapiens
ccactgcttttccc

SEQ ID NO: 6057893 - DNA, 20 bp, Homo sapiens
ccactgcttttggtctgtgt

SEQ ID NO: 6057894 - DNA, 24 bp, Homo sapiens
ccactggaaggaacatggagctgt

SEQ ID NO: 6057895 - DNA, 15 bp, Homo sapiens
ccactggacaacact

SEQ ID NO: 6057896 - DNA, 17 bp, Homo sapiens
ccactggacaacactga

SEQ ID NO: 6057897 - DNA, 23 bp, Homo sapiens
ccactggacaacactgattcctg

SEQ ID NO: 6057898 - DNA, 11 bp, Homo sapiens
ccactggacag

SEQ ID NO: 6057899 - DNA, 15 bp, Homo sapiens
ccactggacagaccc

SEQ ID NO: 6057900 - DNA, 19 bp, Homo sapiens
ccactggacagacccaggt

SEQ ID NO: 6057901 - DNA, 22 bp, Homo sapiens
ccactggacttgagcttggcag

SEQ ID NO: 6057902 - DNA, 14 bp, Homo sapiens
ccccgcttctgcct

SEQ ID NO: 6057903 - DNA, 15 bp, Homo sapiens
ccccgcttgtccagc

SEQ ID NO: 6057904 - DNA, 19 bp, Homo sapiens
ccccgcttgtccagcgcct

SEQ ID NO: 6057905 - DNA, 16 bp, Homo sapiens
ccccggacaagcccag

SEQ ID NO: 6057906 - DNA, 17 bp, Homo sapiens
ccccggacatactctct

SEQ ID NO: 6057907 - DNA, 14 bp, Homo sapiens
ccccggacctacct

SEQ ID NO: 6057908 - DNA, 15 bp, Homo sapiens
ccccggacctacctc

SEQ ID NO: 6057909 - DNA, 16 bp, Homo sapiens
ccccggacgctggctc

SEQ ID NO: 6057910 - DNA, 17 bp, Homo sapiens
ccccggacgctggctcg

SEQ ID NO: 6057911 - DNA, 12 bp, Homo sapiens
ccccggagctgg

SEQ ID NO: 6057912 - DNA, 16 bp, Homo sapiens
ccccggagctgggaag

SEQ ID NO: 6057913 - DNA, 13 bp, Homo sapiens
ccccggaggaagc

SEQ ID NO: 6057914 - DNA, 16 bp, Homo sapiens
ccccggaggaagcttg

SEQ ID NO: 6057915 - DNA, 22 bp, Homo sapiens
ccccggaggcgtggaggagagg

SEQ ID NO: 6057916 - DNA, 14 bp, Homo sapiens
ccccggagttcagt

SEQ ID NO: 6057917 - DNA, 14 bp, Homo sapiens
ccccggcagacgcc

SEQ ID NO: 6057918 - DNA, 14 bp, Homo sapiens
ccccggcaggccct

SEQ ID NO: 6057919 - DNA, 17 bp, Homo sapiens
ccccggcaggccctgca

SEQ ID NO: 6057920 - DNA, 18 bp, Homo sapiens
ccccggcaggccctgcag

SEQ ID NO: 6057921 - DNA, 13 bp, Homo sapiens
ccccggcaggcct

SEQ ID NO: 6057922 - DNA, 23 bp, Homo sapiens
ccccggcatgagactcagtgcag

SEQ ID NO: 6057923 - DNA, 12 bp, Homo sapiens
ccccggccactc

SEQ ID NO: 6057924 - DNA, 15 bp, Homo sapiens
ccccggccactctgt

SEQ ID NO: 6057925 - DNA, 15 bp, Homo sapiens
ccccggcccccctct

SEQ ID NO: 6057926 - DNA, 13 bp, Homo sapiens
ccccggccccctg

SEQ ID NO: 6057927 - DNA, 16 bp, Homo sapiens
ccccggcccctgcccc

SEQ ID NO: 6057928 - DNA, 18 bp, Homo sapiens
ccccggcccctgccccgc

SEQ ID NO: 6057929 - DNA, 12 bp, Homo sapiens
ccccggccctgg

SEQ ID NO: 6057930 - DNA, 14 bp, Homo sapiens
ccccggcctcaggg

SEQ ID NO: 6057931 - DNA, 21 bp, Homo sapiens
ccccggcctcagggcgctcag

SEQ ID NO: 6057932 - DNA, 22 bp, Homo sapiens
ccccggcctccaggctggggcc

SEQ ID NO: 6057933 - DNA, 21 bp, Homo sapiens
ccccggcctgatggccaggcc

SEQ ID NO: 6057934 - DNA, 19 bp, Homo sapiens
ccccggcggggtgcctgct

SEQ ID NO: 6057935 - DNA, 13 bp, Homo sapiens
ccccggctgcaca

SEQ ID NO: 6057936 - DNA, 14 bp, Homo sapiens
ccccggcttgcctg

SEQ ID NO: 6057937 - DNA, 17 bp, Homo sapiens
ccccgggatattataga

SEQ ID NO: 6057938 - DNA, 19 bp, Homo sapiens
ccccgggatcctgccccca

SEQ ID NO: 6057939 - DNA, 16 bp, Homo sapiens
ccccgggatgcgaggc

SEQ ID NO: 6057940 - DNA, 18 bp, Homo sapiens
ccccgggcaaagggtctt

SEQ ID NO: 6057941 - DNA, 19 bp, Homo sapiens
ccccgggcagcagagagag

SEQ ID NO: 6057942 - DNA, 21 bp, Homo sapiens
ccccgggcccgggcccccgcc

SEQ ID NO: 6057943 - DNA, 16 bp, Homo sapiens
ccccgggctctctgct

SEQ ID NO: 6057944 - DNA, 16 bp, Homo sapiens
ccccggggaccctgtg

SEQ ID NO: 6057945 - DNA, 14 bp, Homo sapiens
ccccggggcccagg

SEQ ID NO: 6057946 - DNA, 21 bp, Homo sapiens
ccccggggcgtttctttgccg

SEQ ID NO: 6057947 - DNA, 20 bp, Homo sapiens
ccccgggggcagacacctgt

SEQ ID NO: 6057948 - DNA, 22 bp, Homo sapiens
ccccggggtgagtccattctcc

SEQ ID NO: 6057949 - DNA, 17 bp, Homo sapiens
ccccgggtgcctcagag

SEQ ID NO: 6057950 - DNA, 20 bp, Homo sapiens
ccccgggttcagcctggcct

SEQ ID NO: 6057951 - DNA, 18 bp, Homo sapiens
ccccgggtttggcgggcc

SEQ ID NO: 6057952 - DNA, 23 bp, Homo sapiens
ccccgggtttggcgggccaagga

SEQ ID NO: 6057953 - DNA, 13 bp, Homo sapiens
ccccggtccccca

SEQ ID NO: 6057954 - DNA, 16 bp, Homo sapiens
ccccggtcccttgaga

SEQ ID NO: 6057955 - DNA, 12 bp, Homo sapiens
ccccggtgcctc

SEQ ID NO: 6057956 - DNA, 16 bp, Homo sapiens
ccccggtggcagtgga

SEQ ID NO: 6057957 - DNA, 20 bp, Homo sapiens
ccccgtagccactctctgcc

SEQ ID NO: 6057958 - DNA, 14 bp, Homo sapiens
ccccgtcccagagg

SEQ ID NO: 6057959 - DNA, 15 bp, Homo sapiens
ccccgtcccagaggc

SEQ ID NO: 6057960 - DNA, 16 bp, Homo sapiens
ccccgtccccctctgg

SEQ ID NO: 6057961 - DNA, 16 bp, Homo sapiens
ccccgtccctgtcccc

SEQ ID NO: 6057962 - DNA, 22 bp, Homo sapiens
ccccgtccctgtcccccagcat

SEQ ID NO: 6057963 - DNA, 16 bp, Homo sapiens
ccccgtccctttccct

SEQ ID NO: 6057964 - DNA, 23 bp, Homo sapiens
ccccgtcctggaggttccccagc

SEQ ID NO: 6057965 - DNA, 17 bp, Homo sapiens
ccccgtctctcttggac

SEQ ID NO: 6057966 - DNA, 22 bp, Homo sapiens
ccccgtctctgccctgggctcc

SEQ ID NO: 6057967 - DNA, 22 bp, Homo sapiens
ccccgtctggggttcagcccct

SEQ ID NO: 6057968 - DNA, 14 bp, Homo sapiens
ccccgtctgtggct

SEQ ID NO: 6057969 - DNA, 15 bp, Homo sapiens
ccccgtgcagactgg

SEQ ID NO: 6057970 - DNA, 19 bp, Homo sapiens
ccccgtgcagactggaggg

SEQ ID NO: 6057971 - DNA, 22 bp, Homo sapiens
ccccgtgcggcccgtgcgcagc

SEQ ID NO: 6057972 - DNA, 22 bp, Homo sapiens
ccccgtggccatccctgtgagg

SEQ ID NO: 6057973 - DNA, 15 bp, Homo sapiens
ccccgtggctctggg

SEQ ID NO: 6057974 - DNA, 13 bp, Homo sapiens
ccccgtggggcag

SEQ ID NO: 6057975 - DNA, 22 bp, Homo sapiens
ccccgtggtctttgaataaagt

SEQ ID NO: 6057976 - DNA, 16 bp, Homo sapiens
ccccgtggtgcctgca

SEQ ID NO: 6057977 - DNA, 15 bp, Homo sapiens
ccccgtgtaaaaagc

SEQ ID NO: 6057978 - DNA, 22 bp, Homo sapiens
ccccgtgtagccccgggctgac

SEQ ID NO: 6057979 - DNA, 16 bp, Homo sapiens
ccccgttcccagcgca

SEQ ID NO: 6057980 - DNA, 20 bp, Homo sapiens
ccccgttgaagccgctcccg

SEQ ID NO: 6057981 - DNA, 21 bp, Homo sapiens
ccccgttgcttcccgctgcac

SEQ ID NO: 6057982 - DNA, 13 bp, Homo sapiens
ccccgttgtgcct

SEQ ID NO: 6057983 - DNA, 14 bp, Homo sapiens
ccccgttgtgcctg

SEQ ID NO: 6057984 - DNA, 14 bp, Homo sapiens
ccccgtttcttgca

SEQ ID NO: 6057985 - DNA, 15 bp, Homo sapiens
cccctaaaccccaag

SEQ ID NO: 6057986 - DNA, 17 bp, Homo sapiens
cccctaaacccctgtcc

SEQ ID NO: 6057987 - DNA, 13 bp, Homo sapiens
cccctaaagccag

SEQ ID NO: 6057988 - DNA, 18 bp, Homo sapiens
cccctaagagagcacctg

SEQ ID NO: 6057989 - DNA, 23 bp, Homo sapiens
cccctaagctccaggtgccctgt

SEQ ID NO: 6057990 - DNA, 21 bp, Homo sapiens
cccctaagtgcaaacacagca

SEQ ID NO: 6057991 - DNA, 22 bp, Homo sapiens
cccctaagtgcaaacacagcat

SEQ ID NO: 6057992 - DNA, 17 bp, Homo sapiens
cccctaagtgcccaaag

SEQ ID NO: 6057993 - DNA, 14 bp, Homo sapiens
cccctacacacacc

SEQ ID NO: 6057994 - DNA, 17 bp, Homo sapiens
cccctacagcctgcaca

SEQ ID NO: 6057995 - DNA, 20 bp, Homo sapiens
cccctaccactgtcttcttc

SEQ ID NO: 6057996 - DNA, 13 bp, Homo sapiens
cccctacccaccg

SEQ ID NO: 6057997 - DNA, 15 bp, Homo sapiens
cccctacccatatcc

SEQ ID NO: 6057998 - DNA, 14 bp, Homo sapiens
cccctaccccctca

SEQ ID NO: 6057999 - DNA, 23 bp, Homo sapiens
cccctacccccttgtctgctgct

SEQ ID NO: 6058000 - DNA, 14 bp, Homo sapiens
cccctaccctttcc

SEQ ID NO: 6058001 - DNA, 19 bp, Homo sapiens
cccctaccgatggtcccag

SEQ ID NO: 6058002 - DNA, 22 bp, Homo sapiens
cccctaccgcatggcagctggg

SEQ ID NO: 6058003 - DNA, 15 bp, Homo sapiens
cccctacgcgccttg

SEQ ID NO: 6058004 - DNA, 18 bp, Homo sapiens
cccctactcccctgatcc

SEQ ID NO: 6058005 - DNA, 12 bp, Homo sapiens
cccctactccct

SEQ ID NO: 6058006 - DNA, 13 bp, Homo sapiens
cccctactgctgt

SEQ ID NO: 6058007 - DNA, 20 bp, Homo sapiens
cccctagaaaccacctgggt

SEQ ID NO: 6058008 - DNA, 13 bp, Homo sapiens
cccctagaaaccc

SEQ ID NO: 6058009 - DNA, 18 bp, Homo sapiens
cccctagaaacccaagct

SEQ ID NO: 6058010 - DNA, 19 bp, Homo sapiens
cccctagacctccccctca

SEQ ID NO: 6058011 - DNA, 14 bp, Homo sapiens
cccctagagtccca

SEQ ID NO: 6058012 - DNA, 17 bp, Homo sapiens
cccctagcaaggtccag

SEQ ID NO: 6058013 - DNA, 17 bp, Homo sapiens
cccctagcccaggagag

SEQ ID NO: 6058014 - DNA, 18 bp, Homo sapiens
cccctagcccaggagaga

SEQ ID NO: 6058015 - DNA, 13 bp, Homo sapiens
cccctagccctgg

SEQ ID NO: 6058016 - DNA, 17 bp, Homo sapiens
cccctagccggttcctg

SEQ ID NO: 6058017 - DNA, 20 bp, Homo sapiens
cccctagcgctatctccctg

SEQ ID NO: 6058018 - DNA, 20 bp, Homo sapiens
cccctagctcaccaggcctg

SEQ ID NO: 6058019 - DNA, 21 bp, Homo sapiens
cccctagctcaccaggcctgg

SEQ ID NO: 6058020 - DNA, 22 bp, Homo sapiens
cccctagctcaccaggcctggc

SEQ ID NO: 6058021 - DNA, 20 bp, Homo sapiens
cccctagcttactgataaac

SEQ ID NO: 6058022 - DNA, 21 bp, Homo sapiens
cccctagcttagagcctccct

SEQ ID NO: 6058023 - DNA, 23 bp, Homo sapiens
cccctagctttatatatggacat

SEQ ID NO: 6058024 - DNA, 23 bp, Homo sapiens
cccctaggactcaggcctgccaa

SEQ ID NO: 6058025 - DNA, 19 bp, Homo sapiens
cccctaggatgctgcagca

SEQ ID NO: 6058026 - DNA, 22 bp, Homo sapiens
cccctaggattccccctgccct

SEQ ID NO: 6058027 - DNA, 17 bp, Homo sapiens
cccctagggactgtcct

SEQ ID NO: 6058028 - DNA, 20 bp, Homo sapiens
cccctaggtcatttgtagat

SEQ ID NO: 6058029 - DNA, 19 bp, Homo sapiens
cccctagtaagtgccttcc

SEQ ID NO: 6058030 - DNA, 20 bp, Homo sapiens
cccctagtaagtgccttcca

SEQ ID NO: 6058031 - DNA, 18 bp, Homo sapiens
cccctagtatctggctgg

SEQ ID NO: 6058032 - DNA, 17 bp, Homo sapiens
cccctagtccggttctt

SEQ ID NO: 6058033 - DNA, 15 bp, Homo sapiens
cccctagttccctct

SEQ ID NO: 6058034 - DNA, 12 bp, Homo sapiens
cccctatcctct

SEQ ID NO: 6058035 - DNA, 15 bp, Homo sapiens
cccctatcctgcacc

SEQ ID NO: 6058036 - DNA, 17 bp, Homo sapiens
cccctatcttgtcctgg

SEQ ID NO: 6058037 - DNA, 19 bp, Homo sapiens
cccctatcttgtcctggaa

SEQ ID NO: 6058038 - DNA, 13 bp, Homo sapiens
cccctatgctcca

SEQ ID NO: 6058039 - DNA, 19 bp, Homo sapiens
cccctatggaatttataat

SEQ ID NO: 6058040 - DNA, 20 bp, Homo sapiens
cccctcaaagggagagaaaa

SEQ ID NO: 6058041 - DNA, 13 bp, Homo sapiens
cccctcaacaccc

SEQ ID NO: 6058042 - DNA, 20 bp, Homo sapiens
cccctcaacaccctgcttct

SEQ ID NO: 6058043 - DNA, 21 bp, Homo sapiens
cccctcaacaccctgcttctc

SEQ ID NO: 6058044 - DNA, 11 bp, Homo sapiens
cccctcaaccc

SEQ ID NO: 6058045 - DNA, 23 bp, Homo sapiens
cccctcaactctcctccagagtc

SEQ ID NO: 6058046 - DNA, 21 bp, Homo sapiens
cccctcaagccaggagaccct

SEQ ID NO: 6058047 - DNA, 15 bp, Homo sapiens
cccctcaagccccag

SEQ ID NO: 6058048 - DNA, 20 bp, Homo sapiens
cccctcaaggggcagggagg

SEQ ID NO: 6058049 - DNA, 20 bp, Homo sapiens
cccctcacagactcttccac

SEQ ID NO: 6058050 - DNA, 23 bp, Homo sapiens
cccctcacagactcttccaccag

SEQ ID NO: 6058051 - DNA, 18 bp, Homo sapiens
cccctcacagcctctgac

SEQ ID NO: 6058052 - DNA, 15 bp, Homo sapiens
cccctcacatcctct

SEQ ID NO: 6058053 - DNA, 20 bp, Homo sapiens
cccctcaccatccagtgggc

SEQ ID NO: 6058054 - DNA, 18 bp, Homo sapiens
cccctcaccccagctccg

SEQ ID NO: 6058055 - DNA, 19 bp, Homo sapiens
cccctcacccgctgcccag

SEQ ID NO: 6058056 - DNA, 13 bp, Homo sapiens
cccctcaccctct

SEQ ID NO: 6058057 - DNA, 13 bp, Homo sapiens
cccctcaccctgc

SEQ ID NO: 6058058 - DNA, 13 bp, Homo sapiens
cccctcacctact

SEQ ID NO: 6058059 - DNA, 11 bp, Homo sapiens
cccctcacctc

SEQ ID NO: 6058060 - DNA, 14 bp, Homo sapiens
cccctcacctcagg

SEQ ID NO: 6058061 - DNA, 12 bp, Homo sapiens
cccctcacctgg

SEQ ID NO: 6058062 - DNA, 16 bp, Homo sapiens
cccctcactccccagg

SEQ ID NO: 6058063 - DNA, 14 bp, Homo sapiens
cccctcactggctg

SEQ ID NO: 6058064 - DNA, 17 bp, Homo sapiens
cccctcagacagccccc

SEQ ID NO: 6058065 - DNA, 20 bp, Homo sapiens
cccctcagagcatgatggga

SEQ ID NO: 6058066 - DNA, 16 bp, Homo sapiens
cccctcagagcccatg

SEQ ID NO: 6058067 - DNA, 22 bp, Homo sapiens
cccctcagattttatattttct

SEQ ID NO: 6058068 - DNA, 20 bp, Homo sapiens
cccctcagccacccttggtc

SEQ ID NO: 6058069 - DNA, 14 bp, Homo sapiens
cccctcagcccttg

SEQ ID NO: 6058070 - DNA, 15 bp, Homo sapiens
cccctcagcccttgc

SEQ ID NO: 6058071 - DNA, 18 bp, Homo sapiens
cccctcagcctctgccac

SEQ ID NO: 6058072 - DNA, 21 bp, Homo sapiens
cccctcagcctctgccactgt

SEQ ID NO: 6058073 - DNA, 12 bp, Homo sapiens
cccctcagcctg

SEQ ID NO: 6058074 - DNA, 16 bp, Homo sapiens
cccctcagcctgccca

SEQ ID NO: 6058075 - DNA, 16 bp, Homo sapiens
cccctcagccttggga

SEQ ID NO: 6058076 - DNA, 23 bp, Homo sapiens
cccctcagcgcaggctgcagagc

SEQ ID NO: 6058077 - DNA, 21 bp, Homo sapiens
cccctcagcgggggccttgaa

SEQ ID NO: 6058078 - DNA, 22 bp, Homo sapiens
cccctcagcgggggccttgaag

SEQ ID NO: 6058079 - DNA, 14 bp, Homo sapiens
cccctcagctcggc

SEQ ID NO: 6058080 - DNA, 21 bp, Homo sapiens
cccctcagctctccctcacac

SEQ ID NO: 6058081 - DNA, 16 bp, Homo sapiens
cccctcagctctgtcc

SEQ ID NO: 6058082 - DNA, 18 bp, Homo sapiens
cccctcaggaccctcgct

SEQ ID NO: 6058083 - DNA, 23 bp, Homo sapiens
cccctcaggggaagctgctaggg

SEQ ID NO: 6058084 - DNA, 22 bp, Homo sapiens
cccctcagggggccagctgggg

SEQ ID NO: 6058085 - DNA, 20 bp, Homo sapiens
cccctcagggtccctggtgg

SEQ ID NO: 6058086 - DNA, 20 bp, Homo sapiens
cccctcatacctacacccaa

SEQ ID NO: 6058087 - DNA, 16 bp, Homo sapiens
cccctcatcagccttt

SEQ ID NO: 6058088 - DNA, 22 bp, Homo sapiens
cccctcatcatagcaataacat

SEQ ID NO: 6058089 - DNA, 20 bp, Homo sapiens
cccctcatctctctgcccaa

SEQ ID NO: 6058090 - DNA, 15 bp, Homo sapiens
cccctcatgtgtgct

SEQ ID NO: 6058091 - DNA, 16 bp, Homo sapiens
cccctccaaaatgtgc

SEQ ID NO: 6058092 - DNA, 19 bp, Homo sapiens
cccctccaaacctccagcc

SEQ ID NO: 6058093 - DNA, 19 bp, Homo sapiens
cccctccacgcctcctggc

SEQ ID NO: 6058094 - DNA, 12 bp, Homo sapiens
cccctccactct

SEQ ID NO: 6058095 - DNA, 11 bp, Homo sapiens
cccctccactg

SEQ ID NO: 6058096 - DNA, 13 bp, Homo sapiens
cccctccactgct

SEQ ID NO: 6058097 - DNA, 14 bp, Homo sapiens
cccctccactgctg

SEQ ID NO: 6058098 - DNA, 12 bp, Homo sapiens
cccctccactgt

SEQ ID NO: 6058099 - DNA, 12 bp, Homo sapiens
cccctccagacc

SEQ ID NO: 6058100 - DNA, 13 bp, Homo sapiens
cccctccagaccc

SEQ ID NO: 6058101 - DNA, 15 bp, Homo sapiens
cccctccagaccctg

SEQ ID NO: 6058102 - DNA, 23 bp, Homo sapiens
cccctccagaccctgcctgagcc

SEQ ID NO: 6058103 - DNA, 11 bp, Homo sapiens
cccctccagca

SEQ ID NO: 6058104 - DNA, 15 bp, Homo sapiens
cccctccagcacaca

SEQ ID NO: 6058105 - DNA, 14 bp, Homo sapiens
cccctccagccaga

SEQ ID NO: 6058106 - DNA, 13 bp, Homo sapiens
cccctccagcctt

SEQ ID NO: 6058107 - DNA, 22 bp, Homo sapiens
cccctccagctcatgacactgt

SEQ ID NO: 6058108 - DNA, 14 bp, Homo sapiens
cccctccaggaaga

SEQ ID NO: 6058109 - DNA, 13 bp, Homo sapiens
cccctccaggaga

SEQ ID NO: 6058110 - DNA, 11 bp, Homo sapiens
cccctccaggc

SEQ ID NO: 6058111 - DNA, 22 bp, Homo sapiens
cccctccaggcatgctggcctc

SEQ ID NO: 6058112 - DNA, 20 bp, Homo sapiens
cccctccagttttgcctgag

SEQ ID NO: 6058113 - DNA, 12 bp, Homo sapiens
cccctccatctg

SEQ ID NO: 6058114 - DNA, 17 bp, Homo sapiens
cccctccattggctccc

SEQ ID NO: 6058115 - DNA, 21 bp, Homo sapiens
cccctcccaagcgttcctggc

SEQ ID NO: 6058116 - DNA, 12 bp, Homo sapiens
cccctcccacca

SEQ ID NO: 6058117 - DNA, 16 bp, Homo sapiens
cccctcccaccacagc

SEQ ID NO: 6058118 - DNA, 16 bp, Homo sapiens
cccctcccacccaccg

SEQ ID NO: 6058119 - DNA, 12 bp, Homo sapiens
cccctcccagaa

SEQ ID NO: 6058120 - DNA, 15 bp, Homo sapiens
cccctcccagacagg

SEQ ID NO: 6058121 - DNA, 20 bp, Homo sapiens
cccctcccagacaggccctc

SEQ ID NO: 6058122 - DNA, 13 bp, Homo sapiens
cccctcccagccc

SEQ ID NO: 6058123 - DNA, 13 bp, Homo sapiens
cccctcccaggga

SEQ ID NO: 6058124 - DNA, 21 bp, Homo sapiens
cccctcccaggggagccagct

SEQ ID NO: 6058125 - DNA, 23 bp, Homo sapiens
cccctcccaggggagccagctgc

SEQ ID NO: 6058126 - DNA, 15 bp, Homo sapiens
cccctccccacccac

SEQ ID NO: 6058127 - DNA, 13 bp, Homo sapiens
cccctccccagcc

SEQ ID NO: 6058128 - DNA, 16 bp, Homo sapiens
cccctccccagccagc

SEQ ID NO: 6058129 - DNA, 18 bp, Homo sapiens
cccctccccagccagccc

SEQ ID NO: 6058130 - DNA, 19 bp, Homo sapiens
cccctccccatctgtgttc

SEQ ID NO: 6058131 - DNA, 21 bp, Homo sapiens
cccctccccatgcaggtggtg

SEQ ID NO: 6058132 - DNA, 20 bp, Homo sapiens
cccctccccattagctttca

SEQ ID NO: 6058133 - DNA, 21 bp, Homo sapiens
cccctcccccaacccccaccc

SEQ ID NO: 6058134 - DNA, 14 bp, Homo sapiens
cccctcccccactt

SEQ ID NO: 6058135 - DNA, 17 bp, Homo sapiens
cccctcccccagccact

SEQ ID NO: 6058136 - DNA, 18 bp, Homo sapiens
cccctcccccatgggctg

SEQ ID NO: 6058137 - DNA, 14 bp, Homo sapiens
cccctccccccaga

SEQ ID NO: 6058138 - DNA, 15 bp, Homo sapiens
cccctcccccctgta

SEQ ID NO: 6058139 - DNA, 15 bp, Homo sapiens
cccctcccccgcaga

SEQ ID NO: 6058140 - DNA, 20 bp, Homo sapiens
cccctcccccgtcctggagg

SEQ ID NO: 6058141 - DNA, 18 bp, Homo sapiens
cccctcccccttaagcca

SEQ ID NO: 6058142 - DNA, 12 bp, Homo sapiens
cccctccccgcc

SEQ ID NO: 6058143 - DNA, 15 bp, Homo sapiens
cccctccccgccccc

SEQ ID NO: 6058144 - DNA, 18 bp, Homo sapiens
cccctccccgcctggcca

SEQ ID NO: 6058145 - DNA, 12 bp, Homo sapiens
cccctccccggc

SEQ ID NO: 6058146 - DNA, 11 bp, Homo sapiens
cccctcccctc

SEQ ID NO: 6058147 - DNA, 12 bp, Homo sapiens
cccctcccctca

SEQ ID NO: 6058148 - DNA, 14 bp, Homo sapiens
cccctcccctcagc

SEQ ID NO: 6058149 - DNA, 15 bp, Homo sapiens
cccctcccctcagcc

SEQ ID NO: 6058150 - DNA, 18 bp, Homo sapiens
cccctcccctcagcctgc

SEQ ID NO: 6058151 - DNA, 15 bp, Homo sapiens
cccctcccctccttg

SEQ ID NO: 6058152 - DNA, 20 bp, Homo sapiens
cccctcccctgcccctgccc

SEQ ID NO: 6058153 - DNA, 18 bp, Homo sapiens
cccctcccctgctgcagg

SEQ ID NO: 6058154 - DNA, 19 bp, Homo sapiens
cccctcccgacagcccatc

SEQ ID NO: 6058155 - DNA, 15 bp, Homo sapiens
cccctcccgcttcct

SEQ ID NO: 6058156 - DNA, 17 bp, Homo sapiens
cccctcccgcttcctcc

SEQ ID NO: 6058157 - DNA, 22 bp, Homo sapiens
cccctcccgtctactcattccc

SEQ ID NO: 6058158 - DNA, 14 bp, Homo sapiens
cccctccctcaggg

SEQ ID NO: 6058159 - DNA, 12 bp, Homo sapiens
cccctccctccc

SEQ ID NO: 6058160 - DNA, 14 bp, Homo sapiens
cccctccctcccac

SEQ ID NO: 6058161 - DNA, 15 bp, Homo sapiens
cccctccctcgtggg

SEQ ID NO: 6058162 - DNA, 17 bp, Homo sapiens
cccctccctctgcccca

SEQ ID NO: 6058163 - DNA, 14 bp, Homo sapiens
cccctccctctgct

SEQ ID NO: 6058164 - DNA, 16 bp, Homo sapiens
cccctccctctgctct

SEQ ID NO: 6058165 - DNA, 18 bp, Homo sapiens
cccctccctctgctctca

SEQ ID NO: 6058166 - DNA, 13 bp, Homo sapiens
cccctccctctgt

SEQ ID NO: 6058167 - DNA, 14 bp, Homo sapiens
cccctccctcttcc

SEQ ID NO: 6058168 - DNA, 13 bp, Homo sapiens
cccctccctgcct

SEQ ID NO: 6058169 - DNA, 14 bp, Homo sapiens
cccctccctgcctg

SEQ ID NO: 6058170 - DNA, 15 bp, Homo sapiens
cccctccctgcctgc

SEQ ID NO: 6058171 - DNA, 18 bp, Homo sapiens
cccctccctgctcccagc

SEQ ID NO: 6058172 - DNA, 16 bp, Homo sapiens
cccctccctggcctgt

SEQ ID NO: 6058173 - DNA, 14 bp, Homo sapiens
cccctccctggctc

SEQ ID NO: 6058174 - DNA, 22 bp, Homo sapiens
cccctccctggctcccatgacc

SEQ ID NO: 6058175 - DNA, 13 bp, Homo sapiens
cccctccctgggt

SEQ ID NO: 6058176 - DNA, 12 bp, Homo sapiens
cccctccctgta

SEQ ID NO: 6058177 - DNA, 15 bp, Homo sapiens
cccctcccttctggg

SEQ ID NO: 6058178 - DNA, 16 bp, Homo sapiens
cccctccgccctgcca

SEQ ID NO: 6058179 - DNA, 18 bp, Homo sapiens
cccctccgccgtgccggc

SEQ ID NO: 6058180 - DNA, 21 bp, Homo sapiens
cccctccgggcagagaccacc

SEQ ID NO: 6058181 - DNA, 13 bp, Homo sapiens
cccctcctagcac

SEQ ID NO: 6058182 - DNA, 22 bp, Homo sapiens
cccctcctcacagttgccatgt

SEQ ID NO: 6058183 - DNA, 12 bp, Homo sapiens
cccctcctccac

SEQ ID NO: 6058184 - DNA, 18 bp, Homo sapiens
cccctcctccactctccc

SEQ ID NO: 6058185 - DNA, 15 bp, Homo sapiens
cccctcctccagatc

SEQ ID NO: 6058186 - DNA, 13 bp, Homo sapiens
cccctcctccagc

SEQ ID NO: 6058187 - DNA, 22 bp, Homo sapiens
cccctcctccagcccctgtccc

SEQ ID NO: 6058188 - DNA, 14 bp, Homo sapiens
cccctcctccagta

SEQ ID NO: 6058189 - DNA, 13 bp, Homo sapiens
cccctcctccatg

SEQ ID NO: 6058190 - DNA, 16 bp, Homo sapiens
cccctcctccatgctg

SEQ ID NO: 6058191 - DNA, 20 bp, Homo sapiens
cccctcctccatgctgtccc

SEQ ID NO: 6058192 - DNA, 14 bp, Homo sapiens
cccctcctccctca

SEQ ID NO: 6058193 - DNA, 17 bp, Homo sapiens
cccctcctccctcagac

SEQ ID NO: 6058194 - DNA, 16 bp, Homo sapiens
cccctcctccctcagg

SEQ ID NO: 6058195 - DNA, 18 bp, Homo sapiens
cccctcctcctggactcc

SEQ ID NO: 6058196 - DNA, 19 bp, Homo sapiens
cccctcctccttgctgatt

SEQ ID NO: 6058197 - DNA, 10 bp, Homo sapiens
cccctcctcg

SEQ ID NO: 6058198 - DNA, 19 bp, Homo sapiens
cccctcctctagctgtggg

SEQ ID NO: 6058199 - DNA, 13 bp, Homo sapiens
cccctcctctctg

SEQ ID NO: 6058200 - DNA, 18 bp, Homo sapiens
cccctcctctgaaacagc

SEQ ID NO: 6058201 - DNA, 13 bp, Homo sapiens
cccctcctctgcc

SEQ ID NO: 6058202 - DNA, 23 bp, Homo sapiens
cccctcctcttcccttagcctct

SEQ ID NO: 6058203 - DNA, 16 bp, Homo sapiens
cccctcctcttccgag

SEQ ID NO: 6058204 - DNA, 13 bp, Homo sapiens
cccctcctgcgct

SEQ ID NO: 6058205 - DNA, 11 bp, Homo sapiens
cccctcctgct

SEQ ID NO: 6058206 - DNA, 14 bp, Homo sapiens
cccctcctgctgca

SEQ ID NO: 6058207 - DNA, 22 bp, Homo sapiens
cccctcctgctgcagaggggca

SEQ ID NO: 6058208 - DNA, 16 bp, Homo sapiens
cccctcctgctgtgct

SEQ ID NO: 6058209 - DNA, 17 bp, Homo sapiens
cccctcctgctgtgctg

SEQ ID NO: 6058210 - DNA, 15 bp, Homo sapiens
cccctcctggggcca

SEQ ID NO: 6058211 - DNA, 13 bp, Homo sapiens
cccctcctgggtg

SEQ ID NO: 6058212 - DNA, 10 bp, Homo sapiens
cccctcctgt

SEQ ID NO: 6058213 - DNA, 16 bp, Homo sapiens
cccctccttccagcct

SEQ ID NO: 6058214 - DNA, 18 bp, Homo sapiens
cccctccttccccagacc

SEQ ID NO: 6058215 - DNA, 21 bp, Homo sapiens
cccctccttccccagacccag

SEQ ID NO: 6058216 - DNA, 15 bp, Homo sapiens
cccctccttccctca

SEQ ID NO: 6058217 - DNA, 15 bp, Homo sapiens
cccctccttccttga

SEQ ID NO: 6058218 - DNA, 22 bp, Homo sapiens
cccctccttctaggatagcgct

SEQ ID NO: 6058219 - DNA, 19 bp, Homo sapiens
cccctccttctcccctcca

SEQ ID NO: 6058220 - DNA, 21 bp, Homo sapiens
cccctccttctcccctccaga

SEQ ID NO: 6058221 - DNA, 21 bp, Homo sapiens
cccctccttgccgctgggaga

SEQ ID NO: 6058222 - DNA, 15 bp, Homo sapiens
cccctccttgcctcc

SEQ ID NO: 6058223 - DNA, 12 bp, Homo sapiens
cccctccttgtc

SEQ ID NO: 6058224 - DNA, 16 bp, Homo sapiens
cccctcgacagctctc

SEQ ID NO: 6058225 - DNA, 22 bp, Homo sapiens
cccctcgcaaccctgcctgtca

SEQ ID NO: 6058226 - DNA, 23 bp, Homo sapiens
cccctcgcacacagggctcacag

SEQ ID NO: 6058227 - DNA, 15 bp, Homo sapiens
cccctcgccagcttc

SEQ ID NO: 6058228 - DNA, 18 bp, Homo sapiens
cccctcgccagcttggct

SEQ ID NO: 6058229 - DNA, 22 bp, Homo sapiens
cccctcgcccagtcccagcagc

SEQ ID NO: 6058230 - DNA, 21 bp, Homo sapiens
cccctcgccttttaggctcag

SEQ ID NO: 6058231 - DNA, 15 bp, Homo sapiens
cccctcgcgcccctg

SEQ ID NO: 6058232 - DNA, 17 bp, Homo sapiens
cccctcgcgcccctgtc

SEQ ID NO: 6058233 - DNA, 13 bp, Homo sapiens
cccctcgctgtcc

SEQ ID NO: 6058234 - DNA, 15 bp, Homo sapiens
cccctcggagcctgt

SEQ ID NO: 6058235 - DNA, 18 bp, Homo sapiens
cccctcggagcctgtgtt

SEQ ID NO: 6058236 - DNA, 14 bp, Homo sapiens
cccctcggctaccc

SEQ ID NO: 6058237 - DNA, 17 bp, Homo sapiens
cccctcggctctggagg

SEQ ID NO: 6058238 - DNA, 17 bp, Homo sapiens
cccctcgggggcctgtg

SEQ ID NO: 6058239 - DNA, 18 bp, Homo sapiens
cccctcgtcctgtcccag

SEQ ID NO: 6058240 - DNA, 21 bp, Homo sapiens
cccctcgtcctgtcccagagg

SEQ ID NO: 6058241 - DNA, 15 bp, Homo sapiens
cccctcgtgccagtc

SEQ ID NO: 6058242 - DNA, 11 bp, Homo sapiens
cccctctcaga

SEQ ID NO: 6058243 - DNA, 13 bp, Homo sapiens
cccctctcagaac

SEQ ID NO: 6058244 - DNA, 22 bp, Homo sapiens
cccctctcagaacatactgatt

SEQ ID NO: 6058245 - DNA, 14 bp, Homo sapiens
cccctctcagccct

SEQ ID NO: 6058246 - DNA, 22 bp, Homo sapiens
cccctctcaggctgtgcttacc

SEQ ID NO: 6058247 - DNA, 21 bp, Homo sapiens
cccctctcatccccctgtgga

SEQ ID NO: 6058248 - DNA, 17 bp, Homo sapiens
cccctctcatctgacct

SEQ ID NO: 6058249 - DNA, 20 bp, Homo sapiens
cccctctccaagcgcctggc

SEQ ID NO: 6058250 - DNA, 17 bp, Homo sapiens
cccctctccaggcctgt

SEQ ID NO: 6058251 - DNA, 19 bp, Homo sapiens
cccctctcccctcatggag

SEQ ID NO: 6058252 - DNA, 14 bp, Homo sapiens
cccctctccctgca

SEQ ID NO: 6058253 - DNA, 22 bp, Homo sapiens
cccctctcccttgggctctgat

SEQ ID NO: 6058254 - DNA, 19 bp, Homo sapiens
cccctctcctcccagctgc

SEQ ID NO: 6058255 - DNA, 20 bp, Homo sapiens
cccctctcctccccttcctg

SEQ ID NO: 6058256 - DNA, 13 bp, Homo sapiens
cccctctcctgcc

SEQ ID NO: 6058257 - DNA, 23 bp, Homo sapiens
cccctctcctggagggcgcccag

SEQ ID NO: 6058258 - DNA, 15 bp, Homo sapiens
cccctctcctttcac

SEQ ID NO: 6058259 - DNA, 12 bp, Homo sapiens
cccctctctcac

SEQ ID NO: 6058260 - DNA, 13 bp, Homo sapiens
cccctctctctgg

SEQ ID NO: 6058261 - DNA, 15 bp, Homo sapiens
cccctctctgctcca

SEQ ID NO: 6058262 - DNA, 13 bp, Homo sapiens
cccctctctttct

SEQ ID NO: 6058263 - DNA, 14 bp, Homo sapiens
cccctctctttctc

SEQ ID NO: 6058264 - DNA, 11 bp, Homo sapiens
ccactggagca

SEQ ID NO: 6058265 - DNA, 23 bp, Homo sapiens
ccactggagtctctctctctcca

SEQ ID NO: 6058266 - DNA, 17 bp, Homo sapiens
ccactggatcctgctgc

SEQ ID NO: 6058267 - DNA, 15 bp, Homo sapiens
ccactggatcttcag

SEQ ID NO: 6058268 - DNA, 18 bp, Homo sapiens
ccactggcacttgcctgc

SEQ ID NO: 6058269 - DNA, 13 bp, Homo sapiens
ccactggcatctc

SEQ ID NO: 6058270 - DNA, 14 bp, Homo sapiens
ccactggcatctct

SEQ ID NO: 6058271 - DNA, 15 bp, Homo sapiens
ccactggcatctctg

SEQ ID NO: 6058272 - DNA, 13 bp, Homo sapiens
ccactggcatttt

SEQ ID NO: 6058273 - DNA, 12 bp, Homo sapiens
ccactggccacc

SEQ ID NO: 6058274 - DNA, 17 bp, Homo sapiens
ccactggccaccaggct

SEQ ID NO: 6058275 - DNA, 15 bp, Homo sapiens
ccactggccagtcct

SEQ ID NO: 6058276 - DNA, 20 bp, Homo sapiens
ccactggccagtcctagagc

SEQ ID NO: 6058277 - DNA, 16 bp, Homo sapiens
ccactggcctacccct

SEQ ID NO: 6058278 - DNA, 17 bp, Homo sapiens
ccactggcctacccctt

SEQ ID NO: 6058279 - DNA, 15 bp, Homo sapiens
ccactggctccatga

SEQ ID NO: 6058280 - DNA, 18 bp, Homo sapiens
ccactggctcctccagca

SEQ ID NO: 6058281 - DNA, 15 bp, Homo sapiens
ccactggctcctccc

SEQ ID NO: 6058282 - DNA, 18 bp, Homo sapiens
ccactggctcctcccagc

SEQ ID NO: 6058283 - DNA, 20 bp, Homo sapiens
ccactggctcctcccagcac

SEQ ID NO: 6058284 - DNA, 23 bp, Homo sapiens
ccactggctggacaaactgcacc

SEQ ID NO: 6058285 - DNA, 11 bp, Homo sapiens
ccactggctgt

SEQ ID NO: 6058286 - DNA, 18 bp, Homo sapiens
ccactggctgtgggctcc

SEQ ID NO: 6058287 - DNA, 20 bp, Homo sapiens
ccactggctgtgggctccct

SEQ ID NO: 6058288 - DNA, 20 bp, Homo sapiens
ccactggcttttgcctgtaa

SEQ ID NO: 6058289 - DNA, 23 bp, Homo sapiens
ccactgggaaccaagggccctca

SEQ ID NO: 6058290 - DNA, 19 bp, Homo sapiens
ccactgggacagctggctg

SEQ ID NO: 6058291 - DNA, 18 bp, Homo sapiens
ccactgggacatttttct

SEQ ID NO: 6058292 - DNA, 16 bp, Homo sapiens
ccactgggaccaaccc

SEQ ID NO: 6058293 - DNA, 23 bp, Homo sapiens
ccactgggaccaaccctggggaa

SEQ ID NO: 6058294 - DNA, 22 bp, Homo sapiens
ccactgggacccgaggatttct

SEQ ID NO: 6058295 - DNA, 15 bp, Homo sapiens
ccactgggactccca

SEQ ID NO: 6058296 - DNA, 18 bp, Homo sapiens
ccactgggactcccagca

SEQ ID NO: 6058297 - DNA, 21 bp, Homo sapiens
ccactgggactcccagcagag

SEQ ID NO: 6058298 - DNA, 23 bp, Homo sapiens
ccactgggattcatggctttgta

SEQ ID NO: 6058299 - DNA, 15 bp, Homo sapiens
ccactgggcacctgc

SEQ ID NO: 6058300 - DNA, 17 bp, Homo sapiens
ccactgggcataatgct

SEQ ID NO: 6058301 - DNA, 22 bp, Homo sapiens
ccactgggccagccctgcagcc

SEQ ID NO: 6058302 - DNA, 24 bp, Homo sapiens
ccactgggccagccctgcagccca

SEQ ID NO: 6058303 - DNA, 11 bp, Homo sapiens
ccactgggccc

SEQ ID NO: 6058304 - DNA, 12 bp, Homo sapiens
ccactgggcccc

SEQ ID NO: 6058305 - DNA, 13 bp, Homo sapiens
ccactgggcccct

SEQ ID NO: 6058306 - DNA, 14 bp, Homo sapiens
ccactgggcccctc

SEQ ID NO: 6058307 - DNA, 19 bp, Homo sapiens
ccactgggcccctgtcccc

SEQ ID NO: 6058308 - DNA, 21 bp, Homo sapiens
ccactgggcccctgtccccag

SEQ ID NO: 6058309 - DNA, 23 bp, Homo sapiens
ccactgggccctggggctgccct

SEQ ID NO: 6058310 - DNA, 13 bp, Homo sapiens
ccactgggcctgc

SEQ ID NO: 6058311 - DNA, 15 bp, Homo sapiens
ccactgggctctgga

SEQ ID NO: 6058312 - DNA, 17 bp, Homo sapiens
ccactgggctctggacc

SEQ ID NO: 6058313 - DNA, 23 bp, Homo sapiens
ccactgggctctggacctcagga

SEQ ID NO: 6058314 - DNA, 12 bp, Homo sapiens
ccactggggaaa

SEQ ID NO: 6058315 - DNA, 22 bp, Homo sapiens
ccactggggaaataacagctgt

SEQ ID NO: 6058316 - DNA, 20 bp, Homo sapiens
ccactggggaatgctcccag

SEQ ID NO: 6058317 - DNA, 17 bp, Homo sapiens
ccactggggactttatt

SEQ ID NO: 6058318 - DNA, 22 bp, Homo sapiens
ccactgggtacaagagatggga

SEQ ID NO: 6058319 - DNA, 18 bp, Homo sapiens
ccactgggtctcactcct

SEQ ID NO: 6058320 - DNA, 19 bp, Homo sapiens
ccactgggtctcactcctg

SEQ ID NO: 6058321 - DNA, 20 bp, Homo sapiens
ccactgggtctcactcctga

SEQ ID NO: 6058322 - DNA, 15 bp, Homo sapiens
ccactgggtgagaga

SEQ ID NO: 6058323 - DNA, 17 bp, Homo sapiens
ccactgggtgagagagg

SEQ ID NO: 6058324 - DNA, 19 bp, Homo sapiens
ccactgggtgtaaacacat

SEQ ID NO: 6058325 - DNA, 16 bp, Homo sapiens
ccactgggtttaaaga

SEQ ID NO: 6058326 - DNA, 17 bp, Homo sapiens
ccactgggtttaaagat

SEQ ID NO: 6058327 - DNA, 16 bp, Homo sapiens
ccactggtaacatgtg

SEQ ID NO: 6058328 - DNA, 18 bp, Homo sapiens
ccactggtacttcctttc

SEQ ID NO: 6058329 - DNA, 23 bp, Homo sapiens
ccactggtgacatgtcttttctt

SEQ ID NO: 6058330 - DNA, 19 bp, Homo sapiens
ccactggtgtatgaaatga

SEQ ID NO: 6058331 - DNA, 14 bp, Homo sapiens
ccactgtaaaatga

SEQ ID NO: 6058332 - DNA, 12 bp, Homo sapiens
ccactgtacata

SEQ ID NO: 6058333 - DNA, 12 bp, Homo sapiens
ccactgtagcta

SEQ ID NO: 6058334 - DNA, 14 bp, Homo sapiens
ccactgtatatttt

SEQ ID NO: 6058335 - DNA, 19 bp, Homo sapiens
ccactgtatattttttaat

SEQ ID NO: 6058336 - DNA, 19 bp, Homo sapiens
ccactgtatttgttaattt

SEQ ID NO: 6058337 - DNA, 22 bp, Homo sapiens
ccactgtcagccctcactgtca

SEQ ID NO: 6058338 - DNA, 17 bp, Homo sapiens
ccactgtcatgtgtctc

SEQ ID NO: 6058339 - DNA, 16 bp, Homo sapiens
ccactgtccctaccac

SEQ ID NO: 6058340 - DNA, 17 bp, Homo sapiens
ccactgtccctaccact

SEQ ID NO: 6058341 - DNA, 18 bp, Homo sapiens
ccactgtccctaccactg

SEQ ID NO: 6058342 - DNA, 21 bp, Homo sapiens
ccactgtccctaccactgagc

SEQ ID NO: 6058343 - DNA, 13 bp, Homo sapiens
ccactgtccctgt

SEQ ID NO: 6058344 - DNA, 19 bp, Homo sapiens
ccactgtccctgtccttct

SEQ ID NO: 6058345 - DNA, 22 bp, Homo sapiens
ccactgtccctgtccttctaca

SEQ ID NO: 6058346 - DNA, 13 bp, Homo sapiens
ccactgtccgcct

SEQ ID NO: 6058347 - DNA, 22 bp, Homo sapiens
ccactgtccgcctctgcccgca

SEQ ID NO: 6058348 - DNA, 18 bp, Homo sapiens
ccactgtccgctgtctcc

SEQ ID NO: 6058349 - DNA, 23 bp, Homo sapiens
ccactgtccgctgtctccctcct

SEQ ID NO: 6058350 - DNA, 19 bp, Homo sapiens
ccactgtcctgggcctgca

SEQ ID NO: 6058351 - DNA, 20 bp, Homo sapiens
ccactgtcctgggcctgcag

SEQ ID NO: 6058352 - DNA, 16 bp, Homo sapiens
ccactgtcctgggcgc

SEQ ID NO: 6058353 - DNA, 15 bp, Homo sapiens
ccactgtcctttctc

SEQ ID NO: 6058354 - DNA, 16 bp, Homo sapiens
ccactgtcctttctcc

SEQ ID NO: 6058355 - DNA, 23 bp, Homo sapiens
ccactgtcctttctccaggccct

SEQ ID NO: 6058356 - DNA, 19 bp, Homo sapiens
ccactgtctccacccacct

SEQ ID NO: 6058357 - DNA, 17 bp, Homo sapiens
ccactgtctcttccact

SEQ ID NO: 6058358 - DNA, 21 bp, Homo sapiens
ccactgtctgctaccagggct

SEQ ID NO: 6058359 - DNA, 14 bp, Homo sapiens
ccactgtcttcttc

SEQ ID NO: 6058360 - DNA, 17 bp, Homo sapiens
ccactgtcttgcctgcc

SEQ ID NO: 6058361 - DNA, 22 bp, Homo sapiens
ccactgtcttgcctgccagggc

SEQ ID NO: 6058362 - DNA, 20 bp, Homo sapiens
ccactgtgcaggtgctattg

SEQ ID NO: 6058363 - DNA, 18 bp, Homo sapiens
ccactgtgcaggttccca

SEQ ID NO: 6058364 - DNA, 15 bp, Homo sapiens
ccactgtgccatgtg

SEQ ID NO: 6058365 - DNA, 19 bp, Homo sapiens
ccactgtgccatgtgccag

SEQ ID NO: 6058366 - DNA, 16 bp, Homo sapiens
ccactgtgcctcagag

SEQ ID NO: 6058367 - DNA, 20 bp, Homo sapiens
ccactgtgcctttgcaaatc

SEQ ID NO: 6058368 - DNA, 18 bp, Homo sapiens
ccactgtgcttacagtga

SEQ ID NO: 6058369 - DNA, 16 bp, Homo sapiens
ccactgtggaaaatgc

SEQ ID NO: 6058370 - DNA, 14 bp, Homo sapiens
ccactgtggccaga

SEQ ID NO: 6058371 - DNA, 16 bp, Homo sapiens
ccactgtggccagagc

SEQ ID NO: 6058372 - DNA, 17 bp, Homo sapiens
ccactgtggccagagct

SEQ ID NO: 6058373 - DNA, 19 bp, Homo sapiens
ccactgtggccagagctgg

SEQ ID NO: 6058374 - DNA, 20 bp, Homo sapiens
ccactgtggccagagctgga

SEQ ID NO: 6058375 - DNA, 21 bp, Homo sapiens
ccactgtggccttctcagcct

SEQ ID NO: 6058376 - DNA, 19 bp, Homo sapiens
ccactgtggcgttctgctg

SEQ ID NO: 6058377 - DNA, 19 bp, Homo sapiens
ccactgtggggcaagcctg

SEQ ID NO: 6058378 - DNA, 12 bp, Homo sapiens
ccactgtgtata

SEQ ID NO: 6058379 - DNA, 11 bp, Homo sapiens
ccactgtgtcc

SEQ ID NO: 6058380 - DNA, 13 bp, Homo sapiens
ccactgtgtccag

SEQ ID NO: 6058381 - DNA, 12 bp, Homo sapiens
ccactgtgtccc

SEQ ID NO: 6058382 - DNA, 13 bp, Homo sapiens
ccactgtgtccca

SEQ ID NO: 6058383 - DNA, 14 bp, Homo sapiens
ccactgtgtcccag

SEQ ID NO: 6058384 - DNA, 15 bp, Homo sapiens
ccactgtgtcccagt

SEQ ID NO: 6058385 - DNA, 16 bp, Homo sapiens
ccactgtgtctctgtt

SEQ ID NO: 6058386 - DNA, 18 bp, Homo sapiens
ccactgtgtctctgtttc

SEQ ID NO: 6058387 - DNA, 22 bp, Homo sapiens
ccactgtgtctctgtttcctga

SEQ ID NO: 6058388 - DNA, 19 bp, Homo sapiens
ccactgtgtgccttctgcc

SEQ ID NO: 6058389 - DNA, 16 bp, Homo sapiens
ccactgtgtttagttg

SEQ ID NO: 6058390 - DNA, 19 bp, Homo sapiens
ccactgtgtttctgtgctc

SEQ ID NO: 6058391 - DNA, 20 bp, Homo sapiens
ccactgtgtttctgtgctcc

SEQ ID NO: 6058392 - DNA, 21 bp, Homo sapiens
ccactgtgtttctgtgctcca

SEQ ID NO: 6058393 - DNA, 19 bp, Homo sapiens
ccactgttcagcggagctg

SEQ ID NO: 6058394 - DNA, 22 bp, Homo sapiens
ccactgttctgttcatttccta

SEQ ID NO: 6058395 - DNA, 17 bp, Homo sapiens
ccactgtttcatgagcc

SEQ ID NO: 6058396 - DNA, 21 bp, Homo sapiens
ccactgtttctcttgagctgg

SEQ ID NO: 6058397 - DNA, 23 bp, Homo sapiens
ccactgtttctcttgagctggcc

SEQ ID NO: 6058398 - DNA, 15 bp, Homo sapiens
ccactgtttcttgct

SEQ ID NO: 6058399 - DNA, 14 bp, Homo sapiens
ccactgtttgtcct

SEQ ID NO: 6058400 - DNA, 19 bp, Homo sapiens
ccacttaaaaaatgtccat

SEQ ID NO: 6058401 - DNA, 16 bp, Homo sapiens
ccacttaaaaattaaa

SEQ ID NO: 6058402 - DNA, 14 bp, Homo sapiens
ccacttaagttctt

SEQ ID NO: 6058403 - DNA, 15 bp, Homo sapiens
ccacttaagttcttt

SEQ ID NO: 6058404 - DNA, 13 bp, Homo sapiens
ccacttaatcttc

SEQ ID NO: 6058405 - DNA, 20 bp, Homo sapiens
ccacttaatgtatgttacca

SEQ ID NO: 6058406 - DNA, 18 bp, Homo sapiens
ccacttaattgctttcct

SEQ ID NO: 6058407 - DNA, 12 bp, Homo sapiens
ccacttacctag

SEQ ID NO: 6058408 - DNA, 13 bp, Homo sapiens
ccacttacctcaa

SEQ ID NO: 6058409 - DNA, 14 bp, Homo sapiens
ccacttacctcaaa

SEQ ID NO: 6058410 - DNA, 14 bp, Homo sapiens
ccacttaccttcaa

SEQ ID NO: 6058411 - DNA, 17 bp, Homo sapiens
ccacttagaagatgttg

SEQ ID NO: 6058412 - DNA, 14 bp, Homo sapiens
ccacttagcaggga

SEQ ID NO: 6058413 - DNA, 17 bp, Homo sapiens
ccacttagcagggacag

SEQ ID NO: 6058414 - DNA, 18 bp, Homo sapiens
ccacttagccgcaccctg

SEQ ID NO: 6058415 - DNA, 16 bp, Homo sapiens
ccacttatcagtgtat

SEQ ID NO: 6058416 - DNA, 14 bp, Homo sapiens
ccacttatgctgct

SEQ ID NO: 6058417 - DNA, 15 bp, Homo sapiens
ccacttatgctgctg

SEQ ID NO: 6058418 - DNA, 20 bp, Homo sapiens
ccacttatgctgctgtgaat

SEQ ID NO: 6058419 - DNA, 19 bp, Homo sapiens
ccacttatttattgttgcc

SEQ ID NO: 6058420 - DNA, 14 bp, Homo sapiens
ccacttatttccat

SEQ ID NO: 6058421 - DNA, 14 bp, Homo sapiens
ccacttcaaaacaa

SEQ ID NO: 6058422 - DNA, 15 bp, Homo sapiens
ccacttcaaccccca

SEQ ID NO: 6058423 - DNA, 16 bp, Homo sapiens
ccacttcaacccccag

SEQ ID NO: 6058424 - DNA, 13 bp, Homo sapiens
ccacttcactgcg

SEQ ID NO: 6058425 - DNA, 18 bp, Homo sapiens
ccacttcactttcttcaa

SEQ ID NO: 6058426 - DNA, 23 bp, Homo sapiens
ccacttcaggggatgggtgtgga

SEQ ID NO: 6058427 - DNA, 21 bp, Homo sapiens
ccacttcagggttctcctctc

SEQ ID NO: 6058428 - DNA, 17 bp, Homo sapiens
ccacttcatgcccactg

SEQ ID NO: 6058429 - DNA, 19 bp, Homo sapiens
ccacttcatgcccactgcc

SEQ ID NO: 6058430 - DNA, 23 bp, Homo sapiens
ccacttcattcttgaaagctgtg

SEQ ID NO: 6058431 - DNA, 17 bp, Homo sapiens
ccacttccagagccaga

SEQ ID NO: 6058432 - DNA, 13 bp, Homo sapiens
ccacttccaggag

SEQ ID NO: 6058433 - DNA, 13 bp, Homo sapiens
ccacttccagggg

SEQ ID NO: 6058434 - DNA, 18 bp, Homo sapiens
ccacttccaggtctgcct

SEQ ID NO: 6058435 - DNA, 21 bp, Homo sapiens
ccacttccaggtctgcctggt

SEQ ID NO: 6058436 - DNA, 15 bp, Homo sapiens
ccacttcccacttgc

SEQ ID NO: 6058437 - DNA, 23 bp, Homo sapiens
ccacttcccccgattcagagact

SEQ ID NO: 6058438 - DNA, 23 bp, Homo sapiens
ccacttccccctcttcttctgaa

SEQ ID NO: 6058439 - DNA, 12 bp, Homo sapiens
ccacttccctgc

SEQ ID NO: 6058440 - DNA, 18 bp, Homo sapiens
ccacttccctgcaaggtg

SEQ ID NO: 6058441 - DNA, 16 bp, Homo sapiens
ccacttccctgctttt

SEQ ID NO: 6058442 - DNA, 14 bp, Homo sapiens
ccacttccctgggc

SEQ ID NO: 6058443 - DNA, 14 bp, Homo sapiens
cccctctgcagccg

SEQ ID NO: 6058444 - DNA, 18 bp, Homo sapiens
cccctctgcccagcttgg

SEQ ID NO: 6058445 - DNA, 18 bp, Homo sapiens
cccctctgcccctgcagc

SEQ ID NO: 6058446 - DNA, 12 bp, Homo sapiens
cccctctgccct

SEQ ID NO: 6058447 - DNA, 20 bp, Homo sapiens
cccctctgccctgcgggtca

SEQ ID NO: 6058448 - DNA, 22 bp, Homo sapiens
cccctctgccggtcccccatgc

SEQ ID NO: 6058449 - DNA, 22 bp, Homo sapiens
cccctctgccggtcgggcagcc

SEQ ID NO: 6058450 - DNA, 12 bp, Homo sapiens
cccctctgcctt

SEQ ID NO: 6058451 - DNA, 17 bp, Homo sapiens
cccctctgcctttgagc

SEQ ID NO: 6058452 - DNA, 12 bp, Homo sapiens
cccctctgctgc

SEQ ID NO: 6058453 - DNA, 21 bp, Homo sapiens
cccctctgctgcaacaagctc

SEQ ID NO: 6058454 - DNA, 23 bp, Homo sapiens
cccctctgctgccggctctgggc

SEQ ID NO: 6058455 - DNA, 19 bp, Homo sapiens
cccctctggagaaggcctg

SEQ ID NO: 6058456 - DNA, 20 bp, Homo sapiens
cccctctggagaaggcctgg

SEQ ID NO: 6058457 - DNA, 20 bp, Homo sapiens
cccctctggttatttatttc

SEQ ID NO: 6058458 - DNA, 11 bp, Homo sapiens
cccctctgtag

SEQ ID NO: 6058459 - DNA, 13 bp, Homo sapiens
cccctctgtccag

SEQ ID NO: 6058460 - DNA, 11 bp, Homo sapiens
cccctctgtct

SEQ ID NO: 6058461 - DNA, 22 bp, Homo sapiens
cccctctgtgcttcgactactg

SEQ ID NO: 6058462 - DNA, 19 bp, Homo sapiens
cccctctgttctctcccct

SEQ ID NO: 6058463 - DNA, 16 bp, Homo sapiens
cccctcttagaagaaa

SEQ ID NO: 6058464 - DNA, 22 bp, Homo sapiens
cccctcttagcttacaggaagc

SEQ ID NO: 6058465 - DNA, 21 bp, Homo sapiens
cccctcttcaaagcagagtgg

SEQ ID NO: 6058466 - DNA, 20 bp, Homo sapiens
cccctcttccaaaggcagcg

SEQ ID NO: 6058467 - DNA, 13 bp, Homo sapiens
cccctcttccagc

SEQ ID NO: 6058468 - DNA, 11 bp, Homo sapiens
cccctcttccc

SEQ ID NO: 6058469 - DNA, 20 bp, Homo sapiens
cccctcttcccaccaactct

SEQ ID NO: 6058470 - DNA, 13 bp, Homo sapiens
cccctcttcctct

SEQ ID NO: 6058471 - DNA, 15 bp, Homo sapiens
cccctcttctgagct

SEQ ID NO: 6058472 - DNA, 23 bp, Homo sapiens
cccctcttcttgcggcaccgccc

SEQ ID NO: 6058473 - DNA, 18 bp, Homo sapiens
cccctcttgtctcccctg

SEQ ID NO: 6058474 - DNA, 19 bp, Homo sapiens
cccctctttcgtctactgc

SEQ ID NO: 6058475 - DNA, 18 bp, Homo sapiens
cccctctttctctttctt

SEQ ID NO: 6058476 - DNA, 16 bp, Homo sapiens
cccctctttgcacagc

SEQ ID NO: 6058477 - DNA, 18 bp, Homo sapiens
cccctcttttggccttgt

SEQ ID NO: 6058478 - DNA, 22 bp, Homo sapiens
cccctgaaacatgtgcccctgc

SEQ ID NO: 6058479 - DNA, 13 bp, Homo sapiens
cccctgaaactta

SEQ ID NO: 6058480 - DNA, 16 bp, Homo sapiens
cccctgaaacttattt

SEQ ID NO: 6058481 - DNA, 18 bp, Homo sapiens
cccctgaactggccccag

SEQ ID NO: 6058482 - DNA, 23 bp, Homo sapiens
cccctgaactggccccagctcct

SEQ ID NO: 6058483 - DNA, 23 bp, Homo sapiens
cccctgaagtgaccccagctcca

SEQ ID NO: 6058484 - DNA, 13 bp, Homo sapiens
cccctgaatttaa

SEQ ID NO: 6058485 - DNA, 17 bp, Homo sapiens
cccctgaatttaaatag

SEQ ID NO: 6058486 - DNA, 15 bp, Homo sapiens
cccctgacaacactc

SEQ ID NO: 6058487 - DNA, 16 bp, Homo sapiens
cccctgaccactcaga

SEQ ID NO: 6058488 - DNA, 22 bp, Homo sapiens
cccctgaccactcagagacatg

SEQ ID NO: 6058489 - DNA, 20 bp, Homo sapiens
cccctgacctaccccagcca

SEQ ID NO: 6058490 - DNA, 21 bp, Homo sapiens
cccctgacctaccccagccag

SEQ ID NO: 6058491 - DNA, 15 bp, Homo sapiens
cccctgacctgtcca

SEQ ID NO: 6058492 - DNA, 16 bp, Homo sapiens
cccctgacctgtccag

SEQ ID NO: 6058493 - DNA, 21 bp, Homo sapiens
cccctgagacaaatggaggcc

SEQ ID NO: 6058494 - DNA, 21 bp, Homo sapiens
cccctgagaccacccccaaac

SEQ ID NO: 6058495 - DNA, 14 bp, Homo sapiens
cccctgagagcctg

SEQ ID NO: 6058496 - DNA, 17 bp, Homo sapiens
cccctgagagtttcctc

SEQ ID NO: 6058497 - DNA, 21 bp, Homo sapiens
cccctgagagtttcctcagaa

SEQ ID NO: 6058498 - DNA, 22 bp, Homo sapiens
cccctgagagtttcctcagaac

SEQ ID NO: 6058499 - DNA, 17 bp, Homo sapiens
cccctgagatcccctga

SEQ ID NO: 6058500 - DNA, 20 bp, Homo sapiens
cccctgagatcccctgagcc

SEQ ID NO: 6058501 - DNA, 11 bp, Homo sapiens
cccctgagccc

SEQ ID NO: 6058502 - DNA, 14 bp, Homo sapiens
cccctgagcccact

SEQ ID NO: 6058503 - DNA, 15 bp, Homo sapiens
cccctgagcccagag

SEQ ID NO: 6058504 - DNA, 20 bp, Homo sapiens
cccctgagcctgtgtcctga

SEQ ID NO: 6058505 - DNA, 11 bp, Homo sapiens
cccctgaggac

SEQ ID NO: 6058506 - DNA, 14 bp, Homo sapiens
cccctgaggactgg

SEQ ID NO: 6058507 - DNA, 22 bp, Homo sapiens
cccctgaggcagcccagctcct

SEQ ID NO: 6058508 - DNA, 18 bp, Homo sapiens
cccctgagggtggtcagc

SEQ ID NO: 6058509 - DNA, 20 bp, Homo sapiens
cccctgagggtggtcagcca

SEQ ID NO: 6058510 - DNA, 20 bp, Homo sapiens
cccctgagtcaactggagca

SEQ ID NO: 6058511 - DNA, 22 bp, Homo sapiens
cccctgagttcccaaagggagg

SEQ ID NO: 6058512 - DNA, 23 bp, Homo sapiens
cccctgatacatgagccagtgat

SEQ ID NO: 6058513 - DNA, 20 bp, Homo sapiens
cccctgatcactcccagcac

SEQ ID NO: 6058514 - DNA, 15 bp, Homo sapiens
cccctgatctctgac

SEQ ID NO: 6058515 - DNA, 22 bp, Homo sapiens
cccctgatctctgacctctgct

SEQ ID NO: 6058516 - DNA, 18 bp, Homo sapiens
cccctgatgcccaggtca

SEQ ID NO: 6058517 - DNA, 16 bp, Homo sapiens
cccctgcaaagcccag

SEQ ID NO: 6058518 - DNA, 23 bp, Homo sapiens
cccctgcaagaagcgccgactcc

SEQ ID NO: 6058519 - DNA, 16 bp, Homo sapiens
cccctgcaatgcgtct

SEQ ID NO: 6058520 - DNA, 22 bp, Homo sapiens
cccctgcaatgcgtcttgtgaa

SEQ ID NO: 6058521 - DNA, 15 bp, Homo sapiens
cccctgcacacacct

SEQ ID NO: 6058522 - DNA, 18 bp, Homo sapiens
cccctgcacacacctgca

SEQ ID NO: 6058523 - DNA, 21 bp, Homo sapiens
cccctgcacacacctgcacac

SEQ ID NO: 6058524 - DNA, 21 bp, Homo sapiens
cccctgcacagcaggctgcca

SEQ ID NO: 6058525 - DNA, 14 bp, Homo sapiens
cccctgcacccacc

SEQ ID NO: 6058526 - DNA, 16 bp, Homo sapiens
cccctgcactaggcag

SEQ ID NO: 6058527 - DNA, 22 bp, Homo sapiens
cccctgcactggagtccagtct

SEQ ID NO: 6058528 - DNA, 14 bp, Homo sapiens
cccctgcactgtaa

SEQ ID NO: 6058529 - DNA, 20 bp, Homo sapiens
cccctgcagacgtctggccc

SEQ ID NO: 6058530 - DNA, 14 bp, Homo sapiens
cccctgcagcccag

SEQ ID NO: 6058531 - DNA, 14 bp, Homo sapiens
cccctgcagccctg

SEQ ID NO: 6058532 - DNA, 18 bp, Homo sapiens
cccctgcagcctgggtct

SEQ ID NO: 6058533 - DNA, 11 bp, Homo sapiens
cccctgcagct

SEQ ID NO: 6058534 - DNA, 23 bp, Homo sapiens
cccctgcagctggaatgtgccac

SEQ ID NO: 6058535 - DNA, 19 bp, Homo sapiens
cccctgcaggaaggagctg

SEQ ID NO: 6058536 - DNA, 20 bp, Homo sapiens
cccctgcaggaaggagctgc

SEQ ID NO: 6058537 - DNA, 23 bp, Homo sapiens
cccctgcaggaaggagctgcctg

SEQ ID NO: 6058538 - DNA, 19 bp, Homo sapiens
cccctgcagtttggccctg

SEQ ID NO: 6058539 - DNA, 16 bp, Homo sapiens
cccctgcatgcctggc

SEQ ID NO: 6058540 - DNA, 19 bp, Homo sapiens
cccctgccaaggccggaga

SEQ ID NO: 6058541 - DNA, 14 bp, Homo sapiens
cccctgccacactg

SEQ ID NO: 6058542 - DNA, 16 bp, Homo sapiens
cccctgccacactgat

SEQ ID NO: 6058543 - DNA, 18 bp, Homo sapiens
cccctgccaccgactgcc

SEQ ID NO: 6058544 - DNA, 21 bp, Homo sapiens
cccctgccacctccctgaccc

SEQ ID NO: 6058545 - DNA, 17 bp, Homo sapiens
cccctgccacgcaggcc

SEQ ID NO: 6058546 - DNA, 16 bp, Homo sapiens
cccctgccactcaccc

SEQ ID NO: 6058547 - DNA, 17 bp, Homo sapiens
cccctgccactcaccct

SEQ ID NO: 6058548 - DNA, 22 bp, Homo sapiens
cccctgccactcacccttcctg

SEQ ID NO: 6058549 - DNA, 10 bp, Homo sapiens
cccctgccag

SEQ ID NO: 6058550 - DNA, 18 bp, Homo sapiens
cccctgccagaggcctgg

SEQ ID NO: 6058551 - DNA, 22 bp, Homo sapiens
cccctgccagaggcctggtgcc

SEQ ID NO: 6058552 - DNA, 12 bp, Homo sapiens
cccctgccaggg

SEQ ID NO: 6058553 - DNA, 19 bp, Homo sapiens
cccctgccagggcagggcc

SEQ ID NO: 6058554 - DNA, 15 bp, Homo sapiens
cccctgccagggctc

SEQ ID NO: 6058555 - DNA, 17 bp, Homo sapiens
cccctgccagtgcctta

SEQ ID NO: 6058556 - DNA, 24 bp, Homo sapiens
cccctgcccaagtggctcttggga

SEQ ID NO: 6058557 - DNA, 13 bp, Homo sapiens
cccctgcccagca

SEQ ID NO: 6058558 - DNA, 20 bp, Homo sapiens
cccctgcccagcacctcctc

SEQ ID NO: 6058559 - DNA, 12 bp, Homo sapiens
cccctgccccag

SEQ ID NO: 6058560 - DNA, 14 bp, Homo sapiens
cccctgccccagag

SEQ ID NO: 6058561 - DNA, 14 bp, Homo sapiens
cccctgccccagcc

SEQ ID NO: 6058562 - DNA, 16 bp, Homo sapiens
cccctgccccagccca

SEQ ID NO: 6058563 - DNA, 18 bp, Homo sapiens
cccctgcccccaggactg

SEQ ID NO: 6058564 - DNA, 19 bp, Homo sapiens
cccctgcccccaggactgg

SEQ ID NO: 6058565 - DNA, 17 bp, Homo sapiens
cccctgccccccagcct

SEQ ID NO: 6058566 - DNA, 14 bp, Homo sapiens
cccctgccccgtca

SEQ ID NO: 6058567 - DNA, 22 bp, Homo sapiens
cccctgccccgtcaccatctca

SEQ ID NO: 6058568 - DNA, 19 bp, Homo sapiens
cccctgccccgtcccctgg

SEQ ID NO: 6058569 - DNA, 13 bp, Homo sapiens
cccctgcccctac

SEQ ID NO: 6058570 - DNA, 12 bp, Homo sapiens
cccctgcccctc

SEQ ID NO: 6058571 - DNA, 13 bp, Homo sapiens
cccctgcccgaga

SEQ ID NO: 6058572 - DNA, 19 bp, Homo sapiens
cccctgcccgagagctctt

SEQ ID NO: 6058573 - DNA, 17 bp, Homo sapiens
cccctgcccggctgcgg

SEQ ID NO: 6058574 - DNA, 13 bp, Homo sapiens
cccctgccctcgt

SEQ ID NO: 6058575 - DNA, 13 bp, Homo sapiens
cccctgccctgag

SEQ ID NO: 6058576 - DNA, 20 bp, Homo sapiens
cccctgccctgaggagggcc

SEQ ID NO: 6058577 - DNA, 17 bp, Homo sapiens
cccctgccctggggaga

SEQ ID NO: 6058578 - DNA, 12 bp, Homo sapiens
cccctgccctgt

SEQ ID NO: 6058579 - DNA, 13 bp, Homo sapiens
cccctgccctgtg

SEQ ID NO: 6058580 - DNA, 20 bp, Homo sapiens
cccctgccctgtgccgcact

SEQ ID NO: 6058581 - DNA, 14 bp, Homo sapiens
cccctgccctgtgg

SEQ ID NO: 6058582 - DNA, 13 bp, Homo sapiens
cccctgccgcctg

SEQ ID NO: 6058583 - DNA, 17 bp, Homo sapiens
cccctgccgcctgtgcc

SEQ ID NO: 6058584 - DNA, 21 bp, Homo sapiens
cccctgccggtgcacaggcct

SEQ ID NO: 6058585 - DNA, 22 bp, Homo sapiens
cccctgccggtgcacaggcctc

SEQ ID NO: 6058586 - DNA, 10 bp, Homo sapiens
cccctgcctc

SEQ ID NO: 6058587 - DNA, 12 bp, Homo sapiens
cccctgcctcca

SEQ ID NO: 6058588 - DNA, 18 bp, Homo sapiens
cccctgcctccaccctct

SEQ ID NO: 6058589 - DNA, 21 bp, Homo sapiens
cccctgcctccaccctctgag

SEQ ID NO: 6058590 - DNA, 15 bp, Homo sapiens
cccctgcctccatcc

SEQ ID NO: 6058591 - DNA, 14 bp, Homo sapiens
cccctgcctcctgc

SEQ ID NO: 6058592 - DNA, 17 bp, Homo sapiens
cccctgcctcctgccac

SEQ ID NO: 6058593 - DNA, 19 bp, Homo sapiens
cccctgcctcgagggccgc

SEQ ID NO: 6058594 - DNA, 19 bp, Homo sapiens
cccctgcctctatccctgg

SEQ ID NO: 6058595 - DNA, 16 bp, Homo sapiens
cccctgcctctctgca

SEQ ID NO: 6058596 - DNA, 20 bp, Homo sapiens
cccctgcctgacagccttcc

SEQ ID NO: 6058597 - DNA, 11 bp, Homo sapiens
cccctgcctgc

SEQ ID NO: 6058598 - DNA, 16 bp, Homo sapiens
cccctgcctgccatgt

SEQ ID NO: 6058599 - DNA, 15 bp, Homo sapiens
cccctgcctgccctg

SEQ ID NO: 6058600 - DNA, 12 bp, Homo sapiens
cccctgcctgga

SEQ ID NO: 6058601 - DNA, 15 bp, Homo sapiens
cccctgcctggaact

SEQ ID NO: 6058602 - DNA, 21 bp, Homo sapiens
cccctgcctgggttgggggca

SEQ ID NO: 6058603 - DNA, 15 bp, Homo sapiens
cccctgcctggttct

SEQ ID NO: 6058604 - DNA, 19 bp, Homo sapiens
cccctgccttaacctggga

SEQ ID NO: 6058605 - DNA, 14 bp, Homo sapiens
cccctgccttcctc

SEQ ID NO: 6058606 - DNA, 19 bp, Homo sapiens
cccctgccttcctctgagg

SEQ ID NO: 6058607 - DNA, 14 bp, Homo sapiens
cccctgcctttgtt

SEQ ID NO: 6058608 - DNA, 17 bp, Homo sapiens
cccctgcgcaggccctc

SEQ ID NO: 6058609 - DNA, 23 bp, Homo sapiens
cccctgcgccctccctccctcca

SEQ ID NO: 6058610 - DNA, 19 bp, Homo sapiens
cccctgcgtggcctgagtc

SEQ ID NO: 6058611 - DNA, 13 bp, Homo sapiens
cccctgctaagtg

SEQ ID NO: 6058612 - DNA, 15 bp, Homo sapiens
cccctgctaagtgtt

SEQ ID NO: 6058613 - DNA, 21 bp, Homo sapiens
cccctgctcactgggcccgag

SEQ ID NO: 6058614 - DNA, 23 bp, Homo sapiens
cccctgctctacccatgagcctg

SEQ ID NO: 6058615 - DNA, 12 bp, Homo sapiens
cccctgctgccc

SEQ ID NO: 6058616 - DNA, 16 bp, Homo sapiens
cccctgctgctcatcc

SEQ ID NO: 6058617 - DNA, 15 bp, Homo sapiens
cccctgctgctcctc

SEQ ID NO: 6058618 - DNA, 21 bp, Homo sapiens
cccctgctggctcttctgccc

SEQ ID NO: 6058619 - DNA, 14 bp, Homo sapiens
cccctgctggctgg

SEQ ID NO: 6058620 - DNA, 14 bp, Homo sapiens
cccctgctgggtgt

SEQ ID NO: 6058621 - DNA, 13 bp, Homo sapiens
cccctgctggtgc

SEQ ID NO: 6058622 - DNA, 17 bp, Homo sapiens
cccctgctggtgcccac

SEQ ID NO: 6058623 - DNA, 20 bp, Homo sapiens
cccctgctggttcagggttg

SEQ ID NO: 6058624 - DNA, 12 bp, Homo sapiens
cccctgctgtct

SEQ ID NO: 6058625 - DNA, 14 bp, Homo sapiens
cccctgctgtctct

SEQ ID NO: 6058626 - DNA, 15 bp, Homo sapiens
cccctgctgtgctgc

SEQ ID NO: 6058627 - DNA, 14 bp, Homo sapiens
cccctgcttctccc

SEQ ID NO: 6058628 - DNA, 14 bp, Homo sapiens
cccctgcttctggc

SEQ ID NO: 6058629 - DNA, 22 bp, Homo sapiens
cccctggaaccagcaagtccca

SEQ ID NO: 6058630 - DNA, 16 bp, Homo sapiens
cccctggaacctttcc

SEQ ID NO: 6058631 - DNA, 18 bp, Homo sapiens
cccctggaagagcccagt

SEQ ID NO: 6058632 - DNA, 18 bp, Homo sapiens
cccctggaagttgtcctt

SEQ ID NO: 6058633 - DNA, 22 bp, Homo sapiens
cccctggacagaggcggggcta

SEQ ID NO: 6058634 - DNA, 16 bp, Homo sapiens
cccctggacaggcttc

SEQ ID NO: 6058635 - DNA, 21 bp, Homo sapiens
cccctggacatgcctgtcctg

SEQ ID NO: 6058636 - DNA, 22 bp, Homo sapiens
cccctggacatgcctgtcctga

SEQ ID NO: 6058637 - DNA, 19 bp, Homo sapiens
cccctggaccaccagcccc

SEQ ID NO: 6058638 - DNA, 20 bp, Homo sapiens
cccctggaccaccagcccca

SEQ ID NO: 6058639 - DNA, 11 bp, Homo sapiens
cccctggaccc

SEQ ID NO: 6058640 - DNA, 18 bp, Homo sapiens
cccctggaccccagcctc

SEQ ID NO: 6058641 - DNA, 15 bp, Homo sapiens
cccctggacctggga

SEQ ID NO: 6058642 - DNA, 19 bp, Homo sapiens
cccctggacggggcgggcc

SEQ ID NO: 6058643 - DNA, 15 bp, Homo sapiens
cccctggagaaggtc

SEQ ID NO: 6058644 - DNA, 21 bp, Homo sapiens
cccctggagccagcagggctg

SEQ ID NO: 6058645 - DNA, 16 bp, Homo sapiens
cccctggagccccttc

SEQ ID NO: 6058646 - DNA, 22 bp, Homo sapiens
cccctggatgggcattgggctg

SEQ ID NO: 6058647 - DNA, 15 bp, Homo sapiens
cccctggatgtcccc

SEQ ID NO: 6058648 - DNA, 20 bp, Homo sapiens
cccctggatgtcccctgtcc

SEQ ID NO: 6058649 - DNA, 16 bp, Homo sapiens
cccctggcaaatgcac

SEQ ID NO: 6058650 - DNA, 19 bp, Homo sapiens
cccctggcacgtcctccac

SEQ ID NO: 6058651 - DNA, 15 bp, Homo sapiens
cccctggcactgcag

SEQ ID NO: 6058652 - DNA, 14 bp, Homo sapiens
cccctggcactggc

SEQ ID NO: 6058653 - DNA, 21 bp, Homo sapiens
cccctggcagagatgcctccc

SEQ ID NO: 6058654 - DNA, 16 bp, Homo sapiens
cccctggcatgtttca

SEQ ID NO: 6058655 - DNA, 14 bp, Homo sapiens
cccctggccacagc

SEQ ID NO: 6058656 - DNA, 16 bp, Homo sapiens
cccctggccacagcct

SEQ ID NO: 6058657 - DNA, 12 bp, Homo sapiens
cccctggccagc

SEQ ID NO: 6058658 - DNA, 13 bp, Homo sapiens
cccctggccagct

SEQ ID NO: 6058659 - DNA, 11 bp, Homo sapiens
cccctggccca

SEQ ID NO: 6058660 - DNA, 14 bp, Homo sapiens
cccctggcccagcg

SEQ ID NO: 6058661 - DNA, 16 bp, Homo sapiens
cccctggcccagcggc

SEQ ID NO: 6058662 - DNA, 17 bp, Homo sapiens
cccctggcccagcggcc

SEQ ID NO: 6058663 - DNA, 13 bp, Homo sapiens
cccctggcccagg

SEQ ID NO: 6058664 - DNA, 15 bp, Homo sapiens
cccctggcccatctc

SEQ ID NO: 6058665 - DNA, 21 bp, Homo sapiens
cccctggcccatctcagcctc

SEQ ID NO: 6058666 - DNA, 16 bp, Homo sapiens
cccctggccccgcctg

SEQ ID NO: 6058667 - DNA, 12 bp, Homo sapiens
cccctggcccct

SEQ ID NO: 6058668 - DNA, 13 bp, Homo sapiens
cccctggccctgc

SEQ ID NO: 6058669 - DNA, 14 bp, Homo sapiens
cccctggccctgcc

SEQ ID NO: 6058670 - DNA, 18 bp, Homo sapiens
cccctggccctgcctcac

SEQ ID NO: 6058671 - DNA, 18 bp, Homo sapiens
cccctggcccttccttca

SEQ ID NO: 6058672 - DNA, 11 bp, Homo sapiens
cccctggcctc

SEQ ID NO: 6058673 - DNA, 13 bp, Homo sapiens
cccctggcctccg

SEQ ID NO: 6058674 - DNA, 20 bp, Homo sapiens
cccctggcctgactcccatg

SEQ ID NO: 6058675 - DNA, 13 bp, Homo sapiens
cccctggcctgcc

SEQ ID NO: 6058676 - DNA, 15 bp, Homo sapiens
cccctggctaccttg

SEQ ID NO: 6058677 - DNA, 18 bp, Homo sapiens
cccctggctaccttgtgg

SEQ ID NO: 6058678 - DNA, 13 bp, Homo sapiens
cccctggctcctt

SEQ ID NO: 6058679 - DNA, 11 bp, Homo sapiens
cccctggctct

SEQ ID NO: 6058680 - DNA, 12 bp, Homo sapiens
cccctggctctg

SEQ ID NO: 6058681 - DNA, 17 bp, Homo sapiens
cccctggctgtttggac

SEQ ID NO: 6058682 - DNA, 20 bp, Homo sapiens
cccctggcttttcactgctg

SEQ ID NO: 6058683 - DNA, 23 bp, Homo sapiens
cccctggcttttcactgctggct

SEQ ID NO: 6058684 - DNA, 18 bp, Homo sapiens
cccctgggaacaggcccc

SEQ ID NO: 6058685 - DNA, 17 bp, Homo sapiens
cccctgggaactctcct

SEQ ID NO: 6058686 - DNA, 22 bp, Homo sapiens
cccctgggactaaagccaggaa

SEQ ID NO: 6058687 - DNA, 22 bp, Homo sapiens
cccctgggagacaactggacaa

SEQ ID NO: 6058688 - DNA, 13 bp, Homo sapiens
cccctgggagagt

SEQ ID NO: 6058689 - DNA, 12 bp, Homo sapiens
cccctgggatcc

SEQ ID NO: 6058690 - DNA, 17 bp, Homo sapiens
cccctgggatgctgacc

SEQ ID NO: 6058691 - DNA, 23 bp, Homo sapiens
cccctgggatgctgacccaggaa

SEQ ID NO: 6058692 - DNA, 22 bp, Homo sapiens
cccctgggcagatgtcccccac

SEQ ID NO: 6058693 - DNA, 15 bp, Homo sapiens
cccctgggcagggtt

SEQ ID NO: 6058694 - DNA, 19 bp, Homo sapiens
cccctgggccacccttcac

SEQ ID NO: 6058695 - DNA, 10 bp, Homo sapiens
cccctgggct

SEQ ID NO: 6058696 - DNA, 21 bp, Homo sapiens
cccctgggctaccatctgcat

SEQ ID NO: 6058697 - DNA, 23 bp, Homo sapiens
cccctgggctaccatctgcatgg

SEQ ID NO: 6058698 - DNA, 18 bp, Homo sapiens
cccctgggctctcaccca

SEQ ID NO: 6058699 - DNA, 15 bp, Homo sapiens
cccctgggctggggc

SEQ ID NO: 6058700 - DNA, 16 bp, Homo sapiens
cccctgggcttggcct

SEQ ID NO: 6058701 - DNA, 18 bp, Homo sapiens
cccctgggcttggcctgc

SEQ ID NO: 6058702 - DNA, 21 bp, Homo sapiens
cccctggggacagagccaccc

SEQ ID NO: 6058703 - DNA, 22 bp, Homo sapiens
cccctggggacagagccacccc

SEQ ID NO: 6058704 - DNA, 21 bp, Homo sapiens
cccctggggatcttgccccct

SEQ ID NO: 6058705 - DNA, 14 bp, Homo sapiens
cccctggggcccag

SEQ ID NO: 6058706 - DNA, 19 bp, Homo sapiens
cccctggggcccagcccct

SEQ ID NO: 6058707 - DNA, 12 bp, Homo sapiens
cccctggggcct

SEQ ID NO: 6058708 - DNA, 15 bp, Homo sapiens
cccctggggcctaga

SEQ ID NO: 6058709 - DNA, 14 bp, Homo sapiens
cccctggggctggt

SEQ ID NO: 6058710 - DNA, 16 bp, Homo sapiens
cccctggggctggtgg

SEQ ID NO: 6058711 - DNA, 23 bp, Homo sapiens
cccctggggctggtggattgggc

SEQ ID NO: 6058712 - DNA, 19 bp, Homo sapiens
cccctgggggaggcttcca

SEQ ID NO: 6058713 - DNA, 21 bp, Homo sapiens
cccctggggggcacagccaga

SEQ ID NO: 6058714 - DNA, 20 bp, Homo sapiens
cccctgggggtttcacctgg

SEQ ID NO: 6058715 - DNA, 13 bp, Homo sapiens
cccctggggtggc

SEQ ID NO: 6058716 - DNA, 19 bp, Homo sapiens
cccctggggtggccaccag

SEQ ID NO: 6058717 - DNA, 19 bp, Homo sapiens
cccctggggtggccagggc

SEQ ID NO: 6058718 - DNA, 21 bp, Homo sapiens
cccctggggtggccagggctt

SEQ ID NO: 6058719 - DNA, 21 bp, Homo sapiens
cccctggtcccctccttccca

SEQ ID NO: 6058720 - DNA, 15 bp, Homo sapiens
cccctggtctctggt

SEQ ID NO: 6058721 - DNA, 19 bp, Homo sapiens
cccctggtctgccctgggc

SEQ ID NO: 6058722 - DNA, 14 bp, Homo sapiens
cccctggtcttctc

SEQ ID NO: 6058723 - DNA, 19 bp, Homo sapiens
cccctggtggacagtcctg

SEQ ID NO: 6058724 - DNA, 17 bp, Homo sapiens
cccctggtggctgcagg

SEQ ID NO: 6058725 - DNA, 18 bp, Homo sapiens
cccctggtggctgcaggc

SEQ ID NO: 6058726 - DNA, 11 bp, Homo sapiens
cccctggtggg

SEQ ID NO: 6058727 - DNA, 20 bp, Homo sapiens
cccctggtggtcacaggctg

SEQ ID NO: 6058728 - DNA, 22 bp, Homo sapiens
cccctggtgtccctgcctggcc

SEQ ID NO: 6058729 - DNA, 23 bp, Homo sapiens
cccctgtaaatagttttaaatat

SEQ ID NO: 6058730 - DNA, 15 bp, Homo sapiens
cccctgtaaggttcc

SEQ ID NO: 6058731 - DNA, 21 bp, Homo sapiens
cccctgtaatcaggcaaggag

SEQ ID NO: 6058732 - DNA, 16 bp, Homo sapiens
cccctgtacacaactc

SEQ ID NO: 6058733 - DNA, 18 bp, Homo sapiens
cccctgtacatttgtgct

SEQ ID NO: 6058734 - DNA, 14 bp, Homo sapiens
cccctgtacccagc

SEQ ID NO: 6058735 - DNA, 20 bp, Homo sapiens
cccctgtagactagtgccgt

SEQ ID NO: 6058736 - DNA, 21 bp, Homo sapiens
cccctgtagggtttggacaga

SEQ ID NO: 6058737 - DNA, 12 bp, Homo sapiens
cccctgtcccac

SEQ ID NO: 6058738 - DNA, 17 bp, Homo sapiens
cccctgtcccaccaact

SEQ ID NO: 6058739 - DNA, 20 bp, Homo sapiens
cccctgtcccaccaactctg

SEQ ID NO: 6058740 - DNA, 20 bp, Homo sapiens
cccctgtcccacctggctcc

SEQ ID NO: 6058741 - DNA, 22 bp, Homo sapiens
cccctgtcccatgcaggccctt

SEQ ID NO: 6058742 - DNA, 14 bp, Homo sapiens
cccctgtcccattc

SEQ ID NO: 6058743 - DNA, 15 bp, Homo sapiens
cccctgtcccattct

SEQ ID NO: 6058744 - DNA, 14 bp, Homo sapiens
cccctgtccccaag

SEQ ID NO: 6058745 - DNA, 22 bp, Homo sapiens
cccctgtccccaagacacttcc

SEQ ID NO: 6058746 - DNA, 13 bp, Homo sapiens
cccctgtccccag

SEQ ID NO: 6058747 - DNA, 22 bp, Homo sapiens
cccctgtccccgcactgggctt

SEQ ID NO: 6058748 - DNA, 20 bp, Homo sapiens
cccctgtcccctcagctcca

SEQ ID NO: 6058749 - DNA, 13 bp, Homo sapiens
cccctgtcccctg

SEQ ID NO: 6058750 - DNA, 13 bp, Homo sapiens
cccctgtcctcac

SEQ ID NO: 6058751 - DNA, 23 bp, Homo sapiens
cccctgtcctgtgaatggaagca

SEQ ID NO: 6058752 - DNA, 12 bp, Homo sapiens
cccctgtccttc

SEQ ID NO: 6058753 - DNA, 21 bp, Homo sapiens
cccctgtcgcccacccagctg

SEQ ID NO: 6058754 - DNA, 23 bp, Homo sapiens
cccctgtcgcccacccagctggt

SEQ ID NO: 6058755 - DNA, 14 bp, Homo sapiens
cccctgtctagaga

SEQ ID NO: 6058756 - DNA, 17 bp, Homo sapiens
cccctgtctgttcccag

SEQ ID NO: 6058757 - DNA, 23 bp, Homo sapiens
cccctgtctgttcccagcccctg

SEQ ID NO: 6058758 - DNA, 17 bp, Homo sapiens
cccctgtcttcacctgc

SEQ ID NO: 6058759 - DNA, 20 bp, Homo sapiens
cccctgtcttcacctgccac

SEQ ID NO: 6058760 - DNA, 16 bp, Homo sapiens
cccctgtgactcctcc

SEQ ID NO: 6058761 - DNA, 17 bp, Homo sapiens
cccctgtgactcctccc

SEQ ID NO: 6058762 - DNA, 18 bp, Homo sapiens
cccctgtgactcctccct

SEQ ID NO: 6058763 - DNA, 19 bp, Homo sapiens
cccctgtgactcctccctt

SEQ ID NO: 6058764 - DNA, 15 bp, Homo sapiens
cccctgtgccagctc

SEQ ID NO: 6058765 - DNA, 15 bp, Homo sapiens
cccctgtgcccaccc

SEQ ID NO: 6058766 - DNA, 15 bp, Homo sapiens
cccctgtgccctgca

SEQ ID NO: 6058767 - DNA, 17 bp, Homo sapiens
cccctgtgcctctgtcc

SEQ ID NO: 6058768 - DNA, 24 bp, Homo sapiens
cccctgtgcctctgtcctagactc

SEQ ID NO: 6058769 - DNA, 13 bp, Homo sapiens
cccctgtgctgcg

SEQ ID NO: 6058770 - DNA, 19 bp, Homo sapiens
cccctgtggataccaaggt

SEQ ID NO: 6058771 - DNA, 20 bp, Homo sapiens
cccctgtggatgctgctgcc

SEQ ID NO: 6058772 - DNA, 22 bp, Homo sapiens
cccctgtggatgctgctgcccc

SEQ ID NO: 6058773 - DNA, 17 bp, Homo sapiens
cccctgtggcagaccgg

SEQ ID NO: 6058774 - DNA, 14 bp, Homo sapiens
cccctgtggccaac

SEQ ID NO: 6058775 - DNA, 18 bp, Homo sapiens
cccctgtggccctggcca

SEQ ID NO: 6058776 - DNA, 20 bp, Homo sapiens
cccctgtggggatctcaggg

SEQ ID NO: 6058777 - DNA, 24 bp, Homo sapiens
cccctgtggggatctcaggggctg

SEQ ID NO: 6058778 - DNA, 12 bp, Homo sapiens
cccctgtggtct

SEQ ID NO: 6058779 - DNA, 14 bp, Homo sapiens
cccctgtggtctgt

SEQ ID NO: 6058780 - DNA, 16 bp, Homo sapiens
cccctgtggtctgtgt

SEQ ID NO: 6058781 - DNA, 24 bp, Homo sapiens
cccctgtgtgagttgagtctcctc

SEQ ID NO: 6058782 - DNA, 17 bp, Homo sapiens
cccctgtttctcctcca

SEQ ID NO: 6058783 - DNA, 16 bp, Homo sapiens
cccctgttttctgctg

SEQ ID NO: 6058784 - DNA, 23 bp, Homo sapiens
ccccttaaacacaggctgtcctt

SEQ ID NO: 6058785 - DNA, 22 bp, Homo sapiens
ccccttaaatttctgccctgag

SEQ ID NO: 6058786 - DNA, 15 bp, Homo sapiens
ccccttaagccaaca

SEQ ID NO: 6058787 - DNA, 16 bp, Homo sapiens
ccccttaagccctggc

SEQ ID NO: 6058788 - DNA, 23 bp, Homo sapiens
ccccttaagggttgaaggcagtc

SEQ ID NO: 6058789 - DNA, 22 bp, Homo sapiens
ccccttaatcttgctttcttta

SEQ ID NO: 6058790 - DNA, 19 bp, Homo sapiens
ccccttactacttcttgga

SEQ ID NO: 6058791 - DNA, 21 bp, Homo sapiens
ccccttactatgatctcagga

SEQ ID NO: 6058792 - DNA, 19 bp, Homo sapiens
ccccttagaatgtttctat

SEQ ID NO: 6058793 - DNA, 24 bp, Homo sapiens
ccccttagacagaggccctcaagt

SEQ ID NO: 6058794 - DNA, 20 bp, Homo sapiens
ccccttagaggacctgagtt

SEQ ID NO: 6058795 - DNA, 17 bp, Homo sapiens
ccccttaggccccgtgg

SEQ ID NO: 6058796 - DNA, 15 bp, Homo sapiens
ccccttatcctccct

SEQ ID NO: 6058797 - DNA, 19 bp, Homo sapiens
ccccttattaaggccccag

SEQ ID NO: 6058798 - DNA, 14 bp, Homo sapiens
ccccttattgctgc

SEQ ID NO: 6058799 - DNA, 21 bp, Homo sapiens
ccccttattgctgccaaaacc

SEQ ID NO: 6058800 - DNA, 14 bp, Homo sapiens
ccccttcacaaagc

SEQ ID NO: 6058801 - DNA, 18 bp, Homo sapiens
ccacttcctcctacctgg

SEQ ID NO: 6058802 - DNA, 16 bp, Homo sapiens
ccacttcctgccccaa

SEQ ID NO: 6058803 - DNA, 13 bp, Homo sapiens
ccacttccttaac

SEQ ID NO: 6058804 - DNA, 18 bp, Homo sapiens
ccacttccttaacagctg

SEQ ID NO: 6058805 - DNA, 11 bp, Homo sapiens
ccacttccttt

SEQ ID NO: 6058806 - DNA, 16 bp, Homo sapiens
ccacttcctttcctac

SEQ ID NO: 6058807 - DNA, 12 bp, Homo sapiens
ccacttcctttg

SEQ ID NO: 6058808 - DNA, 18 bp, Homo sapiens
ccacttcgcacacaccca

SEQ ID NO: 6058809 - DNA, 18 bp, Homo sapiens
ccacttcggccaggtcac

SEQ ID NO: 6058810 - DNA, 20 bp, Homo sapiens
ccacttcggccaggtcacac

SEQ ID NO: 6058811 - DNA, 14 bp, Homo sapiens
ccacttctcatcac

SEQ ID NO: 6058812 - DNA, 19 bp, Homo sapiens
ccacttctcatcacacaca

SEQ ID NO: 6058813 - DNA, 15 bp, Homo sapiens
ccacttctcatctta

SEQ ID NO: 6058814 - DNA, 14 bp, Homo sapiens
ccacttctctccag

SEQ ID NO: 6058815 - DNA, 15 bp, Homo sapiens
ccacttctctgctgc

SEQ ID NO: 6058816 - DNA, 12 bp, Homo sapiens
ccacttctgcac

SEQ ID NO: 6058817 - DNA, 22 bp, Homo sapiens
ccacttctgcgatatttttcca

SEQ ID NO: 6058818 - DNA, 17 bp, Homo sapiens
ccacttctgcgggctcc

SEQ ID NO: 6058819 - DNA, 10 bp, Homo sapiens
ccacttctgg

SEQ ID NO: 6058820 - DNA, 12 bp, Homo sapiens
ccacttctggcc

SEQ ID NO: 6058821 - DNA, 16 bp, Homo sapiens
ccacttctggccacat

SEQ ID NO: 6058822 - DNA, 17 bp, Homo sapiens
ccacttctggcctccag

SEQ ID NO: 6058823 - DNA, 18 bp, Homo sapiens
ccacttctggcctccagc

SEQ ID NO: 6058824 - DNA, 20 bp, Homo sapiens
ccacttctggcctccagcct

SEQ ID NO: 6058825 - DNA, 22 bp, Homo sapiens
ccacttctggcctccagccttt

SEQ ID NO: 6058826 - DNA, 18 bp, Homo sapiens
ccacttctggcttcagcc

SEQ ID NO: 6058827 - DNA, 15 bp, Homo sapiens
ccacttctgggtggg

SEQ ID NO: 6058828 - DNA, 14 bp, Homo sapiens
ccacttctggtcaa

SEQ ID NO: 6058829 - DNA, 14 bp, Homo sapiens
ccacttctggtccc

SEQ ID NO: 6058830 - DNA, 13 bp, Homo sapiens
ccacttctgtcca

SEQ ID NO: 6058831 - DNA, 13 bp, Homo sapiens
ccacttctgtggg

SEQ ID NO: 6058832 - DNA, 18 bp, Homo sapiens
ccacttctgtgggcatgg

SEQ ID NO: 6058833 - DNA, 21 bp, Homo sapiens
ccacttctgtgggcatggccg

SEQ ID NO: 6058834 - DNA, 22 bp, Homo sapiens
ccacttcttaaaggcctggaac

SEQ ID NO: 6058835 - DNA, 13 bp, Homo sapiens
ccacttcttcctt

SEQ ID NO: 6058836 - DNA, 17 bp, Homo sapiens
ccacttcttggttcctg

SEQ ID NO: 6058837 - DNA, 20 bp, Homo sapiens
ccacttcttggttcctggga

SEQ ID NO: 6058838 - DNA, 14 bp, Homo sapiens
ccacttgaaatgtt

SEQ ID NO: 6058839 - DNA, 21 bp, Homo sapiens
ccacttgacattccttgtcac

SEQ ID NO: 6058840 - DNA, 13 bp, Homo sapiens
ccacttgacctga

SEQ ID NO: 6058841 - DNA, 13 bp, Homo sapiens
ccacttgagccta

SEQ ID NO: 6058842 - DNA, 18 bp, Homo sapiens
ccacttgagtgtcaagct

SEQ ID NO: 6058843 - DNA, 23 bp, Homo sapiens
ccacttgatatgactaattcagg

SEQ ID NO: 6058844 - DNA, 18 bp, Homo sapiens
ccacttgatgtctgagga

SEQ ID NO: 6058845 - DNA, 14 bp, Homo sapiens
ccacttgattgaga

SEQ ID NO: 6058846 - DNA, 16 bp, Homo sapiens
ccacttgattgagaaa

SEQ ID NO: 6058847 - DNA, 16 bp, Homo sapiens
ccacttgcactgtgct

SEQ ID NO: 6058848 - DNA, 17 bp, Homo sapiens
ccacttgcactgtgctt

SEQ ID NO: 6058849 - DNA, 12 bp, Homo sapiens
ccacttgccctg

SEQ ID NO: 6058850 - DNA, 15 bp, Homo sapiens
ccacttgccctgtgt

SEQ ID NO: 6058851 - DNA, 16 bp, Homo sapiens
ccacttgcctcttcct

SEQ ID NO: 6058852 - DNA, 15 bp, Homo sapiens
ccacttgcctggggc

SEQ ID NO: 6058853 - DNA, 24 bp, Homo sapiens
ccacttgctcagacgagacaccct

SEQ ID NO: 6058854 - DNA, 16 bp, Homo sapiens
ccacttggaaatggca

SEQ ID NO: 6058855 - DNA, 16 bp, Homo sapiens
ccacttggacatgggc

SEQ ID NO: 6058856 - DNA, 12 bp, Homo sapiens
ccacttggccaa

SEQ ID NO: 6058857 - DNA, 19 bp, Homo sapiens
ccacttggccaccaggact

SEQ ID NO: 6058858 - DNA, 20 bp, Homo sapiens
ccacttgggactagatcaca

SEQ ID NO: 6058859 - DNA, 13 bp, Homo sapiens
ccacttgggagct

SEQ ID NO: 6058860 - DNA, 17 bp, Homo sapiens
ccacttggtctgtgaga

SEQ ID NO: 6058861 - DNA, 21 bp, Homo sapiens
ccacttgtatatatggatcag

SEQ ID NO: 6058862 - DNA, 19 bp, Homo sapiens
ccacttgtcaaagaaggtg

SEQ ID NO: 6058863 - DNA, 18 bp, Homo sapiens
ccacttgtcactgacaca

SEQ ID NO: 6058864 - DNA, 19 bp, Homo sapiens
ccacttgtcccactatctg

SEQ ID NO: 6058865 - DNA, 21 bp, Homo sapiens
ccacttgtccgctgggtggta

SEQ ID NO: 6058866 - DNA, 14 bp, Homo sapiens
ccacttgtgggtcc

SEQ ID NO: 6058867 - DNA, 15 bp, Homo sapiens
ccacttgtgggtcct

SEQ ID NO: 6058868 - DNA, 20 bp, Homo sapiens
ccacttgttcattctgtgac

SEQ ID NO: 6058869 - DNA, 15 bp, Homo sapiens
ccacttgtttgcact

SEQ ID NO: 6058870 - DNA, 18 bp, Homo sapiens
ccactttacccacctaga

SEQ ID NO: 6058871 - DNA, 23 bp, Homo sapiens
ccactttcagagcccccagccct

SEQ ID NO: 6058872 - DNA, 14 bp, Homo sapiens
ccactttcagctgt

SEQ ID NO: 6058873 - DNA, 15 bp, Homo sapiens
ccactttcagctgtc

SEQ ID NO: 6058874 - DNA, 18 bp, Homo sapiens
ccactttcatctaccttt

SEQ ID NO: 6058875 - DNA, 20 bp, Homo sapiens
ccactttcatctggggtggg

SEQ ID NO: 6058876 - DNA, 21 bp, Homo sapiens
ccactttcatctggggtgggg

SEQ ID NO: 6058877 - DNA, 16 bp, Homo sapiens
ccactttccaccaact

SEQ ID NO: 6058878 - DNA, 23 bp, Homo sapiens
ccactttccaccaactttttcca

SEQ ID NO: 6058879 - DNA, 16 bp, Homo sapiens
ccactttcccttcccc

SEQ ID NO: 6058880 - DNA, 20 bp, Homo sapiens
ccactttcccttcccctgtg

SEQ ID NO: 6058881 - DNA, 21 bp, Homo sapiens
ccactttcctgagctgtcgct

SEQ ID NO: 6058882 - DNA, 18 bp, Homo sapiens
ccactttcgcctcctcca

SEQ ID NO: 6058883 - DNA, 22 bp, Homo sapiens
ccactttcgcctcctccagctc

SEQ ID NO: 6058884 - DNA, 24 bp, Homo sapiens
ccactttcgcctcctccagctcct

SEQ ID NO: 6058885 - DNA, 13 bp, Homo sapiens
ccactttctgttc

SEQ ID NO: 6058886 - DNA, 14 bp, Homo sapiens
ccactttctgttcc

SEQ ID NO: 6058887 - DNA, 13 bp, Homo sapiens
ccactttctttct

SEQ ID NO: 6058888 - DNA, 16 bp, Homo sapiens
ccactttctttctttc

SEQ ID NO: 6058889 - DNA, 14 bp, Homo sapiens
ccactttgactcag

SEQ ID NO: 6058890 - DNA, 18 bp, Homo sapiens
ccactttgactcagaggc

SEQ ID NO: 6058891 - DNA, 14 bp, Homo sapiens
ccactttgcacatt

SEQ ID NO: 6058892 - DNA, 19 bp, Homo sapiens
ccactttgcacattttgat

SEQ ID NO: 6058893 - DNA, 23 bp, Homo sapiens
ccactttgcacgacgccctctcc

SEQ ID NO: 6058894 - DNA, 17 bp, Homo sapiens
ccactttgcagacctgg

SEQ ID NO: 6058895 - DNA, 19 bp, Homo sapiens
ccactttgcagacctggga

SEQ ID NO: 6058896 - DNA, 23 bp, Homo sapiens
ccactttgcagacctgggacttt

SEQ ID NO: 6058897 - DNA, 20 bp, Homo sapiens
ccactttgcagctaaaataa

SEQ ID NO: 6058898 - DNA, 19 bp, Homo sapiens
ccactttggagactggggt

SEQ ID NO: 6058899 - DNA, 21 bp, Homo sapiens
ccactttggcttctcctgtga

SEQ ID NO: 6058900 - DNA, 13 bp, Homo sapiens
ccactttggggaa

SEQ ID NO: 6058901 - DNA, 21 bp, Homo sapiens
ccactttggtacatggccagt

SEQ ID NO: 6058902 - DNA, 18 bp, Homo sapiens
ccactttgtataaatttt

SEQ ID NO: 6058903 - DNA, 15 bp, Homo sapiens
ccactttgtctgtac

SEQ ID NO: 6058904 - DNA, 20 bp, Homo sapiens
ccactttgttctttaggaga

SEQ ID NO: 6058905 - DNA, 16 bp, Homo sapiens
ccactttgttggccct

SEQ ID NO: 6058906 - DNA, 22 bp, Homo sapiens
ccactttgttggcccttccagt

SEQ ID NO: 6058907 - DNA, 12 bp, Homo sapiens
ccacttttccag

SEQ ID NO: 6058908 - DNA, 20 bp, Homo sapiens
ccacttttcttcttcctggt

SEQ ID NO: 6058909 - DNA, 21 bp, Homo sapiens
ccacttttgcccacctcttct

SEQ ID NO: 6058910 - DNA, 15 bp, Homo sapiens
ccacttttgttcttg

SEQ ID NO: 6058911 - DNA, 15 bp, Homo sapiens
ccactttttccagaa

SEQ ID NO: 6058912 - DNA, 22 bp, Homo sapiens
ccactttttccagaatttgaat

SEQ ID NO: 6058913 - DNA, 15 bp, Homo sapiens
ccactttttgcagct

SEQ ID NO: 6058914 - DNA, 21 bp, Homo sapiens
ccactttttggtaatatatat

SEQ ID NO: 6058915 - DNA, 13 bp, Homo sapiens
ccacttttttcat

SEQ ID NO: 6058916 - DNA, 17 bp, Homo sapiens
ccactttttttttttct

SEQ ID NO: 6058917 - DNA, 19 bp, Homo sapiens
ccactttttttttttctgc

SEQ ID NO: 6058918 - DNA, 21 bp, Homo sapiens
ccagaaaaaaagcccaacaca

SEQ ID NO: 6058919 - DNA, 20 bp, Homo sapiens
ccagaaaaaaataactattt

SEQ ID NO: 6058920 - DNA, 21 bp, Homo sapiens
ccagaaaaaaataactatttt

SEQ ID NO: 6058921 - DNA, 18 bp, Homo sapiens
ccagaaaaagaagaagga

SEQ ID NO: 6058922 - DNA, 16 bp, Homo sapiens
ccagaaaacaaaactg

SEQ ID NO: 6058923 - DNA, 16 bp, Homo sapiens
ccagaaaaccccagca

SEQ ID NO: 6058924 - DNA, 16 bp, Homo sapiens
ccagaaaacctccagt

SEQ ID NO: 6058925 - DNA, 18 bp, Homo sapiens
ccagaaaacctccagtag

SEQ ID NO: 6058926 - DNA, 18 bp, Homo sapiens
ccagaaaaggcagccaga

SEQ ID NO: 6058927 - DNA, 21 bp, Homo sapiens
ccagaaaatagggtggacaga

SEQ ID NO: 6058928 - DNA, 12 bp, Homo sapiens
ccagaaaatata

SEQ ID NO: 6058929 - DNA, 17 bp, Homo sapiens
ccagaaaatataaatgc

SEQ ID NO: 6058930 - DNA, 18 bp, Homo sapiens
ccagaaaatataaatgca

SEQ ID NO: 6058931 - DNA, 22 bp, Homo sapiens
ccagaaaatataaatgcatgat

SEQ ID NO: 6058932 - DNA, 14 bp, Homo sapiens
ccagaaaatgaaat

SEQ ID NO: 6058933 - DNA, 18 bp, Homo sapiens
ccagaaaatttttgtctt

SEQ ID NO: 6058934 - DNA, 21 bp, Homo sapiens
ccagaaacacccacaggcatg

SEQ ID NO: 6058935 - DNA, 19 bp, Homo sapiens
ccagaaacacccctctgtc

SEQ ID NO: 6058936 - DNA, 17 bp, Homo sapiens
ccagaaacagctgcttc

SEQ ID NO: 6058937 - DNA, 22 bp, Homo sapiens
ccagaaacagctgcttctcccc

SEQ ID NO: 6058938 - DNA, 15 bp, Homo sapiens
ccagaaacagggaca

SEQ ID NO: 6058939 - DNA, 21 bp, Homo sapiens
ccagaaacagtgggagccctg

SEQ ID NO: 6058940 - DNA, 22 bp, Homo sapiens
ccagaaacatctctggcccaga

SEQ ID NO: 6058941 - DNA, 23 bp, Homo sapiens
ccagaaaccaaactaggagatga

SEQ ID NO: 6058942 - DNA, 19 bp, Homo sapiens
ccagaaacctgggagagac

SEQ ID NO: 6058943 - DNA, 11 bp, Homo sapiens
ccagaaagagg

SEQ ID NO: 6058944 - DNA, 13 bp, Homo sapiens
ccagaaagaggaa

SEQ ID NO: 6058945 - DNA, 22 bp, Homo sapiens
ccagaaagaggaataaaatgat

SEQ ID NO: 6058946 - DNA, 21 bp, Homo sapiens
ccagaaagcaggagcagctgt

SEQ ID NO: 6058947 - DNA, 23 bp, Homo sapiens
ccagaaagccccacccaggccag

SEQ ID NO: 6058948 - DNA, 19 bp, Homo sapiens
ccagaaagcctcctgcccc

SEQ ID NO: 6058949 - DNA, 23 bp, Homo sapiens
ccagaaagcctcctgccccctgc

SEQ ID NO: 6058950 - DNA, 18 bp, Homo sapiens
ccagaaagcctctctctc

SEQ ID NO: 6058951 - DNA, 13 bp, Homo sapiens
ccagaaagctgag

SEQ ID NO: 6058952 - DNA, 13 bp, Homo sapiens
ccagaaagctgcc

SEQ ID NO: 6058953 - DNA, 15 bp, Homo sapiens
ccagaaagctgccag

SEQ ID NO: 6058954 - DNA, 16 bp, Homo sapiens
ccagaaaggatattta

SEQ ID NO: 6058955 - DNA, 23 bp, Homo sapiens
ccagaaagggtgccagttgggct

SEQ ID NO: 6058956 - DNA, 13 bp, Homo sapiens
ccagaaaggtgtg

SEQ ID NO: 6058957 - DNA, 14 bp, Homo sapiens
ccagaaaggtgtga

SEQ ID NO: 6058958 - DNA, 19 bp, Homo sapiens
ccagaaaggtgtgaggaga

SEQ ID NO: 6058959 - DNA, 20 bp, Homo sapiens
ccagaaaggtgtgaggagag

SEQ ID NO: 6058960 - DNA, 13 bp, Homo sapiens
ccagaaagtcccc

SEQ ID NO: 6058961 - DNA, 19 bp, Homo sapiens
ccagaaagtcccccctcgc

SEQ ID NO: 6058962 - DNA, 23 bp, Homo sapiens
ccagaaagttgtgtaggcaccac

SEQ ID NO: 6058963 - DNA, 20 bp, Homo sapiens
ccagaaataaaacaactctg

SEQ ID NO: 6058964 - DNA, 17 bp, Homo sapiens
ccagaaataaagggacc

SEQ ID NO: 6058965 - DNA, 13 bp, Homo sapiens
ccagaaatcactg

SEQ ID NO: 6058966 - DNA, 14 bp, Homo sapiens
ccagaaatcactgt

SEQ ID NO: 6058967 - DNA, 17 bp, Homo sapiens
ccagaaatcactgtgaa

SEQ ID NO: 6058968 - DNA, 18 bp, Homo sapiens
ccagaaatcactgtgaaa

SEQ ID NO: 6058969 - DNA, 22 bp, Homo sapiens
ccagaaatccatctaaatacct

SEQ ID NO: 6058970 - DNA, 16 bp, Homo sapiens
ccagaaatgccgctgt

SEQ ID NO: 6058971 - DNA, 18 bp, Homo sapiens
ccagaaatgccgctgtgt

SEQ ID NO: 6058972 - DNA, 18 bp, Homo sapiens
ccagaaatggtgagatgt

SEQ ID NO: 6058973 - DNA, 22 bp, Homo sapiens
ccagaaatgtctaaatgctgaa

SEQ ID NO: 6058974 - DNA, 10 bp, Homo sapiens
ccagaaattc

SEQ ID NO: 6058975 - DNA, 17 bp, Homo sapiens
ccagaaattccttccca

SEQ ID NO: 6058976 - DNA, 22 bp, Homo sapiens
ccagaaattctggcccagccaa

SEQ ID NO: 6058977 - DNA, 17 bp, Homo sapiens
ccagaacaaaaagaaat

SEQ ID NO: 6058978 - DNA, 15 bp, Homo sapiens
ccagaacaaaagata

SEQ ID NO: 6058979 - DNA, 19 bp, Homo sapiens
ccagaacaattctgcagag

SEQ ID NO: 6058980 - DNA, 18 bp, Homo sapiens
ccccttcacaccataact

SEQ ID NO: 6058981 - DNA, 18 bp, Homo sapiens
ccccttcagccgagccca

SEQ ID NO: 6058982 - DNA, 13 bp, Homo sapiens
ccccttcaggagc

SEQ ID NO: 6058983 - DNA, 22 bp, Homo sapiens
ccccttccagatcactgccaca

SEQ ID NO: 6058984 - DNA, 23 bp, Homo sapiens
ccccttccagctccctcccctgc

SEQ ID NO: 6058985 - DNA, 16 bp, Homo sapiens
ccccttccatcccaga

SEQ ID NO: 6058986 - DNA, 13 bp, Homo sapiens
ccccttccatgga

SEQ ID NO: 6058987 - DNA, 17 bp, Homo sapiens
ccccttccatttctgcc

SEQ ID NO: 6058988 - DNA, 14 bp, Homo sapiens
ccccttcccacccc

SEQ ID NO: 6058989 - DNA, 12 bp, Homo sapiens
ccccttcccaga

SEQ ID NO: 6058990 - DNA, 14 bp, Homo sapiens
ccccttcccagcca

SEQ ID NO: 6058991 - DNA, 11 bp, Homo sapiens
ccccttcccat

SEQ ID NO: 6058992 - DNA, 13 bp, Homo sapiens
ccccttccccact

SEQ ID NO: 6058993 - DNA, 21 bp, Homo sapiens
ccccttccccactgcctgccc

SEQ ID NO: 6058994 - DNA, 14 bp, Homo sapiens
ccccttccccaggc

SEQ ID NO: 6058995 - DNA, 16 bp, Homo sapiens
ccccttccccatctcc

SEQ ID NO: 6058996 - DNA, 11 bp, Homo sapiens
ccccttcccct

SEQ ID NO: 6058997 - DNA, 16 bp, Homo sapiens
ccccttcccctcccct

SEQ ID NO: 6058998 - DNA, 21 bp, Homo sapiens
ccccttcccctcccctccttg

SEQ ID NO: 6058999 - DNA, 15 bp, Homo sapiens
ccccttcccctgctg

SEQ ID NO: 6059000 - DNA, 14 bp, Homo sapiens
ccccttcccctggg

SEQ ID NO: 6059001 - DNA, 15 bp, Homo sapiens
ccccttcccctggga

SEQ ID NO: 6059002 - DNA, 16 bp, Homo sapiens
ccccttcccgccttcc

SEQ ID NO: 6059003 - DNA, 21 bp, Homo sapiens
ccccttccctctctccctgcc

SEQ ID NO: 6059004 - DNA, 16 bp, Homo sapiens
ccccttccctggcagg

SEQ ID NO: 6059005 - DNA, 15 bp, Homo sapiens
ccccttccctgggag

SEQ ID NO: 6059006 - DNA, 17 bp, Homo sapiens
ccccttccctggggagc

SEQ ID NO: 6059007 - DNA, 15 bp, Homo sapiens
ccccttcccttggag

SEQ ID NO: 6059008 - DNA, 20 bp, Homo sapiens
ccccttcctaattccacagc

SEQ ID NO: 6059009 - DNA, 21 bp, Homo sapiens
ccccttcctaattccacagct

SEQ ID NO: 6059010 - DNA, 22 bp, Homo sapiens
ccccttcctaattccacagctg

SEQ ID NO: 6059011 - DNA, 14 bp, Homo sapiens
ccccttcctaccac

SEQ ID NO: 6059012 - DNA, 22 bp, Homo sapiens
ccccttcctccccaacctgcaa

SEQ ID NO: 6059013 - DNA, 13 bp, Homo sapiens
ccccttcctgcac

SEQ ID NO: 6059014 - DNA, 13 bp, Homo sapiens
ccccttcctggca

SEQ ID NO: 6059015 - DNA, 17 bp, Homo sapiens
ccccttcctgtcctgcc

SEQ ID NO: 6059016 - DNA, 15 bp, Homo sapiens
ccccttcctgtctgg

SEQ ID NO: 6059017 - DNA, 21 bp, Homo sapiens
ccccttcctgtctggcccaaa

SEQ ID NO: 6059018 - DNA, 13 bp, Homo sapiens
ccccttcctgttc

SEQ ID NO: 6059019 - DNA, 20 bp, Homo sapiens
ccccttcctgtttcagaccc

SEQ ID NO: 6059020 - DNA, 14 bp, Homo sapiens
ccccttcctttcct

SEQ ID NO: 6059021 - DNA, 19 bp, Homo sapiens
ccccttcctttggtgcctc

SEQ ID NO: 6059022 - DNA, 15 bp, Homo sapiens
ccccttcgctcctcc

SEQ ID NO: 6059023 - DNA, 19 bp, Homo sapiens
ccccttctacactctcctg

SEQ ID NO: 6059024 - DNA, 20 bp, Homo sapiens
ccccttctacactctcctgg

SEQ ID NO: 6059025 - DNA, 21 bp, Homo sapiens
ccccttctacactctcctggg

SEQ ID NO: 6059026 - DNA, 22 bp, Homo sapiens
ccccttctacactctcctgggc

SEQ ID NO: 6059027 - DNA, 23 bp, Homo sapiens
ccccttctacactctcctgggcc

SEQ ID NO: 6059028 - DNA, 18 bp, Homo sapiens
ccccttctatttggggct

SEQ ID NO: 6059029 - DNA, 12 bp, Homo sapiens
ccccttctccca

SEQ ID NO: 6059030 - DNA, 16 bp, Homo sapiens
ccccttctcccacact

SEQ ID NO: 6059031 - DNA, 13 bp, Homo sapiens
ccccttctcccct

SEQ ID NO: 6059032 - DNA, 17 bp, Homo sapiens
ccccttctccccttcct

SEQ ID NO: 6059033 - DNA, 21 bp, Homo sapiens
ccccttctccccttcctggac

SEQ ID NO: 6059034 - DNA, 13 bp, Homo sapiens
ccccttctctcat

SEQ ID NO: 6059035 - DNA, 16 bp, Homo sapiens
ccccttctctccctgc

SEQ ID NO: 6059036 - DNA, 16 bp, Homo sapiens
ccccttctctgctcca

SEQ ID NO: 6059037 - DNA, 16 bp, Homo sapiens
ccccttctgacccatg

SEQ ID NO: 6059038 - DNA, 20 bp, Homo sapiens
ccccttctgctcagctctgg

SEQ ID NO: 6059039 - DNA, 14 bp, Homo sapiens
ccccttctgtgtca

SEQ ID NO: 6059040 - DNA, 13 bp, Homo sapiens
ccccttctgtgtt

SEQ ID NO: 6059041 - DNA, 12 bp, Homo sapiens
ccccttcttccc

SEQ ID NO: 6059042 - DNA, 13 bp, Homo sapiens
ccccttcttcctc

SEQ ID NO: 6059043 - DNA, 20 bp, Homo sapiens
ccccttcttcctcccctcaa

SEQ ID NO: 6059044 - DNA, 20 bp, Homo sapiens
ccccttcttgggccccagac

SEQ ID NO: 6059045 - DNA, 19 bp, Homo sapiens
ccccttgaagcaataactc

SEQ ID NO: 6059046 - DNA, 18 bp, Homo sapiens
ccccttgaatctgcaggg

SEQ ID NO: 6059047 - DNA, 16 bp, Homo sapiens
ccccttgaccccacac

SEQ ID NO: 6059048 - DNA, 20 bp, Homo sapiens
ccccttgatcgacttcttgg

SEQ ID NO: 6059049 - DNA, 20 bp, Homo sapiens
ccccttgattcccataacat

SEQ ID NO: 6059050 - DNA, 14 bp, Homo sapiens
ccccttgccacccc

SEQ ID NO: 6059051 - DNA, 21 bp, Homo sapiens
ccccttgccagctgctgagcc

SEQ ID NO: 6059052 - DNA, 16 bp, Homo sapiens
ccccttgcccaggcct

SEQ ID NO: 6059053 - DNA, 13 bp, Homo sapiens
ccccttgccccac

SEQ ID NO: 6059054 - DNA, 14 bp, Homo sapiens
ccccttgccctccg

SEQ ID NO: 6059055 - DNA, 18 bp, Homo sapiens
ccccttgccctccgcctg

SEQ ID NO: 6059056 - DNA, 17 bp, Homo sapiens
ccccttgcccttcctga

SEQ ID NO: 6059057 - DNA, 17 bp, Homo sapiens
ccccttgcccttgccct

SEQ ID NO: 6059058 - DNA, 23 bp, Homo sapiens
ccccttgcccttgccctgacctc

SEQ ID NO: 6059059 - DNA, 14 bp, Homo sapiens
ccccttgctctctg

SEQ ID NO: 6059060 - DNA, 23 bp, Homo sapiens
ccccttgctgatgctcctccggg

SEQ ID NO: 6059061 - DNA, 21 bp, Homo sapiens
ccccttgctgctggctcccat

SEQ ID NO: 6059062 - DNA, 13 bp, Homo sapiens
ccccttgcttcta

SEQ ID NO: 6059063 - DNA, 14 bp, Homo sapiens
ccccttgcttctca

SEQ ID NO: 6059064 - DNA, 14 bp, Homo sapiens
ccccttggacctcc

SEQ ID NO: 6059065 - DNA, 21 bp, Homo sapiens
ccccttggaggagagagaccc

SEQ ID NO: 6059066 - DNA, 14 bp, Homo sapiens
ccccttggctggat

SEQ ID NO: 6059067 - DNA, 16 bp, Homo sapiens
ccccttgggcatccac

SEQ ID NO: 6059068 - DNA, 20 bp, Homo sapiens
ccccttgggcctcccactcc

SEQ ID NO: 6059069 - DNA, 16 bp, Homo sapiens
ccccttggttctgcac

SEQ ID NO: 6059070 - DNA, 18 bp, Homo sapiens
ccccttggttctgcactg

SEQ ID NO: 6059071 - DNA, 21 bp, Homo sapiens
ccccttgtcctgaagcccagc

SEQ ID NO: 6059072 - DNA, 14 bp, Homo sapiens
ccccttgtctgctg

SEQ ID NO: 6059073 - DNA, 14 bp, Homo sapiens
ccccttgtcttccc

SEQ ID NO: 6059074 - DNA, 15 bp, Homo sapiens
ccccttgtcttcccc

SEQ ID NO: 6059075 - DNA, 16 bp, Homo sapiens
ccccttgttgcactgc

SEQ ID NO: 6059076 - DNA, 19 bp, Homo sapiens
ccccttgtttctgttgttc

SEQ ID NO: 6059077 - DNA, 19 bp, Homo sapiens
cccctttaaatcaccatag

SEQ ID NO: 6059078 - DNA, 20 bp, Homo sapiens
cccctttactcagcccagct

SEQ ID NO: 6059079 - DNA, 19 bp, Homo sapiens
cccctttactcgtgcatta

SEQ ID NO: 6059080 - DNA, 22 bp, Homo sapiens
cccctttatcgcattgctgtcc

SEQ ID NO: 6059081 - DNA, 21 bp, Homo sapiens
cccctttatgtacaggatgct

SEQ ID NO: 6059082 - DNA, 17 bp, Homo sapiens
cccctttcacactggat

SEQ ID NO: 6059083 - DNA, 24 bp, Homo sapiens
cccctttcagatgtcttctgcctg

SEQ ID NO: 6059084 - DNA, 14 bp, Homo sapiens
cccctttcaggcct

SEQ ID NO: 6059085 - DNA, 12 bp, Homo sapiens
cccctttcccat

SEQ ID NO: 6059086 - DNA, 18 bp, Homo sapiens
cccctttcccatcacccc

SEQ ID NO: 6059087 - DNA, 22 bp, Homo sapiens
cccctttcccatcaccccttcc

SEQ ID NO: 6059088 - DNA, 10 bp, Homo sapiens
cccctttcct

SEQ ID NO: 6059089 - DNA, 14 bp, Homo sapiens
cccctttcctcccc

SEQ ID NO: 6059090 - DNA, 23 bp, Homo sapiens
cccctttcctggacactcagacc

SEQ ID NO: 6059091 - DNA, 18 bp, Homo sapiens
cccctttctctgcctggc

SEQ ID NO: 6059092 - DNA, 10 bp, Homo sapiens
cccctttctt

SEQ ID NO: 6059093 - DNA, 16 bp, Homo sapiens
cccctttcttccccac

SEQ ID NO: 6059094 - DNA, 13 bp, Homo sapiens
cccctttcttcct

SEQ ID NO: 6059095 - DNA, 16 bp, Homo sapiens
cccctttgcctctgtc

SEQ ID NO: 6059096 - DNA, 18 bp, Homo sapiens
cccctttgctgaccctcc

SEQ ID NO: 6059097 - DNA, 17 bp, Homo sapiens
cccctttgggcccaggg

SEQ ID NO: 6059098 - DNA, 14 bp, Homo sapiens
cccctttgggccct

SEQ ID NO: 6059099 - DNA, 15 bp, Homo sapiens
cccctttgggccctg

SEQ ID NO: 6059100 - DNA, 18 bp, Homo sapiens
cccctttgggccctgcat

SEQ ID NO: 6059101 - DNA, 14 bp, Homo sapiens
cccctttggggtag

SEQ ID NO: 6059102 - DNA, 20 bp, Homo sapiens
cccctttggtttggcctcca

SEQ ID NO: 6059103 - DNA, 22 bp, Homo sapiens
cccctttgtcctgcgttttctc

SEQ ID NO: 6059104 - DNA, 13 bp, Homo sapiens
cccctttgtgctg

SEQ ID NO: 6059105 - DNA, 16 bp, Homo sapiens
cccctttgtgctgtgg

SEQ ID NO: 6059106 - DNA, 17 bp, Homo sapiens
ccccttttaaggtttca

SEQ ID NO: 6059107 - DNA, 19 bp, Homo sapiens
ccccttttcagcttctgct

SEQ ID NO: 6059108 - DNA, 22 bp, Homo sapiens
ccccttttccagttgctgtgga

SEQ ID NO: 6059109 - DNA, 16 bp, Homo sapiens
ccccttttccttcaga

SEQ ID NO: 6059110 - DNA, 22 bp, Homo sapiens
ccccttttcgccccctgcctgc

SEQ ID NO: 6059111 - DNA, 16 bp, Homo sapiens
ccccttttctccccac

SEQ ID NO: 6059112 - DNA, 13 bp, Homo sapiens
ccccttttctgtt

SEQ ID NO: 6059113 - DNA, 23 bp, Homo sapiens
ccccttttcttttctaccctagc

SEQ ID NO: 6059114 - DNA, 15 bp, Homo sapiens
ccccttttgcctggc

SEQ ID NO: 6059115 - DNA, 18 bp, Homo sapiens
ccccttttgcctggctgt

SEQ ID NO: 6059116 - DNA, 19 bp, Homo sapiens
ccccttttgcctggctgtg

SEQ ID NO: 6059117 - DNA, 20 bp, Homo sapiens
ccccttttgtgggtttctct

SEQ ID NO: 6059118 - DNA, 22 bp, Homo sapiens
ccccttttgtgggtttctctgt

SEQ ID NO: 6059119 - DNA, 19 bp, Homo sapiens
cccctttttactccccttg

SEQ ID NO: 6059120 - DNA, 17 bp, Homo sapiens
cccctttttcttcctca

SEQ ID NO: 6059121 - DNA, 18 bp, Homo sapiens
cccgaaaatccagcgtgc

SEQ ID NO: 6059122 - DNA, 21 bp, Homo sapiens
cccgaaaggtcacctcactca

SEQ ID NO: 6059123 - DNA, 20 bp, Homo sapiens
cccgaagagggagacagaga

SEQ ID NO: 6059124 - DNA, 23 bp, Homo sapiens
cccgaagccatcacttctccccg

SEQ ID NO: 6059125 - DNA, 11 bp, Homo sapiens
cccgaagccca

SEQ ID NO: 6059126 - DNA, 21 bp, Homo sapiens
cccgaagcccaggctgaagag

SEQ ID NO: 6059127 - DNA, 12 bp, Homo sapiens
cccgaagcgtgc

SEQ ID NO: 6059128 - DNA, 22 bp, Homo sapiens
cccgaaggtctctctggctcta

SEQ ID NO: 6059129 - DNA, 22 bp, Homo sapiens
cccgaaggttatggtcaatccc

SEQ ID NO: 6059130 - DNA, 14 bp, Homo sapiens
cccgaagtgtaggg

SEQ ID NO: 6059131 - DNA, 14 bp, Homo sapiens
cccgaatacaaaca

SEQ ID NO: 6059132 - DNA, 14 bp, Homo sapiens
cccgaatagctggg

SEQ ID NO: 6059133 - DNA, 13 bp, Homo sapiens
cccgaatcctgag

SEQ ID NO: 6059134 - DNA, 17 bp, Homo sapiens
cccgaatttagtcacac

SEQ ID NO: 6059135 - DNA, 16 bp, Homo sapiens
cccgacaccagaagct

SEQ ID NO: 6059136 - DNA, 15 bp, Homo sapiens
cccgacaccagccct

SEQ ID NO: 6059137 - DNA, 22 bp, Homo sapiens
cccgacactgctgcaccagagt

SEQ ID NO: 6059138 - DNA, 14 bp, Homo sapiens
cccgacagagagat

SEQ ID NO: 6059139 - DNA, 14 bp, Homo sapiens
cccgacagcccatc

SEQ ID NO: 6059140 - DNA, 15 bp, Homo sapiens
cccgacaggtgggcc

SEQ ID NO: 6059141 - DNA, 13 bp, Homo sapiens
cccgacagtgcca

SEQ ID NO: 6059142 - DNA, 18 bp, Homo sapiens
cccgaccaatccccagcc

SEQ ID NO: 6059143 - DNA, 16 bp, Homo sapiens
cccgacccagccagct

SEQ ID NO: 6059144 - DNA, 15 bp, Homo sapiens
cccgacccagctcta

SEQ ID NO: 6059145 - DNA, 23 bp, Homo sapiens
cccgacctaccaccccactggct

SEQ ID NO: 6059146 - DNA, 18 bp, Homo sapiens
cccgacctggctgcccct

SEQ ID NO: 6059147 - DNA, 15 bp, Homo sapiens
cccgacgccacagcc

SEQ ID NO: 6059148 - DNA, 15 bp, Homo sapiens
cccgactccagccag

SEQ ID NO: 6059149 - DNA, 14 bp, Homo sapiens
cccgactccaggct

SEQ ID NO: 6059150 - DNA, 12 bp, Homo sapiens
cccgactccagt

SEQ ID NO: 6059151 - DNA, 13 bp, Homo sapiens
cccgactgaccac

SEQ ID NO: 6059152 - DNA, 18 bp, Homo sapiens
cccgagaaccctgagcag

SEQ ID NO: 6059153 - DNA, 18 bp, Homo sapiens
cccgagacaccatcctga

SEQ ID NO: 6059154 - DNA, 20 bp, Homo sapiens
cccgagacaccatcctgagc

SEQ ID NO: 6059155 - DNA, 22 bp, Homo sapiens
cccgagacaccatcctgagcca

SEQ ID NO: 6059156 - DNA, 18 bp, Homo sapiens
cccgagagagaccccacc

SEQ ID NO: 6059157 - DNA, 20 bp, Homo sapiens
cccgagatgtgacccaccag

SEQ ID NO: 6059158 - DNA, 18 bp, Homo sapiens
cccgagcaaccctctgaa

SEQ ID NO: 6059159 - DNA, 20 bp, Homo sapiens
cccgagcaaccctctgaaga

SEQ ID NO: 6059160 - DNA, 22 bp, Homo sapiens
ccagaacacactccatcagctt

SEQ ID NO: 6059161 - DNA, 20 bp, Homo sapiens
ccagaacacggctcacgctt

SEQ ID NO: 6059162 - DNA, 17 bp, Homo sapiens
ccagaacagcatggccc

SEQ ID NO: 6059163 - DNA, 15 bp, Homo sapiens
ccagaacagccctcg

SEQ ID NO: 6059164 - DNA, 20 bp, Homo sapiens
ccagaacagccctcggcctc

SEQ ID NO: 6059165 - DNA, 17 bp, Homo sapiens
ccagaacagtttgtaca

SEQ ID NO: 6059166 - DNA, 13 bp, Homo sapiens
ccagaaccacact

SEQ ID NO: 6059167 - DNA, 17 bp, Homo sapiens
ccagaaccacactgttg

SEQ ID NO: 6059168 - DNA, 14 bp, Homo sapiens
ccagaaccacagat

SEQ ID NO: 6059169 - DNA, 19 bp, Homo sapiens
ccagaaccaccccggcccc

SEQ ID NO: 6059170 - DNA, 19 bp, Homo sapiens
ccagaaccccaactcccag

SEQ ID NO: 6059171 - DNA, 14 bp, Homo sapiens
ccagaaccccgagc

SEQ ID NO: 6059172 - DNA, 19 bp, Homo sapiens
ccagaacctctaagtgctg

SEQ ID NO: 6059173 - DNA, 16 bp, Homo sapiens
ccagaacgcaccccac

SEQ ID NO: 6059174 - DNA, 17 bp, Homo sapiens
ccagaacgcatgcaggg

SEQ ID NO: 6059175 - DNA, 19 bp, Homo sapiens
ccagaacgcatgcagggcc

SEQ ID NO: 6059176 - DNA, 14 bp, Homo sapiens
ccagaacgggcctc

SEQ ID NO: 6059177 - DNA, 16 bp, Homo sapiens
ccagaacgggcctccc

SEQ ID NO: 6059178 - DNA, 18 bp, Homo sapiens
ccagaacgggcctccccg

SEQ ID NO: 6059179 - DNA, 18 bp, Homo sapiens
ccagaacgtggctctgct

SEQ ID NO: 6059180 - DNA, 19 bp, Homo sapiens
ccagaacgtggctctgctg

SEQ ID NO: 6059181 - DNA, 20 bp, Homo sapiens
ccagaacgtggctctgctgg

SEQ ID NO: 6059182 - DNA, 18 bp, Homo sapiens
ccagaactaccaaaatga

SEQ ID NO: 6059183 - DNA, 14 bp, Homo sapiens
ccagaactgccccc

SEQ ID NO: 6059184 - DNA, 16 bp, Homo sapiens
ccagaactgcccccac

SEQ ID NO: 6059185 - DNA, 18 bp, Homo sapiens
ccagaactgcccccactg

SEQ ID NO: 6059186 - DNA, 15 bp, Homo sapiens
ccagaactggctggg

SEQ ID NO: 6059187 - DNA, 16 bp, Homo sapiens
ccagaactggctgggc

SEQ ID NO: 6059188 - DNA, 18 bp, Homo sapiens
ccagaactggctgggccc

SEQ ID NO: 6059189 - DNA, 20 bp, Homo sapiens
ccagaactggctgggcccct

SEQ ID NO: 6059190 - DNA, 21 bp, Homo sapiens
ccagaactggctgggcccctg

SEQ ID NO: 6059191 - DNA, 13 bp, Homo sapiens
ccagaacttccct

SEQ ID NO: 6059192 - DNA, 14 bp, Homo sapiens
ccagaacttccctg

SEQ ID NO: 6059193 - DNA, 11 bp, Homo sapiens
ccagaagaaaa

SEQ ID NO: 6059194 - DNA, 13 bp, Homo sapiens
ccagaagaaaaga

SEQ ID NO: 6059195 - DNA, 17 bp, Homo sapiens
ccagaagaagatggctg

SEQ ID NO: 6059196 - DNA, 11 bp, Homo sapiens
ccagaagaagt

SEQ ID NO: 6059197 - DNA, 18 bp, Homo sapiens
ccagaagaagtgtgagaa

SEQ ID NO: 6059198 - DNA, 16 bp, Homo sapiens
ccagaagaatattcag

SEQ ID NO: 6059199 - DNA, 20 bp, Homo sapiens
ccagaagaatattcaggact

SEQ ID NO: 6059200 - DNA, 18 bp, Homo sapiens
ccagaagacaaaggccca

SEQ ID NO: 6059201 - DNA, 21 bp, Homo sapiens
ccagaagacgtggtctagacc

SEQ ID NO: 6059202 - DNA, 21 bp, Homo sapiens
ccagaagactcctaggccctt

SEQ ID NO: 6059203 - DNA, 17 bp, Homo sapiens
ccagaagagtcaaagta

SEQ ID NO: 6059204 - DNA, 14 bp, Homo sapiens
ccagaagagtcttt

SEQ ID NO: 6059205 - DNA, 22 bp, Homo sapiens
ccagaagatcccctcaggactg

SEQ ID NO: 6059206 - DNA, 23 bp, Homo sapiens
ccagaagatgaacagactgacct

SEQ ID NO: 6059207 - DNA, 13 bp, Homo sapiens
ccagaagatgact

SEQ ID NO: 6059208 - DNA, 19 bp, Homo sapiens
ccagaagatgccagcttct

SEQ ID NO: 6059209 - DNA, 22 bp, Homo sapiens
ccagaagatgtattcagagcca

SEQ ID NO: 6059210 - DNA, 13 bp, Homo sapiens
ccagaagcagcag

SEQ ID NO: 6059211 - DNA, 16 bp, Homo sapiens
ccagaagccaaagact

SEQ ID NO: 6059212 - DNA, 13 bp, Homo sapiens
ccagaagcccaga

SEQ ID NO: 6059213 - DNA, 14 bp, Homo sapiens
ccagaagcccagaa

SEQ ID NO: 6059214 - DNA, 20 bp, Homo sapiens
ccagaagcccatggagcagg

SEQ ID NO: 6059215 - DNA, 15 bp, Homo sapiens
ccagaagcctctgcc

SEQ ID NO: 6059216 - DNA, 20 bp, Homo sapiens
ccagaagcctctggctagag

SEQ ID NO: 6059217 - DNA, 19 bp, Homo sapiens
ccagaagcggcctgtgcgt

SEQ ID NO: 6059218 - DNA, 15 bp, Homo sapiens
ccagaagctccccca

SEQ ID NO: 6059219 - DNA, 17 bp, Homo sapiens
ccagaagctgtactttt

SEQ ID NO: 6059220 - DNA, 23 bp, Homo sapiens
ccagaagctgttgggagaaagca

SEQ ID NO: 6059221 - DNA, 15 bp, Homo sapiens
ccagaagcttccata

SEQ ID NO: 6059222 - DNA, 16 bp, Homo sapiens
ccagaagcttccatag

SEQ ID NO: 6059223 - DNA, 12 bp, Homo sapiens
ccagaaggaacc

SEQ ID NO: 6059224 - DNA, 13 bp, Homo sapiens
ccagaaggaaggt

SEQ ID NO: 6059225 - DNA, 17 bp, Homo sapiens
ccagaaggaatcttctc

SEQ ID NO: 6059226 - DNA, 14 bp, Homo sapiens
ccagaaggagacag

SEQ ID NO: 6059227 - DNA, 18 bp, Homo sapiens
ccagaaggagacaggcag

SEQ ID NO: 6059228 - DNA, 18 bp, Homo sapiens
ccagaaggagcaggccct

SEQ ID NO: 6059229 - DNA, 22 bp, Homo sapiens
ccagaaggagcaggccctgggc

SEQ ID NO: 6059230 - DNA, 20 bp, Homo sapiens
ccagaaggagggcagagcca

SEQ ID NO: 6059231 - DNA, 22 bp, Homo sapiens
ccagaaggcagcaaagaggggc

SEQ ID NO: 6059232 - DNA, 15 bp, Homo sapiens
ccagaaggccacagg

SEQ ID NO: 6059233 - DNA, 18 bp, Homo sapiens
ccagaaggccacaggcca

SEQ ID NO: 6059234 - DNA, 12 bp, Homo sapiens
ccagaaggccct

SEQ ID NO: 6059235 - DNA, 21 bp, Homo sapiens
ccagaaggctgggtccagggg

SEQ ID NO: 6059236 - DNA, 14 bp, Homo sapiens
ccagaaggggagct

SEQ ID NO: 6059237 - DNA, 19 bp, Homo sapiens
ccagaaggggcacgcctgc

SEQ ID NO: 6059238 - DNA, 20 bp, Homo sapiens
ccagaaggggcacgcctgcc

SEQ ID NO: 6059239 - DNA, 13 bp, Homo sapiens
ccagaaggtcacg

SEQ ID NO: 6059240 - DNA, 23 bp, Homo sapiens
ccagaagtaaagtttatttcatg

SEQ ID NO: 6059241 - DNA, 19 bp, Homo sapiens
ccagaagtaacttattttg

SEQ ID NO: 6059242 - DNA, 16 bp, Homo sapiens
ccagaagtagctttgc

SEQ ID NO: 6059243 - DNA, 17 bp, Homo sapiens
ccagaagtagctttgca

SEQ ID NO: 6059244 - DNA, 13 bp, Homo sapiens
ccagaagtcaaca

SEQ ID NO: 6059245 - DNA, 14 bp, Homo sapiens
ccagaagtccacag

SEQ ID NO: 6059246 - DNA, 16 bp, Homo sapiens
ccagaagtgccatgct

SEQ ID NO: 6059247 - DNA, 18 bp, Homo sapiens
ccagaagtggcaggagga

SEQ ID NO: 6059248 - DNA, 17 bp, Homo sapiens
ccagaagtggggctctg

SEQ ID NO: 6059249 - DNA, 23 bp, Homo sapiens
ccagaagttgatgtgggaagaag

SEQ ID NO: 6059250 - DNA, 13 bp, Homo sapiens
ccagaagttgtgg

SEQ ID NO: 6059251 - DNA, 22 bp, Homo sapiens
ccagaagttgtggatttcagtt

SEQ ID NO: 6059252 - DNA, 16 bp, Homo sapiens
ccagaagtttaaatct

SEQ ID NO: 6059253 - DNA, 21 bp, Homo sapiens
ccagaagtttctacattctct

SEQ ID NO: 6059254 - DNA, 22 bp, Homo sapiens
ccagaataaactggcagctcag

SEQ ID NO: 6059255 - DNA, 15 bp, Homo sapiens
ccagaatactgatgg

SEQ ID NO: 6059256 - DNA, 17 bp, Homo sapiens
ccagaatactgggttct

SEQ ID NO: 6059257 - DNA, 20 bp, Homo sapiens
ccagaatcataattttcaag

SEQ ID NO: 6059258 - DNA, 19 bp, Homo sapiens
ccagaatccataaatgtgt

SEQ ID NO: 6059259 - DNA, 13 bp, Homo sapiens
ccagaatcccagc

SEQ ID NO: 6059260 - DNA, 14 bp, Homo sapiens
ccagaatctcatta

SEQ ID NO: 6059261 - DNA, 17 bp, Homo sapiens
ccagaatctctgagcca

SEQ ID NO: 6059262 - DNA, 13 bp, Homo sapiens
ccagaatctgctg

SEQ ID NO: 6059263 - DNA, 18 bp, Homo sapiens
ccagaatctgctgttgcc

SEQ ID NO: 6059264 - DNA, 20 bp, Homo sapiens
ccagaatcttgactttctga

SEQ ID NO: 6059265 - DNA, 22 bp, Homo sapiens
ccagaatgaggcacatgacagt

SEQ ID NO: 6059266 - DNA, 15 bp, Homo sapiens
ccagaatgaggctgc

SEQ ID NO: 6059267 - DNA, 15 bp, Homo sapiens
ccagaatgattttga

SEQ ID NO: 6059268 - DNA, 16 bp, Homo sapiens
ccagaatgtaagaaaa

SEQ ID NO: 6059269 - DNA, 17 bp, Homo sapiens
ccagaatgtaagaaaac

SEQ ID NO: 6059270 - DNA, 22 bp, Homo sapiens
ccagaatgtcagattcctttcc

SEQ ID NO: 6059271 - DNA, 17 bp, Homo sapiens
ccagaatgtgctgcctt

SEQ ID NO: 6059272 - DNA, 18 bp, Homo sapiens
ccagaatgtgctgccttt

SEQ ID NO: 6059273 - DNA, 17 bp, Homo sapiens
ccagaattacccttcct

SEQ ID NO: 6059274 - DNA, 14 bp, Homo sapiens
ccagaattattttt

SEQ ID NO: 6059275 - DNA, 21 bp, Homo sapiens
ccagaattcattccccagctc

SEQ ID NO: 6059276 - DNA, 23 bp, Homo sapiens
ccagaattcattccccagctcca

SEQ ID NO: 6059277 - DNA, 21 bp, Homo sapiens
ccagaattcccagctgtctgt

SEQ ID NO: 6059278 - DNA, 15 bp, Homo sapiens
ccagaattcccttga

SEQ ID NO: 6059279 - DNA, 12 bp, Homo sapiens
ccagaattgaga

SEQ ID NO: 6059280 - DNA, 14 bp, Homo sapiens
ccagaattgcattc

SEQ ID NO: 6059281 - DNA, 22 bp, Homo sapiens
ccagaattgcttgaacccagga

SEQ ID NO: 6059282 - DNA, 18 bp, Homo sapiens
ccagaattggtaaaaaca

SEQ ID NO: 6059283 - DNA, 20 bp, Homo sapiens
ccagaattgtgcaaatggaa

SEQ ID NO: 6059284 - DNA, 16 bp, Homo sapiens
ccagaatttaaaccta

SEQ ID NO: 6059285 - DNA, 12 bp, Homo sapiens
ccagaatttccc

SEQ ID NO: 6059286 - DNA, 23 bp, Homo sapiens
ccagaatttggaaatcctagttt

SEQ ID NO: 6059287 - DNA, 20 bp, Homo sapiens
ccagaatttggaagctagaa

SEQ ID NO: 6059288 - DNA, 18 bp, Homo sapiens
ccagacaacagcccaggc

SEQ ID NO: 6059289 - DNA, 14 bp, Homo sapiens
ccagacaaggagag

SEQ ID NO: 6059290 - DNA, 16 bp, Homo sapiens
ccagacaaggagagcg

SEQ ID NO: 6059291 - DNA, 22 bp, Homo sapiens
ccagacaaggagagcggaggag

SEQ ID NO: 6059292 - DNA, 20 bp, Homo sapiens
ccagacaatgttgtgtttgg

SEQ ID NO: 6059293 - DNA, 12 bp, Homo sapiens
ccagacacaaac

SEQ ID NO: 6059294 - DNA, 14 bp, Homo sapiens
ccagacacaccccc

SEQ ID NO: 6059295 - DNA, 15 bp, Homo sapiens
ccagacacagactgg

SEQ ID NO: 6059296 - DNA, 18 bp, Homo sapiens
ccagacacagactggcaa

SEQ ID NO: 6059297 - DNA, 22 bp, Homo sapiens
ccagacacagactggcaataaa

SEQ ID NO: 6059298 - DNA, 13 bp, Homo sapiens
ccagacacaggcc

SEQ ID NO: 6059299 - DNA, 16 bp, Homo sapiens
ccagacacaggccgtg

SEQ ID NO: 6059300 - DNA, 22 bp, Homo sapiens
ccagacacatgggcttgtgaca

SEQ ID NO: 6059301 - DNA, 22 bp, Homo sapiens
ccagacacatgtccaagaagcc

SEQ ID NO: 6059302 - DNA, 11 bp, Homo sapiens
ccagacacatt

SEQ ID NO: 6059303 - DNA, 17 bp, Homo sapiens
ccagacaccatgtgcaa

SEQ ID NO: 6059304 - DNA, 14 bp, Homo sapiens
ccagacacccagga

SEQ ID NO: 6059305 - DNA, 17 bp, Homo sapiens
ccagacaccttgacagg

SEQ ID NO: 6059306 - DNA, 19 bp, Homo sapiens
ccagacaccttgacagggc

SEQ ID NO: 6059307 - DNA, 14 bp, Homo sapiens
ccagacactgcgcc

SEQ ID NO: 6059308 - DNA, 20 bp, Homo sapiens
ccagacagacagggggctaa

SEQ ID NO: 6059309 - DNA, 11 bp, Homo sapiens
ccagacagacc

SEQ ID NO: 6059310 - DNA, 17 bp, Homo sapiens
ccagacagaccttcaca

SEQ ID NO: 6059311 - DNA, 23 bp, Homo sapiens
ccagacagaccttcacagatgcc

SEQ ID NO: 6059312 - DNA, 14 bp, Homo sapiens
ccagacagagatca

SEQ ID NO: 6059313 - DNA, 14 bp, Homo sapiens
ccagacagaggcag

SEQ ID NO: 6059314 - DNA, 12 bp, Homo sapiens
ccagacagaggg

SEQ ID NO: 6059315 - DNA, 19 bp, Homo sapiens
ccagacagagtggatctgg

SEQ ID NO: 6059316 - DNA, 21 bp, Homo sapiens
ccagacagcaacggggaggcc

SEQ ID NO: 6059317 - DNA, 13 bp, Homo sapiens
ccagacagcaagg

SEQ ID NO: 6059318 - DNA, 16 bp, Homo sapiens
ccagacagcacagggc

SEQ ID NO: 6059319 - DNA, 19 bp, Homo sapiens
ccagacagcacagggcagg

SEQ ID NO: 6059320 - DNA, 19 bp, Homo sapiens
ccagacagcagtgtgaggg

SEQ ID NO: 6059321 - DNA, 12 bp, Homo sapiens
ccagacagcctg

SEQ ID NO: 6059322 - DNA, 13 bp, Homo sapiens
ccagacagctccc

SEQ ID NO: 6059323 - DNA, 20 bp, Homo sapiens
ccagacagctccctctgcct

SEQ ID NO: 6059324 - DNA, 14 bp, Homo sapiens
ccagacagctgctc

SEQ ID NO: 6059325 - DNA, 13 bp, Homo sapiens
ccagacagctgga

SEQ ID NO: 6059326 - DNA, 16 bp, Homo sapiens
ccagacagctggaccc

SEQ ID NO: 6059327 - DNA, 13 bp, Homo sapiens
ccagacaggagga

SEQ ID NO: 6059328 - DNA, 14 bp, Homo sapiens
ccagacaggaggag

SEQ ID NO: 6059329 - DNA, 15 bp, Homo sapiens
ccagacaggaggagt

SEQ ID NO: 6059330 - DNA, 17 bp, Homo sapiens
ccagacaggccctccct

SEQ ID NO: 6059331 - DNA, 18 bp, Homo sapiens
ccagacaggccctccctg

SEQ ID NO: 6059332 - DNA, 21 bp, Homo sapiens
ccagacagtcgctcagtctgt

SEQ ID NO: 6059333 - DNA, 15 bp, Homo sapiens
ccagacagttctttt

SEQ ID NO: 6059334 - DNA, 14 bp, Homo sapiens
ccagacatcaacag

SEQ ID NO: 6059335 - DNA, 12 bp, Homo sapiens
ccagacatcacc

SEQ ID NO: 6059336 - DNA, 14 bp, Homo sapiens
ccagacatgccaca

SEQ ID NO: 6059337 - DNA, 15 bp, Homo sapiens
ccagacatgctgccc

SEQ ID NO: 6059338 - DNA, 20 bp, Homo sapiens
ccagacatgctgcccacccc

SEQ ID NO: 6059339 - DNA, 16 bp, Homo sapiens
ccagacatggacctcc

SEQ ID NO: 6059340 - DNA, 16 bp, Homo sapiens
ccagacatggagggga

SEQ ID NO: 6059341 - DNA, 16 bp, Homo sapiens
cccgagcagctgagca

SEQ ID NO: 6059342 - DNA, 22 bp, Homo sapiens
cccgagcagctgagcagggccg

SEQ ID NO: 6059343 - DNA, 15 bp, Homo sapiens
cccgagccaccccag

SEQ ID NO: 6059344 - DNA, 13 bp, Homo sapiens
cccgagcccagct

SEQ ID NO: 6059345 - DNA, 21 bp, Homo sapiens
cccgagcccagctacattcct

SEQ ID NO: 6059346 - DNA, 15 bp, Homo sapiens
cccgagccccctgtc

SEQ ID NO: 6059347 - DNA, 18 bp, Homo sapiens
cccgagccccctgtcctt

SEQ ID NO: 6059348 - DNA, 15 bp, Homo sapiens
cccgagccccttggg

SEQ ID NO: 6059349 - DNA, 11 bp, Homo sapiens
cccgagccctg

SEQ ID NO: 6059350 - DNA, 14 bp, Homo sapiens
cccgagccctgact

SEQ ID NO: 6059351 - DNA, 22 bp, Homo sapiens
cccgagccgagctctcctgggc

SEQ ID NO: 6059352 - DNA, 17 bp, Homo sapiens
cccgagctcctcttcca

SEQ ID NO: 6059353 - DNA, 21 bp, Homo sapiens
cccgagcttgcctcagggcca

SEQ ID NO: 6059354 - DNA, 16 bp, Homo sapiens
cccgaggacccagacc

SEQ ID NO: 6059355 - DNA, 19 bp, Homo sapiens
cccgaggacccagacccag

SEQ ID NO: 6059356 - DNA, 17 bp, Homo sapiens
cccgaggaccgggctgg

SEQ ID NO: 6059357 - DNA, 15 bp, Homo sapiens
cccgaggagctgggc

SEQ ID NO: 6059358 - DNA, 16 bp, Homo sapiens
cccgaggagctgggcc

SEQ ID NO: 6059359 - DNA, 19 bp, Homo sapiens
cccgaggagctgggcccct

SEQ ID NO: 6059360 - DNA, 21 bp, Homo sapiens
cccgaggagctgggcccctgc

SEQ ID NO: 6059361 - DNA, 21 bp, Homo sapiens
cccgaggcagcaacaggacca

SEQ ID NO: 6059362 - DNA, 12 bp, Homo sapiens
cccgaggccagg

SEQ ID NO: 6059363 - DNA, 15 bp, Homo sapiens
cccgaggccagggcc

SEQ ID NO: 6059364 - DNA, 15 bp, Homo sapiens
cccgaggccctgcat

SEQ ID NO: 6059365 - DNA, 20 bp, Homo sapiens
cccgaggccttctctgaagg

SEQ ID NO: 6059366 - DNA, 21 bp, Homo sapiens
cccgaggccttctctgaagga

SEQ ID NO: 6059367 - DNA, 21 bp, Homo sapiens
cccgaggctcgagctcggggc

SEQ ID NO: 6059368 - DNA, 13 bp, Homo sapiens
cccgaggctgccc

SEQ ID NO: 6059369 - DNA, 14 bp, Homo sapiens
cccgaggctgcccc

SEQ ID NO: 6059370 - DNA, 16 bp, Homo sapiens
cccgaggctgccccag

SEQ ID NO: 6059371 - DNA, 17 bp, Homo sapiens
cccgaggctgccccagg

SEQ ID NO: 6059372 - DNA, 19 bp, Homo sapiens
cccgaggctgccccaggcc

SEQ ID NO: 6059373 - DNA, 23 bp, Homo sapiens
cccgagggaggggaagcttctgt

SEQ ID NO: 6059374 - DNA, 22 bp, Homo sapiens
cccgagggatgatgccacacca

SEQ ID NO: 6059375 - DNA, 22 bp, Homo sapiens
cccgagggcgaaggccattggg

SEQ ID NO: 6059376 - DNA, 18 bp, Homo sapiens
cccgagggcgcctgggtc

SEQ ID NO: 6059377 - DNA, 22 bp, Homo sapiens
cccgagggctgaggagcagcca

SEQ ID NO: 6059378 - DNA, 17 bp, Homo sapiens
cccgaggggagggcagg

SEQ ID NO: 6059379 - DNA, 18 bp, Homo sapiens
cccgaggggggccccggg

SEQ ID NO: 6059380 - DNA, 13 bp, Homo sapiens
cccgagtacctcc

SEQ ID NO: 6059381 - DNA, 15 bp, Homo sapiens
cccgagtacctccag

SEQ ID NO: 6059382 - DNA, 21 bp, Homo sapiens
cccgagtagctgggactacag

SEQ ID NO: 6059383 - DNA, 15 bp, Homo sapiens
cccgagtctccggga

SEQ ID NO: 6059384 - DNA, 14 bp, Homo sapiens
cccgagtctgggac

SEQ ID NO: 6059385 - DNA, 19 bp, Homo sapiens
cccgagtggtggcagccag

SEQ ID NO: 6059386 - DNA, 15 bp, Homo sapiens
cccgagttcctctgg

SEQ ID NO: 6059387 - DNA, 15 bp, Homo sapiens
cccgatacctcagcc

SEQ ID NO: 6059388 - DNA, 22 bp, Homo sapiens
cccgatacctcagccctggccc

SEQ ID NO: 6059389 - DNA, 19 bp, Homo sapiens
cccgatattctccctgacc

SEQ ID NO: 6059390 - DNA, 19 bp, Homo sapiens
cccgatcctcccctggact

SEQ ID NO: 6059391 - DNA, 22 bp, Homo sapiens
cccgatgagggaaggagcccag

SEQ ID NO: 6059392 - DNA, 21 bp, Homo sapiens
cccgatgcgtggctcccagca

SEQ ID NO: 6059393 - DNA, 15 bp, Homo sapiens
cccgatgctgctttc

SEQ ID NO: 6059394 - DNA, 23 bp, Homo sapiens
cccgatgctgctttcccctgtgg

SEQ ID NO: 6059395 - DNA, 20 bp, Homo sapiens
cccgatggactcctgaccat

SEQ ID NO: 6059396 - DNA, 23 bp, Homo sapiens
cccgatggaggactccaggcagc

SEQ ID NO: 6059397 - DNA, 19 bp, Homo sapiens
cccgatggcggggatctgg

SEQ ID NO: 6059398 - DNA, 15 bp, Homo sapiens
cccgattcagagact

SEQ ID NO: 6059399 - DNA, 20 bp, Homo sapiens
cccgattctttcagattgct

SEQ ID NO: 6059400 - DNA, 20 bp, Homo sapiens
cccgcaaaccccctttgtgc

SEQ ID NO: 6059401 - DNA, 15 bp, Homo sapiens
cccgcaacccacagc

SEQ ID NO: 6059402 - DNA, 16 bp, Homo sapiens
cccgcaacccacagct

SEQ ID NO: 6059403 - DNA, 17 bp, Homo sapiens
cccgcaacccacagctc

SEQ ID NO: 6059404 - DNA, 16 bp, Homo sapiens
cccgcaagcaccatcc

SEQ ID NO: 6059405 - DNA, 14 bp, Homo sapiens
cccgcaaggcctct

SEQ ID NO: 6059406 - DNA, 16 bp, Homo sapiens
cccgcaaggcctctca

SEQ ID NO: 6059407 - DNA, 18 bp, Homo sapiens
cccgcaatgtgcccccag

SEQ ID NO: 6059408 - DNA, 20 bp, Homo sapiens
cccgcaatgtgcttccgaga

SEQ ID NO: 6059409 - DNA, 11 bp, Homo sapiens
cccgcacagca

SEQ ID NO: 6059410 - DNA, 12 bp, Homo sapiens
cccgcacagcag

SEQ ID NO: 6059411 - DNA, 18 bp, Homo sapiens
cccgcacagccacccgtg

SEQ ID NO: 6059412 - DNA, 19 bp, Homo sapiens
cccgcaccccccaagctgt

SEQ ID NO: 6059413 - DNA, 14 bp, Homo sapiens
cccgcacccccgcc

SEQ ID NO: 6059414 - DNA, 13 bp, Homo sapiens
cccgcacccctcc

SEQ ID NO: 6059415 - DNA, 18 bp, Homo sapiens
cccgcacgcaagcctcag

SEQ ID NO: 6059416 - DNA, 22 bp, Homo sapiens
cccgcacgcaagcctcagccac

SEQ ID NO: 6059417 - DNA, 15 bp, Homo sapiens
cccgcactctgcccc

SEQ ID NO: 6059418 - DNA, 17 bp, Homo sapiens
cccgcactctgccccca

SEQ ID NO: 6059419 - DNA, 13 bp, Homo sapiens
cccgcactgcaga

SEQ ID NO: 6059420 - DNA, 14 bp, Homo sapiens
cccgcactgcagac

SEQ ID NO: 6059421 - DNA, 14 bp, Homo sapiens
cccgcagacctccc

SEQ ID NO: 6059422 - DNA, 19 bp, Homo sapiens
cccgcagacctccccagcc

SEQ ID NO: 6059423 - DNA, 20 bp, Homo sapiens
cccgcagacctccccagccc

SEQ ID NO: 6059424 - DNA, 21 bp, Homo sapiens
cccgcagacctccccagcccc

SEQ ID NO: 6059425 - DNA, 21 bp, Homo sapiens
cccgcagacctctggattagg

SEQ ID NO: 6059426 - DNA, 20 bp, Homo sapiens
cccgcagacggtctgtgtgc

SEQ ID NO: 6059427 - DNA, 17 bp, Homo sapiens
cccgcagaggtggggtg

SEQ ID NO: 6059428 - DNA, 22 bp, Homo sapiens
cccgcagaggtggggtgctggg

SEQ ID NO: 6059429 - DNA, 18 bp, Homo sapiens
cccgcagcaccagcctga

SEQ ID NO: 6059430 - DNA, 12 bp, Homo sapiens
cccgcagcaccc

SEQ ID NO: 6059431 - DNA, 19 bp, Homo sapiens
cccgcagcaccctgcagag

SEQ ID NO: 6059432 - DNA, 16 bp, Homo sapiens
cccgcagcccgcctgc

SEQ ID NO: 6059433 - DNA, 15 bp, Homo sapiens
cccgcagccctctcc

SEQ ID NO: 6059434 - DNA, 17 bp, Homo sapiens
cccgcagccctctccac

SEQ ID NO: 6059435 - DNA, 21 bp, Homo sapiens
cccgcagccctctccacccag

SEQ ID NO: 6059436 - DNA, 16 bp, Homo sapiens
cccgcagccctggcag

SEQ ID NO: 6059437 - DNA, 15 bp, Homo sapiens
cccgcagcctggcat

SEQ ID NO: 6059438 - DNA, 22 bp, Homo sapiens
cccgcagcctggcatctgtgcg

SEQ ID NO: 6059439 - DNA, 22 bp, Homo sapiens
cccgcagcgcccccatctgtct

SEQ ID NO: 6059440 - DNA, 17 bp, Homo sapiens
cccgcaggatcaggtga

SEQ ID NO: 6059441 - DNA, 18 bp, Homo sapiens
cccgcagggccatgcaga

SEQ ID NO: 6059442 - DNA, 14 bp, Homo sapiens
cccgcagtccccag

SEQ ID NO: 6059443 - DNA, 12 bp, Homo sapiens
cccgcagtgctg

SEQ ID NO: 6059444 - DNA, 20 bp, Homo sapiens
cccgcagtgctgggaccaga

SEQ ID NO: 6059445 - DNA, 19 bp, Homo sapiens
cccgcagtgtgcactaagg

SEQ ID NO: 6059446 - DNA, 15 bp, Homo sapiens
cccgcatcccctgcc

SEQ ID NO: 6059447 - DNA, 20 bp, Homo sapiens
cccgcatgcagcagcttgct

SEQ ID NO: 6059448 - DNA, 17 bp, Homo sapiens
cccgcatgctgcctgcc

SEQ ID NO: 6059449 - DNA, 20 bp, Homo sapiens
cccgcatgctgcctgcctcc

SEQ ID NO: 6059450 - DNA, 19 bp, Homo sapiens
cccgcatggtttttataat

SEQ ID NO: 6059451 - DNA, 20 bp, Homo sapiens
cccgcatgtgtgcctggccg

SEQ ID NO: 6059452 - DNA, 15 bp, Homo sapiens
cccgccaaaagctgc

SEQ ID NO: 6059453 - DNA, 14 bp, Homo sapiens
cccgccaaccctgc

SEQ ID NO: 6059454 - DNA, 23 bp, Homo sapiens
cccgccacacgctcactccaggt

SEQ ID NO: 6059455 - DNA, 18 bp, Homo sapiens
cccgccaccctgtctcag

SEQ ID NO: 6059456 - DNA, 15 bp, Homo sapiens
cccgccacctcaggg

SEQ ID NO: 6059457 - DNA, 16 bp, Homo sapiens
cccgccacctcagggc

SEQ ID NO: 6059458 - DNA, 16 bp, Homo sapiens
cccgccacctccccac

SEQ ID NO: 6059459 - DNA, 16 bp, Homo sapiens
cccgccacggccaccc

SEQ ID NO: 6059460 - DNA, 17 bp, Homo sapiens
cccgccacggccaccct

SEQ ID NO: 6059461 - DNA, 18 bp, Homo sapiens
cccgccacggccaccctc

SEQ ID NO: 6059462 - DNA, 13 bp, Homo sapiens
cccgccagccccg

SEQ ID NO: 6059463 - DNA, 21 bp, Homo sapiens
cccgccagcctacactgccag

SEQ ID NO: 6059464 - DNA, 12 bp, Homo sapiens
cccgccaggagc

SEQ ID NO: 6059465 - DNA, 16 bp, Homo sapiens
cccgccagggctgggg

SEQ ID NO: 6059466 - DNA, 17 bp, Homo sapiens
cccgccagggctgggga

SEQ ID NO: 6059467 - DNA, 16 bp, Homo sapiens
cccgccatggccgtgt

SEQ ID NO: 6059468 - DNA, 13 bp, Homo sapiens
cccgcccacaccc

SEQ ID NO: 6059469 - DNA, 15 bp, Homo sapiens
cccgcccacaccctc

SEQ ID NO: 6059470 - DNA, 12 bp, Homo sapiens
cccgcccaccag

SEQ ID NO: 6059471 - DNA, 17 bp, Homo sapiens
cccgcccaccccgctgc

SEQ ID NO: 6059472 - DNA, 19 bp, Homo sapiens
cccgcccaccccgctgcct

SEQ ID NO: 6059473 - DNA, 15 bp, Homo sapiens
cccgcccacccgcct

SEQ ID NO: 6059474 - DNA, 15 bp, Homo sapiens
cccgcccacctctgc

SEQ ID NO: 6059475 - DNA, 17 bp, Homo sapiens
cccgcccacctctgctg

SEQ ID NO: 6059476 - DNA, 19 bp, Homo sapiens
cccgcccacctctgctgcc

SEQ ID NO: 6059477 - DNA, 16 bp, Homo sapiens
cccgcccactgtcctg

SEQ ID NO: 6059478 - DNA, 20 bp, Homo sapiens
cccgcccactgtcctgggcg

SEQ ID NO: 6059479 - DNA, 15 bp, Homo sapiens
cccgcccaggctggc

SEQ ID NO: 6059480 - DNA, 22 bp, Homo sapiens
cccgcccaggcttagtcactga

SEQ ID NO: 6059481 - DNA, 13 bp, Homo sapiens
cccgccccacagg

SEQ ID NO: 6059482 - DNA, 15 bp, Homo sapiens
cccgccccacattcc

SEQ ID NO: 6059483 - DNA, 17 bp, Homo sapiens
cccgccccacctcccat

SEQ ID NO: 6059484 - DNA, 11 bp, Homo sapiens
cccgccccaga

SEQ ID NO: 6059485 - DNA, 13 bp, Homo sapiens
cccgccccagaga

SEQ ID NO: 6059486 - DNA, 18 bp, Homo sapiens
cccgccccagagactgcc

SEQ ID NO: 6059487 - DNA, 15 bp, Homo sapiens
cccgccccagagctc

SEQ ID NO: 6059488 - DNA, 18 bp, Homo sapiens
cccgccccagagtggccc

SEQ ID NO: 6059489 - DNA, 14 bp, Homo sapiens
cccgccccagcctc

SEQ ID NO: 6059490 - DNA, 16 bp, Homo sapiens
cccgccccagcctcct

SEQ ID NO: 6059491 - DNA, 12 bp, Homo sapiens
cccgccccaggc

SEQ ID NO: 6059492 - DNA, 13 bp, Homo sapiens
cccgccccaggct

SEQ ID NO: 6059493 - DNA, 15 bp, Homo sapiens
cccgccccagggtct

SEQ ID NO: 6059494 - DNA, 13 bp, Homo sapiens
cccgcccccaagc

SEQ ID NO: 6059495 - DNA, 14 bp, Homo sapiens
cccgcccccacccc

SEQ ID NO: 6059496 - DNA, 15 bp, Homo sapiens
cccgcccccacccct

SEQ ID NO: 6059497 - DNA, 18 bp, Homo sapiens
cccgcccccaccgggctg

SEQ ID NO: 6059498 - DNA, 20 bp, Homo sapiens
cccgcccccacgtcgtgggg

SEQ ID NO: 6059499 - DNA, 16 bp, Homo sapiens
cccgccccccagagcc

SEQ ID NO: 6059500 - DNA, 13 bp, Homo sapiens
cccgccccctgaa

SEQ ID NO: 6059501 - DNA, 14 bp, Homo sapiens
cccgccccctgaaa

SEQ ID NO: 6059502 - DNA, 14 bp, Homo sapiens
cccgccccgggctg

SEQ ID NO: 6059503 - DNA, 19 bp, Homo sapiens
cccgccccgggctggccct

SEQ ID NO: 6059504 - DNA, 23 bp, Homo sapiens
cccgccccgggctggccctgtgc

SEQ ID NO: 6059505 - DNA, 20 bp, Homo sapiens
cccgccccgttgtgagctgg

SEQ ID NO: 6059506 - DNA, 18 bp, Homo sapiens
cccgcccctcccacgcct

SEQ ID NO: 6059507 - DNA, 14 bp, Homo sapiens
cccgcccctcgctg

SEQ ID NO: 6059508 - DNA, 19 bp, Homo sapiens
cccgcccctgtggccctgg

SEQ ID NO: 6059509 - DNA, 20 bp, Homo sapiens
cccgcccctgtggccctggc

SEQ ID NO: 6059510 - DNA, 14 bp, Homo sapiens
cccgcccgcacagc

SEQ ID NO: 6059511 - DNA, 15 bp, Homo sapiens
cccgcccgccctcct

SEQ ID NO: 6059512 - DNA, 13 bp, Homo sapiens
cccgcccgcgtcc

SEQ ID NO: 6059513 - DNA, 13 bp, Homo sapiens
cccgccctcacct

SEQ ID NO: 6059514 - DNA, 13 bp, Homo sapiens
cccgccctcaggc

SEQ ID NO: 6059515 - DNA, 17 bp, Homo sapiens
cccgccctcaggctccg

SEQ ID NO: 6059516 - DNA, 11 bp, Homo sapiens
cccgccctcca

SEQ ID NO: 6059517 - DNA, 16 bp, Homo sapiens
cccgccctccacccac

SEQ ID NO: 6059518 - DNA, 17 bp, Homo sapiens
cccgccctcctctgccc

SEQ ID NO: 6059519 - DNA, 11 bp, Homo sapiens
cccgccctcgc

SEQ ID NO: 6059520 - DNA, 11 bp, Homo sapiens
cccgccctctc

SEQ ID NO: 6059521 - DNA, 16 bp, Homo sapiens
cccgccgatagaggga

SEQ ID NO: 6059522 - DNA, 15 bp, Homo sapiens
ccagacattgtattt

SEQ ID NO: 6059523 - DNA, 16 bp, Homo sapiens
ccagaccaaccctggg

SEQ ID NO: 6059524 - DNA, 18 bp, Homo sapiens
ccagaccaaggcagggcc

SEQ ID NO: 6059525 - DNA, 13 bp, Homo sapiens
ccagaccacctgc

SEQ ID NO: 6059526 - DNA, 14 bp, Homo sapiens
ccagaccacctgcc

SEQ ID NO: 6059527 - DNA, 21 bp, Homo sapiens
ccagaccacctgccagccatc

SEQ ID NO: 6059528 - DNA, 17 bp, Homo sapiens
ccagaccagagctctgg

SEQ ID NO: 6059529 - DNA, 19 bp, Homo sapiens
ccagacccacctggagccc

SEQ ID NO: 6059530 - DNA, 21 bp, Homo sapiens
ccagacccacctggagcccgc

SEQ ID NO: 6059531 - DNA, 14 bp, Homo sapiens
ccagacccactgaa

SEQ ID NO: 6059532 - DNA, 10 bp, Homo sapiens
ccagacccag

SEQ ID NO: 6059533 - DNA, 13 bp, Homo sapiens
ccagacccagagg

SEQ ID NO: 6059534 - DNA, 20 bp, Homo sapiens
ccagacccagaggccctgaa

SEQ ID NO: 6059535 - DNA, 22 bp, Homo sapiens
ccagacccagcccgcggcctgg

SEQ ID NO: 6059536 - DNA, 16 bp, Homo sapiens
ccagacccagggcagt

SEQ ID NO: 6059537 - DNA, 14 bp, Homo sapiens
ccagacccagtggg

SEQ ID NO: 6059538 - DNA, 15 bp, Homo sapiens
ccagaccccacgctg

SEQ ID NO: 6059539 - DNA, 17 bp, Homo sapiens
ccagaccccaggctgga

SEQ ID NO: 6059540 - DNA, 15 bp, Homo sapiens
ccagaccccagggca

SEQ ID NO: 6059541 - DNA, 16 bp, Homo sapiens
ccagaccccagggcag

SEQ ID NO: 6059542 - DNA, 19 bp, Homo sapiens
ccagaccccatccagccag

SEQ ID NO: 6059543 - DNA, 22 bp, Homo sapiens
ccagacccccagcaaccctcct

SEQ ID NO: 6059544 - DNA, 15 bp, Homo sapiens
ccagacccccttgcc

SEQ ID NO: 6059545 - DNA, 19 bp, Homo sapiens
ccagacccccttgcccagg

SEQ ID NO: 6059546 - DNA, 16 bp, Homo sapiens
ccagaccccgacaccg

SEQ ID NO: 6059547 - DNA, 14 bp, Homo sapiens
ccagaccccgcagc

SEQ ID NO: 6059548 - DNA, 18 bp, Homo sapiens
ccagaccccgtggctctg

SEQ ID NO: 6059549 - DNA, 12 bp, Homo sapiens
ccagacccctac

SEQ ID NO: 6059550 - DNA, 20 bp, Homo sapiens
ccagacccctaccctttccc

SEQ ID NO: 6059551 - DNA, 21 bp, Homo sapiens
ccagacccctaccctttccca

SEQ ID NO: 6059552 - DNA, 21 bp, Homo sapiens
ccagacccctctggccaggat

SEQ ID NO: 6059553 - DNA, 22 bp, Homo sapiens
ccagacccctctggccaggatg

SEQ ID NO: 6059554 - DNA, 16 bp, Homo sapiens
ccagacccctggcttt

SEQ ID NO: 6059555 - DNA, 17 bp, Homo sapiens
ccagacccctgtggcag

SEQ ID NO: 6059556 - DNA, 18 bp, Homo sapiens
ccagacccctgtggcaga

SEQ ID NO: 6059557 - DNA, 13 bp, Homo sapiens
ccagaccctcctt

SEQ ID NO: 6059558 - DNA, 14 bp, Homo sapiens
ccagaccctccttc

SEQ ID NO: 6059559 - DNA, 21 bp, Homo sapiens
ccagaccctgcctgagcccag

SEQ ID NO: 6059560 - DNA, 14 bp, Homo sapiens
ccagacccttcttg

SEQ ID NO: 6059561 - DNA, 17 bp, Homo sapiens
ccagacccttcttgcct

SEQ ID NO: 6059562 - DNA, 18 bp, Homo sapiens
ccagacccttcttgcctg

SEQ ID NO: 6059563 - DNA, 19 bp, Homo sapiens
ccagacccttcttgcctgc

SEQ ID NO: 6059564 - DNA, 13 bp, Homo sapiens
ccagacctgagct

SEQ ID NO: 6059565 - DNA, 18 bp, Homo sapiens
ccagacctgatcctggag

SEQ ID NO: 6059566 - DNA, 16 bp, Homo sapiens
ccagacctgcagacgc

SEQ ID NO: 6059567 - DNA, 13 bp, Homo sapiens
ccagacctgcatg

SEQ ID NO: 6059568 - DNA, 17 bp, Homo sapiens
ccagacctgcatggtca

SEQ ID NO: 6059569 - DNA, 22 bp, Homo sapiens
ccagacctgcatggtcaagcct

SEQ ID NO: 6059570 - DNA, 19 bp, Homo sapiens
ccagacctgcccctccctc

SEQ ID NO: 6059571 - DNA, 15 bp, Homo sapiens
ccagacctgcctgtc

SEQ ID NO: 6059572 - DNA, 19 bp, Homo sapiens
ccagacctgcgaaggatga

SEQ ID NO: 6059573 - DNA, 18 bp, Homo sapiens
ccagacctgcttcctgaa

SEQ ID NO: 6059574 - DNA, 21 bp, Homo sapiens
ccagacctgcttcctgaaata

SEQ ID NO: 6059575 - DNA, 23 bp, Homo sapiens
ccagacctgcttcctgaaataaa

SEQ ID NO: 6059576 - DNA, 12 bp, Homo sapiens
ccagacctggaa

SEQ ID NO: 6059577 - DNA, 13 bp, Homo sapiens
ccagacctggcct

SEQ ID NO: 6059578 - DNA, 15 bp, Homo sapiens
ccagacctggcctct

SEQ ID NO: 6059579 - DNA, 18 bp, Homo sapiens
ccagacctggcctctgcc

SEQ ID NO: 6059580 - DNA, 20 bp, Homo sapiens
ccagacctggcctctgccat

SEQ ID NO: 6059581 - DNA, 15 bp, Homo sapiens
ccagacctgggccct

SEQ ID NO: 6059582 - DNA, 21 bp, Homo sapiens
ccagacctgttagcagacagg

SEQ ID NO: 6059583 - DNA, 14 bp, Homo sapiens
ccagacctgttctg

SEQ ID NO: 6059584 - DNA, 21 bp, Homo sapiens
ccagaccttaagacactgtga

SEQ ID NO: 6059585 - DNA, 18 bp, Homo sapiens
ccagacctttgaggatat

SEQ ID NO: 6059586 - DNA, 16 bp, Homo sapiens
ccagacgaggggcttc

SEQ ID NO: 6059587 - DNA, 14 bp, Homo sapiens
ccagacgcctggct

SEQ ID NO: 6059588 - DNA, 17 bp, Homo sapiens
ccagacgcctggctgct

SEQ ID NO: 6059589 - DNA, 20 bp, Homo sapiens
ccagacgccttcctctctgg

SEQ ID NO: 6059590 - DNA, 20 bp, Homo sapiens
ccagacgcggaaaccgggtg

SEQ ID NO: 6059591 - DNA, 20 bp, Homo sapiens
ccagacgtgctcctgctgac

SEQ ID NO: 6059592 - DNA, 18 bp, Homo sapiens
ccagacgtggtgcttctc

SEQ ID NO: 6059593 - DNA, 20 bp, Homo sapiens
ccagactagacaccttctgt

SEQ ID NO: 6059594 - DNA, 22 bp, Homo sapiens
ccagactagatggacctgcctg

SEQ ID NO: 6059595 - DNA, 20 bp, Homo sapiens
ccagactatcgtaacctggt

SEQ ID NO: 6059596 - DNA, 15 bp, Homo sapiens
ccagactcagagacc

SEQ ID NO: 6059597 - DNA, 20 bp, Homo sapiens
ccagactcagagaccgtgag

SEQ ID NO: 6059598 - DNA, 13 bp, Homo sapiens
ccagactcagcag

SEQ ID NO: 6059599 - DNA, 16 bp, Homo sapiens
ccagactcagcagagt

SEQ ID NO: 6059600 - DNA, 15 bp, Homo sapiens
ccagactcaggttcc

SEQ ID NO: 6059601 - DNA, 19 bp, Homo sapiens
ccagactcaggttccagaa

SEQ ID NO: 6059602 - DNA, 14 bp, Homo sapiens
ccagactccaccaa

SEQ ID NO: 6059603 - DNA, 15 bp, Homo sapiens
ccagactcccttgct

SEQ ID NO: 6059604 - DNA, 20 bp, Homo sapiens
ccagactcctgactgtctcc

SEQ ID NO: 6059605 - DNA, 18 bp, Homo sapiens
ccagactcctttcctctg

SEQ ID NO: 6059606 - DNA, 18 bp, Homo sapiens
ccagactcgagagggctg

SEQ ID NO: 6059607 - DNA, 22 bp, Homo sapiens
ccagactctgagctgctcaccg

SEQ ID NO: 6059608 - DNA, 15 bp, Homo sapiens
ccagactctgcctag

SEQ ID NO: 6059609 - DNA, 13 bp, Homo sapiens
ccagactctgggg

SEQ ID NO: 6059610 - DNA, 11 bp, Homo sapiens
ccagactctgt

SEQ ID NO: 6059611 - DNA, 14 bp, Homo sapiens
ccagactctgtctc

SEQ ID NO: 6059612 - DNA, 13 bp, Homo sapiens
ccagactcttgcc

SEQ ID NO: 6059613 - DNA, 18 bp, Homo sapiens
ccagactcttgcctgttt

SEQ ID NO: 6059614 - DNA, 17 bp, Homo sapiens
ccagactctttttttga

SEQ ID NO: 6059615 - DNA, 15 bp, Homo sapiens
ccagactgagctctc

SEQ ID NO: 6059616 - DNA, 19 bp, Homo sapiens
ccagactgagctctccagg

SEQ ID NO: 6059617 - DNA, 21 bp, Homo sapiens
ccagactgatgagcacatctc

SEQ ID NO: 6059618 - DNA, 22 bp, Homo sapiens
ccagactgcaggttggacccca

SEQ ID NO: 6059619 - DNA, 22 bp, Homo sapiens
ccagactgcttccaattttctg

SEQ ID NO: 6059620 - DNA, 13 bp, Homo sapiens
ccagactggctgc

SEQ ID NO: 6059621 - DNA, 17 bp, Homo sapiens
ccagactggctgcacag

SEQ ID NO: 6059622 - DNA, 21 bp, Homo sapiens
ccagactggctgcacagccca

SEQ ID NO: 6059623 - DNA, 15 bp, Homo sapiens
ccagactgggcccag

SEQ ID NO: 6059624 - DNA, 16 bp, Homo sapiens
ccagactgggcccagg

SEQ ID NO: 6059625 - DNA, 17 bp, Homo sapiens
ccagactgtaagatgtt

SEQ ID NO: 6059626 - DNA, 18 bp, Homo sapiens
ccagactgtaagatgttg

SEQ ID NO: 6059627 - DNA, 13 bp, Homo sapiens
ccagactgtagag

SEQ ID NO: 6059628 - DNA, 16 bp, Homo sapiens
ccagactgtccaggga

SEQ ID NO: 6059629 - DNA, 19 bp, Homo sapiens
ccagactgtctccacggcc

SEQ ID NO: 6059630 - DNA, 16 bp, Homo sapiens
ccagactgtggagaaa

SEQ ID NO: 6059631 - DNA, 17 bp, Homo sapiens
ccagactgtgtattcat

SEQ ID NO: 6059632 - DNA, 18 bp, Homo sapiens
ccagacttcaaaaggaat

SEQ ID NO: 6059633 - DNA, 14 bp, Homo sapiens
ccagacttccttga

SEQ ID NO: 6059634 - DNA, 15 bp, Homo sapiens
ccagacttccttgag

SEQ ID NO: 6059635 - DNA, 22 bp, Homo sapiens
ccagacttcgctattcccaggc

SEQ ID NO: 6059636 - DNA, 21 bp, Homo sapiens
ccagacttctaaaataaatgt

SEQ ID NO: 6059637 - DNA, 22 bp, Homo sapiens
ccagacttctaaaataaatgtt

SEQ ID NO: 6059638 - DNA, 15 bp, Homo sapiens
ccagacttgcactgg

SEQ ID NO: 6059639 - DNA, 14 bp, Homo sapiens
ccagacttgctgaa

SEQ ID NO: 6059640 - DNA, 18 bp, Homo sapiens
ccagacttgggaggatgt

SEQ ID NO: 6059641 - DNA, 18 bp, Homo sapiens
ccagactttagtgccctg

SEQ ID NO: 6059642 - DNA, 20 bp, Homo sapiens
ccagactttagtgccctgcc

SEQ ID NO: 6059643 - DNA, 23 bp, Homo sapiens
ccagactttagtgccctgccccc

SEQ ID NO: 6059644 - DNA, 21 bp, Homo sapiens
ccagactttctattaatattt

SEQ ID NO: 6059645 - DNA, 12 bp, Homo sapiens
ccagactttctt

SEQ ID NO: 6059646 - DNA, 15 bp, Homo sapiens
ccagactttcttttt

SEQ ID NO: 6059647 - DNA, 16 bp, Homo sapiens
ccagactttgagcctg

SEQ ID NO: 6059648 - DNA, 20 bp, Homo sapiens
ccagacttttggccccagcg

SEQ ID NO: 6059649 - DNA, 18 bp, Homo sapiens
ccagagaaaaagggaggg

SEQ ID NO: 6059650 - DNA, 22 bp, Homo sapiens
ccagagaaagcaaaggtgcact

SEQ ID NO: 6059651 - DNA, 15 bp, Homo sapiens
ccagagaaaggaaag

SEQ ID NO: 6059652 - DNA, 22 bp, Homo sapiens
ccagagaaatgaaagtcagttt

SEQ ID NO: 6059653 - DNA, 18 bp, Homo sapiens
ccagagaacaatcactat

SEQ ID NO: 6059654 - DNA, 19 bp, Homo sapiens
ccagagaacaatcactatt

SEQ ID NO: 6059655 - DNA, 15 bp, Homo sapiens
ccagagaaccattcc

SEQ ID NO: 6059656 - DNA, 13 bp, Homo sapiens
ccagagaacccag

SEQ ID NO: 6059657 - DNA, 20 bp, Homo sapiens
ccagagaagccccgcacggg

SEQ ID NO: 6059658 - DNA, 21 bp, Homo sapiens
ccagagaagccccgcacgggc

SEQ ID NO: 6059659 - DNA, 14 bp, Homo sapiens
ccagagaagcccct

SEQ ID NO: 6059660 - DNA, 19 bp, Homo sapiens
ccagagaagcctattttta

SEQ ID NO: 6059661 - DNA, 22 bp, Homo sapiens
ccagagaagcctcagtccctcc

SEQ ID NO: 6059662 - DNA, 12 bp, Homo sapiens
ccagagaagcta

SEQ ID NO: 6059663 - DNA, 16 bp, Homo sapiens
ccagagaaggacggtg

SEQ ID NO: 6059664 - DNA, 21 bp, Homo sapiens
ccagagaaggacggtgccaag

SEQ ID NO: 6059665 - DNA, 14 bp, Homo sapiens
ccagagaagtgaca

SEQ ID NO: 6059666 - DNA, 15 bp, Homo sapiens
ccagagaagtgacag

SEQ ID NO: 6059667 - DNA, 19 bp, Homo sapiens
ccagagaagtgacagggaa

SEQ ID NO: 6059668 - DNA, 22 bp, Homo sapiens
ccagagaagtgacagggaagct

SEQ ID NO: 6059669 - DNA, 24 bp, Homo sapiens
ccagagaatagatcagtatttcac

SEQ ID NO: 6059670 - DNA, 16 bp, Homo sapiens
ccagagaatgcacctc

SEQ ID NO: 6059671 - DNA, 16 bp, Homo sapiens
ccagagaatgctttga

SEQ ID NO: 6059672 - DNA, 11 bp, Homo sapiens
ccagagacata

SEQ ID NO: 6059673 - DNA, 17 bp, Homo sapiens
ccagagacatacttgaa

SEQ ID NO: 6059674 - DNA, 17 bp, Homo sapiens
ccagagacatgggcctc

SEQ ID NO: 6059675 - DNA, 23 bp, Homo sapiens
ccagagacatgtggcagcaggca

SEQ ID NO: 6059676 - DNA, 14 bp, Homo sapiens
ccagagacccagcg

SEQ ID NO: 6059677 - DNA, 21 bp, Homo sapiens
ccagagacccagcggacacac

SEQ ID NO: 6059678 - DNA, 19 bp, Homo sapiens
ccagagaccgtcctcaccc

SEQ ID NO: 6059679 - DNA, 12 bp, Homo sapiens
ccagagacctca

SEQ ID NO: 6059680 - DNA, 14 bp, Homo sapiens
ccagagacctcatc

SEQ ID NO: 6059681 - DNA, 18 bp, Homo sapiens
ccagagacctcatcagcc

SEQ ID NO: 6059682 - DNA, 14 bp, Homo sapiens
ccagagacctgctc

SEQ ID NO: 6059683 - DNA, 17 bp, Homo sapiens
ccagagacctgctccag

SEQ ID NO: 6059684 - DNA, 18 bp, Homo sapiens
ccagagacctttgcccac

SEQ ID NO: 6059685 - DNA, 19 bp, Homo sapiens
ccagagacctttgcccaca

SEQ ID NO: 6059686 - DNA, 21 bp, Homo sapiens
ccagagaccttttctctccca

SEQ ID NO: 6059687 - DNA, 16 bp, Homo sapiens
ccagagacgcccagcc

SEQ ID NO: 6059688 - DNA, 17 bp, Homo sapiens
ccagagacgcccagccc

SEQ ID NO: 6059689 - DNA, 15 bp, Homo sapiens
ccagagactcagagg

SEQ ID NO: 6059690 - DNA, 14 bp, Homo sapiens
ccagagactgccca

SEQ ID NO: 6059691 - DNA, 15 bp, Homo sapiens
ccagagactgcccac

SEQ ID NO: 6059692 - DNA, 19 bp, Homo sapiens
ccagagactgcccaccctg

SEQ ID NO: 6059693 - DNA, 12 bp, Homo sapiens
ccagagagaaaa

SEQ ID NO: 6059694 - DNA, 23 bp, Homo sapiens
ccagagagaaagaagatttatta

SEQ ID NO: 6059695 - DNA, 21 bp, Homo sapiens
ccagagagaaatcaggcctga

SEQ ID NO: 6059696 - DNA, 17 bp, Homo sapiens
ccagagagaagagcccc

SEQ ID NO: 6059697 - DNA, 20 bp, Homo sapiens
ccagagagaagagccccact

SEQ ID NO: 6059698 - DNA, 19 bp, Homo sapiens
ccagagagaagcaccccac

SEQ ID NO: 6059699 - DNA, 14 bp, Homo sapiens
ccagagagacagac

SEQ ID NO: 6059700 - DNA, 21 bp, Homo sapiens
ccagagagagaagtgcccctg

SEQ ID NO: 6059701 - DNA, 22 bp, Homo sapiens
cccgccgcgccagtccccgcta

SEQ ID NO: 6059702 - DNA, 14 bp, Homo sapiens
cccgccggaggaag

SEQ ID NO: 6059703 - DNA, 20 bp, Homo sapiens
cccgccggaggccagctatc

SEQ ID NO: 6059704 - DNA, 21 bp, Homo sapiens
cccgccggaggccagctatct

SEQ ID NO: 6059705 - DNA, 19 bp, Homo sapiens
cccgccggccgcgcaccgc

SEQ ID NO: 6059706 - DNA, 22 bp, Homo sapiens
cccgccggccgcgcaccgccat

SEQ ID NO: 6059707 - DNA, 18 bp, Homo sapiens
cccgccggttggccggct

SEQ ID NO: 6059708 - DNA, 22 bp, Homo sapiens
cccgccggttggccggctggcc

SEQ ID NO: 6059709 - DNA, 15 bp, Homo sapiens
cccgccgtctgctcc

SEQ ID NO: 6059710 - DNA, 22 bp, Homo sapiens
cccgccgtctgctccggggtgg

SEQ ID NO: 6059711 - DNA, 13 bp, Homo sapiens
cccgccgtgcctg

SEQ ID NO: 6059712 - DNA, 16 bp, Homo sapiens
cccgcctagctgctgt

SEQ ID NO: 6059713 - DNA, 22 bp, Homo sapiens
cccgcctcaaggaagagccagc

SEQ ID NO: 6059714 - DNA, 23 bp, Homo sapiens
cccgcctcaaggaagagccagcc

SEQ ID NO: 6059715 - DNA, 14 bp, Homo sapiens
cccgcctcagcctc

SEQ ID NO: 6059716 - DNA, 22 bp, Homo sapiens
cccgcctccactctagttctag

SEQ ID NO: 6059717 - DNA, 19 bp, Homo sapiens
cccgcctcccccgcaggtt

SEQ ID NO: 6059718 - DNA, 13 bp, Homo sapiens
cccgcctccctct

SEQ ID NO: 6059719 - DNA, 15 bp, Homo sapiens
cccgcctccctctca

SEQ ID NO: 6059720 - DNA, 12 bp, Homo sapiens
cccgcctcctcc

SEQ ID NO: 6059721 - DNA, 23 bp, Homo sapiens
cccgcctgagctcctgctgcgga

SEQ ID NO: 6059722 - DNA, 23 bp, Homo sapiens
cccgcctgagtcagtgctctcag

SEQ ID NO: 6059723 - DNA, 16 bp, Homo sapiens
cccgcctgccagtcct

SEQ ID NO: 6059724 - DNA, 17 bp, Homo sapiens
cccgcctgccctcatgg

SEQ ID NO: 6059725 - DNA, 15 bp, Homo sapiens
cccgcctgccctccc

SEQ ID NO: 6059726 - DNA, 20 bp, Homo sapiens
cccgcctgccctcccacccc

SEQ ID NO: 6059727 - DNA, 14 bp, Homo sapiens
cccgcctgccgtgc

SEQ ID NO: 6059728 - DNA, 16 bp, Homo sapiens
cccgcctgccgtgcat

SEQ ID NO: 6059729 - DNA, 12 bp, Homo sapiens
cccgcctgcctc

SEQ ID NO: 6059730 - DNA, 14 bp, Homo sapiens
cccgcctgcctcct

SEQ ID NO: 6059731 - DNA, 13 bp, Homo sapiens
cccgcctgcgccc

SEQ ID NO: 6059732 - DNA, 17 bp, Homo sapiens
cccgcctggcagaactg

SEQ ID NO: 6059733 - DNA, 11 bp, Homo sapiens
cccgcctggcc

SEQ ID NO: 6059734 - DNA, 14 bp, Homo sapiens
cccgcctggccagg

SEQ ID NO: 6059735 - DNA, 15 bp, Homo sapiens
cccgcctggccagga

SEQ ID NO: 6059736 - DNA, 13 bp, Homo sapiens
cccgcctgtcaca

SEQ ID NO: 6059737 - DNA, 13 bp, Homo sapiens
cccgcctgttccc

SEQ ID NO: 6059738 - DNA, 14 bp, Homo sapiens
cccgcctgttcccc

SEQ ID NO: 6059739 - DNA, 20 bp, Homo sapiens
cccgccttcaggttcctcct

SEQ ID NO: 6059740 - DNA, 22 bp, Homo sapiens
cccgccttccaaaacctgcttc

SEQ ID NO: 6059741 - DNA, 14 bp, Homo sapiens
cccgccttccctca

SEQ ID NO: 6059742 - DNA, 19 bp, Homo sapiens
cccgccttccctcactctt

SEQ ID NO: 6059743 - DNA, 11 bp, Homo sapiens
cccgccttcct

SEQ ID NO: 6059744 - DNA, 19 bp, Homo sapiens
cccgccttcctcctccaca

SEQ ID NO: 6059745 - DNA, 23 bp, Homo sapiens
cccgccttcctgggcagcctttc

SEQ ID NO: 6059746 - DNA, 12 bp, Homo sapiens
cccgccttggcc

SEQ ID NO: 6059747 - DNA, 19 bp, Homo sapiens
cccgccttggcctcccaaa

SEQ ID NO: 6059748 - DNA, 14 bp, Homo sapiens
cccgccttggcctg

SEQ ID NO: 6059749 - DNA, 14 bp, Homo sapiens
cccgccttgtgaga

SEQ ID NO: 6059750 - DNA, 13 bp, Homo sapiens
cccgcgaccaccc

SEQ ID NO: 6059751 - DNA, 14 bp, Homo sapiens
cccgcgaccacccc

SEQ ID NO: 6059752 - DNA, 23 bp, Homo sapiens
cccgcgatgtggaactgctgcca

SEQ ID NO: 6059753 - DNA, 16 bp, Homo sapiens
cccgcgcaccccacgc

SEQ ID NO: 6059754 - DNA, 17 bp, Homo sapiens
cccgcgcagctgcctag

SEQ ID NO: 6059755 - DNA, 13 bp, Homo sapiens
cccgcgccaggcc

SEQ ID NO: 6059756 - DNA, 17 bp, Homo sapiens
cccgcgcccgcgccctc

SEQ ID NO: 6059757 - DNA, 15 bp, Homo sapiens
cccgcgccctccctc

SEQ ID NO: 6059758 - DNA, 17 bp, Homo sapiens
cccgcgcgtgcccccag

SEQ ID NO: 6059759 - DNA, 17 bp, Homo sapiens
cccgcggagcccccgcc

SEQ ID NO: 6059760 - DNA, 22 bp, Homo sapiens
cccgcggcccagacccagcccg

SEQ ID NO: 6059761 - DNA, 17 bp, Homo sapiens
cccgcgggaagccagcc

SEQ ID NO: 6059762 - DNA, 15 bp, Homo sapiens
cccgcgggcacagcc

SEQ ID NO: 6059763 - DNA, 17 bp, Homo sapiens
cccgcgggcacagccag

SEQ ID NO: 6059764 - DNA, 16 bp, Homo sapiens
cccgcgggcctggaca

SEQ ID NO: 6059765 - DNA, 22 bp, Homo sapiens
cccgcggggctgtcggcgctgc

SEQ ID NO: 6059766 - DNA, 14 bp, Homo sapiens
cccgcgggttctag

SEQ ID NO: 6059767 - DNA, 18 bp, Homo sapiens
cccgcggtgctgactgag

SEQ ID NO: 6059768 - DNA, 13 bp, Homo sapiens
cccgctaaggaag

SEQ ID NO: 6059769 - DNA, 20 bp, Homo sapiens
cccgctacaattctgcagaa

SEQ ID NO: 6059770 - DNA, 21 bp, Homo sapiens
cccgctagtggtagtatctcg

SEQ ID NO: 6059771 - DNA, 18 bp, Homo sapiens
cccgctcaacctctcaga

SEQ ID NO: 6059772 - DNA, 21 bp, Homo sapiens
cccgctcacgctgacagcctc

SEQ ID NO: 6059773 - DNA, 13 bp, Homo sapiens
cccgctcagccct

SEQ ID NO: 6059774 - DNA, 15 bp, Homo sapiens
cccgctcagccctcc

SEQ ID NO: 6059775 - DNA, 13 bp, Homo sapiens
cccgctcaggctg

SEQ ID NO: 6059776 - DNA, 12 bp, Homo sapiens
cccgctccagat

SEQ ID NO: 6059777 - DNA, 19 bp, Homo sapiens
cccgctcccacagcttcct

SEQ ID NO: 6059778 - DNA, 13 bp, Homo sapiens
cccgctccccacc

SEQ ID NO: 6059779 - DNA, 20 bp, Homo sapiens
cccgctccgtctctgtcctc

SEQ ID NO: 6059780 - DNA, 18 bp, Homo sapiens
cccgctcctgccgcagac

SEQ ID NO: 6059781 - DNA, 23 bp, Homo sapiens
cccgctcctgccgcagacgggca

SEQ ID NO: 6059782 - DNA, 13 bp, Homo sapiens
cccgctctccctg

SEQ ID NO: 6059783 - DNA, 16 bp, Homo sapiens
cccgctctctggctgt

SEQ ID NO: 6059784 - DNA, 14 bp, Homo sapiens
cccgctctgcatgc

SEQ ID NO: 6059785 - DNA, 17 bp, Homo sapiens
cccgctctgcattgcct

SEQ ID NO: 6059786 - DNA, 15 bp, Homo sapiens
cccgctctgccatca

SEQ ID NO: 6059787 - DNA, 23 bp, Homo sapiens
cccgctctgccgccgcccgctgg

SEQ ID NO: 6059788 - DNA, 23 bp, Homo sapiens
cccgctcttcccaagtcctcgcc

SEQ ID NO: 6059789 - DNA, 17 bp, Homo sapiens
cccgctgagtggactgg

SEQ ID NO: 6059790 - DNA, 19 bp, Homo sapiens
cccgctgagtggactggag

SEQ ID NO: 6059791 - DNA, 22 bp, Homo sapiens
cccgctgatggagccccacctt

SEQ ID NO: 6059792 - DNA, 16 bp, Homo sapiens
cccgctgcccagccct

SEQ ID NO: 6059793 - DNA, 17 bp, Homo sapiens
cccgctgcccagccctc

SEQ ID NO: 6059794 - DNA, 22 bp, Homo sapiens
cccgctgcccagccctcccagc

SEQ ID NO: 6059795 - DNA, 15 bp, Homo sapiens
cccgctgcctcttgg

SEQ ID NO: 6059796 - DNA, 16 bp, Homo sapiens
cccgctgcctcttggc

SEQ ID NO: 6059797 - DNA, 14 bp, Homo sapiens
cccgctgcctggcg

SEQ ID NO: 6059798 - DNA, 16 bp, Homo sapiens
cccgctgcgctgccct

SEQ ID NO: 6059799 - DNA, 18 bp, Homo sapiens
cccgctgcgctgccctgc

SEQ ID NO: 6059800 - DNA, 19 bp, Homo sapiens
cccgctgcgctgccctgca

SEQ ID NO: 6059801 - DNA, 12 bp, Homo sapiens
cccgctggagga

SEQ ID NO: 6059802 - DNA, 13 bp, Homo sapiens
cccgctggaggat

SEQ ID NO: 6059803 - DNA, 16 bp, Homo sapiens
cccgctggcagccacc

SEQ ID NO: 6059804 - DNA, 13 bp, Homo sapiens
cccgctggctggg

SEQ ID NO: 6059805 - DNA, 21 bp, Homo sapiens
cccgctgggatttcttcgctg

SEQ ID NO: 6059806 - DNA, 12 bp, Homo sapiens
cccgctgggctg

SEQ ID NO: 6059807 - DNA, 11 bp, Homo sapiens
cccgctggggg

SEQ ID NO: 6059808 - DNA, 15 bp, Homo sapiens
cccgctgtggccgca

SEQ ID NO: 6059809 - DNA, 24 bp, Homo sapiens
cccgctgtggccggtgccagctgc

SEQ ID NO: 6059810 - DNA, 15 bp, Homo sapiens
cccgctgtgtcctcc

SEQ ID NO: 6059811 - DNA, 16 bp, Homo sapiens
cccgcttagccccgct

SEQ ID NO: 6059812 - DNA, 15 bp, Homo sapiens
cccgcttagcctgcc

SEQ ID NO: 6059813 - DNA, 18 bp, Homo sapiens
cccgcttagcctgcctca

SEQ ID NO: 6059814 - DNA, 19 bp, Homo sapiens
cccgcttagcctgcctcac

SEQ ID NO: 6059815 - DNA, 21 bp, Homo sapiens
cccgcttagcctgcctcaccc

SEQ ID NO: 6059816 - DNA, 17 bp, Homo sapiens
cccgcttagcgctctgg

SEQ ID NO: 6059817 - DNA, 14 bp, Homo sapiens
cccgcttagttctt

SEQ ID NO: 6059818 - DNA, 12 bp, Homo sapiens
cccgcttcccca

SEQ ID NO: 6059819 - DNA, 15 bp, Homo sapiens
cccgcttccccacag

SEQ ID NO: 6059820 - DNA, 19 bp, Homo sapiens
cccgcttccccacagaact

SEQ ID NO: 6059821 - DNA, 22 bp, Homo sapiens
cccgcttcctccggctggacct

SEQ ID NO: 6059822 - DNA, 12 bp, Homo sapiens
cccgcttgcctc

SEQ ID NO: 6059823 - DNA, 18 bp, Homo sapiens
cccgcttttgcagcagag

SEQ ID NO: 6059824 - DNA, 22 bp, Homo sapiens
cccgcttttgttcttccccaca

SEQ ID NO: 6059825 - DNA, 15 bp, Homo sapiens
cccggaagaaccaga

SEQ ID NO: 6059826 - DNA, 16 bp, Homo sapiens
cccggacaagcccagg

SEQ ID NO: 6059827 - DNA, 13 bp, Homo sapiens
cccggacctctgg

SEQ ID NO: 6059828 - DNA, 15 bp, Homo sapiens
cccggacgctggctc

SEQ ID NO: 6059829 - DNA, 17 bp, Homo sapiens
cccggagaaacctgatg

SEQ ID NO: 6059830 - DNA, 22 bp, Homo sapiens
cccggagaaggccgctgcccca

SEQ ID NO: 6059831 - DNA, 16 bp, Homo sapiens
cccggagcacagccct

SEQ ID NO: 6059832 - DNA, 19 bp, Homo sapiens
cccggagcaccacggggtc

SEQ ID NO: 6059833 - DNA, 12 bp, Homo sapiens
cccggagcagca

SEQ ID NO: 6059834 - DNA, 14 bp, Homo sapiens
cccggagcagcagg

SEQ ID NO: 6059835 - DNA, 18 bp, Homo sapiens
cccggagcaggggtctga

SEQ ID NO: 6059836 - DNA, 21 bp, Homo sapiens
cccggagccatcaccctcacc

SEQ ID NO: 6059837 - DNA, 12 bp, Homo sapiens
cccggagcccca

SEQ ID NO: 6059838 - DNA, 13 bp, Homo sapiens
cccggagctcaag

SEQ ID NO: 6059839 - DNA, 17 bp, Homo sapiens
cccggagctgcccctct

SEQ ID NO: 6059840 - DNA, 14 bp, Homo sapiens
cccggagctggagg

SEQ ID NO: 6059841 - DNA, 20 bp, Homo sapiens
cccggaggaaatctgcagag

SEQ ID NO: 6059842 - DNA, 14 bp, Homo sapiens
cccggaggccttcc

SEQ ID NO: 6059843 - DNA, 16 bp, Homo sapiens
cccggaggcgcccacc

SEQ ID NO: 6059844 - DNA, 18 bp, Homo sapiens
cccggaggcgcccacctg

SEQ ID NO: 6059845 - DNA, 22 bp, Homo sapiens
cccggaggcgcccacctgccca

SEQ ID NO: 6059846 - DNA, 19 bp, Homo sapiens
cccggaggcggtgggcctg

SEQ ID NO: 6059847 - DNA, 20 bp, Homo sapiens
cccggaggcgtggaggagag

SEQ ID NO: 6059848 - DNA, 23 bp, Homo sapiens
cccggaggcgtggaggagaggag

SEQ ID NO: 6059849 - DNA, 18 bp, Homo sapiens
cccggaggggcctggcag

SEQ ID NO: 6059850 - DNA, 14 bp, Homo sapiens
cccggatcagagca

SEQ ID NO: 6059851 - DNA, 17 bp, Homo sapiens
cccggatcagagcagga

SEQ ID NO: 6059852 - DNA, 18 bp, Homo sapiens
cccggatcgaggacaagt

SEQ ID NO: 6059853 - DNA, 18 bp, Homo sapiens
cccggatctccaggccca

SEQ ID NO: 6059854 - DNA, 19 bp, Homo sapiens
cccggatctccaggcccag

SEQ ID NO: 6059855 - DNA, 21 bp, Homo sapiens
cccggatgaactcaatgcatg

SEQ ID NO: 6059856 - DNA, 17 bp, Homo sapiens
cccggatgacttgggga

SEQ ID NO: 6059857 - DNA, 18 bp, Homo sapiens
cccggatgtgtgtctcac

SEQ ID NO: 6059858 - DNA, 23 bp, Homo sapiens
cccggcacagagtcgatgctcaa

SEQ ID NO: 6059859 - DNA, 11 bp, Homo sapiens
cccggcacccc

SEQ ID NO: 6059860 - DNA, 17 bp, Homo sapiens
cccggcaccccctgcag

SEQ ID NO: 6059861 - DNA, 19 bp, Homo sapiens
cccggcaccctctggccgc

SEQ ID NO: 6059862 - DNA, 13 bp, Homo sapiens
cccggcactccag

SEQ ID NO: 6059863 - DNA, 17 bp, Homo sapiens
cccggcagccccccagt

SEQ ID NO: 6059864 - DNA, 13 bp, Homo sapiens
cccggcaggccct

SEQ ID NO: 6059865 - DNA, 14 bp, Homo sapiens
cccggcaggccctg

SEQ ID NO: 6059866 - DNA, 18 bp, Homo sapiens
cccggcaggccctgcagt

SEQ ID NO: 6059867 - DNA, 21 bp, Homo sapiens
cccggcagggcgggcagaggg

SEQ ID NO: 6059868 - DNA, 21 bp, Homo sapiens
cccggcatcatttcccctccc

SEQ ID NO: 6059869 - DNA, 16 bp, Homo sapiens
cccggcattctctgcc

SEQ ID NO: 6059870 - DNA, 18 bp, Homo sapiens
cccggcattctctgccca

SEQ ID NO: 6059871 - DNA, 17 bp, Homo sapiens
cccggccaaggacactg

SEQ ID NO: 6059872 - DNA, 19 bp, Homo sapiens
cccggccaaggacccaggc

SEQ ID NO: 6059873 - DNA, 23 bp, Homo sapiens
cccggccaaggacccaggcgctg

SEQ ID NO: 6059874 - DNA, 24 bp, Homo sapiens
cccggccaaggacccaggcgctgc

SEQ ID NO: 6059875 - DNA, 16 bp, Homo sapiens
cccggccacacccagc

SEQ ID NO: 6059876 - DNA, 18 bp, Homo sapiens
cccggccacacccagcgg

SEQ ID NO: 6059877 - DNA, 21 bp, Homo sapiens
cccggccacagctgctggaga

SEQ ID NO: 6059878 - DNA, 14 bp, Homo sapiens
cccggccacctctg

SEQ ID NO: 6059879 - DNA, 18 bp, Homo sapiens
cccggccactccctgcca

SEQ ID NO: 6059880 - DNA, 11 bp, Homo sapiens
cccggccagcc

SEQ ID NO: 6059881 - DNA, 20 bp, Homo sapiens
cccggccagcgggcacaggg

SEQ ID NO: 6059882 - DNA, 22 bp, Homo sapiens
cccggccagcgggcacagggca

SEQ ID NO: 6059883 - DNA, 17 bp, Homo sapiens
cccggccagggcctggt

SEQ ID NO: 6059884 - DNA, 14 bp, Homo sapiens
cccggcccaacctc

SEQ ID NO: 6059885 - DNA, 13 bp, Homo sapiens
cccggcccacgca

SEQ ID NO: 6059886 - DNA, 19 bp, Homo sapiens
cccggcccacgcagagccc

SEQ ID NO: 6059887 - DNA, 13 bp, Homo sapiens
cccggcccagcct

SEQ ID NO: 6059888 - DNA, 20 bp, Homo sapiens
cccggcccagtgccccctgg

SEQ ID NO: 6059889 - DNA, 21 bp, Homo sapiens
cccggccccaccccctgggca

SEQ ID NO: 6059890 - DNA, 14 bp, Homo sapiens
cccggccccagcca

SEQ ID NO: 6059891 - DNA, 14 bp, Homo sapiens
cccggcccctcacc

SEQ ID NO: 6059892 - DNA, 17 bp, Homo sapiens
cccggcccctgccccgc

SEQ ID NO: 6059893 - DNA, 20 bp, Homo sapiens
cccggccctcccccagctcc

SEQ ID NO: 6059894 - DNA, 14 bp, Homo sapiens
cccggccgcgccgc

SEQ ID NO: 6059895 - DNA, 12 bp, Homo sapiens
cccggccggaga

SEQ ID NO: 6059896 - DNA, 17 bp, Homo sapiens
cccggccggagggcagg

SEQ ID NO: 6059897 - DNA, 19 bp, Homo sapiens
cccggccggccctggcttg

SEQ ID NO: 6059898 - DNA, 14 bp, Homo sapiens
cccggccggcctgg

SEQ ID NO: 6059899 - DNA, 14 bp, Homo sapiens
cccggcctcagggc

SEQ ID NO: 6059900 - DNA, 17 bp, Homo sapiens
cccggcctcagggcgct

SEQ ID NO: 6059901 - DNA, 13 bp, Homo sapiens
cccggcctcctag

SEQ ID NO: 6059902 - DNA, 15 bp, Homo sapiens
cccggcctgatggcc

SEQ ID NO: 6059903 - DNA, 20 bp, Homo sapiens
cccggcctgctcccagcagc

SEQ ID NO: 6059904 - DNA, 17 bp, Homo sapiens
cccggcctggccccctc

SEQ ID NO: 6059905 - DNA, 18 bp, Homo sapiens
cccggcctggccccctcg

SEQ ID NO: 6059906 - DNA, 23 bp, Homo sapiens
cccggcgccccgcacctgtacag

SEQ ID NO: 6059907 - DNA, 16 bp, Homo sapiens
cccggcgccctctgtc

SEQ ID NO: 6059908 - DNA, 20 bp, Homo sapiens
cccggcgccctctgtcctga

SEQ ID NO: 6059909 - DNA, 16 bp, Homo sapiens
cccggcgcctgccctg

SEQ ID NO: 6059910 - DNA, 19 bp, Homo sapiens
cccggcgcggtggctcacg

SEQ ID NO: 6059911 - DNA, 20 bp, Homo sapiens
cccggcggggtgcctgctgt

SEQ ID NO: 6059912 - DNA, 22 bp, Homo sapiens
cccggcgtttacctcgtggtgt

SEQ ID NO: 6059913 - DNA, 17 bp, Homo sapiens
cccggctaatttttgta

SEQ ID NO: 6059914 - DNA, 14 bp, Homo sapiens
cccggctccaggct

SEQ ID NO: 6059915 - DNA, 13 bp, Homo sapiens
cccggctcccacc

SEQ ID NO: 6059916 - DNA, 17 bp, Homo sapiens
cccggctcccaccgagg

SEQ ID NO: 6059917 - DNA, 14 bp, Homo sapiens
cccggctccccctg

SEQ ID NO: 6059918 - DNA, 18 bp, Homo sapiens
cccggctccccctgccag

SEQ ID NO: 6059919 - DNA, 22 bp, Homo sapiens
cccggctcctggtcacctagga

SEQ ID NO: 6059920 - DNA, 18 bp, Homo sapiens
cccggctctacgggggcc

SEQ ID NO: 6059921 - DNA, 17 bp, Homo sapiens
cccggctctgaggctgc

SEQ ID NO: 6059922 - DNA, 16 bp, Homo sapiens
cccggctctgtgggtg

SEQ ID NO: 6059923 - DNA, 16 bp, Homo sapiens
cccggctgaccctgtg

SEQ ID NO: 6059924 - DNA, 20 bp, Homo sapiens
cccggctgactcagtgcagg

SEQ ID NO: 6059925 - DNA, 12 bp, Homo sapiens
cccggctgagcc

SEQ ID NO: 6059926 - DNA, 19 bp, Homo sapiens
cccggctgagccccccatg

SEQ ID NO: 6059927 - DNA, 14 bp, Homo sapiens
cccggctgcctgcc

SEQ ID NO: 6059928 - DNA, 17 bp, Homo sapiens
cccggctgctgcttgga

SEQ ID NO: 6059929 - DNA, 17 bp, Homo sapiens
cccggctgggcccgagg

SEQ ID NO: 6059930 - DNA, 23 bp, Homo sapiens
cccggctgggtcggccctgccca

SEQ ID NO: 6059931 - DNA, 23 bp, Homo sapiens
cccggctggttttgtaagatgct

SEQ ID NO: 6059932 - DNA, 20 bp, Homo sapiens
cccggctgtgattgctgcca

SEQ ID NO: 6059933 - DNA, 20 bp, Homo sapiens
cccggcttcctttcccaagc

SEQ ID NO: 6059934 - DNA, 17 bp, Homo sapiens
cccggctttcctccgga

SEQ ID NO: 6059935 - DNA, 18 bp, Homo sapiens
cccggctttggtgcgggg

SEQ ID NO: 6059936 - DNA, 15 bp, Homo sapiens
cccgggaagcaaatg

SEQ ID NO: 6059937 - DNA, 19 bp, Homo sapiens
cccgggaagcatcctcccc

SEQ ID NO: 6059938 - DNA, 22 bp, Homo sapiens
cccgggaagcatcctccccacc

SEQ ID NO: 6059939 - DNA, 12 bp, Homo sapiens
cccgggaaggaa

SEQ ID NO: 6059940 - DNA, 15 bp, Homo sapiens
cccgggaagggggct

SEQ ID NO: 6059941 - DNA, 21 bp, Homo sapiens
cccgggaagggggctgggaca

SEQ ID NO: 6059942 - DNA, 17 bp, Homo sapiens
cccgggaccacagctgc

SEQ ID NO: 6059943 - DNA, 20 bp, Homo sapiens
cccgggaccacagctgctgg

SEQ ID NO: 6059944 - DNA, 21 bp, Homo sapiens
cccgggagatccgccctgggc

SEQ ID NO: 6059945 - DNA, 12 bp, Homo sapiens
cccgggagccta

SEQ ID NO: 6059946 - DNA, 13 bp, Homo sapiens
cccgggagcctag

SEQ ID NO: 6059947 - DNA, 18 bp, Homo sapiens
cccgggagcctaggacca

SEQ ID NO: 6059948 - DNA, 19 bp, Homo sapiens
cccgggagctgctgccctg

SEQ ID NO: 6059949 - DNA, 18 bp, Homo sapiens
cccgggagctgggccctg

SEQ ID NO: 6059950 - DNA, 20 bp, Homo sapiens
cccgggagctgggccctgcc

SEQ ID NO: 6059951 - DNA, 24 bp, Homo sapiens
cccgggagctgggccctgcctgca

SEQ ID NO: 6059952 - DNA, 13 bp, Homo sapiens
cccgggagctttg

SEQ ID NO: 6059953 - DNA, 23 bp, Homo sapiens
cccgggaggaacgtggttcagag

SEQ ID NO: 6059954 - DNA, 20 bp, Homo sapiens
cccgggaggaggatccgggc

SEQ ID NO: 6059955 - DNA, 23 bp, Homo sapiens
cccgggaggcggaggttccagtg

SEQ ID NO: 6059956 - DNA, 23 bp, Homo sapiens
cccgggaggtggagcttgcagtg

SEQ ID NO: 6059957 - DNA, 13 bp, Homo sapiens
cccgggatcctga

SEQ ID NO: 6059958 - DNA, 13 bp, Homo sapiens
cccgggatgcacc

SEQ ID NO: 6059959 - DNA, 17 bp, Homo sapiens
cccgggcaaagggtctt

SEQ ID NO: 6059960 - DNA, 22 bp, Homo sapiens
cccgggcactgtcatgcccagc

SEQ ID NO: 6059961 - DNA, 16 bp, Homo sapiens
cccgggcagcagagag

SEQ ID NO: 6059962 - DNA, 13 bp, Homo sapiens
cccgggcaggcca

SEQ ID NO: 6059963 - DNA, 15 bp, Homo sapiens
cccgggcaggccagc

SEQ ID NO: 6059964 - DNA, 21 bp, Homo sapiens
cccgggcagggctcccacaga

SEQ ID NO: 6059965 - DNA, 18 bp, Homo sapiens
cccgggcaggggccgctt

SEQ ID NO: 6059966 - DNA, 14 bp, Homo sapiens
cccgggccacgccc

SEQ ID NO: 6059967 - DNA, 16 bp, Homo sapiens
cccgggccacgcccca

SEQ ID NO: 6059968 - DNA, 15 bp, Homo sapiens
cccgggcccccgccc

SEQ ID NO: 6059969 - DNA, 17 bp, Homo sapiens
cccgggccctcctgggc

SEQ ID NO: 6059970 - DNA, 18 bp, Homo sapiens
cccgggcctcagggtcct

SEQ ID NO: 6059971 - DNA, 14 bp, Homo sapiens
cccgggcctgcctc

SEQ ID NO: 6059972 - DNA, 16 bp, Homo sapiens
cccgggcctgcctctg

SEQ ID NO: 6059973 - DNA, 20 bp, Homo sapiens
cccgggctcagggaccacag

SEQ ID NO: 6059974 - DNA, 18 bp, Homo sapiens
cccgggctctcctgccct

SEQ ID NO: 6059975 - DNA, 17 bp, Homo sapiens
cccgggctctctgctgt

SEQ ID NO: 6059976 - DNA, 14 bp, Homo sapiens
cccgggctctgcct

SEQ ID NO: 6059977 - DNA, 16 bp, Homo sapiens
cccgggctctggccac

SEQ ID NO: 6059978 - DNA, 14 bp, Homo sapiens
cccgggctgaccca

SEQ ID NO: 6059979 - DNA, 12 bp, Homo sapiens
cccgggctgcct

SEQ ID NO: 6059980 - DNA, 17 bp, Homo sapiens
cccgggctgcctgggct

SEQ ID NO: 6059981 - DNA, 23 bp, Homo sapiens
cccgggctgcctgggctgttggc

SEQ ID NO: 6059982 - DNA, 14 bp, Homo sapiens
cccgggctggccct

SEQ ID NO: 6059983 - DNA, 18 bp, Homo sapiens
cccgggctggccctgtgc

SEQ ID NO: 6059984 - DNA, 16 bp, Homo sapiens
cccgggctgggcccct

SEQ ID NO: 6059985 - DNA, 21 bp, Homo sapiens
cccgggctgggcccctccagg

SEQ ID NO: 6059986 - DNA, 16 bp, Homo sapiens
cccggggaccctgtga

SEQ ID NO: 6059987 - DNA, 17 bp, Homo sapiens
cccggggagctgcagag

SEQ ID NO: 6059988 - DNA, 17 bp, Homo sapiens
cccggggcagagctcag

SEQ ID NO: 6059989 - DNA, 20 bp, Homo sapiens
cccggggcagagctcagagg

SEQ ID NO: 6059990 - DNA, 21 bp, Homo sapiens
cccggggcagctgccagagaa

SEQ ID NO: 6059991 - DNA, 14 bp, Homo sapiens
cccggggcagctgg

SEQ ID NO: 6059992 - DNA, 20 bp, Homo sapiens
cccggggcagctggcaggag

SEQ ID NO: 6059993 - DNA, 20 bp, Homo sapiens
cccggggcctggacaggcgg

SEQ ID NO: 6059994 - DNA, 13 bp, Homo sapiens
cccggggcctgtt

SEQ ID NO: 6059995 - DNA, 17 bp, Homo sapiens
cccggggctggcaagca

SEQ ID NO: 6059996 - DNA, 18 bp, Homo sapiens
cccggggtcctgtggcag

SEQ ID NO: 6059997 - DNA, 22 bp, Homo sapiens
cccggggtcctgtggcaggcag

SEQ ID NO: 6059998 - DNA, 20 bp, Homo sapiens
cccggggtctccacctcagg

SEQ ID NO: 6059999 - DNA, 13 bp, Homo sapiens
cccggggtgcccg

SEQ ID NO: 6060000 - DNA, 16 bp, Homo sapiens
cccggggtggccacag

SEQ ID NO: 6060001 - DNA, 21 bp, Homo sapiens
cccgggtactcagtcagccca

SEQ ID NO: 6060002 - DNA, 19 bp, Homo sapiens
cccgggtctggtgctgagg

SEQ ID NO: 6060003 - DNA, 14 bp, Homo sapiens
cccgggtgcctgtg

SEQ ID NO: 6060004 - DNA, 23 bp, Homo sapiens
cccgggttcacgccattctcctg

SEQ ID NO: 6060005 - DNA, 16 bp, Homo sapiens
cccgggttcagcctgg

SEQ ID NO: 6060006 - DNA, 17 bp, Homo sapiens
cccgggttcagcctggc

SEQ ID NO: 6060007 - DNA, 21 bp, Homo sapiens
cccgggttcagcctggcctgc

SEQ ID NO: 6060008 - DNA, 18 bp, Homo sapiens
cccgggttgggtcaccag

SEQ ID NO: 6060009 - DNA, 22 bp, Homo sapiens
cccgggtttggcgggccaagga

SEQ ID NO: 6060010 - DNA, 14 bp, Homo sapiens
cccggtccacaggt

SEQ ID NO: 6060011 - DNA, 16 bp, Homo sapiens
cccggtccacaggtcc

SEQ ID NO: 6060012 - DNA, 21 bp, Homo sapiens
cccggtccacaggtccaagga

SEQ ID NO: 6060013 - DNA, 14 bp, Homo sapiens
cccggtcccctctg

SEQ ID NO: 6060014 - DNA, 19 bp, Homo sapiens
cccggtccccttcccaggg

SEQ ID NO: 6060015 - DNA, 20 bp, Homo sapiens
cccggtgcagggcctggcat

SEQ ID NO: 6060016 - DNA, 18 bp, Homo sapiens
cccggtgccatcttccat

SEQ ID NO: 6060017 - DNA, 13 bp, Homo sapiens
cccggtgcctctc

SEQ ID NO: 6060018 - DNA, 13 bp, Homo sapiens
cccggtgctccct

SEQ ID NO: 6060019 - DNA, 15 bp, Homo sapiens
cccggtggcagtgga

SEQ ID NO: 6060020 - DNA, 22 bp, Homo sapiens
cccggtggcggcagggccaggc

SEQ ID NO: 6060021 - DNA, 21 bp, Homo sapiens
cccggtggcttctggcacctg

SEQ ID NO: 6060022 - DNA, 17 bp, Homo sapiens
cccggtggtttgccatg

SEQ ID NO: 6060023 - DNA, 17 bp, Homo sapiens
cccggtgtatgcagtgg

SEQ ID NO: 6060024 - DNA, 13 bp, Homo sapiens
cccggtgtgagga

SEQ ID NO: 6060025 - DNA, 14 bp, Homo sapiens
cccggtgtgcagcg

SEQ ID NO: 6060026 - DNA, 17 bp, Homo sapiens
cccggttcaccttgccg

SEQ ID NO: 6060027 - DNA, 17 bp, Homo sapiens
cccggttccctccccag

SEQ ID NO: 6060028 - DNA, 17 bp, Homo sapiens
cccggttgcagtcactg

SEQ ID NO: 6060029 - DNA, 20 bp, Homo sapiens
cccggttgcagtcactgtga

SEQ ID NO: 6060030 - DNA, 15 bp, Homo sapiens
cccggttgctggtca

SEQ ID NO: 6060031 - DNA, 23 bp, Homo sapiens
cccggttgtgagagcctgtgatc

SEQ ID NO: 6060032 - DNA, 23 bp, Homo sapiens
cccggtttcagaagctgcagctg

SEQ ID NO: 6060033 - DNA, 19 bp, Homo sapiens
cccgtaagaccaccttccc

SEQ ID NO: 6060034 - DNA, 13 bp, Homo sapiens
cccgtaaggctgt

SEQ ID NO: 6060035 - DNA, 14 bp, Homo sapiens
cccgtaaggctgta

SEQ ID NO: 6060036 - DNA, 18 bp, Homo sapiens
cccgtaaggctgtacata

SEQ ID NO: 6060037 - DNA, 14 bp, Homo sapiens
cccgtaatgcttag

SEQ ID NO: 6060038 - DNA, 17 bp, Homo sapiens
cccgtacccccgtggtc

SEQ ID NO: 6060039 - DNA, 19 bp, Homo sapiens
cccgtactaggttggacag

SEQ ID NO: 6060040 - DNA, 19 bp, Homo sapiens
cccgtagagaatgtgtgta

SEQ ID NO: 6060041 - DNA, 20 bp, Homo sapiens
cccgtagccactctctgccc

SEQ ID NO: 6060042 - DNA, 15 bp, Homo sapiens
cccgtaggcagcctc

SEQ ID NO: 6060043 - DNA, 22 bp, Homo sapiens
cccgtaggcagcctctctgcta

SEQ ID NO: 6060044 - DNA, 14 bp, Homo sapiens
cccgtagtctcctg

SEQ ID NO: 6060045 - DNA, 16 bp, Homo sapiens
cccgtagtctcctggg

SEQ ID NO: 6060046 - DNA, 17 bp, Homo sapiens
cccgtagtctcctgggt

SEQ ID NO: 6060047 - DNA, 14 bp, Homo sapiens
cccgtatcacagtg

SEQ ID NO: 6060048 - DNA, 19 bp, Homo sapiens
cccgtcagcatcactgatg

SEQ ID NO: 6060049 - DNA, 22 bp, Homo sapiens
cccgtcagcatcactgatggga

SEQ ID NO: 6060050 - DNA, 14 bp, Homo sapiens
cccgtcagggagag

SEQ ID NO: 6060051 - DNA, 18 bp, Homo sapiens
cccgtcatgttcctcaaa

SEQ ID NO: 6060052 - DNA, 18 bp, Homo sapiens
cccgtcccctaaccccca

SEQ ID NO: 6060053 - DNA, 16 bp, Homo sapiens
cccgtcccctgcagcc

SEQ ID NO: 6060054 - DNA, 21 bp, Homo sapiens
cccgtcccctgcagcctgggt

SEQ ID NO: 6060055 - DNA, 14 bp, Homo sapiens
cccgtcccctgggc

SEQ ID NO: 6060056 - DNA, 18 bp, Homo sapiens
cccgtccctttccctgca

SEQ ID NO: 6060057 - DNA, 12 bp, Homo sapiens
cccgtcctccct

SEQ ID NO: 6060058 - DNA, 14 bp, Homo sapiens
cccgtcctgcctgt

SEQ ID NO: 6060059 - DNA, 17 bp, Homo sapiens
cccgtcctgcctgtggc

SEQ ID NO: 6060060 - DNA, 19 bp, Homo sapiens
ccagagagaggagggactg

SEQ ID NO: 6060061 - DNA, 21 bp, Homo sapiens
ccagagagaggatgcagaggg

SEQ ID NO: 6060062 - DNA, 15 bp, Homo sapiens
ccagagagaggatgt

SEQ ID NO: 6060063 - DNA, 15 bp, Homo sapiens
ccagagagcagctcc

SEQ ID NO: 6060064 - DNA, 17 bp, Homo sapiens
ccagagagcaggcaggg

SEQ ID NO: 6060065 - DNA, 19 bp, Homo sapiens
ccagagagcaggcaggggc

SEQ ID NO: 6060066 - DNA, 24 bp, Homo sapiens
ccagagagcaggcaggggcatctg

SEQ ID NO: 6060067 - DNA, 14 bp, Homo sapiens
ccagagagcagggg

SEQ ID NO: 6060068 - DNA, 16 bp, Homo sapiens
ccagagagcaggggag

SEQ ID NO: 6060069 - DNA, 18 bp, Homo sapiens
ccagagagcaggggagct

SEQ ID NO: 6060070 - DNA, 20 bp, Homo sapiens
ccagagagcaggggagcttg

SEQ ID NO: 6060071 - DNA, 21 bp, Homo sapiens
ccagagagcaggggagcttgg

SEQ ID NO: 6060072 - DNA, 12 bp, Homo sapiens
ccagagagcccg

SEQ ID NO: 6060073 - DNA, 15 bp, Homo sapiens
ccagagagcccgagg

SEQ ID NO: 6060074 - DNA, 20 bp, Homo sapiens
ccagagagcccgaggaggtg

SEQ ID NO: 6060075 - DNA, 14 bp, Homo sapiens
ccagagagctgaag

SEQ ID NO: 6060076 - DNA, 18 bp, Homo sapiens
ccagagagcttaaattgt

SEQ ID NO: 6060077 - DNA, 16 bp, Homo sapiens
ccagagaggagcacct

SEQ ID NO: 6060078 - DNA, 13 bp, Homo sapiens
ccagagaggcact

SEQ ID NO: 6060079 - DNA, 19 bp, Homo sapiens
ccagagaggcactcagtga

SEQ ID NO: 6060080 - DNA, 12 bp, Homo sapiens
ccagagaggctc

SEQ ID NO: 6060081 - DNA, 20 bp, Homo sapiens
ccagagagggaagatgacct

SEQ ID NO: 6060082 - DNA, 13 bp, Homo sapiens
ccagagagggccc

SEQ ID NO: 6060083 - DNA, 18 bp, Homo sapiens
ccagagagggcccagctg

SEQ ID NO: 6060084 - DNA, 20 bp, Homo sapiens
ccagagagggcccagctgta

SEQ ID NO: 6060085 - DNA, 18 bp, Homo sapiens
ccagagaggggctgctct

SEQ ID NO: 6060086 - DNA, 19 bp, Homo sapiens
ccagagaggggctgctctc

SEQ ID NO: 6060087 - DNA, 14 bp, Homo sapiens
ccagagagtcctct

SEQ ID NO: 6060088 - DNA, 14 bp, Homo sapiens
ccagagagtcctgt

SEQ ID NO: 6060089 - DNA, 23 bp, Homo sapiens
ccagagagtggagagagcagggc

SEQ ID NO: 6060090 - DNA, 15 bp, Homo sapiens
ccagagagtggctcc

SEQ ID NO: 6060091 - DNA, 17 bp, Homo sapiens
ccagagataaaaatcat

SEQ ID NO: 6060092 - DNA, 18 bp, Homo sapiens
ccagagataaaaatcata

SEQ ID NO: 6060093 - DNA, 15 bp, Homo sapiens
ccagagataaatgtt

SEQ ID NO: 6060094 - DNA, 20 bp, Homo sapiens
ccagagatccaaaagaagcc

SEQ ID NO: 6060095 - DNA, 14 bp, Homo sapiens
ccagagatgcctcc

SEQ ID NO: 6060096 - DNA, 17 bp, Homo sapiens
ccagagatgcctccacc

SEQ ID NO: 6060097 - DNA, 20 bp, Homo sapiens
ccagagatgcctccaccgct

SEQ ID NO: 6060098 - DNA, 15 bp, Homo sapiens
ccagagatgcctgat

SEQ ID NO: 6060099 - DNA, 20 bp, Homo sapiens
ccagagatgcctgatttcat

SEQ ID NO: 6060100 - DNA, 19 bp, Homo sapiens
ccagagatggctccttggg

SEQ ID NO: 6060101 - DNA, 21 bp, Homo sapiens
ccagagatggctccttgggat

SEQ ID NO: 6060102 - DNA, 16 bp, Homo sapiens
ccagagatgggactgg

SEQ ID NO: 6060103 - DNA, 20 bp, Homo sapiens
ccagagcaaaaatgtaaaaa

SEQ ID NO: 6060104 - DNA, 21 bp, Homo sapiens
ccagagcaaaaatgtaaaaaa

SEQ ID NO: 6060105 - DNA, 18 bp, Homo sapiens
ccagagcaaacagaaaaa

SEQ ID NO: 6060106 - DNA, 21 bp, Homo sapiens
ccagagcaacctctcactccc

SEQ ID NO: 6060107 - DNA, 22 bp, Homo sapiens
ccagagcaacgaccagggccga

SEQ ID NO: 6060108 - DNA, 16 bp, Homo sapiens
ccagagcaagcttttt

SEQ ID NO: 6060109 - DNA, 18 bp, Homo sapiens
ccagagcacaagaaggcc

SEQ ID NO: 6060110 - DNA, 21 bp, Homo sapiens
ccagagcacaagttccagctg

SEQ ID NO: 6060111 - DNA, 23 bp, Homo sapiens
ccagagcacccagatcagactct

SEQ ID NO: 6060112 - DNA, 11 bp, Homo sapiens
ccagagcactg

SEQ ID NO: 6060113 - DNA, 14 bp, Homo sapiens
ccagagcactgtat

SEQ ID NO: 6060114 - DNA, 20 bp, Homo sapiens
ccagagcactttagcagatg

SEQ ID NO: 6060115 - DNA, 13 bp, Homo sapiens
ccagagcagacca

SEQ ID NO: 6060116 - DNA, 14 bp, Homo sapiens
ccagagcagagagc

SEQ ID NO: 6060117 - DNA, 15 bp, Homo sapiens
ccagagcagagttta

SEQ ID NO: 6060118 - DNA, 16 bp, Homo sapiens
ccagagcagagtttac

SEQ ID NO: 6060119 - DNA, 17 bp, Homo sapiens
ccagagcagatgcagag

SEQ ID NO: 6060120 - DNA, 23 bp, Homo sapiens
ccagagcagatgcagagagccat

SEQ ID NO: 6060121 - DNA, 20 bp, Homo sapiens
ccagagcagctccaccactg

SEQ ID NO: 6060122 - DNA, 19 bp, Homo sapiens
ccagagcaggagcccctgg

SEQ ID NO: 6060123 - DNA, 20 bp, Homo sapiens
ccagagcaggaggcagggct

SEQ ID NO: 6060124 - DNA, 23 bp, Homo sapiens
ccagagcaggaggcccctggccc

SEQ ID NO: 6060125 - DNA, 12 bp, Homo sapiens
ccagagcagggg

SEQ ID NO: 6060126 - DNA, 16 bp, Homo sapiens
ccagagcaggggctgc

SEQ ID NO: 6060127 - DNA, 19 bp, Homo sapiens
ccagagcaggggctgctgg

SEQ ID NO: 6060128 - DNA, 17 bp, Homo sapiens
ccagagcatctgcccca

SEQ ID NO: 6060129 - DNA, 21 bp, Homo sapiens
ccagagcatctgccccaggta

SEQ ID NO: 6060130 - DNA, 23 bp, Homo sapiens
ccagagcattacgtgagccaggt

SEQ ID NO: 6060131 - DNA, 23 bp, Homo sapiens
ccagagcattccagtcaggctct

SEQ ID NO: 6060132 - DNA, 21 bp, Homo sapiens
ccagagcatttccaacaccac

SEQ ID NO: 6060133 - DNA, 11 bp, Homo sapiens
ccagagccaaa

SEQ ID NO: 6060134 - DNA, 13 bp, Homo sapiens
ccagagccaacct

SEQ ID NO: 6060135 - DNA, 21 bp, Homo sapiens
ccagagccaacctggacttcc

SEQ ID NO: 6060136 - DNA, 23 bp, Homo sapiens
ccagagccaacctggacttcctg

SEQ ID NO: 6060137 - DNA, 13 bp, Homo sapiens
ccagagccacaca

SEQ ID NO: 6060138 - DNA, 15 bp, Homo sapiens
ccagagccacacatg

SEQ ID NO: 6060139 - DNA, 19 bp, Homo sapiens
ccagagccacacatgggca

SEQ ID NO: 6060140 - DNA, 12 bp, Homo sapiens
ccagagccacag

SEQ ID NO: 6060141 - DNA, 13 bp, Homo sapiens
ccagagccacagt

SEQ ID NO: 6060142 - DNA, 12 bp, Homo sapiens
ccagagccacct

SEQ ID NO: 6060143 - DNA, 13 bp, Homo sapiens
ccagagccacctg

SEQ ID NO: 6060144 - DNA, 11 bp, Homo sapiens
ccagagccaga

SEQ ID NO: 6060145 - DNA, 22 bp, Homo sapiens
ccagagccagatgcaggacagg

SEQ ID NO: 6060146 - DNA, 23 bp, Homo sapiens
ccagagccagatgcaggacagga

SEQ ID NO: 6060147 - DNA, 14 bp, Homo sapiens
ccagagccagggct

SEQ ID NO: 6060148 - DNA, 16 bp, Homo sapiens
ccagagccagggctgt

SEQ ID NO: 6060149 - DNA, 23 bp, Homo sapiens
ccagagccagggctgtccttaga

SEQ ID NO: 6060150 - DNA, 22 bp, Homo sapiens
ccagagccaggggggtgaggag

SEQ ID NO: 6060151 - DNA, 23 bp, Homo sapiens
ccagagccaggggggtgaggagc

SEQ ID NO: 6060152 - DNA, 13 bp, Homo sapiens
ccagagccatgga

SEQ ID NO: 6060153 - DNA, 21 bp, Homo sapiens
ccagagccatggactctacac

SEQ ID NO: 6060154 - DNA, 13 bp, Homo sapiens
ccagagcccaagg

SEQ ID NO: 6060155 - DNA, 17 bp, Homo sapiens
ccagagcccaagtgcca

SEQ ID NO: 6060156 - DNA, 21 bp, Homo sapiens
ccagagcccaagtgccatccc

SEQ ID NO: 6060157 - DNA, 20 bp, Homo sapiens
ccagagcccactccatctgg

SEQ ID NO: 6060158 - DNA, 11 bp, Homo sapiens
ccagagcccag

SEQ ID NO: 6060159 - DNA, 12 bp, Homo sapiens
ccagagcccagc

SEQ ID NO: 6060160 - DNA, 14 bp, Homo sapiens
ccagagcccagctc

SEQ ID NO: 6060161 - DNA, 15 bp, Homo sapiens
ccagagcccagctcc

SEQ ID NO: 6060162 - DNA, 17 bp, Homo sapiens
ccagagcccagctccaa

SEQ ID NO: 6060163 - DNA, 18 bp, Homo sapiens
ccagagcccagctccaag

SEQ ID NO: 6060164 - DNA, 15 bp, Homo sapiens
ccagagcccagctct

SEQ ID NO: 6060165 - DNA, 17 bp, Homo sapiens
ccagagcccagctcttg

SEQ ID NO: 6060166 - DNA, 15 bp, Homo sapiens
ccagagcccaggctc

SEQ ID NO: 6060167 - DNA, 18 bp, Homo sapiens
ccagagccccacacggag

SEQ ID NO: 6060168 - DNA, 14 bp, Homo sapiens
ccagagccccccac

SEQ ID NO: 6060169 - DNA, 23 bp, Homo sapiens
ccagagccccccacaatgatgat

SEQ ID NO: 6060170 - DNA, 18 bp, Homo sapiens
ccagagcccttcactgcc

SEQ ID NO: 6060171 - DNA, 21 bp, Homo sapiens
ccagagcccttcactgccatg

SEQ ID NO: 6060172 - DNA, 12 bp, Homo sapiens
ccagagcccttg

SEQ ID NO: 6060173 - DNA, 22 bp, Homo sapiens
ccagagcccttgactgtacaga

SEQ ID NO: 6060174 - DNA, 21 bp, Homo sapiens
ccagagccgcaccctggctgg

SEQ ID NO: 6060175 - DNA, 16 bp, Homo sapiens
ccagagccgggaggaa

SEQ ID NO: 6060176 - DNA, 20 bp, Homo sapiens
ccagagccggggcactttca

SEQ ID NO: 6060177 - DNA, 14 bp, Homo sapiens
ccagagcctccctc

SEQ ID NO: 6060178 - DNA, 17 bp, Homo sapiens
ccagagcctccctcagc

SEQ ID NO: 6060179 - DNA, 21 bp, Homo sapiens
ccagagcctccctcagccacg

SEQ ID NO: 6060180 - DNA, 19 bp, Homo sapiens
ccagagcctctgctggaag

SEQ ID NO: 6060181 - DNA, 13 bp, Homo sapiens
ccagagcctctgg

SEQ ID NO: 6060182 - DNA, 14 bp, Homo sapiens
ccagagcctctggc

SEQ ID NO: 6060183 - DNA, 13 bp, Homo sapiens
ccagagcctgggc

SEQ ID NO: 6060184 - DNA, 20 bp, Homo sapiens
ccagagcctggggctctaac

SEQ ID NO: 6060185 - DNA, 12 bp, Homo sapiens
ccagagcctggt

SEQ ID NO: 6060186 - DNA, 21 bp, Homo sapiens
ccagagcctggtagagactag

SEQ ID NO: 6060187 - DNA, 19 bp, Homo sapiens
ccagagcctgtctttcagc

SEQ ID NO: 6060188 - DNA, 21 bp, Homo sapiens
ccagagcgatgtgttctttgt

SEQ ID NO: 6060189 - DNA, 19 bp, Homo sapiens
ccagagcggtatctctggc

SEQ ID NO: 6060190 - DNA, 22 bp, Homo sapiens
ccagagcgtccttggctgccgt

SEQ ID NO: 6060191 - DNA, 21 bp, Homo sapiens
ccagagcgtgcacttgtgatc

SEQ ID NO: 6060192 - DNA, 20 bp, Homo sapiens
ccagagcgttagaggggcca

SEQ ID NO: 6060193 - DNA, 22 bp, Homo sapiens
ccagagcgttagaggggccagc

SEQ ID NO: 6060194 - DNA, 21 bp, Homo sapiens
ccagagctacccgcagagttc

SEQ ID NO: 6060195 - DNA, 20 bp, Homo sapiens
ccagagctagggctgctgct

SEQ ID NO: 6060196 - DNA, 22 bp, Homo sapiens
ccagagctagggctgctgcttc

SEQ ID NO: 6060197 - DNA, 17 bp, Homo sapiens
ccagagctcccaggacg

SEQ ID NO: 6060198 - DNA, 15 bp, Homo sapiens
ccagagctcctcctt

SEQ ID NO: 6060199 - DNA, 12 bp, Homo sapiens
ccagagctcctg

SEQ ID NO: 6060200 - DNA, 22 bp, Homo sapiens
ccagagctctgacccacagcct

SEQ ID NO: 6060201 - DNA, 16 bp, Homo sapiens
ccagagctctggagcc

SEQ ID NO: 6060202 - DNA, 12 bp, Homo sapiens
ccagagctgagt

SEQ ID NO: 6060203 - DNA, 19 bp, Homo sapiens
ccagagctgagttgggggt

SEQ ID NO: 6060204 - DNA, 13 bp, Homo sapiens
ccagagctgccac

SEQ ID NO: 6060205 - DNA, 15 bp, Homo sapiens
ccagagctgccgact

SEQ ID NO: 6060206 - DNA, 23 bp, Homo sapiens
ccagagctgccgacttggagact

SEQ ID NO: 6060207 - DNA, 16 bp, Homo sapiens
ccagagctgcctatgc

SEQ ID NO: 6060208 - DNA, 14 bp, Homo sapiens
ccagagctgcctcc

SEQ ID NO: 6060209 - DNA, 14 bp, Homo sapiens
ccagagctgcctgc

SEQ ID NO: 6060210 - DNA, 17 bp, Homo sapiens
ccagagctgctggtctc

SEQ ID NO: 6060211 - DNA, 12 bp, Homo sapiens
ccagagctggaa

SEQ ID NO: 6060212 - DNA, 18 bp, Homo sapiens
ccagagctggaacacaat

SEQ ID NO: 6060213 - DNA, 19 bp, Homo sapiens
ccagagctggaaggcaggg

SEQ ID NO: 6060214 - DNA, 22 bp, Homo sapiens
ccagagctggaaggcagggcag

SEQ ID NO: 6060215 - DNA, 23 bp, Homo sapiens
ccagagctggaaggcagggcaga

SEQ ID NO: 6060216 - DNA, 16 bp, Homo sapiens
ccagagctggccaggc

SEQ ID NO: 6060217 - DNA, 15 bp, Homo sapiens
ccagagctggcctcc

SEQ ID NO: 6060218 - DNA, 21 bp, Homo sapiens
ccagagctggcctcccccaac

SEQ ID NO: 6060219 - DNA, 20 bp, Homo sapiens
ccagagctgggtgagtgggg

SEQ ID NO: 6060220 - DNA, 21 bp, Homo sapiens
ccagagctgggtgagtgggga

SEQ ID NO: 6060221 - DNA, 20 bp, Homo sapiens
ccagagctgggtggggacag

SEQ ID NO: 6060222 - DNA, 22 bp, Homo sapiens
ccagagctggtggacccaggga

SEQ ID NO: 6060223 - DNA, 14 bp, Homo sapiens
ccagagctgtgcct

SEQ ID NO: 6060224 - DNA, 19 bp, Homo sapiens
ccagagctgtgcctgctca

SEQ ID NO: 6060225 - DNA, 23 bp, Homo sapiens
ccagagctgtgcctgctcagcag

SEQ ID NO: 6060226 - DNA, 17 bp, Homo sapiens
ccagagcttattggcca

SEQ ID NO: 6060227 - DNA, 19 bp, Homo sapiens
ccagagcttattggccact

SEQ ID NO: 6060228 - DNA, 22 bp, Homo sapiens
ccagagcttattggccactggg

SEQ ID NO: 6060229 - DNA, 17 bp, Homo sapiens
ccagagcttcagggctg

SEQ ID NO: 6060230 - DNA, 18 bp, Homo sapiens
ccagagcttctctgggct

SEQ ID NO: 6060231 - DNA, 19 bp, Homo sapiens
ccagagcttctctgggctg

SEQ ID NO: 6060232 - DNA, 14 bp, Homo sapiens
ccagagcttggaga

SEQ ID NO: 6060233 - DNA, 14 bp, Homo sapiens
ccagaggaactgtc

SEQ ID NO: 6060234 - DNA, 19 bp, Homo sapiens
ccagaggaactgtccagag

SEQ ID NO: 6060235 - DNA, 22 bp, Homo sapiens
ccagaggaactgtccagagagc

SEQ ID NO: 6060236 - DNA, 12 bp, Homo sapiens
ccagaggaagcc

SEQ ID NO: 6060237 - DNA, 16 bp, Homo sapiens
ccagaggaagggaggc

SEQ ID NO: 6060238 - DNA, 17 bp, Homo sapiens
cccgtcgcgctggacag

SEQ ID NO: 6060239 - DNA, 17 bp, Homo sapiens
cccgtcggagctgcctg

SEQ ID NO: 6060240 - DNA, 20 bp, Homo sapiens
cccgtcggagctgcctgcag

SEQ ID NO: 6060241 - DNA, 13 bp, Homo sapiens
cccgtcggccctg

SEQ ID NO: 6060242 - DNA, 17 bp, Homo sapiens
cccgtcggccctgcgtc

SEQ ID NO: 6060243 - DNA, 13 bp, Homo sapiens
cccgtctccagct

SEQ ID NO: 6060244 - DNA, 13 bp, Homo sapiens
cccgtctcctgcc

SEQ ID NO: 6060245 - DNA, 16 bp, Homo sapiens
cccgtctctgccctgg

SEQ ID NO: 6060246 - DNA, 17 bp, Homo sapiens
cccgtctctgctctgct

SEQ ID NO: 6060247 - DNA, 12 bp, Homo sapiens
cccgtctgccca

SEQ ID NO: 6060248 - DNA, 20 bp, Homo sapiens
cccgtctgcccaccattccc

SEQ ID NO: 6060249 - DNA, 13 bp, Homo sapiens
cccgtctgctcct

SEQ ID NO: 6060250 - DNA, 17 bp, Homo sapiens
cccgtctggacctgggg

SEQ ID NO: 6060251 - DNA, 23 bp, Homo sapiens
cccgtctggggttcagcccctcc

SEQ ID NO: 6060252 - DNA, 11 bp, Homo sapiens
cccgtctgtcc

SEQ ID NO: 6060253 - DNA, 19 bp, Homo sapiens
cccgtcttcaatctctgtt

SEQ ID NO: 6060254 - DNA, 14 bp, Homo sapiens
cccgtcttcagcct

SEQ ID NO: 6060255 - DNA, 18 bp, Homo sapiens
cccgtcttcagcctagcc

SEQ ID NO: 6060256 - DNA, 13 bp, Homo sapiens
cccgtcttcctcc

SEQ ID NO: 6060257 - DNA, 15 bp, Homo sapiens
cccgtgaagcagtgc

SEQ ID NO: 6060258 - DNA, 18 bp, Homo sapiens
cccgtgaagcagtgcctc

SEQ ID NO: 6060259 - DNA, 22 bp, Homo sapiens
cccgtgaatgcttacctgtgag

SEQ ID NO: 6060260 - DNA, 16 bp, Homo sapiens
cccgtgacagtggctg

SEQ ID NO: 6060261 - DNA, 13 bp, Homo sapiens
cccgtgacctggt

SEQ ID NO: 6060262 - DNA, 22 bp, Homo sapiens
cccgtgagggtgggggggaccg

SEQ ID NO: 6060263 - DNA, 15 bp, Homo sapiens
cccgtgcagactgga

SEQ ID NO: 6060264 - DNA, 17 bp, Homo sapiens
cccgtgcagtacaggca

SEQ ID NO: 6060265 - DNA, 18 bp, Homo sapiens
cccgtgcagtacaggcaa

SEQ ID NO: 6060266 - DNA, 19 bp, Homo sapiens
cccgtgccacgcgctctgc

SEQ ID NO: 6060267 - DNA, 22 bp, Homo sapiens
cccgtgccacgcgctctgcatg

SEQ ID NO: 6060268 - DNA, 22 bp, Homo sapiens
cccgtgcccccgcctgccaccg

SEQ ID NO: 6060269 - DNA, 17 bp, Homo sapiens
cccgtgcccctttcctt

SEQ ID NO: 6060270 - DNA, 15 bp, Homo sapiens
cccgtgcccgcagga

SEQ ID NO: 6060271 - DNA, 14 bp, Homo sapiens
cccgtgcctgggag

SEQ ID NO: 6060272 - DNA, 15 bp, Homo sapiens
cccgtgcctgggccc

SEQ ID NO: 6060273 - DNA, 17 bp, Homo sapiens
cccgtgcctgggcccct

SEQ ID NO: 6060274 - DNA, 22 bp, Homo sapiens
cccgtgcgcagccgcgctctgc

SEQ ID NO: 6060275 - DNA, 16 bp, Homo sapiens
cccgtgctcctctgcc

SEQ ID NO: 6060276 - DNA, 12 bp, Homo sapiens
cccgtggagggt

SEQ ID NO: 6060277 - DNA, 19 bp, Homo sapiens
cccgtggccatccctgtga

SEQ ID NO: 6060278 - DNA, 12 bp, Homo sapiens
cccgtggcccca

SEQ ID NO: 6060279 - DNA, 20 bp, Homo sapiens
cccgtggccccagcctggcc

SEQ ID NO: 6060280 - DNA, 15 bp, Homo sapiens
cccgtggcctggcat

SEQ ID NO: 6060281 - DNA, 19 bp, Homo sapiens
cccgtggcctggcatctgt

SEQ ID NO: 6060282 - DNA, 22 bp, Homo sapiens
cccgtggggcagggagctgggc

SEQ ID NO: 6060283 - DNA, 21 bp, Homo sapiens
cccgtggggccccggctccca

SEQ ID NO: 6060284 - DNA, 16 bp, Homo sapiens
cccgtggggtgctgcc

SEQ ID NO: 6060285 - DNA, 18 bp, Homo sapiens
cccgtggtctccttgcac

SEQ ID NO: 6060286 - DNA, 13 bp, Homo sapiens
cccgtggtctttg

SEQ ID NO: 6060287 - DNA, 14 bp, Homo sapiens
cccgtggtctttga

SEQ ID NO: 6060288 - DNA, 15 bp, Homo sapiens
cccgtggtctttgaa

SEQ ID NO: 6060289 - DNA, 19 bp, Homo sapiens
cccgtggtctttgaataaa

SEQ ID NO: 6060290 - DNA, 21 bp, Homo sapiens
cccgtggtctttgaataaagt

SEQ ID NO: 6060291 - DNA, 15 bp, Homo sapiens
cccgtggtgcctgca

SEQ ID NO: 6060292 - DNA, 16 bp, Homo sapiens
cccgtggtgcctgcac

SEQ ID NO: 6060293 - DNA, 21 bp, Homo sapiens
cccgtggtggcggtggctgcc

SEQ ID NO: 6060294 - DNA, 22 bp, Homo sapiens
cccgtggtggcggtggctgccc

SEQ ID NO: 6060295 - DNA, 14 bp, Homo sapiens
cccgtgtaaataat

SEQ ID NO: 6060296 - DNA, 20 bp, Homo sapiens
cccgtgtaaatatgtacatt

SEQ ID NO: 6060297 - DNA, 14 bp, Homo sapiens
cccgtgtcctctcc

SEQ ID NO: 6060298 - DNA, 20 bp, Homo sapiens
cccgtgtcctctccctgcca

SEQ ID NO: 6060299 - DNA, 14 bp, Homo sapiens
cccgtgtcctgcct

SEQ ID NO: 6060300 - DNA, 16 bp, Homo sapiens
cccgtgtgcctgagcg

SEQ ID NO: 6060301 - DNA, 13 bp, Homo sapiens
cccgtgtggcctg

SEQ ID NO: 6060302 - DNA, 15 bp, Homo sapiens
cccgtgtggcctggg

SEQ ID NO: 6060303 - DNA, 19 bp, Homo sapiens
cccgtgtggtaccttcagc

SEQ ID NO: 6060304 - DNA, 11 bp, Homo sapiens
cccgtgtgtat

SEQ ID NO: 6060305 - DNA, 17 bp, Homo sapiens
cccgtgtgtatttctaa

SEQ ID NO: 6060306 - DNA, 15 bp, Homo sapiens
cccgtgttcaggaca

SEQ ID NO: 6060307 - DNA, 16 bp, Homo sapiens
cccgttacagctcccc

SEQ ID NO: 6060308 - DNA, 18 bp, Homo sapiens
cccgttccaccccaagag

SEQ ID NO: 6060309 - DNA, 14 bp, Homo sapiens
cccgttccagctga

SEQ ID NO: 6060310 - DNA, 17 bp, Homo sapiens
cccgttctgctggcctg

SEQ ID NO: 6060311 - DNA, 17 bp, Homo sapiens
cccgttgccgggcctgg

SEQ ID NO: 6060312 - DNA, 19 bp, Homo sapiens
cccgttgccgggcctggac

SEQ ID NO: 6060313 - DNA, 20 bp, Homo sapiens
cccgttgggtcccttgctgc

SEQ ID NO: 6060314 - DNA, 16 bp, Homo sapiens
cccgttgtctccctgg

SEQ ID NO: 6060315 - DNA, 20 bp, Homo sapiens
cccgttgtctccctggccct

SEQ ID NO: 6060316 - DNA, 23 bp, Homo sapiens
cccgttgtgtgggtttactctgt

SEQ ID NO: 6060317 - DNA, 12 bp, Homo sapiens
cccgtttccaag

SEQ ID NO: 6060318 - DNA, 15 bp, Homo sapiens
cccgtttccatacag

SEQ ID NO: 6060319 - DNA, 16 bp, Homo sapiens
cccgtttctccaccta

SEQ ID NO: 6060320 - DNA, 19 bp, Homo sapiens
cccgtttctccttttccta

SEQ ID NO: 6060321 - DNA, 20 bp, Homo sapiens
cccgttttaccaataaactg

SEQ ID NO: 6060322 - DNA, 18 bp, Homo sapiens
cccgttttccccatgaca

SEQ ID NO: 6060323 - DNA, 13 bp, Homo sapiens
cccgttttgtcac

SEQ ID NO: 6060324 - DNA, 13 bp, Homo sapiens
ccctaaaatacta

SEQ ID NO: 6060325 - DNA, 23 bp, Homo sapiens
ccctaaacaaaagcaaagatgca

SEQ ID NO: 6060326 - DNA, 18 bp, Homo sapiens
ccctaaacatagtggtat

SEQ ID NO: 6060327 - DNA, 15 bp, Homo sapiens
ccctaaactgcagcc

SEQ ID NO: 6060328 - DNA, 18 bp, Homo sapiens
ccctaaactttggccttt

SEQ ID NO: 6060329 - DNA, 18 bp, Homo sapiens
ccctaaagagcatcctga

SEQ ID NO: 6060330 - DNA, 21 bp, Homo sapiens
ccctaaagatggcgcacccgg

SEQ ID NO: 6060331 - DNA, 19 bp, Homo sapiens
ccctaaagcaaatctgcca

SEQ ID NO: 6060332 - DNA, 20 bp, Homo sapiens
ccctaaagcaaatctgccac

SEQ ID NO: 6060333 - DNA, 21 bp, Homo sapiens
ccctaaagcaaatctgccacc

SEQ ID NO: 6060334 - DNA, 12 bp, Homo sapiens
ccctaaagccag

SEQ ID NO: 6060335 - DNA, 21 bp, Homo sapiens
ccctaaagccaggctcaggag

SEQ ID NO: 6060336 - DNA, 22 bp, Homo sapiens
ccctaaagccaggctcaggaga

SEQ ID NO: 6060337 - DNA, 15 bp, Homo sapiens
ccctaaatctgagga

SEQ ID NO: 6060338 - DNA, 14 bp, Homo sapiens
ccctaacaggctgt

SEQ ID NO: 6060339 - DNA, 16 bp, Homo sapiens
ccctaacatagtgtct

SEQ ID NO: 6060340 - DNA, 12 bp, Homo sapiens
ccctaaccccca

SEQ ID NO: 6060341 - DNA, 20 bp, Homo sapiens
ccctaactctgcccaccctc

SEQ ID NO: 6060342 - DNA, 22 bp, Homo sapiens
ccctaactcttgctcactccct

SEQ ID NO: 6060343 - DNA, 22 bp, Homo sapiens
ccctaactgatttccatccaaa

SEQ ID NO: 6060344 - DNA, 16 bp, Homo sapiens
ccctaagaattcccag

SEQ ID NO: 6060345 - DNA, 19 bp, Homo sapiens
ccctaagactcctcggcct

SEQ ID NO: 6060346 - DNA, 16 bp, Homo sapiens
ccctaagactgccttc

SEQ ID NO: 6060347 - DNA, 18 bp, Homo sapiens
ccctaagagagcacctgg

SEQ ID NO: 6060348 - DNA, 22 bp, Homo sapiens
ccctaagcacaataaaagacat

SEQ ID NO: 6060349 - DNA, 12 bp, Homo sapiens
ccctaagccagc

SEQ ID NO: 6060350 - DNA, 15 bp, Homo sapiens
ccctaagccagcctg

SEQ ID NO: 6060351 - DNA, 16 bp, Homo sapiens
ccctaagccagcctgg

SEQ ID NO: 6060352 - DNA, 23 bp, Homo sapiens
ccctaagccagcctggtccatgc

SEQ ID NO: 6060353 - DNA, 18 bp, Homo sapiens
ccctaagccagctgcccc

SEQ ID NO: 6060354 - DNA, 13 bp, Homo sapiens
ccctaagccccgt

SEQ ID NO: 6060355 - DNA, 21 bp, Homo sapiens
ccctaagcctgtccccagacc

SEQ ID NO: 6060356 - DNA, 19 bp, Homo sapiens
ccctaagctccaggtgccc

SEQ ID NO: 6060357 - DNA, 23 bp, Homo sapiens
ccctaaggaatctgaaagtatat

SEQ ID NO: 6060358 - DNA, 21 bp, Homo sapiens
ccctaagtaagtttcttcctg

SEQ ID NO: 6060359 - DNA, 14 bp, Homo sapiens
ccctaagtccaact

SEQ ID NO: 6060360 - DNA, 15 bp, Homo sapiens
ccctaagtgcccaaa

SEQ ID NO: 6060361 - DNA, 17 bp, Homo sapiens
ccctaagtgcccaaagt

SEQ ID NO: 6060362 - DNA, 19 bp, Homo sapiens
ccctaagtgtggatgttca

SEQ ID NO: 6060363 - DNA, 19 bp, Homo sapiens
ccctaagttattacctctc

SEQ ID NO: 6060364 - DNA, 21 bp, Homo sapiens
ccctaagttcctatttcattt

SEQ ID NO: 6060365 - DNA, 13 bp, Homo sapiens
ccctaataaagct

SEQ ID NO: 6060366 - DNA, 14 bp, Homo sapiens
ccctaataaagctg

SEQ ID NO: 6060367 - DNA, 18 bp, Homo sapiens
ccctaataaagctgtgtg

SEQ ID NO: 6060368 - DNA, 17 bp, Homo sapiens
ccctaatgcgcaggctg

SEQ ID NO: 6060369 - DNA, 22 bp, Homo sapiens
ccctaatgcgcaggctggccct

SEQ ID NO: 6060370 - DNA, 23 bp, Homo sapiens
ccctaatgcgcaggctggccctg

SEQ ID NO: 6060371 - DNA, 23 bp, Homo sapiens
ccctaattaaaaactgtgatttt

SEQ ID NO: 6060372 - DNA, 16 bp, Homo sapiens
ccctaattcatctttt

SEQ ID NO: 6060373 - DNA, 18 bp, Homo sapiens
ccctaattcatcttttaa

SEQ ID NO: 6060374 - DNA, 17 bp, Homo sapiens
ccctaattctcttcgct

SEQ ID NO: 6060375 - DNA, 21 bp, Homo sapiens
ccctaattctcttcgctgtga

SEQ ID NO: 6060376 - DNA, 19 bp, Homo sapiens
ccctaattcttattttata

SEQ ID NO: 6060377 - DNA, 19 bp, Homo sapiens
ccctaatttatgtgctata

SEQ ID NO: 6060378 - DNA, 20 bp, Homo sapiens
ccctacaagttgatcatgca

SEQ ID NO: 6060379 - DNA, 13 bp, Homo sapiens
ccctacacacaca

SEQ ID NO: 6060380 - DNA, 14 bp, Homo sapiens
ccctacacacacac

SEQ ID NO: 6060381 - DNA, 22 bp, Homo sapiens
ccctacacacacactccctgct

SEQ ID NO: 6060382 - DNA, 13 bp, Homo sapiens
ccctacacacacc

SEQ ID NO: 6060383 - DNA, 17 bp, Homo sapiens
ccctacacacacccagg

SEQ ID NO: 6060384 - DNA, 14 bp, Homo sapiens
ccctacacagggcc

SEQ ID NO: 6060385 - DNA, 15 bp, Homo sapiens
ccctacacctccctc

SEQ ID NO: 6060386 - DNA, 16 bp, Homo sapiens
ccctacacctctgggc

SEQ ID NO: 6060387 - DNA, 20 bp, Homo sapiens
ccctacacctctgggccctg

SEQ ID NO: 6060388 - DNA, 12 bp, Homo sapiens
ccctacagacag

SEQ ID NO: 6060389 - DNA, 17 bp, Homo sapiens
ccctacagcctagggca

SEQ ID NO: 6060390 - DNA, 14 bp, Homo sapiens
ccctacagcctgca

SEQ ID NO: 6060391 - DNA, 21 bp, Homo sapiens
ccctacagcctgcacacacct

SEQ ID NO: 6060392 - DNA, 15 bp, Homo sapiens
ccctacatgcatgtt

SEQ ID NO: 6060393 - DNA, 18 bp, Homo sapiens
ccctacatgcatgtttta

SEQ ID NO: 6060394 - DNA, 17 bp, Homo sapiens
ccctaccacctccccag

SEQ ID NO: 6060395 - DNA, 19 bp, Homo sapiens
ccctaccactgagcccttg

SEQ ID NO: 6060396 - DNA, 23 bp, Homo sapiens
ccctaccagcgcccgctgggctg

SEQ ID NO: 6060397 - DNA, 15 bp, Homo sapiens
ccctaccagctcctc

SEQ ID NO: 6060398 - DNA, 22 bp, Homo sapiens
ccctacccacagggcctgactt

SEQ ID NO: 6060399 - DNA, 13 bp, Homo sapiens
ccctacccaccga

SEQ ID NO: 6060400 - DNA, 12 bp, Homo sapiens
ccctacccactc

SEQ ID NO: 6060401 - DNA, 23 bp, Homo sapiens
ccctacccatatccctcccgtgt

SEQ ID NO: 6060402 - DNA, 16 bp, Homo sapiens
ccctacccccaaccct

SEQ ID NO: 6060403 - DNA, 14 bp, Homo sapiens
ccctaccccctcat

SEQ ID NO: 6060404 - DNA, 16 bp, Homo sapiens
ccctaccccctcatcc

SEQ ID NO: 6060405 - DNA, 20 bp, Homo sapiens
ccctacccctgccctgctcc

SEQ ID NO: 6060406 - DNA, 14 bp, Homo sapiens
ccctaccctcctgc

SEQ ID NO: 6060407 - DNA, 15 bp, Homo sapiens
ccctaccctggcagg

SEQ ID NO: 6060408 - DNA, 15 bp, Homo sapiens
ccctacccttcctgc

SEQ ID NO: 6060409 - DNA, 17 bp, Homo sapiens
ccctaccgcatggcagc

SEQ ID NO: 6060410 - DNA, 19 bp, Homo sapiens
ccctaccgcatggcagctg

SEQ ID NO: 6060411 - DNA, 21 bp, Homo sapiens
ccctaccgcatggcagctggg

SEQ ID NO: 6060412 - DNA, 15 bp, Homo sapiens
ccctacctcaacctg

SEQ ID NO: 6060413 - DNA, 13 bp, Homo sapiens
ccctacctccctc

SEQ ID NO: 6060414 - DNA, 22 bp, Homo sapiens
ccctacctgattggtgcaaccc

SEQ ID NO: 6060415 - DNA, 23 bp, Homo sapiens
ccctacctgattggtgcaaccct

SEQ ID NO: 6060416 - DNA, 13 bp, Homo sapiens
ccctacctgggga

SEQ ID NO: 6060417 - DNA, 17 bp, Homo sapiens
ccagaggaaggggccag

SEQ ID NO: 6060418 - DNA, 19 bp, Homo sapiens
ccagaggaaggggccagag

SEQ ID NO: 6060419 - DNA, 21 bp, Homo sapiens
ccagaggaataacttagcttg

SEQ ID NO: 6060420 - DNA, 20 bp, Homo sapiens
ccagaggaatcctggcagcc

SEQ ID NO: 6060421 - DNA, 21 bp, Homo sapiens
ccagaggaatcctggcagccc

SEQ ID NO: 6060422 - DNA, 21 bp, Homo sapiens
ccagaggaatgatgggctttt

SEQ ID NO: 6060423 - DNA, 19 bp, Homo sapiens
ccagaggacaaggaagtgg

SEQ ID NO: 6060424 - DNA, 16 bp, Homo sapiens
ccagaggacagctctg

SEQ ID NO: 6060425 - DNA, 21 bp, Homo sapiens
ccagaggaccaatgcttgcat

SEQ ID NO: 6060426 - DNA, 13 bp, Homo sapiens
ccagaggagacat

SEQ ID NO: 6060427 - DNA, 17 bp, Homo sapiens
ccagaggagaggagaca

SEQ ID NO: 6060428 - DNA, 18 bp, Homo sapiens
ccagaggagaggagacag

SEQ ID NO: 6060429 - DNA, 20 bp, Homo sapiens
ccagaggagaggagacagac

SEQ ID NO: 6060430 - DNA, 20 bp, Homo sapiens
ccagaggagagtggcctggg

SEQ ID NO: 6060431 - DNA, 14 bp, Homo sapiens
ccagaggagcagct

SEQ ID NO: 6060432 - DNA, 15 bp, Homo sapiens
ccagaggagccaagt

SEQ ID NO: 6060433 - DNA, 16 bp, Homo sapiens
ccagaggagccaccag

SEQ ID NO: 6060434 - DNA, 13 bp, Homo sapiens
ccagaggagcctt

SEQ ID NO: 6060435 - DNA, 20 bp, Homo sapiens
ccagaggagctgggagccgg

SEQ ID NO: 6060436 - DNA, 12 bp, Homo sapiens
ccagaggagggc

SEQ ID NO: 6060437 - DNA, 22 bp, Homo sapiens
ccagaggagggcagcagaaggg

SEQ ID NO: 6060438 - DNA, 20 bp, Homo sapiens
ccagaggaggggacttgtag

SEQ ID NO: 6060439 - DNA, 17 bp, Homo sapiens
ccagaggagtttcttaa

SEQ ID NO: 6060440 - DNA, 20 bp, Homo sapiens
ccagaggatcaccagtgcat

SEQ ID NO: 6060441 - DNA, 18 bp, Homo sapiens
ccagaggatgctctttcc

SEQ ID NO: 6060442 - DNA, 20 bp, Homo sapiens
ccagaggatgctctttccca

SEQ ID NO: 6060443 - DNA, 15 bp, Homo sapiens
ccagaggcacagccg

SEQ ID NO: 6060444 - DNA, 17 bp, Homo sapiens
ccagaggcacagccggg

SEQ ID NO: 6060445 - DNA, 18 bp, Homo sapiens
ccagaggcagaaccctgg

SEQ ID NO: 6060446 - DNA, 15 bp, Homo sapiens
ccagaggcagaggtt

SEQ ID NO: 6060447 - DNA, 18 bp, Homo sapiens
ccagaggcagcttctttg

SEQ ID NO: 6060448 - DNA, 12 bp, Homo sapiens
ccagaggcaggc

SEQ ID NO: 6060449 - DNA, 14 bp, Homo sapiens
ccagaggcccccag

SEQ ID NO: 6060450 - DNA, 21 bp, Homo sapiens
ccagaggcccccagcccaggg

SEQ ID NO: 6060451 - DNA, 22 bp, Homo sapiens
ccagaggcccccagcccagggc

SEQ ID NO: 6060452 - DNA, 12 bp, Homo sapiens
ccagaggccctg

SEQ ID NO: 6060453 - DNA, 17 bp, Homo sapiens
ccagaggccctggaggt

SEQ ID NO: 6060454 - DNA, 23 bp, Homo sapiens
ccagaggccgaaggtgcctcaga

SEQ ID NO: 6060455 - DNA, 15 bp, Homo sapiens
ccagaggccgctgcc

SEQ ID NO: 6060456 - DNA, 16 bp, Homo sapiens
ccagaggccgctgccc

SEQ ID NO: 6060457 - DNA, 20 bp, Homo sapiens
ccagaggccgctgcccctga

SEQ ID NO: 6060458 - DNA, 13 bp, Homo sapiens
ccagaggcctggt

SEQ ID NO: 6060459 - DNA, 19 bp, Homo sapiens
ccagaggcctggtgccctg

SEQ ID NO: 6060460 - DNA, 13 bp, Homo sapiens
ccagaggctccca

SEQ ID NO: 6060461 - DNA, 18 bp, Homo sapiens
ccagaggctcccaatcag

SEQ ID NO: 6060462 - DNA, 22 bp, Homo sapiens
ccagaggctcccaatcagcttt

SEQ ID NO: 6060463 - DNA, 22 bp, Homo sapiens
ccagaggctcctctcaggctgg

SEQ ID NO: 6060464 - DNA, 17 bp, Homo sapiens
ccagaggctcctggagc

SEQ ID NO: 6060465 - DNA, 14 bp, Homo sapiens
ccagaggctgcaga

SEQ ID NO: 6060466 - DNA, 12 bp, Homo sapiens
ccagaggctgga

SEQ ID NO: 6060467 - DNA, 15 bp, Homo sapiens
ccagaggctgggagt

SEQ ID NO: 6060468 - DNA, 19 bp, Homo sapiens
ccagaggctgggagtccct

SEQ ID NO: 6060469 - DNA, 15 bp, Homo sapiens
ccagaggctgggttc

SEQ ID NO: 6060470 - DNA, 13 bp, Homo sapiens
ccagagggaccag

SEQ ID NO: 6060471 - DNA, 16 bp, Homo sapiens
ccagagggactggaca

SEQ ID NO: 6060472 - DNA, 23 bp, Homo sapiens
ccagagggactggacagccaggg

SEQ ID NO: 6060473 - DNA, 18 bp, Homo sapiens
ccagagggagctggaacc

SEQ ID NO: 6060474 - DNA, 21 bp, Homo sapiens
ccagagggagtgacagaggca

SEQ ID NO: 6060475 - DNA, 16 bp, Homo sapiens
ccagagggccagcagg

SEQ ID NO: 6060476 - DNA, 18 bp, Homo sapiens
ccagagggccagcaggct

SEQ ID NO: 6060477 - DNA, 15 bp, Homo sapiens
ccagagggcccaggc

SEQ ID NO: 6060478 - DNA, 18 bp, Homo sapiens
ccagagggcccaggcagg

SEQ ID NO: 6060479 - DNA, 15 bp, Homo sapiens
ccagagggcctgcaa

SEQ ID NO: 6060480 - DNA, 17 bp, Homo sapiens
ccagagggcctgcaagg

SEQ ID NO: 6060481 - DNA, 17 bp, Homo sapiens
ccagaggggacgctgag

SEQ ID NO: 6060482 - DNA, 20 bp, Homo sapiens
ccagaggggcggggccagga

SEQ ID NO: 6060483 - DNA, 23 bp, Homo sapiens
ccagaggggctgctccagtgggc

SEQ ID NO: 6060484 - DNA, 15 bp, Homo sapiens
ccagagggggccaga

SEQ ID NO: 6060485 - DNA, 12 bp, Homo sapiens
ccagagggtggg

SEQ ID NO: 6060486 - DNA, 15 bp, Homo sapiens
ccagagggtgggagg

SEQ ID NO: 6060487 - DNA, 15 bp, Homo sapiens
ccagagggttgctgg

SEQ ID NO: 6060488 - DNA, 16 bp, Homo sapiens
ccagagggttgctggt

SEQ ID NO: 6060489 - DNA, 17 bp, Homo sapiens
ccagaggtaacagaaca

SEQ ID NO: 6060490 - DNA, 23 bp, Homo sapiens
ccagaggtcacacagcctgtgtg

SEQ ID NO: 6060491 - DNA, 14 bp, Homo sapiens
ccagaggtccagcc

SEQ ID NO: 6060492 - DNA, 13 bp, Homo sapiens
ccagaggtccagg

SEQ ID NO: 6060493 - DNA, 17 bp, Homo sapiens
ccagaggtccaggtccc

SEQ ID NO: 6060494 - DNA, 22 bp, Homo sapiens
ccagaggtccaggtcccagccc

SEQ ID NO: 6060495 - DNA, 19 bp, Homo sapiens
ccagaggtctagattaata

SEQ ID NO: 6060496 - DNA, 20 bp, Homo sapiens
ccagaggtctcatctcccag

SEQ ID NO: 6060497 - DNA, 17 bp, Homo sapiens
ccagaggtgagggaggc

SEQ ID NO: 6060498 - DNA, 19 bp, Homo sapiens
ccagaggtgagggaggcct

SEQ ID NO: 6060499 - DNA, 12 bp, Homo sapiens
ccagaggtggcc

SEQ ID NO: 6060500 - DNA, 14 bp, Homo sapiens
ccagaggtggccct

SEQ ID NO: 6060501 - DNA, 20 bp, Homo sapiens
ccagaggtggcccttgttta

SEQ ID NO: 6060502 - DNA, 21 bp, Homo sapiens
ccagaggtgggatcctccctc

SEQ ID NO: 6060503 - DNA, 14 bp, Homo sapiens
ccagaggtggggaa

SEQ ID NO: 6060504 - DNA, 22 bp, Homo sapiens
ccagaggtggggaagagagcct

SEQ ID NO: 6060505 - DNA, 19 bp, Homo sapiens
ccagaggttatctgcctgg

SEQ ID NO: 6060506 - DNA, 21 bp, Homo sapiens
ccagagtagagccaggtgctt

SEQ ID NO: 6060507 - DNA, 15 bp, Homo sapiens
ccagagtagcccagg

SEQ ID NO: 6060508 - DNA, 24 bp, Homo sapiens
ccagagtagggttgccagtcctgc

SEQ ID NO: 6060509 - DNA, 18 bp, Homo sapiens
ccagagtaggtgggtctt

SEQ ID NO: 6060510 - DNA, 20 bp, Homo sapiens
ccagagtatgagtgcaagca

SEQ ID NO: 6060511 - DNA, 12 bp, Homo sapiens
ccagagtcaaca

SEQ ID NO: 6060512 - DNA, 17 bp, Homo sapiens
ccagagtcaacaaatta

SEQ ID NO: 6060513 - DNA, 18 bp, Homo sapiens
ccagagtcacaagtagcc

SEQ ID NO: 6060514 - DNA, 21 bp, Homo sapiens
ccagagtcaccttttctgtgg

SEQ ID NO: 6060515 - DNA, 22 bp, Homo sapiens
ccagagtccccccactcccagc

SEQ ID NO: 6060516 - DNA, 16 bp, Homo sapiens
ccagagtccctgcctg

SEQ ID NO: 6060517 - DNA, 17 bp, Homo sapiens
ccagagtccggaggcag

SEQ ID NO: 6060518 - DNA, 16 bp, Homo sapiens
ccagagtcctttccaa

SEQ ID NO: 6060519 - DNA, 22 bp, Homo sapiens
ccagagtctagcgtagtgcagc

SEQ ID NO: 6060520 - DNA, 14 bp, Homo sapiens
ccagagtctcccag

SEQ ID NO: 6060521 - DNA, 15 bp, Homo sapiens
ccagagtctgagccc

SEQ ID NO: 6060522 - DNA, 16 bp, Homo sapiens
ccagagtctgagcccc

SEQ ID NO: 6060523 - DNA, 18 bp, Homo sapiens
ccagagtctgagcccccg

SEQ ID NO: 6060524 - DNA, 17 bp, Homo sapiens
ccagagtctgtattttt

SEQ ID NO: 6060525 - DNA, 16 bp, Homo sapiens
ccagagtgattctagt

SEQ ID NO: 6060526 - DNA, 22 bp, Homo sapiens
ccagagtgctgtcgggaccaca

SEQ ID NO: 6060527 - DNA, 23 bp, Homo sapiens
ccagagtggagatcccacatatt

SEQ ID NO: 6060528 - DNA, 17 bp, Homo sapiens
ccagagtggagtctgag

SEQ ID NO: 6060529 - DNA, 17 bp, Homo sapiens
ccagagtggccacggcc

SEQ ID NO: 6060530 - DNA, 14 bp, Homo sapiens
ccagagtggcccac

SEQ ID NO: 6060531 - DNA, 13 bp, Homo sapiens
ccagagtggcctg

SEQ ID NO: 6060532 - DNA, 16 bp, Homo sapiens
ccagagtggcctggcc

SEQ ID NO: 6060533 - DNA, 17 bp, Homo sapiens
ccagagtggcctggcca

SEQ ID NO: 6060534 - DNA, 23 bp, Homo sapiens
ccagagtgggagaggctgggagg

SEQ ID NO: 6060535 - DNA, 19 bp, Homo sapiens
ccagagtgggctttggtgg

SEQ ID NO: 6060536 - DNA, 20 bp, Homo sapiens
ccagagtgggctttggtggc

SEQ ID NO: 6060537 - DNA, 21 bp, Homo sapiens
ccagagtggggatgacatgca

SEQ ID NO: 6060538 - DNA, 14 bp, Homo sapiens
ccagagtgtcctgc

SEQ ID NO: 6060539 - DNA, 21 bp, Homo sapiens
ccagagttaaaatgtttactg

SEQ ID NO: 6060540 - DNA, 19 bp, Homo sapiens
ccagagttccacaaatcta

SEQ ID NO: 6060541 - DNA, 24 bp, Homo sapiens
ccagagttccacaaatctatatta

SEQ ID NO: 6060542 - DNA, 21 bp, Homo sapiens
ccagagttccccatgcagaca

SEQ ID NO: 6060543 - DNA, 13 bp, Homo sapiens
ccagagttcctgc

SEQ ID NO: 6060544 - DNA, 12 bp, Homo sapiens
ccagagttcttg

SEQ ID NO: 6060545 - DNA, 16 bp, Homo sapiens
ccagagttcttgcacc

SEQ ID NO: 6060546 - DNA, 16 bp, Homo sapiens
ccagagttgctgtgcc

SEQ ID NO: 6060547 - DNA, 23 bp, Homo sapiens
ccagagttgtctttattgtccac

SEQ ID NO: 6060548 - DNA, 16 bp, Homo sapiens
ccagagttgttctcag

SEQ ID NO: 6060549 - DNA, 21 bp, Homo sapiens
ccagagttttctatgaatcta

SEQ ID NO: 6060550 - DNA, 19 bp, Homo sapiens
ccagagtttttaaagcctt

SEQ ID NO: 6060551 - DNA, 22 bp, Homo sapiens
ccagataaaattatagatggga

SEQ ID NO: 6060552 - DNA, 13 bp, Homo sapiens
ccagataaataga

SEQ ID NO: 6060553 - DNA, 14 bp, Homo sapiens
ccagataaatagaa

SEQ ID NO: 6060554 - DNA, 18 bp, Homo sapiens
ccagataactctctttcc

SEQ ID NO: 6060555 - DNA, 12 bp, Homo sapiens
ccagataactta

SEQ ID NO: 6060556 - DNA, 14 bp, Homo sapiens
ccagataagaatgc

SEQ ID NO: 6060557 - DNA, 16 bp, Homo sapiens
ccagataagttattta

SEQ ID NO: 6060558 - DNA, 15 bp, Homo sapiens
ccagatacctgtgag

SEQ ID NO: 6060559 - DNA, 19 bp, Homo sapiens
ccagatacctgtgaggact

SEQ ID NO: 6060560 - DNA, 21 bp, Homo sapiens
ccagatacttcccattttgga

SEQ ID NO: 6060561 - DNA, 14 bp, Homo sapiens
ccagatagagctgg

SEQ ID NO: 6060562 - DNA, 17 bp, Homo sapiens
ccagatagtagaaccag

SEQ ID NO: 6060563 - DNA, 15 bp, Homo sapiens
ccagatagtcccagc

SEQ ID NO: 6060564 - DNA, 20 bp, Homo sapiens
ccagatatggaaacagaaga

SEQ ID NO: 6060565 - DNA, 12 bp, Homo sapiens
ccagatcaaaat

SEQ ID NO: 6060566 - DNA, 15 bp, Homo sapiens
ccagatcaaggatgt

SEQ ID NO: 6060567 - DNA, 13 bp, Homo sapiens
ccagatcactcaa

SEQ ID NO: 6060568 - DNA, 15 bp, Homo sapiens
ccagatcactgccac

SEQ ID NO: 6060569 - DNA, 16 bp, Homo sapiens
ccagatcagccagaag

SEQ ID NO: 6060570 - DNA, 15 bp, Homo sapiens
ccagatcaggaacca

SEQ ID NO: 6060571 - DNA, 13 bp, Homo sapiens
ccagatcagtcag

SEQ ID NO: 6060572 - DNA, 20 bp, Homo sapiens
ccagatcatgttttggtgaa

SEQ ID NO: 6060573 - DNA, 17 bp, Homo sapiens
ccagatccagactgtaa

SEQ ID NO: 6060574 - DNA, 15 bp, Homo sapiens
ccagatccagcctgg

SEQ ID NO: 6060575 - DNA, 18 bp, Homo sapiens
ccagatcccaggcccctg

SEQ ID NO: 6060576 - DNA, 22 bp, Homo sapiens
ccagatcccaggcccctggagg

SEQ ID NO: 6060577 - DNA, 19 bp, Homo sapiens
ccagatccccagggcagcc

SEQ ID NO: 6060578 - DNA, 23 bp, Homo sapiens
ccagatccccagggcagcctcgt

SEQ ID NO: 6060579 - DNA, 14 bp, Homo sapiens
ccagatcctcacaa

SEQ ID NO: 6060580 - DNA, 15 bp, Homo sapiens
ccagatcctcttctc

SEQ ID NO: 6060581 - DNA, 21 bp, Homo sapiens
ccagatcctctttccccactg

SEQ ID NO: 6060582 - DNA, 13 bp, Homo sapiens
ccagatcctggaa

SEQ ID NO: 6060583 - DNA, 12 bp, Homo sapiens
ccagatcctggg

SEQ ID NO: 6060584 - DNA, 15 bp, Homo sapiens
ccagatccttttcca

SEQ ID NO: 6060585 - DNA, 19 bp, Homo sapiens
ccagatccttttccatccc

SEQ ID NO: 6060586 - DNA, 23 bp, Homo sapiens
ccagatccttttccatcccactc

SEQ ID NO: 6060587 - DNA, 14 bp, Homo sapiens
ccagatcgtctcca

SEQ ID NO: 6060588 - DNA, 15 bp, Homo sapiens
ccagatcgttctgcc

SEQ ID NO: 6060589 - DNA, 14 bp, Homo sapiens
ccagatctgcctgg

SEQ ID NO: 6060590 - DNA, 15 bp, Homo sapiens
ccagatctgcctggg

SEQ ID NO: 6060591 - DNA, 20 bp, Homo sapiens
ccagatctgcctgggcctgt

SEQ ID NO: 6060592 - DNA, 17 bp, Homo sapiens
ccagatctggaatgcca

SEQ ID NO: 6060593 - DNA, 17 bp, Homo sapiens
ccagatctgtcctgggg

SEQ ID NO: 6060594 - DNA, 21 bp, Homo sapiens
ccagatctttcagaaatataa

SEQ ID NO: 6060595 - DNA, 18 bp, Homo sapiens
ccagatctttctcttccc

SEQ ID NO: 6060596 - DNA, 14 bp, Homo sapiens
ccctacctgtgcct

SEQ ID NO: 6060597 - DNA, 15 bp, Homo sapiens
ccctaccttccccag

SEQ ID NO: 6060598 - DNA, 20 bp, Homo sapiens
ccctaccttgagaccctctt

SEQ ID NO: 6060599 - DNA, 15 bp, Homo sapiens
ccctaccttgcctcc

SEQ ID NO: 6060600 - DNA, 15 bp, Homo sapiens
ccctacgggcgctgc

SEQ ID NO: 6060601 - DNA, 19 bp, Homo sapiens
ccctacgggcgctgcagcc

SEQ ID NO: 6060602 - DNA, 22 bp, Homo sapiens
ccctacgggcgctgcagcctcc

SEQ ID NO: 6060603 - DNA, 18 bp, Homo sapiens
ccctactccctgcagatg

SEQ ID NO: 6060604 - DNA, 12 bp, Homo sapiens
ccctactcctgc

SEQ ID NO: 6060605 - DNA, 14 bp, Homo sapiens
ccctactctgtgta

SEQ ID NO: 6060606 - DNA, 22 bp, Homo sapiens
ccctactgaaccctgcctcttg

SEQ ID NO: 6060607 - DNA, 14 bp, Homo sapiens
ccctactgagaaac

SEQ ID NO: 6060608 - DNA, 13 bp, Homo sapiens
ccctactgtgggc

SEQ ID NO: 6060609 - DNA, 15 bp, Homo sapiens
ccctactgtggggag

SEQ ID NO: 6060610 - DNA, 16 bp, Homo sapiens
ccctacttagacccag

SEQ ID NO: 6060611 - DNA, 22 bp, Homo sapiens
ccctacttcattttcagagtga

SEQ ID NO: 6060612 - DNA, 21 bp, Homo sapiens
ccctacttgagataatctaaa

SEQ ID NO: 6060613 - DNA, 20 bp, Homo sapiens
ccctactttgcttccgccac

SEQ ID NO: 6060614 - DNA, 21 bp, Homo sapiens
ccctagaaaccacctgggttc

SEQ ID NO: 6060615 - DNA, 17 bp, Homo sapiens
ccctagaaacccaagct

SEQ ID NO: 6060616 - DNA, 17 bp, Homo sapiens
ccctagaaacttccaaa

SEQ ID NO: 6060617 - DNA, 23 bp, Homo sapiens
ccctagaaagccatattccagca

SEQ ID NO: 6060618 - DNA, 16 bp, Homo sapiens
ccctagaaaggagaga

SEQ ID NO: 6060619 - DNA, 19 bp, Homo sapiens
ccctagaaaggagagaacg

SEQ ID NO: 6060620 - DNA, 17 bp, Homo sapiens
ccctagaagaaaacccg

SEQ ID NO: 6060621 - DNA, 22 bp, Homo sapiens
ccctagaagatcacagcagggc

SEQ ID NO: 6060622 - DNA, 19 bp, Homo sapiens
ccctagaatcagcctaggg

SEQ ID NO: 6060623 - DNA, 23 bp, Homo sapiens
ccctagactctgtaaccacctct

SEQ ID NO: 6060624 - DNA, 13 bp, Homo sapiens
ccctagactttag

SEQ ID NO: 6060625 - DNA, 19 bp, Homo sapiens
ccctagagacagtgatgcc

SEQ ID NO: 6060626 - DNA, 20 bp, Homo sapiens
ccctagagacagtgatgcct

SEQ ID NO: 6060627 - DNA, 19 bp, Homo sapiens
ccctagagccctctcctcc

SEQ ID NO: 6060628 - DNA, 18 bp, Homo sapiens
ccctagagcctgcctgga

SEQ ID NO: 6060629 - DNA, 20 bp, Homo sapiens
ccctagaggcaaacatttct

SEQ ID NO: 6060630 - DNA, 20 bp, Homo sapiens
ccctagaggcgagccaggca

SEQ ID NO: 6060631 - DNA, 12 bp, Homo sapiens
ccctagatccag

SEQ ID NO: 6060632 - DNA, 15 bp, Homo sapiens
ccctagatccaggct

SEQ ID NO: 6060633 - DNA, 20 bp, Homo sapiens
ccctagatccaggcttctcc

SEQ ID NO: 6060634 - DNA, 22 bp, Homo sapiens
ccctagatccaggcttctcccg

SEQ ID NO: 6060635 - DNA, 19 bp, Homo sapiens
ccctagatgaagaaagaga

SEQ ID NO: 6060636 - DNA, 17 bp, Homo sapiens
ccctagcaatacaggga

SEQ ID NO: 6060637 - DNA, 19 bp, Homo sapiens
ccctagcagcccaccctgc

SEQ ID NO: 6060638 - DNA, 16 bp, Homo sapiens
ccctagcagtttgcct

SEQ ID NO: 6060639 - DNA, 19 bp, Homo sapiens
ccctagcagtttgcctctg

SEQ ID NO: 6060640 - DNA, 20 bp, Homo sapiens
ccctagcagtttgcctctgc

SEQ ID NO: 6060641 - DNA, 21 bp, Homo sapiens
ccctagcagtttgcctctgca

SEQ ID NO: 6060642 - DNA, 12 bp, Homo sapiens
ccctagccacca

SEQ ID NO: 6060643 - DNA, 18 bp, Homo sapiens
ccctagccattcctggta

SEQ ID NO: 6060644 - DNA, 20 bp, Homo sapiens
ccctagcccagcgctctgcc

SEQ ID NO: 6060645 - DNA, 15 bp, Homo sapiens
ccctagccctcagcc

SEQ ID NO: 6060646 - DNA, 12 bp, Homo sapiens
ccctagccctgc

SEQ ID NO: 6060647 - DNA, 14 bp, Homo sapiens
ccctagccctgctc

SEQ ID NO: 6060648 - DNA, 16 bp, Homo sapiens
ccctagccctgctcca

SEQ ID NO: 6060649 - DNA, 14 bp, Homo sapiens
ccctagccctggtt

SEQ ID NO: 6060650 - DNA, 18 bp, Homo sapiens
ccctagcccttccagcct

SEQ ID NO: 6060651 - DNA, 19 bp, Homo sapiens
ccctagcccttccagcctg

SEQ ID NO: 6060652 - DNA, 21 bp, Homo sapiens
ccctagcccttccagcctggg

SEQ ID NO: 6060653 - DNA, 23 bp, Homo sapiens
ccctagcctgacccggaggaaag

SEQ ID NO: 6060654 - DNA, 20 bp, Homo sapiens
ccctagcggcagaaaggaaa

SEQ ID NO: 6060655 - DNA, 20 bp, Homo sapiens
ccctagcggctgctccttca

SEQ ID NO: 6060656 - DNA, 17 bp, Homo sapiens
ccctagctaataaacct

SEQ ID NO: 6060657 - DNA, 18 bp, Homo sapiens
ccctagctaataaacctg

SEQ ID NO: 6060658 - DNA, 15 bp, Homo sapiens
ccctagctcaccagg

SEQ ID NO: 6060659 - DNA, 22 bp, Homo sapiens
ccctagctgggcaaacccttct

SEQ ID NO: 6060660 - DNA, 19 bp, Homo sapiens
ccctagctgtcccatgggg

SEQ ID NO: 6060661 - DNA, 18 bp, Homo sapiens
ccctagctttagaccctg

SEQ ID NO: 6060662 - DNA, 19 bp, Homo sapiens
ccctagctttagaccctgg

SEQ ID NO: 6060663 - DNA, 17 bp, Homo sapiens
ccctaggaactcagtcc

SEQ ID NO: 6060664 - DNA, 14 bp, Homo sapiens
ccctaggagaccaa

SEQ ID NO: 6060665 - DNA, 23 bp, Homo sapiens
ccctaggaggagaacttgaacaa

SEQ ID NO: 6060666 - DNA, 22 bp, Homo sapiens
ccctaggataaaaagccagggc

SEQ ID NO: 6060667 - DNA, 23 bp, Homo sapiens
ccctaggataaaaagccagggct

SEQ ID NO: 6060668 - DNA, 16 bp, Homo sapiens
ccctaggctttctcct

SEQ ID NO: 6060669 - DNA, 14 bp, Homo sapiens
ccctagggctcaga

SEQ ID NO: 6060670 - DNA, 19 bp, Homo sapiens
ccctagggctctccaagca

SEQ ID NO: 6060671 - DNA, 17 bp, Homo sapiens
ccctagggctgggtgta

SEQ ID NO: 6060672 - DNA, 17 bp, Homo sapiens
ccctaggggacacttcc

SEQ ID NO: 6060673 - DNA, 16 bp, Homo sapiens
ccctaggtctccaccc

SEQ ID NO: 6060674 - DNA, 19 bp, Homo sapiens
ccctaggtgcccagggcca

SEQ ID NO: 6060675 - DNA, 13 bp, Homo sapiens
ccctaggtgctca

SEQ ID NO: 6060676 - DNA, 23 bp, Homo sapiens
ccctaggtgggtcaactccaagg

SEQ ID NO: 6060677 - DNA, 16 bp, Homo sapiens
ccctaggtgttttgtt

SEQ ID NO: 6060678 - DNA, 20 bp, Homo sapiens
ccctagtaagtgccttccat

SEQ ID NO: 6060679 - DNA, 17 bp, Homo sapiens
ccctagtccccctgttt

SEQ ID NO: 6060680 - DNA, 20 bp, Homo sapiens
ccctagtccggttcttcttg

SEQ ID NO: 6060681 - DNA, 16 bp, Homo sapiens
ccctagtgatttttgg

SEQ ID NO: 6060682 - DNA, 14 bp, Homo sapiens
ccctagttacccac

SEQ ID NO: 6060683 - DNA, 18 bp, Homo sapiens
ccctagttccctctgctc

SEQ ID NO: 6060684 - DNA, 23 bp, Homo sapiens
ccctagttccctctgctcagcca

SEQ ID NO: 6060685 - DNA, 21 bp, Homo sapiens
ccctagttttctttcctcctt

SEQ ID NO: 6060686 - DNA, 18 bp, Homo sapiens
ccctataacccctgcctg

SEQ ID NO: 6060687 - DNA, 15 bp, Homo sapiens
ccctatatcagggcc

SEQ ID NO: 6060688 - DNA, 17 bp, Homo sapiens
ccctatatcagggcctg

SEQ ID NO: 6060689 - DNA, 23 bp, Homo sapiens
ccctatatgtagtataaagaaaa

SEQ ID NO: 6060690 - DNA, 12 bp, Homo sapiens
ccctatcaaaac

SEQ ID NO: 6060691 - DNA, 15 bp, Homo sapiens
ccctatcaaaacata

SEQ ID NO: 6060692 - DNA, 16 bp, Homo sapiens
ccctatccaatcaatc

SEQ ID NO: 6060693 - DNA, 18 bp, Homo sapiens
ccctatccacccagccca

SEQ ID NO: 6060694 - DNA, 12 bp, Homo sapiens
ccctatcctccc

SEQ ID NO: 6060695 - DNA, 16 bp, Homo sapiens
ccctatcctgcaccct

SEQ ID NO: 6060696 - DNA, 18 bp, Homo sapiens
ccctatcctgcaccctct

SEQ ID NO: 6060697 - DNA, 22 bp, Homo sapiens
ccctatctattaaagtgacttt

SEQ ID NO: 6060698 - DNA, 11 bp, Homo sapiens
ccctatctccc

SEQ ID NO: 6060699 - DNA, 22 bp, Homo sapiens
ccctatctcctgacagaaggtg

SEQ ID NO: 6060700 - DNA, 17 bp, Homo sapiens
ccctatctcttcctgtc

SEQ ID NO: 6060701 - DNA, 14 bp, Homo sapiens
ccctatctgtattc

SEQ ID NO: 6060702 - DNA, 21 bp, Homo sapiens
ccctatctttgccaccctcat

SEQ ID NO: 6060703 - DNA, 20 bp, Homo sapiens
ccctatgaagtaaagaactg

SEQ ID NO: 6060704 - DNA, 13 bp, Homo sapiens
ccctatgctccag

SEQ ID NO: 6060705 - DNA, 13 bp, Homo sapiens
ccctatgctgcct

SEQ ID NO: 6060706 - DNA, 14 bp, Homo sapiens
ccctatgtcccagc

SEQ ID NO: 6060707 - DNA, 17 bp, Homo sapiens
ccctatgtcccagcccc

SEQ ID NO: 6060708 - DNA, 16 bp, Homo sapiens
ccctatgtctgcaaag

SEQ ID NO: 6060709 - DNA, 15 bp, Homo sapiens
ccctatgtgaaaaga

SEQ ID NO: 6060710 - DNA, 15 bp, Homo sapiens
ccctattctgccatg

SEQ ID NO: 6060711 - DNA, 14 bp, Homo sapiens
ccctattgctgcta

SEQ ID NO: 6060712 - DNA, 15 bp, Homo sapiens
ccctattgctgctaa

SEQ ID NO: 6060713 - DNA, 16 bp, Homo sapiens
ccctattgtctccaag

SEQ ID NO: 6060714 - DNA, 14 bp, Homo sapiens
ccctatttaaaact

SEQ ID NO: 6060715 - DNA, 19 bp, Homo sapiens
ccctatttaaatgaaagga

SEQ ID NO: 6060716 - DNA, 21 bp, Homo sapiens
ccctatttaacagggtctcta

SEQ ID NO: 6060717 - DNA, 20 bp, Homo sapiens
ccctatttagatgataaaga

SEQ ID NO: 6060718 - DNA, 16 bp, Homo sapiens
ccctatttccccaccc

SEQ ID NO: 6060719 - DNA, 18 bp, Homo sapiens
ccctatttgtgaattctg

SEQ ID NO: 6060720 - DNA, 14 bp, Homo sapiens
ccctattttgccat

SEQ ID NO: 6060721 - DNA, 22 bp, Homo sapiens
ccctattttgctgatgaggaaa

SEQ ID NO: 6060722 - DNA, 19 bp, Homo sapiens
ccctattttttgacacttc

SEQ ID NO: 6060723 - DNA, 21 bp, Homo sapiens
ccctattttttttctgttata

SEQ ID NO: 6060724 - DNA, 17 bp, Homo sapiens
ccctcaaaagccaaaaa

SEQ ID NO: 6060725 - DNA, 21 bp, Homo sapiens
ccctcaaaccaagggtacaga

SEQ ID NO: 6060726 - DNA, 16 bp, Homo sapiens
ccctcaaaccctgtgg

SEQ ID NO: 6060727 - DNA, 22 bp, Homo sapiens
ccctcaaagaagtcggaatgtc

SEQ ID NO: 6060728 - DNA, 17 bp, Homo sapiens
ccctcaacaccctgctt

SEQ ID NO: 6060729 - DNA, 15 bp, Homo sapiens
ccctcaacaggccca

SEQ ID NO: 6060730 - DNA, 16 bp, Homo sapiens
ccctcaacaggcccag

SEQ ID NO: 6060731 - DNA, 17 bp, Homo sapiens
ccctcaacaggcccagg

SEQ ID NO: 6060732 - DNA, 18 bp, Homo sapiens
ccctcaacaggcccaggg

SEQ ID NO: 6060733 - DNA, 20 bp, Homo sapiens
ccctcaacaggcccagggag

SEQ ID NO: 6060734 - DNA, 21 bp, Homo sapiens
ccctcaacaggcccagggagg

SEQ ID NO: 6060735 - DNA, 18 bp, Homo sapiens
ccctcaacctcatcctct

SEQ ID NO: 6060736 - DNA, 16 bp, Homo sapiens
ccctcaacctcctggg

SEQ ID NO: 6060737 - DNA, 16 bp, Homo sapiens
ccctcaactctcctcc

SEQ ID NO: 6060738 - DNA, 15 bp, Homo sapiens
ccctcaactgaaggg

SEQ ID NO: 6060739 - DNA, 20 bp, Homo sapiens
ccctcaactgagggccaggg

SEQ ID NO: 6060740 - DNA, 23 bp, Homo sapiens
ccctcaagaggggaagcaactcc

SEQ ID NO: 6060741 - DNA, 23 bp, Homo sapiens
ccctcaagccaggagaccctgtc

SEQ ID NO: 6060742 - DNA, 21 bp, Homo sapiens
ccctcaagccccagcagccct

SEQ ID NO: 6060743 - DNA, 22 bp, Homo sapiens
ccctcaagccccagcagccctc

SEQ ID NO: 6060744 - DNA, 16 bp, Homo sapiens
ccctcaagccccttct

SEQ ID NO: 6060745 - DNA, 23 bp, Homo sapiens
ccctcaaggacaaagtctccagc

SEQ ID NO: 6060746 - DNA, 16 bp, Homo sapiens
ccctcaaggcctccca

SEQ ID NO: 6060747 - DNA, 19 bp, Homo sapiens
ccctcaaggcctcccacag

SEQ ID NO: 6060748 - DNA, 21 bp, Homo sapiens
ccctcaaggcctcccacagtg

SEQ ID NO: 6060749 - DNA, 22 bp, Homo sapiens
ccctcaaggcctcccacagtga

SEQ ID NO: 6060750 - DNA, 19 bp, Homo sapiens
ccctcaatgtgatggtatt

SEQ ID NO: 6060751 - DNA, 21 bp, Homo sapiens
ccctcacaacagtcacctcac

SEQ ID NO: 6060752 - DNA, 22 bp, Homo sapiens
ccctcacaagcgctcccagcct

SEQ ID NO: 6060753 - DNA, 14 bp, Homo sapiens
ccctcacacacaca

SEQ ID NO: 6060754 - DNA, 18 bp, Homo sapiens
ccctcacacacacagctg

SEQ ID NO: 6060755 - DNA, 22 bp, Homo sapiens
ccctcacacacacagctgggca

SEQ ID NO: 6060756 - DNA, 14 bp, Homo sapiens
ccctcacaccctgg

SEQ ID NO: 6060757 - DNA, 18 bp, Homo sapiens
ccctcacacctcccttca

SEQ ID NO: 6060758 - DNA, 21 bp, Homo sapiens
ccctcacacctcccttcatcc

SEQ ID NO: 6060759 - DNA, 15 bp, Homo sapiens
ccctcacactgcaag

SEQ ID NO: 6060760 - DNA, 13 bp, Homo sapiens
ccctcacagcctc

SEQ ID NO: 6060761 - DNA, 15 bp, Homo sapiens
ccctcacagcctctg

SEQ ID NO: 6060762 - DNA, 17 bp, Homo sapiens
ccctcacagcctctgac

SEQ ID NO: 6060763 - DNA, 18 bp, Homo sapiens
ccctcacagtattgctca

SEQ ID NO: 6060764 - DNA, 16 bp, Homo sapiens
ccctcacatcctcctg

SEQ ID NO: 6060765 - DNA, 15 bp, Homo sapiens
ccctcacatcctctc

SEQ ID NO: 6060766 - DNA, 19 bp, Homo sapiens
ccctcacatcctctccagg

SEQ ID NO: 6060767 - DNA, 20 bp, Homo sapiens
ccctcacatcctctccagga

SEQ ID NO: 6060768 - DNA, 12 bp, Homo sapiens
ccctcaccaaca

SEQ ID NO: 6060769 - DNA, 20 bp, Homo sapiens
ccctcaccacagccttctaa

SEQ ID NO: 6060770 - DNA, 13 bp, Homo sapiens
ccctcaccacccc

SEQ ID NO: 6060771 - DNA, 14 bp, Homo sapiens
ccctcaccatccag

SEQ ID NO: 6060772 - DNA, 16 bp, Homo sapiens
ccctcaccatccagtg

SEQ ID NO: 6060773 - DNA, 21 bp, Homo sapiens
ccagatctttctcttccctga

SEQ ID NO: 6060774 - DNA, 15 bp, Homo sapiens
ccagatgacacccta

SEQ ID NO: 6060775 - DNA, 21 bp, Homo sapiens
ccagatgagcagaagctctcg

SEQ ID NO: 6060776 - DNA, 21 bp, Homo sapiens
ccagatgattttcctccctgg

SEQ ID NO: 6060777 - DNA, 14 bp, Homo sapiens
ccagatgcaccagc

SEQ ID NO: 6060778 - DNA, 14 bp, Homo sapiens
ccagatgcaggaca

SEQ ID NO: 6060779 - DNA, 20 bp, Homo sapiens
ccagatgcaggacaggaggc

SEQ ID NO: 6060780 - DNA, 13 bp, Homo sapiens
ccagatgcctccc

SEQ ID NO: 6060781 - DNA, 16 bp, Homo sapiens
ccagatgcctccccaa

SEQ ID NO: 6060782 - DNA, 21 bp, Homo sapiens
ccagatgccttcctgtctttc

SEQ ID NO: 6060783 - DNA, 20 bp, Homo sapiens
ccagatgccttctagattca

SEQ ID NO: 6060784 - DNA, 17 bp, Homo sapiens
ccagatgcgtcccaaga

SEQ ID NO: 6060785 - DNA, 21 bp, Homo sapiens
ccagatgcgtcccaagatgtt

SEQ ID NO: 6060786 - DNA, 13 bp, Homo sapiens
ccagatgctactg

SEQ ID NO: 6060787 - DNA, 19 bp, Homo sapiens
ccagatgctaggctgtctg

SEQ ID NO: 6060788 - DNA, 22 bp, Homo sapiens
ccagatgctgatgttcagtgta

SEQ ID NO: 6060789 - DNA, 20 bp, Homo sapiens
ccagatgctgggcaggaaac

SEQ ID NO: 6060790 - DNA, 13 bp, Homo sapiens
ccagatgctgtca

SEQ ID NO: 6060791 - DNA, 16 bp, Homo sapiens
ccagatggactccagc

SEQ ID NO: 6060792 - DNA, 15 bp, Homo sapiens
ccagatggctccctg

SEQ ID NO: 6060793 - DNA, 19 bp, Homo sapiens
ccagatggctccctgggct

SEQ ID NO: 6060794 - DNA, 20 bp, Homo sapiens
ccagatggctccctgggctg

SEQ ID NO: 6060795 - DNA, 22 bp, Homo sapiens
ccagatggctggaaggggtcca

SEQ ID NO: 6060796 - DNA, 20 bp, Homo sapiens
ccagatggcttcggagggcc

SEQ ID NO: 6060797 - DNA, 23 bp, Homo sapiens
ccagatgggatgggctttctcag

SEQ ID NO: 6060798 - DNA, 16 bp, Homo sapiens
ccagatgggccacggc

SEQ ID NO: 6060799 - DNA, 21 bp, Homo sapiens
ccagatgggccacggctgagc

SEQ ID NO: 6060800 - DNA, 23 bp, Homo sapiens
ccagatgggccacggctgagcct

SEQ ID NO: 6060801 - DNA, 14 bp, Homo sapiens
ccagatggtgggat

SEQ ID NO: 6060802 - DNA, 16 bp, Homo sapiens
ccagatggtgggatgt

SEQ ID NO: 6060803 - DNA, 12 bp, Homo sapiens
ccagatgtaaag

SEQ ID NO: 6060804 - DNA, 20 bp, Homo sapiens
ccagatgtaaagaacgcgac

SEQ ID NO: 6060805 - DNA, 21 bp, Homo sapiens
ccagatgtccgtctctcttgc

SEQ ID NO: 6060806 - DNA, 18 bp, Homo sapiens
ccagatgtgacagtgttg

SEQ ID NO: 6060807 - DNA, 21 bp, Homo sapiens
ccagatgtgatgcttgatatt

SEQ ID NO: 6060808 - DNA, 15 bp, Homo sapiens
ccagatgtgggctca

SEQ ID NO: 6060809 - DNA, 21 bp, Homo sapiens
ccagatgtgtcccccccaggc

SEQ ID NO: 6060810 - DNA, 23 bp, Homo sapiens
ccagatgtgtcccccccaggcct

SEQ ID NO: 6060811 - DNA, 13 bp, Homo sapiens
ccagatgttgctt

SEQ ID NO: 6060812 - DNA, 20 bp, Homo sapiens
ccagatgttgttcctggcta

SEQ ID NO: 6060813 - DNA, 17 bp, Homo sapiens
ccagatgtttccagact

SEQ ID NO: 6060814 - DNA, 23 bp, Homo sapiens
ccagatgtttccagacttccttg

SEQ ID NO: 6060815 - DNA, 19 bp, Homo sapiens
ccagatgtttctcatttta

SEQ ID NO: 6060816 - DNA, 14 bp, Homo sapiens
ccagatgttttaga

SEQ ID NO: 6060817 - DNA, 19 bp, Homo sapiens
ccagatgttttagagataa

SEQ ID NO: 6060818 - DNA, 20 bp, Homo sapiens
ccagatgttttatttatgaa

SEQ ID NO: 6060819 - DNA, 17 bp, Homo sapiens
ccagattagagcctgta

SEQ ID NO: 6060820 - DNA, 17 bp, Homo sapiens
ccagattattttctata

SEQ ID NO: 6060821 - DNA, 18 bp, Homo sapiens
ccagattattttctatat

SEQ ID NO: 6060822 - DNA, 14 bp, Homo sapiens
ccagattcccagac

SEQ ID NO: 6060823 - DNA, 16 bp, Homo sapiens
ccagattcccagacct

SEQ ID NO: 6060824 - DNA, 14 bp, Homo sapiens
ccagattcccaggc

SEQ ID NO: 6060825 - DNA, 19 bp, Homo sapiens
ccagattcccaggccaggc

SEQ ID NO: 6060826 - DNA, 22 bp, Homo sapiens
ccagattcccaggccaggctcc

SEQ ID NO: 6060827 - DNA, 17 bp, Homo sapiens
ccagattcccctgtgtc

SEQ ID NO: 6060828 - DNA, 18 bp, Homo sapiens
ccagattcccctgtgtca

SEQ ID NO: 6060829 - DNA, 12 bp, Homo sapiens
ccagattctgat

SEQ ID NO: 6060830 - DNA, 14 bp, Homo sapiens
ccagattctgatgc

SEQ ID NO: 6060831 - DNA, 15 bp, Homo sapiens
ccagattctgatgca

SEQ ID NO: 6060832 - DNA, 23 bp, Homo sapiens
ccagattctgcctctctggaaag

SEQ ID NO: 6060833 - DNA, 20 bp, Homo sapiens
ccagattctttcctgaggct

SEQ ID NO: 6060834 - DNA, 21 bp, Homo sapiens
ccagattctttcctgaggctg

SEQ ID NO: 6060835 - DNA, 22 bp, Homo sapiens
ccagattctttcctgaggctgg

SEQ ID NO: 6060836 - DNA, 20 bp, Homo sapiens
ccagattgaaaagtgtcctc

SEQ ID NO: 6060837 - DNA, 19 bp, Homo sapiens
ccagattgacgacaagtgc

SEQ ID NO: 6060838 - DNA, 21 bp, Homo sapiens
ccagattgataagtaatgaaa

SEQ ID NO: 6060839 - DNA, 21 bp, Homo sapiens
ccagattgcaacaggctgggc

SEQ ID NO: 6060840 - DNA, 19 bp, Homo sapiens
ccagattggctcacactga

SEQ ID NO: 6060841 - DNA, 20 bp, Homo sapiens
ccagattggctcacactgag

SEQ ID NO: 6060842 - DNA, 16 bp, Homo sapiens
ccagattgtagctctt

SEQ ID NO: 6060843 - DNA, 12 bp, Homo sapiens
ccagattgtgta

SEQ ID NO: 6060844 - DNA, 19 bp, Homo sapiens
ccagatttacactgggaga

SEQ ID NO: 6060845 - DNA, 22 bp, Homo sapiens
ccagatttatgcatattatttt

SEQ ID NO: 6060846 - DNA, 18 bp, Homo sapiens
ccagatttcactctcctt

SEQ ID NO: 6060847 - DNA, 19 bp, Homo sapiens
ccagatttcactctccttg

SEQ ID NO: 6060848 - DNA, 15 bp, Homo sapiens
ccagatttgtctttt

SEQ ID NO: 6060849 - DNA, 14 bp, Homo sapiens
ccagattttattta

SEQ ID NO: 6060850 - DNA, 23 bp, Homo sapiens
ccagattttatttatatctttat

SEQ ID NO: 6060851 - DNA, 22 bp, Homo sapiens
ccagatttttcggaggccccac

SEQ ID NO: 6060852 - DNA, 24 bp, Homo sapiens
ccagattttttacagctgcctgca

SEQ ID NO: 6060853 - DNA, 22 bp, Homo sapiens
ccagcaaaaactgtgggaagat

SEQ ID NO: 6060854 - DNA, 15 bp, Homo sapiens
ccagcaaaaggttgt

SEQ ID NO: 6060855 - DNA, 14 bp, Homo sapiens
ccagcaaaatatat

SEQ ID NO: 6060856 - DNA, 20 bp, Homo sapiens
ccagcaaaatccaaactgct

SEQ ID NO: 6060857 - DNA, 13 bp, Homo sapiens
ccagcaaagcccc

SEQ ID NO: 6060858 - DNA, 14 bp, Homo sapiens
ccagcaaagcccca

SEQ ID NO: 6060859 - DNA, 19 bp, Homo sapiens
ccagcaaagccccatgctg

SEQ ID NO: 6060860 - DNA, 21 bp, Homo sapiens
ccagcaaagccccatgctgga

SEQ ID NO: 6060861 - DNA, 17 bp, Homo sapiens
ccagcaaagcccccaga

SEQ ID NO: 6060862 - DNA, 23 bp, Homo sapiens
ccagcaaagcccccagagcccag

SEQ ID NO: 6060863 - DNA, 18 bp, Homo sapiens
ccagcaaagcctccagca

SEQ ID NO: 6060864 - DNA, 21 bp, Homo sapiens
ccagcaaagcctccagcatct

SEQ ID NO: 6060865 - DNA, 17 bp, Homo sapiens
ccagcaaagttttcaga

SEQ ID NO: 6060866 - DNA, 18 bp, Homo sapiens
ccagcaaatgttcctttt

SEQ ID NO: 6060867 - DNA, 17 bp, Homo sapiens
ccagcaaattgctagtc

SEQ ID NO: 6060868 - DNA, 21 bp, Homo sapiens
ccagcaacacaagctggaagc

SEQ ID NO: 6060869 - DNA, 15 bp, Homo sapiens
ccagcaacacagagc

SEQ ID NO: 6060870 - DNA, 22 bp, Homo sapiens
ccagcaacacagcctgggcccc

SEQ ID NO: 6060871 - DNA, 16 bp, Homo sapiens
ccagcaacacgtcatt

SEQ ID NO: 6060872 - DNA, 10 bp, Homo sapiens
ccagcaacat

SEQ ID NO: 6060873 - DNA, 22 bp, Homo sapiens
ccagcaacatctcgagccccct

SEQ ID NO: 6060874 - DNA, 15 bp, Homo sapiens
ccagcaaccctccta

SEQ ID NO: 6060875 - DNA, 22 bp, Homo sapiens
ccagcaacgcccctccaaacct

SEQ ID NO: 6060876 - DNA, 14 bp, Homo sapiens
ccagcaacttgaac

SEQ ID NO: 6060877 - DNA, 21 bp, Homo sapiens
ccagcaagaataaaaaagaaa

SEQ ID NO: 6060878 - DNA, 23 bp, Homo sapiens
ccagcaagacctcatctgtggag

SEQ ID NO: 6060879 - DNA, 20 bp, Homo sapiens
ccagcaagagggaacaaaac

SEQ ID NO: 6060880 - DNA, 22 bp, Homo sapiens
ccagcaagcggggatgtccctg

SEQ ID NO: 6060881 - DNA, 23 bp, Homo sapiens
ccagcaaggcaggttggatggga

SEQ ID NO: 6060882 - DNA, 16 bp, Homo sapiens
ccagcaagtcccagac

SEQ ID NO: 6060883 - DNA, 21 bp, Homo sapiens
ccagcaagtccttaggctact

SEQ ID NO: 6060884 - DNA, 16 bp, Homo sapiens
ccagcaagtgagagct

SEQ ID NO: 6060885 - DNA, 17 bp, Homo sapiens
ccagcaagtgagagctg

SEQ ID NO: 6060886 - DNA, 19 bp, Homo sapiens
ccagcaagtgagagctggg

SEQ ID NO: 6060887 - DNA, 21 bp, Homo sapiens
ccagcaagtgagagctgggtg

SEQ ID NO: 6060888 - DNA, 16 bp, Homo sapiens
ccagcaataagaaatg

SEQ ID NO: 6060889 - DNA, 22 bp, Homo sapiens
ccagcaatcgcatcccggctga

SEQ ID NO: 6060890 - DNA, 18 bp, Homo sapiens
ccagcaatctccatgtgt

SEQ ID NO: 6060891 - DNA, 12 bp, Homo sapiens
ccagcaatgaca

SEQ ID NO: 6060892 - DNA, 22 bp, Homo sapiens
ccagcaatgacatctcaggggc

SEQ ID NO: 6060893 - DNA, 23 bp, Homo sapiens
ccagcaatgacatctcaggggcc

SEQ ID NO: 6060894 - DNA, 15 bp, Homo sapiens
ccagcaatgccctgc

SEQ ID NO: 6060895 - DNA, 18 bp, Homo sapiens
ccagcaattctcctgcct

SEQ ID NO: 6060896 - DNA, 21 bp, Homo sapiens
ccagcaattctcctgcctcag

SEQ ID NO: 6060897 - DNA, 15 bp, Homo sapiens
ccagcaatttttcca

SEQ ID NO: 6060898 - DNA, 12 bp, Homo sapiens
ccagcacaaaca

SEQ ID NO: 6060899 - DNA, 14 bp, Homo sapiens
ccagcacaaagcag

SEQ ID NO: 6060900 - DNA, 16 bp, Homo sapiens
ccagcacaattcattg

SEQ ID NO: 6060901 - DNA, 16 bp, Homo sapiens
ccagcacacagggcag

SEQ ID NO: 6060902 - DNA, 14 bp, Homo sapiens
ccagcacaccaagt

SEQ ID NO: 6060903 - DNA, 17 bp, Homo sapiens
ccagcacaccaagtggc

SEQ ID NO: 6060904 - DNA, 20 bp, Homo sapiens
ccagcacaccaagtggctgg

SEQ ID NO: 6060905 - DNA, 13 bp, Homo sapiens
ccagcacactccc

SEQ ID NO: 6060906 - DNA, 15 bp, Homo sapiens
ccagcacactcccga

SEQ ID NO: 6060907 - DNA, 15 bp, Homo sapiens
ccagcacactgggag

SEQ ID NO: 6060908 - DNA, 23 bp, Homo sapiens
ccagcacagaaggaatctgtgca

SEQ ID NO: 6060909 - DNA, 13 bp, Homo sapiens
ccagcacagactg

SEQ ID NO: 6060910 - DNA, 18 bp, Homo sapiens
ccagcacagactgttccc

SEQ ID NO: 6060911 - DNA, 20 bp, Homo sapiens
ccagcacagactgttccctc

SEQ ID NO: 6060912 - DNA, 17 bp, Homo sapiens
ccagcacagatgaggag

SEQ ID NO: 6060913 - DNA, 18 bp, Homo sapiens
ccagcacagatgaggagc

SEQ ID NO: 6060914 - DNA, 14 bp, Homo sapiens
ccagcacagctcct

SEQ ID NO: 6060915 - DNA, 17 bp, Homo sapiens
ccagcacagctcctccc

SEQ ID NO: 6060916 - DNA, 20 bp, Homo sapiens
ccagcacagcttagatttca

SEQ ID NO: 6060917 - DNA, 17 bp, Homo sapiens
ccagcacagcttgacct

SEQ ID NO: 6060918 - DNA, 15 bp, Homo sapiens
ccagcacaggagagc

SEQ ID NO: 6060919 - DNA, 24 bp, Homo sapiens
ccagcacaggggccccagatctgc

SEQ ID NO: 6060920 - DNA, 17 bp, Homo sapiens
ccagcacatagcttgcc

SEQ ID NO: 6060921 - DNA, 13 bp, Homo sapiens
ccagcacatgaaa

SEQ ID NO: 6060922 - DNA, 16 bp, Homo sapiens
ccagcacatttcctct

SEQ ID NO: 6060923 - DNA, 19 bp, Homo sapiens
ccagcaccaacaccacggt

SEQ ID NO: 6060924 - DNA, 14 bp, Homo sapiens
ccagcaccacagcc

SEQ ID NO: 6060925 - DNA, 23 bp, Homo sapiens
ccagcaccaccaggtctcccggg

SEQ ID NO: 6060926 - DNA, 21 bp, Homo sapiens
ccagcaccacctacacaggag

SEQ ID NO: 6060927 - DNA, 17 bp, Homo sapiens
ccagcaccatctctcct

SEQ ID NO: 6060928 - DNA, 14 bp, Homo sapiens
ccagcacccaaagg

SEQ ID NO: 6060929 - DNA, 18 bp, Homo sapiens
ccagcacccagcaactcc

SEQ ID NO: 6060930 - DNA, 20 bp, Homo sapiens
ccagcacccccacgccctca

SEQ ID NO: 6060931 - DNA, 13 bp, Homo sapiens
ccagcaccccctc

SEQ ID NO: 6060932 - DNA, 18 bp, Homo sapiens
ccagcacccgggctcagg

SEQ ID NO: 6060933 - DNA, 18 bp, Homo sapiens
ccagcaccctctcctggg

SEQ ID NO: 6060934 - DNA, 23 bp, Homo sapiens
ccagcaccgccggctttcagggc

SEQ ID NO: 6060935 - DNA, 22 bp, Homo sapiens
ccagcaccggccccatttaccc

SEQ ID NO: 6060936 - DNA, 19 bp, Homo sapiens
ccagcacctcctccgtggg

SEQ ID NO: 6060937 - DNA, 12 bp, Homo sapiens
ccagcacctgcc

SEQ ID NO: 6060938 - DNA, 17 bp, Homo sapiens
ccagcacctgcctcctc

SEQ ID NO: 6060939 - DNA, 13 bp, Homo sapiens
ccagcacctgctc

SEQ ID NO: 6060940 - DNA, 20 bp, Homo sapiens
ccagcaccttcaagcgctcc

SEQ ID NO: 6060941 - DNA, 14 bp, Homo sapiens
ccagcaccttgtgc

SEQ ID NO: 6060942 - DNA, 17 bp, Homo sapiens
ccagcacgagcctgggc

SEQ ID NO: 6060943 - DNA, 21 bp, Homo sapiens
ccagcacggtgactctgtcca

SEQ ID NO: 6060944 - DNA, 12 bp, Homo sapiens
ccagcactaacg

SEQ ID NO: 6060945 - DNA, 16 bp, Homo sapiens
ccagcactaaggtgga

SEQ ID NO: 6060946 - DNA, 13 bp, Homo sapiens
ccagcactcagcc

SEQ ID NO: 6060947 - DNA, 13 bp, Homo sapiens
ccagcactccatc

SEQ ID NO: 6060948 - DNA, 13 bp, Homo sapiens
ccagcactcccag

SEQ ID NO: 6060949 - DNA, 21 bp, Homo sapiens
ccagcactcccagggcccgag

SEQ ID NO: 6060950 - DNA, 17 bp, Homo sapiens
ccctcaccatccagtgg

SEQ ID NO: 6060951 - DNA, 21 bp, Homo sapiens
ccctcacccactttggcctcc

SEQ ID NO: 6060952 - DNA, 11 bp, Homo sapiens
ccctcacccat

SEQ ID NO: 6060953 - DNA, 10 bp, Homo sapiens
ccctcacccc

SEQ ID NO: 6060954 - DNA, 15 bp, Homo sapiens
ccctcaccccaatcc

SEQ ID NO: 6060955 - DNA, 16 bp, Homo sapiens
ccctcaccccaatccc

SEQ ID NO: 6060956 - DNA, 12 bp, Homo sapiens
ccctcaccccag

SEQ ID NO: 6060957 - DNA, 16 bp, Homo sapiens
ccctcacccccacctc

SEQ ID NO: 6060958 - DNA, 17 bp, Homo sapiens
ccctcacccccatggcc

SEQ ID NO: 6060959 - DNA, 20 bp, Homo sapiens
ccctcaccccctcctggcaa

SEQ ID NO: 6060960 - DNA, 21 bp, Homo sapiens
ccctcacccgctgcccagccc

SEQ ID NO: 6060961 - DNA, 13 bp, Homo sapiens
ccctcaccctgcc

SEQ ID NO: 6060962 - DNA, 17 bp, Homo sapiens
ccctcaccgcggctgga

SEQ ID NO: 6060963 - DNA, 14 bp, Homo sapiens
ccctcacctcagga

SEQ ID NO: 6060964 - DNA, 14 bp, Homo sapiens
ccctcacctccacc

SEQ ID NO: 6060965 - DNA, 13 bp, Homo sapiens
ccctcacctctga

SEQ ID NO: 6060966 - DNA, 16 bp, Homo sapiens
ccctcacctctgagga

SEQ ID NO: 6060967 - DNA, 17 bp, Homo sapiens
ccctcacctctgaggac

SEQ ID NO: 6060968 - DNA, 13 bp, Homo sapiens
ccctcacctgcag

SEQ ID NO: 6060969 - DNA, 16 bp, Homo sapiens
ccctcacctgggcctt

SEQ ID NO: 6060970 - DNA, 12 bp, Homo sapiens
ccctcacctggt

SEQ ID NO: 6060971 - DNA, 21 bp, Homo sapiens
ccctcacctgtagcagccagt

SEQ ID NO: 6060972 - DNA, 16 bp, Homo sapiens
ccctcaccttctgagt

SEQ ID NO: 6060973 - DNA, 23 bp, Homo sapiens
ccctcaccttggcaccagacacc

SEQ ID NO: 6060974 - DNA, 22 bp, Homo sapiens
ccctcacgtgaccagccccgtg

SEQ ID NO: 6060975 - DNA, 22 bp, Homo sapiens
ccctcactcaagaccaggctgc

SEQ ID NO: 6060976 - DNA, 16 bp, Homo sapiens
ccctcactcaggaacc

SEQ ID NO: 6060977 - DNA, 15 bp, Homo sapiens
ccctcactccactcc

SEQ ID NO: 6060978 - DNA, 13 bp, Homo sapiens
ccctcactcccca

SEQ ID NO: 6060979 - DNA, 15 bp, Homo sapiens
ccctcactccccagg

SEQ ID NO: 6060980 - DNA, 14 bp, Homo sapiens
ccctcactctggcc

SEQ ID NO: 6060981 - DNA, 15 bp, Homo sapiens
ccctcactctgtcag

SEQ ID NO: 6060982 - DNA, 22 bp, Homo sapiens
ccctcactcttgaagtccagga

SEQ ID NO: 6060983 - DNA, 18 bp, Homo sapiens
ccctcactgaatgcctca

SEQ ID NO: 6060984 - DNA, 16 bp, Homo sapiens
ccctcactgccttcca

SEQ ID NO: 6060985 - DNA, 17 bp, Homo sapiens
ccctcactgctggggag

SEQ ID NO: 6060986 - DNA, 20 bp, Homo sapiens
ccctcactggctctcctggc

SEQ ID NO: 6060987 - DNA, 22 bp, Homo sapiens
ccctcactggctggactggagg

SEQ ID NO: 6060988 - DNA, 22 bp, Homo sapiens
ccctcactgtcagtcccactgc

SEQ ID NO: 6060989 - DNA, 9 bp, Homo sapiens
ccctcagaa

SEQ ID NO: 6060990 - DNA, 12 bp, Homo sapiens
ccctcagaaacc

SEQ ID NO: 6060991 - DNA, 20 bp, Homo sapiens
ccctcagaatattaagcaca

SEQ ID NO: 6060992 - DNA, 19 bp, Homo sapiens
ccctcagacagccccctgc

SEQ ID NO: 6060993 - DNA, 16 bp, Homo sapiens
ccctcagacatctcca

SEQ ID NO: 6060994 - DNA, 14 bp, Homo sapiens
ccctcagacccagg

SEQ ID NO: 6060995 - DNA, 16 bp, Homo sapiens
ccctcagacccaggag

SEQ ID NO: 6060996 - DNA, 22 bp, Homo sapiens
ccctcagacccaggagtccaga

SEQ ID NO: 6060997 - DNA, 23 bp, Homo sapiens
ccctcagacccaggggtccaggc

SEQ ID NO: 6060998 - DNA, 15 bp, Homo sapiens
ccctcagactggggc

SEQ ID NO: 6060999 - DNA, 16 bp, Homo sapiens
ccctcagactggggca

SEQ ID NO: 6061000 - DNA, 23 bp, Homo sapiens
ccctcagagacaccaaactgcca

SEQ ID NO: 6061001 - DNA, 13 bp, Homo sapiens
ccctcagagccac

SEQ ID NO: 6061002 - DNA, 13 bp, Homo sapiens
ccctcagagccca

SEQ ID NO: 6061003 - DNA, 15 bp, Homo sapiens
ccctcagaggccttg

SEQ ID NO: 6061004 - DNA, 15 bp, Homo sapiens
ccctcagagtgcaag

SEQ ID NO: 6061005 - DNA, 16 bp, Homo sapiens
ccctcagatgtccctt

SEQ ID NO: 6061006 - DNA, 17 bp, Homo sapiens
ccctcagcaacatccca

SEQ ID NO: 6061007 - DNA, 20 bp, Homo sapiens
ccctcagcaacatcccatct

SEQ ID NO: 6061008 - DNA, 15 bp, Homo sapiens
ccctcagcacccctt

SEQ ID NO: 6061009 - DNA, 18 bp, Homo sapiens
ccctcagcaccccttcca

SEQ ID NO: 6061010 - DNA, 12 bp, Homo sapiens
ccctcagcagct

SEQ ID NO: 6061011 - DNA, 16 bp, Homo sapiens
ccctcagcagctctgg

SEQ ID NO: 6061012 - DNA, 12 bp, Homo sapiens
ccctcagccacc

SEQ ID NO: 6061013 - DNA, 13 bp, Homo sapiens
ccctcagccccag

SEQ ID NO: 6061014 - DNA, 18 bp, Homo sapiens
ccctcagccccagcccag

SEQ ID NO: 6061015 - DNA, 23 bp, Homo sapiens
ccctcagcccctcttgcccccca

SEQ ID NO: 6061016 - DNA, 17 bp, Homo sapiens
ccctcagccctggcctt

SEQ ID NO: 6061017 - DNA, 12 bp, Homo sapiens
ccctcagcctca

SEQ ID NO: 6061018 - DNA, 13 bp, Homo sapiens
ccctcagcctcca

SEQ ID NO: 6061019 - DNA, 17 bp, Homo sapiens
ccctcagcctccaatgc

SEQ ID NO: 6061020 - DNA, 13 bp, Homo sapiens
ccctcagcctccc

SEQ ID NO: 6061021 - DNA, 16 bp, Homo sapiens
ccctcagcctcccctt

SEQ ID NO: 6061022 - DNA, 20 bp, Homo sapiens
ccctcagcctcttctctgca

SEQ ID NO: 6061023 - DNA, 12 bp, Homo sapiens
ccctcagcctgc

SEQ ID NO: 6061024 - DNA, 15 bp, Homo sapiens
ccctcagcctgccca

SEQ ID NO: 6061025 - DNA, 19 bp, Homo sapiens
ccctcagcctgcctgaaga

SEQ ID NO: 6061026 - DNA, 15 bp, Homo sapiens
ccctcagccttggga

SEQ ID NO: 6061027 - DNA, 18 bp, Homo sapiens
ccctcagcgcaggctgca

SEQ ID NO: 6061028 - DNA, 12 bp, Homo sapiens
ccctcagcgctc

SEQ ID NO: 6061029 - DNA, 16 bp, Homo sapiens
ccctcagcgctccctg

SEQ ID NO: 6061030 - DNA, 18 bp, Homo sapiens
ccctcagcgctccctgtc

SEQ ID NO: 6061031 - DNA, 22 bp, Homo sapiens
ccctcagcgggggccttgaaga

SEQ ID NO: 6061032 - DNA, 20 bp, Homo sapiens
ccctcagcgtctccccatgc

SEQ ID NO: 6061033 - DNA, 18 bp, Homo sapiens
ccctcagctatcagtgtt

SEQ ID NO: 6061034 - DNA, 20 bp, Homo sapiens
ccctcagctatcagtgttct

SEQ ID NO: 6061035 - DNA, 21 bp, Homo sapiens
ccctcagctatcagtgttctt

SEQ ID NO: 6061036 - DNA, 20 bp, Homo sapiens
ccctcagctccccggcactg

SEQ ID NO: 6061037 - DNA, 15 bp, Homo sapiens
ccctcagctccctga

SEQ ID NO: 6061038 - DNA, 13 bp, Homo sapiens
ccctcagctcctg

SEQ ID NO: 6061039 - DNA, 15 bp, Homo sapiens
ccctcagctctgtcc

SEQ ID NO: 6061040 - DNA, 16 bp, Homo sapiens
ccctcagctggcggaa

SEQ ID NO: 6061041 - DNA, 17 bp, Homo sapiens
ccctcagctggtcctga

SEQ ID NO: 6061042 - DNA, 19 bp, Homo sapiens
ccctcagctgtcacctgct

SEQ ID NO: 6061043 - DNA, 20 bp, Homo sapiens
ccctcagctgtcacctgctc

SEQ ID NO: 6061044 - DNA, 23 bp, Homo sapiens
ccctcagctgtcacctgctcaca

SEQ ID NO: 6061045 - DNA, 18 bp, Homo sapiens
ccctcagcttcaaataaa

SEQ ID NO: 6061046 - DNA, 18 bp, Homo sapiens
ccctcaggaacccaccct

SEQ ID NO: 6061047 - DNA, 17 bp, Homo sapiens
ccctcaggaccctcgct

SEQ ID NO: 6061048 - DNA, 18 bp, Homo sapiens
ccctcaggaccctcgctg

SEQ ID NO: 6061049 - DNA, 20 bp, Homo sapiens
ccctcaggaccctcgctggc

SEQ ID NO: 6061050 - DNA, 15 bp, Homo sapiens
ccctcaggcacacct

SEQ ID NO: 6061051 - DNA, 20 bp, Homo sapiens
ccctcaggcacaccttgcag

SEQ ID NO: 6061052 - DNA, 12 bp, Homo sapiens
ccctcaggccac

SEQ ID NO: 6061053 - DNA, 20 bp, Homo sapiens
ccctcaggccagtgccagga

SEQ ID NO: 6061054 - DNA, 12 bp, Homo sapiens
ccctcaggccca

SEQ ID NO: 6061055 - DNA, 20 bp, Homo sapiens
ccctcaggcccaggagtcca

SEQ ID NO: 6061056 - DNA, 23 bp, Homo sapiens
ccctcaggcccaggagtccaggc

SEQ ID NO: 6061057 - DNA, 17 bp, Homo sapiens
ccctcaggcctatgcaa

SEQ ID NO: 6061058 - DNA, 20 bp, Homo sapiens
ccctcagggactgcaccctg

SEQ ID NO: 6061059 - DNA, 21 bp, Homo sapiens
ccctcagggagcgatccaggg

SEQ ID NO: 6061060 - DNA, 16 bp, Homo sapiens
ccctcagggcaaagcc

SEQ ID NO: 6061061 - DNA, 17 bp, Homo sapiens
ccctcaggggaagctgc

SEQ ID NO: 6061062 - DNA, 16 bp, Homo sapiens
ccctcagggggccagc

SEQ ID NO: 6061063 - DNA, 19 bp, Homo sapiens
ccctcagggggccagctgg

SEQ ID NO: 6061064 - DNA, 18 bp, Homo sapiens
ccctcagggtccctggtg

SEQ ID NO: 6061065 - DNA, 13 bp, Homo sapiens
ccctcaggtgcct

SEQ ID NO: 6061066 - DNA, 22 bp, Homo sapiens
ccctcaggtgtagctgagctgt

SEQ ID NO: 6061067 - DNA, 12 bp, Homo sapiens
ccctcagtctac

SEQ ID NO: 6061068 - DNA, 18 bp, Homo sapiens
ccctcagtgtgaagcctg

SEQ ID NO: 6061069 - DNA, 16 bp, Homo sapiens
ccctcagttgtgcagc

SEQ ID NO: 6061070 - DNA, 20 bp, Homo sapiens
ccctcagtttggtagtgccc

SEQ ID NO: 6061071 - DNA, 17 bp, Homo sapiens
ccctcataagtttgttt

SEQ ID NO: 6061072 - DNA, 15 bp, Homo sapiens
ccctcataccatctg

SEQ ID NO: 6061073 - DNA, 19 bp, Homo sapiens
ccctcataccatctgctgc

SEQ ID NO: 6061074 - DNA, 15 bp, Homo sapiens
ccctcatagccctca

SEQ ID NO: 6061075 - DNA, 19 bp, Homo sapiens
ccctcatagccctcaccct

SEQ ID NO: 6061076 - DNA, 19 bp, Homo sapiens
ccctcatcaaggacacggg

SEQ ID NO: 6061077 - DNA, 18 bp, Homo sapiens
ccctcatcacacgtcaca

SEQ ID NO: 6061078 - DNA, 15 bp, Homo sapiens
ccctcatcagccttt

SEQ ID NO: 6061079 - DNA, 13 bp, Homo sapiens
ccctcatcctttt

SEQ ID NO: 6061080 - DNA, 19 bp, Homo sapiens
ccctcatctagtcttgacc

SEQ ID NO: 6061081 - DNA, 13 bp, Homo sapiens
ccctcatctgtcc

SEQ ID NO: 6061082 - DNA, 18 bp, Homo sapiens
ccctcatgcccgccagtg

SEQ ID NO: 6061083 - DNA, 13 bp, Homo sapiens
ccctcatggcccc

SEQ ID NO: 6061084 - DNA, 22 bp, Homo sapiens
ccctcatggcgggactggagaa

SEQ ID NO: 6061085 - DNA, 15 bp, Homo sapiens
ccctcatggctctgg

SEQ ID NO: 6061086 - DNA, 23 bp, Homo sapiens
ccctcattaaaatattgaaatct

SEQ ID NO: 6061087 - DNA, 12 bp, Homo sapiens
ccctcattaatg

SEQ ID NO: 6061088 - DNA, 17 bp, Homo sapiens
ccctcattactgggcct

SEQ ID NO: 6061089 - DNA, 13 bp, Homo sapiens
ccctcattcagag

SEQ ID NO: 6061090 - DNA, 16 bp, Homo sapiens
ccctcattcaggaaaa

SEQ ID NO: 6061091 - DNA, 16 bp, Homo sapiens
ccctcattcatcttgc

SEQ ID NO: 6061092 - DNA, 14 bp, Homo sapiens
ccctcattcccctc

SEQ ID NO: 6061093 - DNA, 18 bp, Homo sapiens
ccctcattctgcattaat

SEQ ID NO: 6061094 - DNA, 23 bp, Homo sapiens
ccctcattgctgtcttgccccag

SEQ ID NO: 6061095 - DNA, 16 bp, Homo sapiens
ccctcatttcaggagc

SEQ ID NO: 6061096 - DNA, 17 bp, Homo sapiens
ccctccaaaagcactta

SEQ ID NO: 6061097 - DNA, 19 bp, Homo sapiens
ccctccaaacactgggctc

SEQ ID NO: 6061098 - DNA, 17 bp, Homo sapiens
ccctccaaacctccagc

SEQ ID NO: 6061099 - DNA, 24 bp, Homo sapiens
ccctccaaacctccagcctccctg

SEQ ID NO: 6061100 - DNA, 12 bp, Homo sapiens
ccctccaaagag

SEQ ID NO: 6061101 - DNA, 13 bp, Homo sapiens
ccctccaaagccc

SEQ ID NO: 6061102 - DNA, 16 bp, Homo sapiens
ccctccaaaggaactc

SEQ ID NO: 6061103 - DNA, 21 bp, Homo sapiens
ccctccaaatgtcctttctca

SEQ ID NO: 6061104 - DNA, 14 bp, Homo sapiens
ccctccaagcctgg

SEQ ID NO: 6061105 - DNA, 18 bp, Homo sapiens
ccctccaagcctggcacc

SEQ ID NO: 6061106 - DNA, 12 bp, Homo sapiens
ccctccaagtca

SEQ ID NO: 6061107 - DNA, 21 bp, Homo sapiens
ccctccaagtctgtacctcaa

SEQ ID NO: 6061108 - DNA, 21 bp, Homo sapiens
ccctccaatcctccccgctct

SEQ ID NO: 6061109 - DNA, 15 bp, Homo sapiens
ccctccaatcctgcc

SEQ ID NO: 6061110 - DNA, 16 bp, Homo sapiens
ccctccaatcctgccc

SEQ ID NO: 6061111 - DNA, 13 bp, Homo sapiens
ccctccacacctc

SEQ ID NO: 6061112 - DNA, 18 bp, Homo sapiens
ccctccacacctccaccc

SEQ ID NO: 6061113 - DNA, 17 bp, Homo sapiens
ccctccacacctgcggc

SEQ ID NO: 6061114 - DNA, 19 bp, Homo sapiens
ccctccacagctgcagctg

SEQ ID NO: 6061115 - DNA, 14 bp, Homo sapiens
ccctccacaggagc

SEQ ID NO: 6061116 - DNA, 19 bp, Homo sapiens
ccctccacatcccagcagc

SEQ ID NO: 6061117 - DNA, 16 bp, Homo sapiens
ccctccaccagcctgc

SEQ ID NO: 6061118 - DNA, 19 bp, Homo sapiens
ccctccaccagcctgctga

SEQ ID NO: 6061119 - DNA, 14 bp, Homo sapiens
ccctccaccccagg

SEQ ID NO: 6061120 - DNA, 15 bp, Homo sapiens
ccctccaccccagga

SEQ ID NO: 6061121 - DNA, 19 bp, Homo sapiens
ccctccaccccccactcag

SEQ ID NO: 6061122 - DNA, 22 bp, Homo sapiens
ccctccaccctaaagtctcagg

SEQ ID NO: 6061123 - DNA, 12 bp, Homo sapiens
ccctccaccctg

SEQ ID NO: 6061124 - DNA, 14 bp, Homo sapiens
ccctccaccctgtc

SEQ ID NO: 6061125 - DNA, 15 bp, Homo sapiens
ccctccaccgagcca

SEQ ID NO: 6061126 - DNA, 19 bp, Homo sapiens
ccctccaccgcagaaggaa

SEQ ID NO: 6061127 - DNA, 17 bp, Homo sapiens
ccctccacctccctgca

SEQ ID NO: 6061128 - DNA, 17 bp, Homo sapiens
ccctccacctcctctct

SEQ ID NO: 6061129 - DNA, 18 bp, Homo sapiens
ccctccacctcctctctt

SEQ ID NO: 6061130 - DNA, 15 bp, Homo sapiens
ccctccacctgcttg

SEQ ID NO: 6061131 - DNA, 22 bp, Homo sapiens
ccagcactcccagggcccgagc

SEQ ID NO: 6061132 - DNA, 16 bp, Homo sapiens
ccagcactccccttgc

SEQ ID NO: 6061133 - DNA, 18 bp, Homo sapiens
ccagcactcctctgtctc

SEQ ID NO: 6061134 - DNA, 21 bp, Homo sapiens
ccagcactcctctgtctctgc

SEQ ID NO: 6061135 - DNA, 20 bp, Homo sapiens
ccagcactcgctagcagtgg

SEQ ID NO: 6061136 - DNA, 14 bp, Homo sapiens
ccagcactgaggaa

SEQ ID NO: 6061137 - DNA, 13 bp, Homo sapiens
ccagcactgccca

SEQ ID NO: 6061138 - DNA, 14 bp, Homo sapiens
ccagcactgcccaa

SEQ ID NO: 6061139 - DNA, 22 bp, Homo sapiens
ccagcactgcccatcccacccc

SEQ ID NO: 6061140 - DNA, 15 bp, Homo sapiens
ccagcactgcctcct

SEQ ID NO: 6061141 - DNA, 19 bp, Homo sapiens
ccagcactggaggggccca

SEQ ID NO: 6061142 - DNA, 17 bp, Homo sapiens
ccagcactgtgaagacc

SEQ ID NO: 6061143 - DNA, 17 bp, Homo sapiens
ccagcacttccatggga

SEQ ID NO: 6061144 - DNA, 15 bp, Homo sapiens
ccagcacttggagag

SEQ ID NO: 6061145 - DNA, 15 bp, Homo sapiens
ccagcacttgtatat

SEQ ID NO: 6061146 - DNA, 24 bp, Homo sapiens
ccagcactttgggaagctgaggca

SEQ ID NO: 6061147 - DNA, 19 bp, Homo sapiens
ccagcactttgggaggcag

SEQ ID NO: 6061148 - DNA, 20 bp, Homo sapiens
ccagcactttgggaggcagg

SEQ ID NO: 6061149 - DNA, 22 bp, Homo sapiens
ccagcactttgggaggccaagg

SEQ ID NO: 6061150 - DNA, 19 bp, Homo sapiens
ccagcactttgggaggcct

SEQ ID NO: 6061151 - DNA, 20 bp, Homo sapiens
ccagcactttgggaggctga

SEQ ID NO: 6061152 - DNA, 14 bp, Homo sapiens
ccagcactttgtat

SEQ ID NO: 6061153 - DNA, 22 bp, Homo sapiens
ccagcagaaaagtgcttagaaa

SEQ ID NO: 6061154 - DNA, 12 bp, Homo sapiens
ccagcagaaatg

SEQ ID NO: 6061155 - DNA, 17 bp, Homo sapiens
ccagcagaaatgccccc

SEQ ID NO: 6061156 - DNA, 23 bp, Homo sapiens
ccagcagaaatgcccccattctc

SEQ ID NO: 6061157 - DNA, 13 bp, Homo sapiens
ccagcagaaccag

SEQ ID NO: 6061158 - DNA, 13 bp, Homo sapiens
ccagcagaactga

SEQ ID NO: 6061159 - DNA, 15 bp, Homo sapiens
ccagcagaagaggga

SEQ ID NO: 6061160 - DNA, 19 bp, Homo sapiens
ccagcagaagagggaggct

SEQ ID NO: 6061161 - DNA, 17 bp, Homo sapiens
ccagcagaatggaggca

SEQ ID NO: 6061162 - DNA, 20 bp, Homo sapiens
ccagcagaatggaggcaggg

SEQ ID NO: 6061163 - DNA, 19 bp, Homo sapiens
ccagcagacagagccagga

SEQ ID NO: 6061164 - DNA, 13 bp, Homo sapiens
ccagcagacattg

SEQ ID NO: 6061165 - DNA, 16 bp, Homo sapiens
ccagcagactcctgct

SEQ ID NO: 6061166 - DNA, 14 bp, Homo sapiens
ccagcagagcacct

SEQ ID NO: 6061167 - DNA, 23 bp, Homo sapiens
ccagcagagcaccttagacagtc

SEQ ID NO: 6061168 - DNA, 12 bp, Homo sapiens
ccagcagagcca

SEQ ID NO: 6061169 - DNA, 13 bp, Homo sapiens
ccagcagagccag

SEQ ID NO: 6061170 - DNA, 15 bp, Homo sapiens
ccagcagagccaggg

SEQ ID NO: 6061171 - DNA, 16 bp, Homo sapiens
ccagcagagccagggc

SEQ ID NO: 6061172 - DNA, 19 bp, Homo sapiens
ccagcagagccagggcagg

SEQ ID NO: 6061173 - DNA, 21 bp, Homo sapiens
ccagcagagccagggcagggc

SEQ ID NO: 6061174 - DNA, 21 bp, Homo sapiens
ccagcagagccgttcctggga

SEQ ID NO: 6061175 - DNA, 16 bp, Homo sapiens
ccagcagaggcaggct

SEQ ID NO: 6061176 - DNA, 11 bp, Homo sapiens
ccagcagaggg

SEQ ID NO: 6061177 - DNA, 15 bp, Homo sapiens
ccagcagagggcgcc

SEQ ID NO: 6061178 - DNA, 16 bp, Homo sapiens
ccagcagatcccagct

SEQ ID NO: 6061179 - DNA, 21 bp, Homo sapiens
ccagcagattattcactgatt

SEQ ID NO: 6061180 - DNA, 11 bp, Homo sapiens
ccagcagcaca

SEQ ID NO: 6061181 - DNA, 21 bp, Homo sapiens
ccagcagcacaattctgtccc

SEQ ID NO: 6061182 - DNA, 14 bp, Homo sapiens
ccagcagcacctgc

SEQ ID NO: 6061183 - DNA, 22 bp, Homo sapiens
ccagcagcatagaacaggacct

SEQ ID NO: 6061184 - DNA, 12 bp, Homo sapiens
ccagcagcatgg

SEQ ID NO: 6061185 - DNA, 14 bp, Homo sapiens
ccagcagccagcca

SEQ ID NO: 6061186 - DNA, 15 bp, Homo sapiens
ccagcagccagccaa

SEQ ID NO: 6061187 - DNA, 16 bp, Homo sapiens
ccagcagccagccaaa

SEQ ID NO: 6061188 - DNA, 20 bp, Homo sapiens
ccagcagccctggcctgtgg

SEQ ID NO: 6061189 - DNA, 21 bp, Homo sapiens
ccagcagcctcgcacaggccc

SEQ ID NO: 6061190 - DNA, 18 bp, Homo sapiens
ccagcagcctctgatctg

SEQ ID NO: 6061191 - DNA, 20 bp, Homo sapiens
ccagcagcctctgatctgtg

SEQ ID NO: 6061192 - DNA, 11 bp, Homo sapiens
ccagcagcctg

SEQ ID NO: 6061193 - DNA, 12 bp, Homo sapiens
ccagcagcctgc

SEQ ID NO: 6061194 - DNA, 18 bp, Homo sapiens
ccagcagcctgccagcag

SEQ ID NO: 6061195 - DNA, 14 bp, Homo sapiens
ccagcagcctggac

SEQ ID NO: 6061196 - DNA, 15 bp, Homo sapiens
ccagcagcctggacc

SEQ ID NO: 6061197 - DNA, 11 bp, Homo sapiens
ccagcagcctt

SEQ ID NO: 6061198 - DNA, 13 bp, Homo sapiens
ccagcagccttcc

SEQ ID NO: 6061199 - DNA, 15 bp, Homo sapiens
ccagcagccttccag

SEQ ID NO: 6061200 - DNA, 16 bp, Homo sapiens
ccagcagccttccagt

SEQ ID NO: 6061201 - DNA, 15 bp, Homo sapiens
ccagcagcgcccgag

SEQ ID NO: 6061202 - DNA, 18 bp, Homo sapiens
ccagcagcgcctttccca

SEQ ID NO: 6061203 - DNA, 19 bp, Homo sapiens
ccagcagcgcctttcccaa

SEQ ID NO: 6061204 - DNA, 17 bp, Homo sapiens
ccagcagcgcgcaggcc

SEQ ID NO: 6061205 - DNA, 23 bp, Homo sapiens
ccagcagcgcgcaggcctgcgtg

SEQ ID NO: 6061206 - DNA, 14 bp, Homo sapiens
ccagcagcggccca

SEQ ID NO: 6061207 - DNA, 17 bp, Homo sapiens
ccagcagctgatgctgt

SEQ ID NO: 6061208 - DNA, 23 bp, Homo sapiens
ccagcagctgcgggtctgaagga

SEQ ID NO: 6061209 - DNA, 23 bp, Homo sapiens
ccagcagctgggccggccagcct

SEQ ID NO: 6061210 - DNA, 12 bp, Homo sapiens
ccagcagcttgg

SEQ ID NO: 6061211 - DNA, 11 bp, Homo sapiens
ccagcaggaat

SEQ ID NO: 6061212 - DNA, 17 bp, Homo sapiens
ccagcaggaataaagac

SEQ ID NO: 6061213 - DNA, 18 bp, Homo sapiens
ccagcaggaataaagact

SEQ ID NO: 6061214 - DNA, 22 bp, Homo sapiens
ccagcaggagggaaggacagac

SEQ ID NO: 6061215 - DNA, 23 bp, Homo sapiens
ccagcaggaggttctgggcctct

SEQ ID NO: 6061216 - DNA, 12 bp, Homo sapiens
ccagcaggcact

SEQ ID NO: 6061217 - DNA, 14 bp, Homo sapiens
ccagcaggcagcgc

SEQ ID NO: 6061218 - DNA, 12 bp, Homo sapiens
ccagcaggcagg

SEQ ID NO: 6061219 - DNA, 21 bp, Homo sapiens
ccagcaggcaggcactgtggc

SEQ ID NO: 6061220 - DNA, 23 bp, Homo sapiens
ccagcaggcaggcactgtggccc

SEQ ID NO: 6061221 - DNA, 24 bp, Homo sapiens
ccagcaggcaggcactgtggccct

SEQ ID NO: 6061222 - DNA, 15 bp, Homo sapiens
ccagcaggcaggtgg

SEQ ID NO: 6061223 - DNA, 19 bp, Homo sapiens
ccagcaggcccagcatgca

SEQ ID NO: 6061224 - DNA, 20 bp, Homo sapiens
ccagcaggcccagcatgcag

SEQ ID NO: 6061225 - DNA, 17 bp, Homo sapiens
ccagcaggcccatggga

SEQ ID NO: 6061226 - DNA, 23 bp, Homo sapiens
ccagcaggccggatcggtactgt

SEQ ID NO: 6061227 - DNA, 16 bp, Homo sapiens
ccagcaggcgggctcc

SEQ ID NO: 6061228 - DNA, 14 bp, Homo sapiens
ccagcaggctcctc

SEQ ID NO: 6061229 - DNA, 19 bp, Homo sapiens
ccagcaggctcctcagccc

SEQ ID NO: 6061230 - DNA, 21 bp, Homo sapiens
ccagcaggctcctggctgtgc

SEQ ID NO: 6061231 - DNA, 19 bp, Homo sapiens
ccagcaggctctcaggcca

SEQ ID NO: 6061232 - DNA, 23 bp, Homo sapiens
ccagcaggctctcaggccagctg

SEQ ID NO: 6061233 - DNA, 21 bp, Homo sapiens
ccagcagggcgggccaggaga

SEQ ID NO: 6061234 - DNA, 22 bp, Homo sapiens
ccagcagggcgggccaggagaa

SEQ ID NO: 6061235 - DNA, 14 bp, Homo sapiens
ccagcaggggcaga

SEQ ID NO: 6061236 - DNA, 18 bp, Homo sapiens
ccagcaggggcagaagga

SEQ ID NO: 6061237 - DNA, 12 bp, Homo sapiens
ccagcaggggcc

SEQ ID NO: 6061238 - DNA, 19 bp, Homo sapiens
ccagcaggggggctgtgcc

SEQ ID NO: 6061239 - DNA, 23 bp, Homo sapiens
ccagcaggggggctgtgccaacc

SEQ ID NO: 6061240 - DNA, 23 bp, Homo sapiens
ccagcagggtcttttcatctggg

SEQ ID NO: 6061241 - DNA, 14 bp, Homo sapiens
ccagcaggtgcggc

SEQ ID NO: 6061242 - DNA, 18 bp, Homo sapiens
ccagcaggtgctgacttc

SEQ ID NO: 6061243 - DNA, 13 bp, Homo sapiens
ccagcaggtgtgg

SEQ ID NO: 6061244 - DNA, 23 bp, Homo sapiens
ccagcaggtgtggtggctcatgg

SEQ ID NO: 6061245 - DNA, 21 bp, Homo sapiens
ccagcaggttctctcctgtga

SEQ ID NO: 6061246 - DNA, 14 bp, Homo sapiens
ccagcagtcacttc

SEQ ID NO: 6061247 - DNA, 15 bp, Homo sapiens
ccagcagtcctgggc

SEQ ID NO: 6061248 - DNA, 16 bp, Homo sapiens
ccagcagtctctgcct

SEQ ID NO: 6061249 - DNA, 17 bp, Homo sapiens
ccagcagtctgcctgga

SEQ ID NO: 6061250 - DNA, 15 bp, Homo sapiens
ccagcagtgaatgct

SEQ ID NO: 6061251 - DNA, 17 bp, Homo sapiens
ccagcagtgctgggccc

SEQ ID NO: 6061252 - DNA, 18 bp, Homo sapiens
ccagcagtgctgggccca

SEQ ID NO: 6061253 - DNA, 21 bp, Homo sapiens
ccagcagtgctgggcccagcc

SEQ ID NO: 6061254 - DNA, 22 bp, Homo sapiens
ccagcagtgctgggcccagccg

SEQ ID NO: 6061255 - DNA, 23 bp, Homo sapiens
ccagcagtgctgggcccagccgg

SEQ ID NO: 6061256 - DNA, 21 bp, Homo sapiens
ccagcagtgtggagaccctgc

SEQ ID NO: 6061257 - DNA, 17 bp, Homo sapiens
ccagcagttaggcacct

SEQ ID NO: 6061258 - DNA, 13 bp, Homo sapiens
ccagcagttcaga

SEQ ID NO: 6061259 - DNA, 20 bp, Homo sapiens
ccagcagttcagagctgccc

SEQ ID NO: 6061260 - DNA, 22 bp, Homo sapiens
ccagcagttcagagctgccctc

SEQ ID NO: 6061261 - DNA, 23 bp, Homo sapiens
ccagcagttcagagctgccctct

SEQ ID NO: 6061262 - DNA, 13 bp, Homo sapiens
ccagcagttctgt

SEQ ID NO: 6061263 - DNA, 16 bp, Homo sapiens
ccagcagtttcccaga

SEQ ID NO: 6061264 - DNA, 17 bp, Homo sapiens
ccagcagtttcccagaa

SEQ ID NO: 6061265 - DNA, 15 bp, Homo sapiens
ccagcagtttgggag

SEQ ID NO: 6061266 - DNA, 15 bp, Homo sapiens
ccagcagttttcaag

SEQ ID NO: 6061267 - DNA, 16 bp, Homo sapiens
ccagcataccagttct

SEQ ID NO: 6061268 - DNA, 22 bp, Homo sapiens
ccagcataccagttcttgcaat

SEQ ID NO: 6061269 - DNA, 17 bp, Homo sapiens
ccagcataggggggagg

SEQ ID NO: 6061270 - DNA, 18 bp, Homo sapiens
ccagcatcaccagctaga

SEQ ID NO: 6061271 - DNA, 14 bp, Homo sapiens
ccagcatcacctgc

SEQ ID NO: 6061272 - DNA, 17 bp, Homo sapiens
ccagcatcactccccaa

SEQ ID NO: 6061273 - DNA, 21 bp, Homo sapiens
ccagcatcactccccaaggaa

SEQ ID NO: 6061274 - DNA, 13 bp, Homo sapiens
ccagcatccagcc

SEQ ID NO: 6061275 - DNA, 19 bp, Homo sapiens
ccagcatccagcctgtgtg

SEQ ID NO: 6061276 - DNA, 14 bp, Homo sapiens
ccagcatccctgga

SEQ ID NO: 6061277 - DNA, 15 bp, Homo sapiens
ccagcatccctggag

SEQ ID NO: 6061278 - DNA, 16 bp, Homo sapiens
ccagcatccctggagc

SEQ ID NO: 6061279 - DNA, 17 bp, Homo sapiens
ccagcatccctggagca

SEQ ID NO: 6061280 - DNA, 14 bp, Homo sapiens
ccagcatcccttct

SEQ ID NO: 6061281 - DNA, 17 bp, Homo sapiens
ccagcatcccttctgcc

SEQ ID NO: 6061282 - DNA, 15 bp, Homo sapiens
ccagcatcccttgac

SEQ ID NO: 6061283 - DNA, 21 bp, Homo sapiens
ccagcatcccttgaccaggcc

SEQ ID NO: 6061284 - DNA, 21 bp, Homo sapiens
ccagcatccttttctgcagag

SEQ ID NO: 6061285 - DNA, 16 bp, Homo sapiens
ccagcatctcagagtc

SEQ ID NO: 6061286 - DNA, 17 bp, Homo sapiens
ccagcatctcagcgcca

SEQ ID NO: 6061287 - DNA, 16 bp, Homo sapiens
ccagcatctcccagca

SEQ ID NO: 6061288 - DNA, 11 bp, Homo sapiens
ccagcatctgg

SEQ ID NO: 6061289 - DNA, 14 bp, Homo sapiens
ccagcatctggtct

SEQ ID NO: 6061290 - DNA, 19 bp, Homo sapiens
ccagcatctggtcttgttt

SEQ ID NO: 6061291 - DNA, 13 bp, Homo sapiens
ccagcatgacttt

SEQ ID NO: 6061292 - DNA, 20 bp, Homo sapiens
ccagcatgactttccttagg

SEQ ID NO: 6061293 - DNA, 20 bp, Homo sapiens
ccagcatgcaccacgggccc

SEQ ID NO: 6061294 - DNA, 18 bp, Homo sapiens
ccagcatgtcactcccag

SEQ ID NO: 6061295 - DNA, 15 bp, Homo sapiens
ccagcatgtgtgtgt

SEQ ID NO: 6061296 - DNA, 18 bp, Homo sapiens
ccagcatgtgtgtgtctc

SEQ ID NO: 6061297 - DNA, 17 bp, Homo sapiens
ccagcattcagcacaca

SEQ ID NO: 6061298 - DNA, 20 bp, Homo sapiens
ccagcattccagacttcaaa

SEQ ID NO: 6061299 - DNA, 20 bp, Homo sapiens
ccagcattccagcccctctg

SEQ ID NO: 6061300 - DNA, 21 bp, Homo sapiens
ccagcattccagcccctctgg

SEQ ID NO: 6061301 - DNA, 22 bp, Homo sapiens
ccagcattccagcccctctggt

SEQ ID NO: 6061302 - DNA, 16 bp, Homo sapiens
ccagcattccagctct

SEQ ID NO: 6061303 - DNA, 17 bp, Homo sapiens
ccagcattccagctctg

SEQ ID NO: 6061304 - DNA, 21 bp, Homo sapiens
ccagcattcccaggtaggcca

SEQ ID NO: 6061305 - DNA, 13 bp, Homo sapiens
ccagcattccttt

SEQ ID NO: 6061306 - DNA, 14 bp, Homo sapiens
ccagcattcctttt

SEQ ID NO: 6061307 - DNA, 13 bp, Homo sapiens
ccagcattctcag

SEQ ID NO: 6061308 - DNA, 14 bp, Homo sapiens
ccagcattctcagg

SEQ ID NO: 6061309 - DNA, 20 bp, Homo sapiens
ccagcattgctactgctcag

SEQ ID NO: 6061310 - DNA, 15 bp, Homo sapiens
ccctccaccttccat

SEQ ID NO: 6061311 - DNA, 18 bp, Homo sapiens
ccctccacgttcacccct

SEQ ID NO: 6061312 - DNA, 15 bp, Homo sapiens
ccctccactcactgc

SEQ ID NO: 6061313 - DNA, 21 bp, Homo sapiens
ccctccactcagctgtcctgc

SEQ ID NO: 6061314 - DNA, 14 bp, Homo sapiens
ccctccactcctcc

SEQ ID NO: 6061315 - DNA, 12 bp, Homo sapiens
ccctccactctc

SEQ ID NO: 6061316 - DNA, 23 bp, Homo sapiens
ccctccactctcctcttccaggc

SEQ ID NO: 6061317 - DNA, 15 bp, Homo sapiens
ccctccactctgagg

SEQ ID NO: 6061318 - DNA, 16 bp, Homo sapiens
ccctccactctgaggt

SEQ ID NO: 6061319 - DNA, 12 bp, Homo sapiens
ccctccactgct

SEQ ID NO: 6061320 - DNA, 15 bp, Homo sapiens
ccctccactgctggg

SEQ ID NO: 6061321 - DNA, 18 bp, Homo sapiens
ccctccagaaccaccccg

SEQ ID NO: 6061322 - DNA, 16 bp, Homo sapiens
ccctccagaccctgcc

SEQ ID NO: 6061323 - DNA, 18 bp, Homo sapiens
ccctccagaccctgcctg

SEQ ID NO: 6061324 - DNA, 13 bp, Homo sapiens
ccctccagagaca

SEQ ID NO: 6061325 - DNA, 21 bp, Homo sapiens
ccctccagagacaggaaagaa

SEQ ID NO: 6061326 - DNA, 14 bp, Homo sapiens
ccctccagagcagg

SEQ ID NO: 6061327 - DNA, 19 bp, Homo sapiens
ccctccagagccccacagc

SEQ ID NO: 6061328 - DNA, 15 bp, Homo sapiens
ccctccagcacacac

SEQ ID NO: 6061329 - DNA, 12 bp, Homo sapiens
ccctccagcctt

SEQ ID NO: 6061330 - DNA, 13 bp, Homo sapiens
ccctccagctcca

SEQ ID NO: 6061331 - DNA, 15 bp, Homo sapiens
ccctccagctccctg

SEQ ID NO: 6061332 - DNA, 23 bp, Homo sapiens
ccctccagctggaattgctgctc

SEQ ID NO: 6061333 - DNA, 13 bp, Homo sapiens
ccctccaggaaga

SEQ ID NO: 6061334 - DNA, 11 bp, Homo sapiens
ccctccaggag

SEQ ID NO: 6061335 - DNA, 12 bp, Homo sapiens
ccctccaggaga

SEQ ID NO: 6061336 - DNA, 12 bp, Homo sapiens
ccctccagggcc

SEQ ID NO: 6061337 - DNA, 15 bp, Homo sapiens
ccctccagggccagg

SEQ ID NO: 6061338 - DNA, 13 bp, Homo sapiens
ccctccagtacct

SEQ ID NO: 6061339 - DNA, 17 bp, Homo sapiens
ccctccagtgcttggct

SEQ ID NO: 6061340 - DNA, 21 bp, Homo sapiens
ccctccagtgcttggctgccc

SEQ ID NO: 6061341 - DNA, 16 bp, Homo sapiens
ccctccataagtttaa

SEQ ID NO: 6061342 - DNA, 16 bp, Homo sapiens
ccctccatcccagaca

SEQ ID NO: 6061343 - DNA, 14 bp, Homo sapiens
ccctccatccccat

SEQ ID NO: 6061344 - DNA, 14 bp, Homo sapiens
ccctccatccctgg

SEQ ID NO: 6061345 - DNA, 14 bp, Homo sapiens
ccctccatctgggg

SEQ ID NO: 6061346 - DNA, 16 bp, Homo sapiens
ccctccatctggggat

SEQ ID NO: 6061347 - DNA, 22 bp, Homo sapiens
ccctccatgattccaagggccc

SEQ ID NO: 6061348 - DNA, 14 bp, Homo sapiens
ccctccatggcctg

SEQ ID NO: 6061349 - DNA, 13 bp, Homo sapiens
ccctccatgggct

SEQ ID NO: 6061350 - DNA, 22 bp, Homo sapiens
ccctccatgtagaagagggaga

SEQ ID NO: 6061351 - DNA, 19 bp, Homo sapiens
ccctccattcccacccctc

SEQ ID NO: 6061352 - DNA, 21 bp, Homo sapiens
ccctccattggctcccaagtc

SEQ ID NO: 6061353 - DNA, 22 bp, Homo sapiens
ccctccattgggcacagtccag

SEQ ID NO: 6061354 - DNA, 13 bp, Homo sapiens
ccctcccaaagag

SEQ ID NO: 6061355 - DNA, 13 bp, Homo sapiens
ccctcccaacagc

SEQ ID NO: 6061356 - DNA, 12 bp, Homo sapiens
ccctcccaacct

SEQ ID NO: 6061357 - DNA, 18 bp, Homo sapiens
ccctcccaacctcaatgc

SEQ ID NO: 6061358 - DNA, 21 bp, Homo sapiens
ccctcccaagctggctggggt

SEQ ID NO: 6061359 - DNA, 15 bp, Homo sapiens
ccctcccaaggagcc

SEQ ID NO: 6061360 - DNA, 21 bp, Homo sapiens
ccctcccaaggagccattctg

SEQ ID NO: 6061361 - DNA, 17 bp, Homo sapiens
ccctcccaatcctctct

SEQ ID NO: 6061362 - DNA, 12 bp, Homo sapiens
ccctcccacaca

SEQ ID NO: 6061363 - DNA, 13 bp, Homo sapiens
ccctcccacacac

SEQ ID NO: 6061364 - DNA, 19 bp, Homo sapiens
ccctcccacacccaaagct

SEQ ID NO: 6061365 - DNA, 12 bp, Homo sapiens
ccctcccacagc

SEQ ID NO: 6061366 - DNA, 18 bp, Homo sapiens
ccctcccacagcctcctt

SEQ ID NO: 6061367 - DNA, 14 bp, Homo sapiens
ccctcccacatccc

SEQ ID NO: 6061368 - DNA, 16 bp, Homo sapiens
ccctcccacatccccc

SEQ ID NO: 6061369 - DNA, 16 bp, Homo sapiens
ccctcccaccagaacg

SEQ ID NO: 6061370 - DNA, 22 bp, Homo sapiens
ccctcccaccatgcgctgctca

SEQ ID NO: 6061371 - DNA, 15 bp, Homo sapiens
ccctcccaccctgcg

SEQ ID NO: 6061372 - DNA, 17 bp, Homo sapiens
ccctcccacctctgtga

SEQ ID NO: 6061373 - DNA, 15 bp, Homo sapiens
ccctcccactccctg

SEQ ID NO: 6061374 - DNA, 18 bp, Homo sapiens
ccctcccactccctgggg

SEQ ID NO: 6061375 - DNA, 20 bp, Homo sapiens
ccctcccagaaaaactggct

SEQ ID NO: 6061376 - DNA, 22 bp, Homo sapiens
ccctcccagatccaggaacaca

SEQ ID NO: 6061377 - DNA, 12 bp, Homo sapiens
ccctcccagccc

SEQ ID NO: 6061378 - DNA, 17 bp, Homo sapiens
ccctcccagcccattgc

SEQ ID NO: 6061379 - DNA, 16 bp, Homo sapiens
ccctcccagccctgag

SEQ ID NO: 6061380 - DNA, 18 bp, Homo sapiens
ccctcccagccctgaggg

SEQ ID NO: 6061381 - DNA, 15 bp, Homo sapiens
ccctcccagctctga

SEQ ID NO: 6061382 - DNA, 15 bp, Homo sapiens
ccctcccagctgcac

SEQ ID NO: 6061383 - DNA, 21 bp, Homo sapiens
ccctcccaggaccctccactc

SEQ ID NO: 6061384 - DNA, 13 bp, Homo sapiens
ccctcccaggcga

SEQ ID NO: 6061385 - DNA, 12 bp, Homo sapiens
ccctcccaggct

SEQ ID NO: 6061386 - DNA, 13 bp, Homo sapiens
ccctcccagggag

SEQ ID NO: 6061387 - DNA, 22 bp, Homo sapiens
ccctcccagggccagggccctg

SEQ ID NO: 6061388 - DNA, 14 bp, Homo sapiens
ccctcccaggggag

SEQ ID NO: 6061389 - DNA, 18 bp, Homo sapiens
ccctcccaggggagccag

SEQ ID NO: 6061390 - DNA, 15 bp, Homo sapiens
ccctcccaggtcggg

SEQ ID NO: 6061391 - DNA, 21 bp, Homo sapiens
ccctcccaggtcgggcagtgg

SEQ ID NO: 6061392 - DNA, 21 bp, Homo sapiens
ccctcccagtcctccagacca

SEQ ID NO: 6061393 - DNA, 20 bp, Homo sapiens
ccctcccagtctcatctcct

SEQ ID NO: 6061394 - DNA, 19 bp, Homo sapiens
ccctcccatcctccagccc

SEQ ID NO: 6061395 - DNA, 16 bp, Homo sapiens
ccctcccatctgggag

SEQ ID NO: 6061396 - DNA, 16 bp, Homo sapiens
ccctcccatggcccag

SEQ ID NO: 6061397 - DNA, 20 bp, Homo sapiens
ccctccccaaacccatcaga

SEQ ID NO: 6061398 - DNA, 22 bp, Homo sapiens
ccctccccaaacccatcagaca

SEQ ID NO: 6061399 - DNA, 13 bp, Homo sapiens
ccctccccaaagc

SEQ ID NO: 6061400 - DNA, 14 bp, Homo sapiens
ccctccccaaagcc

SEQ ID NO: 6061401 - DNA, 23 bp, Homo sapiens
ccctccccaaagccactggaagg

SEQ ID NO: 6061402 - DNA, 20 bp, Homo sapiens
ccctccccaactccttcctc

SEQ ID NO: 6061403 - DNA, 21 bp, Homo sapiens
ccctccccaactgaccacctt

SEQ ID NO: 6061404 - DNA, 14 bp, Homo sapiens
ccctccccaaggaa

SEQ ID NO: 6061405 - DNA, 23 bp, Homo sapiens
ccctccccaaggatgaccacacc

SEQ ID NO: 6061406 - DNA, 19 bp, Homo sapiens
ccctccccacacctcccta

SEQ ID NO: 6061407 - DNA, 21 bp, Homo sapiens
ccctccccacacctccctact

SEQ ID NO: 6061408 - DNA, 14 bp, Homo sapiens
ccctccccacagtg

SEQ ID NO: 6061409 - DNA, 19 bp, Homo sapiens
ccctccccacagtgccacc

SEQ ID NO: 6061410 - DNA, 23 bp, Homo sapiens
ccctccccacagtgccacccatg

SEQ ID NO: 6061411 - DNA, 12 bp, Homo sapiens
ccctccccaccc

SEQ ID NO: 6061412 - DNA, 14 bp, Homo sapiens
ccctccccacccaa

SEQ ID NO: 6061413 - DNA, 17 bp, Homo sapiens
ccctccccacccaccac

SEQ ID NO: 6061414 - DNA, 22 bp, Homo sapiens
ccctccccaccccaaccactct

SEQ ID NO: 6061415 - DNA, 12 bp, Homo sapiens
ccctccccagaa

SEQ ID NO: 6061416 - DNA, 20 bp, Homo sapiens
ccctccccagactctcaggt

SEQ ID NO: 6061417 - DNA, 18 bp, Homo sapiens
ccctccccagccagccct

SEQ ID NO: 6061418 - DNA, 20 bp, Homo sapiens
ccctccccagccagcccttc

SEQ ID NO: 6061419 - DNA, 17 bp, Homo sapiens
ccctccccagcccccac

SEQ ID NO: 6061420 - DNA, 15 bp, Homo sapiens
ccctccccagccctt

SEQ ID NO: 6061421 - DNA, 12 bp, Homo sapiens
ccctccccagct

SEQ ID NO: 6061422 - DNA, 13 bp, Homo sapiens
ccctccccagggg

SEQ ID NO: 6061423 - DNA, 11 bp, Homo sapiens
ccctccccagt

SEQ ID NO: 6061424 - DNA, 23 bp, Homo sapiens
ccctccccatctcggggctgctg

SEQ ID NO: 6061425 - DNA, 17 bp, Homo sapiens
ccctccccatctgtgtt

SEQ ID NO: 6061426 - DNA, 23 bp, Homo sapiens
ccctccccatggtgcagtgaaga

SEQ ID NO: 6061427 - DNA, 17 bp, Homo sapiens
ccctccccattcacaga

SEQ ID NO: 6061428 - DNA, 15 bp, Homo sapiens
ccctcccccacggcc

SEQ ID NO: 6061429 - DNA, 23 bp, Homo sapiens
ccctcccccacggccgtccctga

SEQ ID NO: 6061430 - DNA, 15 bp, Homo sapiens
ccctcccccagagcc

SEQ ID NO: 6061431 - DNA, 15 bp, Homo sapiens
ccctcccccagcaga

SEQ ID NO: 6061432 - DNA, 13 bp, Homo sapiens
ccctcccccagct

SEQ ID NO: 6061433 - DNA, 12 bp, Homo sapiens
ccctcccccagg

SEQ ID NO: 6061434 - DNA, 21 bp, Homo sapiens
ccctcccccattccctccatt

SEQ ID NO: 6061435 - DNA, 20 bp, Homo sapiens
ccctcccccccatgcactgt

SEQ ID NO: 6061436 - DNA, 19 bp, Homo sapiens
ccctcccccctcggccgcc

SEQ ID NO: 6061437 - DNA, 13 bp, Homo sapiens
ccctcccccgtcc

SEQ ID NO: 6061438 - DNA, 12 bp, Homo sapiens
ccctccccctca

SEQ ID NO: 6061439 - DNA, 13 bp, Homo sapiens
ccctccccctcaa

SEQ ID NO: 6061440 - DNA, 14 bp, Homo sapiens
ccctccccctcctg

SEQ ID NO: 6061441 - DNA, 23 bp, Homo sapiens
ccctccccctgccagaggcctgg

SEQ ID NO: 6061442 - DNA, 15 bp, Homo sapiens
ccctcccccttcccc

SEQ ID NO: 6061443 - DNA, 13 bp, Homo sapiens
ccctcccccttct

SEQ ID NO: 6061444 - DNA, 13 bp, Homo sapiens
ccctcccccttgt

SEQ ID NO: 6061445 - DNA, 21 bp, Homo sapiens
ccctccccgcccctgtggccc

SEQ ID NO: 6061446 - DNA, 17 bp, Homo sapiens
ccctccccgcccttttt

SEQ ID NO: 6061447 - DNA, 16 bp, Homo sapiens
ccctccccgcctcctc

SEQ ID NO: 6061448 - DNA, 17 bp, Homo sapiens
ccctccccgcctggcca

SEQ ID NO: 6061449 - DNA, 22 bp, Homo sapiens
ccctccccgcctggccagggca

SEQ ID NO: 6061450 - DNA, 21 bp, Homo sapiens
ccctccccggcaccctctggc

SEQ ID NO: 6061451 - DNA, 14 bp, Homo sapiens
ccctccccggccct

SEQ ID NO: 6061452 - DNA, 20 bp, Homo sapiens
ccctccccgggcagcagaga

SEQ ID NO: 6061453 - DNA, 21 bp, Homo sapiens
ccctcccctaatgcctgcgga

SEQ ID NO: 6061454 - DNA, 17 bp, Homo sapiens
ccctcccctcagagccc

SEQ ID NO: 6061455 - DNA, 15 bp, Homo sapiens
ccctcccctcagcgc

SEQ ID NO: 6061456 - DNA, 18 bp, Homo sapiens
ccctcccctccatccctg

SEQ ID NO: 6061457 - DNA, 15 bp, Homo sapiens
ccctcccctccccgt

SEQ ID NO: 6061458 - DNA, 16 bp, Homo sapiens
ccctcccctgccccca

SEQ ID NO: 6061459 - DNA, 13 bp, Homo sapiens
ccctcccctgctc

SEQ ID NO: 6061460 - DNA, 16 bp, Homo sapiens
ccctcccctgctccca

SEQ ID NO: 6061461 - DNA, 12 bp, Homo sapiens
ccctcccctggg

SEQ ID NO: 6061462 - DNA, 13 bp, Homo sapiens
ccctcccctggga

SEQ ID NO: 6061463 - DNA, 14 bp, Homo sapiens
ccctcccctgggac

SEQ ID NO: 6061464 - DNA, 15 bp, Homo sapiens
ccctcccctgggact

SEQ ID NO: 6061465 - DNA, 13 bp, Homo sapiens
ccctccccttccc

SEQ ID NO: 6061466 - DNA, 14 bp, Homo sapiens
ccctccccttctct

SEQ ID NO: 6061467 - DNA, 14 bp, Homo sapiens
ccctccccttgcct

SEQ ID NO: 6061468 - DNA, 23 bp, Homo sapiens
ccctcccgacagcccatcacctc

SEQ ID NO: 6061469 - DNA, 16 bp, Homo sapiens
ccctcccgcagagact

SEQ ID NO: 6061470 - DNA, 23 bp, Homo sapiens
ccctcccgccccttcccactcac

SEQ ID NO: 6061471 - DNA, 15 bp, Homo sapiens
ccctcccgcttcctc

SEQ ID NO: 6061472 - DNA, 14 bp, Homo sapiens
ccctcccggcctgg

SEQ ID NO: 6061473 - DNA, 20 bp, Homo sapiens
ccctcccgtagtctcctggg

SEQ ID NO: 6061474 - DNA, 15 bp, Homo sapiens
ccctccctaccctaa

SEQ ID NO: 6061475 - DNA, 15 bp, Homo sapiens
ccctccctacctcaa

SEQ ID NO: 6061476 - DNA, 12 bp, Homo sapiens
ccctccctagcc

SEQ ID NO: 6061477 - DNA, 19 bp, Homo sapiens
ccctccctagcccttccag

SEQ ID NO: 6061478 - DNA, 20 bp, Homo sapiens
ccctccctagcccttccagc

SEQ ID NO: 6061479 - DNA, 21 bp, Homo sapiens
ccctccctatatgcacccctg

SEQ ID NO: 6061480 - DNA, 19 bp, Homo sapiens
ccctccctatgtctgcaaa

SEQ ID NO: 6061481 - DNA, 20 bp, Homo sapiens
ccctccctatgtctgcaaag

SEQ ID NO: 6061482 - DNA, 13 bp, Homo sapiens
ccctccctcagcc

SEQ ID NO: 6061483 - DNA, 16 bp, Homo sapiens
ccctccctcagccgtc

SEQ ID NO: 6061484 - DNA, 16 bp, Homo sapiens
ccctccctcagggagc

SEQ ID NO: 6061485 - DNA, 14 bp, Homo sapiens
ccctccctccacac

SEQ ID NO: 6061486 - DNA, 16 bp, Homo sapiens
ccctccctccagggtc

SEQ ID NO: 6061487 - DNA, 14 bp, Homo sapiens
ccctccctcccaca

SEQ ID NO: 6061488 - DNA, 15 bp, Homo sapiens
ccctccctcccagat

SEQ ID NO: 6061489 - DNA, 16 bp, Homo sapiens
ccctccctcccagatc

SEQ ID NO: 6061490 - DNA, 14 bp, Homo sapiens
ccctccctccctgc

SEQ ID NO: 6061491 - DNA, 15 bp, Homo sapiens
ccctccctccctgct

SEQ ID NO: 6061492 - DNA, 14 bp, Homo sapiens
ccctccctcctgcc

SEQ ID NO: 6061493 - DNA, 13 bp, Homo sapiens
ccagcattgctgg

SEQ ID NO: 6061494 - DNA, 18 bp, Homo sapiens
ccagcatttaagtgacct

SEQ ID NO: 6061495 - DNA, 19 bp, Homo sapiens
ccagcatttagctggccac

SEQ ID NO: 6061496 - DNA, 19 bp, Homo sapiens
ccagcatttcccgaaggcc

SEQ ID NO: 6061497 - DNA, 16 bp, Homo sapiens
ccagcatttcccttcc

SEQ ID NO: 6061498 - DNA, 16 bp, Homo sapiens
ccagcatttcctcagt

SEQ ID NO: 6061499 - DNA, 14 bp, Homo sapiens
ccagcatttgggta

SEQ ID NO: 6061500 - DNA, 24 bp, Homo sapiens
ccagcatttggttttacacaggaa

SEQ ID NO: 6061501 - DNA, 13 bp, Homo sapiens
ccagcatttgtcc

SEQ ID NO: 6061502 - DNA, 14 bp, Homo sapiens
ccagcattttacta

SEQ ID NO: 6061503 - DNA, 18 bp, Homo sapiens
ccagcattttactgattc

SEQ ID NO: 6061504 - DNA, 16 bp, Homo sapiens
ccagccaaacacacag

SEQ ID NO: 6061505 - DNA, 20 bp, Homo sapiens
ccagccaaacacacagaagg

SEQ ID NO: 6061506 - DNA, 21 bp, Homo sapiens
ccagccaaacacacagaaggg

SEQ ID NO: 6061507 - DNA, 19 bp, Homo sapiens
ccagccaaaccctgtctga

SEQ ID NO: 6061508 - DNA, 21 bp, Homo sapiens
ccagccaaagaaatgggcctg

SEQ ID NO: 6061509 - DNA, 19 bp, Homo sapiens
ccagccaaagcctcctcca

SEQ ID NO: 6061510 - DNA, 18 bp, Homo sapiens
ccagccaaccatcatgtg

SEQ ID NO: 6061511 - DNA, 13 bp, Homo sapiens
ccagccaacccct

SEQ ID NO: 6061512 - DNA, 16 bp, Homo sapiens
ccagccaagcctgact

SEQ ID NO: 6061513 - DNA, 20 bp, Homo sapiens
ccagccaagctctgcagtcc

SEQ ID NO: 6061514 - DNA, 18 bp, Homo sapiens
ccagccaagtgccttccg

SEQ ID NO: 6061515 - DNA, 21 bp, Homo sapiens
ccagccaatctagaggcaagc

SEQ ID NO: 6061516 - DNA, 17 bp, Homo sapiens
ccagccacacagagcct

SEQ ID NO: 6061517 - DNA, 10 bp, Homo sapiens
ccagccacag

SEQ ID NO: 6061518 - DNA, 19 bp, Homo sapiens
ccagccacagacccctggg

SEQ ID NO: 6061519 - DNA, 20 bp, Homo sapiens
ccagccacagacccctggga

SEQ ID NO: 6061520 - DNA, 15 bp, Homo sapiens
ccagccacagagcaa

SEQ ID NO: 6061521 - DNA, 15 bp, Homo sapiens
ccagccaccaaggct

SEQ ID NO: 6061522 - DNA, 20 bp, Homo sapiens
ccagccaccaaggctgcctg

SEQ ID NO: 6061523 - DNA, 15 bp, Homo sapiens
ccagccaccaccact

SEQ ID NO: 6061524 - DNA, 20 bp, Homo sapiens
ccagccaccaccactgtccc

SEQ ID NO: 6061525 - DNA, 21 bp, Homo sapiens
ccagccaccaccctcaggtgc

SEQ ID NO: 6061526 - DNA, 18 bp, Homo sapiens
ccagccaccccgcagtca

SEQ ID NO: 6061527 - DNA, 13 bp, Homo sapiens
ccagccaccccgg

SEQ ID NO: 6061528 - DNA, 14 bp, Homo sapiens
ccagccacccctca

SEQ ID NO: 6061529 - DNA, 16 bp, Homo sapiens
ccagccacccctgcca

SEQ ID NO: 6061530 - DNA, 18 bp, Homo sapiens
ccagccacccctgccact

SEQ ID NO: 6061531 - DNA, 23 bp, Homo sapiens
ccagccacccggatctccaggcc

SEQ ID NO: 6061532 - DNA, 23 bp, Homo sapiens
ccagccaccctaactgagctgcc

SEQ ID NO: 6061533 - DNA, 14 bp, Homo sapiens
ccagccacctccca

SEQ ID NO: 6061534 - DNA, 19 bp, Homo sapiens
ccagccacctcccaaggac

SEQ ID NO: 6061535 - DNA, 12 bp, Homo sapiens
ccagccacctct

SEQ ID NO: 6061536 - DNA, 21 bp, Homo sapiens
ccagccacggacgctggctcc

SEQ ID NO: 6061537 - DNA, 14 bp, Homo sapiens
ccagccacgtggag

SEQ ID NO: 6061538 - DNA, 16 bp, Homo sapiens
ccagccactccaagcc

SEQ ID NO: 6061539 - DNA, 15 bp, Homo sapiens
ccagccactctacca

SEQ ID NO: 6061540 - DNA, 13 bp, Homo sapiens
ccagccactgcag

SEQ ID NO: 6061541 - DNA, 15 bp, Homo sapiens
ccagccactgcagca

SEQ ID NO: 6061542 - DNA, 17 bp, Homo sapiens
ccagccactgccaagct

SEQ ID NO: 6061543 - DNA, 23 bp, Homo sapiens
ccagccactgccaagcttcctgt

SEQ ID NO: 6061544 - DNA, 13 bp, Homo sapiens
ccagccagaagcc

SEQ ID NO: 6061545 - DNA, 20 bp, Homo sapiens
ccagccagaggcatctgagg

SEQ ID NO: 6061546 - DNA, 19 bp, Homo sapiens
ccagccagagttcctgcgg

SEQ ID NO: 6061547 - DNA, 13 bp, Homo sapiens
ccagccagatcct

SEQ ID NO: 6061548 - DNA, 16 bp, Homo sapiens
ccagccagcagccagc

SEQ ID NO: 6061549 - DNA, 23 bp, Homo sapiens
ccagccagcagccagctctcagc

SEQ ID NO: 6061550 - DNA, 16 bp, Homo sapiens
ccagccagcaggttct

SEQ ID NO: 6061551 - DNA, 11 bp, Homo sapiens
ccagccagcca

SEQ ID NO: 6061552 - DNA, 12 bp, Homo sapiens
ccagccagccac

SEQ ID NO: 6061553 - DNA, 15 bp, Homo sapiens
ccagccagccacccc

SEQ ID NO: 6061554 - DNA, 14 bp, Homo sapiens
ccagccagccagga

SEQ ID NO: 6061555 - DNA, 13 bp, Homo sapiens
ccagccagccctg

SEQ ID NO: 6061556 - DNA, 19 bp, Homo sapiens
ccagccagcccttcccagg

SEQ ID NO: 6061557 - DNA, 21 bp, Homo sapiens
ccagccagcccttcccaggcc

SEQ ID NO: 6061558 - DNA, 19 bp, Homo sapiens
ccagccagcctcagaaggc

SEQ ID NO: 6061559 - DNA, 12 bp, Homo sapiens
ccagccagcgcc

SEQ ID NO: 6061560 - DNA, 13 bp, Homo sapiens
ccagccagctcct

SEQ ID NO: 6061561 - DNA, 14 bp, Homo sapiens
ccagccagctgcag

SEQ ID NO: 6061562 - DNA, 15 bp, Homo sapiens
ccagccagctgcagg

SEQ ID NO: 6061563 - DNA, 18 bp, Homo sapiens
ccagccaggaactggctc

SEQ ID NO: 6061564 - DNA, 14 bp, Homo sapiens
ccagccaggagcag

SEQ ID NO: 6061565 - DNA, 12 bp, Homo sapiens
ccagccaggcag

SEQ ID NO: 6061566 - DNA, 13 bp, Homo sapiens
ccagccaggcaga

SEQ ID NO: 6061567 - DNA, 20 bp, Homo sapiens
ccagccaggccaacagcacc

SEQ ID NO: 6061568 - DNA, 12 bp, Homo sapiens
ccagccaggccc

SEQ ID NO: 6061569 - DNA, 16 bp, Homo sapiens
ccagccaggcccagcc

SEQ ID NO: 6061570 - DNA, 22 bp, Homo sapiens
ccagccaggcccagccgacccc

SEQ ID NO: 6061571 - DNA, 15 bp, Homo sapiens
ccagccaggcccagg

SEQ ID NO: 6061572 - DNA, 22 bp, Homo sapiens
ccagccaggcccaggccagccc

SEQ ID NO: 6061573 - DNA, 12 bp, Homo sapiens
ccagccaggcgg

SEQ ID NO: 6061574 - DNA, 19 bp, Homo sapiens
ccagccaggctctgtgctg

SEQ ID NO: 6061575 - DNA, 15 bp, Homo sapiens
ccagccagggctcaa

SEQ ID NO: 6061576 - DNA, 20 bp, Homo sapiens
ccagccagtgacctgaggaa

SEQ ID NO: 6061577 - DNA, 23 bp, Homo sapiens
ccagccataaaagcattgtctct

SEQ ID NO: 6061578 - DNA, 18 bp, Homo sapiens
ccagccatcaagagactg

SEQ ID NO: 6061579 - DNA, 20 bp, Homo sapiens
ccagccatcacaaggggaac

SEQ ID NO: 6061580 - DNA, 22 bp, Homo sapiens
ccagccatcggaagagagggct

SEQ ID NO: 6061581 - DNA, 18 bp, Homo sapiens
ccagccatctgcccaggg

SEQ ID NO: 6061582 - DNA, 18 bp, Homo sapiens
ccagccatgccagctggc

SEQ ID NO: 6061583 - DNA, 13 bp, Homo sapiens
ccagccatgccca

SEQ ID NO: 6061584 - DNA, 18 bp, Homo sapiens
ccagccatgcccacgccc

SEQ ID NO: 6061585 - DNA, 20 bp, Homo sapiens
ccagccatgggccctctgag

SEQ ID NO: 6061586 - DNA, 21 bp, Homo sapiens
ccagccatgggccctctgagc

SEQ ID NO: 6061587 - DNA, 19 bp, Homo sapiens
ccagccatggtgaggaagc

SEQ ID NO: 6061588 - DNA, 16 bp, Homo sapiens
ccagccattcctgaag

SEQ ID NO: 6061589 - DNA, 14 bp, Homo sapiens
ccagcccaaacctg

SEQ ID NO: 6061590 - DNA, 16 bp, Homo sapiens
ccagcccaaacctggg

SEQ ID NO: 6061591 - DNA, 18 bp, Homo sapiens
ccagcccaaacctgggaa

SEQ ID NO: 6061592 - DNA, 18 bp, Homo sapiens
ccagcccaaaccttgggc

SEQ ID NO: 6061593 - DNA, 15 bp, Homo sapiens
ccagcccaaagctgg

SEQ ID NO: 6061594 - DNA, 12 bp, Homo sapiens
ccagcccaaagg

SEQ ID NO: 6061595 - DNA, 21 bp, Homo sapiens
ccagcccaaaggggacaggcc

SEQ ID NO: 6061596 - DNA, 13 bp, Homo sapiens
ccagcccaagtcc

SEQ ID NO: 6061597 - DNA, 20 bp, Homo sapiens
ccagcccaagtgaggcagcc

SEQ ID NO: 6061598 - DNA, 14 bp, Homo sapiens
ccagcccaataaag

SEQ ID NO: 6061599 - DNA, 17 bp, Homo sapiens
ccagcccaataaaggtc

SEQ ID NO: 6061600 - DNA, 15 bp, Homo sapiens
ccagcccacacagcc

SEQ ID NO: 6061601 - DNA, 14 bp, Homo sapiens
ccagcccacagagc

SEQ ID NO: 6061602 - DNA, 16 bp, Homo sapiens
ccagcccacagagcct

SEQ ID NO: 6061603 - DNA, 17 bp, Homo sapiens
ccagcccacagagcctg

SEQ ID NO: 6061604 - DNA, 18 bp, Homo sapiens
ccagcccacagagcctga

SEQ ID NO: 6061605 - DNA, 15 bp, Homo sapiens
ccagcccacccaacc

SEQ ID NO: 6061606 - DNA, 15 bp, Homo sapiens
ccagcccaccccatg

SEQ ID NO: 6061607 - DNA, 18 bp, Homo sapiens
ccagcccaccccatggcc

SEQ ID NO: 6061608 - DNA, 22 bp, Homo sapiens
ccagcccaccctcctgtcttcc

SEQ ID NO: 6061609 - DNA, 21 bp, Homo sapiens
ccagcccaccctgctcctcct

SEQ ID NO: 6061610 - DNA, 20 bp, Homo sapiens
ccagcccacctcaacccaga

SEQ ID NO: 6061611 - DNA, 14 bp, Homo sapiens
ccagcccacctgct

SEQ ID NO: 6061612 - DNA, 20 bp, Homo sapiens
ccagcccacctgctcccagg

SEQ ID NO: 6061613 - DNA, 12 bp, Homo sapiens
ccagcccactgg

SEQ ID NO: 6061614 - DNA, 17 bp, Homo sapiens
ccagcccactgggccct

SEQ ID NO: 6061615 - DNA, 20 bp, Homo sapiens
ccagcccactgggccctggg

SEQ ID NO: 6061616 - DNA, 21 bp, Homo sapiens
ccagcccactgggccctgggg

SEQ ID NO: 6061617 - DNA, 22 bp, Homo sapiens
ccagcccactgggccctggggc

SEQ ID NO: 6061618 - DNA, 13 bp, Homo sapiens
ccagcccagacag

SEQ ID NO: 6061619 - DNA, 14 bp, Homo sapiens
ccagcccagacagc

SEQ ID NO: 6061620 - DNA, 12 bp, Homo sapiens
ccagcccagacc

SEQ ID NO: 6061621 - DNA, 20 bp, Homo sapiens
ccagcccagacccccagtgt

SEQ ID NO: 6061622 - DNA, 11 bp, Homo sapiens
ccagcccagag

SEQ ID NO: 6061623 - DNA, 12 bp, Homo sapiens
ccagcccagagc

SEQ ID NO: 6061624 - DNA, 16 bp, Homo sapiens
ccagcccagagccacc

SEQ ID NO: 6061625 - DNA, 20 bp, Homo sapiens
ccagcccagagccacctgga

SEQ ID NO: 6061626 - DNA, 16 bp, Homo sapiens
ccagcccagagcccgg

SEQ ID NO: 6061627 - DNA, 21 bp, Homo sapiens
ccagcccagattcccctgtgt

SEQ ID NO: 6061628 - DNA, 23 bp, Homo sapiens
ccagcccagattcccctgtgtca

SEQ ID NO: 6061629 - DNA, 14 bp, Homo sapiens
ccagcccagcaccc

SEQ ID NO: 6061630 - DNA, 16 bp, Homo sapiens
ccagcccagccaggcc

SEQ ID NO: 6061631 - DNA, 15 bp, Homo sapiens
ccagcccagcccgct

SEQ ID NO: 6061632 - DNA, 13 bp, Homo sapiens
ccagcccagcctg

SEQ ID NO: 6061633 - DNA, 14 bp, Homo sapiens
ccagcccagctcca

SEQ ID NO: 6061634 - DNA, 16 bp, Homo sapiens
ccagcccagctccact

SEQ ID NO: 6061635 - DNA, 13 bp, Homo sapiens
ccagcccagctgg

SEQ ID NO: 6061636 - DNA, 17 bp, Homo sapiens
ccagcccagctggccgg

SEQ ID NO: 6061637 - DNA, 10 bp, Homo sapiens
ccagcccagg

SEQ ID NO: 6061638 - DNA, 15 bp, Homo sapiens
ccagcccaggcctgg

SEQ ID NO: 6061639 - DNA, 13 bp, Homo sapiens
ccagcccagggct

SEQ ID NO: 6061640 - DNA, 17 bp, Homo sapiens
ccagcccagggctcctg

SEQ ID NO: 6061641 - DNA, 21 bp, Homo sapiens
ccagcccatccattaggccag

SEQ ID NO: 6061642 - DNA, 16 bp, Homo sapiens
ccagcccatctcggag

SEQ ID NO: 6061643 - DNA, 22 bp, Homo sapiens
ccagcccatcttgcctccatgg

SEQ ID NO: 6061644 - DNA, 12 bp, Homo sapiens
ccagcccatgct

SEQ ID NO: 6061645 - DNA, 13 bp, Homo sapiens
ccagcccatgctg

SEQ ID NO: 6061646 - DNA, 19 bp, Homo sapiens
ccagcccatgctggctggg

SEQ ID NO: 6061647 - DNA, 19 bp, Homo sapiens
ccagcccatggccctgtgc

SEQ ID NO: 6061648 - DNA, 20 bp, Homo sapiens
ccagcccattggccgagctc

SEQ ID NO: 6061649 - DNA, 22 bp, Homo sapiens
ccagcccattggccgagctcct

SEQ ID NO: 6061650 - DNA, 20 bp, Homo sapiens
ccagcccatttgggctctgg

SEQ ID NO: 6061651 - DNA, 15 bp, Homo sapiens
ccagccccaagctgg

SEQ ID NO: 6061652 - DNA, 18 bp, Homo sapiens
ccagccccaaggggtggc

SEQ ID NO: 6061653 - DNA, 21 bp, Homo sapiens
ccagccccaatccagagaagc

SEQ ID NO: 6061654 - DNA, 22 bp, Homo sapiens
ccagccccaatccagagaagcg

SEQ ID NO: 6061655 - DNA, 13 bp, Homo sapiens
ccagccccacacc

SEQ ID NO: 6061656 - DNA, 13 bp, Homo sapiens
ccagccccacagc

SEQ ID NO: 6061657 - DNA, 14 bp, Homo sapiens
ccagccccacccag

SEQ ID NO: 6061658 - DNA, 21 bp, Homo sapiens
ccagccccacccccagccagg

SEQ ID NO: 6061659 - DNA, 13 bp, Homo sapiens
ccagccccactgc

SEQ ID NO: 6061660 - DNA, 16 bp, Homo sapiens
ccagccccactgccag

SEQ ID NO: 6061661 - DNA, 17 bp, Homo sapiens
ccagccccactgccagc

SEQ ID NO: 6061662 - DNA, 18 bp, Homo sapiens
ccagccccactgccagca

SEQ ID NO: 6061663 - DNA, 19 bp, Homo sapiens
ccagccccactgccagcag

SEQ ID NO: 6061664 - DNA, 20 bp, Homo sapiens
ccagccccactgccagcagc

SEQ ID NO: 6061665 - DNA, 16 bp, Homo sapiens
ccagccccactgccct

SEQ ID NO: 6061666 - DNA, 21 bp, Homo sapiens
ccagccccactgccctccagg

SEQ ID NO: 6061667 - DNA, 23 bp, Homo sapiens
ccagccccagacaacagcccagg

SEQ ID NO: 6061668 - DNA, 22 bp, Homo sapiens
ccagccccagcaagagcacaag

SEQ ID NO: 6061669 - DNA, 14 bp, Homo sapiens
ccagccccaggcct

SEQ ID NO: 6061670 - DNA, 13 bp, Homo sapiens
ccagccccagggg

SEQ ID NO: 6061671 - DNA, 16 bp, Homo sapiens
ccagccccaggggtgc

SEQ ID NO: 6061672 - DNA, 16 bp, Homo sapiens
ccagccccagtgccca

SEQ ID NO: 6061673 - DNA, 16 bp, Homo sapiens
ccagccccatcaggac

SEQ ID NO: 6061674 - DNA, 14 bp, Homo sapiens
ccctccctcctggc

SEQ ID NO: 6061675 - DNA, 15 bp, Homo sapiens
ccctccctcgcatcc

SEQ ID NO: 6061676 - DNA, 14 bp, Homo sapiens
ccctccctctccag

SEQ ID NO: 6061677 - DNA, 14 bp, Homo sapiens
ccctccctctgccc

SEQ ID NO: 6061678 - DNA, 15 bp, Homo sapiens
ccctccctctgcccc

SEQ ID NO: 6061679 - DNA, 13 bp, Homo sapiens
ccctccctctgct

SEQ ID NO: 6061680 - DNA, 15 bp, Homo sapiens
ccctccctctgctct

SEQ ID NO: 6061681 - DNA, 18 bp, Homo sapiens
ccctccctctgctctcat

SEQ ID NO: 6061682 - DNA, 23 bp, Homo sapiens
ccctccctctttccctcccttcc

SEQ ID NO: 6061683 - DNA, 13 bp, Homo sapiens
ccctccctgcagg

SEQ ID NO: 6061684 - DNA, 16 bp, Homo sapiens
ccctccctgcaggggc

SEQ ID NO: 6061685 - DNA, 11 bp, Homo sapiens
ccctccctgcc

SEQ ID NO: 6061686 - DNA, 20 bp, Homo sapiens
ccctccctgccgaacacaca

SEQ ID NO: 6061687 - DNA, 13 bp, Homo sapiens
ccctccctgcctg

SEQ ID NO: 6061688 - DNA, 20 bp, Homo sapiens
ccctccctgcctgagggcag

SEQ ID NO: 6061689 - DNA, 12 bp, Homo sapiens
ccctccctgcta

SEQ ID NO: 6061690 - DNA, 14 bp, Homo sapiens
ccctccctgctgtc

SEQ ID NO: 6061691 - DNA, 17 bp, Homo sapiens
ccctccctgctgtcccc

SEQ ID NO: 6061692 - DNA, 19 bp, Homo sapiens
ccctccctgctgtcccctc

SEQ ID NO: 6061693 - DNA, 20 bp, Homo sapiens
ccctccctgcttgcacactt

SEQ ID NO: 6061694 - DNA, 14 bp, Homo sapiens
ccctccctggagtg

SEQ ID NO: 6061695 - DNA, 15 bp, Homo sapiens
ccctccctggcctgt

SEQ ID NO: 6061696 - DNA, 12 bp, Homo sapiens
ccctccctgggt

SEQ ID NO: 6061697 - DNA, 11 bp, Homo sapiens
ccctccctgtc

SEQ ID NO: 6061698 - DNA, 13 bp, Homo sapiens
ccctccctgtccc

SEQ ID NO: 6061699 - DNA, 14 bp, Homo sapiens
ccctccctgtccca

SEQ ID NO: 6061700 - DNA, 15 bp, Homo sapiens
ccctcccttcacagg

SEQ ID NO: 6061701 - DNA, 20 bp, Homo sapiens
ccctcccttcctgtctattt

SEQ ID NO: 6061702 - DNA, 19 bp, Homo sapiens
ccctcccttccttgggcag

SEQ ID NO: 6061703 - DNA, 17 bp, Homo sapiens
ccctcccttctccctgg

SEQ ID NO: 6061704 - DNA, 22 bp, Homo sapiens
ccctcccttggaaacctgccct

SEQ ID NO: 6061705 - DNA, 13 bp, Homo sapiens
ccctccgacctct

SEQ ID NO: 6061706 - DNA, 13 bp, Homo sapiens
ccctccgagccgc

SEQ ID NO: 6061707 - DNA, 20 bp, Homo sapiens
ccctccgatccttcctccca

SEQ ID NO: 6061708 - DNA, 17 bp, Homo sapiens
ccctccgatgctgaggc

SEQ ID NO: 6061709 - DNA, 18 bp, Homo sapiens
ccctccgatgctgaggcc

SEQ ID NO: 6061710 - DNA, 23 bp, Homo sapiens
ccctccgcagcagggaagctctt

SEQ ID NO: 6061711 - DNA, 13 bp, Homo sapiens
ccctccgcctaga

SEQ ID NO: 6061712 - DNA, 13 bp, Homo sapiens
ccctccgcctcca

SEQ ID NO: 6061713 - DNA, 17 bp, Homo sapiens
ccctccgcctcccatcc

SEQ ID NO: 6061714 - DNA, 14 bp, Homo sapiens
ccctccgccttcac

SEQ ID NO: 6061715 - DNA, 17 bp, Homo sapiens
ccctccgcggctggagc

SEQ ID NO: 6061716 - DNA, 23 bp, Homo sapiens
ccctccggcgggtgacagctccg

SEQ ID NO: 6061717 - DNA, 13 bp, Homo sapiens
ccctccgggcaga

SEQ ID NO: 6061718 - DNA, 22 bp, Homo sapiens
ccctccgggcagagaccaccgc

SEQ ID NO: 6061719 - DNA, 16 bp, Homo sapiens
ccctccgtcctggcag

SEQ ID NO: 6061720 - DNA, 18 bp, Homo sapiens
ccctccgtggcatcacct

SEQ ID NO: 6061721 - DNA, 23 bp, Homo sapiens
ccctccgtggcatcaccttaggc

SEQ ID NO: 6061722 - DNA, 16 bp, Homo sapiens
ccctccgtgtggagca

SEQ ID NO: 6061723 - DNA, 21 bp, Homo sapiens
ccctccgttcctcctcagcct

SEQ ID NO: 6061724 - DNA, 13 bp, Homo sapiens
ccctcctaaccta

SEQ ID NO: 6061725 - DNA, 18 bp, Homo sapiens
ccctcctacccctcccag

SEQ ID NO: 6061726 - DNA, 20 bp, Homo sapiens
ccctcctacccctcccagct

SEQ ID NO: 6061727 - DNA, 19 bp, Homo sapiens
ccctcctacgcagatgctg

SEQ ID NO: 6061728 - DNA, 19 bp, Homo sapiens
ccctcctagcctgctctgc

SEQ ID NO: 6061729 - DNA, 20 bp, Homo sapiens
ccctcctatcacctcccctc

SEQ ID NO: 6061730 - DNA, 21 bp, Homo sapiens
ccctcctatcacctcccctcc

SEQ ID NO: 6061731 - DNA, 12 bp, Homo sapiens
ccctcctcacac

SEQ ID NO: 6061732 - DNA, 14 bp, Homo sapiens
ccctcctcaccccg

SEQ ID NO: 6061733 - DNA, 23 bp, Homo sapiens
ccctcctcacctctggactggct

SEQ ID NO: 6061734 - DNA, 16 bp, Homo sapiens
ccctcctcactcccta

SEQ ID NO: 6061735 - DNA, 19 bp, Homo sapiens
ccctcctcactccctaggc

SEQ ID NO: 6061736 - DNA, 14 bp, Homo sapiens
ccctcctcactggc

SEQ ID NO: 6061737 - DNA, 15 bp, Homo sapiens
ccctcctcactggcc

SEQ ID NO: 6061738 - DNA, 10 bp, Homo sapiens
ccctcctcag

SEQ ID NO: 6061739 - DNA, 13 bp, Homo sapiens
ccctcctcagcca

SEQ ID NO: 6061740 - DNA, 22 bp, Homo sapiens
ccctcctcagcgagaggcagca

SEQ ID NO: 6061741 - DNA, 13 bp, Homo sapiens
ccctcctccactc

SEQ ID NO: 6061742 - DNA, 15 bp, Homo sapiens
ccctcctccagatca

SEQ ID NO: 6061743 - DNA, 19 bp, Homo sapiens
ccctcctccagcccctgtc

SEQ ID NO: 6061744 - DNA, 17 bp, Homo sapiens
ccctcctccagccgctg

SEQ ID NO: 6061745 - DNA, 23 bp, Homo sapiens
ccctcctccagccgctggcaaca

SEQ ID NO: 6061746 - DNA, 20 bp, Homo sapiens
ccctcctccaggtcggagtg

SEQ ID NO: 6061747 - DNA, 16 bp, Homo sapiens
ccctcctccatgctgt

SEQ ID NO: 6061748 - DNA, 10 bp, Homo sapiens
ccctcctccc

SEQ ID NO: 6061749 - DNA, 12 bp, Homo sapiens
ccctcctcccat

SEQ ID NO: 6061750 - DNA, 16 bp, Homo sapiens
ccctcctcccccagtg

SEQ ID NO: 6061751 - DNA, 23 bp, Homo sapiens
ccctcctcccccggctgggcctc

SEQ ID NO: 6061752 - DNA, 14 bp, Homo sapiens
ccctcctccccgcg

SEQ ID NO: 6061753 - DNA, 19 bp, Homo sapiens
ccctcctccccttcctgca

SEQ ID NO: 6061754 - DNA, 20 bp, Homo sapiens
ccctcctccccttcctgcac

SEQ ID NO: 6061755 - DNA, 22 bp, Homo sapiens
ccctcctccccttcctgcaccc

SEQ ID NO: 6061756 - DNA, 13 bp, Homo sapiens
ccctcctccctca

SEQ ID NO: 6061757 - DNA, 15 bp, Homo sapiens
ccctcctccctcagg

SEQ ID NO: 6061758 - DNA, 22 bp, Homo sapiens
ccctcctcccttctactgcttc

SEQ ID NO: 6061759 - DNA, 12 bp, Homo sapiens
ccctcctccttt

SEQ ID NO: 6061760 - DNA, 12 bp, Homo sapiens
ccctcctcgggc

SEQ ID NO: 6061761 - DNA, 14 bp, Homo sapiens
ccctcctcgggccg

SEQ ID NO: 6061762 - DNA, 21 bp, Homo sapiens
ccctcctcgggcgcctgcgct

SEQ ID NO: 6061763 - DNA, 18 bp, Homo sapiens
ccctcctctagccatccc

SEQ ID NO: 6061764 - DNA, 19 bp, Homo sapiens
ccctcctctagccatccct

SEQ ID NO: 6061765 - DNA, 13 bp, Homo sapiens
ccctcctctccca

SEQ ID NO: 6061766 - DNA, 21 bp, Homo sapiens
ccctcctctcccgtctcgcct

SEQ ID NO: 6061767 - DNA, 22 bp, Homo sapiens
ccctcctctcccgtctcgcctg

SEQ ID NO: 6061768 - DNA, 14 bp, Homo sapiens
ccctcctctccctg

SEQ ID NO: 6061769 - DNA, 20 bp, Homo sapiens
ccctcctctcctgcccagct

SEQ ID NO: 6061770 - DNA, 19 bp, Homo sapiens
ccctcctctgaaacagctg

SEQ ID NO: 6061771 - DNA, 20 bp, Homo sapiens
ccctcctctgaaacagctgc

SEQ ID NO: 6061772 - DNA, 12 bp, Homo sapiens
ccctcctctgcc

SEQ ID NO: 6061773 - DNA, 14 bp, Homo sapiens
ccctcctctgcccc

SEQ ID NO: 6061774 - DNA, 12 bp, Homo sapiens
ccctcctctggc

SEQ ID NO: 6061775 - DNA, 13 bp, Homo sapiens
ccctcctctgtgc

SEQ ID NO: 6061776 - DNA, 15 bp, Homo sapiens
ccctcctctgtgctc

SEQ ID NO: 6061777 - DNA, 23 bp, Homo sapiens
ccctcctcttcccttagcctctc

SEQ ID NO: 6061778 - DNA, 18 bp, Homo sapiens
ccctcctcttccgagctg

SEQ ID NO: 6061779 - DNA, 17 bp, Homo sapiens
ccctcctcttcctgtag

SEQ ID NO: 6061780 - DNA, 23 bp, Homo sapiens
ccctcctgaaccgcacagctcag

SEQ ID NO: 6061781 - DNA, 18 bp, Homo sapiens
ccctcctgacccccatgt

SEQ ID NO: 6061782 - DNA, 12 bp, Homo sapiens
ccctcctgagcc

SEQ ID NO: 6061783 - DNA, 13 bp, Homo sapiens
ccctcctgagcct

SEQ ID NO: 6061784 - DNA, 24 bp, Homo sapiens
ccctcctgagcctcacctttcctg

SEQ ID NO: 6061785 - DNA, 20 bp, Homo sapiens
ccctcctgagggaggacctg

SEQ ID NO: 6061786 - DNA, 20 bp, Homo sapiens
ccctcctgattaaggcgtgg

SEQ ID NO: 6061787 - DNA, 11 bp, Homo sapiens
ccctcctgcac

SEQ ID NO: 6061788 - DNA, 15 bp, Homo sapiens
ccctcctgcacacag

SEQ ID NO: 6061789 - DNA, 20 bp, Homo sapiens
ccctcctgcacacagaatgc

SEQ ID NO: 6061790 - DNA, 16 bp, Homo sapiens
ccctcctgcacacagg

SEQ ID NO: 6061791 - DNA, 15 bp, Homo sapiens
ccctcctgcaggctg

SEQ ID NO: 6061792 - DNA, 12 bp, Homo sapiens
ccctcctgccca

SEQ ID NO: 6061793 - DNA, 21 bp, Homo sapiens
ccctcctgcccacgcagacct

SEQ ID NO: 6061794 - DNA, 14 bp, Homo sapiens
ccctcctgcccagg

SEQ ID NO: 6061795 - DNA, 20 bp, Homo sapiens
ccctcctgccgactcctggg

SEQ ID NO: 6061796 - DNA, 20 bp, Homo sapiens
ccctcctgccgctcctctct

SEQ ID NO: 6061797 - DNA, 15 bp, Homo sapiens
ccctcctgctcctcc

SEQ ID NO: 6061798 - DNA, 16 bp, Homo sapiens
ccctcctgctcctccc

SEQ ID NO: 6061799 - DNA, 18 bp, Homo sapiens
ccctcctgctcctccctg

SEQ ID NO: 6061800 - DNA, 21 bp, Homo sapiens
ccctcctgctcctccctgccc

SEQ ID NO: 6061801 - DNA, 14 bp, Homo sapiens
ccctcctgctgagc

SEQ ID NO: 6061802 - DNA, 15 bp, Homo sapiens
ccctcctgctgagct

SEQ ID NO: 6061803 - DNA, 19 bp, Homo sapiens
ccctcctgctgagctgccc

SEQ ID NO: 6061804 - DNA, 21 bp, Homo sapiens
ccctcctgctgcctaataaag

SEQ ID NO: 6061805 - DNA, 17 bp, Homo sapiens
ccctcctgctggctgag

SEQ ID NO: 6061806 - DNA, 15 bp, Homo sapiens
ccctcctgctgggcg

SEQ ID NO: 6061807 - DNA, 14 bp, Homo sapiens
ccctcctgctgtgc

SEQ ID NO: 6061808 - DNA, 15 bp, Homo sapiens
ccctcctgctgtgct

SEQ ID NO: 6061809 - DNA, 17 bp, Homo sapiens
ccctcctgctgtgctgg

SEQ ID NO: 6061810 - DNA, 13 bp, Homo sapiens
ccctcctggagca

SEQ ID NO: 6061811 - DNA, 14 bp, Homo sapiens
ccctcctggccaga

SEQ ID NO: 6061812 - DNA, 12 bp, Homo sapiens
ccctcctggcct

SEQ ID NO: 6061813 - DNA, 16 bp, Homo sapiens
ccctcctggccttcct

SEQ ID NO: 6061814 - DNA, 19 bp, Homo sapiens
ccctcctggccttcctcgt

SEQ ID NO: 6061815 - DNA, 23 bp, Homo sapiens
ccctcctggcgagttctctttgg

SEQ ID NO: 6061816 - DNA, 17 bp, Homo sapiens
ccctcctggctcacagc

SEQ ID NO: 6061817 - DNA, 11 bp, Homo sapiens
ccctcctggga

SEQ ID NO: 6061818 - DNA, 19 bp, Homo sapiens
ccctcctgggaacctcctt

SEQ ID NO: 6061819 - DNA, 19 bp, Homo sapiens
ccctcctgggatctgctcg

SEQ ID NO: 6061820 - DNA, 17 bp, Homo sapiens
ccctcctgggcccaggc

SEQ ID NO: 6061821 - DNA, 18 bp, Homo sapiens
ccctcctgggcccaggca

SEQ ID NO: 6061822 - DNA, 19 bp, Homo sapiens
ccctcctgggccctgggct

SEQ ID NO: 6061823 - DNA, 13 bp, Homo sapiens
ccctcctggggcc

SEQ ID NO: 6061824 - DNA, 12 bp, Homo sapiens
ccctcctgggtg

SEQ ID NO: 6061825 - DNA, 17 bp, Homo sapiens
ccctcctggtcctggac

SEQ ID NO: 6061826 - DNA, 13 bp, Homo sapiens
ccctcctggtgac

SEQ ID NO: 6061827 - DNA, 20 bp, Homo sapiens
ccctcctggtgtcaccccag

SEQ ID NO: 6061828 - DNA, 22 bp, Homo sapiens
ccctcctggtgtcaccccagag

SEQ ID NO: 6061829 - DNA, 12 bp, Homo sapiens
ccctcctgtctt

SEQ ID NO: 6061830 - DNA, 15 bp, Homo sapiens
ccctcctgtcttccc

SEQ ID NO: 6061831 - DNA, 18 bp, Homo sapiens
ccctcctgttgcacccag

SEQ ID NO: 6061832 - DNA, 11 bp, Homo sapiens
ccctccttcca

SEQ ID NO: 6061833 - DNA, 16 bp, Homo sapiens
ccctccttcccagctg

SEQ ID NO: 6061834 - DNA, 13 bp, Homo sapiens
ccctccttcccat

SEQ ID NO: 6061835 - DNA, 16 bp, Homo sapiens
ccctccttccccaccc

SEQ ID NO: 6061836 - DNA, 19 bp, Homo sapiens
ccctccttccccagaccca

SEQ ID NO: 6061837 - DNA, 20 bp, Homo sapiens
ccctccttccccagacccag

SEQ ID NO: 6061838 - DNA, 22 bp, Homo sapiens
ccctccttccccagacccagag

SEQ ID NO: 6061839 - DNA, 12 bp, Homo sapiens
ccctccttccct

SEQ ID NO: 6061840 - DNA, 19 bp, Homo sapiens
ccctccttccctggtccag

SEQ ID NO: 6061841 - DNA, 16 bp, Homo sapiens
ccctccttccttgacc

SEQ ID NO: 6061842 - DNA, 18 bp, Homo sapiens
ccctccttccttgaccag

SEQ ID NO: 6061843 - DNA, 12 bp, Homo sapiens
ccctccttctcc

SEQ ID NO: 6061844 - DNA, 17 bp, Homo sapiens
ccctccttctcccctcc

SEQ ID NO: 6061845 - DNA, 20 bp, Homo sapiens
ccctccttctcccctccaga

SEQ ID NO: 6061846 - DNA, 16 bp, Homo sapiens
ccctccttcttgccct

SEQ ID NO: 6061847 - DNA, 17 bp, Homo sapiens
ccctccttgcaaccagg

SEQ ID NO: 6061848 - DNA, 23 bp, Homo sapiens
ccctccttgcaaccaggcagctg

SEQ ID NO: 6061849 - DNA, 14 bp, Homo sapiens
ccctccttgccacc

SEQ ID NO: 6061850 - DNA, 15 bp, Homo sapiens
ccctccttgccaccc

SEQ ID NO: 6061851 - DNA, 12 bp, Homo sapiens
ccctccttgccg

SEQ ID NO: 6061852 - DNA, 17 bp, Homo sapiens
ccctccttgcctcctgt

SEQ ID NO: 6061853 - DNA, 20 bp, Homo sapiens
ccctccttgctctgcaggca

SEQ ID NO: 6061854 - DNA, 23 bp, Homo sapiens
ccctccttgggtcattgacctct

SEQ ID NO: 6061855 - DNA, 18 bp, Homo sapiens
ccctccttgtccacccac

SEQ ID NO: 6061856 - DNA, 13 bp, Homo sapiens
ccagccccatccc

SEQ ID NO: 6061857 - DNA, 14 bp, Homo sapiens
ccagcccccacagc

SEQ ID NO: 6061858 - DNA, 15 bp, Homo sapiens
ccagcccccacagcc

SEQ ID NO: 6061859 - DNA, 18 bp, Homo sapiens
ccagcccccacagccctg

SEQ ID NO: 6061860 - DNA, 23 bp, Homo sapiens
ccagcccccacctccgccccaga

SEQ ID NO: 6061861 - DNA, 19 bp, Homo sapiens
ccagcccccaggaagacat

SEQ ID NO: 6061862 - DNA, 14 bp, Homo sapiens
ccagcccccagtgc

SEQ ID NO: 6061863 - DNA, 13 bp, Homo sapiens
ccagcccccccac

SEQ ID NO: 6061864 - DNA, 17 bp, Homo sapiens
ccagcccccccacccac

SEQ ID NO: 6061865 - DNA, 18 bp, Homo sapiens
ccagcccccccacccacc

SEQ ID NO: 6061866 - DNA, 20 bp, Homo sapiens
ccagcccccgccccagagtg

SEQ ID NO: 6061867 - DNA, 23 bp, Homo sapiens
ccagcccccgccccagagtggcc

SEQ ID NO: 6061868 - DNA, 19 bp, Homo sapiens
ccagccccctccagctcat

SEQ ID NO: 6061869 - DNA, 20 bp, Homo sapiens
ccagccccctccagctcatg

SEQ ID NO: 6061870 - DNA, 15 bp, Homo sapiens
ccagccccctcccac

SEQ ID NO: 6061871 - DNA, 15 bp, Homo sapiens
ccagccccctcctgg

SEQ ID NO: 6061872 - DNA, 22 bp, Homo sapiens
ccagccccctcctggtgccacc

SEQ ID NO: 6061873 - DNA, 19 bp, Homo sapiens
ccagccccctgaccactca

SEQ ID NO: 6061874 - DNA, 22 bp, Homo sapiens
ccagccccctgaccactcagag

SEQ ID NO: 6061875 - DNA, 14 bp, Homo sapiens
ccagccccctggca

SEQ ID NO: 6061876 - DNA, 15 bp, Homo sapiens
ccagccccctggcat

SEQ ID NO: 6061877 - DNA, 23 bp, Homo sapiens
ccagccccctttgggcccaggga

SEQ ID NO: 6061878 - DNA, 14 bp, Homo sapiens
ccagccccgactcc

SEQ ID NO: 6061879 - DNA, 17 bp, Homo sapiens
ccagccccgactccagc

SEQ ID NO: 6061880 - DNA, 18 bp, Homo sapiens
ccagccccgactccagcc

SEQ ID NO: 6061881 - DNA, 21 bp, Homo sapiens
ccagccccgactccagccagc

SEQ ID NO: 6061882 - DNA, 22 bp, Homo sapiens
ccagccccgactccagccagcg

SEQ ID NO: 6061883 - DNA, 15 bp, Homo sapiens
ccagccccgctccca

SEQ ID NO: 6061884 - DNA, 17 bp, Homo sapiens
ccagccccgtcccagag

SEQ ID NO: 6061885 - DNA, 14 bp, Homo sapiens
ccagcccctactgc

SEQ ID NO: 6061886 - DNA, 12 bp, Homo sapiens
ccagcccctaga

SEQ ID NO: 6061887 - DNA, 21 bp, Homo sapiens
ccagcccctagaaacccaagc

SEQ ID NO: 6061888 - DNA, 23 bp, Homo sapiens
ccagcccctagatgaagaaagag

SEQ ID NO: 6061889 - DNA, 18 bp, Homo sapiens
ccagcccctagcccagga

SEQ ID NO: 6061890 - DNA, 11 bp, Homo sapiens
ccagcccctcc

SEQ ID NO: 6061891 - DNA, 13 bp, Homo sapiens
ccagcccctccag

SEQ ID NO: 6061892 - DNA, 12 bp, Homo sapiens
ccagcccctccc

SEQ ID NO: 6061893 - DNA, 16 bp, Homo sapiens
ccagcccctcccacca

SEQ ID NO: 6061894 - DNA, 18 bp, Homo sapiens
ccagcccctcccccatct

SEQ ID NO: 6061895 - DNA, 21 bp, Homo sapiens
ccagcccctcccccatctccc

SEQ ID NO: 6061896 - DNA, 23 bp, Homo sapiens
ccagcccctccccgcctcctccc

SEQ ID NO: 6061897 - DNA, 14 bp, Homo sapiens
ccagcccctcctcc

SEQ ID NO: 6061898 - DNA, 15 bp, Homo sapiens
ccagcccctcctccc

SEQ ID NO: 6061899 - DNA, 24 bp, Homo sapiens
ccagcccctcctccccttcctgca

SEQ ID NO: 6061900 - DNA, 16 bp, Homo sapiens
ccagcccctcctccct

SEQ ID NO: 6061901 - DNA, 17 bp, Homo sapiens
ccagcccctcctccctc

SEQ ID NO: 6061902 - DNA, 19 bp, Homo sapiens
ccagcccctcctccctcaa

SEQ ID NO: 6061903 - DNA, 20 bp, Homo sapiens
ccagcccctcctccctcaga

SEQ ID NO: 6061904 - DNA, 21 bp, Homo sapiens
ccagcccctctcccctctctg

SEQ ID NO: 6061905 - DNA, 22 bp, Homo sapiens
ccagcccctctggtcgctcctg

SEQ ID NO: 6061906 - DNA, 18 bp, Homo sapiens
ccagcccctcttggagaa

SEQ ID NO: 6061907 - DNA, 20 bp, Homo sapiens
ccagcccctcttggagaagt

SEQ ID NO: 6061908 - DNA, 21 bp, Homo sapiens
ccagcccctcttggagaagtc

SEQ ID NO: 6061909 - DNA, 14 bp, Homo sapiens
ccagcccctgcaga

SEQ ID NO: 6061910 - DNA, 13 bp, Homo sapiens
ccagcccctgccc

SEQ ID NO: 6061911 - DNA, 16 bp, Homo sapiens
ccagcccctgcccctc

SEQ ID NO: 6061912 - DNA, 13 bp, Homo sapiens
ccagcccctgctg

SEQ ID NO: 6061913 - DNA, 14 bp, Homo sapiens
ccagcccctggacc

SEQ ID NO: 6061914 - DNA, 18 bp, Homo sapiens
ccagcccctggggcccag

SEQ ID NO: 6061915 - DNA, 12 bp, Homo sapiens
ccagcccctgta

SEQ ID NO: 6061916 - DNA, 19 bp, Homo sapiens
ccagcccctgtatggcact

SEQ ID NO: 6061917 - DNA, 18 bp, Homo sapiens
ccagccccttagacagag

SEQ ID NO: 6061918 - DNA, 19 bp, Homo sapiens
ccagccccttcaattattt

SEQ ID NO: 6061919 - DNA, 13 bp, Homo sapiens
ccagccccttccc

SEQ ID NO: 6061920 - DNA, 20 bp, Homo sapiens
ccagccccttcccctgggaa

SEQ ID NO: 6061921 - DNA, 21 bp, Homo sapiens
ccagccccttcccctgggaac

SEQ ID NO: 6061922 - DNA, 15 bp, Homo sapiens
ccagccccttcctgg

SEQ ID NO: 6061923 - DNA, 16 bp, Homo sapiens
ccagccccttcctggg

SEQ ID NO: 6061924 - DNA, 17 bp, Homo sapiens
ccagccccttcctgggt

SEQ ID NO: 6061925 - DNA, 18 bp, Homo sapiens
ccagccccttcctgggta

SEQ ID NO: 6061926 - DNA, 21 bp, Homo sapiens
ccagccccttctcagaatcta

SEQ ID NO: 6061927 - DNA, 15 bp, Homo sapiens
ccagccccttctccc

SEQ ID NO: 6061928 - DNA, 21 bp, Homo sapiens
ccagccccttctcccagcaca

SEQ ID NO: 6061929 - DNA, 15 bp, Homo sapiens
ccagccccttctgac

SEQ ID NO: 6061930 - DNA, 23 bp, Homo sapiens
ccagccccttctgacccatgctg

SEQ ID NO: 6061931 - DNA, 16 bp, Homo sapiens
ccagccccttgcttca

SEQ ID NO: 6061932 - DNA, 21 bp, Homo sapiens
ccagcccctttgcctctgtcc

SEQ ID NO: 6061933 - DNA, 17 bp, Homo sapiens
ccagccccttttctctg

SEQ ID NO: 6061934 - DNA, 15 bp, Homo sapiens
ccagcccgcaactct

SEQ ID NO: 6061935 - DNA, 14 bp, Homo sapiens
ccagcccgcggcct

SEQ ID NO: 6061936 - DNA, 16 bp, Homo sapiens
ccagcccgcggcctgg

SEQ ID NO: 6061937 - DNA, 18 bp, Homo sapiens
ccagcccgcggcctggac

SEQ ID NO: 6061938 - DNA, 17 bp, Homo sapiens
ccagcccggacctctgg

SEQ ID NO: 6061939 - DNA, 13 bp, Homo sapiens
ccagcccggcctg

SEQ ID NO: 6061940 - DNA, 20 bp, Homo sapiens
ccagcccggcctgctcccag

SEQ ID NO: 6061941 - DNA, 21 bp, Homo sapiens
ccagcccggctcggcccagca

SEQ ID NO: 6061942 - DNA, 13 bp, Homo sapiens
ccagcccgggagc

SEQ ID NO: 6061943 - DNA, 16 bp, Homo sapiens
ccagcccgggagccta

SEQ ID NO: 6061944 - DNA, 21 bp, Homo sapiens
ccagcccgggagcctaggacc

SEQ ID NO: 6061945 - DNA, 18 bp, Homo sapiens
ccagccctactctgtgta

SEQ ID NO: 6061946 - DNA, 14 bp, Homo sapiens
ccagccctagctgt

SEQ ID NO: 6061947 - DNA, 17 bp, Homo sapiens
ccagccctagctgtccc

SEQ ID NO: 6061948 - DNA, 18 bp, Homo sapiens
ccagccctagctgtccca

SEQ ID NO: 6061949 - DNA, 23 bp, Homo sapiens
ccagccctagctgtcccatgggg

SEQ ID NO: 6061950 - DNA, 15 bp, Homo sapiens
ccagccctatggatg

SEQ ID NO: 6061951 - DNA, 12 bp, Homo sapiens
ccagccctcagc

SEQ ID NO: 6061952 - DNA, 16 bp, Homo sapiens
ccagccctcaggccag

SEQ ID NO: 6061953 - DNA, 19 bp, Homo sapiens
ccagccctcaggccagtgc

SEQ ID NO: 6061954 - DNA, 21 bp, Homo sapiens
ccagccctcaggccagtgcca

SEQ ID NO: 6061955 - DNA, 19 bp, Homo sapiens
ccagccctcagtcaccccc

SEQ ID NO: 6061956 - DNA, 13 bp, Homo sapiens
ccagccctcatcc

SEQ ID NO: 6061957 - DNA, 14 bp, Homo sapiens
ccagccctccagag

SEQ ID NO: 6061958 - DNA, 15 bp, Homo sapiens
ccagccctccagagc

SEQ ID NO: 6061959 - DNA, 17 bp, Homo sapiens
ccagccctcccagctgg

SEQ ID NO: 6061960 - DNA, 21 bp, Homo sapiens
ccagccctccctggctgtgag

SEQ ID NO: 6061961 - DNA, 24 bp, Homo sapiens
ccagccctccctggctgtgagcag

SEQ ID NO: 6061962 - DNA, 16 bp, Homo sapiens
ccagccctccctgtcc

SEQ ID NO: 6061963 - DNA, 13 bp, Homo sapiens
ccagccctccgcc

SEQ ID NO: 6061964 - DNA, 19 bp, Homo sapiens
ccagccctccgccagccct

SEQ ID NO: 6061965 - DNA, 12 bp, Homo sapiens
ccagccctccta

SEQ ID NO: 6061966 - DNA, 18 bp, Homo sapiens
ccagccctccttcagggg

SEQ ID NO: 6061967 - DNA, 13 bp, Homo sapiens
ccagccctctgtg

SEQ ID NO: 6061968 - DNA, 23 bp, Homo sapiens
ccagccctctgtggccaggagcc

SEQ ID NO: 6061969 - DNA, 16 bp, Homo sapiens
ccagccctgagccatg

SEQ ID NO: 6061970 - DNA, 14 bp, Homo sapiens
ccagccctgagttc

SEQ ID NO: 6061971 - DNA, 15 bp, Homo sapiens
ccagccctgcacgac

SEQ ID NO: 6061972 - DNA, 18 bp, Homo sapiens
ccagccctgcccaccctc

SEQ ID NO: 6061973 - DNA, 16 bp, Homo sapiens
ccagccctgcccagag

SEQ ID NO: 6061974 - DNA, 15 bp, Homo sapiens
ccagccctgcctgga

SEQ ID NO: 6061975 - DNA, 16 bp, Homo sapiens
ccagccctgcctggag

SEQ ID NO: 6061976 - DNA, 18 bp, Homo sapiens
ccagccctgcctggagga

SEQ ID NO: 6061977 - DNA, 11 bp, Homo sapiens
ccagccctgct

SEQ ID NO: 6061978 - DNA, 15 bp, Homo sapiens
ccagccctgctggcc

SEQ ID NO: 6061979 - DNA, 17 bp, Homo sapiens
ccagccctgctggggat

SEQ ID NO: 6061980 - DNA, 19 bp, Homo sapiens
ccagccctgctggggatcc

SEQ ID NO: 6061981 - DNA, 10 bp, Homo sapiens
ccagccctgg

SEQ ID NO: 6061982 - DNA, 12 bp, Homo sapiens
ccagccctggag

SEQ ID NO: 6061983 - DNA, 13 bp, Homo sapiens
ccagccctggagg

SEQ ID NO: 6061984 - DNA, 18 bp, Homo sapiens
ccagccctggaggctgga

SEQ ID NO: 6061985 - DNA, 22 bp, Homo sapiens
ccagccctggaggctggatggc

SEQ ID NO: 6061986 - DNA, 15 bp, Homo sapiens
ccagccctggcccag

SEQ ID NO: 6061987 - DNA, 16 bp, Homo sapiens
ccagccctggcccagg

SEQ ID NO: 6061988 - DNA, 18 bp, Homo sapiens
ccagccctggcccaggtg

SEQ ID NO: 6061989 - DNA, 19 bp, Homo sapiens
ccagccctggcccaggtgc

SEQ ID NO: 6061990 - DNA, 15 bp, Homo sapiens
ccagccctggcccct

SEQ ID NO: 6061991 - DNA, 12 bp, Homo sapiens
ccagccctggct

SEQ ID NO: 6061992 - DNA, 15 bp, Homo sapiens
ccagccctgggaacc

SEQ ID NO: 6061993 - DNA, 22 bp, Homo sapiens
ccagccctgggaaccactccca

SEQ ID NO: 6061994 - DNA, 12 bp, Homo sapiens
ccagccctgggc

SEQ ID NO: 6061995 - DNA, 16 bp, Homo sapiens
ccagccctgggcaagg

SEQ ID NO: 6061996 - DNA, 17 bp, Homo sapiens
ccagccctgggcttggc

SEQ ID NO: 6061997 - DNA, 22 bp, Homo sapiens
ccagccctgggcttggctcttg

SEQ ID NO: 6061998 - DNA, 12 bp, Homo sapiens
ccagccctggtg

SEQ ID NO: 6061999 - DNA, 15 bp, Homo sapiens
ccagccctgtcctgg

SEQ ID NO: 6062000 - DNA, 15 bp, Homo sapiens
ccagccctgtggaag

SEQ ID NO: 6062001 - DNA, 22 bp, Homo sapiens
ccagccctgttccgcctcactg

SEQ ID NO: 6062002 - DNA, 11 bp, Homo sapiens
ccagcccttag

SEQ ID NO: 6062003 - DNA, 18 bp, Homo sapiens
ccagcccttagcacagag

SEQ ID NO: 6062004 - DNA, 23 bp, Homo sapiens
ccagcccttagcacagagaggga

SEQ ID NO: 6062005 - DNA, 17 bp, Homo sapiens
ccagcccttagcaggga

SEQ ID NO: 6062006 - DNA, 16 bp, Homo sapiens
ccagcccttcaggaag

SEQ ID NO: 6062007 - DNA, 17 bp, Homo sapiens
ccagcccttcaggaagc

SEQ ID NO: 6062008 - DNA, 18 bp, Homo sapiens
ccagcccttcaggaagca

SEQ ID NO: 6062009 - DNA, 21 bp, Homo sapiens
ccagcccttcccaggccagcg

SEQ ID NO: 6062010 - DNA, 14 bp, Homo sapiens
ccagcccttcccca

SEQ ID NO: 6062011 - DNA, 15 bp, Homo sapiens
ccagcccttccctgc

SEQ ID NO: 6062012 - DNA, 16 bp, Homo sapiens
ccagcccttccctggc

SEQ ID NO: 6062013 - DNA, 15 bp, Homo sapiens
ccagcccttcctctc

SEQ ID NO: 6062014 - DNA, 18 bp, Homo sapiens
ccagcccttcctctcact

SEQ ID NO: 6062015 - DNA, 21 bp, Homo sapiens
ccagcccttcctctcactcct

SEQ ID NO: 6062016 - DNA, 14 bp, Homo sapiens
ccagcccttccttg

SEQ ID NO: 6062017 - DNA, 17 bp, Homo sapiens
ccagcccttccttgggc

SEQ ID NO: 6062018 - DNA, 19 bp, Homo sapiens
ccagcccttctgcctttct

SEQ ID NO: 6062019 - DNA, 23 bp, Homo sapiens
ccagccctttgcaggcccagcag

SEQ ID NO: 6062020 - DNA, 20 bp, Homo sapiens
ccagccctttgggaggctga

SEQ ID NO: 6062021 - DNA, 20 bp, Homo sapiens
ccagccgaagctgcaggggc

SEQ ID NO: 6062022 - DNA, 14 bp, Homo sapiens
ccagccgaccccct

SEQ ID NO: 6062023 - DNA, 22 bp, Homo sapiens
ccagccgaccctcctggccttc

SEQ ID NO: 6062024 - DNA, 20 bp, Homo sapiens
ccagccgagatagccaaggc

SEQ ID NO: 6062025 - DNA, 22 bp, Homo sapiens
ccagccgagatagccaaggcca

SEQ ID NO: 6062026 - DNA, 22 bp, Homo sapiens
ccagccgagcgagaaccaggct

SEQ ID NO: 6062027 - DNA, 15 bp, Homo sapiens
ccagccgattcctcc

SEQ ID NO: 6062028 - DNA, 17 bp, Homo sapiens
ccagccgattcctccag

SEQ ID NO: 6062029 - DNA, 21 bp, Homo sapiens
ccagccgattcctccagccct

SEQ ID NO: 6062030 - DNA, 23 bp, Homo sapiens
ccagccgcaatctggctcctcct

SEQ ID NO: 6062031 - DNA, 14 bp, Homo sapiens
ccagccgccatgct

SEQ ID NO: 6062032 - DNA, 19 bp, Homo sapiens
ccagccgccatgctcctgg

SEQ ID NO: 6062033 - DNA, 23 bp, Homo sapiens
ccagccgccattgccaccaggag

SEQ ID NO: 6062034 - DNA, 18 bp, Homo sapiens
ccagccgcccacccccac

SEQ ID NO: 6062035 - DNA, 12 bp, Homo sapiens
ccctccttgtct

SEQ ID NO: 6062036 - DNA, 23 bp, Homo sapiens
ccctccttgtctagtttcccaca

SEQ ID NO: 6062037 - DNA, 19 bp, Homo sapiens
ccctccttgtgctgccagt

SEQ ID NO: 6062038 - DNA, 23 bp, Homo sapiens
ccctcctttaccgaggacagcct

SEQ ID NO: 6062039 - DNA, 20 bp, Homo sapiens
ccctcctttcccaacacttc

SEQ ID NO: 6062040 - DNA, 15 bp, Homo sapiens
ccctcctttcctttg

SEQ ID NO: 6062041 - DNA, 14 bp, Homo sapiens
ccctcctttgtctt

SEQ ID NO: 6062042 - DNA, 13 bp, Homo sapiens
ccctcctttgttt

SEQ ID NO: 6062043 - DNA, 18 bp, Homo sapiens
ccctcgaaccaaggcagc

SEQ ID NO: 6062044 - DNA, 20 bp, Homo sapiens
ccctcgaaccaaggcagcct

SEQ ID NO: 6062045 - DNA, 24 bp, Homo sapiens
ccctcgaaccaaggcagcctccag

SEQ ID NO: 6062046 - DNA, 23 bp, Homo sapiens
ccctcgacagcgcccctgctgtc

SEQ ID NO: 6062047 - DNA, 17 bp, Homo sapiens
ccctcgacagctctctg

SEQ ID NO: 6062048 - DNA, 16 bp, Homo sapiens
ccctcgaccctgtgca

SEQ ID NO: 6062049 - DNA, 17 bp, Homo sapiens
ccctcgaccctgtgcag

SEQ ID NO: 6062050 - DNA, 15 bp, Homo sapiens
ccctcgactcagcac

SEQ ID NO: 6062051 - DNA, 17 bp, Homo sapiens
ccctcgactcagcacca

SEQ ID NO: 6062052 - DNA, 19 bp, Homo sapiens
ccctcgacttgaccctttc

SEQ ID NO: 6062053 - DNA, 22 bp, Homo sapiens
ccctcgagctctgtagcctggt

SEQ ID NO: 6062054 - DNA, 16 bp, Homo sapiens
ccctcgaggcctacag

SEQ ID NO: 6062055 - DNA, 17 bp, Homo sapiens
ccctcgaggcctacaga

SEQ ID NO: 6062056 - DNA, 17 bp, Homo sapiens
ccctcgcaaccctgcct

SEQ ID NO: 6062057 - DNA, 16 bp, Homo sapiens
ccctcgcacacagggc

SEQ ID NO: 6062058 - DNA, 23 bp, Homo sapiens
ccctcgcacacagggctcacagg

SEQ ID NO: 6062059 - DNA, 13 bp, Homo sapiens
ccctcgcagacct

SEQ ID NO: 6062060 - DNA, 21 bp, Homo sapiens
ccctcgcatccgcctctgagc

SEQ ID NO: 6062061 - DNA, 21 bp, Homo sapiens
ccctcgccagcttctcctgcg

SEQ ID NO: 6062062 - DNA, 22 bp, Homo sapiens
ccctcgccagcttctcctgcgc

SEQ ID NO: 6062063 - DNA, 20 bp, Homo sapiens
ccctcgcccagtcccagcag

SEQ ID NO: 6062064 - DNA, 22 bp, Homo sapiens
ccctcgcccagtcccagcagcc

SEQ ID NO: 6062065 - DNA, 21 bp, Homo sapiens
ccctcgccccaaagttgctca

SEQ ID NO: 6062066 - DNA, 13 bp, Homo sapiens
ccctcgccccagc

SEQ ID NO: 6062067 - DNA, 15 bp, Homo sapiens
ccctcgccctgtgag

SEQ ID NO: 6062068 - DNA, 20 bp, Homo sapiens
ccctcgcctcctcctcctgc

SEQ ID NO: 6062069 - DNA, 13 bp, Homo sapiens
ccctcgctgccac

SEQ ID NO: 6062070 - DNA, 14 bp, Homo sapiens
ccctcgctgccacc

SEQ ID NO: 6062071 - DNA, 17 bp, Homo sapiens
ccctcgctgcttctgtg

SEQ ID NO: 6062072 - DNA, 14 bp, Homo sapiens
ccctcgctggcccc

SEQ ID NO: 6062073 - DNA, 15 bp, Homo sapiens
ccctcgctggccccc

SEQ ID NO: 6062074 - DNA, 17 bp, Homo sapiens
ccctcgctggcccccac

SEQ ID NO: 6062075 - DNA, 20 bp, Homo sapiens
ccctcgctggcccccactgg

SEQ ID NO: 6062076 - DNA, 21 bp, Homo sapiens
ccctcgctggcccccactggc

SEQ ID NO: 6062077 - DNA, 23 bp, Homo sapiens
ccctcgctggcccccactggctg

SEQ ID NO: 6062078 - DNA, 16 bp, Homo sapiens
ccctcgctgtcctgct

SEQ ID NO: 6062079 - DNA, 19 bp, Homo sapiens
ccctcgctgtcctgctgtg

SEQ ID NO: 6062080 - DNA, 20 bp, Homo sapiens
ccctcgcttcataggcagag

SEQ ID NO: 6062081 - DNA, 21 bp, Homo sapiens
ccctcggaagccgtctgactc

SEQ ID NO: 6062082 - DNA, 22 bp, Homo sapiens
ccctcggaagccgtctgactcc

SEQ ID NO: 6062083 - DNA, 23 bp, Homo sapiens
ccctcggaagccgtctgactcca

SEQ ID NO: 6062084 - DNA, 13 bp, Homo sapiens
ccctcggagaaga

SEQ ID NO: 6062085 - DNA, 14 bp, Homo sapiens
ccctcggagccccc

SEQ ID NO: 6062086 - DNA, 16 bp, Homo sapiens
ccctcggagcccccca

SEQ ID NO: 6062087 - DNA, 21 bp, Homo sapiens
ccctcggagccccccactcag

SEQ ID NO: 6062088 - DNA, 15 bp, Homo sapiens
ccctcggagctggct

SEQ ID NO: 6062089 - DNA, 19 bp, Homo sapiens
ccctcggagctggctgtgc

SEQ ID NO: 6062090 - DNA, 19 bp, Homo sapiens
ccctcggaggtccagctgg

SEQ ID NO: 6062091 - DNA, 18 bp, Homo sapiens
ccctcggagttcttcttg

SEQ ID NO: 6062092 - DNA, 20 bp, Homo sapiens
ccctcggcaaccgtggggag

SEQ ID NO: 6062093 - DNA, 19 bp, Homo sapiens
ccctcggcattcacacaca

SEQ ID NO: 6062094 - DNA, 22 bp, Homo sapiens
ccctcggcattcacacacagcc

SEQ ID NO: 6062095 - DNA, 16 bp, Homo sapiens
ccctcggcccctcacc

SEQ ID NO: 6062096 - DNA, 17 bp, Homo sapiens
ccctcggcccctcacca

SEQ ID NO: 6062097 - DNA, 20 bp, Homo sapiens
ccctcggcccctcaccacct

SEQ ID NO: 6062098 - DNA, 22 bp, Homo sapiens
ccctcggcctccgaggctcccc

SEQ ID NO: 6062099 - DNA, 13 bp, Homo sapiens
ccctcggctctgg

SEQ ID NO: 6062100 - DNA, 19 bp, Homo sapiens
ccctcgggaagcagccagc

SEQ ID NO: 6062101 - DNA, 18 bp, Homo sapiens
ccctcgggaccctcccag

SEQ ID NO: 6062102 - DNA, 16 bp, Homo sapiens
ccctcgggcccacctg

SEQ ID NO: 6062103 - DNA, 13 bp, Homo sapiens
ccctcgggcccag

SEQ ID NO: 6062104 - DNA, 20 bp, Homo sapiens
ccctcggggatgtgtcctga

SEQ ID NO: 6062105 - DNA, 17 bp, Homo sapiens
ccctcgggggctcttcc

SEQ ID NO: 6062106 - DNA, 23 bp, Homo sapiens
ccctcggggggtcacaggcccag

SEQ ID NO: 6062107 - DNA, 19 bp, Homo sapiens
ccctcggggtgtcagaaat

SEQ ID NO: 6062108 - DNA, 21 bp, Homo sapiens
ccctcgggtctccccacctgc

SEQ ID NO: 6062109 - DNA, 18 bp, Homo sapiens
ccctcgggtggggctggt

SEQ ID NO: 6062110 - DNA, 21 bp, Homo sapiens
ccctcgggtggggctggtggg

SEQ ID NO: 6062111 - DNA, 22 bp, Homo sapiens
ccctcggtcacctgtgctacct

SEQ ID NO: 6062112 - DNA, 20 bp, Homo sapiens
ccctcggtcagcaccgtggt

SEQ ID NO: 6062113 - DNA, 18 bp, Homo sapiens
ccctcggtggctgcacag

SEQ ID NO: 6062114 - DNA, 15 bp, Homo sapiens
ccctcgtccacaggg

SEQ ID NO: 6062115 - DNA, 20 bp, Homo sapiens
ccctcgtccaccccccacac

SEQ ID NO: 6062116 - DNA, 18 bp, Homo sapiens
ccctcgtccgtctgtctc

SEQ ID NO: 6062117 - DNA, 19 bp, Homo sapiens
ccctcgtccgtctgtctcg

SEQ ID NO: 6062118 - DNA, 17 bp, Homo sapiens
ccctcgtcctgtcccag

SEQ ID NO: 6062119 - DNA, 15 bp, Homo sapiens
ccctcgtctttccca

SEQ ID NO: 6062120 - DNA, 21 bp, Homo sapiens
ccctcgtctttcccaaaggca

SEQ ID NO: 6062121 - DNA, 23 bp, Homo sapiens
ccctcgtggacacctgccctgcc

SEQ ID NO: 6062122 - DNA, 16 bp, Homo sapiens
ccctcgtggccagccc

SEQ ID NO: 6062123 - DNA, 19 bp, Homo sapiens
ccctcgtggccagcccggc

SEQ ID NO: 6062124 - DNA, 15 bp, Homo sapiens
ccctcgtggccttcc

SEQ ID NO: 6062125 - DNA, 20 bp, Homo sapiens
ccctcgtggtccccaacagc

SEQ ID NO: 6062126 - DNA, 22 bp, Homo sapiens
ccctcgtgtcagctcaggcagc

SEQ ID NO: 6062127 - DNA, 15 bp, Homo sapiens
ccctcgtttgatagt

SEQ ID NO: 6062128 - DNA, 23 bp, Homo sapiens
ccctctaacccccagtgccacag

SEQ ID NO: 6062129 - DNA, 18 bp, Homo sapiens
ccctctaactggacagcc

SEQ ID NO: 6062130 - DNA, 21 bp, Homo sapiens
ccctctaagcacattccaaac

SEQ ID NO: 6062131 - DNA, 13 bp, Homo sapiens
ccctctacaggtc

SEQ ID NO: 6062132 - DNA, 18 bp, Homo sapiens
ccctctactcttcctgtc

SEQ ID NO: 6062133 - DNA, 19 bp, Homo sapiens
ccctctagaaatttttcag

SEQ ID NO: 6062134 - DNA, 15 bp, Homo sapiens
ccctctaggctctgc

SEQ ID NO: 6062135 - DNA, 10 bp, Homo sapiens
ccctctaggg

SEQ ID NO: 6062136 - DNA, 16 bp, Homo sapiens
ccctctatgctggctt

SEQ ID NO: 6062137 - DNA, 20 bp, Homo sapiens
ccctctatttattagccaac

SEQ ID NO: 6062138 - DNA, 17 bp, Homo sapiens
ccctctcaacacccagt

SEQ ID NO: 6062139 - DNA, 13 bp, Homo sapiens
ccctctcactcca

SEQ ID NO: 6062140 - DNA, 21 bp, Homo sapiens
ccctctcactccagccaaaga

SEQ ID NO: 6062141 - DNA, 23 bp, Homo sapiens
ccctctcagaggcctgctgccag

SEQ ID NO: 6062142 - DNA, 14 bp, Homo sapiens
ccctctcagctcca

SEQ ID NO: 6062143 - DNA, 10 bp, Homo sapiens
ccctctcagg

SEQ ID NO: 6062144 - DNA, 21 bp, Homo sapiens
ccctctcaggcatgcctgtgt

SEQ ID NO: 6062145 - DNA, 22 bp, Homo sapiens
ccctctcaggcatgcctgtgtg

SEQ ID NO: 6062146 - DNA, 21 bp, Homo sapiens
ccctctcatccaggtcctttc

SEQ ID NO: 6062147 - DNA, 16 bp, Homo sapiens
ccctctcatctcaggt

SEQ ID NO: 6062148 - DNA, 20 bp, Homo sapiens
ccctctcatctcaggtagaa

SEQ ID NO: 6062149 - DNA, 17 bp, Homo sapiens
ccctctcatgtccctcc

SEQ ID NO: 6062150 - DNA, 18 bp, Homo sapiens
ccctctcatgtccctcca

SEQ ID NO: 6062151 - DNA, 15 bp, Homo sapiens
ccctctccaagacag

SEQ ID NO: 6062152 - DNA, 21 bp, Homo sapiens
ccctctccaagacagcagcag

SEQ ID NO: 6062153 - DNA, 21 bp, Homo sapiens
ccctctccaagcgcctggctt

SEQ ID NO: 6062154 - DNA, 16 bp, Homo sapiens
ccctctccacacccag

SEQ ID NO: 6062155 - DNA, 15 bp, Homo sapiens
ccctctccacccaga

SEQ ID NO: 6062156 - DNA, 16 bp, Homo sapiens
ccctctccacccagag

SEQ ID NO: 6062157 - DNA, 19 bp, Homo sapiens
ccctctccacccagaggtc

SEQ ID NO: 6062158 - DNA, 16 bp, Homo sapiens
ccctctccagcctgct

SEQ ID NO: 6062159 - DNA, 13 bp, Homo sapiens
ccctctccatgcc

SEQ ID NO: 6062160 - DNA, 13 bp, Homo sapiens
ccctctcccaccc

SEQ ID NO: 6062161 - DNA, 14 bp, Homo sapiens
ccctctcccaggcc

SEQ ID NO: 6062162 - DNA, 18 bp, Homo sapiens
ccctctcccagtccattt

SEQ ID NO: 6062163 - DNA, 20 bp, Homo sapiens
ccctctccccacccctaccc

SEQ ID NO: 6062164 - DNA, 11 bp, Homo sapiens
ccctctcccct

SEQ ID NO: 6062165 - DNA, 10 bp, Homo sapiens
ccctctccct

SEQ ID NO: 6062166 - DNA, 15 bp, Homo sapiens
ccctctccctctctc

SEQ ID NO: 6062167 - DNA, 18 bp, Homo sapiens
ccctctccctctctctgg

SEQ ID NO: 6062168 - DNA, 14 bp, Homo sapiens
ccctctccctgcat

SEQ ID NO: 6062169 - DNA, 14 bp, Homo sapiens
ccctctccctgtgt

SEQ ID NO: 6062170 - DNA, 13 bp, Homo sapiens
ccctctcctccca

SEQ ID NO: 6062171 - DNA, 19 bp, Homo sapiens
ccctctcctcccagctgct

SEQ ID NO: 6062172 - DNA, 15 bp, Homo sapiens
ccctctcctccctct

SEQ ID NO: 6062173 - DNA, 13 bp, Homo sapiens
ccctctcctctgc

SEQ ID NO: 6062174 - DNA, 19 bp, Homo sapiens
ccctctcctgcccagatgc

SEQ ID NO: 6062175 - DNA, 15 bp, Homo sapiens
ccctctcctgcttcc

SEQ ID NO: 6062176 - DNA, 11 bp, Homo sapiens
ccctctcctgg

SEQ ID NO: 6062177 - DNA, 13 bp, Homo sapiens
ccctctcctggac

SEQ ID NO: 6062178 - DNA, 14 bp, Homo sapiens
ccctctcctgggca

SEQ ID NO: 6062179 - DNA, 21 bp, Homo sapiens
ccctctcctgggcagctgcct

SEQ ID NO: 6062180 - DNA, 13 bp, Homo sapiens
ccctctcctgggg

SEQ ID NO: 6062181 - DNA, 21 bp, Homo sapiens
ccctctcctttgttcccggct

SEQ ID NO: 6062182 - DNA, 22 bp, Homo sapiens
ccctctcgccccatccctgctt

SEQ ID NO: 6062183 - DNA, 15 bp, Homo sapiens
ccctctcgcctcatt

SEQ ID NO: 6062184 - DNA, 19 bp, Homo sapiens
ccctctcgctcccctctgc

SEQ ID NO: 6062185 - DNA, 16 bp, Homo sapiens
ccctctctagggaccc

SEQ ID NO: 6062186 - DNA, 24 bp, Homo sapiens
ccctctctatcggggtcacttgca

SEQ ID NO: 6062187 - DNA, 14 bp, Homo sapiens
ccctctctcaccag

SEQ ID NO: 6062188 - DNA, 12 bp, Homo sapiens
ccctctctccct

SEQ ID NO: 6062189 - DNA, 18 bp, Homo sapiens
ccctctctctcactcccc

SEQ ID NO: 6062190 - DNA, 11 bp, Homo sapiens
ccctctctctg

SEQ ID NO: 6062191 - DNA, 15 bp, Homo sapiens
ccctctctctgactc

SEQ ID NO: 6062192 - DNA, 18 bp, Homo sapiens
ccctctctctgactctca

SEQ ID NO: 6062193 - DNA, 19 bp, Homo sapiens
ccctctctcttctgctcca

SEQ ID NO: 6062194 - DNA, 22 bp, Homo sapiens
ccctctctcttctgctccaccc

SEQ ID NO: 6062195 - DNA, 12 bp, Homo sapiens
ccctctctgcag

SEQ ID NO: 6062196 - DNA, 13 bp, Homo sapiens
ccctctctgcagt

SEQ ID NO: 6062197 - DNA, 15 bp, Homo sapiens
ccctctctgcccctg

SEQ ID NO: 6062198 - DNA, 16 bp, Homo sapiens
ccctctctgcccctga

SEQ ID NO: 6062199 - DNA, 13 bp, Homo sapiens
ccctctctgccct

SEQ ID NO: 6062200 - DNA, 16 bp, Homo sapiens
ccctctctgctccttc

SEQ ID NO: 6062201 - DNA, 13 bp, Homo sapiens
ccctctctggacc

SEQ ID NO: 6062202 - DNA, 14 bp, Homo sapiens
ccctctctggacct

SEQ ID NO: 6062203 - DNA, 14 bp, Homo sapiens
ccctctctggagaa

SEQ ID NO: 6062204 - DNA, 13 bp, Homo sapiens
ccctctctgggcc

SEQ ID NO: 6062205 - DNA, 19 bp, Homo sapiens
ccctctctgggcctcagag

SEQ ID NO: 6062206 - DNA, 18 bp, Homo sapiens
ccctctcttaatgccacg

SEQ ID NO: 6062207 - DNA, 13 bp, Homo sapiens
ccctctcttccct

SEQ ID NO: 6062208 - DNA, 14 bp, Homo sapiens
ccctctcttgcctt

SEQ ID NO: 6062209 - DNA, 12 bp, Homo sapiens
ccctctcttggc

SEQ ID NO: 6062210 - DNA, 12 bp, Homo sapiens
ccctctctttct

SEQ ID NO: 6062211 - DNA, 15 bp, Homo sapiens
ccctctctttctctg

SEQ ID NO: 6062212 - DNA, 21 bp, Homo sapiens
ccctctcttttgaggctctct

SEQ ID NO: 6062213 - DNA, 19 bp, Homo sapiens
ccctctgaaagttgtacat

SEQ ID NO: 6062214 - DNA, 16 bp, Homo sapiens
ccctctgacctgcact

SEQ ID NO: 6062215 - DNA, 18 bp, Homo sapiens
ccctctgagacagagagc

SEQ ID NO: 6062216 - DNA, 21 bp, Homo sapiens
ccctctgagcaactgtgcagc

SEQ ID NO: 6062217 - DNA, 15 bp, Homo sapiens
ccctctgagccgcca

SEQ ID NO: 6062218 - DNA, 11 bp, Homo sapiens
ccctctgaggc

SEQ ID NO: 6062219 - DNA, 18 bp, Homo sapiens
ccctctgaggctcagccc

SEQ ID NO: 6062220 - DNA, 16 bp, Homo sapiens
ccctctgattgttccc

SEQ ID NO: 6062221 - DNA, 20 bp, Homo sapiens
ccctctgcagccggaggagg

SEQ ID NO: 6062222 - DNA, 23 bp, Homo sapiens
ccctctgcattgacctggagggg

SEQ ID NO: 6062223 - DNA, 9 bp, Homo sapiens
ccctctgcc

SEQ ID NO: 6062224 - DNA, 12 bp, Homo sapiens
ccctctgccacc

SEQ ID NO: 6062225 - DNA, 13 bp, Homo sapiens
ccctctgccacca

SEQ ID NO: 6062226 - DNA, 15 bp, Homo sapiens
ccctctgcccactcc

SEQ ID NO: 6062227 - DNA, 19 bp, Homo sapiens
ccctctgcccactccctgc

SEQ ID NO: 6062228 - DNA, 15 bp, Homo sapiens
ccctctgcccagctt

SEQ ID NO: 6062229 - DNA, 16 bp, Homo sapiens
ccctctgcccagcttg

SEQ ID NO: 6062230 - DNA, 16 bp, Homo sapiens
ccctctgccccaagca

SEQ ID NO: 6062231 - DNA, 21 bp, Homo sapiens
ccctctgccccaagcagccag

SEQ ID NO: 6062232 - DNA, 15 bp, Homo sapiens
ccctctgccccatca

SEQ ID NO: 6062233 - DNA, 13 bp, Homo sapiens
ccctctgcccctg

SEQ ID NO: 6062234 - DNA, 18 bp, Homo sapiens
ccctctgcccctgcagct

SEQ ID NO: 6062235 - DNA, 19 bp, Homo sapiens
ccctctgcccctgcagctg

SEQ ID NO: 6062236 - DNA, 13 bp, Homo sapiens
ccctctgccctgt

SEQ ID NO: 6062237 - DNA, 16 bp, Homo sapiens
ccctctgccctgtata

SEQ ID NO: 6062238 - DNA, 20 bp, Homo sapiens
ccctctgccgaccgcctgct

SEQ ID NO: 6062239 - DNA, 24 bp, Homo sapiens
ccctctgccgaccgcctgcttcac

SEQ ID NO: 6062240 - DNA, 20 bp, Homo sapiens
ccctctgccggtcgggcagc

SEQ ID NO: 6062241 - DNA, 23 bp, Homo sapiens
ccctctgccggtcgggcagccag

SEQ ID NO: 6062242 - DNA, 12 bp, Homo sapiens
ccctctgcctca

SEQ ID NO: 6062243 - DNA, 19 bp, Homo sapiens
ccctctgcctcatcctcct

SEQ ID NO: 6062244 - DNA, 12 bp, Homo sapiens
ccctctgcctcc

SEQ ID NO: 6062245 - DNA, 21 bp, Homo sapiens
ccctctgcctgaaccttccat

SEQ ID NO: 6062246 - DNA, 16 bp, Homo sapiens
ccctctgcctgcactc

SEQ ID NO: 6062247 - DNA, 20 bp, Homo sapiens
ccctctgcctgggatgccct

SEQ ID NO: 6062248 - DNA, 16 bp, Homo sapiens
ccctctgcctgtccct

SEQ ID NO: 6062249 - DNA, 22 bp, Homo sapiens
ccctctgccttgccctcctggg

SEQ ID NO: 6062250 - DNA, 20 bp, Homo sapiens
ccctctgcctttgagcttct

SEQ ID NO: 6062251 - DNA, 18 bp, Homo sapiens
ccctctgcgccccagcga

SEQ ID NO: 6062252 - DNA, 21 bp, Homo sapiens
ccctctgcggccactgcgcca

SEQ ID NO: 6062253 - DNA, 22 bp, Homo sapiens
ccctctgcgtcccccagccctc

SEQ ID NO: 6062254 - DNA, 13 bp, Homo sapiens
ccctctgctctca

SEQ ID NO: 6062255 - DNA, 14 bp, Homo sapiens
ccctctgctctcat

SEQ ID NO: 6062256 - DNA, 16 bp, Homo sapiens
ccctctgctctcatag

SEQ ID NO: 6062257 - DNA, 18 bp, Homo sapiens
ccctctgctctcatagga

SEQ ID NO: 6062258 - DNA, 20 bp, Homo sapiens
ccctctgctctgcctggagt

SEQ ID NO: 6062259 - DNA, 21 bp, Homo sapiens
ccctctgctgaagacttgccc

SEQ ID NO: 6062260 - DNA, 14 bp, Homo sapiens
ccctctgctgcaca

SEQ ID NO: 6062261 - DNA, 12 bp, Homo sapiens
ccctctgctgcc

SEQ ID NO: 6062262 - DNA, 12 bp, Homo sapiens
ccctctgctgtc

SEQ ID NO: 6062263 - DNA, 21 bp, Homo sapiens
ccctctgctgtcctgcagtag

SEQ ID NO: 6062264 - DNA, 20 bp, Homo sapiens
ccctctggagaaggcctgga

SEQ ID NO: 6062265 - DNA, 22 bp, Homo sapiens
ccctctggagaaggcctggaag

SEQ ID NO: 6062266 - DNA, 12 bp, Homo sapiens
ccctctggaggg

SEQ ID NO: 6062267 - DNA, 21 bp, Homo sapiens
ccctctggagtggccactaag

SEQ ID NO: 6062268 - DNA, 19 bp, Homo sapiens
ccctctggagtttcatgtt

SEQ ID NO: 6062269 - DNA, 19 bp, Homo sapiens
ccctctggattctgaatct

SEQ ID NO: 6062270 - DNA, 22 bp, Homo sapiens
ccctctggctccagctggccgg

SEQ ID NO: 6062271 - DNA, 12 bp, Homo sapiens
ccctctggcttc

SEQ ID NO: 6062272 - DNA, 15 bp, Homo sapiens
ccctctgggaacctc

SEQ ID NO: 6062273 - DNA, 21 bp, Homo sapiens
ccctctgggaacctcccagag

SEQ ID NO: 6062274 - DNA, 11 bp, Homo sapiens
ccctctgggat

SEQ ID NO: 6062275 - DNA, 10 bp, Homo sapiens
ccctctgggc

SEQ ID NO: 6062276 - DNA, 22 bp, Homo sapiens
ccctctgggcacgcctgctggc

SEQ ID NO: 6062277 - DNA, 20 bp, Homo sapiens
ccctctgggcagctgtcatg

SEQ ID NO: 6062278 - DNA, 12 bp, Homo sapiens
ccctctgggcct

SEQ ID NO: 6062279 - DNA, 14 bp, Homo sapiens
ccctctgggcctgt

SEQ ID NO: 6062280 - DNA, 15 bp, Homo sapiens
ccctctgggcctgtt

SEQ ID NO: 6062281 - DNA, 18 bp, Homo sapiens
ccctctgggcctgttctc

SEQ ID NO: 6062282 - DNA, 11 bp, Homo sapiens
ccctctgggct

SEQ ID NO: 6062283 - DNA, 16 bp, Homo sapiens
ccctctgggctctgag

SEQ ID NO: 6062284 - DNA, 15 bp, Homo sapiens
ccctctgggggctct

SEQ ID NO: 6062285 - DNA, 20 bp, Homo sapiens
ccctctggtcgctcctgccc

SEQ ID NO: 6062286 - DNA, 20 bp, Homo sapiens
ccctctggtctactctagaa

SEQ ID NO: 6062287 - DNA, 21 bp, Homo sapiens
ccctctggtctactctagaag

SEQ ID NO: 6062288 - DNA, 14 bp, Homo sapiens
ccctctgtagctcc

SEQ ID NO: 6062289 - DNA, 20 bp, Homo sapiens
ccctctgtagctccctcctc

SEQ ID NO: 6062290 - DNA, 13 bp, Homo sapiens
ccctctgtccaca

SEQ ID NO: 6062291 - DNA, 20 bp, Homo sapiens
ccctctgtccaggcactgag

SEQ ID NO: 6062292 - DNA, 12 bp, Homo sapiens
ccctctgtcccc

SEQ ID NO: 6062293 - DNA, 20 bp, Homo sapiens
ccctctgtccttcccccagc

SEQ ID NO: 6062294 - DNA, 14 bp, Homo sapiens
ccctctgtcttttc

SEQ ID NO: 6062295 - DNA, 12 bp, Homo sapiens
ccctctgtgcct

SEQ ID NO: 6062296 - DNA, 14 bp, Homo sapiens
ccctctgtgcctaa

SEQ ID NO: 6062297 - DNA, 18 bp, Homo sapiens
ccctctgtgcctaataaa

SEQ ID NO: 6062298 - DNA, 22 bp, Homo sapiens
ccctctgtgcttcgactactgc

SEQ ID NO: 6062299 - DNA, 15 bp, Homo sapiens
ccctctgtggccagg

SEQ ID NO: 6062300 - DNA, 18 bp, Homo sapiens
ccctctgtggccaggagc

SEQ ID NO: 6062301 - DNA, 14 bp, Homo sapiens
ccctctgtggcctg

SEQ ID NO: 6062302 - DNA, 18 bp, Homo sapiens
ccctctgtgtatttgctt

SEQ ID NO: 6062303 - DNA, 14 bp, Homo sapiens
ccctctgtgtctgc

SEQ ID NO: 6062304 - DNA, 12 bp, Homo sapiens
ccctctgttagg

SEQ ID NO: 6062305 - DNA, 22 bp, Homo sapiens
ccctctgttctctcccctcaca

SEQ ID NO: 6062306 - DNA, 20 bp, Homo sapiens
ccctctgttctgcacacagc

SEQ ID NO: 6062307 - DNA, 21 bp, Homo sapiens
ccctctgttctgcacacagca

SEQ ID NO: 6062308 - DNA, 18 bp, Homo sapiens
ccctctgttgccaggcta

SEQ ID NO: 6062309 - DNA, 22 bp, Homo sapiens
ccctcttaagatctgactgcca

SEQ ID NO: 6062310 - DNA, 18 bp, Homo sapiens
ccctcttattcctctagg

SEQ ID NO: 6062311 - DNA, 20 bp, Homo sapiens
ccctcttattgttcctctta

SEQ ID NO: 6062312 - DNA, 14 bp, Homo sapiens
ccctcttcaaagca

SEQ ID NO: 6062313 - DNA, 13 bp, Homo sapiens
ccctcttccagct

SEQ ID NO: 6062314 - DNA, 13 bp, Homo sapiens
ccctcttccccct

SEQ ID NO: 6062315 - DNA, 20 bp, Homo sapiens
ccctcttcccccttcccctg

SEQ ID NO: 6062316 - DNA, 11 bp, Homo sapiens
ccctcttccct

SEQ ID NO: 6062317 - DNA, 20 bp, Homo sapiens
ccctcttcccttcctccatt

SEQ ID NO: 6062318 - DNA, 20 bp, Homo sapiens
ccctcttcctaccctgcctc

SEQ ID NO: 6062319 - DNA, 12 bp, Homo sapiens
ccctcttcctct

SEQ ID NO: 6062320 - DNA, 15 bp, Homo sapiens
ccctcttcctctcca

SEQ ID NO: 6062321 - DNA, 18 bp, Homo sapiens
ccctcttcctcttgaccc

SEQ ID NO: 6062322 - DNA, 12 bp, Homo sapiens
ccctcttcctga

SEQ ID NO: 6062323 - DNA, 20 bp, Homo sapiens
ccctcttcctgacgaaactg

SEQ ID NO: 6062324 - DNA, 14 bp, Homo sapiens
ccctcttcctgtga

SEQ ID NO: 6062325 - DNA, 14 bp, Homo sapiens
ccctcttccttccc

SEQ ID NO: 6062326 - DNA, 21 bp, Homo sapiens
ccctcttcggtgttcttcttc

SEQ ID NO: 6062327 - DNA, 20 bp, Homo sapiens
ccctcttctcaagtgcctta

SEQ ID NO: 6062328 - DNA, 20 bp, Homo sapiens
ccctcttctcctctggcttc

SEQ ID NO: 6062329 - DNA, 13 bp, Homo sapiens
ccctcttctcctt

SEQ ID NO: 6062330 - DNA, 17 bp, Homo sapiens
ccctcttctctcctcag

SEQ ID NO: 6062331 - DNA, 15 bp, Homo sapiens
ccctcttctgagcta

SEQ ID NO: 6062332 - DNA, 15 bp, Homo sapiens
ccctcttctgctcct

SEQ ID NO: 6062333 - DNA, 21 bp, Homo sapiens
ccctcttcttctttccttcca

SEQ ID NO: 6062334 - DNA, 22 bp, Homo sapiens
ccctcttcttgcggcaccgccc

SEQ ID NO: 6062335 - DNA, 24 bp, Homo sapiens
ccctcttctttcagacttgccatg

SEQ ID NO: 6062336 - DNA, 19 bp, Homo sapiens
ccctcttgacccatctccc

SEQ ID NO: 6062337 - DNA, 17 bp, Homo sapiens
ccctcttgccagcctcc

SEQ ID NO: 6062338 - DNA, 20 bp, Homo sapiens
ccctcttgccagcctccttg

SEQ ID NO: 6062339 - DNA, 23 bp, Homo sapiens
ccctcttgccagcctccttgctg

SEQ ID NO: 6062340 - DNA, 14 bp, Homo sapiens
ccctcttgccatcc

SEQ ID NO: 6062341 - DNA, 19 bp, Homo sapiens
ccctcttgccatcctgatg

SEQ ID NO: 6062342 - DNA, 13 bp, Homo sapiens
ccctcttgcccat

SEQ ID NO: 6062343 - DNA, 15 bp, Homo sapiens
ccctcttgcccatcc

SEQ ID NO: 6062344 - DNA, 21 bp, Homo sapiens
ccctcttgcccgcacccctcc

SEQ ID NO: 6062345 - DNA, 17 bp, Homo sapiens
ccctcttgcgggcctgg

SEQ ID NO: 6062346 - DNA, 15 bp, Homo sapiens
ccctcttggagaagt

SEQ ID NO: 6062347 - DNA, 23 bp, Homo sapiens
ccctcttggagaagtctcagcta

SEQ ID NO: 6062348 - DNA, 23 bp, Homo sapiens
ccctcttggtgtgattgcacaga

SEQ ID NO: 6062349 - DNA, 12 bp, Homo sapiens
ccctcttgtaag

SEQ ID NO: 6062350 - DNA, 22 bp, Homo sapiens
ccctcttgtcctttaatatttg

SEQ ID NO: 6062351 - DNA, 13 bp, Homo sapiens
ccctcttgtctcc

SEQ ID NO: 6062352 - DNA, 15 bp, Homo sapiens
ccctcttgttttgtt

SEQ ID NO: 6062353 - DNA, 19 bp, Homo sapiens
ccctctttaatgctgtctt

SEQ ID NO: 6062354 - DNA, 17 bp, Homo sapiens
ccctctttcccaccctc

SEQ ID NO: 6062355 - DNA, 16 bp, Homo sapiens
ccctctttccccacct

SEQ ID NO: 6062356 - DNA, 18 bp, Homo sapiens
ccctctttccccacctct

SEQ ID NO: 6062357 - DNA, 13 bp, Homo sapiens
ccctctttcctgt

SEQ ID NO: 6062358 - DNA, 15 bp, Homo sapiens
ccctctttcctgtgc

SEQ ID NO: 6062359 - DNA, 17 bp, Homo sapiens
ccctctttcctgtgcca

SEQ ID NO: 6062360 - DNA, 22 bp, Homo sapiens
ccctctttctacattctcatct

SEQ ID NO: 6062361 - DNA, 17 bp, Homo sapiens
ccctctttctagcctgg

SEQ ID NO: 6062362 - DNA, 15 bp, Homo sapiens
ccctctttctctctg

SEQ ID NO: 6062363 - DNA, 17 bp, Homo sapiens
ccctctttctctctgtg

SEQ ID NO: 6062364 - DNA, 19 bp, Homo sapiens
ccctctttctctctgtgtg

SEQ ID NO: 6062365 - DNA, 22 bp, Homo sapiens
ccctctttctctctgtgtggca

SEQ ID NO: 6062366 - DNA, 20 bp, Homo sapiens
ccctctttcttgtttgtcag

SEQ ID NO: 6062367 - DNA, 23 bp, Homo sapiens
ccctctttctttcttttgtgttg

SEQ ID NO: 6062368 - DNA, 15 bp, Homo sapiens
ccctctttgctgcag

SEQ ID NO: 6062369 - DNA, 20 bp, Homo sapiens
ccctctttggctcccctgta

SEQ ID NO: 6062370 - DNA, 16 bp, Homo sapiens
ccctcttttaccaact

SEQ ID NO: 6062371 - DNA, 21 bp, Homo sapiens
ccctcttttcttactcctcct

SEQ ID NO: 6062372 - DNA, 22 bp, Homo sapiens
ccctcttttcttactcctcctc

SEQ ID NO: 6062373 - DNA, 12 bp, Homo sapiens
ccctctttttct

SEQ ID NO: 6062374 - DNA, 14 bp, Homo sapiens
ccctgaaaacccag

SEQ ID NO: 6062375 - DNA, 17 bp, Homo sapiens
ccctgaaaacccagaga

SEQ ID NO: 6062376 - DNA, 17 bp, Homo sapiens
ccctgaaaacctcacat

SEQ ID NO: 6062377 - DNA, 14 bp, Homo sapiens
ccctgaaaatgtta

SEQ ID NO: 6062378 - DNA, 13 bp, Homo sapiens
ccctgaaacacga

SEQ ID NO: 6062379 - DNA, 21 bp, Homo sapiens
ccctgaaacctagtactgccc

SEQ ID NO: 6062380 - DNA, 18 bp, Homo sapiens
ccctgaaacgagaagtgc

SEQ ID NO: 6062381 - DNA, 22 bp, Homo sapiens
ccctgaaactgagtctgtggac

SEQ ID NO: 6062382 - DNA, 15 bp, Homo sapiens
ccctgaaacttattt

SEQ ID NO: 6062383 - DNA, 17 bp, Homo sapiens
ccctgaaacttattttt

SEQ ID NO: 6062384 - DNA, 15 bp, Homo sapiens
ccctgaaagccctga

SEQ ID NO: 6062385 - DNA, 20 bp, Homo sapiens
ccctgaaagtcccagatcaa

SEQ ID NO: 6062386 - DNA, 13 bp, Homo sapiens
ccctgaaatgtgt

SEQ ID NO: 6062387 - DNA, 21 bp, Homo sapiens
ccctgaaattatataaggcat

SEQ ID NO: 6062388 - DNA, 22 bp, Homo sapiens
ccctgaacaacgagccttttca

SEQ ID NO: 6062389 - DNA, 15 bp, Homo sapiens
ccctgaacactcatc

SEQ ID NO: 6062390 - DNA, 18 bp, Homo sapiens
ccctgaacatctgtgtgt

SEQ ID NO: 6062391 - DNA, 19 bp, Homo sapiens
ccctgaaccacgaggctgc

SEQ ID NO: 6062392 - DNA, 17 bp, Homo sapiens
ccctgaacccacacctg

SEQ ID NO: 6062393 - DNA, 18 bp, Homo sapiens
ccctgaacccctggccag

SEQ ID NO: 6062394 - DNA, 15 bp, Homo sapiens
ccagccgcccagatc

SEQ ID NO: 6062395 - DNA, 15 bp, Homo sapiens
ccagccgccccagcc

SEQ ID NO: 6062396 - DNA, 15 bp, Homo sapiens
ccagccgccctgggc

SEQ ID NO: 6062397 - DNA, 19 bp, Homo sapiens
ccagccgcgcatcagactg

SEQ ID NO: 6062398 - DNA, 20 bp, Homo sapiens
ccagccgctgcagggctccc

SEQ ID NO: 6062399 - DNA, 23 bp, Homo sapiens
ccagccgctgcagggctcccatg

SEQ ID NO: 6062400 - DNA, 14 bp, Homo sapiens
ccagccggcatggc

SEQ ID NO: 6062401 - DNA, 13 bp, Homo sapiens
ccagccggcctct

SEQ ID NO: 6062402 - DNA, 22 bp, Homo sapiens
ccagccggcctctctggcctcc

SEQ ID NO: 6062403 - DNA, 21 bp, Homo sapiens
ccagccggggtggggtgcctg

SEQ ID NO: 6062404 - DNA, 23 bp, Homo sapiens
ccagccggggtggggtgcctgag

SEQ ID NO: 6062405 - DNA, 19 bp, Homo sapiens
ccagccgggtacctcagtt

SEQ ID NO: 6062406 - DNA, 16 bp, Homo sapiens
ccagccggtgcctggc

SEQ ID NO: 6062407 - DNA, 20 bp, Homo sapiens
ccagccgtaatggggactct

SEQ ID NO: 6062408 - DNA, 21 bp, Homo sapiens
ccagccgtgatgctcaggctt

SEQ ID NO: 6062409 - DNA, 14 bp, Homo sapiens
ccagccgtggccag

SEQ ID NO: 6062410 - DNA, 20 bp, Homo sapiens
ccagccgtgtgtgcatgtgc

SEQ ID NO: 6062411 - DNA, 20 bp, Homo sapiens
ccagcctacaagctggcact

SEQ ID NO: 6062412 - DNA, 18 bp, Homo sapiens
ccagcctacactgccagc

SEQ ID NO: 6062413 - DNA, 13 bp, Homo sapiens
ccagcctagccct

SEQ ID NO: 6062414 - DNA, 19 bp, Homo sapiens
ccagcctatatttcctctt

SEQ ID NO: 6062415 - DNA, 19 bp, Homo sapiens
ccagcctatctctcttctg

SEQ ID NO: 6062416 - DNA, 20 bp, Homo sapiens
ccagcctatgagcatcctga

SEQ ID NO: 6062417 - DNA, 22 bp, Homo sapiens
ccagcctatgagcatcctgagc

SEQ ID NO: 6062418 - DNA, 23 bp, Homo sapiens
ccagcctatgagcatcctgagcc

SEQ ID NO: 6062419 - DNA, 17 bp, Homo sapiens
ccagcctcaaatccagg

SEQ ID NO: 6062420 - DNA, 19 bp, Homo sapiens
ccagcctcaaatccaggac

SEQ ID NO: 6062421 - DNA, 18 bp, Homo sapiens
ccagcctcacagatgctg

SEQ ID NO: 6062422 - DNA, 17 bp, Homo sapiens
ccagcctcacccttgcg

SEQ ID NO: 6062423 - DNA, 18 bp, Homo sapiens
ccagcctcactccatttc

SEQ ID NO: 6062424 - DNA, 15 bp, Homo sapiens
ccagcctcacttcct

SEQ ID NO: 6062425 - DNA, 22 bp, Homo sapiens
ccagcctcacttcctttgccct

SEQ ID NO: 6062426 - DNA, 14 bp, Homo sapiens
ccagcctcagaagc

SEQ ID NO: 6062427 - DNA, 17 bp, Homo sapiens
ccagcctcagaagcctt

SEQ ID NO: 6062428 - DNA, 18 bp, Homo sapiens
ccagcctcagaagccttc

SEQ ID NO: 6062429 - DNA, 13 bp, Homo sapiens
ccagcctcagcct

SEQ ID NO: 6062430 - DNA, 13 bp, Homo sapiens
ccagcctcagctc

SEQ ID NO: 6062431 - DNA, 14 bp, Homo sapiens
ccagcctcagctct

SEQ ID NO: 6062432 - DNA, 12 bp, Homo sapiens
ccagcctcagtc

SEQ ID NO: 6062433 - DNA, 15 bp, Homo sapiens
ccagcctcagtgcca

SEQ ID NO: 6062434 - DNA, 20 bp, Homo sapiens
ccagcctcattgtgccaagc

SEQ ID NO: 6062435 - DNA, 22 bp, Homo sapiens
ccagcctcattgtgccaagcct

SEQ ID NO: 6062436 - DNA, 13 bp, Homo sapiens
ccagcctccagag

SEQ ID NO: 6062437 - DNA, 15 bp, Homo sapiens
ccagcctccagagaa

SEQ ID NO: 6062438 - DNA, 17 bp, Homo sapiens
ccagcctccagagaagc

SEQ ID NO: 6062439 - DNA, 13 bp, Homo sapiens
ccagcctccaggc

SEQ ID NO: 6062440 - DNA, 15 bp, Homo sapiens
ccagcctccagggca

SEQ ID NO: 6062441 - DNA, 13 bp, Homo sapiens
ccagcctcccagc

SEQ ID NO: 6062442 - DNA, 12 bp, Homo sapiens
ccagcctccccc

SEQ ID NO: 6062443 - DNA, 14 bp, Homo sapiens
ccagcctcccccag

SEQ ID NO: 6062444 - DNA, 15 bp, Homo sapiens
ccagcctcccccagg

SEQ ID NO: 6062445 - DNA, 17 bp, Homo sapiens
ccagcctcccccaggct

SEQ ID NO: 6062446 - DNA, 18 bp, Homo sapiens
ccagcctcccccaggctg

SEQ ID NO: 6062447 - DNA, 13 bp, Homo sapiens
ccagcctcccctc

SEQ ID NO: 6062448 - DNA, 15 bp, Homo sapiens
ccagcctcccctccc

SEQ ID NO: 6062449 - DNA, 11 bp, Homo sapiens
ccagcctccct

SEQ ID NO: 6062450 - DNA, 14 bp, Homo sapiens
ccagcctccctgtc

SEQ ID NO: 6062451 - DNA, 18 bp, Homo sapiens
ccagcctccgagagggag

SEQ ID NO: 6062452 - DNA, 21 bp, Homo sapiens
ccagcctccgagagggagaga

SEQ ID NO: 6062453 - DNA, 11 bp, Homo sapiens
ccagcctcctc

SEQ ID NO: 6062454 - DNA, 18 bp, Homo sapiens
ccagcctcctcccaccac

SEQ ID NO: 6062455 - DNA, 16 bp, Homo sapiens
ccagcctcctctggac

SEQ ID NO: 6062456 - DNA, 19 bp, Homo sapiens
ccagcctccttgctgaccc

SEQ ID NO: 6062457 - DNA, 15 bp, Homo sapiens
ccagcctctagggac

SEQ ID NO: 6062458 - DNA, 17 bp, Homo sapiens
ccagcctctagggaccc

SEQ ID NO: 6062459 - DNA, 23 bp, Homo sapiens
ccagcctctccccgctctggatc

SEQ ID NO: 6062460 - DNA, 14 bp, Homo sapiens
ccagcctctcccct

SEQ ID NO: 6062461 - DNA, 21 bp, Homo sapiens
ccagcctctcccggctgcctg

SEQ ID NO: 6062462 - DNA, 22 bp, Homo sapiens
ccagcctctcccggctgcctgc

SEQ ID NO: 6062463 - DNA, 14 bp, Homo sapiens
ccagcctctctggc

SEQ ID NO: 6062464 - DNA, 19 bp, Homo sapiens
ccagcctctgagtcccgtg

SEQ ID NO: 6062465 - DNA, 17 bp, Homo sapiens
ccagcctctgccgctgc

SEQ ID NO: 6062466 - DNA, 15 bp, Homo sapiens
ccagcctctggggca

SEQ ID NO: 6062467 - DNA, 13 bp, Homo sapiens
ccagcctctgtcc

SEQ ID NO: 6062468 - DNA, 15 bp, Homo sapiens
ccagcctctgttccc

SEQ ID NO: 6062469 - DNA, 13 bp, Homo sapiens
ccagcctctttcc

SEQ ID NO: 6062470 - DNA, 14 bp, Homo sapiens
ccagcctctttccc

SEQ ID NO: 6062471 - DNA, 22 bp, Homo sapiens
ccagcctgaaagatacagggga

SEQ ID NO: 6062472 - DNA, 19 bp, Homo sapiens
ccagcctgaacagaagctc

SEQ ID NO: 6062473 - DNA, 18 bp, Homo sapiens
ccagcctgacgcctactg

SEQ ID NO: 6062474 - DNA, 22 bp, Homo sapiens
ccagcctgactagaactcctgt

SEQ ID NO: 6062475 - DNA, 16 bp, Homo sapiens
ccagcctgactgcaca

SEQ ID NO: 6062476 - DNA, 16 bp, Homo sapiens
ccagcctgagccacag

SEQ ID NO: 6062477 - DNA, 16 bp, Homo sapiens
ccagcctgagtgacag

SEQ ID NO: 6062478 - DNA, 22 bp, Homo sapiens
ccagcctgagtgacagagcgag

SEQ ID NO: 6062479 - DNA, 15 bp, Homo sapiens
ccagcctgccaggcc

SEQ ID NO: 6062480 - DNA, 20 bp, Homo sapiens
ccagcctgcccaagcccagg

SEQ ID NO: 6062481 - DNA, 13 bp, Homo sapiens
ccagcctgccccc

SEQ ID NO: 6062482 - DNA, 14 bp, Homo sapiens
ccagcctgccccct

SEQ ID NO: 6062483 - DNA, 17 bp, Homo sapiens
ccagcctgccctccagc

SEQ ID NO: 6062484 - DNA, 21 bp, Homo sapiens
ccagcctgcctggcaggctgt

SEQ ID NO: 6062485 - DNA, 21 bp, Homo sapiens
ccagcctgcgcctgctgcatg

SEQ ID NO: 6062486 - DNA, 22 bp, Homo sapiens
ccagcctgcgggaagctgacct

SEQ ID NO: 6062487 - DNA, 10 bp, Homo sapiens
ccagcctgct

SEQ ID NO: 6062488 - DNA, 12 bp, Homo sapiens
ccagcctgctag

SEQ ID NO: 6062489 - DNA, 14 bp, Homo sapiens
ccagcctgctagct

SEQ ID NO: 6062490 - DNA, 15 bp, Homo sapiens
ccagcctgctctccc

SEQ ID NO: 6062491 - DNA, 12 bp, Homo sapiens
ccagcctgctga

SEQ ID NO: 6062492 - DNA, 17 bp, Homo sapiens
ccagcctgctgagagcc

SEQ ID NO: 6062493 - DNA, 20 bp, Homo sapiens
ccagcctgctgagagccccc

SEQ ID NO: 6062494 - DNA, 15 bp, Homo sapiens
ccagcctgcttccca

SEQ ID NO: 6062495 - DNA, 13 bp, Homo sapiens
ccagcctggagat

SEQ ID NO: 6062496 - DNA, 17 bp, Homo sapiens
ccagcctggatgccatc

SEQ ID NO: 6062497 - DNA, 10 bp, Homo sapiens
ccagcctggc

SEQ ID NO: 6062498 - DNA, 14 bp, Homo sapiens
ccagcctggcacag

SEQ ID NO: 6062499 - DNA, 12 bp, Homo sapiens
ccagcctggcat

SEQ ID NO: 6062500 - DNA, 13 bp, Homo sapiens
ccagcctggcatc

SEQ ID NO: 6062501 - DNA, 19 bp, Homo sapiens
ccagcctggcatcagttta

SEQ ID NO: 6062502 - DNA, 15 bp, Homo sapiens
ccagcctggcccagc

SEQ ID NO: 6062503 - DNA, 18 bp, Homo sapiens
ccagcctggcccagctcc

SEQ ID NO: 6062504 - DNA, 20 bp, Homo sapiens
ccagcctggcccagctcccc

SEQ ID NO: 6062505 - DNA, 14 bp, Homo sapiens
ccagcctggcctcc

SEQ ID NO: 6062506 - DNA, 12 bp, Homo sapiens
ccagcctggctc

SEQ ID NO: 6062507 - DNA, 23 bp, Homo sapiens
ccagcctggctcccacaggcagc

SEQ ID NO: 6062508 - DNA, 13 bp, Homo sapiens
ccagcctggcttc

SEQ ID NO: 6062509 - DNA, 19 bp, Homo sapiens
ccagcctggcttctggagc

SEQ ID NO: 6062510 - DNA, 20 bp, Homo sapiens
ccagcctggcttctggagcc

SEQ ID NO: 6062511 - DNA, 21 bp, Homo sapiens
ccagcctggcttctggagccc

SEQ ID NO: 6062512 - DNA, 16 bp, Homo sapiens
ccagcctgggagccca

SEQ ID NO: 6062513 - DNA, 16 bp, Homo sapiens
ccagcctgggaggcac

SEQ ID NO: 6062514 - DNA, 17 bp, Homo sapiens
ccagcctgggaggcaca

SEQ ID NO: 6062515 - DNA, 21 bp, Homo sapiens
ccagcctgggataggggcaga

SEQ ID NO: 6062516 - DNA, 16 bp, Homo sapiens
ccagcctgggcaacaa

SEQ ID NO: 6062517 - DNA, 18 bp, Homo sapiens
ccagcctgggcaacaaag

SEQ ID NO: 6062518 - DNA, 23 bp, Homo sapiens
ccagcctgggcagccaggctgcc

SEQ ID NO: 6062519 - DNA, 12 bp, Homo sapiens
ccagcctgggcc

SEQ ID NO: 6062520 - DNA, 18 bp, Homo sapiens
ccagcctgggccatctct

SEQ ID NO: 6062521 - DNA, 22 bp, Homo sapiens
ccagcctgggcccatctccctg

SEQ ID NO: 6062522 - DNA, 12 bp, Homo sapiens
ccagcctgggct

SEQ ID NO: 6062523 - DNA, 18 bp, Homo sapiens
ccagcctgggctcctctg

SEQ ID NO: 6062524 - DNA, 21 bp, Homo sapiens
ccagcctgggctcctctgcat

SEQ ID NO: 6062525 - DNA, 18 bp, Homo sapiens
ccagcctggggaccccac

SEQ ID NO: 6062526 - DNA, 18 bp, Homo sapiens
ccagcctggggcctggca

SEQ ID NO: 6062527 - DNA, 22 bp, Homo sapiens
ccagcctggggctccctctctg

SEQ ID NO: 6062528 - DNA, 18 bp, Homo sapiens
ccagcctgggggccagtg

SEQ ID NO: 6062529 - DNA, 18 bp, Homo sapiens
ccagcctgggggctggga

SEQ ID NO: 6062530 - DNA, 21 bp, Homo sapiens
ccagcctgtaccttgctgtgg

SEQ ID NO: 6062531 - DNA, 22 bp, Homo sapiens
ccagcctgtaccttgctgtggg

SEQ ID NO: 6062532 - DNA, 20 bp, Homo sapiens
ccagcctgtagggaactttc

SEQ ID NO: 6062533 - DNA, 10 bp, Homo sapiens
ccagcctgtc

SEQ ID NO: 6062534 - DNA, 12 bp, Homo sapiens
ccagcctgtcac

SEQ ID NO: 6062535 - DNA, 18 bp, Homo sapiens
ccagcctgtcagatccag

SEQ ID NO: 6062536 - DNA, 12 bp, Homo sapiens
ccagcctgtcca

SEQ ID NO: 6062537 - DNA, 14 bp, Homo sapiens
ccagcctgtcccac

SEQ ID NO: 6062538 - DNA, 16 bp, Homo sapiens
ccagcctgtcctggta

SEQ ID NO: 6062539 - DNA, 16 bp, Homo sapiens
ccagcctgtcggccac

SEQ ID NO: 6062540 - DNA, 19 bp, Homo sapiens
ccagcctgtggcctcagca

SEQ ID NO: 6062541 - DNA, 20 bp, Homo sapiens
ccagcctgtggcctcagcat

SEQ ID NO: 6062542 - DNA, 21 bp, Homo sapiens
ccagcctgtggttacagtgca

SEQ ID NO: 6062543 - DNA, 15 bp, Homo sapiens
ccagcctgtgtgttc

SEQ ID NO: 6062544 - DNA, 14 bp, Homo sapiens
ccagcctgttggac

SEQ ID NO: 6062545 - DNA, 15 bp, Homo sapiens
ccagccttccaggtg

SEQ ID NO: 6062546 - DNA, 17 bp, Homo sapiens
ccagccttctctcaagg

SEQ ID NO: 6062547 - DNA, 19 bp, Homo sapiens
ccagccttctctctctggt

SEQ ID NO: 6062548 - DNA, 14 bp, Homo sapiens
ccagccttcttccc

SEQ ID NO: 6062549 - DNA, 19 bp, Homo sapiens
ccagccttgaccattctcc

SEQ ID NO: 6062550 - DNA, 22 bp, Homo sapiens
ccagccttgaccattctccacc

SEQ ID NO: 6062551 - DNA, 23 bp, Homo sapiens
ccagccttgaccattctccacct

SEQ ID NO: 6062552 - DNA, 16 bp, Homo sapiens
ccagccttgagatgct

SEQ ID NO: 6062553 - DNA, 18 bp, Homo sapiens
ccagccttgagccctggc

SEQ ID NO: 6062554 - DNA, 15 bp, Homo sapiens
ccagccttgcccagc

SEQ ID NO: 6062555 - DNA, 16 bp, Homo sapiens
ccagccttgcccagct

SEQ ID NO: 6062556 - DNA, 17 bp, Homo sapiens
ccagccttgcccagctt

SEQ ID NO: 6062557 - DNA, 22 bp, Homo sapiens
ccagccttgctctcttcaataa

SEQ ID NO: 6062558 - DNA, 21 bp, Homo sapiens
ccagccttggggggtgggggc

SEQ ID NO: 6062559 - DNA, 14 bp, Homo sapiens
ccagccttggtgcc

SEQ ID NO: 6062560 - DNA, 17 bp, Homo sapiens
ccagccttggtttggaa

SEQ ID NO: 6062561 - DNA, 21 bp, Homo sapiens
ccagccttgtacagtctgctc

SEQ ID NO: 6062562 - DNA, 14 bp, Homo sapiens
ccagcctttccaag

SEQ ID NO: 6062563 - DNA, 17 bp, Homo sapiens
ccagcctttctaaggct

SEQ ID NO: 6062564 - DNA, 20 bp, Homo sapiens
ccagcctttctcccaggcca

SEQ ID NO: 6062565 - DNA, 17 bp, Homo sapiens
ccagcctttgctccctc

SEQ ID NO: 6062566 - DNA, 18 bp, Homo sapiens
ccagcctttgggtcctgg

SEQ ID NO: 6062567 - DNA, 22 bp, Homo sapiens
ccagcctttgggtcctgggcag

SEQ ID NO: 6062568 - DNA, 23 bp, Homo sapiens
ccagcctttgggtcctgggcagg

SEQ ID NO: 6062569 - DNA, 21 bp, Homo sapiens
ccagcctttgttccccactgg

SEQ ID NO: 6062570 - DNA, 20 bp, Homo sapiens
ccagcgagccacaggaacgg

SEQ ID NO: 6062571 - DNA, 22 bp, Homo sapiens
ccagcgagcgcccagctcctga

SEQ ID NO: 6062572 - DNA, 15 bp, Homo sapiens
ccagcgagctctcaa

SEQ ID NO: 6062573 - DNA, 17 bp, Homo sapiens
ccagcgaggcgaggctg

SEQ ID NO: 6062574 - DNA, 20 bp, Homo sapiens
ccctgaacccctggccagct

SEQ ID NO: 6062575 - DNA, 24 bp, Homo sapiens
ccctgaacccctggccagctctga

SEQ ID NO: 6062576 - DNA, 16 bp, Homo sapiens
ccctgaacctcagttt

SEQ ID NO: 6062577 - DNA, 18 bp, Homo sapiens
ccctgaacctcagtttcc

SEQ ID NO: 6062578 - DNA, 19 bp, Homo sapiens
ccctgaacctcagtttcct

SEQ ID NO: 6062579 - DNA, 15 bp, Homo sapiens
ccctgaacgttttct

SEQ ID NO: 6062580 - DNA, 12 bp, Homo sapiens
ccctgaactcag

SEQ ID NO: 6062581 - DNA, 17 bp, Homo sapiens
ccctgaactggccccag

SEQ ID NO: 6062582 - DNA, 11 bp, Homo sapiens
ccctgaagcca

SEQ ID NO: 6062583 - DNA, 14 bp, Homo sapiens
ccctgaagccagcc

SEQ ID NO: 6062584 - DNA, 15 bp, Homo sapiens
ccctgaagccagcct

SEQ ID NO: 6062585 - DNA, 13 bp, Homo sapiens
ccctgaagcctcc

SEQ ID NO: 6062586 - DNA, 14 bp, Homo sapiens
ccctgaaggaacca

SEQ ID NO: 6062587 - DNA, 17 bp, Homo sapiens
ccctgaaggggccatga

SEQ ID NO: 6062588 - DNA, 16 bp, Homo sapiens
ccctgaagtgacccca

SEQ ID NO: 6062589 - DNA, 19 bp, Homo sapiens
ccctgaagtgaccccagct

SEQ ID NO: 6062590 - DNA, 15 bp, Homo sapiens
ccctgaatccccctt

SEQ ID NO: 6062591 - DNA, 21 bp, Homo sapiens
ccctgaatcccccttgccacc

SEQ ID NO: 6062592 - DNA, 16 bp, Homo sapiens
ccctgaatccgtactt

SEQ ID NO: 6062593 - DNA, 18 bp, Homo sapiens
ccctgaatctgaccacag

SEQ ID NO: 6062594 - DNA, 21 bp, Homo sapiens
ccctgaatctgaccacagaca

SEQ ID NO: 6062595 - DNA, 22 bp, Homo sapiens
ccctgaatttcttcttttcctg

SEQ ID NO: 6062596 - DNA, 20 bp, Homo sapiens
ccctgacaacaactatcacc

SEQ ID NO: 6062597 - DNA, 22 bp, Homo sapiens
ccctgacaacactcattgacct

SEQ ID NO: 6062598 - DNA, 13 bp, Homo sapiens
ccctgacactgtc

SEQ ID NO: 6062599 - DNA, 22 bp, Homo sapiens
ccctgacagatctagttctctt

SEQ ID NO: 6062600 - DNA, 13 bp, Homo sapiens
ccctgacaggcct

SEQ ID NO: 6062601 - DNA, 20 bp, Homo sapiens
ccctgacatgctaacctctc

SEQ ID NO: 6062602 - DNA, 15 bp, Homo sapiens
ccctgaccaccctgc

SEQ ID NO: 6062603 - DNA, 22 bp, Homo sapiens
ccctgaccaccctgcctgtgga

SEQ ID NO: 6062604 - DNA, 14 bp, Homo sapiens
ccctgaccactcag

SEQ ID NO: 6062605 - DNA, 15 bp, Homo sapiens
ccctgaccactcaga

SEQ ID NO: 6062606 - DNA, 17 bp, Homo sapiens
ccctgaccactcagaga

SEQ ID NO: 6062607 - DNA, 20 bp, Homo sapiens
ccctgaccatggttttggct

SEQ ID NO: 6062608 - DNA, 21 bp, Homo sapiens
ccctgaccgtgtacatagccc

SEQ ID NO: 6062609 - DNA, 20 bp, Homo sapiens
ccctgacctaccccagccag

SEQ ID NO: 6062610 - DNA, 16 bp, Homo sapiens
ccctgacctcccagcc

SEQ ID NO: 6062611 - DNA, 17 bp, Homo sapiens
ccctgacctcccagccc

SEQ ID NO: 6062612 - DNA, 18 bp, Homo sapiens
ccctgacctcccagccct

SEQ ID NO: 6062613 - DNA, 17 bp, Homo sapiens
ccctgacctccctctaa

SEQ ID NO: 6062614 - DNA, 15 bp, Homo sapiens
ccctgacctgtccag

SEQ ID NO: 6062615 - DNA, 17 bp, Homo sapiens
ccctgaccttctccagg

SEQ ID NO: 6062616 - DNA, 14 bp, Homo sapiens
ccctgaccttggct

SEQ ID NO: 6062617 - DNA, 20 bp, Homo sapiens
ccctgaccttggctgactgg

SEQ ID NO: 6062618 - DNA, 21 bp, Homo sapiens
ccctgactaaactaccacctc

SEQ ID NO: 6062619 - DNA, 21 bp, Homo sapiens
ccctgactcattctgaaggag

SEQ ID NO: 6062620 - DNA, 18 bp, Homo sapiens
ccctgactccctgtgggg

SEQ ID NO: 6062621 - DNA, 23 bp, Homo sapiens
ccctgactcctctggctttccca

SEQ ID NO: 6062622 - DNA, 14 bp, Homo sapiens
ccctgactcctgga

SEQ ID NO: 6062623 - DNA, 15 bp, Homo sapiens
ccctgactcctggac

SEQ ID NO: 6062624 - DNA, 16 bp, Homo sapiens
ccctgactcctggact

SEQ ID NO: 6062625 - DNA, 18 bp, Homo sapiens
ccctgactcctggactcc

SEQ ID NO: 6062626 - DNA, 17 bp, Homo sapiens
ccctgactctctgtgac

SEQ ID NO: 6062627 - DNA, 14 bp, Homo sapiens
ccctgacttcccag

SEQ ID NO: 6062628 - DNA, 16 bp, Homo sapiens
ccctgacttcccagct

SEQ ID NO: 6062629 - DNA, 20 bp, Homo sapiens
ccctgacttcccagctggca

SEQ ID NO: 6062630 - DNA, 22 bp, Homo sapiens
ccctgacttcccagctggcagc

SEQ ID NO: 6062631 - DNA, 14 bp, Homo sapiens
ccctgacttctccc

SEQ ID NO: 6062632 - DNA, 16 bp, Homo sapiens
ccctgacttctccccc

SEQ ID NO: 6062633 - DNA, 20 bp, Homo sapiens
ccctgacttctcccccgccc

SEQ ID NO: 6062634 - DNA, 18 bp, Homo sapiens
ccctgagaaacccaccag

SEQ ID NO: 6062635 - DNA, 22 bp, Homo sapiens
ccctgagaaacccaccagccta

SEQ ID NO: 6062636 - DNA, 16 bp, Homo sapiens
ccctgagaagcctcat

SEQ ID NO: 6062637 - DNA, 16 bp, Homo sapiens
ccctgagacaaatgga

SEQ ID NO: 6062638 - DNA, 17 bp, Homo sapiens
ccctgagacaaatggag

SEQ ID NO: 6062639 - DNA, 17 bp, Homo sapiens
ccctgagaccaccccca

SEQ ID NO: 6062640 - DNA, 14 bp, Homo sapiens
ccctgagactccag

SEQ ID NO: 6062641 - DNA, 16 bp, Homo sapiens
ccctgagactccagaa

SEQ ID NO: 6062642 - DNA, 19 bp, Homo sapiens
ccctgagactcccgccttt

SEQ ID NO: 6062643 - DNA, 21 bp, Homo sapiens
ccctgagactcccgcctttga

SEQ ID NO: 6062644 - DNA, 22 bp, Homo sapiens
ccctgagacttttcaggagagc

SEQ ID NO: 6062645 - DNA, 21 bp, Homo sapiens
ccctgagagagaatagagctg

SEQ ID NO: 6062646 - DNA, 17 bp, Homo sapiens
ccctgagagcatgtggg

SEQ ID NO: 6062647 - DNA, 13 bp, Homo sapiens
ccctgagagcctg

SEQ ID NO: 6062648 - DNA, 23 bp, Homo sapiens
ccctgagagtctggtctgcgcct

SEQ ID NO: 6062649 - DNA, 19 bp, Homo sapiens
ccctgagagtttcctcaga

SEQ ID NO: 6062650 - DNA, 17 bp, Homo sapiens
ccctgagatcccctgag

SEQ ID NO: 6062651 - DNA, 20 bp, Homo sapiens
ccctgagatcccctgagccc

SEQ ID NO: 6062652 - DNA, 14 bp, Homo sapiens
ccctgagatgggcc

SEQ ID NO: 6062653 - DNA, 21 bp, Homo sapiens
ccctgagcaatgtctgtgcta

SEQ ID NO: 6062654 - DNA, 11 bp, Homo sapiens
ccctgagcagg

SEQ ID NO: 6062655 - DNA, 23 bp, Homo sapiens
ccctgagcagggtccacagctgg

SEQ ID NO: 6062656 - DNA, 15 bp, Homo sapiens
ccctgagccagcagg

SEQ ID NO: 6062657 - DNA, 21 bp, Homo sapiens
ccctgagccagggtctccaga

SEQ ID NO: 6062658 - DNA, 14 bp, Homo sapiens
ccctgagccatggc

SEQ ID NO: 6062659 - DNA, 14 bp, Homo sapiens
ccctgagcccacca

SEQ ID NO: 6062660 - DNA, 14 bp, Homo sapiens
ccctgagcccactg

SEQ ID NO: 6062661 - DNA, 16 bp, Homo sapiens
ccctgagcccactgtg

SEQ ID NO: 6062662 - DNA, 15 bp, Homo sapiens
ccctgagcccagaga

SEQ ID NO: 6062663 - DNA, 23 bp, Homo sapiens
ccctgagcccagagaagctggaa

SEQ ID NO: 6062664 - DNA, 15 bp, Homo sapiens
ccctgagccccttcc

SEQ ID NO: 6062665 - DNA, 13 bp, Homo sapiens
ccctgagcccggc

SEQ ID NO: 6062666 - DNA, 16 bp, Homo sapiens
ccctgagcccggccct

SEQ ID NO: 6062667 - DNA, 22 bp, Homo sapiens
ccctgagcccggccctccccca

SEQ ID NO: 6062668 - DNA, 11 bp, Homo sapiens
ccctgagccct

SEQ ID NO: 6062669 - DNA, 12 bp, Homo sapiens
ccctgagcctga

SEQ ID NO: 6062670 - DNA, 18 bp, Homo sapiens
ccctgagcctgacctttc

SEQ ID NO: 6062671 - DNA, 13 bp, Homo sapiens
ccctgagcctgca

SEQ ID NO: 6062672 - DNA, 19 bp, Homo sapiens
ccctgagcctgccccagct

SEQ ID NO: 6062673 - DNA, 14 bp, Homo sapiens
ccctgagcctggca

SEQ ID NO: 6062674 - DNA, 16 bp, Homo sapiens
ccctgagcctggcagg

SEQ ID NO: 6062675 - DNA, 16 bp, Homo sapiens
ccctgagcctgtgtcc

SEQ ID NO: 6062676 - DNA, 17 bp, Homo sapiens
ccctgagcctgtgtcct

SEQ ID NO: 6062677 - DNA, 18 bp, Homo sapiens
ccctgagcctgtgtcctg

SEQ ID NO: 6062678 - DNA, 22 bp, Homo sapiens
ccctgagcctgtgtcctgaaga

SEQ ID NO: 6062679 - DNA, 20 bp, Homo sapiens
ccctgagctagtgtcacctg

SEQ ID NO: 6062680 - DNA, 19 bp, Homo sapiens
ccctgagctcaggctgagc

SEQ ID NO: 6062681 - DNA, 20 bp, Homo sapiens
ccctgagctcaggctgagcc

SEQ ID NO: 6062682 - DNA, 23 bp, Homo sapiens
ccctgagctcaggctgagcccag

SEQ ID NO: 6062683 - DNA, 12 bp, Homo sapiens
ccctgagctcgg

SEQ ID NO: 6062684 - DNA, 23 bp, Homo sapiens
ccctgagctcttgctatctctca

SEQ ID NO: 6062685 - DNA, 13 bp, Homo sapiens
ccctgagctgagg

SEQ ID NO: 6062686 - DNA, 18 bp, Homo sapiens
ccctgagctttccgggga

SEQ ID NO: 6062687 - DNA, 12 bp, Homo sapiens
ccctgaggaata

SEQ ID NO: 6062688 - DNA, 23 bp, Homo sapiens
ccctgaggacaggggcatctctg

SEQ ID NO: 6062689 - DNA, 13 bp, Homo sapiens
ccctgaggacctg

SEQ ID NO: 6062690 - DNA, 12 bp, Homo sapiens
ccctgaggactg

SEQ ID NO: 6062691 - DNA, 18 bp, Homo sapiens
ccctgaggactggagacc

SEQ ID NO: 6062692 - DNA, 12 bp, Homo sapiens
ccctgaggaggc

SEQ ID NO: 6062693 - DNA, 17 bp, Homo sapiens
ccctgaggaggccgctt

SEQ ID NO: 6062694 - DNA, 21 bp, Homo sapiens
ccctgaggaggccgcttagtg

SEQ ID NO: 6062695 - DNA, 15 bp, Homo sapiens
ccctgaggagggccc

SEQ ID NO: 6062696 - DNA, 13 bp, Homo sapiens
ccctgaggagtct

SEQ ID NO: 6062697 - DNA, 21 bp, Homo sapiens
ccctgaggagtctgaggtcct

SEQ ID NO: 6062698 - DNA, 16 bp, Homo sapiens
ccctgaggagtgatgg

SEQ ID NO: 6062699 - DNA, 23 bp, Homo sapiens
ccctgaggatcccctgtcccctg

SEQ ID NO: 6062700 - DNA, 16 bp, Homo sapiens
ccctgaggcagcccag

SEQ ID NO: 6062701 - DNA, 17 bp, Homo sapiens
ccctgaggcaggtcccc

SEQ ID NO: 6062702 - DNA, 21 bp, Homo sapiens
ccctgaggcaggtccccagac

SEQ ID NO: 6062703 - DNA, 22 bp, Homo sapiens
ccctgaggcaggtgagaaccca

SEQ ID NO: 6062704 - DNA, 16 bp, Homo sapiens
ccctgaggcccagagg

SEQ ID NO: 6062705 - DNA, 14 bp, Homo sapiens
ccctgaggccctgg

SEQ ID NO: 6062706 - DNA, 17 bp, Homo sapiens
ccctgaggccctgggct

SEQ ID NO: 6062707 - DNA, 17 bp, Homo sapiens
ccctgaggcctgaggcc

SEQ ID NO: 6062708 - DNA, 18 bp, Homo sapiens
ccctgaggcctgaggcct

SEQ ID NO: 6062709 - DNA, 19 bp, Homo sapiens
ccctgaggcctgaggcctg

SEQ ID NO: 6062710 - DNA, 12 bp, Homo sapiens
ccctgaggctgg

SEQ ID NO: 6062711 - DNA, 15 bp, Homo sapiens
ccctgaggctggcat

SEQ ID NO: 6062712 - DNA, 21 bp, Homo sapiens
ccctgaggctggcatcctggc

SEQ ID NO: 6062713 - DNA, 13 bp, Homo sapiens
ccctgaggcttca

SEQ ID NO: 6062714 - DNA, 18 bp, Homo sapiens
ccctgagggacgagcaga

SEQ ID NO: 6062715 - DNA, 14 bp, Homo sapiens
ccctgagggccctt

SEQ ID NO: 6062716 - DNA, 22 bp, Homo sapiens
ccctgagggcggagcgcctcct

SEQ ID NO: 6062717 - DNA, 15 bp, Homo sapiens
ccctgagggctcctc

SEQ ID NO: 6062718 - DNA, 16 bp, Homo sapiens
ccctgagggctcctcc

SEQ ID NO: 6062719 - DNA, 17 bp, Homo sapiens
ccctgagggctcctcca

SEQ ID NO: 6062720 - DNA, 19 bp, Homo sapiens
ccctgagggctcctccatg

SEQ ID NO: 6062721 - DNA, 20 bp, Homo sapiens
ccctgagggctcctccatgg

SEQ ID NO: 6062722 - DNA, 16 bp, Homo sapiens
ccctgaggggcctgcc

SEQ ID NO: 6062723 - DNA, 19 bp, Homo sapiens
ccctgaggggctggggagg

SEQ ID NO: 6062724 - DNA, 17 bp, Homo sapiens
ccctgaggggtccctga

SEQ ID NO: 6062725 - DNA, 22 bp, Homo sapiens
ccctgagggtttccaccttggc

SEQ ID NO: 6062726 - DNA, 21 bp, Homo sapiens
ccctgaggtcagggagtgctg

SEQ ID NO: 6062727 - DNA, 20 bp, Homo sapiens
ccctgaggtgaaagggagct

SEQ ID NO: 6062728 - DNA, 17 bp, Homo sapiens
ccctgaggtgcagggga

SEQ ID NO: 6062729 - DNA, 15 bp, Homo sapiens
ccctgaggtgtgggg

SEQ ID NO: 6062730 - DNA, 20 bp, Homo sapiens
ccctgagtccgcctgcgcct

SEQ ID NO: 6062731 - DNA, 13 bp, Homo sapiens
ccctgagtcctgg

SEQ ID NO: 6062732 - DNA, 23 bp, Homo sapiens
ccctgagtctggacctccatccc

SEQ ID NO: 6062733 - DNA, 14 bp, Homo sapiens
ccctgagtgcgggc

SEQ ID NO: 6062734 - DNA, 21 bp, Homo sapiens
ccctgagtggatctccaagga

SEQ ID NO: 6062735 - DNA, 23 bp, Homo sapiens
ccctgagtggatctccaaggacc

SEQ ID NO: 6062736 - DNA, 15 bp, Homo sapiens
ccctgagtggtcact

SEQ ID NO: 6062737 - DNA, 16 bp, Homo sapiens
ccctgagtggtcactg

SEQ ID NO: 6062738 - DNA, 23 bp, Homo sapiens
ccctgagtggtcactggtcaggg

SEQ ID NO: 6062739 - DNA, 21 bp, Homo sapiens
ccctgagtgtcccaagccggg

SEQ ID NO: 6062740 - DNA, 18 bp, Homo sapiens
ccctgataacaacctgga

SEQ ID NO: 6062741 - DNA, 20 bp, Homo sapiens
ccctgatcaagtcaccggag

SEQ ID NO: 6062742 - DNA, 16 bp, Homo sapiens
ccctgatcactcccag

SEQ ID NO: 6062743 - DNA, 17 bp, Homo sapiens
ccctgatcactcccagc

SEQ ID NO: 6062744 - DNA, 16 bp, Homo sapiens
ccctgatccagacaag

SEQ ID NO: 6062745 - DNA, 13 bp, Homo sapiens
ccctgatctctga

SEQ ID NO: 6062746 - DNA, 20 bp, Homo sapiens
ccctgatctctgacctctgc

SEQ ID NO: 6062747 - DNA, 20 bp, Homo sapiens
ccctgatgacacccaccctg

SEQ ID NO: 6062748 - DNA, 20 bp, Homo sapiens
ccctgatgcaggtcagccca

SEQ ID NO: 6062749 - DNA, 18 bp, Homo sapiens
ccctgatggaccctcagt

SEQ ID NO: 6062750 - DNA, 20 bp, Homo sapiens
ccctgatgttcgccgtctgg

SEQ ID NO: 6062751 - DNA, 18 bp, Homo sapiens
ccctgattaaagtgcctt

SEQ ID NO: 6062752 - DNA, 20 bp, Homo sapiens
ccagcgaggcgaggctgcct

SEQ ID NO: 6062753 - DNA, 20 bp, Homo sapiens
ccagcgaggtgggagaggcc

SEQ ID NO: 6062754 - DNA, 15 bp, Homo sapiens
ccagcgagtggtcaa

SEQ ID NO: 6062755 - DNA, 18 bp, Homo sapiens
ccagcgatctctccactg

SEQ ID NO: 6062756 - DNA, 23 bp, Homo sapiens
ccagcgatggtgctgcccaggcc

SEQ ID NO: 6062757 - DNA, 21 bp, Homo sapiens
ccagcgattattgatcaaaat

SEQ ID NO: 6062758 - DNA, 18 bp, Homo sapiens
ccagcgattccctctccc

SEQ ID NO: 6062759 - DNA, 21 bp, Homo sapiens
ccagcgcatggcgccccgggc

SEQ ID NO: 6062760 - DNA, 24 bp, Homo sapiens
ccagcgccaagtaaacagggtacc

SEQ ID NO: 6062761 - DNA, 15 bp, Homo sapiens
ccagcgccagggccc

SEQ ID NO: 6062762 - DNA, 17 bp, Homo sapiens
ccagcgccagggcccag

SEQ ID NO: 6062763 - DNA, 21 bp, Homo sapiens
ccagcgcccccactcctcctc

SEQ ID NO: 6062764 - DNA, 14 bp, Homo sapiens
ccagcgcccccaga

SEQ ID NO: 6062765 - DNA, 17 bp, Homo sapiens
ccagcgcccctcagcct

SEQ ID NO: 6062766 - DNA, 20 bp, Homo sapiens
ccagcgcccctcagcctctg

SEQ ID NO: 6062767 - DNA, 19 bp, Homo sapiens
ccagcgcccgctgggctga

SEQ ID NO: 6062768 - DNA, 14 bp, Homo sapiens
ccagcgcctccctc

SEQ ID NO: 6062769 - DNA, 16 bp, Homo sapiens
ccagcgcctccctcca

SEQ ID NO: 6062770 - DNA, 17 bp, Homo sapiens
ccagcgcctccctccac

SEQ ID NO: 6062771 - DNA, 21 bp, Homo sapiens
ccagcgcctgccctccctggg

SEQ ID NO: 6062772 - DNA, 15 bp, Homo sapiens
ccagcgcctgtgctg

SEQ ID NO: 6062773 - DNA, 20 bp, Homo sapiens
ccagcgcggacatcccctgc

SEQ ID NO: 6062774 - DNA, 21 bp, Homo sapiens
ccagcgcggacatcccctgct

SEQ ID NO: 6062775 - DNA, 18 bp, Homo sapiens
ccagcgcggccagcgtcc

SEQ ID NO: 6062776 - DNA, 20 bp, Homo sapiens
ccagcgcggcttggccgcca

SEQ ID NO: 6062777 - DNA, 14 bp, Homo sapiens
ccagcgctgaacag

SEQ ID NO: 6062778 - DNA, 15 bp, Homo sapiens
ccagcgctgacgtgt

SEQ ID NO: 6062779 - DNA, 16 bp, Homo sapiens
ccagcgctggctccag

SEQ ID NO: 6062780 - DNA, 21 bp, Homo sapiens
ccagcgcttgaagcctgaacc

SEQ ID NO: 6062781 - DNA, 21 bp, Homo sapiens
ccagcggacagtggcaggaca

SEQ ID NO: 6062782 - DNA, 15 bp, Homo sapiens
ccagcggcccaagag

SEQ ID NO: 6062783 - DNA, 13 bp, Homo sapiens
ccagcggcccctc

SEQ ID NO: 6062784 - DNA, 17 bp, Homo sapiens
ccagcggccctcccagg

SEQ ID NO: 6062785 - DNA, 13 bp, Homo sapiens
ccagcggctccaa

SEQ ID NO: 6062786 - DNA, 14 bp, Homo sapiens
ccagcggctccaac

SEQ ID NO: 6062787 - DNA, 18 bp, Homo sapiens
ccagcggctcttcctgga

SEQ ID NO: 6062788 - DNA, 13 bp, Homo sapiens
ccagcggctgagt

SEQ ID NO: 6062789 - DNA, 12 bp, Homo sapiens
ccagcggctgct

SEQ ID NO: 6062790 - DNA, 13 bp, Homo sapiens
ccagcggctgctc

SEQ ID NO: 6062791 - DNA, 15 bp, Homo sapiens
ccagcggctgctcaa

SEQ ID NO: 6062792 - DNA, 21 bp, Homo sapiens
ccagcggctggtgcagggcct

SEQ ID NO: 6062793 - DNA, 17 bp, Homo sapiens
ccagcggcttagccaag

SEQ ID NO: 6062794 - DNA, 21 bp, Homo sapiens
ccagcggcttagccaagccct

SEQ ID NO: 6062795 - DNA, 17 bp, Homo sapiens
ccagcgggaatggcagc

SEQ ID NO: 6062796 - DNA, 16 bp, Homo sapiens
ccagcgggcacagggc

SEQ ID NO: 6062797 - DNA, 17 bp, Homo sapiens
ccagcgggcacagggca

SEQ ID NO: 6062798 - DNA, 18 bp, Homo sapiens
ccagcgggcacagggcac

SEQ ID NO: 6062799 - DNA, 19 bp, Homo sapiens
ccagcgggcacagggcacc

SEQ ID NO: 6062800 - DNA, 22 bp, Homo sapiens
ccagcgggcacagggcaccaga

SEQ ID NO: 6062801 - DNA, 12 bp, Homo sapiens
ccagcgggctgg

SEQ ID NO: 6062802 - DNA, 14 bp, Homo sapiens
ccagcggggctgct

SEQ ID NO: 6062803 - DNA, 17 bp, Homo sapiens
ccagcgtcactccagtg

SEQ ID NO: 6062804 - DNA, 22 bp, Homo sapiens
ccagcgtcactccagtgctcag

SEQ ID NO: 6062805 - DNA, 15 bp, Homo sapiens
ccagcgtcaggccta

SEQ ID NO: 6062806 - DNA, 23 bp, Homo sapiens
ccagcgtcagtttcactccctct

SEQ ID NO: 6062807 - DNA, 14 bp, Homo sapiens
ccagcgtcccaggg

SEQ ID NO: 6062808 - DNA, 15 bp, Homo sapiens
ccagcgtcccagggt

SEQ ID NO: 6062809 - DNA, 15 bp, Homo sapiens
ccagcgtcccagtct

SEQ ID NO: 6062810 - DNA, 12 bp, Homo sapiens
ccagcgtccccg

SEQ ID NO: 6062811 - DNA, 16 bp, Homo sapiens
ccagcgtcccttggtg

SEQ ID NO: 6062812 - DNA, 17 bp, Homo sapiens
ccagcgtcccttggtga

SEQ ID NO: 6062813 - DNA, 13 bp, Homo sapiens
ccagcgtcctcag

SEQ ID NO: 6062814 - DNA, 14 bp, Homo sapiens
ccagcgtcctcagc

SEQ ID NO: 6062815 - DNA, 15 bp, Homo sapiens
ccagcgtcctcagca

SEQ ID NO: 6062816 - DNA, 23 bp, Homo sapiens
ccagcgtcctcgttcaaaacatt

SEQ ID NO: 6062817 - DNA, 22 bp, Homo sapiens
ccagcgtctctcctccctcctg

SEQ ID NO: 6062818 - DNA, 13 bp, Homo sapiens
ccagcgtctgcag

SEQ ID NO: 6062819 - DNA, 15 bp, Homo sapiens
ccagcgtctgcaggg

SEQ ID NO: 6062820 - DNA, 18 bp, Homo sapiens
ccagcgtctgcagggtga

SEQ ID NO: 6062821 - DNA, 19 bp, Homo sapiens
ccagcgtctgcagggtgac

SEQ ID NO: 6062822 - DNA, 21 bp, Homo sapiens
ccagcgtgagtggtggaggag

SEQ ID NO: 6062823 - DNA, 19 bp, Homo sapiens
ccagcgtggcccaggccgg

SEQ ID NO: 6062824 - DNA, 22 bp, Homo sapiens
ccagcgtggcccaggccgggaa

SEQ ID NO: 6062825 - DNA, 24 bp, Homo sapiens
ccagcgtgggggtggccactcctg

SEQ ID NO: 6062826 - DNA, 17 bp, Homo sapiens
ccagcgtgtggagcaga

SEQ ID NO: 6062827 - DNA, 14 bp, Homo sapiens
ccagcgtgtgtatc

SEQ ID NO: 6062828 - DNA, 16 bp, Homo sapiens
ccagcgttcccttctc

SEQ ID NO: 6062829 - DNA, 17 bp, Homo sapiens
ccagcgttcccttctcc

SEQ ID NO: 6062830 - DNA, 19 bp, Homo sapiens
ccagcgttcccttctcccc

SEQ ID NO: 6062831 - DNA, 23 bp, Homo sapiens
ccagcgttcccttctcccccttg

SEQ ID NO: 6062832 - DNA, 23 bp, Homo sapiens
ccagcgtttagtttctagaggcc

SEQ ID NO: 6062833 - DNA, 16 bp, Homo sapiens
ccagcgtttattgtag

SEQ ID NO: 6062834 - DNA, 18 bp, Homo sapiens
ccagctaaacaccaaccc

SEQ ID NO: 6062835 - DNA, 17 bp, Homo sapiens
ccagctaaagaggtggg

SEQ ID NO: 6062836 - DNA, 20 bp, Homo sapiens
ccagctaaagcagtcctcca

SEQ ID NO: 6062837 - DNA, 14 bp, Homo sapiens
ccagctaaataatc

SEQ ID NO: 6062838 - DNA, 14 bp, Homo sapiens
ccagctaagaacct

SEQ ID NO: 6062839 - DNA, 17 bp, Homo sapiens
ccagctaagaacctgga

SEQ ID NO: 6062840 - DNA, 19 bp, Homo sapiens
ccagctaaggagtccctgg

SEQ ID NO: 6062841 - DNA, 15 bp, Homo sapiens
ccagctaaggggtgg

SEQ ID NO: 6062842 - DNA, 16 bp, Homo sapiens
ccagctaaggggtggg

SEQ ID NO: 6062843 - DNA, 23 bp, Homo sapiens
ccagctaataaaccagattccag

SEQ ID NO: 6062844 - DNA, 20 bp, Homo sapiens
ccagctaatctgtagggctg

SEQ ID NO: 6062845 - DNA, 21 bp, Homo sapiens
ccagctaatctgtagggctgg

SEQ ID NO: 6062846 - DNA, 22 bp, Homo sapiens
ccagctaatctgtagggctgga

SEQ ID NO: 6062847 - DNA, 16 bp, Homo sapiens
ccagctaattggtcca

SEQ ID NO: 6062848 - DNA, 14 bp, Homo sapiens
ccagctaatttttg

SEQ ID NO: 6062849 - DNA, 17 bp, Homo sapiens
ccagctaatttttgtat

SEQ ID NO: 6062850 - DNA, 21 bp, Homo sapiens
ccagctacatgggaggctgag

SEQ ID NO: 6062851 - DNA, 13 bp, Homo sapiens
ccagctacattcc

SEQ ID NO: 6062852 - DNA, 14 bp, Homo sapiens
ccagctacattcct

SEQ ID NO: 6062853 - DNA, 21 bp, Homo sapiens
ccagctacattcctcagctgc

SEQ ID NO: 6062854 - DNA, 17 bp, Homo sapiens
ccagctaccaagtcaga

SEQ ID NO: 6062855 - DNA, 16 bp, Homo sapiens
ccagctacccaggagg

SEQ ID NO: 6062856 - DNA, 18 bp, Homo sapiens
ccagctacccaggaggct

SEQ ID NO: 6062857 - DNA, 13 bp, Homo sapiens
ccagctactaagg

SEQ ID NO: 6062858 - DNA, 20 bp, Homo sapiens
ccagctactcaagaggctga

SEQ ID NO: 6062859 - DNA, 14 bp, Homo sapiens
ccagctactcagaa

SEQ ID NO: 6062860 - DNA, 17 bp, Homo sapiens
ccagctactcagaagcc

SEQ ID NO: 6062861 - DNA, 20 bp, Homo sapiens
ccagctactcagaagcctga

SEQ ID NO: 6062862 - DNA, 13 bp, Homo sapiens
ccagctactcagg

SEQ ID NO: 6062863 - DNA, 14 bp, Homo sapiens
ccagctactcagga

SEQ ID NO: 6062864 - DNA, 16 bp, Homo sapiens
ccagctactcaggagg

SEQ ID NO: 6062865 - DNA, 24 bp, Homo sapiens
ccagctactcatgaggctgaggca

SEQ ID NO: 6062866 - DNA, 17 bp, Homo sapiens
ccagctactcgggaggc

SEQ ID NO: 6062867 - DNA, 21 bp, Homo sapiens
ccagctactcgggaggctgag

SEQ ID NO: 6062868 - DNA, 17 bp, Homo sapiens
ccagctacttcctcctc

SEQ ID NO: 6062869 - DNA, 14 bp, Homo sapiens
ccagctacttggga

SEQ ID NO: 6062870 - DNA, 16 bp, Homo sapiens
ccagctacttgggagc

SEQ ID NO: 6062871 - DNA, 18 bp, Homo sapiens
ccagctacttgggagcct

SEQ ID NO: 6062872 - DNA, 16 bp, Homo sapiens
ccagctacttgggagg

SEQ ID NO: 6062873 - DNA, 19 bp, Homo sapiens
ccagctacttgggaggctg

SEQ ID NO: 6062874 - DNA, 16 bp, Homo sapiens
ccagctagggctggac

SEQ ID NO: 6062875 - DNA, 21 bp, Homo sapiens
ccagctagggggcgttattta

SEQ ID NO: 6062876 - DNA, 18 bp, Homo sapiens
ccagctagtgacccacat

SEQ ID NO: 6062877 - DNA, 15 bp, Homo sapiens
ccagctatacctgtg

SEQ ID NO: 6062878 - DNA, 15 bp, Homo sapiens
ccagctatctgcctg

SEQ ID NO: 6062879 - DNA, 19 bp, Homo sapiens
ccagctatctgcctgacag

SEQ ID NO: 6062880 - DNA, 15 bp, Homo sapiens
ccagctatctgtcat

SEQ ID NO: 6062881 - DNA, 16 bp, Homo sapiens
ccagctatggccccag

SEQ ID NO: 6062882 - DNA, 18 bp, Homo sapiens
ccagctatggccccaggg

SEQ ID NO: 6062883 - DNA, 21 bp, Homo sapiens
ccagctatttttactagaaca

SEQ ID NO: 6062884 - DNA, 17 bp, Homo sapiens
ccagctcaatggactgg

SEQ ID NO: 6062885 - DNA, 15 bp, Homo sapiens
ccagctcacaagccc

SEQ ID NO: 6062886 - DNA, 18 bp, Homo sapiens
ccagctcacaagcccagg

SEQ ID NO: 6062887 - DNA, 13 bp, Homo sapiens
ccagctcacagtg

SEQ ID NO: 6062888 - DNA, 13 bp, Homo sapiens
ccagctcaccccc

SEQ ID NO: 6062889 - DNA, 19 bp, Homo sapiens
ccagctcacccctggagga

SEQ ID NO: 6062890 - DNA, 16 bp, Homo sapiens
ccagctcagaacccag

SEQ ID NO: 6062891 - DNA, 17 bp, Homo sapiens
ccagctcagaggcccag

SEQ ID NO: 6062892 - DNA, 22 bp, Homo sapiens
ccagctcagaggcccaggaatc

SEQ ID NO: 6062893 - DNA, 15 bp, Homo sapiens
ccagctcagcactgc

SEQ ID NO: 6062894 - DNA, 12 bp, Homo sapiens
ccagctcagcag

SEQ ID NO: 6062895 - DNA, 21 bp, Homo sapiens
ccagctcagcagttcacttcc

SEQ ID NO: 6062896 - DNA, 18 bp, Homo sapiens
ccagctcagccccggcca

SEQ ID NO: 6062897 - DNA, 19 bp, Homo sapiens
ccagctcaggacagatgcc

SEQ ID NO: 6062898 - DNA, 20 bp, Homo sapiens
ccagctcaggacagatgcca

SEQ ID NO: 6062899 - DNA, 23 bp, Homo sapiens
ccagctcaggacagatgccacac

SEQ ID NO: 6062900 - DNA, 12 bp, Homo sapiens
ccagctcagggg

SEQ ID NO: 6062901 - DNA, 14 bp, Homo sapiens
ccagctcaggtgac

SEQ ID NO: 6062902 - DNA, 22 bp, Homo sapiens
ccagctcagtcccacagcccct

SEQ ID NO: 6062903 - DNA, 22 bp, Homo sapiens
ccagctcagtcccatcagagag

SEQ ID NO: 6062904 - DNA, 14 bp, Homo sapiens
ccagctcagtgcca

SEQ ID NO: 6062905 - DNA, 14 bp, Homo sapiens
ccagctcagtgttt

SEQ ID NO: 6062906 - DNA, 19 bp, Homo sapiens
ccagctcataaaatggaag

SEQ ID NO: 6062907 - DNA, 21 bp, Homo sapiens
ccagctcatctccaaggatcc

SEQ ID NO: 6062908 - DNA, 21 bp, Homo sapiens
ccagctcatgtaggtgagcct

SEQ ID NO: 6062909 - DNA, 16 bp, Homo sapiens
ccagctcattcatttt

SEQ ID NO: 6062910 - DNA, 17 bp, Homo sapiens
ccagctcattcatttta

SEQ ID NO: 6062911 - DNA, 12 bp, Homo sapiens
ccagctccaccc

SEQ ID NO: 6062912 - DNA, 17 bp, Homo sapiens
ccagctccactcagggc

SEQ ID NO: 6062913 - DNA, 14 bp, Homo sapiens
ccagctccaggccc

SEQ ID NO: 6062914 - DNA, 12 bp, Homo sapiens
ccagctccaggg

SEQ ID NO: 6062915 - DNA, 13 bp, Homo sapiens
ccagctccagggc

SEQ ID NO: 6062916 - DNA, 15 bp, Homo sapiens
ccagctccagggcca

SEQ ID NO: 6062917 - DNA, 21 bp, Homo sapiens
ccagctcccaacagaggcctc

SEQ ID NO: 6062918 - DNA, 15 bp, Homo sapiens
ccagctcccacaccg

SEQ ID NO: 6062919 - DNA, 11 bp, Homo sapiens
ccagctcccag

SEQ ID NO: 6062920 - DNA, 16 bp, Homo sapiens
ccagctcccagatggc

SEQ ID NO: 6062921 - DNA, 12 bp, Homo sapiens
ccagctcccagc

SEQ ID NO: 6062922 - DNA, 20 bp, Homo sapiens
ccagctcccaggaccacagg

SEQ ID NO: 6062923 - DNA, 23 bp, Homo sapiens
ccagctccccaagaaagcctcag

SEQ ID NO: 6062924 - DNA, 13 bp, Homo sapiens
ccagctccccagg

SEQ ID NO: 6062925 - DNA, 15 bp, Homo sapiens
ccagctccccaggac

SEQ ID NO: 6062926 - DNA, 19 bp, Homo sapiens
ccagctccccccgcccacc

SEQ ID NO: 6062927 - DNA, 15 bp, Homo sapiens
ccagctcccccggga

SEQ ID NO: 6062928 - DNA, 14 bp, Homo sapiens
ccagctccccgggg

SEQ ID NO: 6062929 - DNA, 18 bp, Homo sapiens
ccagctcccgctgtggcc

SEQ ID NO: 6062930 - DNA, 15 bp, Homo sapiens
ccagctccctcccct

SEQ ID NO: 6062931 - DNA, 19 bp, Homo sapiens
ccctgattcatactccttt

SEQ ID NO: 6062932 - DNA, 23 bp, Homo sapiens
ccctgattgacctgctccgctgc

SEQ ID NO: 6062933 - DNA, 24 bp, Homo sapiens
ccctgattgacctgctccgctgct

SEQ ID NO: 6062934 - DNA, 18 bp, Homo sapiens
ccctgattgtgccagtgc

SEQ ID NO: 6062935 - DNA, 21 bp, Homo sapiens
ccctgatttaatatgcaaagt

SEQ ID NO: 6062936 - DNA, 16 bp, Homo sapiens
ccctgatttcttgctt

SEQ ID NO: 6062937 - DNA, 18 bp, Homo sapiens
ccctgatttgctgggcag

SEQ ID NO: 6062938 - DNA, 15 bp, Homo sapiens
ccctgatttgctgtt

SEQ ID NO: 6062939 - DNA, 17 bp, Homo sapiens
ccctgcaaaactccagg

SEQ ID NO: 6062940 - DNA, 22 bp, Homo sapiens
ccctgcaaaactccaggcagga

SEQ ID NO: 6062941 - DNA, 20 bp, Homo sapiens
ccctgcaaaaggactctcag

SEQ ID NO: 6062942 - DNA, 22 bp, Homo sapiens
ccctgcaaacagaacagggtca

SEQ ID NO: 6062943 - DNA, 24 bp, Homo sapiens
ccctgcaaacagaacagggtcatg

SEQ ID NO: 6062944 - DNA, 21 bp, Homo sapiens
ccctgcaaagacagtatttat

SEQ ID NO: 6062945 - DNA, 15 bp, Homo sapiens
ccctgcaaagcccag

SEQ ID NO: 6062946 - DNA, 17 bp, Homo sapiens
ccctgcaaagcccagct

SEQ ID NO: 6062947 - DNA, 19 bp, Homo sapiens
ccctgcaaagcccagcttg

SEQ ID NO: 6062948 - DNA, 16 bp, Homo sapiens
ccctgcaaaggactgt

SEQ ID NO: 6062949 - DNA, 23 bp, Homo sapiens
ccctgcaaatttttttgtatttt

SEQ ID NO: 6062950 - DNA, 12 bp, Homo sapiens
ccctgcaagaca

SEQ ID NO: 6062951 - DNA, 18 bp, Homo sapiens
ccctgcaagacacaggct

SEQ ID NO: 6062952 - DNA, 14 bp, Homo sapiens
ccctgcaagcccgt

SEQ ID NO: 6062953 - DNA, 19 bp, Homo sapiens
ccctgcaatgcgtcttgtg

SEQ ID NO: 6062954 - DNA, 16 bp, Homo sapiens
ccctgcacaagccagg

SEQ ID NO: 6062955 - DNA, 15 bp, Homo sapiens
ccctgcacacacctg

SEQ ID NO: 6062956 - DNA, 20 bp, Homo sapiens
ccctgcacacacctgcacac

SEQ ID NO: 6062957 - DNA, 14 bp, Homo sapiens
ccctgcacagcagg

SEQ ID NO: 6062958 - DNA, 14 bp, Homo sapiens
ccctgcacaggcac

SEQ ID NO: 6062959 - DNA, 22 bp, Homo sapiens
ccctgcacagtgacttctgaga

SEQ ID NO: 6062960 - DNA, 18 bp, Homo sapiens
ccctgcaccaggccatca

SEQ ID NO: 6062961 - DNA, 12 bp, Homo sapiens
ccctgcacccac

SEQ ID NO: 6062962 - DNA, 16 bp, Homo sapiens
ccctgcacccacccct

SEQ ID NO: 6062963 - DNA, 21 bp, Homo sapiens
ccctgcacccacccctgccca

SEQ ID NO: 6062964 - DNA, 23 bp, Homo sapiens
ccctgcacccacccctgcccagg

SEQ ID NO: 6062965 - DNA, 13 bp, Homo sapiens
ccctgcaccctgg

SEQ ID NO: 6062966 - DNA, 20 bp, Homo sapiens
ccctgcaccgccgcagaagc

SEQ ID NO: 6062967 - DNA, 21 bp, Homo sapiens
ccctgcaccgccgcagaagca

SEQ ID NO: 6062968 - DNA, 14 bp, Homo sapiens
ccctgcacctgctg

SEQ ID NO: 6062969 - DNA, 15 bp, Homo sapiens
ccctgcacctgctgc

SEQ ID NO: 6062970 - DNA, 16 bp, Homo sapiens
ccctgcacctgctgcg

SEQ ID NO: 6062971 - DNA, 16 bp, Homo sapiens
ccctgcacctggcctg

SEQ ID NO: 6062972 - DNA, 15 bp, Homo sapiens
ccctgcaccttcccc

SEQ ID NO: 6062973 - DNA, 15 bp, Homo sapiens
ccctgcaccttgggc

SEQ ID NO: 6062974 - DNA, 13 bp, Homo sapiens
ccctgcacgtcat

SEQ ID NO: 6062975 - DNA, 15 bp, Homo sapiens
ccctgcacgtcatgg

SEQ ID NO: 6062976 - DNA, 21 bp, Homo sapiens
ccctgcactaaagccagcctg

SEQ ID NO: 6062977 - DNA, 18 bp, Homo sapiens
ccctgcactaggcaggta

SEQ ID NO: 6062978 - DNA, 13 bp, Homo sapiens
ccctgcactcccg

SEQ ID NO: 6062979 - DNA, 10 bp, Homo sapiens
ccctgcactg

SEQ ID NO: 6062980 - DNA, 16 bp, Homo sapiens
ccctgcactgtaaaat

SEQ ID NO: 6062981 - DNA, 17 bp, Homo sapiens
ccctgcactgtaaaatg

SEQ ID NO: 6062982 - DNA, 18 bp, Homo sapiens
ccctgcactgtcctgctc

SEQ ID NO: 6062983 - DNA, 15 bp, Homo sapiens
ccctgcactgtgccc

SEQ ID NO: 6062984 - DNA, 13 bp, Homo sapiens
ccctgcagaccct

SEQ ID NO: 6062985 - DNA, 19 bp, Homo sapiens
ccctgcagaccctgccctt

SEQ ID NO: 6062986 - DNA, 14 bp, Homo sapiens
ccctgcagacctca

SEQ ID NO: 6062987 - DNA, 16 bp, Homo sapiens
ccctgcagagcaataa

SEQ ID NO: 6062988 - DNA, 21 bp, Homo sapiens
ccctgcagagcaataacacta

SEQ ID NO: 6062989 - DNA, 18 bp, Homo sapiens
ccctgcagagggcacaga

SEQ ID NO: 6062990 - DNA, 18 bp, Homo sapiens
ccctgcagatgccaccct

SEQ ID NO: 6062991 - DNA, 20 bp, Homo sapiens
ccctgcagatgccaccctag

SEQ ID NO: 6062992 - DNA, 21 bp, Homo sapiens
ccctgcagattctgagcaaag

SEQ ID NO: 6062993 - DNA, 22 bp, Homo sapiens
ccctgcagcacgcggccttgtc

SEQ ID NO: 6062994 - DNA, 21 bp, Homo sapiens
ccctgcagcacggacaataaa

SEQ ID NO: 6062995 - DNA, 23 bp, Homo sapiens
ccctgcagcccaaaacccagggc

SEQ ID NO: 6062996 - DNA, 13 bp, Homo sapiens
ccctgcagcccag

SEQ ID NO: 6062997 - DNA, 13 bp, Homo sapiens
ccctgcagccctg

SEQ ID NO: 6062998 - DNA, 21 bp, Homo sapiens
ccctgcagcggtggttgtcac

SEQ ID NO: 6062999 - DNA, 21 bp, Homo sapiens
ccctgcagctctcatgctgcc

SEQ ID NO: 6063000 - DNA, 14 bp, Homo sapiens
ccctgcagctgacc

SEQ ID NO: 6063001 - DNA, 22 bp, Homo sapiens
ccctgcagcttgtagccagccg

SEQ ID NO: 6063002 - DNA, 15 bp, Homo sapiens
ccctgcagctttgag

SEQ ID NO: 6063003 - DNA, 17 bp, Homo sapiens
ccctgcaggaaggagct

SEQ ID NO: 6063004 - DNA, 13 bp, Homo sapiens
ccctgcaggagca

SEQ ID NO: 6063005 - DNA, 15 bp, Homo sapiens
ccctgcaggagcagg

SEQ ID NO: 6063006 - DNA, 16 bp, Homo sapiens
ccctgcaggagcaggg

SEQ ID NO: 6063007 - DNA, 22 bp, Homo sapiens
ccctgcaggagcagggcggctg

SEQ ID NO: 6063008 - DNA, 23 bp, Homo sapiens
ccctgcaggaggcctgggagggc

SEQ ID NO: 6063009 - DNA, 14 bp, Homo sapiens
ccctgcaggcacag

SEQ ID NO: 6063010 - DNA, 12 bp, Homo sapiens
ccctgcaggcag

SEQ ID NO: 6063011 - DNA, 14 bp, Homo sapiens
ccctgcaggccagg

SEQ ID NO: 6063012 - DNA, 15 bp, Homo sapiens
ccctgcaggccaggc

SEQ ID NO: 6063013 - DNA, 21 bp, Homo sapiens
ccctgcaggccaggccagctt

SEQ ID NO: 6063014 - DNA, 22 bp, Homo sapiens
ccctgcaggctgcaggagggca

SEQ ID NO: 6063015 - DNA, 12 bp, Homo sapiens
ccctgcagggca

SEQ ID NO: 6063016 - DNA, 14 bp, Homo sapiens
ccctgcagggccgg

SEQ ID NO: 6063017 - DNA, 21 bp, Homo sapiens
ccctgcagggcgcccctggga

SEQ ID NO: 6063018 - DNA, 13 bp, Homo sapiens
ccctgcaggggag

SEQ ID NO: 6063019 - DNA, 13 bp, Homo sapiens
ccctgcagtgttc

SEQ ID NO: 6063020 - DNA, 21 bp, Homo sapiens
ccctgcagtgttcgcttggct

SEQ ID NO: 6063021 - DNA, 22 bp, Homo sapiens
ccctgcagttcccctggaagca

SEQ ID NO: 6063022 - DNA, 22 bp, Homo sapiens
ccctgcagtttggccctggagc

SEQ ID NO: 6063023 - DNA, 21 bp, Homo sapiens
ccctgcataatgttaagcttt

SEQ ID NO: 6063024 - DNA, 18 bp, Homo sapiens
ccctgcatatgcttctga

SEQ ID NO: 6063025 - DNA, 12 bp, Homo sapiens
ccctgcatcccc

SEQ ID NO: 6063026 - DNA, 13 bp, Homo sapiens
ccctgcatcctga

SEQ ID NO: 6063027 - DNA, 20 bp, Homo sapiens
ccctgcatcctgaggccagt

SEQ ID NO: 6063028 - DNA, 16 bp, Homo sapiens
ccctgcatctgtctgc

SEQ ID NO: 6063029 - DNA, 17 bp, Homo sapiens
ccctgcatctgtctgct

SEQ ID NO: 6063030 - DNA, 12 bp, Homo sapiens
ccctgcatgcct

SEQ ID NO: 6063031 - DNA, 15 bp, Homo sapiens
ccctgcatgcctggc

SEQ ID NO: 6063032 - DNA, 18 bp, Homo sapiens
ccctgcatgcctggcccc

SEQ ID NO: 6063033 - DNA, 21 bp, Homo sapiens
ccctgcatgcctggcccctcc

SEQ ID NO: 6063034 - DNA, 14 bp, Homo sapiens
ccctgcattggcct

SEQ ID NO: 6063035 - DNA, 22 bp, Homo sapiens
ccctgcattggcctggcctcca

SEQ ID NO: 6063036 - DNA, 14 bp, Homo sapiens
ccctgcattttcct

SEQ ID NO: 6063037 - DNA, 21 bp, Homo sapiens
ccctgcattttcctcttgtcc

SEQ ID NO: 6063038 - DNA, 14 bp, Homo sapiens
ccctgccaactcca

SEQ ID NO: 6063039 - DNA, 18 bp, Homo sapiens
ccctgccaactttccaga

SEQ ID NO: 6063040 - DNA, 20 bp, Homo sapiens
ccctgccaactttccagact

SEQ ID NO: 6063041 - DNA, 15 bp, Homo sapiens
ccctgccaagcctgg

SEQ ID NO: 6063042 - DNA, 17 bp, Homo sapiens
ccctgccaagcctggag

SEQ ID NO: 6063043 - DNA, 18 bp, Homo sapiens
ccctgccaagcctggagc

SEQ ID NO: 6063044 - DNA, 23 bp, Homo sapiens
ccctgccaagcctggagcccctg

SEQ ID NO: 6063045 - DNA, 17 bp, Homo sapiens
ccctgccaagtctcaga

SEQ ID NO: 6063046 - DNA, 18 bp, Homo sapiens
ccctgccacactcagtcc

SEQ ID NO: 6063047 - DNA, 16 bp, Homo sapiens
ccctgccacagccaga

SEQ ID NO: 6063048 - DNA, 17 bp, Homo sapiens
ccctgccacagccagag

SEQ ID NO: 6063049 - DNA, 17 bp, Homo sapiens
ccctgccacatacaggt

SEQ ID NO: 6063050 - DNA, 18 bp, Homo sapiens
ccctgccacatacaggtg

SEQ ID NO: 6063051 - DNA, 20 bp, Homo sapiens
ccctgccacatacaggtgct

SEQ ID NO: 6063052 - DNA, 15 bp, Homo sapiens
ccctgccaccaggcc

SEQ ID NO: 6063053 - DNA, 22 bp, Homo sapiens
ccctgccaccctctgctgcaca

SEQ ID NO: 6063054 - DNA, 23 bp, Homo sapiens
ccctgccaccctctgctgcacag

SEQ ID NO: 6063055 - DNA, 13 bp, Homo sapiens
ccctgccaccgac

SEQ ID NO: 6063056 - DNA, 16 bp, Homo sapiens
ccctgccaccgactgc

SEQ ID NO: 6063057 - DNA, 17 bp, Homo sapiens
ccctgccaccgactgcc

SEQ ID NO: 6063058 - DNA, 14 bp, Homo sapiens
ccctgccacctccc

SEQ ID NO: 6063059 - DNA, 17 bp, Homo sapiens
ccctgccacctcctgcc

SEQ ID NO: 6063060 - DNA, 13 bp, Homo sapiens
ccctgccactcac

SEQ ID NO: 6063061 - DNA, 14 bp, Homo sapiens
ccctgccactcacc

SEQ ID NO: 6063062 - DNA, 15 bp, Homo sapiens
ccctgccactcaccc

SEQ ID NO: 6063063 - DNA, 14 bp, Homo sapiens
ccctgccactcctc

SEQ ID NO: 6063064 - DNA, 21 bp, Homo sapiens
ccctgccagaccccctggaga

SEQ ID NO: 6063065 - DNA, 14 bp, Homo sapiens
ccctgccagagcag

SEQ ID NO: 6063066 - DNA, 17 bp, Homo sapiens
ccctgccagaggcctgg

SEQ ID NO: 6063067 - DNA, 16 bp, Homo sapiens
ccctgccagaggggaa

SEQ ID NO: 6063068 - DNA, 17 bp, Homo sapiens
ccctgccagcaccccca

SEQ ID NO: 6063069 - DNA, 23 bp, Homo sapiens
ccctgccagcacccccacgccct

SEQ ID NO: 6063070 - DNA, 21 bp, Homo sapiens
ccctgccaggcacaggcaggg

SEQ ID NO: 6063071 - DNA, 22 bp, Homo sapiens
ccctgccaggcacaggcagggc

SEQ ID NO: 6063072 - DNA, 12 bp, Homo sapiens
ccctgccaggct

SEQ ID NO: 6063073 - DNA, 17 bp, Homo sapiens
ccctgccaggctgtcag

SEQ ID NO: 6063074 - DNA, 21 bp, Homo sapiens
ccctgccaggctgtcagcgcc

SEQ ID NO: 6063075 - DNA, 14 bp, Homo sapiens
ccctgccagggcag

SEQ ID NO: 6063076 - DNA, 15 bp, Homo sapiens
ccctgccagggctcg

SEQ ID NO: 6063077 - DNA, 22 bp, Homo sapiens
ccctgccagtgaagtccttcag

SEQ ID NO: 6063078 - DNA, 20 bp, Homo sapiens
ccctgccagtgccagggtgg

SEQ ID NO: 6063079 - DNA, 14 bp, Homo sapiens
ccctgccagtgcct

SEQ ID NO: 6063080 - DNA, 20 bp, Homo sapiens
ccctgccatcatgtttacag

SEQ ID NO: 6063081 - DNA, 13 bp, Homo sapiens
ccctgccatcccc

SEQ ID NO: 6063082 - DNA, 16 bp, Homo sapiens
ccctgccatccccctc

SEQ ID NO: 6063083 - DNA, 15 bp, Homo sapiens
ccctgccatggaggc

SEQ ID NO: 6063084 - DNA, 10 bp, Homo sapiens
ccctgcccaa

SEQ ID NO: 6063085 - DNA, 14 bp, Homo sapiens
ccctgcccaagggc

SEQ ID NO: 6063086 - DNA, 20 bp, Homo sapiens
ccctgcccaagggcctccca

SEQ ID NO: 6063087 - DNA, 22 bp, Homo sapiens
ccctgcccaagggcctcccacc

SEQ ID NO: 6063088 - DNA, 14 bp, Homo sapiens
ccctgcccaagtga

SEQ ID NO: 6063089 - DNA, 21 bp, Homo sapiens
ccctgcccaagtggctcttgg

SEQ ID NO: 6063090 - DNA, 23 bp, Homo sapiens
ccctgcccaagtggctcttggga

SEQ ID NO: 6063091 - DNA, 20 bp, Homo sapiens
ccctgcccaatcctccctgg

SEQ ID NO: 6063092 - DNA, 18 bp, Homo sapiens
ccctgcccacacctcctg

SEQ ID NO: 6063093 - DNA, 20 bp, Homo sapiens
ccctgcccacacctcctggg

SEQ ID NO: 6063094 - DNA, 13 bp, Homo sapiens
ccctgcccacaga

SEQ ID NO: 6063095 - DNA, 16 bp, Homo sapiens
ccctgcccaccccatc

SEQ ID NO: 6063096 - DNA, 20 bp, Homo sapiens
ccctgcccaccccatccctg

SEQ ID NO: 6063097 - DNA, 18 bp, Homo sapiens
ccctgcccacccccggga

SEQ ID NO: 6063098 - DNA, 20 bp, Homo sapiens
ccctgcccaccctctggaga

SEQ ID NO: 6063099 - DNA, 20 bp, Homo sapiens
ccctgcccacctggcctctg

SEQ ID NO: 6063100 - DNA, 22 bp, Homo sapiens
ccctgcccacctggcctctgca

SEQ ID NO: 6063101 - DNA, 21 bp, Homo sapiens
ccctgcccacgcccttggagc

SEQ ID NO: 6063102 - DNA, 13 bp, Homo sapiens
ccctgcccagcac

SEQ ID NO: 6063103 - DNA, 16 bp, Homo sapiens
ccctgcccagcacctc

SEQ ID NO: 6063104 - DNA, 18 bp, Homo sapiens
ccctgcccagcacctcct

SEQ ID NO: 6063105 - DNA, 14 bp, Homo sapiens
ccctgcccagccag

SEQ ID NO: 6063106 - DNA, 16 bp, Homo sapiens
ccctgcccagcctgct

SEQ ID NO: 6063107 - DNA, 20 bp, Homo sapiens
ccctgcccagcctgtggtgc

SEQ ID NO: 6063108 - DNA, 20 bp, Homo sapiens
ccctgcccaggcagtctttg

SEQ ID NO: 6063109 - DNA, 20 bp, Homo sapiens
ccagctccctcccctgctca

SEQ ID NO: 6063110 - DNA, 14 bp, Homo sapiens
ccagctccctctat

SEQ ID NO: 6063111 - DNA, 16 bp, Homo sapiens
ccagctccctctattt

SEQ ID NO: 6063112 - DNA, 14 bp, Homo sapiens
ccagctccctgcac

SEQ ID NO: 6063113 - DNA, 15 bp, Homo sapiens
ccagctccctgcacc

SEQ ID NO: 6063114 - DNA, 22 bp, Homo sapiens
ccagctccctgtgcccccaggg

SEQ ID NO: 6063115 - DNA, 18 bp, Homo sapiens
ccagctcccttgggaagg

SEQ ID NO: 6063116 - DNA, 18 bp, Homo sapiens
ccagctccgacctctctc

SEQ ID NO: 6063117 - DNA, 19 bp, Homo sapiens
ccagctccgcgccaggatg

SEQ ID NO: 6063118 - DNA, 19 bp, Homo sapiens
ccagctccggcctgtcctc

SEQ ID NO: 6063119 - DNA, 21 bp, Homo sapiens
ccagctccgtgtttctctaag

SEQ ID NO: 6063120 - DNA, 23 bp, Homo sapiens
ccagctccgtttctaccaccgca

SEQ ID NO: 6063121 - DNA, 13 bp, Homo sapiens
ccagctcctcaca

SEQ ID NO: 6063122 - DNA, 16 bp, Homo sapiens
ccagctcctcacatac

SEQ ID NO: 6063123 - DNA, 20 bp, Homo sapiens
ccagctcctccgtgcttcct

SEQ ID NO: 6063124 - DNA, 11 bp, Homo sapiens
ccagctcctct

SEQ ID NO: 6063125 - DNA, 20 bp, Homo sapiens
ccagctcctctaggggcagc

SEQ ID NO: 6063126 - DNA, 23 bp, Homo sapiens
ccagctcctctaggggcagcctc

SEQ ID NO: 6063127 - DNA, 14 bp, Homo sapiens
ccagctcctctcca

SEQ ID NO: 6063128 - DNA, 15 bp, Homo sapiens
ccagctcctctccag

SEQ ID NO: 6063129 - DNA, 19 bp, Homo sapiens
ccagctcctctccagacac

SEQ ID NO: 6063130 - DNA, 16 bp, Homo sapiens
ccagctcctctctgaa

SEQ ID NO: 6063131 - DNA, 14 bp, Homo sapiens
ccagctcctctgag

SEQ ID NO: 6063132 - DNA, 16 bp, Homo sapiens
ccagctcctctgagcc

SEQ ID NO: 6063133 - DNA, 11 bp, Homo sapiens
ccagctcctga

SEQ ID NO: 6063134 - DNA, 14 bp, Homo sapiens
ccagctcctgaata

SEQ ID NO: 6063135 - DNA, 12 bp, Homo sapiens
ccagctcctgac

SEQ ID NO: 6063136 - DNA, 20 bp, Homo sapiens
ccagctcctgacactgctgg

SEQ ID NO: 6063137 - DNA, 15 bp, Homo sapiens
ccagctcctgccccg

SEQ ID NO: 6063138 - DNA, 21 bp, Homo sapiens
ccagctcctgccccgccggcc

SEQ ID NO: 6063139 - DNA, 20 bp, Homo sapiens
ccagctcctggtagctgatg

SEQ ID NO: 6063140 - DNA, 14 bp, Homo sapiens
ccagctccttagac

SEQ ID NO: 6063141 - DNA, 18 bp, Homo sapiens
ccagctccttggctgcag

SEQ ID NO: 6063142 - DNA, 22 bp, Homo sapiens
ccagctccttggctgcagccat

SEQ ID NO: 6063143 - DNA, 23 bp, Homo sapiens
ccagctccttggggcagggcctg

SEQ ID NO: 6063144 - DNA, 21 bp, Homo sapiens
ccagctcctttcccttttcca

SEQ ID NO: 6063145 - DNA, 22 bp, Homo sapiens
ccagctcctttctcctgtgaat

SEQ ID NO: 6063146 - DNA, 16 bp, Homo sapiens
ccagctccttttctgt

SEQ ID NO: 6063147 - DNA, 17 bp, Homo sapiens
ccagctccttttctgtg

SEQ ID NO: 6063148 - DNA, 21 bp, Homo sapiens
ccagctccttttgtccccagg

SEQ ID NO: 6063149 - DNA, 16 bp, Homo sapiens
ccagctcgctggcttt

SEQ ID NO: 6063150 - DNA, 18 bp, Homo sapiens
ccagctcgctggctttct

SEQ ID NO: 6063151 - DNA, 22 bp, Homo sapiens
ccagctcgctggctttctctct

SEQ ID NO: 6063152 - DNA, 17 bp, Homo sapiens
ccagctctaagcagcca

SEQ ID NO: 6063153 - DNA, 16 bp, Homo sapiens
ccagctctacattctg

SEQ ID NO: 6063154 - DNA, 21 bp, Homo sapiens
ccagctctacattctgctctg

SEQ ID NO: 6063155 - DNA, 22 bp, Homo sapiens
ccagctctacattctgctctgc

SEQ ID NO: 6063156 - DNA, 23 bp, Homo sapiens
ccagctctacattctgctctgcc

SEQ ID NO: 6063157 - DNA, 16 bp, Homo sapiens
ccagctctacgtccca

SEQ ID NO: 6063158 - DNA, 17 bp, Homo sapiens
ccagctctagcctctgg

SEQ ID NO: 6063159 - DNA, 13 bp, Homo sapiens
ccagctctcagcc

SEQ ID NO: 6063160 - DNA, 21 bp, Homo sapiens
ccagctctcagttacaagtgc

SEQ ID NO: 6063161 - DNA, 16 bp, Homo sapiens
ccagctctcccctgcg

SEQ ID NO: 6063162 - DNA, 14 bp, Homo sapiens
ccagctctccctct

SEQ ID NO: 6063163 - DNA, 18 bp, Homo sapiens
ccagctctccctctggcc

SEQ ID NO: 6063164 - DNA, 20 bp, Homo sapiens
ccagctctccctctggccct

SEQ ID NO: 6063165 - DNA, 21 bp, Homo sapiens
ccagctctccctctggccctg

SEQ ID NO: 6063166 - DNA, 14 bp, Homo sapiens
ccagctctcttcct

SEQ ID NO: 6063167 - DNA, 16 bp, Homo sapiens
ccagctctcttcctgt

SEQ ID NO: 6063168 - DNA, 19 bp, Homo sapiens
ccagctctcttcctgtctt

SEQ ID NO: 6063169 - DNA, 17 bp, Homo sapiens
ccagctctcttctggct

SEQ ID NO: 6063170 - DNA, 15 bp, Homo sapiens
ccagctctgaaacca

SEQ ID NO: 6063171 - DNA, 21 bp, Homo sapiens
ccagctctgaaaccagtgtta

SEQ ID NO: 6063172 - DNA, 13 bp, Homo sapiens
ccagctctgacat

SEQ ID NO: 6063173 - DNA, 13 bp, Homo sapiens
ccagctctgagca

SEQ ID NO: 6063174 - DNA, 15 bp, Homo sapiens
ccagctctgagcaga

SEQ ID NO: 6063175 - DNA, 21 bp, Homo sapiens
ccagctctgagcagacagggc

SEQ ID NO: 6063176 - DNA, 18 bp, Homo sapiens
ccagctctgaggggaggg

SEQ ID NO: 6063177 - DNA, 14 bp, Homo sapiens
ccagctctggaggg

SEQ ID NO: 6063178 - DNA, 13 bp, Homo sapiens
ccagctctggagt

SEQ ID NO: 6063179 - DNA, 18 bp, Homo sapiens
ccagctctggatgaaggc

SEQ ID NO: 6063180 - DNA, 19 bp, Homo sapiens
ccagctctggatgaaggca

SEQ ID NO: 6063181 - DNA, 24 bp, Homo sapiens
ccagctctggctcagggcccacct

SEQ ID NO: 6063182 - DNA, 11 bp, Homo sapiens
ccagctctggt

SEQ ID NO: 6063183 - DNA, 13 bp, Homo sapiens
ccagctctggtcc

SEQ ID NO: 6063184 - DNA, 14 bp, Homo sapiens
ccagctctggtcca

SEQ ID NO: 6063185 - DNA, 14 bp, Homo sapiens
ccagctctgtatca

SEQ ID NO: 6063186 - DNA, 21 bp, Homo sapiens
ccagctctgtatcaggaccca

SEQ ID NO: 6063187 - DNA, 17 bp, Homo sapiens
ccagctctgtcaccctg

SEQ ID NO: 6063188 - DNA, 11 bp, Homo sapiens
ccagctctgtg

SEQ ID NO: 6063189 - DNA, 12 bp, Homo sapiens
ccagctctgtgg

SEQ ID NO: 6063190 - DNA, 13 bp, Homo sapiens
ccagctctgtggc

SEQ ID NO: 6063191 - DNA, 22 bp, Homo sapiens
ccagctctgtggcctgtgtcca

SEQ ID NO: 6063192 - DNA, 20 bp, Homo sapiens
ccagctctgtgggccctacc

SEQ ID NO: 6063193 - DNA, 22 bp, Homo sapiens
ccagctctgtgggccctaccct

SEQ ID NO: 6063194 - DNA, 12 bp, Homo sapiens
ccagctctgttc

SEQ ID NO: 6063195 - DNA, 23 bp, Homo sapiens
ccagctctgttcttcctcagcca

SEQ ID NO: 6063196 - DNA, 19 bp, Homo sapiens
ccagctcttgctctcttgt

SEQ ID NO: 6063197 - DNA, 11 bp, Homo sapiens
ccagctcttgg

SEQ ID NO: 6063198 - DNA, 15 bp, Homo sapiens
ccagctctttattac

SEQ ID NO: 6063199 - DNA, 16 bp, Homo sapiens
ccagctctttcctcct

SEQ ID NO: 6063200 - DNA, 17 bp, Homo sapiens
ccagctctttcctcctt

SEQ ID NO: 6063201 - DNA, 16 bp, Homo sapiens
ccagctctttggtgcc

SEQ ID NO: 6063202 - DNA, 21 bp, Homo sapiens
ccagctgaaatactgaggggt

SEQ ID NO: 6063203 - DNA, 15 bp, Homo sapiens
ccagctgaaggcagt

SEQ ID NO: 6063204 - DNA, 17 bp, Homo sapiens
ccagctgaaggcagtgg

SEQ ID NO: 6063205 - DNA, 18 bp, Homo sapiens
ccagctgaaggcagtggc

SEQ ID NO: 6063206 - DNA, 22 bp, Homo sapiens
ccagctgaaggcagtggcaggg

SEQ ID NO: 6063207 - DNA, 21 bp, Homo sapiens
ccagctgacagtcctctccac

SEQ ID NO: 6063208 - DNA, 21 bp, Homo sapiens
ccagctgacatcttgaatcct

SEQ ID NO: 6063209 - DNA, 22 bp, Homo sapiens
ccagctgaccctggttctctct

SEQ ID NO: 6063210 - DNA, 17 bp, Homo sapiens
ccagctgactaaacttt

SEQ ID NO: 6063211 - DNA, 15 bp, Homo sapiens
ccagctgaggctggg

SEQ ID NO: 6063212 - DNA, 14 bp, Homo sapiens
ccagctgagtcctg

SEQ ID NO: 6063213 - DNA, 17 bp, Homo sapiens
ccagctgagtcctgggg

SEQ ID NO: 6063214 - DNA, 21 bp, Homo sapiens
ccagctgagtctatgtaggtg

SEQ ID NO: 6063215 - DNA, 13 bp, Homo sapiens
ccagctgcaaagt

SEQ ID NO: 6063216 - DNA, 14 bp, Homo sapiens
ccagctgcaaagtg

SEQ ID NO: 6063217 - DNA, 16 bp, Homo sapiens
ccagctgcaccagagc

SEQ ID NO: 6063218 - DNA, 17 bp, Homo sapiens
ccagctgcaccagagca

SEQ ID NO: 6063219 - DNA, 13 bp, Homo sapiens
ccagctgcacccc

SEQ ID NO: 6063220 - DNA, 17 bp, Homo sapiens
ccagctgcaccccttcc

SEQ ID NO: 6063221 - DNA, 20 bp, Homo sapiens
ccagctgcaccccttcctgg

SEQ ID NO: 6063222 - DNA, 22 bp, Homo sapiens
ccagctgcacctgccagcctgg

SEQ ID NO: 6063223 - DNA, 13 bp, Homo sapiens
ccagctgcactga

SEQ ID NO: 6063224 - DNA, 14 bp, Homo sapiens
ccagctgcactgat

SEQ ID NO: 6063225 - DNA, 18 bp, Homo sapiens
ccagctgcactgatgctg

SEQ ID NO: 6063226 - DNA, 16 bp, Homo sapiens
ccagctgcagaccatg

SEQ ID NO: 6063227 - DNA, 23 bp, Homo sapiens
ccagctgcagcctggttggcagc

SEQ ID NO: 6063228 - DNA, 20 bp, Homo sapiens
ccagctgcaggaatcaaaaa

SEQ ID NO: 6063229 - DNA, 15 bp, Homo sapiens
ccagctgccaagtgc

SEQ ID NO: 6063230 - DNA, 13 bp, Homo sapiens
ccagctgccaggg

SEQ ID NO: 6063231 - DNA, 15 bp, Homo sapiens
ccagctgccagggaa

SEQ ID NO: 6063232 - DNA, 21 bp, Homo sapiens
ccagctgccagggaagacaga

SEQ ID NO: 6063233 - DNA, 11 bp, Homo sapiens
ccagctgcccc

SEQ ID NO: 6063234 - DNA, 19 bp, Homo sapiens
ccagctgcccccagagcca

SEQ ID NO: 6063235 - DNA, 21 bp, Homo sapiens
ccagctgcccccagagccaca

SEQ ID NO: 6063236 - DNA, 13 bp, Homo sapiens
ccagctgcccctc

SEQ ID NO: 6063237 - DNA, 14 bp, Homo sapiens
ccagctgcccctcc

SEQ ID NO: 6063238 - DNA, 17 bp, Homo sapiens
ccagctgcccctccctg

SEQ ID NO: 6063239 - DNA, 19 bp, Homo sapiens
ccagctgcccctccctgcc

SEQ ID NO: 6063240 - DNA, 20 bp, Homo sapiens
ccagctgccctatgggcctg

SEQ ID NO: 6063241 - DNA, 21 bp, Homo sapiens
ccagctgccctatgggcctgc

SEQ ID NO: 6063242 - DNA, 16 bp, Homo sapiens
ccagctgcccttccgc

SEQ ID NO: 6063243 - DNA, 18 bp, Homo sapiens
ccagctgcccttgcaggg

SEQ ID NO: 6063244 - DNA, 11 bp, Homo sapiens
ccagctgccta

SEQ ID NO: 6063245 - DNA, 18 bp, Homo sapiens
ccagctgcctaggattca

SEQ ID NO: 6063246 - DNA, 13 bp, Homo sapiens
ccagctgcctctt

SEQ ID NO: 6063247 - DNA, 22 bp, Homo sapiens
ccagctgcctctttgctgcttt

SEQ ID NO: 6063248 - DNA, 13 bp, Homo sapiens
ccagctgcctgga

SEQ ID NO: 6063249 - DNA, 22 bp, Homo sapiens
ccagctgcctggagagggtctc

SEQ ID NO: 6063250 - DNA, 14 bp, Homo sapiens
ccagctgcctgggc

SEQ ID NO: 6063251 - DNA, 21 bp, Homo sapiens
ccagctgcctgtgcctgccat

SEQ ID NO: 6063252 - DNA, 23 bp, Homo sapiens
ccagctgcctgtgcctgccatgg

SEQ ID NO: 6063253 - DNA, 24 bp, Homo sapiens
ccagctgcctgtgcctgccatggg

SEQ ID NO: 6063254 - DNA, 13 bp, Homo sapiens
ccagctgccttcc

SEQ ID NO: 6063255 - DNA, 18 bp, Homo sapiens
ccagctgcggccaggcct

SEQ ID NO: 6063256 - DNA, 19 bp, Homo sapiens
ccagctgcggccaggcctg

SEQ ID NO: 6063257 - DNA, 14 bp, Homo sapiens
ccagctgcgttttt

SEQ ID NO: 6063258 - DNA, 12 bp, Homo sapiens
ccagctgctccc

SEQ ID NO: 6063259 - DNA, 14 bp, Homo sapiens
ccagctgctcccct

SEQ ID NO: 6063260 - DNA, 16 bp, Homo sapiens
ccagctgctcccctgc

SEQ ID NO: 6063261 - DNA, 17 bp, Homo sapiens
ccagctgctcccctgga

SEQ ID NO: 6063262 - DNA, 12 bp, Homo sapiens
ccagctgctcct

SEQ ID NO: 6063263 - DNA, 14 bp, Homo sapiens
ccagctgctctgcc

SEQ ID NO: 6063264 - DNA, 19 bp, Homo sapiens
ccagctgctctgcccagag

SEQ ID NO: 6063265 - DNA, 22 bp, Homo sapiens
ccagctgctctgccccttgggc

SEQ ID NO: 6063266 - DNA, 16 bp, Homo sapiens
ccagctgctgagccgc

SEQ ID NO: 6063267 - DNA, 17 bp, Homo sapiens
ccagctgctgagccgca

SEQ ID NO: 6063268 - DNA, 22 bp, Homo sapiens
ccagctgctgctctcccctccc

SEQ ID NO: 6063269 - DNA, 16 bp, Homo sapiens
ccagctgctgctctga

SEQ ID NO: 6063270 - DNA, 12 bp, Homo sapiens
ccagctgctgga

SEQ ID NO: 6063271 - DNA, 14 bp, Homo sapiens
ccagctgctgtcag

SEQ ID NO: 6063272 - DNA, 19 bp, Homo sapiens
ccagctgctgtcttctgga

SEQ ID NO: 6063273 - DNA, 18 bp, Homo sapiens
ccagctgcttcagggagg

SEQ ID NO: 6063274 - DNA, 17 bp, Homo sapiens
ccagctgcttctgccca

SEQ ID NO: 6063275 - DNA, 18 bp, Homo sapiens
ccagctgcttctgcccac

SEQ ID NO: 6063276 - DNA, 23 bp, Homo sapiens
ccagctgcttgggcttcatcctc

SEQ ID NO: 6063277 - DNA, 13 bp, Homo sapiens
ccagctgcttttt

SEQ ID NO: 6063278 - DNA, 23 bp, Homo sapiens
ccagctggaaggtactatgccag

SEQ ID NO: 6063279 - DNA, 18 bp, Homo sapiens
ccagctggaggcaggggc

SEQ ID NO: 6063280 - DNA, 22 bp, Homo sapiens
ccagctggaggcaggggcttcc

SEQ ID NO: 6063281 - DNA, 17 bp, Homo sapiens
ccagctggatcgctgca

SEQ ID NO: 6063282 - DNA, 12 bp, Homo sapiens
ccagctggcagc

SEQ ID NO: 6063283 - DNA, 20 bp, Homo sapiens
ccagctggcagcagagtgtg

SEQ ID NO: 6063284 - DNA, 14 bp, Homo sapiens
ccagctggcagcgc

SEQ ID NO: 6063285 - DNA, 15 bp, Homo sapiens
ccagctggcagcgcc

SEQ ID NO: 6063286 - DNA, 20 bp, Homo sapiens
ccagctggcagcgcctcccg

SEQ ID NO: 6063287 - DNA, 14 bp, Homo sapiens
ccagctggcccagt

SEQ ID NO: 6063288 - DNA, 18 bp, Homo sapiens
ccctgcccaggccggcca

SEQ ID NO: 6063289 - DNA, 22 bp, Homo sapiens
ccctgcccaggccggccagcct

SEQ ID NO: 6063290 - DNA, 21 bp, Homo sapiens
ccctgcccaggtatcctgggg

SEQ ID NO: 6063291 - DNA, 23 bp, Homo sapiens
ccctgcccaggtggcctcctggc

SEQ ID NO: 6063292 - DNA, 15 bp, Homo sapiens
ccctgcccatacccc

SEQ ID NO: 6063293 - DNA, 23 bp, Homo sapiens
ccctgcccatacccctgcctggg

SEQ ID NO: 6063294 - DNA, 13 bp, Homo sapiens
ccctgcccatccg

SEQ ID NO: 6063295 - DNA, 12 bp, Homo sapiens
ccctgcccatgt

SEQ ID NO: 6063296 - DNA, 12 bp, Homo sapiens
ccctgccccaaa

SEQ ID NO: 6063297 - DNA, 12 bp, Homo sapiens
ccctgccccaac

SEQ ID NO: 6063298 - DNA, 12 bp, Homo sapiens
ccctgccccaca

SEQ ID NO: 6063299 - DNA, 18 bp, Homo sapiens
ccctgccccacacaggcc

SEQ ID NO: 6063300 - DNA, 19 bp, Homo sapiens
ccctgccccacacaggcct

SEQ ID NO: 6063301 - DNA, 15 bp, Homo sapiens
ccctgccccacacct

SEQ ID NO: 6063302 - DNA, 19 bp, Homo sapiens
ccctgccccacacctcctc

SEQ ID NO: 6063303 - DNA, 23 bp, Homo sapiens
ccctgccccaccccacctcacag

SEQ ID NO: 6063304 - DNA, 17 bp, Homo sapiens
ccctgccccaccccatc

SEQ ID NO: 6063305 - DNA, 16 bp, Homo sapiens
ccctgccccagagaag

SEQ ID NO: 6063306 - DNA, 22 bp, Homo sapiens
ccctgccccagagaagcctcag

SEQ ID NO: 6063307 - DNA, 23 bp, Homo sapiens
ccctgccccagaggtcgcagcta

SEQ ID NO: 6063308 - DNA, 16 bp, Homo sapiens
ccctgccccagcaaga

SEQ ID NO: 6063309 - DNA, 15 bp, Homo sapiens
ccctgccccagccca

SEQ ID NO: 6063310 - DNA, 16 bp, Homo sapiens
ccctgccccagcccct

SEQ ID NO: 6063311 - DNA, 15 bp, Homo sapiens
ccctgccccaggcct

SEQ ID NO: 6063312 - DNA, 14 bp, Homo sapiens
ccctgccccatgaa

SEQ ID NO: 6063313 - DNA, 15 bp, Homo sapiens
ccctgcccccaaagg

SEQ ID NO: 6063314 - DNA, 22 bp, Homo sapiens
ccctgcccccaaaggtggtctg

SEQ ID NO: 6063315 - DNA, 14 bp, Homo sapiens
ccctgcccccagga

SEQ ID NO: 6063316 - DNA, 16 bp, Homo sapiens
ccctgcccccaggact

SEQ ID NO: 6063317 - DNA, 20 bp, Homo sapiens
ccctgcccccaggactgggc

SEQ ID NO: 6063318 - DNA, 23 bp, Homo sapiens
ccctgcccccaggactgggccac

SEQ ID NO: 6063319 - DNA, 16 bp, Homo sapiens
ccctgcccccatctcc

SEQ ID NO: 6063320 - DNA, 13 bp, Homo sapiens
ccctgccccccac

SEQ ID NO: 6063321 - DNA, 23 bp, Homo sapiens
ccctgccccccacattctggctc

SEQ ID NO: 6063322 - DNA, 14 bp, Homo sapiens
ccctgccccccagc

SEQ ID NO: 6063323 - DNA, 15 bp, Homo sapiens
ccctgccccccagcc

SEQ ID NO: 6063324 - DNA, 21 bp, Homo sapiens
ccctgccccccctaagagaca

SEQ ID NO: 6063325 - DNA, 16 bp, Homo sapiens
ccctgccccctgcagg

SEQ ID NO: 6063326 - DNA, 19 bp, Homo sapiens
ccctgccccctgcaggaag

SEQ ID NO: 6063327 - DNA, 17 bp, Homo sapiens
ccctgccccctgccagc

SEQ ID NO: 6063328 - DNA, 14 bp, Homo sapiens
ccctgccccctggc

SEQ ID NO: 6063329 - DNA, 14 bp, Homo sapiens
ccctgccccgcccc

SEQ ID NO: 6063330 - DNA, 22 bp, Homo sapiens
ccctgccccgccccccagagcc

SEQ ID NO: 6063331 - DNA, 12 bp, Homo sapiens
ccctgccccggg

SEQ ID NO: 6063332 - DNA, 17 bp, Homo sapiens
ccctgccccgggatgca

SEQ ID NO: 6063333 - DNA, 21 bp, Homo sapiens
ccctgccccgtcaccatctca

SEQ ID NO: 6063334 - DNA, 18 bp, Homo sapiens
ccctgccccgttgcttcc

SEQ ID NO: 6063335 - DNA, 11 bp, Homo sapiens
ccctgccccta

SEQ ID NO: 6063336 - DNA, 17 bp, Homo sapiens
ccctgcccctaagttat

SEQ ID NO: 6063337 - DNA, 22 bp, Homo sapiens
ccctgcccctacgggcgctgca

SEQ ID NO: 6063338 - DNA, 12 bp, Homo sapiens
ccctgcccctgc

SEQ ID NO: 6063339 - DNA, 13 bp, Homo sapiens
ccctgcccctgca

SEQ ID NO: 6063340 - DNA, 16 bp, Homo sapiens
ccctgcccctgcccca

SEQ ID NO: 6063341 - DNA, 17 bp, Homo sapiens
ccctgcccctgccccgt

SEQ ID NO: 6063342 - DNA, 17 bp, Homo sapiens
ccctgcccctgcccctg

SEQ ID NO: 6063343 - DNA, 16 bp, Homo sapiens
ccctgcccctgcccga

SEQ ID NO: 6063344 - DNA, 14 bp, Homo sapiens
ccctgcccctgtcc

SEQ ID NO: 6063345 - DNA, 16 bp, Homo sapiens
ccctgcccctgtggga

SEQ ID NO: 6063346 - DNA, 20 bp, Homo sapiens
ccctgccccttaaccccaag

SEQ ID NO: 6063347 - DNA, 19 bp, Homo sapiens
ccctgcccgaccccatctc

SEQ ID NO: 6063348 - DNA, 16 bp, Homo sapiens
ccctgcccgtgtacat

SEQ ID NO: 6063349 - DNA, 20 bp, Homo sapiens
ccctgcccgttcttgaaatg

SEQ ID NO: 6063350 - DNA, 14 bp, Homo sapiens
ccctgccctcactc

SEQ ID NO: 6063351 - DNA, 14 bp, Homo sapiens
ccctgccctcatgg

SEQ ID NO: 6063352 - DNA, 15 bp, Homo sapiens
ccctgccctcccaag

SEQ ID NO: 6063353 - DNA, 15 bp, Homo sapiens
ccctgccctccccca

SEQ ID NO: 6063354 - DNA, 15 bp, Homo sapiens
ccctgccctcccctc

SEQ ID NO: 6063355 - DNA, 22 bp, Homo sapiens
ccctgccctcccctgctcccag

SEQ ID NO: 6063356 - DNA, 17 bp, Homo sapiens
ccctgccctcccctgtc

SEQ ID NO: 6063357 - DNA, 12 bp, Homo sapiens
ccctgccctcgg

SEQ ID NO: 6063358 - DNA, 17 bp, Homo sapiens
ccctgccctcggccatt

SEQ ID NO: 6063359 - DNA, 17 bp, Homo sapiens
ccctgccctcgggtctc

SEQ ID NO: 6063360 - DNA, 18 bp, Homo sapiens
ccctgccctcgtggccag

SEQ ID NO: 6063361 - DNA, 19 bp, Homo sapiens
ccctgccctcgtggccagc

SEQ ID NO: 6063362 - DNA, 13 bp, Homo sapiens
ccctgccctgagg

SEQ ID NO: 6063363 - DNA, 11 bp, Homo sapiens
ccctgccctgc

SEQ ID NO: 6063364 - DNA, 12 bp, Homo sapiens
ccctgccctgca

SEQ ID NO: 6063365 - DNA, 17 bp, Homo sapiens
ccctgccctgccacctg

SEQ ID NO: 6063366 - DNA, 14 bp, Homo sapiens
ccctgccctgccca

SEQ ID NO: 6063367 - DNA, 18 bp, Homo sapiens
ccctgccctgctcctaag

SEQ ID NO: 6063368 - DNA, 13 bp, Homo sapiens
ccctgccctgctg

SEQ ID NO: 6063369 - DNA, 12 bp, Homo sapiens
ccctgccctggc

SEQ ID NO: 6063370 - DNA, 18 bp, Homo sapiens
ccctgccctggccactgg

SEQ ID NO: 6063371 - DNA, 15 bp, Homo sapiens
ccctgccctggccta

SEQ ID NO: 6063372 - DNA, 16 bp, Homo sapiens
ccctgccctggcctac

SEQ ID NO: 6063373 - DNA, 23 bp, Homo sapiens
ccctgccctgggcgagcccctcc

SEQ ID NO: 6063374 - DNA, 13 bp, Homo sapiens
ccctgccctgggg

SEQ ID NO: 6063375 - DNA, 22 bp, Homo sapiens
ccctgccctggtttcctgccct

SEQ ID NO: 6063376 - DNA, 12 bp, Homo sapiens
ccctgccctgta

SEQ ID NO: 6063377 - DNA, 13 bp, Homo sapiens
ccctgccctgtcc

SEQ ID NO: 6063378 - DNA, 17 bp, Homo sapiens
ccctgccctgtcctcca

SEQ ID NO: 6063379 - DNA, 20 bp, Homo sapiens
ccctgccctgtgccgcactc

SEQ ID NO: 6063380 - DNA, 16 bp, Homo sapiens
ccctgccctgtgggcc

SEQ ID NO: 6063381 - DNA, 15 bp, Homo sapiens
ccctgccctgtgggg

SEQ ID NO: 6063382 - DNA, 17 bp, Homo sapiens
ccctgcccttcctcagg

SEQ ID NO: 6063383 - DNA, 18 bp, Homo sapiens
ccctgcccttggcaccac

SEQ ID NO: 6063384 - DNA, 17 bp, Homo sapiens
ccctgccgaacacacat

SEQ ID NO: 6063385 - DNA, 18 bp, Homo sapiens
ccctgccgaacacacatc

SEQ ID NO: 6063386 - DNA, 13 bp, Homo sapiens
ccctgccgcctca

SEQ ID NO: 6063387 - DNA, 14 bp, Homo sapiens
ccctgccgcctcaa

SEQ ID NO: 6063388 - DNA, 15 bp, Homo sapiens
ccctgccgcctcccg

SEQ ID NO: 6063389 - DNA, 20 bp, Homo sapiens
ccctgccggccccccaagga

SEQ ID NO: 6063390 - DNA, 16 bp, Homo sapiens
ccctgccggccttggc

SEQ ID NO: 6063391 - DNA, 20 bp, Homo sapiens
ccctgccggtgcacaggcct

SEQ ID NO: 6063392 - DNA, 21 bp, Homo sapiens
ccctgccggtgcacaggcctc

SEQ ID NO: 6063393 - DNA, 22 bp, Homo sapiens
ccctgccggtgcacaggcctct

SEQ ID NO: 6063394 - DNA, 15 bp, Homo sapiens
ccctgccgtcaccac

SEQ ID NO: 6063395 - DNA, 16 bp, Homo sapiens
ccctgccgtcaccacc

SEQ ID NO: 6063396 - DNA, 22 bp, Homo sapiens
ccctgccgtcaccaccacccct

SEQ ID NO: 6063397 - DNA, 20 bp, Homo sapiens
ccctgcctcacatctccctt

SEQ ID NO: 6063398 - DNA, 15 bp, Homo sapiens
ccctgcctcacctct

SEQ ID NO: 6063399 - DNA, 14 bp, Homo sapiens
ccctgcctcagctg

SEQ ID NO: 6063400 - DNA, 17 bp, Homo sapiens
ccctgcctcagctgacc

SEQ ID NO: 6063401 - DNA, 23 bp, Homo sapiens
ccctgcctcaggccaagggacca

SEQ ID NO: 6063402 - DNA, 17 bp, Homo sapiens
ccctgcctcatccacca

SEQ ID NO: 6063403 - DNA, 12 bp, Homo sapiens
ccctgcctccac

SEQ ID NO: 6063404 - DNA, 22 bp, Homo sapiens
ccctgcctccaccctctgagct

SEQ ID NO: 6063405 - DNA, 22 bp, Homo sapiens
ccctgcctccaccgagccagct

SEQ ID NO: 6063406 - DNA, 23 bp, Homo sapiens
ccctgcctccaccgagccagctt

SEQ ID NO: 6063407 - DNA, 23 bp, Homo sapiens
ccctgcctccagctgtcagcctg

SEQ ID NO: 6063408 - DNA, 13 bp, Homo sapiens
ccctgcctccatc

SEQ ID NO: 6063409 - DNA, 19 bp, Homo sapiens
ccctgcctcccatgcctgg

SEQ ID NO: 6063410 - DNA, 22 bp, Homo sapiens
ccctgcctccctttctgggagg

SEQ ID NO: 6063411 - DNA, 14 bp, Homo sapiens
ccctgcctcctgcc

SEQ ID NO: 6063412 - DNA, 18 bp, Homo sapiens
ccctgcctcctgcctatg

SEQ ID NO: 6063413 - DNA, 13 bp, Homo sapiens
ccctgcctcctgg

SEQ ID NO: 6063414 - DNA, 14 bp, Homo sapiens
ccctgcctcctgga

SEQ ID NO: 6063415 - DNA, 23 bp, Homo sapiens
ccctgcctcctttgtgaggaagc

SEQ ID NO: 6063416 - DNA, 14 bp, Homo sapiens
ccctgcctcgaggg

SEQ ID NO: 6063417 - DNA, 21 bp, Homo sapiens
ccctgcctcgagggccgcctg

SEQ ID NO: 6063418 - DNA, 22 bp, Homo sapiens
ccctgcctcggttgattgtgca

SEQ ID NO: 6063419 - DNA, 15 bp, Homo sapiens
ccctgcctctaccca

SEQ ID NO: 6063420 - DNA, 11 bp, Homo sapiens
ccctgcctctc

SEQ ID NO: 6063421 - DNA, 19 bp, Homo sapiens
ccctgcctctcccaggcag

SEQ ID NO: 6063422 - DNA, 21 bp, Homo sapiens
ccctgcctctccgcccctgag

SEQ ID NO: 6063423 - DNA, 22 bp, Homo sapiens
ccctgcctctccgcccctgagc

SEQ ID NO: 6063424 - DNA, 23 bp, Homo sapiens
ccctgcctctccgcccctgagcc

SEQ ID NO: 6063425 - DNA, 14 bp, Homo sapiens
ccctgcctctctgc

SEQ ID NO: 6063426 - DNA, 15 bp, Homo sapiens
ccctgcctctctgca

SEQ ID NO: 6063427 - DNA, 21 bp, Homo sapiens
ccctgcctgagcccaggagct

SEQ ID NO: 6063428 - DNA, 12 bp, Homo sapiens
ccctgcctgagg

SEQ ID NO: 6063429 - DNA, 13 bp, Homo sapiens
ccctgcctgagga

SEQ ID NO: 6063430 - DNA, 14 bp, Homo sapiens
ccctgcctgaggag

SEQ ID NO: 6063431 - DNA, 16 bp, Homo sapiens
ccctgcctgaggagga

SEQ ID NO: 6063432 - DNA, 21 bp, Homo sapiens
ccctgcctgagggcccctctg

SEQ ID NO: 6063433 - DNA, 13 bp, Homo sapiens
ccctgcctgcagc

SEQ ID NO: 6063434 - DNA, 15 bp, Homo sapiens
ccctgcctgcagcca

SEQ ID NO: 6063435 - DNA, 16 bp, Homo sapiens
ccctgcctgcagccag

SEQ ID NO: 6063436 - DNA, 18 bp, Homo sapiens
ccctgcctgcagccaggg

SEQ ID NO: 6063437 - DNA, 22 bp, Homo sapiens
ccctgcctgcagccagggctgg

SEQ ID NO: 6063438 - DNA, 23 bp, Homo sapiens
ccctgcctgcagccagggctggg

SEQ ID NO: 6063439 - DNA, 14 bp, Homo sapiens
ccctgcctgcctct

SEQ ID NO: 6063440 - DNA, 13 bp, Homo sapiens
ccctgcctgctgt

SEQ ID NO: 6063441 - DNA, 14 bp, Homo sapiens
ccctgcctgctgtg

SEQ ID NO: 6063442 - DNA, 21 bp, Homo sapiens
ccctgcctgctgtggagccca

SEQ ID NO: 6063443 - DNA, 13 bp, Homo sapiens
ccctgcctggagg

SEQ ID NO: 6063444 - DNA, 18 bp, Homo sapiens
ccctgcctggaggacctg

SEQ ID NO: 6063445 - DNA, 23 bp, Homo sapiens
ccctgcctggaggctcctctagg

SEQ ID NO: 6063446 - DNA, 21 bp, Homo sapiens
ccctgcctggatttcttccta

SEQ ID NO: 6063447 - DNA, 21 bp, Homo sapiens
ccctgcctggcggcaggggtc

SEQ ID NO: 6063448 - DNA, 13 bp, Homo sapiens
ccctgcctgggtt

SEQ ID NO: 6063449 - DNA, 20 bp, Homo sapiens
ccctgcctgggttgggggca

SEQ ID NO: 6063450 - DNA, 22 bp, Homo sapiens
ccctgcctggttctaggctgct

SEQ ID NO: 6063451 - DNA, 12 bp, Homo sapiens
ccctgcctgtca

SEQ ID NO: 6063452 - DNA, 18 bp, Homo sapiens
ccctgcctgtcacctggg

SEQ ID NO: 6063453 - DNA, 23 bp, Homo sapiens
ccctgcctgtgcccgcatgtgtg

SEQ ID NO: 6063454 - DNA, 12 bp, Homo sapiens
ccctgcctgtgg

SEQ ID NO: 6063455 - DNA, 17 bp, Homo sapiens
ccctgcctgtggaggtg

SEQ ID NO: 6063456 - DNA, 18 bp, Homo sapiens
ccctgcctgttggcaggc

SEQ ID NO: 6063457 - DNA, 13 bp, Homo sapiens
ccctgccttcctc

SEQ ID NO: 6063458 - DNA, 16 bp, Homo sapiens
ccctgccttcctctga

SEQ ID NO: 6063459 - DNA, 18 bp, Homo sapiens
ccctgccttcctctgagg

SEQ ID NO: 6063460 - DNA, 19 bp, Homo sapiens
ccctgccttcctctgagga

SEQ ID NO: 6063461 - DNA, 20 bp, Homo sapiens
ccctgccttcctctgaggac

SEQ ID NO: 6063462 - DNA, 13 bp, Homo sapiens
ccctgccttgccg

SEQ ID NO: 6063463 - DNA, 17 bp, Homo sapiens
ccctgccttgccgctcc

SEQ ID NO: 6063464 - DNA, 15 bp, Homo sapiens
ccctgccttgctgcc

SEQ ID NO: 6063465 - DNA, 13 bp, Homo sapiens
ccctgcctttgtt

SEQ ID NO: 6063466 - DNA, 15 bp, Homo sapiens
ccctgcgcaggccct

SEQ ID NO: 6063467 - DNA, 20 bp, Homo sapiens
ccctgcgccccgcacgactg

SEQ ID NO: 6063468 - DNA, 14 bp, Homo sapiens
ccagctggccggga

SEQ ID NO: 6063469 - DNA, 14 bp, Homo sapiens
ccagctggcctttg

SEQ ID NO: 6063470 - DNA, 15 bp, Homo sapiens
ccagctggctctgca

SEQ ID NO: 6063471 - DNA, 18 bp, Homo sapiens
ccagctggctctgcagca

SEQ ID NO: 6063472 - DNA, 20 bp, Homo sapiens
ccagctggctgggtcgcccc

SEQ ID NO: 6063473 - DNA, 16 bp, Homo sapiens
ccagctgggaagccct

SEQ ID NO: 6063474 - DNA, 20 bp, Homo sapiens
ccagctgggaagcccttttt

SEQ ID NO: 6063475 - DNA, 21 bp, Homo sapiens
ccagctgggacctaatgctgg

SEQ ID NO: 6063476 - DNA, 18 bp, Homo sapiens
ccagctgggagcactggt

SEQ ID NO: 6063477 - DNA, 16 bp, Homo sapiens
ccagctgggcctcctg

SEQ ID NO: 6063478 - DNA, 20 bp, Homo sapiens
ccagctgggcctcctgcctc

SEQ ID NO: 6063479 - DNA, 22 bp, Homo sapiens
ccagctgggcctcctgcctccg

SEQ ID NO: 6063480 - DNA, 12 bp, Homo sapiens
ccagctgggctc

SEQ ID NO: 6063481 - DNA, 16 bp, Homo sapiens
ccagctgggctctgca

SEQ ID NO: 6063482 - DNA, 13 bp, Homo sapiens
ccagctgggctgt

SEQ ID NO: 6063483 - DNA, 12 bp, Homo sapiens
ccagctggggag

SEQ ID NO: 6063484 - DNA, 13 bp, Homo sapiens
ccagctggggaga

SEQ ID NO: 6063485 - DNA, 16 bp, Homo sapiens
ccagctggggagatgg

SEQ ID NO: 6063486 - DNA, 20 bp, Homo sapiens
ccagctggggagatgggggc

SEQ ID NO: 6063487 - DNA, 12 bp, Homo sapiens
ccagctggggcc

SEQ ID NO: 6063488 - DNA, 20 bp, Homo sapiens
ccagctggggccagaggctg

SEQ ID NO: 6063489 - DNA, 19 bp, Homo sapiens
ccagctggggccaggctgg

SEQ ID NO: 6063490 - DNA, 22 bp, Homo sapiens
ccagctggggccaggctgggtc

SEQ ID NO: 6063491 - DNA, 22 bp, Homo sapiens
ccagctggggcgtggggagggc

SEQ ID NO: 6063492 - DNA, 12 bp, Homo sapiens
ccagctgggggg

SEQ ID NO: 6063493 - DNA, 20 bp, Homo sapiens
ccagctggggggcagggggg

SEQ ID NO: 6063494 - DNA, 20 bp, Homo sapiens
ccagctgggtgccccaggga

SEQ ID NO: 6063495 - DNA, 17 bp, Homo sapiens
ccagctggtgcccccag

SEQ ID NO: 6063496 - DNA, 19 bp, Homo sapiens
ccagctggtgctgcaagga

SEQ ID NO: 6063497 - DNA, 12 bp, Homo sapiens
ccagctggtggc

SEQ ID NO: 6063498 - DNA, 20 bp, Homo sapiens
ccagctggtgtcactctgcc

SEQ ID NO: 6063499 - DNA, 16 bp, Homo sapiens
ccagctgtaccggcca

SEQ ID NO: 6063500 - DNA, 14 bp, Homo sapiens
ccagctgtagccat

SEQ ID NO: 6063501 - DNA, 15 bp, Homo sapiens
ccagctgtagccatg

SEQ ID NO: 6063502 - DNA, 16 bp, Homo sapiens
ccagctgtagccatgg

SEQ ID NO: 6063503 - DNA, 21 bp, Homo sapiens
ccagctgtagccatggctcag

SEQ ID NO: 6063504 - DNA, 24 bp, Homo sapiens
ccagctgtagccatggctcaggca

SEQ ID NO: 6063505 - DNA, 15 bp, Homo sapiens
ccagctgtcaagggc

SEQ ID NO: 6063506 - DNA, 18 bp, Homo sapiens
ccagctgtccccccactc

SEQ ID NO: 6063507 - DNA, 16 bp, Homo sapiens
ccagctgtctcccacg

SEQ ID NO: 6063508 - DNA, 20 bp, Homo sapiens
ccagctgtgactgagggcct

SEQ ID NO: 6063509 - DNA, 19 bp, Homo sapiens
ccagctgtgagccttggct

SEQ ID NO: 6063510 - DNA, 16 bp, Homo sapiens
ccagctgtgcccctcc

SEQ ID NO: 6063511 - DNA, 21 bp, Homo sapiens
ccagctgtgctctggacaggc

SEQ ID NO: 6063512 - DNA, 18 bp, Homo sapiens
ccagctgtgctgggaggt

SEQ ID NO: 6063513 - DNA, 20 bp, Homo sapiens
ccagctgtgggcggctcctg

SEQ ID NO: 6063514 - DNA, 22 bp, Homo sapiens
ccagctgtgggtacagagaggt

SEQ ID NO: 6063515 - DNA, 23 bp, Homo sapiens
ccagctgtgggtacagagaggtc

SEQ ID NO: 6063516 - DNA, 13 bp, Homo sapiens
ccagctgtggttt

SEQ ID NO: 6063517 - DNA, 14 bp, Homo sapiens
ccagctgtggtttt

SEQ ID NO: 6063518 - DNA, 13 bp, Homo sapiens
ccagctgtgtcca

SEQ ID NO: 6063519 - DNA, 19 bp, Homo sapiens
ccagctgtgtccttcgggg

SEQ ID NO: 6063520 - DNA, 22 bp, Homo sapiens
ccagctgtgtccttcgggggcg

SEQ ID NO: 6063521 - DNA, 22 bp, Homo sapiens
ccagcttaaacccatacaatgt

SEQ ID NO: 6063522 - DNA, 19 bp, Homo sapiens
ccagcttagagttcttctt

SEQ ID NO: 6063523 - DNA, 16 bp, Homo sapiens
ccagcttatctcaggg

SEQ ID NO: 6063524 - DNA, 16 bp, Homo sapiens
ccagcttatctcctcc

SEQ ID NO: 6063525 - DNA, 18 bp, Homo sapiens
ccagcttcaaatgcaaat

SEQ ID NO: 6063526 - DNA, 12 bp, Homo sapiens
ccagcttcactc

SEQ ID NO: 6063527 - DNA, 15 bp, Homo sapiens
ccagcttcacttctg

SEQ ID NO: 6063528 - DNA, 11 bp, Homo sapiens
ccagcttcagc

SEQ ID NO: 6063529 - DNA, 12 bp, Homo sapiens
ccagcttcagct

SEQ ID NO: 6063530 - DNA, 24 bp, Homo sapiens
ccagcttcaggcaccagcatccac

SEQ ID NO: 6063531 - DNA, 18 bp, Homo sapiens
ccagcttccaaagcctag

SEQ ID NO: 6063532 - DNA, 13 bp, Homo sapiens
ccagcttcccctc

SEQ ID NO: 6063533 - DNA, 23 bp, Homo sapiens
ccagcttcccctcgctgtcctgc

SEQ ID NO: 6063534 - DNA, 15 bp, Homo sapiens
ccagcttcctggtgt

SEQ ID NO: 6063535 - DNA, 16 bp, Homo sapiens
ccagcttcctgtgcag

SEQ ID NO: 6063536 - DNA, 14 bp, Homo sapiens
ccagcttcctgtgg

SEQ ID NO: 6063537 - DNA, 21 bp, Homo sapiens
ccagcttcctgtgggccagga

SEQ ID NO: 6063538 - DNA, 21 bp, Homo sapiens
ccagcttcggagggcccctgc

SEQ ID NO: 6063539 - DNA, 21 bp, Homo sapiens
ccagcttcgtgctggaggaac

SEQ ID NO: 6063540 - DNA, 20 bp, Homo sapiens
ccagcttctcagtttctgcc

SEQ ID NO: 6063541 - DNA, 14 bp, Homo sapiens
ccagcttctccagg

SEQ ID NO: 6063542 - DNA, 15 bp, Homo sapiens
ccagcttctccaggc

SEQ ID NO: 6063543 - DNA, 13 bp, Homo sapiens
ccagcttctcctg

SEQ ID NO: 6063544 - DNA, 14 bp, Homo sapiens
ccagcttctcctgc

SEQ ID NO: 6063545 - DNA, 18 bp, Homo sapiens
ccagcttctcctgcgccc

SEQ ID NO: 6063546 - DNA, 16 bp, Homo sapiens
ccagcttctctctcca

SEQ ID NO: 6063547 - DNA, 20 bp, Homo sapiens
ccagcttctctctccagggt

SEQ ID NO: 6063548 - DNA, 21 bp, Homo sapiens
ccagcttctctctccctgtca

SEQ ID NO: 6063549 - DNA, 22 bp, Homo sapiens
ccagcttctggtactctcctag

SEQ ID NO: 6063550 - DNA, 14 bp, Homo sapiens
ccagcttctttctc

SEQ ID NO: 6063551 - DNA, 18 bp, Homo sapiens
ccagcttgaaaccttcac

SEQ ID NO: 6063552 - DNA, 20 bp, Homo sapiens
ccagcttgaaaccttcactt

SEQ ID NO: 6063553 - DNA, 15 bp, Homo sapiens
ccagcttgctgaggg

SEQ ID NO: 6063554 - DNA, 19 bp, Homo sapiens
ccagcttggacatcagtgt

SEQ ID NO: 6063555 - DNA, 21 bp, Homo sapiens
ccagcttggacatcagtgttt

SEQ ID NO: 6063556 - DNA, 19 bp, Homo sapiens
ccagcttggagtgccacat

SEQ ID NO: 6063557 - DNA, 19 bp, Homo sapiens
ccagcttggagtgccacgt

SEQ ID NO: 6063558 - DNA, 23 bp, Homo sapiens
ccagcttggagtgccacgtggcc

SEQ ID NO: 6063559 - DNA, 16 bp, Homo sapiens
ccagcttggctcacaa

SEQ ID NO: 6063560 - DNA, 13 bp, Homo sapiens
ccagcttgggcag

SEQ ID NO: 6063561 - DNA, 16 bp, Homo sapiens
ccagcttggggccacc

SEQ ID NO: 6063562 - DNA, 16 bp, Homo sapiens
ccagcttggttccagg

SEQ ID NO: 6063563 - DNA, 21 bp, Homo sapiens
ccagcttgtttacatgcttat

SEQ ID NO: 6063564 - DNA, 23 bp, Homo sapiens
ccagcttgtttacatgcttattc

SEQ ID NO: 6063565 - DNA, 20 bp, Homo sapiens
ccagctttaaaaagaaaaaa

SEQ ID NO: 6063566 - DNA, 16 bp, Homo sapiens
ccagctttactgtggc

SEQ ID NO: 6063567 - DNA, 23 bp, Homo sapiens
ccagctttactgtggctgtctgg

SEQ ID NO: 6063568 - DNA, 18 bp, Homo sapiens
ccagctttcagggacagc

SEQ ID NO: 6063569 - DNA, 12 bp, Homo sapiens
ccagctttccat

SEQ ID NO: 6063570 - DNA, 12 bp, Homo sapiens
ccagctttcctg

SEQ ID NO: 6063571 - DNA, 18 bp, Homo sapiens
ccagctttctccccgcta

SEQ ID NO: 6063572 - DNA, 13 bp, Homo sapiens
ccagctttctctt

SEQ ID NO: 6063573 - DNA, 15 bp, Homo sapiens
ccagctttgcccaac

SEQ ID NO: 6063574 - DNA, 20 bp, Homo sapiens
ccagctttgctaccaaagca

SEQ ID NO: 6063575 - DNA, 17 bp, Homo sapiens
ccagcttttactgtttt

SEQ ID NO: 6063576 - DNA, 13 bp, Homo sapiens
ccagcttttcaaa

SEQ ID NO: 6063577 - DNA, 17 bp, Homo sapiens
ccagcttttcctcaggg

SEQ ID NO: 6063578 - DNA, 16 bp, Homo sapiens
ccagcttttcctccct

SEQ ID NO: 6063579 - DNA, 18 bp, Homo sapiens
ccagcttttcctcccttg

SEQ ID NO: 6063580 - DNA, 16 bp, Homo sapiens
ccagcttttcttgcca

SEQ ID NO: 6063581 - DNA, 17 bp, Homo sapiens
ccagcttttcttgccag

SEQ ID NO: 6063582 - DNA, 21 bp, Homo sapiens
ccagcttttcttgccagctca

SEQ ID NO: 6063583 - DNA, 23 bp, Homo sapiens
ccagcttttcttgccagctcagc

SEQ ID NO: 6063584 - DNA, 17 bp, Homo sapiens
ccagctttttctctcag

SEQ ID NO: 6063585 - DNA, 11 bp, Homo sapiens
ccaggaaaaac

SEQ ID NO: 6063586 - DNA, 15 bp, Homo sapiens
ccaggaaaaaggaca

SEQ ID NO: 6063587 - DNA, 13 bp, Homo sapiens
ccaggaaacatga

SEQ ID NO: 6063588 - DNA, 21 bp, Homo sapiens
ccaggaaactccacatctgcc

SEQ ID NO: 6063589 - DNA, 22 bp, Homo sapiens
ccaggaaagatgtcccacaggg

SEQ ID NO: 6063590 - DNA, 11 bp, Homo sapiens
ccaggaaagga

SEQ ID NO: 6063591 - DNA, 19 bp, Homo sapiens
ccaggaaaggacggctgag

SEQ ID NO: 6063592 - DNA, 22 bp, Homo sapiens
ccaggaaaggacggctgagcat

SEQ ID NO: 6063593 - DNA, 12 bp, Homo sapiens
ccaggaaaggag

SEQ ID NO: 6063594 - DNA, 15 bp, Homo sapiens
ccaggaaaggctcca

SEQ ID NO: 6063595 - DNA, 16 bp, Homo sapiens
ccaggaaaggctccag

SEQ ID NO: 6063596 - DNA, 17 bp, Homo sapiens
ccaggaaaggctccagg

SEQ ID NO: 6063597 - DNA, 23 bp, Homo sapiens
ccaggaaaggctccaggagcagc

SEQ ID NO: 6063598 - DNA, 16 bp, Homo sapiens
ccaggaaatgtgcaca

SEQ ID NO: 6063599 - DNA, 15 bp, Homo sapiens
ccaggaacacatgca

SEQ ID NO: 6063600 - DNA, 17 bp, Homo sapiens
ccaggaacacatgcaca

SEQ ID NO: 6063601 - DNA, 18 bp, Homo sapiens
ccaggaacacatgcacac

SEQ ID NO: 6063602 - DNA, 18 bp, Homo sapiens
ccaggaacagcaaatgca

SEQ ID NO: 6063603 - DNA, 14 bp, Homo sapiens
ccaggaacagggac

SEQ ID NO: 6063604 - DNA, 15 bp, Homo sapiens
ccaggaacagggacc

SEQ ID NO: 6063605 - DNA, 17 bp, Homo sapiens
ccaggaacagggaccag

SEQ ID NO: 6063606 - DNA, 18 bp, Homo sapiens
ccaggaacagggaccagc

SEQ ID NO: 6063607 - DNA, 22 bp, Homo sapiens
ccaggaaccaaaaaaccccagc

SEQ ID NO: 6063608 - DNA, 23 bp, Homo sapiens
ccaggaaccaaaaaaccccagct

SEQ ID NO: 6063609 - DNA, 24 bp, Homo sapiens
ccaggaaccacaccacatctaagc

SEQ ID NO: 6063610 - DNA, 17 bp, Homo sapiens
ccaggaacgctctcctc

SEQ ID NO: 6063611 - DNA, 14 bp, Homo sapiens
ccaggaactggctc

SEQ ID NO: 6063612 - DNA, 15 bp, Homo sapiens
ccaggaactggctcc

SEQ ID NO: 6063613 - DNA, 16 bp, Homo sapiens
ccaggaagaagcaggg

SEQ ID NO: 6063614 - DNA, 17 bp, Homo sapiens
ccaggaagaaggcccgg

SEQ ID NO: 6063615 - DNA, 21 bp, Homo sapiens
ccaggaagaaggcccgggagg

SEQ ID NO: 6063616 - DNA, 13 bp, Homo sapiens
ccaggaagatcca

SEQ ID NO: 6063617 - DNA, 19 bp, Homo sapiens
ccaggaagatcccccagaa

SEQ ID NO: 6063618 - DNA, 13 bp, Homo sapiens
ccaggaagcacag

SEQ ID NO: 6063619 - DNA, 19 bp, Homo sapiens
ccaggaagcacgttcacta

SEQ ID NO: 6063620 - DNA, 13 bp, Homo sapiens
ccaggaagcaggg

SEQ ID NO: 6063621 - DNA, 20 bp, Homo sapiens
ccaggaagcagggagagttg

SEQ ID NO: 6063622 - DNA, 10 bp, Homo sapiens
ccaggaagcc

SEQ ID NO: 6063623 - DNA, 19 bp, Homo sapiens
ccaggaagccagcaggctc

SEQ ID NO: 6063624 - DNA, 22 bp, Homo sapiens
ccaggaagccagcaggctctca

SEQ ID NO: 6063625 - DNA, 12 bp, Homo sapiens
ccaggaagccca

SEQ ID NO: 6063626 - DNA, 17 bp, Homo sapiens
ccaggaagcccactgcc

SEQ ID NO: 6063627 - DNA, 18 bp, Homo sapiens
ccaggaagcccactgcct

SEQ ID NO: 6063628 - DNA, 21 bp, Homo sapiens
ccaggaagcccactgcctcct

SEQ ID NO: 6063629 - DNA, 20 bp, Homo sapiens
ccaggaagccccgctcaggt

SEQ ID NO: 6063630 - DNA, 11 bp, Homo sapiens
ccaggaagccg

SEQ ID NO: 6063631 - DNA, 22 bp, Homo sapiens
ccaggaagccgtcctggcgcct

SEQ ID NO: 6063632 - DNA, 14 bp, Homo sapiens
ccaggaagctccct

SEQ ID NO: 6063633 - DNA, 15 bp, Homo sapiens
ccaggaagctttggt

SEQ ID NO: 6063634 - DNA, 16 bp, Homo sapiens
ccaggaaggaaacaga

SEQ ID NO: 6063635 - DNA, 14 bp, Homo sapiens
ccaggaaggaagag

SEQ ID NO: 6063636 - DNA, 12 bp, Homo sapiens
ccaggaaggcag

SEQ ID NO: 6063637 - DNA, 15 bp, Homo sapiens
ccaggaaggcagctg

SEQ ID NO: 6063638 - DNA, 16 bp, Homo sapiens
ccaggaaggcagctgc

SEQ ID NO: 6063639 - DNA, 20 bp, Homo sapiens
ccaggaaggcggcaggcaga

SEQ ID NO: 6063640 - DNA, 21 bp, Homo sapiens
ccaggaaggcggcaggcagag

SEQ ID NO: 6063641 - DNA, 22 bp, Homo sapiens
ccaggaaggcggcaggcagaga

SEQ ID NO: 6063642 - DNA, 18 bp, Homo sapiens
ccaggaaggcggggcttc

SEQ ID NO: 6063643 - DNA, 22 bp, Homo sapiens
ccaggaagggagggagctgagg

SEQ ID NO: 6063644 - DNA, 23 bp, Homo sapiens
ccaggaagggagggagctgaggc

SEQ ID NO: 6063645 - DNA, 23 bp, Homo sapiens
ccaggaagggccattttggtgct

SEQ ID NO: 6063646 - DNA, 17 bp, Homo sapiens
ccaggaaggggacagga

SEQ ID NO: 6063647 - DNA, 13 bp, Homo sapiens
ccctgcgcccctg

SEQ ID NO: 6063648 - DNA, 13 bp, Homo sapiens
ccctgcgccctcc

SEQ ID NO: 6063649 - DNA, 17 bp, Homo sapiens
ccctgcgccctccctcc

SEQ ID NO: 6063650 - DNA, 23 bp, Homo sapiens
ccctgcgccctccctccctccac

SEQ ID NO: 6063651 - DNA, 18 bp, Homo sapiens
ccctgcgcctccagaggt

SEQ ID NO: 6063652 - DNA, 15 bp, Homo sapiens
ccctgcgcctgtgat

SEQ ID NO: 6063653 - DNA, 22 bp, Homo sapiens
ccctgcgctctctttgcaactg

SEQ ID NO: 6063654 - DNA, 17 bp, Homo sapiens
ccctgcgcttcctgagc

SEQ ID NO: 6063655 - DNA, 17 bp, Homo sapiens
ccctgcggaagccacag

SEQ ID NO: 6063656 - DNA, 21 bp, Homo sapiens
ccctgcggaagccacagggtg

SEQ ID NO: 6063657 - DNA, 17 bp, Homo sapiens
ccctgcggagctgcatg

SEQ ID NO: 6063658 - DNA, 20 bp, Homo sapiens
ccctgcggcctccacacctg

SEQ ID NO: 6063659 - DNA, 18 bp, Homo sapiens
ccctgcggctctggaaag

SEQ ID NO: 6063660 - DNA, 12 bp, Homo sapiens
ccctgcgggcca

SEQ ID NO: 6063661 - DNA, 16 bp, Homo sapiens
ccctgcgggccacagg

SEQ ID NO: 6063662 - DNA, 22 bp, Homo sapiens
ccctgcgggccacagggcaaaa

SEQ ID NO: 6063663 - DNA, 13 bp, Homo sapiens
ccctgcgggccag

SEQ ID NO: 6063664 - DNA, 18 bp, Homo sapiens
ccctgcgggccagggtcc

SEQ ID NO: 6063665 - DNA, 21 bp, Homo sapiens
ccctgcgggcgcgggcagcca

SEQ ID NO: 6063666 - DNA, 23 bp, Homo sapiens
ccctgcgggcgcgggcagccacc

SEQ ID NO: 6063667 - DNA, 19 bp, Homo sapiens
ccctgcgggtcacaggagg

SEQ ID NO: 6063668 - DNA, 21 bp, Homo sapiens
ccctgcgggtcacaggaggga

SEQ ID NO: 6063669 - DNA, 15 bp, Homo sapiens
ccctgcggtcaggct

SEQ ID NO: 6063670 - DNA, 20 bp, Homo sapiens
ccctgcgtaaccctcgccct

SEQ ID NO: 6063671 - DNA, 17 bp, Homo sapiens
ccctgcgtcgagctggg

SEQ ID NO: 6063672 - DNA, 16 bp, Homo sapiens
ccctgcgtggcctgag

SEQ ID NO: 6063673 - DNA, 22 bp, Homo sapiens
ccctgcgtgggggccagtcagg

SEQ ID NO: 6063674 - DNA, 16 bp, Homo sapiens
ccctgcgttggagcca

SEQ ID NO: 6063675 - DNA, 19 bp, Homo sapiens
ccctgcgttggagccactc

SEQ ID NO: 6063676 - DNA, 23 bp, Homo sapiens
ccctgctaaatgccatgtttatc

SEQ ID NO: 6063677 - DNA, 18 bp, Homo sapiens
ccctgctaccaaggccca

SEQ ID NO: 6063678 - DNA, 22 bp, Homo sapiens
ccctgctacctgctgagccaga

SEQ ID NO: 6063679 - DNA, 13 bp, Homo sapiens
ccctgctacctgt

SEQ ID NO: 6063680 - DNA, 19 bp, Homo sapiens
ccctgctactccactgacc

SEQ ID NO: 6063681 - DNA, 17 bp, Homo sapiens
ccctgctactcctgtgc

SEQ ID NO: 6063682 - DNA, 21 bp, Homo sapiens
ccctgctactcctgtgctctg

SEQ ID NO: 6063683 - DNA, 22 bp, Homo sapiens
ccctgctactcctgtgctctgg

SEQ ID NO: 6063684 - DNA, 16 bp, Homo sapiens
ccctgctagcacagag

SEQ ID NO: 6063685 - DNA, 14 bp, Homo sapiens
ccctgctatgaaag

SEQ ID NO: 6063686 - DNA, 23 bp, Homo sapiens
ccctgctatgaaaggaataaaac

SEQ ID NO: 6063687 - DNA, 20 bp, Homo sapiens
ccctgctatttcaggccctc

SEQ ID NO: 6063688 - DNA, 23 bp, Homo sapiens
ccctgctatttcaggccctcagc

SEQ ID NO: 6063689 - DNA, 16 bp, Homo sapiens
ccctgctcactgggcc

SEQ ID NO: 6063690 - DNA, 17 bp, Homo sapiens
ccctgctcactgggccc

SEQ ID NO: 6063691 - DNA, 18 bp, Homo sapiens
ccctgctcactgggcccg

SEQ ID NO: 6063692 - DNA, 21 bp, Homo sapiens
ccctgctcagcccatcccctg

SEQ ID NO: 6063693 - DNA, 18 bp, Homo sapiens
ccctgctcagctggccgg

SEQ ID NO: 6063694 - DNA, 14 bp, Homo sapiens
ccctgctcaggcct

SEQ ID NO: 6063695 - DNA, 13 bp, Homo sapiens
ccctgctcagtgc

SEQ ID NO: 6063696 - DNA, 16 bp, Homo sapiens
ccctgctcagtgcttg

SEQ ID NO: 6063697 - DNA, 15 bp, Homo sapiens
ccctgctcatccact

SEQ ID NO: 6063698 - DNA, 17 bp, Homo sapiens
ccctgctccaccagcag

SEQ ID NO: 6063699 - DNA, 18 bp, Homo sapiens
ccctgctccaccagcagc

SEQ ID NO: 6063700 - DNA, 20 bp, Homo sapiens
ccctgctccatgggcacctc

SEQ ID NO: 6063701 - DNA, 17 bp, Homo sapiens
ccctgctcccacagaac

SEQ ID NO: 6063702 - DNA, 19 bp, Homo sapiens
ccctgctcccacgcctgct

SEQ ID NO: 6063703 - DNA, 18 bp, Homo sapiens
ccctgctcccagcctgct

SEQ ID NO: 6063704 - DNA, 20 bp, Homo sapiens
ccctgctcccagcctgctga

SEQ ID NO: 6063705 - DNA, 22 bp, Homo sapiens
ccctgctcccagggactgacac

SEQ ID NO: 6063706 - DNA, 17 bp, Homo sapiens
ccctgctcccggctctg

SEQ ID NO: 6063707 - DNA, 19 bp, Homo sapiens
ccctgctcccggctctgag

SEQ ID NO: 6063708 - DNA, 12 bp, Homo sapiens
ccctgctccctg

SEQ ID NO: 6063709 - DNA, 19 bp, Homo sapiens
ccctgctccctgcctcctg

SEQ ID NO: 6063710 - DNA, 20 bp, Homo sapiens
ccctgctccctgcctcctgc

SEQ ID NO: 6063711 - DNA, 14 bp, Homo sapiens
ccctgctccctgct

SEQ ID NO: 6063712 - DNA, 10 bp, Homo sapiens
ccctgctcct

SEQ ID NO: 6063713 - DNA, 14 bp, Homo sapiens
ccctgctcctacct

SEQ ID NO: 6063714 - DNA, 17 bp, Homo sapiens
ccctgctcctcatggga

SEQ ID NO: 6063715 - DNA, 16 bp, Homo sapiens
ccctgctcctcccaac

SEQ ID NO: 6063716 - DNA, 15 bp, Homo sapiens
ccctgctcctccctg

SEQ ID NO: 6063717 - DNA, 21 bp, Homo sapiens
ccctgctcctccctggctgcc

SEQ ID NO: 6063718 - DNA, 14 bp, Homo sapiens
ccctgctcctgcag

SEQ ID NO: 6063719 - DNA, 15 bp, Homo sapiens
ccctgctcctgcagc

SEQ ID NO: 6063720 - DNA, 21 bp, Homo sapiens
ccctgctctacccatgagcct

SEQ ID NO: 6063721 - DNA, 22 bp, Homo sapiens
ccctgctctacccatgagcctg

SEQ ID NO: 6063722 - DNA, 22 bp, Homo sapiens
ccctgctctccgaccagacacc

SEQ ID NO: 6063723 - DNA, 12 bp, Homo sapiens
ccctgctctgta

SEQ ID NO: 6063724 - DNA, 22 bp, Homo sapiens
ccctgctcttctctccccagcc

SEQ ID NO: 6063725 - DNA, 13 bp, Homo sapiens
ccctgctctttct

SEQ ID NO: 6063726 - DNA, 13 bp, Homo sapiens
ccctgctgacctt

SEQ ID NO: 6063727 - DNA, 17 bp, Homo sapiens
ccctgctgagcacagac

SEQ ID NO: 6063728 - DNA, 13 bp, Homo sapiens
ccctgctgcacta

SEQ ID NO: 6063729 - DNA, 22 bp, Homo sapiens
ccctgctgcaggggctctggag

SEQ ID NO: 6063730 - DNA, 21 bp, Homo sapiens
ccctgctgccaggctcccact

SEQ ID NO: 6063731 - DNA, 13 bp, Homo sapiens
ccctgctgccccc

SEQ ID NO: 6063732 - DNA, 13 bp, Homo sapiens
ccctgctgccctc

SEQ ID NO: 6063733 - DNA, 22 bp, Homo sapiens
ccctgctgccgcctcccagcct

SEQ ID NO: 6063734 - DNA, 11 bp, Homo sapiens
ccctgctgcct

SEQ ID NO: 6063735 - DNA, 19 bp, Homo sapiens
ccctgctgccttctgacgg

SEQ ID NO: 6063736 - DNA, 24 bp, Homo sapiens
ccctgctgctcctcggccagagct

SEQ ID NO: 6063737 - DNA, 19 bp, Homo sapiens
ccctgctgctgctcctccc

SEQ ID NO: 6063738 - DNA, 15 bp, Homo sapiens
ccctgctgctggtgc

SEQ ID NO: 6063739 - DNA, 23 bp, Homo sapiens
ccctgctgcttaagtgcatgcat

SEQ ID NO: 6063740 - DNA, 16 bp, Homo sapiens
ccctgctgcttcctaa

SEQ ID NO: 6063741 - DNA, 13 bp, Homo sapiens
ccctgctggccaa

SEQ ID NO: 6063742 - DNA, 17 bp, Homo sapiens
ccctgctggccgcctca

SEQ ID NO: 6063743 - DNA, 18 bp, Homo sapiens
ccctgctggccgcctcac

SEQ ID NO: 6063744 - DNA, 13 bp, Homo sapiens
ccctgctggctct

SEQ ID NO: 6063745 - DNA, 14 bp, Homo sapiens
ccctgctggctctt

SEQ ID NO: 6063746 - DNA, 15 bp, Homo sapiens
ccctgctggctcttc

SEQ ID NO: 6063747 - DNA, 10 bp, Homo sapiens
ccctgctggg

SEQ ID NO: 6063748 - DNA, 11 bp, Homo sapiens
ccctgctgggg

SEQ ID NO: 6063749 - DNA, 22 bp, Homo sapiens
ccctgctggggtctcaggtcca

SEQ ID NO: 6063750 - DNA, 13 bp, Homo sapiens
ccctgctggtgcc

SEQ ID NO: 6063751 - DNA, 13 bp, Homo sapiens
ccctgctggttca

SEQ ID NO: 6063752 - DNA, 20 bp, Homo sapiens
ccctgctgtcattgcttctt

SEQ ID NO: 6063753 - DNA, 16 bp, Homo sapiens
ccctgctgtcccctct

SEQ ID NO: 6063754 - DNA, 17 bp, Homo sapiens
ccctgctgtcccctctt

SEQ ID NO: 6063755 - DNA, 21 bp, Homo sapiens
ccctgctgtcttccccaccgc

SEQ ID NO: 6063756 - DNA, 21 bp, Homo sapiens
ccctgctgtgccatgctgggc

SEQ ID NO: 6063757 - DNA, 18 bp, Homo sapiens
ccctgctgtgctgctcaa

SEQ ID NO: 6063758 - DNA, 16 bp, Homo sapiens
ccctgctgtgtgggag

SEQ ID NO: 6063759 - DNA, 17 bp, Homo sapiens
ccctgcttacctgacgg

SEQ ID NO: 6063760 - DNA, 22 bp, Homo sapiens
ccctgcttagaacccttctgct

SEQ ID NO: 6063761 - DNA, 13 bp, Homo sapiens
ccctgcttaggat

SEQ ID NO: 6063762 - DNA, 21 bp, Homo sapiens
ccctgcttcaatacccaaatc

SEQ ID NO: 6063763 - DNA, 12 bp, Homo sapiens
ccctgcttcacc

SEQ ID NO: 6063764 - DNA, 15 bp, Homo sapiens
ccctgcttcctgctt

SEQ ID NO: 6063765 - DNA, 12 bp, Homo sapiens
ccctgcttctca

SEQ ID NO: 6063766 - DNA, 16 bp, Homo sapiens
ccctgcttctcagccc

SEQ ID NO: 6063767 - DNA, 15 bp, Homo sapiens
ccctgcttctccagc

SEQ ID NO: 6063768 - DNA, 21 bp, Homo sapiens
ccctgcttctccagcctggac

SEQ ID NO: 6063769 - DNA, 14 bp, Homo sapiens
ccctgcttctcccg

SEQ ID NO: 6063770 - DNA, 20 bp, Homo sapiens
ccctgcttctcccgccattg

SEQ ID NO: 6063771 - DNA, 18 bp, Homo sapiens
ccctgcttctcccgggga

SEQ ID NO: 6063772 - DNA, 12 bp, Homo sapiens
ccctgcttctgc

SEQ ID NO: 6063773 - DNA, 15 bp, Homo sapiens
ccctgcttctgctgc

SEQ ID NO: 6063774 - DNA, 15 bp, Homo sapiens
ccctgcttctggcgc

SEQ ID NO: 6063775 - DNA, 21 bp, Homo sapiens
ccctgcttgcacacttcccca

SEQ ID NO: 6063776 - DNA, 16 bp, Homo sapiens
ccctgcttgctggaaa

SEQ ID NO: 6063777 - DNA, 18 bp, Homo sapiens
ccctgctttagagctagg

SEQ ID NO: 6063778 - DNA, 14 bp, Homo sapiens
ccctgctttcagat

SEQ ID NO: 6063779 - DNA, 13 bp, Homo sapiens
ccctgctttgcaa

SEQ ID NO: 6063780 - DNA, 16 bp, Homo sapiens
ccctgctttgcatctt

SEQ ID NO: 6063781 - DNA, 18 bp, Homo sapiens
ccctgctttgccccactg

SEQ ID NO: 6063782 - DNA, 23 bp, Homo sapiens
ccctgctttgggctgccctggtg

SEQ ID NO: 6063783 - DNA, 10 bp, Homo sapiens
ccctgctttt

SEQ ID NO: 6063784 - DNA, 17 bp, Homo sapiens
ccctggaaaacagacgg

SEQ ID NO: 6063785 - DNA, 21 bp, Homo sapiens
ccctggaaacccacctctctg

SEQ ID NO: 6063786 - DNA, 15 bp, Homo sapiens
ccctggaaaccttcc

SEQ ID NO: 6063787 - DNA, 21 bp, Homo sapiens
ccctggaaccgggaagggtgg

SEQ ID NO: 6063788 - DNA, 21 bp, Homo sapiens
ccctggaacctttcccttgtg

SEQ ID NO: 6063789 - DNA, 15 bp, Homo sapiens
ccctggaactgtctc

SEQ ID NO: 6063790 - DNA, 15 bp, Homo sapiens
ccctggaagagccca

SEQ ID NO: 6063791 - DNA, 12 bp, Homo sapiens
ccctggaagccg

SEQ ID NO: 6063792 - DNA, 18 bp, Homo sapiens
ccctggaagccggcggcc

SEQ ID NO: 6063793 - DNA, 22 bp, Homo sapiens
ccctggaagccggcggcccaag

SEQ ID NO: 6063794 - DNA, 19 bp, Homo sapiens
ccctggaagctctccgagc

SEQ ID NO: 6063795 - DNA, 16 bp, Homo sapiens
ccctggaagctggaag

SEQ ID NO: 6063796 - DNA, 9 bp, Homo sapiens
ccctggaat

SEQ ID NO: 6063797 - DNA, 22 bp, Homo sapiens
ccctggaatacgatcctgcagg

SEQ ID NO: 6063798 - DNA, 18 bp, Homo sapiens
ccctggaattcagcaccc

SEQ ID NO: 6063799 - DNA, 20 bp, Homo sapiens
ccctggaattcagcaccctg

SEQ ID NO: 6063800 - DNA, 12 bp, Homo sapiens
ccctggacacag

SEQ ID NO: 6063801 - DNA, 20 bp, Homo sapiens
ccctggacacagcccaccct

SEQ ID NO: 6063802 - DNA, 18 bp, Homo sapiens
ccctggacacagctcttc

SEQ ID NO: 6063803 - DNA, 21 bp, Homo sapiens
ccctggacacagctcttcatt

SEQ ID NO: 6063804 - DNA, 23 bp, Homo sapiens
ccctggacagaggcggggctaca

SEQ ID NO: 6063805 - DNA, 17 bp, Homo sapiens
ccctggacagatggccc

SEQ ID NO: 6063806 - DNA, 16 bp, Homo sapiens
ccctggacagcaggag

SEQ ID NO: 6063807 - DNA, 14 bp, Homo sapiens
ccctggacaggcag

SEQ ID NO: 6063808 - DNA, 20 bp, Homo sapiens
ccctggacaggcagcctcct

SEQ ID NO: 6063809 - DNA, 14 bp, Homo sapiens
ccctggacatgcct

SEQ ID NO: 6063810 - DNA, 21 bp, Homo sapiens
ccctggaccaccagccccagc

SEQ ID NO: 6063811 - DNA, 22 bp, Homo sapiens
ccctggaccaccagccccagca

SEQ ID NO: 6063812 - DNA, 14 bp, Homo sapiens
ccctggaccccagc

SEQ ID NO: 6063813 - DNA, 18 bp, Homo sapiens
ccctggaccccagcctca

SEQ ID NO: 6063814 - DNA, 19 bp, Homo sapiens
ccctggaccgagtggacca

SEQ ID NO: 6063815 - DNA, 18 bp, Homo sapiens
ccctggaccttgggccta

SEQ ID NO: 6063816 - DNA, 14 bp, Homo sapiens
ccctggactctgtg

SEQ ID NO: 6063817 - DNA, 14 bp, Homo sapiens
ccctggactgggag

SEQ ID NO: 6063818 - DNA, 21 bp, Homo sapiens
ccctggactgtgtgctcagga

SEQ ID NO: 6063819 - DNA, 14 bp, Homo sapiens
ccctggacttctct

SEQ ID NO: 6063820 - DNA, 17 bp, Homo sapiens
ccctggacttgcctctg

SEQ ID NO: 6063821 - DNA, 19 bp, Homo sapiens
ccctggagaaaaaaattgc

SEQ ID NO: 6063822 - DNA, 18 bp, Homo sapiens
ccctggagaccacactgc

SEQ ID NO: 6063823 - DNA, 17 bp, Homo sapiens
ccctggagagccccatg

SEQ ID NO: 6063824 - DNA, 18 bp, Homo sapiens
ccctggagagtgcacatg

SEQ ID NO: 6063825 - DNA, 14 bp, Homo sapiens
ccctggagcagcca

SEQ ID NO: 6063826 - DNA, 21 bp, Homo sapiens
ccaggaaggggcggggagaag

SEQ ID NO: 6063827 - DNA, 16 bp, Homo sapiens
ccaggaaggggctgga

SEQ ID NO: 6063828 - DNA, 17 bp, Homo sapiens
ccaggaaggtagcccag

SEQ ID NO: 6063829 - DNA, 18 bp, Homo sapiens
ccaggaagtagcacaggc

SEQ ID NO: 6063830 - DNA, 22 bp, Homo sapiens
ccaggaagtagcacaggctgag

SEQ ID NO: 6063831 - DNA, 15 bp, Homo sapiens
ccaggaagtccagct

SEQ ID NO: 6063832 - DNA, 16 bp, Homo sapiens
ccaggaagtccagctc

SEQ ID NO: 6063833 - DNA, 19 bp, Homo sapiens
ccaggaagtccagctcctt

SEQ ID NO: 6063834 - DNA, 20 bp, Homo sapiens
ccaggaagtctcatctgggg

SEQ ID NO: 6063835 - DNA, 17 bp, Homo sapiens
ccaggaagtgggagaag

SEQ ID NO: 6063836 - DNA, 22 bp, Homo sapiens
ccaggaagtgggagaagtggcc

SEQ ID NO: 6063837 - DNA, 17 bp, Homo sapiens
ccaggaatagtggacat

SEQ ID NO: 6063838 - DNA, 15 bp, Homo sapiens
ccaggaatgaagata

SEQ ID NO: 6063839 - DNA, 19 bp, Homo sapiens
ccaggaatgcctcctccct

SEQ ID NO: 6063840 - DNA, 22 bp, Homo sapiens
ccaggaatgctgggcccccagc

SEQ ID NO: 6063841 - DNA, 20 bp, Homo sapiens
ccaggaatggagcctgcacg

SEQ ID NO: 6063842 - DNA, 17 bp, Homo sapiens
ccaggaattctcacagg

SEQ ID NO: 6063843 - DNA, 14 bp, Homo sapiens
ccaggaatttccca

SEQ ID NO: 6063844 - DNA, 16 bp, Homo sapiens
ccaggaatttcccagg

SEQ ID NO: 6063845 - DNA, 22 bp, Homo sapiens
ccaggaattttgtgtgattggc

SEQ ID NO: 6063846 - DNA, 18 bp, Homo sapiens
ccaggacaagcacgaggc

SEQ ID NO: 6063847 - DNA, 15 bp, Homo sapiens
ccaggacaagcatgg

SEQ ID NO: 6063848 - DNA, 23 bp, Homo sapiens
ccaggacaagcatggtcccacat

SEQ ID NO: 6063849 - DNA, 23 bp, Homo sapiens
ccaggacacagattatcaactgg

SEQ ID NO: 6063850 - DNA, 19 bp, Homo sapiens
ccaggacaccacacccagc

SEQ ID NO: 6063851 - DNA, 21 bp, Homo sapiens
ccaggacaccacacccagcct

SEQ ID NO: 6063852 - DNA, 22 bp, Homo sapiens
ccaggacaccacacccagcctc

SEQ ID NO: 6063853 - DNA, 16 bp, Homo sapiens
ccaggacaccagtcca

SEQ ID NO: 6063854 - DNA, 18 bp, Homo sapiens
ccaggacaccgggcaggg

SEQ ID NO: 6063855 - DNA, 14 bp, Homo sapiens
ccaggacacctgcc

SEQ ID NO: 6063856 - DNA, 19 bp, Homo sapiens
ccaggacacctgccccagc

SEQ ID NO: 6063857 - DNA, 20 bp, Homo sapiens
ccaggacacctgccccagcg

SEQ ID NO: 6063858 - DNA, 21 bp, Homo sapiens
ccaggacacctgccccagcgc

SEQ ID NO: 6063859 - DNA, 12 bp, Homo sapiens
ccaggacactgc

SEQ ID NO: 6063860 - DNA, 13 bp, Homo sapiens
ccaggacactgcc

SEQ ID NO: 6063861 - DNA, 18 bp, Homo sapiens
ccaggacagctgcaggtg

SEQ ID NO: 6063862 - DNA, 16 bp, Homo sapiens
ccaggacagctggctg

SEQ ID NO: 6063863 - DNA, 20 bp, Homo sapiens
ccaggacagctggctgctga

SEQ ID NO: 6063864 - DNA, 13 bp, Homo sapiens
ccaggacaggaaa

SEQ ID NO: 6063865 - DNA, 15 bp, Homo sapiens
ccaggacaggatcca

SEQ ID NO: 6063866 - DNA, 13 bp, Homo sapiens
ccaggacaggccc

SEQ ID NO: 6063867 - DNA, 17 bp, Homo sapiens
ccaggacaggcccggcg

SEQ ID NO: 6063868 - DNA, 20 bp, Homo sapiens
ccaggacaggctgcggcccc

SEQ ID NO: 6063869 - DNA, 17 bp, Homo sapiens
ccaggacatctcctggc

SEQ ID NO: 6063870 - DNA, 18 bp, Homo sapiens
ccaggacatctcctggct

SEQ ID NO: 6063871 - DNA, 14 bp, Homo sapiens
ccaggaccaagcca

SEQ ID NO: 6063872 - DNA, 16 bp, Homo sapiens
ccaggaccacacagtc

SEQ ID NO: 6063873 - DNA, 18 bp, Homo sapiens
ccaggaccacacagtccc

SEQ ID NO: 6063874 - DNA, 18 bp, Homo sapiens
ccaggaccacaggctcag

SEQ ID NO: 6063875 - DNA, 19 bp, Homo sapiens
ccaggaccacaggctcagg

SEQ ID NO: 6063876 - DNA, 14 bp, Homo sapiens
ccaggaccagcctg

SEQ ID NO: 6063877 - DNA, 13 bp, Homo sapiens
ccaggaccagctc

SEQ ID NO: 6063878 - DNA, 16 bp, Homo sapiens
ccaggaccagctcagg

SEQ ID NO: 6063879 - DNA, 17 bp, Homo sapiens
ccaggaccagctcagga

SEQ ID NO: 6063880 - DNA, 15 bp, Homo sapiens
ccaggaccagctggg

SEQ ID NO: 6063881 - DNA, 16 bp, Homo sapiens
ccaggaccagctgggg

SEQ ID NO: 6063882 - DNA, 18 bp, Homo sapiens
ccaggaccagctggggcg

SEQ ID NO: 6063883 - DNA, 23 bp, Homo sapiens
ccaggaccagtcaacctgggcaa

SEQ ID NO: 6063884 - DNA, 22 bp, Homo sapiens
ccaggaccagtttatgtttgtg

SEQ ID NO: 6063885 - DNA, 12 bp, Homo sapiens
ccaggacccagg

SEQ ID NO: 6063886 - DNA, 15 bp, Homo sapiens
ccaggacccagggtc

SEQ ID NO: 6063887 - DNA, 11 bp, Homo sapiens
ccaggacccca

SEQ ID NO: 6063888 - DNA, 13 bp, Homo sapiens
ccaggaccccagg

SEQ ID NO: 6063889 - DNA, 11 bp, Homo sapiens
ccaggaccccc

SEQ ID NO: 6063890 - DNA, 15 bp, Homo sapiens
ccaggacccccccag

SEQ ID NO: 6063891 - DNA, 17 bp, Homo sapiens
ccaggacccccccagtc

SEQ ID NO: 6063892 - DNA, 18 bp, Homo sapiens
ccaggacccccccagtcc

SEQ ID NO: 6063893 - DNA, 19 bp, Homo sapiens
ccaggacccctcagctccc

SEQ ID NO: 6063894 - DNA, 18 bp, Homo sapiens
ccaggacccgccagcccc

SEQ ID NO: 6063895 - DNA, 20 bp, Homo sapiens
ccaggacccgccagccccgc

SEQ ID NO: 6063896 - DNA, 14 bp, Homo sapiens
ccaggaccctgaag

SEQ ID NO: 6063897 - DNA, 19 bp, Homo sapiens
ccaggaccctgaaggggcc

SEQ ID NO: 6063898 - DNA, 13 bp, Homo sapiens
ccaggaccctgag

SEQ ID NO: 6063899 - DNA, 16 bp, Homo sapiens
ccaggaccctgagggt

SEQ ID NO: 6063900 - DNA, 16 bp, Homo sapiens
ccaggaccctgccagg

SEQ ID NO: 6063901 - DNA, 19 bp, Homo sapiens
ccaggaccctgccaggcac

SEQ ID NO: 6063902 - DNA, 18 bp, Homo sapiens
ccaggaccctggacccag

SEQ ID NO: 6063903 - DNA, 21 bp, Homo sapiens
ccaggacctccggagcgccct

SEQ ID NO: 6063904 - DNA, 14 bp, Homo sapiens
ccaggacctcttca

SEQ ID NO: 6063905 - DNA, 18 bp, Homo sapiens
ccaggacctcttctggag

SEQ ID NO: 6063906 - DNA, 15 bp, Homo sapiens
ccaggacctgagcct

SEQ ID NO: 6063907 - DNA, 16 bp, Homo sapiens
ccaggacctgagcctg

SEQ ID NO: 6063908 - DNA, 18 bp, Homo sapiens
ccaggacctgagcctggc

SEQ ID NO: 6063909 - DNA, 17 bp, Homo sapiens
ccaggacctggctgcca

SEQ ID NO: 6063910 - DNA, 17 bp, Homo sapiens
ccaggacgcatgcaggg

SEQ ID NO: 6063911 - DNA, 14 bp, Homo sapiens
ccaggacgccactc

SEQ ID NO: 6063912 - DNA, 15 bp, Homo sapiens
ccaggacgccactca

SEQ ID NO: 6063913 - DNA, 16 bp, Homo sapiens
ccaggacgcttctgaa

SEQ ID NO: 6063914 - DNA, 19 bp, Homo sapiens
ccaggacgcttctgaatgc

SEQ ID NO: 6063915 - DNA, 20 bp, Homo sapiens
ccaggacggggccggccagg

SEQ ID NO: 6063916 - DNA, 21 bp, Homo sapiens
ccaggacggggccggccaggt

SEQ ID NO: 6063917 - DNA, 13 bp, Homo sapiens
ccaggacggtctg

SEQ ID NO: 6063918 - DNA, 17 bp, Homo sapiens
ccaggacggtctgtgcc

SEQ ID NO: 6063919 - DNA, 18 bp, Homo sapiens
ccaggacggtctgtgccc

SEQ ID NO: 6063920 - DNA, 21 bp, Homo sapiens
ccaggacggtctgtgcccgag

SEQ ID NO: 6063921 - DNA, 21 bp, Homo sapiens
ccaggacgtcctatctccccc

SEQ ID NO: 6063922 - DNA, 18 bp, Homo sapiens
ccaggactatagcccagg

SEQ ID NO: 6063923 - DNA, 15 bp, Homo sapiens
ccaggactcaccctc

SEQ ID NO: 6063924 - DNA, 16 bp, Homo sapiens
ccaggactcaccctca

SEQ ID NO: 6063925 - DNA, 17 bp, Homo sapiens
ccaggactcaccctcca

SEQ ID NO: 6063926 - DNA, 16 bp, Homo sapiens
ccaggactccactgga

SEQ ID NO: 6063927 - DNA, 15 bp, Homo sapiens
ccaggactcccagaa

SEQ ID NO: 6063928 - DNA, 19 bp, Homo sapiens
ccaggactccccaggccag

SEQ ID NO: 6063929 - DNA, 14 bp, Homo sapiens
ccaggactcctccc

SEQ ID NO: 6063930 - DNA, 22 bp, Homo sapiens
ccaggactccttgttctgctct

SEQ ID NO: 6063931 - DNA, 16 bp, Homo sapiens
ccaggactctctttct

SEQ ID NO: 6063932 - DNA, 20 bp, Homo sapiens
ccaggactctctttcttcca

SEQ ID NO: 6063933 - DNA, 13 bp, Homo sapiens
ccaggactctgca

SEQ ID NO: 6063934 - DNA, 14 bp, Homo sapiens
ccaggactctgcag

SEQ ID NO: 6063935 - DNA, 16 bp, Homo sapiens
ccaggactctgcagcc

SEQ ID NO: 6063936 - DNA, 14 bp, Homo sapiens
ccaggactctgcct

SEQ ID NO: 6063937 - DNA, 15 bp, Homo sapiens
ccaggactctgcctt

SEQ ID NO: 6063938 - DNA, 13 bp, Homo sapiens
ccaggactctggc

SEQ ID NO: 6063939 - DNA, 14 bp, Homo sapiens
ccaggactctggca

SEQ ID NO: 6063940 - DNA, 13 bp, Homo sapiens
ccaggactgagat

SEQ ID NO: 6063941 - DNA, 14 bp, Homo sapiens
ccaggactggctgt

SEQ ID NO: 6063942 - DNA, 12 bp, Homo sapiens
ccaggactgggc

SEQ ID NO: 6063943 - DNA, 17 bp, Homo sapiens
ccaggactgggccactt

SEQ ID NO: 6063944 - DNA, 23 bp, Homo sapiens
ccaggactggggcttgccaggct

SEQ ID NO: 6063945 - DNA, 15 bp, Homo sapiens
ccaggactgtgactc

SEQ ID NO: 6063946 - DNA, 23 bp, Homo sapiens
ccaggacttaagacaaatgggac

SEQ ID NO: 6063947 - DNA, 17 bp, Homo sapiens
ccaggacttggggtcag

SEQ ID NO: 6063948 - DNA, 16 bp, Homo sapiens
ccaggacttggtcttt

SEQ ID NO: 6063949 - DNA, 22 bp, Homo sapiens
ccaggagaaagatgaaactgaa

SEQ ID NO: 6063950 - DNA, 23 bp, Homo sapiens
ccaggagaaagccgggggagggg

SEQ ID NO: 6063951 - DNA, 19 bp, Homo sapiens
ccaggagaaatcaacagga

SEQ ID NO: 6063952 - DNA, 12 bp, Homo sapiens
ccaggagaactg

SEQ ID NO: 6063953 - DNA, 20 bp, Homo sapiens
ccaggagaagaaagaggtga

SEQ ID NO: 6063954 - DNA, 20 bp, Homo sapiens
ccaggagaagacccctgccc

SEQ ID NO: 6063955 - DNA, 22 bp, Homo sapiens
ccaggagaagacccctgcccaa

SEQ ID NO: 6063956 - DNA, 13 bp, Homo sapiens
ccaggagaagctc

SEQ ID NO: 6063957 - DNA, 18 bp, Homo sapiens
ccaggagaagctcagctg

SEQ ID NO: 6063958 - DNA, 21 bp, Homo sapiens
ccaggagaagctcagctgcat

SEQ ID NO: 6063959 - DNA, 20 bp, Homo sapiens
ccaggagaaggccaattcct

SEQ ID NO: 6063960 - DNA, 16 bp, Homo sapiens
ccaggagaagggctgg

SEQ ID NO: 6063961 - DNA, 20 bp, Homo sapiens
ccaggagaagggctggggcc

SEQ ID NO: 6063962 - DNA, 16 bp, Homo sapiens
ccaggagaagggggct

SEQ ID NO: 6063963 - DNA, 23 bp, Homo sapiens
ccaggagaagggggctctgcccc

SEQ ID NO: 6063964 - DNA, 17 bp, Homo sapiens
ccaggagaagttgaggg

SEQ ID NO: 6063965 - DNA, 23 bp, Homo sapiens
ccaggagaataaaagaaattcct

SEQ ID NO: 6063966 - DNA, 24 bp, Homo sapiens
ccaggagaattaggaaggccatgg

SEQ ID NO: 6063967 - DNA, 15 bp, Homo sapiens
ccaggagacagacca

SEQ ID NO: 6063968 - DNA, 13 bp, Homo sapiens
ccaggagacctgc

SEQ ID NO: 6063969 - DNA, 19 bp, Homo sapiens
ccaggagacctgctctccg

SEQ ID NO: 6063970 - DNA, 11 bp, Homo sapiens
ccaggagagag

SEQ ID NO: 6063971 - DNA, 14 bp, Homo sapiens
ccaggagagagaaa

SEQ ID NO: 6063972 - DNA, 16 bp, Homo sapiens
ccaggagagagaaagc

SEQ ID NO: 6063973 - DNA, 17 bp, Homo sapiens
ccaggagagagaaagcc

SEQ ID NO: 6063974 - DNA, 17 bp, Homo sapiens
ccaggagagagccagga

SEQ ID NO: 6063975 - DNA, 19 bp, Homo sapiens
ccaggagagccagccctcc

SEQ ID NO: 6063976 - DNA, 19 bp, Homo sapiens
ccaggagagcccccaccag

SEQ ID NO: 6063977 - DNA, 20 bp, Homo sapiens
ccaggagagcccccaccagc

SEQ ID NO: 6063978 - DNA, 17 bp, Homo sapiens
ccaggagagcctggggg

SEQ ID NO: 6063979 - DNA, 19 bp, Homo sapiens
ccaggagatgaggctggat

SEQ ID NO: 6063980 - DNA, 15 bp, Homo sapiens
ccaggagatgggtcc

SEQ ID NO: 6063981 - DNA, 18 bp, Homo sapiens
ccaggagatgggtccagg

SEQ ID NO: 6063982 - DNA, 14 bp, Homo sapiens
ccaggagattacaa

SEQ ID NO: 6063983 - DNA, 23 bp, Homo sapiens
ccaggagcaaatgtttctgcagt

SEQ ID NO: 6063984 - DNA, 20 bp, Homo sapiens
ccaggagcaaccgtgcagcc

SEQ ID NO: 6063985 - DNA, 17 bp, Homo sapiens
ccaggagcaagtgaggc

SEQ ID NO: 6063986 - DNA, 22 bp, Homo sapiens
ccaggagcaagtgaggccggag

SEQ ID NO: 6063987 - DNA, 14 bp, Homo sapiens
ccaggagcaatggg

SEQ ID NO: 6063988 - DNA, 15 bp, Homo sapiens
ccaggagcaatggga

SEQ ID NO: 6063989 - DNA, 16 bp, Homo sapiens
ccaggagcaatgggac

SEQ ID NO: 6063990 - DNA, 17 bp, Homo sapiens
ccaggagcaatgggact

SEQ ID NO: 6063991 - DNA, 18 bp, Homo sapiens
ccaggagcaatgggactg

SEQ ID NO: 6063992 - DNA, 18 bp, Homo sapiens
ccaggagcacacggccct

SEQ ID NO: 6063993 - DNA, 14 bp, Homo sapiens
ccaggagcacctgg

SEQ ID NO: 6063994 - DNA, 16 bp, Homo sapiens
ccaggagcacggctct

SEQ ID NO: 6063995 - DNA, 17 bp, Homo sapiens
ccaggagcacggctctg

SEQ ID NO: 6063996 - DNA, 15 bp, Homo sapiens
ccaggagcagcagcc

SEQ ID NO: 6063997 - DNA, 16 bp, Homo sapiens
ccaggagcagcagcca

SEQ ID NO: 6063998 - DNA, 18 bp, Homo sapiens
ccaggagcagcagccagc

SEQ ID NO: 6063999 - DNA, 12 bp, Homo sapiens
ccaggagcagcc

SEQ ID NO: 6064000 - DNA, 13 bp, Homo sapiens
ccaggagcagcca

SEQ ID NO: 6064001 - DNA, 16 bp, Homo sapiens
ccaggagcagccacat

SEQ ID NO: 6064002 - DNA, 16 bp, Homo sapiens
ccaggagcagccctgg

SEQ ID NO: 6064003 - DNA, 16 bp, Homo sapiens
ccaggagcagcctcca

SEQ ID NO: 6064004 - DNA, 12 bp, Homo sapiens
ccaggagcagct

SEQ ID NO: 6064005 - DNA, 13 bp, Homo sapiens
ccaggagcagctg

SEQ ID NO: 6064006 - DNA, 14 bp, Homo sapiens
ccctggagcaggag

SEQ ID NO: 6064007 - DNA, 22 bp, Homo sapiens
ccctggagccaactgctgcttt

SEQ ID NO: 6064008 - DNA, 20 bp, Homo sapiens
ccctggagccagcagggctg

SEQ ID NO: 6064009 - DNA, 23 bp, Homo sapiens
ccctggagccagggcagaggaat

SEQ ID NO: 6064010 - DNA, 17 bp, Homo sapiens
ccctggagccatccctt

SEQ ID NO: 6064011 - DNA, 15 bp, Homo sapiens
ccctggagccccttc

SEQ ID NO: 6064012 - DNA, 17 bp, Homo sapiens
ccctggagccccttcgg

SEQ ID NO: 6064013 - DNA, 14 bp, Homo sapiens
ccctggagcctcag

SEQ ID NO: 6064014 - DNA, 18 bp, Homo sapiens
ccctggagcggctctcct

SEQ ID NO: 6064015 - DNA, 19 bp, Homo sapiens
ccctggagcggctctcctg

SEQ ID NO: 6064016 - DNA, 10 bp, Homo sapiens
ccctggagct

SEQ ID NO: 6064017 - DNA, 20 bp, Homo sapiens
ccctggagctcaagccgtgg

SEQ ID NO: 6064018 - DNA, 19 bp, Homo sapiens
ccctggagctcctgctggg

SEQ ID NO: 6064019 - DNA, 13 bp, Homo sapiens
ccctggagctgtc

SEQ ID NO: 6064020 - DNA, 15 bp, Homo sapiens
ccctggagctgtcct

SEQ ID NO: 6064021 - DNA, 11 bp, Homo sapiens
ccctggaggat

SEQ ID NO: 6064022 - DNA, 22 bp, Homo sapiens
ccctggaggcacgcaccactgc

SEQ ID NO: 6064023 - DNA, 16 bp, Homo sapiens
ccctggaggctgcctc

SEQ ID NO: 6064024 - DNA, 17 bp, Homo sapiens
ccctggaggctgcctcc

SEQ ID NO: 6064025 - DNA, 18 bp, Homo sapiens
ccctggagggcaagccct

SEQ ID NO: 6064026 - DNA, 19 bp, Homo sapiens
ccctggagggcaagccctg

SEQ ID NO: 6064027 - DNA, 23 bp, Homo sapiens
ccctggagggcaagccctgccca

SEQ ID NO: 6064028 - DNA, 13 bp, Homo sapiens
ccctggagggcag

SEQ ID NO: 6064029 - DNA, 16 bp, Homo sapiens
ccctggagggcagaga

SEQ ID NO: 6064030 - DNA, 23 bp, Homo sapiens
ccctggaggggacttccacacct

SEQ ID NO: 6064031 - DNA, 15 bp, Homo sapiens
ccctggaggtgccag

SEQ ID NO: 6064032 - DNA, 16 bp, Homo sapiens
ccctggaggtgccagc

SEQ ID NO: 6064033 - DNA, 23 bp, Homo sapiens
ccctggaggtgccagcaaagccc

SEQ ID NO: 6064034 - DNA, 13 bp, Homo sapiens
ccctggagtcagg

SEQ ID NO: 6064035 - DNA, 18 bp, Homo sapiens
ccctggagtcatgccaag

SEQ ID NO: 6064036 - DNA, 23 bp, Homo sapiens
ccctggagtcccctgggcctgga

SEQ ID NO: 6064037 - DNA, 12 bp, Homo sapiens
ccctggagtggc

SEQ ID NO: 6064038 - DNA, 20 bp, Homo sapiens
ccctggagtggcatggtcct

SEQ ID NO: 6064039 - DNA, 21 bp, Homo sapiens
ccctggagtggcatggtcctg

SEQ ID NO: 6064040 - DNA, 22 bp, Homo sapiens
ccctggagtggcatggtcctgt

SEQ ID NO: 6064041 - DNA, 17 bp, Homo sapiens
ccctggagtgtgtcaga

SEQ ID NO: 6064042 - DNA, 24 bp, Homo sapiens
ccctggagtgtgtcagagcccagg

SEQ ID NO: 6064043 - DNA, 20 bp, Homo sapiens
ccctggatcacataccaggt

SEQ ID NO: 6064044 - DNA, 15 bp, Homo sapiens
ccctggatcagaaca

SEQ ID NO: 6064045 - DNA, 22 bp, Homo sapiens
ccctggatcagggttgttctgg

SEQ ID NO: 6064046 - DNA, 19 bp, Homo sapiens
ccctggatccatcaggcca

SEQ ID NO: 6064047 - DNA, 21 bp, Homo sapiens
ccctggatgcagcctcacagt

SEQ ID NO: 6064048 - DNA, 15 bp, Homo sapiens
ccctggatggcctct

SEQ ID NO: 6064049 - DNA, 16 bp, Homo sapiens
ccctggatggcctctg

SEQ ID NO: 6064050 - DNA, 17 bp, Homo sapiens
ccctggatggcctctgg

SEQ ID NO: 6064051 - DNA, 21 bp, Homo sapiens
ccctggatgggcattgggctg

SEQ ID NO: 6064052 - DNA, 22 bp, Homo sapiens
ccctggatgtcccctgtcccac

SEQ ID NO: 6064053 - DNA, 21 bp, Homo sapiens
ccctggatgtgaagctcacac

SEQ ID NO: 6064054 - DNA, 21 bp, Homo sapiens
ccctggattaggagggtgaca

SEQ ID NO: 6064055 - DNA, 14 bp, Homo sapiens
ccctggcaaatgca

SEQ ID NO: 6064056 - DNA, 11 bp, Homo sapiens
ccctggcaccc

SEQ ID NO: 6064057 - DNA, 21 bp, Homo sapiens
ccctggcagagatgcctccct

SEQ ID NO: 6064058 - DNA, 15 bp, Homo sapiens
ccctggcagcacagc

SEQ ID NO: 6064059 - DNA, 16 bp, Homo sapiens
ccctggcagcacagcc

SEQ ID NO: 6064060 - DNA, 14 bp, Homo sapiens
ccctggcagcccct

SEQ ID NO: 6064061 - DNA, 14 bp, Homo sapiens
ccctggcagctgcc

SEQ ID NO: 6064062 - DNA, 20 bp, Homo sapiens
ccctggcagctgcccctcct

SEQ ID NO: 6064063 - DNA, 22 bp, Homo sapiens
ccctggcagctgcccctcctgg

SEQ ID NO: 6064064 - DNA, 16 bp, Homo sapiens
ccctggcaggcttcca

SEQ ID NO: 6064065 - DNA, 13 bp, Homo sapiens
ccctggcagggac

SEQ ID NO: 6064066 - DNA, 23 bp, Homo sapiens
ccctggcaggtggccaggcaggc

SEQ ID NO: 6064067 - DNA, 14 bp, Homo sapiens
ccctggcagtgctg

SEQ ID NO: 6064068 - DNA, 23 bp, Homo sapiens
ccctggcatcgtgtattccatat

SEQ ID NO: 6064069 - DNA, 20 bp, Homo sapiens
ccctggcatgtcaacagcgt

SEQ ID NO: 6064070 - DNA, 23 bp, Homo sapiens
ccctggcatgtcagagccaggct

SEQ ID NO: 6064071 - DNA, 19 bp, Homo sapiens
ccctggcatgtttcaccac

SEQ ID NO: 6064072 - DNA, 19 bp, Homo sapiens
ccctggcattgtttccacc

SEQ ID NO: 6064073 - DNA, 13 bp, Homo sapiens
ccctggccaagct

SEQ ID NO: 6064074 - DNA, 15 bp, Homo sapiens
ccctggccacagcct

SEQ ID NO: 6064075 - DNA, 17 bp, Homo sapiens
ccctggccacctgccag

SEQ ID NO: 6064076 - DNA, 21 bp, Homo sapiens
ccctggccactaaagcttcag

SEQ ID NO: 6064077 - DNA, 22 bp, Homo sapiens
ccctggccactaaagcttcaga

SEQ ID NO: 6064078 - DNA, 16 bp, Homo sapiens
ccctggccactggccc

SEQ ID NO: 6064079 - DNA, 21 bp, Homo sapiens
ccctggccactggccctgttt

SEQ ID NO: 6064080 - DNA, 13 bp, Homo sapiens
ccctggccagccc

SEQ ID NO: 6064081 - DNA, 14 bp, Homo sapiens
ccctggccagccct

SEQ ID NO: 6064082 - DNA, 16 bp, Homo sapiens
ccctggccagcccttc

SEQ ID NO: 6064083 - DNA, 15 bp, Homo sapiens
ccctggccagccggg

SEQ ID NO: 6064084 - DNA, 13 bp, Homo sapiens
ccctggccagggc

SEQ ID NO: 6064085 - DNA, 14 bp, Homo sapiens
ccctggccatctct

SEQ ID NO: 6064086 - DNA, 15 bp, Homo sapiens
ccctggccatctctg

SEQ ID NO: 6064087 - DNA, 17 bp, Homo sapiens
ccctggcccacccccca

SEQ ID NO: 6064088 - DNA, 20 bp, Homo sapiens
ccctggcccaccccccagcc

SEQ ID NO: 6064089 - DNA, 11 bp, Homo sapiens
ccctggcccag

SEQ ID NO: 6064090 - DNA, 14 bp, Homo sapiens
ccctggcccagcct

SEQ ID NO: 6064091 - DNA, 18 bp, Homo sapiens
ccctggcccagcctgtgg

SEQ ID NO: 6064092 - DNA, 21 bp, Homo sapiens
ccctggcccagcggcccctcc

SEQ ID NO: 6064093 - DNA, 14 bp, Homo sapiens
ccctggcccaggag

SEQ ID NO: 6064094 - DNA, 14 bp, Homo sapiens
ccctggcccaggtg

SEQ ID NO: 6064095 - DNA, 15 bp, Homo sapiens
ccctggcccaggtgc

SEQ ID NO: 6064096 - DNA, 19 bp, Homo sapiens
ccctggcccatctcagcct

SEQ ID NO: 6064097 - DNA, 12 bp, Homo sapiens
ccctggccccag

SEQ ID NO: 6064098 - DNA, 13 bp, Homo sapiens
ccctggccccagg

SEQ ID NO: 6064099 - DNA, 15 bp, Homo sapiens
ccctggccccagtga

SEQ ID NO: 6064100 - DNA, 11 bp, Homo sapiens
ccctggccccc

SEQ ID NO: 6064101 - DNA, 14 bp, Homo sapiens
ccctggcccccatc

SEQ ID NO: 6064102 - DNA, 21 bp, Homo sapiens
ccctggcccccatcagccctg

SEQ ID NO: 6064103 - DNA, 22 bp, Homo sapiens
ccctggcccccatcagccctgc

SEQ ID NO: 6064104 - DNA, 23 bp, Homo sapiens
ccctggcccccatcagccctgct

SEQ ID NO: 6064105 - DNA, 20 bp, Homo sapiens
ccctggccccctccctggat

SEQ ID NO: 6064106 - DNA, 21 bp, Homo sapiens
ccctggccccctccctggatg

SEQ ID NO: 6064107 - DNA, 18 bp, Homo sapiens
ccctggccccgcctgcct

SEQ ID NO: 6064108 - DNA, 13 bp, Homo sapiens
ccctggcccctcc

SEQ ID NO: 6064109 - DNA, 21 bp, Homo sapiens
ccctggcccctcccacatccc

SEQ ID NO: 6064110 - DNA, 14 bp, Homo sapiens
ccctggcccctgtg

SEQ ID NO: 6064111 - DNA, 14 bp, Homo sapiens
ccctggcccggtcc

SEQ ID NO: 6064112 - DNA, 13 bp, Homo sapiens
ccctggccctcaa

SEQ ID NO: 6064113 - DNA, 20 bp, Homo sapiens
ccctggccctcaaggcctcc

SEQ ID NO: 6064114 - DNA, 16 bp, Homo sapiens
ccctggccctgcctca

SEQ ID NO: 6064115 - DNA, 16 bp, Homo sapiens
ccctggcccttccttc

SEQ ID NO: 6064116 - DNA, 22 bp, Homo sapiens
ccctggcccttccttcacccac

SEQ ID NO: 6064117 - DNA, 22 bp, Homo sapiens
ccctggccctttccccttcccc

SEQ ID NO: 6064118 - DNA, 20 bp, Homo sapiens
ccctggccgagtccaagctg

SEQ ID NO: 6064119 - DNA, 20 bp, Homo sapiens
ccctggccgcgctccgggct

SEQ ID NO: 6064120 - DNA, 20 bp, Homo sapiens
ccctggccgcttctccccag

SEQ ID NO: 6064121 - DNA, 19 bp, Homo sapiens
ccctggcctaccacagctg

SEQ ID NO: 6064122 - DNA, 21 bp, Homo sapiens
ccctggcctaccacagctgcc

SEQ ID NO: 6064123 - DNA, 16 bp, Homo sapiens
ccctggcctagaccag

SEQ ID NO: 6064124 - DNA, 20 bp, Homo sapiens
ccctggcctcacgcccagcc

SEQ ID NO: 6064125 - DNA, 13 bp, Homo sapiens
ccctggcctcccc

SEQ ID NO: 6064126 - DNA, 14 bp, Homo sapiens
ccctggcctcccct

SEQ ID NO: 6064127 - DNA, 13 bp, Homo sapiens
ccctggcctctgt

SEQ ID NO: 6064128 - DNA, 15 bp, Homo sapiens
ccctggcctctgtgc

SEQ ID NO: 6064129 - DNA, 11 bp, Homo sapiens
ccctggcctga

SEQ ID NO: 6064130 - DNA, 15 bp, Homo sapiens
ccctggcctgagagg

SEQ ID NO: 6064131 - DNA, 13 bp, Homo sapiens
ccctggcctgccg

SEQ ID NO: 6064132 - DNA, 12 bp, Homo sapiens
ccctggcctggc

SEQ ID NO: 6064133 - DNA, 19 bp, Homo sapiens
ccctggcctggctctcctg

SEQ ID NO: 6064134 - DNA, 20 bp, Homo sapiens
ccctggcctggctctcctgt

SEQ ID NO: 6064135 - DNA, 14 bp, Homo sapiens
ccctggcctggtcc

SEQ ID NO: 6064136 - DNA, 19 bp, Homo sapiens
ccctggcctggtccctggt

SEQ ID NO: 6064137 - DNA, 23 bp, Homo sapiens
ccctggcctggtccctggtcctt

SEQ ID NO: 6064138 - DNA, 15 bp, Homo sapiens
ccctggcctgtggag

SEQ ID NO: 6064139 - DNA, 14 bp, Homo sapiens
ccctggcctttttc

SEQ ID NO: 6064140 - DNA, 14 bp, Homo sapiens
ccctggcggcaggg

SEQ ID NO: 6064141 - DNA, 15 bp, Homo sapiens
ccctggcggcagggg

SEQ ID NO: 6064142 - DNA, 21 bp, Homo sapiens
ccctggcgggtggctgcaagc

SEQ ID NO: 6064143 - DNA, 19 bp, Homo sapiens
ccctggcgtcctctccctc

SEQ ID NO: 6064144 - DNA, 18 bp, Homo sapiens
ccctggctcactggcagg

SEQ ID NO: 6064145 - DNA, 12 bp, Homo sapiens
ccctggctcagg

SEQ ID NO: 6064146 - DNA, 13 bp, Homo sapiens
ccctggctcaggg

SEQ ID NO: 6064147 - DNA, 19 bp, Homo sapiens
ccctggctcccacaggccc

SEQ ID NO: 6064148 - DNA, 14 bp, Homo sapiens
ccctggctcccatg

SEQ ID NO: 6064149 - DNA, 12 bp, Homo sapiens
ccctggctccct

SEQ ID NO: 6064150 - DNA, 16 bp, Homo sapiens
ccctggctccctcctc

SEQ ID NO: 6064151 - DNA, 20 bp, Homo sapiens
ccctggctccctcctccagg

SEQ ID NO: 6064152 - DNA, 23 bp, Homo sapiens
ccctggctccctcctccaggcct

SEQ ID NO: 6064153 - DNA, 12 bp, Homo sapiens
ccctggctcctt

SEQ ID NO: 6064154 - DNA, 16 bp, Homo sapiens
ccctggctccttcacc

SEQ ID NO: 6064155 - DNA, 19 bp, Homo sapiens
ccctggctccttcaccacc

SEQ ID NO: 6064156 - DNA, 20 bp, Homo sapiens
ccctggctccttgtgccaga

SEQ ID NO: 6064157 - DNA, 14 bp, Homo sapiens
ccctggctctgccc

SEQ ID NO: 6064158 - DNA, 17 bp, Homo sapiens
ccctggctctgcccctc

SEQ ID NO: 6064159 - DNA, 20 bp, Homo sapiens
ccctggctctgcccctcagg

SEQ ID NO: 6064160 - DNA, 13 bp, Homo sapiens
ccctggctcttct

SEQ ID NO: 6064161 - DNA, 10 bp, Homo sapiens
ccctggctga

SEQ ID NO: 6064162 - DNA, 18 bp, Homo sapiens
ccctggctgaacagtgct

SEQ ID NO: 6064163 - DNA, 14 bp, Homo sapiens
ccctggctgaagga

SEQ ID NO: 6064164 - DNA, 18 bp, Homo sapiens
ccctggctgaaggactgt

SEQ ID NO: 6064165 - DNA, 14 bp, Homo sapiens
ccctggctgacctg

SEQ ID NO: 6064166 - DNA, 19 bp, Homo sapiens
ccctggctgacctgctgtg

SEQ ID NO: 6064167 - DNA, 21 bp, Homo sapiens
ccctggctgacctgctgtgga

SEQ ID NO: 6064168 - DNA, 17 bp, Homo sapiens
ccctggctgcagcctcc

SEQ ID NO: 6064169 - DNA, 16 bp, Homo sapiens
ccctggctgccctggc

SEQ ID NO: 6064170 - DNA, 17 bp, Homo sapiens
ccctggctgccctggcc

SEQ ID NO: 6064171 - DNA, 22 bp, Homo sapiens
ccctggctgccctggccctgag

SEQ ID NO: 6064172 - DNA, 18 bp, Homo sapiens
ccctggctgggatcagag

SEQ ID NO: 6064173 - DNA, 21 bp, Homo sapiens
ccctggctgggatcagagcag

SEQ ID NO: 6064174 - DNA, 22 bp, Homo sapiens
ccctggctgggatcagagcagg

SEQ ID NO: 6064175 - DNA, 17 bp, Homo sapiens
ccctggctggggacttg

SEQ ID NO: 6064176 - DNA, 11 bp, Homo sapiens
ccctggctggt

SEQ ID NO: 6064177 - DNA, 15 bp, Homo sapiens
ccctggctgtactgc

SEQ ID NO: 6064178 - DNA, 22 bp, Homo sapiens
ccctggctgtactgctcaggct

SEQ ID NO: 6064179 - DNA, 21 bp, Homo sapiens
ccctggctgtgagcagcctcc

SEQ ID NO: 6064180 - DNA, 15 bp, Homo sapiens
ccctggctgtgggta

SEQ ID NO: 6064181 - DNA, 14 bp, Homo sapiens
ccctggcttcctta

SEQ ID NO: 6064182 - DNA, 15 bp, Homo sapiens
ccctggcttctgtgg

SEQ ID NO: 6064183 - DNA, 17 bp, Homo sapiens
ccctggcttctgtgggg

SEQ ID NO: 6064184 - DNA, 10 bp, Homo sapiens
ccctggcttt

SEQ ID NO: 6064185 - DNA, 16 bp, Homo sapiens
ccctggctttgcctct

SEQ ID NO: 6064186 - DNA, 22 bp, Homo sapiens
ccaggagcagctggcactgaca

SEQ ID NO: 6064187 - DNA, 22 bp, Homo sapiens
ccaggagcagcttttggtctcc

SEQ ID NO: 6064188 - DNA, 23 bp, Homo sapiens
ccaggagcagcttttggtctcct

SEQ ID NO: 6064189 - DNA, 13 bp, Homo sapiens
ccaggagcataga

SEQ ID NO: 6064190 - DNA, 19 bp, Homo sapiens
ccaggagcatagaagccac

SEQ ID NO: 6064191 - DNA, 18 bp, Homo sapiens
ccaggagcatccacctcc

SEQ ID NO: 6064192 - DNA, 20 bp, Homo sapiens
ccaggagcatccacctcctt

SEQ ID NO: 6064193 - DNA, 20 bp, Homo sapiens
ccaggagcattttgtgtctt

SEQ ID NO: 6064194 - DNA, 11 bp, Homo sapiens
ccaggagccag

SEQ ID NO: 6064195 - DNA, 16 bp, Homo sapiens
ccaggagccaggtgtc

SEQ ID NO: 6064196 - DNA, 15 bp, Homo sapiens
ccaggagccatgaca

SEQ ID NO: 6064197 - DNA, 13 bp, Homo sapiens
ccaggagcccatt

SEQ ID NO: 6064198 - DNA, 17 bp, Homo sapiens
ccaggagccccagccag

SEQ ID NO: 6064199 - DNA, 16 bp, Homo sapiens
ccaggagccccgaggc

SEQ ID NO: 6064200 - DNA, 19 bp, Homo sapiens
ccaggagccccgaggcctt

SEQ ID NO: 6064201 - DNA, 15 bp, Homo sapiens
ccaggagcccgtcag

SEQ ID NO: 6064202 - DNA, 13 bp, Homo sapiens
ccaggagccctgg

SEQ ID NO: 6064203 - DNA, 17 bp, Homo sapiens
ccaggagccctggcccg

SEQ ID NO: 6064204 - DNA, 22 bp, Homo sapiens
ccaggagccggacacttctcag

SEQ ID NO: 6064205 - DNA, 21 bp, Homo sapiens
ccaggagccgggcctcccacc

SEQ ID NO: 6064206 - DNA, 12 bp, Homo sapiens
ccaggagcctac

SEQ ID NO: 6064207 - DNA, 12 bp, Homo sapiens
ccaggagcctcc

SEQ ID NO: 6064208 - DNA, 15 bp, Homo sapiens
ccaggagcctcctga

SEQ ID NO: 6064209 - DNA, 19 bp, Homo sapiens
ccaggagcctcctgccctt

SEQ ID NO: 6064210 - DNA, 16 bp, Homo sapiens
ccaggagcctgtgcct

SEQ ID NO: 6064211 - DNA, 17 bp, Homo sapiens
ccaggagcgcagctgca

SEQ ID NO: 6064212 - DNA, 12 bp, Homo sapiens
ccaggagctagc

SEQ ID NO: 6064213 - DNA, 17 bp, Homo sapiens
ccaggagctcaggtggg

SEQ ID NO: 6064214 - DNA, 15 bp, Homo sapiens
ccaggagctctctgc

SEQ ID NO: 6064215 - DNA, 20 bp, Homo sapiens
ccaggagctctgcgccaggc

SEQ ID NO: 6064216 - DNA, 13 bp, Homo sapiens
ccaggagctcttc

SEQ ID NO: 6064217 - DNA, 18 bp, Homo sapiens
ccaggagctcttcaggcc

SEQ ID NO: 6064218 - DNA, 21 bp, Homo sapiens
ccaggagctcttcaggcctcc

SEQ ID NO: 6064219 - DNA, 16 bp, Homo sapiens
ccaggagctgcccaga

SEQ ID NO: 6064220 - DNA, 17 bp, Homo sapiens
ccaggagctgctcacta

SEQ ID NO: 6064221 - DNA, 16 bp, Homo sapiens
ccaggagctgggcaga

SEQ ID NO: 6064222 - DNA, 23 bp, Homo sapiens
ccaggagctgggcagaaggccaa

SEQ ID NO: 6064223 - DNA, 23 bp, Homo sapiens
ccaggagctgtcaccaaggaaac

SEQ ID NO: 6064224 - DNA, 14 bp, Homo sapiens
ccaggagcttcttc

SEQ ID NO: 6064225 - DNA, 24 bp, Homo sapiens
ccaggaggaagtcgggaggcgtgg

SEQ ID NO: 6064226 - DNA, 14 bp, Homo sapiens
ccaggaggacccag

SEQ ID NO: 6064227 - DNA, 22 bp, Homo sapiens
ccaggaggagagagatgctgct

SEQ ID NO: 6064228 - DNA, 18 bp, Homo sapiens
ccaggaggagaggaaagg

SEQ ID NO: 6064229 - DNA, 19 bp, Homo sapiens
ccaggaggagaggaaagga

SEQ ID NO: 6064230 - DNA, 18 bp, Homo sapiens
ccaggaggagttagccaa

SEQ ID NO: 6064231 - DNA, 20 bp, Homo sapiens
ccaggaggagttagccaaac

SEQ ID NO: 6064232 - DNA, 15 bp, Homo sapiens
ccaggaggcagctca

SEQ ID NO: 6064233 - DNA, 13 bp, Homo sapiens
ccaggaggcagtg

SEQ ID NO: 6064234 - DNA, 14 bp, Homo sapiens
ccaggaggcagtgg

SEQ ID NO: 6064235 - DNA, 16 bp, Homo sapiens
ccaggaggcagtggac

SEQ ID NO: 6064236 - DNA, 13 bp, Homo sapiens
ccaggaggccagc

SEQ ID NO: 6064237 - DNA, 14 bp, Homo sapiens
ccaggaggccagcc

SEQ ID NO: 6064238 - DNA, 15 bp, Homo sapiens
ccaggaggccagcct

SEQ ID NO: 6064239 - DNA, 23 bp, Homo sapiens
ccaggaggccctggtcctggcct

SEQ ID NO: 6064240 - DNA, 21 bp, Homo sapiens
ccaggaggccgagtggctgcc

SEQ ID NO: 6064241 - DNA, 14 bp, Homo sapiens
ccaggaggcctggg

SEQ ID NO: 6064242 - DNA, 13 bp, Homo sapiens
ccaggaggctgag

SEQ ID NO: 6064243 - DNA, 17 bp, Homo sapiens
ccaggaggctgaggcag

SEQ ID NO: 6064244 - DNA, 18 bp, Homo sapiens
ccaggaggctgaggcagg

SEQ ID NO: 6064245 - DNA, 15 bp, Homo sapiens
ccaggaggctgaggt

SEQ ID NO: 6064246 - DNA, 15 bp, Homo sapiens
ccaggaggctgcggc

SEQ ID NO: 6064247 - DNA, 23 bp, Homo sapiens
ccaggagggacaaaggagcctgt

SEQ ID NO: 6064248 - DNA, 18 bp, Homo sapiens
ccaggagggaccaccctc

SEQ ID NO: 6064249 - DNA, 19 bp, Homo sapiens
ccaggagggaccaccctcc

SEQ ID NO: 6064250 - DNA, 21 bp, Homo sapiens
ccaggagggagagcctctgtt

SEQ ID NO: 6064251 - DNA, 16 bp, Homo sapiens
ccaggagggcactgga

SEQ ID NO: 6064252 - DNA, 17 bp, Homo sapiens
ccaggagggcatcagct

SEQ ID NO: 6064253 - DNA, 22 bp, Homo sapiens
ccaggagggcatcagctttccc

SEQ ID NO: 6064254 - DNA, 16 bp, Homo sapiens
ccaggagggctttgtg

SEQ ID NO: 6064255 - DNA, 20 bp, Homo sapiens
ccaggaggggaacactgccc

SEQ ID NO: 6064256 - DNA, 13 bp, Homo sapiens
ccaggaggggcct

SEQ ID NO: 6064257 - DNA, 20 bp, Homo sapiens
ccaggaggggcctctgaaat

SEQ ID NO: 6064258 - DNA, 16 bp, Homo sapiens
ccaggaggggcctggg

SEQ ID NO: 6064259 - DNA, 22 bp, Homo sapiens
ccaggaggggcctgggcagccc

SEQ ID NO: 6064260 - DNA, 14 bp, Homo sapiens
ccaggaggggtctg

SEQ ID NO: 6064261 - DNA, 21 bp, Homo sapiens
ccaggaggggtctgcctccca

SEQ ID NO: 6064262 - DNA, 17 bp, Homo sapiens
ccaggagggtaacagaa

SEQ ID NO: 6064263 - DNA, 18 bp, Homo sapiens
ccaggaggtcctcctctc

SEQ ID NO: 6064264 - DNA, 15 bp, Homo sapiens
ccaggaggtgcagtg

SEQ ID NO: 6064265 - DNA, 18 bp, Homo sapiens
ccaggaggtgccactgga

SEQ ID NO: 6064266 - DNA, 21 bp, Homo sapiens
ccaggaggtgccactggagtg

SEQ ID NO: 6064267 - DNA, 18 bp, Homo sapiens
ccaggaggtgcttgaggc

SEQ ID NO: 6064268 - DNA, 22 bp, Homo sapiens
ccaggaggtgggagtgaggagc

SEQ ID NO: 6064269 - DNA, 23 bp, Homo sapiens
ccaggaggttcccccgaccaggt

SEQ ID NO: 6064270 - DNA, 20 bp, Homo sapiens
ccaggaggttggtgactgaa

SEQ ID NO: 6064271 - DNA, 15 bp, Homo sapiens
ccaggagtaagacaa

SEQ ID NO: 6064272 - DNA, 15 bp, Homo sapiens
ccaggagtaagccca

SEQ ID NO: 6064273 - DNA, 13 bp, Homo sapiens
ccaggagtccaga

SEQ ID NO: 6064274 - DNA, 21 bp, Homo sapiens
ccaggagtccagaccccccag

SEQ ID NO: 6064275 - DNA, 22 bp, Homo sapiens
ccaggagtccagaccccccagc

SEQ ID NO: 6064276 - DNA, 23 bp, Homo sapiens
ccaggagtccagaccccccagcc

SEQ ID NO: 6064277 - DNA, 17 bp, Homo sapiens
ccaggagtccagcccct

SEQ ID NO: 6064278 - DNA, 21 bp, Homo sapiens
ccaggagtccagcccctcctc

SEQ ID NO: 6064279 - DNA, 23 bp, Homo sapiens
ccaggagtccagcccctcctccc

SEQ ID NO: 6064280 - DNA, 14 bp, Homo sapiens
ccaggagtggggag

SEQ ID NO: 6064281 - DNA, 16 bp, Homo sapiens
ccaggagtggggagag

SEQ ID NO: 6064282 - DNA, 17 bp, Homo sapiens
ccaggagtggggagagt

SEQ ID NO: 6064283 - DNA, 18 bp, Homo sapiens
ccaggagtgggtgggaca

SEQ ID NO: 6064284 - DNA, 19 bp, Homo sapiens
ccaggagtgggtggggagt

SEQ ID NO: 6064285 - DNA, 16 bp, Homo sapiens
ccaggagttcccaaat

SEQ ID NO: 6064286 - DNA, 15 bp, Homo sapiens
ccaggagttctgaag

SEQ ID NO: 6064287 - DNA, 21 bp, Homo sapiens
ccaggagtttgagacaagccc

SEQ ID NO: 6064288 - DNA, 19 bp, Homo sapiens
ccaggagtttgaggctgca

SEQ ID NO: 6064289 - DNA, 15 bp, Homo sapiens
ccaggagtttggcca

SEQ ID NO: 6064290 - DNA, 13 bp, Homo sapiens
ccaggataaagct

SEQ ID NO: 6064291 - DNA, 21 bp, Homo sapiens
ccaggataaggagactgaggc

SEQ ID NO: 6064292 - DNA, 22 bp, Homo sapiens
ccaggataaggagactgaggct

SEQ ID NO: 6064293 - DNA, 18 bp, Homo sapiens
ccaggatcactctctgct

SEQ ID NO: 6064294 - DNA, 14 bp, Homo sapiens
ccaggatcagccag

SEQ ID NO: 6064295 - DNA, 20 bp, Homo sapiens
ccaggatcatggtgtaataa

SEQ ID NO: 6064296 - DNA, 20 bp, Homo sapiens
ccaggatccctcccagatcc

SEQ ID NO: 6064297 - DNA, 14 bp, Homo sapiens
ccaggatcctgcag

SEQ ID NO: 6064298 - DNA, 18 bp, Homo sapiens
ccaggatctcctgccagc

SEQ ID NO: 6064299 - DNA, 20 bp, Homo sapiens
ccaggatctcctgccagccc

SEQ ID NO: 6064300 - DNA, 21 bp, Homo sapiens
ccaggatctcctgccagccca

SEQ ID NO: 6064301 - DNA, 22 bp, Homo sapiens
ccaggatctcctgccagcccag

SEQ ID NO: 6064302 - DNA, 17 bp, Homo sapiens
ccaggatctgctccaac

SEQ ID NO: 6064303 - DNA, 18 bp, Homo sapiens
ccaggatctgctccaaca

SEQ ID NO: 6064304 - DNA, 21 bp, Homo sapiens
ccaggatctgctccaacagaa

SEQ ID NO: 6064305 - DNA, 21 bp, Homo sapiens
ccaggatctgggttaggtggc

SEQ ID NO: 6064306 - DNA, 13 bp, Homo sapiens
ccaggatctttga

SEQ ID NO: 6064307 - DNA, 16 bp, Homo sapiens
ccaggatctttgactg

SEQ ID NO: 6064308 - DNA, 20 bp, Homo sapiens
ccaggatgagcatcccagga

SEQ ID NO: 6064309 - DNA, 21 bp, Homo sapiens
ccaggatgccacgcctggaag

SEQ ID NO: 6064310 - DNA, 23 bp, Homo sapiens
ccaggatgccacgcctggaaggg

SEQ ID NO: 6064311 - DNA, 21 bp, Homo sapiens
ccaggatgcctgagccccctg

SEQ ID NO: 6064312 - DNA, 20 bp, Homo sapiens
ccaggatgctaaagatgatg

SEQ ID NO: 6064313 - DNA, 21 bp, Homo sapiens
ccaggatgctaaagatgatga

SEQ ID NO: 6064314 - DNA, 20 bp, Homo sapiens
ccaggatgctcccccaggga

SEQ ID NO: 6064315 - DNA, 17 bp, Homo sapiens
ccaggatggactcttct

SEQ ID NO: 6064316 - DNA, 20 bp, Homo sapiens
ccaggatggagcaagctctt

SEQ ID NO: 6064317 - DNA, 14 bp, Homo sapiens
ccaggatggagggg

SEQ ID NO: 6064318 - DNA, 22 bp, Homo sapiens
ccaggatggaggggtggtcctg

SEQ ID NO: 6064319 - DNA, 22 bp, Homo sapiens
ccaggatggatgcatcacactc

SEQ ID NO: 6064320 - DNA, 20 bp, Homo sapiens
ccaggatggcgtgtcccctg

SEQ ID NO: 6064321 - DNA, 19 bp, Homo sapiens
ccaggatggggaggggctc

SEQ ID NO: 6064322 - DNA, 22 bp, Homo sapiens
ccaggatgggtgtctggggagg

SEQ ID NO: 6064323 - DNA, 15 bp, Homo sapiens
ccaggatggtcccag

SEQ ID NO: 6064324 - DNA, 23 bp, Homo sapiens
ccaggatggtcttgatctcctga

SEQ ID NO: 6064325 - DNA, 20 bp, Homo sapiens
ccaggattaatctctaaaat

SEQ ID NO: 6064326 - DNA, 20 bp, Homo sapiens
ccaggattattgtcaaagaa

SEQ ID NO: 6064327 - DNA, 14 bp, Homo sapiens
ccaggattcaggcc

SEQ ID NO: 6064328 - DNA, 21 bp, Homo sapiens
ccaggattcaggcctctgagg

SEQ ID NO: 6064329 - DNA, 16 bp, Homo sapiens
ccaggattcccagaga

SEQ ID NO: 6064330 - DNA, 17 bp, Homo sapiens
ccaggattcccccagcc

SEQ ID NO: 6064331 - DNA, 15 bp, Homo sapiens
ccaggattggcacaa

SEQ ID NO: 6064332 - DNA, 24 bp, Homo sapiens
ccaggattggcacaagctccctgg

SEQ ID NO: 6064333 - DNA, 14 bp, Homo sapiens
ccaggattggcctg

SEQ ID NO: 6064334 - DNA, 22 bp, Homo sapiens
ccaggattggggacctgatgga

SEQ ID NO: 6064335 - DNA, 21 bp, Homo sapiens
ccaggattgtacgtgggagag

SEQ ID NO: 6064336 - DNA, 15 bp, Homo sapiens
ccaggattgtccaca

SEQ ID NO: 6064337 - DNA, 20 bp, Homo sapiens
ccaggattgtccacaaatgt

SEQ ID NO: 6064338 - DNA, 23 bp, Homo sapiens
ccaggattgtccacaaatgtcct

SEQ ID NO: 6064339 - DNA, 14 bp, Homo sapiens
ccaggatttataaa

SEQ ID NO: 6064340 - DNA, 17 bp, Homo sapiens
ccaggatttataaagca

SEQ ID NO: 6064341 - DNA, 18 bp, Homo sapiens
ccaggatttgctgggaga

SEQ ID NO: 6064342 - DNA, 14 bp, Homo sapiens
ccaggatttggttg

SEQ ID NO: 6064343 - DNA, 19 bp, Homo sapiens
ccaggattttgtattgcca

SEQ ID NO: 6064344 - DNA, 20 bp, Homo sapiens
ccaggcaaagtgcacctcaa

SEQ ID NO: 6064345 - DNA, 19 bp, Homo sapiens
ccaggcaacctcccatccc

SEQ ID NO: 6064346 - DNA, 14 bp, Homo sapiens
ccaggcaagaaaag

SEQ ID NO: 6064347 - DNA, 23 bp, Homo sapiens
ccaggcaaggctgacttctctga

SEQ ID NO: 6064348 - DNA, 16 bp, Homo sapiens
ccaggcaaggctgtgg

SEQ ID NO: 6064349 - DNA, 23 bp, Homo sapiens
ccaggcaatggcctaaacttcag

SEQ ID NO: 6064350 - DNA, 15 bp, Homo sapiens
ccaggcacacacagc

SEQ ID NO: 6064351 - DNA, 16 bp, Homo sapiens
ccaggcacacacagcc

SEQ ID NO: 6064352 - DNA, 17 bp, Homo sapiens
ccaggcacacacagccc

SEQ ID NO: 6064353 - DNA, 16 bp, Homo sapiens
ccaggcacacactgtg

SEQ ID NO: 6064354 - DNA, 22 bp, Homo sapiens
ccaggcacacactgtgctttct

SEQ ID NO: 6064355 - DNA, 14 bp, Homo sapiens
ccaggcacagctga

SEQ ID NO: 6064356 - DNA, 15 bp, Homo sapiens
ccaggcacagctgag

SEQ ID NO: 6064357 - DNA, 16 bp, Homo sapiens
ccaggcacagctgagt

SEQ ID NO: 6064358 - DNA, 23 bp, Homo sapiens
ccaggcacagctgagttatgatg

SEQ ID NO: 6064359 - DNA, 18 bp, Homo sapiens
ccaggcacaggcagggca

SEQ ID NO: 6064360 - DNA, 14 bp, Homo sapiens
ccaggcacagggcc

SEQ ID NO: 6064361 - DNA, 15 bp, Homo sapiens
ccaggcacatggctg

SEQ ID NO: 6064362 - DNA, 16 bp, Homo sapiens
ccctggctttggcgcc

SEQ ID NO: 6064363 - DNA, 13 bp, Homo sapiens
ccctgggaaaggg

SEQ ID NO: 6064364 - DNA, 22 bp, Homo sapiens
ccctgggaacacagtgccccag

SEQ ID NO: 6064365 - DNA, 13 bp, Homo sapiens
ccctgggaactca

SEQ ID NO: 6064366 - DNA, 19 bp, Homo sapiens
ccctgggaactctcctggc

SEQ ID NO: 6064367 - DNA, 20 bp, Homo sapiens
ccctgggaactctcctggcc

SEQ ID NO: 6064368 - DNA, 22 bp, Homo sapiens
ccctgggaagcctgtgccagca

SEQ ID NO: 6064369 - DNA, 15 bp, Homo sapiens
ccctgggaaggcctc

SEQ ID NO: 6064370 - DNA, 23 bp, Homo sapiens
ccctgggacatcaggagactggg

SEQ ID NO: 6064371 - DNA, 20 bp, Homo sapiens
ccctgggactttcccaccca

SEQ ID NO: 6064372 - DNA, 21 bp, Homo sapiens
ccctgggactttcccacccag

SEQ ID NO: 6064373 - DNA, 22 bp, Homo sapiens
ccctgggactttcccacccagg

SEQ ID NO: 6064374 - DNA, 22 bp, Homo sapiens
ccctgggagaatcgctcctgca

SEQ ID NO: 6064375 - DNA, 24 bp, Homo sapiens
ccctgggagaatcgctcctgcagc

SEQ ID NO: 6064376 - DNA, 20 bp, Homo sapiens
ccctgggagacaactggaca

SEQ ID NO: 6064377 - DNA, 22 bp, Homo sapiens
ccctgggagcgcctgaccctgg

SEQ ID NO: 6064378 - DNA, 17 bp, Homo sapiens
ccctgggagctctggga

SEQ ID NO: 6064379 - DNA, 18 bp, Homo sapiens
ccctgggaggcagtgatg

SEQ ID NO: 6064380 - DNA, 24 bp, Homo sapiens
ccctgggaggcgggcgcactgcct

SEQ ID NO: 6064381 - DNA, 16 bp, Homo sapiens
ccctgggaggctctgg

SEQ ID NO: 6064382 - DNA, 17 bp, Homo sapiens
ccctgggaggctctgga

SEQ ID NO: 6064383 - DNA, 14 bp, Homo sapiens
ccctgggagggagg

SEQ ID NO: 6064384 - DNA, 19 bp, Homo sapiens
ccctgggagggaggtggtc

SEQ ID NO: 6064385 - DNA, 21 bp, Homo sapiens
ccctgggagggaggtggtcct

SEQ ID NO: 6064386 - DNA, 15 bp, Homo sapiens
ccctgggatgcctca

SEQ ID NO: 6064387 - DNA, 18 bp, Homo sapiens
ccctgggatgcctcacca

SEQ ID NO: 6064388 - DNA, 23 bp, Homo sapiens
ccctgggatgctgacccaggaat

SEQ ID NO: 6064389 - DNA, 21 bp, Homo sapiens
ccctgggatggaacctcagga

SEQ ID NO: 6064390 - DNA, 23 bp, Homo sapiens
ccctgggatggacgctgccggga

SEQ ID NO: 6064391 - DNA, 17 bp, Homo sapiens
ccctgggattcaggaaa

SEQ ID NO: 6064392 - DNA, 19 bp, Homo sapiens
ccctgggcaaacagagcta

SEQ ID NO: 6064393 - DNA, 20 bp, Homo sapiens
ccctgggcaaacagagctac

SEQ ID NO: 6064394 - DNA, 17 bp, Homo sapiens
ccctgggcaatgcagtg

SEQ ID NO: 6064395 - DNA, 19 bp, Homo sapiens
ccctgggcacccacctcca

SEQ ID NO: 6064396 - DNA, 15 bp, Homo sapiens
ccctgggcaccctgc

SEQ ID NO: 6064397 - DNA, 12 bp, Homo sapiens
ccctgggccacc

SEQ ID NO: 6064398 - DNA, 13 bp, Homo sapiens
ccctgggccaccc

SEQ ID NO: 6064399 - DNA, 15 bp, Homo sapiens
ccctgggccaccctt

SEQ ID NO: 6064400 - DNA, 16 bp, Homo sapiens
ccctgggccacccttc

SEQ ID NO: 6064401 - DNA, 16 bp, Homo sapiens
ccctgggccacctcct

SEQ ID NO: 6064402 - DNA, 20 bp, Homo sapiens
ccctgggccacctcctaccc

SEQ ID NO: 6064403 - DNA, 12 bp, Homo sapiens
ccctgggccagg

SEQ ID NO: 6064404 - DNA, 13 bp, Homo sapiens
ccctgggccaggc

SEQ ID NO: 6064405 - DNA, 16 bp, Homo sapiens
ccctgggccagggtct

SEQ ID NO: 6064406 - DNA, 17 bp, Homo sapiens
ccctgggccagggtctg

SEQ ID NO: 6064407 - DNA, 22 bp, Homo sapiens
ccctgggccccaccacctaggc

SEQ ID NO: 6064408 - DNA, 17 bp, Homo sapiens
ccctgggcccctccacg

SEQ ID NO: 6064409 - DNA, 12 bp, Homo sapiens
ccctgggcctcc

SEQ ID NO: 6064410 - DNA, 13 bp, Homo sapiens
ccctgggcctcca

SEQ ID NO: 6064411 - DNA, 18 bp, Homo sapiens
ccctgggcctccacctct

SEQ ID NO: 6064412 - DNA, 14 bp, Homo sapiens
ccctgggcctgctg

SEQ ID NO: 6064413 - DNA, 16 bp, Homo sapiens
ccctgggcctgctgct

SEQ ID NO: 6064414 - DNA, 13 bp, Homo sapiens
ccctgggcctgga

SEQ ID NO: 6064415 - DNA, 16 bp, Homo sapiens
ccctgggcctgtctca

SEQ ID NO: 6064416 - DNA, 22 bp, Homo sapiens
ccctgggcctgtctcagattgg

SEQ ID NO: 6064417 - DNA, 13 bp, Homo sapiens
ccctgggccttgg

SEQ ID NO: 6064418 - DNA, 21 bp, Homo sapiens
ccctgggcgagcccctccttc

SEQ ID NO: 6064419 - DNA, 14 bp, Homo sapiens
ccctgggctaagca

SEQ ID NO: 6064420 - DNA, 19 bp, Homo sapiens
ccctgggctaccatctgca

SEQ ID NO: 6064421 - DNA, 20 bp, Homo sapiens
ccctgggctaccatctgcat

SEQ ID NO: 6064422 - DNA, 15 bp, Homo sapiens
ccctgggctccacac

SEQ ID NO: 6064423 - DNA, 21 bp, Homo sapiens
ccctgggctccacacagcagt

SEQ ID NO: 6064424 - DNA, 22 bp, Homo sapiens
ccctgggctccacacagcagtg

SEQ ID NO: 6064425 - DNA, 17 bp, Homo sapiens
ccctgggctcggaggct

SEQ ID NO: 6064426 - DNA, 18 bp, Homo sapiens
ccctgggctctcacccag

SEQ ID NO: 6064427 - DNA, 13 bp, Homo sapiens
ccctgggctctgc

SEQ ID NO: 6064428 - DNA, 16 bp, Homo sapiens
ccctgggctctgcccc

SEQ ID NO: 6064429 - DNA, 23 bp, Homo sapiens
ccctgggctctggtctgtaggtt

SEQ ID NO: 6064430 - DNA, 13 bp, Homo sapiens
ccctgggctgaga

SEQ ID NO: 6064431 - DNA, 13 bp, Homo sapiens
ccctgggctgcct

SEQ ID NO: 6064432 - DNA, 21 bp, Homo sapiens
ccctgggctgcctcctcctga

SEQ ID NO: 6064433 - DNA, 14 bp, Homo sapiens
ccctgggctggaat

SEQ ID NO: 6064434 - DNA, 17 bp, Homo sapiens
ccctgggctggactgga

SEQ ID NO: 6064435 - DNA, 19 bp, Homo sapiens
ccctgggctggagagttgg

SEQ ID NO: 6064436 - DNA, 19 bp, Homo sapiens
ccctgggctggcatgggga

SEQ ID NO: 6064437 - DNA, 16 bp, Homo sapiens
ccctgggctggggagg

SEQ ID NO: 6064438 - DNA, 19 bp, Homo sapiens
ccctgggctggggaggagg

SEQ ID NO: 6064439 - DNA, 19 bp, Homo sapiens
ccctgggctgggtgctggg

SEQ ID NO: 6064440 - DNA, 20 bp, Homo sapiens
ccctgggctgggtgctggga

SEQ ID NO: 6064441 - DNA, 17 bp, Homo sapiens
ccctgggctgtccagcc

SEQ ID NO: 6064442 - DNA, 20 bp, Homo sapiens
ccctgggctgtctgtcacca

SEQ ID NO: 6064443 - DNA, 19 bp, Homo sapiens
ccctgggcttggcctgctg

SEQ ID NO: 6064444 - DNA, 21 bp, Homo sapiens
ccctgggcttggcctgctgtg

SEQ ID NO: 6064445 - DNA, 13 bp, Homo sapiens
ccctggggaaata

SEQ ID NO: 6064446 - DNA, 21 bp, Homo sapiens
ccctggggaagaggccttggg

SEQ ID NO: 6064447 - DNA, 23 bp, Homo sapiens
ccctggggacagagccaccccat

SEQ ID NO: 6064448 - DNA, 19 bp, Homo sapiens
ccctggggactgttccaaa

SEQ ID NO: 6064449 - DNA, 23 bp, Homo sapiens
ccctggggactgttccaaagcca

SEQ ID NO: 6064450 - DNA, 23 bp, Homo sapiens
ccctggggacttcaactgcccag

SEQ ID NO: 6064451 - DNA, 21 bp, Homo sapiens
ccctggggagaacccttcctg

SEQ ID NO: 6064452 - DNA, 21 bp, Homo sapiens
ccctggggagccctcaggctc

SEQ ID NO: 6064453 - DNA, 20 bp, Homo sapiens
ccctggggagcttttgccca

SEQ ID NO: 6064454 - DNA, 22 bp, Homo sapiens
ccctggggagcttttgcccaca

SEQ ID NO: 6064455 - DNA, 18 bp, Homo sapiens
ccctggggaggacccctg

SEQ ID NO: 6064456 - DNA, 23 bp, Homo sapiens
ccctggggatcacagcctcaccc

SEQ ID NO: 6064457 - DNA, 20 bp, Homo sapiens
ccctggggatcttcccacag

SEQ ID NO: 6064458 - DNA, 21 bp, Homo sapiens
ccctggggatcttcccacagg

SEQ ID NO: 6064459 - DNA, 12 bp, Homo sapiens
ccctggggcact

SEQ ID NO: 6064460 - DNA, 14 bp, Homo sapiens
ccctggggcactcc

SEQ ID NO: 6064461 - DNA, 18 bp, Homo sapiens
ccctggggcactccccca

SEQ ID NO: 6064462 - DNA, 19 bp, Homo sapiens
ccctggggcactcccccag

SEQ ID NO: 6064463 - DNA, 15 bp, Homo sapiens
ccctggggcaggggt

SEQ ID NO: 6064464 - DNA, 16 bp, Homo sapiens
ccctggggcatccacc

SEQ ID NO: 6064465 - DNA, 18 bp, Homo sapiens
ccctggggccatgggtgc

SEQ ID NO: 6064466 - DNA, 18 bp, Homo sapiens
ccctggggcccagcccct

SEQ ID NO: 6064467 - DNA, 15 bp, Homo sapiens
ccctggggcctagac

SEQ ID NO: 6064468 - DNA, 12 bp, Homo sapiens
ccctggggcctg

SEQ ID NO: 6064469 - DNA, 14 bp, Homo sapiens
ccctggggcctgac

SEQ ID NO: 6064470 - DNA, 21 bp, Homo sapiens
ccctggggcctgactgctcag

SEQ ID NO: 6064471 - DNA, 14 bp, Homo sapiens
ccctggggcctgga

SEQ ID NO: 6064472 - DNA, 17 bp, Homo sapiens
ccctggggcctggacct

SEQ ID NO: 6064473 - DNA, 23 bp, Homo sapiens
ccctggggcctggacctgcctcc

SEQ ID NO: 6064474 - DNA, 13 bp, Homo sapiens
ccctggggcctgt

SEQ ID NO: 6064475 - DNA, 17 bp, Homo sapiens
ccctggggcctgtactg

SEQ ID NO: 6064476 - DNA, 22 bp, Homo sapiens
ccctggggcctgtactgcctgc

SEQ ID NO: 6064477 - DNA, 19 bp, Homo sapiens
ccctggggcgggcagccag

SEQ ID NO: 6064478 - DNA, 17 bp, Homo sapiens
ccctggggcgtgcagca

SEQ ID NO: 6064479 - DNA, 19 bp, Homo sapiens
ccctggggcgtgcagcagg

SEQ ID NO: 6064480 - DNA, 21 bp, Homo sapiens
ccctggggctaggctggagcc

SEQ ID NO: 6064481 - DNA, 21 bp, Homo sapiens
ccctggggctgatctcaggga

SEQ ID NO: 6064482 - DNA, 22 bp, Homo sapiens
ccctggggctgggccccccagc

SEQ ID NO: 6064483 - DNA, 15 bp, Homo sapiens
ccctggggctggtgg

SEQ ID NO: 6064484 - DNA, 23 bp, Homo sapiens
ccctggggctgtgcattcccacg

SEQ ID NO: 6064485 - DNA, 15 bp, Homo sapiens
ccctggggcttctcc

SEQ ID NO: 6064486 - DNA, 19 bp, Homo sapiens
ccctggggcttctcctgac

SEQ ID NO: 6064487 - DNA, 21 bp, Homo sapiens
ccctggggcttctcctgaccc

SEQ ID NO: 6064488 - DNA, 18 bp, Homo sapiens
ccctgggggaagccctgg

SEQ ID NO: 6064489 - DNA, 17 bp, Homo sapiens
ccctgggggaggcttcc

SEQ ID NO: 6064490 - DNA, 23 bp, Homo sapiens
ccctgggggaggcttccagctca
